United States Patent 7,250,289 (METHODS OF GENETIC ANALYSIS OF MOUSE) - sequence listing, part 14

SEQ ID NO: 523583 - DNA, 25 bp, Mus musculus
gattgttttcagagctgcatctcac

SEQ ID NO: 523584 - DNA, 25 bp, Mus musculus
gattgttttcagtcgttgatccacc

SEQ ID NO: 523585 - DNA, 25 bp, Mus musculus
gattgttttcagtgctgcatctcac

SEQ ID NO: 523586 - DNA, 25 bp, Mus musculus
gattgttttctgaaccgagctatca

SEQ ID NO: 523587 - DNA, 25 bp, Mus musculus
gattgttttctgatctcaacgttac

SEQ ID NO: 523588 - DNA, 25 bp, Mus musculus
gattgttttctgtaccgagctatca

SEQ ID NO: 523589 - DNA, 25 bp, Mus musculus
gattgttttctgttctcaacgttac

SEQ ID NO: 523590 - DNA, 25 bp, Mus musculus
gattgttttggcatcttgtagtgac

SEQ ID NO: 523591 - DNA, 25 bp, Mus musculus
gattgttttggcttcttgtagtgac

SEQ ID NO: 523592 - DNA, 25 bp, Mus musculus
gattgttttgttcttagtttgctaa

SEQ ID NO: 523593 - DNA, 25 bp, Mus musculus
gattgttttgttgttagtttgctaa

SEQ ID NO: 523594 - DNA, 25 bp, Mus musculus
gattgtttttggatctctgcctata

SEQ ID NO: 523595 - DNA, 25 bp, Mus musculus
gattgtttttggttctctgcctata

SEQ ID NO: 523596 - DNA, 25 bp, Mus musculus
gatttaaaattcacagagctgcatt

SEQ ID NO: 523597 - DNA, 25 bp, Mus musculus
gatttaaaattctcagagctgcatt

SEQ ID NO: 523598 - DNA, 25 bp, Mus musculus
gatttaaagatgacagcagtttgca

SEQ ID NO: 523599 - DNA, 25 bp, Mus musculus
gatttaaagatgtcagcagtttgca

SEQ ID NO: 523600 - DNA, 25 bp, Mus musculus
gatttaaagcgcattttagacccag

SEQ ID NO: 523601 - DNA, 25 bp, Mus musculus
gatttaaagcgctttttagacccag

SEQ ID NO: 523602 - DNA, 25 bp, Mus musculus
gatttaaaggcacgtggcttcattt

SEQ ID NO: 523603 - DNA, 25 bp, Mus musculus
gatttaaaggcaggtggcttcattt

SEQ ID NO: 523604 - DNA, 25 bp, Mus musculus
gatttaaataatacctgcttttcat

SEQ ID NO: 523605 - DNA, 25 bp, Mus musculus
gatttaaataattcctgcttttcat

SEQ ID NO: 523606 - DNA, 25 bp, Mus musculus
gatttaaatttccacgtcttcttgg

SEQ ID NO: 523607 - DNA, 25 bp, Mus musculus
gatttaaatttcgacgtcttcttgg

SEQ ID NO: 523608 - DNA, 25 bp, Mus musculus
gatttaacatccatctcacagagtt

SEQ ID NO: 523609 - DNA, 25 bp, Mus musculus
gatttaacatccttctcacagagtt

SEQ ID NO: 523610 - DNA, 25 bp, Mus musculus
gatttaaccaaacccacttcacctt

SEQ ID NO: 523611 - DNA, 25 bp, Mus musculus
gatttaaccaaagccacttcacctt

SEQ ID NO: 523612 - DNA, 25 bp, Mus musculus
gatttaaccaccaggtttctgccct

SEQ ID NO: 523613 - DNA, 25 bp, Mus musculus
gatttaaccacctggtttctgccct

SEQ ID NO: 523614 - DNA, 25 bp, Mus musculus
gatttaacccttcatcgggctgaaa

SEQ ID NO: 523615 - DNA, 25 bp, Mus musculus
gatttaacccttgatcgggctgaaa

SEQ ID NO: 523616 - DNA, 25 bp, Mus musculus
gatttaacgcctagtaagtccaaag

SEQ ID NO: 523617 - DNA, 25 bp, Mus musculus
gatttaacgccttgtaagtccaaag

SEQ ID NO: 523618 - DNA, 25 bp, Mus musculus
gatttaacgtcaaccatttgacagg

SEQ ID NO: 523619 - DNA, 25 bp, Mus musculus
gatttaacgtcatccatttgacagg

SEQ ID NO: 523620 - DNA, 25 bp, Mus musculus
gatttaacttttcctattgctcttc

SEQ ID NO: 523621 - DNA, 25 bp, Mus musculus
gatttaacttttgctattgctcttc

SEQ ID NO: 523622 - DNA, 25 bp, Mus musculus
gatttaagacatcaccagcattaag

SEQ ID NO: 523623 - DNA, 25 bp, Mus musculus
gatttaagacatgaccagcattaag

SEQ ID NO: 523624 - DNA, 25 bp, Mus musculus
gatttaagcacacactgcctctgga

SEQ ID NO: 523625 - DNA, 25 bp, Mus musculus
gatttaagcacagactgcctctgga

SEQ ID NO: 523626 - DNA, 25 bp, Mus musculus
gatttaagcttaccgtttccttgtg

SEQ ID NO: 523627 - DNA, 25 bp, Mus musculus
gatttaagcttagcgtttccttgtg

SEQ ID NO: 523628 - DNA, 25 bp, Mus musculus
gatttaagctttccctatggattgc

SEQ ID NO: 523629 - DNA, 25 bp, Mus musculus
gatttaagctttgcctatggattgc

SEQ ID NO: 523630 - DNA, 25 bp, Mus musculus
gatttaaggcaacctgcctaccttg

SEQ ID NO: 523631 - DNA, 25 bp, Mus musculus
gatttaaggcaagctgcctaccttg

SEQ ID NO: 523632 - DNA, 25 bp, Mus musculus
gatttaaggcacacatcctccaaat

SEQ ID NO: 523633 - DNA, 25 bp, Mus musculus
gatttaaggcactcatcctccaaat

SEQ ID NO: 523634 - DNA, 25 bp, Mus musculus
gatttaaggcctaccactttcagaa

SEQ ID NO: 523635 - DNA, 25 bp, Mus musculus
gatttaaggccttccactttcagaa

SEQ ID NO: 523636 - DNA, 25 bp, Mus musculus
gatttaagggtcaaagaagccagca

SEQ ID NO: 523637 - DNA, 25 bp, Mus musculus
gatttaagggtctaagaagccagca

SEQ ID NO: 523638 - DNA, 25 bp, Mus musculus
gatttaagtagaccgcctgtgtgga

SEQ ID NO: 523639 - DNA, 25 bp, Mus musculus
gatttaagtagagcgcctgtgtgga

SEQ ID NO: 523640 - DNA, 25 bp, Mus musculus
gatttaagtaggatcaccagcaaac

SEQ ID NO: 523641 - DNA, 25 bp, Mus musculus
gatttaagtaggttcaccagcaaac

SEQ ID NO: 523642 - DNA, 25 bp, Mus musculus
gatttaagtgttacctccggagtca

SEQ ID NO: 523643 - DNA, 25 bp, Mus musculus
gatttaagtgtttcctccggagtca

SEQ ID NO: 523644 - DNA, 25 bp, Mus musculus
gatttaagttacagagcctgagccg

SEQ ID NO: 523645 - DNA, 25 bp, Mus musculus
gatttaagttactgagcctgagccg

SEQ ID NO: 523646 - DNA, 25 bp, Mus musculus
gatttaagttagagctagcccctct

SEQ ID NO: 523647 - DNA, 25 bp, Mus musculus
gatttaagttagtgctagcccctct

SEQ ID NO: 523648 - DNA, 25 bp, Mus musculus
gatttaatacatcttcagtagctgt

SEQ ID NO: 523649 - DNA, 25 bp, Mus musculus
gatttaatacatgttcagtagctgt

SEQ ID NO: 523650 - DNA, 25 bp, Mus musculus
gatttaatagccacggaactctcca

SEQ ID NO: 523651 - DNA, 25 bp, Mus musculus
gatttaatagcctcggaactctcca

SEQ ID NO: 523652 - DNA, 25 bp, Mus musculus
gatttaatgccgagtccatctcttg

SEQ ID NO: 523653 - DNA, 25 bp, Mus musculus
gatttaatgccgtgtccatctcttg

SEQ ID NO: 523654 - DNA, 25 bp, Mus musculus
gatttaatgctcactgaccacatga

SEQ ID NO: 523655 - DNA, 25 bp, Mus musculus
gatttaatgctctctgaccacatga

SEQ ID NO: 523656 - DNA, 25 bp, Mus musculus
gatttaatggctcagccgatcactc

SEQ ID NO: 523657 - DNA, 25 bp, Mus musculus
gatttaatggctgagccgatcactc

SEQ ID NO: 523658 - DNA, 25 bp, Mus musculus
gatttaattcttcatacttgtttat

SEQ ID NO: 523659 - DNA, 25 bp, Mus musculus
gatttaattcttgatacttgtttat

SEQ ID NO: 523660 - DNA, 25 bp, Mus musculus
gatttaattttaactccattttgat

SEQ ID NO: 523661 - DNA, 25 bp, Mus musculus
gatttaattttatctccattttgat

SEQ ID NO: 523662 - DNA, 25 bp, Mus musculus
gatttacaaacaagcccattgccct

SEQ ID NO: 523663 - DNA, 25 bp, Mus musculus
gatttacaaacatgcccattgccct

SEQ ID NO: 523664 - DNA, 25 bp, Mus musculus
gatttacacgctctattccagataa

SEQ ID NO: 523665 - DNA, 25 bp, Mus musculus
gatttacacgctgtattccagataa

SEQ ID NO: 523666 - DNA, 25 bp, Mus musculus
gatttacactccctgttaatctagt

SEQ ID NO: 523667 - DNA, 25 bp, Mus musculus
gatttacactccgtgttaatctagt

SEQ ID NO: 523668 - DNA, 25 bp, Mus musculus
gatttacactgcctatccagaataa

SEQ ID NO: 523669 - DNA, 25 bp, Mus musculus
gatttacactgcgtatccagaataa

SEQ ID NO: 523670 - DNA, 25 bp, Mus musculus
gatttacagacgatagtcataaaca

SEQ ID NO: 523671 - DNA, 25 bp, Mus musculus
gatttacagacgttagtcataaaca

SEQ ID NO: 523672 - DNA, 25 bp, Mus musculus
gatttacagccacgctttcctctta

SEQ ID NO: 523673 - DNA, 25 bp, Mus musculus
gatttacagccaggctttcctctta

SEQ ID NO: 523674 - DNA, 25 bp, Mus musculus
gatttacagcgaaccttttggactc

SEQ ID NO: 523675 - DNA, 25 bp, Mus musculus
gatttacagcgatccttttggactc

SEQ ID NO: 523676 - DNA, 25 bp, Mus musculus
gatttacagctcacagttggcacta

SEQ ID NO: 523677 - DNA, 25 bp, Mus musculus
gatttacagctctcagttggcacta

SEQ ID NO: 523678 - DNA, 25 bp, Mus musculus
gatttacaggtcagctatgcctagc

SEQ ID NO: 523679 - DNA, 25 bp, Mus musculus
gatttacaggtctgctatgcctagc

SEQ ID NO: 523680 - DNA, 25 bp, Mus musculus
gatttacagttcctatcctctagta

SEQ ID NO: 523681 - DNA, 25 bp, Mus musculus
gatttacagttcgtatcctctagta

SEQ ID NO: 523682 - DNA, 25 bp, Mus musculus
gatttacataaaagcatctcagtgc

SEQ ID NO: 523683 - DNA, 25 bp, Mus musculus
gatttacataaatgcatctcagtgc

SEQ ID NO: 523684 - DNA, 25 bp, Mus musculus
gatttacatcatctccaagtgtctt

SEQ ID NO: 523685 - DNA, 25 bp, Mus musculus
gatttacatcatgtccaagtgtctt

SEQ ID NO: 523686 - DNA, 25 bp, Mus musculus
gatttacatcccaagagcccattat

SEQ ID NO: 523687 - DNA, 25 bp, Mus musculus
gatttacatccctagagcccattat

SEQ ID NO: 523688 - DNA, 25 bp, Mus musculus
gatttacatcttattattccagagc

SEQ ID NO: 523689 - DNA, 25 bp, Mus musculus
gatttacatctttttattccagagc

SEQ ID NO: 523690 - DNA, 25 bp, Mus musculus
gatttacatgataacgaggcagctt

SEQ ID NO: 523691 - DNA, 25 bp, Mus musculus
gatttacatgattacgaggcagctt

SEQ ID NO: 523692 - DNA, 25 bp, Mus musculus
gatttacatgtgacttttgttgttg

SEQ ID NO: 523693 - DNA, 25 bp, Mus musculus
gatttacatgtgtcttttgttgttg

SEQ ID NO: 523694 - DNA, 25 bp, Mus musculus
gatttaccaaagacactggagacaa

SEQ ID NO: 523695 - DNA, 25 bp, Mus musculus
gatttaccaaagtcactggagacaa

SEQ ID NO: 523696 - DNA, 25 bp, Mus musculus
gatttaccaaataatgccatcattc

SEQ ID NO: 523697 - DNA, 25 bp, Mus musculus
gatttaccaaattatgccatcattc

SEQ ID NO: 523698 - DNA, 25 bp, Mus musculus
gatttaccacagattgtccagttat

SEQ ID NO: 523699 - DNA, 25 bp, Mus musculus
gatttaccacagtttgtccagttat

SEQ ID NO: 523700 - DNA, 25 bp, Mus musculus
gatttaccactgaaaaacagccact

SEQ ID NO: 523701 - DNA, 25 bp, Mus musculus
gatttaccactgtaaaacagccact

SEQ ID NO: 523702 - DNA, 25 bp, Mus musculus
gatttaccagttacatccgaaccct

SEQ ID NO: 523703 - DNA, 25 bp, Mus musculus
gatttaccagttctgagaggcaaga

SEQ ID NO: 523704 - DNA, 25 bp, Mus musculus
gatttaccagttgtgagaggcaaga

SEQ ID NO: 523705 - DNA, 25 bp, Mus musculus
gatttaccagtttcatccgaaccct

SEQ ID NO: 523706 - DNA, 25 bp, Mus musculus
gatttaccatatacttgacttctga

SEQ ID NO: 523707 - DNA, 25 bp, Mus musculus
gatttaccatattcttgacttctga

SEQ ID NO: 523708 - DNA, 25 bp, Mus musculus
gatttaccatgaagtttcagcttta

SEQ ID NO: 523709 - DNA, 25 bp, Mus musculus
gatttaccatgatgtttcagcttta

SEQ ID NO: 523710 - DNA, 25 bp, Mus musculus
gatttaccattcagggacattccct

SEQ ID NO: 523711 - DNA, 25 bp, Mus musculus
gatttaccattctgggacattccct

SEQ ID NO: 523712 - DNA, 25 bp, Mus musculus
gatttacccacaaattggctctgag

SEQ ID NO: 523713 - DNA, 25 bp, Mus musculus
gatttacccacatattggctctgag

SEQ ID NO: 523714 - DNA, 25 bp, Mus musculus
gatttacctagaaacagactctcag

SEQ ID NO: 523715 - DNA, 25 bp, Mus musculus
gatttacctagatacagactctcag

SEQ ID NO: 523716 - DNA, 25 bp, Mus musculus
gatttacctctgatggatttcctgt

SEQ ID NO: 523717 - DNA, 25 bp, Mus musculus
gatttacctctgttggatttcctgt

SEQ ID NO: 523718 - DNA, 25 bp, Mus musculus
gatttacctgttactcaacctggga

SEQ ID NO: 523719 - DNA, 25 bp, Mus musculus
gatttacctgtttctcaacctggga

SEQ ID NO: 523720 - DNA, 25 bp, Mus musculus
gatttaccttgaaaatgggccattg

SEQ ID NO: 523721 - DNA, 25 bp, Mus musculus
gatttaccttgaattgagtcagctt

SEQ ID NO: 523722 - DNA, 25 bp, Mus musculus
gatttaccttgataatgggccattg

SEQ ID NO: 523723 - DNA, 25 bp, Mus musculus
gatttaccttgatttgagtcagctt

SEQ ID NO: 523724 - DNA, 25 bp, Mus musculus
gatttacgcgatatctaaagagcat

SEQ ID NO: 523725 - DNA, 25 bp, Mus musculus
gatttacgcgatttctaaagagcat

SEQ ID NO: 523726 - DNA, 25 bp, Mus musculus
gatttacgggccaatactcaggata

SEQ ID NO: 523727 - DNA, 25 bp, Mus musculus
gatttacgggcctatactcaggata

SEQ ID NO: 523728 - DNA, 25 bp, Mus musculus
gatttacgtagaatggcacccaacc

SEQ ID NO: 523729 - DNA, 25 bp, Mus musculus
gatttacgtagattggcacccaacc

SEQ ID NO: 523730 - DNA, 25 bp, Mus musculus
gatttactacagcttgtgcaacgtt

SEQ ID NO: 523731 - DNA, 25 bp, Mus musculus
gatttactacaggttgtgcaacgtt

SEQ ID NO: 523732 - DNA, 25 bp, Mus musculus
gatttactccctaagacatgtgctg

SEQ ID NO: 523733 - DNA, 25 bp, Mus musculus
gatttactcccttagacatgtgctg

SEQ ID NO: 523734 - DNA, 25 bp, Mus musculus
gatttactctgtaagatctcattac

SEQ ID NO: 523735 - DNA, 25 bp, Mus musculus
gatttactctgttagatctcattac

SEQ ID NO: 523736 - DNA, 25 bp, Mus musculus
gatttactgatgcaaccaaggagag

SEQ ID NO: 523737 - DNA, 25 bp, Mus musculus
gatttactgatggaaccaaggagag

SEQ ID NO: 523738 - DNA, 25 bp, Mus musculus
gatttacttagaactgcaccagccc

SEQ ID NO: 523739 - DNA, 25 bp, Mus musculus
gatttacttagatctgcaccagccc

SEQ ID NO: 523740 - DNA, 25 bp, Mus musculus
gatttacttagtcagatatatgctt

SEQ ID NO: 523741 - DNA, 25 bp, Mus musculus
gatttacttagtgagatatatgctt

SEQ ID NO: 523742 - DNA, 25 bp, Mus musculus
gatttacttatgctcgtacatctaa

SEQ ID NO: 523743 - DNA, 25 bp, Mus musculus
gatttacttatggtcgtacatctaa

SEQ ID NO: 523744 - DNA, 25 bp, Mus musculus
gatttacttcccagacacctttttg

SEQ ID NO: 523745 - DNA, 25 bp, Mus musculus
gatttacttccctgacacctttttg

SEQ ID NO: 523746 - DNA, 25 bp, Mus musculus
gatttacttcctatctgtgaaatgg

SEQ ID NO: 523747 - DNA, 25 bp, Mus musculus
gatttacttcctttctgtgaaatgg

SEQ ID NO: 523748 - DNA, 25 bp, Mus musculus
gatttacttgcgattgtatgttttt

SEQ ID NO: 523749 - DNA, 25 bp, Mus musculus
gatttacttgcgtttgtatgttttt

SEQ ID NO: 523750 - DNA, 25 bp, Mus musculus
gatttacttgtcaggatcatccatg

SEQ ID NO: 523751 - DNA, 25 bp, Mus musculus
gatttacttgtctggatcatccatg

SEQ ID NO: 523752 - DNA, 25 bp, Mus musculus
gatttactttaacctgttcctcaga

SEQ ID NO: 523753 - DNA, 25 bp, Mus musculus
gatttactttaagctgttcctcaga

SEQ ID NO: 523754 - DNA, 25 bp, Mus musculus
gatttagaaatccagatgcattttt

SEQ ID NO: 523755 - DNA, 25 bp, Mus musculus
gatttagaaatcgagatgcattttt

SEQ ID NO: 523756 - DNA, 25 bp, Mus musculus
gatttagacatcatgggttagttta

SEQ ID NO: 523757 - DNA, 25 bp, Mus musculus
gatttagacatcttgggttagttta

SEQ ID NO: 523758 - DNA, 25 bp, Mus musculus
gatttagacttgagaccgtgtcatg

SEQ ID NO: 523759 - DNA, 25 bp, Mus musculus
gatttagacttgtgaccgtgtcatg

SEQ ID NO: 523760 - DNA, 25 bp, Mus musculus
gatttagagaccagggattacttca

SEQ ID NO: 523761 - DNA, 25 bp, Mus musculus
gatttagagacctgggattacttca

SEQ ID NO: 523762 - DNA, 25 bp, Mus musculus
gatttagagcttaccaggaatccag

SEQ ID NO: 523763 - DNA, 25 bp, Mus musculus
gatttagagctttccaggaatccag

SEQ ID NO: 523764 - DNA, 25 bp, Mus musculus
gatttagatacgattatgttctctg

SEQ ID NO: 523765 - DNA, 25 bp, Mus musculus
gatttagatacgtttatgttctctg

SEQ ID NO: 523766 - DNA, 25 bp, Mus musculus
gatttagatcggctttcttacccta

SEQ ID NO: 523767 - DNA, 25 bp, Mus musculus
gatttagatcgggtttcttacccta

SEQ ID NO: 523768 - DNA, 25 bp, Mus musculus
gatttagatctacttaccacatcac

SEQ ID NO: 523769 - DNA, 25 bp, Mus musculus
gatttagatctagttaccacatcac

SEQ ID NO: 523770 - DNA, 25 bp, Mus musculus
gatttagatctcactgaatcaggct

SEQ ID NO: 523771 - DNA, 25 bp, Mus musculus
gatttagatctctctgaatcaggct

SEQ ID NO: 523772 - DNA, 25 bp, Mus musculus
gatttagatcttctctggtggcaag

SEQ ID NO: 523773 - DNA, 25 bp, Mus musculus
gatttagatcttgtctggtggcaag

SEQ ID NO: 523774 - DNA, 25 bp, Mus musculus
gatttagattctatacaaggcccat

SEQ ID NO: 523775 - DNA, 25 bp, Mus musculus
gatttagattctttacaaggcccat

SEQ ID NO: 523776 - DNA, 25 bp, Mus musculus
gatttagattgcatactcatgggca

SEQ ID NO: 523777 - DNA, 25 bp, Mus musculus
gatttagattgcttactcatgggca

SEQ ID NO: 523778 - DNA, 25 bp, Mus musculus
gatttagcagtcattttcagccatg

SEQ ID NO: 523779 - DNA, 25 bp, Mus musculus
gatttagcagtctttttcagccatg

SEQ ID NO: 523780 - DNA, 25 bp, Mus musculus
gatttagcatgcagagtgtcactgt

SEQ ID NO: 523781 - DNA, 25 bp, Mus musculus
gatttagcatgctgagtgtcactgt

SEQ ID NO: 523782 - DNA, 25 bp, Mus musculus
gatttagcattgactgtcagaacca

SEQ ID NO: 523783 - DNA, 25 bp, Mus musculus
gatttagcattgtctgtcagaacca

SEQ ID NO: 523784 - DNA, 25 bp, Mus musculus
gatttagccaggaagtatacatcaa

SEQ ID NO: 523785 - DNA, 25 bp, Mus musculus
gatttagccaggtagtatacatcaa

SEQ ID NO: 523786 - DNA, 25 bp, Mus musculus
gatttagcctttagcatgtgggcct

SEQ ID NO: 523787 - DNA, 25 bp, Mus musculus
gatttagccttttgcatgtgggcct

SEQ ID NO: 523788 - DNA, 25 bp, Mus musculus
gatttagctcagaggtagagcgctt

SEQ ID NO: 523789 - DNA, 25 bp, Mus musculus
gatttagctcagcaccaggatttat

SEQ ID NO: 523790 - DNA, 25 bp, Mus musculus
gatttagctcaggaccaggatttat

SEQ ID NO: 523791 - DNA, 25 bp, Mus musculus
gatttagctcagtggtagagcgctt

SEQ ID NO: 523792 - DNA, 25 bp, Mus musculus
gatttagctgggaaaactatctttg

SEQ ID NO: 523793 - DNA, 25 bp, Mus musculus
gatttagctgggtaaactatctttg

SEQ ID NO: 523794 - DNA, 25 bp, Mus musculus
gatttagcttctaatgccagagcca

SEQ ID NO: 523795 - DNA, 25 bp, Mus musculus
gatttagcttcttatgccagagcca

SEQ ID NO: 523796 - DNA, 25 bp, Mus musculus
gatttaggacttcacttcagattat

SEQ ID NO: 523797 - DNA, 25 bp, Mus musculus
gatttaggacttgacttcagattat

SEQ ID NO: 523798 - DNA, 25 bp, Mus musculus
gatttaggccaaatgtcagcacaca

SEQ ID NO: 523799 - DNA, 25 bp, Mus musculus
gatttaggccaattgtcagcacaca

SEQ ID NO: 523800 - DNA, 25 bp, Mus musculus
gatttagggatgagaaaccttccac

SEQ ID NO: 523801 - DNA, 25 bp, Mus musculus
gatttagggatgtgaaaccttccac

SEQ ID NO: 523802 - DNA, 25 bp, Mus musculus
gatttaggtgatagaattcaaagca

SEQ ID NO: 523803 - DNA, 25 bp, Mus musculus
gatttaggtgattgaattcaaagca

SEQ ID NO: 523804 - DNA, 25 bp, Mus musculus
gatttagtaatccagaacctgatgt

SEQ ID NO: 523805 - DNA, 25 bp, Mus musculus
gatttagtaatcgagaacctgatgt

SEQ ID NO: 523806 - DNA, 25 bp, Mus musculus
gatttagtagacagcattcccagtg

SEQ ID NO: 523807 - DNA, 25 bp, Mus musculus
gatttagtagactgcattcccagtg

SEQ ID NO: 523808 - DNA, 25 bp, Mus musculus
gatttagtatgtaagctccatgctt

SEQ ID NO: 523809 - DNA, 25 bp, Mus musculus
gatttagtatgttagctccatgctt

SEQ ID NO: 523810 - DNA, 25 bp, Mus musculus
gatttagtcactacctcttaataga

SEQ ID NO: 523811 - DNA, 25 bp, Mus musculus
gatttagtcacttcctcttaataga

SEQ ID NO: 523812 - DNA, 25 bp, Mus musculus
gatttagtcataatgcctcctgagt

SEQ ID NO: 523813 - DNA, 25 bp, Mus musculus
gatttagtcatattgcctcctgagt

SEQ ID NO: 523814 - DNA, 25 bp, Mus musculus
gatttagtccatatactcatttggt

SEQ ID NO: 523815 - DNA, 25 bp, Mus musculus
gatttagtccatttactcatttggt

SEQ ID NO: 523816 - DNA, 25 bp, Mus musculus
gatttagtcttaacattacccatga

SEQ ID NO: 523817 - DNA, 25 bp, Mus musculus
gatttagtcttatcattacccatga

SEQ ID NO: 523818 - DNA, 25 bp, Mus musculus
gatttagttcacagcactcgtgtca

SEQ ID NO: 523819 - DNA, 25 bp, Mus musculus
gatttagttcactgcactcgtgtca

SEQ ID NO: 523820 - DNA, 25 bp, Mus musculus
gatttagttccactgaagacctcaa

SEQ ID NO: 523821 - DNA, 25 bp, Mus musculus
gatttagttccagtgaagacctcaa

SEQ ID NO: 523822 - DNA, 25 bp, Mus musculus
gatttagttctgatgtcattgctgt

SEQ ID NO: 523823 - DNA, 25 bp, Mus musculus
gatttagttctgttgtcattgctgt

SEQ ID NO: 523824 - DNA, 25 bp, Mus musculus
gatttataaagcaactgtgacctct

SEQ ID NO: 523825 - DNA, 25 bp, Mus musculus
gatttataaagctactgtgacctct

SEQ ID NO: 523826 - DNA, 25 bp, Mus musculus
gatttataaagtaccacaagtcaga

SEQ ID NO: 523827 - DNA, 25 bp, Mus musculus
gatttataaagttccacaagtcaga

SEQ ID NO: 523828 - DNA, 25 bp, Mus musculus
gatttatacctaaaacaacgctgta

SEQ ID NO: 523829 - DNA, 25 bp, Mus musculus
gatttatacctataacaacgctgta

SEQ ID NO: 523830 - DNA, 25 bp, Mus musculus
gatttatactcaaccagctaccatg

SEQ ID NO: 523831 - DNA, 25 bp, Mus musculus
gatttatactcatccagctaccatg

SEQ ID NO: 523832 - DNA, 25 bp, Mus musculus
gatttatactgtactgatgttgcaa

SEQ ID NO: 523833 - DNA, 25 bp, Mus musculus
gatttatactgttctgatgttgcaa

SEQ ID NO: 523834 - DNA, 25 bp, Mus musculus
gatttatacttcatggtgcaccgtg

SEQ ID NO: 523835 - DNA, 25 bp, Mus musculus
gatttatacttcttggtgcaccgtg

SEQ ID NO: 523836 - DNA, 25 bp, Mus musculus
gatttatagcagagacttttacaca

SEQ ID NO: 523837 - DNA, 25 bp, Mus musculus
gatttatagcagtgacttttacaca

SEQ ID NO: 523838 - DNA, 25 bp, Mus musculus
gatttataggacatccaacctggct

SEQ ID NO: 523839 - DNA, 25 bp, Mus musculus
gatttataggacttccaacctggct

SEQ ID NO: 523840 - DNA, 25 bp, Mus musculus
gatttatatgcaagctggacctgga

SEQ ID NO: 523841 - DNA, 25 bp, Mus musculus
gatttatatgcatgctggacctgga

SEQ ID NO: 523842 - DNA, 25 bp, Mus musculus
gatttatcaccaagacggatccaga

SEQ ID NO: 523843 - DNA, 25 bp, Mus musculus
gatttatcaccatgacggatccaga

SEQ ID NO: 523844 - DNA, 25 bp, Mus musculus
gatttatcacctctccatgctataa

SEQ ID NO: 523845 - DNA, 25 bp, Mus musculus
gatttatcacctgtccatgctataa

SEQ ID NO: 523846 - DNA, 25 bp, Mus musculus
gatttatcagtaagccccgaattcc

SEQ ID NO: 523847 - DNA, 25 bp, Mus musculus
gatttatcagtatgccccgaattcc

SEQ ID NO: 523848 - DNA, 25 bp, Mus musculus
gatttatcatctagaatcctccaca

SEQ ID NO: 523849 - DNA, 25 bp, Mus musculus
gatttatcatcttgaatcctccaca

SEQ ID NO: 523850 - DNA, 25 bp, Mus musculus
gatttatccaaacccgtttcactgt

SEQ ID NO: 523851 - DNA, 25 bp, Mus musculus
gatttatccaaagccgtttcactgt

SEQ ID NO: 523852 - DNA, 25 bp, Mus musculus
gatttatccagtacttttgacatga

SEQ ID NO: 523853 - DNA, 25 bp, Mus musculus
gatttatccagttcttttgacatga

SEQ ID NO: 523854 - DNA, 25 bp, Mus musculus
gatttatccatacatttagttcctc

SEQ ID NO: 523855 - DNA, 25 bp, Mus musculus
gatttatccatagatttagttcctc

SEQ ID NO: 523856 - DNA, 25 bp, Mus musculus
gatttatcccagaagcagtcagcaa

SEQ ID NO: 523857 - DNA, 25 bp, Mus musculus
gatttatcccagtagcagtcagcaa

SEQ ID NO: 523858 - DNA, 25 bp, Mus musculus
gatttatcccttatgagagcccagt

SEQ ID NO: 523859 - DNA, 25 bp, Mus musculus
gatttatcccttttgagagcccagt

SEQ ID NO: 523860 - DNA, 25 bp, Mus musculus
gatttatcggaacacctagccagga

SEQ ID NO: 523861 - DNA, 25 bp, Mus musculus
gatttatcggaagacctagccagga

SEQ ID NO: 523862 - DNA, 25 bp, Mus musculus
gatttatctactagctttgagacag

SEQ ID NO: 523863 - DNA, 25 bp, Mus musculus
gatttatctacttgctttgagacag

SEQ ID NO: 523864 - DNA, 25 bp, Mus musculus
gatttatctccacattagcctgtgg

SEQ ID NO: 523865 - DNA, 25 bp, Mus musculus
gatttatctccagattagcctgtgg

SEQ ID NO: 523866 - DNA, 25 bp, Mus musculus
gatttatcttttacagttcccaagg

SEQ ID NO: 523867 - DNA, 25 bp, Mus musculus
gatttatcttttcactattcacaga

SEQ ID NO: 523868 - DNA, 25 bp, Mus musculus
gatttatcttttgactattcacaga

SEQ ID NO: 523869 - DNA, 25 bp, Mus musculus
gatttatctttttcagttcccaagg

SEQ ID NO: 523870 - DNA, 25 bp, Mus musculus
gatttatgaataatctcgaacacag

SEQ ID NO: 523871 - DNA, 25 bp, Mus musculus
gatttatgaatattctcgaacacag

SEQ ID NO: 523872 - DNA, 25 bp, Mus musculus
gatttatgacacatccagcctgtct

SEQ ID NO: 523873 - DNA, 25 bp, Mus musculus
gatttatgacacttccagcctgtct

SEQ ID NO: 523874 - DNA, 25 bp, Mus musculus
gatttatgactaactgttctggtac

SEQ ID NO: 523875 - DNA, 25 bp, Mus musculus
gatttatgactatctgttctggtac

SEQ ID NO: 523876 - DNA, 25 bp, Mus musculus
gatttatgcaggatttcttccacct

SEQ ID NO: 523877 - DNA, 25 bp, Mus musculus
gatttatgcaggttttcttccacct

SEQ ID NO: 523878 - DNA, 25 bp, Mus musculus
gatttatgccaaaagtctcttgaag

SEQ ID NO: 523879 - DNA, 25 bp, Mus musculus
gatttatgccaatagtctcttgaag

SEQ ID NO: 523880 - DNA, 25 bp, Mus musculus
gatttatgccacatccaacctggct

SEQ ID NO: 523881 - DNA, 25 bp, Mus musculus
gatttatgccacttccaacctggct

SEQ ID NO: 523882 - DNA, 25 bp, Mus musculus
gatttatgccatcgagcccaacttc

SEQ ID NO: 523883 - DNA, 25 bp, Mus musculus
gatttatgccatggagcccaacttc

SEQ ID NO: 523884 - DNA, 25 bp, Mus musculus
gatttatggcataaaccgtcctagg

SEQ ID NO: 523885 - DNA, 25 bp, Mus musculus
gatttatggcattaaccgtcctagg

SEQ ID NO: 523886 - DNA, 25 bp, Mus musculus
gatttatgggcacctgggattcttc

SEQ ID NO: 523887 - DNA, 25 bp, Mus musculus
gatttatgggcagctgggattcttc

SEQ ID NO: 523888 - DNA, 25 bp, Mus musculus
gatttatgtcaactcttgcctgtat

SEQ ID NO: 523889 - DNA, 25 bp, Mus musculus
gatttatgtcaagtcttgcctgtat

SEQ ID NO: 523890 - DNA, 25 bp, Mus musculus
gatttatgtcatccctgtttgttag

SEQ ID NO: 523891 - DNA, 25 bp, Mus musculus
gatttatgtcatgcctgtttgttag

SEQ ID NO: 523892 - DNA, 25 bp, Mus musculus
gatttatgtcctaggaaaactcttt

SEQ ID NO: 523893 - DNA, 25 bp, Mus musculus
gatttatgtccttggaaaactcttt

SEQ ID NO: 523894 - DNA, 25 bp, Mus musculus
gatttatgtgaccatcccctccaca

SEQ ID NO: 523895 - DNA, 25 bp, Mus musculus
gatttatgtgacgatcccctccaca

SEQ ID NO: 523896 - DNA, 25 bp, Mus musculus
gatttattcaagataagggccggat

SEQ ID NO: 523897 - DNA, 25 bp, Mus musculus
gatttattcaagttaagggccggat

SEQ ID NO: 523898 - DNA, 25 bp, Mus musculus
gatttattcactagcttagccacca

SEQ ID NO: 523899 - DNA, 25 bp, Mus musculus
gatttattcacttgcttagccacca

SEQ ID NO: 523900 - DNA, 25 bp, Mus musculus
gatttattcattagaacctctcttc

SEQ ID NO: 523901 - DNA, 25 bp, Mus musculus
gatttattcatttgaacctctcttc

SEQ ID NO: 523902 - DNA, 25 bp, Mus musculus
gatttattccgaagttgaaacagca

SEQ ID NO: 523903 - DNA, 25 bp, Mus musculus
gatttattccgatgttgaaacagca

SEQ ID NO: 523904 - DNA, 25 bp, Mus musculus
gatttattcctgagtctgcatttgc

SEQ ID NO: 523905 - DNA, 25 bp, Mus musculus
gatttattcctgtgtctgcatttgc

SEQ ID NO: 523906 - DNA, 25 bp, Mus musculus
gatttattcggtcagtctaacacta

SEQ ID NO: 523907 - DNA, 25 bp, Mus musculus
gatttattcggtgagtctaacacta

SEQ ID NO: 523908 - DNA, 25 bp, Mus musculus
gatttattgccaaagaaatacctaa

SEQ ID NO: 523909 - DNA, 25 bp, Mus musculus
gatttattgccatagaaatacctaa

SEQ ID NO: 523910 - DNA, 25 bp, Mus musculus
gatttattggttacacgtttcagga

SEQ ID NO: 523911 - DNA, 25 bp, Mus musculus
gatttattggtttcacgtttcagga

SEQ ID NO: 523912 - DNA, 25 bp, Mus musculus
gatttattgtgtattatcaccgtgc

SEQ ID NO: 523913 - DNA, 25 bp, Mus musculus
gatttattgtgttttatcaccgtgc

SEQ ID NO: 523914 - DNA, 25 bp, Mus musculus
gatttattgttccacgccatttctg

SEQ ID NO: 523915 - DNA, 25 bp, Mus musculus
gatttattgttcgacgccatttctg

SEQ ID NO: 523916 - DNA, 25 bp, Mus musculus
gatttatttaacacagtgctgccag

SEQ ID NO: 523917 - DNA, 25 bp, Mus musculus
gatttatttaactcagtgctgccag

SEQ ID NO: 523918 - DNA, 25 bp, Mus musculus
gatttatttaggcaactcccagtaa

SEQ ID NO: 523919 - DNA, 25 bp, Mus musculus
gatttatttagggaactcccagtaa

SEQ ID NO: 523920 - DNA, 25 bp, Mus musculus
gatttatttatgacttcctctatga

SEQ ID NO: 523921 - DNA, 25 bp, Mus musculus
gatttatttatgtcttcctctatga

SEQ ID NO: 523922 - DNA, 25 bp, Mus musculus
gatttattttcaccattcgttatgt

SEQ ID NO: 523923 - DNA, 25 bp, Mus musculus
gatttattttcagcattcgttatgt

SEQ ID NO: 523924 - DNA, 25 bp, Mus musculus
gatttattttcccactactgtcaat

SEQ ID NO: 523925 - DNA, 25 bp, Mus musculus
gatttattttccgactactgtcaat

SEQ ID NO: 523926 - DNA, 25 bp, Mus musculus
gatttattttgcacacagttctata

SEQ ID NO: 523927 - DNA, 25 bp, Mus musculus
gatttattttgccttctctatgtct

SEQ ID NO: 523928 - DNA, 25 bp, Mus musculus
gatttattttgcgttctctatgtct

SEQ ID NO: 523929 - DNA, 25 bp, Mus musculus
gatttattttgctcacagttctata

SEQ ID NO: 523930 - DNA, 25 bp, Mus musculus
gatttatttttgaactacacggcat

SEQ ID NO: 523931 - DNA, 25 bp, Mus musculus
gatttatttttgtactacacggcat

SEQ ID NO: 523932 - DNA, 25 bp, Mus musculus
gatttcaaactaagtacccctgaca

SEQ ID NO: 523933 - DNA, 25 bp, Mus musculus
gatttcaaactatgtacccctgaca

SEQ ID NO: 523934 - DNA, 25 bp, Mus musculus
gatttcaaactcagaagtgtcttac

SEQ ID NO: 523935 - DNA, 25 bp, Mus musculus
gatttcaaactccacactgatacca

SEQ ID NO: 523936 - DNA, 25 bp, Mus musculus
gatttcaaactcgacactgatacca

SEQ ID NO: 523937 - DNA, 25 bp, Mus musculus
gatttcaaactctgaagtgtcttac

SEQ ID NO: 523938 - DNA, 25 bp, Mus musculus
gatttcaaagacaggaactatcccc

SEQ ID NO: 523939 - DNA, 25 bp, Mus musculus
gatttcaaagactggaactatcccc

SEQ ID NO: 523940 - DNA, 25 bp, Mus musculus
gatttcaacactctttttagcagga

SEQ ID NO: 523941 - DNA, 25 bp, Mus musculus
gatttcaacactgtttttagcagga

SEQ ID NO: 523942 - DNA, 25 bp, Mus musculus
gatttcaacattctgtgctcactaa

SEQ ID NO: 523943 - DNA, 25 bp, Mus musculus
gatttcaacattgtgtgctcactaa

SEQ ID NO: 523944 - DNA, 25 bp, Mus musculus
gatttcaaccctagtcttgtatgtg

SEQ ID NO: 523945 - DNA, 25 bp, Mus musculus
gatttcaacccttgtcttgtatgtg

SEQ ID NO: 523946 - DNA, 25 bp, Mus musculus
gatttcaactggactggagctacta

SEQ ID NO: 523947 - DNA, 25 bp, Mus musculus
gatttcaactggtctggagctacta

SEQ ID NO: 523948 - DNA, 25 bp, Mus musculus
gatttcaacttgaagcatccactga

SEQ ID NO: 523949 - DNA, 25 bp, Mus musculus
gatttcaacttgtagcatccactga

SEQ ID NO: 523950 - DNA, 25 bp, Mus musculus
gatttcaagcctatcgtcctctaat

SEQ ID NO: 523951 - DNA, 25 bp, Mus musculus
gatttcaagcctttcgtcctctaat

SEQ ID NO: 523952 - DNA, 25 bp, Mus musculus
gatttcaagtgtcaacaaacccaag

SEQ ID NO: 523953 - DNA, 25 bp, Mus musculus
gatttcaagtgtgaacaaacccaag

SEQ ID NO: 523954 - DNA, 25 bp, Mus musculus
gatttcaagtttccttcaaggccag

SEQ ID NO: 523955 - DNA, 25 bp, Mus musculus
gatttcaagtttgcttcaaggccag

SEQ ID NO: 523956 - DNA, 25 bp, Mus musculus
gatttcaatcacagagccttggtct

SEQ ID NO: 523957 - DNA, 25 bp, Mus musculus
gatttcaatcactgagccttggtct

SEQ ID NO: 523958 - DNA, 25 bp, Mus musculus
gatttcaatcagcagagccaaggac

SEQ ID NO: 523959 - DNA, 25 bp, Mus musculus
gatttcaatcaggagagccaaggac

SEQ ID NO: 523960 - DNA, 25 bp, Mus musculus
gatttcaatctcatgaggtctcata

SEQ ID NO: 523961 - DNA, 25 bp, Mus musculus
gatttcaatctcttgaggtctcata

SEQ ID NO: 523962 - DNA, 25 bp, Mus musculus
gatttcaatgacacttttctctcca

SEQ ID NO: 523963 - DNA, 25 bp, Mus musculus
gatttcaatgactcttttctctcca

SEQ ID NO: 523964 - DNA, 25 bp, Mus musculus
gatttcaatgccagggacccaaatg

SEQ ID NO: 523965 - DNA, 25 bp, Mus musculus
gatttcaatgcctgggacccaaatg

SEQ ID NO: 523966 - DNA, 25 bp, Mus musculus
gatttcaattggctccttgcatttc

SEQ ID NO: 523967 - DNA, 25 bp, Mus musculus
gatttcaattgggtccttgcatttc

SEQ ID NO: 523968 - DNA, 25 bp, Mus musculus
gatttcacagttaccatatttattc

SEQ ID NO: 523969 - DNA, 25 bp, Mus musculus
gatttcacagtttccatatttattc

SEQ ID NO: 523970 - DNA, 25 bp, Mus musculus
gatttcacatatacaaggttctttg

SEQ ID NO: 523971 - DNA, 25 bp, Mus musculus
gatttcacatatctcccagtaggag

SEQ ID NO: 523972 - DNA, 25 bp, Mus musculus
gatttcacatatgtcccagtaggag

SEQ ID NO: 523973 - DNA, 25 bp, Mus musculus
gatttcacatattcaaggttctttg

SEQ ID NO: 523974 - DNA, 25 bp, Mus musculus
gatttcacatctccatagctagacc

SEQ ID NO: 523975 - DNA, 25 bp, Mus musculus
gatttcacatctgcatagctagacc

SEQ ID NO: 523976 - DNA, 25 bp, Mus musculus
gatttcacatgaaacctggctcagt

SEQ ID NO: 523977 - DNA, 25 bp, Mus musculus
gatttcacatgatacctggctcagt

SEQ ID NO: 523978 - DNA, 25 bp, Mus musculus
gatttcaccaagagatctccaaggt

SEQ ID NO: 523979 - DNA, 25 bp, Mus musculus
gatttcaccaagtgatctccaaggt

SEQ ID NO: 523980 - DNA, 25 bp, Mus musculus
gatttcaccattactgttgcggaga

SEQ ID NO: 523981 - DNA, 25 bp, Mus musculus
gatttcaccatttctgttgcggaga

SEQ ID NO: 523982 - DNA, 25 bp, Mus musculus
gatttcacctacaatgtccttcaag

SEQ ID NO: 523983 - DNA, 25 bp, Mus musculus
gatttcacctactatgtccttcaag

SEQ ID NO: 523984 - DNA, 25 bp, Mus musculus
gatttcacctttctgtgtccaactg

SEQ ID NO: 523985 - DNA, 25 bp, Mus musculus
gatttcacctttgtgtgtccaactg

SEQ ID NO: 523986 - DNA, 25 bp, Mus musculus
gatttcacgaagaaggtttcctctg

SEQ ID NO: 523987 - DNA, 25 bp, Mus musculus
gatttcacgaagagatcctgcccat

SEQ ID NO: 523988 - DNA, 25 bp, Mus musculus
gatttcacgaagtaggtttcctctg

SEQ ID NO: 523989 - DNA, 25 bp, Mus musculus
gatttcacgaagtgatcctgcccat

SEQ ID NO: 523990 - DNA, 25 bp, Mus musculus
gatttcacgtacaccagagtaactg

SEQ ID NO: 523991 - DNA, 25 bp, Mus musculus
gatttcacgtactccagagtaactg

SEQ ID NO: 523992 - DNA, 25 bp, Mus musculus
gatttcacgtgcacagagccattat

SEQ ID NO: 523993 - DNA, 25 bp, Mus musculus
gatttcacgtgctcagagccattat

SEQ ID NO: 523994 - DNA, 25 bp, Mus musculus
gatttcactcacatacgacatctga

SEQ ID NO: 523995 - DNA, 25 bp, Mus musculus
gatttcactcacttacgacatctga

SEQ ID NO: 523996 - DNA, 25 bp, Mus musculus
gatttcactggtatctgaggtaaca

SEQ ID NO: 523997 - DNA, 25 bp, Mus musculus
gatttcactggtttctgaggtaaca

SEQ ID NO: 523998 - DNA, 25 bp, Mus musculus
gatttcacttatactctctctcctg

SEQ ID NO: 523999 - DNA, 25 bp, Mus musculus
gatttcacttattctctctctcctg

SEQ ID NO: 524000 - DNA, 25 bp, Mus musculus
gatttcacttttctcaaatatccta

SEQ ID NO: 524001 - DNA, 25 bp, Mus musculus
gatttcacttttgtcaaatatccta

SEQ ID NO: 524002 - DNA, 25 bp, Mus musculus
gatttcagaactaaatacctacaca

SEQ ID NO: 524003 - DNA, 25 bp, Mus musculus
gatttcagaacttaatacctacaca

SEQ ID NO: 524004 - DNA, 25 bp, Mus musculus
gatttcagaataatactgcagttgt

SEQ ID NO: 524005 - DNA, 25 bp, Mus musculus
gatttcagaatattactgcagttgt

SEQ ID NO: 524006 - DNA, 25 bp, Mus musculus
gatttcagcagtcagagccctactc

SEQ ID NO: 524007 - DNA, 25 bp, Mus musculus
gatttcagcagtcatggtattccaa

SEQ ID NO: 524008 - DNA, 25 bp, Mus musculus
gatttcagcagtgagagccctactc

SEQ ID NO: 524009 - DNA, 25 bp, Mus musculus
gatttcagcagtgatggtattccaa

SEQ ID NO: 524010 - DNA, 25 bp, Mus musculus
gatttcagcattcatcggcttgtcc

SEQ ID NO: 524011 - DNA, 25 bp, Mus musculus
gatttcagcattgatcggcttgtcc

SEQ ID NO: 524012 - DNA, 25 bp, Mus musculus
gatttcagccagatgtattgctcct

SEQ ID NO: 524013 - DNA, 25 bp, Mus musculus
gatttcagccagttgtattgctcct

SEQ ID NO: 524014 - DNA, 25 bp, Mus musculus
gatttcagcccaagcattaaacaga

SEQ ID NO: 524015 - DNA, 25 bp, Mus musculus
gatttcagcccatgcattaaacaga

SEQ ID NO: 524016 - DNA, 25 bp, Mus musculus
gatttcagcctaacgaccacaagac

SEQ ID NO: 524017 - DNA, 25 bp, Mus musculus
gatttcagcctatcgaccacaagac

SEQ ID NO: 524018 - DNA, 25 bp, Mus musculus
gatttcagcctcaatgctattggta

SEQ ID NO: 524019 - DNA, 25 bp, Mus musculus
gatttcagcctctatgctattggta

SEQ ID NO: 524020 - DNA, 25 bp, Mus musculus
gatttcagcgctcgtgaatttcaca

SEQ ID NO: 524021 - DNA, 25 bp, Mus musculus
gatttcagcgctggtgaatttcaca

SEQ ID NO: 524022 - DNA, 25 bp, Mus musculus
gatttcaggaaacatccttacaagt

SEQ ID NO: 524023 - DNA, 25 bp, Mus musculus
gatttcaggaaagatccttacaagt

SEQ ID NO: 524024 - DNA, 25 bp, Mus musculus
gatttcaggtatattcacatggtca

SEQ ID NO: 524025 - DNA, 25 bp, Mus musculus
gatttcaggtattttcacatggtca

SEQ ID NO: 524026 - DNA, 25 bp, Mus musculus
gatttcaggtgcacaaaatgcagaa

SEQ ID NO: 524027 - DNA, 25 bp, Mus musculus
gatttcaggtgctcaaaatgcagaa

SEQ ID NO: 524028 - DNA, 25 bp, Mus musculus
gatttcaggtgtcgcaatccagcta

SEQ ID NO: 524029 - DNA, 25 bp, Mus musculus
gatttcaggtgtggcaatccagcta

SEQ ID NO: 524030 - DNA, 25 bp, Mus musculus
gatttcagtacacggccggaaccag

SEQ ID NO: 524031 - DNA, 25 bp, Mus musculus
gatttcagtacagggccggaaccag

SEQ ID NO: 524032 - DNA, 25 bp, Mus musculus
gatttcagtataacaggatccagag

SEQ ID NO: 524033 - DNA, 25 bp, Mus musculus
gatttcagtatatcaggatccagag

SEQ ID NO: 524034 - DNA, 25 bp, Mus musculus
gatttcagtatcattgtcttccaaa

SEQ ID NO: 524035 - DNA, 25 bp, Mus musculus
gatttcagtatctttgtcttccaaa

SEQ ID NO: 524036 - DNA, 25 bp, Mus musculus
gatttcagtcaacagtgtccaacac

SEQ ID NO: 524037 - DNA, 25 bp, Mus musculus
gatttcagtcaagagtgtccaacac

SEQ ID NO: 524038 - DNA, 25 bp, Mus musculus
gatttcagttcgaaacggacctgag

SEQ ID NO: 524039 - DNA, 25 bp, Mus musculus
gatttcagttcgtaacggacctgag

SEQ ID NO: 524040 - DNA, 25 bp, Mus musculus
gatttcatacctaatactgttctat

SEQ ID NO: 524041 - DNA, 25 bp, Mus musculus
gatttcataccttatactgttctat

SEQ ID NO: 524042 - DNA, 25 bp, Mus musculus
gatttcatatcacgcagtgctgagt

SEQ ID NO: 524043 - DNA, 25 bp, Mus musculus
gatttcatatcaggcagtgctgagt

SEQ ID NO: 524044 - DNA, 25 bp, Mus musculus
gatttcatcaacaatcatgcttcgg

SEQ ID NO: 524045 - DNA, 25 bp, Mus musculus
gatttcatcaactatcatgcttcgg

SEQ ID NO: 524046 - DNA, 25 bp, Mus musculus
gatttcatcacactcacaaaggaga

SEQ ID NO: 524047 - DNA, 25 bp, Mus musculus
gatttcatcacagtcacaaaggaga

SEQ ID NO: 524048 - DNA, 25 bp, Mus musculus
gatttcatcattaccctatgtacaa

SEQ ID NO: 524049 - DNA, 25 bp, Mus musculus
gatttcatcatttccctatgtacaa

SEQ ID NO: 524050 - DNA, 25 bp, Mus musculus
gatttcatctgtcttacacctttac

SEQ ID NO: 524051 - DNA, 25 bp, Mus musculus
gatttcatctgtgttacacctttac

SEQ ID NO: 524052 - DNA, 25 bp, Mus musculus
gatttcatcttaactcagcagccag

SEQ ID NO: 524053 - DNA, 25 bp, Mus musculus
gatttcatcttatctcagcagccag

SEQ ID NO: 524054 - DNA, 25 bp, Mus musculus
gatttcatgatcacataccacagtg

SEQ ID NO: 524055 - DNA, 25 bp, Mus musculus
gatttcatgatctcataccacagtg

SEQ ID NO: 524056 - DNA, 25 bp, Mus musculus
gatttcatgtctcggagcctggacc

SEQ ID NO: 524057 - DNA, 25 bp, Mus musculus
gatttcatgtctgggagcctggacc

SEQ ID NO: 524058 - DNA, 25 bp, Mus musculus
gatttcatgtgaactcatgtgcaca

SEQ ID NO: 524059 - DNA, 25 bp, Mus musculus
gatttcatgtgatctcatgtgcaca

SEQ ID NO: 524060 - DNA, 25 bp, Mus musculus
gatttcatgttcctaaatgccatgt

SEQ ID NO: 524061 - DNA, 25 bp, Mus musculus
gatttcatgttcgtaaatgccatgt

SEQ ID NO: 524062 - DNA, 25 bp, Mus musculus
gatttcattatacacgctaaagcat

SEQ ID NO: 524063 - DNA, 25 bp, Mus musculus
gatttcattatagacgctaaagcat

SEQ ID NO: 524064 - DNA, 25 bp, Mus musculus
gatttcattctaactgtgtccagta

SEQ ID NO: 524065 - DNA, 25 bp, Mus musculus
gatttcattctatctgtgtccagta

SEQ ID NO: 524066 - DNA, 25 bp, Mus musculus
gatttcattcttatttcaatgcaga

SEQ ID NO: 524067 - DNA, 25 bp, Mus musculus
gatttcattcttcttttagtaattt

SEQ ID NO: 524068 - DNA, 25 bp, Mus musculus
gatttcattcttgttttagtaattt

SEQ ID NO: 524069 - DNA, 25 bp, Mus musculus
gatttcattcttttttcaatgcaga

SEQ ID NO: 524070 - DNA, 25 bp, Mus musculus
gatttcattgacaaacttgctcggt

SEQ ID NO: 524071 - DNA, 25 bp, Mus musculus
gatttcattgactaacttgctcggt

SEQ ID NO: 524072 - DNA, 25 bp, Mus musculus
gatttcattggtcgatttgacccat

SEQ ID NO: 524073 - DNA, 25 bp, Mus musculus
gatttcattggtggatttgacccat

SEQ ID NO: 524074 - DNA, 25 bp, Mus musculus
gatttcatttacagtgttaacattg

SEQ ID NO: 524075 - DNA, 25 bp, Mus musculus
gatttcatttactgtgttaacattg

SEQ ID NO: 524076 - DNA, 25 bp, Mus musculus
gatttcatttagagatcttccccaa

SEQ ID NO: 524077 - DNA, 25 bp, Mus musculus
gatttcatttagtgatcttccccaa

SEQ ID NO: 524078 - DNA, 25 bp, Mus musculus
gatttcattttcaaccgacaaattt

SEQ ID NO: 524079 - DNA, 25 bp, Mus musculus
gatttcattttctaccgacaaattt

SEQ ID NO: 524080 - DNA, 25 bp, Mus musculus
gatttcattttgatgcaattggcac

SEQ ID NO: 524081 - DNA, 25 bp, Mus musculus
gatttcattttgttgcaattggcac

SEQ ID NO: 524082 - DNA, 25 bp, Mus musculus
gatttccaaaaacactttgtgaagt

SEQ ID NO: 524083 - DNA, 25 bp, Mus musculus
gatttccaaaaagactttgtgaagt

SEQ ID NO: 524084 - DNA, 25 bp, Mus musculus
gatttccaagacaactagcccttag

SEQ ID NO: 524085 - DNA, 25 bp, Mus musculus
gatttccaagactactagcccttag

SEQ ID NO: 524086 - DNA, 25 bp, Mus musculus
gatttccacacgaacaatgatcact

SEQ ID NO: 524087 - DNA, 25 bp, Mus musculus
gatttccacacgtacaatgatcact

SEQ ID NO: 524088 - DNA, 25 bp, Mus musculus
gatttccacaggatcgtggactgac

SEQ ID NO: 524089 - DNA, 25 bp, Mus musculus
gatttccacaggctccgaagggttg

SEQ ID NO: 524090 - DNA, 25 bp, Mus musculus
gatttccacagggtccgaagggttg

SEQ ID NO: 524091 - DNA, 25 bp, Mus musculus
gatttccacaggttcgtggactgac

SEQ ID NO: 524092 - DNA, 25 bp, Mus musculus
gatttccacataattgcactttatt

SEQ ID NO: 524093 - DNA, 25 bp, Mus musculus
gatttccacatatttgcactttatt

SEQ ID NO: 524094 - DNA, 25 bp, Mus musculus
gatttccacgtgagttcttgtttat

SEQ ID NO: 524095 - DNA, 25 bp, Mus musculus
gatttccacgtgtgttcttgtttat

SEQ ID NO: 524096 - DNA, 25 bp, Mus musculus
gatttccagaccagtgaatcacaag

SEQ ID NO: 524097 - DNA, 25 bp, Mus musculus
gatttccagacctgtgaatcacaag

SEQ ID NO: 524098 - DNA, 25 bp, Mus musculus
gatttccaggaaaatcattcataag

SEQ ID NO: 524099 - DNA, 25 bp, Mus musculus
gatttccaggaatatcattcataag

SEQ ID NO: 524100 - DNA, 25 bp, Mus musculus
gatttccagggaatggagtaccaag

SEQ ID NO: 524101 - DNA, 25 bp, Mus musculus
gatttccagggattggagtaccaag

SEQ ID NO: 524102 - DNA, 25 bp, Mus musculus
gatttccagggcattacttatgtga

SEQ ID NO: 524103 - DNA, 25 bp, Mus musculus
gatttccagggctttacttatgtga

SEQ ID NO: 524104 - DNA, 25 bp, Mus musculus
gatttccagggtactcatgtttttg

SEQ ID NO: 524105 - DNA, 25 bp, Mus musculus
gatttccagggttctcatgtttttg

SEQ ID NO: 524106 - DNA, 25 bp, Mus musculus
gatttccagtgaaacctgttgctaa

SEQ ID NO: 524107 - DNA, 25 bp, Mus musculus
gatttccagtgatacctgttgctaa

SEQ ID NO: 524108 - DNA, 25 bp, Mus musculus
gatttccatactcaatctggcaggc

SEQ ID NO: 524109 - DNA, 25 bp, Mus musculus
gatttccatactgaatctggcaggc

SEQ ID NO: 524110 - DNA, 25 bp, Mus musculus
gatttccatcaaagaactgtacttt

SEQ ID NO: 524111 - DNA, 25 bp, Mus musculus
gatttccatcaatgaactgtacttt

SEQ ID NO: 524112 - DNA, 25 bp, Mus musculus
gatttccatcggaaggtgtgtatgt

SEQ ID NO: 524113 - DNA, 25 bp, Mus musculus
gatttccatcggtaggtgtgtatgt

SEQ ID NO: 524114 - DNA, 25 bp, Mus musculus
gatttccatggaaggatacttctca

SEQ ID NO: 524115 - DNA, 25 bp, Mus musculus
gatttccatggatggatacttctca

SEQ ID NO: 524116 - DNA, 25 bp, Mus musculus
gatttccatgtgatcggctctgccg

SEQ ID NO: 524117 - DNA, 25 bp, Mus musculus
gatttccatgtgttcggctctgccg

SEQ ID NO: 524118 - DNA, 25 bp, Mus musculus
gatttccattagatgttcacatttg

SEQ ID NO: 524119 - DNA, 25 bp, Mus musculus
gatttccattagttgttcacatttg

SEQ ID NO: 524120 - DNA, 25 bp, Mus musculus
gatttccattcaatcatatggacag

SEQ ID NO: 524121 - DNA, 25 bp, Mus musculus
gatttccattcaatcgcatggccat

SEQ ID NO: 524122 - DNA, 25 bp, Mus musculus
gatttccattcattcatatggacag

SEQ ID NO: 524123 - DNA, 25 bp, Mus musculus
gatttccattcattcgcatggccat

SEQ ID NO: 524124 - DNA, 25 bp, Mus musculus
gatttcccaagtcgcattttcatct

SEQ ID NO: 524125 - DNA, 25 bp, Mus musculus
gatttcccaagtggcattttcatct

SEQ ID NO: 524126 - DNA, 25 bp, Mus musculus
gatttcccaatacaccatttcatta

SEQ ID NO: 524127 - DNA, 25 bp, Mus musculus
gatttcccaatagaccatttcatta

SEQ ID NO: 524128 - DNA, 25 bp, Mus musculus
gatttcccaatcctgtgacctggtg

SEQ ID NO: 524129 - DNA, 25 bp, Mus musculus
gatttcccaatcgtgtgacctggtg

SEQ ID NO: 524130 - DNA, 25 bp, Mus musculus
gatttcccacatcaaatggcctgtg

SEQ ID NO: 524131 - DNA, 25 bp, Mus musculus
gatttcccacatgaaatggcctgtg

SEQ ID NO: 524132 - DNA, 25 bp, Mus musculus
gatttcccactgaagacggcgtctg

SEQ ID NO: 524133 - DNA, 25 bp, Mus musculus
gatttcccactgtagacggcgtctg

SEQ ID NO: 524134 - DNA, 25 bp, Mus musculus
gatttcccagcacccaatctgtcta

SEQ ID NO: 524135 - DNA, 25 bp, Mus musculus
gatttcccagcagccaatctgtcta

SEQ ID NO: 524136 - DNA, 25 bp, Mus musculus
gatttcccaggtagcagtttgactt

SEQ ID NO: 524137 - DNA, 25 bp, Mus musculus
gatttcccaggttgcagtttgactt

SEQ ID NO: 524138 - DNA, 25 bp, Mus musculus
gatttcccagtacacaagaggcccc

SEQ ID NO: 524139 - DNA, 25 bp, Mus musculus
gatttcccagtagacaagaggcccc

SEQ ID NO: 524140 - DNA, 25 bp, Mus musculus
gatttcccatacctatgacgttcag

SEQ ID NO: 524141 - DNA, 25 bp, Mus musculus
gatttcccatacgtatgacgttcag

SEQ ID NO: 524142 - DNA, 25 bp, Mus musculus
gatttcccatggacatccagagttt

SEQ ID NO: 524143 - DNA, 25 bp, Mus musculus
gatttcccatggtcatccagagttt

SEQ ID NO: 524144 - DNA, 25 bp, Mus musculus
gatttcccatttcattgttaccaag

SEQ ID NO: 524145 - DNA, 25 bp, Mus musculus
gatttcccatttgattgttaccaag

SEQ ID NO: 524146 - DNA, 25 bp, Mus musculus
gatttccccaaaactggcctgttat

SEQ ID NO: 524147 - DNA, 25 bp, Mus musculus
gatttccccaaatctggcctgttat

SEQ ID NO: 524148 - DNA, 25 bp, Mus musculus
gatttccccacacaatcttggtcta

SEQ ID NO: 524149 - DNA, 25 bp, Mus musculus
gatttccccacagaatcttggtcta

SEQ ID NO: 524150 - DNA, 25 bp, Mus musculus
gatttccccaggcaaaggtggatgc

SEQ ID NO: 524151 - DNA, 25 bp, Mus musculus
gatttccccagggaaaggtggatgc

SEQ ID NO: 524152 - DNA, 25 bp, Mus musculus
gatttccccatcctttagccaggaa

SEQ ID NO: 524153 - DNA, 25 bp, Mus musculus
gatttccccatcgtttagccaggaa

SEQ ID NO: 524154 - DNA, 25 bp, Mus musculus
gatttccccattacatgtcagtaca

SEQ ID NO: 524155 - DNA, 25 bp, Mus musculus
gatttccccatttcatgtcagtaca

SEQ ID NO: 524156 - DNA, 25 bp, Mus musculus
gatttccccgagaagtttgccttat

SEQ ID NO: 524157 - DNA, 25 bp, Mus musculus
gatttccccgagtagtttgccttat

SEQ ID NO: 524158 - DNA, 25 bp, Mus musculus
gatttcccctctaagtcacaggact

SEQ ID NO: 524159 - DNA, 25 bp, Mus musculus
gatttcccctcttagtcacaggact

SEQ ID NO: 524160 - DNA, 25 bp, Mus musculus
gatttccctaatcctagacatcaca

SEQ ID NO: 524161 - DNA, 25 bp, Mus musculus
gatttccctaatgctagacatcaca

SEQ ID NO: 524162 - DNA, 25 bp, Mus musculus
gatttccctcagaggaattctgaca

SEQ ID NO: 524163 - DNA, 25 bp, Mus musculus
gatttccctcagtggaattctgaca

SEQ ID NO: 524164 - DNA, 25 bp, Mus musculus
gatttccctctaactgatatttata

SEQ ID NO: 524165 - DNA, 25 bp, Mus musculus
gatttccctctatctgatatttata

SEQ ID NO: 524166 - DNA, 25 bp, Mus musculus
gatttccctgacaatcttctaactt

SEQ ID NO: 524167 - DNA, 25 bp, Mus musculus
gatttccctgactatcttctaactt

SEQ ID NO: 524168 - DNA, 25 bp, Mus musculus
gatttccctgagagaagttcaacct

SEQ ID NO: 524169 - DNA, 25 bp, Mus musculus
gatttccctgagtgaagttcaacct

SEQ ID NO: 524170 - DNA, 25 bp, Mus musculus
gatttccctgctcagttctcagcta

SEQ ID NO: 524171 - DNA, 25 bp, Mus musculus
gatttccctgctgagttctcagcta

SEQ ID NO: 524172 - DNA, 25 bp, Mus musculus
gatttccctggacctccgaaacgaa

SEQ ID NO: 524173 - DNA, 25 bp, Mus musculus
gatttccctggaccttgacaaaaag

SEQ ID NO: 524174 - DNA, 25 bp, Mus musculus
gatttccctggacttctgcaggaaa

SEQ ID NO: 524175 - DNA, 25 bp, Mus musculus
gatttccctggagctccgaaacgaa

SEQ ID NO: 524176 - DNA, 25 bp, Mus musculus
gatttccctggagcttgacaaaaag

SEQ ID NO: 524177 - DNA, 25 bp, Mus musculus
gatttccctggagttctgcaggaaa

SEQ ID NO: 524178 - DNA, 25 bp, Mus musculus
gatttccctggccagtgagctgcaa

SEQ ID NO: 524179 - DNA, 25 bp, Mus musculus
gatttccctggcgagtgagctgcaa

SEQ ID NO: 524180 - DNA, 25 bp, Mus musculus
gatttccctgggaaaccgatatcct

SEQ ID NO: 524181 - DNA, 25 bp, Mus musculus
gatttccctgggtaaccgatatcct

SEQ ID NO: 524182 - DNA, 25 bp, Mus musculus
gatttccctgttccctagggcaact

SEQ ID NO: 524183 - DNA, 25 bp, Mus musculus
gatttccctgttcttacagaggtta

SEQ ID NO: 524184 - DNA, 25 bp, Mus musculus
gatttccctgttgcctagggcaact

SEQ ID NO: 524185 - DNA, 25 bp, Mus musculus
gatttccctgttgttacagaggtta

SEQ ID NO: 524186 - DNA, 25 bp, Mus musculus
gatttcccttctacactggagtcaa

SEQ ID NO: 524187 - DNA, 25 bp, Mus musculus
gatttcccttcttcactggagtcaa

SEQ ID NO: 524188 - DNA, 25 bp, Mus musculus
gatttccgatgacttcctggtacag

SEQ ID NO: 524189 - DNA, 25 bp, Mus musculus
gatttccgatgagttcctggtacag

SEQ ID NO: 524190 - DNA, 25 bp, Mus musculus
gatttccgggtgaagccgtccactt

SEQ ID NO: 524191 - DNA, 25 bp, Mus musculus
gatttccgggtgtagccgtccactt

SEQ ID NO: 524192 - DNA, 25 bp, Mus musculus
gatttccgtctgattcaatgtttcc

SEQ ID NO: 524193 - DNA, 25 bp, Mus musculus
gatttccgtctgtttcaatgtttcc

SEQ ID NO: 524194 - DNA, 25 bp, Mus musculus
gatttccgtggaatataatctaaac

SEQ ID NO: 524195 - DNA, 25 bp, Mus musculus
gatttccgtggattataatctaaac

SEQ ID NO: 524196 - DNA, 25 bp, Mus musculus
gatttccgtgggagtttcccaccag

SEQ ID NO: 524197 - DNA, 25 bp, Mus musculus
gatttccgtgggtgtttcccaccag

SEQ ID NO: 524198 - DNA, 25 bp, Mus musculus
gatttcctatgtcaccatgttctgc

SEQ ID NO: 524199 - DNA, 25 bp, Mus musculus
gatttcctatgtgaccatgttctgc

SEQ ID NO: 524200 - DNA, 25 bp, Mus musculus
gatttcctattaaggcacttccttt

SEQ ID NO: 524201 - DNA, 25 bp, Mus musculus
gatttcctattatggcacttccttt

SEQ ID NO: 524202 - DNA, 25 bp, Mus musculus
gatttcctattcatagtgtctggtt

SEQ ID NO: 524203 - DNA, 25 bp, Mus musculus
gatttcctattcttagtgtctggtt

SEQ ID NO: 524204 - DNA, 25 bp, Mus musculus
gatttcctatttatggcatttcatt

SEQ ID NO: 524205 - DNA, 25 bp, Mus musculus
gatttcctatttttggcatttcatt

SEQ ID NO: 524206 - DNA, 25 bp, Mus musculus
gatttcctcaatctcagcaaagcta

SEQ ID NO: 524207 - DNA, 25 bp, Mus musculus
gatttcctcaatgtcagcaaagcta

SEQ ID NO: 524208 - DNA, 25 bp, Mus musculus
gatttcctcaggaacagacgaattt

SEQ ID NO: 524209 - DNA, 25 bp, Mus musculus
gatttcctcaggtacagacgaattt

SEQ ID NO: 524210 - DNA, 25 bp, Mus musculus
gatttcctcatcctctcacacagat

SEQ ID NO: 524211 - DNA, 25 bp, Mus musculus
gatttcctcatcgtctcacacagat

SEQ ID NO: 524212 - DNA, 25 bp, Mus musculus
gatttcctcattcttgaccctattg

SEQ ID NO: 524213 - DNA, 25 bp, Mus musculus
gatttcctcattgttgaccctattg

SEQ ID NO: 524214 - DNA, 25 bp, Mus musculus
gatttcctccagaaaggcctgatga

SEQ ID NO: 524215 - DNA, 25 bp, Mus musculus
gatttcctccagtaaggcctgatga

SEQ ID NO: 524216 - DNA, 25 bp, Mus musculus
gatttcctcgatatccaggactgca

SEQ ID NO: 524217 - DNA, 25 bp, Mus musculus
gatttcctcgatttccaggactgca

SEQ ID NO: 524218 - DNA, 25 bp, Mus musculus
gatttcctcttgcagcttatgtgca

SEQ ID NO: 524219 - DNA, 25 bp, Mus musculus
gatttcctcttggagcttatgtgca

SEQ ID NO: 524220 - DNA, 25 bp, Mus musculus
gatttcctgaagcacctttgacaga

SEQ ID NO: 524221 - DNA, 25 bp, Mus musculus
gatttcctgaaggacctttgacaga

SEQ ID NO: 524222 - DNA, 25 bp, Mus musculus
gatttcctgagccatgtatcttttt

SEQ ID NO: 524223 - DNA, 25 bp, Mus musculus
gatttcctgagcgatgtatcttttt

SEQ ID NO: 524224 - DNA, 25 bp, Mus musculus
gatttcctgcaacgccgggcgaccg

SEQ ID NO: 524225 - DNA, 25 bp, Mus musculus
gatttcctgcaaggccgggcgaccg

SEQ ID NO: 524226 - DNA, 25 bp, Mus musculus
gatttcctgcagatgaacatagaga

SEQ ID NO: 524227 - DNA, 25 bp, Mus musculus
gatttcctgcagttgaacatagaga

SEQ ID NO: 524228 - DNA, 25 bp, Mus musculus
gatttcctgctactttgggcgaata

SEQ ID NO: 524229 - DNA, 25 bp, Mus musculus
gatttcctgctagtttgggcgaata

SEQ ID NO: 524230 - DNA, 25 bp, Mus musculus
gatttcctgctgaggatacagtcag

SEQ ID NO: 524231 - DNA, 25 bp, Mus musculus
gatttcctgctgtggatacagtcag

SEQ ID NO: 524232 - DNA, 25 bp, Mus musculus
gatttcctgcttcgtcgtcttttaa

SEQ ID NO: 524233 - DNA, 25 bp, Mus musculus
gatttcctgcttggtcgtcttttaa

SEQ ID NO: 524234 - DNA, 25 bp, Mus musculus
gatttcctgggtaatccactgcaag

SEQ ID NO: 524235 - DNA, 25 bp, Mus musculus
gatttcctgggttatccactgcaag

SEQ ID NO: 524236 - DNA, 25 bp, Mus musculus
gatttcctgttaccagcactagagc

SEQ ID NO: 524237 - DNA, 25 bp, Mus musculus
gatttcctgttagcagcactagagc

SEQ ID NO: 524238 - DNA, 25 bp, Mus musculus
gatttccttacacgagctcttctga

SEQ ID NO: 524239 - DNA, 25 bp, Mus musculus
gatttccttacaggagctcttctga

SEQ ID NO: 524240 - DNA, 25 bp, Mus musculus
gatttccttgaaaaaactgttcctt

SEQ ID NO: 524241 - DNA, 25 bp, Mus musculus
gatttccttgaataaactgttcctt

SEQ ID NO: 524242 - DNA, 25 bp, Mus musculus
gatttccttgagattccatatgcat

SEQ ID NO: 524243 - DNA, 25 bp, Mus musculus
gatttccttgagtttccatatgcat

SEQ ID NO: 524244 - DNA, 25 bp, Mus musculus
gatttccttgtacttcactatagta

SEQ ID NO: 524245 - DNA, 25 bp, Mus musculus
gatttccttgtagttcactatagta

SEQ ID NO: 524246 - DNA, 25 bp, Mus musculus
gatttcctttcgaatggcactacct

SEQ ID NO: 524247 - DNA, 25 bp, Mus musculus
gatttcctttcgtatggcactacct

SEQ ID NO: 524248 - DNA, 25 bp, Mus musculus
gatttcctttgtactgtttggacta

SEQ ID NO: 524249 - DNA, 25 bp, Mus musculus
gatttcctttgttctgtttggacta

SEQ ID NO: 524250 - DNA, 25 bp, Mus musculus
gatttcgaagtgaagaaactatctt

SEQ ID NO: 524251 - DNA, 25 bp, Mus musculus
gatttcgaagtgtagaaactatctt

SEQ ID NO: 524252 - DNA, 25 bp, Mus musculus
gatttcgaatcaatacaaagtctct

SEQ ID NO: 524253 - DNA, 25 bp, Mus musculus
gatttcgaatcattacaaagtctct

SEQ ID NO: 524254 - DNA, 25 bp, Mus musculus
gatttcgaatctacagtccaggaga

SEQ ID NO: 524255 - DNA, 25 bp, Mus musculus
gatttcgaatcttcagtccaggaga

SEQ ID NO: 524256 - DNA, 25 bp, Mus musculus
gatttcgagaatccctaaactctgg

SEQ ID NO: 524257 - DNA, 25 bp, Mus musculus
gatttcgagaatgcctaaactctgg

SEQ ID NO: 524258 - DNA, 25 bp, Mus musculus
gatttcgaggccatagcaatagtcg

SEQ ID NO: 524259 - DNA, 25 bp, Mus musculus
gatttcgaggccttagcaatagtcg

SEQ ID NO: 524260 - DNA, 25 bp, Mus musculus
gatttcgatctcaagccagagtgtg

SEQ ID NO: 524261 - DNA, 25 bp, Mus musculus
gatttcgatctctagccagagtgtg

SEQ ID NO: 524262 - DNA, 25 bp, Mus musculus
gatttcgatgttatcaaagcccggg

SEQ ID NO: 524263 - DNA, 25 bp, Mus musculus
gatttcgatgttttcaaagcccggg

SEQ ID NO: 524264 - DNA, 25 bp, Mus musculus
gatttcgattttctcttacaaccta

SEQ ID NO: 524265 - DNA, 25 bp, Mus musculus
gatttcgattttgtcttacaaccta

SEQ ID NO: 524266 - DNA, 25 bp, Mus musculus
gatttcgcctttagaaggttactca

SEQ ID NO: 524267 - DNA, 25 bp, Mus musculus
gatttcgccttttgaaggttactca

SEQ ID NO: 524268 - DNA, 25 bp, Mus musculus
gatttcggaactcgaaatgaccatc

SEQ ID NO: 524269 - DNA, 25 bp, Mus musculus
gatttcggaactggaaatgaccatc

SEQ ID NO: 524270 - DNA, 25 bp, Mus musculus
gatttcggagttcccaataagcctc

SEQ ID NO: 524271 - DNA, 25 bp, Mus musculus
gatttcggagttgccaataagcctc

SEQ ID NO: 524272 - DNA, 25 bp, Mus musculus
gatttcggctgccttttgcacaaaa

SEQ ID NO: 524273 - DNA, 25 bp, Mus musculus
gatttcggctgcgttttgcacaaaa

SEQ ID NO: 524274 - DNA, 25 bp, Mus musculus
gatttcggtttcacaaatggcagac

SEQ ID NO: 524275 - DNA, 25 bp, Mus musculus
gatttcggtttctcaaatggcagac

SEQ ID NO: 524276 - DNA, 25 bp, Mus musculus
gatttcgtaggacgccaaatcagtg

SEQ ID NO: 524277 - DNA, 25 bp, Mus musculus
gatttcgtaggaggccaaatcagtg

SEQ ID NO: 524278 - DNA, 25 bp, Mus musculus
gatttcgtcacaaagcttttctgca

SEQ ID NO: 524279 - DNA, 25 bp, Mus musculus
gatttcgtcacatagcttttctgca

SEQ ID NO: 524280 - DNA, 25 bp, Mus musculus
gatttcgtccggaatatcctgtgga

SEQ ID NO: 524281 - DNA, 25 bp, Mus musculus
gatttcgtccggtatatcctgtgga

SEQ ID NO: 524282 - DNA, 25 bp, Mus musculus
gatttcgtgaacaaagatggacaat

SEQ ID NO: 524283 - DNA, 25 bp, Mus musculus
gatttcgtgaactaagatggacaat

SEQ ID NO: 524284 - DNA, 25 bp, Mus musculus
gatttcgtgtaactctatcctgtac

SEQ ID NO: 524285 - DNA, 25 bp, Mus musculus
gatttcgtgtaagtctatcctgtac

SEQ ID NO: 524286 - DNA, 25 bp, Mus musculus
gatttcgtgtatatcccacagggac

SEQ ID NO: 524287 - DNA, 25 bp, Mus musculus
gatttcgtgtatttcccacagggac

SEQ ID NO: 524288 - DNA, 25 bp, Mus musculus
gatttctaaagacacttctgggctg

SEQ ID NO: 524289 - DNA, 25 bp, Mus musculus
gatttctaaagagacttctgggctg

SEQ ID NO: 524290 - DNA, 25 bp, Mus musculus
gatttctaacccaggatctgatggt

SEQ ID NO: 524291 - DNA, 25 bp, Mus musculus
gatttctaaccctggatctgatggt

SEQ ID NO: 524292 - DNA, 25 bp, Mus musculus
gatttctaactaagacaaatggatt

SEQ ID NO: 524293 - DNA, 25 bp, Mus musculus
gatttctaactatgacaaatggatt

SEQ ID NO: 524294 - DNA, 25 bp, Mus musculus
gatttctaagccaaatgttttctaa

SEQ ID NO: 524295 - DNA, 25 bp, Mus musculus
gatttctaagcctaatgttttctaa

SEQ ID NO: 524296 - DNA, 25 bp, Mus musculus
gatttctaaggactccagcgccctc

SEQ ID NO: 524297 - DNA, 25 bp, Mus musculus
gatttctaaggagtccagcgccctc

SEQ ID NO: 524298 - DNA, 25 bp, Mus musculus
gatttctaataactgcgtgggccct

SEQ ID NO: 524299 - DNA, 25 bp, Mus musculus
gatttctaataagtgcgtgggccct

SEQ ID NO: 524300 - DNA, 25 bp, Mus musculus
gatttctacatcatcacaaacacac

SEQ ID NO: 524301 - DNA, 25 bp, Mus musculus
gatttctacatcttcacaaacacac

SEQ ID NO: 524302 - DNA, 25 bp, Mus musculus
gatttctaccatactgtgattctta

SEQ ID NO: 524303 - DNA, 25 bp, Mus musculus
gatttctaccattctgtgattctta

SEQ ID NO: 524304 - DNA, 25 bp, Mus musculus
gatttctacccacccaagatcaaag

SEQ ID NO: 524305 - DNA, 25 bp, Mus musculus
gatttctacccagccaagatcaaag

SEQ ID NO: 524306 - DNA, 25 bp, Mus musculus
gatttctacgacacggaggagcaga

SEQ ID NO: 524307 - DNA, 25 bp, Mus musculus
gatttctacgactcggaggagcaga

SEQ ID NO: 524308 - DNA, 25 bp, Mus musculus
gatttctactgccagtgagctcagc

SEQ ID NO: 524309 - DNA, 25 bp, Mus musculus
gatttctactgcgagtgagctcagc

SEQ ID NO: 524310 - DNA, 25 bp, Mus musculus
gatttctagctcagtgaccttggga

SEQ ID NO: 524311 - DNA, 25 bp, Mus musculus
gatttctagctctgtgaccttggga

SEQ ID NO: 524312 - DNA, 25 bp, Mus musculus
gatttctagctgagccttttaaacc

SEQ ID NO: 524313 - DNA, 25 bp, Mus musculus
gatttctagctgtgccttttaaacc

SEQ ID NO: 524314 - DNA, 25 bp, Mus musculus
gatttctagggcagggctaaagacc

SEQ ID NO: 524315 - DNA, 25 bp, Mus musculus
gatttctagggctgggctaaagacc

SEQ ID NO: 524316 - DNA, 25 bp, Mus musculus
gatttctaggttcaattccagattc

SEQ ID NO: 524317 - DNA, 25 bp, Mus musculus
gatttctaggttgaattccagattc

SEQ ID NO: 524318 - DNA, 25 bp, Mus musculus
gatttctagtcaaagtgccagcaca

SEQ ID NO: 524319 - DNA, 25 bp, Mus musculus
gatttctagtcatagtgccagcaca

SEQ ID NO: 524320 - DNA, 25 bp, Mus musculus
gatttctagttcacagtaaagtcac

SEQ ID NO: 524321 - DNA, 25 bp, Mus musculus
gatttctagttctcagtaaagtcac

SEQ ID NO: 524322 - DNA, 25 bp, Mus musculus
gatttctatctgaacttctctttgc

SEQ ID NO: 524323 - DNA, 25 bp, Mus musculus
gatttctatctgtacttctctttgc

SEQ ID NO: 524324 - DNA, 25 bp, Mus musculus
gatttctatgaacctcgacagccag

SEQ ID NO: 524325 - DNA, 25 bp, Mus musculus
gatttctatgaagctcgacagccag

SEQ ID NO: 524326 - DNA, 25 bp, Mus musculus
gatttctatgacatcgtccgaacag

SEQ ID NO: 524327 - DNA, 25 bp, Mus musculus
gatttctatgacttcgtccgaacag

SEQ ID NO: 524328 - DNA, 25 bp, Mus musculus
gatttctatggccaccagatgctta

SEQ ID NO: 524329 - DNA, 25 bp, Mus musculus
gatttctatggcgaccagatgctta

SEQ ID NO: 524330 - DNA, 25 bp, Mus musculus
gatttctcaatgaaattctgttaag

SEQ ID NO: 524331 - DNA, 25 bp, Mus musculus
gatttctcaatgtaattctgttaag

SEQ ID NO: 524332 - DNA, 25 bp, Mus musculus
gatttctcaattaggattccctcct

SEQ ID NO: 524333 - DNA, 25 bp, Mus musculus
gatttctcaatttggattccctcct

SEQ ID NO: 524334 - DNA, 25 bp, Mus musculus
gatttctcacttcgttggaagatca

SEQ ID NO: 524335 - DNA, 25 bp, Mus musculus
gatttctcacttggttggaagatca

SEQ ID NO: 524336 - DNA, 25 bp, Mus musculus
gatttctcaggtactttcaagtagc

SEQ ID NO: 524337 - DNA, 25 bp, Mus musculus
gatttctcaggttctttcaagtagc

SEQ ID NO: 524338 - DNA, 25 bp, Mus musculus
gatttctcatcacccgaaagtccag

SEQ ID NO: 524339 - DNA, 25 bp, Mus musculus
gatttctcatcagccgaaagtccag

SEQ ID NO: 524340 - DNA, 25 bp, Mus musculus
gatttctccaagctcctaccatctt

SEQ ID NO: 524341 - DNA, 25 bp, Mus musculus
gatttctccaaggtcctaccatctt

SEQ ID NO: 524342 - DNA, 25 bp, Mus musculus
gatttctccatcaaatcctggctgt

SEQ ID NO: 524343 - DNA, 25 bp, Mus musculus
gatttctccatctaatcctggctgt

SEQ ID NO: 524344 - DNA, 25 bp, Mus musculus
gatttctccatgcattaacttttgt

SEQ ID NO: 524345 - DNA, 25 bp, Mus musculus
gatttctccatggattaacttttgt

SEQ ID NO: 524346 - DNA, 25 bp, Mus musculus
gatttctcccataccagtgtgccag

SEQ ID NO: 524347 - DNA, 25 bp, Mus musculus
gatttctcccatattagtttaatat

SEQ ID NO: 524348 - DNA, 25 bp, Mus musculus
gatttctcccattccagtgtgccag

SEQ ID NO: 524349 - DNA, 25 bp, Mus musculus
gatttctcccattttagtttaatat

SEQ ID NO: 524350 - DNA, 25 bp, Mus musculus
gatttctcctagattttcaaagaag

SEQ ID NO: 524351 - DNA, 25 bp, Mus musculus
gatttctcctagtttttcaaagaag

SEQ ID NO: 524352 - DNA, 25 bp, Mus musculus
gatttctcctatatggactccaagg

SEQ ID NO: 524353 - DNA, 25 bp, Mus musculus
gatttctcctatttggactccaagg

SEQ ID NO: 524354 - DNA, 25 bp, Mus musculus
gatttctcctctcactatttctgtt

SEQ ID NO: 524355 - DNA, 25 bp, Mus musculus
gatttctcctctgactatttctgtt

SEQ ID NO: 524356 - DNA, 25 bp, Mus musculus
gatttctcctgaagatttttctgtt

SEQ ID NO: 524357 - DNA, 25 bp, Mus musculus
gatttctcctgatgatttttctgtt

SEQ ID NO: 524358 - DNA, 25 bp, Mus musculus
gatttctcctgtaatttttagccca

SEQ ID NO: 524359 - DNA, 25 bp, Mus musculus
gatttctcctgttatttttagccca

SEQ ID NO: 524360 - DNA, 25 bp, Mus musculus
gatttctcgtctattctgactggca

SEQ ID NO: 524361 - DNA, 25 bp, Mus musculus
gatttctcgtcttttctgactggca

SEQ ID NO: 524362 - DNA, 25 bp, Mus musculus
gatttctcgtggaattttgaacctt

SEQ ID NO: 524363 - DNA, 25 bp, Mus musculus
gatttctcgtggtattttgaacctt

SEQ ID NO: 524364 - DNA, 25 bp, Mus musculus
gatttctctaatatgcctggctggg

SEQ ID NO: 524365 - DNA, 25 bp, Mus musculus
gatttctctaatttgcctggctggg

SEQ ID NO: 524366 - DNA, 25 bp, Mus musculus
gatttctctacacgctgcattaaag

SEQ ID NO: 524367 - DNA, 25 bp, Mus musculus
gatttctctacaggctgcattaaag

SEQ ID NO: 524368 - DNA, 25 bp, Mus musculus
gatttctctagcacaaggttctaca

SEQ ID NO: 524369 - DNA, 25 bp, Mus musculus
gatttctctagctcaaggttctaca

SEQ ID NO: 524370 - DNA, 25 bp, Mus musculus
gatttctctatgaaggactctccag

SEQ ID NO: 524371 - DNA, 25 bp, Mus musculus
gatttctctatgtaggactctccag

SEQ ID NO: 524372 - DNA, 25 bp, Mus musculus
gatttctctattaagttcctcgcgg

SEQ ID NO: 524373 - DNA, 25 bp, Mus musculus
gatttctctatttagttcctcgcgg

SEQ ID NO: 524374 - DNA, 25 bp, Mus musculus
gatttctctcctagatagactgtca

SEQ ID NO: 524375 - DNA, 25 bp, Mus musculus
gatttctctccttgatagactgtca

SEQ ID NO: 524376 - DNA, 25 bp, Mus musculus
gatttctctgccaggattgaaacac

SEQ ID NO: 524377 - DNA, 25 bp, Mus musculus
gatttctctgcctggattgaaacac

SEQ ID NO: 524378 - DNA, 25 bp, Mus musculus
gatttctctgtgaatggctatgctc

SEQ ID NO: 524379 - DNA, 25 bp, Mus musculus
gatttctctgtgtatggctatgctc

SEQ ID NO: 524380 - DNA, 25 bp, Mus musculus
gatttctctgttagcatgagtctgc

SEQ ID NO: 524381 - DNA, 25 bp, Mus musculus
gatttctctgttatcaccctctttt

SEQ ID NO: 524382 - DNA, 25 bp, Mus musculus
gatttctctgtttgcatgagtctgc

SEQ ID NO: 524383 - DNA, 25 bp, Mus musculus
gatttctctgttttcaccctctttt

SEQ ID NO: 524384 - DNA, 25 bp, Mus musculus
gatttctcttaaatccattcgtgta

SEQ ID NO: 524385 - DNA, 25 bp, Mus musculus
gatttctcttaattccattcgtgta

SEQ ID NO: 524386 - DNA, 25 bp, Mus musculus
gatttctcttacctttgtgaattgc

SEQ ID NO: 524387 - DNA, 25 bp, Mus musculus
gatttctcttacgtttgtgaattgc

SEQ ID NO: 524388 - DNA, 25 bp, Mus musculus
gatttctcttatcgaacccgcagat

SEQ ID NO: 524389 - DNA, 25 bp, Mus musculus
gatttctcttatggaacccgcagat

SEQ ID NO: 524390 - DNA, 25 bp, Mus musculus
gatttctcttctctctgaaaacgga

SEQ ID NO: 524391 - DNA, 25 bp, Mus musculus
gatttctcttctgtctgaaaacgga

SEQ ID NO: 524392 - DNA, 25 bp, Mus musculus
gatttctcttgtagctttcttccaa

SEQ ID NO: 524393 - DNA, 25 bp, Mus musculus
gatttctcttgttgctttcttccaa

SEQ ID NO: 524394 - DNA, 25 bp, Mus musculus
gatttctgaaatctagtcaggcttt

SEQ ID NO: 524395 - DNA, 25 bp, Mus musculus
gatttctgaaatgtagtcaggcttt

SEQ ID NO: 524396 - DNA, 25 bp, Mus musculus
gatttctgaagcctccttagtcgat

SEQ ID NO: 524397 - DNA, 25 bp, Mus musculus
gatttctgaagcgtccttagtcgat

SEQ ID NO: 524398 - DNA, 25 bp, Mus musculus
gatttctgacttattcacaatgagc

SEQ ID NO: 524399 - DNA, 25 bp, Mus musculus
gatttctgactttttcacaatgagc

SEQ ID NO: 524400 - DNA, 25 bp, Mus musculus
gatttctgagaaagtctaccataac

SEQ ID NO: 524401 - DNA, 25 bp, Mus musculus
gatttctgagaatgtctaccataac

SEQ ID NO: 524402 - DNA, 25 bp, Mus musculus
gatttctgagttccgccagaggaat

SEQ ID NO: 524403 - DNA, 25 bp, Mus musculus
gatttctgagttgcgccagaggaat

SEQ ID NO: 524404 - DNA, 25 bp, Mus musculus
gatttctgcacaccctattgttaag

SEQ ID NO: 524405 - DNA, 25 bp, Mus musculus
gatttctgcacagcctattgttaag

SEQ ID NO: 524406 - DNA, 25 bp, Mus musculus
gatttctgccagagatcttcttgta

SEQ ID NO: 524407 - DNA, 25 bp, Mus musculus
gatttctgccagcaaccacaggtgg

SEQ ID NO: 524408 - DNA, 25 bp, Mus musculus
gatttctgccaggaaccacaggtgg

SEQ ID NO: 524409 - DNA, 25 bp, Mus musculus
gatttctgccagtgatcttcttgta

SEQ ID NO: 524410 - DNA, 25 bp, Mus musculus
gatttctgctaaaattgacacacct

SEQ ID NO: 524411 - DNA, 25 bp, Mus musculus
gatttctgctaatattgacacacct

SEQ ID NO: 524412 - DNA, 25 bp, Mus musculus
gatttctgctagaacttcagttggg

SEQ ID NO: 524413 - DNA, 25 bp, Mus musculus
gatttctgctagtacttcagttggg

SEQ ID NO: 524414 - DNA, 25 bp, Mus musculus
gatttctgctccacatttgtattgt

SEQ ID NO: 524415 - DNA, 25 bp, Mus musculus
gatttctgctcctcatttgtattgt

SEQ ID NO: 524416 - DNA, 25 bp, Mus musculus
gatttctgctttcacaacagtctgt

SEQ ID NO: 524417 - DNA, 25 bp, Mus musculus
gatttctgctttgacaacagtctgt

SEQ ID NO: 524418 - DNA, 25 bp, Mus musculus
gatttctggatgaccccaactttta

SEQ ID NO: 524419 - DNA, 25 bp, Mus musculus
gatttctggatgtccccaactttta

SEQ ID NO: 524420 - DNA, 25 bp, Mus musculus
gatttctggctcagcattcctgaga

SEQ ID NO: 524421 - DNA, 25 bp, Mus musculus
gatttctggctctgcattcctgaga

SEQ ID NO: 524422 - DNA, 25 bp, Mus musculus
gatttctggttaccatcagctggga

SEQ ID NO: 524423 - DNA, 25 bp, Mus musculus
gatttctggttagcatcagctggga

SEQ ID NO: 524424 - DNA, 25 bp, Mus musculus
gatttctggttcacaactttgtcaa

SEQ ID NO: 524425 - DNA, 25 bp, Mus musculus
gatttctggttctcaactttgtcaa

SEQ ID NO: 524426 - DNA, 25 bp, Mus musculus
gatttctgtaacctttgacctaatg

SEQ ID NO: 524427 - DNA, 25 bp, Mus musculus
gatttctgtaacgtttgacctaatg

SEQ ID NO: 524428 - DNA, 25 bp, Mus musculus
gatttctgtacaagtcacactagtt

SEQ ID NO: 524429 - DNA, 25 bp, Mus musculus
gatttctgtacatgtcacactagtt

SEQ ID NO: 524430 - DNA, 25 bp, Mus musculus
gatttctgtataatgtcgggttcta

SEQ ID NO: 524431 - DNA, 25 bp, Mus musculus
gatttctgtatattgtcgggttcta

SEQ ID NO: 524432 - DNA, 25 bp, Mus musculus
gatttctgtcagcatatgcgtcgaa

SEQ ID NO: 524433 - DNA, 25 bp, Mus musculus
gatttctgtcaggatatgcgtcgaa

SEQ ID NO: 524434 - DNA, 25 bp, Mus musculus
gatttctgtccgctaatctgcttta

SEQ ID NO: 524435 - DNA, 25 bp, Mus musculus
gatttctgtccggtaatctgcttta

SEQ ID NO: 524436 - DNA, 25 bp, Mus musculus
gatttctgtcttagacatctaccag

SEQ ID NO: 524437 - DNA, 25 bp, Mus musculus
gatttctgtctttgacatctaccag

SEQ ID NO: 524438 - DNA, 25 bp, Mus musculus
gatttctgtgaaatcgagcccactt

SEQ ID NO: 524439 - DNA, 25 bp, Mus musculus
gatttctgtgaattcgagcccactt

SEQ ID NO: 524440 - DNA, 25 bp, Mus musculus
gatttctgtggcattcgggaacact

SEQ ID NO: 524441 - DNA, 25 bp, Mus musculus
gatttctgtggctttcgggaacact

SEQ ID NO: 524442 - DNA, 25 bp, Mus musculus
gatttctgttcaaattcaggcagtt

SEQ ID NO: 524443 - DNA, 25 bp, Mus musculus
gatttctgttcatattcaggcagtt

SEQ ID NO: 524444 - DNA, 25 bp, Mus musculus
gatttctgttccagctttaagaatg

SEQ ID NO: 524445 - DNA, 25 bp, Mus musculus
gatttctgttcctgctttaagaatg

SEQ ID NO: 524446 - DNA, 25 bp, Mus musculus
gatttctgttgaaaccttggtgtta

SEQ ID NO: 524447 - DNA, 25 bp, Mus musculus
gatttctgttgataccttggtgtta

SEQ ID NO: 524448 - DNA, 25 bp, Mus musculus
gatttcttaatactctgtgactcaa

SEQ ID NO: 524449 - DNA, 25 bp, Mus musculus
gatttcttaatagtctgtgactcaa

SEQ ID NO: 524450 - DNA, 25 bp, Mus musculus
gatttcttactcacttttggctaat

SEQ ID NO: 524451 - DNA, 25 bp, Mus musculus
gatttcttactctcttttggctaat

SEQ ID NO: 524452 - DNA, 25 bp, Mus musculus
gatttcttagaactcatgtaaacgg

SEQ ID NO: 524453 - DNA, 25 bp, Mus musculus
gatttcttagaagtcatgtaaacgg

SEQ ID NO: 524454 - DNA, 25 bp, Mus musculus
gatttcttagcacagtgcctagcat

SEQ ID NO: 524455 - DNA, 25 bp, Mus musculus
gatttcttagcagagtgcctagcat

SEQ ID NO: 524456 - DNA, 25 bp, Mus musculus
gatttcttatccaccaaagctctga

SEQ ID NO: 524457 - DNA, 25 bp, Mus musculus
gatttcttatcctccaaagctctga

SEQ ID NO: 524458 - DNA, 25 bp, Mus musculus
gatttcttatctataaacgattata

SEQ ID NO: 524459 - DNA, 25 bp, Mus musculus
gatttcttatctttaaacgattata

SEQ ID NO: 524460 - DNA, 25 bp, Mus musculus
gatttcttcaaccagttagtcacag

SEQ ID NO: 524461 - DNA, 25 bp, Mus musculus
gatttcttcaacgagttagtcacag

SEQ ID NO: 524462 - DNA, 25 bp, Mus musculus
gatttcttcaagcacaagtatcaga

SEQ ID NO: 524463 - DNA, 25 bp, Mus musculus
gatttcttcaagcacacacattctt

SEQ ID NO: 524464 - DNA, 25 bp, Mus musculus
gatttcttcaaggacaagtatcaga

SEQ ID NO: 524465 - DNA, 25 bp, Mus musculus
gatttcttcaaggacacacattctt

SEQ ID NO: 524466 - DNA, 25 bp, Mus musculus
gatttcttcaccatggatttccatg

SEQ ID NO: 524467 - DNA, 25 bp, Mus musculus
gatttcttcaccttggatttccatg

SEQ ID NO: 524468 - DNA, 25 bp, Mus musculus
gatttcttcacgagtgcatgtgcgc

SEQ ID NO: 524469 - DNA, 25 bp, Mus musculus
gatttcttcacgtgtgcatgtgcgc

SEQ ID NO: 524470 - DNA, 25 bp, Mus musculus
gatttcttcataactggctgactga

SEQ ID NO: 524471 - DNA, 25 bp, Mus musculus
gatttcttcatatctggctgactga

SEQ ID NO: 524472 - DNA, 25 bp, Mus musculus
gatttcttcatcatgcattctgcgt

SEQ ID NO: 524473 - DNA, 25 bp, Mus musculus
gatttcttcatcttgcattctgcgt

SEQ ID NO: 524474 - DNA, 25 bp, Mus musculus
gatttcttccaaatttaccttgaat

SEQ ID NO: 524475 - DNA, 25 bp, Mus musculus
gatttcttccaattttaccttgaat

SEQ ID NO: 524476 - DNA, 25 bp, Mus musculus
gatttcttccatcaacactattaat

SEQ ID NO: 524477 - DNA, 25 bp, Mus musculus
gatttcttccatgaacactattaat

SEQ ID NO: 524478 - DNA, 25 bp, Mus musculus
gatttcttctagaacttgttttcga

SEQ ID NO: 524479 - DNA, 25 bp, Mus musculus
gatttcttctagtacttgttttcga

SEQ ID NO: 524480 - DNA, 25 bp, Mus musculus
gatttcttctggcaggcactggaca

SEQ ID NO: 524481 - DNA, 25 bp, Mus musculus
gatttcttctgggaggcactggaca

SEQ ID NO: 524482 - DNA, 25 bp, Mus musculus
gatttcttctgtatcttccttttga

SEQ ID NO: 524483 - DNA, 25 bp, Mus musculus
gatttcttctgtttcttccttttga

SEQ ID NO: 524484 - DNA, 25 bp, Mus musculus
gatttcttgagccattactcagtat

SEQ ID NO: 524485 - DNA, 25 bp, Mus musculus
gatttcttgagcgattactcagtat

SEQ ID NO: 524486 - DNA, 25 bp, Mus musculus
gatttcttgagtctaaccccgtgat

SEQ ID NO: 524487 - DNA, 25 bp, Mus musculus
gatttcttgagtgtaaccccgtgat

SEQ ID NO: 524488 - DNA, 25 bp, Mus musculus
gatttcttgatacctctcgtaccac

SEQ ID NO: 524489 - DNA, 25 bp, Mus musculus
gatttcttgatagctctcgtaccac

SEQ ID NO: 524490 - DNA, 25 bp, Mus musculus
gatttcttgatgagtgattgtacag

SEQ ID NO: 524491 - DNA, 25 bp, Mus musculus
gatttcttgatgtgtgattgtacag

SEQ ID NO: 524492 - DNA, 25 bp, Mus musculus
gatttcttgcatagcatgtcacagt

SEQ ID NO: 524493 - DNA, 25 bp, Mus musculus
gatttcttgcattgcatgtcacagt

SEQ ID NO: 524494 - DNA, 25 bp, Mus musculus
gatttcttgctgacatttcgagaat

SEQ ID NO: 524495 - DNA, 25 bp, Mus musculus
gatttcttgctgtcatttcgagaat

SEQ ID NO: 524496 - DNA, 25 bp, Mus musculus
gatttcttgtgaagcatgcctcttt

SEQ ID NO: 524497 - DNA, 25 bp, Mus musculus
gatttcttgtgatgcatgcctcttt

SEQ ID NO: 524498 - DNA, 25 bp, Mus musculus
gatttcttgtggaattctgaacctt

SEQ ID NO: 524499 - DNA, 25 bp, Mus musculus
gatttcttgtggtattctgaacctt

SEQ ID NO: 524500 - DNA, 25 bp, Mus musculus
gatttcttgttaactcttgccctag

SEQ ID NO: 524501 - DNA, 25 bp, Mus musculus
gatttcttgttaattcatggattga

SEQ ID NO: 524502 - DNA, 25 bp, Mus musculus
gatttcttgttatctcttgccctag

SEQ ID NO: 524503 - DNA, 25 bp, Mus musculus
gatttcttgttatttcatggattga

SEQ ID NO: 524504 - DNA, 25 bp, Mus musculus
gatttctttactacagtgcactgga

SEQ ID NO: 524505 - DNA, 25 bp, Mus musculus
gatttctttacttcagtgcactgga

SEQ ID NO: 524506 - DNA, 25 bp, Mus musculus
gatttctttcagacctaacacagcc

SEQ ID NO: 524507 - DNA, 25 bp, Mus musculus
gatttctttcagtcctaacacagcc

SEQ ID NO: 524508 - DNA, 25 bp, Mus musculus
gatttctttcggcaagcacaacaac

SEQ ID NO: 524509 - DNA, 25 bp, Mus musculus
gatttctttcgggaagcacaacaac

SEQ ID NO: 524510 - DNA, 25 bp, Mus musculus
gatttctttctaagctggagtcttc

SEQ ID NO: 524511 - DNA, 25 bp, Mus musculus
gatttctttctatgctggagtcttc

SEQ ID NO: 524512 - DNA, 25 bp, Mus musculus
gatttctttctcagtgacactatag

SEQ ID NO: 524513 - DNA, 25 bp, Mus musculus
gatttctttctctgtgacactatag

SEQ ID NO: 524514 - DNA, 25 bp, Mus musculus
gatttctttcttcccttcaatgtga

SEQ ID NO: 524515 - DNA, 25 bp, Mus musculus
gatttctttcttcgatgcagcatga

SEQ ID NO: 524516 - DNA, 25 bp, Mus musculus
gatttctttcttgccttcaatgtga

SEQ ID NO: 524517 - DNA, 25 bp, Mus musculus
gatttctttcttggatgcagcatga

SEQ ID NO: 524518 - DNA, 25 bp, Mus musculus
gatttctttgagaacaggtctccct

SEQ ID NO: 524519 - DNA, 25 bp, Mus musculus
gatttctttgagtacaggtctccct

SEQ ID NO: 524520 - DNA, 25 bp, Mus musculus
gatttctttgccaatcctgcaaata

SEQ ID NO: 524521 - DNA, 25 bp, Mus musculus
gatttctttgcctatcctgcaaata

SEQ ID NO: 524522 - DNA, 25 bp, Mus musculus
gatttctttggccagcaggaagcca

SEQ ID NO: 524523 - DNA, 25 bp, Mus musculus
gatttctttggcgagcaggaagcca

SEQ ID NO: 524524 - DNA, 25 bp, Mus musculus
gatttctttgtacttcagctagccg

SEQ ID NO: 524525 - DNA, 25 bp, Mus musculus
gatttctttgtagttcagctagccg

SEQ ID NO: 524526 - DNA, 25 bp, Mus musculus
gatttcttttagagacatggagaca

SEQ ID NO: 524527 - DNA, 25 bp, Mus musculus
gatttcttttagagggcggctactc

SEQ ID NO: 524528 - DNA, 25 bp, Mus musculus
gatttcttttagatcaagaccaggc

SEQ ID NO: 524529 - DNA, 25 bp, Mus musculus
gatttcttttagtgacatggagaca

SEQ ID NO: 524530 - DNA, 25 bp, Mus musculus
gatttcttttagtgggcggctactc

SEQ ID NO: 524531 - DNA, 25 bp, Mus musculus
gatttcttttagttcaagaccaggc

SEQ ID NO: 524532 - DNA, 25 bp, Mus musculus
gatttcttttatacagttgcctgca

SEQ ID NO: 524533 - DNA, 25 bp, Mus musculus
gatttcttttattcagttgcctgca

SEQ ID NO: 524534 - DNA, 25 bp, Mus musculus
gatttcttttccaagcatgctgttg

SEQ ID NO: 524535 - DNA, 25 bp, Mus musculus
gatttcttttcctagcatgctgttg

SEQ ID NO: 524536 - DNA, 25 bp, Mus musculus
gatttcttttgtaccgtggcatcga

SEQ ID NO: 524537 - DNA, 25 bp, Mus musculus
gatttcttttgtcaggctacaacaa

SEQ ID NO: 524538 - DNA, 25 bp, Mus musculus
gatttcttttgtgaggctacaacaa

SEQ ID NO: 524539 - DNA, 25 bp, Mus musculus
gatttcttttgttccgtggcatcga

SEQ ID NO: 524540 - DNA, 25 bp, Mus musculus
gatttgaaactaatgctgcacagaa

SEQ ID NO: 524541 - DNA, 25 bp, Mus musculus
gatttgaaactattgctgcacagaa

SEQ ID NO: 524542 - DNA, 25 bp, Mus musculus
gatttgaaagcaatcttcgtgtatt

SEQ ID NO: 524543 - DNA, 25 bp, Mus musculus
gatttgaaagcattcttcgtgtatt

SEQ ID NO: 524544 - DNA, 25 bp, Mus musculus
gatttgaacacaccgggcagagcca

SEQ ID NO: 524545 - DNA, 25 bp, Mus musculus
gatttgaacacagcgggcagagcca

SEQ ID NO: 524546 - DNA, 25 bp, Mus musculus
gatttgaacagcaccacattgagca

SEQ ID NO: 524547 - DNA, 25 bp, Mus musculus
gatttgaacagctccacattgagca

SEQ ID NO: 524548 - DNA, 25 bp, Mus musculus
gatttgaaccccagtgtgtctgtgt

SEQ ID NO: 524549 - DNA, 25 bp, Mus musculus
gatttgaacccctgtgtgtctgtgt

SEQ ID NO: 524550 - DNA, 25 bp, Mus musculus
gatttgaacccgatcaaagaaattt

SEQ ID NO: 524551 - DNA, 25 bp, Mus musculus
gatttgaacccgttcaaagaaattt

SEQ ID NO: 524552 - DNA, 25 bp, Mus musculus
gatttgaactgtacgacctgggcca

SEQ ID NO: 524553 - DNA, 25 bp, Mus musculus
gatttgaactgttcgacctgggcca

SEQ ID NO: 524554 - DNA, 25 bp, Mus musculus
gatttgaagacacctcccctgaagg

SEQ ID NO: 524555 - DNA, 25 bp, Mus musculus
gatttgaagacagctcccctgaagg

SEQ ID NO: 524556 - DNA, 25 bp, Mus musculus
gatttgaagaccatcctatctgtag

SEQ ID NO: 524557 - DNA, 25 bp, Mus musculus
gatttgaagaccttcctatctgtag

SEQ ID NO: 524558 - DNA, 25 bp, Mus musculus
gatttgaatctcattagatcctgga

SEQ ID NO: 524559 - DNA, 25 bp, Mus musculus
gatttgaatctctttagatcctgga

SEQ ID NO: 524560 - DNA, 25 bp, Mus musculus
gatttgaatgtacacctcttaccct

SEQ ID NO: 524561 - DNA, 25 bp, Mus musculus
gatttgaatgtagacctcttaccct

SEQ ID NO: 524562 - DNA, 25 bp, Mus musculus
gatttgaattcacccaggaagcatt

SEQ ID NO: 524563 - DNA, 25 bp, Mus musculus
gatttgaattcagccaggaagcatt

SEQ ID NO: 524564 - DNA, 25 bp, Mus musculus
gatttgacagaaccggaactctctt

SEQ ID NO: 524565 - DNA, 25 bp, Mus musculus
gatttgacagaagcggaactctctt

SEQ ID NO: 524566 - DNA, 25 bp, Mus musculus
gatttgacatacattatagccagct

SEQ ID NO: 524567 - DNA, 25 bp, Mus musculus
gatttgacatactttatagccagct

SEQ ID NO: 524568 - DNA, 25 bp, Mus musculus
gatttgaccacgctgtaatctccag

SEQ ID NO: 524569 - DNA, 25 bp, Mus musculus
gatttgaccacggtgtaatctccag

SEQ ID NO: 524570 - DNA, 25 bp, Mus musculus
gatttgaccagcaacttgtgctcaa

SEQ ID NO: 524571 - DNA, 25 bp, Mus musculus
gatttgaccagctacttgtgctcaa

SEQ ID NO: 524572 - DNA, 25 bp, Mus musculus
gatttgaccataagatgtgtttcct

SEQ ID NO: 524573 - DNA, 25 bp, Mus musculus
gatttgaccatatgatgtgtttcct

SEQ ID NO: 524574 - DNA, 25 bp, Mus musculus
gatttgaccccaacaccagggagga

SEQ ID NO: 524575 - DNA, 25 bp, Mus musculus
gatttgaccccatcaccagggagga

SEQ ID NO: 524576 - DNA, 25 bp, Mus musculus
gatttgacccgtcagaggttttcag

SEQ ID NO: 524577 - DNA, 25 bp, Mus musculus
gatttgacccgtgagaggttttcag

SEQ ID NO: 524578 - DNA, 25 bp, Mus musculus
gatttgaccctgcagagttaacctt

SEQ ID NO: 524579 - DNA, 25 bp, Mus musculus
gatttgaccctggagagttaacctt

SEQ ID NO: 524580 - DNA, 25 bp, Mus musculus
gatttgacctgaattttagttacca

SEQ ID NO: 524581 - DNA, 25 bp, Mus musculus
gatttgacctgatttttagttacca

SEQ ID NO: 524582 - DNA, 25 bp, Mus musculus
gatttgactcagcagcaataatttt

SEQ ID NO: 524583 - DNA, 25 bp, Mus musculus
gatttgactcaggagcaataatttt

SEQ ID NO: 524584 - DNA, 25 bp, Mus musculus
gatttgactgctccatatgccaacc

SEQ ID NO: 524585 - DNA, 25 bp, Mus musculus
gatttgactgctgcatatgccaacc

SEQ ID NO: 524586 - DNA, 25 bp, Mus musculus
gatttgactggcatggtcttgggta

SEQ ID NO: 524587 - DNA, 25 bp, Mus musculus
gatttgactggcttggtcttgggta

SEQ ID NO: 524588 - DNA, 25 bp, Mus musculus
gatttgacttctactcatgagttcc

SEQ ID NO: 524589 - DNA, 25 bp, Mus musculus
gatttgacttcttctcatgagttcc

SEQ ID NO: 524590 - DNA, 25 bp, Mus musculus
gatttgagacaactgcatactggaa

SEQ ID NO: 524591 - DNA, 25 bp, Mus musculus
gatttgagacaagtgcatactggaa

SEQ ID NO: 524592 - DNA, 25 bp, Mus musculus
gatttgagacatactggctcgtcac

SEQ ID NO: 524593 - DNA, 25 bp, Mus musculus
gatttgagacattctggctcgtcac

SEQ ID NO: 524594 - DNA, 25 bp, Mus musculus
gatttgagagttccctcaggtctga

SEQ ID NO: 524595 - DNA, 25 bp, Mus musculus
gatttgagagttgcctcaggtctga

SEQ ID NO: 524596 - DNA, 25 bp, Mus musculus
gatttgagctctatggcttgcatta

SEQ ID NO: 524597 - DNA, 25 bp, Mus musculus
gatttgagctctcaactattgctcc

SEQ ID NO: 524598 - DNA, 25 bp, Mus musculus
gatttgagctctgaactattgctcc

SEQ ID NO: 524599 - DNA, 25 bp, Mus musculus
gatttgagctctttggcttgcatta

SEQ ID NO: 524600 - DNA, 25 bp, Mus musculus
gatttgaggcaaccatggacccttt

SEQ ID NO: 524601 - DNA, 25 bp, Mus musculus
gatttgaggcaagcatggacccttt

SEQ ID NO: 524602 - DNA, 25 bp, Mus musculus
gatttgaggcatcctggttttccag

SEQ ID NO: 524603 - DNA, 25 bp, Mus musculus
gatttgaggcatgctggttttccag

SEQ ID NO: 524604 - DNA, 25 bp, Mus musculus
gatttgaggcccataaatgcttcat

SEQ ID NO: 524605 - DNA, 25 bp, Mus musculus
gatttgaggcccttaaatgcttcat

SEQ ID NO: 524606 - DNA, 25 bp, Mus musculus
gatttgagtgctatccatggctgag

SEQ ID NO: 524607 - DNA, 25 bp, Mus musculus
gatttgagtgctttccatggctgag

SEQ ID NO: 524608 - DNA, 25 bp, Mus musculus
gatttgagttcaagaccacctggcc

SEQ ID NO: 524609 - DNA, 25 bp, Mus musculus
gatttgagttcatgaccacctggcc

SEQ ID NO: 524610 - DNA, 25 bp, Mus musculus
gatttgataaatagacgaaggcccc

SEQ ID NO: 524611 - DNA, 25 bp, Mus musculus
gatttgataaattgacgaaggcccc

SEQ ID NO: 524612 - DNA, 25 bp, Mus musculus
gatttgatagtcatctcctgtcttt

SEQ ID NO: 524613 - DNA, 25 bp, Mus musculus
gatttgatagtcttctcctgtcttt

SEQ ID NO: 524614 - DNA, 25 bp, Mus musculus
gatttgatattaaccttcttacggg

SEQ ID NO: 524615 - DNA, 25 bp, Mus musculus
gatttgatattatccttcttacggg

SEQ ID NO: 524616 - DNA, 25 bp, Mus musculus
gatttgatcatactgggctcccctt

SEQ ID NO: 524617 - DNA, 25 bp, Mus musculus
gatttgatcatagtgggctcccctt

SEQ ID NO: 524618 - DNA, 25 bp, Mus musculus
gatttgatccaaagcacatgtttct

SEQ ID NO: 524619 - DNA, 25 bp, Mus musculus
gatttgatccaatgcacatgtttct

SEQ ID NO: 524620 - DNA, 25 bp, Mus musculus
gatttgatcttcagacagtggccct

SEQ ID NO: 524621 - DNA, 25 bp, Mus musculus
gatttgatcttctgacagtggccct

SEQ ID NO: 524622 - DNA, 25 bp, Mus musculus
gatttgatgatgatgtacgattaga

SEQ ID NO: 524623 - DNA, 25 bp, Mus musculus
gatttgatgatgttgtacgattaga

SEQ ID NO: 524624 - DNA, 25 bp, Mus musculus
gatttgatggtcaactgttattttc

SEQ ID NO: 524625 - DNA, 25 bp, Mus musculus
gatttgatggtctactgttattttc

SEQ ID NO: 524626 - DNA, 25 bp, Mus musculus
gatttgatgtttagctctagatgtc

SEQ ID NO: 524627 - DNA, 25 bp, Mus musculus
gatttgatgtttatggcctaattcc

SEQ ID NO: 524628 - DNA, 25 bp, Mus musculus
gatttgatgttttgctctagatgtc

SEQ ID NO: 524629 - DNA, 25 bp, Mus musculus
gatttgatgtttttggcctaattcc

SEQ ID NO: 524630 - DNA, 25 bp, Mus musculus
gatttgattcatacctaagtagcag

SEQ ID NO: 524631 - DNA, 25 bp, Mus musculus
gatttgattcattcctaagtagcag

SEQ ID NO: 524632 - DNA, 25 bp, Mus musculus
gatttgattgtgaaccttagcaggt

SEQ ID NO: 524633 - DNA, 25 bp, Mus musculus
gatttgattgtgtaccttagcaggt

SEQ ID NO: 524634 - DNA, 25 bp, Mus musculus
gatttgatttctcgaacccacgtgg

SEQ ID NO: 524635 - DNA, 25 bp, Mus musculus
gatttgatttctggaacccacgtgg

SEQ ID NO: 524636 - DNA, 25 bp, Mus musculus
gatttgcaaactcggaaacgactcc

SEQ ID NO: 524637 - DNA, 25 bp, Mus musculus
gatttgcaaactgggaaacgactcc

SEQ ID NO: 524638 - DNA, 25 bp, Mus musculus
gatttgcaaatccatcgtggccatt

SEQ ID NO: 524639 - DNA, 25 bp, Mus musculus
gatttgcaaatcgatcgtggccatt

SEQ ID NO: 524640 - DNA, 25 bp, Mus musculus
gatttgcaacctcaaattttccacc

SEQ ID NO: 524641 - DNA, 25 bp, Mus musculus
gatttgcaacctgaaattttccacc

SEQ ID NO: 524642 - DNA, 25 bp, Mus musculus
gatttgcaactgacatggattcctg

SEQ ID NO: 524643 - DNA, 25 bp, Mus musculus
gatttgcaactgtcatggattcctg

SEQ ID NO: 524644 - DNA, 25 bp, Mus musculus
gatttgcaagtcactaacagccgtt

SEQ ID NO: 524645 - DNA, 25 bp, Mus musculus
gatttgcaagtctctaacagccgtt

SEQ ID NO: 524646 - DNA, 25 bp, Mus musculus
gatttgcacctaacggaatacccag

SEQ ID NO: 524647 - DNA, 25 bp, Mus musculus
gatttgcacctatcggaatacccag

SEQ ID NO: 524648 - DNA, 25 bp, Mus musculus
gatttgcactagaccatgttagccc

SEQ ID NO: 524649 - DNA, 25 bp, Mus musculus
gatttgcactagtccatgttagccc

SEQ ID NO: 524650 - DNA, 25 bp, Mus musculus
gatttgcagaacaccactattttta

SEQ ID NO: 524651 - DNA, 25 bp, Mus musculus
gatttgcagaactccactattttta

SEQ ID NO: 524652 - DNA, 25 bp, Mus musculus
gatttgcagcatcaagtgcccgata

SEQ ID NO: 524653 - DNA, 25 bp, Mus musculus
gatttgcagcatgaagtgcccgata

SEQ ID NO: 524654 - DNA, 25 bp, Mus musculus
gatttgcagctccaacatgcgggat

SEQ ID NO: 524655 - DNA, 25 bp, Mus musculus
gatttgcagctcgaacatgcgggat

SEQ ID NO: 524656 - DNA, 25 bp, Mus musculus
gatttgcaggcccttatgttttaca

SEQ ID NO: 524657 - DNA, 25 bp, Mus musculus
gatttgcaggccgttatgttttaca

SEQ ID NO: 524658 - DNA, 25 bp, Mus musculus
gatttgcagtccctttatggtcaca

SEQ ID NO: 524659 - DNA, 25 bp, Mus musculus
gatttgcagtccgtttatggtcaca

SEQ ID NO: 524660 - DNA, 25 bp, Mus musculus
gatttgcatcatacaaacctcctct

SEQ ID NO: 524661 - DNA, 25 bp, Mus musculus
gatttgcatcattcaaacctcctct

SEQ ID NO: 524662 - DNA, 25 bp, Mus musculus
gatttgcatctcattacatagctgt

SEQ ID NO: 524663 - DNA, 25 bp, Mus musculus
gatttgcatctctttacatagctgt

SEQ ID NO: 524664 - DNA, 25 bp, Mus musculus
gatttgcatgggatctctctctcga

SEQ ID NO: 524665 - DNA, 25 bp, Mus musculus
gatttgcatgggttctctctctcga

SEQ ID NO: 524666 - DNA, 25 bp, Mus musculus
gatttgcatgtgatgagccaccact

SEQ ID NO: 524667 - DNA, 25 bp, Mus musculus
gatttgcatgtgttgagccaccact

SEQ ID NO: 524668 - DNA, 25 bp, Mus musculus
gatttgcattgaacacaaactgtaa

SEQ ID NO: 524669 - DNA, 25 bp, Mus musculus
gatttgcattgatcacaaactgtaa

SEQ ID NO: 524670 - DNA, 25 bp, Mus musculus
gatttgcatttaaactctctttgaa

SEQ ID NO: 524671 - DNA, 25 bp, Mus musculus
gatttgcatttatactctctttgaa

SEQ ID NO: 524672 - DNA, 25 bp, Mus musculus
gatttgccacccagatgtgcaggca

SEQ ID NO: 524673 - DNA, 25 bp, Mus musculus
gatttgccaccctgatgtgcaggca

SEQ ID NO: 524674 - DNA, 25 bp, Mus musculus
gatttgccacgtctccttggaagaa

SEQ ID NO: 524675 - DNA, 25 bp, Mus musculus
gatttgccacgtgtccttggaagaa

SEQ ID NO: 524676 - DNA, 25 bp, Mus musculus
gatttgccacttagaatctccagtc

SEQ ID NO: 524677 - DNA, 25 bp, Mus musculus
gatttgccactttgaatctccagtc

SEQ ID NO: 524678 - DNA, 25 bp, Mus musculus
gatttgccagagctctgaagcagca

SEQ ID NO: 524679 - DNA, 25 bp, Mus musculus
gatttgccagaggtctgaagcagca

SEQ ID NO: 524680 - DNA, 25 bp, Mus musculus
gatttgccagctagacacttacagt

SEQ ID NO: 524681 - DNA, 25 bp, Mus musculus
gatttgccagcttgacacttacagt

SEQ ID NO: 524682 - DNA, 25 bp, Mus musculus
gatttgcccactattactacactag

SEQ ID NO: 524683 - DNA, 25 bp, Mus musculus
gatttgcccacttttactacactag

SEQ ID NO: 524684 - DNA, 25 bp, Mus musculus
gatttgcccagcagcaccgggcctg

SEQ ID NO: 524685 - DNA, 25 bp, Mus musculus
gatttgcccagctgcaccgggcctg

SEQ ID NO: 524686 - DNA, 25 bp, Mus musculus
gatttgcccatgagagtgattctaa

SEQ ID NO: 524687 - DNA, 25 bp, Mus musculus
gatttgcccatgtgagtgattctaa

SEQ ID NO: 524688 - DNA, 25 bp, Mus musculus
gatttgccccaaagtatgtccaatt

SEQ ID NO: 524689 - DNA, 25 bp, Mus musculus
gatttgccccaactacttattatta

SEQ ID NO: 524690 - DNA, 25 bp, Mus musculus
gatttgccccaagtacttattatta

SEQ ID NO: 524691 - DNA, 25 bp, Mus musculus
gatttgccccaatgtatgtccaatt

SEQ ID NO: 524692 - DNA, 25 bp, Mus musculus
gatttgccccaccatgacgagaaga

SEQ ID NO: 524693 - DNA, 25 bp, Mus musculus
gatttgccccacgatgacgagaaga

SEQ ID NO: 524694 - DNA, 25 bp, Mus musculus
gatttgccctctctgttaggaataa

SEQ ID NO: 524695 - DNA, 25 bp, Mus musculus
gatttgccctctgtgttaggaataa

SEQ ID NO: 524696 - DNA, 25 bp, Mus musculus
gatttgccggctatttgagatgaga

SEQ ID NO: 524697 - DNA, 25 bp, Mus musculus
gatttgccggctttttgagatgaga

SEQ ID NO: 524698 - DNA, 25 bp, Mus musculus
gatttgcctaacaggacaatctaat

SEQ ID NO: 524699 - DNA, 25 bp, Mus musculus
gatttgcctaactggacaatctaat

SEQ ID NO: 524700 - DNA, 25 bp, Mus musculus
gatttgcctacaaggtacaacctcg

SEQ ID NO: 524701 - DNA, 25 bp, Mus musculus
gatttgcctacatggtacaacctcg

SEQ ID NO: 524702 - DNA, 25 bp, Mus musculus
gatttgcctatgattggagttgact

SEQ ID NO: 524703 - DNA, 25 bp, Mus musculus
gatttgcctatgtttggagttgact

SEQ ID NO: 524704 - DNA, 25 bp, Mus musculus
gatttgcctattatttgggaagaca

SEQ ID NO: 524705 - DNA, 25 bp, Mus musculus
gatttgcctattttttgggaagaca

SEQ ID NO: 524706 - DNA, 25 bp, Mus musculus
gatttgcctcttatgactccacaaa

SEQ ID NO: 524707 - DNA, 25 bp, Mus musculus
gatttgcctcttttgactccacaaa

SEQ ID NO: 524708 - DNA, 25 bp, Mus musculus
gatttgcctgagcacctgcagcaga

SEQ ID NO: 524709 - DNA, 25 bp, Mus musculus
gatttgcctgaggacctgcagcaga

SEQ ID NO: 524710 - DNA, 25 bp, Mus musculus
gatttgcctgcccatcccatccatt

SEQ ID NO: 524711 - DNA, 25 bp, Mus musculus
gatttgcctgccgatcccatccatt

SEQ ID NO: 524712 - DNA, 25 bp, Mus musculus
gatttgcgggcactctgctttgtac

SEQ ID NO: 524713 - DNA, 25 bp, Mus musculus
gatttgcgggcagtctgctttgtac

SEQ ID NO: 524714 - DNA, 25 bp, Mus musculus
gatttgcgtattacatacccaggta

SEQ ID NO: 524715 - DNA, 25 bp, Mus musculus
gatttgcgtatttcatacccaggta

SEQ ID NO: 524716 - DNA, 25 bp, Mus musculus
gatttgcgtctacatagtccaccca

SEQ ID NO: 524717 - DNA, 25 bp, Mus musculus
gatttgcgtctagatagtccaccca

SEQ ID NO: 524718 - DNA, 25 bp, Mus musculus
gatttgctaaccattcatcggtgat

SEQ ID NO: 524719 - DNA, 25 bp, Mus musculus
gatttgctaacctttcatcggtgat

SEQ ID NO: 524720 - DNA, 25 bp, Mus musculus
gatttgctagagactcctttagccc

SEQ ID NO: 524721 - DNA, 25 bp, Mus musculus
gatttgctagagtctcctttagccc

SEQ ID NO: 524722 - DNA, 25 bp, Mus musculus
gatttgctcacaagacatctttgat

SEQ ID NO: 524723 - DNA, 25 bp, Mus musculus
gatttgctcacatgacatctttgat

SEQ ID NO: 524724 - DNA, 25 bp, Mus musculus
gatttgctcatgattttccgaagtc

SEQ ID NO: 524725 - DNA, 25 bp, Mus musculus
gatttgctcatgtttttccgaagtc

SEQ ID NO: 524726 - DNA, 25 bp, Mus musculus
gatttgctcctaccaagagcctttc

SEQ ID NO: 524727 - DNA, 25 bp, Mus musculus
gatttgctcctagcaagagcctttc

SEQ ID NO: 524728 - DNA, 25 bp, Mus musculus
gatttgctctccagacatctgtgtc

SEQ ID NO: 524729 - DNA, 25 bp, Mus musculus
gatttgctctcctgacatctgtgtc

SEQ ID NO: 524730 - DNA, 25 bp, Mus musculus
gatttgctcttgacacctacatgat

SEQ ID NO: 524731 - DNA, 25 bp, Mus musculus
gatttgctcttgatactgaatagct

SEQ ID NO: 524732 - DNA, 25 bp, Mus musculus
gatttgctcttgtcacctacatgat

SEQ ID NO: 524733 - DNA, 25 bp, Mus musculus
gatttgctcttgttactgaatagct

SEQ ID NO: 524734 - DNA, 25 bp, Mus musculus
gatttgctgacacatgtcttaacct

SEQ ID NO: 524735 - DNA, 25 bp, Mus musculus
gatttgctgacagatgtcttaacct

SEQ ID NO: 524736 - DNA, 25 bp, Mus musculus
gatttgctgagaacattccttccct

SEQ ID NO: 524737 - DNA, 25 bp, Mus musculus
gatttgctgagaacccacttgggcc

SEQ ID NO: 524738 - DNA, 25 bp, Mus musculus
gatttgctgagatcattccttccct

SEQ ID NO: 524739 - DNA, 25 bp, Mus musculus
gatttgctgagatcccacttgggcc

SEQ ID NO: 524740 - DNA, 25 bp, Mus musculus
gatttgctgcagattggaagctgtg

SEQ ID NO: 524741 - DNA, 25 bp, Mus musculus
gatttgctgcagtttggaagctgtg

SEQ ID NO: 524742 - DNA, 25 bp, Mus musculus
gatttgctggaaagctctgtgtgcc

SEQ ID NO: 524743 - DNA, 25 bp, Mus musculus
gatttgctggaatgctctgtgtgcc

SEQ ID NO: 524744 - DNA, 25 bp, Mus musculus
gatttgctgtagatagccgtggagt

SEQ ID NO: 524745 - DNA, 25 bp, Mus musculus
gatttgctgtagttagccgtggagt

SEQ ID NO: 524746 - DNA, 25 bp, Mus musculus
gatttgctgtgacaattcttataac

SEQ ID NO: 524747 - DNA, 25 bp, Mus musculus
gatttgctgtgagaattcttataac

SEQ ID NO: 524748 - DNA, 25 bp, Mus musculus
gatttgctgttgacattcccatgtg

SEQ ID NO: 524749 - DNA, 25 bp, Mus musculus
gatttgctgttgtcattcccatgtg

SEQ ID NO: 524750 - DNA, 25 bp, Mus musculus
gatttgcttaaaattgctcctcaca

SEQ ID NO: 524751 - DNA, 25 bp, Mus musculus
gatttgcttaaatttgctcctcaca

SEQ ID NO: 524752 - DNA, 25 bp, Mus musculus
gatttgcttaatctatcacttctaa

SEQ ID NO: 524753 - DNA, 25 bp, Mus musculus
gatttgcttaatgtatcacttctaa

SEQ ID NO: 524754 - DNA, 25 bp, Mus musculus
gatttgcttagtccaggagttccaa

SEQ ID NO: 524755 - DNA, 25 bp, Mus musculus
gatttgcttagtgcaggagttccaa

SEQ ID NO: 524756 - DNA, 25 bp, Mus musculus
gatttgcttctgagtggctaacata

SEQ ID NO: 524757 - DNA, 25 bp, Mus musculus
gatttgcttctgtgtggctaacata

SEQ ID NO: 524758 - DNA, 25 bp, Mus musculus
gatttgcttcttaaacttctgcgga

SEQ ID NO: 524759 - DNA, 25 bp, Mus musculus
gatttgcttctttaacttctgcgga

SEQ ID NO: 524760 - DNA, 25 bp, Mus musculus
gatttgcttgcactgaaccttatat

SEQ ID NO: 524761 - DNA, 25 bp, Mus musculus
gatttgcttgcagtgaaccttatat

SEQ ID NO: 524762 - DNA, 25 bp, Mus musculus
gatttgctttcccttttcatgtggt

SEQ ID NO: 524763 - DNA, 25 bp, Mus musculus
gatttgctttccgttttcatgtggt

SEQ ID NO: 524764 - DNA, 25 bp, Mus musculus
gatttgctttctcaaaaccttgggc

SEQ ID NO: 524765 - DNA, 25 bp, Mus musculus
gatttgctttctgaaaaccttgggc

SEQ ID NO: 524766 - DNA, 25 bp, Mus musculus
gatttgctttgtcgctgagcttggt

SEQ ID NO: 524767 - DNA, 25 bp, Mus musculus
gatttgctttgtggctgagcttggt

SEQ ID NO: 524768 - DNA, 25 bp, Mus musculus
gatttgcttttacggtagcctgatc

SEQ ID NO: 524769 - DNA, 25 bp, Mus musculus
gatttgcttttagggtagcctgatc

SEQ ID NO: 524770 - DNA, 25 bp, Mus musculus
gatttggaaacactatttcgtagct

SEQ ID NO: 524771 - DNA, 25 bp, Mus musculus
gatttggaaacagtatttcgtagct

SEQ ID NO: 524772 - DNA, 25 bp, Mus musculus
gatttggaagctcttagtcctatat

SEQ ID NO: 524773 - DNA, 25 bp, Mus musculus
gatttggaagctgttagtcctatat

SEQ ID NO: 524774 - DNA, 25 bp, Mus musculus
gatttggaagtcagacgagcctgtc

SEQ ID NO: 524775 - DNA, 25 bp, Mus musculus
gatttggaagtctgacgagcctgtc

SEQ ID NO: 524776 - DNA, 25 bp, Mus musculus
gatttggaagtgagtccgtctgccc

SEQ ID NO: 524777 - DNA, 25 bp, Mus musculus
gatttggaagtgtgtccgtctgccc

SEQ ID NO: 524778 - DNA, 25 bp, Mus musculus
gatttggaatagattatccagaagc

SEQ ID NO: 524779 - DNA, 25 bp, Mus musculus
gatttggaatagtttatccagaagc

SEQ ID NO: 524780 - DNA, 25 bp, Mus musculus
gatttggaatccacactcggtggca

SEQ ID NO: 524781 - DNA, 25 bp, Mus musculus
gatttggaatcctcactcggtggca

SEQ ID NO: 524782 - DNA, 25 bp, Mus musculus
gatttggacaacaactatttgccac

SEQ ID NO: 524783 - DNA, 25 bp, Mus musculus
gatttggacaactactatttgccac

SEQ ID NO: 524784 - DNA, 25 bp, Mus musculus
gatttggaccatcttctacaggatc

SEQ ID NO: 524785 - DNA, 25 bp, Mus musculus
gatttggaccatgttctacaggatc

SEQ ID NO: 524786 - DNA, 25 bp, Mus musculus
gatttggaccctaaaatgcagctta

SEQ ID NO: 524787 - DNA, 25 bp, Mus musculus
gatttggacccttaaatgcagctta

SEQ ID NO: 524788 - DNA, 25 bp, Mus musculus
gatttggacgcgatccaacatggaa

SEQ ID NO: 524789 - DNA, 25 bp, Mus musculus
gatttggacgcgttccaacatggaa

SEQ ID NO: 524790 - DNA, 25 bp, Mus musculus
gatttggactcgcacagctgacggc

SEQ ID NO: 524791 - DNA, 25 bp, Mus musculus
gatttggactcggacagctgacggc

SEQ ID NO: 524792 - DNA, 25 bp, Mus musculus
gatttggagaccagtaacactgtat

SEQ ID NO: 524793 - DNA, 25 bp, Mus musculus
gatttggagacctgtaacactgtat

SEQ ID NO: 524794 - DNA, 25 bp, Mus musculus
gatttggagacgatgtttttcacag

SEQ ID NO: 524795 - DNA, 25 bp, Mus musculus
gatttggagacgttgtttttcacag

SEQ ID NO: 524796 - DNA, 25 bp, Mus musculus
gatttggagccaccatgggagacaa

SEQ ID NO: 524797 - DNA, 25 bp, Mus musculus
gatttggagccagcatgggagacaa

SEQ ID NO: 524798 - DNA, 25 bp, Mus musculus
gatttggagctacctaggagacaca

SEQ ID NO: 524799 - DNA, 25 bp, Mus musculus
gatttggagctagctaggagacaca

SEQ ID NO: 524800 - DNA, 25 bp, Mus musculus
gatttggaggcgctcttcctgccac

SEQ ID NO: 524801 - DNA, 25 bp, Mus musculus
gatttggaggcggtcttcctgccac

SEQ ID NO: 524802 - DNA, 25 bp, Mus musculus
gatttggagtccatgagccacctga

SEQ ID NO: 524803 - DNA, 25 bp, Mus musculus
gatttggagtccttgagccacctga

SEQ ID NO: 524804 - DNA, 25 bp, Mus musculus
gatttggatcatagcctaaagttgc

SEQ ID NO: 524805 - DNA, 25 bp, Mus musculus
gatttggatcattgcctaaagttgc

SEQ ID NO: 524806 - DNA, 25 bp, Mus musculus
gatttggatctaagctggacctttg

SEQ ID NO: 524807 - DNA, 25 bp, Mus musculus
gatttggatctatgctggacctttg

SEQ ID NO: 524808 - DNA, 25 bp, Mus musculus
gatttggatctcacacagcatggga

SEQ ID NO: 524809 - DNA, 25 bp, Mus musculus
gatttggatctctcacagcatggga

SEQ ID NO: 524810 - DNA, 25 bp, Mus musculus
gatttggatgttccactaccccact

SEQ ID NO: 524811 - DNA, 25 bp, Mus musculus
gatttggatgttgcactaccccact

SEQ ID NO: 524812 - DNA, 25 bp, Mus musculus
gatttggattgcaactttctcattg

SEQ ID NO: 524813 - DNA, 25 bp, Mus musculus
gatttggattgctactttctcattg

SEQ ID NO: 524814 - DNA, 25 bp, Mus musculus
gatttggcaagtatgtatcgtgaga

SEQ ID NO: 524815 - DNA, 25 bp, Mus musculus
gatttggcaagtttgtatcgtgaga

SEQ ID NO: 524816 - DNA, 25 bp, Mus musculus
gatttggccatcatacccttagaaa

SEQ ID NO: 524817 - DNA, 25 bp, Mus musculus
gatttggccatcttacccttagaaa

SEQ ID NO: 524818 - DNA, 25 bp, Mus musculus
gatttggccccaatataaaggatgt

SEQ ID NO: 524819 - DNA, 25 bp, Mus musculus
gatttggccccattataaaggatgt

SEQ ID NO: 524820 - DNA, 25 bp, Mus musculus
gatttggcccctccaagttgaaagc

SEQ ID NO: 524821 - DNA, 25 bp, Mus musculus
gatttggcccctgcaagttgaaagc

SEQ ID NO: 524822 - DNA, 25 bp, Mus musculus
gatttggcccgtaagtactcaggtc

SEQ ID NO: 524823 - DNA, 25 bp, Mus musculus
gatttggcccgttagtactcaggtc

SEQ ID NO: 524824 - DNA, 25 bp, Mus musculus
gatttggccgtaatgggcgcctggt

SEQ ID NO: 524825 - DNA, 25 bp, Mus musculus
gatttggccgtattgggcgcctggt

SEQ ID NO: 524826 - DNA, 25 bp, Mus musculus
gatttggccgtccacattttatgag

SEQ ID NO: 524827 - DNA, 25 bp, Mus musculus
gatttggccgtcgacattttatgag

SEQ ID NO: 524828 - DNA, 25 bp, Mus musculus
gatttggcctatagtgacactctgt

SEQ ID NO: 524829 - DNA, 25 bp, Mus musculus
gatttggcctattgtgacactctgt

SEQ ID NO: 524830 - DNA, 25 bp, Mus musculus
gatttggcctctatgggatctacaa

SEQ ID NO: 524831 - DNA, 25 bp, Mus musculus
gatttggcctctttgggatctacaa

SEQ ID NO: 524832 - DNA, 25 bp, Mus musculus
gatttggcctggaagtagaatggtt

SEQ ID NO: 524833 - DNA, 25 bp, Mus musculus
gatttggcctggtagtagaatggtt

SEQ ID NO: 524834 - DNA, 25 bp, Mus musculus
gatttggccttacactgaagtcccg

SEQ ID NO: 524835 - DNA, 25 bp, Mus musculus
gatttggccttagactgaagtcccg

SEQ ID NO: 524836 - DNA, 25 bp, Mus musculus
gatttggcgatcaagcattccagac

SEQ ID NO: 524837 - DNA, 25 bp, Mus musculus
gatttggcgatctagcattccagac

SEQ ID NO: 524838 - DNA, 25 bp, Mus musculus
gatttggctctgaccaggaatatga

SEQ ID NO: 524839 - DNA, 25 bp, Mus musculus
gatttggctctgtccaggaatatga

SEQ ID NO: 524840 - DNA, 25 bp, Mus musculus
gatttggctggacaggttaccatca

SEQ ID NO: 524841 - DNA, 25 bp, Mus musculus
gatttggctggagaggttaccatca

SEQ ID NO: 524842 - DNA, 25 bp, Mus musculus
gatttggctgggagtagcagttatt

SEQ ID NO: 524843 - DNA, 25 bp, Mus musculus
gatttggctgggtgtagcagttatt

SEQ ID NO: 524844 - DNA, 25 bp, Mus musculus
gatttggctggtaccttagtgctaa

SEQ ID NO: 524845 - DNA, 25 bp, Mus musculus
gatttggctggttccttagtgctaa

SEQ ID NO: 524846 - DNA, 25 bp, Mus musculus
gatttgggacccacagatggcgaga

SEQ ID NO: 524847 - DNA, 25 bp, Mus musculus
gatttgggaccctcagatggcgaga

SEQ ID NO: 524848 - DNA, 25 bp, Mus musculus
gatttgggcactctaatgactatat

SEQ ID NO: 524849 - DNA, 25 bp, Mus musculus
gatttgggcactgtaatgactatat

SEQ ID NO: 524850 - DNA, 25 bp, Mus musculus
gatttgggcagaatcttccgctggc

SEQ ID NO: 524851 - DNA, 25 bp, Mus musculus
gatttgggcagattcttccgctggc

SEQ ID NO: 524852 - DNA, 25 bp, Mus musculus
gatttgggcaggctttcagtttcca

SEQ ID NO: 524853 - DNA, 25 bp, Mus musculus
gatttgggcagggtttcagtttcca

SEQ ID NO: 524854 - DNA, 25 bp, Mus musculus
gatttgggctccagctcttagtggc

SEQ ID NO: 524855 - DNA, 25 bp, Mus musculus
gatttgggctcctgctcttagtggc

SEQ ID NO: 524856 - DNA, 25 bp, Mus musculus
gatttgggcttaacactgggtactt

SEQ ID NO: 524857 - DNA, 25 bp, Mus musculus
gatttgggcttatcactgggtactt

SEQ ID NO: 524858 - DNA, 25 bp, Mus musculus
gatttgggcttcaccacatgaggac

SEQ ID NO: 524859 - DNA, 25 bp, Mus musculus
gatttgggcttctccacatgaggac

SEQ ID NO: 524860 - DNA, 25 bp, Mus musculus
gatttgggtggcagcatgcctatta

SEQ ID NO: 524861 - DNA, 25 bp, Mus musculus
gatttgggtggctgcatgcctatta

SEQ ID NO: 524862 - DNA, 25 bp, Mus musculus
gatttggtcaaacaactccaccact

SEQ ID NO: 524863 - DNA, 25 bp, Mus musculus
gatttggtcaaagaactccaccact

SEQ ID NO: 524864 - DNA, 25 bp, Mus musculus
gatttggtcagcaggccctctgaaa

SEQ ID NO: 524865 - DNA, 25 bp, Mus musculus
gatttggtcagctggccctctgaaa

SEQ ID NO: 524866 - DNA, 25 bp, Mus musculus
gatttggtcagtctttttcatttac

SEQ ID NO: 524867 - DNA, 25 bp, Mus musculus
gatttggtcagtgtttttcatttac

SEQ ID NO: 524868 - DNA, 25 bp, Mus musculus
gatttggtcatgatatgcacaccat

SEQ ID NO: 524869 - DNA, 25 bp, Mus musculus
gatttggtcatgttatgcacaccat

SEQ ID NO: 524870 - DNA, 25 bp, Mus musculus
gatttggtccacattaaatgtattt

SEQ ID NO: 524871 - DNA, 25 bp, Mus musculus
gatttggtccactttaaatgtattt

SEQ ID NO: 524872 - DNA, 25 bp, Mus musculus
gatttggtccttctaggttctactg

SEQ ID NO: 524873 - DNA, 25 bp, Mus musculus
gatttggtccttgtaggttctactg

SEQ ID NO: 524874 - DNA, 25 bp, Mus musculus
gatttggtcttcagcctgacacttg

SEQ ID NO: 524875 - DNA, 25 bp, Mus musculus
gatttggtcttctgcctgacacttg

SEQ ID NO: 524876 - DNA, 25 bp, Mus musculus
gatttggtgctcaacacttacagcc

SEQ ID NO: 524877 - DNA, 25 bp, Mus musculus
gatttggtgctctacacttacagcc

SEQ ID NO: 524878 - DNA, 25 bp, Mus musculus
gatttggtggcacctgtaatctaaa

SEQ ID NO: 524879 - DNA, 25 bp, Mus musculus
gatttggtggcagctgtaatctaaa

SEQ ID NO: 524880 - DNA, 25 bp, Mus musculus
gatttggtggttcctgtattcccag

SEQ ID NO: 524881 - DNA, 25 bp, Mus musculus
gatttggtggttgctgtattcccag

SEQ ID NO: 524882 - DNA, 25 bp, Mus musculus
gatttggtgtctcccagttgcacct

SEQ ID NO: 524883 - DNA, 25 bp, Mus musculus
gatttggtgtctgccagttgcacct

SEQ ID NO: 524884 - DNA, 25 bp, Mus musculus
gatttggtgtttcatgagtcgactt

SEQ ID NO: 524885 - DNA, 25 bp, Mus musculus
gatttggtgtttgatgagtcgactt

SEQ ID NO: 524886 - DNA, 25 bp, Mus musculus
gatttggttagtcttagtatgtttc

SEQ ID NO: 524887 - DNA, 25 bp, Mus musculus
gatttggttagtgttagtatgtttc

SEQ ID NO: 524888 - DNA, 25 bp, Mus musculus
gatttggttatacatactgtattgt

SEQ ID NO: 524889 - DNA, 25 bp, Mus musculus
gatttggttatagatactgtattgt

SEQ ID NO: 524890 - DNA, 25 bp, Mus musculus
gatttggttcttatgtgtaatagga

SEQ ID NO: 524891 - DNA, 25 bp, Mus musculus
gatttggttcttttgtgtaatagga

SEQ ID NO: 524892 - DNA, 25 bp, Mus musculus
gatttggttgagatccaagtaggga

SEQ ID NO: 524893 - DNA, 25 bp, Mus musculus
gatttggttgagttccaagtaggga

SEQ ID NO: 524894 - DNA, 25 bp, Mus musculus
gatttggtttgtagccaccaagcca

SEQ ID NO: 524895 - DNA, 25 bp, Mus musculus
gatttggtttgttgccaccaagcca

SEQ ID NO: 524896 - DNA, 25 bp, Mus musculus
gatttgtaaactattgaggcccata

SEQ ID NO: 524897 - DNA, 25 bp, Mus musculus
gatttgtaaacttttgaggcccata

SEQ ID NO: 524898 - DNA, 25 bp, Mus musculus
gatttgtaactgataatctttaact

SEQ ID NO: 524899 - DNA, 25 bp, Mus musculus
gatttgtaactgttaatctttaact

SEQ ID NO: 524900 - DNA, 25 bp, Mus musculus
gatttgtaagtgcagtctcatcctc

SEQ ID NO: 524901 - DNA, 25 bp, Mus musculus
gatttgtaagtggagtctcatcctc

SEQ ID NO: 524902 - DNA, 25 bp, Mus musculus
gatttgtaatcacctcactcatcaa

SEQ ID NO: 524903 - DNA, 25 bp, Mus musculus
gatttgtaatcagctcactcatcaa

SEQ ID NO: 524904 - DNA, 25 bp, Mus musculus
gatttgtaatctctcaggtcctaag

SEQ ID NO: 524905 - DNA, 25 bp, Mus musculus
gatttgtaatctgtcaggtcctaag

SEQ ID NO: 524906 - DNA, 25 bp, Mus musculus
gatttgtacagacatcattgtaggc

SEQ ID NO: 524907 - DNA, 25 bp, Mus musculus
gatttgtacagagatcattgtaggc

SEQ ID NO: 524908 - DNA, 25 bp, Mus musculus
gatttgtaccacatcaggtttgatt

SEQ ID NO: 524909 - DNA, 25 bp, Mus musculus
gatttgtaccacttcaggtttgatt

SEQ ID NO: 524910 - DNA, 25 bp, Mus musculus
gatttgtacgcaatctggagacttg

SEQ ID NO: 524911 - DNA, 25 bp, Mus musculus
gatttgtacgcattctggagacttg

SEQ ID NO: 524912 - DNA, 25 bp, Mus musculus
gatttgtactaacgtttaaagctgt

SEQ ID NO: 524913 - DNA, 25 bp, Mus musculus
gatttgtactaaggtttaaagctgt

SEQ ID NO: 524914 - DNA, 25 bp, Mus musculus
gatttgtactcaaaccagggtcaca

SEQ ID NO: 524915 - DNA, 25 bp, Mus musculus
gatttgtactcataccagggtcaca

SEQ ID NO: 524916 - DNA, 25 bp, Mus musculus
gatttgtactggagacagctggaga

SEQ ID NO: 524917 - DNA, 25 bp, Mus musculus
gatttgtactggaggttttctcctc

SEQ ID NO: 524918 - DNA, 25 bp, Mus musculus
gatttgtactggtgacagctggaga

SEQ ID NO: 524919 - DNA, 25 bp, Mus musculus
gatttgtactggtggttttctcctc

SEQ ID NO: 524920 - DNA, 25 bp, Mus musculus
gatttgtagcaccttgagagccatg

SEQ ID NO: 524921 - DNA, 25 bp, Mus musculus
gatttgtagcacgttgagagccatg

SEQ ID NO: 524922 - DNA, 25 bp, Mus musculus
gatttgtagcctaaactgtagggag

SEQ ID NO: 524923 - DNA, 25 bp, Mus musculus
gatttgtagccttaactgtagggag

SEQ ID NO: 524924 - DNA, 25 bp, Mus musculus
gatttgtagtaacatgcgttggatt

SEQ ID NO: 524925 - DNA, 25 bp, Mus musculus
gatttgtagtaagatgcgttggatt

SEQ ID NO: 524926 - DNA, 25 bp, Mus musculus
gatttgtatatgaagttctcactgg

SEQ ID NO: 524927 - DNA, 25 bp, Mus musculus
gatttgtatatgtagttctcactgg

SEQ ID NO: 524928 - DNA, 25 bp, Mus musculus
gatttgtatcctattgttgctatgc

SEQ ID NO: 524929 - DNA, 25 bp, Mus musculus
gatttgtatccttttgttgctatgc

SEQ ID NO: 524930 - DNA, 25 bp, Mus musculus
gatttgtatcgcaccttgaacgatc

SEQ ID NO: 524931 - DNA, 25 bp, Mus musculus
gatttgtatcgctccttgaacgatc

SEQ ID NO: 524932 - DNA, 25 bp, Mus musculus
gatttgtatctgaaccaaaacccct

SEQ ID NO: 524933 - DNA, 25 bp, Mus musculus
gatttgtatctgtaccaaaacccct

SEQ ID NO: 524934 - DNA, 25 bp, Mus musculus
gatttgtatgctcctctctgttaga

SEQ ID NO: 524935 - DNA, 25 bp, Mus musculus
gatttgtatgctgctctctgttaga

SEQ ID NO: 524936 - DNA, 25 bp, Mus musculus
gatttgtatggcctttgatttttgc

SEQ ID NO: 524937 - DNA, 25 bp, Mus musculus
gatttgtatggcgtttgatttttgc

SEQ ID NO: 524938 - DNA, 25 bp, Mus musculus
gatttgtatgtaattttggagctta

SEQ ID NO: 524939 - DNA, 25 bp, Mus musculus
gatttgtatgtatttttggagctta

SEQ ID NO: 524940 - DNA, 25 bp, Mus musculus
gatttgtcaatcatgtaaaggtctg

SEQ ID NO: 524941 - DNA, 25 bp, Mus musculus
gatttgtcaatcttgtaaaggtctg

SEQ ID NO: 524942 - DNA, 25 bp, Mus musculus
gatttgtcacctctgccgaatgaca

SEQ ID NO: 524943 - DNA, 25 bp, Mus musculus
gatttgtcacctgtgccgaatgaca

SEQ ID NO: 524944 - DNA, 25 bp, Mus musculus
gatttgtcatgcaggtctcagtggt

SEQ ID NO: 524945 - DNA, 25 bp, Mus musculus
gatttgtcatgctggtctcagtggt

SEQ ID NO: 524946 - DNA, 25 bp, Mus musculus
gatttgtcccacatatacatagctt

SEQ ID NO: 524947 - DNA, 25 bp, Mus musculus
gatttgtcccacttatacatagctt

SEQ ID NO: 524948 - DNA, 25 bp, Mus musculus
gatttgtccccgagatgattcttgg

SEQ ID NO: 524949 - DNA, 25 bp, Mus musculus
gatttgtccccgtgatgattcttgg

SEQ ID NO: 524950 - DNA, 25 bp, Mus musculus
gatttgtccctgatagagaaagcca

SEQ ID NO: 524951 - DNA, 25 bp, Mus musculus
gatttgtccctgttagagaaagcca

SEQ ID NO: 524952 - DNA, 25 bp, Mus musculus
gatttgtctacgatcttgatggaac

SEQ ID NO: 524953 - DNA, 25 bp, Mus musculus
gatttgtctacgttcttgatggaac

SEQ ID NO: 524954 - DNA, 25 bp, Mus musculus
gatttgtctatactcagtcactcca

SEQ ID NO: 524955 - DNA, 25 bp, Mus musculus
gatttgtctatagtcagtcactcca

SEQ ID NO: 524956 - DNA, 25 bp, Mus musculus
gatttgtctctaccttcatcagtta

SEQ ID NO: 524957 - DNA, 25 bp, Mus musculus
gatttgtctctagcttcatcagtta

SEQ ID NO: 524958 - DNA, 25 bp, Mus musculus
gatttgtcttacagtttctctacta

SEQ ID NO: 524959 - DNA, 25 bp, Mus musculus
gatttgtcttactgtttctctacta

SEQ ID NO: 524960 - DNA, 25 bp, Mus musculus
gatttgtcttgaaggaatcattgtt

SEQ ID NO: 524961 - DNA, 25 bp, Mus musculus
gatttgtcttgatggaatcattgtt

SEQ ID NO: 524962 - DNA, 25 bp, Mus musculus
gatttgtgaagaccctttgatctga

SEQ ID NO: 524963 - DNA, 25 bp, Mus musculus
gatttgtgaagagcctttgatctga

SEQ ID NO: 524964 - DNA, 25 bp, Mus musculus
gatttgtgattcagttggactggca

SEQ ID NO: 524965 - DNA, 25 bp, Mus musculus
gatttgtgattctgttggactggca

SEQ ID NO: 524966 - DNA, 25 bp, Mus musculus
gatttgtgcacgaaggtggcagact

SEQ ID NO: 524967 - DNA, 25 bp, Mus musculus
gatttgtgcacgtaggtggcagact

SEQ ID NO: 524968 - DNA, 25 bp, Mus musculus
gatttgtgcagtcgtcttcctggcc

SEQ ID NO: 524969 - DNA, 25 bp, Mus musculus
gatttgtgcagtggtcttcctggcc

SEQ ID NO: 524970 - DNA, 25 bp, Mus musculus
gatttgtgcctacaatcacttagta

SEQ ID NO: 524971 - DNA, 25 bp, Mus musculus
gatttgtgcctagaatcacttagta

SEQ ID NO: 524972 - DNA, 25 bp, Mus musculus
gatttgtgccttctacatcaactac

SEQ ID NO: 524973 - DNA, 25 bp, Mus musculus
gatttgtgccttgtacatcaactac

SEQ ID NO: 524974 - DNA, 25 bp, Mus musculus
gatttgtgctctatgtgtgagaaga

SEQ ID NO: 524975 - DNA, 25 bp, Mus musculus
gatttgtgctctttgtgtgagaaga

SEQ ID NO: 524976 - DNA, 25 bp, Mus musculus
gatttgtgctgtctggctggatatt

SEQ ID NO: 524977 - DNA, 25 bp, Mus musculus
gatttgtgctgtgtggctggatatt

SEQ ID NO: 524978 - DNA, 25 bp, Mus musculus
gatttgtgcttcaactgggagccct

SEQ ID NO: 524979 - DNA, 25 bp, Mus musculus
gatttgtgcttctactgggagccct

SEQ ID NO: 524980 - DNA, 25 bp, Mus musculus
gatttgtgcttgacatcagtatcca

SEQ ID NO: 524981 - DNA, 25 bp, Mus musculus
gatttgtgcttgtcatcagtatcca

SEQ ID NO: 524982 - DNA, 25 bp, Mus musculus
gatttgtgggataggtcactgacat

SEQ ID NO: 524983 - DNA, 25 bp, Mus musculus
gatttgtgggattggtcactgacat

SEQ ID NO: 524984 - DNA, 25 bp, Mus musculus
gatttgtgtcacatgccatttcact

SEQ ID NO: 524985 - DNA, 25 bp, Mus musculus
gatttgtgtcacttgccatttcact

SEQ ID NO: 524986 - DNA, 25 bp, Mus musculus
gatttgtgtccaaaaccccggtgct

SEQ ID NO: 524987 - DNA, 25 bp, Mus musculus
gatttgtgtccataaccccggtgct

SEQ ID NO: 524988 - DNA, 25 bp, Mus musculus
gatttgtgtgctcagataccagtca

SEQ ID NO: 524989 - DNA, 25 bp, Mus musculus
gatttgtgtgctgagataccagtca

SEQ ID NO: 524990 - DNA, 25 bp, Mus musculus
gatttgtgttagattgcttgaatac

SEQ ID NO: 524991 - DNA, 25 bp, Mus musculus
gatttgtgttagtttgcttgaatac

SEQ ID NO: 524992 - DNA, 25 bp, Mus musculus
gatttgtgtttactcttcagtctat

SEQ ID NO: 524993 - DNA, 25 bp, Mus musculus
gatttgtgtttagtcttcagtctat

SEQ ID NO: 524994 - DNA, 25 bp, Mus musculus
gatttgtgttttaagacagcatctc

SEQ ID NO: 524995 - DNA, 25 bp, Mus musculus
gatttgtgtttttagacagcatctc

SEQ ID NO: 524996 - DNA, 25 bp, Mus musculus
gatttgttcaagacctccctccact

SEQ ID NO: 524997 - DNA, 25 bp, Mus musculus
gatttgttcaagtcctccctccact

SEQ ID NO: 524998 - DNA, 25 bp, Mus musculus
gatttgttccagatgttacacggct

SEQ ID NO: 524999 - DNA, 25 bp, Mus musculus
gatttgttccagttgttacacggct

SEQ ID NO: 525000 - DNA, 25 bp, Mus musculus
gatttgttcccacactcagggtaga

SEQ ID NO: 525001 - DNA, 25 bp, Mus musculus
gatttgttcccagactcagggtaga

SEQ ID NO: 525002 - DNA, 25 bp, Mus musculus
gatttgttcttcactagaaggcttt

SEQ ID NO: 525003 - DNA, 25 bp, Mus musculus
gatttgttcttctctagaaggcttt

SEQ ID NO: 525004 - DNA, 25 bp, Mus musculus
gatttgttgaagaaattggacccta

SEQ ID NO: 525005 - DNA, 25 bp, Mus musculus
gatttgttgaagtaattggacccta

SEQ ID NO: 525006 - DNA, 25 bp, Mus musculus
gatttgttgctaactgtagaaacct

SEQ ID NO: 525007 - DNA, 25 bp, Mus musculus
gatttgttgctatctgtagaaacct

SEQ ID NO: 525008 - DNA, 25 bp, Mus musculus
gatttgttggagacttgaaacctag

SEQ ID NO: 525009 - DNA, 25 bp, Mus musculus
gatttgttggagtcttgaaacctag

SEQ ID NO: 525010 - DNA, 25 bp, Mus musculus
gatttgttgtaacagcaccacctgc

SEQ ID NO: 525011 - DNA, 25 bp, Mus musculus
gatttgttgtaagagcaccacctgc

SEQ ID NO: 525012 - DNA, 25 bp, Mus musculus
gatttgtttaacacactgctgtcag

SEQ ID NO: 525013 - DNA, 25 bp, Mus musculus
gatttgtttaactcactgctgtcag

SEQ ID NO: 525014 - DNA, 25 bp, Mus musculus
gatttgtttaccaaccatttcattg

SEQ ID NO: 525015 - DNA, 25 bp, Mus musculus
gatttgtttacctaccatttcattg

SEQ ID NO: 525016 - DNA, 25 bp, Mus musculus
gatttgtttctgaatagtacgatca

SEQ ID NO: 525017 - DNA, 25 bp, Mus musculus
gatttgtttctgatattgacttgag

SEQ ID NO: 525018 - DNA, 25 bp, Mus musculus
gatttgtttctgtatagtacgatca

SEQ ID NO: 525019 - DNA, 25 bp, Mus musculus
gatttgtttctgttattgacttgag

SEQ ID NO: 525020 - DNA, 25 bp, Mus musculus
gatttgtttgtcactccagctacat

SEQ ID NO: 525021 - DNA, 25 bp, Mus musculus
gatttgtttgtctctccagctacat

SEQ ID NO: 525022 - DNA, 25 bp, Mus musculus
gatttgttttatacttgttactggt

SEQ ID NO: 525023 - DNA, 25 bp, Mus musculus
gatttgttttattcttgttactggt

SEQ ID NO: 525024 - DNA, 25 bp, Mus musculus
gattttaaatcaacagcatgttcaa

SEQ ID NO: 525025 - DNA, 25 bp, Mus musculus
gattttaaatcatcagcatgttcaa

SEQ ID NO: 525026 - DNA, 25 bp, Mus musculus
gattttaaatggactcatcacatga

SEQ ID NO: 525027 - DNA, 25 bp, Mus musculus
gattttaaatggtctcatcacatga

SEQ ID NO: 525028 - DNA, 25 bp, Mus musculus
gattttaaatgtccccaatatacct

SEQ ID NO: 525029 - DNA, 25 bp, Mus musculus
gattttaaatgtgcccaatatacct

SEQ ID NO: 525030 - DNA, 25 bp, Mus musculus
gattttaacaccagatacccggata

SEQ ID NO: 525031 - DNA, 25 bp, Mus musculus
gattttaacacctgatacccggata

SEQ ID NO: 525032 - DNA, 25 bp, Mus musculus
gattttaacagtaacaacctctaga

SEQ ID NO: 525033 - DNA, 25 bp, Mus musculus
gattttaacagttacaacctctaga

SEQ ID NO: 525034 - DNA, 25 bp, Mus musculus
gattttaacattcgctacctcttag

SEQ ID NO: 525035 - DNA, 25 bp, Mus musculus
gattttaacattggctacctcttag

SEQ ID NO: 525036 - DNA, 25 bp, Mus musculus
gattttaacctcagtcatctcagat

SEQ ID NO: 525037 - DNA, 25 bp, Mus musculus
gattttaacctctgtcatctcagat

SEQ ID NO: 525038 - DNA, 25 bp, Mus musculus
gattttaacgcaagcttcctgctgt

SEQ ID NO: 525039 - DNA, 25 bp, Mus musculus
gattttaacgcatgcttcctgctgt

SEQ ID NO: 525040 - DNA, 25 bp, Mus musculus
gattttaacttccaacccggctcag

SEQ ID NO: 525041 - DNA, 25 bp, Mus musculus
gattttaacttcgaacccggctcag

SEQ ID NO: 525042 - DNA, 25 bp, Mus musculus
gattttaacttgatctgcagtggta

SEQ ID NO: 525043 - DNA, 25 bp, Mus musculus
gattttaacttgttctgcagtggta

SEQ ID NO: 525044 - DNA, 25 bp, Mus musculus
gattttaagcccaaaggtgtatctt

SEQ ID NO: 525045 - DNA, 25 bp, Mus musculus
gattttaagccctaaggtgtatctt

SEQ ID NO: 525046 - DNA, 25 bp, Mus musculus
gattttaagtaaagtcggcttatgt

SEQ ID NO: 525047 - DNA, 25 bp, Mus musculus
gattttaagtaatgtcggcttatgt

SEQ ID NO: 525048 - DNA, 25 bp, Mus musculus
gattttaagtacctacacctcgcct

SEQ ID NO: 525049 - DNA, 25 bp, Mus musculus
gattttaagtacgtacacctcgcct

SEQ ID NO: 525050 - DNA, 25 bp, Mus musculus
gattttaagttcctgaagcccagca

SEQ ID NO: 525051 - DNA, 25 bp, Mus musculus
gattttaagttcgtgaagcccagca

SEQ ID NO: 525052 - DNA, 25 bp, Mus musculus
gattttaataaccaaagcaggagaa

SEQ ID NO: 525053 - DNA, 25 bp, Mus musculus
gattttaataacgaaagcaggagaa

SEQ ID NO: 525054 - DNA, 25 bp, Mus musculus
gattttaatatcaccattgatgtac

SEQ ID NO: 525055 - DNA, 25 bp, Mus musculus
gattttaatatctccattgatgtac

SEQ ID NO: 525056 - DNA, 25 bp, Mus musculus
gattttaattgaacctaagcagcca

SEQ ID NO: 525057 - DNA, 25 bp, Mus musculus
gattttaattgatcctaagcagcca

SEQ ID NO: 525058 - DNA, 25 bp, Mus musculus
gattttacaaaacagccaccctgcc

SEQ ID NO: 525059 - DNA, 25 bp, Mus musculus
gattttacaaaagagccaccctgcc

SEQ ID NO: 525060 - DNA, 25 bp, Mus musculus
gattttacaatcaccctggaaactc

SEQ ID NO: 525061 - DNA, 25 bp, Mus musculus
gattttacaatctccctggaaactc

SEQ ID NO: 525062 - DNA, 25 bp, Mus musculus
gattttacactgcttaaaccctgaa

SEQ ID NO: 525063 - DNA, 25 bp, Mus musculus
gattttacactggttaaaccctgaa

SEQ ID NO: 525064 - DNA, 25 bp, Mus musculus
gattttacagccatactctgctatg

SEQ ID NO: 525065 - DNA, 25 bp, Mus musculus
gattttacagccttactctgctatg

SEQ ID NO: 525066 - DNA, 25 bp, Mus musculus
gattttacagtgcacggacaatgct

SEQ ID NO: 525067 - DNA, 25 bp, Mus musculus
gattttacagtggacggacaatgct

SEQ ID NO: 525068 - DNA, 25 bp, Mus musculus
gattttacatctccatccatttgga

SEQ ID NO: 525069 - DNA, 25 bp, Mus musculus
gattttacatctgcatccatttgga

SEQ ID NO: 525070 - DNA, 25 bp, Mus musculus
gattttacatttatgtccttgctcc

SEQ ID NO: 525071 - DNA, 25 bp, Mus musculus
gattttacatttttgtccttgctcc

SEQ ID NO: 525072 - DNA, 25 bp, Mus musculus
gattttaccaagacaatacatgttt

SEQ ID NO: 525073 - DNA, 25 bp, Mus musculus
gattttaccaagtcaatacatgttt

SEQ ID NO: 525074 - DNA, 25 bp, Mus musculus
gattttaccagaacaccttttcaga

SEQ ID NO: 525075 - DNA, 25 bp, Mus musculus
gattttaccagatcaccttttcaga

SEQ ID NO: 525076 - DNA, 25 bp, Mus musculus
gattttaccagtcagtcctagtgtc

SEQ ID NO: 525077 - DNA, 25 bp, Mus musculus
gattttaccagtgagtcctagtgtc

SEQ ID NO: 525078 - DNA, 25 bp, Mus musculus
gattttaccctgatgcagcaaatga

SEQ ID NO: 525079 - DNA, 25 bp, Mus musculus
gattttaccctgttgcagcaaatga

SEQ ID NO: 525080 - DNA, 25 bp, Mus musculus
gattttacctcaaatactgtacatt

SEQ ID NO: 525081 - DNA, 25 bp, Mus musculus
gattttacctcatatactgtacatt

SEQ ID NO: 525082 - DNA, 25 bp, Mus musculus
gattttacctggaagtggtaatact

SEQ ID NO: 525083 - DNA, 25 bp, Mus musculus
gattttacctggtagtggtaatact

SEQ ID NO: 525084 - DNA, 25 bp, Mus musculus
gattttactcttagcatattcgagc

SEQ ID NO: 525085 - DNA, 25 bp, Mus musculus
gattttactctttgcatattcgagc

SEQ ID NO: 525086 - DNA, 25 bp, Mus musculus
gattttactgacctttcatcacaag

SEQ ID NO: 525087 - DNA, 25 bp, Mus musculus
gattttactgacgtttcatcacaag

SEQ ID NO: 525088 - DNA, 25 bp, Mus musculus
gattttactggaatctgttcaactg

SEQ ID NO: 525089 - DNA, 25 bp, Mus musculus
gattttactggattctgttcaactg

SEQ ID NO: 525090 - DNA, 25 bp, Mus musculus
gattttactgtgatactaggaattg

SEQ ID NO: 525091 - DNA, 25 bp, Mus musculus
gattttactgtgttactaggaattg

SEQ ID NO: 525092 - DNA, 25 bp, Mus musculus
gattttactgttaaccatgagccat

SEQ ID NO: 525093 - DNA, 25 bp, Mus musculus
gattttactgtttaccatgagccat

SEQ ID NO: 525094 - DNA, 25 bp, Mus musculus
gattttacttgtactgacagtagct

SEQ ID NO: 525095 - DNA, 25 bp, Mus musculus
gattttacttgttctgacagtagct

SEQ ID NO: 525096 - DNA, 25 bp, Mus musculus
gattttactttgcttactcacttag

SEQ ID NO: 525097 - DNA, 25 bp, Mus musculus
gattttactttggttactcacttag

SEQ ID NO: 525098 - DNA, 25 bp, Mus musculus
gattttacttttctccaatggcggg

SEQ ID NO: 525099 - DNA, 25 bp, Mus musculus
gattttacttttgtccaatggcggg

SEQ ID NO: 525100 - DNA, 25 bp, Mus musculus
gattttagaactagccttccacagg

SEQ ID NO: 525101 - DNA, 25 bp, Mus musculus
gattttagaacttgccttccacagg

SEQ ID NO: 525102 - DNA, 25 bp, Mus musculus
gattttagagaacgaccaatgtgcc

SEQ ID NO: 525103 - DNA, 25 bp, Mus musculus
gattttagagaaggaccaatgtgcc

SEQ ID NO: 525104 - DNA, 25 bp, Mus musculus
gattttagataaatggcccagccta

SEQ ID NO: 525105 - DNA, 25 bp, Mus musculus
gattttagataattggcccagccta

SEQ ID NO: 525106 - DNA, 25 bp, Mus musculus
gattttagatctatcatatgtcatt

SEQ ID NO: 525107 - DNA, 25 bp, Mus musculus
gattttagatctttcatatgtcatt

SEQ ID NO: 525108 - DNA, 25 bp, Mus musculus
gattttagcaacactactttagtga

SEQ ID NO: 525109 - DNA, 25 bp, Mus musculus
gattttagcaactctactttagtga

SEQ ID NO: 525110 - DNA, 25 bp, Mus musculus
gattttagcccgagctgtgctggaa

SEQ ID NO: 525111 - DNA, 25 bp, Mus musculus
gattttagcccgtgctgtgctggaa

SEQ ID NO: 525112 - DNA, 25 bp, Mus musculus
gattttagccctactgatattacaa

SEQ ID NO: 525113 - DNA, 25 bp, Mus musculus
gattttagcccttctgatattacaa

SEQ ID NO: 525114 - DNA, 25 bp, Mus musculus
gattttagcttaatgcagaactctt

SEQ ID NO: 525115 - DNA, 25 bp, Mus musculus
gattttagcttattgcagaactctt

SEQ ID NO: 525116 - DNA, 25 bp, Mus musculus
gattttaggagtagctacccagact

SEQ ID NO: 525117 - DNA, 25 bp, Mus musculus
gattttaggagttgctacccagact

SEQ ID NO: 525118 - DNA, 25 bp, Mus musculus
gattttaggcccaacattgaacatc

SEQ ID NO: 525119 - DNA, 25 bp, Mus musculus
gattttaggccctacattgaacatc

SEQ ID NO: 525120 - DNA, 25 bp, Mus musculus
gattttagggttatctgaatcaaag

SEQ ID NO: 525121 - DNA, 25 bp, Mus musculus
gattttagggttttctgaatcaaag

SEQ ID NO: 525122 - DNA, 25 bp, Mus musculus
gattttagtctccttgtcccactta

SEQ ID NO: 525123 - DNA, 25 bp, Mus musculus
gattttagtctcgttgtcccactta

SEQ ID NO: 525124 - DNA, 25 bp, Mus musculus
gattttagtgggacttgactctccc

SEQ ID NO: 525125 - DNA, 25 bp, Mus musculus
gattttagtgggtcttgactctccc

SEQ ID NO: 525126 - DNA, 25 bp, Mus musculus
gattttataatcagttagcccagtt

SEQ ID NO: 525127 - DNA, 25 bp, Mus musculus
gattttataatctgttagcccagtt

SEQ ID NO: 525128 - DNA, 25 bp, Mus musculus
gattttatactcctgtcggtaccca

SEQ ID NO: 525129 - DNA, 25 bp, Mus musculus
gattttatactcgtgtcggtaccca

SEQ ID NO: 525130 - DNA, 25 bp, Mus musculus
gattttatagatccacgttcctgaa

SEQ ID NO: 525131 - DNA, 25 bp, Mus musculus
gattttatagatgcacgttcctgaa

SEQ ID NO: 525132 - DNA, 25 bp, Mus musculus
gattttatatctctaagcaccccgt

SEQ ID NO: 525133 - DNA, 25 bp, Mus musculus
gattttatatctgtaagcaccccgt

SEQ ID NO: 525134 - DNA, 25 bp, Mus musculus
gattttatattcactaggcttgaca

SEQ ID NO: 525135 - DNA, 25 bp, Mus musculus
gattttatattctctaggcttgaca

SEQ ID NO: 525136 - DNA, 25 bp, Mus musculus
gattttatcctcacgcagaatggtt

SEQ ID NO: 525137 - DNA, 25 bp, Mus musculus
gattttatcctcataccttaaggct

SEQ ID NO: 525138 - DNA, 25 bp, Mus musculus
gattttatcctctcgcagaatggtt

SEQ ID NO: 525139 - DNA, 25 bp, Mus musculus
gattttatcctcttaccttaaggct

SEQ ID NO: 525140 - DNA, 25 bp, Mus musculus
gattttatcttacgatcttccccaa

SEQ ID NO: 525141 - DNA, 25 bp, Mus musculus
gattttatcttaggatcttccccaa

SEQ ID NO: 525142 - DNA, 25 bp, Mus musculus
gattttatgctcaggtgggccatca

SEQ ID NO: 525143 - DNA, 25 bp, Mus musculus
gattttatgctctggtgggccatca

SEQ ID NO: 525144 - DNA, 25 bp, Mus musculus
gattttatggtacctatctatcttt

SEQ ID NO: 525145 - DNA, 25 bp, Mus musculus
gattttatggtagctatctatcttt

SEQ ID NO: 525146 - DNA, 25 bp, Mus musculus
gattttattatgatcagaaacctgt

SEQ ID NO: 525147 - DNA, 25 bp, Mus musculus
gattttattatgttcagaaacctgt

SEQ ID NO: 525148 - DNA, 25 bp, Mus musculus
gattttattctgaagttggagccca

SEQ ID NO: 525149 - DNA, 25 bp, Mus musculus
gattttattctgtagttggagccca

SEQ ID NO: 525150 - DNA, 25 bp, Mus musculus
gattttattgacaggttgcccttac

SEQ ID NO: 525151 - DNA, 25 bp, Mus musculus
gattttattgaccagtgtgttgaac

SEQ ID NO: 525152 - DNA, 25 bp, Mus musculus
gattttattgaccatctggcagacc

SEQ ID NO: 525153 - DNA, 25 bp, Mus musculus
gattttattgacgagtgtgttgaac

SEQ ID NO: 525154 - DNA, 25 bp, Mus musculus
gattttattgacgatctggcagacc

SEQ ID NO: 525155 - DNA, 25 bp, Mus musculus
gattttattgactggttgcccttac

SEQ ID NO: 525156 - DNA, 25 bp, Mus musculus
gattttattgcactgtaagctacca

SEQ ID NO: 525157 - DNA, 25 bp, Mus musculus
gattttattgcagtgtaagctacca

SEQ ID NO: 525158 - DNA, 25 bp, Mus musculus
gattttcaaaccacctgacactgat

SEQ ID NO: 525159 - DNA, 25 bp, Mus musculus
gattttcaaacctcctgacactgat

SEQ ID NO: 525160 - DNA, 25 bp, Mus musculus
gattttcaaactccaccaacacttc

SEQ ID NO: 525161 - DNA, 25 bp, Mus musculus
gattttcaaactgcaccaacacttc

SEQ ID NO: 525162 - DNA, 25 bp, Mus musculus
gattttcaaagaacagtccagtttt

SEQ ID NO: 525163 - DNA, 25 bp, Mus musculus
gattttcaaagatcagtccagtttt

SEQ ID NO: 525164 - DNA, 25 bp, Mus musculus
gattttcaaattcaagtagcaactt

SEQ ID NO: 525165 - DNA, 25 bp, Mus musculus
gattttcaaattgaagtagcaactt

SEQ ID NO: 525166 - DNA, 25 bp, Mus musculus
gattttcaagaaagccgtcagcacg

SEQ ID NO: 525167 - DNA, 25 bp, Mus musculus
gattttcaagaatgccgtcagcacg

SEQ ID NO: 525168 - DNA, 25 bp, Mus musculus
gattttcaagatcaattcccattaa

SEQ ID NO: 525169 - DNA, 25 bp, Mus musculus
gattttcaagatgaattcccattaa

SEQ ID NO: 525170 - DNA, 25 bp, Mus musculus
gattttcaatcaatcaatttcattt

SEQ ID NO: 525171 - DNA, 25 bp, Mus musculus
gattttcaatcattcaatttcattt

SEQ ID NO: 525172 - DNA, 25 bp, Mus musculus
gattttcacagaaatgatcactgta

SEQ ID NO: 525173 - DNA, 25 bp, Mus musculus
gattttcacagatatgatcactgta

SEQ ID NO: 525174 - DNA, 25 bp, Mus musculus
gattttcacattctggatcatgtta

SEQ ID NO: 525175 - DNA, 25 bp, Mus musculus
gattttcacattgtggatcatgtta

SEQ ID NO: 525176 - DNA, 25 bp, Mus musculus
gattttcaccacagaattttctgac

SEQ ID NO: 525177 - DNA, 25 bp, Mus musculus
gattttcaccactgaattttctgac

SEQ ID NO: 525178 - DNA, 25 bp, Mus musculus
gattttcacctcacatgctttagat

SEQ ID NO: 525179 - DNA, 25 bp, Mus musculus
gattttcacctctcatgctttagat

SEQ ID NO: 525180 - DNA, 25 bp, Mus musculus
gattttcactgcaggatactcattg

SEQ ID NO: 525181 - DNA, 25 bp, Mus musculus
gattttcactgctggatactcattg

SEQ ID NO: 525182 - DNA, 25 bp, Mus musculus
gattttcagaagactcataagttga

SEQ ID NO: 525183 - DNA, 25 bp, Mus musculus
gattttcagaagtctcataagttga

SEQ ID NO: 525184 - DNA, 25 bp, Mus musculus
gattttcagaatcacgtcccacact

SEQ ID NO: 525185 - DNA, 25 bp, Mus musculus
gattttcagaatgacgtcccacact

SEQ ID NO: 525186 - DNA, 25 bp, Mus musculus
gattttcagactaaaagccataaag

SEQ ID NO: 525187 - DNA, 25 bp, Mus musculus
gattttcagacttaaagccataaag

SEQ ID NO: 525188 - DNA, 25 bp, Mus musculus
gattttcagaggagcaacttcgcca

SEQ ID NO: 525189 - DNA, 25 bp, Mus musculus
gattttcagaggtgcaacttcgcca

SEQ ID NO: 525190 - DNA, 25 bp, Mus musculus
gattttcagatgaggtcccaggtgt

SEQ ID NO: 525191 - DNA, 25 bp, Mus musculus
gattttcagatgtggtcccaggtgt

SEQ ID NO: 525192 - DNA, 25 bp, Mus musculus
gattttcagcaaagttcaccatcct

SEQ ID NO: 525193 - DNA, 25 bp, Mus musculus
gattttcagcaacttacggactaca

SEQ ID NO: 525194 - DNA, 25 bp, Mus musculus
gattttcagcaagttacggactaca

SEQ ID NO: 525195 - DNA, 25 bp, Mus musculus
gattttcagcaatgttcaccatcct

SEQ ID NO: 525196 - DNA, 25 bp, Mus musculus
gattttcaggatctcttaatggacg

SEQ ID NO: 525197 - DNA, 25 bp, Mus musculus
gattttcaggatgtcttaatggacg

SEQ ID NO: 525198 - DNA, 25 bp, Mus musculus
gattttcagtttctactgcctggta

SEQ ID NO: 525199 - DNA, 25 bp, Mus musculus
gattttcagtttgtactgcctggta

SEQ ID NO: 525200 - DNA, 25 bp, Mus musculus
gattttcataatctcgggcactgag

SEQ ID NO: 525201 - DNA, 25 bp, Mus musculus
gattttcataatgtcgggcactgag

SEQ ID NO: 525202 - DNA, 25 bp, Mus musculus
gattttcatcacacaacttaggatc

SEQ ID NO: 525203 - DNA, 25 bp, Mus musculus
gattttcatcactcaacttaggatc

SEQ ID NO: 525204 - DNA, 25 bp, Mus musculus
gattttcatcatctgactacagcca

SEQ ID NO: 525205 - DNA, 25 bp, Mus musculus
gattttcatcatgtgactacagcca

SEQ ID NO: 525206 - DNA, 25 bp, Mus musculus
gattttcatctcaacttgtgatttt

SEQ ID NO: 525207 - DNA, 25 bp, Mus musculus
gattttcatctctacttgtgatttt

SEQ ID NO: 525208 - DNA, 25 bp, Mus musculus
gattttcattctcagacactgatag

SEQ ID NO: 525209 - DNA, 25 bp, Mus musculus
gattttcattctgagacactgatag

SEQ ID NO: 525210 - DNA, 25 bp, Mus musculus
gattttcattggacgctcacattct

SEQ ID NO: 525211 - DNA, 25 bp, Mus musculus
gattttcattggtcgctcacattct

SEQ ID NO: 525212 - DNA, 25 bp, Mus musculus
gattttccaagcactaaatttctgt

SEQ ID NO: 525213 - DNA, 25 bp, Mus musculus
gattttccaagctctaaatttctgt

SEQ ID NO: 525214 - DNA, 25 bp, Mus musculus
gattttccaagtccaaagttcagcc

SEQ ID NO: 525215 - DNA, 25 bp, Mus musculus
gattttccaagtgcaaagttcagcc

SEQ ID NO: 525216 - DNA, 25 bp, Mus musculus
gattttccaattattcagaggtata

SEQ ID NO: 525217 - DNA, 25 bp, Mus musculus
gattttccaatttttcagaggtata

SEQ ID NO: 525218 - DNA, 25 bp, Mus musculus
gattttccactgatgtaccaatgta

SEQ ID NO: 525219 - DNA, 25 bp, Mus musculus
gattttccactgttgtaccaatgta

SEQ ID NO: 525220 - DNA, 25 bp, Mus musculus
gattttccacttcttcagagagaga

SEQ ID NO: 525221 - DNA, 25 bp, Mus musculus
gattttccacttgttcagagagaga

SEQ ID NO: 525222 - DNA, 25 bp, Mus musculus
gattttccagagataccatgcagat

SEQ ID NO: 525223 - DNA, 25 bp, Mus musculus
gattttccagagttaccatgcagat

SEQ ID NO: 525224 - DNA, 25 bp, Mus musculus
gattttccagggattaagcattgct

SEQ ID NO: 525225 - DNA, 25 bp, Mus musculus
gattttccagggtttaagcattgct

SEQ ID NO: 525226 - DNA, 25 bp, Mus musculus
gattttccatccagtagagtgcaaa

SEQ ID NO: 525227 - DNA, 25 bp, Mus musculus
gattttccatcctgtagagtgcaaa

SEQ ID NO: 525228 - DNA, 25 bp, Mus musculus
gattttccatgaacccttgagatgt

SEQ ID NO: 525229 - DNA, 25 bp, Mus musculus
gattttccatgatcccttgagatgt

SEQ ID NO: 525230 - DNA, 25 bp, Mus musculus
gattttcccaccaaatttagtatgt

SEQ ID NO: 525231 - DNA, 25 bp, Mus musculus
gattttcccacctaatttagtatgt

SEQ ID NO: 525232 - DNA, 25 bp, Mus musculus
gattttcccatcagtgacttggata

SEQ ID NO: 525233 - DNA, 25 bp, Mus musculus
gattttcccatctgtgacttggata

SEQ ID NO: 525234 - DNA, 25 bp, Mus musculus
gattttcccattctccatgatggca

SEQ ID NO: 525235 - DNA, 25 bp, Mus musculus
gattttcccattgtccatgatggca

SEQ ID NO: 525236 - DNA, 25 bp, Mus musculus
gattttccctaaaacatatggagag

SEQ ID NO: 525237 - DNA, 25 bp, Mus musculus
gattttccctaatacatatggagag

SEQ ID NO: 525238 - DNA, 25 bp, Mus musculus
gattttccctgaaggctgggattca

SEQ ID NO: 525239 - DNA, 25 bp, Mus musculus
gattttccctgatggctgggattca

SEQ ID NO: 525240 - DNA, 25 bp, Mus musculus
gattttccctgtcagcctatggaga

SEQ ID NO: 525241 - DNA, 25 bp, Mus musculus
gattttccctgtgagcctatggaga

SEQ ID NO: 525242 - DNA, 25 bp, Mus musculus
gattttcccttgctatcttccagtc

SEQ ID NO: 525243 - DNA, 25 bp, Mus musculus
gattttcccttggtatcttccagtc

SEQ ID NO: 525244 - DNA, 25 bp, Mus musculus
gattttccggagatatcaccgaaat

SEQ ID NO: 525245 - DNA, 25 bp, Mus musculus
gattttccggagttatcaccgaaat

SEQ ID NO: 525246 - DNA, 25 bp, Mus musculus
gattttcctaaccaggattttctga

SEQ ID NO: 525247 - DNA, 25 bp, Mus musculus
gattttcctaacgaggattttctga

SEQ ID NO: 525248 - DNA, 25 bp, Mus musculus
gattttcctcagatgggtcgtttta

SEQ ID NO: 525249 - DNA, 25 bp, Mus musculus
gattttcctcagttgggtcgtttta

SEQ ID NO: 525250 - DNA, 25 bp, Mus musculus
gattttcctccaagtggctaaatgc

SEQ ID NO: 525251 - DNA, 25 bp, Mus musculus
gattttcctccatgtggctaaatgc

SEQ ID NO: 525252 - DNA, 25 bp, Mus musculus
gattttcctcggagtggtcctgggc

SEQ ID NO: 525253 - DNA, 25 bp, Mus musculus
gattttcctcggtgtggtcctgggc

SEQ ID NO: 525254 - DNA, 25 bp, Mus musculus
gattttcctcttctataacagcatt

SEQ ID NO: 525255 - DNA, 25 bp, Mus musculus
gattttcctcttgtataacagcatt

SEQ ID NO: 525256 - DNA, 25 bp, Mus musculus
gattttcctgatcaacatcattgaa

SEQ ID NO: 525257 - DNA, 25 bp, Mus musculus
gattttcctgatgaacatcattgaa

SEQ ID NO: 525258 - DNA, 25 bp, Mus musculus
gattttcctggtacgatactatcaa

SEQ ID NO: 525259 - DNA, 25 bp, Mus musculus
gattttcctggttcgatactatcaa

SEQ ID NO: 525260 - DNA, 25 bp, Mus musculus
gattttccttatctattgatttgag

SEQ ID NO: 525261 - DNA, 25 bp, Mus musculus
gattttccttatgtattgatttgag

SEQ ID NO: 525262 - DNA, 25 bp, Mus musculus
gattttcggatgaaggagaatggaa

SEQ ID NO: 525263 - DNA, 25 bp, Mus musculus
gattttcggatgtaggagaatggaa

SEQ ID NO: 525264 - DNA, 25 bp, Mus musculus
gattttcgtgcaattaattcctatg

SEQ ID NO: 525265 - DNA, 25 bp, Mus musculus
gattttcgtgcatttaattcctatg

SEQ ID NO: 525266 - DNA, 25 bp, Mus musculus
gattttcgtggtagacagtaatgac

SEQ ID NO: 525267 - DNA, 25 bp, Mus musculus
gattttcgtggttgacagtaatgac

SEQ ID NO: 525268 - DNA, 25 bp, Mus musculus
gattttctaagactttatctcactt

SEQ ID NO: 525269 - DNA, 25 bp, Mus musculus
gattttctaagagtttatctcactt

SEQ ID NO: 525270 - DNA, 25 bp, Mus musculus
gattttctaccgcagattcagacat

SEQ ID NO: 525271 - DNA, 25 bp, Mus musculus
gattttctaccggagattcagacat

SEQ ID NO: 525272 - DNA, 25 bp, Mus musculus
gattttctacgtcgacatataccta

SEQ ID NO: 525273 - DNA, 25 bp, Mus musculus
gattttctacgtggacatataccta

SEQ ID NO: 525274 - DNA, 25 bp, Mus musculus
gattttctactgcaggtgccgcaca

SEQ ID NO: 525275 - DNA, 25 bp, Mus musculus
gattttctactggaggtgccgcaca

SEQ ID NO: 525276 - DNA, 25 bp, Mus musculus
gattttctacttactgcattaactt

SEQ ID NO: 525277 - DNA, 25 bp, Mus musculus
gattttctactttctgcattaactt

SEQ ID NO: 525278 - DNA, 25 bp, Mus musculus
gattttctagttactgaggcttgta

SEQ ID NO: 525279 - DNA, 25 bp, Mus musculus
gattttctagtttctgaggcttgta

SEQ ID NO: 525280 - DNA, 25 bp, Mus musculus
gattttctataaagcgttgcacatg

SEQ ID NO: 525281 - DNA, 25 bp, Mus musculus
gattttctataatgcgttgcacatg

SEQ ID NO: 525282 - DNA, 25 bp, Mus musculus
gattttctatacaagcgtgggaact

SEQ ID NO: 525283 - DNA, 25 bp, Mus musculus
gattttctatactagcgtgggaact

SEQ ID NO: 525284 - DNA, 25 bp, Mus musculus
gattttctatttccactgagcctca

SEQ ID NO: 525285 - DNA, 25 bp, Mus musculus
gattttctatttgcactgagcctca

SEQ ID NO: 525286 - DNA, 25 bp, Mus musculus
gattttctcaagaacctggcgaaga

SEQ ID NO: 525287 - DNA, 25 bp, Mus musculus
gattttctcaagtacctggcgaaga

SEQ ID NO: 525288 - DNA, 25 bp, Mus musculus
gattttctcattccatggctgtagg

SEQ ID NO: 525289 - DNA, 25 bp, Mus musculus
gattttctcattgcatggctgtagg

SEQ ID NO: 525290 - DNA, 25 bp, Mus musculus
gattttctccaacggactctgtgta

SEQ ID NO: 525291 - DNA, 25 bp, Mus musculus
gattttctccaacggtcaggtgtcc

SEQ ID NO: 525292 - DNA, 25 bp, Mus musculus
gattttctccaagggactctgtgta

SEQ ID NO: 525293 - DNA, 25 bp, Mus musculus
gattttctccaagggtcaggtgtcc

SEQ ID NO: 525294 - DNA, 25 bp, Mus musculus
gattttctgagacggaagttcgtgt

SEQ ID NO: 525295 - DNA, 25 bp, Mus musculus
gattttctgagagggaagttcgtgt

SEQ ID NO: 525296 - DNA, 25 bp, Mus musculus
gattttctgagcatttctacccaca

SEQ ID NO: 525297 - DNA, 25 bp, Mus musculus
gattttctgagcttttctacccaca

SEQ ID NO: 525298 - DNA, 25 bp, Mus musculus
gattttctgcagctaccggcgcttg

SEQ ID NO: 525299 - DNA, 25 bp, Mus musculus
gattttctgcaggtaccggcgcttg

SEQ ID NO: 525300 - DNA, 25 bp, Mus musculus
gattttctgtaccaatgagatccca

SEQ ID NO: 525301 - DNA, 25 bp, Mus musculus
gattttctgtacgaatgagatccca

SEQ ID NO: 525302 - DNA, 25 bp, Mus musculus
gattttctgtgtataagccaacctc

SEQ ID NO: 525303 - DNA, 25 bp, Mus musculus
gattttctgtgtttaagccaacctc

SEQ ID NO: 525304 - DNA, 25 bp, Mus musculus
gattttctgttcacgtgtattattt

SEQ ID NO: 525305 - DNA, 25 bp, Mus musculus
gattttctgttctcgtgtattattt

SEQ ID NO: 525306 - DNA, 25 bp, Mus musculus
gattttcttaatacctgctcagttg

SEQ ID NO: 525307 - DNA, 25 bp, Mus musculus
gattttcttaattcctgctcagttg

SEQ ID NO: 525308 - DNA, 25 bp, Mus musculus
gattttcttagacacttcagatttt

SEQ ID NO: 525309 - DNA, 25 bp, Mus musculus
gattttcttagagacttcagatttt

SEQ ID NO: 525310 - DNA, 25 bp, Mus musculus
gattttcttatccagaattcctcac

SEQ ID NO: 525311 - DNA, 25 bp, Mus musculus
gattttcttatcgagaattcctcac

SEQ ID NO: 525312 - DNA, 25 bp, Mus musculus
gattttcttcttaacaaccaacgct

SEQ ID NO: 525313 - DNA, 25 bp, Mus musculus
gattttcttctttacaaccaacgct

SEQ ID NO: 525314 - DNA, 25 bp, Mus musculus
gattttcttgccatacatgctgagg

SEQ ID NO: 525315 - DNA, 25 bp, Mus musculus
gattttcttgccttacatgctgagg

SEQ ID NO: 525316 - DNA, 25 bp, Mus musculus
gattttcttggtatttggttgttca

SEQ ID NO: 525317 - DNA, 25 bp, Mus musculus
gattttcttggtcctcattttctga

SEQ ID NO: 525318 - DNA, 25 bp, Mus musculus
gattttcttggtgctcattttctga

SEQ ID NO: 525319 - DNA, 25 bp, Mus musculus
gattttcttggtttttggttgttca

SEQ ID NO: 525320 - DNA, 25 bp, Mus musculus
gattttcttgttaaagctttgacca

SEQ ID NO: 525321 - DNA, 25 bp, Mus musculus
gattttcttgttaatgatgtccttg

SEQ ID NO: 525322 - DNA, 25 bp, Mus musculus
gattttcttgtttaagctttgacca

SEQ ID NO: 525323 - DNA, 25 bp, Mus musculus
gattttcttgtttatgatgtccttg

SEQ ID NO: 525324 - DNA, 25 bp, Mus musculus
gattttctttaaatcgacatctaaa

SEQ ID NO: 525325 - DNA, 25 bp, Mus musculus
gattttctttaactttgcttggttg

SEQ ID NO: 525326 - DNA, 25 bp, Mus musculus
gattttctttaagtttgcttggttg

SEQ ID NO: 525327 - DNA, 25 bp, Mus musculus
gattttctttaattcgacatctaaa

SEQ ID NO: 525328 - DNA, 25 bp, Mus musculus
gattttctttccaaggcgatttcca

SEQ ID NO: 525329 - DNA, 25 bp, Mus musculus
gattttctttcctaggcgatttcca

SEQ ID NO: 525330 - DNA, 25 bp, Mus musculus
gattttctttggattgtaacactat

SEQ ID NO: 525331 - DNA, 25 bp, Mus musculus
gattttctttggtttgtaacactat

SEQ ID NO: 525332 - DNA, 25 bp, Mus musculus
gattttcttttcaaatacttccagg

SEQ ID NO: 525333 - DNA, 25 bp, Mus musculus
gattttcttttctaatacttccagg

SEQ ID NO: 525334 - DNA, 25 bp, Mus musculus
gattttgaaaataacctgtagcctc

SEQ ID NO: 525335 - DNA, 25 bp, Mus musculus
gattttgaaaattacctgtagcctc

SEQ ID NO: 525336 - DNA, 25 bp, Mus musculus
gattttgaacacatatctgcccacc

SEQ ID NO: 525337 - DNA, 25 bp, Mus musculus
gattttgaacacttatctgcccacc

SEQ ID NO: 525338 - DNA, 25 bp, Mus musculus
gattttgaactacctgtgtgcactg

SEQ ID NO: 525339 - DNA, 25 bp, Mus musculus
gattttgaactacggtctcactgtg

SEQ ID NO: 525340 - DNA, 25 bp, Mus musculus
gattttgaactagctgtgtgcactg

SEQ ID NO: 525341 - DNA, 25 bp, Mus musculus
gattttgaactagggtctcactgtg

SEQ ID NO: 525342 - DNA, 25 bp, Mus musculus
gattttgaactcagagggccctctg

SEQ ID NO: 525343 - DNA, 25 bp, Mus musculus
gattttgaactctgagggccctctg

SEQ ID NO: 525344 - DNA, 25 bp, Mus musculus
gattttgaattcaaccgcatagtct

SEQ ID NO: 525345 - DNA, 25 bp, Mus musculus
gattttgaattctaccgcatagtct

SEQ ID NO: 525346 - DNA, 25 bp, Mus musculus
gattttgaccgacttcagttttgtc

SEQ ID NO: 525347 - DNA, 25 bp, Mus musculus
gattttgaccgagttcagttttgtc

SEQ ID NO: 525348 - DNA, 25 bp, Mus musculus
gattttgacctacttcttctctctt

SEQ ID NO: 525349 - DNA, 25 bp, Mus musculus
gattttgacctagttcttctctctt

SEQ ID NO: 525350 - DNA, 25 bp, Mus musculus
gattttgactccaaatgcagcacat

SEQ ID NO: 525351 - DNA, 25 bp, Mus musculus
gattttgactcctaatgcagcacat

SEQ ID NO: 525352 - DNA, 25 bp, Mus musculus
gattttgacttgagtacctgtgtac

SEQ ID NO: 525353 - DNA, 25 bp, Mus musculus
gattttgacttgtgtacctgtgtac

SEQ ID NO: 525354 - DNA, 25 bp, Mus musculus
gattttgagaccatcctgatctata

SEQ ID NO: 525355 - DNA, 25 bp, Mus musculus
gattttgagaccttcctgatctata

SEQ ID NO: 525356 - DNA, 25 bp, Mus musculus
gattttgagataatcgcttggacta

SEQ ID NO: 525357 - DNA, 25 bp, Mus musculus
gattttgagatattcgcttggacta

SEQ ID NO: 525358 - DNA, 25 bp, Mus musculus
gattttgaggacctcttacttccct

SEQ ID NO: 525359 - DNA, 25 bp, Mus musculus
gattttgaggacgtcttacttccct

SEQ ID NO: 525360 - DNA, 25 bp, Mus musculus
gattttgagtcactccaagggagca

SEQ ID NO: 525361 - DNA, 25 bp, Mus musculus
gattttgagtcagtccaagggagca

SEQ ID NO: 525362 - DNA, 25 bp, Mus musculus
gattttgatatgaattgtcctgtac

SEQ ID NO: 525363 - DNA, 25 bp, Mus musculus
gattttgatatgtattgtcctgtac

SEQ ID NO: 525364 - DNA, 25 bp, Mus musculus
gattttgatcacagggcatgggccc

SEQ ID NO: 525365 - DNA, 25 bp, Mus musculus
gattttgatcactgggcatgggccc

SEQ ID NO: 525366 - DNA, 25 bp, Mus musculus
gattttgatcagagcatccgatgga

SEQ ID NO: 525367 - DNA, 25 bp, Mus musculus
gattttgatcagtgcatccgatgga

SEQ ID NO: 525368 - DNA, 25 bp, Mus musculus
gattttgatccgatttcagatccaa

SEQ ID NO: 525369 - DNA, 25 bp, Mus musculus
gattttgatccgttttcagatccaa

SEQ ID NO: 525370 - DNA, 25 bp, Mus musculus
gattttgatctacgcagaaggccat

SEQ ID NO: 525371 - DNA, 25 bp, Mus musculus
gattttgatctaggcagaaggccat

SEQ ID NO: 525372 - DNA, 25 bp, Mus musculus
gattttgatctccatgacctgatac

SEQ ID NO: 525373 - DNA, 25 bp, Mus musculus
gattttgatctcgatgacctgatac

SEQ ID NO: 525374 - DNA, 25 bp, Mus musculus
gattttgatctgctctcatcaggta

SEQ ID NO: 525375 - DNA, 25 bp, Mus musculus
gattttgatctggtctcatcaggta

SEQ ID NO: 525376 - DNA, 25 bp, Mus musculus
gattttgatgcgatttttcccgtga

SEQ ID NO: 525377 - DNA, 25 bp, Mus musculus
gattttgatgcgttttttcccgtga

SEQ ID NO: 525378 - DNA, 25 bp, Mus musculus
gattttgcaacaacctgactgcttg

SEQ ID NO: 525379 - DNA, 25 bp, Mus musculus
gattttgcaacatcctgactgcttg

SEQ ID NO: 525380 - DNA, 25 bp, Mus musculus
gattttgcaaggcaacagttcactg

SEQ ID NO: 525381 - DNA, 25 bp, Mus musculus
gattttgcaagggaacagttcactg

SEQ ID NO: 525382 - DNA, 25 bp, Mus musculus
gattttgcaattcagttcctttaat

SEQ ID NO: 525383 - DNA, 25 bp, Mus musculus
gattttgcaattgagttcctttaat

SEQ ID NO: 525384 - DNA, 25 bp, Mus musculus
gattttgcacatagacttaatgacc

SEQ ID NO: 525385 - DNA, 25 bp, Mus musculus
gattttgcacattgacttaatgacc

SEQ ID NO: 525386 - DNA, 25 bp, Mus musculus
gattttgcaccaattcttgattttt

SEQ ID NO: 525387 - DNA, 25 bp, Mus musculus
gattttgcaccatttcttgattttt

SEQ ID NO: 525388 - DNA, 25 bp, Mus musculus
gattttgcacgtacatggacacaca

SEQ ID NO: 525389 - DNA, 25 bp, Mus musculus
gattttgcacgttcatggacacaca

SEQ ID NO: 525390 - DNA, 25 bp, Mus musculus
gattttgcaggactacattgccttc

SEQ ID NO: 525391 - DNA, 25 bp, Mus musculus
gattttgcaggagtacattgccttc

SEQ ID NO: 525392 - DNA, 25 bp, Mus musculus
gattttgccactatcggatgttgaa

SEQ ID NO: 525393 - DNA, 25 bp, Mus musculus
gattttgccactttcggatgttgaa

SEQ ID NO: 525394 - DNA, 25 bp, Mus musculus
gattttgccggtctcttgaatttta

SEQ ID NO: 525395 - DNA, 25 bp, Mus musculus
gattttgccggtgtcttgaatttta

SEQ ID NO: 525396 - DNA, 25 bp, Mus musculus
gattttgcctttatggtacctagtg

SEQ ID NO: 525397 - DNA, 25 bp, Mus musculus
gattttgcctttttggtacctagtg

SEQ ID NO: 525398 - DNA, 25 bp, Mus musculus
gattttgcgaacagcattctcacta

SEQ ID NO: 525399 - DNA, 25 bp, Mus musculus
gattttgcgaactgcattctcacta

SEQ ID NO: 525400 - DNA, 25 bp, Mus musculus
gattttgcgccacttcttgaaaggt

SEQ ID NO: 525401 - DNA, 25 bp, Mus musculus
gattttgcgccagttcttgaaaggt

SEQ ID NO: 525402 - DNA, 25 bp, Mus musculus
gattttgcggaaatgggagcctaat

SEQ ID NO: 525403 - DNA, 25 bp, Mus musculus
gattttgcggaattgggagcctaat

SEQ ID NO: 525404 - DNA, 25 bp, Mus musculus
gattttgctagtcctgttcgcatct

SEQ ID NO: 525405 - DNA, 25 bp, Mus musculus
gattttgctagtgctgttcgcatct

SEQ ID NO: 525406 - DNA, 25 bp, Mus musculus
gattttgctctcagttttatagtta

SEQ ID NO: 525407 - DNA, 25 bp, Mus musculus
gattttgctctctgttttatagtta

SEQ ID NO: 525408 - DNA, 25 bp, Mus musculus
gattttgctgacaaaacaaacccaa

SEQ ID NO: 525409 - DNA, 25 bp, Mus musculus
gattttgctgactaaacaaacccaa

SEQ ID NO: 525410 - DNA, 25 bp, Mus musculus
gattttgctgggacatacaatatgt

SEQ ID NO: 525411 - DNA, 25 bp, Mus musculus
gattttgctgggtcatacaatatgt

SEQ ID NO: 525412 - DNA, 25 bp, Mus musculus
gattttggaaacacatgggccttag

SEQ ID NO: 525413 - DNA, 25 bp, Mus musculus
gattttggaaactcatgggccttag

SEQ ID NO: 525414 - DNA, 25 bp, Mus musculus
gattttggactcatgtcatctgaga

SEQ ID NO: 525415 - DNA, 25 bp, Mus musculus
gattttggactcttgtcatctgaga

SEQ ID NO: 525416 - DNA, 25 bp, Mus musculus
gattttggagctaacatctaccttc

SEQ ID NO: 525417 - DNA, 25 bp, Mus musculus
gattttggagctagactgtgtcaga

SEQ ID NO: 525418 - DNA, 25 bp, Mus musculus
gattttggagctcgacacagtcctc

SEQ ID NO: 525419 - DNA, 25 bp, Mus musculus
gattttggagctggacacagtcctc

SEQ ID NO: 525420 - DNA, 25 bp, Mus musculus
gattttggagcttacatctaccttc

SEQ ID NO: 525421 - DNA, 25 bp, Mus musculus
gattttggagcttgactgtgtcaga

SEQ ID NO: 525422 - DNA, 25 bp, Mus musculus
gattttggattcagaggcccgagtt

SEQ ID NO: 525423 - DNA, 25 bp, Mus musculus
gattttggattctgaggcccgagtt

SEQ ID NO: 525424 - DNA, 25 bp, Mus musculus
gattttggatttctaccaccaccct

SEQ ID NO: 525425 - DNA, 25 bp, Mus musculus
gattttggatttgtaccaccaccct

SEQ ID NO: 525426 - DNA, 25 bp, Mus musculus
gattttggcaagagtcctacagcgt

SEQ ID NO: 525427 - DNA, 25 bp, Mus musculus
gattttggcaagctgttctcttacc

SEQ ID NO: 525428 - DNA, 25 bp, Mus musculus
gattttggcaaggtgttctcttacc

SEQ ID NO: 525429 - DNA, 25 bp, Mus musculus
gattttggcaagtgtcctacagcgt

SEQ ID NO: 525430 - DNA, 25 bp, Mus musculus
gattttggccaaactggcttcgact

SEQ ID NO: 525431 - DNA, 25 bp, Mus musculus
gattttggccaatctggcttcgact

SEQ ID NO: 525432 - DNA, 25 bp, Mus musculus
gattttggccacctcaccgaggagt

SEQ ID NO: 525433 - DNA, 25 bp, Mus musculus
gattttggccacgtcaccgaggagt

SEQ ID NO: 525434 - DNA, 25 bp, Mus musculus
gattttggccagatggaatcaggct

SEQ ID NO: 525435 - DNA, 25 bp, Mus musculus
gattttggccagttggaatcaggct

SEQ ID NO: 525436 - DNA, 25 bp, Mus musculus
gattttggctccatacctggaaatt

SEQ ID NO: 525437 - DNA, 25 bp, Mus musculus
gattttggctccttacctggaaatt

SEQ ID NO: 525438 - DNA, 25 bp, Mus musculus
gattttgggaatatagtgcaaagag

SEQ ID NO: 525439 - DNA, 25 bp, Mus musculus
gattttgggaatttagtgcaaagag

SEQ ID NO: 525440 - DNA, 25 bp, Mus musculus
gattttgggattacattgaccagct

SEQ ID NO: 525441 - DNA, 25 bp, Mus musculus
gattttgggatttcattgaccagct

SEQ ID NO: 525442 - DNA, 25 bp, Mus musculus
gattttggtcgtcttgtttctctaa

SEQ ID NO: 525443 - DNA, 25 bp, Mus musculus
gattttggtcgtgttgtttctctaa

SEQ ID NO: 525444 - DNA, 25 bp, Mus musculus
gattttggtttcactcaccgattat

SEQ ID NO: 525445 - DNA, 25 bp, Mus musculus
gattttggtttctctcaccgattat

SEQ ID NO: 525446 - DNA, 25 bp, Mus musculus
gattttgtaacacttaatttgagca

SEQ ID NO: 525447 - DNA, 25 bp, Mus musculus
gattttgtaacagttaatttgagca

SEQ ID NO: 525448 - DNA, 25 bp, Mus musculus
gattttgtacataccaccttgacac

SEQ ID NO: 525449 - DNA, 25 bp, Mus musculus
gattttgtacattccaccttgacac

SEQ ID NO: 525450 - DNA, 25 bp, Mus musculus
gattttgtactgcaatttcaactgg

SEQ ID NO: 525451 - DNA, 25 bp, Mus musculus
gattttgtactggaatttcaactgg

SEQ ID NO: 525452 - DNA, 25 bp, Mus musculus
gattttgtagctatttctactcgtc

SEQ ID NO: 525453 - DNA, 25 bp, Mus musculus
gattttgtagctttttctactcgtc

SEQ ID NO: 525454 - DNA, 25 bp, Mus musculus
gattttgtcaatcagctggataatg

SEQ ID NO: 525455 - DNA, 25 bp, Mus musculus
gattttgtcaatgagctggataatg

SEQ ID NO: 525456 - DNA, 25 bp, Mus musculus
gattttgtcatccaggtggctttag

SEQ ID NO: 525457 - DNA, 25 bp, Mus musculus
gattttgtcatcgaggtggctttag

SEQ ID NO: 525458 - DNA, 25 bp, Mus musculus
gattttgtcattcgctgaagttgtt

SEQ ID NO: 525459 - DNA, 25 bp, Mus musculus
gattttgtcattggctgaagttgtt

SEQ ID NO: 525460 - DNA, 25 bp, Mus musculus
gattttgtccttacaaaacaggcca

SEQ ID NO: 525461 - DNA, 25 bp, Mus musculus
gattttgtcctttcaaaacaggcca

SEQ ID NO: 525462 - DNA, 25 bp, Mus musculus
gattttgtctagacagcttgcttct

SEQ ID NO: 525463 - DNA, 25 bp, Mus musculus
gattttgtctagtcagcttgcttct

SEQ ID NO: 525464 - DNA, 25 bp, Mus musculus
gattttgtctccaatctttcattca

SEQ ID NO: 525465 - DNA, 25 bp, Mus musculus
gattttgtctcctatctttcattca

SEQ ID NO: 525466 - DNA, 25 bp, Mus musculus
gattttgtcttgcttgagcttgcac

SEQ ID NO: 525467 - DNA, 25 bp, Mus musculus
gattttgtcttggttgagcttgcac

SEQ ID NO: 525468 - DNA, 25 bp, Mus musculus
gattttgtgacaaactcttagtgca

SEQ ID NO: 525469 - DNA, 25 bp, Mus musculus
gattttgtgacatactcttagtgca

SEQ ID NO: 525470 - DNA, 25 bp, Mus musculus
gattttgtgagaatgcctcccagtt

SEQ ID NO: 525471 - DNA, 25 bp, Mus musculus
gattttgtgagattgcctcccagtt

SEQ ID NO: 525472 - DNA, 25 bp, Mus musculus
gattttgtgcacaggaaccatgata

SEQ ID NO: 525473 - DNA, 25 bp, Mus musculus
gattttgtgcactggaaccatgata

SEQ ID NO: 525474 - DNA, 25 bp, Mus musculus
gattttgtggtgcatgcaacccgaa

SEQ ID NO: 525475 - DNA, 25 bp, Mus musculus
gattttgtggtggatgcaacccgaa

SEQ ID NO: 525476 - DNA, 25 bp, Mus musculus
gattttgtgtttcagcacgttgagt

SEQ ID NO: 525477 - DNA, 25 bp, Mus musculus
gattttgtgtttgagcacgttgagt

SEQ ID NO: 525478 - DNA, 25 bp, Mus musculus
gattttgttaacatgggtactatct

SEQ ID NO: 525479 - DNA, 25 bp, Mus musculus
gattttgttaacttgggtactatct

SEQ ID NO: 525480 - DNA, 25 bp, Mus musculus
gattttgttaccaagcagcatttga

SEQ ID NO: 525481 - DNA, 25 bp, Mus musculus
gattttgttacctagcagcatttga

SEQ ID NO: 525482 - DNA, 25 bp, Mus musculus
gattttgttatacagggtaagccaa

SEQ ID NO: 525483 - DNA, 25 bp, Mus musculus
gattttgttatagagggtaagccaa

SEQ ID NO: 525484 - DNA, 25 bp, Mus musculus
gattttgttatgatcactgtgccat

SEQ ID NO: 525485 - DNA, 25 bp, Mus musculus
gattttgttatgttcactgtgccat

SEQ ID NO: 525486 - DNA, 25 bp, Mus musculus
gattttgttgaccatgttcatgaat

SEQ ID NO: 525487 - DNA, 25 bp, Mus musculus
gattttgttgacgatgttcatgaat

SEQ ID NO: 525488 - DNA, 25 bp, Mus musculus
gattttgttggcatcgaattcgcac

SEQ ID NO: 525489 - DNA, 25 bp, Mus musculus
gattttgttggcttcgaattcgcac

SEQ ID NO: 525490 - DNA, 25 bp, Mus musculus
gattttgttgtaaatcctccagttt

SEQ ID NO: 525491 - DNA, 25 bp, Mus musculus
gattttgttgtatatcctccagttt

SEQ ID NO: 525492 - DNA, 25 bp, Mus musculus
gattttgttgtcattaggagcacca

SEQ ID NO: 525493 - DNA, 25 bp, Mus musculus
gattttgttgtctttaggagcacca

SEQ ID NO: 525494 - DNA, 25 bp, Mus musculus
gattttgttgtgcatcatttaaaac

SEQ ID NO: 525495 - DNA, 25 bp, Mus musculus
gattttgttgtggatcatttaaaac

SEQ ID NO: 525496 - DNA, 25 bp, Mus musculus
gattttgtttctccacttcactatg

SEQ ID NO: 525497 - DNA, 25 bp, Mus musculus
gattttgtttctgcacttcactatg

SEQ ID NO: 525498 - DNA, 25 bp, Mus musculus
gattttgtttgcactaaggttatgg

SEQ ID NO: 525499 - DNA, 25 bp, Mus musculus
gattttgtttgctctaaggttatgg

SEQ ID NO: 525500 - DNA, 25 bp, Mus musculus
gatttttaacacaatgtcgctcagg

SEQ ID NO: 525501 - DNA, 25 bp, Mus musculus
gatttttaacactatgtcgctcagg

SEQ ID NO: 525502 - DNA, 25 bp, Mus musculus
gatttttaaggccagccatttggaa

SEQ ID NO: 525503 - DNA, 25 bp, Mus musculus
gatttttaaggcgagccatttggaa

SEQ ID NO: 525504 - DNA, 25 bp, Mus musculus
gatttttacactaatatatggacct

SEQ ID NO: 525505 - DNA, 25 bp, Mus musculus
gatttttacacttatatatggacct

SEQ ID NO: 525506 - DNA, 25 bp, Mus musculus
gatttttaccaacttactgcttcct

SEQ ID NO: 525507 - DNA, 25 bp, Mus musculus
gatttttaccaagttactgcttcct

SEQ ID NO: 525508 - DNA, 25 bp, Mus musculus
gatttttaccgtagatgctggtgta

SEQ ID NO: 525509 - DNA, 25 bp, Mus musculus
gatttttaccgttgatgctggtgta

SEQ ID NO: 525510 - DNA, 25 bp, Mus musculus
gatttttacggcaacaggacctggt

SEQ ID NO: 525511 - DNA, 25 bp, Mus musculus
gatttttacggctacaggacctggt

SEQ ID NO: 525512 - DNA, 25 bp, Mus musculus
gatttttactacagccagcctgtgt

SEQ ID NO: 525513 - DNA, 25 bp, Mus musculus
gatttttactactgccagcctgtgt

SEQ ID NO: 525514 - DNA, 25 bp, Mus musculus
gatttttactgaaagtccctgatca

SEQ ID NO: 525515 - DNA, 25 bp, Mus musculus
gatttttactgatagtccctgatca

SEQ ID NO: 525516 - DNA, 25 bp, Mus musculus
gatttttactgcaacaaaggaaaca

SEQ ID NO: 525517 - DNA, 25 bp, Mus musculus
gatttttactgctacaaaggaaaca

SEQ ID NO: 525518 - DNA, 25 bp, Mus musculus
gatttttagaggaaagctgtttggt

SEQ ID NO: 525519 - DNA, 25 bp, Mus musculus
gatttttagaggtaagctgtttggt

SEQ ID NO: 525520 - DNA, 25 bp, Mus musculus
gatttttagcagatggttaacccac

SEQ ID NO: 525521 - DNA, 25 bp, Mus musculus
gatttttagcagttggttaacccac

SEQ ID NO: 525522 - DNA, 25 bp, Mus musculus
gatttttagctactccttactggac

SEQ ID NO: 525523 - DNA, 25 bp, Mus musculus
gatttttagctagtccttactggac

SEQ ID NO: 525524 - DNA, 25 bp, Mus musculus
gatttttatctactaacacctccca

SEQ ID NO: 525525 - DNA, 25 bp, Mus musculus
gatttttatctagtaacacctccca

SEQ ID NO: 525526 - DNA, 25 bp, Mus musculus
gatttttatcttacctaacattggt

SEQ ID NO: 525527 - DNA, 25 bp, Mus musculus
gatttttatctttcctaacattggt

SEQ ID NO: 525528 - DNA, 25 bp, Mus musculus
gatttttatggaaggccttgcagcc

SEQ ID NO: 525529 - DNA, 25 bp, Mus musculus
gatttttatggatggccttgcagcc

SEQ ID NO: 525530 - DNA, 25 bp, Mus musculus
gatttttatggccacaccactggtt

SEQ ID NO: 525531 - DNA, 25 bp, Mus musculus
gatttttatggcgacaccactggtt

SEQ ID NO: 525532 - DNA, 25 bp, Mus musculus
gatttttatgtcaccggaccagcca

SEQ ID NO: 525533 - DNA, 25 bp, Mus musculus
gatttttatgtctccggaccagcca

SEQ ID NO: 525534 - DNA, 25 bp, Mus musculus
gatttttattatagccatgtccagc

SEQ ID NO: 525535 - DNA, 25 bp, Mus musculus
gatttttattattgccatgtccagc

SEQ ID NO: 525536 - DNA, 25 bp, Mus musculus
gatttttattcacttcagctgagct

SEQ ID NO: 525537 - DNA, 25 bp, Mus musculus
gatttttattcagttcagctgagct

SEQ ID NO: 525538 - DNA, 25 bp, Mus musculus
gatttttattcgagtcattgacctg

SEQ ID NO: 525539 - DNA, 25 bp, Mus musculus
gatttttattcgtgtcattgacctg

SEQ ID NO: 525540 - DNA, 25 bp, Mus musculus
gatttttattggaccactgaaacta

SEQ ID NO: 525541 - DNA, 25 bp, Mus musculus
gatttttattggtccactgaaacta

SEQ ID NO: 525542 - DNA, 25 bp, Mus musculus
gatttttattgtcttggatatatag

SEQ ID NO: 525543 - DNA, 25 bp, Mus musculus
gatttttattgtgttggatatatag

SEQ ID NO: 525544 - DNA, 25 bp, Mus musculus
gatttttattttcactcgggaatgg

SEQ ID NO: 525545 - DNA, 25 bp, Mus musculus
gatttttattttgactcgggaatgg

SEQ ID NO: 525546 - DNA, 25 bp, Mus musculus
gatttttcaagtcgtggaattcaca

SEQ ID NO: 525547 - DNA, 25 bp, Mus musculus
gatttttcaagtggtggaattcaca

SEQ ID NO: 525548 - DNA, 25 bp, Mus musculus
gatttttcaataatccgtggtagcc

SEQ ID NO: 525549 - DNA, 25 bp, Mus musculus
gatttttcaatattccgtggtagcc

SEQ ID NO: 525550 - DNA, 25 bp, Mus musculus
gatttttcactaaagctcatgtaag

SEQ ID NO: 525551 - DNA, 25 bp, Mus musculus
gatttttcactatagctcatgtaag

SEQ ID NO: 525552 - DNA, 25 bp, Mus musculus
gatttttcagagagttgtgaaacct

SEQ ID NO: 525553 - DNA, 25 bp, Mus musculus
gatttttcagagtgttgtgaaacct

SEQ ID NO: 525554 - DNA, 25 bp, Mus musculus
gatttttcagctcctacagtataag

SEQ ID NO: 525555 - DNA, 25 bp, Mus musculus
gatttttcagctgctacagtataag

SEQ ID NO: 525556 - DNA, 25 bp, Mus musculus
gatttttccaatcatttgactaata

SEQ ID NO: 525557 - DNA, 25 bp, Mus musculus
gatttttccaatgatttgactaata

SEQ ID NO: 525558 - DNA, 25 bp, Mus musculus
gatttttccacaatcctatactcag

SEQ ID NO: 525559 - DNA, 25 bp, Mus musculus
gatttttccacattcctatactcag

SEQ ID NO: 525560 - DNA, 25 bp, Mus musculus
gatttttcccaacactcggtgttat

SEQ ID NO: 525561 - DNA, 25 bp, Mus musculus
gatttttcccaagactcggtgttat

SEQ ID NO: 525562 - DNA, 25 bp, Mus musculus
gatttttccccaaggatctcaaaat

SEQ ID NO: 525563 - DNA, 25 bp, Mus musculus
gatttttccccatggatctcaaaat

SEQ ID NO: 525564 - DNA, 25 bp, Mus musculus
gatttttcccgcagatttacagaga

SEQ ID NO: 525565 - DNA, 25 bp, Mus musculus
gatttttcccgctgatttacagaga

SEQ ID NO: 525566 - DNA, 25 bp, Mus musculus
gatttttccggaagttcacatagct

SEQ ID NO: 525567 - DNA, 25 bp, Mus musculus
gatttttccggatgttcacatagct

SEQ ID NO: 525568 - DNA, 25 bp, Mus musculus
gatttttccgtcaggtccaaggaag

SEQ ID NO: 525569 - DNA, 25 bp, Mus musculus
gatttttccgtctggtccaaggaag

SEQ ID NO: 525570 - DNA, 25 bp, Mus musculus
gatttttcctataatctctacatgt

SEQ ID NO: 525571 - DNA, 25 bp, Mus musculus
gatttttcctattatctctacatgt

SEQ ID NO: 525572 - DNA, 25 bp, Mus musculus
gatttttcctccatgtttgtcacat

SEQ ID NO: 525573 - DNA, 25 bp, Mus musculus
gatttttcctccttgtttgtcacat

SEQ ID NO: 525574 - DNA, 25 bp, Mus musculus
gatttttccttaaatgctcctcgga

SEQ ID NO: 525575 - DNA, 25 bp, Mus musculus
gatttttccttatatgctcctcgga

SEQ ID NO: 525576 - DNA, 25 bp, Mus musculus
gatttttccttcaatatgctttccc

SEQ ID NO: 525577 - DNA, 25 bp, Mus musculus
gatttttccttctatatgctttccc

SEQ ID NO: 525578 - DNA, 25 bp, Mus musculus
gatttttcgcatagtgcataattga

SEQ ID NO: 525579 - DNA, 25 bp, Mus musculus
gatttttcgcattgtgcataattga

SEQ ID NO: 525580 - DNA, 25 bp, Mus musculus
gatttttcggttccatttttgcact

SEQ ID NO: 525581 - DNA, 25 bp, Mus musculus
gatttttcggttgcatttttgcact

SEQ ID NO: 525582 - DNA, 25 bp, Mus musculus
gatttttcgtcccaacagtggaatg

SEQ ID NO: 525583 - DNA, 25 bp, Mus musculus
gatttttcgtccgaacagtggaatg

SEQ ID NO: 525584 - DNA, 25 bp, Mus musculus
gatttttctacaaccaaactgccaa

SEQ ID NO: 525585 - DNA, 25 bp, Mus musculus
gatttttctacatccaaactgccaa

SEQ ID NO: 525586 - DNA, 25 bp, Mus musculus
gatttttctacccatggagttgtga

SEQ ID NO: 525587 - DNA, 25 bp, Mus musculus
gatttttctaccgatggagttgtga

SEQ ID NO: 525588 - DNA, 25 bp, Mus musculus
gatttttctactccccagaattcgg

SEQ ID NO: 525589 - DNA, 25 bp, Mus musculus
gatttttctactgcccagaattcgg

SEQ ID NO: 525590 - DNA, 25 bp, Mus musculus
gatttttctagtagcctcagtttaa

SEQ ID NO: 525591 - DNA, 25 bp, Mus musculus
gatttttctagttgcctcagtttaa

SEQ ID NO: 525592 - DNA, 25 bp, Mus musculus
gatttttctattagacctcgagtgt

SEQ ID NO: 525593 - DNA, 25 bp, Mus musculus
gatttttctatttgacctcgagtgt

SEQ ID NO: 525594 - DNA, 25 bp, Mus musculus
gatttttctgagcactgtactggta

SEQ ID NO: 525595 - DNA, 25 bp, Mus musculus
gatttttctgaggactgtactggta

SEQ ID NO: 525596 - DNA, 25 bp, Mus musculus
gatttttctgcacgctccaatcaaa

SEQ ID NO: 525597 - DNA, 25 bp, Mus musculus
gatttttctgcaggctccaatcaaa

SEQ ID NO: 525598 - DNA, 25 bp, Mus musculus
gatttttctggaccacccaagactg

SEQ ID NO: 525599 - DNA, 25 bp, Mus musculus
gatttttctggagcacccaagactg

SEQ ID NO: 525600 - DNA, 25 bp, Mus musculus
gatttttctgtccaatttgctccct

SEQ ID NO: 525601 - DNA, 25 bp, Mus musculus
gatttttctgtcgaatttgctccct

SEQ ID NO: 525602 - DNA, 25 bp, Mus musculus
gatttttcttaactgggcctggtgt

SEQ ID NO: 525603 - DNA, 25 bp, Mus musculus
gatttttcttaagtgggcctggtgt

SEQ ID NO: 525604 - DNA, 25 bp, Mus musculus
gatttttcttacctcatatacctct

SEQ ID NO: 525605 - DNA, 25 bp, Mus musculus
gatttttcttacgtcatatacctct

SEQ ID NO: 525606 - DNA, 25 bp, Mus musculus
gatttttcttatccagtgggtggta

SEQ ID NO: 525607 - DNA, 25 bp, Mus musculus
gatttttcttatgcagtgggtggta

SEQ ID NO: 525608 - DNA, 25 bp, Mus musculus
gatttttcttccagaaatccctctc

SEQ ID NO: 525609 - DNA, 25 bp, Mus musculus
gatttttcttcctgaaatccctctc

SEQ ID NO: 525610 - DNA, 25 bp, Mus musculus
gatttttctttacggacatgacctt

SEQ ID NO: 525611 - DNA, 25 bp, Mus musculus
gatttttctttagggacatgacctt

SEQ ID NO: 525612 - DNA, 25 bp, Mus musculus
gatttttgagccagcgttgtctcac

SEQ ID NO: 525613 - DNA, 25 bp, Mus musculus
gatttttgagcctgcgttgtctcac

SEQ ID NO: 525614 - DNA, 25 bp, Mus musculus
gatttttgagttcagggcctgccta

SEQ ID NO: 525615 - DNA, 25 bp, Mus musculus
gatttttgagttgagggcctgccta

SEQ ID NO: 525616 - DNA, 25 bp, Mus musculus
gatttttgcagcagggactacccta

SEQ ID NO: 525617 - DNA, 25 bp, Mus musculus
gatttttgcagctgggactacccta

SEQ ID NO: 525618 - DNA, 25 bp, Mus musculus
gatttttgccagatagtagcccagc

SEQ ID NO: 525619 - DNA, 25 bp, Mus musculus
gatttttgccagttagtagcccagc

SEQ ID NO: 525620 - DNA, 25 bp, Mus musculus
gatttttgccggcattttgctgtat

SEQ ID NO: 525621 - DNA, 25 bp, Mus musculus
gatttttgccgggattttgctgtat

SEQ ID NO: 525622 - DNA, 25 bp, Mus musculus
gatttttgcctacagctgttctgga

SEQ ID NO: 525623 - DNA, 25 bp, Mus musculus
gatttttgcctagagctgttctgga

SEQ ID NO: 525624 - DNA, 25 bp, Mus musculus
gatttttgctacactcttatggata

SEQ ID NO: 525625 - DNA, 25 bp, Mus musculus
gatttttgctactctcttatggata

SEQ ID NO: 525626 - DNA, 25 bp, Mus musculus
gatttttgctttatatagaccatag

SEQ ID NO: 525627 - DNA, 25 bp, Mus musculus
gatttttgctttttatagaccatag

SEQ ID NO: 525628 - DNA, 25 bp, Mus musculus
gatttttggctaatctgccatccca

SEQ ID NO: 525629 - DNA, 25 bp, Mus musculus
gatttttggctattctgccatccca

SEQ ID NO: 525630 - DNA, 25 bp, Mus musculus
gatttttgggatatgcctggcacag

SEQ ID NO: 525631 - DNA, 25 bp, Mus musculus
gatttttgggatttgcctggcacag

SEQ ID NO: 525632 - DNA, 25 bp, Mus musculus
gatttttgggttactggtatgcttg

SEQ ID NO: 525633 - DNA, 25 bp, Mus musculus
gatttttgggtttctggtatgcttg

SEQ ID NO: 525634 - DNA, 25 bp, Mus musculus
gatttttggtctaataacgcatgct

SEQ ID NO: 525635 - DNA, 25 bp, Mus musculus
gatttttggtcttataacgcatgct

SEQ ID NO: 525636 - DNA, 25 bp, Mus musculus
gatttttgtaataactatcagtgca

SEQ ID NO: 525637 - DNA, 25 bp, Mus musculus
gatttttgtaatcggtgggctccca

SEQ ID NO: 525638 - DNA, 25 bp, Mus musculus
gatttttgtaatgggtgggctccca

SEQ ID NO: 525639 - DNA, 25 bp, Mus musculus
gatttttgtaattactatcagtgca

SEQ ID NO: 525640 - DNA, 25 bp, Mus musculus
gatttttgtcaaactctgctctcac

SEQ ID NO: 525641 - DNA, 25 bp, Mus musculus
gatttttgtcaatctctgctctcac

SEQ ID NO: 525642 - DNA, 25 bp, Mus musculus
gatttttgtccacttggtcatcttc

SEQ ID NO: 525643 - DNA, 25 bp, Mus musculus
gatttttgtccagttggtcatcttc

SEQ ID NO: 525644 - DNA, 25 bp, Mus musculus
gatttttgtctgagaggtacccctt

SEQ ID NO: 525645 - DNA, 25 bp, Mus musculus
gatttttgtctgtgaggtacccctt

SEQ ID NO: 525646 - DNA, 25 bp, Mus musculus
gatttttgtcttcagttgttgttgt

SEQ ID NO: 525647 - DNA, 25 bp, Mus musculus
gatttttgtcttgagttgttgttgt

SEQ ID NO: 525648 - DNA, 25 bp, Mus musculus
gatttttgtgagatgcctggtctac

SEQ ID NO: 525649 - DNA, 25 bp, Mus musculus
gatttttgtgagttgcctggtctac

SEQ ID NO: 525650 - DNA, 25 bp, Mus musculus
gatttttgtgtgctgagattccaac

SEQ ID NO: 525651 - DNA, 25 bp, Mus musculus
gatttttgtgtggtgagattccaac

SEQ ID NO: 525652 - DNA, 25 bp, Mus musculus
gatttttgttatacttggttcttgg

SEQ ID NO: 525653 - DNA, 25 bp, Mus musculus
gatttttgttattcttggttcttgg

SEQ ID NO: 525654 - DNA, 25 bp, Mus musculus
gattttttaatcatgccaacaagca

SEQ ID NO: 525655 - DNA, 25 bp, Mus musculus
gattttttaatcttgccaacaagca

SEQ ID NO: 525656 - DNA, 25 bp, Mus musculus
gattttttaatgcagctctttctct

SEQ ID NO: 525657 - DNA, 25 bp, Mus musculus
gattttttaatggagctctttctct

SEQ ID NO: 525658 - DNA, 25 bp, Mus musculus
gattttttcacaacgttccaagcac

SEQ ID NO: 525659 - DNA, 25 bp, Mus musculus
gattttttcacatcgttccaagcac

SEQ ID NO: 525660 - DNA, 25 bp, Mus musculus
gattttttcacgaaagttcgcatat

SEQ ID NO: 525661 - DNA, 25 bp, Mus musculus
gattttttcacgtaagttcgcatat

SEQ ID NO: 525662 - DNA, 25 bp, Mus musculus
gattttttcatgcaatatgtgctaa

SEQ ID NO: 525663 - DNA, 25 bp, Mus musculus
gattttttcatggaatatgtgctaa

SEQ ID NO: 525664 - DNA, 25 bp, Mus musculus
gattttttccaaatagcaactcatg

SEQ ID NO: 525665 - DNA, 25 bp, Mus musculus
gattttttccaattagcaactcatg

SEQ ID NO: 525666 - DNA, 25 bp, Mus musculus
gattttttccagataagcttaataa

SEQ ID NO: 525667 - DNA, 25 bp, Mus musculus
gattttttccagttaagcttaataa

SEQ ID NO: 525668 - DNA, 25 bp, Mus musculus
gattttttctcccatagtagctaag

SEQ ID NO: 525669 - DNA, 25 bp, Mus musculus
gattttttctccgatagtagctaag

SEQ ID NO: 525670 - DNA, 25 bp, Mus musculus
gattttttgaatcggcagacctgtc

SEQ ID NO: 525671 - DNA, 25 bp, Mus musculus
gattttttgaatgggcagacctgtc

SEQ ID NO: 525672 - DNA, 25 bp, Mus musculus
gattttttgataatccgcggtccca

SEQ ID NO: 525673 - DNA, 25 bp, Mus musculus
gattttttgatattccgcggtccca

SEQ ID NO: 525674 - DNA, 25 bp, Mus musculus
gattttttgcctactcagtaactga

SEQ ID NO: 525675 - DNA, 25 bp, Mus musculus
gattttttgccttctcagtaactga

SEQ ID NO: 525676 - DNA, 25 bp, Mus musculus
gattttttgctactgttttttatga

SEQ ID NO: 525677 - DNA, 25 bp, Mus musculus
gattttttgctagtgttttttatga

SEQ ID NO: 525678 - DNA, 25 bp, Mus musculus
gattttttgtaccaacctggatctc

SEQ ID NO: 525679 - DNA, 25 bp, Mus musculus
gattttttgtacgaacctggatctc

SEQ ID NO: 525680 - DNA, 25 bp, Mus musculus
gcaaaaaacatgctcattctgtgaa

SEQ ID NO: 525681 - DNA, 25 bp, Mus musculus
gcaaaaaacatggtcattctgtgaa

SEQ ID NO: 525682 - DNA, 25 bp, Mus musculus
gcaaaaaagattctgtctggaccag

SEQ ID NO: 525683 - DNA, 25 bp, Mus musculus
gcaaaaaagattgtgtctggaccag

SEQ ID NO: 525684 - DNA, 25 bp, Mus musculus
gcaaaaaaggccctattccaactcg

SEQ ID NO: 525685 - DNA, 25 bp, Mus musculus
gcaaaaaaggccgtattccaactcg

SEQ ID NO: 525686 - DNA, 25 bp, Mus musculus
gcaaaaacctagacaaaaaattctg

SEQ ID NO: 525687 - DNA, 25 bp, Mus musculus
gcaaaaacctagtcaaaaaattctg

SEQ ID NO: 525688 - DNA, 25 bp, Mus musculus
gcaaaaactcacaatcataagggaa

SEQ ID NO: 525689 - DNA, 25 bp, Mus musculus
gcaaaaactcactatcataagggaa

SEQ ID NO: 525690 - DNA, 25 bp, Mus musculus
gcaaaaagcaatagaagcctcgccc

SEQ ID NO: 525691 - DNA, 25 bp, Mus musculus
gcaaaaagcaattgaagcctcgccc

SEQ ID NO: 525692 - DNA, 25 bp, Mus musculus
gcaaaaagcgccacaatgaccggat

SEQ ID NO: 525693 - DNA, 25 bp, Mus musculus
gcaaaaagcgcctcaatgaccggat

SEQ ID NO: 525694 - DNA, 25 bp, Mus musculus
gcaaaaagcgctctcctaggaaaca

SEQ ID NO: 525695 - DNA, 25 bp, Mus musculus
gcaaaaagcgctgtcctaggaaaca

SEQ ID NO: 525696 - DNA, 25 bp, Mus musculus
gcaaaaagcggccaatacctcggga

SEQ ID NO: 525697 - DNA, 25 bp, Mus musculus
gcaaaaagcggcgaatacctcggga

SEQ ID NO: 525698 - DNA, 25 bp, Mus musculus
gcaaaaagtaccacttcttcaaagt

SEQ ID NO: 525699 - DNA, 25 bp, Mus musculus
gcaaaaagtacctcttcttcaaagt

SEQ ID NO: 525700 - DNA, 25 bp, Mus musculus
gcaaaaagtggtccctcggcggaca

SEQ ID NO: 525701 - DNA, 25 bp, Mus musculus
gcaaaaagtggtgcctcggcggaca

SEQ ID NO: 525702 - DNA, 25 bp, Mus musculus
gcaaaaatcctaccctgatgttatg

SEQ ID NO: 525703 - DNA, 25 bp, Mus musculus
gcaaaaatcctagcctgatgttatg

SEQ ID NO: 525704 - DNA, 25 bp, Mus musculus
gcaaaaatgaccagatgtttttcca

SEQ ID NO: 525705 - DNA, 25 bp, Mus musculus
gcaaaaatgacctgatgtttttcca

SEQ ID NO: 525706 - DNA, 25 bp, Mus musculus
gcaaaaatgtgaaccgctcgcagac

SEQ ID NO: 525707 - DNA, 25 bp, Mus musculus
gcaaaaatgtgatccgctcgcagac

SEQ ID NO: 525708 - DNA, 25 bp, Mus musculus
gcaaaaatgtggacccggtgtacga

SEQ ID NO: 525709 - DNA, 25 bp, Mus musculus
gcaaaaatgtggtcccggtgtacga

SEQ ID NO: 525710 - DNA, 25 bp, Mus musculus
gcaaaaattcatcctgttagtacaa

SEQ ID NO: 525711 - DNA, 25 bp, Mus musculus
gcaaaaattcatgctgttagtacaa

SEQ ID NO: 525712 - DNA, 25 bp, Mus musculus
gcaaaacactaccactaacaacaac

SEQ ID NO: 525713 - DNA, 25 bp, Mus musculus
gcaaaacactacgactaacaacaac

SEQ ID NO: 525714 - DNA, 25 bp, Mus musculus
gcaaaacactcactactttgaaaaa

SEQ ID NO: 525715 - DNA, 25 bp, Mus musculus
gcaaaacactcagtactttgaaaaa

SEQ ID NO: 525716 - DNA, 25 bp, Mus musculus
gcaaaacagcttaagaactcacgga

SEQ ID NO: 525717 - DNA, 25 bp, Mus musculus
gcaaaacagctttagaactcacgga

SEQ ID NO: 525718 - DNA, 25 bp, Mus musculus
gcaaaacaggctctagcgttcgaac

SEQ ID NO: 525719 - DNA, 25 bp, Mus musculus
gcaaaacaggctgtagcgttcgaac

SEQ ID NO: 525720 - DNA, 25 bp, Mus musculus
gcaaaacatcccagattaccacggc

SEQ ID NO: 525721 - DNA, 25 bp, Mus musculus
gcaaaacatccctgattaccacggc

SEQ ID NO: 525722 - DNA, 25 bp, Mus musculus
gcaaaacatgaaagagggactcctt

SEQ ID NO: 525723 - DNA, 25 bp, Mus musculus
gcaaaacatgaatgagggactcctt

SEQ ID NO: 525724 - DNA, 25 bp, Mus musculus
gcaaaacccaggaccaagaaatatc

SEQ ID NO: 525725 - DNA, 25 bp, Mus musculus
gcaaaacccaggtccaagaaatatc

SEQ ID NO: 525726 - DNA, 25 bp, Mus musculus
gcaaaacccctcaggaaggtgcttt

SEQ ID NO: 525727 - DNA, 25 bp, Mus musculus
gcaaaacccctctggaaggtgcttt

SEQ ID NO: 525728 - DNA, 25 bp, Mus musculus
gcaaaaccctttcattagtcttcag

SEQ ID NO: 525729 - DNA, 25 bp, Mus musculus
gcaaaaccctttgattagtcttcag

SEQ ID NO: 525730 - DNA, 25 bp, Mus musculus
gcaaaaccgcccattcctagtattt

SEQ ID NO: 525731 - DNA, 25 bp, Mus musculus
gcaaaaccgccctttcctagtattt

SEQ ID NO: 525732 - DNA, 25 bp, Mus musculus
gcaaaaccgggacaaacgcttcacg

SEQ ID NO: 525733 - DNA, 25 bp, Mus musculus
gcaaaaccgggagaaacgcttcacg

SEQ ID NO: 525734 - DNA, 25 bp, Mus musculus
gcaaaaccgtctatccttgaatact

SEQ ID NO: 525735 - DNA, 25 bp, Mus musculus
gcaaaaccgtctttccttgaatact

SEQ ID NO: 525736 - DNA, 25 bp, Mus musculus
gcaaaacctacactaagctcagaaa

SEQ ID NO: 525737 - DNA, 25 bp, Mus musculus
gcaaaacctacagtaagctcagaaa

SEQ ID NO: 525738 - DNA, 25 bp, Mus musculus
gcaaaacctcaaagggctgaccagt

SEQ ID NO: 525739 - DNA, 25 bp, Mus musculus
gcaaaacctcaatgggctgaccagt

SEQ ID NO: 525740 - DNA, 25 bp, Mus musculus
gcaaaacctcacactgtgttctggg

SEQ ID NO: 525741 - DNA, 25 bp, Mus musculus
gcaaaacctcactctgtgttctggg

SEQ ID NO: 525742 - DNA, 25 bp, Mus musculus
gcaaaacctcttatgctgggctctg

SEQ ID NO: 525743 - DNA, 25 bp, Mus musculus
gcaaaacctcttttgctgggctctg

SEQ ID NO: 525744 - DNA, 25 bp, Mus musculus
gcaaaacctggaaattcaccggaag

SEQ ID NO: 525745 - DNA, 25 bp, Mus musculus
gcaaaacctggatattcaccggaag

SEQ ID NO: 525746 - DNA, 25 bp, Mus musculus
gcaaaacctgtgcaggacttgtgat

SEQ ID NO: 525747 - DNA, 25 bp, Mus musculus
gcaaaacctgtggaggacttgtgat

SEQ ID NO: 525748 - DNA, 25 bp, Mus musculus
gcaaaacgactgcaggtcaacatat

SEQ ID NO: 525749 - DNA, 25 bp, Mus musculus
gcaaaacgactggaggtcaacatat

SEQ ID NO: 525750 - DNA, 25 bp, Mus musculus
gcaaaacgtcagcacatgtagtcag

SEQ ID NO: 525751 - DNA, 25 bp, Mus musculus
gcaaaacgtcaggacatgtagtcag

SEQ ID NO: 525752 - DNA, 25 bp, Mus musculus
gcaaaacgttggcagccacctgtaa

SEQ ID NO: 525753 - DNA, 25 bp, Mus musculus
gcaaaacgttgggagccacctgtaa

SEQ ID NO: 525754 - DNA, 25 bp, Mus musculus
gcaaaacgtttaatgttcgtcagct

SEQ ID NO: 525755 - DNA, 25 bp, Mus musculus
gcaaaacgtttattgttcgtcagct

SEQ ID NO: 525756 - DNA, 25 bp, Mus musculus
gcaaaactcactcatctataatccc

SEQ ID NO: 525757 - DNA, 25 bp, Mus musculus
gcaaaactcactgatctataatccc

SEQ ID NO: 525758 - DNA, 25 bp, Mus musculus
gcaaaactgattactcccttctggg

SEQ ID NO: 525759 - DNA, 25 bp, Mus musculus
gcaaaactgatttctcccttctggg

SEQ ID NO: 525760 - DNA, 25 bp, Mus musculus
gcaaaactgctaaccaagacccgga

SEQ ID NO: 525761 - DNA, 25 bp, Mus musculus
gcaaaactgctatccaagacccgga

SEQ ID NO: 525762 - DNA, 25 bp, Mus musculus
gcaaaactggccacctgctaccatt

SEQ ID NO: 525763 - DNA, 25 bp, Mus musculus
gcaaaactggcctcctgctaccatt

SEQ ID NO: 525764 - DNA, 25 bp, Mus musculus
gcaaaactgtatcctgttgttgttg

SEQ ID NO: 525765 - DNA, 25 bp, Mus musculus
gcaaaactgtatgctgttgttgttg

SEQ ID NO: 525766 - DNA, 25 bp, Mus musculus
gcaaaactgtctcgcttgggtcagc

SEQ ID NO: 525767 - DNA, 25 bp, Mus musculus
gcaaaactgtctggcttgggtcagc

SEQ ID NO: 525768 - DNA, 25 bp, Mus musculus
gcaaaacttatcagacctactttcc

SEQ ID NO: 525769 - DNA, 25 bp, Mus musculus
gcaaaacttatctgacctactttcc

SEQ ID NO: 525770 - DNA, 25 bp, Mus musculus
gcaaaacttgaaagaatctgattta

SEQ ID NO: 525771 - DNA, 25 bp, Mus musculus
gcaaaacttgaatgaatctgattta

SEQ ID NO: 525772 - DNA, 25 bp, Mus musculus
gcaaaactttcaattcttctattca

SEQ ID NO: 525773 - DNA, 25 bp, Mus musculus
gcaaaactttcatttcttctattca

SEQ ID NO: 525774 - DNA, 25 bp, Mus musculus
gcaaaactttgaaaacctggactag

SEQ ID NO: 525775 - DNA, 25 bp, Mus musculus
gcaaaactttgataacctggactag

SEQ ID NO: 525776 - DNA, 25 bp, Mus musculus
gcaaaagaaactctctgtgctgctc

SEQ ID NO: 525777 - DNA, 25 bp, Mus musculus
gcaaaagaaactgtctgtgctgctc

SEQ ID NO: 525778 - DNA, 25 bp, Mus musculus
gcaaaagacattccaggccctgagt

SEQ ID NO: 525779 - DNA, 25 bp, Mus musculus
gcaaaagacattgcaggccctgagt

SEQ ID NO: 525780 - DNA, 25 bp, Mus musculus
gcaaaagaccgaactctcagcacag

SEQ ID NO: 525781 - DNA, 25 bp, Mus musculus
gcaaaagaccgatctctcagcacag

SEQ ID NO: 525782 - DNA, 25 bp, Mus musculus
gcaaaagagaacatcccagaagttg

SEQ ID NO: 525783 - DNA, 25 bp, Mus musculus
gcaaaagagaacttcccagaagttg

SEQ ID NO: 525784 - DNA, 25 bp, Mus musculus
gcaaaagagacacagtggccagact

SEQ ID NO: 525785 - DNA, 25 bp, Mus musculus
gcaaaagagacagagtggccagact

SEQ ID NO: 525786 - DNA, 25 bp, Mus musculus
gcaaaagagacgatgccagcagaca

SEQ ID NO: 525787 - DNA, 25 bp, Mus musculus
gcaaaagagacgttgccagcagaca

SEQ ID NO: 525788 - DNA, 25 bp, Mus musculus
gcaaaagatgatcccttcctcctaa

SEQ ID NO: 525789 - DNA, 25 bp, Mus musculus
gcaaaagatgatgccttcctcctaa

SEQ ID NO: 525790 - DNA, 25 bp, Mus musculus
gcaaaagcagcaccacctaagcggg

SEQ ID NO: 525791 - DNA, 25 bp, Mus musculus
gcaaaagcagcagcacctaagcggg

SEQ ID NO: 525792 - DNA, 25 bp, Mus musculus
gcaaaagcagtgagggatgccctga

SEQ ID NO: 525793 - DNA, 25 bp, Mus musculus
gcaaaagcagtgtgggatgccctga

SEQ ID NO: 525794 - DNA, 25 bp, Mus musculus
gcaaaagcatttcctaccaagcctg

SEQ ID NO: 525795 - DNA, 25 bp, Mus musculus
gcaaaagcatttgctaccaagcctg

SEQ ID NO: 525796 - DNA, 25 bp, Mus musculus
gcaaaagcccagatgtctatgaagt

SEQ ID NO: 525797 - DNA, 25 bp, Mus musculus
gcaaaagcccagttgtctatgaagt

SEQ ID NO: 525798 - DNA, 25 bp, Mus musculus
gcaaaagcccgacactagctattaa

SEQ ID NO: 525799 - DNA, 25 bp, Mus musculus
gcaaaagcccgagactagctattaa

SEQ ID NO: 525800 - DNA, 25 bp, Mus musculus
gcaaaagcctgacaccttggctact

SEQ ID NO: 525801 - DNA, 25 bp, Mus musculus
gcaaaagcctgagaccttggctact

SEQ ID NO: 525802 - DNA, 25 bp, Mus musculus
gcaaaagctggtctatttctgtatc

SEQ ID NO: 525803 - DNA, 25 bp, Mus musculus
gcaaaagctggtgtatttctgtatc

SEQ ID NO: 525804 - DNA, 25 bp, Mus musculus
gcaaaagcttgcaaactccttgcgc

SEQ ID NO: 525805 - DNA, 25 bp, Mus musculus
gcaaaagcttgctaactccttgcgc

SEQ ID NO: 525806 - DNA, 25 bp, Mus musculus
gcaaaagcttttcagcgctgtccaa

SEQ ID NO: 525807 - DNA, 25 bp, Mus musculus
gcaaaagcttttgagcgctgtccaa

SEQ ID NO: 525808 - DNA, 25 bp, Mus musculus
gcaaaaggaacaaagcctggagcct

SEQ ID NO: 525809 - DNA, 25 bp, Mus musculus
gcaaaaggaacatagcctggagcct

SEQ ID NO: 525810 - DNA, 25 bp, Mus musculus
gcaaaaggaattattcgcctacaga

SEQ ID NO: 525811 - DNA, 25 bp, Mus musculus
gcaaaaggaatttttcgcctacaga

SEQ ID NO: 525812 - DNA, 25 bp, Mus musculus
gcaaaaggacccacatttcacgtac

SEQ ID NO: 525813 - DNA, 25 bp, Mus musculus
gcaaaaggaccctcatttcacgtac

SEQ ID NO: 525814 - DNA, 25 bp, Mus musculus
gcaaaaggagaaccccttcgctgca

SEQ ID NO: 525815 - DNA, 25 bp, Mus musculus
gcaaaaggagaagcccttcgctgca

SEQ ID NO: 525816 - DNA, 25 bp, Mus musculus
gcaaaaggagacaagctggcacggt

SEQ ID NO: 525817 - DNA, 25 bp, Mus musculus
gcaaaaggagactagctggcacggt

SEQ ID NO: 525818 - DNA, 25 bp, Mus musculus
gcaaaaggcactacagcgtcaagaa

SEQ ID NO: 525819 - DNA, 25 bp, Mus musculus
gcaaaaggcacttcagcgtcaagaa

SEQ ID NO: 525820 - DNA, 25 bp, Mus musculus
gcaaaaggcgagaccctgcttccag

SEQ ID NO: 525821 - DNA, 25 bp, Mus musculus
gcaaaaggcgagtccctgcttccag

SEQ ID NO: 525822 - DNA, 25 bp, Mus musculus
gcaaaaggcggactgaccccaactt

SEQ ID NO: 525823 - DNA, 25 bp, Mus musculus
gcaaaaggcggagtgaccccaactt

SEQ ID NO: 525824 - DNA, 25 bp, Mus musculus
gcaaaaggctccaccagtaaattct

SEQ ID NO: 525825 - DNA, 25 bp, Mus musculus
gcaaaaggctcctccagtaaattct

SEQ ID NO: 525826 - DNA, 25 bp, Mus musculus
gcaaaaggtgggacttgagccgctt

SEQ ID NO: 525827 - DNA, 25 bp, Mus musculus
gcaaaaggtgggtcttgagccgctt

SEQ ID NO: 525828 - DNA, 25 bp, Mus musculus
gcaaaaggtgtgagagcccaactca

SEQ ID NO: 525829 - DNA, 25 bp, Mus musculus
gcaaaaggtgtgtgagcccaactca

SEQ ID NO: 525830 - DNA, 25 bp, Mus musculus
gcaaaaggtttacctcccagtgcct

SEQ ID NO: 525831 - DNA, 25 bp, Mus musculus
gcaaaaggtttagctcccagtgcct

SEQ ID NO: 525832 - DNA, 25 bp, Mus musculus
gcaaaagtaaccattacaggcatga

SEQ ID NO: 525833 - DNA, 25 bp, Mus musculus
gcaaaagtaacctttacaggcatga

SEQ ID NO: 525834 - DNA, 25 bp, Mus musculus
gcaaaagtacgaaggctttctccaa

SEQ ID NO: 525835 - DNA, 25 bp, Mus musculus
gcaaaagtacgatggctttctccaa

SEQ ID NO: 525836 - DNA, 25 bp, Mus musculus
gcaaaagtcattccccttccttaac

SEQ ID NO: 525837 - DNA, 25 bp, Mus musculus
gcaaaagtcattgcccttccttaac

SEQ ID NO: 525838 - DNA, 25 bp, Mus musculus
gcaaaagtctgtataatatttcccc

SEQ ID NO: 525839 - DNA, 25 bp, Mus musculus
gcaaaagtctgtttaatatttcccc

SEQ ID NO: 525840 - DNA, 25 bp, Mus musculus
gcaaaagtgagcaccccaggccaat

SEQ ID NO: 525841 - DNA, 25 bp, Mus musculus
gcaaaagtgagctccccaggccaat

SEQ ID NO: 525842 - DNA, 25 bp, Mus musculus
gcaaaagtgtagattctctcttctt

SEQ ID NO: 525843 - DNA, 25 bp, Mus musculus
gcaaaagtgtagtttctctcttctt

SEQ ID NO: 525844 - DNA, 25 bp, Mus musculus
gcaaaagttaacatgtaggccaagt

SEQ ID NO: 525845 - DNA, 25 bp, Mus musculus
gcaaaagttaacttgtaggccaagt

SEQ ID NO: 525846 - DNA, 25 bp, Mus musculus
gcaaaagttatgcacactcaggcct

SEQ ID NO: 525847 - DNA, 25 bp, Mus musculus
gcaaaagttatggacactcaggcct

SEQ ID NO: 525848 - DNA, 25 bp, Mus musculus
gcaaaagttcttagtactatgtcag

SEQ ID NO: 525849 - DNA, 25 bp, Mus musculus
gcaaaagttctttgtactatgtcag

SEQ ID NO: 525850 - DNA, 25 bp, Mus musculus
gcaaaagttggactcgcagctcgct

SEQ ID NO: 525851 - DNA, 25 bp, Mus musculus
gcaaaagttggagtcgcagctcgct

SEQ ID NO: 525852 - DNA, 25 bp, Mus musculus
gcaaaataactcaggatctcatggc

SEQ ID NO: 525853 - DNA, 25 bp, Mus musculus
gcaaaataactctggatctcatggc

SEQ ID NO: 525854 - DNA, 25 bp, Mus musculus
gcaaaataatcaatctgttcataga

SEQ ID NO: 525855 - DNA, 25 bp, Mus musculus
gcaaaataatcattctgttcataga

SEQ ID NO: 525856 - DNA, 25 bp, Mus musculus
gcaaaataatgcaagcacatgacat

SEQ ID NO: 525857 - DNA, 25 bp, Mus musculus
gcaaaataatgctagcacatgacat

SEQ ID NO: 525858 - DNA, 25 bp, Mus musculus
gcaaaatacaaactctggccctcgc

SEQ ID NO: 525859 - DNA, 25 bp, Mus musculus
gcaaaatacaaagtctggccctcgc

SEQ ID NO: 525860 - DNA, 25 bp, Mus musculus
gcaaaatacacaactctcggaactt

SEQ ID NO: 525861 - DNA, 25 bp, Mus musculus
gcaaaatacacatctctcggaactt

SEQ ID NO: 525862 - DNA, 25 bp, Mus musculus
gcaaaatactgcaaaccttccaaag

SEQ ID NO: 525863 - DNA, 25 bp, Mus musculus
gcaaaatactgctaaccttccaaag

SEQ ID NO: 525864 - DNA, 25 bp, Mus musculus
gcaaaatagccaattgcttctgaaa

SEQ ID NO: 525865 - DNA, 25 bp, Mus musculus
gcaaaatagccatttgcttctgaaa

SEQ ID NO: 525866 - DNA, 25 bp, Mus musculus
gcaaaatagcttccatctcagtcaa

SEQ ID NO: 525867 - DNA, 25 bp, Mus musculus
gcaaaatagcttgcatctcagtcaa

SEQ ID NO: 525868 - DNA, 25 bp, Mus musculus
gcaaaatcaaacaacaacctcaaac

SEQ ID NO: 525869 - DNA, 25 bp, Mus musculus
gcaaaatcaaactacaacctcaaac

SEQ ID NO: 525870 - DNA, 25 bp, Mus musculus
gcaaaatcaaataattcggcgcccc

SEQ ID NO: 525871 - DNA, 25 bp, Mus musculus
gcaaaatcaaattattcggcgcccc

SEQ ID NO: 525872 - DNA, 25 bp, Mus musculus
gcaaaatcaccacgctttagagaca

SEQ ID NO: 525873 - DNA, 25 bp, Mus musculus
gcaaaatcaccaggctttagagaca

SEQ ID NO: 525874 - DNA, 25 bp, Mus musculus
gcaaaatcagacagatcagatctct

SEQ ID NO: 525875 - DNA, 25 bp, Mus musculus
gcaaaatcagactgatcagatctct

SEQ ID NO: 525876 - DNA, 25 bp, Mus musculus
gcaaaatcagtgctgcctaggttac

SEQ ID NO: 525877 - DNA, 25 bp, Mus musculus
gcaaaatcagtggtgcctaggttac

SEQ ID NO: 525878 - DNA, 25 bp, Mus musculus
gcaaaatcatctaccaccgcaaact

SEQ ID NO: 525879 - DNA, 25 bp, Mus musculus
gcaaaatcatcttccaccgcaaact

SEQ ID NO: 525880 - DNA, 25 bp, Mus musculus
gcaaaatccccacaaagcttacttt

SEQ ID NO: 525881 - DNA, 25 bp, Mus musculus
gcaaaatccccagaaagcttacttt

SEQ ID NO: 525882 - DNA, 25 bp, Mus musculus
gcaaaatccgagaggccaacaagct

SEQ ID NO: 525883 - DNA, 25 bp, Mus musculus
gcaaaatccgagtggccaacaagct

SEQ ID NO: 525884 - DNA, 25 bp, Mus musculus
gcaaaatctatgactttactgtcct

SEQ ID NO: 525885 - DNA, 25 bp, Mus musculus
gcaaaatctatgtctttactgtcct

SEQ ID NO: 525886 - DNA, 25 bp, Mus musculus
gcaaaatctccacggcaaggccagc

SEQ ID NO: 525887 - DNA, 25 bp, Mus musculus
gcaaaatctccagggcaaggccagc

SEQ ID NO: 525888 - DNA, 25 bp, Mus musculus
gcaaaatcttataatcctcttactg

SEQ ID NO: 525889 - DNA, 25 bp, Mus musculus
gcaaaatcttattatcctcttactg

SEQ ID NO: 525890 - DNA, 25 bp, Mus musculus
gcaaaatgacttaactgtacctccg

SEQ ID NO: 525891 - DNA, 25 bp, Mus musculus
gcaaaatgactttactgtacctccg

SEQ ID NO: 525892 - DNA, 25 bp, Mus musculus
gcaaaatgagttatcccacagtaat

SEQ ID NO: 525893 - DNA, 25 bp, Mus musculus
gcaaaatgagttttcccacagtaat

SEQ ID NO: 525894 - DNA, 25 bp, Mus musculus
gcaaaatgatcaagcccttcttcca

SEQ ID NO: 525895 - DNA, 25 bp, Mus musculus
gcaaaatgatcatgcccttcttcca

SEQ ID NO: 525896 - DNA, 25 bp, Mus musculus
gcaaaatgatctcttttacccttaa

SEQ ID NO: 525897 - DNA, 25 bp, Mus musculus
gcaaaatgatctgttttacccttaa

SEQ ID NO: 525898 - DNA, 25 bp, Mus musculus
gcaaaatgccttaattgaaccagaa

SEQ ID NO: 525899 - DNA, 25 bp, Mus musculus
gcaaaatgcctttattgaaccagaa

SEQ ID NO: 525900 - DNA, 25 bp, Mus musculus
gcaaaatgcgggctcgttgtaatta

SEQ ID NO: 525901 - DNA, 25 bp, Mus musculus
gcaaaatgcggggtcgttgtaatta

SEQ ID NO: 525902 - DNA, 25 bp, Mus musculus
gcaaaatgctaaatacatctctagt

SEQ ID NO: 525903 - DNA, 25 bp, Mus musculus
gcaaaatgctaattacatctctagt

SEQ ID NO: 525904 - DNA, 25 bp, Mus musculus
gcaaaatggacaagggatcctcctt

SEQ ID NO: 525905 - DNA, 25 bp, Mus musculus
gcaaaatggacatgggatcctcctt

SEQ ID NO: 525906 - DNA, 25 bp, Mus musculus
gcaaaatggctacagcaaggacaag

SEQ ID NO: 525907 - DNA, 25 bp, Mus musculus
gcaaaatggctagagcaaggacaag

SEQ ID NO: 525908 - DNA, 25 bp, Mus musculus
gcaaaatgggcgaatagtctacaga

SEQ ID NO: 525909 - DNA, 25 bp, Mus musculus
gcaaaatgggcgtatagtctacaga

SEQ ID NO: 525910 - DNA, 25 bp, Mus musculus
gcaaaatgtttgcttcttttttcaa

SEQ ID NO: 525911 - DNA, 25 bp, Mus musculus
gcaaaatgtttggttcttttttcaa

SEQ ID NO: 525912 - DNA, 25 bp, Mus musculus
gcaaaattaaaccaacaaatggcca

SEQ ID NO: 525913 - DNA, 25 bp, Mus musculus
gcaaaattaaacgaacaaatggcca

SEQ ID NO: 525914 - DNA, 25 bp, Mus musculus
gcaaaattatcaatcacagggcata

SEQ ID NO: 525915 - DNA, 25 bp, Mus musculus
gcaaaattatcattcacagggcata

SEQ ID NO: 525916 - DNA, 25 bp, Mus musculus
gcaaaattcctcatcatgctaggct

SEQ ID NO: 525917 - DNA, 25 bp, Mus musculus
gcaaaattcctcttcatgctaggct

SEQ ID NO: 525918 - DNA, 25 bp, Mus musculus
gcaaaattctttactgtcaggttgt

SEQ ID NO: 525919 - DNA, 25 bp, Mus musculus
gcaaaattcttttctgtcaggttgt

SEQ ID NO: 525920 - DNA, 25 bp, Mus musculus
gcaaaattgtaaagtagcttgtgaa

SEQ ID NO: 525921 - DNA, 25 bp, Mus musculus
gcaaaattgtaatgtagcttgtgaa

SEQ ID NO: 525922 - DNA, 25 bp, Mus musculus
gcaaaatttgcaaagtcatacccca

SEQ ID NO: 525923 - DNA, 25 bp, Mus musculus
gcaaaatttgcatagtcatacccca

SEQ ID NO: 525924 - DNA, 25 bp, Mus musculus
gcaaaattttccagtgattaccagt

SEQ ID NO: 525925 - DNA, 25 bp, Mus musculus
gcaaaattttcctgtgattaccagt

SEQ ID NO: 525926 - DNA, 25 bp, Mus musculus
gcaaacaaaactagctttacttgag

SEQ ID NO: 525927 - DNA, 25 bp, Mus musculus
gcaaacaaaacttgctttacttgag

SEQ ID NO: 525928 - DNA, 25 bp, Mus musculus
gcaaacaaatcaagatggacggctc

SEQ ID NO: 525929 - DNA, 25 bp, Mus musculus
gcaaacaaatcatgatggacggctc

SEQ ID NO: 525930 - DNA, 25 bp, Mus musculus
gcaaacaacactaactgaggtcact

SEQ ID NO: 525931 - DNA, 25 bp, Mus musculus
gcaaacaacacttactgaggtcact

SEQ ID NO: 525932 - DNA, 25 bp, Mus musculus
gcaaacaacccaagtgtaactctgt

SEQ ID NO: 525933 - DNA, 25 bp, Mus musculus
gcaaacaacccatgtgtaactctgt

SEQ ID NO: 525934 - DNA, 25 bp, Mus musculus
gcaaacaaccctcagaagaactgag

SEQ ID NO: 525935 - DNA, 25 bp, Mus musculus
gcaaacaaccctgagaagaactgag

SEQ ID NO: 525936 - DNA, 25 bp, Mus musculus
gcaaacaagactcctgttctttcct

SEQ ID NO: 525937 - DNA, 25 bp, Mus musculus
gcaaacaagactgctgttctttcct

SEQ ID NO: 525938 - DNA, 25 bp, Mus musculus
gcaaacaaggtacaaaatcgcccta

SEQ ID NO: 525939 - DNA, 25 bp, Mus musculus
gcaaacaaggtagaaaatcgcccta

SEQ ID NO: 525940 - DNA, 25 bp, Mus musculus
gcaaacaaggtcactcggccggaga

SEQ ID NO: 525941 - DNA, 25 bp, Mus musculus
gcaaacaaggtctctcggccggaga

SEQ ID NO: 525942 - DNA, 25 bp, Mus musculus
gcaaacaatcaaacccagcataaat

SEQ ID NO: 525943 - DNA, 25 bp, Mus musculus
gcaaacaatcaatcccagcataaat

SEQ ID NO: 525944 - DNA, 25 bp, Mus musculus
gcaaacaatgcaaatgtacttcctg

SEQ ID NO: 525945 - DNA, 25 bp, Mus musculus
gcaaacaatgcatatgtacttcctg

SEQ ID NO: 525946 - DNA, 25 bp, Mus musculus
gcaaacaatgctagccttcttttaa

SEQ ID NO: 525947 - DNA, 25 bp, Mus musculus
gcaaacaatgcttgccttcttttaa

SEQ ID NO: 525948 - DNA, 25 bp, Mus musculus
gcaaacaattgcatggccacgaagt

SEQ ID NO: 525949 - DNA, 25 bp, Mus musculus
gcaaacaattgcttggccacgaagt

SEQ ID NO: 525950 - DNA, 25 bp, Mus musculus
gcaaacacaagtctaagtcccgatc

SEQ ID NO: 525951 - DNA, 25 bp, Mus musculus
gcaaacacaagtgtaagtcccgatc

SEQ ID NO: 525952 - DNA, 25 bp, Mus musculus
gcaaacaccactattgaagctgtta

SEQ ID NO: 525953 - DNA, 25 bp, Mus musculus
gcaaacaccacttttgaagctgtta

SEQ ID NO: 525954 - DNA, 25 bp, Mus musculus
gcaaacacccacagccatagaagta

SEQ ID NO: 525955 - DNA, 25 bp, Mus musculus
gcaaacacccactgccatagaagta

SEQ ID NO: 525956 - DNA, 25 bp, Mus musculus
gcaaacaccgatcgatttatcttga

SEQ ID NO: 525957 - DNA, 25 bp, Mus musculus
gcaaacaccgatggatttatcttga

SEQ ID NO: 525958 - DNA, 25 bp, Mus musculus
gcaaacactgggaattcagctgtta

SEQ ID NO: 525959 - DNA, 25 bp, Mus musculus
gcaaacactgggtattcagctgtta

SEQ ID NO: 525960 - DNA, 25 bp, Mus musculus
gcaaacagacctatgtggaagcatt

SEQ ID NO: 525961 - DNA, 25 bp, Mus musculus
gcaaacagacctcatctttgtaatg

SEQ ID NO: 525962 - DNA, 25 bp, Mus musculus
gcaaacagacctgatctttgtaatg

SEQ ID NO: 525963 - DNA, 25 bp, Mus musculus
gcaaacagacctttgtggaagcatt

SEQ ID NO: 525964 - DNA, 25 bp, Mus musculus
gcaaacagagatatcaagaatggta

SEQ ID NO: 525965 - DNA, 25 bp, Mus musculus
gcaaacagagatttcaagaatggta

SEQ ID NO: 525966 - DNA, 25 bp, Mus musculus
gcaaacagaggacgtggccacttct

SEQ ID NO: 525967 - DNA, 25 bp, Mus musculus
gcaaacagaggaggtggccacttct

SEQ ID NO: 525968 - DNA, 25 bp, Mus musculus
gcaaacagattcatacactggcatg

SEQ ID NO: 525969 - DNA, 25 bp, Mus musculus
gcaaacagattcttacactggcatg

SEQ ID NO: 525970 - DNA, 25 bp, Mus musculus
gcaaacagctgcattagagtagaca

SEQ ID NO: 525971 - DNA, 25 bp, Mus musculus
gcaaacagctgctttagagtagaca

SEQ ID NO: 525972 - DNA, 25 bp, Mus musculus
gcaaacaggcccctagcatatccgt

SEQ ID NO: 525973 - DNA, 25 bp, Mus musculus
gcaaacaggcccgtagcatatccgt

SEQ ID NO: 525974 - DNA, 25 bp, Mus musculus
gcaaacaggctgaagattctcacct

SEQ ID NO: 525975 - DNA, 25 bp, Mus musculus
gcaaacaggctgtagattctcacct

SEQ ID NO: 525976 - DNA, 25 bp, Mus musculus
gcaaacagggacatccagaatagag

SEQ ID NO: 525977 - DNA, 25 bp, Mus musculus
gcaaacagggacttccagaatagag

SEQ ID NO: 525978 - DNA, 25 bp, Mus musculus
gcaaacaggtgcagacctcaaccaa

SEQ ID NO: 525979 - DNA, 25 bp, Mus musculus
gcaaacaggtgctgacctcaaccaa

SEQ ID NO: 525980 - DNA, 25 bp, Mus musculus
gcaaacagtcctcctgcgttagaag

SEQ ID NO: 525981 - DNA, 25 bp, Mus musculus
gcaaacagtcctgctgcgttagaag

SEQ ID NO: 525982 - DNA, 25 bp, Mus musculus
gcaaacagtctaattcggcgaatct

SEQ ID NO: 525983 - DNA, 25 bp, Mus musculus
gcaaacagtctatttcggcgaatct

SEQ ID NO: 525984 - DNA, 25 bp, Mus musculus
gcaaacagtgcccaaaacttcatat

SEQ ID NO: 525985 - DNA, 25 bp, Mus musculus
gcaaacagtgccgaaaacttcatat

SEQ ID NO: 525986 - DNA, 25 bp, Mus musculus
gcaaacagtgtgacttattttcctg

SEQ ID NO: 525987 - DNA, 25 bp, Mus musculus
gcaaacagtgtgtcttattttcctg

SEQ ID NO: 525988 - DNA, 25 bp, Mus musculus
gcaaacagtttcaagggctcctaga

SEQ ID NO: 525989 - DNA, 25 bp, Mus musculus
gcaaacagtttctagggctcctaga

SEQ ID NO: 525990 - DNA, 25 bp, Mus musculus
gcaaacagtttgagggcataacctt

SEQ ID NO: 525991 - DNA, 25 bp, Mus musculus
gcaaacagtttgtgggcataacctt

SEQ ID NO: 525992 - DNA, 25 bp, Mus musculus
gcaaacatatttaacacttggagta

SEQ ID NO: 525993 - DNA, 25 bp, Mus musculus
gcaaacatattttacacttggagta

SEQ ID NO: 525994 - DNA, 25 bp, Mus musculus
gcaaacatctgtagcctgggcagac

SEQ ID NO: 525995 - DNA, 25 bp, Mus musculus
gcaaacatctgttgcctgggcagac

SEQ ID NO: 525996 - DNA, 25 bp, Mus musculus
gcaaacatggaaacagtgctttagc

SEQ ID NO: 525997 - DNA, 25 bp, Mus musculus
gcaaacatggaatcagtgctttagc

SEQ ID NO: 525998 - DNA, 25 bp, Mus musculus
gcaaacatggcacgctctacacaga

SEQ ID NO: 525999 - DNA, 25 bp, Mus musculus
gcaaacatggcaggctctacacaga

SEQ ID NO: 526000 - DNA, 25 bp, Mus musculus
gcaaacatgggtcactgctacatct

SEQ ID NO: 526001 - DNA, 25 bp, Mus musculus
gcaaacatgggtgactgctacatct

SEQ ID NO: 526002 - DNA, 25 bp, Mus musculus
gcaaacattgccaggaagctgtcaa

SEQ ID NO: 526003 - DNA, 25 bp, Mus musculus
gcaaacattgcctggaagctgtcaa

SEQ ID NO: 526004 - DNA, 25 bp, Mus musculus
gcaaacattgctcctctgtgagagg

SEQ ID NO: 526005 - DNA, 25 bp, Mus musculus
gcaaacattgctgctctgtgagagg

SEQ ID NO: 526006 - DNA, 25 bp, Mus musculus
gcaaacatttgcatgtgttctctta

SEQ ID NO: 526007 - DNA, 25 bp, Mus musculus
gcaaacatttgcttgtgttctctta

SEQ ID NO: 526008 - DNA, 25 bp, Mus musculus
gcaaaccaccatattgttcatgttg

SEQ ID NO: 526009 - DNA, 25 bp, Mus musculus
gcaaaccaccattttgttcatgttg

SEQ ID NO: 526010 - DNA, 25 bp, Mus musculus
gcaaaccagattatcatgtacacac

SEQ ID NO: 526011 - DNA, 25 bp, Mus musculus
gcaaaccagattttcatgtacacac

SEQ ID NO: 526012 - DNA, 25 bp, Mus musculus
gcaaaccagccaactaaaggcccat

SEQ ID NO: 526013 - DNA, 25 bp, Mus musculus
gcaaaccagccatctaaaggcccat

SEQ ID NO: 526014 - DNA, 25 bp, Mus musculus
gcaaaccagctgcagaaatcttgat

SEQ ID NO: 526015 - DNA, 25 bp, Mus musculus
gcaaaccagctgcttgctcttagga

SEQ ID NO: 526016 - DNA, 25 bp, Mus musculus
gcaaaccagctggagaaatcttgat

SEQ ID NO: 526017 - DNA, 25 bp, Mus musculus
gcaaaccagctggttgctcttagga

SEQ ID NO: 526018 - DNA, 25 bp, Mus musculus
gcaaaccagcttctgacccaggcag

SEQ ID NO: 526019 - DNA, 25 bp, Mus musculus
gcaaaccagcttgtgacccaggcag

SEQ ID NO: 526020 - DNA, 25 bp, Mus musculus
gcaaaccagtagatacggacttatt

SEQ ID NO: 526021 - DNA, 25 bp, Mus musculus
gcaaaccagtagttacggacttatt

SEQ ID NO: 526022 - DNA, 25 bp, Mus musculus
gcaaaccatcctctgactggcataa

SEQ ID NO: 526023 - DNA, 25 bp, Mus musculus
gcaaaccatcctgtgactggcataa

SEQ ID NO: 526024 - DNA, 25 bp, Mus musculus
gcaaaccatgctacgtgatggctgt

SEQ ID NO: 526025 - DNA, 25 bp, Mus musculus
gcaaaccatgcttcgtgatggctgt

SEQ ID NO: 526026 - DNA, 25 bp, Mus musculus
gcaaaccatggcacacaagtcatca

SEQ ID NO: 526027 - DNA, 25 bp, Mus musculus
gcaaaccatggctcacaagtcatca

SEQ ID NO: 526028 - DNA, 25 bp, Mus musculus
gcaaacccaaggaagagtaagccaa

SEQ ID NO: 526029 - DNA, 25 bp, Mus musculus
gcaaacccaaggtagagtaagccaa

SEQ ID NO: 526030 - DNA, 25 bp, Mus musculus
gcaaacccaattcctgaccctgcaa

SEQ ID NO: 526031 - DNA, 25 bp, Mus musculus
gcaaacccaattgctgaccctgcaa

SEQ ID NO: 526032 - DNA, 25 bp, Mus musculus
gcaaacccataaaggactaaaactt

SEQ ID NO: 526033 - DNA, 25 bp, Mus musculus
gcaaacccataatggactaaaactt

SEQ ID NO: 526034 - DNA, 25 bp, Mus musculus
gcaaaccccattaatgcaactgagt

SEQ ID NO: 526035 - DNA, 25 bp, Mus musculus
gcaaaccccatttatgcaactgagt

SEQ ID NO: 526036 - DNA, 25 bp, Mus musculus
gcaaaccctctccaggtgacagcag

SEQ ID NO: 526037 - DNA, 25 bp, Mus musculus
gcaaaccctctcgaggtgacagcag

SEQ ID NO: 526038 - DNA, 25 bp, Mus musculus
gcaaaccctgagaagtggagagaga

SEQ ID NO: 526039 - DNA, 25 bp, Mus musculus
gcaaaccctgagtagtggagagaga

SEQ ID NO: 526040 - DNA, 25 bp, Mus musculus
gcaaacccttgtcaactgaagaata

SEQ ID NO: 526041 - DNA, 25 bp, Mus musculus
gcaaacccttgtgaactgaagaata

SEQ ID NO: 526042 - DNA, 25 bp, Mus musculus
gcaaaccgaacactctcatgctgaa

SEQ ID NO: 526043 - DNA, 25 bp, Mus musculus
gcaaaccgaacagtctcatgctgaa

SEQ ID NO: 526044 - DNA, 25 bp, Mus musculus
gcaaaccggcttatgttacacggct

SEQ ID NO: 526045 - DNA, 25 bp, Mus musculus
gcaaaccggcttttgttacacggct

SEQ ID NO: 526046 - DNA, 25 bp, Mus musculus
gcaaaccgggccattaggactcaaa

SEQ ID NO: 526047 - DNA, 25 bp, Mus musculus
gcaaaccgggcctttaggactcaaa

SEQ ID NO: 526048 - DNA, 25 bp, Mus musculus
gcaaaccgtactctgtagcctgggc

SEQ ID NO: 526049 - DNA, 25 bp, Mus musculus
gcaaaccgtactgtgtagcctgggc

SEQ ID NO: 526050 - DNA, 25 bp, Mus musculus
gcaaaccgtgttagtggcagcacag

SEQ ID NO: 526051 - DNA, 25 bp, Mus musculus
gcaaaccgtgtttgtggcagcacag

SEQ ID NO: 526052 - DNA, 25 bp, Mus musculus
gcaaacctaagaccatccattaatg

SEQ ID NO: 526053 - DNA, 25 bp, Mus musculus
gcaaacctaagagcatccattaatg

SEQ ID NO: 526054 - DNA, 25 bp, Mus musculus
gcaaacctcatgatgtttccattca

SEQ ID NO: 526055 - DNA, 25 bp, Mus musculus
gcaaacctcatgttgtttccattca

SEQ ID NO: 526056 - DNA, 25 bp, Mus musculus
gcaaacctcattaattcctgggacc

SEQ ID NO: 526057 - DNA, 25 bp, Mus musculus
gcaaacctcatttattcctgggacc

SEQ ID NO: 526058 - DNA, 25 bp, Mus musculus
gcaaacctccaacaaggattccaga

SEQ ID NO: 526059 - DNA, 25 bp, Mus musculus
gcaaacctccaagaaggattccaga

SEQ ID NO: 526060 - DNA, 25 bp, Mus musculus
gcaaacctccagaaatatagctcag

SEQ ID NO: 526061 - DNA, 25 bp, Mus musculus
gcaaacctccagtaatatagctcag

SEQ ID NO: 526062 - DNA, 25 bp, Mus musculus
gcaaacctcgttcccatgtttgaag

SEQ ID NO: 526063 - DNA, 25 bp, Mus musculus
gcaaacctcgttgccatgtttgaag

SEQ ID NO: 526064 - DNA, 25 bp, Mus musculus
gcaaacctctgcaaaacggaaagtg

SEQ ID NO: 526065 - DNA, 25 bp, Mus musculus
gcaaacctctgctaaacggaaagtg

SEQ ID NO: 526066 - DNA, 25 bp, Mus musculus
gcaaacctgagtacattctccgaga

SEQ ID NO: 526067 - DNA, 25 bp, Mus musculus
gcaaacctgagttcattctccgaga

SEQ ID NO: 526068 - DNA, 25 bp, Mus musculus
gcaaaccttagtcattgtcaacccc

SEQ ID NO: 526069 - DNA, 25 bp, Mus musculus
gcaaaccttagtgattgtcaacccc

SEQ ID NO: 526070 - DNA, 25 bp, Mus musculus
gcaaaccttcccatgttttgtgttt

SEQ ID NO: 526071 - DNA, 25 bp, Mus musculus
gcaaaccttcccttgttttgtgttt

SEQ ID NO: 526072 - DNA, 25 bp, Mus musculus
gcaaaccttctgaatagcccttgaa

SEQ ID NO: 526073 - DNA, 25 bp, Mus musculus
gcaaaccttctgtatagcccttgaa

SEQ ID NO: 526074 - DNA, 25 bp, Mus musculus
gcaaaccttcttagagaaagctctc

SEQ ID NO: 526075 - DNA, 25 bp, Mus musculus
gcaaaccttctttgagaaagctctc

SEQ ID NO: 526076 - DNA, 25 bp, Mus musculus
gcaaacgaactactaagcctcttcc

SEQ ID NO: 526077 - DNA, 25 bp, Mus musculus
gcaaacgaactagtaagcctcttcc

SEQ ID NO: 526078 - DNA, 25 bp, Mus musculus
gcaaacgaagttcattcctgtctaa

SEQ ID NO: 526079 - DNA, 25 bp, Mus musculus
gcaaacgaagttgattcctgtctaa

SEQ ID NO: 526080 - DNA, 25 bp, Mus musculus
gcaaacgacttgacatcgtcagtat

SEQ ID NO: 526081 - DNA, 25 bp, Mus musculus
gcaaacgacttgtcatcgtcagtat

SEQ ID NO: 526082 - DNA, 25 bp, Mus musculus
gcaaacgagtagagggcctgctctc

SEQ ID NO: 526083 - DNA, 25 bp, Mus musculus
gcaaacgagtagtgggcctgctctc

SEQ ID NO: 526084 - DNA, 25 bp, Mus musculus
gcaaacgatcttcggagccagcctg

SEQ ID NO: 526085 - DNA, 25 bp, Mus musculus
gcaaacgatcttgggagccagcctg

SEQ ID NO: 526086 - DNA, 25 bp, Mus musculus
gcaaacgcaacacagtctaatacag

SEQ ID NO: 526087 - DNA, 25 bp, Mus musculus
gcaaacgcaacagagtctaatacag

SEQ ID NO: 526088 - DNA, 25 bp, Mus musculus
gcaaacgcacgcacctacgtaggca

SEQ ID NO: 526089 - DNA, 25 bp, Mus musculus
gcaaacgcacgctcctacgtaggca

SEQ ID NO: 526090 - DNA, 25 bp, Mus musculus
gcaaacgccagtcttgctgctatgg

SEQ ID NO: 526091 - DNA, 25 bp, Mus musculus
gcaaacgccagtgttgctgctatgg

SEQ ID NO: 526092 - DNA, 25 bp, Mus musculus
gcaaacgcctgcctataaataaaaa

SEQ ID NO: 526093 - DNA, 25 bp, Mus musculus
gcaaacgcctgcgtataaataaaaa

SEQ ID NO: 526094 - DNA, 25 bp, Mus musculus
gcaaacggcacactgtaggtcttca

SEQ ID NO: 526095 - DNA, 25 bp, Mus musculus
gcaaacggcacagtgtaggtcttca

SEQ ID NO: 526096 - DNA, 25 bp, Mus musculus
gcaaacggcattacaatgcgccctc

SEQ ID NO: 526097 - DNA, 25 bp, Mus musculus
gcaaacggcatttcaatgcgccctc

SEQ ID NO: 526098 - DNA, 25 bp, Mus musculus
gcaaacgggcggatgagtatttaat

SEQ ID NO: 526099 - DNA, 25 bp, Mus musculus
gcaaacgggcggttgagtatttaat

SEQ ID NO: 526100 - DNA, 25 bp, Mus musculus
gcaaacggtcaacattccacgaaca

SEQ ID NO: 526101 - DNA, 25 bp, Mus musculus
gcaaacggtcaagattccacgaaca

SEQ ID NO: 526102 - DNA, 25 bp, Mus musculus
gcaaacggttgacttagagagcttt

SEQ ID NO: 526103 - DNA, 25 bp, Mus musculus
gcaaacggttgagttagagagcttt

SEQ ID NO: 526104 - DNA, 25 bp, Mus musculus
gcaaacgtgctgcattgctgcccac

SEQ ID NO: 526105 - DNA, 25 bp, Mus musculus
gcaaacgtgctggattgctgcccac

SEQ ID NO: 526106 - DNA, 25 bp, Mus musculus
gcaaacgtggcaatgttggctatga

SEQ ID NO: 526107 - DNA, 25 bp, Mus musculus
gcaaacgtggcattgttggctatga

SEQ ID NO: 526108 - DNA, 25 bp, Mus musculus
gcaaacgttcataccaagagccatt

SEQ ID NO: 526109 - DNA, 25 bp, Mus musculus
gcaaacgttcattccaagagccatt

SEQ ID NO: 526110 - DNA, 25 bp, Mus musculus
gcaaactaaactccctattttcaca

SEQ ID NO: 526111 - DNA, 25 bp, Mus musculus
gcaaactaaactgcctattttcaca

SEQ ID NO: 526112 - DNA, 25 bp, Mus musculus
gcaaactaacaccacttcttttgtt

SEQ ID NO: 526113 - DNA, 25 bp, Mus musculus
gcaaactaacacgacttcttttgtt

SEQ ID NO: 526114 - DNA, 25 bp, Mus musculus
gcaaactaacgacttacaccatttt

SEQ ID NO: 526115 - DNA, 25 bp, Mus musculus
gcaaactaacgagttacaccatttt

SEQ ID NO: 526116 - DNA, 25 bp, Mus musculus
gcaaactacaacatacgttgcaatt

SEQ ID NO: 526117 - DNA, 25 bp, Mus musculus
gcaaactacaacttacgttgcaatt

SEQ ID NO: 526118 - DNA, 25 bp, Mus musculus
gcaaactactctcaagggaaggcta

SEQ ID NO: 526119 - DNA, 25 bp, Mus musculus
gcaaactactctgaagggaaggcta

SEQ ID NO: 526120 - DNA, 25 bp, Mus musculus
gcaaactatgccatcaagatctatg

SEQ ID NO: 526121 - DNA, 25 bp, Mus musculus
gcaaactatgccttcaagatctatg

SEQ ID NO: 526122 - DNA, 25 bp, Mus musculus
gcaaactatgtcaagctcctctaat

SEQ ID NO: 526123 - DNA, 25 bp, Mus musculus
gcaaactatgtctagctcctctaat

SEQ ID NO: 526124 - DNA, 25 bp, Mus musculus
gcaaactattcactcttagaaaatc

SEQ ID NO: 526125 - DNA, 25 bp, Mus musculus
gcaaactattcagtcttagaaaatc

SEQ ID NO: 526126 - DNA, 25 bp, Mus musculus
gcaaactcaagtcgtctgtttctgt

SEQ ID NO: 526127 - DNA, 25 bp, Mus musculus
gcaaactcaagtcgtgcttcaccgg

SEQ ID NO: 526128 - DNA, 25 bp, Mus musculus
gcaaactcaagtggtctgtttctgt

SEQ ID NO: 526129 - DNA, 25 bp, Mus musculus
gcaaactcaagtggtgcttcaccgg

SEQ ID NO: 526130 - DNA, 25 bp, Mus musculus
gcaaactcacgtatgtcaaggtgaa

SEQ ID NO: 526131 - DNA, 25 bp, Mus musculus
gcaaactcacgtttgtcaaggtgaa

SEQ ID NO: 526132 - DNA, 25 bp, Mus musculus
gcaaactcatttattcggcaaagac

SEQ ID NO: 526133 - DNA, 25 bp, Mus musculus
gcaaactcattttttcggcaaagac

SEQ ID NO: 526134 - DNA, 25 bp, Mus musculus
gcaaactccccaccgtggaggaggt

SEQ ID NO: 526135 - DNA, 25 bp, Mus musculus
gcaaactccccagcgtggaggaggt

SEQ ID NO: 526136 - DNA, 25 bp, Mus musculus
gcaaactcgattatctacggttgca

SEQ ID NO: 526137 - DNA, 25 bp, Mus musculus
gcaaactcgattttctacggttgca

SEQ ID NO: 526138 - DNA, 25 bp, Mus musculus
gcaaactctgagagcctaggcatgg

SEQ ID NO: 526139 - DNA, 25 bp, Mus musculus
gcaaactctgagtgcctaggcatgg

SEQ ID NO: 526140 - DNA, 25 bp, Mus musculus
gcaaactgaacaaccattggtccgt

SEQ ID NO: 526141 - DNA, 25 bp, Mus musculus
gcaaactgaacatccattggtccgt

SEQ ID NO: 526142 - DNA, 25 bp, Mus musculus
gcaaactgaagcatctctgacgcca

SEQ ID NO: 526143 - DNA, 25 bp, Mus musculus
gcaaactgaagcttctctgacgcca

SEQ ID NO: 526144 - DNA, 25 bp, Mus musculus
gcaaactgaattcaatgcccagaac

SEQ ID NO: 526145 - DNA, 25 bp, Mus musculus
gcaaactgaattgaatgcccagaac

SEQ ID NO: 526146 - DNA, 25 bp, Mus musculus
gcaaactgactgatttcaccgtctc

SEQ ID NO: 526147 - DNA, 25 bp, Mus musculus
gcaaactgactgttttcaccgtctc

SEQ ID NO: 526148 - DNA, 25 bp, Mus musculus
gcaaactgacttactttgttctacc

SEQ ID NO: 526149 - DNA, 25 bp, Mus musculus
gcaaactgactttctttgttctacc

SEQ ID NO: 526150 - DNA, 25 bp, Mus musculus
gcaaactgcaaaccaaggccgctct

SEQ ID NO: 526151 - DNA, 25 bp, Mus musculus
gcaaactgcaaagcaaggccgctct

SEQ ID NO: 526152 - DNA, 25 bp, Mus musculus
gcaaactgcaccagttacctacagt

SEQ ID NO: 526153 - DNA, 25 bp, Mus musculus
gcaaactgcacctgttacctacagt

SEQ ID NO: 526154 - DNA, 25 bp, Mus musculus
gcaaactgccgtatccgaagggttt

SEQ ID NO: 526155 - DNA, 25 bp, Mus musculus
gcaaactgccgtttccgaagggttt

SEQ ID NO: 526156 - DNA, 25 bp, Mus musculus
gcaaactgcgctaccgattgggcta

SEQ ID NO: 526157 - DNA, 25 bp, Mus musculus
gcaaactgcgcttccgattgggcta

SEQ ID NO: 526158 - DNA, 25 bp, Mus musculus
gcaaactgctgtagtgtgaccactg

SEQ ID NO: 526159 - DNA, 25 bp, Mus musculus
gcaaactgctgttgtgtgaccactg

SEQ ID NO: 526160 - DNA, 25 bp, Mus musculus
gcaaactgcttcactcttggagagg

SEQ ID NO: 526161 - DNA, 25 bp, Mus musculus
gcaaactgcttctctcttggagagg

SEQ ID NO: 526162 - DNA, 25 bp, Mus musculus
gcaaactgctttcaactttacagct

SEQ ID NO: 526163 - DNA, 25 bp, Mus musculus
gcaaactgctttgaactttacagct

SEQ ID NO: 526164 - DNA, 25 bp, Mus musculus
gcaaactggaaacgactcggtcact

SEQ ID NO: 526165 - DNA, 25 bp, Mus musculus
gcaaactggaaaggactcggtcact

SEQ ID NO: 526166 - DNA, 25 bp, Mus musculus
gcaaactggatgaccgagtgccaca

SEQ ID NO: 526167 - DNA, 25 bp, Mus musculus
gcaaactggatgtccgagtgccaca

SEQ ID NO: 526168 - DNA, 25 bp, Mus musculus
gcaaactggcttctgttagttaatt

SEQ ID NO: 526169 - DNA, 25 bp, Mus musculus
gcaaactggcttgtgttagttaatt

SEQ ID NO: 526170 - DNA, 25 bp, Mus musculus
gcaaactggggcaaaatccgcagca

SEQ ID NO: 526171 - DNA, 25 bp, Mus musculus
gcaaactggggctaaatccgcagca

SEQ ID NO: 526172 - DNA, 25 bp, Mus musculus
gcaaactggtgcacaaggccctgtg

SEQ ID NO: 526173 - DNA, 25 bp, Mus musculus
gcaaactggtgctcaaggccctgtg

SEQ ID NO: 526174 - DNA, 25 bp, Mus musculus
gcaaactgtcaaccatttcttccac

SEQ ID NO: 526175 - DNA, 25 bp, Mus musculus
gcaaactgtcaagcatttcttccac

SEQ ID NO: 526176 - DNA, 25 bp, Mus musculus
gcaaactgtcttaagtctatgcaaa

SEQ ID NO: 526177 - DNA, 25 bp, Mus musculus
gcaaactgtcttcactactccgatg

SEQ ID NO: 526178 - DNA, 25 bp, Mus musculus
gcaaactgtcttgactactccgatg

SEQ ID NO: 526179 - DNA, 25 bp, Mus musculus
gcaaactgtctttagtctatgcaaa

SEQ ID NO: 526180 - DNA, 25 bp, Mus musculus
gcaaactgtgctctgtgaagcccaa

SEQ ID NO: 526181 - DNA, 25 bp, Mus musculus
gcaaactgtgctgtgtgaagcccaa

SEQ ID NO: 526182 - DNA, 25 bp, Mus musculus
gcaaacttaatcattcagcattcta

SEQ ID NO: 526183 - DNA, 25 bp, Mus musculus
gcaaacttaatctttcagcattcta

SEQ ID NO: 526184 - DNA, 25 bp, Mus musculus
gcaaacttagtaattttgatgcgta

SEQ ID NO: 526185 - DNA, 25 bp, Mus musculus
gcaaacttagtatttttgatgcgta

SEQ ID NO: 526186 - DNA, 25 bp, Mus musculus
gcaaacttatctccagaggtggtct

SEQ ID NO: 526187 - DNA, 25 bp, Mus musculus
gcaaacttatctgcagaggtggtct

SEQ ID NO: 526188 - DNA, 25 bp, Mus musculus
gcaaacttatgtctcagtgtgccag

SEQ ID NO: 526189 - DNA, 25 bp, Mus musculus
gcaaacttatgtgtcagtgtgccag

SEQ ID NO: 526190 - DNA, 25 bp, Mus musculus
gcaaacttcccgctatcaactcagt

SEQ ID NO: 526191 - DNA, 25 bp, Mus musculus
gcaaacttcccggtatcaactcagt

SEQ ID NO: 526192 - DNA, 25 bp, Mus musculus
gcaaacttccctcggtgagtgtgac

SEQ ID NO: 526193 - DNA, 25 bp, Mus musculus
gcaaacttccctgggtgagtgtgac

SEQ ID NO: 526194 - DNA, 25 bp, Mus musculus
gcaaacttctctctttacaacccag

SEQ ID NO: 526195 - DNA, 25 bp, Mus musculus
gcaaacttctctgtttacaacccag

SEQ ID NO: 526196 - DNA, 25 bp, Mus musculus
gcaaacttctgcataacccaaaaca

SEQ ID NO: 526197 - DNA, 25 bp, Mus musculus
gcaaacttctgcttaacccaaaaca

SEQ ID NO: 526198 - DNA, 25 bp, Mus musculus
gcaaacttgcacacttgcagatact

SEQ ID NO: 526199 - DNA, 25 bp, Mus musculus
gcaaacttgcactcttgcagatact

SEQ ID NO: 526200 - DNA, 25 bp, Mus musculus
gcaaacttgcctacttgctaataaa

SEQ ID NO: 526201 - DNA, 25 bp, Mus musculus
gcaaacttgccttcttgctaataaa

SEQ ID NO: 526202 - DNA, 25 bp, Mus musculus
gcaaacttggtgatctgagactccc

SEQ ID NO: 526203 - DNA, 25 bp, Mus musculus
gcaaacttggtgttctgagactccc

SEQ ID NO: 526204 - DNA, 25 bp, Mus musculus
gcaaacttgtatatcacctgtccag

SEQ ID NO: 526205 - DNA, 25 bp, Mus musculus
gcaaacttgtatttcacctgtccag

SEQ ID NO: 526206 - DNA, 25 bp, Mus musculus
gcaaactttaccaaggcggtccagg

SEQ ID NO: 526207 - DNA, 25 bp, Mus musculus
gcaaactttacctaggcggtccagg

SEQ ID NO: 526208 - DNA, 25 bp, Mus musculus
gcaaactttttgcttcgttccagca

SEQ ID NO: 526209 - DNA, 25 bp, Mus musculus
gcaaactttttggttcgttccagca

SEQ ID NO: 526210 - DNA, 25 bp, Mus musculus
gcaaagaaaaccaccgtgaaacatt

SEQ ID NO: 526211 - DNA, 25 bp, Mus musculus
gcaaagaaaacctccgtgaaacatt

SEQ ID NO: 526212 - DNA, 25 bp, Mus musculus
gcaaagaaaactaccttggtcttgg

SEQ ID NO: 526213 - DNA, 25 bp, Mus musculus
gcaaagaaaacttccttggtcttgg

SEQ ID NO: 526214 - DNA, 25 bp, Mus musculus
gcaaagaaacaactctccaaagact

SEQ ID NO: 526215 - DNA, 25 bp, Mus musculus
gcaaagaaacaagtctccaaagact

SEQ ID NO: 526216 - DNA, 25 bp, Mus musculus
gcaaagaaacgaaacccttgtagag

SEQ ID NO: 526217 - DNA, 25 bp, Mus musculus
gcaaagaaacgatacccttgtagag

SEQ ID NO: 526218 - DNA, 25 bp, Mus musculus
gcaaagaaatacatcctggcctcac

SEQ ID NO: 526219 - DNA, 25 bp, Mus musculus
gcaaagaaatacttcctggcctcac

SEQ ID NO: 526220 - DNA, 25 bp, Mus musculus
gcaaagaacattctagtcccaacat

SEQ ID NO: 526221 - DNA, 25 bp, Mus musculus
gcaaagaacattgtagtcccaacat

SEQ ID NO: 526222 - DNA, 25 bp, Mus musculus
gcaaagaaccctcccatagttttga

SEQ ID NO: 526223 - DNA, 25 bp, Mus musculus
gcaaagaaccctgccatagttttga

SEQ ID NO: 526224 - DNA, 25 bp, Mus musculus
gcaaagaagaccactacagcagact

SEQ ID NO: 526225 - DNA, 25 bp, Mus musculus
gcaaagaagacctctacagcagact

SEQ ID NO: 526226 - DNA, 25 bp, Mus musculus
gcaaagaagataacgcccggcggca

SEQ ID NO: 526227 - DNA, 25 bp, Mus musculus
gcaaagaagatatcgcccggcggca

SEQ ID NO: 526228 - DNA, 25 bp, Mus musculus
gcaaagaagcaacttgtgatcagaa

SEQ ID NO: 526229 - DNA, 25 bp, Mus musculus
gcaaagaagcaagttgtgatcagaa

SEQ ID NO: 526230 - DNA, 25 bp, Mus musculus
gcaaagaagcctataaagacgggag

SEQ ID NO: 526231 - DNA, 25 bp, Mus musculus
gcaaagaagcctttaaagacgggag

SEQ ID NO: 526232 - DNA, 25 bp, Mus musculus
gcaaagacacttctagggatgactc

SEQ ID NO: 526233 - DNA, 25 bp, Mus musculus
gcaaagacacttgtagggatgactc

SEQ ID NO: 526234 - DNA, 25 bp, Mus musculus
gcaaagacagcaccatttcccagga

SEQ ID NO: 526235 - DNA, 25 bp, Mus musculus
gcaaagacagcacctacagcatgag

SEQ ID NO: 526236 - DNA, 25 bp, Mus musculus
gcaaagacagcagcatttcccagga

SEQ ID NO: 526237 - DNA, 25 bp, Mus musculus
gcaaagacagcagctacagcatgag

SEQ ID NO: 526238 - DNA, 25 bp, Mus musculus
gcaaagacaggcaccctacagacat

SEQ ID NO: 526239 - DNA, 25 bp, Mus musculus
gcaaagacaggctccctacagacat

SEQ ID NO: 526240 - DNA, 25 bp, Mus musculus
gcaaagacagtgatggctgccccag

SEQ ID NO: 526241 - DNA, 25 bp, Mus musculus
gcaaagacagtgttggctgccccag

SEQ ID NO: 526242 - DNA, 25 bp, Mus musculus
gcaaagaccatacagcaccaataaa

SEQ ID NO: 526243 - DNA, 25 bp, Mus musculus
gcaaagaccatagagcaccaataaa

SEQ ID NO: 526244 - DNA, 25 bp, Mus musculus
gcaaagacctctacaagtcggcttt

SEQ ID NO: 526245 - DNA, 25 bp, Mus musculus
gcaaagacctcttcaagtcggcttt

SEQ ID NO: 526246 - DNA, 25 bp, Mus musculus
gcaaagactccaatgtcacttcatt

SEQ ID NO: 526247 - DNA, 25 bp, Mus musculus
gcaaagactccattgtcacttcatt

SEQ ID NO: 526248 - DNA, 25 bp, Mus musculus
gcaaagactgctccatcaaaatttg

SEQ ID NO: 526249 - DNA, 25 bp, Mus musculus
gcaaagactgctgcatcaaaatttg

SEQ ID NO: 526250 - DNA, 25 bp, Mus musculus
gcaaagacttccctcaacagtgctc

SEQ ID NO: 526251 - DNA, 25 bp, Mus musculus
gcaaagacttccgtcaacagtgctc

SEQ ID NO: 526252 - DNA, 25 bp, Mus musculus
gcaaagagacaacttccacatcagt

SEQ ID NO: 526253 - DNA, 25 bp, Mus musculus
gcaaagagacaagttccacatcagt

SEQ ID NO: 526254 - DNA, 25 bp, Mus musculus
gcaaagagacagatggaccgcatta

SEQ ID NO: 526255 - DNA, 25 bp, Mus musculus
gcaaagagacagttggaccgcatta

SEQ ID NO: 526256 - DNA, 25 bp, Mus musculus
gcaaagagaccgcaaactgaccaaa

SEQ ID NO: 526257 - DNA, 25 bp, Mus musculus
gcaaagagaccggaaactgaccaaa

SEQ ID NO: 526258 - DNA, 25 bp, Mus musculus
gcaaagagagtcctcagctagcatg

SEQ ID NO: 526259 - DNA, 25 bp, Mus musculus
gcaaagagagtcgtcagctagcatg

SEQ ID NO: 526260 - DNA, 25 bp, Mus musculus
gcaaagagattcagttccttgcccg

SEQ ID NO: 526261 - DNA, 25 bp, Mus musculus
gcaaagagattctgttccttgcccg

SEQ ID NO: 526262 - DNA, 25 bp, Mus musculus
gcaaagagcactcttttacctgagg

SEQ ID NO: 526263 - DNA, 25 bp, Mus musculus
gcaaagagcactgttttacctgagg

SEQ ID NO: 526264 - DNA, 25 bp, Mus musculus
gcaaagagctaccttcagccagtga

SEQ ID NO: 526265 - DNA, 25 bp, Mus musculus
gcaaagagctacgttcagccagtga

SEQ ID NO: 526266 - DNA, 25 bp, Mus musculus
gcaaagagcttaccatgttctgtgt

SEQ ID NO: 526267 - DNA, 25 bp, Mus musculus
gcaaagagcttagcatgttctgtgt

SEQ ID NO: 526268 - DNA, 25 bp, Mus musculus
gcaaagaggagcacccacaggaagt

SEQ ID NO: 526269 - DNA, 25 bp, Mus musculus
gcaaagaggagctcccacaggaagt

SEQ ID NO: 526270 - DNA, 25 bp, Mus musculus
gcaaagaggctgcacaatgttttaa

SEQ ID NO: 526271 - DNA, 25 bp, Mus musculus
gcaaagaggctggacaatgttttaa

SEQ ID NO: 526272 - DNA, 25 bp, Mus musculus
gcaaagagttttaccagcccaagcc

SEQ ID NO: 526273 - DNA, 25 bp, Mus musculus
gcaaagagtttttccagcccaagcc

SEQ ID NO: 526274 - DNA, 25 bp, Mus musculus
gcaaagatacttccagtctgaactt

SEQ ID NO: 526275 - DNA, 25 bp, Mus musculus
gcaaagatacttgcagtctgaactt

SEQ ID NO: 526276 - DNA, 25 bp, Mus musculus
gcaaagatcactatgtcaccagccc

SEQ ID NO: 526277 - DNA, 25 bp, Mus musculus
gcaaagatcactttgtcaccagccc

SEQ ID NO: 526278 - DNA, 25 bp, Mus musculus
gcaaagatcagccactgccgggact

SEQ ID NO: 526279 - DNA, 25 bp, Mus musculus
gcaaagatcagcgactgccgggact

SEQ ID NO: 526280 - DNA, 25 bp, Mus musculus
gcaaagatctccataggcctgaaga

SEQ ID NO: 526281 - DNA, 25 bp, Mus musculus
gcaaagatctccttaggcctgaaga

SEQ ID NO: 526282 - DNA, 25 bp, Mus musculus
gcaaagatctgtacagccatcccgt

SEQ ID NO: 526283 - DNA, 25 bp, Mus musculus
gcaaagatctgttcagccatcccgt

SEQ ID NO: 526284 - DNA, 25 bp, Mus musculus
gcaaagatgagtatgttacctcgta

SEQ ID NO: 526285 - DNA, 25 bp, Mus musculus
gcaaagatgagtttgttacctcgta

SEQ ID NO: 526286 - DNA, 25 bp, Mus musculus
gcaaagatggccacccgtaggatgt

SEQ ID NO: 526287 - DNA, 25 bp, Mus musculus
gcaaagatggccatttggaacccaa

SEQ ID NO: 526288 - DNA, 25 bp, Mus musculus
gcaaagatggcctcccgtaggatgt

SEQ ID NO: 526289 - DNA, 25 bp, Mus musculus
gcaaagatggccttttggaacccaa

SEQ ID NO: 526290 - DNA, 25 bp, Mus musculus
gcaaagatgttgatccttcctggaa

SEQ ID NO: 526291 - DNA, 25 bp, Mus musculus
gcaaagatgttgttccttcctggaa

SEQ ID NO: 526292 - DNA, 25 bp, Mus musculus
gcaaagattgtaaaggcacacacat

SEQ ID NO: 526293 - DNA, 25 bp, Mus musculus
gcaaagattgtataggcacacacat

SEQ ID NO: 526294 - DNA, 25 bp, Mus musculus
gcaaagcaaactagtttttccgtct

SEQ ID NO: 526295 - DNA, 25 bp, Mus musculus
gcaaagcaaacttgtttttccgtct

SEQ ID NO: 526296 - DNA, 25 bp, Mus musculus
gcaaagcaacctcctgttcttgagt

SEQ ID NO: 526297 - DNA, 25 bp, Mus musculus
gcaaagcaacctgctgttcttgagt

SEQ ID NO: 526298 - DNA, 25 bp, Mus musculus
gcaaagcaactgatctgcctactgt

SEQ ID NO: 526299 - DNA, 25 bp, Mus musculus
gcaaagcaactgttctgcctactgt

SEQ ID NO: 526300 - DNA, 25 bp, Mus musculus
gcaaagcaacttagtgctgtttcac

SEQ ID NO: 526301 - DNA, 25 bp, Mus musculus
gcaaagcaactttgtgctgtttcac

SEQ ID NO: 526302 - DNA, 25 bp, Mus musculus
gcaaagcaatatccccatcaaccgg

SEQ ID NO: 526303 - DNA, 25 bp, Mus musculus
gcaaagcaatatgcccatcaaccgg

SEQ ID NO: 526304 - DNA, 25 bp, Mus musculus
gcaaagcaatccaactttccttttg

SEQ ID NO: 526305 - DNA, 25 bp, Mus musculus
gcaaagcaatcctactttccttttg

SEQ ID NO: 526306 - DNA, 25 bp, Mus musculus
gcaaagcaatggcactggcattttt

SEQ ID NO: 526307 - DNA, 25 bp, Mus musculus
gcaaagcaatgggactggcattttt

SEQ ID NO: 526308 - DNA, 25 bp, Mus musculus
gcaaagcaatgtcaggttacacaac

SEQ ID NO: 526309 - DNA, 25 bp, Mus musculus
gcaaagcaatgtgaggttacacaac

SEQ ID NO: 526310 - DNA, 25 bp, Mus musculus
gcaaagcagaccctcaaactgacgg

SEQ ID NO: 526311 - DNA, 25 bp, Mus musculus
gcaaagcagaccgtcaaactgacgg

SEQ ID NO: 526312 - DNA, 25 bp, Mus musculus
gcaaagcagcaaacccatatgacaa

SEQ ID NO: 526313 - DNA, 25 bp, Mus musculus
gcaaagcagcaatcccatatgacaa

SEQ ID NO: 526314 - DNA, 25 bp, Mus musculus
gcaaagcagcataagcgctggtttt

SEQ ID NO: 526315 - DNA, 25 bp, Mus musculus
gcaaagcagcattagcgctggtttt

SEQ ID NO: 526316 - DNA, 25 bp, Mus musculus
gcaaagcagctgagacacttggaga

SEQ ID NO: 526317 - DNA, 25 bp, Mus musculus
gcaaagcagctgtgacacttggaga

SEQ ID NO: 526318 - DNA, 25 bp, Mus musculus
gcaaagcattctcatcagtcgcaat

SEQ ID NO: 526319 - DNA, 25 bp, Mus musculus
gcaaagcattctgatcagtcgcaat

SEQ ID NO: 526320 - DNA, 25 bp, Mus musculus
gcaaagccagctctaggtcttgctt

SEQ ID NO: 526321 - DNA, 25 bp, Mus musculus
gcaaagccagctctatctgagagca

SEQ ID NO: 526322 - DNA, 25 bp, Mus musculus
gcaaagccagctgtaggtcttgctt

SEQ ID NO: 526323 - DNA, 25 bp, Mus musculus
gcaaagccagctgtatctgagagca

SEQ ID NO: 526324 - DNA, 25 bp, Mus musculus
gcaaagccatccacagtaagaccta

SEQ ID NO: 526325 - DNA, 25 bp, Mus musculus
gcaaagccatcctcagtaagaccta

SEQ ID NO: 526326 - DNA, 25 bp, Mus musculus
gcaaagccatcgatctacagaagac

SEQ ID NO: 526327 - DNA, 25 bp, Mus musculus
gcaaagccatcgttctacagaagac

SEQ ID NO: 526328 - DNA, 25 bp, Mus musculus
gcaaagcccctgacttagactttaa

SEQ ID NO: 526329 - DNA, 25 bp, Mus musculus
gcaaagcccctgtcttagactttaa

SEQ ID NO: 526330 - DNA, 25 bp, Mus musculus
gcaaagcccgataattgagttggat

SEQ ID NO: 526331 - DNA, 25 bp, Mus musculus
gcaaagcccgattattgagttggat

SEQ ID NO: 526332 - DNA, 25 bp, Mus musculus
gcaaagcccggcagaggacaccttg

SEQ ID NO: 526333 - DNA, 25 bp, Mus musculus
gcaaagcccggctgaggacaccttg

SEQ ID NO: 526334 - DNA, 25 bp, Mus musculus
gcaaagccgtcaacgtgaagaacat

SEQ ID NO: 526335 - DNA, 25 bp, Mus musculus
gcaaagccgtcatcgtgaagaacat

SEQ ID NO: 526336 - DNA, 25 bp, Mus musculus
gcaaagcctcaaaggtttcacctct

SEQ ID NO: 526337 - DNA, 25 bp, Mus musculus
gcaaagcctcaatggtttcacctct

SEQ ID NO: 526338 - DNA, 25 bp, Mus musculus
gcaaagcctcagcacttggctatta

SEQ ID NO: 526339 - DNA, 25 bp, Mus musculus
gcaaagcctcaggacttggctatta

SEQ ID NO: 526340 - DNA, 25 bp, Mus musculus
gcaaagcctgttacttggccaggag

SEQ ID NO: 526341 - DNA, 25 bp, Mus musculus
gcaaagcctgtttcttggccaggag

SEQ ID NO: 526342 - DNA, 25 bp, Mus musculus
gcaaagcctttcatacaacagtgaa

SEQ ID NO: 526343 - DNA, 25 bp, Mus musculus
gcaaagcctttcttacaacagtgaa

SEQ ID NO: 526344 - DNA, 25 bp, Mus musculus
gcaaagcctttgcatataacagtca

SEQ ID NO: 526345 - DNA, 25 bp, Mus musculus
gcaaagcctttggatataacagtca

SEQ ID NO: 526346 - DNA, 25 bp, Mus musculus
gcaaagcgaaagagggtcgccccac

SEQ ID NO: 526347 - DNA, 25 bp, Mus musculus
gcaaagcgaaagtgggtcgccccac

SEQ ID NO: 526348 - DNA, 25 bp, Mus musculus
gcaaagctaaaaaagggtgtttcag

SEQ ID NO: 526349 - DNA, 25 bp, Mus musculus
gcaaagctaaaatagggtgtttcag

SEQ ID NO: 526350 - DNA, 25 bp, Mus musculus
gcaaagctagacagtaacccaagaa

SEQ ID NO: 526351 - DNA, 25 bp, Mus musculus
gcaaagctagactgtaacccaagaa

SEQ ID NO: 526352 - DNA, 25 bp, Mus musculus
gcaaagctagcaccgtcctgaagaa

SEQ ID NO: 526353 - DNA, 25 bp, Mus musculus
gcaaagctagcagcgtcctgaagaa

SEQ ID NO: 526354 - DNA, 25 bp, Mus musculus
gcaaagctatttactactggaacat

SEQ ID NO: 526355 - DNA, 25 bp, Mus musculus
gcaaagctatttactgttgtttctg

SEQ ID NO: 526356 - DNA, 25 bp, Mus musculus
gcaaagctattttctactggaacat

SEQ ID NO: 526357 - DNA, 25 bp, Mus musculus
gcaaagctattttctgttgtttctg

SEQ ID NO: 526358 - DNA, 25 bp, Mus musculus
gcaaagctgaacaagattctgccta

SEQ ID NO: 526359 - DNA, 25 bp, Mus musculus
gcaaagctgaactagattctgccta

SEQ ID NO: 526360 - DNA, 25 bp, Mus musculus
gcaaagctgagtcaactgtaactgt

SEQ ID NO: 526361 - DNA, 25 bp, Mus musculus
gcaaagctgagtcctatttgataca

SEQ ID NO: 526362 - DNA, 25 bp, Mus musculus
gcaaagctgagtgaactgtaactgt

SEQ ID NO: 526363 - DNA, 25 bp, Mus musculus
gcaaagctgagtgctatttgataca

SEQ ID NO: 526364 - DNA, 25 bp, Mus musculus
gcaaagctgcacaagaacggaaccc

SEQ ID NO: 526365 - DNA, 25 bp, Mus musculus
gcaaagctgcactagaacggaaccc

SEQ ID NO: 526366 - DNA, 25 bp, Mus musculus
gcaaagctgctgcactagtttagga

SEQ ID NO: 526367 - DNA, 25 bp, Mus musculus
gcaaagctgctggactagtttagga

SEQ ID NO: 526368 - DNA, 25 bp, Mus musculus
gcaaagctgtgaagttccatgtttt

SEQ ID NO: 526369 - DNA, 25 bp, Mus musculus
gcaaagctgtgatgttccatgtttt

SEQ ID NO: 526370 - DNA, 25 bp, Mus musculus
gcaaagcttcagacaggaaaaccca

SEQ ID NO: 526371 - DNA, 25 bp, Mus musculus
gcaaagcttcagtcaggaaaaccca

SEQ ID NO: 526372 - DNA, 25 bp, Mus musculus
gcaaagcttgctcaactggatctca

SEQ ID NO: 526373 - DNA, 25 bp, Mus musculus
gcaaagcttgctgaactggatctca

SEQ ID NO: 526374 - DNA, 25 bp, Mus musculus
gcaaagctttcaagcgatccagcca

SEQ ID NO: 526375 - DNA, 25 bp, Mus musculus
gcaaagctttcatgcgatccagcca

SEQ ID NO: 526376 - DNA, 25 bp, Mus musculus
gcaaagcttttaaccagacgagaat

SEQ ID NO: 526377 - DNA, 25 bp, Mus musculus
gcaaagcttttatccagacgagaat

SEQ ID NO: 526378 - DNA, 25 bp, Mus musculus
gcaaaggaaaccagaaggacccaag

SEQ ID NO: 526379 - DNA, 25 bp, Mus musculus
gcaaaggaaacctgaaggacccaag

SEQ ID NO: 526380 - DNA, 25 bp, Mus musculus
gcaaaggaaattagccttcaccgtt

SEQ ID NO: 526381 - DNA, 25 bp, Mus musculus
gcaaaggaaatttgccttcaccgtt

SEQ ID NO: 526382 - DNA, 25 bp, Mus musculus
gcaaaggaagccagcatgcacataa

SEQ ID NO: 526383 - DNA, 25 bp, Mus musculus
gcaaaggaagcctgcatgcacataa

SEQ ID NO: 526384 - DNA, 25 bp, Mus musculus
gcaaaggacattcacttggccagaa

SEQ ID NO: 526385 - DNA, 25 bp, Mus musculus
gcaaaggacattgacttggccagaa

SEQ ID NO: 526386 - DNA, 25 bp, Mus musculus
gcaaaggaccagaattcagttccca

SEQ ID NO: 526387 - DNA, 25 bp, Mus musculus
gcaaaggaccagtattcagttccca

SEQ ID NO: 526388 - DNA, 25 bp, Mus musculus
gcaaaggactgactgaagctggcca

SEQ ID NO: 526389 - DNA, 25 bp, Mus musculus
gcaaaggactgagtgaagctggcca

SEQ ID NO: 526390 - DNA, 25 bp, Mus musculus
gcaaaggactggcactgcaaaattc

SEQ ID NO: 526391 - DNA, 25 bp, Mus musculus
gcaaaggactgggactgcaaaattc

SEQ ID NO: 526392 - DNA, 25 bp, Mus musculus
gcaaaggacttgatcctccctgagt

SEQ ID NO: 526393 - DNA, 25 bp, Mus musculus
gcaaaggacttgttcctccctgagt

SEQ ID NO: 526394 - DNA, 25 bp, Mus musculus
gcaaaggaggagcattccatcatta

SEQ ID NO: 526395 - DNA, 25 bp, Mus musculus
gcaaaggaggaggattccatcatta

SEQ ID NO: 526396 - DNA, 25 bp, Mus musculus
gcaaaggatcctagagggttccggt

SEQ ID NO: 526397 - DNA, 25 bp, Mus musculus
gcaaaggatcctctttcaattccca

SEQ ID NO: 526398 - DNA, 25 bp, Mus musculus
gcaaaggatcctgtttcaattccca

SEQ ID NO: 526399 - DNA, 25 bp, Mus musculus
gcaaaggatccttgagggttccggt

SEQ ID NO: 526400 - DNA, 25 bp, Mus musculus
gcaaaggattccaagaccaagacca

SEQ ID NO: 526401 - DNA, 25 bp, Mus musculus
gcaaaggattccagtgtttccaaac

SEQ ID NO: 526402 - DNA, 25 bp, Mus musculus
gcaaaggattcctagaccaagacca

SEQ ID NO: 526403 - DNA, 25 bp, Mus musculus
gcaaaggattcctgtgtttccaaac

SEQ ID NO: 526404 - DNA, 25 bp, Mus musculus
gcaaaggattctaatagcagagcta

SEQ ID NO: 526405 - DNA, 25 bp, Mus musculus
gcaaaggattcttatagcagagcta

SEQ ID NO: 526406 - DNA, 25 bp, Mus musculus
gcaaaggattttagctgcaacaaaa

SEQ ID NO: 526407 - DNA, 25 bp, Mus musculus
gcaaaggatttttgctgcaacaaaa

SEQ ID NO: 526408 - DNA, 25 bp, Mus musculus
gcaaaggcaaggcaccaagttttca

SEQ ID NO: 526409 - DNA, 25 bp, Mus musculus
gcaaaggcaagggaccaagttttca

SEQ ID NO: 526410 - DNA, 25 bp, Mus musculus
gcaaaggcacttcatgccaaacttg

SEQ ID NO: 526411 - DNA, 25 bp, Mus musculus
gcaaaggcacttgatgccaaacttg

SEQ ID NO: 526412 - DNA, 25 bp, Mus musculus
gcaaaggcagataccgtctctagct

SEQ ID NO: 526413 - DNA, 25 bp, Mus musculus
gcaaaggcagattccgtctctagct

SEQ ID NO: 526414 - DNA, 25 bp, Mus musculus
gcaaaggcagcaataggactagtaa

SEQ ID NO: 526415 - DNA, 25 bp, Mus musculus
gcaaaggcagcacgctaccggacgg

SEQ ID NO: 526416 - DNA, 25 bp, Mus musculus
gcaaaggcagcaggctaccggacgg

SEQ ID NO: 526417 - DNA, 25 bp, Mus musculus
gcaaaggcagcattaggactagtaa

SEQ ID NO: 526418 - DNA, 25 bp, Mus musculus
gcaaaggcagctcattgcagagcta

SEQ ID NO: 526419 - DNA, 25 bp, Mus musculus
gcaaaggcagctgattgcagagcta

SEQ ID NO: 526420 - DNA, 25 bp, Mus musculus
gcaaaggcattaagagatcagttca

SEQ ID NO: 526421 - DNA, 25 bp, Mus musculus
gcaaaggcattatgagatcagttca

SEQ ID NO: 526422 - DNA, 25 bp, Mus musculus
gcaaaggcccaactaccgaagcaaa

SEQ ID NO: 526423 - DNA, 25 bp, Mus musculus
gcaaaggcccaagtaccgaagcaaa

SEQ ID NO: 526424 - DNA, 25 bp, Mus musculus
gcaaaggcccgcaggtcaagcagac

SEQ ID NO: 526425 - DNA, 25 bp, Mus musculus
gcaaaggcccgctggtcaagcagac

SEQ ID NO: 526426 - DNA, 25 bp, Mus musculus
gcaaaggccgatcagctgcctgttc

SEQ ID NO: 526427 - DNA, 25 bp, Mus musculus
gcaaaggccgatgagctgcctgttc

SEQ ID NO: 526428 - DNA, 25 bp, Mus musculus
gcaaaggccggtagatatcagatca

SEQ ID NO: 526429 - DNA, 25 bp, Mus musculus
gcaaaggccggttgatatcagatca

SEQ ID NO: 526430 - DNA, 25 bp, Mus musculus
gcaaaggcgacgacccaactaagag

SEQ ID NO: 526431 - DNA, 25 bp, Mus musculus
gcaaaggcgacgtcccaactaagag

SEQ ID NO: 526432 - DNA, 25 bp, Mus musculus
gcaaaggcgcgccttctctgctctg

SEQ ID NO: 526433 - DNA, 25 bp, Mus musculus
gcaaaggcgcgcgttctctgctctg

SEQ ID NO: 526434 - DNA, 25 bp, Mus musculus
gcaaaggcgtgtactacaaggccct

SEQ ID NO: 526435 - DNA, 25 bp, Mus musculus
gcaaaggcgtgttctacaaggccct

SEQ ID NO: 526436 - DNA, 25 bp, Mus musculus
gcaaaggctccccaagaggcatgaa

SEQ ID NO: 526437 - DNA, 25 bp, Mus musculus
gcaaaggctcccgaagaggcatgaa

SEQ ID NO: 526438 - DNA, 25 bp, Mus musculus
gcaaaggctgaaaacactgtttctg

SEQ ID NO: 526439 - DNA, 25 bp, Mus musculus
gcaaaggctgaatacactgtttctg

SEQ ID NO: 526440 - DNA, 25 bp, Mus musculus
gcaaaggctgggactctaaggtcct

SEQ ID NO: 526441 - DNA, 25 bp, Mus musculus
gcaaaggctgggtctctaaggtcct

SEQ ID NO: 526442 - DNA, 25 bp, Mus musculus
gcaaaggctgtgagcaaccttcctt

SEQ ID NO: 526443 - DNA, 25 bp, Mus musculus
gcaaaggctgtgtgcaaccttcctt

SEQ ID NO: 526444 - DNA, 25 bp, Mus musculus
gcaaaggctttgcacggagctcaaa

SEQ ID NO: 526445 - DNA, 25 bp, Mus musculus
gcaaaggctttggacggagctcaaa

SEQ ID NO: 526446 - DNA, 25 bp, Mus musculus
gcaaagggaacacctgtttttccac

SEQ ID NO: 526447 - DNA, 25 bp, Mus musculus
gcaaagggaacagctgtttttccac

SEQ ID NO: 526448 - DNA, 25 bp, Mus musculus
gcaaagggattactgcctgcccgat

SEQ ID NO: 526449 - DNA, 25 bp, Mus musculus
gcaaagggattagtgcctgcccgat

SEQ ID NO: 526450 - DNA, 25 bp, Mus musculus
gcaaagggccatcggctcaccagct

SEQ ID NO: 526451 - DNA, 25 bp, Mus musculus
gcaaagggccatgggctcaccagct

SEQ ID NO: 526452 - DNA, 25 bp, Mus musculus
gcaaagggcctgaccccgggcagaa

SEQ ID NO: 526453 - DNA, 25 bp, Mus musculus
gcaaagggcctgtccccgggcagaa

SEQ ID NO: 526454 - DNA, 25 bp, Mus musculus
gcaaagggctgaacatgtccaggaa

SEQ ID NO: 526455 - DNA, 25 bp, Mus musculus
gcaaagggctgatcatgtccaggaa

SEQ ID NO: 526456 - DNA, 25 bp, Mus musculus
gcaaagggctttacacctaaggtca

SEQ ID NO: 526457 - DNA, 25 bp, Mus musculus
gcaaagggcttttcacctaaggtca

SEQ ID NO: 526458 - DNA, 25 bp, Mus musculus
gcaaagggtcttacgtattgggcac

SEQ ID NO: 526459 - DNA, 25 bp, Mus musculus
gcaaagggtctttcgtattgggcac

SEQ ID NO: 526460 - DNA, 25 bp, Mus musculus
gcaaagggtgtcagcgtacatccct

SEQ ID NO: 526461 - DNA, 25 bp, Mus musculus
gcaaagggtgtctgcgtacatccct

SEQ ID NO: 526462 - DNA, 25 bp, Mus musculus
gcaaagggtgtgatgagtgttcccc

SEQ ID NO: 526463 - DNA, 25 bp, Mus musculus
gcaaagggtgtgttgagtgttcccc

SEQ ID NO: 526464 - DNA, 25 bp, Mus musculus
gcaaaggtaatgctcttccctcctg

SEQ ID NO: 526465 - DNA, 25 bp, Mus musculus
gcaaaggtaatggtcttccctcctg

SEQ ID NO: 526466 - DNA, 25 bp, Mus musculus
gcaaaggtacttactgacaaactga

SEQ ID NO: 526467 - DNA, 25 bp, Mus musculus
gcaaaggtactttctgacaaactga

SEQ ID NO: 526468 - DNA, 25 bp, Mus musculus
gcaaaggtcaccactttctgaagag

SEQ ID NO: 526469 - DNA, 25 bp, Mus musculus
gcaaaggtcacctctttctgaagag

SEQ ID NO: 526470 - DNA, 25 bp, Mus musculus
gcaaaggtcattccatcagctcagt

SEQ ID NO: 526471 - DNA, 25 bp, Mus musculus
gcaaaggtcattgcatcagctcagt

SEQ ID NO: 526472 - DNA, 25 bp, Mus musculus
gcaaaggtcccaatgctcggaggaa

SEQ ID NO: 526473 - DNA, 25 bp, Mus musculus
gcaaaggtcccattgctcggaggaa

SEQ ID NO: 526474 - DNA, 25 bp, Mus musculus
gcaaaggtctgcatttgaggaatat

SEQ ID NO: 526475 - DNA, 25 bp, Mus musculus
gcaaaggtctgcttttgaggaatat

SEQ ID NO: 526476 - DNA, 25 bp, Mus musculus
gcaaaggtgagaacttccagagtaa

SEQ ID NO: 526477 - DNA, 25 bp, Mus musculus
gcaaaggtgagatcttccagagtaa

SEQ ID NO: 526478 - DNA, 25 bp, Mus musculus
gcaaaggtggtcacagacagtcatt

SEQ ID NO: 526479 - DNA, 25 bp, Mus musculus
gcaaaggtggtctcagacagtcatt

SEQ ID NO: 526480 - DNA, 25 bp, Mus musculus
gcaaaggtggtgatctgtaccctta

SEQ ID NO: 526481 - DNA, 25 bp, Mus musculus
gcaaaggtggtgttctgtaccctta

SEQ ID NO: 526482 - DNA, 25 bp, Mus musculus
gcaaaggttatgatcccaacctgct

SEQ ID NO: 526483 - DNA, 25 bp, Mus musculus
gcaaaggttatgttcccaacctgct

SEQ ID NO: 526484 - DNA, 25 bp, Mus musculus
gcaaaggtttgcacacagttagaca

SEQ ID NO: 526485 - DNA, 25 bp, Mus musculus
gcaaaggtttgctcacagttagaca

SEQ ID NO: 526486 - DNA, 25 bp, Mus musculus
gcaaaggtttttcctgagtgcctga

SEQ ID NO: 526487 - DNA, 25 bp, Mus musculus
gcaaaggtttttgctgagtgcctga

SEQ ID NO: 526488 - DNA, 25 bp, Mus musculus
gcaaagtaaaacagacggcacgcgt

SEQ ID NO: 526489 - DNA, 25 bp, Mus musculus
gcaaagtaaaactgacggcacgcgt

SEQ ID NO: 526490 - DNA, 25 bp, Mus musculus
gcaaagtacatcaagctaccggtaa

SEQ ID NO: 526491 - DNA, 25 bp, Mus musculus
gcaaagtacatctagctaccggtaa

SEQ ID NO: 526492 - DNA, 25 bp, Mus musculus
gcaaagtacccaagtggctgaagct

SEQ ID NO: 526493 - DNA, 25 bp, Mus musculus
gcaaagtacccatgtggctgaagct

SEQ ID NO: 526494 - DNA, 25 bp, Mus musculus
gcaaagtagaatctttcctaaggaa

SEQ ID NO: 526495 - DNA, 25 bp, Mus musculus
gcaaagtagaatgtttcctaaggaa

SEQ ID NO: 526496 - DNA, 25 bp, Mus musculus
gcaaagtagaccaaacagaatcctt

SEQ ID NO: 526497 - DNA, 25 bp, Mus musculus
gcaaagtagacctaacagaatcctt

SEQ ID NO: 526498 - DNA, 25 bp, Mus musculus
gcaaagtagcccattctaaagctaa

SEQ ID NO: 526499 - DNA, 25 bp, Mus musculus
gcaaagtagccctttctaaagctaa

SEQ ID NO: 526500 - DNA, 25 bp, Mus musculus
gcaaagtagcgacactgtgcacact

SEQ ID NO: 526501 - DNA, 25 bp, Mus musculus
gcaaagtagcgagactgtgcacact

SEQ ID NO: 526502 - DNA, 25 bp, Mus musculus
gcaaagtagctcaggcggattttcc

SEQ ID NO: 526503 - DNA, 25 bp, Mus musculus
gcaaagtagctctggcggattttcc

SEQ ID NO: 526504 - DNA, 25 bp, Mus musculus
gcaaagtcaaataggattcctggaa

SEQ ID NO: 526505 - DNA, 25 bp, Mus musculus
gcaaagtcaaattggattcctggaa

SEQ ID NO: 526506 - DNA, 25 bp, Mus musculus
gcaaagtcaaggctatctcatgaaa

SEQ ID NO: 526507 - DNA, 25 bp, Mus musculus
gcaaagtcaagggtatctcatgaaa

SEQ ID NO: 526508 - DNA, 25 bp, Mus musculus
gcaaagtcacaacccgctgtggcgg

SEQ ID NO: 526509 - DNA, 25 bp, Mus musculus
gcaaagtcacaagccgctgtggcgg

SEQ ID NO: 526510 - DNA, 25 bp, Mus musculus
gcaaagtcctatcacacagttcttt

SEQ ID NO: 526511 - DNA, 25 bp, Mus musculus
gcaaagtcctatgacacagttcttt

SEQ ID NO: 526512 - DNA, 25 bp, Mus musculus
gcaaagtcctgactcgcaagcccaa

SEQ ID NO: 526513 - DNA, 25 bp, Mus musculus
gcaaagtcctgagtcgcaagcccaa

SEQ ID NO: 526514 - DNA, 25 bp, Mus musculus
gcaaagtctatcacagtcccaaaaa

SEQ ID NO: 526515 - DNA, 25 bp, Mus musculus
gcaaagtctatctcagtcccaaaaa

SEQ ID NO: 526516 - DNA, 25 bp, Mus musculus
gcaaagtctcatagtgcaaaagctt

SEQ ID NO: 526517 - DNA, 25 bp, Mus musculus
gcaaagtctcattgtgcaaaagctt

SEQ ID NO: 526518 - DNA, 25 bp, Mus musculus
gcaaagtctgctcacagtgctattt

SEQ ID NO: 526519 - DNA, 25 bp, Mus musculus
gcaaagtctgctgacagtgctattt

SEQ ID NO: 526520 - DNA, 25 bp, Mus musculus
gcaaagtgactcaaccagtaaggta

SEQ ID NO: 526521 - DNA, 25 bp, Mus musculus
gcaaagtgactctaccagtaaggta

SEQ ID NO: 526522 - DNA, 25 bp, Mus musculus
gcaaagtgccacagagatcccgctg

SEQ ID NO: 526523 - DNA, 25 bp, Mus musculus
gcaaagtgccactgagatcccgctg

SEQ ID NO: 526524 - DNA, 25 bp, Mus musculus
gcaaagtggaccataccctccttgt

SEQ ID NO: 526525 - DNA, 25 bp, Mus musculus
gcaaagtggaccttaccctccttgt

SEQ ID NO: 526526 - DNA, 25 bp, Mus musculus
gcaaagtgtccccatttataattat

SEQ ID NO: 526527 - DNA, 25 bp, Mus musculus
gcaaagtgtcccgatttataattat

SEQ ID NO: 526528 - DNA, 25 bp, Mus musculus
gcaaagtgtctgaagcaagcggctg

SEQ ID NO: 526529 - DNA, 25 bp, Mus musculus
gcaaagtgtctgtagcaagcggctg

SEQ ID NO: 526530 - DNA, 25 bp, Mus musculus
gcaaagtgtggacttggtcttcccc

SEQ ID NO: 526531 - DNA, 25 bp, Mus musculus
gcaaagtgtggagttggtcttcccc

SEQ ID NO: 526532 - DNA, 25 bp, Mus musculus
gcaaagtgttgaacatgagagccat

SEQ ID NO: 526533 - DNA, 25 bp, Mus musculus
gcaaagtgttgatcatgagagccat

SEQ ID NO: 526534 - DNA, 25 bp, Mus musculus
gcaaagttacgtcgcatgagactaa

SEQ ID NO: 526535 - DNA, 25 bp, Mus musculus
gcaaagttacgtggcatgagactaa

SEQ ID NO: 526536 - DNA, 25 bp, Mus musculus
gcaaagttactgcaatgaactgctt

SEQ ID NO: 526537 - DNA, 25 bp, Mus musculus
gcaaagttactggaatgaactgctt

SEQ ID NO: 526538 - DNA, 25 bp, Mus musculus
gcaaagttatatactccattagctg

SEQ ID NO: 526539 - DNA, 25 bp, Mus musculus
gcaaagttatattctccattagctg

SEQ ID NO: 526540 - DNA, 25 bp, Mus musculus
gcaaagttcagtacaattgatccta

SEQ ID NO: 526541 - DNA, 25 bp, Mus musculus
gcaaagttcagttcaattgatccta

SEQ ID NO: 526542 - DNA, 25 bp, Mus musculus
gcaaagttcattctagtgttaccaa

SEQ ID NO: 526543 - DNA, 25 bp, Mus musculus
gcaaagttcattgtagtgttaccaa

SEQ ID NO: 526544 - DNA, 25 bp, Mus musculus
gcaaagttccccatatctagagact

SEQ ID NO: 526545 - DNA, 25 bp, Mus musculus
gcaaagttccccttatctagagact

SEQ ID NO: 526546 - DNA, 25 bp, Mus musculus
gcaaagttctagaatgatccatcaa

SEQ ID NO: 526547 - DNA, 25 bp, Mus musculus
gcaaagttctagtatgatccatcaa

SEQ ID NO: 526548 - DNA, 25 bp, Mus musculus
gcaaagttctgacctgagcatgatc

SEQ ID NO: 526549 - DNA, 25 bp, Mus musculus
gcaaagttctgagctgagcatgatc

SEQ ID NO: 526550 - DNA, 25 bp, Mus musculus
gcaaagttgcatccaagagccaatg

SEQ ID NO: 526551 - DNA, 25 bp, Mus musculus
gcaaagttgcatgcaagagccaatg

SEQ ID NO: 526552 - DNA, 25 bp, Mus musculus
gcaaagtttcctcttgactgagtgt

SEQ ID NO: 526553 - DNA, 25 bp, Mus musculus
gcaaagtttcctgttgactgagtgt

SEQ ID NO: 526554 - DNA, 25 bp, Mus musculus
gcaaagttttcaagtgagcctcata

SEQ ID NO: 526555 - DNA, 25 bp, Mus musculus
gcaaagttttcatgtgagcctcata

SEQ ID NO: 526556 - DNA, 25 bp, Mus musculus
gcaaagttttgaacgatctccatcc

SEQ ID NO: 526557 - DNA, 25 bp, Mus musculus
gcaaagttttgatcgatctccatcc

SEQ ID NO: 526558 - DNA, 25 bp, Mus musculus
gcaaataatcttagtactgtgcatt

SEQ ID NO: 526559 - DNA, 25 bp, Mus musculus
gcaaataatctttgtactgtgcatt

SEQ ID NO: 526560 - DNA, 25 bp, Mus musculus
gcaaataattctcacttagcctcat

SEQ ID NO: 526561 - DNA, 25 bp, Mus musculus
gcaaataattctgacttagcctcat

SEQ ID NO: 526562 - DNA, 25 bp, Mus musculus
gcaaatacaccaagatcttccacac

SEQ ID NO: 526563 - DNA, 25 bp, Mus musculus
gcaaatacaccatgatcttccacac

SEQ ID NO: 526564 - DNA, 25 bp, Mus musculus
gcaaatacacggactggatcagaat

SEQ ID NO: 526565 - DNA, 25 bp, Mus musculus
gcaaatacacggtctggatcagaat

SEQ ID NO: 526566 - DNA, 25 bp, Mus musculus
gcaaatacatggacccttccagata

SEQ ID NO: 526567 - DNA, 25 bp, Mus musculus
gcaaatacatggtcccttccagata

SEQ ID NO: 526568 - DNA, 25 bp, Mus musculus
gcaaataccctacgcttagttttgg

SEQ ID NO: 526569 - DNA, 25 bp, Mus musculus
gcaaataccctaggcttagttttgg

SEQ ID NO: 526570 - DNA, 25 bp, Mus musculus
gcaaatacccttacacgggaccaga

SEQ ID NO: 526571 - DNA, 25 bp, Mus musculus
gcaaataccctttcacgggaccaga

SEQ ID NO: 526572 - DNA, 25 bp, Mus musculus
gcaaatacctccagaaacactggca

SEQ ID NO: 526573 - DNA, 25 bp, Mus musculus
gcaaatacctcctgaaacactggca

SEQ ID NO: 526574 - DNA, 25 bp, Mus musculus
gcaaataccttgagaaaacctgagc

SEQ ID NO: 526575 - DNA, 25 bp, Mus musculus
gcaaataccttgtgaaaacctgagc

SEQ ID NO: 526576 - DNA, 25 bp, Mus musculus
gcaaatactacgagtccaaccaatc

SEQ ID NO: 526577 - DNA, 25 bp, Mus musculus
gcaaatactacgtgtccaaccaatc

SEQ ID NO: 526578 - DNA, 25 bp, Mus musculus
gcaaatactgctcttctaggtgact

SEQ ID NO: 526579 - DNA, 25 bp, Mus musculus
gcaaatactgctgttctaggtgact

SEQ ID NO: 526580 - DNA, 25 bp, Mus musculus
gcaaatactgttagcccctgagcct

SEQ ID NO: 526581 - DNA, 25 bp, Mus musculus
gcaaatactgtttgcccctgagcct

SEQ ID NO: 526582 - DNA, 25 bp, Mus musculus
gcaaatacttaacgtctggaccctc

SEQ ID NO: 526583 - DNA, 25 bp, Mus musculus
gcaaatacttaaggtctggaccctc

SEQ ID NO: 526584 - DNA, 25 bp, Mus musculus
gcaaatactttaactggatccacga

SEQ ID NO: 526585 - DNA, 25 bp, Mus musculus
gcaaatactttatctggatccacga

SEQ ID NO: 526586 - DNA, 25 bp, Mus musculus
gcaaatagacccagagccttcgata

SEQ ID NO: 526587 - DNA, 25 bp, Mus musculus
gcaaatagaccctgagccttcgata

SEQ ID NO: 526588 - DNA, 25 bp, Mus musculus
gcaaatagtggtactcagcagcacc

SEQ ID NO: 526589 - DNA, 25 bp, Mus musculus
gcaaatagtggttctcagcagcacc

SEQ ID NO: 526590 - DNA, 25 bp, Mus musculus
gcaaatatacagcacatggcaaata

SEQ ID NO: 526591 - DNA, 25 bp, Mus musculus
gcaaatatacaggacatggcaaata

SEQ ID NO: 526592 - DNA, 25 bp, Mus musculus
gcaaatatcatgagtcctggcttaa

SEQ ID NO: 526593 - DNA, 25 bp, Mus musculus
gcaaatatcatgtgtcctggcttaa

SEQ ID NO: 526594 - DNA, 25 bp, Mus musculus
gcaaatatccaaaaggtcacggact

SEQ ID NO: 526595 - DNA, 25 bp, Mus musculus
gcaaatatccaataggtcacggact

SEQ ID NO: 526596 - DNA, 25 bp, Mus musculus
gcaaatatcccacctgtacttttac

SEQ ID NO: 526597 - DNA, 25 bp, Mus musculus
gcaaatatcccagctgtacttttac

SEQ ID NO: 526598 - DNA, 25 bp, Mus musculus
gcaaatatctgcatgtccagccagg

SEQ ID NO: 526599 - DNA, 25 bp, Mus musculus
gcaaatatctgcttgtccagccagg

SEQ ID NO: 526600 - DNA, 25 bp, Mus musculus
gcaaatattgccactaattctgaat

SEQ ID NO: 526601 - DNA, 25 bp, Mus musculus
gcaaatattgcctctaattctgaat

SEQ ID NO: 526602 - DNA, 25 bp, Mus musculus
gcaaatatttgactcgctgtggcaa

SEQ ID NO: 526603 - DNA, 25 bp, Mus musculus
gcaaatatttgagtcgctgtggcaa

SEQ ID NO: 526604 - DNA, 25 bp, Mus musculus
gcaaatattttcagaactactgtct

SEQ ID NO: 526605 - DNA, 25 bp, Mus musculus
gcaaatattttctgaactactgtct

SEQ ID NO: 526606 - DNA, 25 bp, Mus musculus
gcaaatcaaagaccatccctgggaa

SEQ ID NO: 526607 - DNA, 25 bp, Mus musculus
gcaaatcaaagagcatccctgggaa

SEQ ID NO: 526608 - DNA, 25 bp, Mus musculus
gcaaatcactgaatcttcttcagag

SEQ ID NO: 526609 - DNA, 25 bp, Mus musculus
gcaaatcactgattcttcttcagag

SEQ ID NO: 526610 - DNA, 25 bp, Mus musculus
gcaaatcagacacagcaaaagacat

SEQ ID NO: 526611 - DNA, 25 bp, Mus musculus
gcaaatcagacagagcaaaagacat

SEQ ID NO: 526612 - DNA, 25 bp, Mus musculus
gcaaatcagtataactctgggtcaa

SEQ ID NO: 526613 - DNA, 25 bp, Mus musculus
gcaaatcagtattactctgggtcaa

SEQ ID NO: 526614 - DNA, 25 bp, Mus musculus
gcaaatcccaccaccaaagtagtga

SEQ ID NO: 526615 - DNA, 25 bp, Mus musculus
gcaaatcccacctccaaagtagtga

SEQ ID NO: 526616 - DNA, 25 bp, Mus musculus
gcaaatcccattagtgttatcagga

SEQ ID NO: 526617 - DNA, 25 bp, Mus musculus
gcaaatcccatttgtgttatcagga

SEQ ID NO: 526618 - DNA, 25 bp, Mus musculus
gcaaatcccgagaagcaatctgttc

SEQ ID NO: 526619 - DNA, 25 bp, Mus musculus
gcaaatcccgagtagcaatctgttc

SEQ ID NO: 526620 - DNA, 25 bp, Mus musculus
gcaaatccctccacgtgtagaatgt

SEQ ID NO: 526621 - DNA, 25 bp, Mus musculus
gcaaatccctcctcgtgtagaatgt

SEQ ID NO: 526622 - DNA, 25 bp, Mus musculus
gcaaatccctttatcatctgacatc

SEQ ID NO: 526623 - DNA, 25 bp, Mus musculus
gcaaatccctttttcatctgacatc

SEQ ID NO: 526624 - DNA, 25 bp, Mus musculus
gcaaatcctattcctgttatcaaga

SEQ ID NO: 526625 - DNA, 25 bp, Mus musculus
gcaaatcctattgctgttatcaaga

SEQ ID NO: 526626 - DNA, 25 bp, Mus musculus
gcaaatcctggaatataaacgtaaa

SEQ ID NO: 526627 - DNA, 25 bp, Mus musculus
gcaaatcctggattataaacgtaaa

SEQ ID NO: 526628 - DNA, 25 bp, Mus musculus
gcaaatcctggtactttagacctgg

SEQ ID NO: 526629 - DNA, 25 bp, Mus musculus
gcaaatcctggttctttagacctgg

SEQ ID NO: 526630 - DNA, 25 bp, Mus musculus
gcaaatcgagaaagccgcggcaggc

SEQ ID NO: 526631 - DNA, 25 bp, Mus musculus
gcaaatcgagaatgccgcggcaggc

SEQ ID NO: 526632 - DNA, 25 bp, Mus musculus
gcaaatcgcggcagtctgactcgag

SEQ ID NO: 526633 - DNA, 25 bp, Mus musculus
gcaaatcgcggctgtctgactcgag

SEQ ID NO: 526634 - DNA, 25 bp, Mus musculus
gcaaatcggattctggcagaggcca

SEQ ID NO: 526635 - DNA, 25 bp, Mus musculus
gcaaatcggattgtggcagaggcca

SEQ ID NO: 526636 - DNA, 25 bp, Mus musculus
gcaaatcgttggcatgcatgaacaa

SEQ ID NO: 526637 - DNA, 25 bp, Mus musculus
gcaaatcgttgggatgcatgaacaa

SEQ ID NO: 526638 - DNA, 25 bp, Mus musculus
gcaaatctcagactcgagggtcata

SEQ ID NO: 526639 - DNA, 25 bp, Mus musculus
gcaaatctcagagtcgagggtcata

SEQ ID NO: 526640 - DNA, 25 bp, Mus musculus
gcaaatctcagcaatgtcctgtctt

SEQ ID NO: 526641 - DNA, 25 bp, Mus musculus
gcaaatctcagctatgtcctgtctt

SEQ ID NO: 526642 - DNA, 25 bp, Mus musculus
gcaaatctctatctgttggttcccc

SEQ ID NO: 526643 - DNA, 25 bp, Mus musculus
gcaaatctctatgtgttggttcccc

SEQ ID NO: 526644 - DNA, 25 bp, Mus musculus
gcaaatctgaaaaactttacatgta

SEQ ID NO: 526645 - DNA, 25 bp, Mus musculus
gcaaatctgaaatactttacatgta

SEQ ID NO: 526646 - DNA, 25 bp, Mus musculus
gcaaatctggatattggcctctacc

SEQ ID NO: 526647 - DNA, 25 bp, Mus musculus
gcaaatctggattttggcctctacc

SEQ ID NO: 526648 - DNA, 25 bp, Mus musculus
gcaaatctgtccaaagtgcctttca

SEQ ID NO: 526649 - DNA, 25 bp, Mus musculus
gcaaatctgtccatgatagaagcga

SEQ ID NO: 526650 - DNA, 25 bp, Mus musculus
gcaaatctgtcctaagtgcctttca

SEQ ID NO: 526651 - DNA, 25 bp, Mus musculus
gcaaatctgtccttgatagaagcga

SEQ ID NO: 526652 - DNA, 25 bp, Mus musculus
gcaaatctgtctagtcctgattcac

SEQ ID NO: 526653 - DNA, 25 bp, Mus musculus
gcaaatctgtcttgtcctgattcac

SEQ ID NO: 526654 - DNA, 25 bp, Mus musculus
gcaaatctgtttcagcaatggaatg

SEQ ID NO: 526655 - DNA, 25 bp, Mus musculus
gcaaatctgtttgagcaatggaatg

SEQ ID NO: 526656 - DNA, 25 bp, Mus musculus
gcaaatcttagtccgggcagaccga

SEQ ID NO: 526657 - DNA, 25 bp, Mus musculus
gcaaatcttagtgcgggcagaccga

SEQ ID NO: 526658 - DNA, 25 bp, Mus musculus
gcaaatcttctcaggtgttcatatg

SEQ ID NO: 526659 - DNA, 25 bp, Mus musculus
gcaaatcttctcataacatctcctg

SEQ ID NO: 526660 - DNA, 25 bp, Mus musculus
gcaaatcttctctggtgttcatatg

SEQ ID NO: 526661 - DNA, 25 bp, Mus musculus
gcaaatcttctcttaacatctcctg

SEQ ID NO: 526662 - DNA, 25 bp, Mus musculus
gcaaatgaattcactgtacctcagg

SEQ ID NO: 526663 - DNA, 25 bp, Mus musculus
gcaaatgaattctctgtacctcagg

SEQ ID NO: 526664 - DNA, 25 bp, Mus musculus
gcaaatgacagcaggcacttgggcc

SEQ ID NO: 526665 - DNA, 25 bp, Mus musculus
gcaaatgacagctggcacttgggcc

SEQ ID NO: 526666 - DNA, 25 bp, Mus musculus
gcaaatgactacagcacccagacag

SEQ ID NO: 526667 - DNA, 25 bp, Mus musculus
gcaaatgactactgcacccagacag

SEQ ID NO: 526668 - DNA, 25 bp, Mus musculus
gcaaatgactgcagacctggagaca

SEQ ID NO: 526669 - DNA, 25 bp, Mus musculus
gcaaatgactgctgacctggagaca

SEQ ID NO: 526670 - DNA, 25 bp, Mus musculus
gcaaatgacttacctttaacaatcg

SEQ ID NO: 526671 - DNA, 25 bp, Mus musculus
gcaaatgacttagctttaacaatcg

SEQ ID NO: 526672 - DNA, 25 bp, Mus musculus
gcaaatgacttgagagcatgcttat

SEQ ID NO: 526673 - DNA, 25 bp, Mus musculus
gcaaatgacttgtgagcatgcttat

SEQ ID NO: 526674 - DNA, 25 bp, Mus musculus
gcaaatgagcaaagctttagccaag

SEQ ID NO: 526675 - DNA, 25 bp, Mus musculus
gcaaatgagcaatgctttagccaag

SEQ ID NO: 526676 - DNA, 25 bp, Mus musculus
gcaaatgattgtccaaggcatccat

SEQ ID NO: 526677 - DNA, 25 bp, Mus musculus
gcaaatgattgtgcaaggcatccat

SEQ ID NO: 526678 - DNA, 25 bp, Mus musculus
gcaaatgcacagattagcattacct

SEQ ID NO: 526679 - DNA, 25 bp, Mus musculus
gcaaatgcacagtttagcattacct

SEQ ID NO: 526680 - DNA, 25 bp, Mus musculus
gcaaatgcattcatattagctgatt

SEQ ID NO: 526681 - DNA, 25 bp, Mus musculus
gcaaatgcattcttattagctgatt

SEQ ID NO: 526682 - DNA, 25 bp, Mus musculus
gcaaatgccactacaattactggaa

SEQ ID NO: 526683 - DNA, 25 bp, Mus musculus
gcaaatgccacttcaattactggaa

SEQ ID NO: 526684 - DNA, 25 bp, Mus musculus
gcaaatgccctgatgtcacttctgg

SEQ ID NO: 526685 - DNA, 25 bp, Mus musculus
gcaaatgccctgttgtcacttctgg

SEQ ID NO: 526686 - DNA, 25 bp, Mus musculus
gcaaatgcctcaatcaggagctctg

SEQ ID NO: 526687 - DNA, 25 bp, Mus musculus
gcaaatgcctcacagtataaccagt

SEQ ID NO: 526688 - DNA, 25 bp, Mus musculus
gcaaatgcctcagagtataaccagt

SEQ ID NO: 526689 - DNA, 25 bp, Mus musculus
gcaaatgcctcattcaggagctctg

SEQ ID NO: 526690 - DNA, 25 bp, Mus musculus
gcaaatgccttaagatcaatagttt

SEQ ID NO: 526691 - DNA, 25 bp, Mus musculus
gcaaatgccttatgatcaatagttt

SEQ ID NO: 526692 - DNA, 25 bp, Mus musculus
gcaaatgcgggacttacaagatcaa

SEQ ID NO: 526693 - DNA, 25 bp, Mus musculus
gcaaatgcgggagttacaagatcaa

SEQ ID NO: 526694 - DNA, 25 bp, Mus musculus
gcaaatgctctacaaggcaaccatg

SEQ ID NO: 526695 - DNA, 25 bp, Mus musculus
gcaaatgctctagaaggcaaccatg

SEQ ID NO: 526696 - DNA, 25 bp, Mus musculus
gcaaatgctgcgaacagtgttactt

SEQ ID NO: 526697 - DNA, 25 bp, Mus musculus
gcaaatgctgcgtacagtgttactt

SEQ ID NO: 526698 - DNA, 25 bp, Mus musculus
gcaaatgctggcattacctgtgcag

SEQ ID NO: 526699 - DNA, 25 bp, Mus musculus
gcaaatgctggctttacctgtgcag

SEQ ID NO: 526700 - DNA, 25 bp, Mus musculus
gcaaatgctgggagttgggacacat

SEQ ID NO: 526701 - DNA, 25 bp, Mus musculus
gcaaatgctgggtgttgggacacat

SEQ ID NO: 526702 - DNA, 25 bp, Mus musculus
gcaaatgcttacagttaatggcgct

SEQ ID NO: 526703 - DNA, 25 bp, Mus musculus
gcaaatgcttactgttaatggcgct

SEQ ID NO: 526704 - DNA, 25 bp, Mus musculus
gcaaatggaaacactcggccacctt

SEQ ID NO: 526705 - DNA, 25 bp, Mus musculus
gcaaatggaaactctcggccacctt

SEQ ID NO: 526706 - DNA, 25 bp, Mus musculus
gcaaatggaagtcacatccgtctgt

SEQ ID NO: 526707 - DNA, 25 bp, Mus musculus
gcaaatggaagtgacatccgtctgt

SEQ ID NO: 526708 - DNA, 25 bp, Mus musculus
gcaaatggaccaatatctatataga

SEQ ID NO: 526709 - DNA, 25 bp, Mus musculus
gcaaatggaccattatctatataga

SEQ ID NO: 526710 - DNA, 25 bp, Mus musculus
gcaaatggactcacaggtgtccgaa

SEQ ID NO: 526711 - DNA, 25 bp, Mus musculus
gcaaatggactctcaggtgtccgaa

SEQ ID NO: 526712 - DNA, 25 bp, Mus musculus
gcaaatggactgatcgtgccaccaa

SEQ ID NO: 526713 - DNA, 25 bp, Mus musculus
gcaaatggactgttcgtgccaccaa

SEQ ID NO: 526714 - DNA, 25 bp, Mus musculus
gcaaatggagcacagaacccagttc

SEQ ID NO: 526715 - DNA, 25 bp, Mus musculus
gcaaatggagcagagaacccagttc

SEQ ID NO: 526716 - DNA, 25 bp, Mus musculus
gcaaatggcagaagctgcttcaccc

SEQ ID NO: 526717 - DNA, 25 bp, Mus musculus
gcaaatggcagatgctgcttcaccc

SEQ ID NO: 526718 - DNA, 25 bp, Mus musculus
gcaaatggcatgcaacccggaccaa

SEQ ID NO: 526719 - DNA, 25 bp, Mus musculus
gcaaatggcatggaacccggaccaa

SEQ ID NO: 526720 - DNA, 25 bp, Mus musculus
gcaaatggctggcattcgagcccta

SEQ ID NO: 526721 - DNA, 25 bp, Mus musculus
gcaaatggctgggattcgagcccta

SEQ ID NO: 526722 - DNA, 25 bp, Mus musculus
gcaaatgggagcatatcaacgtcta

SEQ ID NO: 526723 - DNA, 25 bp, Mus musculus
gcaaatgggagcttatcaacgtcta

SEQ ID NO: 526724 - DNA, 25 bp, Mus musculus
gcaaatgggcgcattaagtctgata

SEQ ID NO: 526725 - DNA, 25 bp, Mus musculus
gcaaatgggcgctttaagtctgata

SEQ ID NO: 526726 - DNA, 25 bp, Mus musculus
gcaaatggtagtacccgggagcctc

SEQ ID NO: 526727 - DNA, 25 bp, Mus musculus
gcaaatggtagttcccgggagcctc

SEQ ID NO: 526728 - DNA, 25 bp, Mus musculus
gcaaatggtctgacttgaacagtaa

SEQ ID NO: 526729 - DNA, 25 bp, Mus musculus
gcaaatggtctgtcttgaacagtaa

SEQ ID NO: 526730 - DNA, 25 bp, Mus musculus
gcaaatgtacagcttatcagggcag

SEQ ID NO: 526731 - DNA, 25 bp, Mus musculus
gcaaatgtacaggttatcagggcag

SEQ ID NO: 526732 - DNA, 25 bp, Mus musculus
gcaaatgtaccccattgttttgggt

SEQ ID NO: 526733 - DNA, 25 bp, Mus musculus
gcaaatgtacccgattgttttgggt

SEQ ID NO: 526734 - DNA, 25 bp, Mus musculus
gcaaatgtatgcagtccaggtcccc

SEQ ID NO: 526735 - DNA, 25 bp, Mus musculus
gcaaatgtatgctgtccaggtcccc

SEQ ID NO: 526736 - DNA, 25 bp, Mus musculus
gcaaatgtatttacatgtcccaggg

SEQ ID NO: 526737 - DNA, 25 bp, Mus musculus
gcaaatgtattttcatgtcccaggg

SEQ ID NO: 526738 - DNA, 25 bp, Mus musculus
gcaaatgtcaagagtggtgccatca

SEQ ID NO: 526739 - DNA, 25 bp, Mus musculus
gcaaatgtcaagtgtggtgccatca

SEQ ID NO: 526740 - DNA, 25 bp, Mus musculus
gcaaatgtgacactgtctatcagta

SEQ ID NO: 526741 - DNA, 25 bp, Mus musculus
gcaaatgtgacagtgtctatcagta

SEQ ID NO: 526742 - DNA, 25 bp, Mus musculus
gcaaatgtggcaatatactgtggtt

SEQ ID NO: 526743 - DNA, 25 bp, Mus musculus
gcaaatgtggcattatactgtggtt

SEQ ID NO: 526744 - DNA, 25 bp, Mus musculus
gcaaatgtggtaacccctgaacctt

SEQ ID NO: 526745 - DNA, 25 bp, Mus musculus
gcaaatgtggtatcccctgaacctt

SEQ ID NO: 526746 - DNA, 25 bp, Mus musculus
gcaaatgtgtctcgtttaatcctaa

SEQ ID NO: 526747 - DNA, 25 bp, Mus musculus
gcaaatgtgtctggtttaatcctaa

SEQ ID NO: 526748 - DNA, 25 bp, Mus musculus
gcaaatgtgtgtctcactgctccta

SEQ ID NO: 526749 - DNA, 25 bp, Mus musculus
gcaaatgtgtgtgtcactgctccta

SEQ ID NO: 526750 - DNA, 25 bp, Mus musculus
gcaaatgttaccactggcttcatgg

SEQ ID NO: 526751 - DNA, 25 bp, Mus musculus
gcaaatgttacctctggcttcatgg

SEQ ID NO: 526752 - DNA, 25 bp, Mus musculus
gcaaatgttcttaatgtgttttccc

SEQ ID NO: 526753 - DNA, 25 bp, Mus musculus
gcaaatgttctttatgtgttttccc

SEQ ID NO: 526754 - DNA, 25 bp, Mus musculus
gcaaatgtttagacctcacaattca

SEQ ID NO: 526755 - DNA, 25 bp, Mus musculus
gcaaatgtttagatgacagcatcat

SEQ ID NO: 526756 - DNA, 25 bp, Mus musculus
gcaaatgtttagtcctcacaattca

SEQ ID NO: 526757 - DNA, 25 bp, Mus musculus
gcaaatgtttagttgacagcatcat

SEQ ID NO: 526758 - DNA, 25 bp, Mus musculus
gcaaatgtttttcccctcagataat

SEQ ID NO: 526759 - DNA, 25 bp, Mus musculus
gcaaatgtttttgccctcagataat

SEQ ID NO: 526760 - DNA, 25 bp, Mus musculus
gcaaattaagtcatgattacctgat

SEQ ID NO: 526761 - DNA, 25 bp, Mus musculus
gcaaattaagtcttgattacctgat

SEQ ID NO: 526762 - DNA, 25 bp, Mus musculus
gcaaattacagtctttccctgccgc

SEQ ID NO: 526763 - DNA, 25 bp, Mus musculus
gcaaattacagtgtttccctgccgc

SEQ ID NO: 526764 - DNA, 25 bp, Mus musculus
gcaaattaccagcacagctgcttgg

SEQ ID NO: 526765 - DNA, 25 bp, Mus musculus
gcaaattaccaggacagctgcttgg

SEQ ID NO: 526766 - DNA, 25 bp, Mus musculus
gcaaattactgcatcttcatttaaa

SEQ ID NO: 526767 - DNA, 25 bp, Mus musculus
gcaaattactgcttcttcatttaaa

SEQ ID NO: 526768 - DNA, 25 bp, Mus musculus
gcaaattagctcatactcagggtca

SEQ ID NO: 526769 - DNA, 25 bp, Mus musculus
gcaaattagctcttactcagggtca

SEQ ID NO: 526770 - DNA, 25 bp, Mus musculus
gcaaattcaaatcctatgtactttt

SEQ ID NO: 526771 - DNA, 25 bp, Mus musculus
gcaaattcaaatgctatgtactttt

SEQ ID NO: 526772 - DNA, 25 bp, Mus musculus
gcaaattcaaggcaagcgtctacta

SEQ ID NO: 526773 - DNA, 25 bp, Mus musculus
gcaaattcaagggaagcgtctacta

SEQ ID NO: 526774 - DNA, 25 bp, Mus musculus
gcaaattcacttacacagttctaga

SEQ ID NO: 526775 - DNA, 25 bp, Mus musculus
gcaaattcactttcacagttctaga

SEQ ID NO: 526776 - DNA, 25 bp, Mus musculus
gcaaattcagagcagcattctccgt

SEQ ID NO: 526777 - DNA, 25 bp, Mus musculus
gcaaattcagagcagtgttctccat

SEQ ID NO: 526778 - DNA, 25 bp, Mus musculus
gcaaattcagaggagcattctccgt

SEQ ID NO: 526779 - DNA, 25 bp, Mus musculus
gcaaattcagaggagtgttctccat

SEQ ID NO: 526780 - DNA, 25 bp, Mus musculus
gcaaattccagcatcgggcaagtga

SEQ ID NO: 526781 - DNA, 25 bp, Mus musculus
gcaaattccagcttcgggcaagtga

SEQ ID NO: 526782 - DNA, 25 bp, Mus musculus
gcaaattcccacaggatttagacaa

SEQ ID NO: 526783 - DNA, 25 bp, Mus musculus
gcaaattcccactggatttagacaa

SEQ ID NO: 526784 - DNA, 25 bp, Mus musculus
gcaaattcccagaattataatccac

SEQ ID NO: 526785 - DNA, 25 bp, Mus musculus
gcaaattcccagatctgaagacgga

SEQ ID NO: 526786 - DNA, 25 bp, Mus musculus
gcaaattcccagtattataatccac

SEQ ID NO: 526787 - DNA, 25 bp, Mus musculus
gcaaattcccagttctgaagacgga

SEQ ID NO: 526788 - DNA, 25 bp, Mus musculus
gcaaattccttcaaaatctgatgtg

SEQ ID NO: 526789 - DNA, 25 bp, Mus musculus
gcaaattccttctaaatctgatgtg

SEQ ID NO: 526790 - DNA, 25 bp, Mus musculus
gcaaattctagcagtggtgtgtcca

SEQ ID NO: 526791 - DNA, 25 bp, Mus musculus
gcaaattctagctgtggtgtgtcca

SEQ ID NO: 526792 - DNA, 25 bp, Mus musculus
gcaaattctcttcagccgtgtaagc

SEQ ID NO: 526793 - DNA, 25 bp, Mus musculus
gcaaattctcttgagccgtgtaagc

SEQ ID NO: 526794 - DNA, 25 bp, Mus musculus
gcaaattctgttccctacttgaaaa

SEQ ID NO: 526795 - DNA, 25 bp, Mus musculus
gcaaattctgttgcctacttgaaaa

SEQ ID NO: 526796 - DNA, 25 bp, Mus musculus
gcaaattcttaaagtctgtgccttc

SEQ ID NO: 526797 - DNA, 25 bp, Mus musculus
gcaaattcttaatgtctgtgccttc

SEQ ID NO: 526798 - DNA, 25 bp, Mus musculus
gcaaattcttccaggccgtcagtcc

SEQ ID NO: 526799 - DNA, 25 bp, Mus musculus
gcaaattcttcctggccgtcagtcc

SEQ ID NO: 526800 - DNA, 25 bp, Mus musculus
gcaaattctttcagctcaaggagag

SEQ ID NO: 526801 - DNA, 25 bp, Mus musculus
gcaaattctttctgctcaaggagag

SEQ ID NO: 526802 - DNA, 25 bp, Mus musculus
gcaaattgcatgagatttcactgaa

SEQ ID NO: 526803 - DNA, 25 bp, Mus musculus
gcaaattgcatgtgatttcactgaa

SEQ ID NO: 526804 - DNA, 25 bp, Mus musculus
gcaaattggtacctgggctgctttc

SEQ ID NO: 526805 - DNA, 25 bp, Mus musculus
gcaaattggtacgtgggctgctttc

SEQ ID NO: 526806 - DNA, 25 bp, Mus musculus
gcaaattgtgttcctagtcctctga

SEQ ID NO: 526807 - DNA, 25 bp, Mus musculus
gcaaattgtgttgctagtcctctga

SEQ ID NO: 526808 - DNA, 25 bp, Mus musculus
gcaaattgttccacagacttcactg

SEQ ID NO: 526809 - DNA, 25 bp, Mus musculus
gcaaattgttcctcagacttcactg

SEQ ID NO: 526810 - DNA, 25 bp, Mus musculus
gcaaatttaggtacatacatattgt

SEQ ID NO: 526811 - DNA, 25 bp, Mus musculus
gcaaatttaggttcatacatattgt

SEQ ID NO: 526812 - DNA, 25 bp, Mus musculus
gcaaatttccccatctggtttatag

SEQ ID NO: 526813 - DNA, 25 bp, Mus musculus
gcaaatttccccttctggtttatag

SEQ ID NO: 526814 - DNA, 25 bp, Mus musculus
gcaaatttctcaaaattctactcca

SEQ ID NO: 526815 - DNA, 25 bp, Mus musculus
gcaaatttctcaatgaaggctccaa

SEQ ID NO: 526816 - DNA, 25 bp, Mus musculus
gcaaatttctcataattctactcca

SEQ ID NO: 526817 - DNA, 25 bp, Mus musculus
gcaaatttctcattgaaggctccaa

SEQ ID NO: 526818 - DNA, 25 bp, Mus musculus
gcaaatttgcctaagctgtctgtgt

SEQ ID NO: 526819 - DNA, 25 bp, Mus musculus
gcaaatttgccttagctgtctgtgt

SEQ ID NO: 526820 - DNA, 25 bp, Mus musculus
gcaaatttgctgctgatgccataaa

SEQ ID NO: 526821 - DNA, 25 bp, Mus musculus
gcaaatttgctggtgatgccataaa

SEQ ID NO: 526822 - DNA, 25 bp, Mus musculus
gcaaatttgtagctttccgatcccg

SEQ ID NO: 526823 - DNA, 25 bp, Mus musculus
gcaaatttgtaggtttccgatcccg

SEQ ID NO: 526824 - DNA, 25 bp, Mus musculus
gcaaattttcttccaaccagcttaa

SEQ ID NO: 526825 - DNA, 25 bp, Mus musculus
gcaaattttcttgcaaccagcttaa

SEQ ID NO: 526826 - DNA, 25 bp, Mus musculus
gcaaattttgaactggcaattacga

SEQ ID NO: 526827 - DNA, 25 bp, Mus musculus
gcaaattttgaagtggcaattacga

SEQ ID NO: 526828 - DNA, 25 bp, Mus musculus
gcaaattttttacttctcctcttct

SEQ ID NO: 526829 - DNA, 25 bp, Mus musculus
gcaaattttttagttctcctcttct

SEQ ID NO: 526830 - DNA, 25 bp, Mus musculus
gcaacaaaacacaacctcgaagtct

SEQ ID NO: 526831 - DNA, 25 bp, Mus musculus
gcaacaaaacactacctcgaagtct

SEQ ID NO: 526832 - DNA, 25 bp, Mus musculus
gcaacaaaacccacagaattcctga

SEQ ID NO: 526833 - DNA, 25 bp, Mus musculus
gcaacaaaaccctcagaattcctga

SEQ ID NO: 526834 - DNA, 25 bp, Mus musculus
gcaacaaaaccgacgcttcaaggag

SEQ ID NO: 526835 - DNA, 25 bp, Mus musculus
gcaacaaaaccgtcgcttcaaggag

SEQ ID NO: 526836 - DNA, 25 bp, Mus musculus
gcaacaaaagcccacgcagagggaa

SEQ ID NO: 526837 - DNA, 25 bp, Mus musculus
gcaacaaaagccgacgcagagggaa

SEQ ID NO: 526838 - DNA, 25 bp, Mus musculus
gcaacaaaaggcctaatcaagagta

SEQ ID NO: 526839 - DNA, 25 bp, Mus musculus
gcaacaaaaggcgtaatcaagagta

SEQ ID NO: 526840 - DNA, 25 bp, Mus musculus
gcaacaaacatactgaagctgtgtt

SEQ ID NO: 526841 - DNA, 25 bp, Mus musculus
gcaacaaacatagtgaagctgtgtt

SEQ ID NO: 526842 - DNA, 25 bp, Mus musculus
gcaacaaagccaccccatgtgtaat

SEQ ID NO: 526843 - DNA, 25 bp, Mus musculus
gcaacaaagccagcccatgtgtaat

SEQ ID NO: 526844 - DNA, 25 bp, Mus musculus
gcaacaacagctagcctgtttcctg

SEQ ID NO: 526845 - DNA, 25 bp, Mus musculus
gcaacaacagcttgcctgtttcctg

SEQ ID NO: 526846 - DNA, 25 bp, Mus musculus
gcaacaacatttagaaaggcaacat

SEQ ID NO: 526847 - DNA, 25 bp, Mus musculus
gcaacaacattttgaaaggcaacat

SEQ ID NO: 526848 - DNA, 25 bp, Mus musculus
gcaacaaccaggatcggctgcggga

SEQ ID NO: 526849 - DNA, 25 bp, Mus musculus
gcaacaaccaggttcggctgcggga

SEQ ID NO: 526850 - DNA, 25 bp, Mus musculus
gcaacaacctgcactctgtagtggg

SEQ ID NO: 526851 - DNA, 25 bp, Mus musculus
gcaacaacctgctctctgtagtggg

SEQ ID NO: 526852 - DNA, 25 bp, Mus musculus
gcaacaactacgcatgctcagtatt

SEQ ID NO: 526853 - DNA, 25 bp, Mus musculus
gcaacaactacggatgctcagtatt

SEQ ID NO: 526854 - DNA, 25 bp, Mus musculus
gcaacaactgacatatggtctctat

SEQ ID NO: 526855 - DNA, 25 bp, Mus musculus
gcaacaactgacttatggtctctat

SEQ ID NO: 526856 - DNA, 25 bp, Mus musculus
gcaacaagaagtacgcacgctcgga

SEQ ID NO: 526857 - DNA, 25 bp, Mus musculus
gcaacaagaagttcgcacgctcgga

SEQ ID NO: 526858 - DNA, 25 bp, Mus musculus
gcaacaagacgcacacgctgtgccg

SEQ ID NO: 526859 - DNA, 25 bp, Mus musculus
gcaacaagacgctcacgctgtgccg

SEQ ID NO: 526860 - DNA, 25 bp, Mus musculus
gcaacaagactaagtatcctctaca

SEQ ID NO: 526861 - DNA, 25 bp, Mus musculus
gcaacaagactatgtatcctctaca

SEQ ID NO: 526862 - DNA, 25 bp, Mus musculus
gcaacaagagcaacatcaaggccat

SEQ ID NO: 526863 - DNA, 25 bp, Mus musculus
gcaacaagagcatcatcaaggccat

SEQ ID NO: 526864 - DNA, 25 bp, Mus musculus
gcaacaagcctcaaagacagtggtt

SEQ ID NO: 526865 - DNA, 25 bp, Mus musculus
gcaacaagcctctaagacagtggtt

SEQ ID NO: 526866 - DNA, 25 bp, Mus musculus
gcaacaagctggaacacctgtacct

SEQ ID NO: 526867 - DNA, 25 bp, Mus musculus
gcaacaagctggtacacctgtacct

SEQ ID NO: 526868 - DNA, 25 bp, Mus musculus
gcaacaagtccaagtcatttcaaag

SEQ ID NO: 526869 - DNA, 25 bp, Mus musculus
gcaacaagtccatgtcatttcaaag

SEQ ID NO: 526870 - DNA, 25 bp, Mus musculus
gcaacaagtcttctcatcttctgaa

SEQ ID NO: 526871 - DNA, 25 bp, Mus musculus
gcaacaagtcttgtcatcttctgaa

SEQ ID NO: 526872 - DNA, 25 bp, Mus musculus
gcaacaagtgctctaagctactgaa

SEQ ID NO: 526873 - DNA, 25 bp, Mus musculus
gcaacaagtgctgtaagctactgaa

SEQ ID NO: 526874 - DNA, 25 bp, Mus musculus
gcaacaatatgcatttcctggttat

SEQ ID NO: 526875 - DNA, 25 bp, Mus musculus
gcaacaatatgcttttcctggttat

SEQ ID NO: 526876 - DNA, 25 bp, Mus musculus
gcaacaatcaaaatatggacccatg

SEQ ID NO: 526877 - DNA, 25 bp, Mus musculus
gcaacaatcaaattatggacccatg

SEQ ID NO: 526878 - DNA, 25 bp, Mus musculus
gcaacaatgtagcatcttcctgggt

SEQ ID NO: 526879 - DNA, 25 bp, Mus musculus
gcaacaatgtaggatcttcctgggt

SEQ ID NO: 526880 - DNA, 25 bp, Mus musculus
gcaacacaccaactatttttaccac

SEQ ID NO: 526881 - DNA, 25 bp, Mus musculus
gcaacacaccaagtatttttaccac

SEQ ID NO: 526882 - DNA, 25 bp, Mus musculus
gcaacacacggtcggcattgggaat

SEQ ID NO: 526883 - DNA, 25 bp, Mus musculus
gcaacacacggtgggcattgggaat

SEQ ID NO: 526884 - DNA, 25 bp, Mus musculus
gcaacacagagaaccccatgtctca

SEQ ID NO: 526885 - DNA, 25 bp, Mus musculus
gcaacacagagatccccatgtctca

SEQ ID NO: 526886 - DNA, 25 bp, Mus musculus
gcaacacagcgtcctgatggcatta

SEQ ID NO: 526887 - DNA, 25 bp, Mus musculus
gcaacacagcgtgctgatggcatta

SEQ ID NO: 526888 - DNA, 25 bp, Mus musculus
gcaacacagggaacttggtcaggaa

SEQ ID NO: 526889 - DNA, 25 bp, Mus musculus
gcaacacagggatcttggtcaggaa

SEQ ID NO: 526890 - DNA, 25 bp, Mus musculus
gcaacacagtgactctccgcatcat

SEQ ID NO: 526891 - DNA, 25 bp, Mus musculus
gcaacacagtgagtctccgcatcat

SEQ ID NO: 526892 - DNA, 25 bp, Mus musculus
gcaacacataccatcttagtctagt

SEQ ID NO: 526893 - DNA, 25 bp, Mus musculus
gcaacacataccttcttagtctagt

SEQ ID NO: 526894 - DNA, 25 bp, Mus musculus
gcaacacatggacaatgggcacaaa

SEQ ID NO: 526895 - DNA, 25 bp, Mus musculus
gcaacacatggagaatgggcacaaa

SEQ ID NO: 526896 - DNA, 25 bp, Mus musculus
gcaacacatttgacaccaggctttg

SEQ ID NO: 526897 - DNA, 25 bp, Mus musculus
gcaacacatttgtcaccaggctttg

SEQ ID NO: 526898 - DNA, 25 bp, Mus musculus
gcaacaccacgactgcagagcgaag

SEQ ID NO: 526899 - DNA, 25 bp, Mus musculus
gcaacaccacgagtgcagagcgaag

SEQ ID NO: 526900 - DNA, 25 bp, Mus musculus
gcaacaccagacctgatggaaaaat

SEQ ID NO: 526901 - DNA, 25 bp, Mus musculus
gcaacaccagacgtgatggaaaaat

SEQ ID NO: 526902 - DNA, 25 bp, Mus musculus
gcaacaccagctcccaataacttta

SEQ ID NO: 526903 - DNA, 25 bp, Mus musculus
gcaacaccagctgccaataacttta

SEQ ID NO: 526904 - DNA, 25 bp, Mus musculus
gcaacaccagtcagaggttcctaga

SEQ ID NO: 526905 - DNA, 25 bp, Mus musculus
gcaacaccagtctgaggttcctaga

SEQ ID NO: 526906 - DNA, 25 bp, Mus musculus
gcaacaccagttatcattccttaca

SEQ ID NO: 526907 - DNA, 25 bp, Mus musculus
gcaacaccagttcccattgctcatt

SEQ ID NO: 526908 - DNA, 25 bp, Mus musculus
gcaacaccagttgccattgctcatt

SEQ ID NO: 526909 - DNA, 25 bp, Mus musculus
gcaacaccagttttcattccttaca

SEQ ID NO: 526910 - DNA, 25 bp, Mus musculus
gcaacaccatgtacaggttgaaaaa

SEQ ID NO: 526911 - DNA, 25 bp, Mus musculus
gcaacaccatgttcaggttgaaaaa

SEQ ID NO: 526912 - DNA, 25 bp, Mus musculus
gcaacacctaagaaattcctatgta

SEQ ID NO: 526913 - DNA, 25 bp, Mus musculus
gcaacacctaagtaattcctatgta

SEQ ID NO: 526914 - DNA, 25 bp, Mus musculus
gcaacacctgctaaccgaggatggt

SEQ ID NO: 526915 - DNA, 25 bp, Mus musculus
gcaacacctgcttaccgaggatggt

SEQ ID NO: 526916 - DNA, 25 bp, Mus musculus
gcaacacgaattctgcattgacatt

SEQ ID NO: 526917 - DNA, 25 bp, Mus musculus
gcaacacgaattgtgcattgacatt

SEQ ID NO: 526918 - DNA, 25 bp, Mus musculus
gcaacacgcgttagtggaggccatt

SEQ ID NO: 526919 - DNA, 25 bp, Mus musculus
gcaacacgcgtttgtggaggccatt

SEQ ID NO: 526920 - DNA, 25 bp, Mus musculus
gcaacacgggcgagatcaaagcact

SEQ ID NO: 526921 - DNA, 25 bp, Mus musculus
gcaacacgggcgtgatcaaagcact

SEQ ID NO: 526922 - DNA, 25 bp, Mus musculus
gcaacactagagacagggcatggtt

SEQ ID NO: 526923 - DNA, 25 bp, Mus musculus
gcaacactagagtcagggcatggtt

SEQ ID NO: 526924 - DNA, 25 bp, Mus musculus
gcaacactatataatttcttaagat

SEQ ID NO: 526925 - DNA, 25 bp, Mus musculus
gcaacactatattatttcttaagat

SEQ ID NO: 526926 - DNA, 25 bp, Mus musculus
gcaacactcactctctccaggaaaa

SEQ ID NO: 526927 - DNA, 25 bp, Mus musculus
gcaacactcactgtctccaggaaaa

SEQ ID NO: 526928 - DNA, 25 bp, Mus musculus
gcaacactcatgaggtgggctggct

SEQ ID NO: 526929 - DNA, 25 bp, Mus musculus
gcaacactcatgtggtgggctggct

SEQ ID NO: 526930 - DNA, 25 bp, Mus musculus
gcaacactcctaactgctatctgag

SEQ ID NO: 526931 - DNA, 25 bp, Mus musculus
gcaacactcctatctgctatctgag

SEQ ID NO: 526932 - DNA, 25 bp, Mus musculus
gcaacactcttacctttggtgtcag

SEQ ID NO: 526933 - DNA, 25 bp, Mus musculus
gcaacactcttagctttggtgtcag

SEQ ID NO: 526934 - DNA, 25 bp, Mus musculus
gcaacactgaccctagagcagcttt

SEQ ID NO: 526935 - DNA, 25 bp, Mus musculus
gcaacactgaccgtagagcagcttt

SEQ ID NO: 526936 - DNA, 25 bp, Mus musculus
gcaacactgcccaggcactaggact

SEQ ID NO: 526937 - DNA, 25 bp, Mus musculus
gcaacactgccctggcactaggact

SEQ ID NO: 526938 - DNA, 25 bp, Mus musculus
gcaacacttaccacacttttcaaag

SEQ ID NO: 526939 - DNA, 25 bp, Mus musculus
gcaacacttacctcacttttcaaag

SEQ ID NO: 526940 - DNA, 25 bp, Mus musculus
gcaacacttcctaacagggcaatag

SEQ ID NO: 526941 - DNA, 25 bp, Mus musculus
gcaacacttccttacagggcaatag

SEQ ID NO: 526942 - DNA, 25 bp, Mus musculus
gcaacacttctcatgacaatcgctt

SEQ ID NO: 526943 - DNA, 25 bp, Mus musculus
gcaacacttctcttgacaatcgctt

SEQ ID NO: 526944 - DNA, 25 bp, Mus musculus
gcaacacttgtgaagactgccagcc

SEQ ID NO: 526945 - DNA, 25 bp, Mus musculus
gcaacacttgtgtagactgccagcc

SEQ ID NO: 526946 - DNA, 25 bp, Mus musculus
gcaacactttgcacatcatgtaaat

SEQ ID NO: 526947 - DNA, 25 bp, Mus musculus
gcaacactttgctcatcatgtaaat

SEQ ID NO: 526948 - DNA, 25 bp, Mus musculus
gcaacagaatcaagtttgttcccat

SEQ ID NO: 526949 - DNA, 25 bp, Mus musculus
gcaacagaatcatgtttgttcccat

SEQ ID NO: 526950 - DNA, 25 bp, Mus musculus
gcaacagaccagatcactttccaaa

SEQ ID NO: 526951 - DNA, 25 bp, Mus musculus
gcaacagaccagttcactttccaaa

SEQ ID NO: 526952 - DNA, 25 bp, Mus musculus
gcaacagacctgagcgtttgttcac

SEQ ID NO: 526953 - DNA, 25 bp, Mus musculus
gcaacagacctgtgcgtttgttcac

SEQ ID NO: 526954 - DNA, 25 bp, Mus musculus
gcaacagatagtattgtatttagtt

SEQ ID NO: 526955 - DNA, 25 bp, Mus musculus
gcaacagatagttttgtatttagtt

SEQ ID NO: 526956 - DNA, 25 bp, Mus musculus
gcaacagatcatatcgggtgactta

SEQ ID NO: 526957 - DNA, 25 bp, Mus musculus
gcaacagatcatttcgggtgactta

SEQ ID NO: 526958 - DNA, 25 bp, Mus musculus
gcaacagatccactatttaaaacat

SEQ ID NO: 526959 - DNA, 25 bp, Mus musculus
gcaacagatccagtatttaaaacat

SEQ ID NO: 526960 - DNA, 25 bp, Mus musculus
gcaacagattgcacgtaaggctagc

SEQ ID NO: 526961 - DNA, 25 bp, Mus musculus
gcaacagattgctcgtaaggctagc

SEQ ID NO: 526962 - DNA, 25 bp, Mus musculus
gcaacagattggagatagaccatct

SEQ ID NO: 526963 - DNA, 25 bp, Mus musculus
gcaacagattggtgatagaccatct

SEQ ID NO: 526964 - DNA, 25 bp, Mus musculus
gcaacagatttgacagaggtgatca

SEQ ID NO: 526965 - DNA, 25 bp, Mus musculus
gcaacagatttgtcagaggtgatca

SEQ ID NO: 526966 - DNA, 25 bp, Mus musculus
gcaacagcaccaaggaacgcaagtt

SEQ ID NO: 526967 - DNA, 25 bp, Mus musculus
gcaacagcaccatggaacgcaagtt

SEQ ID NO: 526968 - DNA, 25 bp, Mus musculus
gcaacagcacgcaggattgcattag

SEQ ID NO: 526969 - DNA, 25 bp, Mus musculus
gcaacagcacgctggattgcattag

SEQ ID NO: 526970 - DNA, 25 bp, Mus musculus
gcaacagcagcaatatttactgggt

SEQ ID NO: 526971 - DNA, 25 bp, Mus musculus
gcaacagcagcacaatctcacgagt

SEQ ID NO: 526972 - DNA, 25 bp, Mus musculus
gcaacagcagcagaatctcacgagt

SEQ ID NO: 526973 - DNA, 25 bp, Mus musculus
gcaacagcagcattatttactgggt

SEQ ID NO: 526974 - DNA, 25 bp, Mus musculus
gcaacagcaggtactactcctagaa

SEQ ID NO: 526975 - DNA, 25 bp, Mus musculus
gcaacagcaggttctactcctagaa

SEQ ID NO: 526976 - DNA, 25 bp, Mus musculus
gcaacagcagtcatatttctagtat

SEQ ID NO: 526977 - DNA, 25 bp, Mus musculus
gcaacagcagtcttatttctagtat

SEQ ID NO: 526978 - DNA, 25 bp, Mus musculus
gcaacagcagttcatcttccagcag

SEQ ID NO: 526979 - DNA, 25 bp, Mus musculus
gcaacagcagttccatgaccaccag

SEQ ID NO: 526980 - DNA, 25 bp, Mus musculus
gcaacagcagttgatcttccagcag

SEQ ID NO: 526981 - DNA, 25 bp, Mus musculus
gcaacagcagttgcatgaccaccag

SEQ ID NO: 526982 - DNA, 25 bp, Mus musculus
gcaacagccaagattctgactccca

SEQ ID NO: 526983 - DNA, 25 bp, Mus musculus
gcaacagccaagtttctgactccca

SEQ ID NO: 526984 - DNA, 25 bp, Mus musculus
gcaacagccactactgagaccagac

SEQ ID NO: 526985 - DNA, 25 bp, Mus musculus
gcaacagccacttctgagaccagac

SEQ ID NO: 526986 - DNA, 25 bp, Mus musculus
gcaacagccagactagcagtggatg

SEQ ID NO: 526987 - DNA, 25 bp, Mus musculus
gcaacagccagagtagcagtggatg

SEQ ID NO: 526988 - DNA, 25 bp, Mus musculus
gcaacagccagcaccgagaattcag

SEQ ID NO: 526989 - DNA, 25 bp, Mus musculus
gcaacagccagccactgaaagtaat

SEQ ID NO: 526990 - DNA, 25 bp, Mus musculus
gcaacagccagcgactgaaagtaat

SEQ ID NO: 526991 - DNA, 25 bp, Mus musculus
gcaacagccagctccgagaattcag

SEQ ID NO: 526992 - DNA, 25 bp, Mus musculus
gcaacagccctgagtctgagagact

SEQ ID NO: 526993 - DNA, 25 bp, Mus musculus
gcaacagccctgtgtctgagagact

SEQ ID NO: 526994 - DNA, 25 bp, Mus musculus
gcaacagcctgaagcctgtgacagt

SEQ ID NO: 526995 - DNA, 25 bp, Mus musculus
gcaacagcctgatgcctgtgacagt

SEQ ID NO: 526996 - DNA, 25 bp, Mus musculus
gcaacagcctgcaacagggccacag

SEQ ID NO: 526997 - DNA, 25 bp, Mus musculus
gcaacagcctgctacagggccacag

SEQ ID NO: 526998 - DNA, 25 bp, Mus musculus
gcaacagcctgtcaaacactgaagg

SEQ ID NO: 526999 - DNA, 25 bp, Mus musculus
gcaacagcctgtgaaacactgaagg

SEQ ID NO: 527000 - DNA, 25 bp, Mus musculus
gcaacagcgaaacttctatatccac

SEQ ID NO: 527001 - DNA, 25 bp, Mus musculus
gcaacagcgaaagttctatatccac

SEQ ID NO: 527002 - DNA, 25 bp, Mus musculus
gcaacagcgactagttctacagagt

SEQ ID NO: 527003 - DNA, 25 bp, Mus musculus
gcaacagcgacttgttctacagagt

SEQ ID NO: 527004 - DNA, 25 bp, Mus musculus
gcaacagcgagaatgcactcacatt

SEQ ID NO: 527005 - DNA, 25 bp, Mus musculus
gcaacagcgagattgcactcacatt

SEQ ID NO: 527006 - DNA, 25 bp, Mus musculus
gcaacagctaagagtggaacatcca

SEQ ID NO: 527007 - DNA, 25 bp, Mus musculus
gcaacagctaagtgtggaacatcca

SEQ ID NO: 527008 - DNA, 25 bp, Mus musculus
gcaacagctactccacagaacttta

SEQ ID NO: 527009 - DNA, 25 bp, Mus musculus
gcaacagctactgcacagaacttta

SEQ ID NO: 527010 - DNA, 25 bp, Mus musculus
gcaacagctccaagattatcagaaa

SEQ ID NO: 527011 - DNA, 25 bp, Mus musculus
gcaacagctccatgattatcagaaa

SEQ ID NO: 527012 - DNA, 25 bp, Mus musculus
gcaacagctctgcaattcggatctt

SEQ ID NO: 527013 - DNA, 25 bp, Mus musculus
gcaacagctctggaattcggatctt

SEQ ID NO: 527014 - DNA, 25 bp, Mus musculus
gcaacagctgcccttcgagagcttt

SEQ ID NO: 527015 - DNA, 25 bp, Mus musculus
gcaacagctgccgttcgagagcttt

SEQ ID NO: 527016 - DNA, 25 bp, Mus musculus
gcaacagcttctactcagtgaatct

SEQ ID NO: 527017 - DNA, 25 bp, Mus musculus
gcaacagcttcttctcagtgaatct

SEQ ID NO: 527018 - DNA, 25 bp, Mus musculus
gcaacagcttgccttgggcttgaaa

SEQ ID NO: 527019 - DNA, 25 bp, Mus musculus
gcaacagcttgcgttgggcttgaaa

SEQ ID NO: 527020 - DNA, 25 bp, Mus musculus
gcaacaggaaaacacatgtcagagt

SEQ ID NO: 527021 - DNA, 25 bp, Mus musculus
gcaacaggaaaagacatgtcagagt

SEQ ID NO: 527022 - DNA, 25 bp, Mus musculus
gcaacaggacgcacgacgatcagct

SEQ ID NO: 527023 - DNA, 25 bp, Mus musculus
gcaacaggacgctcgacgatcagct

SEQ ID NO: 527024 - DNA, 25 bp, Mus musculus
gcaacaggccggcatttttactcgg

SEQ ID NO: 527025 - DNA, 25 bp, Mus musculus
gcaacaggccgggatttttactcgg

SEQ ID NO: 527026 - DNA, 25 bp, Mus musculus
gcaacaggctgcacaacattagaca

SEQ ID NO: 527027 - DNA, 25 bp, Mus musculus
gcaacaggctgctcaacattagaca

SEQ ID NO: 527028 - DNA, 25 bp, Mus musculus
gcaacagggcctagggtattcacaa

SEQ ID NO: 527029 - DNA, 25 bp, Mus musculus
gcaacagggccttgggtattcacaa

SEQ ID NO: 527030 - DNA, 25 bp, Mus musculus
gcaacagggcgtattccttctccag

SEQ ID NO: 527031 - DNA, 25 bp, Mus musculus
gcaacagggcgttttccttctccag

SEQ ID NO: 527032 - DNA, 25 bp, Mus musculus
gcaacagggtggagaaagtttaact

SEQ ID NO: 527033 - DNA, 25 bp, Mus musculus
gcaacagggtggtgaaagtttaact

SEQ ID NO: 527034 - DNA, 25 bp, Mus musculus
gcaacagggttgatccttcaaagga

SEQ ID NO: 527035 - DNA, 25 bp, Mus musculus
gcaacagggttgttccttcaaagga

SEQ ID NO: 527036 - DNA, 25 bp, Mus musculus
gcaacaggtactattagcctctctg

SEQ ID NO: 527037 - DNA, 25 bp, Mus musculus
gcaacaggtacttttagcctctctg

SEQ ID NO: 527038 - DNA, 25 bp, Mus musculus
gcaacagtaaatccaaacccactca

SEQ ID NO: 527039 - DNA, 25 bp, Mus musculus
gcaacagtaaatgcaaacccactca

SEQ ID NO: 527040 - DNA, 25 bp, Mus musculus
gcaacagtaggacagatggcccaag

SEQ ID NO: 527041 - DNA, 25 bp, Mus musculus
gcaacagtaggagagatggcccaag

SEQ ID NO: 527042 - DNA, 25 bp, Mus musculus
gcaacagtagtaagacccttcctca

SEQ ID NO: 527043 - DNA, 25 bp, Mus musculus
gcaacagtagtatgacccttcctca

SEQ ID NO: 527044 - DNA, 25 bp, Mus musculus
gcaacagtatggcagagcacctctt

SEQ ID NO: 527045 - DNA, 25 bp, Mus musculus
gcaacagtatgggagagcacctctt

SEQ ID NO: 527046 - DNA, 25 bp, Mus musculus
gcaacagtcagtcgaagcttggaca

SEQ ID NO: 527047 - DNA, 25 bp, Mus musculus
gcaacagtcagtggaagcttggaca

SEQ ID NO: 527048 - DNA, 25 bp, Mus musculus
gcaacagtgacactggagacgacat

SEQ ID NO: 527049 - DNA, 25 bp, Mus musculus
gcaacagtgacagtggagacgacat

SEQ ID NO: 527050 - DNA, 25 bp, Mus musculus
gcaacagtgcctccaggctgcagga

SEQ ID NO: 527051 - DNA, 25 bp, Mus musculus
gcaacagtgcctgcaggctgcagga

SEQ ID NO: 527052 - DNA, 25 bp, Mus musculus
gcaacagtggccagtgggacctgct

SEQ ID NO: 527053 - DNA, 25 bp, Mus musculus
gcaacagtggcctgtgggacctgct

SEQ ID NO: 527054 - DNA, 25 bp, Mus musculus
gcaacagtggctccgacagatccag

SEQ ID NO: 527055 - DNA, 25 bp, Mus musculus
gcaacagtggctgcgacagatccag

SEQ ID NO: 527056 - DNA, 25 bp, Mus musculus
gcaacagtggttatcttctgaaggc

SEQ ID NO: 527057 - DNA, 25 bp, Mus musculus
gcaacagtggttttcttctgaaggc

SEQ ID NO: 527058 - DNA, 25 bp, Mus musculus
gcaacagttaacactatgggctcag

SEQ ID NO: 527059 - DNA, 25 bp, Mus musculus
gcaacagttaactctatgggctcag

SEQ ID NO: 527060 - DNA, 25 bp, Mus musculus
gcaacagttactcaagaatgcaatc

SEQ ID NO: 527061 - DNA, 25 bp, Mus musculus
gcaacagttactgaagaatgcaatc

SEQ ID NO: 527062 - DNA, 25 bp, Mus musculus
gcaacagttagccaaaacacatgta

SEQ ID NO: 527063 - DNA, 25 bp, Mus musculus
gcaacagttagcgaaaacacatgta

SEQ ID NO: 527064 - DNA, 25 bp, Mus musculus
gcaacagttcttattcttaactcct

SEQ ID NO: 527065 - DNA, 25 bp, Mus musculus
gcaacagttctttttcttaactcct

SEQ ID NO: 527066 - DNA, 25 bp, Mus musculus
gcaacagttgatctctctgccgaac

SEQ ID NO: 527067 - DNA, 25 bp, Mus musculus
gcaacagttgatgtctctgccgaac

SEQ ID NO: 527068 - DNA, 25 bp, Mus musculus
gcaacagtttagctcaatgtccttt

SEQ ID NO: 527069 - DNA, 25 bp, Mus musculus
gcaacagtttaggtcaatgtccttt

SEQ ID NO: 527070 - DNA, 25 bp, Mus musculus
gcaacagtttatctctgaggtcact

SEQ ID NO: 527071 - DNA, 25 bp, Mus musculus
gcaacagtttatgtctgaggtcact

SEQ ID NO: 527072 - DNA, 25 bp, Mus musculus
gcaacagtttggactgcatttgtta

SEQ ID NO: 527073 - DNA, 25 bp, Mus musculus
gcaacagtttggcacctgaacaggg

SEQ ID NO: 527074 - DNA, 25 bp, Mus musculus
gcaacagtttgggacctgaacaggg

SEQ ID NO: 527075 - DNA, 25 bp, Mus musculus
gcaacagtttggtctgcatttgtta

SEQ ID NO: 527076 - DNA, 25 bp, Mus musculus
gcaacataaaacacttgtcctaccc

SEQ ID NO: 527077 - DNA, 25 bp, Mus musculus
gcaacataaaactcttgtcctaccc

SEQ ID NO: 527078 - DNA, 25 bp, Mus musculus
gcaacataaatcaagagctggtact

SEQ ID NO: 527079 - DNA, 25 bp, Mus musculus
gcaacataaatctagagctggtact

SEQ ID NO: 527080 - DNA, 25 bp, Mus musculus
gcaacataccttcgccatgttggaa

SEQ ID NO: 527081 - DNA, 25 bp, Mus musculus
gcaacataccttggccatgttggaa

SEQ ID NO: 527082 - DNA, 25 bp, Mus musculus
gcaacatagcttcagggtaggacct

SEQ ID NO: 527083 - DNA, 25 bp, Mus musculus
gcaacatagcttgagggtaggacct

SEQ ID NO: 527084 - DNA, 25 bp, Mus musculus
gcaacatagtggacggtgccagcaa

SEQ ID NO: 527085 - DNA, 25 bp, Mus musculus
gcaacatagtggtcggtgccagcaa

SEQ ID NO: 527086 - DNA, 25 bp, Mus musculus
gcaacatagttcctttcccttgtac

SEQ ID NO: 527087 - DNA, 25 bp, Mus musculus
gcaacatagttcgtttcccttgtac

SEQ ID NO: 527088 - DNA, 25 bp, Mus musculus
gcaacatatcatcccgctgacaaag

SEQ ID NO: 527089 - DNA, 25 bp, Mus musculus
gcaacatatcatgccgctgacaaag

SEQ ID NO: 527090 - DNA, 25 bp, Mus musculus
gcaacatattgaagcatttgtcata

SEQ ID NO: 527091 - DNA, 25 bp, Mus musculus
gcaacatattgatgcatttgtcata

SEQ ID NO: 527092 - DNA, 25 bp, Mus musculus
gcaacatcagacaatcatacacgaa

SEQ ID NO: 527093 - DNA, 25 bp, Mus musculus
gcaacatcagactatcatacacgaa

SEQ ID NO: 527094 - DNA, 25 bp, Mus musculus
gcaacatcagatattacttgtcaat

SEQ ID NO: 527095 - DNA, 25 bp, Mus musculus
gcaacatcagattttacttgtcaat

SEQ ID NO: 527096 - DNA, 25 bp, Mus musculus
gcaacatcagcgagcaacgacagat

SEQ ID NO: 527097 - DNA, 25 bp, Mus musculus
gcaacatcagcgtgcaacgacagat

SEQ ID NO: 527098 - DNA, 25 bp, Mus musculus
gcaacatcataaaagctgttctttg

SEQ ID NO: 527099 - DNA, 25 bp, Mus musculus
gcaacatcataatagctgttctttg

SEQ ID NO: 527100 - DNA, 25 bp, Mus musculus
gcaacatcatcaatatctcggcctt

SEQ ID NO: 527101 - DNA, 25 bp, Mus musculus
gcaacatcatcattatctcggcctt

SEQ ID NO: 527102 - DNA, 25 bp, Mus musculus
gcaacatcctagatgacaagtctat

SEQ ID NO: 527103 - DNA, 25 bp, Mus musculus
gcaacatcctagttgacaagtctat

SEQ ID NO: 527104 - DNA, 25 bp, Mus musculus
gcaacatcggatcctgctctgatta

SEQ ID NO: 527105 - DNA, 25 bp, Mus musculus
gcaacatcggatgctgctctgatta

SEQ ID NO: 527106 - DNA, 25 bp, Mus musculus
gcaacatcttaaagcccagctggcg

SEQ ID NO: 527107 - DNA, 25 bp, Mus musculus
gcaacatcttaatgcccagctggcg

SEQ ID NO: 527108 - DNA, 25 bp, Mus musculus
gcaacatcttcacctgtggggacaa

SEQ ID NO: 527109 - DNA, 25 bp, Mus musculus
gcaacatcttcactaactttttcag

SEQ ID NO: 527110 - DNA, 25 bp, Mus musculus
gcaacatcttcagctgtggggacaa

SEQ ID NO: 527111 - DNA, 25 bp, Mus musculus
gcaacatcttcagtaactttttcag

SEQ ID NO: 527112 - DNA, 25 bp, Mus musculus
gcaacatcttgtacttggttcaact

SEQ ID NO: 527113 - DNA, 25 bp, Mus musculus
gcaacatcttgttcttggttcaact

SEQ ID NO: 527114 - DNA, 25 bp, Mus musculus
gcaacatgaattacaccaagaccgt

SEQ ID NO: 527115 - DNA, 25 bp, Mus musculus
gcaacatgaatttcaccaagaccgt

SEQ ID NO: 527116 - DNA, 25 bp, Mus musculus
gcaacatggacccaaagtgcccggg

SEQ ID NO: 527117 - DNA, 25 bp, Mus musculus
gcaacatggaccgaaagtgcccggg

SEQ ID NO: 527118 - DNA, 25 bp, Mus musculus
gcaacatggtcaacttgccaacaag

SEQ ID NO: 527119 - DNA, 25 bp, Mus musculus
gcaacatggtcatcttgccaacaag

SEQ ID NO: 527120 - DNA, 25 bp, Mus musculus
gcaacatgtcgtctgctacaggcaa

SEQ ID NO: 527121 - DNA, 25 bp, Mus musculus
gcaacatgtcgtgtgctacaggcaa

SEQ ID NO: 527122 - DNA, 25 bp, Mus musculus
gcaacatgtggaaattcctcatcca

SEQ ID NO: 527123 - DNA, 25 bp, Mus musculus
gcaacatgtggatattcctcatcca

SEQ ID NO: 527124 - DNA, 25 bp, Mus musculus
gcaacatgttatatcagttttccat

SEQ ID NO: 527125 - DNA, 25 bp, Mus musculus
gcaacatgttatttcagttttccat

SEQ ID NO: 527126 - DNA, 25 bp, Mus musculus
gcaacattaacaactggcaggccag

SEQ ID NO: 527127 - DNA, 25 bp, Mus musculus
gcaacattaacatctggcaggccag

SEQ ID NO: 527128 - DNA, 25 bp, Mus musculus
gcaacattatcaacagtatctgcac

SEQ ID NO: 527129 - DNA, 25 bp, Mus musculus
gcaacattatcatcagtatctgcac

SEQ ID NO: 527130 - DNA, 25 bp, Mus musculus
gcaacattcatcagctttggatcca

SEQ ID NO: 527131 - DNA, 25 bp, Mus musculus
gcaacattcatctgctttggatcca

SEQ ID NO: 527132 - DNA, 25 bp, Mus musculus
gcaacattccctatgtatttttgag

SEQ ID NO: 527133 - DNA, 25 bp, Mus musculus
gcaacattccctttgtatttttgag

SEQ ID NO: 527134 - DNA, 25 bp, Mus musculus
gcaacattccttattcaccaactag

SEQ ID NO: 527135 - DNA, 25 bp, Mus musculus
gcaacattcctttttcaccaactag

SEQ ID NO: 527136 - DNA, 25 bp, Mus musculus
gcaacattcgccagggcaagctgga

SEQ ID NO: 527137 - DNA, 25 bp, Mus musculus
gcaacattcgcctgggcaagctgga

SEQ ID NO: 527138 - DNA, 25 bp, Mus musculus
gcaacattcttgctaaagcgccaga

SEQ ID NO: 527139 - DNA, 25 bp, Mus musculus
gcaacattcttggtaaagcgccaga

SEQ ID NO: 527140 - DNA, 25 bp, Mus musculus
gcaacattgaggacttggcactccc

SEQ ID NO: 527141 - DNA, 25 bp, Mus musculus
gcaacattgaggtcttggcactccc

SEQ ID NO: 527142 - DNA, 25 bp, Mus musculus
gcaacattggccaactatccttata

SEQ ID NO: 527143 - DNA, 25 bp, Mus musculus
gcaacattggcctactatccttata

SEQ ID NO: 527144 - DNA, 25 bp, Mus musculus
gcaacattggcgaaggacccagaaa

SEQ ID NO: 527145 - DNA, 25 bp, Mus musculus
gcaacattggcgtaggacccagaaa

SEQ ID NO: 527146 - DNA, 25 bp, Mus musculus
gcaacattggtcctcaagtctacac

SEQ ID NO: 527147 - DNA, 25 bp, Mus musculus
gcaacattggtcgtcaagtctacac

SEQ ID NO: 527148 - DNA, 25 bp, Mus musculus
gcaacatttccaaagatcttccttt

SEQ ID NO: 527149 - DNA, 25 bp, Mus musculus
gcaacatttccatagatcttccttt

SEQ ID NO: 527150 - DNA, 25 bp, Mus musculus
gcaacatttcgtagtgttcttggca

SEQ ID NO: 527151 - DNA, 25 bp, Mus musculus
gcaacatttcgttgtgttcttggca

SEQ ID NO: 527152 - DNA, 25 bp, Mus musculus
gcaacatttctgcatgcgtattttg

SEQ ID NO: 527153 - DNA, 25 bp, Mus musculus
gcaacatttctggatgcgtattttg

SEQ ID NO: 527154 - DNA, 25 bp, Mus musculus
gcaacatttgagctcctgaagactt

SEQ ID NO: 527155 - DNA, 25 bp, Mus musculus
gcaacatttgaggtcctgaagactt

SEQ ID NO: 527156 - DNA, 25 bp, Mus musculus
gcaacatttgccagccatatgagga

SEQ ID NO: 527157 - DNA, 25 bp, Mus musculus
gcaacatttgcctgccatatgagga

SEQ ID NO: 527158 - DNA, 25 bp, Mus musculus
gcaacatttgggccagctaaacatg

SEQ ID NO: 527159 - DNA, 25 bp, Mus musculus
gcaacatttggggcagctaaacatg

SEQ ID NO: 527160 - DNA, 25 bp, Mus musculus
gcaacatttgttataagttctggca

SEQ ID NO: 527161 - DNA, 25 bp, Mus musculus
gcaacatttgttttaagttctggca

SEQ ID NO: 527162 - DNA, 25 bp, Mus musculus
gcaacattttgaaggcagagcccaa

SEQ ID NO: 527163 - DNA, 25 bp, Mus musculus
gcaacattttgatggcagagcccaa

SEQ ID NO: 527164 - DNA, 25 bp, Mus musculus
gcaacattttgcaacatagactatt

SEQ ID NO: 527165 - DNA, 25 bp, Mus musculus
gcaacattttgctacatagactatt

SEQ ID NO: 527166 - DNA, 25 bp, Mus musculus
gcaacattttggcacgtctcactgc

SEQ ID NO: 527167 - DNA, 25 bp, Mus musculus
gcaacattttgggacgtctcactgc

SEQ ID NO: 527168 - DNA, 25 bp, Mus musculus
gcaaccaaaaatacccatcacagat

SEQ ID NO: 527169 - DNA, 25 bp, Mus musculus
gcaaccaaaaattcccatcacagat

SEQ ID NO: 527170 - DNA, 25 bp, Mus musculus
gcaaccaaaggcatttccctttaag

SEQ ID NO: 527171 - DNA, 25 bp, Mus musculus
gcaaccaaaggcttttccctttaag

SEQ ID NO: 527172 - DNA, 25 bp, Mus musculus
gcaaccaaagtactggcctgtcatt

SEQ ID NO: 527173 - DNA, 25 bp, Mus musculus
gcaaccaaagtagtggcctgtcatt

SEQ ID NO: 527174 - DNA, 25 bp, Mus musculus
gcaaccaacgtacagcaggcattca

SEQ ID NO: 527175 - DNA, 25 bp, Mus musculus
gcaaccaacgtagagcaggcattca

SEQ ID NO: 527176 - DNA, 25 bp, Mus musculus
gcaaccaaggagactgtaccctgga

SEQ ID NO: 527177 - DNA, 25 bp, Mus musculus
gcaaccaaggagtctgtaccctgga

SEQ ID NO: 527178 - DNA, 25 bp, Mus musculus
gcaaccaaggcgagtcaggagctct

SEQ ID NO: 527179 - DNA, 25 bp, Mus musculus
gcaaccaaggcgtgtcaggagctct

SEQ ID NO: 527180 - DNA, 25 bp, Mus musculus
gcaaccaagtctacctctatttttt

SEQ ID NO: 527181 - DNA, 25 bp, Mus musculus
gcaaccaagtcttcctctatttttt

SEQ ID NO: 527182 - DNA, 25 bp, Mus musculus
gcaaccaatataaaaagggcgctta

SEQ ID NO: 527183 - DNA, 25 bp, Mus musculus
gcaaccaatatataaagggcgctta

SEQ ID NO: 527184 - DNA, 25 bp, Mus musculus
gcaaccaatgcaactgtcttcaagt

SEQ ID NO: 527185 - DNA, 25 bp, Mus musculus
gcaaccaatgcatctgtcttcaagt

SEQ ID NO: 527186 - DNA, 25 bp, Mus musculus
gcaaccaattttaatcctacatgaa

SEQ ID NO: 527187 - DNA, 25 bp, Mus musculus
gcaaccaatttttatcctacatgaa

SEQ ID NO: 527188 - DNA, 25 bp, Mus musculus
gcaaccacaggacggttcacaaggg

SEQ ID NO: 527189 - DNA, 25 bp, Mus musculus
gcaaccacaggagggttcacaaggg

SEQ ID NO: 527190 - DNA, 25 bp, Mus musculus
gcaaccacatggaagcttcaacaac

SEQ ID NO: 527191 - DNA, 25 bp, Mus musculus
gcaaccacatggaggctcacaacca

SEQ ID NO: 527192 - DNA, 25 bp, Mus musculus
gcaaccacatggtagcttcaacaac

SEQ ID NO: 527193 - DNA, 25 bp, Mus musculus
gcaaccacatggtggctcacaacca

SEQ ID NO: 527194 - DNA, 25 bp, Mus musculus
gcaaccaccgagagggaggacggga

SEQ ID NO: 527195 - DNA, 25 bp, Mus musculus
gcaaccaccgagtgggaggacggga

SEQ ID NO: 527196 - DNA, 25 bp, Mus musculus
gcaaccactagtaagctgaccaaga

SEQ ID NO: 527197 - DNA, 25 bp, Mus musculus
gcaaccactagttagctgaccaaga

SEQ ID NO: 527198 - DNA, 25 bp, Mus musculus
gcaaccactatactccttagtgtaa

SEQ ID NO: 527199 - DNA, 25 bp, Mus musculus
gcaaccactatagtccttagtgtaa

SEQ ID NO: 527200 - DNA, 25 bp, Mus musculus
gcaaccacttctctaggaggattct

SEQ ID NO: 527201 - DNA, 25 bp, Mus musculus
gcaaccacttctgtaggaggattct

SEQ ID NO: 527202 - DNA, 25 bp, Mus musculus
gcaaccagacccaagaggtgggaag

SEQ ID NO: 527203 - DNA, 25 bp, Mus musculus
gcaaccagaccctagaggtgggaag

SEQ ID NO: 527204 - DNA, 25 bp, Mus musculus
gcaaccagaggcatcggaaagtcta

SEQ ID NO: 527205 - DNA, 25 bp, Mus musculus
gcaaccagaggcttcggaaagtcta

SEQ ID NO: 527206 - DNA, 25 bp, Mus musculus
gcaaccagcagcatgtggacattat

SEQ ID NO: 527207 - DNA, 25 bp, Mus musculus
gcaaccagcagcttgtggacattat

SEQ ID NO: 527208 - DNA, 25 bp, Mus musculus
gcaaccaggaccagaactgtgattt

SEQ ID NO: 527209 - DNA, 25 bp, Mus musculus
gcaaccaggacctgaactgtgattt

SEQ ID NO: 527210 - DNA, 25 bp, Mus musculus
gcaaccaggttgaatgtcatctcta

SEQ ID NO: 527211 - DNA, 25 bp, Mus musculus
gcaaccaggttgtatgtcatctcta

SEQ ID NO: 527212 - DNA, 25 bp, Mus musculus
gcaaccaggtttaaaagagcttagg

SEQ ID NO: 527213 - DNA, 25 bp, Mus musculus
gcaaccaggttttaaagagcttagg

SEQ ID NO: 527214 - DNA, 25 bp, Mus musculus
gcaaccagtaagagaaaacacccat

SEQ ID NO: 527215 - DNA, 25 bp, Mus musculus
gcaaccagtaagtgaaaacacccat

SEQ ID NO: 527216 - DNA, 25 bp, Mus musculus
gcaaccagtgctcttgattgttgag

SEQ ID NO: 527217 - DNA, 25 bp, Mus musculus
gcaaccagtgctgttgattgttgag

SEQ ID NO: 527218 - DNA, 25 bp, Mus musculus
gcaaccatacacaatttggatgtct

SEQ ID NO: 527219 - DNA, 25 bp, Mus musculus
gcaaccatacactatttggatgtct

SEQ ID NO: 527220 - DNA, 25 bp, Mus musculus
gcaaccatatttatactttgtcttg

SEQ ID NO: 527221 - DNA, 25 bp, Mus musculus
gcaaccatatttttactttgtcttg

SEQ ID NO: 527222 - DNA, 25 bp, Mus musculus
gcaaccatcgaaattcttcatcact

SEQ ID NO: 527223 - DNA, 25 bp, Mus musculus
gcaaccatcgaatttcttcatcact

SEQ ID NO: 527224 - DNA, 25 bp, Mus musculus
gcaaccatcgtaccagatctttctg

SEQ ID NO: 527225 - DNA, 25 bp, Mus musculus
gcaaccatcgtagcagatctttctg

SEQ ID NO: 527226 - DNA, 25 bp, Mus musculus
gcaaccatctctatagcaactggag

SEQ ID NO: 527227 - DNA, 25 bp, Mus musculus
gcaaccatctctttagcaactggag

SEQ ID NO: 527228 - DNA, 25 bp, Mus musculus
gcaaccatctgtcaggccaacactg

SEQ ID NO: 527229 - DNA, 25 bp, Mus musculus
gcaaccatctgtgaggccaacactg

SEQ ID NO: 527230 - DNA, 25 bp, Mus musculus
gcaaccatgagcacttgtatgccat

SEQ ID NO: 527231 - DNA, 25 bp, Mus musculus
gcaaccatgagctcttgtatgccat

SEQ ID NO: 527232 - DNA, 25 bp, Mus musculus
gcaaccattggaaagaccgtcaata

SEQ ID NO: 527233 - DNA, 25 bp, Mus musculus
gcaaccattggatagaccgtcaata

SEQ ID NO: 527234 - DNA, 25 bp, Mus musculus
gcaaccattggtctacaggatatca

SEQ ID NO: 527235 - DNA, 25 bp, Mus musculus
gcaaccattggtgtacaggatatca

SEQ ID NO: 527236 - DNA, 25 bp, Mus musculus
gcaaccatttgtacagagtggccta

SEQ ID NO: 527237 - DNA, 25 bp, Mus musculus
gcaaccatttgttcagagtggccta

SEQ ID NO: 527238 - DNA, 25 bp, Mus musculus
gcaacccaaattagaatccccttct

SEQ ID NO: 527239 - DNA, 25 bp, Mus musculus
gcaacccaaatttgaatccccttct

SEQ ID NO: 527240 - DNA, 25 bp, Mus musculus
gcaacccaagggacaaagcccatgg

SEQ ID NO: 527241 - DNA, 25 bp, Mus musculus
gcaacccaagggtcaaagcccatgg

SEQ ID NO: 527242 - DNA, 25 bp, Mus musculus
gcaacccacagacttctccagggaa

SEQ ID NO: 527243 - DNA, 25 bp, Mus musculus
gcaacccacagagttctccagggaa

SEQ ID NO: 527244 - DNA, 25 bp, Mus musculus
gcaacccaggcaattacaaccagtg

SEQ ID NO: 527245 - DNA, 25 bp, Mus musculus
gcaacccaggcatttacaaccagtg

SEQ ID NO: 527246 - DNA, 25 bp, Mus musculus
gcaacccaggtaatgtctgatcact

SEQ ID NO: 527247 - DNA, 25 bp, Mus musculus
gcaacccaggtattgtctgatcact

SEQ ID NO: 527248 - DNA, 25 bp, Mus musculus
gcaacccatgcccattggtatttta

SEQ ID NO: 527249 - DNA, 25 bp, Mus musculus
gcaacccatgccgattggtatttta

SEQ ID NO: 527250 - DNA, 25 bp, Mus musculus
gcaaccccagtcatgaaccggtttg

SEQ ID NO: 527251 - DNA, 25 bp, Mus musculus
gcaaccccagtcttgaaccggtttg

SEQ ID NO: 527252 - DNA, 25 bp, Mus musculus
gcaaccccattgagcggccaggcgg

SEQ ID NO: 527253 - DNA, 25 bp, Mus musculus
gcaaccccattgtgcggccaggcgg

SEQ ID NO: 527254 - DNA, 25 bp, Mus musculus
gcaacccctaagacatttgacaatg

SEQ ID NO: 527255 - DNA, 25 bp, Mus musculus
gcaacccctaagtcatttgacaatg

SEQ ID NO: 527256 - DNA, 25 bp, Mus musculus
gcaacccctcatctaactggattca

SEQ ID NO: 527257 - DNA, 25 bp, Mus musculus
gcaacccctcatgtaactggattca

SEQ ID NO: 527258 - DNA, 25 bp, Mus musculus
gcaacccctgttataatagtgtgga

SEQ ID NO: 527259 - DNA, 25 bp, Mus musculus
gcaacccctgttttaatagtgtgga

SEQ ID NO: 527260 - DNA, 25 bp, Mus musculus
gcaaccccttacataagctccaggg

SEQ ID NO: 527261 - DNA, 25 bp, Mus musculus
gcaaccccttacttaagctccaggg

SEQ ID NO: 527262 - DNA, 25 bp, Mus musculus
gcaaccccttatacctaacaagatt

SEQ ID NO: 527263 - DNA, 25 bp, Mus musculus
gcaaccccttattcctaacaagatt

SEQ ID NO: 527264 - DNA, 25 bp, Mus musculus
gcaacccgagctactacaacaggag

SEQ ID NO: 527265 - DNA, 25 bp, Mus musculus
gcaacccgagcttctacaacaggag

SEQ ID NO: 527266 - DNA, 25 bp, Mus musculus
gcaaccctaagtactttggttccag

SEQ ID NO: 527267 - DNA, 25 bp, Mus musculus
gcaaccctaagttctttggttccag

SEQ ID NO: 527268 - DNA, 25 bp, Mus musculus
gcaaccctacggagagtcttaagca

SEQ ID NO: 527269 - DNA, 25 bp, Mus musculus
gcaaccctacggtgagtcttaagca

SEQ ID NO: 527270 - DNA, 25 bp, Mus musculus
gcaaccctacgtcgtcagcctgaaa

SEQ ID NO: 527271 - DNA, 25 bp, Mus musculus
gcaaccctacgtggtcagcctgaaa

SEQ ID NO: 527272 - DNA, 25 bp, Mus musculus
gcaaccctagtgaaacccagaggat

SEQ ID NO: 527273 - DNA, 25 bp, Mus musculus
gcaaccctagtgtaacccagaggat

SEQ ID NO: 527274 - DNA, 25 bp, Mus musculus
gcaaccctcaaaaagcagccatcaa

SEQ ID NO: 527275 - DNA, 25 bp, Mus musculus
gcaaccctcaaatagcagccatcaa

SEQ ID NO: 527276 - DNA, 25 bp, Mus musculus
gcaaccctccctattctgggataga

SEQ ID NO: 527277 - DNA, 25 bp, Mus musculus
gcaaccctcccttttctgggataga

SEQ ID NO: 527278 - DNA, 25 bp, Mus musculus
gcaaccctcctgcattaggccaaag

SEQ ID NO: 527279 - DNA, 25 bp, Mus musculus
gcaaccctcctggattaggccaaag

SEQ ID NO: 527280 - DNA, 25 bp, Mus musculus
gcaaccctctgtaaatgggcaaaca

SEQ ID NO: 527281 - DNA, 25 bp, Mus musculus
gcaaccctctgttaatgggcaaaca

SEQ ID NO: 527282 - DNA, 25 bp, Mus musculus
gcaaccctgaaactgtctgtcttca

SEQ ID NO: 527283 - DNA, 25 bp, Mus musculus
gcaaccctgaaagtgtctgtcttca

SEQ ID NO: 527284 - DNA, 25 bp, Mus musculus
gcaaccctgactcatgagtatcctc

SEQ ID NO: 527285 - DNA, 25 bp, Mus musculus
gcaaccctgactgatgagtatcctc

SEQ ID NO: 527286 - DNA, 25 bp, Mus musculus
gcaaccctgcgacttttagttccag

SEQ ID NO: 527287 - DNA, 25 bp, Mus musculus
gcaaccctgcgagttttagttccag

SEQ ID NO: 527288 - DNA, 25 bp, Mus musculus
gcaaccctgggcactaaacaaggat

SEQ ID NO: 527289 - DNA, 25 bp, Mus musculus
gcaaccctgggctctaaacaaggat

SEQ ID NO: 527290 - DNA, 25 bp, Mus musculus
gcaaccctgggtagctctttccaaa

SEQ ID NO: 527291 - DNA, 25 bp, Mus musculus
gcaaccctgggttgctctttccaaa

SEQ ID NO: 527292 - DNA, 25 bp, Mus musculus
gcaaccctgtatatacctaatccta

SEQ ID NO: 527293 - DNA, 25 bp, Mus musculus
gcaaccctgtatttacctaatccta

SEQ ID NO: 527294 - DNA, 25 bp, Mus musculus
gcaaccctgtcaccaacggcaaaga

SEQ ID NO: 527295 - DNA, 25 bp, Mus musculus
gcaaccctgtcagcaacggcaaaga

SEQ ID NO: 527296 - DNA, 25 bp, Mus musculus
gcaacccttacaccctagatttgat

SEQ ID NO: 527297 - DNA, 25 bp, Mus musculus
gcaacccttacagcctagatttgat

SEQ ID NO: 527298 - DNA, 25 bp, Mus musculus
gcaacccttgcaacaaggtgctgca

SEQ ID NO: 527299 - DNA, 25 bp, Mus musculus
gcaacccttgcatcaaggtgctgca

SEQ ID NO: 527300 - DNA, 25 bp, Mus musculus
gcaacccttggtctatccctaatta

SEQ ID NO: 527301 - DNA, 25 bp, Mus musculus
gcaacccttggtgtatccctaatta

SEQ ID NO: 527302 - DNA, 25 bp, Mus musculus
gcaaccctttagcttcctaatgtac

SEQ ID NO: 527303 - DNA, 25 bp, Mus musculus
gcaaccctttaggttcctaatgtac

SEQ ID NO: 527304 - DNA, 25 bp, Mus musculus
gcaaccgaaggcacgtgcggcttta

SEQ ID NO: 527305 - DNA, 25 bp, Mus musculus
gcaaccgaaggctcgtgcggcttta

SEQ ID NO: 527306 - DNA, 25 bp, Mus musculus
gcaaccgatgcactagaaaaccaag

SEQ ID NO: 527307 - DNA, 25 bp, Mus musculus
gcaaccgatgcagtagaaaaccaag

SEQ ID NO: 527308 - DNA, 25 bp, Mus musculus
gcaaccgattaaatccattggatgg

SEQ ID NO: 527309 - DNA, 25 bp, Mus musculus
gcaaccgattaattccattggatgg

SEQ ID NO: 527310 - DNA, 25 bp, Mus musculus
gcaaccgcaaggctgagcagaggtt

SEQ ID NO: 527311 - DNA, 25 bp, Mus musculus
gcaaccgcaagggtgagcagaggtt

SEQ ID NO: 527312 - DNA, 25 bp, Mus musculus
gcaaccgcactgataagctgttttg

SEQ ID NO: 527313 - DNA, 25 bp, Mus musculus
gcaaccgcactgttaagctgttttg

SEQ ID NO: 527314 - DNA, 25 bp, Mus musculus
gcaaccgcatcaatgctgccaagga

SEQ ID NO: 527315 - DNA, 25 bp, Mus musculus
gcaaccgcatcattgctgccaagga

SEQ ID NO: 527316 - DNA, 25 bp, Mus musculus
gcaaccgcatgaactgtaatgcctt

SEQ ID NO: 527317 - DNA, 25 bp, Mus musculus
gcaaccgcatgatctgtaatgcctt

SEQ ID NO: 527318 - DNA, 25 bp, Mus musculus
gcaaccgccattcccattattaagg

SEQ ID NO: 527319 - DNA, 25 bp, Mus musculus
gcaaccgccattgccattattaagg

SEQ ID NO: 527320 - DNA, 25 bp, Mus musculus
gcaaccggagggaagatggtttaca

SEQ ID NO: 527321 - DNA, 25 bp, Mus musculus
gcaaccggagggtagatggtttaca

SEQ ID NO: 527322 - DNA, 25 bp, Mus musculus
gcaaccggtggcagtgctcatgtat

SEQ ID NO: 527323 - DNA, 25 bp, Mus musculus
gcaaccggtggctgtgctcatgtat

SEQ ID NO: 527324 - DNA, 25 bp, Mus musculus
gcaaccggttgtaccgtgagggcca

SEQ ID NO: 527325 - DNA, 25 bp, Mus musculus
gcaaccggttgttccgtgagggcca

SEQ ID NO: 527326 - DNA, 25 bp, Mus musculus
gcaaccgtaagcatgggagcctttt

SEQ ID NO: 527327 - DNA, 25 bp, Mus musculus
gcaaccgtaagcttgggagcctttt

SEQ ID NO: 527328 - DNA, 25 bp, Mus musculus
gcaaccgtagatcatagccaaagaa

SEQ ID NO: 527329 - DNA, 25 bp, Mus musculus
gcaaccgtagatgatagccaaagaa

SEQ ID NO: 527330 - DNA, 25 bp, Mus musculus
gcaaccgtcaatactggaaggtctt

SEQ ID NO: 527331 - DNA, 25 bp, Mus musculus
gcaaccgtcaattctggaaggtctt

SEQ ID NO: 527332 - DNA, 25 bp, Mus musculus
gcaaccgtcagcatgcctgaaatta

SEQ ID NO: 527333 - DNA, 25 bp, Mus musculus
gcaaccgtcagcttgcctgaaatta

SEQ ID NO: 527334 - DNA, 25 bp, Mus musculus
gcaaccgtgaaaccaggacacacag

SEQ ID NO: 527335 - DNA, 25 bp, Mus musculus
gcaaccgtgaaagcaggacacacag

SEQ ID NO: 527336 - DNA, 25 bp, Mus musculus
gcaacctaaggtatgatgttcaatt

SEQ ID NO: 527337 - DNA, 25 bp, Mus musculus
gcaacctaaggtttgatgttcaatt

SEQ ID NO: 527338 - DNA, 25 bp, Mus musculus
gcaacctaagttagcctttgtgagg

SEQ ID NO: 527339 - DNA, 25 bp, Mus musculus
gcaacctaagtttgcctttgtgagg

SEQ ID NO: 527340 - DNA, 25 bp, Mus musculus
gcaacctaccatagtgaactccaaa

SEQ ID NO: 527341 - DNA, 25 bp, Mus musculus
gcaacctaccattgtgaactccaaa

SEQ ID NO: 527342 - DNA, 25 bp, Mus musculus
gcaacctaggaactcacatggcaga

SEQ ID NO: 527343 - DNA, 25 bp, Mus musculus
gcaacctaggaagtcacatggcaga

SEQ ID NO: 527344 - DNA, 25 bp, Mus musculus
gcaacctaggctagtgatcagaatg

SEQ ID NO: 527345 - DNA, 25 bp, Mus musculus
gcaacctaggcttgtgatcagaatg

SEQ ID NO: 527346 - DNA, 25 bp, Mus musculus
gcaacctagtgaaggagagtgcttt

SEQ ID NO: 527347 - DNA, 25 bp, Mus musculus
gcaacctagtgatggagagtgcttt

SEQ ID NO: 527348 - DNA, 25 bp, Mus musculus
gcaacctatgagaagactgcttttt

SEQ ID NO: 527349 - DNA, 25 bp, Mus musculus
gcaacctatgagtagactgcttttt

SEQ ID NO: 527350 - DNA, 25 bp, Mus musculus
gcaacctcacacaggtgctctctaa

SEQ ID NO: 527351 - DNA, 25 bp, Mus musculus
gcaacctcacactggtgctctctaa

SEQ ID NO: 527352 - DNA, 25 bp, Mus musculus
gcaacctccctgagtatgatgctat

SEQ ID NO: 527353 - DNA, 25 bp, Mus musculus
gcaacctccctgtgtatgatgctat

SEQ ID NO: 527354 - DNA, 25 bp, Mus musculus
gcaacctcctatatcatgaatctgt

SEQ ID NO: 527355 - DNA, 25 bp, Mus musculus
gcaacctcctatttcatgaatctgt

SEQ ID NO: 527356 - DNA, 25 bp, Mus musculus
gcaacctctataaatgttctcagat

SEQ ID NO: 527357 - DNA, 25 bp, Mus musculus
gcaacctctatatatgttctcagat

SEQ ID NO: 527358 - DNA, 25 bp, Mus musculus
gcaacctcttcaccttacagtggga

SEQ ID NO: 527359 - DNA, 25 bp, Mus musculus
gcaacctcttcagcttacagtggga

SEQ ID NO: 527360 - DNA, 25 bp, Mus musculus
gcaacctgactgcagtatcaaacta

SEQ ID NO: 527361 - DNA, 25 bp, Mus musculus
gcaacctgactggagtatcaaacta

SEQ ID NO: 527362 - DNA, 25 bp, Mus musculus
gcaacctgagagatcgcgagcttca

SEQ ID NO: 527363 - DNA, 25 bp, Mus musculus
gcaacctgagagttcgcgagcttca

SEQ ID NO: 527364 - DNA, 25 bp, Mus musculus
gcaacctgagctacgatccagggaa

SEQ ID NO: 527365 - DNA, 25 bp, Mus musculus
gcaacctgagcttcgatccagggaa

SEQ ID NO: 527366 - DNA, 25 bp, Mus musculus
gcaacctgatatatctggctgggaa

SEQ ID NO: 527367 - DNA, 25 bp, Mus musculus
gcaacctgatatttctggctgggaa

SEQ ID NO: 527368 - DNA, 25 bp, Mus musculus
gcaacctgcctcaatttgtgggcag

SEQ ID NO: 527369 - DNA, 25 bp, Mus musculus
gcaacctgcctctatttgtgggcag

SEQ ID NO: 527370 - DNA, 25 bp, Mus musculus
gcaacctgctggagctttattttta

SEQ ID NO: 527371 - DNA, 25 bp, Mus musculus
gcaacctgctggtgctttattttta

SEQ ID NO: 527372 - DNA, 25 bp, Mus musculus
gcaacctgctgtacttgagtgacta

SEQ ID NO: 527373 - DNA, 25 bp, Mus musculus
gcaacctgctgttcttgagtgacta

SEQ ID NO: 527374 - DNA, 25 bp, Mus musculus
gcaacctggaacaagctcttacctt

SEQ ID NO: 527375 - DNA, 25 bp, Mus musculus
gcaacctggaactagctcttacctt

SEQ ID NO: 527376 - DNA, 25 bp, Mus musculus
gcaacctggacaatgctgcactggc

SEQ ID NO: 527377 - DNA, 25 bp, Mus musculus
gcaacctggacattgctgcactggc

SEQ ID NO: 527378 - DNA, 25 bp, Mus musculus
gcaacctggatgagcccatgtggag

SEQ ID NO: 527379 - DNA, 25 bp, Mus musculus
gcaacctggatgtgcccatgtggag

SEQ ID NO: 527380 - DNA, 25 bp, Mus musculus
gcaacctggcatctcattaaataaa

SEQ ID NO: 527381 - DNA, 25 bp, Mus musculus
gcaacctggcatgtcattaaataaa

SEQ ID NO: 527382 - DNA, 25 bp, Mus musculus
gcaacctgtattattaaccattgag

SEQ ID NO: 527383 - DNA, 25 bp, Mus musculus
gcaacctgtatttttaaccattgag

SEQ ID NO: 527384 - DNA, 25 bp, Mus musculus
gcaaccttacgaagatgtttttgta

SEQ ID NO: 527385 - DNA, 25 bp, Mus musculus
gcaaccttacgatgatgtttttgta

SEQ ID NO: 527386 - DNA, 25 bp, Mus musculus
gcaaccttatgcactattttagcca

SEQ ID NO: 527387 - DNA, 25 bp, Mus musculus
gcaaccttatgctctattttagcca

SEQ ID NO: 527388 - DNA, 25 bp, Mus musculus
gcaaccttcaaaagtgacctcctaa

SEQ ID NO: 527389 - DNA, 25 bp, Mus musculus
gcaaccttcaaatgtgacctcctaa

SEQ ID NO: 527390 - DNA, 25 bp, Mus musculus
gcaaccttcgaaactcacgttatca

SEQ ID NO: 527391 - DNA, 25 bp, Mus musculus
gcaaccttcgaatctcacgttatca

SEQ ID NO: 527392 - DNA, 25 bp, Mus musculus
gcaaccttcgtgctaccaggcttta

SEQ ID NO: 527393 - DNA, 25 bp, Mus musculus
gcaaccttcgtggtaccaggcttta

SEQ ID NO: 527394 - DNA, 25 bp, Mus musculus
gcaaccttctgcaataattggctga

SEQ ID NO: 527395 - DNA, 25 bp, Mus musculus
gcaaccttctgcataacctgtgtga

SEQ ID NO: 527396 - DNA, 25 bp, Mus musculus
gcaaccttctgctataattggctga

SEQ ID NO: 527397 - DNA, 25 bp, Mus musculus
gcaaccttctgcttaacctgtgtga

SEQ ID NO: 527398 - DNA, 25 bp, Mus musculus
gcaaccttgattaagagctcccatg

SEQ ID NO: 527399 - DNA, 25 bp, Mus musculus
gcaaccttgatttagagctcccatg

SEQ ID NO: 527400 - DNA, 25 bp, Mus musculus
gcaaccttgcttattatatcagaaa

SEQ ID NO: 527401 - DNA, 25 bp, Mus musculus
gcaaccttgctttttatatcagaaa

SEQ ID NO: 527402 - DNA, 25 bp, Mus musculus
gcaaccttggacaaacagcatggct

SEQ ID NO: 527403 - DNA, 25 bp, Mus musculus
gcaaccttggactaacagcatggct

SEQ ID NO: 527404 - DNA, 25 bp, Mus musculus
gcaaccttggctacttgcagtttat

SEQ ID NO: 527405 - DNA, 25 bp, Mus musculus
gcaaccttggcttcttgcagtttat

SEQ ID NO: 527406 - DNA, 25 bp, Mus musculus
gcaaccttgtacctgtattagtgga

SEQ ID NO: 527407 - DNA, 25 bp, Mus musculus
gcaaccttgtacgtgtattagtgga

SEQ ID NO: 527408 - DNA, 25 bp, Mus musculus
gcaaccttgtcaaccacagacgaat

SEQ ID NO: 527409 - DNA, 25 bp, Mus musculus
gcaaccttgtcatccacagacgaat

SEQ ID NO: 527410 - DNA, 25 bp, Mus musculus
gcaaccttgtgccaaatacttcaat

SEQ ID NO: 527411 - DNA, 25 bp, Mus musculus
gcaaccttgtgcgaaatacttcaat

SEQ ID NO: 527412 - DNA, 25 bp, Mus musculus
gcaaccttgttcagtgccagtgatt

SEQ ID NO: 527413 - DNA, 25 bp, Mus musculus
gcaaccttgttctgtgccagtgatt

SEQ ID NO: 527414 - DNA, 25 bp, Mus musculus
gcaacctttcctaagtgataacaaa

SEQ ID NO: 527415 - DNA, 25 bp, Mus musculus
gcaacctttccttagtgataacaaa

SEQ ID NO: 527416 - DNA, 25 bp, Mus musculus
gcaaccttttaacctttcacacact

SEQ ID NO: 527417 - DNA, 25 bp, Mus musculus
gcaaccttttaagctttcacacact

SEQ ID NO: 527418 - DNA, 25 bp, Mus musculus
gcaaccttttctatttgatctatgg

SEQ ID NO: 527419 - DNA, 25 bp, Mus musculus
gcaaccttttctttttgatctatgg

SEQ ID NO: 527420 - DNA, 25 bp, Mus musculus
gcaaccttttgccatgtaacttacc

SEQ ID NO: 527421 - DNA, 25 bp, Mus musculus
gcaaccttttgcgatgtaacttacc

SEQ ID NO: 527422 - DNA, 25 bp, Mus musculus
gcaacctttttgactagtttctgta

SEQ ID NO: 527423 - DNA, 25 bp, Mus musculus
gcaacctttttgtctagtttctgta

SEQ ID NO: 527424 - DNA, 25 bp, Mus musculus
gcaacgaaactcagacagcaatgga

SEQ ID NO: 527425 - DNA, 25 bp, Mus musculus
gcaacgaaactctgacagcaatgga

SEQ ID NO: 527426 - DNA, 25 bp, Mus musculus
gcaacgaacacgagcaagctaagct

SEQ ID NO: 527427 - DNA, 25 bp, Mus musculus
gcaacgaacacgtgcaagctaagct

SEQ ID NO: 527428 - DNA, 25 bp, Mus musculus
gcaacgaacttcacagcaagctcag

SEQ ID NO: 527429 - DNA, 25 bp, Mus musculus
gcaacgaacttctcagcaagctcag

SEQ ID NO: 527430 - DNA, 25 bp, Mus musculus
gcaacgaagtctagcagaactctgg

SEQ ID NO: 527431 - DNA, 25 bp, Mus musculus
gcaacgaagtcttgcagaactctgg

SEQ ID NO: 527432 - DNA, 25 bp, Mus musculus
gcaacgaatctacaccactgtgaca

SEQ ID NO: 527433 - DNA, 25 bp, Mus musculus
gcaacgaatctagaccactgtgaca

SEQ ID NO: 527434 - DNA, 25 bp, Mus musculus
gcaacgacaaaacgcccgacgtatt

SEQ ID NO: 527435 - DNA, 25 bp, Mus musculus
gcaacgacaaaaggcccgacgtatt

SEQ ID NO: 527436 - DNA, 25 bp, Mus musculus
gcaacgacaccaaaccagaggactt

SEQ ID NO: 527437 - DNA, 25 bp, Mus musculus
gcaacgacaccataccagaggactt

SEQ ID NO: 527438 - DNA, 25 bp, Mus musculus
gcaacgacacgtagttctgttttgt

SEQ ID NO: 527439 - DNA, 25 bp, Mus musculus
gcaacgacacgttgttctgttttgt

SEQ ID NO: 527440 - DNA, 25 bp, Mus musculus
gcaacgacttccattgcaccaaaga

SEQ ID NO: 527441 - DNA, 25 bp, Mus musculus
gcaacgacttcctttgcaccaaaga

SEQ ID NO: 527442 - DNA, 25 bp, Mus musculus
gcaacgagaggcacgcctctggaag

SEQ ID NO: 527443 - DNA, 25 bp, Mus musculus
gcaacgagaggctcgcctctggaag

SEQ ID NO: 527444 - DNA, 25 bp, Mus musculus
gcaacgagcaaaaaagccactagtt

SEQ ID NO: 527445 - DNA, 25 bp, Mus musculus
gcaacgagcaaataagccactagtt

SEQ ID NO: 527446 - DNA, 25 bp, Mus musculus
gcaacgagtgttcaccaactgcaag

SEQ ID NO: 527447 - DNA, 25 bp, Mus musculus
gcaacgagtgttgaccaactgcaag

SEQ ID NO: 527448 - DNA, 25 bp, Mus musculus
gcaacgatctcaactccagctttag

SEQ ID NO: 527449 - DNA, 25 bp, Mus musculus
gcaacgatctcatctccagctttag

SEQ ID NO: 527450 - DNA, 25 bp, Mus musculus
gcaacgattcctaacttacgctttg

SEQ ID NO: 527451 - DNA, 25 bp, Mus musculus
gcaacgattccttacttacgctttg

SEQ ID NO: 527452 - DNA, 25 bp, Mus musculus
gcaacgcagtgcattcttagaggat

SEQ ID NO: 527453 - DNA, 25 bp, Mus musculus
gcaacgcagtgctttcttagaggat

SEQ ID NO: 527454 - DNA, 25 bp, Mus musculus
gcaacgccacgcactggtacaagat

SEQ ID NO: 527455 - DNA, 25 bp, Mus musculus
gcaacgccacgctctggtacaagat

SEQ ID NO: 527456 - DNA, 25 bp, Mus musculus
gcaacgccggtcaggactcgggcat

SEQ ID NO: 527457 - DNA, 25 bp, Mus musculus
gcaacgccggtctggactcgggcat

SEQ ID NO: 527458 - DNA, 25 bp, Mus musculus
gcaacgcgtctgcacaacattaagt

SEQ ID NO: 527459 - DNA, 25 bp, Mus musculus
gcaacgcgtctggacaacattaagt

SEQ ID NO: 527460 - DNA, 25 bp, Mus musculus
gcaacgctgatgagaccttctttgg

SEQ ID NO: 527461 - DNA, 25 bp, Mus musculus
gcaacgctgatgtgaccttctttgg

SEQ ID NO: 527462 - DNA, 25 bp, Mus musculus
gcaacgctgctgcatcctaagagga

SEQ ID NO: 527463 - DNA, 25 bp, Mus musculus
gcaacgctgctggatcctaagagga

SEQ ID NO: 527464 - DNA, 25 bp, Mus musculus
gcaacgcttataatatggatttttt

SEQ ID NO: 527465 - DNA, 25 bp, Mus musculus
gcaacgcttatattatggatttttt

SEQ ID NO: 527466 - DNA, 25 bp, Mus musculus
gcaacgctttatacatcttctgtgg

SEQ ID NO: 527467 - DNA, 25 bp, Mus musculus
gcaacgctttattcatcttctgtgg

SEQ ID NO: 527468 - DNA, 25 bp, Mus musculus
gcaacggaagccatagactctctta

SEQ ID NO: 527469 - DNA, 25 bp, Mus musculus
gcaacggaagccttagactctctta

SEQ ID NO: 527470 - DNA, 25 bp, Mus musculus
gcaacggaagggaagtcctggactc

SEQ ID NO: 527471 - DNA, 25 bp, Mus musculus
gcaacggaagggtagtcctggactc

SEQ ID NO: 527472 - DNA, 25 bp, Mus musculus
gcaacggacaggaaacagctggctt

SEQ ID NO: 527473 - DNA, 25 bp, Mus musculus
gcaacggacaggtaacagctggctt

SEQ ID NO: 527474 - DNA, 25 bp, Mus musculus
gcaacggagaaccacatttacaact

SEQ ID NO: 527475 - DNA, 25 bp, Mus musculus
gcaacggagaacgacatttacaact

SEQ ID NO: 527476 - DNA, 25 bp, Mus musculus
gcaacggataagagggcctttactc

SEQ ID NO: 527477 - DNA, 25 bp, Mus musculus
gcaacggataagctgactccagagt

SEQ ID NO: 527478 - DNA, 25 bp, Mus musculus
gcaacggataaggtgactccagagt

SEQ ID NO: 527479 - DNA, 25 bp, Mus musculus
gcaacggataagtgggcctttactc

SEQ ID NO: 527480 - DNA, 25 bp, Mus musculus
gcaacggcaagtacacctgcaaggt

SEQ ID NO: 527481 - DNA, 25 bp, Mus musculus
gcaacggcaagttcacctgcaaggt

SEQ ID NO: 527482 - DNA, 25 bp, Mus musculus
gcaacggcacagctagtttttctga

SEQ ID NO: 527483 - DNA, 25 bp, Mus musculus
gcaacggcacaggtagtttttctga

SEQ ID NO: 527484 - DNA, 25 bp, Mus musculus
gcaacgggaccaagtgtacagctca

SEQ ID NO: 527485 - DNA, 25 bp, Mus musculus
gcaacgggaccatgtgtacagctca

SEQ ID NO: 527486 - DNA, 25 bp, Mus musculus
gcaacgggacctcggtgtattatac

SEQ ID NO: 527487 - DNA, 25 bp, Mus musculus
gcaacgggacctgggtgtattatac

SEQ ID NO: 527488 - DNA, 25 bp, Mus musculus
gcaacgggcactatgctgtttgcca

SEQ ID NO: 527489 - DNA, 25 bp, Mus musculus
gcaacgggcactttgctgtttgcca

SEQ ID NO: 527490 - DNA, 25 bp, Mus musculus
gcaacgggcgttatgtgtgcatgaa

SEQ ID NO: 527491 - DNA, 25 bp, Mus musculus
gcaacgggcgttttgtgtgcatgaa

SEQ ID NO: 527492 - DNA, 25 bp, Mus musculus
gcaacgtagacccatcttgtacagt

SEQ ID NO: 527493 - DNA, 25 bp, Mus musculus
gcaacgtagaccgatcttgtacagt

SEQ ID NO: 527494 - DNA, 25 bp, Mus musculus
gcaacgtaggctatttaacagggtg

SEQ ID NO: 527495 - DNA, 25 bp, Mus musculus
gcaacgtaggctttttaacagggtg

SEQ ID NO: 527496 - DNA, 25 bp, Mus musculus
gcaacgtctattacaaagccatcca

SEQ ID NO: 527497 - DNA, 25 bp, Mus musculus
gcaacgtctattcagttatcacttt

SEQ ID NO: 527498 - DNA, 25 bp, Mus musculus
gcaacgtctattgagttatcacttt

SEQ ID NO: 527499 - DNA, 25 bp, Mus musculus
gcaacgtctatttcaaagccatcca

SEQ ID NO: 527500 - DNA, 25 bp, Mus musculus
gcaacgtgaaatcagaacatgctct

SEQ ID NO: 527501 - DNA, 25 bp, Mus musculus
gcaacgtgaaatgagaacatgctct

SEQ ID NO: 527502 - DNA, 25 bp, Mus musculus
gcaacgtgagctagaccagtctata

SEQ ID NO: 527503 - DNA, 25 bp, Mus musculus
gcaacgtgagcttgaccagtctata

SEQ ID NO: 527504 - DNA, 25 bp, Mus musculus
gcaacgtggaagatctgcatgtgaa

SEQ ID NO: 527505 - DNA, 25 bp, Mus musculus
gcaacgtggaagttctgcatgtgaa

SEQ ID NO: 527506 - DNA, 25 bp, Mus musculus
gcaacgtggtcaatttcaatttcat

SEQ ID NO: 527507 - DNA, 25 bp, Mus musculus
gcaacgtggtcattttcaatttcat

SEQ ID NO: 527508 - DNA, 25 bp, Mus musculus
gcaacgttagccacagagcctttta

SEQ ID NO: 527509 - DNA, 25 bp, Mus musculus
gcaacgttagcctcagagcctttta

SEQ ID NO: 527510 - DNA, 25 bp, Mus musculus
gcaactaatccaataaaagccgcct

SEQ ID NO: 527511 - DNA, 25 bp, Mus musculus
gcaactaatccattaaaagccgcct

SEQ ID NO: 527512 - DNA, 25 bp, Mus musculus
gcaactacatggatgatgtatatat

SEQ ID NO: 527513 - DNA, 25 bp, Mus musculus
gcaactacatggttgatgtatatat

SEQ ID NO: 527514 - DNA, 25 bp, Mus musculus
gcaactacatttcgcttctataacc

SEQ ID NO: 527515 - DNA, 25 bp, Mus musculus
gcaactacatttggcttctataacc

SEQ ID NO: 527516 - DNA, 25 bp, Mus musculus
gcaactaccagtcgtggctgtgtat

SEQ ID NO: 527517 - DNA, 25 bp, Mus musculus
gcaactaccagtggtggctgtgtat

SEQ ID NO: 527518 - DNA, 25 bp, Mus musculus
gcaactaccataattggatgctgat

SEQ ID NO: 527519 - DNA, 25 bp, Mus musculus
gcaactaccatatttggatgctgat

SEQ ID NO: 527520 - DNA, 25 bp, Mus musculus
gcaactaccgcgaggtgcgcttcga

SEQ ID NO: 527521 - DNA, 25 bp, Mus musculus
gcaactaccgcgtggtgcgcttcga

SEQ ID NO: 527522 - DNA, 25 bp, Mus musculus
gcaactacctacactgttttaccag

SEQ ID NO: 527523 - DNA, 25 bp, Mus musculus
gcaactacctactctgttttaccag

SEQ ID NO: 527524 - DNA, 25 bp, Mus musculus
gcaactacgaccaggatttcaccgt

SEQ ID NO: 527525 - DNA, 25 bp, Mus musculus
gcaactacgacctggatttcaccgt

SEQ ID NO: 527526 - DNA, 25 bp, Mus musculus
gcaactacggcaagacaggcgaggt

SEQ ID NO: 527527 - DNA, 25 bp, Mus musculus
gcaactacggcatgacaggcgaggt

SEQ ID NO: 527528 - DNA, 25 bp, Mus musculus
gcaactactaaaactgacatcgggt

SEQ ID NO: 527529 - DNA, 25 bp, Mus musculus
gcaactactaaatctgacatcgggt

SEQ ID NO: 527530 - DNA, 25 bp, Mus musculus
gcaactactacaacagctgagatca

SEQ ID NO: 527531 - DNA, 25 bp, Mus musculus
gcaactactacatcagctgagatca

SEQ ID NO: 527532 - DNA, 25 bp, Mus musculus
gcaactactctgcagctgaagagac

SEQ ID NO: 527533 - DNA, 25 bp, Mus musculus
gcaactactctggagctgaagagac

SEQ ID NO: 527534 - DNA, 25 bp, Mus musculus
gcaactactgctcgaatccttgcta

SEQ ID NO: 527535 - DNA, 25 bp, Mus musculus
gcaactactgctggaatccttgcta

SEQ ID NO: 527536 - DNA, 25 bp, Mus musculus
gcaactagaaaccttgagcacgtgt

SEQ ID NO: 527537 - DNA, 25 bp, Mus musculus
gcaactagaaacgttgagcacgtgt

SEQ ID NO: 527538 - DNA, 25 bp, Mus musculus
gcaactagaattcccttgaaagacc

SEQ ID NO: 527539 - DNA, 25 bp, Mus musculus
gcaactagaattgccttgaaagacc

SEQ ID NO: 527540 - DNA, 25 bp, Mus musculus
gcaactagacgcaacctttactatt

SEQ ID NO: 527541 - DNA, 25 bp, Mus musculus
gcaactagacgcagcccgcaggcag

SEQ ID NO: 527542 - DNA, 25 bp, Mus musculus
gcaactagacgctacctttactatt

SEQ ID NO: 527543 - DNA, 25 bp, Mus musculus
gcaactagacgctgcccgcaggcag

SEQ ID NO: 527544 - DNA, 25 bp, Mus musculus
gcaactagagggattcagcctgcct

SEQ ID NO: 527545 - DNA, 25 bp, Mus musculus
gcaactagagggtttcagcctgcct

SEQ ID NO: 527546 - DNA, 25 bp, Mus musculus
gcaactatacaaagatttcctatgg

SEQ ID NO: 527547 - DNA, 25 bp, Mus musculus
gcaactatacaatgatttcctatgg

SEQ ID NO: 527548 - DNA, 25 bp, Mus musculus
gcaactatctgcagtttttggtttt

SEQ ID NO: 527549 - DNA, 25 bp, Mus musculus
gcaactatctgctgtttttggtttt

SEQ ID NO: 527550 - DNA, 25 bp, Mus musculus
gcaactatgtatactgtggtttctt

SEQ ID NO: 527551 - DNA, 25 bp, Mus musculus
gcaactatgtattctgtggtttctt

SEQ ID NO: 527552 - DNA, 25 bp, Mus musculus
gcaactcaagttattaggaattcgt

SEQ ID NO: 527553 - DNA, 25 bp, Mus musculus
gcaactcaagtttttaggaattcgt

SEQ ID NO: 527554 - DNA, 25 bp, Mus musculus
gcaactcaatgacctgaaaacctgt

SEQ ID NO: 527555 - DNA, 25 bp, Mus musculus
gcaactcaatgagctgaaaacctgt

SEQ ID NO: 527556 - DNA, 25 bp, Mus musculus
gcaactcacattagctgctcagagt

SEQ ID NO: 527557 - DNA, 25 bp, Mus musculus
gcaactcacatttgctgctcagagt

SEQ ID NO: 527558 - DNA, 25 bp, Mus musculus
gcaactcagcagcaagtagtcacat

SEQ ID NO: 527559 - DNA, 25 bp, Mus musculus
gcaactcagcaggaagtagtcacat

SEQ ID NO: 527560 - DNA, 25 bp, Mus musculus
gcaactcagtgtaccagcagggcat

SEQ ID NO: 527561 - DNA, 25 bp, Mus musculus
gcaactcagtgttccagcagggcat

SEQ ID NO: 527562 - DNA, 25 bp, Mus musculus
gcaactcataacactgtaattccag

SEQ ID NO: 527563 - DNA, 25 bp, Mus musculus
gcaactcataactctgtaattccag

SEQ ID NO: 527564 - DNA, 25 bp, Mus musculus
gcaactcataccacatttcatctta

SEQ ID NO: 527565 - DNA, 25 bp, Mus musculus
gcaactcatacctcatttcatctta

SEQ ID NO: 527566 - DNA, 25 bp, Mus musculus
gcaactcatccacatggcactttta

SEQ ID NO: 527567 - DNA, 25 bp, Mus musculus
gcaactcatccagatggcactttta

SEQ ID NO: 527568 - DNA, 25 bp, Mus musculus
gcaactcatcgaatgatttacggcg

SEQ ID NO: 527569 - DNA, 25 bp, Mus musculus
gcaactcatcgattgatttacggcg

SEQ ID NO: 527570 - DNA, 25 bp, Mus musculus
gcaactcatgtgatagctatcaatg

SEQ ID NO: 527571 - DNA, 25 bp, Mus musculus
gcaactcatgtgttagctatcaatg

SEQ ID NO: 527572 - DNA, 25 bp, Mus musculus
gcaactccagaaagaaccacaccag

SEQ ID NO: 527573 - DNA, 25 bp, Mus musculus
gcaactccagaatgaaccacaccag

SEQ ID NO: 527574 - DNA, 25 bp, Mus musculus
gcaactccagcaaactcggaggcaa

SEQ ID NO: 527575 - DNA, 25 bp, Mus musculus
gcaactccagcatactcggaggcaa

SEQ ID NO: 527576 - DNA, 25 bp, Mus musculus
gcaactccagccagatgggcagcca

SEQ ID NO: 527577 - DNA, 25 bp, Mus musculus
gcaactccagcctgatgggcagcca

SEQ ID NO: 527578 - DNA, 25 bp, Mus musculus
gcaactccagttaccggagagctgg

SEQ ID NO: 527579 - DNA, 25 bp, Mus musculus
gcaactccagtttccggagagctgg

SEQ ID NO: 527580 - DNA, 25 bp, Mus musculus
gcaactccataaccataaagccaat

SEQ ID NO: 527581 - DNA, 25 bp, Mus musculus
gcaactccataagcataaagccaat

SEQ ID NO: 527582 - DNA, 25 bp, Mus musculus
gcaactccatatctttcctgaagtg

SEQ ID NO: 527583 - DNA, 25 bp, Mus musculus
gcaactccatatgtttcctgaagtg

SEQ ID NO: 527584 - DNA, 25 bp, Mus musculus
gcaactcccagcatgaagatgtctt

SEQ ID NO: 527585 - DNA, 25 bp, Mus musculus
gcaactcccagcttgaagatgtctt

SEQ ID NO: 527586 - DNA, 25 bp, Mus musculus
gcaactcccagtacatcacagattg

SEQ ID NO: 527587 - DNA, 25 bp, Mus musculus
gcaactcccagttcatcacagattg

SEQ ID NO: 527588 - DNA, 25 bp, Mus musculus
gcaactccgtcaccagttcaacaac

SEQ ID NO: 527589 - DNA, 25 bp, Mus musculus
gcaactccgtcagcagttcaacaac

SEQ ID NO: 527590 - DNA, 25 bp, Mus musculus
gcaactcctatgctgtccctgatga

SEQ ID NO: 527591 - DNA, 25 bp, Mus musculus
gcaactcctatggtgtccctgatga

SEQ ID NO: 527592 - DNA, 25 bp, Mus musculus
gcaactcctgagctgctttggcgaa

SEQ ID NO: 527593 - DNA, 25 bp, Mus musculus
gcaactcctgaggtgctttggcgaa

SEQ ID NO: 527594 - DNA, 25 bp, Mus musculus
gcaactcctggtatatgtgcagaga

SEQ ID NO: 527595 - DNA, 25 bp, Mus musculus
gcaactcctggtttatgtgcagaga

SEQ ID NO: 527596 - DNA, 25 bp, Mus musculus
gcaactcctgtacttttgtcttgga

SEQ ID NO: 527597 - DNA, 25 bp, Mus musculus
gcaactcctgtagttttgtcttgga

SEQ ID NO: 527598 - DNA, 25 bp, Mus musculus
gcaactcgaaatagctaacacatat

SEQ ID NO: 527599 - DNA, 25 bp, Mus musculus
gcaactcgaaattgctaacacatat

SEQ ID NO: 527600 - DNA, 25 bp, Mus musculus
gcaactctaaaaagtgctgcccata

SEQ ID NO: 527601 - DNA, 25 bp, Mus musculus
gcaactctaaaatgtgctgcccata

SEQ ID NO: 527602 - DNA, 25 bp, Mus musculus
gcaactctacttctcaattcctgtc

SEQ ID NO: 527603 - DNA, 25 bp, Mus musculus
gcaactctacttgtcaattcctgtc

SEQ ID NO: 527604 - DNA, 25 bp, Mus musculus
gcaactctagttacaccttttggtt

SEQ ID NO: 527605 - DNA, 25 bp, Mus musculus
gcaactctagtttcaccttttggtt

SEQ ID NO: 527606 - DNA, 25 bp, Mus musculus
gcaactctatcactaaactggactt

SEQ ID NO: 527607 - DNA, 25 bp, Mus musculus
gcaactctatcagtaaactggactt

SEQ ID NO: 527608 - DNA, 25 bp, Mus musculus
gcaactctcaatagcagggatttta

SEQ ID NO: 527609 - DNA, 25 bp, Mus musculus
gcaactctcaattgcagggatttta

SEQ ID NO: 527610 - DNA, 25 bp, Mus musculus
gcaactctctggaaggaaatctacc

SEQ ID NO: 527611 - DNA, 25 bp, Mus musculus
gcaactctctggtaggaaatctacc

SEQ ID NO: 527612 - DNA, 25 bp, Mus musculus
gcaactctcttcagaagcactggag

SEQ ID NO: 527613 - DNA, 25 bp, Mus musculus
gcaactctcttctgaagcactggag

SEQ ID NO: 527614 - DNA, 25 bp, Mus musculus
gcaactctgatgattgagattgaac

SEQ ID NO: 527615 - DNA, 25 bp, Mus musculus
gcaactctgatgtttgagattgaac

SEQ ID NO: 527616 - DNA, 25 bp, Mus musculus
gcaactctgcaaccattcatccaag

SEQ ID NO: 527617 - DNA, 25 bp, Mus musculus
gcaactctgcaagcattcatccaag

SEQ ID NO: 527618 - DNA, 25 bp, Mus musculus
gcaactctgccccagaaagactgag

SEQ ID NO: 527619 - DNA, 25 bp, Mus musculus
gcaactctgcccgagaaagactgag

SEQ ID NO: 527620 - DNA, 25 bp, Mus musculus
gcaactctggagactatggtattct

SEQ ID NO: 527621 - DNA, 25 bp, Mus musculus
gcaactctggagtctatggtattct

SEQ ID NO: 527622 - DNA, 25 bp, Mus musculus
gcaactctggcaactcagttactga

SEQ ID NO: 527623 - DNA, 25 bp, Mus musculus
gcaactctggcatctcagttactga

SEQ ID NO: 527624 - DNA, 25 bp, Mus musculus
gcaactctgtgcataacctgtgaac

SEQ ID NO: 527625 - DNA, 25 bp, Mus musculus
gcaactctgtgcttaacctgtgaac

SEQ ID NO: 527626 - DNA, 25 bp, Mus musculus
gcaactcttccacgtgcaaaggatt

SEQ ID NO: 527627 - DNA, 25 bp, Mus musculus
gcaactcttccaggtgcaaaggatt

SEQ ID NO: 527628 - DNA, 25 bp, Mus musculus
gcaactcttgcactttccttgaaaa

SEQ ID NO: 527629 - DNA, 25 bp, Mus musculus
gcaactcttgcagtttccttgaaaa

SEQ ID NO: 527630 - DNA, 25 bp, Mus musculus
gcaactgaaactctgcggagcattc

SEQ ID NO: 527631 - DNA, 25 bp, Mus musculus
gcaactgaaactgtgcggagcattc

SEQ ID NO: 527632 - DNA, 25 bp, Mus musculus
gcaactgaagctctgatatttccaa

SEQ ID NO: 527633 - DNA, 25 bp, Mus musculus
gcaactgaagctgtgatatttccaa

SEQ ID NO: 527634 - DNA, 25 bp, Mus musculus
gcaactgaaggcacgattcttacca

SEQ ID NO: 527635 - DNA, 25 bp, Mus musculus
gcaactgaaggctcgattcttacca

SEQ ID NO: 527636 - DNA, 25 bp, Mus musculus
gcaactgaatcaattagataccact

SEQ ID NO: 527637 - DNA, 25 bp, Mus musculus
gcaactgaatcatttagataccact

SEQ ID NO: 527638 - DNA, 25 bp, Mus musculus
gcaactgaatgcagcttcactgtta

SEQ ID NO: 527639 - DNA, 25 bp, Mus musculus
gcaactgaatgctgcttcactgtta

SEQ ID NO: 527640 - DNA, 25 bp, Mus musculus
gcaactgacaaaccttatgctggaa

SEQ ID NO: 527641 - DNA, 25 bp, Mus musculus
gcaactgacaaagcttatgctggaa

SEQ ID NO: 527642 - DNA, 25 bp, Mus musculus
gcaactgacagacctattgatggag

SEQ ID NO: 527643 - DNA, 25 bp, Mus musculus
gcaactgacagagctattgatggag

SEQ ID NO: 527644 - DNA, 25 bp, Mus musculus
gcaactgacgacagtcatcttgaag

SEQ ID NO: 527645 - DNA, 25 bp, Mus musculus
gcaactgacgactgtcatcttgaag

SEQ ID NO: 527646 - DNA, 25 bp, Mus musculus
gcaactgacttacacctgtacctgg

SEQ ID NO: 527647 - DNA, 25 bp, Mus musculus
gcaactgacttagacctgtacctgg

SEQ ID NO: 527648 - DNA, 25 bp, Mus musculus
gcaactgaggaacgccatttttctg

SEQ ID NO: 527649 - DNA, 25 bp, Mus musculus
gcaactgaggaacttcgtgacacta

SEQ ID NO: 527650 - DNA, 25 bp, Mus musculus
gcaactgaggaaggccatttttctg

SEQ ID NO: 527651 - DNA, 25 bp, Mus musculus
gcaactgaggaagttcgtgacacta

SEQ ID NO: 527652 - DNA, 25 bp, Mus musculus
gcaactgataccagcgaaatcccaa

SEQ ID NO: 527653 - DNA, 25 bp, Mus musculus
gcaactgatacctgcgaaatcccaa

SEQ ID NO: 527654 - DNA, 25 bp, Mus musculus
gcaactgatcctcggaagctaggta

SEQ ID NO: 527655 - DNA, 25 bp, Mus musculus
gcaactgatcctgggaagctaggta

SEQ ID NO: 527656 - DNA, 25 bp, Mus musculus
gcaactgatgctctcaaggctggta

SEQ ID NO: 527657 - DNA, 25 bp, Mus musculus
gcaactgatgctgtcaaggctggta

SEQ ID NO: 527658 - DNA, 25 bp, Mus musculus
gcaactgatgggatcacacacacca

SEQ ID NO: 527659 - DNA, 25 bp, Mus musculus
gcaactgatgggttcacacacacca

SEQ ID NO: 527660 - DNA, 25 bp, Mus musculus
gcaactgatgttaaatgggaccatt

SEQ ID NO: 527661 - DNA, 25 bp, Mus musculus
gcaactgatgtttaatgggaccatt

SEQ ID NO: 527662 - DNA, 25 bp, Mus musculus
gcaactgcaagaactcctagcggga

SEQ ID NO: 527663 - DNA, 25 bp, Mus musculus
gcaactgcaagatctcctagcggga

SEQ ID NO: 527664 - DNA, 25 bp, Mus musculus
gcaactgcaagtagggttgttttaa

SEQ ID NO: 527665 - DNA, 25 bp, Mus musculus
gcaactgcaagttgggttgttttaa

SEQ ID NO: 527666 - DNA, 25 bp, Mus musculus
gcaactgcagcgagttcaggaatta

SEQ ID NO: 527667 - DNA, 25 bp, Mus musculus
gcaactgcagcgtgttcaggaatta

SEQ ID NO: 527668 - DNA, 25 bp, Mus musculus
gcaactgcaggcatgtgtcctcata

SEQ ID NO: 527669 - DNA, 25 bp, Mus musculus
gcaactgcaggcttgtgtcctcata

SEQ ID NO: 527670 - DNA, 25 bp, Mus musculus
gcaactgccaaaattacgttcccat

SEQ ID NO: 527671 - DNA, 25 bp, Mus musculus
gcaactgccaaatttacgttcccat

SEQ ID NO: 527672 - DNA, 25 bp, Mus musculus
gcaactgccaagaacactgctggtg

SEQ ID NO: 527673 - DNA, 25 bp, Mus musculus
gcaactgccaagtacactgctggtg

SEQ ID NO: 527674 - DNA, 25 bp, Mus musculus
gcaactgccatgagaatttctgtga

SEQ ID NO: 527675 - DNA, 25 bp, Mus musculus
gcaactgccatgtgaatttctgtga

SEQ ID NO: 527676 - DNA, 25 bp, Mus musculus
gcaactgccttccaaagggcacgta

SEQ ID NO: 527677 - DNA, 25 bp, Mus musculus
gcaactgccttcgaaagggcacgta

SEQ ID NO: 527678 - DNA, 25 bp, Mus musculus
gcaactgcgtgcagcaagagcttta

SEQ ID NO: 527679 - DNA, 25 bp, Mus musculus
gcaactgcgtgctgcaagagcttta

SEQ ID NO: 527680 - DNA, 25 bp, Mus musculus
gcaactgctgcaaagcgctgtgaat

SEQ ID NO: 527681 - DNA, 25 bp, Mus musculus
gcaactgctgcatagcgctgtgaat

SEQ ID NO: 527682 - DNA, 25 bp, Mus musculus
gcaactgctgtcatcaggctttttc

SEQ ID NO: 527683 - DNA, 25 bp, Mus musculus
gcaactgctgtcttcaggctttttc

SEQ ID NO: 527684 - DNA, 25 bp, Mus musculus
gcaactgctgttccataagctactt

SEQ ID NO: 527685 - DNA, 25 bp, Mus musculus
gcaactgctgttgcataagctactt

SEQ ID NO: 527686 - DNA, 25 bp, Mus musculus
gcaactgcttaacacatgcacggag

SEQ ID NO: 527687 - DNA, 25 bp, Mus musculus
gcaactgcttaagacatgcacggag

SEQ ID NO: 527688 - DNA, 25 bp, Mus musculus
gcaactgcttgcctctgagatcatt

SEQ ID NO: 527689 - DNA, 25 bp, Mus musculus
gcaactgcttgcgtctgagatcatt

SEQ ID NO: 527690 - DNA, 25 bp, Mus musculus
gcaactgctttcatctgttcacata

SEQ ID NO: 527691 - DNA, 25 bp, Mus musculus
gcaactgctttcttctgttcacata

SEQ ID NO: 527692 - DNA, 25 bp, Mus musculus
gcaactggaccactatctttcctgg

SEQ ID NO: 527693 - DNA, 25 bp, Mus musculus
gcaactggaccagtatctttcctgg

SEQ ID NO: 527694 - DNA, 25 bp, Mus musculus
gcaactggacggagggcaccactat

SEQ ID NO: 527695 - DNA, 25 bp, Mus musculus
gcaactggacggtgggcaccactat

SEQ ID NO: 527696 - DNA, 25 bp, Mus musculus
gcaactggcagaacaggcgtcagaa

SEQ ID NO: 527697 - DNA, 25 bp, Mus musculus
gcaactggcagatcaggcgtcagaa

SEQ ID NO: 527698 - DNA, 25 bp, Mus musculus
gcaactggcataatcatctggtaaa

SEQ ID NO: 527699 - DNA, 25 bp, Mus musculus
gcaactggcatattcatctggtaaa

SEQ ID NO: 527700 - DNA, 25 bp, Mus musculus
gcaactggccagacaaggctgtgtt

SEQ ID NO: 527701 - DNA, 25 bp, Mus musculus
gcaactggccagtcaaggctgtgtt

SEQ ID NO: 527702 - DNA, 25 bp, Mus musculus
gcaactggctcccctggctatggga

SEQ ID NO: 527703 - DNA, 25 bp, Mus musculus
gcaactggctccgctggctatggga

SEQ ID NO: 527704 - DNA, 25 bp, Mus musculus
gcaactggctttaacatagattctg

SEQ ID NO: 527705 - DNA, 25 bp, Mus musculus
gcaactggcttttacatagattctg

SEQ ID NO: 527706 - DNA, 25 bp, Mus musculus
gcaactgggacaaatatcactcaag

SEQ ID NO: 527707 - DNA, 25 bp, Mus musculus
gcaactgggacatatatcactcaag

SEQ ID NO: 527708 - DNA, 25 bp, Mus musculus
gcaactgggcaaacgatgtaaccat

SEQ ID NO: 527709 - DNA, 25 bp, Mus musculus
gcaactgggcaatcgatgtaaccat

SEQ ID NO: 527710 - DNA, 25 bp, Mus musculus
gcaactgggcctcggttcgggcacc

SEQ ID NO: 527711 - DNA, 25 bp, Mus musculus
gcaactgggcctgggttcgggcacc

SEQ ID NO: 527712 - DNA, 25 bp, Mus musculus
gcaactgggtctcgaccagctacat

SEQ ID NO: 527713 - DNA, 25 bp, Mus musculus
gcaactgggtctggaccagctacat

SEQ ID NO: 527714 - DNA, 25 bp, Mus musculus
gcaactggtacgctggcgatcctta

SEQ ID NO: 527715 - DNA, 25 bp, Mus musculus
gcaactggtacggtggcgatcctta

SEQ ID NO: 527716 - DNA, 25 bp, Mus musculus
gcaactggtcaaatcatgcttgtta

SEQ ID NO: 527717 - DNA, 25 bp, Mus musculus
gcaactggtcaattcatgcttgtta

SEQ ID NO: 527718 - DNA, 25 bp, Mus musculus
gcaactgtaaatcggagtgggctcc

SEQ ID NO: 527719 - DNA, 25 bp, Mus musculus
gcaactgtaaatgggagtgggctcc

SEQ ID NO: 527720 - DNA, 25 bp, Mus musculus
gcaactgtagctatgctcctaatca

SEQ ID NO: 527721 - DNA, 25 bp, Mus musculus
gcaactgtagctttgctcctaatca

SEQ ID NO: 527722 - DNA, 25 bp, Mus musculus
gcaactgtcagcacatggcataagt

SEQ ID NO: 527723 - DNA, 25 bp, Mus musculus
gcaactgtcagctcatggcataagt

SEQ ID NO: 527724 - DNA, 25 bp, Mus musculus
gcaactgtcagtccttggactggga

SEQ ID NO: 527725 - DNA, 25 bp, Mus musculus
gcaactgtcagtgcttggactggga

SEQ ID NO: 527726 - DNA, 25 bp, Mus musculus
gcaactgtcattctcattaaatcta

SEQ ID NO: 527727 - DNA, 25 bp, Mus musculus
gcaactgtcattgtcattaaatcta

SEQ ID NO: 527728 - DNA, 25 bp, Mus musculus
gcaactgtctcaccccaagctaaat

SEQ ID NO: 527729 - DNA, 25 bp, Mus musculus
gcaactgtctcagcccaagctaaat

SEQ ID NO: 527730 - DNA, 25 bp, Mus musculus
gcaactgtctccagtaactgttggt

SEQ ID NO: 527731 - DNA, 25 bp, Mus musculus
gcaactgtctcctgtaactgttggt

SEQ ID NO: 527732 - DNA, 25 bp, Mus musculus
gcaactgtgaagacagcaactttgc

SEQ ID NO: 527733 - DNA, 25 bp, Mus musculus
gcaactgtgaagaggatgtatcctt

SEQ ID NO: 527734 - DNA, 25 bp, Mus musculus
gcaactgtgaagtcagcaactttgc

SEQ ID NO: 527735 - DNA, 25 bp, Mus musculus
gcaactgtgaagtggatgtatcctt

SEQ ID NO: 527736 - DNA, 25 bp, Mus musculus
gcaactgtgaccctgaggccgccat

SEQ ID NO: 527737 - DNA, 25 bp, Mus musculus
gcaactgtgaccgtgaggccgccat

SEQ ID NO: 527738 - DNA, 25 bp, Mus musculus
gcaactgtgagcaaagctgcagatg

SEQ ID NO: 527739 - DNA, 25 bp, Mus musculus
gcaactgtgagctaagctgcagatg

SEQ ID NO: 527740 - DNA, 25 bp, Mus musculus
gcaactgtgatgcagcagctaactc

SEQ ID NO: 527741 - DNA, 25 bp, Mus musculus
gcaactgtgatggagcagctaactc

SEQ ID NO: 527742 - DNA, 25 bp, Mus musculus
gcaactgtggacagtctgctggtaa

SEQ ID NO: 527743 - DNA, 25 bp, Mus musculus
gcaactgtggactgtctgctggtaa

SEQ ID NO: 527744 - DNA, 25 bp, Mus musculus
gcaactgtggtgcactttctgagga

SEQ ID NO: 527745 - DNA, 25 bp, Mus musculus
gcaactgtggtggactttctgagga

SEQ ID NO: 527746 - DNA, 25 bp, Mus musculus
gcaactgtgtacatcagaggacatc

SEQ ID NO: 527747 - DNA, 25 bp, Mus musculus
gcaactgtgtacttcagaggacatc

SEQ ID NO: 527748 - DNA, 25 bp, Mus musculus
gcaactgtgttcagacctatgggtc

SEQ ID NO: 527749 - DNA, 25 bp, Mus musculus
gcaactgtgttctgacctatgggtc

SEQ ID NO: 527750 - DNA, 25 bp, Mus musculus
gcaactgttaacaatgtcctcaggg

SEQ ID NO: 527751 - DNA, 25 bp, Mus musculus
gcaactgttaactatgtcctcaggg

SEQ ID NO: 527752 - DNA, 25 bp, Mus musculus
gcaactgttactaaagagcccacta

SEQ ID NO: 527753 - DNA, 25 bp, Mus musculus
gcaactgttacttaagagcccacta

SEQ ID NO: 527754 - DNA, 25 bp, Mus musculus
gcaactgttcagagaattccctcac

SEQ ID NO: 527755 - DNA, 25 bp, Mus musculus
gcaactgttcagtgaattccctcac

SEQ ID NO: 527756 - DNA, 25 bp, Mus musculus
gcaactgttcttatttcaaatttca

SEQ ID NO: 527757 - DNA, 25 bp, Mus musculus
gcaactgttcttttttcaaatttca

SEQ ID NO: 527758 - DNA, 25 bp, Mus musculus
gcaactgttgctatcacatgatctt

SEQ ID NO: 527759 - DNA, 25 bp, Mus musculus
gcaactgttgctttcacatgatctt

SEQ ID NO: 527760 - DNA, 25 bp, Mus musculus
gcaactgttgttccacactcaaata

SEQ ID NO: 527761 - DNA, 25 bp, Mus musculus
gcaactgttgttgcacactcaaata

SEQ ID NO: 527762 - DNA, 25 bp, Mus musculus
gcaactgtttatattactgggctct

SEQ ID NO: 527763 - DNA, 25 bp, Mus musculus
gcaactgtttattttactgggctct

SEQ ID NO: 527764 - DNA, 25 bp, Mus musculus
gcaactgttttaagccggttccaca

SEQ ID NO: 527765 - DNA, 25 bp, Mus musculus
gcaactgttttatgccggttccaca

SEQ ID NO: 527766 - DNA, 25 bp, Mus musculus
gcaactgttttgctcgagagatgta

SEQ ID NO: 527767 - DNA, 25 bp, Mus musculus
gcaactgttttggtcgagagatgta

SEQ ID NO: 527768 - DNA, 25 bp, Mus musculus
gcaacttatccccaacaggtggtga

SEQ ID NO: 527769 - DNA, 25 bp, Mus musculus
gcaacttatccccacttgaacattg

SEQ ID NO: 527770 - DNA, 25 bp, Mus musculus
gcaacttatcccgaacaggtggtga

SEQ ID NO: 527771 - DNA, 25 bp, Mus musculus
gcaacttatcccgacttgaacattg

SEQ ID NO: 527772 - DNA, 25 bp, Mus musculus
gcaacttcaatcagctttaaaaccc

SEQ ID NO: 527773 - DNA, 25 bp, Mus musculus
gcaacttcaatctgctttaaaaccc

SEQ ID NO: 527774 - DNA, 25 bp, Mus musculus
gcaacttcaatgaacggcccagcgt

SEQ ID NO: 527775 - DNA, 25 bp, Mus musculus
gcaacttcaatgtacggcccagcgt

SEQ ID NO: 527776 - DNA, 25 bp, Mus musculus
gcaacttcagtccagttcatttatg

SEQ ID NO: 527777 - DNA, 25 bp, Mus musculus
gcaacttcagtcgagttcatttatg

SEQ ID NO: 527778 - DNA, 25 bp, Mus musculus
gcaacttcctgcaaaatgtctactt

SEQ ID NO: 527779 - DNA, 25 bp, Mus musculus
gcaacttcctgctaaatgtctactt

SEQ ID NO: 527780 - DNA, 25 bp, Mus musculus
gcaacttctatgagcccgcagaacc

SEQ ID NO: 527781 - DNA, 25 bp, Mus musculus
gcaacttctatgtgcccgcagaacc

SEQ ID NO: 527782 - DNA, 25 bp, Mus musculus
gcaacttctcatagcaaggcaagag

SEQ ID NO: 527783 - DNA, 25 bp, Mus musculus
gcaacttctcattgcaaggcaagag

SEQ ID NO: 527784 - DNA, 25 bp, Mus musculus
gcaacttctgcaatctctagtgctg

SEQ ID NO: 527785 - DNA, 25 bp, Mus musculus
gcaacttctgcattctctagtgctg

SEQ ID NO: 527786 - DNA, 25 bp, Mus musculus
gcaacttctgctatgttccagttac

SEQ ID NO: 527787 - DNA, 25 bp, Mus musculus
gcaacttctgctttgttccagttac

SEQ ID NO: 527788 - DNA, 25 bp, Mus musculus
gcaacttctgtcatggtcagaccta

SEQ ID NO: 527789 - DNA, 25 bp, Mus musculus
gcaacttctgtcttggtcagaccta

SEQ ID NO: 527790 - DNA, 25 bp, Mus musculus
gcaacttgaagcaaagccccagctg

SEQ ID NO: 527791 - DNA, 25 bp, Mus musculus
gcaacttgaagctaagccccagctg

SEQ ID NO: 527792 - DNA, 25 bp, Mus musculus
gcaacttgatcgctgtcagaacctg

SEQ ID NO: 527793 - DNA, 25 bp, Mus musculus
gcaacttgatcggtgtcagaacctg

SEQ ID NO: 527794 - DNA, 25 bp, Mus musculus
gcaacttgatgcaggctagagtaat

SEQ ID NO: 527795 - DNA, 25 bp, Mus musculus
gcaacttgatgctggctagagtaat

SEQ ID NO: 527796 - DNA, 25 bp, Mus musculus
gcaacttgcgatagattgtgtcatc

SEQ ID NO: 527797 - DNA, 25 bp, Mus musculus
gcaacttgcgattgattgtgtcatc

SEQ ID NO: 527798 - DNA, 25 bp, Mus musculus
gcaacttgctgaataatgacttcca

SEQ ID NO: 527799 - DNA, 25 bp, Mus musculus
gcaacttgctgattaatgacttcca

SEQ ID NO: 527800 - DNA, 25 bp, Mus musculus
gcaacttgcttaagcctaaaaggag

SEQ ID NO: 527801 - DNA, 25 bp, Mus musculus
gcaacttgcttatgcctaaaaggag

SEQ ID NO: 527802 - DNA, 25 bp, Mus musculus
gcaacttggagcacccagagcgagt

SEQ ID NO: 527803 - DNA, 25 bp, Mus musculus
gcaacttggagctcccagagcgagt

SEQ ID NO: 527804 - DNA, 25 bp, Mus musculus
gcaacttggcagaaactggtggcat

SEQ ID NO: 527805 - DNA, 25 bp, Mus musculus
gcaacttggcagtaactggtggcat

SEQ ID NO: 527806 - DNA, 25 bp, Mus musculus
gcaacttggtaacaacctgcctcaa

SEQ ID NO: 527807 - DNA, 25 bp, Mus musculus
gcaacttggtaagaacctgcctcaa

SEQ ID NO: 527808 - DNA, 25 bp, Mus musculus
gcaacttgtagcatgtgaccaagcc

SEQ ID NO: 527809 - DNA, 25 bp, Mus musculus
gcaacttgtagcttgtgaccaagcc

SEQ ID NO: 527810 - DNA, 25 bp, Mus musculus
gcaacttgtcttaggacctcagcta

SEQ ID NO: 527811 - DNA, 25 bp, Mus musculus
gcaacttgtctttggacctcagcta

SEQ ID NO: 527812 - DNA, 25 bp, Mus musculus
gcaacttgtgtgagagcttctcctg

SEQ ID NO: 527813 - DNA, 25 bp, Mus musculus
gcaacttgtgtgtgagcttctcctg

SEQ ID NO: 527814 - DNA, 25 bp, Mus musculus
gcaactttaaacacttgggtgggat

SEQ ID NO: 527815 - DNA, 25 bp, Mus musculus
gcaactttaaactcttgggtgggat

SEQ ID NO: 527816 - DNA, 25 bp, Mus musculus
gcaactttaacactgctttactaac

SEQ ID NO: 527817 - DNA, 25 bp, Mus musculus
gcaactttaacagtgctttactaac

SEQ ID NO: 527818 - DNA, 25 bp, Mus musculus
gcaactttactaaatgtacccaatg

SEQ ID NO: 527819 - DNA, 25 bp, Mus musculus
gcaactttactatatgtacccaatg

SEQ ID NO: 527820 - DNA, 25 bp, Mus musculus
gcaactttattgcttcaatctggat

SEQ ID NO: 527821 - DNA, 25 bp, Mus musculus
gcaactttattggttcaatctggat

SEQ ID NO: 527822 - DNA, 25 bp, Mus musculus
gcaactttcaaacgaattggcccta

SEQ ID NO: 527823 - DNA, 25 bp, Mus musculus
gcaactttcaaaggaattggcccta

SEQ ID NO: 527824 - DNA, 25 bp, Mus musculus
gcaactttctgaaaagtgattcaat

SEQ ID NO: 527825 - DNA, 25 bp, Mus musculus
gcaactttctgaacatcccacagca

SEQ ID NO: 527826 - DNA, 25 bp, Mus musculus
gcaactttctgataagtgattcaat

SEQ ID NO: 527827 - DNA, 25 bp, Mus musculus
gcaactttctgatcatcccacagca

SEQ ID NO: 527828 - DNA, 25 bp, Mus musculus
gcaactttcttaaattctaaaccgt

SEQ ID NO: 527829 - DNA, 25 bp, Mus musculus
gcaactttcttatattctaaaccgt

SEQ ID NO: 527830 - DNA, 25 bp, Mus musculus
gcaactttgaccagttattgggatt

SEQ ID NO: 527831 - DNA, 25 bp, Mus musculus
gcaactttgacctgttattgggatt

SEQ ID NO: 527832 - DNA, 25 bp, Mus musculus
gcaactttggtactgttcaggccta

SEQ ID NO: 527833 - DNA, 25 bp, Mus musculus
gcaactttggtagtgttcaggccta

SEQ ID NO: 527834 - DNA, 25 bp, Mus musculus
gcaacttttacaagacctctggctt

SEQ ID NO: 527835 - DNA, 25 bp, Mus musculus
gcaacttttacatgacctctggctt

SEQ ID NO: 527836 - DNA, 25 bp, Mus musculus
gcaagaaaacttaaaggctccattt

SEQ ID NO: 527837 - DNA, 25 bp, Mus musculus
gcaagaaaactttaaggctccattt

SEQ ID NO: 527838 - DNA, 25 bp, Mus musculus
gcaagaaacaagactttccttaaca

SEQ ID NO: 527839 - DNA, 25 bp, Mus musculus
gcaagaaacaagtctttccttaaca

SEQ ID NO: 527840 - DNA, 25 bp, Mus musculus
gcaagaaacagacagcccgggaaat

SEQ ID NO: 527841 - DNA, 25 bp, Mus musculus
gcaagaaacagagagcccgggaaat

SEQ ID NO: 527842 - DNA, 25 bp, Mus musculus
gcaagaaaccagacctgcagatcta

SEQ ID NO: 527843 - DNA, 25 bp, Mus musculus
gcaagaaaccagtcctgcagatcta

SEQ ID NO: 527844 - DNA, 25 bp, Mus musculus
gcaagaaagattacctcggctcaca

SEQ ID NO: 527845 - DNA, 25 bp, Mus musculus
gcaagaaagatttcctcggctcaca

SEQ ID NO: 527846 - DNA, 25 bp, Mus musculus
gcaagaaatcaaatcccggcatgga

SEQ ID NO: 527847 - DNA, 25 bp, Mus musculus
gcaagaaatcaattcccggcatgga

SEQ ID NO: 527848 - DNA, 25 bp, Mus musculus
gcaagaaatctaacagtaggtccat

SEQ ID NO: 527849 - DNA, 25 bp, Mus musculus
gcaagaaatctatcagtaggtccat

SEQ ID NO: 527850 - DNA, 25 bp, Mus musculus
gcaagaaatggtagagctcaaggct

SEQ ID NO: 527851 - DNA, 25 bp, Mus musculus
gcaagaaatggttgagctcaaggct

SEQ ID NO: 527852 - DNA, 25 bp, Mus musculus
gcaagaacacttactaaggtggcat

SEQ ID NO: 527853 - DNA, 25 bp, Mus musculus
gcaagaacactttctaaggtggcat

SEQ ID NO: 527854 - DNA, 25 bp, Mus musculus
gcaagaacagatcactggcagattt

SEQ ID NO: 527855 - DNA, 25 bp, Mus musculus
gcaagaacagatgactggcagattt

SEQ ID NO: 527856 - DNA, 25 bp, Mus musculus
gcaagaacagcaacctgattttact

SEQ ID NO: 527857 - DNA, 25 bp, Mus musculus
gcaagaacagcatcctgattttact

SEQ ID NO: 527858 - DNA, 25 bp, Mus musculus
gcaagaacaggtcttcctaaccagg

SEQ ID NO: 527859 - DNA, 25 bp, Mus musculus
gcaagaacaggtgttcctaaccagg

SEQ ID NO: 527860 - DNA, 25 bp, Mus musculus
gcaagaacatatcccagttcctgat

SEQ ID NO: 527861 - DNA, 25 bp, Mus musculus
gcaagaacatatgccagttcctgat

SEQ ID NO: 527862 - DNA, 25 bp, Mus musculus
gcaagaacccaacacatcttcctat

SEQ ID NO: 527863 - DNA, 25 bp, Mus musculus
gcaagaacccaagacatcttcctat

SEQ ID NO: 527864 - DNA, 25 bp, Mus musculus
gcaagaacccttatgaatgtagtga

SEQ ID NO: 527865 - DNA, 25 bp, Mus musculus
gcaagaacccttttgaatgtagtga

SEQ ID NO: 527866 - DNA, 25 bp, Mus musculus
gcaagaaccgagctcctcacaaggg

SEQ ID NO: 527867 - DNA, 25 bp, Mus musculus
gcaagaaccgaggtcctcacaaggg

SEQ ID NO: 527868 - DNA, 25 bp, Mus musculus
gcaagaacctaaagccgctgctgga

SEQ ID NO: 527869 - DNA, 25 bp, Mus musculus
gcaagaacctaatgccgctgctgga

SEQ ID NO: 527870 - DNA, 25 bp, Mus musculus
gcaagaacctatacagccagaaatg

SEQ ID NO: 527871 - DNA, 25 bp, Mus musculus
gcaagaacctattcagccagaaatg

SEQ ID NO: 527872 - DNA, 25 bp, Mus musculus
gcaagaacctgaaggacatgttcag

SEQ ID NO: 527873 - DNA, 25 bp, Mus musculus
gcaagaacctgatggacatgttcag

SEQ ID NO: 527874 - DNA, 25 bp, Mus musculus
gcaagaaccttgacttaaccaactg

SEQ ID NO: 527875 - DNA, 25 bp, Mus musculus
gcaagaaccttgtcttaaccaactg

SEQ ID NO: 527876 - DNA, 25 bp, Mus musculus
gcaagaacgaccactttggatatcc

SEQ ID NO: 527877 - DNA, 25 bp, Mus musculus
gcaagaacgacctctttggatatcc

SEQ ID NO: 527878 - DNA, 25 bp, Mus musculus
gcaagaacgcttcgacatcgaggaa

SEQ ID NO: 527879 - DNA, 25 bp, Mus musculus
gcaagaacgcttggacatcgaggaa

SEQ ID NO: 527880 - DNA, 25 bp, Mus musculus
gcaagaactcaacagagctcccagg

SEQ ID NO: 527881 - DNA, 25 bp, Mus musculus
gcaagaactcaagagagctcccagg

SEQ ID NO: 527882 - DNA, 25 bp, Mus musculus
gcaagaactctaagtcagccatgga

SEQ ID NO: 527883 - DNA, 25 bp, Mus musculus
gcaagaactctatgtcagccatgga

SEQ ID NO: 527884 - DNA, 25 bp, Mus musculus
gcaagaacttgaagccagccacagt

SEQ ID NO: 527885 - DNA, 25 bp, Mus musculus
gcaagaacttgatgccagccacagt

SEQ ID NO: 527886 - DNA, 25 bp, Mus musculus
gcaagaactttcactttatgagaga

SEQ ID NO: 527887 - DNA, 25 bp, Mus musculus
gcaagaactttctctttatgagaga

SEQ ID NO: 527888 - DNA, 25 bp, Mus musculus
gcaagaagaagtccggccataccaa

SEQ ID NO: 527889 - DNA, 25 bp, Mus musculus
gcaagaagaagtgcggccataccaa

SEQ ID NO: 527890 - DNA, 25 bp, Mus musculus
gcaagaagagcgaggccccacccat

SEQ ID NO: 527891 - DNA, 25 bp, Mus musculus
gcaagaagagcgtggccccacccat

SEQ ID NO: 527892 - DNA, 25 bp, Mus musculus
gcaagaagatacaagagttcccagt

SEQ ID NO: 527893 - DNA, 25 bp, Mus musculus
gcaagaagatactagagttcccagt

SEQ ID NO: 527894 - DNA, 25 bp, Mus musculus
gcaagaagatcgagataaaccccag

SEQ ID NO: 527895 - DNA, 25 bp, Mus musculus
gcaagaagatcgtgataaaccccag

SEQ ID NO: 527896 - DNA, 25 bp, Mus musculus
gcaagaagcaaaagcccatgggaaa

SEQ ID NO: 527897 - DNA, 25 bp, Mus musculus
gcaagaagcaaatgcccatgggaaa

SEQ ID NO: 527898 - DNA, 25 bp, Mus musculus
gcaagaagcacgcacatgccatcaa

SEQ ID NO: 527899 - DNA, 25 bp, Mus musculus
gcaagaagcacggacatgccatcaa

SEQ ID NO: 527900 - DNA, 25 bp, Mus musculus
gcaagaagcagaagcagtcaactga

SEQ ID NO: 527901 - DNA, 25 bp, Mus musculus
gcaagaagcagatgcagtcaactga

SEQ ID NO: 527902 - DNA, 25 bp, Mus musculus
gcaagaagccacaggaatctgacgt

SEQ ID NO: 527903 - DNA, 25 bp, Mus musculus
gcaagaagccactggaatctgacgt

SEQ ID NO: 527904 - DNA, 25 bp, Mus musculus
gcaagaagccctatgggaacagcct

SEQ ID NO: 527905 - DNA, 25 bp, Mus musculus
gcaagaagccctttgggaacagcct

SEQ ID NO: 527906 - DNA, 25 bp, Mus musculus
gcaagaagccttagcaatgccatag

SEQ ID NO: 527907 - DNA, 25 bp, Mus musculus
gcaagaagcctttgcaatgccatag

SEQ ID NO: 527908 - DNA, 25 bp, Mus musculus
gcaagaaggccgctgccacagccaa

SEQ ID NO: 527909 - DNA, 25 bp, Mus musculus
gcaagaaggccggtgccacagccaa

SEQ ID NO: 527910 - DNA, 25 bp, Mus musculus
gcaagaaggctgcacgatcgtctga

SEQ ID NO: 527911 - DNA, 25 bp, Mus musculus
gcaagaaggctggacgatcgtctga

SEQ ID NO: 527912 - DNA, 25 bp, Mus musculus
gcaagaagtgaaacctcactcacgg

SEQ ID NO: 527913 - DNA, 25 bp, Mus musculus
gcaagaagtgaatcctcactcacgg

SEQ ID NO: 527914 - DNA, 25 bp, Mus musculus
gcaagaagtgatccggctcctactc

SEQ ID NO: 527915 - DNA, 25 bp, Mus musculus
gcaagaagtgatgcggctcctactc

SEQ ID NO: 527916 - DNA, 25 bp, Mus musculus
gcaagaagtttaaccacagacagcc

SEQ ID NO: 527917 - DNA, 25 bp, Mus musculus
gcaagaagtttatccacagacagcc

SEQ ID NO: 527918 - DNA, 25 bp, Mus musculus
gcaagaataaggacacccagccggg

SEQ ID NO: 527919 - DNA, 25 bp, Mus musculus
gcaagaataaggtcacccagccggg

SEQ ID NO: 527920 - DNA, 25 bp, Mus musculus
gcaagaataccacatagcccaaata

SEQ ID NO: 527921 - DNA, 25 bp, Mus musculus
gcaagaataccagatagcccaaata

SEQ ID NO: 527922 - DNA, 25 bp, Mus musculus
gcaagaatagtcacctggtcccaag

SEQ ID NO: 527923 - DNA, 25 bp, Mus musculus
gcaagaatagtctcctggtcccaag

SEQ ID NO: 527924 - DNA, 25 bp, Mus musculus
gcaagaatcgctctacttagttaag

SEQ ID NO: 527925 - DNA, 25 bp, Mus musculus
gcaagaatcgctgtacttagttaag

SEQ ID NO: 527926 - DNA, 25 bp, Mus musculus
gcaagaatctatctacaagtgagca

SEQ ID NO: 527927 - DNA, 25 bp, Mus musculus
gcaagaatctatgtacaagtgagca

SEQ ID NO: 527928 - DNA, 25 bp, Mus musculus
gcaagaatctcccaagtcaacgttt

SEQ ID NO: 527929 - DNA, 25 bp, Mus musculus
gcaagaatctccgaagtcaacgttt

SEQ ID NO: 527930 - DNA, 25 bp, Mus musculus
gcaagaatgggaacatggtgtttta

SEQ ID NO: 527931 - DNA, 25 bp, Mus musculus
gcaagaatgggatcatggtgtttta

SEQ ID NO: 527932 - DNA, 25 bp, Mus musculus
gcaagaattaaactcttcccaaagg

SEQ ID NO: 527933 - DNA, 25 bp, Mus musculus
gcaagaattaaagtcttcccaaagg

SEQ ID NO: 527934 - DNA, 25 bp, Mus musculus
gcaagaattccacccaagactgtta

SEQ ID NO: 527935 - DNA, 25 bp, Mus musculus
gcaagaattccagccaagactgtta

SEQ ID NO: 527936 - DNA, 25 bp, Mus musculus
gcaagacaccagatgaaaacccttt

SEQ ID NO: 527937 - DNA, 25 bp, Mus musculus
gcaagacaccagttgaaaacccttt

SEQ ID NO: 527938 - DNA, 25 bp, Mus musculus
gcaagacacttgacagcagccagcc

SEQ ID NO: 527939 - DNA, 25 bp, Mus musculus
gcaagacacttgtcagcagccagcc

SEQ ID NO: 527940 - DNA, 25 bp, Mus musculus
gcaagacagaagcaatcacccctca

SEQ ID NO: 527941 - DNA, 25 bp, Mus musculus
gcaagacagaaggaatcacccctca

SEQ ID NO: 527942 - DNA, 25 bp, Mus musculus
gcaagacagaatcattagacagcct

SEQ ID NO: 527943 - DNA, 25 bp, Mus musculus
gcaagacagaatgattagacagcct

SEQ ID NO: 527944 - DNA, 25 bp, Mus musculus
gcaagacaggaactgacctcacaac

SEQ ID NO: 527945 - DNA, 25 bp, Mus musculus
gcaagacaggaagtgacctcacaac

SEQ ID NO: 527946 - DNA, 25 bp, Mus musculus
gcaagacagtctattacaagtacat

SEQ ID NO: 527947 - DNA, 25 bp, Mus musculus
gcaagacagtcttttacaagtacat

SEQ ID NO: 527948 - DNA, 25 bp, Mus musculus
gcaagacagttgcaccgggacccga

SEQ ID NO: 527949 - DNA, 25 bp, Mus musculus
gcaagacagttggaccgggacccga

SEQ ID NO: 527950 - DNA, 25 bp, Mus musculus
gcaagacatggcctttatgagaaga

SEQ ID NO: 527951 - DNA, 25 bp, Mus musculus
gcaagacatggcgtttatgagaaga

SEQ ID NO: 527952 - DNA, 25 bp, Mus musculus
gcaagaccagctactacatgggcct

SEQ ID NO: 527953 - DNA, 25 bp, Mus musculus
gcaagaccagcttctacatgggcct

SEQ ID NO: 527954 - DNA, 25 bp, Mus musculus
gcaagaccaggaagtagcgagcagt

SEQ ID NO: 527955 - DNA, 25 bp, Mus musculus
gcaagaccaggatgtagcgagcagt

SEQ ID NO: 527956 - DNA, 25 bp, Mus musculus
gcaagaccagtgcagagtccacact

SEQ ID NO: 527957 - DNA, 25 bp, Mus musculus
gcaagaccagtggagagtccacact

SEQ ID NO: 527958 - DNA, 25 bp, Mus musculus
gcaagacccaaaccattcaaccaga

SEQ ID NO: 527959 - DNA, 25 bp, Mus musculus
gcaagacccaaagcattcaaccaga

SEQ ID NO: 527960 - DNA, 25 bp, Mus musculus
gcaagacccatcaggtgcggcacca

SEQ ID NO: 527961 - DNA, 25 bp, Mus musculus
gcaagacccatctggtgcggcacca

SEQ ID NO: 527962 - DNA, 25 bp, Mus musculus
gcaagaccccacactgttgaacata

SEQ ID NO: 527963 - DNA, 25 bp, Mus musculus
gcaagaccccactctgttgaacata

SEQ ID NO: 527964 - DNA, 25 bp, Mus musculus
gcaagacccgaactaaactcatcat

SEQ ID NO: 527965 - DNA, 25 bp, Mus musculus
gcaagacccgaagtaaactcatcat

SEQ ID NO: 527966 - DNA, 25 bp, Mus musculus
gcaagaccctggacctcacgggcag

SEQ ID NO: 527967 - DNA, 25 bp, Mus musculus
gcaagaccctggtcctcacgggcag

SEQ ID NO: 527968 - DNA, 25 bp, Mus musculus
gcaagaccctttaacaaccaatgaa

SEQ ID NO: 527969 - DNA, 25 bp, Mus musculus
gcaagacccttttacaaccaatgaa

SEQ ID NO: 527970 - DNA, 25 bp, Mus musculus
gcaagaccgtggaagtgccttacaa

SEQ ID NO: 527971 - DNA, 25 bp, Mus musculus
gcaagaccgtggtagtgccttacaa

SEQ ID NO: 527972 - DNA, 25 bp, Mus musculus
gcaagacctaacaagagtgctttcc

SEQ ID NO: 527973 - DNA, 25 bp, Mus musculus
gcaagacctaactagagtgctttcc

SEQ ID NO: 527974 - DNA, 25 bp, Mus musculus
gcaagacctcagagtgatcagccga

SEQ ID NO: 527975 - DNA, 25 bp, Mus musculus
gcaagacctcagtgtgatcagccga

SEQ ID NO: 527976 - DNA, 25 bp, Mus musculus
gcaagacctcggcacagtatggcaa

SEQ ID NO: 527977 - DNA, 25 bp, Mus musculus
gcaagacctcgggacagtatggcaa

SEQ ID NO: 527978 - DNA, 25 bp, Mus musculus
gcaagacctgtgactatggccaggg

SEQ ID NO: 527979 - DNA, 25 bp, Mus musculus
gcaagacctgtgctcgggtttgtcc

SEQ ID NO: 527980 - DNA, 25 bp, Mus musculus
gcaagacctgtggtcgggtttgtcc

SEQ ID NO: 527981 - DNA, 25 bp, Mus musculus
gcaagacctgtgtctatggccaggg

SEQ ID NO: 527982 - DNA, 25 bp, Mus musculus
gcaagaccttcgcttctttagccaa

SEQ ID NO: 527983 - DNA, 25 bp, Mus musculus
gcaagaccttcggttctttagccaa

SEQ ID NO: 527984 - DNA, 25 bp, Mus musculus
gcaagaccttctactggcgcgagca

SEQ ID NO: 527985 - DNA, 25 bp, Mus musculus
gcaagaccttcttctggcgcgagca

SEQ ID NO: 527986 - DNA, 25 bp, Mus musculus
gcaagaccttgcaatttcagagatg

SEQ ID NO: 527987 - DNA, 25 bp, Mus musculus
gcaagaccttgctatttcagagatg

SEQ ID NO: 527988 - DNA, 25 bp, Mus musculus
gcaagacgagttctactgctgacac

SEQ ID NO: 527989 - DNA, 25 bp, Mus musculus
gcaagacgagttgtactgctgacac

SEQ ID NO: 527990 - DNA, 25 bp, Mus musculus
gcaagacgcacacgcataggaggca

SEQ ID NO: 527991 - DNA, 25 bp, Mus musculus
gcaagacgcacaggcataggaggca

SEQ ID NO: 527992 - DNA, 25 bp, Mus musculus
gcaagacggagtcgctttgactcat

SEQ ID NO: 527993 - DNA, 25 bp, Mus musculus
gcaagacggagtggctttgactcat

SEQ ID NO: 527994 - DNA, 25 bp, Mus musculus
gcaagacggcaaccaccaacagcat

SEQ ID NO: 527995 - DNA, 25 bp, Mus musculus
gcaagacggcaagcaccaacagcat

SEQ ID NO: 527996 - DNA, 25 bp, Mus musculus
gcaagacggccactttcaaagccat

SEQ ID NO: 527997 - DNA, 25 bp, Mus musculus
gcaagacggccagtttcaaagccat

SEQ ID NO: 527998 - DNA, 25 bp, Mus musculus
gcaagactaaatataggccctttta

SEQ ID NO: 527999 - DNA, 25 bp, Mus musculus
gcaagactaaatttaggccctttta

SEQ ID NO: 528000 - DNA, 25 bp, Mus musculus
gcaagactacagacttcgtgaacta

SEQ ID NO: 528001 - DNA, 25 bp, Mus musculus
gcaagactacagtcttcgtgaacta

SEQ ID NO: 528002 - DNA, 25 bp, Mus musculus
gcaagactactgcacttgtatccat

SEQ ID NO: 528003 - DNA, 25 bp, Mus musculus
gcaagactactggacttgtatccat

SEQ ID NO: 528004 - DNA, 25 bp, Mus musculus
gcaagactcagtacagcggcacagc

SEQ ID NO: 528005 - DNA, 25 bp, Mus musculus
gcaagactcagttcagcggcacagc

SEQ ID NO: 528006 - DNA, 25 bp, Mus musculus
gcaagactggacacctcatgtcatg

SEQ ID NO: 528007 - DNA, 25 bp, Mus musculus
gcaagactggactcctcatgtcatg

SEQ ID NO: 528008 - DNA, 25 bp, Mus musculus
gcaagactggccagagtcgctcagt

SEQ ID NO: 528009 - DNA, 25 bp, Mus musculus
gcaagactggcctgagtcgctcagt

SEQ ID NO: 528010 - DNA, 25 bp, Mus musculus
gcaagactgtctaacgcaaagtgat

SEQ ID NO: 528011 - DNA, 25 bp, Mus musculus
gcaagactgtcttacgcaaagtgat

SEQ ID NO: 528012 - DNA, 25 bp, Mus musculus
gcaagactgtgtacaccaagctgga

SEQ ID NO: 528013 - DNA, 25 bp, Mus musculus
gcaagactgtgttcaccaagctgga

SEQ ID NO: 528014 - DNA, 25 bp, Mus musculus
gcaagactgtttattcacttaccgg

SEQ ID NO: 528015 - DNA, 25 bp, Mus musculus
gcaagactgttttttcacttaccgg

SEQ ID NO: 528016 - DNA, 25 bp, Mus musculus
gcaagacttaacaggaaacttctat

SEQ ID NO: 528017 - DNA, 25 bp, Mus musculus
gcaagacttaactggaaacttctat

SEQ ID NO: 528018 - DNA, 25 bp, Mus musculus
gcaagacttttgctctgtgaattta

SEQ ID NO: 528019 - DNA, 25 bp, Mus musculus
gcaagacttttggtctgtgaattta

SEQ ID NO: 528020 - DNA, 25 bp, Mus musculus
gcaagagaagccatgactgtcccaa

SEQ ID NO: 528021 - DNA, 25 bp, Mus musculus
gcaagagaagccttgactgtcccaa

SEQ ID NO: 528022 - DNA, 25 bp, Mus musculus
gcaagagaagctactctggccataa

SEQ ID NO: 528023 - DNA, 25 bp, Mus musculus
gcaagagaagcttctctggccataa

SEQ ID NO: 528024 - DNA, 25 bp, Mus musculus
gcaagagaaggtcagctaaatggtt

SEQ ID NO: 528025 - DNA, 25 bp, Mus musculus
gcaagagaaggtgagctaaatggtt

SEQ ID NO: 528026 - DNA, 25 bp, Mus musculus
gcaagagaatttagacaaggctata

SEQ ID NO: 528027 - DNA, 25 bp, Mus musculus
gcaagagaattttgacaaggctata

SEQ ID NO: 528028 - DNA, 25 bp, Mus musculus
gcaagagacacaatccaagaaacag

SEQ ID NO: 528029 - DNA, 25 bp, Mus musculus
gcaagagacacattccaagaaacag

SEQ ID NO: 528030 - DNA, 25 bp, Mus musculus
gcaagagaccagctatctgcctcac

SEQ ID NO: 528031 - DNA, 25 bp, Mus musculus
gcaagagaccaggtatctgcctcac

SEQ ID NO: 528032 - DNA, 25 bp, Mus musculus
gcaagagaccatcaagccccaggag

SEQ ID NO: 528033 - DNA, 25 bp, Mus musculus
gcaagagaccatgaagccccaggag

SEQ ID NO: 528034 - DNA, 25 bp, Mus musculus
gcaagagacctacagcaaatcttat

SEQ ID NO: 528035 - DNA, 25 bp, Mus musculus
gcaagagacctagagcaaatcttat

SEQ ID NO: 528036 - DNA, 25 bp, Mus musculus
gcaagagactcaactcctgaaggga

SEQ ID NO: 528037 - DNA, 25 bp, Mus musculus
gcaagagactcatctcctgaaggga

SEQ ID NO: 528038 - DNA, 25 bp, Mus musculus
gcaagagagactccgatggacactt

SEQ ID NO: 528039 - DNA, 25 bp, Mus musculus
gcaagagagactgcgatggacactt

SEQ ID NO: 528040 - DNA, 25 bp, Mus musculus
gcaagagagcagattgctggcataa

SEQ ID NO: 528041 - DNA, 25 bp, Mus musculus
gcaagagagcagtttgctggcataa

SEQ ID NO: 528042 - DNA, 25 bp, Mus musculus
gcaagagagccaactactgagccat

SEQ ID NO: 528043 - DNA, 25 bp, Mus musculus
gcaagagagccatctactgagccat

SEQ ID NO: 528044 - DNA, 25 bp, Mus musculus
gcaagagatacaacggcacgccctg

SEQ ID NO: 528045 - DNA, 25 bp, Mus musculus
gcaagagatacatcggcacgccctg

SEQ ID NO: 528046 - DNA, 25 bp, Mus musculus
gcaagagatgagactctccttcctt

SEQ ID NO: 528047 - DNA, 25 bp, Mus musculus
gcaagagatgagtctctccttcctt

SEQ ID NO: 528048 - DNA, 25 bp, Mus musculus
gcaagagcaacaatttcgtccctat

SEQ ID NO: 528049 - DNA, 25 bp, Mus musculus
gcaagagcaacattttcgtccctat

SEQ ID NO: 528050 - DNA, 25 bp, Mus musculus
gcaagagcaagtagtgttctaaact

SEQ ID NO: 528051 - DNA, 25 bp, Mus musculus
gcaagagcaagttgtgttctaaact

SEQ ID NO: 528052 - DNA, 25 bp, Mus musculus
gcaagagcaattagttctaatttca

SEQ ID NO: 528053 - DNA, 25 bp, Mus musculus
gcaagagcaatttgttctaatttca

SEQ ID NO: 528054 - DNA, 25 bp, Mus musculus
gcaagagcaccaacatcctgatgat

SEQ ID NO: 528055 - DNA, 25 bp, Mus musculus
gcaagagcaccatcatcctgatgat

SEQ ID NO: 528056 - DNA, 25 bp, Mus musculus
gcaagagcaccgaagttctattgtt

SEQ ID NO: 528057 - DNA, 25 bp, Mus musculus
gcaagagcaccgtagttctattgtt

SEQ ID NO: 528058 - DNA, 25 bp, Mus musculus
gcaagagcagaacgcccactctgta

SEQ ID NO: 528059 - DNA, 25 bp, Mus musculus
gcaagagcagaaggcccactctgta

SEQ ID NO: 528060 - DNA, 25 bp, Mus musculus
gcaagagcagatagcagaaaccaaa

SEQ ID NO: 528061 - DNA, 25 bp, Mus musculus
gcaagagcagattgcagaaaccaaa

SEQ ID NO: 528062 - DNA, 25 bp, Mus musculus
gcaagagcagcaaaggattacaacc

SEQ ID NO: 528063 - DNA, 25 bp, Mus musculus
gcaagagcagcataggattacaacc

SEQ ID NO: 528064 - DNA, 25 bp, Mus musculus
gcaagagccagaatcttacccatct

SEQ ID NO: 528065 - DNA, 25 bp, Mus musculus
gcaagagccagattcttacccatct

SEQ ID NO: 528066 - DNA, 25 bp, Mus musculus
gcaagagccatactttttaaactga

SEQ ID NO: 528067 - DNA, 25 bp, Mus musculus
gcaagagccatagtttttaaactga

SEQ ID NO: 528068 - DNA, 25 bp, Mus musculus
gcaagagcctctactggcttctcca

SEQ ID NO: 528069 - DNA, 25 bp, Mus musculus
gcaagagcctcttctggcttctcca

SEQ ID NO: 528070 - DNA, 25 bp, Mus musculus
gcaagagcctggatttcatcatctt

SEQ ID NO: 528071 - DNA, 25 bp, Mus musculus
gcaagagcctggttttcatcatctt

SEQ ID NO: 528072 - DNA, 25 bp, Mus musculus
gcaagagctctgcaaaccacctcag

SEQ ID NO: 528073 - DNA, 25 bp, Mus musculus
gcaagagctctggaaaccacctcag

SEQ ID NO: 528074 - DNA, 25 bp, Mus musculus
gcaagagctcttcgccacaggatgc

SEQ ID NO: 528075 - DNA, 25 bp, Mus musculus
gcaagagctcttggccacaggatgc

SEQ ID NO: 528076 - DNA, 25 bp, Mus musculus
gcaagagctgatatgagtggtttcc

SEQ ID NO: 528077 - DNA, 25 bp, Mus musculus
gcaagagctgatttgagtggtttcc

SEQ ID NO: 528078 - DNA, 25 bp, Mus musculus
gcaagagcttgcagacttccgggaa

SEQ ID NO: 528079 - DNA, 25 bp, Mus musculus
gcaagagcttgctgacttccgggaa

SEQ ID NO: 528080 - DNA, 25 bp, Mus musculus
gcaagaggaacgcttaggcagccct

SEQ ID NO: 528081 - DNA, 25 bp, Mus musculus
gcaagaggaacggttaggcagccct

SEQ ID NO: 528082 - DNA, 25 bp, Mus musculus
gcaagaggaccaacagtttcaatta

SEQ ID NO: 528083 - DNA, 25 bp, Mus musculus
gcaagaggaccatcagtttcaatta

SEQ ID NO: 528084 - DNA, 25 bp, Mus musculus
gcaagaggatccacgtcagccattt

SEQ ID NO: 528085 - DNA, 25 bp, Mus musculus
gcaagaggatcctcgtcagccattt

SEQ ID NO: 528086 - DNA, 25 bp, Mus musculus
gcaagaggcacaagccaagctggac

SEQ ID NO: 528087 - DNA, 25 bp, Mus musculus
gcaagaggcacatgccaagctggac

SEQ ID NO: 528088 - DNA, 25 bp, Mus musculus
gcaagaggctgtctcaattctcaag

SEQ ID NO: 528089 - DNA, 25 bp, Mus musculus
gcaagaggctgtgtcaattctcaag

SEQ ID NO: 528090 - DNA, 25 bp, Mus musculus
gcaagagggtctacctgagtgccga

SEQ ID NO: 528091 - DNA, 25 bp, Mus musculus
gcaagagggtcttcctgagtgccga

SEQ ID NO: 528092 - DNA, 25 bp, Mus musculus
gcaagagggttgcccatgagttcaa

SEQ ID NO: 528093 - DNA, 25 bp, Mus musculus
gcaagagggttggccatgagttcaa

SEQ ID NO: 528094 - DNA, 25 bp, Mus musculus
gcaagagtaggaataccttccctag

SEQ ID NO: 528095 - DNA, 25 bp, Mus musculus
gcaagagtaggattaccttccctag

SEQ ID NO: 528096 - DNA, 25 bp, Mus musculus
gcaagagtaggtcgcttccttctcc

SEQ ID NO: 528097 - DNA, 25 bp, Mus musculus
gcaagagtaggtggcttccttctcc

SEQ ID NO: 528098 - DNA, 25 bp, Mus musculus
gcaagagtccacaattagcatacag

SEQ ID NO: 528099 - DNA, 25 bp, Mus musculus
gcaagagtccactattagcatacag

SEQ ID NO: 528100 - DNA, 25 bp, Mus musculus
gcaagagtccataactgtctgccca

SEQ ID NO: 528101 - DNA, 25 bp, Mus musculus
gcaagagtccattactgtctgccca

SEQ ID NO: 528102 - DNA, 25 bp, Mus musculus
gcaagagtccttcagataccagcat

SEQ ID NO: 528103 - DNA, 25 bp, Mus musculus
gcaagagtccttgagataccagcat

SEQ ID NO: 528104 - DNA, 25 bp, Mus musculus
gcaagagtctcaaaagttcaaagcc

SEQ ID NO: 528105 - DNA, 25 bp, Mus musculus
gcaagagtctcataagttcaaagcc

SEQ ID NO: 528106 - DNA, 25 bp, Mus musculus
gcaagagtcttcagactttcctgcc

SEQ ID NO: 528107 - DNA, 25 bp, Mus musculus
gcaagagtcttctgactttcctgcc

SEQ ID NO: 528108 - DNA, 25 bp, Mus musculus
gcaagagtctttccaggcaaaacta

SEQ ID NO: 528109 - DNA, 25 bp, Mus musculus
gcaagagtctttgcaggcaaaacta

SEQ ID NO: 528110 - DNA, 25 bp, Mus musculus
gcaagagtgccaaggagcgcctgaa

SEQ ID NO: 528111 - DNA, 25 bp, Mus musculus
gcaagagtgccatggagcgcctgaa

SEQ ID NO: 528112 - DNA, 25 bp, Mus musculus
gcaagagtggccaccatatgctggg

SEQ ID NO: 528113 - DNA, 25 bp, Mus musculus
gcaagagtggcctccatatgctggg

SEQ ID NO: 528114 - DNA, 25 bp, Mus musculus
gcaagagttgccaggcagccggcca

SEQ ID NO: 528115 - DNA, 25 bp, Mus musculus
gcaagagttgcctggcagccggcca

SEQ ID NO: 528116 - DNA, 25 bp, Mus musculus
gcaagagttgcgaagtgacactgaa

SEQ ID NO: 528117 - DNA, 25 bp, Mus musculus
gcaagagttgcgtagtgacactgaa

SEQ ID NO: 528118 - DNA, 25 bp, Mus musculus
gcaagagttgtcctgcccactgaag

SEQ ID NO: 528119 - DNA, 25 bp, Mus musculus
gcaagagttgtcgtgcccactgaag

SEQ ID NO: 528120 - DNA, 25 bp, Mus musculus
gcaagagtttcactcgcagttccca

SEQ ID NO: 528121 - DNA, 25 bp, Mus musculus
gcaagagtttcagtcgcagttccca

SEQ ID NO: 528122 - DNA, 25 bp, Mus musculus
gcaagataaattacacaacatacag

SEQ ID NO: 528123 - DNA, 25 bp, Mus musculus
gcaagataaatttcacaacatacag

SEQ ID NO: 528124 - DNA, 25 bp, Mus musculus
gcaagataccgaaattcaagctgtt

SEQ ID NO: 528125 - DNA, 25 bp, Mus musculus
gcaagataccgatattcaagctgtt

SEQ ID NO: 528126 - DNA, 25 bp, Mus musculus
gcaagatactatatccagtgccttt

SEQ ID NO: 528127 - DNA, 25 bp, Mus musculus
gcaagatactatttccagtgccttt

SEQ ID NO: 528128 - DNA, 25 bp, Mus musculus
gcaagatagacccagtagccagata

SEQ ID NO: 528129 - DNA, 25 bp, Mus musculus
gcaagatagaccgagtagccagata

SEQ ID NO: 528130 - DNA, 25 bp, Mus musculus
gcaagatatgataatgcctgcctat

SEQ ID NO: 528131 - DNA, 25 bp, Mus musculus
gcaagatatgattatgcctgcctat

SEQ ID NO: 528132 - DNA, 25 bp, Mus musculus
gcaagatattaaacaacccctcttc

SEQ ID NO: 528133 - DNA, 25 bp, Mus musculus
gcaagatattaatcaacccctcttc

SEQ ID NO: 528134 - DNA, 25 bp, Mus musculus
gcaagatcacatccctagctttgat

SEQ ID NO: 528135 - DNA, 25 bp, Mus musculus
gcaagatcacatgcctagctttgat

SEQ ID NO: 528136 - DNA, 25 bp, Mus musculus
gcaagatcacgtccttgtgccaggt

SEQ ID NO: 528137 - DNA, 25 bp, Mus musculus
gcaagatcacgtgcttgtgccaggt

SEQ ID NO: 528138 - DNA, 25 bp, Mus musculus
gcaagatcaggacttgtcacccagt

SEQ ID NO: 528139 - DNA, 25 bp, Mus musculus
gcaagatcaggagttgtcacccagt

SEQ ID NO: 528140 - DNA, 25 bp, Mus musculus
gcaagatcattcaaactctataaaa

SEQ ID NO: 528141 - DNA, 25 bp, Mus musculus
gcaagatcattctaactctataaaa

SEQ ID NO: 528142 - DNA, 25 bp, Mus musculus
gcaagatccaagactccatgatgtt

SEQ ID NO: 528143 - DNA, 25 bp, Mus musculus
gcaagatccaagtctccatgatgtt

SEQ ID NO: 528144 - DNA, 25 bp, Mus musculus
gcaagatccggacccctaacattcg

SEQ ID NO: 528145 - DNA, 25 bp, Mus musculus
gcaagatccggagccctaacattcg

SEQ ID NO: 528146 - DNA, 25 bp, Mus musculus
gcaagatcctaaaagccagctgtaa

SEQ ID NO: 528147 - DNA, 25 bp, Mus musculus
gcaagatcctaatagccagctgtaa

SEQ ID NO: 528148 - DNA, 25 bp, Mus musculus
gcaagatcctgtacagccagtgtgg

SEQ ID NO: 528149 - DNA, 25 bp, Mus musculus
gcaagatcctgttcagccagtgtgg

SEQ ID NO: 528150 - DNA, 25 bp, Mus musculus
gcaagatctagcagagcctggttct

SEQ ID NO: 528151 - DNA, 25 bp, Mus musculus
gcaagatctagctgagcctggttct

SEQ ID NO: 528152 - DNA, 25 bp, Mus musculus
gcaagatctctcatacatactgttg

SEQ ID NO: 528153 - DNA, 25 bp, Mus musculus
gcaagatctctcttacatactgttg

SEQ ID NO: 528154 - DNA, 25 bp, Mus musculus
gcaagatctgtgataacacctctgg

SEQ ID NO: 528155 - DNA, 25 bp, Mus musculus
gcaagatctgtgatgggctccggaa

SEQ ID NO: 528156 - DNA, 25 bp, Mus musculus
gcaagatctgtgttaacacctctgg

SEQ ID NO: 528157 - DNA, 25 bp, Mus musculus
gcaagatctgtgttgggctccggaa

SEQ ID NO: 528158 - DNA, 25 bp, Mus musculus
gcaagatgaacactctggccaaccg

SEQ ID NO: 528159 - DNA, 25 bp, Mus musculus
gcaagatgaacagtctggccaaccg

SEQ ID NO: 528160 - DNA, 25 bp, Mus musculus
gcaagatgacttaatacttcatgaa

SEQ ID NO: 528161 - DNA, 25 bp, Mus musculus
gcaagatgactttatacttcatgaa

SEQ ID NO: 528162 - DNA, 25 bp, Mus musculus
gcaagatgcaccaccgccgttgtgt

SEQ ID NO: 528163 - DNA, 25 bp, Mus musculus
gcaagatgcacctccgccgttgtgt

SEQ ID NO: 528164 - DNA, 25 bp, Mus musculus
gcaagatgctaccagctggatggaa

SEQ ID NO: 528165 - DNA, 25 bp, Mus musculus
gcaagatgctacgagctggatggaa

SEQ ID NO: 528166 - DNA, 25 bp, Mus musculus
gcaagatgctctatcctacaggaaa

SEQ ID NO: 528167 - DNA, 25 bp, Mus musculus
gcaagatgctctttcctacaggaaa

SEQ ID NO: 528168 - DNA, 25 bp, Mus musculus
gcaagatgctgccactacccataag

SEQ ID NO: 528169 - DNA, 25 bp, Mus musculus
gcaagatgctgcgactacccataag

SEQ ID NO: 528170 - DNA, 25 bp, Mus musculus
gcaagatggcctctgttctggcaaa

SEQ ID NO: 528171 - DNA, 25 bp, Mus musculus
gcaagatggcctgtgttctggcaaa

SEQ ID NO: 528172 - DNA, 25 bp, Mus musculus
gcaagatgggccaggtgtacatagt

SEQ ID NO: 528173 - DNA, 25 bp, Mus musculus
gcaagatgggcctggtgtacatagt

SEQ ID NO: 528174 - DNA, 25 bp, Mus musculus
gcaagatggtctcccactatttgta

SEQ ID NO: 528175 - DNA, 25 bp, Mus musculus
gcaagatggtctgccactatttgta

SEQ ID NO: 528176 - DNA, 25 bp, Mus musculus
gcaagatgtctgctggtttaagcaa

SEQ ID NO: 528177 - DNA, 25 bp, Mus musculus
gcaagatgtctggtggtttaagcaa

SEQ ID NO: 528178 - DNA, 25 bp, Mus musculus
gcaagatgtcttaatgtctctgaat

SEQ ID NO: 528179 - DNA, 25 bp, Mus musculus
gcaagatgtctttatgtctctgaat

SEQ ID NO: 528180 - DNA, 25 bp, Mus musculus
gcaagatgtgaaagaacccttctgc

SEQ ID NO: 528181 - DNA, 25 bp, Mus musculus
gcaagatgtgaatgaacccttctgc

SEQ ID NO: 528182 - DNA, 25 bp, Mus musculus
gcaagatgtgcaagacttcctcgtc

SEQ ID NO: 528183 - DNA, 25 bp, Mus musculus
gcaagatgtgcatgacttcctcgtc

SEQ ID NO: 528184 - DNA, 25 bp, Mus musculus
gcaagatgttccaggtgtgcaacaa

SEQ ID NO: 528185 - DNA, 25 bp, Mus musculus
gcaagatgttcctggtgtgcaacaa

SEQ ID NO: 528186 - DNA, 25 bp, Mus musculus
gcaagatgtttcagcctggctggga

SEQ ID NO: 528187 - DNA, 25 bp, Mus musculus
gcaagatgtttctgcctggctggga

SEQ ID NO: 528188 - DNA, 25 bp, Mus musculus
gcaagattagttcccctgggtcacc

SEQ ID NO: 528189 - DNA, 25 bp, Mus musculus
gcaagattagttgccctgggtcacc

SEQ ID NO: 528190 - DNA, 25 bp, Mus musculus
gcaagattcatgacctggcttcgac

SEQ ID NO: 528191 - DNA, 25 bp, Mus musculus
gcaagattcatgtcctggcttcgac

SEQ ID NO: 528192 - DNA, 25 bp, Mus musculus
gcaagattcgtgcttctgggttcct

SEQ ID NO: 528193 - DNA, 25 bp, Mus musculus
gcaagattcgtggttctgggttcct

SEQ ID NO: 528194 - DNA, 25 bp, Mus musculus
gcaagattgatcacacccagacttc

SEQ ID NO: 528195 - DNA, 25 bp, Mus musculus
gcaagattgatctcacccagacttc

SEQ ID NO: 528196 - DNA, 25 bp, Mus musculus
gcaagattgctgatagctctcaggc

SEQ ID NO: 528197 - DNA, 25 bp, Mus musculus
gcaagattgctgttagctctcaggc

SEQ ID NO: 528198 - DNA, 25 bp, Mus musculus
gcaagatttcgacgcaaatgcacag

SEQ ID NO: 528199 - DNA, 25 bp, Mus musculus
gcaagatttcgaggcaaatgcacag

SEQ ID NO: 528200 - DNA, 25 bp, Mus musculus
gcaagatttgcacttccttcagtga

SEQ ID NO: 528201 - DNA, 25 bp, Mus musculus
gcaagatttgcagttccttcagtga

SEQ ID NO: 528202 - DNA, 25 bp, Mus musculus
gcaagattttccctttatgtatata

SEQ ID NO: 528203 - DNA, 25 bp, Mus musculus
gcaagattttccgtttatgtatata

SEQ ID NO: 528204 - DNA, 25 bp, Mus musculus
gcaagattttgccacagctccagag

SEQ ID NO: 528205 - DNA, 25 bp, Mus musculus
gcaagattttgcgacagctccagag

SEQ ID NO: 528206 - DNA, 25 bp, Mus musculus
gcaagatttttaatggccaggtcta

SEQ ID NO: 528207 - DNA, 25 bp, Mus musculus
gcaagatttttattggccaggtcta

SEQ ID NO: 528208 - DNA, 25 bp, Mus musculus
gcaagcaaacgtacatacatatcaa

SEQ ID NO: 528209 - DNA, 25 bp, Mus musculus
gcaagcaaacgttcatacatatcaa

SEQ ID NO: 528210 - DNA, 25 bp, Mus musculus
gcaagcaaactgatagaagctcact

SEQ ID NO: 528211 - DNA, 25 bp, Mus musculus
gcaagcaaactgttagaagctcact

SEQ ID NO: 528212 - DNA, 25 bp, Mus musculus
gcaagcaaagatctcggaagattca

SEQ ID NO: 528213 - DNA, 25 bp, Mus musculus
gcaagcaaagatgtcggaagattca

SEQ ID NO: 528214 - DNA, 25 bp, Mus musculus
gcaagcaaccttaatcctctaagcg

SEQ ID NO: 528215 - DNA, 25 bp, Mus musculus
gcaagcaacctttatcctctaagcg

SEQ ID NO: 528216 - DNA, 25 bp, Mus musculus
gcaagcaactgactgctgggagaaa

SEQ ID NO: 528217 - DNA, 25 bp, Mus musculus
gcaagcaactgagtgctgggagaaa

SEQ ID NO: 528218 - DNA, 25 bp, Mus musculus
gcaagcaagattccacctagggatt

SEQ ID NO: 528219 - DNA, 25 bp, Mus musculus
gcaagcaagattgcacctagggatt

SEQ ID NO: 528220 - DNA, 25 bp, Mus musculus
gcaagcaagcatagtaccagccttt

SEQ ID NO: 528221 - DNA, 25 bp, Mus musculus
gcaagcaagcattgtaccagccttt

SEQ ID NO: 528222 - DNA, 25 bp, Mus musculus
gcaagcaaggctattcccaggaaac

SEQ ID NO: 528223 - DNA, 25 bp, Mus musculus
gcaagcaaggcttttcccaggaaac

SEQ ID NO: 528224 - DNA, 25 bp, Mus musculus
gcaagcaagggcaatccctattgag

SEQ ID NO: 528225 - DNA, 25 bp, Mus musculus
gcaagcaagggctatccctattgag

SEQ ID NO: 528226 - DNA, 25 bp, Mus musculus
gcaagcaagtctagggattggcacc

SEQ ID NO: 528227 - DNA, 25 bp, Mus musculus
gcaagcaagtcttgggattggcacc

SEQ ID NO: 528228 - DNA, 25 bp, Mus musculus
gcaagcaagtgcacgcctggcgatg

SEQ ID NO: 528229 - DNA, 25 bp, Mus musculus
gcaagcaagtgctcgcctggcgatg

SEQ ID NO: 528230 - DNA, 25 bp, Mus musculus
gcaagcaatgcaatgttaactggct

SEQ ID NO: 528231 - DNA, 25 bp, Mus musculus
gcaagcaatgcattgttaactggct

SEQ ID NO: 528232 - DNA, 25 bp, Mus musculus
gcaagcacaacaaccatactctaat

SEQ ID NO: 528233 - DNA, 25 bp, Mus musculus
gcaagcacaacacacagggccgaga

SEQ ID NO: 528234 - DNA, 25 bp, Mus musculus
gcaagcacaacagacagggccgaga

SEQ ID NO: 528235 - DNA, 25 bp, Mus musculus
gcaagcacaacatccatactctaat

SEQ ID NO: 528236 - DNA, 25 bp, Mus musculus
gcaagcacaactctaacctagttta

SEQ ID NO: 528237 - DNA, 25 bp, Mus musculus
gcaagcacaactgtaacctagttta

SEQ ID NO: 528238 - DNA, 25 bp, Mus musculus
gcaagcacacccctgattgtgaaaa

SEQ ID NO: 528239 - DNA, 25 bp, Mus musculus
gcaagcacacccgtgattgtgaaaa

SEQ ID NO: 528240 - DNA, 25 bp, Mus musculus
gcaagcacagacagctggtgctgtg

SEQ ID NO: 528241 - DNA, 25 bp, Mus musculus
gcaagcacagactgctggtgctgtg

SEQ ID NO: 528242 - DNA, 25 bp, Mus musculus
gcaagcacagcaaaagcctcctaga

SEQ ID NO: 528243 - DNA, 25 bp, Mus musculus
gcaagcacagcataagcctcctaga

SEQ ID NO: 528244 - DNA, 25 bp, Mus musculus
gcaagcacaggaaacagtgccacag

SEQ ID NO: 528245 - DNA, 25 bp, Mus musculus
gcaagcacaggatacagtgccacag

SEQ ID NO: 528246 - DNA, 25 bp, Mus musculus
gcaagcacagtactagagagggcat

SEQ ID NO: 528247 - DNA, 25 bp, Mus musculus
gcaagcacagtagtagagagggcat

SEQ ID NO: 528248 - DNA, 25 bp, Mus musculus
gcaagcacataaactccgtagcaag

SEQ ID NO: 528249 - DNA, 25 bp, Mus musculus
gcaagcacataatctccgtagcaag

SEQ ID NO: 528250 - DNA, 25 bp, Mus musculus
gcaagcaccaagagtgaaaacaact

SEQ ID NO: 528251 - DNA, 25 bp, Mus musculus
gcaagcaccaagatggcattttctg

SEQ ID NO: 528252 - DNA, 25 bp, Mus musculus
gcaagcaccaagtgtgaaaacaact

SEQ ID NO: 528253 - DNA, 25 bp, Mus musculus
gcaagcaccaagttggcattttctg

SEQ ID NO: 528254 - DNA, 25 bp, Mus musculus
gcaagcaccttcattggctgagaac

SEQ ID NO: 528255 - DNA, 25 bp, Mus musculus
gcaagcaccttctttggctgagaac

SEQ ID NO: 528256 - DNA, 25 bp, Mus musculus
gcaagcacgctgagaaggctagtct

SEQ ID NO: 528257 - DNA, 25 bp, Mus musculus
gcaagcacgctgtgaaggctagtct

SEQ ID NO: 528258 - DNA, 25 bp, Mus musculus
gcaagcactataccacggttttcta

SEQ ID NO: 528259 - DNA, 25 bp, Mus musculus
gcaagcactatagcacggttttcta

SEQ ID NO: 528260 - DNA, 25 bp, Mus musculus
gcaagcactggcagagtcaaagaag

SEQ ID NO: 528261 - DNA, 25 bp, Mus musculus
gcaagcactggctgagtcaaagaag

SEQ ID NO: 528262 - DNA, 25 bp, Mus musculus
gcaagcacttagcacagccgagaag

SEQ ID NO: 528263 - DNA, 25 bp, Mus musculus
gcaagcacttaggacagccgagaag

SEQ ID NO: 528264 - DNA, 25 bp, Mus musculus
gcaagcagaagtcaaaatcccaaca

SEQ ID NO: 528265 - DNA, 25 bp, Mus musculus
gcaagcagaagtgaaaatcccaaca

SEQ ID NO: 528266 - DNA, 25 bp, Mus musculus
gcaagcagacaacgcatccatacat

SEQ ID NO: 528267 - DNA, 25 bp, Mus musculus
gcaagcagacaaggcatccatacat

SEQ ID NO: 528268 - DNA, 25 bp, Mus musculus
gcaagcagacagacgccaggtattt

SEQ ID NO: 528269 - DNA, 25 bp, Mus musculus
gcaagcagacagtcgccaggtattt

SEQ ID NO: 528270 - DNA, 25 bp, Mus musculus
gcaagcagactgcatccctagagat

SEQ ID NO: 528271 - DNA, 25 bp, Mus musculus
gcaagcagactggatccctagagat

SEQ ID NO: 528272 - DNA, 25 bp, Mus musculus
gcaagcagatacaggtgccttttcc

SEQ ID NO: 528273 - DNA, 25 bp, Mus musculus
gcaagcagatactggtgccttttcc

SEQ ID NO: 528274 - DNA, 25 bp, Mus musculus
gcaagcagccagctgtcaggcaacc

SEQ ID NO: 528275 - DNA, 25 bp, Mus musculus
gcaagcagccaggtgtcaggcaacc

SEQ ID NO: 528276 - DNA, 25 bp, Mus musculus
gcaagcagccatagtataacttact

SEQ ID NO: 528277 - DNA, 25 bp, Mus musculus
gcaagcagccattgtataacttact

SEQ ID NO: 528278 - DNA, 25 bp, Mus musculus
gcaagcagcctacaccaaacgtgat

SEQ ID NO: 528279 - DNA, 25 bp, Mus musculus
gcaagcagcctagaccaaacgtgat

SEQ ID NO: 528280 - DNA, 25 bp, Mus musculus
gcaagcagccttctttgttacatta

SEQ ID NO: 528281 - DNA, 25 bp, Mus musculus
gcaagcagccttgtttgttacatta

SEQ ID NO: 528282 - DNA, 25 bp, Mus musculus
gcaagcagcggcaaagggtccgcac

SEQ ID NO: 528283 - DNA, 25 bp, Mus musculus
gcaagcagcggctaagggtccgcac

SEQ ID NO: 528284 - DNA, 25 bp, Mus musculus
gcaagcagcgtaatatgcccagaca

SEQ ID NO: 528285 - DNA, 25 bp, Mus musculus
gcaagcagcgtattatgcccagaca

SEQ ID NO: 528286 - DNA, 25 bp, Mus musculus
gcaagcagctaactcaattactcat

SEQ ID NO: 528287 - DNA, 25 bp, Mus musculus
gcaagcagctaagtcaattactcat

SEQ ID NO: 528288 - DNA, 25 bp, Mus musculus
gcaagcagctcaaagtagacacagt

SEQ ID NO: 528289 - DNA, 25 bp, Mus musculus
gcaagcagctcatagtagacacagt

SEQ ID NO: 528290 - DNA, 25 bp, Mus musculus
gcaagcagctgactaactggagacc

SEQ ID NO: 528291 - DNA, 25 bp, Mus musculus
gcaagcagctgagtaactggagacc

SEQ ID NO: 528292 - DNA, 25 bp, Mus musculus
gcaagcagcttacagtttttatacg

SEQ ID NO: 528293 - DNA, 25 bp, Mus musculus
gcaagcagcttagagtttttatacg

SEQ ID NO: 528294 - DNA, 25 bp, Mus musculus
gcaagcaggccacagacgtgctgaa

SEQ ID NO: 528295 - DNA, 25 bp, Mus musculus
gcaagcaggccagagacgtgctgaa

SEQ ID NO: 528296 - DNA, 25 bp, Mus musculus
gcaagcaggcctataacttgtattc

SEQ ID NO: 528297 - DNA, 25 bp, Mus musculus
gcaagcaggcctttaacttgtattc

SEQ ID NO: 528298 - DNA, 25 bp, Mus musculus
gcaagcaggctgaactgttgacctt

SEQ ID NO: 528299 - DNA, 25 bp, Mus musculus
gcaagcaggctgtactgttgacctt

SEQ ID NO: 528300 - DNA, 25 bp, Mus musculus
gcaagcagggtcaactggagcgagc

SEQ ID NO: 528301 - DNA, 25 bp, Mus musculus
gcaagcagggtctactggagcgagc

SEQ ID NO: 528302 - DNA, 25 bp, Mus musculus
gcaagcaggtgcagtcttctccgtg

SEQ ID NO: 528303 - DNA, 25 bp, Mus musculus
gcaagcaggtgctgtcttctccgtg

SEQ ID NO: 528304 - DNA, 25 bp, Mus musculus
gcaagcagtgctagcgcacagtcac

SEQ ID NO: 528305 - DNA, 25 bp, Mus musculus
gcaagcagtgcttgcgcacagtcac

SEQ ID NO: 528306 - DNA, 25 bp, Mus musculus
gcaagcagttgcaggaggcctccta

SEQ ID NO: 528307 - DNA, 25 bp, Mus musculus
gcaagcagttgctggaggcctccta

SEQ ID NO: 528308 - DNA, 25 bp, Mus musculus
gcaagcatagcaaggcggcatacat

SEQ ID NO: 528309 - DNA, 25 bp, Mus musculus
gcaagcatagcatggcggcatacat

SEQ ID NO: 528310 - DNA, 25 bp, Mus musculus
gcaagcatatatacctactagtgtt

SEQ ID NO: 528311 - DNA, 25 bp, Mus musculus
gcaagcatatattcctactagtgtt

SEQ ID NO: 528312 - DNA, 25 bp, Mus musculus
gcaagcatcaaaacggcctccaggt

SEQ ID NO: 528313 - DNA, 25 bp, Mus musculus
gcaagcatcaaatcggcctccaggt

SEQ ID NO: 528314 - DNA, 25 bp, Mus musculus
gcaagcatcaccacagtatatgggt

SEQ ID NO: 528315 - DNA, 25 bp, Mus musculus
gcaagcatcacctcagtatatgggt

SEQ ID NO: 528316 - DNA, 25 bp, Mus musculus
gcaagcatccgcctgagcaggctgc

SEQ ID NO: 528317 - DNA, 25 bp, Mus musculus
gcaagcatccgcgtgagcaggctgc

SEQ ID NO: 528318 - DNA, 25 bp, Mus musculus
gcaagcatccttcgaagttaggcag

SEQ ID NO: 528319 - DNA, 25 bp, Mus musculus
gcaagcatccttggaagttaggcag

SEQ ID NO: 528320 - DNA, 25 bp, Mus musculus
gcaagcatcgtgcatcatttgtctt

SEQ ID NO: 528321 - DNA, 25 bp, Mus musculus
gcaagcatcgtggatcatttgtctt

SEQ ID NO: 528322 - DNA, 25 bp, Mus musculus
gcaagcatctggagccctcatgaaa

SEQ ID NO: 528323 - DNA, 25 bp, Mus musculus
gcaagcatctggtgccctcatgaaa

SEQ ID NO: 528324 - DNA, 25 bp, Mus musculus
gcaagcatgaatcgcggccaaccta

SEQ ID NO: 528325 - DNA, 25 bp, Mus musculus
gcaagcatgaatggcggccaaccta

SEQ ID NO: 528326 - DNA, 25 bp, Mus musculus
gcaagcatgcacctgtgttttgtgt

SEQ ID NO: 528327 - DNA, 25 bp, Mus musculus
gcaagcatgcacgtgtgttttgtgt

SEQ ID NO: 528328 - DNA, 25 bp, Mus musculus
gcaagcatgcctactgctggtactg

SEQ ID NO: 528329 - DNA, 25 bp, Mus musculus
gcaagcatgccttctgctggtactg

SEQ ID NO: 528330 - DNA, 25 bp, Mus musculus
gcaagcatggcacttgtccatcagc

SEQ ID NO: 528331 - DNA, 25 bp, Mus musculus
gcaagcatggcagttgtccatcagc

SEQ ID NO: 528332 - DNA, 25 bp, Mus musculus
gcaagcattaacagcctgagttcaa

SEQ ID NO: 528333 - DNA, 25 bp, Mus musculus
gcaagcattaactgcctgagttcaa

SEQ ID NO: 528334 - DNA, 25 bp, Mus musculus
gcaagcattgcaccattaagaagaa

SEQ ID NO: 528335 - DNA, 25 bp, Mus musculus
gcaagcattgcagcattaagaagaa

SEQ ID NO: 528336 - DNA, 25 bp, Mus musculus
gcaagcattttgcagtttacggaaa

SEQ ID NO: 528337 - DNA, 25 bp, Mus musculus
gcaagcattttggagtttacggaaa

SEQ ID NO: 528338 - DNA, 25 bp, Mus musculus
gcaagccaaaacagcagggaatttc

SEQ ID NO: 528339 - DNA, 25 bp, Mus musculus
gcaagccaaaactgcagggaatttc

SEQ ID NO: 528340 - DNA, 25 bp, Mus musculus
gcaagccaagctataaccaaccaag

SEQ ID NO: 528341 - DNA, 25 bp, Mus musculus
gcaagccaagctttaaccaaccaag

SEQ ID NO: 528342 - DNA, 25 bp, Mus musculus
gcaagccacaaaccaaaggtccaga

SEQ ID NO: 528343 - DNA, 25 bp, Mus musculus
gcaagccacaaagcaaaggtccaga

SEQ ID NO: 528344 - DNA, 25 bp, Mus musculus
gcaagccaccagaacgacatcagaa

SEQ ID NO: 528345 - DNA, 25 bp, Mus musculus
gcaagccaccagtacgacatcagaa

SEQ ID NO: 528346 - DNA, 25 bp, Mus musculus
gcaagccagacacacggcaacttgt

SEQ ID NO: 528347 - DNA, 25 bp, Mus musculus
gcaagccagacagacggcaacttgt

SEQ ID NO: 528348 - DNA, 25 bp, Mus musculus
gcaagccagagacgttttactacaa

SEQ ID NO: 528349 - DNA, 25 bp, Mus musculus
gcaagccagagaggttttactacaa

SEQ ID NO: 528350 - DNA, 25 bp, Mus musculus
gcaagccagctacgtgcaaaataac

SEQ ID NO: 528351 - DNA, 25 bp, Mus musculus
gcaagccagctaggtgcaaaataac

SEQ ID NO: 528352 - DNA, 25 bp, Mus musculus
gcaagccagttgcaagtcccagtaa

SEQ ID NO: 528353 - DNA, 25 bp, Mus musculus
gcaagccagttggaagtcccagtaa

SEQ ID NO: 528354 - DNA, 25 bp, Mus musculus
gcaagccatatgaagtaggccagta

SEQ ID NO: 528355 - DNA, 25 bp, Mus musculus
gcaagccatatgtagtaggccagta

SEQ ID NO: 528356 - DNA, 25 bp, Mus musculus
gcaagccatgccaatttgttctcag

SEQ ID NO: 528357 - DNA, 25 bp, Mus musculus
gcaagccatgcctatttgttctcag

SEQ ID NO: 528358 - DNA, 25 bp, Mus musculus
gcaagccatgctacccatatgaagt

SEQ ID NO: 528359 - DNA, 25 bp, Mus musculus
gcaagccatgcttcccatatgaagt

SEQ ID NO: 528360 - DNA, 25 bp, Mus musculus
gcaagccattgactggatcttcatt

SEQ ID NO: 528361 - DNA, 25 bp, Mus musculus
gcaagccattgagtggatcttcatt

SEQ ID NO: 528362 - DNA, 25 bp, Mus musculus
gcaagccatttgcactacggaattg

SEQ ID NO: 528363 - DNA, 25 bp, Mus musculus
gcaagccatttggactacggaattg

SEQ ID NO: 528364 - DNA, 25 bp, Mus musculus
gcaagcccaacactttctggagaag

SEQ ID NO: 528365 - DNA, 25 bp, Mus musculus
gcaagcccaacagtttctggagaag

SEQ ID NO: 528366 - DNA, 25 bp, Mus musculus
gcaagcccacagcattgataatcgt

SEQ ID NO: 528367 - DNA, 25 bp, Mus musculus
gcaagcccacaggattgataatcgt

SEQ ID NO: 528368 - DNA, 25 bp, Mus musculus
gcaagcccaccactagtgagctgta

SEQ ID NO: 528369 - DNA, 25 bp, Mus musculus
gcaagcccaccagtagtgagctgta

SEQ ID NO: 528370 - DNA, 25 bp, Mus musculus
gcaagcccaggacatagtttggact

SEQ ID NO: 528371 - DNA, 25 bp, Mus musculus
gcaagcccaggagatagtttggact

SEQ ID NO: 528372 - DNA, 25 bp, Mus musculus
gcaagcccaggtctagcaggtagta

SEQ ID NO: 528373 - DNA, 25 bp, Mus musculus
gcaagcccaggtgtagcaggtagta

SEQ ID NO: 528374 - DNA, 25 bp, Mus musculus
gcaagccccactacagatggtagat

SEQ ID NO: 528375 - DNA, 25 bp, Mus musculus
gcaagccccacttcagatggtagat

SEQ ID NO: 528376 - DNA, 25 bp, Mus musculus
gcaagcccctagaaaaattcattgg

SEQ ID NO: 528377 - DNA, 25 bp, Mus musculus
gcaagcccctagagtgtgctttgta

SEQ ID NO: 528378 - DNA, 25 bp, Mus musculus
gcaagcccctagtaaaattcattgg

SEQ ID NO: 528379 - DNA, 25 bp, Mus musculus
gcaagcccctagtgtgtgctttgta

SEQ ID NO: 528380 - DNA, 25 bp, Mus musculus
gcaagcccgcacagtacatcgcagt

SEQ ID NO: 528381 - DNA, 25 bp, Mus musculus
gcaagcccgcactgtacatcgcagt

SEQ ID NO: 528382 - DNA, 25 bp, Mus musculus
gcaagcccgtcgcagatatggtaga

SEQ ID NO: 528383 - DNA, 25 bp, Mus musculus
gcaagcccgtcggagatatggtaga

SEQ ID NO: 528384 - DNA, 25 bp, Mus musculus
gcaagcccgttgacctgtgaggtca

SEQ ID NO: 528385 - DNA, 25 bp, Mus musculus
gcaagcccgttgtcctgtgaggtca

SEQ ID NO: 528386 - DNA, 25 bp, Mus musculus
gcaagccctgggaagccaactaggt

SEQ ID NO: 528387 - DNA, 25 bp, Mus musculus
gcaagccctgggtagccaactaggt

SEQ ID NO: 528388 - DNA, 25 bp, Mus musculus
gcaagcccttagaagtaataccaga

SEQ ID NO: 528389 - DNA, 25 bp, Mus musculus
gcaagcccttagtagtaataccaga

SEQ ID NO: 528390 - DNA, 25 bp, Mus musculus
gcaagcccttcactgacatcattga

SEQ ID NO: 528391 - DNA, 25 bp, Mus musculus
gcaagcccttcagtgacatcattga

SEQ ID NO: 528392 - DNA, 25 bp, Mus musculus
gcaagcctataaccccggtgcattg

SEQ ID NO: 528393 - DNA, 25 bp, Mus musculus
gcaagcctataagcccggtgcattg

SEQ ID NO: 528394 - DNA, 25 bp, Mus musculus
gcaagcctattgagtgcatgcacac

SEQ ID NO: 528395 - DNA, 25 bp, Mus musculus
gcaagcctattgtgtgcatgcacac

SEQ ID NO: 528396 - DNA, 25 bp, Mus musculus
gcaagcctcaatccagccaaaggaa

SEQ ID NO: 528397 - DNA, 25 bp, Mus musculus
gcaagcctcaatgcagccaaaggaa

SEQ ID NO: 528398 - DNA, 25 bp, Mus musculus
gcaagcctcaccagtgcaacaaagt

SEQ ID NO: 528399 - DNA, 25 bp, Mus musculus
gcaagcctcacctgtgcaacaaagt

SEQ ID NO: 528400 - DNA, 25 bp, Mus musculus
gcaagcctccatacttctgagggat

SEQ ID NO: 528401 - DNA, 25 bp, Mus musculus
gcaagcctccattcttctgagggat

SEQ ID NO: 528402 - DNA, 25 bp, Mus musculus
gcaagcctcgctcagtacaaggagt

SEQ ID NO: 528403 - DNA, 25 bp, Mus musculus
gcaagcctcgctgagtacaaggagt

SEQ ID NO: 528404 - DNA, 25 bp, Mus musculus
gcaagcctcggcatgtatccgaagt

SEQ ID NO: 528405 - DNA, 25 bp, Mus musculus
gcaagcctcggcttgtatccgaagt

SEQ ID NO: 528406 - DNA, 25 bp, Mus musculus
gcaagcctgaccacctaagtcggat

SEQ ID NO: 528407 - DNA, 25 bp, Mus musculus
gcaagcctgacctcctaagtcggat

SEQ ID NO: 528408 - DNA, 25 bp, Mus musculus
gcaagcctgagaagtaccagctccg

SEQ ID NO: 528409 - DNA, 25 bp, Mus musculus
gcaagcctgagatgtaccagctccg

SEQ ID NO: 528410 - DNA, 25 bp, Mus musculus
gcaagcctgagcaaaacacctgtga

SEQ ID NO: 528411 - DNA, 25 bp, Mus musculus
gcaagcctgagctaaacacctgtga

SEQ ID NO: 528412 - DNA, 25 bp, Mus musculus
gcaagcctgcccagttggttgtagt

SEQ ID NO: 528413 - DNA, 25 bp, Mus musculus
gcaagcctgccctgttggttgtagt

SEQ ID NO: 528414 - DNA, 25 bp, Mus musculus
gcaagcctgctcatatgtaattagt

SEQ ID NO: 528415 - DNA, 25 bp, Mus musculus
gcaagcctgctcttatgtaattagt

SEQ ID NO: 528416 - DNA, 25 bp, Mus musculus
gcaagcctggccaaagtcagtgact

SEQ ID NO: 528417 - DNA, 25 bp, Mus musculus
gcaagcctggcctaagtcagtgact

SEQ ID NO: 528418 - DNA, 25 bp, Mus musculus
gcaagcctggctcggaacgacatga

SEQ ID NO: 528419 - DNA, 25 bp, Mus musculus
gcaagcctggctgggaacgacatga

SEQ ID NO: 528420 - DNA, 25 bp, Mus musculus
gcaagcctgtggagtattttctcga

SEQ ID NO: 528421 - DNA, 25 bp, Mus musculus
gcaagcctgtggtgtattttctcga

SEQ ID NO: 528422 - DNA, 25 bp, Mus musculus
gcaagcctttgacgtccagggacgt

SEQ ID NO: 528423 - DNA, 25 bp, Mus musculus
gcaagcctttgactatgagtgtgta

SEQ ID NO: 528424 - DNA, 25 bp, Mus musculus
gcaagcctttgaggtccagggacgt

SEQ ID NO: 528425 - DNA, 25 bp, Mus musculus
gcaagcctttgagtatgagtgtgta

SEQ ID NO: 528426 - DNA, 25 bp, Mus musculus
gcaagcctttgtcctgttctaggaa

SEQ ID NO: 528427 - DNA, 25 bp, Mus musculus
gcaagcctttgtgctgttctaggaa

SEQ ID NO: 528428 - DNA, 25 bp, Mus musculus
gcaagcgaaaggcactttgcttttt

SEQ ID NO: 528429 - DNA, 25 bp, Mus musculus
gcaagcgaaagggactttgcttttt

SEQ ID NO: 528430 - DNA, 25 bp, Mus musculus
gcaagcgagggcagattccacagaa

SEQ ID NO: 528431 - DNA, 25 bp, Mus musculus
gcaagcgagggctgattccacagaa

SEQ ID NO: 528432 - DNA, 25 bp, Mus musculus
gcaagcgatgatcaggctttcacta

SEQ ID NO: 528433 - DNA, 25 bp, Mus musculus
gcaagcgatgatgaggctttcacta

SEQ ID NO: 528434 - DNA, 25 bp, Mus musculus
gcaagcgcacagagggcatcgtgta

SEQ ID NO: 528435 - DNA, 25 bp, Mus musculus
gcaagcgcacagtgggcatcgtgta

SEQ ID NO: 528436 - DNA, 25 bp, Mus musculus
gcaagcgcctgaaaggttccatcaa

SEQ ID NO: 528437 - DNA, 25 bp, Mus musculus
gcaagcgcctgataggttccatcaa

SEQ ID NO: 528438 - DNA, 25 bp, Mus musculus
gcaagcgctaccattatacagtgcc

SEQ ID NO: 528439 - DNA, 25 bp, Mus musculus
gcaagcgctacctttatacagtgcc

SEQ ID NO: 528440 - DNA, 25 bp, Mus musculus
gcaagcgctcccaagtgtgaagggt

SEQ ID NO: 528441 - DNA, 25 bp, Mus musculus
gcaagcgctccctagtgtgaagggt

SEQ ID NO: 528442 - DNA, 25 bp, Mus musculus
gcaagcgctgttacggtaagcttta

SEQ ID NO: 528443 - DNA, 25 bp, Mus musculus
gcaagcgctgttcgtgagagactct

SEQ ID NO: 528444 - DNA, 25 bp, Mus musculus
gcaagcgctgttggtgagagactct

SEQ ID NO: 528445 - DNA, 25 bp, Mus musculus
gcaagcgctgtttcggtaagcttta

SEQ ID NO: 528446 - DNA, 25 bp, Mus musculus
gcaagcgcttgaagcgggatgccga

SEQ ID NO: 528447 - DNA, 25 bp, Mus musculus
gcaagcgcttgatgcgggatgccga

SEQ ID NO: 528448 - DNA, 25 bp, Mus musculus
gcaagcggagaacttcccctcagaa

SEQ ID NO: 528449 - DNA, 25 bp, Mus musculus
gcaagcggagaagttcccctcagaa

SEQ ID NO: 528450 - DNA, 25 bp, Mus musculus
gcaagcggaggcactctgcaaactt

SEQ ID NO: 528451 - DNA, 25 bp, Mus musculus
gcaagcggaggctctctgcaaactt

SEQ ID NO: 528452 - DNA, 25 bp, Mus musculus
gcaagcggcacacttcagaagcaag

SEQ ID NO: 528453 - DNA, 25 bp, Mus musculus
gcaagcggcacagttcagaagcaag

SEQ ID NO: 528454 - DNA, 25 bp, Mus musculus
gcaagcggcaccagcagcggagtac

SEQ ID NO: 528455 - DNA, 25 bp, Mus musculus
gcaagcggcacctgcagcggagtac

SEQ ID NO: 528456 - DNA, 25 bp, Mus musculus
gcaagcggcggaatttcagcaagca

SEQ ID NO: 528457 - DNA, 25 bp, Mus musculus
gcaagcggcggattttcagcaagca

SEQ ID NO: 528458 - DNA, 25 bp, Mus musculus
gcaagcgggcatagctttgaaacct

SEQ ID NO: 528459 - DNA, 25 bp, Mus musculus
gcaagcgggcattgctttgaaacct

SEQ ID NO: 528460 - DNA, 25 bp, Mus musculus
gcaagcgtatatagaagattattct

SEQ ID NO: 528461 - DNA, 25 bp, Mus musculus
gcaagcgtatattgaagattattct

SEQ ID NO: 528462 - DNA, 25 bp, Mus musculus
gcaagcgtcatcatcgaagccactg

SEQ ID NO: 528463 - DNA, 25 bp, Mus musculus
gcaagcgtcatcttcgaagccactg

SEQ ID NO: 528464 - DNA, 25 bp, Mus musculus
gcaagcgtctttctattactgatga

SEQ ID NO: 528465 - DNA, 25 bp, Mus musculus
gcaagcgtctttgtattactgatga

SEQ ID NO: 528466 - DNA, 25 bp, Mus musculus
gcaagcgtgcagaaactaactcctc

SEQ ID NO: 528467 - DNA, 25 bp, Mus musculus
gcaagcgtgcagtaactaactcctc

SEQ ID NO: 528468 - DNA, 25 bp, Mus musculus
gcaagcgtttacagagcacctcaaa

SEQ ID NO: 528469 - DNA, 25 bp, Mus musculus
gcaagcgtttactgagcacctcaaa

SEQ ID NO: 528470 - DNA, 25 bp, Mus musculus
gcaagcgttttgagcttcagattaa

SEQ ID NO: 528471 - DNA, 25 bp, Mus musculus
gcaagcgttttgtgcttcagattaa

SEQ ID NO: 528472 - DNA, 25 bp, Mus musculus
gcaagctaccttattatggatgtta

SEQ ID NO: 528473 - DNA, 25 bp, Mus musculus
gcaagctacctttttatggatgtta

SEQ ID NO: 528474 - DNA, 25 bp, Mus musculus
gcaagctactagatcgacgggttta

SEQ ID NO: 528475 - DNA, 25 bp, Mus musculus
gcaagctactagttcgacgggttta

SEQ ID NO: 528476 - DNA, 25 bp, Mus musculus
gcaagctagattacgttaactctca

SEQ ID NO: 528477 - DNA, 25 bp, Mus musculus
gcaagctagatttcgttaactctca

SEQ ID NO: 528478 - DNA, 25 bp, Mus musculus
gcaagctatgacagctgtgacctca

SEQ ID NO: 528479 - DNA, 25 bp, Mus musculus
gcaagctatgactgctgtgacctca

SEQ ID NO: 528480 - DNA, 25 bp, Mus musculus
gcaagctattgtcacctattctgaa

SEQ ID NO: 528481 - DNA, 25 bp, Mus musculus
gcaagctattgtgacctattctgaa

SEQ ID NO: 528482 - DNA, 25 bp, Mus musculus
gcaagctatttccttgttgagtaca

SEQ ID NO: 528483 - DNA, 25 bp, Mus musculus
gcaagctatttcgttgttgagtaca

SEQ ID NO: 528484 - DNA, 25 bp, Mus musculus
gcaagctcaggcaggatggatatta

SEQ ID NO: 528485 - DNA, 25 bp, Mus musculus
gcaagctcaggctggatggatatta

SEQ ID NO: 528486 - DNA, 25 bp, Mus musculus
gcaagctcatcacacatgtggcttt

SEQ ID NO: 528487 - DNA, 25 bp, Mus musculus
gcaagctcatcagacatgtggcttt

SEQ ID NO: 528488 - DNA, 25 bp, Mus musculus
gcaagctcatttacttgtgtgtctc

SEQ ID NO: 528489 - DNA, 25 bp, Mus musculus
gcaagctcattttcttgtgtgtctc

SEQ ID NO: 528490 - DNA, 25 bp, Mus musculus
gcaagctccttgacgttgagtgaca

SEQ ID NO: 528491 - DNA, 25 bp, Mus musculus
gcaagctccttgtcgttgagtgaca

SEQ ID NO: 528492 - DNA, 25 bp, Mus musculus
gcaagctcgaccaacaagcttcaag

SEQ ID NO: 528493 - DNA, 25 bp, Mus musculus
gcaagctcgacctacaagcttcaag

SEQ ID NO: 528494 - DNA, 25 bp, Mus musculus
gcaagctctacaagtgcatcaagaa

SEQ ID NO: 528495 - DNA, 25 bp, Mus musculus
gcaagctctacatgtgcatcaagaa

SEQ ID NO: 528496 - DNA, 25 bp, Mus musculus
gcaagctctgaacctactgtgcctc

SEQ ID NO: 528497 - DNA, 25 bp, Mus musculus
gcaagctctgaagctactgtgcctc

SEQ ID NO: 528498 - DNA, 25 bp, Mus musculus
gcaagctctgagaacacactcggct

SEQ ID NO: 528499 - DNA, 25 bp, Mus musculus
gcaagctctgagtacacactcggct

SEQ ID NO: 528500 - DNA, 25 bp, Mus musculus
gcaagctctgccataggacattcaa

SEQ ID NO: 528501 - DNA, 25 bp, Mus musculus
gcaagctctgccttaggacattcaa

SEQ ID NO: 528502 - DNA, 25 bp, Mus musculus
gcaagctctggacatttcttagacc

SEQ ID NO: 528503 - DNA, 25 bp, Mus musculus
gcaagctctggagatttcttagacc

SEQ ID NO: 528504 - DNA, 25 bp, Mus musculus
gcaagctcttggatggcgatgagaa

SEQ ID NO: 528505 - DNA, 25 bp, Mus musculus
gcaagctcttggttggcgatgagaa

SEQ ID NO: 528506 - DNA, 25 bp, Mus musculus
gcaagctctttacaaggaacccctg

SEQ ID NO: 528507 - DNA, 25 bp, Mus musculus
gcaagctctttagaaggaacccctg

SEQ ID NO: 528508 - DNA, 25 bp, Mus musculus
gcaagctgaacacccgtataacttt

SEQ ID NO: 528509 - DNA, 25 bp, Mus musculus
gcaagctgaacagccgtataacttt

SEQ ID NO: 528510 - DNA, 25 bp, Mus musculus
gcaagctgaagcctttgttgaacaa

SEQ ID NO: 528511 - DNA, 25 bp, Mus musculus
gcaagctgaagcgtttgttgaacaa

SEQ ID NO: 528512 - DNA, 25 bp, Mus musculus
gcaagctgagctacaaaatttggca

SEQ ID NO: 528513 - DNA, 25 bp, Mus musculus
gcaagctgagcttcaaaatttggca

SEQ ID NO: 528514 - DNA, 25 bp, Mus musculus
gcaagctgaggcacagtaccgttca

SEQ ID NO: 528515 - DNA, 25 bp, Mus musculus
gcaagctgaggctcagtaccgttca

SEQ ID NO: 528516 - DNA, 25 bp, Mus musculus
gcaagctgattgaattttccaccat

SEQ ID NO: 528517 - DNA, 25 bp, Mus musculus
gcaagctgattgtattttccaccat

SEQ ID NO: 528518 - DNA, 25 bp, Mus musculus
gcaagctgcccaaatgtattcacac

SEQ ID NO: 528519 - DNA, 25 bp, Mus musculus
gcaagctgcccatatgtattcacac

SEQ ID NO: 528520 - DNA, 25 bp, Mus musculus
gcaagctgccccagcaaaaggagaa

SEQ ID NO: 528521 - DNA, 25 bp, Mus musculus
gcaagctgcccctgcaaaaggagaa

SEQ ID NO: 528522 - DNA, 25 bp, Mus musculus
gcaagctgctctcggaagatccaga

SEQ ID NO: 528523 - DNA, 25 bp, Mus musculus
gcaagctgctctgggaagatccaga

SEQ ID NO: 528524 - DNA, 25 bp, Mus musculus
gcaagctgctggctgtcagcaagca

SEQ ID NO: 528525 - DNA, 25 bp, Mus musculus
gcaagctgctgggtgtcagcaagca

SEQ ID NO: 528526 - DNA, 25 bp, Mus musculus
gcaagctgcttccagagactcacaa

SEQ ID NO: 528527 - DNA, 25 bp, Mus musculus
gcaagctgcttcgagagactcacaa

SEQ ID NO: 528528 - DNA, 25 bp, Mus musculus
gcaagctggcacacctctaagtatt

SEQ ID NO: 528529 - DNA, 25 bp, Mus musculus
gcaagctggcactcctctaagtatt

SEQ ID NO: 528530 - DNA, 25 bp, Mus musculus
gcaagctgggcaaaaaggacctttt

SEQ ID NO: 528531 - DNA, 25 bp, Mus musculus
gcaagctgggcataaaggacctttt

SEQ ID NO: 528532 - DNA, 25 bp, Mus musculus
gcaagctgggccacagtgacatgaa

SEQ ID NO: 528533 - DNA, 25 bp, Mus musculus
gcaagctgggcctcagtgacatgaa

SEQ ID NO: 528534 - DNA, 25 bp, Mus musculus
gcaagctgggtgctatattcactga

SEQ ID NO: 528535 - DNA, 25 bp, Mus musculus
gcaagctgggtggtatattcactga

SEQ ID NO: 528536 - DNA, 25 bp, Mus musculus
gcaagctgtaccatgagctgattct

SEQ ID NO: 528537 - DNA, 25 bp, Mus musculus
gcaagctgtaccttgagctgattct

SEQ ID NO: 528538 - DNA, 25 bp, Mus musculus
gcaagctgtattctgtgtgtgctgt

SEQ ID NO: 528539 - DNA, 25 bp, Mus musculus
gcaagctgtattgtgtgtgtgctgt

SEQ ID NO: 528540 - DNA, 25 bp, Mus musculus
gcaagctgtcggaccaagggcacaa

SEQ ID NO: 528541 - DNA, 25 bp, Mus musculus
gcaagctgtcggtccaagggcacaa

SEQ ID NO: 528542 - DNA, 25 bp, Mus musculus
gcaagctgtcttctacatgatctag

SEQ ID NO: 528543 - DNA, 25 bp, Mus musculus
gcaagctgtcttgtacatgatctag

SEQ ID NO: 528544 - DNA, 25 bp, Mus musculus
gcaagctgtggcaggccccatgaga

SEQ ID NO: 528545 - DNA, 25 bp, Mus musculus
gcaagctgtggctggccccatgaga

SEQ ID NO: 528546 - DNA, 25 bp, Mus musculus
gcaagctgtgtgatcataatgaccc

SEQ ID NO: 528547 - DNA, 25 bp, Mus musculus
gcaagctgtgtgttcataatgaccc

SEQ ID NO: 528548 - DNA, 25 bp, Mus musculus
gcaagctgttccctgtgttcgttct

SEQ ID NO: 528549 - DNA, 25 bp, Mus musculus
gcaagctgttccgtgtgttcgttct

SEQ ID NO: 528550 - DNA, 25 bp, Mus musculus
gcaagcttaagtctttcctttcacc

SEQ ID NO: 528551 - DNA, 25 bp, Mus musculus
gcaagcttaagtgtttcctttcacc

SEQ ID NO: 528552 - DNA, 25 bp, Mus musculus
gcaagcttaatgatcacagactaga

SEQ ID NO: 528553 - DNA, 25 bp, Mus musculus
gcaagcttaatgttcacagactaga

SEQ ID NO: 528554 - DNA, 25 bp, Mus musculus
gcaagcttacataacagtgtgctga

SEQ ID NO: 528555 - DNA, 25 bp, Mus musculus
gcaagcttacatattccattttggt

SEQ ID NO: 528556 - DNA, 25 bp, Mus musculus
gcaagcttacattacagtgtgctga

SEQ ID NO: 528557 - DNA, 25 bp, Mus musculus
gcaagcttacattttccattttggt

SEQ ID NO: 528558 - DNA, 25 bp, Mus musculus
gcaagcttaggaaaccctgtgcctt

SEQ ID NO: 528559 - DNA, 25 bp, Mus musculus
gcaagcttaggataccctgtgcctt

SEQ ID NO: 528560 - DNA, 25 bp, Mus musculus
gcaagcttatctaccagacaactgt

SEQ ID NO: 528561 - DNA, 25 bp, Mus musculus
gcaagcttatcttccagacaactgt

SEQ ID NO: 528562 - DNA, 25 bp, Mus musculus
gcaagcttcagaacttgttctcaaa

SEQ ID NO: 528563 - DNA, 25 bp, Mus musculus
gcaagcttcagatcttgttctcaaa

SEQ ID NO: 528564 - DNA, 25 bp, Mus musculus
gcaagcttcaggagctctactgtga

SEQ ID NO: 528565 - DNA, 25 bp, Mus musculus
gcaagcttcaggcaaacaaatggtt

SEQ ID NO: 528566 - DNA, 25 bp, Mus musculus
gcaagcttcagggaaacaaatggtt

SEQ ID NO: 528567 - DNA, 25 bp, Mus musculus
gcaagcttcaggtgctctactgtga

SEQ ID NO: 528568 - DNA, 25 bp, Mus musculus
gcaagcttcataaggagactcccct

SEQ ID NO: 528569 - DNA, 25 bp, Mus musculus
gcaagcttcatatggagactcccct

SEQ ID NO: 528570 - DNA, 25 bp, Mus musculus
gcaagcttcatcaagcttctgtcat

SEQ ID NO: 528571 - DNA, 25 bp, Mus musculus
gcaagcttcatctagcttctgtcat

SEQ ID NO: 528572 - DNA, 25 bp, Mus musculus
gcaagcttcccgacacagtgagctg

SEQ ID NO: 528573 - DNA, 25 bp, Mus musculus
gcaagcttcccgtcacagtgagctg

SEQ ID NO: 528574 - DNA, 25 bp, Mus musculus
gcaagcttcctgaagagcttctgga

SEQ ID NO: 528575 - DNA, 25 bp, Mus musculus
gcaagcttcctgtagagcttctgga

SEQ ID NO: 528576 - DNA, 25 bp, Mus musculus
gcaagcttccttaacttctacagta

SEQ ID NO: 528577 - DNA, 25 bp, Mus musculus
gcaagcttcctttacttctacagta

SEQ ID NO: 528578 - DNA, 25 bp, Mus musculus
gcaagcttctgtcccctacatcaga

SEQ ID NO: 528579 - DNA, 25 bp, Mus musculus
gcaagcttctgtgccctacatcaga

SEQ ID NO: 528580 - DNA, 25 bp, Mus musculus
gcaagcttgctactctacagtgttt

SEQ ID NO: 528581 - DNA, 25 bp, Mus musculus
gcaagcttgctagtctacagtgttt

SEQ ID NO: 528582 - DNA, 25 bp, Mus musculus
gcaagcttggagacccacatcttgg

SEQ ID NO: 528583 - DNA, 25 bp, Mus musculus
gcaagcttggagtcccacatcttgg

SEQ ID NO: 528584 - DNA, 25 bp, Mus musculus
gcaagctttagactccaagccgtgc

SEQ ID NO: 528585 - DNA, 25 bp, Mus musculus
gcaagctttagagtccaagccgtgc

SEQ ID NO: 528586 - DNA, 25 bp, Mus musculus
gcaagctttcaacaggtgacatgac

SEQ ID NO: 528587 - DNA, 25 bp, Mus musculus
gcaagctttcaagaggtgacatgac

SEQ ID NO: 528588 - DNA, 25 bp, Mus musculus
gcaagctttcctataatgtatatac

SEQ ID NO: 528589 - DNA, 25 bp, Mus musculus
gcaagctttcctttaatgtatatac

SEQ ID NO: 528590 - DNA, 25 bp, Mus musculus
gcaagctttggacaacaaaatgcga

SEQ ID NO: 528591 - DNA, 25 bp, Mus musculus
gcaagctttggagaacaaaatgcga

SEQ ID NO: 528592 - DNA, 25 bp, Mus musculus
gcaagcttttccatcagaagtacct

SEQ ID NO: 528593 - DNA, 25 bp, Mus musculus
gcaagcttttccttcagaagtacct

SEQ ID NO: 528594 - DNA, 25 bp, Mus musculus
gcaaggaaacggaattgtgcatttg

SEQ ID NO: 528595 - DNA, 25 bp, Mus musculus
gcaaggaaacggtattgtgcatttg

SEQ ID NO: 528596 - DNA, 25 bp, Mus musculus
gcaaggaacacaacttccgtacacg

SEQ ID NO: 528597 - DNA, 25 bp, Mus musculus
gcaaggaacacatcttccgtacacg

SEQ ID NO: 528598 - DNA, 25 bp, Mus musculus
gcaaggaacagcaggcatttggcca

SEQ ID NO: 528599 - DNA, 25 bp, Mus musculus
gcaaggaacagctggcatttggcca

SEQ ID NO: 528600 - DNA, 25 bp, Mus musculus
gcaaggaaccgtcggtgccaggacc

SEQ ID NO: 528601 - DNA, 25 bp, Mus musculus
gcaaggaaccgtgggtgccaggacc

SEQ ID NO: 528602 - DNA, 25 bp, Mus musculus
gcaaggaaccttccagcatgtgcaa

SEQ ID NO: 528603 - DNA, 25 bp, Mus musculus
gcaaggaaccttgcagcatgtgcaa

SEQ ID NO: 528604 - DNA, 25 bp, Mus musculus
gcaaggaactcactccctttttaat

SEQ ID NO: 528605 - DNA, 25 bp, Mus musculus
gcaaggaactcagtccctttttaat

SEQ ID NO: 528606 - DNA, 25 bp, Mus musculus
gcaaggaactccacatgggttggat

SEQ ID NO: 528607 - DNA, 25 bp, Mus musculus
gcaaggaactcctcatgggttggat

SEQ ID NO: 528608 - DNA, 25 bp, Mus musculus
gcaaggaactctccgaggtgcattt

SEQ ID NO: 528609 - DNA, 25 bp, Mus musculus
gcaaggaactctgcgaggtgcattt

SEQ ID NO: 528610 - DNA, 25 bp, Mus musculus
gcaaggaagccaaacccaggaaata

SEQ ID NO: 528611 - DNA, 25 bp, Mus musculus
gcaaggaagccatacccaggaaata

SEQ ID NO: 528612 - DNA, 25 bp, Mus musculus
gcaaggaaggtgacaagcacaccct

SEQ ID NO: 528613 - DNA, 25 bp, Mus musculus
gcaaggaaggtgtcaagcacaccct

SEQ ID NO: 528614 - DNA, 25 bp, Mus musculus
gcaaggaatgtacacacccattaga

SEQ ID NO: 528615 - DNA, 25 bp, Mus musculus
gcaaggaatgtagacacccattaga

SEQ ID NO: 528616 - DNA, 25 bp, Mus musculus
gcaaggacaaagcaaatccaaccaa

SEQ ID NO: 528617 - DNA, 25 bp, Mus musculus
gcaaggacaaaggaaatccaaccaa

SEQ ID NO: 528618 - DNA, 25 bp, Mus musculus
gcaaggacagttctgcacaggccct

SEQ ID NO: 528619 - DNA, 25 bp, Mus musculus
gcaaggacagttgtgcacaggccct

SEQ ID NO: 528620 - DNA, 25 bp, Mus musculus
gcaaggaccaaccaggagtctacac

SEQ ID NO: 528621 - DNA, 25 bp, Mus musculus
gcaaggaccaacgaggagtctacac

SEQ ID NO: 528622 - DNA, 25 bp, Mus musculus
gcaaggacccaaagagacttcatct

SEQ ID NO: 528623 - DNA, 25 bp, Mus musculus
gcaaggacccaatgagacttcatct

SEQ ID NO: 528624 - DNA, 25 bp, Mus musculus
gcaaggacctggctgaacatcatga

SEQ ID NO: 528625 - DNA, 25 bp, Mus musculus
gcaaggacctgggtgaacatcatga

SEQ ID NO: 528626 - DNA, 25 bp, Mus musculus
gcaaggacctgtcatagttcagcag

SEQ ID NO: 528627 - DNA, 25 bp, Mus musculus
gcaaggacctgtgatagttcagcag

SEQ ID NO: 528628 - DNA, 25 bp, Mus musculus
gcaaggactcagctcagtatgctgt

SEQ ID NO: 528629 - DNA, 25 bp, Mus musculus
gcaaggactcaggtcagtatgctgt

SEQ ID NO: 528630 - DNA, 25 bp, Mus musculus
gcaaggactctgagcctccggctct

SEQ ID NO: 528631 - DNA, 25 bp, Mus musculus
gcaaggactctgtgcctccggctct

SEQ ID NO: 528632 - DNA, 25 bp, Mus musculus
gcaaggacttctcgtgagctctcga

SEQ ID NO: 528633 - DNA, 25 bp, Mus musculus
gcaaggacttctggtgagctctcga

SEQ ID NO: 528634 - DNA, 25 bp, Mus musculus
gcaaggacttgcacagacagtcgat

SEQ ID NO: 528635 - DNA, 25 bp, Mus musculus
gcaaggacttgctcagacagtcgat

SEQ ID NO: 528636 - DNA, 25 bp, Mus musculus
gcaaggagaaatcccgaccggtgct

SEQ ID NO: 528637 - DNA, 25 bp, Mus musculus
gcaaggagaaatgccgaccggtgct

SEQ ID NO: 528638 - DNA, 25 bp, Mus musculus
gcaaggagagctactcggtgtacgt

SEQ ID NO: 528639 - DNA, 25 bp, Mus musculus
gcaaggagagcttctcggtgtacgt

SEQ ID NO: 528640 - DNA, 25 bp, Mus musculus
gcaaggagcagtacctgcgccaggt

SEQ ID NO: 528641 - DNA, 25 bp, Mus musculus
gcaaggagcagttcctgcgccaggt

SEQ ID NO: 528642 - DNA, 25 bp, Mus musculus
gcaaggagcccacttagcagcagct

SEQ ID NO: 528643 - DNA, 25 bp, Mus musculus
gcaaggagcccagttagcagcagct

SEQ ID NO: 528644 - DNA, 25 bp, Mus musculus
gcaaggaggagcctccttcatccac

SEQ ID NO: 528645 - DNA, 25 bp, Mus musculus
gcaaggaggagcgtccttcatccac

SEQ ID NO: 528646 - DNA, 25 bp, Mus musculus
gcaaggaggccccaggtttacttct

SEQ ID NO: 528647 - DNA, 25 bp, Mus musculus
gcaaggaggcccgaggtttacttct

SEQ ID NO: 528648 - DNA, 25 bp, Mus musculus
gcaaggagggccataagagcctgat

SEQ ID NO: 528649 - DNA, 25 bp, Mus musculus
gcaaggagggccttaagagcctgat

SEQ ID NO: 528650 - DNA, 25 bp, Mus musculus
gcaaggaggtgtaccgctgcgacat

SEQ ID NO: 528651 - DNA, 25 bp, Mus musculus
gcaaggaggtgttccgctgcgacat

SEQ ID NO: 528652 - DNA, 25 bp, Mus musculus
gcaaggagtagcattcaattctgga

SEQ ID NO: 528653 - DNA, 25 bp, Mus musculus
gcaaggagtagctttcaattctgga

SEQ ID NO: 528654 - DNA, 25 bp, Mus musculus
gcaaggagtgaccagccagtgtcct

SEQ ID NO: 528655 - DNA, 25 bp, Mus musculus
gcaaggagtgacgagccagtgtcct

SEQ ID NO: 528656 - DNA, 25 bp, Mus musculus
gcaaggagtgcaacttctaaggaac

SEQ ID NO: 528657 - DNA, 25 bp, Mus musculus
gcaaggagtgcatcttctaaggaac

SEQ ID NO: 528658 - DNA, 25 bp, Mus musculus
gcaaggagtgtcaggcaactgcaat

SEQ ID NO: 528659 - DNA, 25 bp, Mus musculus
gcaaggagtgtctggcaactgcaat

SEQ ID NO: 528660 - DNA, 25 bp, Mus musculus
gcaaggatatcgattacagccataa

SEQ ID NO: 528661 - DNA, 25 bp, Mus musculus
gcaaggatatcgtttacagccataa

SEQ ID NO: 528662 - DNA, 25 bp, Mus musculus
gcaaggatatttcttctcctttacg

SEQ ID NO: 528663 - DNA, 25 bp, Mus musculus
gcaaggatatttgttctcctttacg

SEQ ID NO: 528664 - DNA, 25 bp, Mus musculus
gcaaggatcggaagcggactcccat

SEQ ID NO: 528665 - DNA, 25 bp, Mus musculus
gcaaggatcggatgcggactcccat

SEQ ID NO: 528666 - DNA, 25 bp, Mus musculus
gcaaggatcttgcatagtacctaaa

SEQ ID NO: 528667 - DNA, 25 bp, Mus musculus
gcaaggatcttggatagtacctaaa

SEQ ID NO: 528668 - DNA, 25 bp, Mus musculus
gcaaggatgacgaggcagcccctca

SEQ ID NO: 528669 - DNA, 25 bp, Mus musculus
gcaaggatgacgtggcagcccctca

SEQ ID NO: 528670 - DNA, 25 bp, Mus musculus
gcaaggatgatgacgtgtcctcccc

SEQ ID NO: 528671 - DNA, 25 bp, Mus musculus
gcaaggatgatgtcgtgtcctcccc

SEQ ID NO: 528672 - DNA, 25 bp, Mus musculus
gcaaggatgctcaggaagtaccgga

SEQ ID NO: 528673 - DNA, 25 bp, Mus musculus
gcaaggatgctctggaagtaccgga

SEQ ID NO: 528674 - DNA, 25 bp, Mus musculus
gcaaggatgtagacgtggaactcaa

SEQ ID NO: 528675 - DNA, 25 bp, Mus musculus
gcaaggatgtagtcgtggaactcaa

SEQ ID NO: 528676 - DNA, 25 bp, Mus musculus
gcaaggattgcgaggcatgtgctca

SEQ ID NO: 528677 - DNA, 25 bp, Mus musculus
gcaaggattgcgtggcatgtgctca

SEQ ID NO: 528678 - DNA, 25 bp, Mus musculus
gcaaggatttcaccagctgtggctc

SEQ ID NO: 528679 - DNA, 25 bp, Mus musculus
gcaaggatttcagcagctgtggctc

SEQ ID NO: 528680 - DNA, 25 bp, Mus musculus
gcaaggatttcccttgtcactaaga

SEQ ID NO: 528681 - DNA, 25 bp, Mus musculus
gcaaggatttccgttgtcactaaga

SEQ ID NO: 528682 - DNA, 25 bp, Mus musculus
gcaaggcaaacacgctcagagttca

SEQ ID NO: 528683 - DNA, 25 bp, Mus musculus
gcaaggcaaacaggctcagagttca

SEQ ID NO: 528684 - DNA, 25 bp, Mus musculus
gcaaggcaaagtagtccaagtcgtt

SEQ ID NO: 528685 - DNA, 25 bp, Mus musculus
gcaaggcaaagttgtccaagtcgtt

SEQ ID NO: 528686 - DNA, 25 bp, Mus musculus
gcaaggcaagtgatctctccagcta

SEQ ID NO: 528687 - DNA, 25 bp, Mus musculus
gcaaggcaagtgttctctccagcta

SEQ ID NO: 528688 - DNA, 25 bp, Mus musculus
gcaaggcatcccagggaaaactggc

SEQ ID NO: 528689 - DNA, 25 bp, Mus musculus
gcaaggcatccctgggaaaactggc

SEQ ID NO: 528690 - DNA, 25 bp, Mus musculus
gcaaggcatctgaaccccgaagaag

SEQ ID NO: 528691 - DNA, 25 bp, Mus musculus
gcaaggcatctgtaccccgaagaag

SEQ ID NO: 528692 - DNA, 25 bp, Mus musculus
gcaaggcatgagacctgtcatggaa

SEQ ID NO: 528693 - DNA, 25 bp, Mus musculus
gcaaggcatgagtcctgtcatggaa

SEQ ID NO: 528694 - DNA, 25 bp, Mus musculus
gcaaggcatgcaatggatttcacaa

SEQ ID NO: 528695 - DNA, 25 bp, Mus musculus
gcaaggcatgcattggatttcacaa

SEQ ID NO: 528696 - DNA, 25 bp, Mus musculus
gcaaggcatgccatccttcaaatga

SEQ ID NO: 528697 - DNA, 25 bp, Mus musculus
gcaaggcatgccttccttcaaatga

SEQ ID NO: 528698 - DNA, 25 bp, Mus musculus
gcaaggcattataacttcattaagc

SEQ ID NO: 528699 - DNA, 25 bp, Mus musculus
gcaaggcattattacttcattaagc

SEQ ID NO: 528700 - DNA, 25 bp, Mus musculus
gcaaggcattcgaagggacagatat

SEQ ID NO: 528701 - DNA, 25 bp, Mus musculus
gcaaggcattcgtagggacagatat

SEQ ID NO: 528702 - DNA, 25 bp, Mus musculus
gcaaggccaaagcaaactgtttctc

SEQ ID NO: 528703 - DNA, 25 bp, Mus musculus
gcaaggccaaaggaaactgtttctc

SEQ ID NO: 528704 - DNA, 25 bp, Mus musculus
gcaaggccaagcaacgcagcgtgaa

SEQ ID NO: 528705 - DNA, 25 bp, Mus musculus
gcaaggccaagctacgcagcgtgaa

SEQ ID NO: 528706 - DNA, 25 bp, Mus musculus
gcaaggccaaggacttcagtcgctg

SEQ ID NO: 528707 - DNA, 25 bp, Mus musculus
gcaaggccaaggtcttcagtcgctg

SEQ ID NO: 528708 - DNA, 25 bp, Mus musculus
gcaaggccacaccacagggtacttc

SEQ ID NO: 528709 - DNA, 25 bp, Mus musculus
gcaaggccacacgacagggtacttc

SEQ ID NO: 528710 - DNA, 25 bp, Mus musculus
gcaaggccaccgatgtgctcactat

SEQ ID NO: 528711 - DNA, 25 bp, Mus musculus
gcaaggccaccgttgtgctcactat

SEQ ID NO: 528712 - DNA, 25 bp, Mus musculus
gcaaggccacgaacagaatactcat

SEQ ID NO: 528713 - DNA, 25 bp, Mus musculus
gcaaggccacgatcagaatactcat

SEQ ID NO: 528714 - DNA, 25 bp, Mus musculus
gcaaggccacttagaggatgatgat

SEQ ID NO: 528715 - DNA, 25 bp, Mus musculus
gcaaggccactttgaggatgatgat

SEQ ID NO: 528716 - DNA, 25 bp, Mus musculus
gcaaggccagatatcacattggttt

SEQ ID NO: 528717 - DNA, 25 bp, Mus musculus
gcaaggccagatttcacattggttt

SEQ ID NO: 528718 - DNA, 25 bp, Mus musculus
gcaaggcccagtatctgaggatcaa

SEQ ID NO: 528719 - DNA, 25 bp, Mus musculus
gcaaggcccagtttctgaggatcaa

SEQ ID NO: 528720 - DNA, 25 bp, Mus musculus
gcaaggcccctactatgctgtttgg

SEQ ID NO: 528721 - DNA, 25 bp, Mus musculus
gcaaggcccctagtatgctgtttgg

SEQ ID NO: 528722 - DNA, 25 bp, Mus musculus
gcaaggccctatcttctattcttag

SEQ ID NO: 528723 - DNA, 25 bp, Mus musculus
gcaaggccctatgttctattcttag

SEQ ID NO: 528724 - DNA, 25 bp, Mus musculus
gcaaggccctgacgaggcaaccatt

SEQ ID NO: 528725 - DNA, 25 bp, Mus musculus
gcaaggccctgaggaggcaaccatt

SEQ ID NO: 528726 - DNA, 25 bp, Mus musculus
gcaaggccgtttaagaactcagaga

SEQ ID NO: 528727 - DNA, 25 bp, Mus musculus
gcaaggccgttttagaactcagaga

SEQ ID NO: 528728 - DNA, 25 bp, Mus musculus
gcaaggcctcggagaaggataccaa

SEQ ID NO: 528729 - DNA, 25 bp, Mus musculus
gcaaggcctcggtgaaggataccaa

SEQ ID NO: 528730 - DNA, 25 bp, Mus musculus
gcaaggcctgccatctgatgggcag

SEQ ID NO: 528731 - DNA, 25 bp, Mus musculus
gcaaggcctgccttctgatgggcag

SEQ ID NO: 528732 - DNA, 25 bp, Mus musculus
gcaaggcctgcgactaggaggacct

SEQ ID NO: 528733 - DNA, 25 bp, Mus musculus
gcaaggcctgcgtctaggaggacct

SEQ ID NO: 528734 - DNA, 25 bp, Mus musculus
gcaaggccttcgattttgataagtc

SEQ ID NO: 528735 - DNA, 25 bp, Mus musculus
gcaaggccttcgtttttgataagtc

SEQ ID NO: 528736 - DNA, 25 bp, Mus musculus
gcaaggccttttacacaggagcgga

SEQ ID NO: 528737 - DNA, 25 bp, Mus musculus
gcaaggcctttttcacaggagcgga

SEQ ID NO: 528738 - DNA, 25 bp, Mus musculus
gcaaggcgccttagcccagggcgct

SEQ ID NO: 528739 - DNA, 25 bp, Mus musculus
gcaaggcgcctttgcccagggcgct

SEQ ID NO: 528740 - DNA, 25 bp, Mus musculus
gcaaggctaataccattaccaaaga

SEQ ID NO: 528741 - DNA, 25 bp, Mus musculus
gcaaggctaatagcattaccaaaga

SEQ ID NO: 528742 - DNA, 25 bp, Mus musculus
gcaaggctaccaatcctaaaagcgg

SEQ ID NO: 528743 - DNA, 25 bp, Mus musculus
gcaaggctaccattcctaaaagcgg

SEQ ID NO: 528744 - DNA, 25 bp, Mus musculus
gcaaggctagtgatgtccagtggca

SEQ ID NO: 528745 - DNA, 25 bp, Mus musculus
gcaaggctagtgttgtccagtggca

SEQ ID NO: 528746 - DNA, 25 bp, Mus musculus
gcaaggctatgtcctacactgtcca

SEQ ID NO: 528747 - DNA, 25 bp, Mus musculus
gcaaggctatgtgctacactgtcca

SEQ ID NO: 528748 - DNA, 25 bp, Mus musculus
gcaaggctattgaaattgacaacaa

SEQ ID NO: 528749 - DNA, 25 bp, Mus musculus
gcaaggctattgctgtgactttgaa

SEQ ID NO: 528750 - DNA, 25 bp, Mus musculus
gcaaggctattggtgtgactttgaa

SEQ ID NO: 528751 - DNA, 25 bp, Mus musculus
gcaaggctattgtaattgacaacaa

SEQ ID NO: 528752 - DNA, 25 bp, Mus musculus
gcaaggctcagtccctggttctgtc

SEQ ID NO: 528753 - DNA, 25 bp, Mus musculus
gcaaggctcagtgcctggttctgtc

SEQ ID NO: 528754 - DNA, 25 bp, Mus musculus
gcaaggctctaacagtcctgtactt

SEQ ID NO: 528755 - DNA, 25 bp, Mus musculus
gcaaggctctaagagtcctgtactt

SEQ ID NO: 528756 - DNA, 25 bp, Mus musculus
gcaaggctctttcaaatacactcag

SEQ ID NO: 528757 - DNA, 25 bp, Mus musculus
gcaaggctctttgaaatacactcag

SEQ ID NO: 528758 - DNA, 25 bp, Mus musculus
gcaaggctgagcagaggtttccctt

SEQ ID NO: 528759 - DNA, 25 bp, Mus musculus
gcaaggctgagctgaggtttccctt

SEQ ID NO: 528760 - DNA, 25 bp, Mus musculus
gcaaggctgagtccgtgccttcttt

SEQ ID NO: 528761 - DNA, 25 bp, Mus musculus
gcaaggctgagtgcgtgccttcttt

SEQ ID NO: 528762 - DNA, 25 bp, Mus musculus
gcaaggctggaaacatcccaaacca

SEQ ID NO: 528763 - DNA, 25 bp, Mus musculus
gcaaggctggaatcatcccaaacca

SEQ ID NO: 528764 - DNA, 25 bp, Mus musculus
gcaaggcttcacatcctaaaggtta

SEQ ID NO: 528765 - DNA, 25 bp, Mus musculus
gcaaggcttcacttcctaaaggtta

SEQ ID NO: 528766 - DNA, 25 bp, Mus musculus
gcaaggctttcgatcaacagttctt

SEQ ID NO: 528767 - DNA, 25 bp, Mus musculus
gcaaggctttcgttcaacagttctt

SEQ ID NO: 528768 - DNA, 25 bp, Mus musculus
gcaagggaacctcaagctacaaact

SEQ ID NO: 528769 - DNA, 25 bp, Mus musculus
gcaagggaacctgaagctacaaact

SEQ ID NO: 528770 - DNA, 25 bp, Mus musculus
gcaagggaagctaccccaaggttct

SEQ ID NO: 528771 - DNA, 25 bp, Mus musculus
gcaagggaagcttccccaaggttct

SEQ ID NO: 528772 - DNA, 25 bp, Mus musculus
gcaagggaccacacagcacaagggc

SEQ ID NO: 528773 - DNA, 25 bp, Mus musculus
gcaagggaccactcagcacaagggc

SEQ ID NO: 528774 - DNA, 25 bp, Mus musculus
gcaagggaccctactgctactctgg

SEQ ID NO: 528775 - DNA, 25 bp, Mus musculus
gcaagggacccttctgctactctgg

SEQ ID NO: 528776 - DNA, 25 bp, Mus musculus
gcaagggactataggtacgacgtat

SEQ ID NO: 528777 - DNA, 25 bp, Mus musculus
gcaagggactattggtacgacgtat

SEQ ID NO: 528778 - DNA, 25 bp, Mus musculus
gcaagggagtcaatcacttactgaa

SEQ ID NO: 528779 - DNA, 25 bp, Mus musculus
gcaagggagtcattcacttactgaa

SEQ ID NO: 528780 - DNA, 25 bp, Mus musculus
gcaagggatgttatccagaggtttt

SEQ ID NO: 528781 - DNA, 25 bp, Mus musculus
gcaagggatgttttccagaggtttt

SEQ ID NO: 528782 - DNA, 25 bp, Mus musculus
gcaagggatttgctggacctcctag

SEQ ID NO: 528783 - DNA, 25 bp, Mus musculus
gcaagggatttggtggacctcctag

SEQ ID NO: 528784 - DNA, 25 bp, Mus musculus
gcaagggcattgaggagcctccaga

SEQ ID NO: 528785 - DNA, 25 bp, Mus musculus
gcaagggcattgtggagcctccaga

SEQ ID NO: 528786 - DNA, 25 bp, Mus musculus
gcaagggccaagacttgccgcatca

SEQ ID NO: 528787 - DNA, 25 bp, Mus musculus
gcaagggccaagtcttgccgcatca

SEQ ID NO: 528788 - DNA, 25 bp, Mus musculus
gcaagggccctaaaatttcatacag

SEQ ID NO: 528789 - DNA, 25 bp, Mus musculus
gcaagggccctataatttcatacag

SEQ ID NO: 528790 - DNA, 25 bp, Mus musculus
gcaagggcgcagcaagcctgttcat

SEQ ID NO: 528791 - DNA, 25 bp, Mus musculus
gcaagggcgcaggaagcctgttcat

SEQ ID NO: 528792 - DNA, 25 bp, Mus musculus
gcaagggcgccgaagtcaaccagaa

SEQ ID NO: 528793 - DNA, 25 bp, Mus musculus
gcaagggcgccgtagtcaaccagaa

SEQ ID NO: 528794 - DNA, 25 bp, Mus musculus
gcaagggcggtaaaggtcttggcaa

SEQ ID NO: 528795 - DNA, 25 bp, Mus musculus
gcaagggcggtataggtcttggcaa

SEQ ID NO: 528796 - DNA, 25 bp, Mus musculus
gcaagggctattataactcttgtaa

SEQ ID NO: 528797 - DNA, 25 bp, Mus musculus
gcaagggctattttaactcttgtaa

SEQ ID NO: 528798 - DNA, 25 bp, Mus musculus
gcaagggctgaaagatggctccata

SEQ ID NO: 528799 - DNA, 25 bp, Mus musculus
gcaagggctgaatgatggctccata

SEQ ID NO: 528800 - DNA, 25 bp, Mus musculus
gcaaggggtataacagcagccaaat

SEQ ID NO: 528801 - DNA, 25 bp, Mus musculus
gcaaggggtatatcagcagccaaat

SEQ ID NO: 528802 - DNA, 25 bp, Mus musculus
gcaagggtacccaggtgcagaccaa

SEQ ID NO: 528803 - DNA, 25 bp, Mus musculus
gcaagggtaccctggtgcagaccaa

SEQ ID NO: 528804 - DNA, 25 bp, Mus musculus
gcaagggtacttaactgggcatctc

SEQ ID NO: 528805 - DNA, 25 bp, Mus musculus
gcaagggtactttactgggcatctc

SEQ ID NO: 528806 - DNA, 25 bp, Mus musculus
gcaagggtagatatgttacctggat

SEQ ID NO: 528807 - DNA, 25 bp, Mus musculus
gcaagggtagatttgttacctggat

SEQ ID NO: 528808 - DNA, 25 bp, Mus musculus
gcaagggtcaacacctcaggacatc

SEQ ID NO: 528809 - DNA, 25 bp, Mus musculus
gcaagggtcaactcctcaggacatc

SEQ ID NO: 528810 - DNA, 25 bp, Mus musculus
gcaagggtcattacgtcgctgggaa

SEQ ID NO: 528811 - DNA, 25 bp, Mus musculus
gcaagggtcatttcgtcgctgggaa

SEQ ID NO: 528812 - DNA, 25 bp, Mus musculus
gcaagggtccgaattgccatcgaaa

SEQ ID NO: 528813 - DNA, 25 bp, Mus musculus
gcaagggtccgatttgccatcgaaa

SEQ ID NO: 528814 - DNA, 25 bp, Mus musculus
gcaagggtctaacgcccctgggaca

SEQ ID NO: 528815 - DNA, 25 bp, Mus musculus
gcaagggtctaaggcccctgggaca

SEQ ID NO: 528816 - DNA, 25 bp, Mus musculus
gcaagggtctggactcccaggtgtt

SEQ ID NO: 528817 - DNA, 25 bp, Mus musculus
gcaagggtctggtctcccaggtgtt

SEQ ID NO: 528818 - DNA, 25 bp, Mus musculus
gcaagggtgcatcgttcgatcctat

SEQ ID NO: 528819 - DNA, 25 bp, Mus musculus
gcaagggtgcatggttcgatcctat

SEQ ID NO: 528820 - DNA, 25 bp, Mus musculus
gcaagggtgcttagatgccttcata

SEQ ID NO: 528821 - DNA, 25 bp, Mus musculus
gcaagggtgctttgatgccttcata

SEQ ID NO: 528822 - DNA, 25 bp, Mus musculus
gcaagggttcttctaaagtccccag

SEQ ID NO: 528823 - DNA, 25 bp, Mus musculus
gcaagggttcttgtaaagtccccag

SEQ ID NO: 528824 - DNA, 25 bp, Mus musculus
gcaagggtttgaaggcagccttccc

SEQ ID NO: 528825 - DNA, 25 bp, Mus musculus
gcaagggtttgatggcagccttccc

SEQ ID NO: 528826 - DNA, 25 bp, Mus musculus
gcaaggtacacaaggccagcattca

SEQ ID NO: 528827 - DNA, 25 bp, Mus musculus
gcaaggtacacatggccagcattca

SEQ ID NO: 528828 - DNA, 25 bp, Mus musculus
gcaaggtagactcggtttctcatcc

SEQ ID NO: 528829 - DNA, 25 bp, Mus musculus
gcaaggtagactgggtttctcatcc

SEQ ID NO: 528830 - DNA, 25 bp, Mus musculus
gcaaggtagggcagacagacacaga

SEQ ID NO: 528831 - DNA, 25 bp, Mus musculus
gcaaggtagggctgacagacacaga

SEQ ID NO: 528832 - DNA, 25 bp, Mus musculus
gcaaggtcaaagactgaatcagcct

SEQ ID NO: 528833 - DNA, 25 bp, Mus musculus
gcaaggtcaaagtctgaatcagcct

SEQ ID NO: 528834 - DNA, 25 bp, Mus musculus
gcaaggtcacaaaccagctgagcac

SEQ ID NO: 528835 - DNA, 25 bp, Mus musculus
gcaaggtcacaatccagctgagcac

SEQ ID NO: 528836 - DNA, 25 bp, Mus musculus
gcaaggtccaagctacaatcccagt

SEQ ID NO: 528837 - DNA, 25 bp, Mus musculus
gcaaggtccaaggtacaatcccagt

SEQ ID NO: 528838 - DNA, 25 bp, Mus musculus
gcaaggtccaggctttgttcccagt

SEQ ID NO: 528839 - DNA, 25 bp, Mus musculus
gcaaggtccagggtttgttcccagt

SEQ ID NO: 528840 - DNA, 25 bp, Mus musculus
gcaaggtccttaataaacctgactg

SEQ ID NO: 528841 - DNA, 25 bp, Mus musculus
gcaaggtccttattaaacctgactg

SEQ ID NO: 528842 - DNA, 25 bp, Mus musculus
gcaaggtcgttaacaccaggctaaa

SEQ ID NO: 528843 - DNA, 25 bp, Mus musculus
gcaaggtcgttatcaccaggctaaa

SEQ ID NO: 528844 - DNA, 25 bp, Mus musculus
gcaaggtctagtcaatccacaccag

SEQ ID NO: 528845 - DNA, 25 bp, Mus musculus
gcaaggtctagtgaatccacaccag

SEQ ID NO: 528846 - DNA, 25 bp, Mus musculus
gcaaggtctcccatgacatgttact

SEQ ID NO: 528847 - DNA, 25 bp, Mus musculus
gcaaggtctcccttgacatgttact

SEQ ID NO: 528848 - DNA, 25 bp, Mus musculus
gcaaggtctcggcaatttacagaac

SEQ ID NO: 528849 - DNA, 25 bp, Mus musculus
gcaaggtctcgggaatttacagaac

SEQ ID NO: 528850 - DNA, 25 bp, Mus musculus
gcaaggtgaatgagccccagaagaa

SEQ ID NO: 528851 - DNA, 25 bp, Mus musculus
gcaaggtgaatgtgccccagaagaa

SEQ ID NO: 528852 - DNA, 25 bp, Mus musculus
gcaaggtgagttagcatcacagcta

SEQ ID NO: 528853 - DNA, 25 bp, Mus musculus
gcaaggtgagtttgcatcacagcta

SEQ ID NO: 528854 - DNA, 25 bp, Mus musculus
gcaaggtgatctccagttctgttta

SEQ ID NO: 528855 - DNA, 25 bp, Mus musculus
gcaaggtgatctgcagttctgttta

SEQ ID NO: 528856 - DNA, 25 bp, Mus musculus
gcaaggtgcaccagttcacgctagt

SEQ ID NO: 528857 - DNA, 25 bp, Mus musculus
gcaaggtgcacctgttcacgctagt

SEQ ID NO: 528858 - DNA, 25 bp, Mus musculus
gcaaggtggaacactttagatcatt

SEQ ID NO: 528859 - DNA, 25 bp, Mus musculus
gcaaggtggaactctttagatcatt

SEQ ID NO: 528860 - DNA, 25 bp, Mus musculus
gcaaggtggccacgtcaacactgta

SEQ ID NO: 528861 - DNA, 25 bp, Mus musculus
gcaaggtggccaggtcaacactgta

SEQ ID NO: 528862 - DNA, 25 bp, Mus musculus
gcaaggtggcgcagatactgctcaa

SEQ ID NO: 528863 - DNA, 25 bp, Mus musculus
gcaaggtggcgctgatactgctcaa

SEQ ID NO: 528864 - DNA, 25 bp, Mus musculus
gcaaggtgggtccattttgttctcc

SEQ ID NO: 528865 - DNA, 25 bp, Mus musculus
gcaaggtgggtcgattttgttctcc

SEQ ID NO: 528866 - DNA, 25 bp, Mus musculus
gcaaggttacctctgctttttaatt

SEQ ID NO: 528867 - DNA, 25 bp, Mus musculus
gcaaggttacctgtgctttttaatt

SEQ ID NO: 528868 - DNA, 25 bp, Mus musculus
gcaaggttactaacagactcctggg

SEQ ID NO: 528869 - DNA, 25 bp, Mus musculus
gcaaggttactatcagactcctggg

SEQ ID NO: 528870 - DNA, 25 bp, Mus musculus
gcaaggttccacagactaagacatt

SEQ ID NO: 528871 - DNA, 25 bp, Mus musculus
gcaaggttccactgactaagacatt

SEQ ID NO: 528872 - DNA, 25 bp, Mus musculus
gcaaggttccttactactaaatggt

SEQ ID NO: 528873 - DNA, 25 bp, Mus musculus
gcaaggttcctttctactaaatggt

SEQ ID NO: 528874 - DNA, 25 bp, Mus musculus
gcaaggttctggatacactttattc

SEQ ID NO: 528875 - DNA, 25 bp, Mus musculus
gcaaggttctggttacactttattc

SEQ ID NO: 528876 - DNA, 25 bp, Mus musculus
gcaaggttgaaaactgagcacggat

SEQ ID NO: 528877 - DNA, 25 bp, Mus musculus
gcaaggttgaaatctgagcacggat

SEQ ID NO: 528878 - DNA, 25 bp, Mus musculus
gcaaggttggatctgccatgtgccc

SEQ ID NO: 528879 - DNA, 25 bp, Mus musculus
gcaaggttggatgtgccatgtgccc

SEQ ID NO: 528880 - DNA, 25 bp, Mus musculus
gcaaggtttgacacaccatagcata

SEQ ID NO: 528881 - DNA, 25 bp, Mus musculus
gcaaggtttgactcaccatagcata

SEQ ID NO: 528882 - DNA, 25 bp, Mus musculus
gcaaggtttgttctatattatgatc

SEQ ID NO: 528883 - DNA, 25 bp, Mus musculus
gcaaggtttgttgtatattatgatc

SEQ ID NO: 528884 - DNA, 25 bp, Mus musculus
gcaagtaaattgaactgtcccaata

SEQ ID NO: 528885 - DNA, 25 bp, Mus musculus
gcaagtaaattgtactgtcccaata

SEQ ID NO: 528886 - DNA, 25 bp, Mus musculus
gcaagtaacttgaacatccgaaaag

SEQ ID NO: 528887 - DNA, 25 bp, Mus musculus
gcaagtaacttgtacatccgaaaag

SEQ ID NO: 528888 - DNA, 25 bp, Mus musculus
gcaagtaaggtcaccgggttgcaac

SEQ ID NO: 528889 - DNA, 25 bp, Mus musculus
gcaagtaaggtctccgggttgcaac

SEQ ID NO: 528890 - DNA, 25 bp, Mus musculus
gcaagtaagtctatgctgcgtgttg

SEQ ID NO: 528891 - DNA, 25 bp, Mus musculus
gcaagtaagtctttgctgcgtgttg

SEQ ID NO: 528892 - DNA, 25 bp, Mus musculus
gcaagtaagttaaagccatcacatt

SEQ ID NO: 528893 - DNA, 25 bp, Mus musculus
gcaagtaagttatagccatcacatt

SEQ ID NO: 528894 - DNA, 25 bp, Mus musculus
gcaagtacaccaagtctggtcgtgg

SEQ ID NO: 528895 - DNA, 25 bp, Mus musculus
gcaagtacaccatgtctggtcgtgg

SEQ ID NO: 528896 - DNA, 25 bp, Mus musculus
gcaagtacactaatctgaactcaga

SEQ ID NO: 528897 - DNA, 25 bp, Mus musculus
gcaagtacactattctgaactcaga

SEQ ID NO: 528898 - DNA, 25 bp, Mus musculus
gcaagtacactcaggctgagggtaa

SEQ ID NO: 528899 - DNA, 25 bp, Mus musculus
gcaagtacactctggctgagggtaa

SEQ ID NO: 528900 - DNA, 25 bp, Mus musculus
gcaagtaccaccctatggagtatat

SEQ ID NO: 528901 - DNA, 25 bp, Mus musculus
gcaagtaccaccgtatggagtatat

SEQ ID NO: 528902 - DNA, 25 bp, Mus musculus
gcaagtacctgcctatggagtgtat

SEQ ID NO: 528903 - DNA, 25 bp, Mus musculus
gcaagtacctgcgtatggagtgtat

SEQ ID NO: 528904 - DNA, 25 bp, Mus musculus
gcaagtacctggctgtgcagactta

SEQ ID NO: 528905 - DNA, 25 bp, Mus musculus
gcaagtacctgggtgtgcagactta

SEQ ID NO: 528906 - DNA, 25 bp, Mus musculus
gcaagtacgaacaggacttctccca

SEQ ID NO: 528907 - DNA, 25 bp, Mus musculus
gcaagtacgaactggacttctccca

SEQ ID NO: 528908 - DNA, 25 bp, Mus musculus
gcaagtacggcgagaagtgccagtt

SEQ ID NO: 528909 - DNA, 25 bp, Mus musculus
gcaagtacggcgtgaagtgccagtt

SEQ ID NO: 528910 - DNA, 25 bp, Mus musculus
gcaagtactaccagcatcatttcaa

SEQ ID NO: 528911 - DNA, 25 bp, Mus musculus
gcaagtactacctgcatcatttcaa

SEQ ID NO: 528912 - DNA, 25 bp, Mus musculus
gcaagtactggcctgcctgtaaaaa

SEQ ID NO: 528913 - DNA, 25 bp, Mus musculus
gcaagtactggcgtgcctgtaaaaa

SEQ ID NO: 528914 - DNA, 25 bp, Mus musculus
gcaagtactgggatacagccaccct

SEQ ID NO: 528915 - DNA, 25 bp, Mus musculus
gcaagtactgggttacagccaccct

SEQ ID NO: 528916 - DNA, 25 bp, Mus musculus
gcaagtactttacctcgcagctgca

SEQ ID NO: 528917 - DNA, 25 bp, Mus musculus
gcaagtactttagctcgcagctgca

SEQ ID NO: 528918 - DNA, 25 bp, Mus musculus
gcaagtagaataccctctctgggtg

SEQ ID NO: 528919 - DNA, 25 bp, Mus musculus
gcaagtagaatagcctctctgggtg

SEQ ID NO: 528920 - DNA, 25 bp, Mus musculus
gcaagtagatacagagccatcccac

SEQ ID NO: 528921 - DNA, 25 bp, Mus musculus
gcaagtagatactgagccatcccac

SEQ ID NO: 528922 - DNA, 25 bp, Mus musculus
gcaagtagccagcatgccagcctaa

SEQ ID NO: 528923 - DNA, 25 bp, Mus musculus
gcaagtagccaggatgccagcctaa

SEQ ID NO: 528924 - DNA, 25 bp, Mus musculus
gcaagtagtcttcatttaccaacaa

SEQ ID NO: 528925 - DNA, 25 bp, Mus musculus
gcaagtagtcttgatttaccaacaa

SEQ ID NO: 528926 - DNA, 25 bp, Mus musculus
gcaagtagtgacagtacagcactca

SEQ ID NO: 528927 - DNA, 25 bp, Mus musculus
gcaagtagtgactgtacagcactca

SEQ ID NO: 528928 - DNA, 25 bp, Mus musculus
gcaagtagttgcatcacttctggat

SEQ ID NO: 528929 - DNA, 25 bp, Mus musculus
gcaagtagttgcttcacttctggat

SEQ ID NO: 528930 - DNA, 25 bp, Mus musculus
gcaagtatattcactttagcactag

SEQ ID NO: 528931 - DNA, 25 bp, Mus musculus
gcaagtatattctctttagcactag

SEQ ID NO: 528932 - DNA, 25 bp, Mus musculus
gcaagtatcagtaagacccaggaga

SEQ ID NO: 528933 - DNA, 25 bp, Mus musculus
gcaagtatcagttagacccaggaga

SEQ ID NO: 528934 - DNA, 25 bp, Mus musculus
gcaagtatctgtacaatgttaagcc

SEQ ID NO: 528935 - DNA, 25 bp, Mus musculus
gcaagtatctgttcaatgttaagcc

SEQ ID NO: 528936 - DNA, 25 bp, Mus musculus
gcaagtatgctgcagttttatccag

SEQ ID NO: 528937 - DNA, 25 bp, Mus musculus
gcaagtatgctggagttttatccag

SEQ ID NO: 528938 - DNA, 25 bp, Mus musculus
gcaagtatgggcagttcagcggcct

SEQ ID NO: 528939 - DNA, 25 bp, Mus musculus
gcaagtatgggctgttcagcggcct

SEQ ID NO: 528940 - DNA, 25 bp, Mus musculus
gcaagtatggtcaaacttcccgtgt

SEQ ID NO: 528941 - DNA, 25 bp, Mus musculus
gcaagtatggtctaacttcccgtgt

SEQ ID NO: 528942 - DNA, 25 bp, Mus musculus
gcaagtattctccactgagctacat

SEQ ID NO: 528943 - DNA, 25 bp, Mus musculus
gcaagtattctcgactgagctacat

SEQ ID NO: 528944 - DNA, 25 bp, Mus musculus
gcaagtattctgcttatctagtaac

SEQ ID NO: 528945 - DNA, 25 bp, Mus musculus
gcaagtattctggttatctagtaac

SEQ ID NO: 528946 - DNA, 25 bp, Mus musculus
gcaagtattgatcctgagcttcaga

SEQ ID NO: 528947 - DNA, 25 bp, Mus musculus
gcaagtattgatgctgagcttcaga

SEQ ID NO: 528948 - DNA, 25 bp, Mus musculus
gcaagtcaaatcatgatgtttttgt

SEQ ID NO: 528949 - DNA, 25 bp, Mus musculus
gcaagtcaaatcttgatgtttttgt

SEQ ID NO: 528950 - DNA, 25 bp, Mus musculus
gcaagtcaacaccaagttctgtttt

SEQ ID NO: 528951 - DNA, 25 bp, Mus musculus
gcaagtcaacacgaagttctgtttt

SEQ ID NO: 528952 - DNA, 25 bp, Mus musculus
gcaagtcaagtgagccaactgcttt

SEQ ID NO: 528953 - DNA, 25 bp, Mus musculus
gcaagtcaagtgtgccaactgcttt

SEQ ID NO: 528954 - DNA, 25 bp, Mus musculus
gcaagtcaatccacaagtctcgcag

SEQ ID NO: 528955 - DNA, 25 bp, Mus musculus
gcaagtcaatcctcaagtctcgcag

SEQ ID NO: 528956 - DNA, 25 bp, Mus musculus
gcaagtcacaaaccgccgggtcacg

SEQ ID NO: 528957 - DNA, 25 bp, Mus musculus
gcaagtcacaaagcgccgggtcacg

SEQ ID NO: 528958 - DNA, 25 bp, Mus musculus
gcaagtcacatcacattcagcatca

SEQ ID NO: 528959 - DNA, 25 bp, Mus musculus
gcaagtcacatctcattcagcatca

SEQ ID NO: 528960 - DNA, 25 bp, Mus musculus
gcaagtcacccaacacagatgctgg

SEQ ID NO: 528961 - DNA, 25 bp, Mus musculus
gcaagtcacccatcacagatgctgg

SEQ ID NO: 528962 - DNA, 25 bp, Mus musculus
gcaagtcactgaaagccgcagaaac

SEQ ID NO: 528963 - DNA, 25 bp, Mus musculus
gcaagtcactgatagccgcagaaac

SEQ ID NO: 528964 - DNA, 25 bp, Mus musculus
gcaagtcacttgacaacccgtgctg

SEQ ID NO: 528965 - DNA, 25 bp, Mus musculus
gcaagtcacttgtcaacccgtgctg

SEQ ID NO: 528966 - DNA, 25 bp, Mus musculus
gcaagtcactttcgtaccattcctg

SEQ ID NO: 528967 - DNA, 25 bp, Mus musculus
gcaagtcactttggtaccattcctg

SEQ ID NO: 528968 - DNA, 25 bp, Mus musculus
gcaagtcagacaacggcaggttcct

SEQ ID NO: 528969 - DNA, 25 bp, Mus musculus
gcaagtcagacatcggcaggttcct

SEQ ID NO: 528970 - DNA, 25 bp, Mus musculus
gcaagtcagacgagcctgtctatga

SEQ ID NO: 528971 - DNA, 25 bp, Mus musculus
gcaagtcagacgtgcctgtctatga

SEQ ID NO: 528972 - DNA, 25 bp, Mus musculus
gcaagtcagtcacagacggcgttta

SEQ ID NO: 528973 - DNA, 25 bp, Mus musculus
gcaagtcagtcagagacggcgttta

SEQ ID NO: 528974 - DNA, 25 bp, Mus musculus
gcaagtcagttgctgtctacacaat

SEQ ID NO: 528975 - DNA, 25 bp, Mus musculus
gcaagtcagttggtgtctacacaat

SEQ ID NO: 528976 - DNA, 25 bp, Mus musculus
gcaagtcatcaacctgcaaaatgct

SEQ ID NO: 528977 - DNA, 25 bp, Mus musculus
gcaagtcatcaagctgcaaaatgct

SEQ ID NO: 528978 - DNA, 25 bp, Mus musculus
gcaagtcatccaagtcattccttag

SEQ ID NO: 528979 - DNA, 25 bp, Mus musculus
gcaagtcatccatgtcattccttag

SEQ ID NO: 528980 - DNA, 25 bp, Mus musculus
gcaagtcattgcctttttaaccata

SEQ ID NO: 528981 - DNA, 25 bp, Mus musculus
gcaagtcattgcgtttttaaccata

SEQ ID NO: 528982 - DNA, 25 bp, Mus musculus
gcaagtcattggagctgtgcaaggc

SEQ ID NO: 528983 - DNA, 25 bp, Mus musculus
gcaagtcattggtgctgtgcaaggc

SEQ ID NO: 528984 - DNA, 25 bp, Mus musculus
gcaagtccaatcagtccaagcatca

SEQ ID NO: 528985 - DNA, 25 bp, Mus musculus
gcaagtccaatctgtccaagcatca

SEQ ID NO: 528986 - DNA, 25 bp, Mus musculus
gcaagtccacgtagagcgccaggcc

SEQ ID NO: 528987 - DNA, 25 bp, Mus musculus
gcaagtccacgttgagcgccaggcc

SEQ ID NO: 528988 - DNA, 25 bp, Mus musculus
gcaagtccacttacatccaggagca

SEQ ID NO: 528989 - DNA, 25 bp, Mus musculus
gcaagtccactttcatccaggagca

SEQ ID NO: 528990 - DNA, 25 bp, Mus musculus
gcaagtccagcaccctagaggtaaa

SEQ ID NO: 528991 - DNA, 25 bp, Mus musculus
gcaagtccagcagcctagaggtaaa

SEQ ID NO: 528992 - DNA, 25 bp, Mus musculus
gcaagtccatttctgctcagtgtat

SEQ ID NO: 528993 - DNA, 25 bp, Mus musculus
gcaagtccatttgtgctcagtgtat

SEQ ID NO: 528994 - DNA, 25 bp, Mus musculus
gcaagtcccagcattcacaatgggt

SEQ ID NO: 528995 - DNA, 25 bp, Mus musculus
gcaagtcccagctttcacaatgggt

SEQ ID NO: 528996 - DNA, 25 bp, Mus musculus
gcaagtccccacagtcctgatgatg

SEQ ID NO: 528997 - DNA, 25 bp, Mus musculus
gcaagtccccactgtcctgatgatg

SEQ ID NO: 528998 - DNA, 25 bp, Mus musculus
gcaagtcccgttctggtagtaggtc

SEQ ID NO: 528999 - DNA, 25 bp, Mus musculus
gcaagtcccgttgtggtagtaggtc

SEQ ID NO: 529000 - DNA, 25 bp, Mus musculus
gcaagtccctatattgttaacagtt

SEQ ID NO: 529001 - DNA, 25 bp, Mus musculus
gcaagtccctattttgttaacagtt

SEQ ID NO: 529002 - DNA, 25 bp, Mus musculus
gcaagtccgtaacagtttagaaaca

SEQ ID NO: 529003 - DNA, 25 bp, Mus musculus
gcaagtccgtaagagtttagaaaca

SEQ ID NO: 529004 - DNA, 25 bp, Mus musculus
gcaagtccttgcagacatcagacga

SEQ ID NO: 529005 - DNA, 25 bp, Mus musculus
gcaagtccttgctgacatcagacga

SEQ ID NO: 529006 - DNA, 25 bp, Mus musculus
gcaagtccttggatcttatgcacga

SEQ ID NO: 529007 - DNA, 25 bp, Mus musculus
gcaagtccttggttcttatgcacga

SEQ ID NO: 529008 - DNA, 25 bp, Mus musculus
gcaagtcggtggctattccccagct

SEQ ID NO: 529009 - DNA, 25 bp, Mus musculus
gcaagtcggtgggtattccccagct

SEQ ID NO: 529010 - DNA, 25 bp, Mus musculus
gcaagtcgtattactccaaaggccg

SEQ ID NO: 529011 - DNA, 25 bp, Mus musculus
gcaagtcgtatttctccaaaggccg

SEQ ID NO: 529012 - DNA, 25 bp, Mus musculus
gcaagtctacagatagatcccagca

SEQ ID NO: 529013 - DNA, 25 bp, Mus musculus
gcaagtctacagttagatcccagca

SEQ ID NO: 529014 - DNA, 25 bp, Mus musculus
gcaagtctactaaggccatgggata

SEQ ID NO: 529015 - DNA, 25 bp, Mus musculus
gcaagtctactatggccatgggata

SEQ ID NO: 529016 - DNA, 25 bp, Mus musculus
gcaagtctactccaacaaacctggg

SEQ ID NO: 529017 - DNA, 25 bp, Mus musculus
gcaagtctactcgaacaaacctggg

SEQ ID NO: 529018 - DNA, 25 bp, Mus musculus
gcaagtctagtgcattattgtccag

SEQ ID NO: 529019 - DNA, 25 bp, Mus musculus
gcaagtctagtggattattgtccag

SEQ ID NO: 529020 - DNA, 25 bp, Mus musculus
gcaagtctatgcacaagcacctttc

SEQ ID NO: 529021 - DNA, 25 bp, Mus musculus
gcaagtctatgctcaagcacctttc

SEQ ID NO: 529022 - DNA, 25 bp, Mus musculus
gcaagtctcaagctgcctgggcaaa

SEQ ID NO: 529023 - DNA, 25 bp, Mus musculus
gcaagtctcaaggtgcctgggcaaa

SEQ ID NO: 529024 - DNA, 25 bp, Mus musculus
gcaagtctcactctataatagccac

SEQ ID NO: 529025 - DNA, 25 bp, Mus musculus
gcaagtctcactgtataatagccac

SEQ ID NO: 529026 - DNA, 25 bp, Mus musculus
gcaagtctccaactgttagcaacat

SEQ ID NO: 529027 - DNA, 25 bp, Mus musculus
gcaagtctccaagtgttagcaacat

SEQ ID NO: 529028 - DNA, 25 bp, Mus musculus
gcaagtctcgctcgtttctctgtat

SEQ ID NO: 529029 - DNA, 25 bp, Mus musculus
gcaagtctcgctggtttctctgtat

SEQ ID NO: 529030 - DNA, 25 bp, Mus musculus
gcaagtctctccaccatgaaaaggg

SEQ ID NO: 529031 - DNA, 25 bp, Mus musculus
gcaagtctctcctccatgaaaaggg

SEQ ID NO: 529032 - DNA, 25 bp, Mus musculus
gcaagtctgcatccaaacccattgg

SEQ ID NO: 529033 - DNA, 25 bp, Mus musculus
gcaagtctgcatgcaaacccattgg

SEQ ID NO: 529034 - DNA, 25 bp, Mus musculus
gcaagtctggcactagcccgacaga

SEQ ID NO: 529035 - DNA, 25 bp, Mus musculus
gcaagtctggcagtagcccgacaga

SEQ ID NO: 529036 - DNA, 25 bp, Mus musculus
gcaagtctgggtacactgagagtcc

SEQ ID NO: 529037 - DNA, 25 bp, Mus musculus
gcaagtctgggttcactgagagtcc

SEQ ID NO: 529038 - DNA, 25 bp, Mus musculus
gcaagtctgtgtacacccagcaaat

SEQ ID NO: 529039 - DNA, 25 bp, Mus musculus
gcaagtctgtgttcacccagcaaat

SEQ ID NO: 529040 - DNA, 25 bp, Mus musculus
gcaagtcttagcactatcaggtttc

SEQ ID NO: 529041 - DNA, 25 bp, Mus musculus
gcaagtcttagctctatcaggtttc

SEQ ID NO: 529042 - DNA, 25 bp, Mus musculus
gcaagtcttagtagcctaggtcaag

SEQ ID NO: 529043 - DNA, 25 bp, Mus musculus
gcaagtcttagttgcctaggtcaag

SEQ ID NO: 529044 - DNA, 25 bp, Mus musculus
gcaagtcttcatatttgtttccaac

SEQ ID NO: 529045 - DNA, 25 bp, Mus musculus
gcaagtcttcatttttgtttccaac

SEQ ID NO: 529046 - DNA, 25 bp, Mus musculus
gcaagtcttcttacatgaaccacag

SEQ ID NO: 529047 - DNA, 25 bp, Mus musculus
gcaagtcttctttcatgaaccacag

SEQ ID NO: 529048 - DNA, 25 bp, Mus musculus
gcaagtcttgagcttctggaaggta

SEQ ID NO: 529049 - DNA, 25 bp, Mus musculus
gcaagtcttgaggttctggaaggta

SEQ ID NO: 529050 - DNA, 25 bp, Mus musculus
gcaagtcttgctatagcagcctcca

SEQ ID NO: 529051 - DNA, 25 bp, Mus musculus
gcaagtcttgctttagcagcctcca

SEQ ID NO: 529052 - DNA, 25 bp, Mus musculus
gcaagtctttgcacatcttcaattg

SEQ ID NO: 529053 - DNA, 25 bp, Mus musculus
gcaagtctttgctcatcttcaattg

SEQ ID NO: 529054 - DNA, 25 bp, Mus musculus
gcaagtgaactaagaccattccctt

SEQ ID NO: 529055 - DNA, 25 bp, Mus musculus
gcaagtgaactatgaccattccctt

SEQ ID NO: 529056 - DNA, 25 bp, Mus musculus
gcaagtgaatcactgagttcaggac

SEQ ID NO: 529057 - DNA, 25 bp, Mus musculus
gcaagtgaatcagtgagttcaggac

SEQ ID NO: 529058 - DNA, 25 bp, Mus musculus
gcaagtgaatctatctgccacatgt

SEQ ID NO: 529059 - DNA, 25 bp, Mus musculus
gcaagtgaatctttctgccacatgt

SEQ ID NO: 529060 - DNA, 25 bp, Mus musculus
gcaagtgacactcgctcagaagtat

SEQ ID NO: 529061 - DNA, 25 bp, Mus musculus
gcaagtgacactctggacctcggtc

SEQ ID NO: 529062 - DNA, 25 bp, Mus musculus
gcaagtgacactggctcagaagtat

SEQ ID NO: 529063 - DNA, 25 bp, Mus musculus
gcaagtgacactgtggacctcggtc

SEQ ID NO: 529064 - DNA, 25 bp, Mus musculus
gcaagtgacattcttcctggtgggt

SEQ ID NO: 529065 - DNA, 25 bp, Mus musculus
gcaagtgacattgttcctggtgggt

SEQ ID NO: 529066 - DNA, 25 bp, Mus musculus
gcaagtgaccagagacttcacccgt

SEQ ID NO: 529067 - DNA, 25 bp, Mus musculus
gcaagtgaccagtgacttcacccgt

SEQ ID NO: 529068 - DNA, 25 bp, Mus musculus
gcaagtgacgatcgcggagactccc

SEQ ID NO: 529069 - DNA, 25 bp, Mus musculus
gcaagtgacgatggcggagactccc

SEQ ID NO: 529070 - DNA, 25 bp, Mus musculus
gcaagtgagaccctgcaggcacaga

SEQ ID NO: 529071 - DNA, 25 bp, Mus musculus
gcaagtgagaccgtgcaggcacaga

SEQ ID NO: 529072 - DNA, 25 bp, Mus musculus
gcaagtgagactacctaactgtaca

SEQ ID NO: 529073 - DNA, 25 bp, Mus musculus
gcaagtgagacttcctaactgtaca

SEQ ID NO: 529074 - DNA, 25 bp, Mus musculus
gcaagtgagctgaggtctcccggcc

SEQ ID NO: 529075 - DNA, 25 bp, Mus musculus
gcaagtgagctgtggtctcccggcc

SEQ ID NO: 529076 - DNA, 25 bp, Mus musculus
gcaagtgaggcccctaccggtcgtt

SEQ ID NO: 529077 - DNA, 25 bp, Mus musculus
gcaagtgaggccgctaccggtcgtt

SEQ ID NO: 529078 - DNA, 25 bp, Mus musculus
gcaagtgagggcctacagtttccca

SEQ ID NO: 529079 - DNA, 25 bp, Mus musculus
gcaagtgagggcgtacagtttccca

SEQ ID NO: 529080 - DNA, 25 bp, Mus musculus
gcaagtgatcagagtttgacagccc

SEQ ID NO: 529081 - DNA, 25 bp, Mus musculus
gcaagtgatcagtgtttgacagccc

SEQ ID NO: 529082 - DNA, 25 bp, Mus musculus
gcaagtgattaaccctttccagagc

SEQ ID NO: 529083 - DNA, 25 bp, Mus musculus
gcaagtgattaagcctttccagagc

SEQ ID NO: 529084 - DNA, 25 bp, Mus musculus
gcaagtgcaacaccagcagcgacac

SEQ ID NO: 529085 - DNA, 25 bp, Mus musculus
gcaagtgcaacagcagcagcgacac

SEQ ID NO: 529086 - DNA, 25 bp, Mus musculus
gcaagtgcaggcagctacagaccag

SEQ ID NO: 529087 - DNA, 25 bp, Mus musculus
gcaagtgcaggctgctacagaccag

SEQ ID NO: 529088 - DNA, 25 bp, Mus musculus
gcaagtgcagggatcgccaaaggat

SEQ ID NO: 529089 - DNA, 25 bp, Mus musculus
gcaagtgcagggttcgccaaaggat

SEQ ID NO: 529090 - DNA, 25 bp, Mus musculus
gcaagtgccactacaatcagtatgg

SEQ ID NO: 529091 - DNA, 25 bp, Mus musculus
gcaagtgccacttcaatcagtatgg

SEQ ID NO: 529092 - DNA, 25 bp, Mus musculus
gcaagtgcccatcgtagagatcgac

SEQ ID NO: 529093 - DNA, 25 bp, Mus musculus
gcaagtgcccatggtagagatcgac

SEQ ID NO: 529094 - DNA, 25 bp, Mus musculus
gcaagtgcctccagatcaagttgct

SEQ ID NO: 529095 - DNA, 25 bp, Mus musculus
gcaagtgcctcctgatcaagttgct

SEQ ID NO: 529096 - DNA, 25 bp, Mus musculus
gcaagtgcctggagctcatccgaat

SEQ ID NO: 529097 - DNA, 25 bp, Mus musculus
gcaagtgcctggtgctcatccgaat

SEQ ID NO: 529098 - DNA, 25 bp, Mus musculus
gcaagtgccttgctatgtgtacttc

SEQ ID NO: 529099 - DNA, 25 bp, Mus musculus
gcaagtgccttggtatgtgtacttc

SEQ ID NO: 529100 - DNA, 25 bp, Mus musculus
gcaagtgcctttaccgtcatgctta

SEQ ID NO: 529101 - DNA, 25 bp, Mus musculus
gcaagtgccttttccgtcatgctta

SEQ ID NO: 529102 - DNA, 25 bp, Mus musculus
gcaagtgctactatggcatgaacac

SEQ ID NO: 529103 - DNA, 25 bp, Mus musculus
gcaagtgctactttggcatgaacac

SEQ ID NO: 529104 - DNA, 25 bp, Mus musculus
gcaagtgctataatcctagtcagat

SEQ ID NO: 529105 - DNA, 25 bp, Mus musculus
gcaagtgctatattcctagtcagat

SEQ ID NO: 529106 - DNA, 25 bp, Mus musculus
gcaagtgctcataaactgtcgcaac

SEQ ID NO: 529107 - DNA, 25 bp, Mus musculus
gcaagtgctcattaactgtcgcaac

SEQ ID NO: 529108 - DNA, 25 bp, Mus musculus
gcaagtgctggtacctgaatcgact

SEQ ID NO: 529109 - DNA, 25 bp, Mus musculus
gcaagtgctggttcctgaatcgact

SEQ ID NO: 529110 - DNA, 25 bp, Mus musculus
gcaagtgctgtactgctgagacaaa

SEQ ID NO: 529111 - DNA, 25 bp, Mus musculus
gcaagtgctgtagtgctgagacaaa

SEQ ID NO: 529112 - DNA, 25 bp, Mus musculus
gcaagtgctgtgaggagtcttctca

SEQ ID NO: 529113 - DNA, 25 bp, Mus musculus
gcaagtgctgtgtggagtcttctca

SEQ ID NO: 529114 - DNA, 25 bp, Mus musculus
gcaagtgcttctaggcggactgtta

SEQ ID NO: 529115 - DNA, 25 bp, Mus musculus
gcaagtgcttcttggcggactgtta

SEQ ID NO: 529116 - DNA, 25 bp, Mus musculus
gcaagtgcttgcatagggctagata

SEQ ID NO: 529117 - DNA, 25 bp, Mus musculus
gcaagtgcttgcttagggctagata

SEQ ID NO: 529118 - DNA, 25 bp, Mus musculus
gcaagtgctttcctggcattcgtga

SEQ ID NO: 529119 - DNA, 25 bp, Mus musculus
gcaagtgctttcgtggcattcgtga

SEQ ID NO: 529120 - DNA, 25 bp, Mus musculus
gcaagtgcttttaatactatgcata

SEQ ID NO: 529121 - DNA, 25 bp, Mus musculus
gcaagtgctttttatactatgcata

SEQ ID NO: 529122 - DNA, 25 bp, Mus musculus
gcaagtggaatgataccctgtgggt

SEQ ID NO: 529123 - DNA, 25 bp, Mus musculus
gcaagtggaatgttaccctgtgggt

SEQ ID NO: 529124 - DNA, 25 bp, Mus musculus
gcaagtggatcaatcgactccggaa

SEQ ID NO: 529125 - DNA, 25 bp, Mus musculus
gcaagtggatcattcgactccggaa

SEQ ID NO: 529126 - DNA, 25 bp, Mus musculus
gcaagtggcacactatgatggagta

SEQ ID NO: 529127 - DNA, 25 bp, Mus musculus
gcaagtggcacagtatgatggagta

SEQ ID NO: 529128 - DNA, 25 bp, Mus musculus
gcaagtggccaacaccctggtgtat

SEQ ID NO: 529129 - DNA, 25 bp, Mus musculus
gcaagtggccaagaccctggtgtat

SEQ ID NO: 529130 - DNA, 25 bp, Mus musculus
gcaagtggcgcacctcaagcagaag

SEQ ID NO: 529131 - DNA, 25 bp, Mus musculus
gcaagtggcgcagctcaagcagaag

SEQ ID NO: 529132 - DNA, 25 bp, Mus musculus
gcaagtggctggatggttttcgaaa

SEQ ID NO: 529133 - DNA, 25 bp, Mus musculus
gcaagtggctggttggttttcgaaa

SEQ ID NO: 529134 - DNA, 25 bp, Mus musculus
gcaagtggcttaagggtgcctgcta

SEQ ID NO: 529135 - DNA, 25 bp, Mus musculus
gcaagtggcttatgggtgcctgcta

SEQ ID NO: 529136 - DNA, 25 bp, Mus musculus
gcaagtggcttcacaaagagctcta

SEQ ID NO: 529137 - DNA, 25 bp, Mus musculus
gcaagtggcttctcaaagagctcta

SEQ ID NO: 529138 - DNA, 25 bp, Mus musculus
gcaagtgggaccacagcaaacacag

SEQ ID NO: 529139 - DNA, 25 bp, Mus musculus
gcaagtgggacctcagcaaacacag

SEQ ID NO: 529140 - DNA, 25 bp, Mus musculus
gcaagtgggattctttcttcgtaca

SEQ ID NO: 529141 - DNA, 25 bp, Mus musculus
gcaagtgggattgtttcttcgtaca

SEQ ID NO: 529142 - DNA, 25 bp, Mus musculus
gcaagtgggtgtctagtttttacta

SEQ ID NO: 529143 - DNA, 25 bp, Mus musculus
gcaagtgggtgtgtagtttttacta

SEQ ID NO: 529144 - DNA, 25 bp, Mus musculus
gcaagtggtatccttgagcatccct

SEQ ID NO: 529145 - DNA, 25 bp, Mus musculus
gcaagtggtatcgttgagcatccct

SEQ ID NO: 529146 - DNA, 25 bp, Mus musculus
gcaagtggtccacagttctatatgt

SEQ ID NO: 529147 - DNA, 25 bp, Mus musculus
gcaagtggtccagagttctatatgt

SEQ ID NO: 529148 - DNA, 25 bp, Mus musculus
gcaagtggtgtgagataacctctta

SEQ ID NO: 529149 - DNA, 25 bp, Mus musculus
gcaagtggtgtgtgataacctctta

SEQ ID NO: 529150 - DNA, 25 bp, Mus musculus
gcaagtgtacctcaacggcgagttt

SEQ ID NO: 529151 - DNA, 25 bp, Mus musculus
gcaagtgtacctgaacggcgagttt

SEQ ID NO: 529152 - DNA, 25 bp, Mus musculus
gcaagtgtactaaaaactgtctgta

SEQ ID NO: 529153 - DNA, 25 bp, Mus musculus
gcaagtgtactataaactgtctgta

SEQ ID NO: 529154 - DNA, 25 bp, Mus musculus
gcaagtgtagccatcgcctccgggc

SEQ ID NO: 529155 - DNA, 25 bp, Mus musculus
gcaagtgtagccttcgcctccgggc

SEQ ID NO: 529156 - DNA, 25 bp, Mus musculus
gcaagtgtaggcacatacccaggtt

SEQ ID NO: 529157 - DNA, 25 bp, Mus musculus
gcaagtgtaggctcatacccaggtt

SEQ ID NO: 529158 - DNA, 25 bp, Mus musculus
gcaagtgtagttctcaccaccctgg

SEQ ID NO: 529159 - DNA, 25 bp, Mus musculus
gcaagtgtagttgtcaccaccctgg

SEQ ID NO: 529160 - DNA, 25 bp, Mus musculus
gcaagtgtcaataaacctcaagttt

SEQ ID NO: 529161 - DNA, 25 bp, Mus musculus
gcaagtgtcaattaacctcaagttt

SEQ ID NO: 529162 - DNA, 25 bp, Mus musculus
gcaagtgtcacacaagtattcaata

SEQ ID NO: 529163 - DNA, 25 bp, Mus musculus
gcaagtgtcacagaagtattcaata

SEQ ID NO: 529164 - DNA, 25 bp, Mus musculus
gcaagtgtcagcacagagacccgag

SEQ ID NO: 529165 - DNA, 25 bp, Mus musculus
gcaagtgtcagctcagagacccgag

SEQ ID NO: 529166 - DNA, 25 bp, Mus musculus
gcaagtgtcctgaaacatatccaac

SEQ ID NO: 529167 - DNA, 25 bp, Mus musculus
gcaagtgtcctgtaacatatccaac

SEQ ID NO: 529168 - DNA, 25 bp, Mus musculus
gcaagtgtgataactcagggtacat

SEQ ID NO: 529169 - DNA, 25 bp, Mus musculus
gcaagtgtgatatctcagggtacat

SEQ ID NO: 529170 - DNA, 25 bp, Mus musculus
gcaagtgtggccatggtactaagga

SEQ ID NO: 529171 - DNA, 25 bp, Mus musculus
gcaagtgtggccttggtactaagga

SEQ ID NO: 529172 - DNA, 25 bp, Mus musculus
gcaagtgtgtctactcccactgtct

SEQ ID NO: 529173 - DNA, 25 bp, Mus musculus
gcaagtgtgtcttctcccactgtct

SEQ ID NO: 529174 - DNA, 25 bp, Mus musculus
gcaagtgttactaaagttgtatctt

SEQ ID NO: 529175 - DNA, 25 bp, Mus musculus
gcaagtgttacttaagttgtatctt

SEQ ID NO: 529176 - DNA, 25 bp, Mus musculus
gcaagtgttcacctgtgttctttta

SEQ ID NO: 529177 - DNA, 25 bp, Mus musculus
gcaagtgttcacgtgtgttctttta

SEQ ID NO: 529178 - DNA, 25 bp, Mus musculus
gcaagtgttcttccacaacatcctt

SEQ ID NO: 529179 - DNA, 25 bp, Mus musculus
gcaagtgttcttctctcttgaagat

SEQ ID NO: 529180 - DNA, 25 bp, Mus musculus
gcaagtgttcttgcacaacatcctt

SEQ ID NO: 529181 - DNA, 25 bp, Mus musculus
gcaagtgttcttgtctcttgaagat

SEQ ID NO: 529182 - DNA, 25 bp, Mus musculus
gcaagtgttgagatccttaatgtat

SEQ ID NO: 529183 - DNA, 25 bp, Mus musculus
gcaagtgttgagttccttaatgtat

SEQ ID NO: 529184 - DNA, 25 bp, Mus musculus
gcaagtgttttcagtggaacccctt

SEQ ID NO: 529185 - DNA, 25 bp, Mus musculus
gcaagtgttttctgtggaacccctt

SEQ ID NO: 529186 - DNA, 25 bp, Mus musculus
gcaagttaaaccagagattcccaca

SEQ ID NO: 529187 - DNA, 25 bp, Mus musculus
gcaagttaaacctgagattcccaca

SEQ ID NO: 529188 - DNA, 25 bp, Mus musculus
gcaagttacgtaattggtctcagta

SEQ ID NO: 529189 - DNA, 25 bp, Mus musculus
gcaagttacgtatttggtctcagta

SEQ ID NO: 529190 - DNA, 25 bp, Mus musculus
gcaagttactcacagcaaccgcata

SEQ ID NO: 529191 - DNA, 25 bp, Mus musculus
gcaagttactcagagcaaccgcata

SEQ ID NO: 529192 - DNA, 25 bp, Mus musculus
gcaagttagcaactatatctgatta

SEQ ID NO: 529193 - DNA, 25 bp, Mus musculus
gcaagttagcaagtatatctgatta

SEQ ID NO: 529194 - DNA, 25 bp, Mus musculus
gcaagttagcttagagaaccctcct

SEQ ID NO: 529195 - DNA, 25 bp, Mus musculus
gcaagttagctttgagaaccctcct

SEQ ID NO: 529196 - DNA, 25 bp, Mus musculus
gcaagttatattacacctaagcata

SEQ ID NO: 529197 - DNA, 25 bp, Mus musculus
gcaagttatatttcacctaagcata

SEQ ID NO: 529198 - DNA, 25 bp, Mus musculus
gcaagttatccaacacaacaccatc

SEQ ID NO: 529199 - DNA, 25 bp, Mus musculus
gcaagttatccatcacaacaccatc

SEQ ID NO: 529200 - DNA, 25 bp, Mus musculus
gcaagttatttcagtagcatcccca

SEQ ID NO: 529201 - DNA, 25 bp, Mus musculus
gcaagttatttctgtagcatcccca

SEQ ID NO: 529202 - DNA, 25 bp, Mus musculus
gcaagttcaatgaccgtgcgacctg

SEQ ID NO: 529203 - DNA, 25 bp, Mus musculus
gcaagttcaatgtccgtgcgacctg

SEQ ID NO: 529204 - DNA, 25 bp, Mus musculus
gcaagttcacacaggactctacaga

SEQ ID NO: 529205 - DNA, 25 bp, Mus musculus
gcaagttcacactggactctacaga

SEQ ID NO: 529206 - DNA, 25 bp, Mus musculus
gcaagttcacagaggtcctcaagac

SEQ ID NO: 529207 - DNA, 25 bp, Mus musculus
gcaagttcacagtggtcctcaagac

SEQ ID NO: 529208 - DNA, 25 bp, Mus musculus
gcaagttcagctccaagcaactcaa

SEQ ID NO: 529209 - DNA, 25 bp, Mus musculus
gcaagttcagctgcaagcaactcaa

SEQ ID NO: 529210 - DNA, 25 bp, Mus musculus
gcaagttcatcacccacatcaagtg

SEQ ID NO: 529211 - DNA, 25 bp, Mus musculus
gcaagttcatcagccacatcaagtg

SEQ ID NO: 529212 - DNA, 25 bp, Mus musculus
gcaagttcatgaaacccgggaaagt

SEQ ID NO: 529213 - DNA, 25 bp, Mus musculus
gcaagttcatgatacccgggaaagt

SEQ ID NO: 529214 - DNA, 25 bp, Mus musculus
gcaagttccaagagattctgaccga

SEQ ID NO: 529215 - DNA, 25 bp, Mus musculus
gcaagttccaagtgattctgaccga

SEQ ID NO: 529216 - DNA, 25 bp, Mus musculus
gcaagttcctgcatctgggacagct

SEQ ID NO: 529217 - DNA, 25 bp, Mus musculus
gcaagttcctgcttctgggacagct

SEQ ID NO: 529218 - DNA, 25 bp, Mus musculus
gcaagttccttgcagttatgcagta

SEQ ID NO: 529219 - DNA, 25 bp, Mus musculus
gcaagttccttggagttatgcagta

SEQ ID NO: 529220 - DNA, 25 bp, Mus musculus
gcaagttcggtcatgagttcctgga

SEQ ID NO: 529221 - DNA, 25 bp, Mus musculus
gcaagttcggtcttgagttcctgga

SEQ ID NO: 529222 - DNA, 25 bp, Mus musculus
gcaagttctaagcaataacctgcat

SEQ ID NO: 529223 - DNA, 25 bp, Mus musculus
gcaagttctaaggaataacctgcat

SEQ ID NO: 529224 - DNA, 25 bp, Mus musculus
gcaagttctccaacactttaagatt

SEQ ID NO: 529225 - DNA, 25 bp, Mus musculus
gcaagttctccatcactttaagatt

SEQ ID NO: 529226 - DNA, 25 bp, Mus musculus
gcaagttctgcaaaagactacctgt

SEQ ID NO: 529227 - DNA, 25 bp, Mus musculus
gcaagttctgcataagactacctgt

SEQ ID NO: 529228 - DNA, 25 bp, Mus musculus
gcaagttctggtagacctgtatcaa

SEQ ID NO: 529229 - DNA, 25 bp, Mus musculus
gcaagttctggttgacctgtatcaa

SEQ ID NO: 529230 - DNA, 25 bp, Mus musculus
gcaagttcttgtacccatcagctaa

SEQ ID NO: 529231 - DNA, 25 bp, Mus musculus
gcaagttcttgttcccatcagctaa

SEQ ID NO: 529232 - DNA, 25 bp, Mus musculus
gcaagttgatatacggcattagcat

SEQ ID NO: 529233 - DNA, 25 bp, Mus musculus
gcaagttgatattcggcattagcat

SEQ ID NO: 529234 - DNA, 25 bp, Mus musculus
gcaagttgattcagtacctggtaaa

SEQ ID NO: 529235 - DNA, 25 bp, Mus musculus
gcaagttgattcctggccagaccaa

SEQ ID NO: 529236 - DNA, 25 bp, Mus musculus
gcaagttgattcgtggccagaccaa

SEQ ID NO: 529237 - DNA, 25 bp, Mus musculus
gcaagttgattctgtacctggtaaa

SEQ ID NO: 529238 - DNA, 25 bp, Mus musculus
gcaagttgcatgcacagaaggccat

SEQ ID NO: 529239 - DNA, 25 bp, Mus musculus
gcaagttgcatggacagaaggccat

SEQ ID NO: 529240 - DNA, 25 bp, Mus musculus
gcaagttgctagaggcttttctttc

SEQ ID NO: 529241 - DNA, 25 bp, Mus musculus
gcaagttgctagtggcttttctttc

SEQ ID NO: 529242 - DNA, 25 bp, Mus musculus
gcaagttgcttcatcactcattgaa

SEQ ID NO: 529243 - DNA, 25 bp, Mus musculus
gcaagttgcttcttcactcattgaa

SEQ ID NO: 529244 - DNA, 25 bp, Mus musculus
gcaagttggctcagtctgttggcac

SEQ ID NO: 529245 - DNA, 25 bp, Mus musculus
gcaagttggctctgtctgttggcac

SEQ ID NO: 529246 - DNA, 25 bp, Mus musculus
gcaagttggttcagcaaggtttcct

SEQ ID NO: 529247 - DNA, 25 bp, Mus musculus
gcaagttggttctgcaaggtttcct

SEQ ID NO: 529248 - DNA, 25 bp, Mus musculus
gcaagttgtcataagcttttccctt

SEQ ID NO: 529249 - DNA, 25 bp, Mus musculus
gcaagttgtcattagcttttccctt

SEQ ID NO: 529250 - DNA, 25 bp, Mus musculus
gcaagttgtgacctcttgttaactt

SEQ ID NO: 529251 - DNA, 25 bp, Mus musculus
gcaagttgtgacgtcttgttaactt

SEQ ID NO: 529252 - DNA, 25 bp, Mus musculus
gcaagttgtgccatggtatatatca

SEQ ID NO: 529253 - DNA, 25 bp, Mus musculus
gcaagttgtgccttggtatatatca

SEQ ID NO: 529254 - DNA, 25 bp, Mus musculus
gcaagttgtgctccctctatgaaaa

SEQ ID NO: 529255 - DNA, 25 bp, Mus musculus
gcaagttgtgctgcctctatgaaaa

SEQ ID NO: 529256 - DNA, 25 bp, Mus musculus
gcaagttgttctacctattaacctt

SEQ ID NO: 529257 - DNA, 25 bp, Mus musculus
gcaagttgttcttcctattaacctt

SEQ ID NO: 529258 - DNA, 25 bp, Mus musculus
gcaagttgttgtccaaactatttct

SEQ ID NO: 529259 - DNA, 25 bp, Mus musculus
gcaagttgttgtgcaaactatttct

SEQ ID NO: 529260 - DNA, 25 bp, Mus musculus
gcaagtttacttcaaggctccggga

SEQ ID NO: 529261 - DNA, 25 bp, Mus musculus
gcaagtttacttgaaggctccggga

SEQ ID NO: 529262 - DNA, 25 bp, Mus musculus
gcaagtttcaaaacccagagaagaa

SEQ ID NO: 529263 - DNA, 25 bp, Mus musculus
gcaagtttcaaatcccagagaagaa

SEQ ID NO: 529264 - DNA, 25 bp, Mus musculus
gcaagtttcacaatccagctgcaaa

SEQ ID NO: 529265 - DNA, 25 bp, Mus musculus
gcaagtttcacattccagctgcaaa

SEQ ID NO: 529266 - DNA, 25 bp, Mus musculus
gcaagtttcagtattagcccaggct

SEQ ID NO: 529267 - DNA, 25 bp, Mus musculus
gcaagtttcagttttagcccaggct

SEQ ID NO: 529268 - DNA, 25 bp, Mus musculus
gcaagtttcctcatgggcatctcaa

SEQ ID NO: 529269 - DNA, 25 bp, Mus musculus
gcaagtttcctcttgggcatctcaa

SEQ ID NO: 529270 - DNA, 25 bp, Mus musculus
gcaagtttgctcaggatgtcagcca

SEQ ID NO: 529271 - DNA, 25 bp, Mus musculus
gcaagtttgctctggatgtcagcca

SEQ ID NO: 529272 - DNA, 25 bp, Mus musculus
gcaagtttgggtctcccatatcaga

SEQ ID NO: 529273 - DNA, 25 bp, Mus musculus
gcaagtttgggtgtcccatatcaga

SEQ ID NO: 529274 - DNA, 25 bp, Mus musculus
gcaagtttgtgtagatgcgggccaa

SEQ ID NO: 529275 - DNA, 25 bp, Mus musculus
gcaagtttgtgttgatgcgggccaa

SEQ ID NO: 529276 - DNA, 25 bp, Mus musculus
gcaagtttgttccttggtgcatttt

SEQ ID NO: 529277 - DNA, 25 bp, Mus musculus
gcaagtttgttcgttggtgcatttt

SEQ ID NO: 529278 - DNA, 25 bp, Mus musculus
gcaagttttctgaccccaagttctc

SEQ ID NO: 529279 - DNA, 25 bp, Mus musculus
gcaagttttctgtccccaagttctc

SEQ ID NO: 529280 - DNA, 25 bp, Mus musculus
gcaagttttcttaagctacgggatc

SEQ ID NO: 529281 - DNA, 25 bp, Mus musculus
gcaagttttctttagctacgggatc

SEQ ID NO: 529282 - DNA, 25 bp, Mus musculus
gcaagtttttaaagccccagagggc

SEQ ID NO: 529283 - DNA, 25 bp, Mus musculus
gcaagtttttaatgccccagagggc

SEQ ID NO: 529284 - DNA, 25 bp, Mus musculus
gcaagtttttctcatacttaccagg

SEQ ID NO: 529285 - DNA, 25 bp, Mus musculus
gcaagtttttctgatacttaccagg

SEQ ID NO: 529286 - DNA, 25 bp, Mus musculus
gcaagttttttcattagccctagat

SEQ ID NO: 529287 - DNA, 25 bp, Mus musculus
gcaagttttttctttagccctagat

SEQ ID NO: 529288 - DNA, 25 bp, Mus musculus
gcaataaacactactatgggccgcc

SEQ ID NO: 529289 - DNA, 25 bp, Mus musculus
gcaataaacacttctatgggccgcc

SEQ ID NO: 529290 - DNA, 25 bp, Mus musculus
gcaataaaccgtcacagttgcttta

SEQ ID NO: 529291 - DNA, 25 bp, Mus musculus
gcaataaaccgtgacagttgcttta

SEQ ID NO: 529292 - DNA, 25 bp, Mus musculus
gcaataaacttgagccgggttctac

SEQ ID NO: 529293 - DNA, 25 bp, Mus musculus
gcaataaacttgtgccgggttctac

SEQ ID NO: 529294 - DNA, 25 bp, Mus musculus
gcaataaagggaccacccgctgtga

SEQ ID NO: 529295 - DNA, 25 bp, Mus musculus
gcaataaagggagcacccgctgtga

SEQ ID NO: 529296 - DNA, 25 bp, Mus musculus
gcaataaagtagcttcccttccttc

SEQ ID NO: 529297 - DNA, 25 bp, Mus musculus
gcaataaagtaggttcccttccttc

SEQ ID NO: 529298 - DNA, 25 bp, Mus musculus
gcaataaatatccaggccctggttt

SEQ ID NO: 529299 - DNA, 25 bp, Mus musculus
gcaataaatatcgaggccctggttt

SEQ ID NO: 529300 - DNA, 25 bp, Mus musculus
gcaataacttcactctttctccatc

SEQ ID NO: 529301 - DNA, 25 bp, Mus musculus
gcaataacttcagtctttctccatc

SEQ ID NO: 529302 - DNA, 25 bp, Mus musculus
gcaataagatccattaccgccagtt

SEQ ID NO: 529303 - DNA, 25 bp, Mus musculus
gcaataagatcctttaccgccagtt

SEQ ID NO: 529304 - DNA, 25 bp, Mus musculus
gcaataagggtaacgtgtggcagca

SEQ ID NO: 529305 - DNA, 25 bp, Mus musculus
gcaataagggtatcgtgtggcagca

SEQ ID NO: 529306 - DNA, 25 bp, Mus musculus
gcaataagtggtccccaaacatgga

SEQ ID NO: 529307 - DNA, 25 bp, Mus musculus
gcaataagtggtgcccaaacatgga

SEQ ID NO: 529308 - DNA, 25 bp, Mus musculus
gcaataagtttcagttgacggcatg

SEQ ID NO: 529309 - DNA, 25 bp, Mus musculus
gcaataagtttctgttgacggcatg

SEQ ID NO: 529310 - DNA, 25 bp, Mus musculus
gcaataataagcatcccaacacctc

SEQ ID NO: 529311 - DNA, 25 bp, Mus musculus
gcaataataagcttcccaacacctc

SEQ ID NO: 529312 - DNA, 25 bp, Mus musculus
gcaataatagtcagagggtccctcc

SEQ ID NO: 529313 - DNA, 25 bp, Mus musculus
gcaataatagtctgagggtccctcc

SEQ ID NO: 529314 - DNA, 25 bp, Mus musculus
gcaataatgcaaacgctgtcctata

SEQ ID NO: 529315 - DNA, 25 bp, Mus musculus
gcaataatgcaatcgctgtcctata

SEQ ID NO: 529316 - DNA, 25 bp, Mus musculus
gcaataatgtgcaagacttctgtct

SEQ ID NO: 529317 - DNA, 25 bp, Mus musculus
gcaataatgtgctagacttctgtct

SEQ ID NO: 529318 - DNA, 25 bp, Mus musculus
gcaatacagctcaggtctgcttggc

SEQ ID NO: 529319 - DNA, 25 bp, Mus musculus
gcaatacagctctggtctgcttggc

SEQ ID NO: 529320 - DNA, 25 bp, Mus musculus
gcaataccaacaagagtttcttttt

SEQ ID NO: 529321 - DNA, 25 bp, Mus musculus
gcaataccaacatgagtttcttttt

SEQ ID NO: 529322 - DNA, 25 bp, Mus musculus
gcaataccagataaaccacaccttt

SEQ ID NO: 529323 - DNA, 25 bp, Mus musculus
gcaataccagattaaccacaccttt

SEQ ID NO: 529324 - DNA, 25 bp, Mus musculus
gcaatacctaacaggatttccggag

SEQ ID NO: 529325 - DNA, 25 bp, Mus musculus
gcaatacctaactggatttccggag

SEQ ID NO: 529326 - DNA, 25 bp, Mus musculus
gcaatacctttcagatgccacggtt

SEQ ID NO: 529327 - DNA, 25 bp, Mus musculus
gcaatacctttctgatgccacggtt

SEQ ID NO: 529328 - DNA, 25 bp, Mus musculus
gcaatacggaacacacgcgatgtga

SEQ ID NO: 529329 - DNA, 25 bp, Mus musculus
gcaatacggaactcacgcgatgtga

SEQ ID NO: 529330 - DNA, 25 bp, Mus musculus
gcaatacgggcactttctaggaata

SEQ ID NO: 529331 - DNA, 25 bp, Mus musculus
gcaatacgggcagtttctaggaata

SEQ ID NO: 529332 - DNA, 25 bp, Mus musculus
gcaatacgtgggacacatatccaga

SEQ ID NO: 529333 - DNA, 25 bp, Mus musculus
gcaatacgtgggtcacatatccaga

SEQ ID NO: 529334 - DNA, 25 bp, Mus musculus
gcaatactcaccacttaaaacgctt

SEQ ID NO: 529335 - DNA, 25 bp, Mus musculus
gcaatactcacctcttaaaacgctt

SEQ ID NO: 529336 - DNA, 25 bp, Mus musculus
gcaatactcatgaactgctcttatg

SEQ ID NO: 529337 - DNA, 25 bp, Mus musculus
gcaatactcatgtactgctcttatg

SEQ ID NO: 529338 - DNA, 25 bp, Mus musculus
gcaatactcgtgagcaaactctgta

SEQ ID NO: 529339 - DNA, 25 bp, Mus musculus
gcaatactcgtgtgcaaactctgta

SEQ ID NO: 529340 - DNA, 25 bp, Mus musculus
gcaatactgatgctggtgatgcgca

SEQ ID NO: 529341 - DNA, 25 bp, Mus musculus
gcaatactgatggtggtgatgcgca

SEQ ID NO: 529342 - DNA, 25 bp, Mus musculus
gcaatactggagaaaccgcttccta

SEQ ID NO: 529343 - DNA, 25 bp, Mus musculus
gcaatactggagtaaccgcttccta

SEQ ID NO: 529344 - DNA, 25 bp, Mus musculus
gcaatactgtggcagcttttccagc

SEQ ID NO: 529345 - DNA, 25 bp, Mus musculus
gcaatactgtgggagcttttccagc

SEQ ID NO: 529346 - DNA, 25 bp, Mus musculus
gcaatacttacaactctacaatgag

SEQ ID NO: 529347 - DNA, 25 bp, Mus musculus
gcaatacttacatctctacaatgag

SEQ ID NO: 529348 - DNA, 25 bp, Mus musculus
gcaatacttagcagggttctcctga

SEQ ID NO: 529349 - DNA, 25 bp, Mus musculus
gcaatacttagctgggttctcctga

SEQ ID NO: 529350 - DNA, 25 bp, Mus musculus
gcaatactttacacttgttggatga

SEQ ID NO: 529351 - DNA, 25 bp, Mus musculus
gcaatactttactcttgttggatga

SEQ ID NO: 529352 - DNA, 25 bp, Mus musculus
gcaatagaatgtacggtcacccctg

SEQ ID NO: 529353 - DNA, 25 bp, Mus musculus
gcaatagaatgttcggtcacccctg

SEQ ID NO: 529354 - DNA, 25 bp, Mus musculus
gcaatagagagcacccttcacctgg

SEQ ID NO: 529355 - DNA, 25 bp, Mus musculus
gcaatagagagctcccttcacctgg

SEQ ID NO: 529356 - DNA, 25 bp, Mus musculus
gcaatagcaatcaccaggatgccta

SEQ ID NO: 529357 - DNA, 25 bp, Mus musculus
gcaatagcaatctccaggatgccta

SEQ ID NO: 529358 - DNA, 25 bp, Mus musculus
gcaatagcattacgttttaaatcaa

SEQ ID NO: 529359 - DNA, 25 bp, Mus musculus
gcaatagcattaggttttaaatcaa

SEQ ID NO: 529360 - DNA, 25 bp, Mus musculus
gcaatagcccttcgaatacacctgt

SEQ ID NO: 529361 - DNA, 25 bp, Mus musculus
gcaatagcccttggaatacacctgt

SEQ ID NO: 529362 - DNA, 25 bp, Mus musculus
gcaatagctataaagtgacacccta

SEQ ID NO: 529363 - DNA, 25 bp, Mus musculus
gcaatagctatatagtgacacccta

SEQ ID NO: 529364 - DNA, 25 bp, Mus musculus
gcaatagctgtaacctctcaggttt

SEQ ID NO: 529365 - DNA, 25 bp, Mus musculus
gcaatagctgtatcctctcaggttt

SEQ ID NO: 529366 - DNA, 25 bp, Mus musculus
gcaatagcttctctgtcttgtacaa

SEQ ID NO: 529367 - DNA, 25 bp, Mus musculus
gcaatagcttctgtgtcttgtacaa

SEQ ID NO: 529368 - DNA, 25 bp, Mus musculus
gcaataggacccagccataggaaga

SEQ ID NO: 529369 - DNA, 25 bp, Mus musculus
gcaataggaccctgccataggaaga

SEQ ID NO: 529370 - DNA, 25 bp, Mus musculus
gcaataggatccaacgcagcaccgt

SEQ ID NO: 529371 - DNA, 25 bp, Mus musculus
gcaataggatcctacgcagcaccgt

SEQ ID NO: 529372 - DNA, 25 bp, Mus musculus
gcaatagtatcaatatcaatttcag

SEQ ID NO: 529373 - DNA, 25 bp, Mus musculus
gcaatagtatcattatcaatttcag

SEQ ID NO: 529374 - DNA, 25 bp, Mus musculus
gcaatagtccatagtctcacataga

SEQ ID NO: 529375 - DNA, 25 bp, Mus musculus
gcaatagtccattgtctcacataga

SEQ ID NO: 529376 - DNA, 25 bp, Mus musculus
gcaatagtctgcatctcaatgttat

SEQ ID NO: 529377 - DNA, 25 bp, Mus musculus
gcaatagtctgcttctcaatgttat

SEQ ID NO: 529378 - DNA, 25 bp, Mus musculus
gcaatagtggcaaatatcgcaacgt

SEQ ID NO: 529379 - DNA, 25 bp, Mus musculus
gcaatagtggcatatatcgcaacgt

SEQ ID NO: 529380 - DNA, 25 bp, Mus musculus
gcaatagttactctttcacgaagga

SEQ ID NO: 529381 - DNA, 25 bp, Mus musculus
gcaatagttactgtttcacgaagga

SEQ ID NO: 529382 - DNA, 25 bp, Mus musculus
gcaatagttgggattatctacgggt

SEQ ID NO: 529383 - DNA, 25 bp, Mus musculus
gcaatagttgggtttatctacgggt

SEQ ID NO: 529384 - DNA, 25 bp, Mus musculus
gcaatagtttctcaaaaagtcccac

SEQ ID NO: 529385 - DNA, 25 bp, Mus musculus
gcaatagtttctgaaaaagtcccac

SEQ ID NO: 529386 - DNA, 25 bp, Mus musculus
gcaatataacttctgatgcccataa

SEQ ID NO: 529387 - DNA, 25 bp, Mus musculus
gcaatataacttgtgatgcccataa

SEQ ID NO: 529388 - DNA, 25 bp, Mus musculus
gcaatatcaaaacccggtccctcaa

SEQ ID NO: 529389 - DNA, 25 bp, Mus musculus
gcaatatcaaaagccggtccctcaa

SEQ ID NO: 529390 - DNA, 25 bp, Mus musculus
gcaatatcagctcactaacacgggt

SEQ ID NO: 529391 - DNA, 25 bp, Mus musculus
gcaatatcagctgactaacacgggt

SEQ ID NO: 529392 - DNA, 25 bp, Mus musculus
gcaatatcatcaccacacgcactta

SEQ ID NO: 529393 - DNA, 25 bp, Mus musculus
gcaatatcatcagcacacgcactta

SEQ ID NO: 529394 - DNA, 25 bp, Mus musculus
gcaatatccttcacaccattaatca

SEQ ID NO: 529395 - DNA, 25 bp, Mus musculus
gcaatatccttctcaccattaatca

SEQ ID NO: 529396 - DNA, 25 bp, Mus musculus
gcaatatctaccaccagtgtaaatt

SEQ ID NO: 529397 - DNA, 25 bp, Mus musculus
gcaatatctacctccagtgtaaatt

SEQ ID NO: 529398 - DNA, 25 bp, Mus musculus
gcaatatctatcacattccaataca

SEQ ID NO: 529399 - DNA, 25 bp, Mus musculus
gcaatatctatctcattccaataca

SEQ ID NO: 529400 - DNA, 25 bp, Mus musculus
gcaatatctgtacaattctgttttt

SEQ ID NO: 529401 - DNA, 25 bp, Mus musculus
gcaatatctgtagaattctgttttt

SEQ ID NO: 529402 - DNA, 25 bp, Mus musculus
gcaatatgcctcactgttggtacta

SEQ ID NO: 529403 - DNA, 25 bp, Mus musculus
gcaatatgcctctctgttggtacta

SEQ ID NO: 529404 - DNA, 25 bp, Mus musculus
gcaatatgcttgataccacagtgtc

SEQ ID NO: 529405 - DNA, 25 bp, Mus musculus
gcaatatgcttgttaccacagtgtc

SEQ ID NO: 529406 - DNA, 25 bp, Mus musculus
gcaatatgggacaccaggcccgtgt

SEQ ID NO: 529407 - DNA, 25 bp, Mus musculus
gcaatatgggactccaggcccgtgt

SEQ ID NO: 529408 - DNA, 25 bp, Mus musculus
gcaatatgtagcatgaattacgcgt

SEQ ID NO: 529409 - DNA, 25 bp, Mus musculus
gcaatatgtagcttgaattacgcgt

SEQ ID NO: 529410 - DNA, 25 bp, Mus musculus
gcaatatgttctaaggtttcagttt

SEQ ID NO: 529411 - DNA, 25 bp, Mus musculus
gcaatatgttcttaggtttcagttt

SEQ ID NO: 529412 - DNA, 25 bp, Mus musculus
gcaatattatctatactactatact

SEQ ID NO: 529413 - DNA, 25 bp, Mus musculus
gcaatattatctttactactatact

SEQ ID NO: 529414 - DNA, 25 bp, Mus musculus
gcaatattcgacagcctcaaggaga

SEQ ID NO: 529415 - DNA, 25 bp, Mus musculus
gcaatattcgactgcctcaaggaga

SEQ ID NO: 529416 - DNA, 25 bp, Mus musculus
gcaatattcttgcttgggtaccacc

SEQ ID NO: 529417 - DNA, 25 bp, Mus musculus
gcaatattcttggttgggtaccacc

SEQ ID NO: 529418 - DNA, 25 bp, Mus musculus
gcaatattgactattcttttgtttg

SEQ ID NO: 529419 - DNA, 25 bp, Mus musculus
gcaatattgacttttcttttgtttg

SEQ ID NO: 529420 - DNA, 25 bp, Mus musculus
gcaatatttttaccactgctaaggt

SEQ ID NO: 529421 - DNA, 25 bp, Mus musculus
gcaatatttttagcactgctaaggt

SEQ ID NO: 529422 - DNA, 25 bp, Mus musculus
gcaatatttttcatcacatgccaaa

SEQ ID NO: 529423 - DNA, 25 bp, Mus musculus
gcaatatttttcttcacatgccaaa

SEQ ID NO: 529424 - DNA, 25 bp, Mus musculus
gcaatcaaatatatctggccagtgt

SEQ ID NO: 529425 - DNA, 25 bp, Mus musculus
gcaatcaaatatttctggccagtgt

SEQ ID NO: 529426 - DNA, 25 bp, Mus musculus
gcaatcaatcctaatgactcccatg

SEQ ID NO: 529427 - DNA, 25 bp, Mus musculus
gcaatcaatccttatgactcccatg

SEQ ID NO: 529428 - DNA, 25 bp, Mus musculus
gcaatcacatgcctttccgatagag

SEQ ID NO: 529429 - DNA, 25 bp, Mus musculus
gcaatcacatgcgtttccgatagag

SEQ ID NO: 529430 - DNA, 25 bp, Mus musculus
gcaatcactcttatcataaccttcc

SEQ ID NO: 529431 - DNA, 25 bp, Mus musculus
gcaatcactcttttcataaccttcc

SEQ ID NO: 529432 - DNA, 25 bp, Mus musculus
gcaatcactgaaacactacgaatgg

SEQ ID NO: 529433 - DNA, 25 bp, Mus musculus
gcaatcactgaatcactacgaatgg

SEQ ID NO: 529434 - DNA, 25 bp, Mus musculus
gcaatcactttcatttctgtgtctc

SEQ ID NO: 529435 - DNA, 25 bp, Mus musculus
gcaatcactttcttttctgtgtctc

SEQ ID NO: 529436 - DNA, 25 bp, Mus musculus
gcaatcagtataccataggctccat

SEQ ID NO: 529437 - DNA, 25 bp, Mus musculus
gcaatcagtatagcataggctccat

SEQ ID NO: 529438 - DNA, 25 bp, Mus musculus
gcaatcagtcccaactcttgaaagg

SEQ ID NO: 529439 - DNA, 25 bp, Mus musculus
gcaatcagtccctactcttgaaagg

SEQ ID NO: 529440 - DNA, 25 bp, Mus musculus
gcaatcagtctgagcaactttctta

SEQ ID NO: 529441 - DNA, 25 bp, Mus musculus
gcaatcagtctgtgcaactttctta

SEQ ID NO: 529442 - DNA, 25 bp, Mus musculus
gcaatcagtgcgagccaaagctgct

SEQ ID NO: 529443 - DNA, 25 bp, Mus musculus
gcaatcagtgcgtgccaaagctgct

SEQ ID NO: 529444 - DNA, 25 bp, Mus musculus
gcaatcagttaaatctgtgtcactt

SEQ ID NO: 529445 - DNA, 25 bp, Mus musculus
gcaatcagttaattctgtgtcactt

SEQ ID NO: 529446 - DNA, 25 bp, Mus musculus
gcaatcatgagcatcgtctccagaa

SEQ ID NO: 529447 - DNA, 25 bp, Mus musculus
gcaatcatgagcttcgtctccagaa

SEQ ID NO: 529448 - DNA, 25 bp, Mus musculus
gcaatcatggcgctcgctcgctcag

SEQ ID NO: 529449 - DNA, 25 bp, Mus musculus
gcaatcatggcggtcgctcgctcag

SEQ ID NO: 529450 - DNA, 25 bp, Mus musculus
gcaatcatggttcactgcagtcttg

SEQ ID NO: 529451 - DNA, 25 bp, Mus musculus
gcaatcatggttgactgcagtcttg

SEQ ID NO: 529452 - DNA, 25 bp, Mus musculus
gcaatcatgtcaactgcaatgcttt

SEQ ID NO: 529453 - DNA, 25 bp, Mus musculus
gcaatcatgtcatctgcaatgcttt

SEQ ID NO: 529454 - DNA, 25 bp, Mus musculus
gcaatcatgtgacgtagcccacgga

SEQ ID NO: 529455 - DNA, 25 bp, Mus musculus
gcaatcatgtgaggtagcccacgga

SEQ ID NO: 529456 - DNA, 25 bp, Mus musculus
gcaatcattccaaattcccagctga

SEQ ID NO: 529457 - DNA, 25 bp, Mus musculus
gcaatcattccatattcccagctga

SEQ ID NO: 529458 - DNA, 25 bp, Mus musculus
gcaatcattgtaacctggcagttat

SEQ ID NO: 529459 - DNA, 25 bp, Mus musculus
gcaatcattgtatcctggcagttat

SEQ ID NO: 529460 - DNA, 25 bp, Mus musculus
gcaatcatttgtactgtctttaagg

SEQ ID NO: 529461 - DNA, 25 bp, Mus musculus
gcaatcatttgttctgtctttaagg

SEQ ID NO: 529462 - DNA, 25 bp, Mus musculus
gcaatccaccgcatgcaagaagggc

SEQ ID NO: 529463 - DNA, 25 bp, Mus musculus
gcaatccaccgcttgcaagaagggc

SEQ ID NO: 529464 - DNA, 25 bp, Mus musculus
gcaatccactcaagctgtgtatgct

SEQ ID NO: 529465 - DNA, 25 bp, Mus musculus
gcaatccactcatgctgtgtatgct

SEQ ID NO: 529466 - DNA, 25 bp, Mus musculus
gcaatccactgacctatcgccttag

SEQ ID NO: 529467 - DNA, 25 bp, Mus musculus
gcaatccactgagctatcgccttag

SEQ ID NO: 529468 - DNA, 25 bp, Mus musculus
gcaatccatgcacagtcaaaaatat

SEQ ID NO: 529469 - DNA, 25 bp, Mus musculus
gcaatccatgcagagtcaaaaatat

SEQ ID NO: 529470 - DNA, 25 bp, Mus musculus
gcaatcccacaaacctgtgtacata

SEQ ID NO: 529471 - DNA, 25 bp, Mus musculus
gcaatcccacaatcctgtgtacata

SEQ ID NO: 529472 - DNA, 25 bp, Mus musculus
gcaatcccagcacacttccttagtg

SEQ ID NO: 529473 - DNA, 25 bp, Mus musculus
gcaatcccagcagacttccttagtg

SEQ ID NO: 529474 - DNA, 25 bp, Mus musculus
gcaatcccagcccttatgaagattt

SEQ ID NO: 529475 - DNA, 25 bp, Mus musculus
gcaatcccagccgttatgaagattt

SEQ ID NO: 529476 - DNA, 25 bp, Mus musculus
gcaatccccaaaaaattttcaagta

SEQ ID NO: 529477 - DNA, 25 bp, Mus musculus
gcaatccccaaataattttcaagta

SEQ ID NO: 529478 - DNA, 25 bp, Mus musculus
gcaatccccaccaagacatatttaa

SEQ ID NO: 529479 - DNA, 25 bp, Mus musculus
gcaatccccacctagacatatttaa

SEQ ID NO: 529480 - DNA, 25 bp, Mus musculus
gcaatcccctttactgtactataga

SEQ ID NO: 529481 - DNA, 25 bp, Mus musculus
gcaatccccttttctgtactataga

SEQ ID NO: 529482 - DNA, 25 bp, Mus musculus
gcaatcccgagacgacactgtgctt

SEQ ID NO: 529483 - DNA, 25 bp, Mus musculus
gcaatcccgagaggacactgtgctt

SEQ ID NO: 529484 - DNA, 25 bp, Mus musculus
gcaatccctgggaatttctatccat

SEQ ID NO: 529485 - DNA, 25 bp, Mus musculus
gcaatccctgggtatttctatccat

SEQ ID NO: 529486 - DNA, 25 bp, Mus musculus
gcaatccctttcataaagtgcccac

SEQ ID NO: 529487 - DNA, 25 bp, Mus musculus
gcaatccctttcttaaagtgcccac

SEQ ID NO: 529488 - DNA, 25 bp, Mus musculus
gcaatccgcagcatgctgaatggct

SEQ ID NO: 529489 - DNA, 25 bp, Mus musculus
gcaatccgcagcttgctgaatggct

SEQ ID NO: 529490 - DNA, 25 bp, Mus musculus
gcaatccggccgagggtggtatcta

SEQ ID NO: 529491 - DNA, 25 bp, Mus musculus
gcaatccggccgtgggtggtatcta

SEQ ID NO: 529492 - DNA, 25 bp, Mus musculus
gcaatcctaaccacaagtggacgat

SEQ ID NO: 529493 - DNA, 25 bp, Mus musculus
gcaatcctaacctcaagtggacgat

SEQ ID NO: 529494 - DNA, 25 bp, Mus musculus
gcaatcctgacaactggcaaaacaa

SEQ ID NO: 529495 - DNA, 25 bp, Mus musculus
gcaatcctgacactaaatatactaa

SEQ ID NO: 529496 - DNA, 25 bp, Mus musculus
gcaatcctgacagtaaatatactaa

SEQ ID NO: 529497 - DNA, 25 bp, Mus musculus
gcaatcctgacatctggcaaaacaa

SEQ ID NO: 529498 - DNA, 25 bp, Mus musculus
gcaatcctgaccactgactacaaga

SEQ ID NO: 529499 - DNA, 25 bp, Mus musculus
gcaatcctgacctctgactacaaga

SEQ ID NO: 529500 - DNA, 25 bp, Mus musculus
gcaatcctgggaactgttgtgttac

SEQ ID NO: 529501 - DNA, 25 bp, Mus musculus
gcaatcctgggatctgttgtgttac

SEQ ID NO: 529502 - DNA, 25 bp, Mus musculus
gcaatcctggttctgtgtgcacttt

SEQ ID NO: 529503 - DNA, 25 bp, Mus musculus
gcaatcctggttgtgtgtgcacttt

SEQ ID NO: 529504 - DNA, 25 bp, Mus musculus
gcaatcctgtcaaatctgaacgtga

SEQ ID NO: 529505 - DNA, 25 bp, Mus musculus
gcaatcctgtcatatctgaacgtga

SEQ ID NO: 529506 - DNA, 25 bp, Mus musculus
gcaatcctgtccaggtctttattta

SEQ ID NO: 529507 - DNA, 25 bp, Mus musculus
gcaatcctgtcctggtctttattta

SEQ ID NO: 529508 - DNA, 25 bp, Mus musculus
gcaatccttaaactgtgtcccacct

SEQ ID NO: 529509 - DNA, 25 bp, Mus musculus
gcaatccttaaagtgtgtcccacct

SEQ ID NO: 529510 - DNA, 25 bp, Mus musculus
gcaatccttatgcaggcctgtgacc

SEQ ID NO: 529511 - DNA, 25 bp, Mus musculus
gcaatccttatggaggcctgtgacc

SEQ ID NO: 529512 - DNA, 25 bp, Mus musculus
gcaatccttgaacacctatttttct

SEQ ID NO: 529513 - DNA, 25 bp, Mus musculus
gcaatccttgaagacctatttttct

SEQ ID NO: 529514 - DNA, 25 bp, Mus musculus
gcaatcgcaggacaggccatcttct

SEQ ID NO: 529515 - DNA, 25 bp, Mus musculus
gcaatcgcaggagaggccatcttct

SEQ ID NO: 529516 - DNA, 25 bp, Mus musculus
gcaatcgcatgtctgccgccagtaa

SEQ ID NO: 529517 - DNA, 25 bp, Mus musculus
gcaatcgcatgtgtgccgccagtaa

SEQ ID NO: 529518 - DNA, 25 bp, Mus musculus
gcaatcggacaaattttacaatcta

SEQ ID NO: 529519 - DNA, 25 bp, Mus musculus
gcaatcggacaatttttacaatcta

SEQ ID NO: 529520 - DNA, 25 bp, Mus musculus
gcaatcggtgatctatcattcccta

SEQ ID NO: 529521 - DNA, 25 bp, Mus musculus
gcaatcggtgatgtatcattcccta

SEQ ID NO: 529522 - DNA, 25 bp, Mus musculus
gcaatcgtcatacggaggttcacat

SEQ ID NO: 529523 - DNA, 25 bp, Mus musculus
gcaatcgtcatagggaggttcacat

SEQ ID NO: 529524 - DNA, 25 bp, Mus musculus
gcaatcgtccttcttacagcagtaa

SEQ ID NO: 529525 - DNA, 25 bp, Mus musculus
gcaatcgtccttgttacagcagtaa

SEQ ID NO: 529526 - DNA, 25 bp, Mus musculus
gcaatcgtgcgcaatgaagtgattg

SEQ ID NO: 529527 - DNA, 25 bp, Mus musculus
gcaatcgtgcgctatgaagtgattg

SEQ ID NO: 529528 - DNA, 25 bp, Mus musculus
gcaatcgtgttgagcttgagccaaa

SEQ ID NO: 529529 - DNA, 25 bp, Mus musculus
gcaatcgtgttgtgcttgagccaaa

SEQ ID NO: 529530 - DNA, 25 bp, Mus musculus
gcaatcgtttctcggtggttttaat

SEQ ID NO: 529531 - DNA, 25 bp, Mus musculus
gcaatcgtttctgggtggttttaat

SEQ ID NO: 529532 - DNA, 25 bp, Mus musculus
gcaatctagcaacactggaggtgac

SEQ ID NO: 529533 - DNA, 25 bp, Mus musculus
gcaatctagcaagactggaggtgac

SEQ ID NO: 529534 - DNA, 25 bp, Mus musculus
gcaatctattgcagactcgtggttt

SEQ ID NO: 529535 - DNA, 25 bp, Mus musculus
gcaatctattgctgactcgtggttt

SEQ ID NO: 529536 - DNA, 25 bp, Mus musculus
gcaatctcagctcagtcatactttc

SEQ ID NO: 529537 - DNA, 25 bp, Mus musculus
gcaatctcagctgagtcatactttc

SEQ ID NO: 529538 - DNA, 25 bp, Mus musculus
gcaatctcccagagccttttacaga

SEQ ID NO: 529539 - DNA, 25 bp, Mus musculus
gcaatctcccagtgccttttacaga

SEQ ID NO: 529540 - DNA, 25 bp, Mus musculus
gcaatctccctgaatagttcgcatg

SEQ ID NO: 529541 - DNA, 25 bp, Mus musculus
gcaatctccctgtatagttcgcatg

SEQ ID NO: 529542 - DNA, 25 bp, Mus musculus
gcaatctctagtaagaactccagaa

SEQ ID NO: 529543 - DNA, 25 bp, Mus musculus
gcaatctctagttagaactccagaa

SEQ ID NO: 529544 - DNA, 25 bp, Mus musculus
gcaatctctatacatctgtcaggtt

SEQ ID NO: 529545 - DNA, 25 bp, Mus musculus
gcaatctctatagatctgtcaggtt

SEQ ID NO: 529546 - DNA, 25 bp, Mus musculus
gcaatctctcctacgaccaaattaa

SEQ ID NO: 529547 - DNA, 25 bp, Mus musculus
gcaatctctccttcgaccaaattaa

SEQ ID NO: 529548 - DNA, 25 bp, Mus musculus
gcaatctctgccagaacatgctgat

SEQ ID NO: 529549 - DNA, 25 bp, Mus musculus
gcaatctctgcctgaacatgctgat

SEQ ID NO: 529550 - DNA, 25 bp, Mus musculus
gcaatctcttcaacatccatcaaga

SEQ ID NO: 529551 - DNA, 25 bp, Mus musculus
gcaatctcttcaacctaattgagag

SEQ ID NO: 529552 - DNA, 25 bp, Mus musculus
gcaatctcttcatcatccatcaaga

SEQ ID NO: 529553 - DNA, 25 bp, Mus musculus
gcaatctcttcatcctaattgagag

SEQ ID NO: 529554 - DNA, 25 bp, Mus musculus
gcaatctcttcccaggtacttggta

SEQ ID NO: 529555 - DNA, 25 bp, Mus musculus
gcaatctcttccgaggtacttggta

SEQ ID NO: 529556 - DNA, 25 bp, Mus musculus
gcaatctgagccagttttgaggttt

SEQ ID NO: 529557 - DNA, 25 bp, Mus musculus
gcaatctgagcctgttttgaggttt

SEQ ID NO: 529558 - DNA, 25 bp, Mus musculus
gcaatctgcacaaatttggatgaca

SEQ ID NO: 529559 - DNA, 25 bp, Mus musculus
gcaatctgcacatatttggatgaca

SEQ ID NO: 529560 - DNA, 25 bp, Mus musculus
gcaatctgcagcatagctacctagt

SEQ ID NO: 529561 - DNA, 25 bp, Mus musculus
gcaatctgcagcttagctacctagt

SEQ ID NO: 529562 - DNA, 25 bp, Mus musculus
gcaatctgcattcttgttcacttaa

SEQ ID NO: 529563 - DNA, 25 bp, Mus musculus
gcaatctgcattgttgttcacttaa

SEQ ID NO: 529564 - DNA, 25 bp, Mus musculus
gcaatctggattagtttactccaca

SEQ ID NO: 529565 - DNA, 25 bp, Mus musculus
gcaatctggatttgtttactccaca

SEQ ID NO: 529566 - DNA, 25 bp, Mus musculus
gcaatctgtcagaatctatcaaaaa

SEQ ID NO: 529567 - DNA, 25 bp, Mus musculus
gcaatctgtcagtatctatcaaaaa

SEQ ID NO: 529568 - DNA, 25 bp, Mus musculus
gcaatctgtggacaattttcccaaa

SEQ ID NO: 529569 - DNA, 25 bp, Mus musculus
gcaatctgtggagaattttcccaaa

SEQ ID NO: 529570 - DNA, 25 bp, Mus musculus
gcaatctgttccctgcatccaaaag

SEQ ID NO: 529571 - DNA, 25 bp, Mus musculus
gcaatctgttccgtgcatccaaaag

SEQ ID NO: 529572 - DNA, 25 bp, Mus musculus
gcaatctgttgtataagtgcctaca

SEQ ID NO: 529573 - DNA, 25 bp, Mus musculus
gcaatctgttgtttaagtgcctaca

SEQ ID NO: 529574 - DNA, 25 bp, Mus musculus
gcaatcttaatcatctgctttcaag

SEQ ID NO: 529575 - DNA, 25 bp, Mus musculus
gcaatcttaatcttctgctttcaag

SEQ ID NO: 529576 - DNA, 25 bp, Mus musculus
gcaatcttagcaaaagtacccttat

SEQ ID NO: 529577 - DNA, 25 bp, Mus musculus
gcaatcttagcataagtacccttat

SEQ ID NO: 529578 - DNA, 25 bp, Mus musculus
gcaatcttcagtacaccagcttgaa

SEQ ID NO: 529579 - DNA, 25 bp, Mus musculus
gcaatcttcagtacattcatagcat

SEQ ID NO: 529580 - DNA, 25 bp, Mus musculus
gcaatcttcagttcaccagcttgaa

SEQ ID NO: 529581 - DNA, 25 bp, Mus musculus
gcaatcttcagttcattcatagcat

SEQ ID NO: 529582 - DNA, 25 bp, Mus musculus
gcaatcttcctacaggtgtgagaca

SEQ ID NO: 529583 - DNA, 25 bp, Mus musculus
gcaatcttcctacagtaacaggcca

SEQ ID NO: 529584 - DNA, 25 bp, Mus musculus
gcaatcttcctagaggtgtgagaca

SEQ ID NO: 529585 - DNA, 25 bp, Mus musculus
gcaatcttcctagagtaacaggcca

SEQ ID NO: 529586 - DNA, 25 bp, Mus musculus
gcaatcttcctgacaagtctgagtc

SEQ ID NO: 529587 - DNA, 25 bp, Mus musculus
gcaatcttcctgtcaagtctgagtc

SEQ ID NO: 529588 - DNA, 25 bp, Mus musculus
gcaatgaaaacacttcagaggacca

SEQ ID NO: 529589 - DNA, 25 bp, Mus musculus
gcaatgaaaacagttcagaggacca

SEQ ID NO: 529590 - DNA, 25 bp, Mus musculus
gcaatgaaatcaacagctggctgga

SEQ ID NO: 529591 - DNA, 25 bp, Mus musculus
gcaatgaaatcatcagctggctgga

SEQ ID NO: 529592 - DNA, 25 bp, Mus musculus
gcaatgaaattactcctcaggctga

SEQ ID NO: 529593 - DNA, 25 bp, Mus musculus
gcaatgaaattagtcctcaggctga

SEQ ID NO: 529594 - DNA, 25 bp, Mus musculus
gcaatgaacatactcttctcagatt

SEQ ID NO: 529595 - DNA, 25 bp, Mus musculus
gcaatgaacatagtcttctcagatt

SEQ ID NO: 529596 - DNA, 25 bp, Mus musculus
gcaatgaactgtaccaatccctggg

SEQ ID NO: 529597 - DNA, 25 bp, Mus musculus
gcaatgaactgttccaatccctggg

SEQ ID NO: 529598 - DNA, 25 bp, Mus musculus
gcaatgaatccgagcctgcaatggt

SEQ ID NO: 529599 - DNA, 25 bp, Mus musculus
gcaatgaatccgtgcctgcaatggt

SEQ ID NO: 529600 - DNA, 25 bp, Mus musculus
gcaatgaatgtcaggtttcccgtgc

SEQ ID NO: 529601 - DNA, 25 bp, Mus musculus
gcaatgaatgtctggtttcccgtgc

SEQ ID NO: 529602 - DNA, 25 bp, Mus musculus
gcaatgacacagagcctgaggactt

SEQ ID NO: 529603 - DNA, 25 bp, Mus musculus
gcaatgacacagtgcctgaggactt

SEQ ID NO: 529604 - DNA, 25 bp, Mus musculus
gcaatgaccaagctgaccagggcta

SEQ ID NO: 529605 - DNA, 25 bp, Mus musculus
gcaatgaccaaggtgaccagggcta

SEQ ID NO: 529606 - DNA, 25 bp, Mus musculus
gcaatgacggtgaggaatacttccc

SEQ ID NO: 529607 - DNA, 25 bp, Mus musculus
gcaatgacggtgtggaatacttccc

SEQ ID NO: 529608 - DNA, 25 bp, Mus musculus
gcaatgacgttacttctgtcctagt

SEQ ID NO: 529609 - DNA, 25 bp, Mus musculus
gcaatgacgttagttctgtcctagt

SEQ ID NO: 529610 - DNA, 25 bp, Mus musculus
gcaatgactatgaggccttggtcca

SEQ ID NO: 529611 - DNA, 25 bp, Mus musculus
gcaatgactatgtggccttggtcca

SEQ ID NO: 529612 - DNA, 25 bp, Mus musculus
gcaatgactcttctcacttttgtag

SEQ ID NO: 529613 - DNA, 25 bp, Mus musculus
gcaatgactcttgtcacttttgtag

SEQ ID NO: 529614 - DNA, 25 bp, Mus musculus
gcaatgactttgcttgagtctccta

SEQ ID NO: 529615 - DNA, 25 bp, Mus musculus
gcaatgactttggttgagtctccta

SEQ ID NO: 529616 - DNA, 25 bp, Mus musculus
gcaatgagaagcaatccggtcccca

SEQ ID NO: 529617 - DNA, 25 bp, Mus musculus
gcaatgagaagctatccggtcccca

SEQ ID NO: 529618 - DNA, 25 bp, Mus musculus
gcaatgagagcaaaacagagtctgt

SEQ ID NO: 529619 - DNA, 25 bp, Mus musculus
gcaatgagagcataacagagtctgt

SEQ ID NO: 529620 - DNA, 25 bp, Mus musculus
gcaatgagccacagcaaaataataa

SEQ ID NO: 529621 - DNA, 25 bp, Mus musculus
gcaatgagccactgcaaaataataa

SEQ ID NO: 529622 - DNA, 25 bp, Mus musculus
gcaatgaggaagaggcctctccctc

SEQ ID NO: 529623 - DNA, 25 bp, Mus musculus
gcaatgaggaagtggcctctccctc

SEQ ID NO: 529624 - DNA, 25 bp, Mus musculus
gcaatgaggacacagctaatgggga

SEQ ID NO: 529625 - DNA, 25 bp, Mus musculus
gcaatgaggacagagctaatgggga

SEQ ID NO: 529626 - DNA, 25 bp, Mus musculus
gcaatgaggaccatctctttttgct

SEQ ID NO: 529627 - DNA, 25 bp, Mus musculus
gcaatgaggaccttctctttttgct

SEQ ID NO: 529628 - DNA, 25 bp, Mus musculus
gcaatgaggccaccgccttttggaa

SEQ ID NO: 529629 - DNA, 25 bp, Mus musculus
gcaatgaggccagcgccttttggaa

SEQ ID NO: 529630 - DNA, 25 bp, Mus musculus
gcaatgagtcaaactatacccaaaa

SEQ ID NO: 529631 - DNA, 25 bp, Mus musculus
gcaatgagtcaatctatacccaaaa

SEQ ID NO: 529632 - DNA, 25 bp, Mus musculus
gcaatgagtcatcgtgcctctggct

SEQ ID NO: 529633 - DNA, 25 bp, Mus musculus
gcaatgagtcatggtgcctctggct

SEQ ID NO: 529634 - DNA, 25 bp, Mus musculus
gcaatgatagcacgtgggccatatt

SEQ ID NO: 529635 - DNA, 25 bp, Mus musculus
gcaatgatagcaggtgggccatatt

SEQ ID NO: 529636 - DNA, 25 bp, Mus musculus
gcaatgatattaaactccttcctgt

SEQ ID NO: 529637 - DNA, 25 bp, Mus musculus
gcaatgatattatactccttcctgt

SEQ ID NO: 529638 - DNA, 25 bp, Mus musculus
gcaatgatcaatcgctctcagcatc

SEQ ID NO: 529639 - DNA, 25 bp, Mus musculus
gcaatgatcaatggctctcagcatc

SEQ ID NO: 529640 - DNA, 25 bp, Mus musculus
gcaatgatccctatagggcaaaagg

SEQ ID NO: 529641 - DNA, 25 bp, Mus musculus
gcaatgatccctttagggcaaaagg

SEQ ID NO: 529642 - DNA, 25 bp, Mus musculus
gcaatgatgaggatctgccgtccaa

SEQ ID NO: 529643 - DNA, 25 bp, Mus musculus
gcaatgatgaggttctgccgtccaa

SEQ ID NO: 529644 - DNA, 25 bp, Mus musculus
gcaatgatgatccaaacacctagtc

SEQ ID NO: 529645 - DNA, 25 bp, Mus musculus
gcaatgatgatcgaaacacctagtc

SEQ ID NO: 529646 - DNA, 25 bp, Mus musculus
gcaatgatgcaaaggaactgactaa

SEQ ID NO: 529647 - DNA, 25 bp, Mus musculus
gcaatgatgcaatggaactgactaa

SEQ ID NO: 529648 - DNA, 25 bp, Mus musculus
gcaatgatgcccagttttgctgagt

SEQ ID NO: 529649 - DNA, 25 bp, Mus musculus
gcaatgatgccctgttttgctgagt

SEQ ID NO: 529650 - DNA, 25 bp, Mus musculus
gcaatgatgggaaatacctttaatc

SEQ ID NO: 529651 - DNA, 25 bp, Mus musculus
gcaatgatgggatatacctttaatc

SEQ ID NO: 529652 - DNA, 25 bp, Mus musculus
gcaatgatgtccaccaaagacctgt

SEQ ID NO: 529653 - DNA, 25 bp, Mus musculus
gcaatgatgtcctccaaagacctgt

SEQ ID NO: 529654 - DNA, 25 bp, Mus musculus
gcaatgatgtcgctatcactgatta

SEQ ID NO: 529655 - DNA, 25 bp, Mus musculus
gcaatgatgtcggtatcactgatta

SEQ ID NO: 529656 - DNA, 25 bp, Mus musculus
gcaatgattgatactgacgctgatt

SEQ ID NO: 529657 - DNA, 25 bp, Mus musculus
gcaatgattgattctgacgctgatt

SEQ ID NO: 529658 - DNA, 25 bp, Mus musculus
gcaatgattgcaatgtgctgtcaga

SEQ ID NO: 529659 - DNA, 25 bp, Mus musculus
gcaatgattgcattgtgctgtcaga

SEQ ID NO: 529660 - DNA, 25 bp, Mus musculus
gcaatgattgctcttttctggccat

SEQ ID NO: 529661 - DNA, 25 bp, Mus musculus
gcaatgattgctgttttctggccat

SEQ ID NO: 529662 - DNA, 25 bp, Mus musculus
gcaatgcaaactctaggcttacttc

SEQ ID NO: 529663 - DNA, 25 bp, Mus musculus
gcaatgcaaactgtaggcttacttc

SEQ ID NO: 529664 - DNA, 25 bp, Mus musculus
gcaatgcaacgcagggccactgctg

SEQ ID NO: 529665 - DNA, 25 bp, Mus musculus
gcaatgcaacgctgggccactgctg

SEQ ID NO: 529666 - DNA, 25 bp, Mus musculus
gcaatgcaatgtaaactggctagca

SEQ ID NO: 529667 - DNA, 25 bp, Mus musculus
gcaatgcaatgttaactggctagca

SEQ ID NO: 529668 - DNA, 25 bp, Mus musculus
gcaatgcaggttctttgtccgaaac

SEQ ID NO: 529669 - DNA, 25 bp, Mus musculus
gcaatgcaggttgtttgtccgaaac

SEQ ID NO: 529670 - DNA, 25 bp, Mus musculus
gcaatgcatcatatagatcgcccct

SEQ ID NO: 529671 - DNA, 25 bp, Mus musculus
gcaatgcatcatttagatcgcccct

SEQ ID NO: 529672 - DNA, 25 bp, Mus musculus
gcaatgcatggccttccaataaaag

SEQ ID NO: 529673 - DNA, 25 bp, Mus musculus
gcaatgcatggcgttccaataaaag

SEQ ID NO: 529674 - DNA, 25 bp, Mus musculus
gcaatgcatgtaccaacaggctgac

SEQ ID NO: 529675 - DNA, 25 bp, Mus musculus
gcaatgcatgtagcaacaggctgac

SEQ ID NO: 529676 - DNA, 25 bp, Mus musculus
gcaatgcatgtgaggctatgcctca

SEQ ID NO: 529677 - DNA, 25 bp, Mus musculus
gcaatgcatgtgtggctatgcctca

SEQ ID NO: 529678 - DNA, 25 bp, Mus musculus
gcaatgccaaccaaagccagaagag

SEQ ID NO: 529679 - DNA, 25 bp, Mus musculus
gcaatgccaacctaagccagaagag

SEQ ID NO: 529680 - DNA, 25 bp, Mus musculus
gcaatgccaactacggcttcacctg

SEQ ID NO: 529681 - DNA, 25 bp, Mus musculus
gcaatgccaacttcggcttcacctg

SEQ ID NO: 529682 - DNA, 25 bp, Mus musculus
gcaatgccacatatagatcttagga

SEQ ID NO: 529683 - DNA, 25 bp, Mus musculus
gcaatgccacatttagatcttagga

SEQ ID NO: 529684 - DNA, 25 bp, Mus musculus
gcaatgccagcaccaggcggacgaa

SEQ ID NO: 529685 - DNA, 25 bp, Mus musculus
gcaatgccagcagcaggcggacgaa

SEQ ID NO: 529686 - DNA, 25 bp, Mus musculus
gcaatgccatagctttttcatgaat

SEQ ID NO: 529687 - DNA, 25 bp, Mus musculus
gcaatgccataggtttttcatgaat

SEQ ID NO: 529688 - DNA, 25 bp, Mus musculus
gcaatgccgtggattctctcgacag

SEQ ID NO: 529689 - DNA, 25 bp, Mus musculus
gcaatgccgtggtttctctcgacag

SEQ ID NO: 529690 - DNA, 25 bp, Mus musculus
gcaatgcctggaatgtgcttgttaa

SEQ ID NO: 529691 - DNA, 25 bp, Mus musculus
gcaatgcctggattgtgcttgttaa

SEQ ID NO: 529692 - DNA, 25 bp, Mus musculus
gcaatgccttgtatcttcatgacat

SEQ ID NO: 529693 - DNA, 25 bp, Mus musculus
gcaatgccttgtttcttcatgacat

SEQ ID NO: 529694 - DNA, 25 bp, Mus musculus
gcaatgcgaaagatgaaacagcgca

SEQ ID NO: 529695 - DNA, 25 bp, Mus musculus
gcaatgcgaaagttgaaacagcgca

SEQ ID NO: 529696 - DNA, 25 bp, Mus musculus
gcaatgcgacgaatggaccctcctg

SEQ ID NO: 529697 - DNA, 25 bp, Mus musculus
gcaatgcgacgattggaccctcctg

SEQ ID NO: 529698 - DNA, 25 bp, Mus musculus
gcaatgcgattacacctttgttaca

SEQ ID NO: 529699 - DNA, 25 bp, Mus musculus
gcaatgcgattagacctttgttaca

SEQ ID NO: 529700 - DNA, 25 bp, Mus musculus
gcaatgcggtgacgcctgacccaat

SEQ ID NO: 529701 - DNA, 25 bp, Mus musculus
gcaatgcggtgaggcctgacccaat

SEQ ID NO: 529702 - DNA, 25 bp, Mus musculus
gcaatgcgtttgacctagctaataa

SEQ ID NO: 529703 - DNA, 25 bp, Mus musculus
gcaatgcgtttgtcctagctaataa

SEQ ID NO: 529704 - DNA, 25 bp, Mus musculus
gcaatgctagtgaggatagactcgt

SEQ ID NO: 529705 - DNA, 25 bp, Mus musculus
gcaatgctagtgtggatagactcgt

SEQ ID NO: 529706 - DNA, 25 bp, Mus musculus
gcaatgctatgaactctaccactaa

SEQ ID NO: 529707 - DNA, 25 bp, Mus musculus
gcaatgctatgatctctaccactaa

SEQ ID NO: 529708 - DNA, 25 bp, Mus musculus
gcaatgctcagcatgatcagtacta

SEQ ID NO: 529709 - DNA, 25 bp, Mus musculus
gcaatgctcagcttgatcagtacta

SEQ ID NO: 529710 - DNA, 25 bp, Mus musculus
gcaatgctcattcagagatgctcct

SEQ ID NO: 529711 - DNA, 25 bp, Mus musculus
gcaatgctcattgagagatgctcct

SEQ ID NO: 529712 - DNA, 25 bp, Mus musculus
gcaatgctccttagagtctttggtg

SEQ ID NO: 529713 - DNA, 25 bp, Mus musculus
gcaatgctcctttgagtctttggtg

SEQ ID NO: 529714 - DNA, 25 bp, Mus musculus
gcaatgctctggctgtggctgacct

SEQ ID NO: 529715 - DNA, 25 bp, Mus musculus
gcaatgctctgggtgtggctgacct

SEQ ID NO: 529716 - DNA, 25 bp, Mus musculus
gcaatgctgacccagcttcttgggt

SEQ ID NO: 529717 - DNA, 25 bp, Mus musculus
gcaatgctgaccgagcttcttgggt

SEQ ID NO: 529718 - DNA, 25 bp, Mus musculus
gcaatgctgatgagggctgatgttt

SEQ ID NO: 529719 - DNA, 25 bp, Mus musculus
gcaatgctgatgtgggctgatgttt

SEQ ID NO: 529720 - DNA, 25 bp, Mus musculus
gcaatgctgcaaaaagagatttctg

SEQ ID NO: 529721 - DNA, 25 bp, Mus musculus
gcaatgctgcaataagagatttctg

SEQ ID NO: 529722 - DNA, 25 bp, Mus musculus
gcaatgctggagcaatcctgagaca

SEQ ID NO: 529723 - DNA, 25 bp, Mus musculus
gcaatgctggaggaatcctgagaca

SEQ ID NO: 529724 - DNA, 25 bp, Mus musculus
gcaatgctgtaaaataccatgctag

SEQ ID NO: 529725 - DNA, 25 bp, Mus musculus
gcaatgctgtaatataccatgctag

SEQ ID NO: 529726 - DNA, 25 bp, Mus musculus
gcaatgctgtccaactattattcca

SEQ ID NO: 529727 - DNA, 25 bp, Mus musculus
gcaatgctgtcctactattattcca

SEQ ID NO: 529728 - DNA, 25 bp, Mus musculus
gcaatgctgttcatggagaatgttc

SEQ ID NO: 529729 - DNA, 25 bp, Mus musculus
gcaatgctgttcttggagaatgttc

SEQ ID NO: 529730 - DNA, 25 bp, Mus musculus
gcaatgcttcttaccaaatatgtct

SEQ ID NO: 529731 - DNA, 25 bp, Mus musculus
gcaatgcttctttccaaatatgtct

SEQ ID NO: 529732 - DNA, 25 bp, Mus musculus
gcaatgcttgtaattatgtgcaaat

SEQ ID NO: 529733 - DNA, 25 bp, Mus musculus
gcaatgcttgtatttatgtgcaaat

SEQ ID NO: 529734 - DNA, 25 bp, Mus musculus
gcaatgctttccaggctatttgtcc

SEQ ID NO: 529735 - DNA, 25 bp, Mus musculus
gcaatgctttcctggctatttgtcc

SEQ ID NO: 529736 - DNA, 25 bp, Mus musculus
gcaatgctttgaatgaatacccacc

SEQ ID NO: 529737 - DNA, 25 bp, Mus musculus
gcaatgctttgattgaatacccacc

SEQ ID NO: 529738 - DNA, 25 bp, Mus musculus
gcaatggagactatgagtcctacac

SEQ ID NO: 529739 - DNA, 25 bp, Mus musculus
gcaatggagactttgagtcctacac

SEQ ID NO: 529740 - DNA, 25 bp, Mus musculus
gcaatggaggagaccgtgtctccca

SEQ ID NO: 529741 - DNA, 25 bp, Mus musculus
gcaatggaggagtccgtgtctccca

SEQ ID NO: 529742 - DNA, 25 bp, Mus musculus
gcaatggatacacgacatcacaccc

SEQ ID NO: 529743 - DNA, 25 bp, Mus musculus
gcaatggatacaggacatcacaccc

SEQ ID NO: 529744 - DNA, 25 bp, Mus musculus
gcaatggatgaacctcgctctggag

SEQ ID NO: 529745 - DNA, 25 bp, Mus musculus
gcaatggatgaagctcgctctggag

SEQ ID NO: 529746 - DNA, 25 bp, Mus musculus
gcaatggatgctaggctcttaagaa

SEQ ID NO: 529747 - DNA, 25 bp, Mus musculus
gcaatggatgcttggctcttaagaa

SEQ ID NO: 529748 - DNA, 25 bp, Mus musculus
gcaatggatgggaatcggactcttt

SEQ ID NO: 529749 - DNA, 25 bp, Mus musculus
gcaatggatgggtatcggactcttt

SEQ ID NO: 529750 - DNA, 25 bp, Mus musculus
gcaatggattgcagcctctcaattc

SEQ ID NO: 529751 - DNA, 25 bp, Mus musculus
gcaatggattgctgcctctcaattc

SEQ ID NO: 529752 - DNA, 25 bp, Mus musculus
gcaatggcaaaaataggcgctcttc

SEQ ID NO: 529753 - DNA, 25 bp, Mus musculus
gcaatggcaaaattaggcgctcttc

SEQ ID NO: 529754 - DNA, 25 bp, Mus musculus
gcaatggcaagaaccatgaggccct

SEQ ID NO: 529755 - DNA, 25 bp, Mus musculus
gcaatggcaagatccatgaggccct

SEQ ID NO: 529756 - DNA, 25 bp, Mus musculus
gcaatggcaagtagcggtcctactt

SEQ ID NO: 529757 - DNA, 25 bp, Mus musculus
gcaatggcaagttgcggtcctactt

SEQ ID NO: 529758 - DNA, 25 bp, Mus musculus
gcaatggcacttaatctcctgtgta

SEQ ID NO: 529759 - DNA, 25 bp, Mus musculus
gcaatggcactttatctcctgtgta

SEQ ID NO: 529760 - DNA, 25 bp, Mus musculus
gcaatggcagcccatgctttaggct

SEQ ID NO: 529761 - DNA, 25 bp, Mus musculus
gcaatggcagccgatgctttaggct

SEQ ID NO: 529762 - DNA, 25 bp, Mus musculus
gcaatggcatttctgtagttgcaca

SEQ ID NO: 529763 - DNA, 25 bp, Mus musculus
gcaatggcatttgtgtagttgcaca

SEQ ID NO: 529764 - DNA, 25 bp, Mus musculus
gcaatggccagccagattctctggg

SEQ ID NO: 529765 - DNA, 25 bp, Mus musculus
gcaatggccagcgagattctctggg

SEQ ID NO: 529766 - DNA, 25 bp, Mus musculus
gcaatggcccagcttaccagttgtg

SEQ ID NO: 529767 - DNA, 25 bp, Mus musculus
gcaatggcccaggttaccagttgtg

SEQ ID NO: 529768 - DNA, 25 bp, Mus musculus
gcaatggccgaactacaggaactcc

SEQ ID NO: 529769 - DNA, 25 bp, Mus musculus
gcaatggccgaagtacaggaactcc

SEQ ID NO: 529770 - DNA, 25 bp, Mus musculus
gcaatggctgccatgaacgtgggat

SEQ ID NO: 529771 - DNA, 25 bp, Mus musculus
gcaatggctgccttgaacgtgggat

SEQ ID NO: 529772 - DNA, 25 bp, Mus musculus
gcaatgggagacaagactcctcctg

SEQ ID NO: 529773 - DNA, 25 bp, Mus musculus
gcaatgggagactagactcctcctg

SEQ ID NO: 529774 - DNA, 25 bp, Mus musculus
gcaatgggagctcattttcacttct

SEQ ID NO: 529775 - DNA, 25 bp, Mus musculus
gcaatgggagctgattttcacttct

SEQ ID NO: 529776 - DNA, 25 bp, Mus musculus
gcaatgggattcatgaagcgtgaac

SEQ ID NO: 529777 - DNA, 25 bp, Mus musculus
gcaatgggattcttgaagcgtgaac

SEQ ID NO: 529778 - DNA, 25 bp, Mus musculus
gcaatggtcaccaactgtatgggca

SEQ ID NO: 529779 - DNA, 25 bp, Mus musculus
gcaatggtcacctactgtatgggca

SEQ ID NO: 529780 - DNA, 25 bp, Mus musculus
gcaatggtcactctgtttccacaca

SEQ ID NO: 529781 - DNA, 25 bp, Mus musculus
gcaatggtcactgtgtttccacaca

SEQ ID NO: 529782 - DNA, 25 bp, Mus musculus
gcaatggtcttcataggtgattcct

SEQ ID NO: 529783 - DNA, 25 bp, Mus musculus
gcaatggtcttcttaggtgattcct

SEQ ID NO: 529784 - DNA, 25 bp, Mus musculus
gcaatggttgtgagggctgcttctt

SEQ ID NO: 529785 - DNA, 25 bp, Mus musculus
gcaatggttgtgtgggctgcttctt

SEQ ID NO: 529786 - DNA, 25 bp, Mus musculus
gcaatggtttagaatcaggtactag

SEQ ID NO: 529787 - DNA, 25 bp, Mus musculus
gcaatggtttagtatcaggtactag

SEQ ID NO: 529788 - DNA, 25 bp, Mus musculus
gcaatggtttgcatggcgctagtgt

SEQ ID NO: 529789 - DNA, 25 bp, Mus musculus
gcaatggtttgcttggcgctagtgt

SEQ ID NO: 529790 - DNA, 25 bp, Mus musculus
gcaatgtaaaaacctactaatgagt

SEQ ID NO: 529791 - DNA, 25 bp, Mus musculus
gcaatgtaaaaagctactaatgagt

SEQ ID NO: 529792 - DNA, 25 bp, Mus musculus
gcaatgtaccctaaaggaggctgct

SEQ ID NO: 529793 - DNA, 25 bp, Mus musculus
gcaatgtacccttaaggaggctgct

SEQ ID NO: 529794 - DNA, 25 bp, Mus musculus
gcaatgtagtaaatcctttgtttct

SEQ ID NO: 529795 - DNA, 25 bp, Mus musculus
gcaatgtagtaattcctttgtttct

SEQ ID NO: 529796 - DNA, 25 bp, Mus musculus
gcaatgtatgccacagtttgtcact

SEQ ID NO: 529797 - DNA, 25 bp, Mus musculus
gcaatgtatgcctcagtttgtcact

SEQ ID NO: 529798 - DNA, 25 bp, Mus musculus
gcaatgtattggcttggtctctccc

SEQ ID NO: 529799 - DNA, 25 bp, Mus musculus
gcaatgtattgggttggtctctccc

SEQ ID NO: 529800 - DNA, 25 bp, Mus musculus
gcaatgtcaatactatccccatggt

SEQ ID NO: 529801 - DNA, 25 bp, Mus musculus
gcaatgtcaatagtatccccatggt

SEQ ID NO: 529802 - DNA, 25 bp, Mus musculus
gcaatgtcactgcaagcaatgctgt

SEQ ID NO: 529803 - DNA, 25 bp, Mus musculus
gcaatgtcactggaagcaatgctgt

SEQ ID NO: 529804 - DNA, 25 bp, Mus musculus
gcaatgtcacttatgctcttctgat

SEQ ID NO: 529805 - DNA, 25 bp, Mus musculus
gcaatgtcacttttgctcttctgat

SEQ ID NO: 529806 - DNA, 25 bp, Mus musculus
gcaatgtcatatcaaagcatccttt

SEQ ID NO: 529807 - DNA, 25 bp, Mus musculus
gcaatgtcatatgaaagcatccttt

SEQ ID NO: 529808 - DNA, 25 bp, Mus musculus
gcaatgtcccggatagtctctgtag

SEQ ID NO: 529809 - DNA, 25 bp, Mus musculus
gcaatgtcccggttagtctctgtag

SEQ ID NO: 529810 - DNA, 25 bp, Mus musculus
gcaatgtcctcgctggcttgtatta

SEQ ID NO: 529811 - DNA, 25 bp, Mus musculus
gcaatgtcctcggtggcttgtatta

SEQ ID NO: 529812 - DNA, 25 bp, Mus musculus
gcaatgtctggaccattcagtaagt

SEQ ID NO: 529813 - DNA, 25 bp, Mus musculus
gcaatgtctggagcattcagtaagt

SEQ ID NO: 529814 - DNA, 25 bp, Mus musculus
gcaatgtggagcagtccttcttcaa

SEQ ID NO: 529815 - DNA, 25 bp, Mus musculus
gcaatgtggagctgtccttcttcaa

SEQ ID NO: 529816 - DNA, 25 bp, Mus musculus
gcaatgtggtggacaaggatctttt

SEQ ID NO: 529817 - DNA, 25 bp, Mus musculus
gcaatgtggtggtcaaggatctttt

SEQ ID NO: 529818 - DNA, 25 bp, Mus musculus
gcaatgtggtgtaggacacggccat

SEQ ID NO: 529819 - DNA, 25 bp, Mus musculus
gcaatgtggtgttggacacggccat

SEQ ID NO: 529820 - DNA, 25 bp, Mus musculus
gcaatgtgtaccattatagcccagt

SEQ ID NO: 529821 - DNA, 25 bp, Mus musculus
gcaatgtgtacctttatagcccagt

SEQ ID NO: 529822 - DNA, 25 bp, Mus musculus
gcaatgttactaaaatagaggtcgt

SEQ ID NO: 529823 - DNA, 25 bp, Mus musculus
gcaatgttactataatagaggtcgt

SEQ ID NO: 529824 - DNA, 25 bp, Mus musculus
gcaatgttactcacctcagttaggg

SEQ ID NO: 529825 - DNA, 25 bp, Mus musculus
gcaatgttactctcctcagttaggg

SEQ ID NO: 529826 - DNA, 25 bp, Mus musculus
gcaatgttcacaatcttcatgtcta

SEQ ID NO: 529827 - DNA, 25 bp, Mus musculus
gcaatgttcacattcttcatgtcta

SEQ ID NO: 529828 - DNA, 25 bp, Mus musculus
gcaatgttccggatcgagggtctcg

SEQ ID NO: 529829 - DNA, 25 bp, Mus musculus
gcaatgttccggttcgagggtctcg

SEQ ID NO: 529830 - DNA, 25 bp, Mus musculus
gcaatgttctcactacaggcgtacc

SEQ ID NO: 529831 - DNA, 25 bp, Mus musculus
gcaatgttctcagtacaggcgtacc

SEQ ID NO: 529832 - DNA, 25 bp, Mus musculus
gcaatgttctccacagttgttttag

SEQ ID NO: 529833 - DNA, 25 bp, Mus musculus
gcaatgttctcctcagttgttttag

SEQ ID NO: 529834 - DNA, 25 bp, Mus musculus
gcaatgttgactcagttcctactat

SEQ ID NO: 529835 - DNA, 25 bp, Mus musculus
gcaatgttgactgagttcctactat

SEQ ID NO: 529836 - DNA, 25 bp, Mus musculus
gcaatgttgcaccaagggcagcttg

SEQ ID NO: 529837 - DNA, 25 bp, Mus musculus
gcaatgttgcacgaagggcagcttg

SEQ ID NO: 529838 - DNA, 25 bp, Mus musculus
gcaatgttggtcacagactctcagc

SEQ ID NO: 529839 - DNA, 25 bp, Mus musculus
gcaatgttggtctcagactctcagc

SEQ ID NO: 529840 - DNA, 25 bp, Mus musculus
gcaatgttgtacaatggctgattta

SEQ ID NO: 529841 - DNA, 25 bp, Mus musculus
gcaatgttgtactatggctgattta

SEQ ID NO: 529842 - DNA, 25 bp, Mus musculus
gcaatgtttaataaagtgcccaaag

SEQ ID NO: 529843 - DNA, 25 bp, Mus musculus
gcaatgtttaattaagtgcccaaag

SEQ ID NO: 529844 - DNA, 25 bp, Mus musculus
gcaatgtttatgacctttcctaccc

SEQ ID NO: 529845 - DNA, 25 bp, Mus musculus
gcaatgtttatgtcctttcctaccc

SEQ ID NO: 529846 - DNA, 25 bp, Mus musculus
gcaatgtttctgctatcctttaaga

SEQ ID NO: 529847 - DNA, 25 bp, Mus musculus
gcaatgtttctggtatcctttaaga

SEQ ID NO: 529848 - DNA, 25 bp, Mus musculus
gcaatgtttgttcctaaatctatga

SEQ ID NO: 529849 - DNA, 25 bp, Mus musculus
gcaatgtttgttgctaaatctatga

SEQ ID NO: 529850 - DNA, 25 bp, Mus musculus
gcaatgttttacacagtcatccaaa

SEQ ID NO: 529851 - DNA, 25 bp, Mus musculus
gcaatgttttactcagtcatccaaa

SEQ ID NO: 529852 - DNA, 25 bp, Mus musculus
gcaatgttttcacccatagaccttg

SEQ ID NO: 529853 - DNA, 25 bp, Mus musculus
gcaatgttttcagccatagaccttg

SEQ ID NO: 529854 - DNA, 25 bp, Mus musculus
gcaatgttttctctagtggttccct

SEQ ID NO: 529855 - DNA, 25 bp, Mus musculus
gcaatgttttctgtagtggttccct

SEQ ID NO: 529856 - DNA, 25 bp, Mus musculus
gcaattaacttccaggagttccttg

SEQ ID NO: 529857 - DNA, 25 bp, Mus musculus
gcaattaacttcgaggagttccttg

SEQ ID NO: 529858 - DNA, 25 bp, Mus musculus
gcaattaactttagggagccaggaa

SEQ ID NO: 529859 - DNA, 25 bp, Mus musculus
gcaattaacttttgggagccaggaa

SEQ ID NO: 529860 - DNA, 25 bp, Mus musculus
gcaattaagaagaagcatggtagcc

SEQ ID NO: 529861 - DNA, 25 bp, Mus musculus
gcaattaagaagtagcatggtagcc

SEQ ID NO: 529862 - DNA, 25 bp, Mus musculus
gcaattaatcttattaccacagctg

SEQ ID NO: 529863 - DNA, 25 bp, Mus musculus
gcaattaatctttttaccacagctg

SEQ ID NO: 529864 - DNA, 25 bp, Mus musculus
gcaattacatgaaggctggcaacca

SEQ ID NO: 529865 - DNA, 25 bp, Mus musculus
gcaattacatgatggctggcaacca

SEQ ID NO: 529866 - DNA, 25 bp, Mus musculus
gcaattacatgcagacgtgctctgc

SEQ ID NO: 529867 - DNA, 25 bp, Mus musculus
gcaattacatgctgacgtgctctgc

SEQ ID NO: 529868 - DNA, 25 bp, Mus musculus
gcaattacccttcattgccagcttg

SEQ ID NO: 529869 - DNA, 25 bp, Mus musculus
gcaattacccttgattgccagcttg

SEQ ID NO: 529870 - DNA, 25 bp, Mus musculus
gcaattactttcaatgctcctggca

SEQ ID NO: 529871 - DNA, 25 bp, Mus musculus
gcaattactttctatgctcctggca

SEQ ID NO: 529872 - DNA, 25 bp, Mus musculus
gcaattagcaaacatcatgagcaaa

SEQ ID NO: 529873 - DNA, 25 bp, Mus musculus
gcaattagcaaagatcatgagcaaa

SEQ ID NO: 529874 - DNA, 25 bp, Mus musculus
gcaattaggcatcgtgctcatcaca

SEQ ID NO: 529875 - DNA, 25 bp, Mus musculus
gcaattaggcatggtgctcatcaca

SEQ ID NO: 529876 - DNA, 25 bp, Mus musculus
gcaattaggttaacattacgtttat

SEQ ID NO: 529877 - DNA, 25 bp, Mus musculus
gcaattaggttatcattacgtttat

SEQ ID NO: 529878 - DNA, 25 bp, Mus musculus
gcaattaggttgacgtcattttaaa

SEQ ID NO: 529879 - DNA, 25 bp, Mus musculus
gcaattaggttgctttattcaggta

SEQ ID NO: 529880 - DNA, 25 bp, Mus musculus
gcaattaggttggtttattcaggta

SEQ ID NO: 529881 - DNA, 25 bp, Mus musculus
gcaattaggttgtcgtcattttaaa

SEQ ID NO: 529882 - DNA, 25 bp, Mus musculus
gcaattaggtttacataggctgtgt

SEQ ID NO: 529883 - DNA, 25 bp, Mus musculus
gcaattaggttttcataggctgtgt

SEQ ID NO: 529884 - DNA, 25 bp, Mus musculus
gcaattatacccaaccctgtgaatt

SEQ ID NO: 529885 - DNA, 25 bp, Mus musculus
gcaattataccctaccctgtgaatt

SEQ ID NO: 529886 - DNA, 25 bp, Mus musculus
gcaattatcataacatctacccaga

SEQ ID NO: 529887 - DNA, 25 bp, Mus musculus
gcaattatcatatcatctacccaga

SEQ ID NO: 529888 - DNA, 25 bp, Mus musculus
gcaattatgacaagacagtccccag

SEQ ID NO: 529889 - DNA, 25 bp, Mus musculus
gcaattatgacatgacagtccccag

SEQ ID NO: 529890 - DNA, 25 bp, Mus musculus
gcaattatgatgatatccgtggcag

SEQ ID NO: 529891 - DNA, 25 bp, Mus musculus
gcaattatgatgttatccgtggcag

SEQ ID NO: 529892 - DNA, 25 bp, Mus musculus
gcaattattttcagtatgtacatcc

SEQ ID NO: 529893 - DNA, 25 bp, Mus musculus
gcaattattttctgtatgtacatcc

SEQ ID NO: 529894 - DNA, 25 bp, Mus musculus
gcaattcaaaaacagccaaagtcct

SEQ ID NO: 529895 - DNA, 25 bp, Mus musculus
gcaattcaaaaagagccaaagtcct

SEQ ID NO: 529896 - DNA, 25 bp, Mus musculus
gcaattcaactgactgcagcacata

SEQ ID NO: 529897 - DNA, 25 bp, Mus musculus
gcaattcaactgtctgcagcacata

SEQ ID NO: 529898 - DNA, 25 bp, Mus musculus
gcaattcaatgccatgagctataaa

SEQ ID NO: 529899 - DNA, 25 bp, Mus musculus
gcaattcaatgcgatgagctataaa

SEQ ID NO: 529900 - DNA, 25 bp, Mus musculus
gcaattcagccgcatgcaggttatt

SEQ ID NO: 529901 - DNA, 25 bp, Mus musculus
gcaattcagccggatgcaggttatt

SEQ ID NO: 529902 - DNA, 25 bp, Mus musculus
gcaattcattctacagttatcatgg

SEQ ID NO: 529903 - DNA, 25 bp, Mus musculus
gcaattcattcttcagttatcatgg

SEQ ID NO: 529904 - DNA, 25 bp, Mus musculus
gcaattccaaacataggtccctgat

SEQ ID NO: 529905 - DNA, 25 bp, Mus musculus
gcaattccaaacttaggtccctgat

SEQ ID NO: 529906 - DNA, 25 bp, Mus musculus
gcaattccagaaaacccttacgaat

SEQ ID NO: 529907 - DNA, 25 bp, Mus musculus
gcaattccagaatacccttacgaat

SEQ ID NO: 529908 - DNA, 25 bp, Mus musculus
gcaattccaggaactgtgttctaca

SEQ ID NO: 529909 - DNA, 25 bp, Mus musculus
gcaattccaggatctgtgttctaca

SEQ ID NO: 529910 - DNA, 25 bp, Mus musculus
gcaattccagttagtgataattagc

SEQ ID NO: 529911 - DNA, 25 bp, Mus musculus
gcaattccagttagtgataattagt

SEQ ID NO: 529912 - DNA, 25 bp, Mus musculus
gcaattccagtttgtgataattagc

SEQ ID NO: 529913 - DNA, 25 bp, Mus musculus
gcaattccagtttgtgataattagt

SEQ ID NO: 529914 - DNA, 25 bp, Mus musculus
gcaattccatacagaagctacactt

SEQ ID NO: 529915 - DNA, 25 bp, Mus musculus
gcaattccatactgaagctacactt

SEQ ID NO: 529916 - DNA, 25 bp, Mus musculus
gcaattccccaaaggactttggcag

SEQ ID NO: 529917 - DNA, 25 bp, Mus musculus
gcaattccccaatggactttggcag

SEQ ID NO: 529918 - DNA, 25 bp, Mus musculus
gcaattccctgtccagcctgaagaa

SEQ ID NO: 529919 - DNA, 25 bp, Mus musculus
gcaattccctgtgcagcctgaagaa

SEQ ID NO: 529920 - DNA, 25 bp, Mus musculus
gcaattccgcttaataatccgattt

SEQ ID NO: 529921 - DNA, 25 bp, Mus musculus
gcaattccgctttataatccgattt

SEQ ID NO: 529922 - DNA, 25 bp, Mus musculus
gcaattccggaacatcttcaggcag

SEQ ID NO: 529923 - DNA, 25 bp, Mus musculus
gcaattccggaagatcttcaggcag

SEQ ID NO: 529924 - DNA, 25 bp, Mus musculus
gcaattcctcgaagttggtgttttc

SEQ ID NO: 529925 - DNA, 25 bp, Mus musculus
gcaattcctcgatgttggtgttttc

SEQ ID NO: 529926 - DNA, 25 bp, Mus musculus
gcaattccttctctcatattacatc

SEQ ID NO: 529927 - DNA, 25 bp, Mus musculus
gcaattccttctgtcatattacatc

SEQ ID NO: 529928 - DNA, 25 bp, Mus musculus
gcaattctctttctggatggctgta

SEQ ID NO: 529929 - DNA, 25 bp, Mus musculus
gcaattctctttgtggatggctgta

SEQ ID NO: 529930 - DNA, 25 bp, Mus musculus
gcaattctggccaaaaagcatcttg

SEQ ID NO: 529931 - DNA, 25 bp, Mus musculus
gcaattctggcctaaaagcatcttg

SEQ ID NO: 529932 - DNA, 25 bp, Mus musculus
gcaattctgtaaagcatgtgtatcc

SEQ ID NO: 529933 - DNA, 25 bp, Mus musculus
gcaattctgtaatgcatgtgtatcc

SEQ ID NO: 529934 - DNA, 25 bp, Mus musculus
gcaattctgtagagtcgtttcttat

SEQ ID NO: 529935 - DNA, 25 bp, Mus musculus
gcaattctgtagtgtcgtttcttat

SEQ ID NO: 529936 - DNA, 25 bp, Mus musculus
gcaattctgttcctgcaataggact

SEQ ID NO: 529937 - DNA, 25 bp, Mus musculus
gcaattctgttcgtgcaataggact

SEQ ID NO: 529938 - DNA, 25 bp, Mus musculus
gcaattcttcaaataaaggtccctt

SEQ ID NO: 529939 - DNA, 25 bp, Mus musculus
gcaattcttcaattaaaggtccctt

SEQ ID NO: 529940 - DNA, 25 bp, Mus musculus
gcaattctttctccctatacccttt

SEQ ID NO: 529941 - DNA, 25 bp, Mus musculus
gcaattctttctgcctatacccttt

SEQ ID NO: 529942 - DNA, 25 bp, Mus musculus
gcaattgatgggagcctgctgctgt

SEQ ID NO: 529943 - DNA, 25 bp, Mus musculus
gcaattgatgggtgcctgctgctgt

SEQ ID NO: 529944 - DNA, 25 bp, Mus musculus
gcaattgattgactgagaatctgat

SEQ ID NO: 529945 - DNA, 25 bp, Mus musculus
gcaattgattgagtgagaatctgat

SEQ ID NO: 529946 - DNA, 25 bp, Mus musculus
gcaattgattgccactgtctgagcc

SEQ ID NO: 529947 - DNA, 25 bp, Mus musculus
gcaattgattgcgactgtctgagcc

SEQ ID NO: 529948 - DNA, 25 bp, Mus musculus
gcaattgatttcacttcacacagtg

SEQ ID NO: 529949 - DNA, 25 bp, Mus musculus
gcaattgatttctcttcacacagtg

SEQ ID NO: 529950 - DNA, 25 bp, Mus musculus
gcaattgcaacaagcttctcggtag

SEQ ID NO: 529951 - DNA, 25 bp, Mus musculus
gcaattgcaacatgcttctcggtag

SEQ ID NO: 529952 - DNA, 25 bp, Mus musculus
gcaattgcagtgaagacgaccgaga

SEQ ID NO: 529953 - DNA, 25 bp, Mus musculus
gcaattgcagtgtagacgaccgaga

SEQ ID NO: 529954 - DNA, 25 bp, Mus musculus
gcaattgccaaaacttctgtattta

SEQ ID NO: 529955 - DNA, 25 bp, Mus musculus
gcaattgccaaatcttctgtattta

SEQ ID NO: 529956 - DNA, 25 bp, Mus musculus
gcaattgcctatagggtaccccaga

SEQ ID NO: 529957 - DNA, 25 bp, Mus musculus
gcaattgcctattgggtaccccaga

SEQ ID NO: 529958 - DNA, 25 bp, Mus musculus
gcaattgctctaaaccactcagcta

SEQ ID NO: 529959 - DNA, 25 bp, Mus musculus
gcaattgctctataccactcagcta

SEQ ID NO: 529960 - DNA, 25 bp, Mus musculus
gcaattgcttcaatcggtgcactaa

SEQ ID NO: 529961 - DNA, 25 bp, Mus musculus
gcaattgcttcattcggtgcactaa

SEQ ID NO: 529962 - DNA, 25 bp, Mus musculus
gcaattggagcccatgcacctggcg

SEQ ID NO: 529963 - DNA, 25 bp, Mus musculus
gcaattggagccgatgcacctggcg

SEQ ID NO: 529964 - DNA, 25 bp, Mus musculus
gcaattggatgccaggcactcacat

SEQ ID NO: 529965 - DNA, 25 bp, Mus musculus
gcaattggatgcgaggcactcacat

SEQ ID NO: 529966 - DNA, 25 bp, Mus musculus
gcaattgggattacatccacactga

SEQ ID NO: 529967 - DNA, 25 bp, Mus musculus
gcaattgggatttcatccacactga

SEQ ID NO: 529968 - DNA, 25 bp, Mus musculus
gcaattggtacacggactacaggta

SEQ ID NO: 529969 - DNA, 25 bp, Mus musculus
gcaattggtacagggactacaggta

SEQ ID NO: 529970 - DNA, 25 bp, Mus musculus
gcaattgtccatacactgggatgct

SEQ ID NO: 529971 - DNA, 25 bp, Mus musculus
gcaattgtccattcactgggatgct

SEQ ID NO: 529972 - DNA, 25 bp, Mus musculus
gcaattgtcctcatttagatgtgta

SEQ ID NO: 529973 - DNA, 25 bp, Mus musculus
gcaattgtcctcttttagatgtgta

SEQ ID NO: 529974 - DNA, 25 bp, Mus musculus
gcaattgtgcttactattcgatggt

SEQ ID NO: 529975 - DNA, 25 bp, Mus musculus
gcaattgtgctttctattcgatggt

SEQ ID NO: 529976 - DNA, 25 bp, Mus musculus
gcaattgtgttccctttacctttct

SEQ ID NO: 529977 - DNA, 25 bp, Mus musculus
gcaattgtgttcgctttacctttct

SEQ ID NO: 529978 - DNA, 25 bp, Mus musculus
gcaattgttccaaaaagccactaga

SEQ ID NO: 529979 - DNA, 25 bp, Mus musculus
gcaattgttccataaagccactaga

SEQ ID NO: 529980 - DNA, 25 bp, Mus musculus
gcaattgttgttcgctttcagcaaa

SEQ ID NO: 529981 - DNA, 25 bp, Mus musculus
gcaattgttgttggctttcagcaaa

SEQ ID NO: 529982 - DNA, 25 bp, Mus musculus
gcaattgttttgacaactgtaactt

SEQ ID NO: 529983 - DNA, 25 bp, Mus musculus
gcaattgttttgtcaactgtaactt

SEQ ID NO: 529984 - DNA, 25 bp, Mus musculus
gcaatttaatgtaggtagtatagca

SEQ ID NO: 529985 - DNA, 25 bp, Mus musculus
gcaatttaatgttggtagtatagca

SEQ ID NO: 529986 - DNA, 25 bp, Mus musculus
gcaatttagcctcgaaagtaagttt

SEQ ID NO: 529987 - DNA, 25 bp, Mus musculus
gcaatttagcctggaaagtaagttt

SEQ ID NO: 529988 - DNA, 25 bp, Mus musculus
gcaatttagttccagtgccatccag

SEQ ID NO: 529989 - DNA, 25 bp, Mus musculus
gcaatttagttcgagtgccatccag

SEQ ID NO: 529990 - DNA, 25 bp, Mus musculus
gcaatttatactaatctgtgtcaag

SEQ ID NO: 529991 - DNA, 25 bp, Mus musculus
gcaatttatacttatctgtgtcaag

SEQ ID NO: 529992 - DNA, 25 bp, Mus musculus
gcaatttcccccacatgatgtctaa

SEQ ID NO: 529993 - DNA, 25 bp, Mus musculus
gcaatttccccctcatgatgtctaa

SEQ ID NO: 529994 - DNA, 25 bp, Mus musculus
gcaatttccctacagatggcacaat

SEQ ID NO: 529995 - DNA, 25 bp, Mus musculus
gcaatttccctagagatggcacaat

SEQ ID NO: 529996 - DNA, 25 bp, Mus musculus
gcaatttccctgcagatgaacacat

SEQ ID NO: 529997 - DNA, 25 bp, Mus musculus
gcaatttccctggagatgaacacat

SEQ ID NO: 529998 - DNA, 25 bp, Mus musculus
gcaatttcctaaacactctgacttt

SEQ ID NO: 529999 - DNA, 25 bp, Mus musculus
gcaatttcctaatcactctgacttt

SEQ ID NO: 530000 - DNA, 25 bp, Mus musculus
gcaatttccttgatactagatcact

SEQ ID NO: 530001 - DNA, 25 bp, Mus musculus
gcaatttccttgttactagatcact

SEQ ID NO: 530002 - DNA, 25 bp, Mus musculus
gcaatttctcataaacattcttgtc

SEQ ID NO: 530003 - DNA, 25 bp, Mus musculus
gcaatttctcattaacattcttgtc

SEQ ID NO: 530004 - DNA, 25 bp, Mus musculus
gcaatttctttgagcagtagtccat

SEQ ID NO: 530005 - DNA, 25 bp, Mus musculus
gcaatttctttgtgcagtagtccat

SEQ ID NO: 530006 - DNA, 25 bp, Mus musculus
gcaatttgactcaacactatcagtt

SEQ ID NO: 530007 - DNA, 25 bp, Mus musculus
gcaatttgactctacactatcagtt

SEQ ID NO: 530008 - DNA, 25 bp, Mus musculus
gcaatttgagcacacttcagcgata

SEQ ID NO: 530009 - DNA, 25 bp, Mus musculus
gcaatttgagcagacttcagcgata

SEQ ID NO: 530010 - DNA, 25 bp, Mus musculus
gcaatttgattgctttccttctatt

SEQ ID NO: 530011 - DNA, 25 bp, Mus musculus
gcaatttgattggtttccttctatt

SEQ ID NO: 530012 - DNA, 25 bp, Mus musculus
gcaatttgcctgagatgtgccaact

SEQ ID NO: 530013 - DNA, 25 bp, Mus musculus
gcaatttgcctgtgatgtgccaact

SEQ ID NO: 530014 - DNA, 25 bp, Mus musculus
gcaatttgtattactttatggtggt

SEQ ID NO: 530015 - DNA, 25 bp, Mus musculus
gcaatttgtatttctttatggtggt

SEQ ID NO: 530016 - DNA, 25 bp, Mus musculus
gcaattttacgtatcagtaggcaga

SEQ ID NO: 530017 - DNA, 25 bp, Mus musculus
gcaattttacgtttcagtaggcaga

SEQ ID NO: 530018 - DNA, 25 bp, Mus musculus
gcaattttattactgtggctgaaca

SEQ ID NO: 530019 - DNA, 25 bp, Mus musculus
gcaattttattagtgtggctgaaca

SEQ ID NO: 530020 - DNA, 25 bp, Mus musculus
gcaattttccagaggcgtgtcttac

SEQ ID NO: 530021 - DNA, 25 bp, Mus musculus
gcaattttccagtggcgtgtcttac

SEQ ID NO: 530022 - DNA, 25 bp, Mus musculus
gcaattttcgagagtgtagtcattc

SEQ ID NO: 530023 - DNA, 25 bp, Mus musculus
gcaattttcgagtgtgtagtcattc

SEQ ID NO: 530024 - DNA, 25 bp, Mus musculus
gcaattttctgaccatattcactga

SEQ ID NO: 530025 - DNA, 25 bp, Mus musculus
gcaattttctgagcatattcactga

SEQ ID NO: 530026 - DNA, 25 bp, Mus musculus
gcaattttctgtatattagggacaa

SEQ ID NO: 530027 - DNA, 25 bp, Mus musculus
gcaattttctgtttattagggacaa

SEQ ID NO: 530028 - DNA, 25 bp, Mus musculus
gcaatttttctgattcttcaacttc

SEQ ID NO: 530029 - DNA, 25 bp, Mus musculus
gcaatttttctgctcagtgctctga

SEQ ID NO: 530030 - DNA, 25 bp, Mus musculus
gcaatttttctggtcagtgctctga

SEQ ID NO: 530031 - DNA, 25 bp, Mus musculus
gcaatttttctgtttcttcaacttc

SEQ ID NO: 530032 - DNA, 25 bp, Mus musculus
gcaatttttgaaatgcctgatgcct

SEQ ID NO: 530033 - DNA, 25 bp, Mus musculus
gcaatttttgaattgcctgatgcct

SEQ ID NO: 530034 - DNA, 25 bp, Mus musculus
gcaattttttacatggtgcctgctt

SEQ ID NO: 530035 - DNA, 25 bp, Mus musculus
gcaattttttacttggtgcctgctt

SEQ ID NO: 530036 - DNA, 25 bp, Mus musculus
gcaattttttgactgccaactccga

SEQ ID NO: 530037 - DNA, 25 bp, Mus musculus
gcaattttttgagtgccaactccga

SEQ ID NO: 530038 - DNA, 25 bp, Mus musculus
gcacaaaaacttcactccatcctta

SEQ ID NO: 530039 - DNA, 25 bp, Mus musculus
gcacaaaaacttgactccatcctta

SEQ ID NO: 530040 - DNA, 25 bp, Mus musculus
gcacaaaacgatagagcagtccaca

SEQ ID NO: 530041 - DNA, 25 bp, Mus musculus
gcacaaaacgattgagcagtccaca

SEQ ID NO: 530042 - DNA, 25 bp, Mus musculus
gcacaaaacttgctggagttcacag

SEQ ID NO: 530043 - DNA, 25 bp, Mus musculus
gcacaaaacttggtggagttcacag

SEQ ID NO: 530044 - DNA, 25 bp, Mus musculus
gcacaaaagagcctctaagctgaag

SEQ ID NO: 530045 - DNA, 25 bp, Mus musculus
gcacaaaagagcgtctaagctgaag

SEQ ID NO: 530046 - DNA, 25 bp, Mus musculus
gcacaaaagcctctagaaccccgtt

SEQ ID NO: 530047 - DNA, 25 bp, Mus musculus
gcacaaaagcctgtagaaccccgtt

SEQ ID NO: 530048 - DNA, 25 bp, Mus musculus
gcacaaacaaccatcacctgggcaa

SEQ ID NO: 530049 - DNA, 25 bp, Mus musculus
gcacaaacaaccatggaagcacttt

SEQ ID NO: 530050 - DNA, 25 bp, Mus musculus
gcacaaacaaccttcacctgggcaa

SEQ ID NO: 530051 - DNA, 25 bp, Mus musculus
gcacaaacaaccttggaagcacttt

SEQ ID NO: 530052 - DNA, 25 bp, Mus musculus
gcacaaacaagacgagaaccagtta

SEQ ID NO: 530053 - DNA, 25 bp, Mus musculus
gcacaaacaagaggagaaccagtta

SEQ ID NO: 530054 - DNA, 25 bp, Mus musculus
gcacaaacaccaagctgcagacagc

SEQ ID NO: 530055 - DNA, 25 bp, Mus musculus
gcacaaacaccatgctgcagacagc

SEQ ID NO: 530056 - DNA, 25 bp, Mus musculus
gcacaaaccatgaagctgctctaat

SEQ ID NO: 530057 - DNA, 25 bp, Mus musculus
gcacaaaccatgtagctgctctaat

SEQ ID NO: 530058 - DNA, 25 bp, Mus musculus
gcacaaacttatcctctttgtccaa

SEQ ID NO: 530059 - DNA, 25 bp, Mus musculus
gcacaaacttatgctctttgtccaa

SEQ ID NO: 530060 - DNA, 25 bp, Mus musculus
gcacaaagaggaccccggtagcggt

SEQ ID NO: 530061 - DNA, 25 bp, Mus musculus
gcacaaagaggagcccggtagcggt

SEQ ID NO: 530062 - DNA, 25 bp, Mus musculus
gcacaaagttagcttcaggacctgt

SEQ ID NO: 530063 - DNA, 25 bp, Mus musculus
gcacaaagttaggttcaggacctgt

SEQ ID NO: 530064 - DNA, 25 bp, Mus musculus
gcacaaagttcccaatagcttctct

SEQ ID NO: 530065 - DNA, 25 bp, Mus musculus
gcacaaagttccgaatagcttctct

SEQ ID NO: 530066 - DNA, 25 bp, Mus musculus
gcacaaatatgccagctacctttgg

SEQ ID NO: 530067 - DNA, 25 bp, Mus musculus
gcacaaatatgcgagctacctttgg

SEQ ID NO: 530068 - DNA, 25 bp, Mus musculus
gcacaaatcatcactgtagctctaa

SEQ ID NO: 530069 - DNA, 25 bp, Mus musculus
gcacaaatcatctctgtagctctaa

SEQ ID NO: 530070 - DNA, 25 bp, Mus musculus
gcacaaatcctgagaacggagcata

SEQ ID NO: 530071 - DNA, 25 bp, Mus musculus
gcacaaatcctgtgaacggagcata

SEQ ID NO: 530072 - DNA, 25 bp, Mus musculus
gcacaaatcggaccccatggattat

SEQ ID NO: 530073 - DNA, 25 bp, Mus musculus
gcacaaatcggagcccatggattat

SEQ ID NO: 530074 - DNA, 25 bp, Mus musculus
gcacaaatgtgcctcatctactcag

SEQ ID NO: 530075 - DNA, 25 bp, Mus musculus
gcacaaatgtgcgtcatctactcag

SEQ ID NO: 530076 - DNA, 25 bp, Mus musculus
gcacaaatttctcactggtgcattt

SEQ ID NO: 530077 - DNA, 25 bp, Mus musculus
gcacaaatttctgactggtgcattt

SEQ ID NO: 530078 - DNA, 25 bp, Mus musculus
gcacaacaacatcatcgctctcaag

SEQ ID NO: 530079 - DNA, 25 bp, Mus musculus
gcacaacaacatgatcgctctcaag

SEQ ID NO: 530080 - DNA, 25 bp, Mus musculus
gcacaacagcacagacttaaggata

SEQ ID NO: 530081 - DNA, 25 bp, Mus musculus
gcacaacagcactgacttaaggata

SEQ ID NO: 530082 - DNA, 25 bp, Mus musculus
gcacaacaggtcatgtgccaccagg

SEQ ID NO: 530083 - DNA, 25 bp, Mus musculus
gcacaacaggtcttgtgccaccagg

SEQ ID NO: 530084 - DNA, 25 bp, Mus musculus
gcacaacagtgcctcttttaatagc

SEQ ID NO: 530085 - DNA, 25 bp, Mus musculus
gcacaacagtgcgtcttttaatagc

SEQ ID NO: 530086 - DNA, 25 bp, Mus musculus
gcacaacatgaacgctagggacctt

SEQ ID NO: 530087 - DNA, 25 bp, Mus musculus
gcacaacatgaaggctagggacctt

SEQ ID NO: 530088 - DNA, 25 bp, Mus musculus
gcacaacatgcgaatgcggtacata

SEQ ID NO: 530089 - DNA, 25 bp, Mus musculus
gcacaacatgcgtatgcggtacata

SEQ ID NO: 530090 - DNA, 25 bp, Mus musculus
gcacaacattgtccctatttgatat

SEQ ID NO: 530091 - DNA, 25 bp, Mus musculus
gcacaacattgtgcctatttgatat

SEQ ID NO: 530092 - DNA, 25 bp, Mus musculus
gcacaacccttgacttatcactatg

SEQ ID NO: 530093 - DNA, 25 bp, Mus musculus
gcacaacccttgtcttatcactatg

SEQ ID NO: 530094 - DNA, 25 bp, Mus musculus
gcacaaccgtccatgtgggcatcca

SEQ ID NO: 530095 - DNA, 25 bp, Mus musculus
gcacaaccgtccttgtgggcatcca

SEQ ID NO: 530096 - DNA, 25 bp, Mus musculus
gcacaacctgtaaagcattcttgga

SEQ ID NO: 530097 - DNA, 25 bp, Mus musculus
gcacaacctgtatagcattcttgga

SEQ ID NO: 530098 - DNA, 25 bp, Mus musculus
gcacaaccttacatgttctcatttg

SEQ ID NO: 530099 - DNA, 25 bp, Mus musculus
gcacaaccttacttgttctcatttg

SEQ ID NO: 530100 - DNA, 25 bp, Mus musculus
gcacaacgacggcaactggcactgg

SEQ ID NO: 530101 - DNA, 25 bp, Mus musculus
gcacaacgacgggaactggcactgg

SEQ ID NO: 530102 - DNA, 25 bp, Mus musculus
gcacaacgcctccaaagcactggaa

SEQ ID NO: 530103 - DNA, 25 bp, Mus musculus
gcacaacgcctcgaaagcactggaa

SEQ ID NO: 530104 - DNA, 25 bp, Mus musculus
gcacaacgctgtcttttgctcggcg

SEQ ID NO: 530105 - DNA, 25 bp, Mus musculus
gcacaacgctgtgttttgctcggcg

SEQ ID NO: 530106 - DNA, 25 bp, Mus musculus
gcacaacgtggcacttctaatgtct

SEQ ID NO: 530107 - DNA, 25 bp, Mus musculus
gcacaacgtggcctttgcctttgaa

SEQ ID NO: 530108 - DNA, 25 bp, Mus musculus
gcacaacgtggcgtttgcctttgaa

SEQ ID NO: 530109 - DNA, 25 bp, Mus musculus
gcacaacgtggctcttctaatgtct

SEQ ID NO: 530110 - DNA, 25 bp, Mus musculus
gcacaactagaaagagcactctcca

SEQ ID NO: 530111 - DNA, 25 bp, Mus musculus
gcacaactagaatgagcactctcca

SEQ ID NO: 530112 - DNA, 25 bp, Mus musculus
gcacaactctttatacggttggctc

SEQ ID NO: 530113 - DNA, 25 bp, Mus musculus
gcacaactctttttacggttggctc

SEQ ID NO: 530114 - DNA, 25 bp, Mus musculus
gcacaactgagaaggtgctggccac

SEQ ID NO: 530115 - DNA, 25 bp, Mus musculus
gcacaactgagatggtgctggccac

SEQ ID NO: 530116 - DNA, 25 bp, Mus musculus
gcacaactgccaactccaaatattt

SEQ ID NO: 530117 - DNA, 25 bp, Mus musculus
gcacaactgccatctccaaatattt

SEQ ID NO: 530118 - DNA, 25 bp, Mus musculus
gcacaactgtatcgttcttgtacga

SEQ ID NO: 530119 - DNA, 25 bp, Mus musculus
gcacaactgtatggttcttgtacga

SEQ ID NO: 530120 - DNA, 25 bp, Mus musculus
gcacaactgtccacaaggcaatcag

SEQ ID NO: 530121 - DNA, 25 bp, Mus musculus
gcacaactgtcctcaaggcaatcag

SEQ ID NO: 530122 - DNA, 25 bp, Mus musculus
gcacaactttgcatggagcagtaat

SEQ ID NO: 530123 - DNA, 25 bp, Mus musculus
gcacaactttgcttggagcagtaat

SEQ ID NO: 530124 - DNA, 25 bp, Mus musculus
gcacaagaccaacccggcaagttca

SEQ ID NO: 530125 - DNA, 25 bp, Mus musculus
gcacaagaccaagccggcaagttca

SEQ ID NO: 530126 - DNA, 25 bp, Mus musculus
gcacaagaggccacaggtctgctgt

SEQ ID NO: 530127 - DNA, 25 bp, Mus musculus
gcacaagaggcctcaggtctgctgt

SEQ ID NO: 530128 - DNA, 25 bp, Mus musculus
gcacaagagtttcctacctacctgt

SEQ ID NO: 530129 - DNA, 25 bp, Mus musculus
gcacaagagtttgctacctacctgt

SEQ ID NO: 530130 - DNA, 25 bp, Mus musculus
gcacaagatacaataatctgggaag

SEQ ID NO: 530131 - DNA, 25 bp, Mus musculus
gcacaagatacattaatctgggaag

SEQ ID NO: 530132 - DNA, 25 bp, Mus musculus
gcacaagatctcaattttcaaaaga

SEQ ID NO: 530133 - DNA, 25 bp, Mus musculus
gcacaagatctctattttcaaaaga

SEQ ID NO: 530134 - DNA, 25 bp, Mus musculus
gcacaagcaatgatcaacctggcat

SEQ ID NO: 530135 - DNA, 25 bp, Mus musculus
gcacaagcaatgttcaacctggcat

SEQ ID NO: 530136 - DNA, 25 bp, Mus musculus
gcacaagcacaacaataatcctgag

SEQ ID NO: 530137 - DNA, 25 bp, Mus musculus
gcacaagcacaagaataatcctgag

SEQ ID NO: 530138 - DNA, 25 bp, Mus musculus
gcacaagcaccaattatgactaacc

SEQ ID NO: 530139 - DNA, 25 bp, Mus musculus
gcacaagcaccatttatgactaacc

SEQ ID NO: 530140 - DNA, 25 bp, Mus musculus
gcacaagcacgtatacctggaacta

SEQ ID NO: 530141 - DNA, 25 bp, Mus musculus
gcacaagcacgtttacctggaacta

SEQ ID NO: 530142 - DNA, 25 bp, Mus musculus
gcacaagcagtgaagccacaagcaa

SEQ ID NO: 530143 - DNA, 25 bp, Mus musculus
gcacaagcagtgtagccacaagcaa

SEQ ID NO: 530144 - DNA, 25 bp, Mus musculus
gcacaagcatctatatactcatcat

SEQ ID NO: 530145 - DNA, 25 bp, Mus musculus
gcacaagcatctttatactcatcat

SEQ ID NO: 530146 - DNA, 25 bp, Mus musculus
gcacaagcattgatgctccagtggt

SEQ ID NO: 530147 - DNA, 25 bp, Mus musculus
gcacaagcattgttgctccagtggt

SEQ ID NO: 530148 - DNA, 25 bp, Mus musculus
gcacaagcggtaacgacttctaagt

SEQ ID NO: 530149 - DNA, 25 bp, Mus musculus
gcacaagcggtatcgacttctaagt

SEQ ID NO: 530150 - DNA, 25 bp, Mus musculus
gcacaagctcttaacagccgggcca

SEQ ID NO: 530151 - DNA, 25 bp, Mus musculus
gcacaagctctttacagccgggcca

SEQ ID NO: 530152 - DNA, 25 bp, Mus musculus
gcacaaggacgtctgtttgtccaaa

SEQ ID NO: 530153 - DNA, 25 bp, Mus musculus
gcacaaggacgtgtgtttgtccaaa

SEQ ID NO: 530154 - DNA, 25 bp, Mus musculus
gcacaaggaggaaagcgacgcagag

SEQ ID NO: 530155 - DNA, 25 bp, Mus musculus
gcacaaggaggatagcgacgcagag

SEQ ID NO: 530156 - DNA, 25 bp, Mus musculus
gcacaaggccatctaagcaaagaca

SEQ ID NO: 530157 - DNA, 25 bp, Mus musculus
gcacaaggccatgtaagcaaagaca

SEQ ID NO: 530158 - DNA, 25 bp, Mus musculus
gcacaaggcggcacatgttttaagt

SEQ ID NO: 530159 - DNA, 25 bp, Mus musculus
gcacaaggcggctcatgttttaagt

SEQ ID NO: 530160 - DNA, 25 bp, Mus musculus
gcacaagggagtagaccacctacct

SEQ ID NO: 530161 - DNA, 25 bp, Mus musculus
gcacaagggagttgaccacctacct

SEQ ID NO: 530162 - DNA, 25 bp, Mus musculus
gcacaagggcgtcggtttgatcccc

SEQ ID NO: 530163 - DNA, 25 bp, Mus musculus
gcacaagggcgtgggtttgatcccc

SEQ ID NO: 530164 - DNA, 25 bp, Mus musculus
gcacaaggtgacagggctgcactcg

SEQ ID NO: 530165 - DNA, 25 bp, Mus musculus
gcacaaggtgactgggctgcactcg

SEQ ID NO: 530166 - DNA, 25 bp, Mus musculus
gcacaaggttccaggttaatcccca

SEQ ID NO: 530167 - DNA, 25 bp, Mus musculus
gcacaaggttcctggttaatcccca

SEQ ID NO: 530168 - DNA, 25 bp, Mus musculus
gcacaaggttctacagagctaggta

SEQ ID NO: 530169 - DNA, 25 bp, Mus musculus
gcacaaggttctcgtctctcttttc

SEQ ID NO: 530170 - DNA, 25 bp, Mus musculus
gcacaaggttctggtctctcttttc

SEQ ID NO: 530171 - DNA, 25 bp, Mus musculus
gcacaaggttcttcagagctaggta

SEQ ID NO: 530172 - DNA, 25 bp, Mus musculus
gcacaagtacacatcgcgctcagga

SEQ ID NO: 530173 - DNA, 25 bp, Mus musculus
gcacaagtacacttcgcgctcagga

SEQ ID NO: 530174 - DNA, 25 bp, Mus musculus
gcacaagtaccactctgcaacacaa

SEQ ID NO: 530175 - DNA, 25 bp, Mus musculus
gcacaagtaccagtctgcaacacaa

SEQ ID NO: 530176 - DNA, 25 bp, Mus musculus
gcacaagtattaattccctggattc

SEQ ID NO: 530177 - DNA, 25 bp, Mus musculus
gcacaagtattatttccctggattc

SEQ ID NO: 530178 - DNA, 25 bp, Mus musculus
gcacaagtcacaaaaaactactgta

SEQ ID NO: 530179 - DNA, 25 bp, Mus musculus
gcacaagtcacataaaactactgta

SEQ ID NO: 530180 - DNA, 25 bp, Mus musculus
gcacaagtccccaaatcctagaaac

SEQ ID NO: 530181 - DNA, 25 bp, Mus musculus
gcacaagtcccctaatcctagaaac

SEQ ID NO: 530182 - DNA, 25 bp, Mus musculus
gcacaagtcgacagcagagagcgca

SEQ ID NO: 530183 - DNA, 25 bp, Mus musculus
gcacaagtcgactgcagagagcgca

SEQ ID NO: 530184 - DNA, 25 bp, Mus musculus
gcacaagtcgtaatcgccgtggtga

SEQ ID NO: 530185 - DNA, 25 bp, Mus musculus
gcacaagtcgtattcgccgtggtga

SEQ ID NO: 530186 - DNA, 25 bp, Mus musculus
gcacaagtgatcataactgcttttg

SEQ ID NO: 530187 - DNA, 25 bp, Mus musculus
gcacaagtgatcttaactgcttttg

SEQ ID NO: 530188 - DNA, 25 bp, Mus musculus
gcacaagtgcatatttcctctgttt

SEQ ID NO: 530189 - DNA, 25 bp, Mus musculus
gcacaagtgcatttttcctctgttt

SEQ ID NO: 530190 - DNA, 25 bp, Mus musculus
gcacaagtgtgcaatcatttaaaca

SEQ ID NO: 530191 - DNA, 25 bp, Mus musculus
gcacaagtgtgctatcatttaaaca

SEQ ID NO: 530192 - DNA, 25 bp, Mus musculus
gcacaagttcccacttgaccaagtg

SEQ ID NO: 530193 - DNA, 25 bp, Mus musculus
gcacaagttccctcttgaccaagtg

SEQ ID NO: 530194 - DNA, 25 bp, Mus musculus
gcacaagttcttacccaggcaagat

SEQ ID NO: 530195 - DNA, 25 bp, Mus musculus
gcacaagttctttcccaggcaagat

SEQ ID NO: 530196 - DNA, 25 bp, Mus musculus
gcacaatagcaccagctcctcggag

SEQ ID NO: 530197 - DNA, 25 bp, Mus musculus
gcacaatagcacgagctcctcggag

SEQ ID NO: 530198 - DNA, 25 bp, Mus musculus
gcacaatagccaatcagttagccca

SEQ ID NO: 530199 - DNA, 25 bp, Mus musculus
gcacaatagccattcagttagccca

SEQ ID NO: 530200 - DNA, 25 bp, Mus musculus
gcacaatattagctcattccagtat

SEQ ID NO: 530201 - DNA, 25 bp, Mus musculus
gcacaatattaggtcattccagtat

SEQ ID NO: 530202 - DNA, 25 bp, Mus musculus
gcacaatcaagaactggcatcccag

SEQ ID NO: 530203 - DNA, 25 bp, Mus musculus
gcacaatcaagatctggcatcccag

SEQ ID NO: 530204 - DNA, 25 bp, Mus musculus
gcacaatcacagcagttgcctggca

SEQ ID NO: 530205 - DNA, 25 bp, Mus musculus
gcacaatcacaggagttgcctggca

SEQ ID NO: 530206 - DNA, 25 bp, Mus musculus
gcacaatcaccacacgactaagagc

SEQ ID NO: 530207 - DNA, 25 bp, Mus musculus
gcacaatcaccagacgactaagagc

SEQ ID NO: 530208 - DNA, 25 bp, Mus musculus
gcacaatcccaccattttttaaagg

SEQ ID NO: 530209 - DNA, 25 bp, Mus musculus
gcacaatcccacgattttttaaagg

SEQ ID NO: 530210 - DNA, 25 bp, Mus musculus
gcacaatctgatatgtctgtctgtc

SEQ ID NO: 530211 - DNA, 25 bp, Mus musculus
gcacaatctgatttgtctgtctgtc

SEQ ID NO: 530212 - DNA, 25 bp, Mus musculus
gcacaatctgtgatgatcgctggga

SEQ ID NO: 530213 - DNA, 25 bp, Mus musculus
gcacaatctgtgttgatcgctggga

SEQ ID NO: 530214 - DNA, 25 bp, Mus musculus
gcacaatgaaaacatcctggctctg

SEQ ID NO: 530215 - DNA, 25 bp, Mus musculus
gcacaatgaaaagatcctggctctg

SEQ ID NO: 530216 - DNA, 25 bp, Mus musculus
gcacaatgaatccagtgggactcct

SEQ ID NO: 530217 - DNA, 25 bp, Mus musculus
gcacaatgaatcgagtgggactcct

SEQ ID NO: 530218 - DNA, 25 bp, Mus musculus
gcacaatgacatagagctgtacagt

SEQ ID NO: 530219 - DNA, 25 bp, Mus musculus
gcacaatgacattgagctgtacagt

SEQ ID NO: 530220 - DNA, 25 bp, Mus musculus
gcacaatgagttactgcctcaggag

SEQ ID NO: 530221 - DNA, 25 bp, Mus musculus
gcacaatgagtttctgcctcaggag

SEQ ID NO: 530222 - DNA, 25 bp, Mus musculus
gcacaatggtgacaggttctacgct

SEQ ID NO: 530223 - DNA, 25 bp, Mus musculus
gcacaatggtgagaggttctacgct

SEQ ID NO: 530224 - DNA, 25 bp, Mus musculus
gcacaatgtaatcgcctttcagatt

SEQ ID NO: 530225 - DNA, 25 bp, Mus musculus
gcacaatgtaatggcctttcagatt

SEQ ID NO: 530226 - DNA, 25 bp, Mus musculus
gcacaatgtataaacctggtactgt

SEQ ID NO: 530227 - DNA, 25 bp, Mus musculus
gcacaatgtatatacctggtactgt

SEQ ID NO: 530228 - DNA, 25 bp, Mus musculus
gcacaatgtctactttagtgtcctt

SEQ ID NO: 530229 - DNA, 25 bp, Mus musculus
gcacaatgtctagtttagtgtcctt

SEQ ID NO: 530230 - DNA, 25 bp, Mus musculus
gcacaatgtctgctgtttacaatca

SEQ ID NO: 530231 - DNA, 25 bp, Mus musculus
gcacaatgtctggtgtttacaatca

SEQ ID NO: 530232 - DNA, 25 bp, Mus musculus
gcacaatgtggacacacctggctga

SEQ ID NO: 530233 - DNA, 25 bp, Mus musculus
gcacaatgtggagacacctggctga

SEQ ID NO: 530234 - DNA, 25 bp, Mus musculus
gcacaatgtggtactgttctataga

SEQ ID NO: 530235 - DNA, 25 bp, Mus musculus
gcacaatgtggttctgttctataga

SEQ ID NO: 530236 - DNA, 25 bp, Mus musculus
gcacaatgttgaacttttctccact

SEQ ID NO: 530237 - DNA, 25 bp, Mus musculus
gcacaatgttgatcttttctccact

SEQ ID NO: 530238 - DNA, 25 bp, Mus musculus
gcacaattagcactgggtcccttct

SEQ ID NO: 530239 - DNA, 25 bp, Mus musculus
gcacaattagcagtgggtcccttct

SEQ ID NO: 530240 - DNA, 25 bp, Mus musculus
gcacaattctcacattcttcagtga

SEQ ID NO: 530241 - DNA, 25 bp, Mus musculus
gcacaattctcagattcttcagtga

SEQ ID NO: 530242 - DNA, 25 bp, Mus musculus
gcacaattgggaacacatttaccaa

SEQ ID NO: 530243 - DNA, 25 bp, Mus musculus
gcacaattgggatcacatttaccaa

SEQ ID NO: 530244 - DNA, 25 bp, Mus musculus
gcacaatttacaccttctccaagca

SEQ ID NO: 530245 - DNA, 25 bp, Mus musculus
gcacaatttacagcttctccaagca

SEQ ID NO: 530246 - DNA, 25 bp, Mus musculus
gcacaatttcttatgatgatttcca

SEQ ID NO: 530247 - DNA, 25 bp, Mus musculus
gcacaatttcttttgatgatttcca

SEQ ID NO: 530248 - DNA, 25 bp, Mus musculus
gcacaattttataaggtcattctaa

SEQ ID NO: 530249 - DNA, 25 bp, Mus musculus
gcacaattttattaggtcattctaa

SEQ ID NO: 530250 - DNA, 25 bp, Mus musculus
gcacacaaagataccacagtacctt

SEQ ID NO: 530251 - DNA, 25 bp, Mus musculus
gcacacaaagattccacagtacctt

SEQ ID NO: 530252 - DNA, 25 bp, Mus musculus
gcacacaaatgcatacccagggaga

SEQ ID NO: 530253 - DNA, 25 bp, Mus musculus
gcacacaaatgcttacccagggaga

SEQ ID NO: 530254 - DNA, 25 bp, Mus musculus
gcacacaacagaaaaacatacacac

SEQ ID NO: 530255 - DNA, 25 bp, Mus musculus
gcacacaacagataaacatacacac

SEQ ID NO: 530256 - DNA, 25 bp, Mus musculus
gcacacaaccctccgagtactattt

SEQ ID NO: 530257 - DNA, 25 bp, Mus musculus
gcacacaaccctgcgagtactattt

SEQ ID NO: 530258 - DNA, 25 bp, Mus musculus
gcacacaacgacatctttcctgatg

SEQ ID NO: 530259 - DNA, 25 bp, Mus musculus
gcacacaacgacttctttcctgatg

SEQ ID NO: 530260 - DNA, 25 bp, Mus musculus
gcacacaacgcaatatatacacaca

SEQ ID NO: 530261 - DNA, 25 bp, Mus musculus
gcacacaacgcattatatacacaca

SEQ ID NO: 530262 - DNA, 25 bp, Mus musculus
gcacacaatatcagtaaggcagtca

SEQ ID NO: 530263 - DNA, 25 bp, Mus musculus
gcacacaatatctgtaaggcagtca

SEQ ID NO: 530264 - DNA, 25 bp, Mus musculus
gcacacaatggcattcctgaaaggc

SEQ ID NO: 530265 - DNA, 25 bp, Mus musculus
gcacacaatggctttcctgaaaggc

SEQ ID NO: 530266 - DNA, 25 bp, Mus musculus
gcacacacaagaatacatacaacag

SEQ ID NO: 530267 - DNA, 25 bp, Mus musculus
gcacacacaagattacatacaacag

SEQ ID NO: 530268 - DNA, 25 bp, Mus musculus
gcacacacaaggatgcactcttagt

SEQ ID NO: 530269 - DNA, 25 bp, Mus musculus
gcacacacaaggttgcactcttagt

SEQ ID NO: 530270 - DNA, 25 bp, Mus musculus
gcacacacacagactaccagattgg

SEQ ID NO: 530271 - DNA, 25 bp, Mus musculus
gcacacacacagtctaccagattgg

SEQ ID NO: 530272 - DNA, 25 bp, Mus musculus
gcacacacagctaagcacaacacag

SEQ ID NO: 530273 - DNA, 25 bp, Mus musculus
gcacacacagcttagcacaacacag

SEQ ID NO: 530274 - DNA, 25 bp, Mus musculus
gcacacacatctaccatatacacag

SEQ ID NO: 530275 - DNA, 25 bp, Mus musculus
gcacacacatcttccatatacacag

SEQ ID NO: 530276 - DNA, 25 bp, Mus musculus
gcacacaccagtagccttagctact

SEQ ID NO: 530277 - DNA, 25 bp, Mus musculus
gcacacaccagttgccttagctact

SEQ ID NO: 530278 - DNA, 25 bp, Mus musculus
gcacacaccattaagtttgagaact

SEQ ID NO: 530279 - DNA, 25 bp, Mus musculus
gcacacaccatttagtttgagaact

SEQ ID NO: 530280 - DNA, 25 bp, Mus musculus
gcacacacctcacaaatgcttgttt

SEQ ID NO: 530281 - DNA, 25 bp, Mus musculus
gcacacacctcagaaatgcttgttt

SEQ ID NO: 530282 - DNA, 25 bp, Mus musculus
gcacacacctgtaagtagatctctg

SEQ ID NO: 530283 - DNA, 25 bp, Mus musculus
gcacacacctgttagtagatctctg

SEQ ID NO: 530284 - DNA, 25 bp, Mus musculus
gcacacaccttactcagggtgaatc

SEQ ID NO: 530285 - DNA, 25 bp, Mus musculus
gcacacaccttactctagggcaaac

SEQ ID NO: 530286 - DNA, 25 bp, Mus musculus
gcacacaccttagtcagggtgaatc

SEQ ID NO: 530287 - DNA, 25 bp, Mus musculus
gcacacaccttagtctagggcaaac

SEQ ID NO: 530288 - DNA, 25 bp, Mus musculus
gcacacacgcatcgaggcaagctct

SEQ ID NO: 530289 - DNA, 25 bp, Mus musculus
gcacacacgcatggaggcaagctct

SEQ ID NO: 530290 - DNA, 25 bp, Mus musculus
gcacacacgtgaaggacagacagac

SEQ ID NO: 530291 - DNA, 25 bp, Mus musculus
gcacacacgtgatggacagacagac

SEQ ID NO: 530292 - DNA, 25 bp, Mus musculus
gcacacactattctaacgcagcggg

SEQ ID NO: 530293 - DNA, 25 bp, Mus musculus
gcacacactattgtaacgcagcggg

SEQ ID NO: 530294 - DNA, 25 bp, Mus musculus
gcacacactgacactcttaaagctg

SEQ ID NO: 530295 - DNA, 25 bp, Mus musculus
gcacacactgactctcttaaagctg

SEQ ID NO: 530296 - DNA, 25 bp, Mus musculus
gcacacactgcgacatggtgtcagt

SEQ ID NO: 530297 - DNA, 25 bp, Mus musculus
gcacacactgcgtcatggtgtcagt

SEQ ID NO: 530298 - DNA, 25 bp, Mus musculus
gcacacactgtactctcggtttctg

SEQ ID NO: 530299 - DNA, 25 bp, Mus musculus
gcacacactgtagtctcggtttctg

SEQ ID NO: 530300 - DNA, 25 bp, Mus musculus
gcacacagacctcatgttttctaca

SEQ ID NO: 530301 - DNA, 25 bp, Mus musculus
gcacacagacctgatgttttctaca

SEQ ID NO: 530302 - DNA, 25 bp, Mus musculus
gcacacagagagatggttctgcaca

SEQ ID NO: 530303 - DNA, 25 bp, Mus musculus
gcacacagagagttggttctgcaca

SEQ ID NO: 530304 - DNA, 25 bp, Mus musculus
gcacacagattcaccagcagaaagg

SEQ ID NO: 530305 - DNA, 25 bp, Mus musculus
gcacacagattctccagcagaaagg

SEQ ID NO: 530306 - DNA, 25 bp, Mus musculus
gcacacagcacaagagtgtaatccc

SEQ ID NO: 530307 - DNA, 25 bp, Mus musculus
gcacacagcacatgagtgtaatccc

SEQ ID NO: 530308 - DNA, 25 bp, Mus musculus
gcacacagccagacggagcaccgga

SEQ ID NO: 530309 - DNA, 25 bp, Mus musculus
gcacacagccagtcggagcaccgga

SEQ ID NO: 530310 - DNA, 25 bp, Mus musculus
gcacacagcctgaatgtggaccaaa

SEQ ID NO: 530311 - DNA, 25 bp, Mus musculus
gcacacagcctgtatgtggaccaaa

SEQ ID NO: 530312 - DNA, 25 bp, Mus musculus
gcacacagcgacagagagatcatat

SEQ ID NO: 530313 - DNA, 25 bp, Mus musculus
gcacacagcgactgagagatcatat

SEQ ID NO: 530314 - DNA, 25 bp, Mus musculus
gcacacaggaccaacgggcctcttg

SEQ ID NO: 530315 - DNA, 25 bp, Mus musculus
gcacacaggacctacgggcctcttg

SEQ ID NO: 530316 - DNA, 25 bp, Mus musculus
gcacacaggagcagactcaacttca

SEQ ID NO: 530317 - DNA, 25 bp, Mus musculus
gcacacaggagctgactcaacttca

SEQ ID NO: 530318 - DNA, 25 bp, Mus musculus
gcacacaggcgcagatgctggaagt

SEQ ID NO: 530319 - DNA, 25 bp, Mus musculus
gcacacaggcgctgatgctggaagt

SEQ ID NO: 530320 - DNA, 25 bp, Mus musculus
gcacacagggccaacatctgctaaa

SEQ ID NO: 530321 - DNA, 25 bp, Mus musculus
gcacacagggcctacatctgctaaa

SEQ ID NO: 530322 - DNA, 25 bp, Mus musculus
gcacacaggttgcttcttgaccaaa

SEQ ID NO: 530323 - DNA, 25 bp, Mus musculus
gcacacaggttggttcttgaccaaa

SEQ ID NO: 530324 - DNA, 25 bp, Mus musculus
gcacacagtaggcatactattcctc

SEQ ID NO: 530325 - DNA, 25 bp, Mus musculus
gcacacagtagggatactattcctc

SEQ ID NO: 530326 - DNA, 25 bp, Mus musculus
gcacacagtattacctcgtcagagc

SEQ ID NO: 530327 - DNA, 25 bp, Mus musculus
gcacacagtattccctcaagatcaa

SEQ ID NO: 530328 - DNA, 25 bp, Mus musculus
gcacacagtattgcctcaagatcaa

SEQ ID NO: 530329 - DNA, 25 bp, Mus musculus
gcacacagtatttcctcgtcagagc

SEQ ID NO: 530330 - DNA, 25 bp, Mus musculus
gcacacagtcagcttaggcacacag

SEQ ID NO: 530331 - DNA, 25 bp, Mus musculus
gcacacagtcaggttaggcacacag

SEQ ID NO: 530332 - DNA, 25 bp, Mus musculus
gcacacagtggtccacaggcctaga

SEQ ID NO: 530333 - DNA, 25 bp, Mus musculus
gcacacagtggtgcacaggcctaga

SEQ ID NO: 530334 - DNA, 25 bp, Mus musculus
gcacacagtgtaatattctctctct

SEQ ID NO: 530335 - DNA, 25 bp, Mus musculus
gcacacagtgtattattctctctct

SEQ ID NO: 530336 - DNA, 25 bp, Mus musculus
gcacacagtgtcctaggcagacatt

SEQ ID NO: 530337 - DNA, 25 bp, Mus musculus
gcacacagtgtcgtaggcagacatt

SEQ ID NO: 530338 - DNA, 25 bp, Mus musculus
gcacacataaccaatctactttcag

SEQ ID NO: 530339 - DNA, 25 bp, Mus musculus
gcacacataacctatctactttcag

SEQ ID NO: 530340 - DNA, 25 bp, Mus musculus
gcacacatatgccatggctctcaaa

SEQ ID NO: 530341 - DNA, 25 bp, Mus musculus
gcacacatatgcgatggctctcaaa

SEQ ID NO: 530342 - DNA, 25 bp, Mus musculus
gcacacatccaaattgccatcaaag

SEQ ID NO: 530343 - DNA, 25 bp, Mus musculus
gcacacatccaatttgccatcaaag

SEQ ID NO: 530344 - DNA, 25 bp, Mus musculus
gcacacatcgcacccaaggtttata

SEQ ID NO: 530345 - DNA, 25 bp, Mus musculus
gcacacatcgcagccaaggtttata

SEQ ID NO: 530346 - DNA, 25 bp, Mus musculus
gcacacatctgtctgagacctcttg

SEQ ID NO: 530347 - DNA, 25 bp, Mus musculus
gcacacatctgtgtgagacctcttg

SEQ ID NO: 530348 - DNA, 25 bp, Mus musculus
gcacacatcttgaggaacgctggtt

SEQ ID NO: 530349 - DNA, 25 bp, Mus musculus
gcacacatcttgtggaacgctggtt

SEQ ID NO: 530350 - DNA, 25 bp, Mus musculus
gcacacatgactaaaactcgcagga

SEQ ID NO: 530351 - DNA, 25 bp, Mus musculus
gcacacatgacttaaactcgcagga

SEQ ID NO: 530352 - DNA, 25 bp, Mus musculus
gcacacatgcacattgtcctcatga

SEQ ID NO: 530353 - DNA, 25 bp, Mus musculus
gcacacatgcaccactgtaggacag

SEQ ID NO: 530354 - DNA, 25 bp, Mus musculus
gcacacatgcacgactgtaggacag

SEQ ID NO: 530355 - DNA, 25 bp, Mus musculus
gcacacatgcactttgtcctcatga

SEQ ID NO: 530356 - DNA, 25 bp, Mus musculus
gcacacatgcttatacaatcacaca

SEQ ID NO: 530357 - DNA, 25 bp, Mus musculus
gcacacatgcttttacaatcacaca

SEQ ID NO: 530358 - DNA, 25 bp, Mus musculus
gcacacatggacactgactctgtac

SEQ ID NO: 530359 - DNA, 25 bp, Mus musculus
gcacacatggactctgactctgtac

SEQ ID NO: 530360 - DNA, 25 bp, Mus musculus
gcacacatgggactgttgtcacact

SEQ ID NO: 530361 - DNA, 25 bp, Mus musculus
gcacacatgggagtgttgtcacact

SEQ ID NO: 530362 - DNA, 25 bp, Mus musculus
gcacacatgtatctagtgcacatag

SEQ ID NO: 530363 - DNA, 25 bp, Mus musculus
gcacacatgtatgtagtgcacatag

SEQ ID NO: 530364 - DNA, 25 bp, Mus musculus
gcacacatgtgactctctcaggtga

SEQ ID NO: 530365 - DNA, 25 bp, Mus musculus
gcacacatgtgagtctctcaggtga

SEQ ID NO: 530366 - DNA, 25 bp, Mus musculus
gcacacatgtgtctatgcaccatgt

SEQ ID NO: 530367 - DNA, 25 bp, Mus musculus
gcacacatgtgtgtatgcaccatgt

SEQ ID NO: 530368 - DNA, 25 bp, Mus musculus
gcacacattaaccaacgactagcaa

SEQ ID NO: 530369 - DNA, 25 bp, Mus musculus
gcacacattaacgaacgactagcaa

SEQ ID NO: 530370 - DNA, 25 bp, Mus musculus
gcacacattcgaagggatctctgta

SEQ ID NO: 530371 - DNA, 25 bp, Mus musculus
gcacacattcgatgggatctctgta

SEQ ID NO: 530372 - DNA, 25 bp, Mus musculus
gcacacattctgctgtagttcacaa

SEQ ID NO: 530373 - DNA, 25 bp, Mus musculus
gcacacattctggtgtagttcacaa

SEQ ID NO: 530374 - DNA, 25 bp, Mus musculus
gcacaccaaagcctggtccaattgg

SEQ ID NO: 530375 - DNA, 25 bp, Mus musculus
gcacaccaaagcgtggtccaattgg

SEQ ID NO: 530376 - DNA, 25 bp, Mus musculus
gcacaccaaaggctcgagcagcagt

SEQ ID NO: 530377 - DNA, 25 bp, Mus musculus
gcacaccaaagggtcgagcagcagt

SEQ ID NO: 530378 - DNA, 25 bp, Mus musculus
gcacaccaacttagtggagttccgg

SEQ ID NO: 530379 - DNA, 25 bp, Mus musculus
gcacaccaactttgtggagttccgg

SEQ ID NO: 530380 - DNA, 25 bp, Mus musculus
gcacaccaaggcacaaaacaagtac

SEQ ID NO: 530381 - DNA, 25 bp, Mus musculus
gcacaccaaggctcaaaacaagtac

SEQ ID NO: 530382 - DNA, 25 bp, Mus musculus
gcacaccaatggatttgctagccaa

SEQ ID NO: 530383 - DNA, 25 bp, Mus musculus
gcacaccaatggttttgctagccaa

SEQ ID NO: 530384 - DNA, 25 bp, Mus musculus
gcacaccagagcactttaaagacag

SEQ ID NO: 530385 - DNA, 25 bp, Mus musculus
gcacaccagagcaggtcatgccaaa

SEQ ID NO: 530386 - DNA, 25 bp, Mus musculus
gcacaccagagctctttaaagacag

SEQ ID NO: 530387 - DNA, 25 bp, Mus musculus
gcacaccagagctggtcatgccaaa

SEQ ID NO: 530388 - DNA, 25 bp, Mus musculus
gcacaccagcatatgttcagcaagt

SEQ ID NO: 530389 - DNA, 25 bp, Mus musculus
gcacaccagcatttgttcagcaagt

SEQ ID NO: 530390 - DNA, 25 bp, Mus musculus
gcacaccaggacaactacagcatga

SEQ ID NO: 530391 - DNA, 25 bp, Mus musculus
gcacaccaggactactacagcatga

SEQ ID NO: 530392 - DNA, 25 bp, Mus musculus
gcacaccaggccacgagaactttgt

SEQ ID NO: 530393 - DNA, 25 bp, Mus musculus
gcacaccaggcctcgagaactttgt

SEQ ID NO: 530394 - DNA, 25 bp, Mus musculus
gcacaccaggtgatgagatacacac

SEQ ID NO: 530395 - DNA, 25 bp, Mus musculus
gcacaccaggtgttgagatacacac

SEQ ID NO: 530396 - DNA, 25 bp, Mus musculus
gcacaccagtgtccttttaaagaat

SEQ ID NO: 530397 - DNA, 25 bp, Mus musculus
gcacaccagtgtgcttttaaagaat

SEQ ID NO: 530398 - DNA, 25 bp, Mus musculus
gcacaccatgtgctgtgaccctggg

SEQ ID NO: 530399 - DNA, 25 bp, Mus musculus
gcacaccatgtggtgtgaccctggg

SEQ ID NO: 530400 - DNA, 25 bp, Mus musculus
gcacacccacataagtttttacgca

SEQ ID NO: 530401 - DNA, 25 bp, Mus musculus
gcacacccacattagtttttacgca

SEQ ID NO: 530402 - DNA, 25 bp, Mus musculus
gcacaccccaaccttataggaagtt

SEQ ID NO: 530403 - DNA, 25 bp, Mus musculus
gcacaccccaacgttataggaagtt

SEQ ID NO: 530404 - DNA, 25 bp, Mus musculus
gcacacccctaaacgtcttaaatct

SEQ ID NO: 530405 - DNA, 25 bp, Mus musculus
gcacacccctaatcgtcttaaatct

SEQ ID NO: 530406 - DNA, 25 bp, Mus musculus
gcacacccgcaacaataaacctgat

SEQ ID NO: 530407 - DNA, 25 bp, Mus musculus
gcacacccgcaagaataaacctgat

SEQ ID NO: 530408 - DNA, 25 bp, Mus musculus
gcacaccctatgagtactgtaaaca

SEQ ID NO: 530409 - DNA, 25 bp, Mus musculus
gcacaccctatgtgtactgtaaaca

SEQ ID NO: 530410 - DNA, 25 bp, Mus musculus
gcacaccctggacacattgctggag

SEQ ID NO: 530411 - DNA, 25 bp, Mus musculus
gcacaccctggagacattgctggag

SEQ ID NO: 530412 - DNA, 25 bp, Mus musculus
gcacaccctgggagtggaaggctaa

SEQ ID NO: 530413 - DNA, 25 bp, Mus musculus
gcacaccctgggtgtggaaggctaa

SEQ ID NO: 530414 - DNA, 25 bp, Mus musculus
gcacacccttagattgacacacttg

SEQ ID NO: 530415 - DNA, 25 bp, Mus musculus
gcacacccttagtttgacacacttg

SEQ ID NO: 530416 - DNA, 25 bp, Mus musculus
gcacaccgatgcaatccacagaggt

SEQ ID NO: 530417 - DNA, 25 bp, Mus musculus
gcacaccgatgctatccacagaggt

SEQ ID NO: 530418 - DNA, 25 bp, Mus musculus
gcacaccggaggatgctttcgaaaa

SEQ ID NO: 530419 - DNA, 25 bp, Mus musculus
gcacaccggaggttgctttcgaaaa

SEQ ID NO: 530420 - DNA, 25 bp, Mus musculus
gcacaccggattagccctttgcagg

SEQ ID NO: 530421 - DNA, 25 bp, Mus musculus
gcacaccggatttgccctttgcagg

SEQ ID NO: 530422 - DNA, 25 bp, Mus musculus
gcacaccggcccagtttgttgatca

SEQ ID NO: 530423 - DNA, 25 bp, Mus musculus
gcacaccggccctgtttgttgatca

SEQ ID NO: 530424 - DNA, 25 bp, Mus musculus
gcacaccgggaacgcgcccaattgg

SEQ ID NO: 530425 - DNA, 25 bp, Mus musculus
gcacaccgggaaggcgcccaattgg

SEQ ID NO: 530426 - DNA, 25 bp, Mus musculus
gcacacctagaaacaaccgagccag

SEQ ID NO: 530427 - DNA, 25 bp, Mus musculus
gcacacctagaatcaaccgagccag

SEQ ID NO: 530428 - DNA, 25 bp, Mus musculus
gcacacctataaactgagaacatgg

SEQ ID NO: 530429 - DNA, 25 bp, Mus musculus
gcacacctataatctgagaacatgg

SEQ ID NO: 530430 - DNA, 25 bp, Mus musculus
gcacacctcatacgtatggaatttt

SEQ ID NO: 530431 - DNA, 25 bp, Mus musculus
gcacacctcataggtatggaatttt

SEQ ID NO: 530432 - DNA, 25 bp, Mus musculus
gcacacctgactctatttgcatcag

SEQ ID NO: 530433 - DNA, 25 bp, Mus musculus
gcacacctgactgtatttgcatcag

SEQ ID NO: 530434 - DNA, 25 bp, Mus musculus
gcacacctggacagcatggtaagga

SEQ ID NO: 530435 - DNA, 25 bp, Mus musculus
gcacacctggactgcatggtaagga

SEQ ID NO: 530436 - DNA, 25 bp, Mus musculus
gcacacctgtggaacttagggtcca

SEQ ID NO: 530437 - DNA, 25 bp, Mus musculus
gcacacctgtggtacttagggtcca

SEQ ID NO: 530438 - DNA, 25 bp, Mus musculus
gcacaccttagaatgtaagcaggct

SEQ ID NO: 530439 - DNA, 25 bp, Mus musculus
gcacaccttagattgtaagcaggct

SEQ ID NO: 530440 - DNA, 25 bp, Mus musculus
gcacaccttggcctcagtggccttg

SEQ ID NO: 530441 - DNA, 25 bp, Mus musculus
gcacaccttggcgtcagtggccttg

SEQ ID NO: 530442 - DNA, 25 bp, Mus musculus
gcacaccttggtacagccctcagtg

SEQ ID NO: 530443 - DNA, 25 bp, Mus musculus
gcacaccttggttcagccctcagtg

SEQ ID NO: 530444 - DNA, 25 bp, Mus musculus
gcacacctttagaaaactgaccagt

SEQ ID NO: 530445 - DNA, 25 bp, Mus musculus
gcacacctttagtaaactgaccagt

SEQ ID NO: 530446 - DNA, 25 bp, Mus musculus
gcacacgacgaaagccagacacgga

SEQ ID NO: 530447 - DNA, 25 bp, Mus musculus
gcacacgacgaatgccagacacgga

SEQ ID NO: 530448 - DNA, 25 bp, Mus musculus
gcacacgatcctagcagacattgta

SEQ ID NO: 530449 - DNA, 25 bp, Mus musculus
gcacacgatccttgcagacattgta

SEQ ID NO: 530450 - DNA, 25 bp, Mus musculus
gcacacgcatgcacatgtttgtgca

SEQ ID NO: 530451 - DNA, 25 bp, Mus musculus
gcacacgcatgctcatgtttgtgca

SEQ ID NO: 530452 - DNA, 25 bp, Mus musculus
gcacacgcccttagcgttgtgtgtg

SEQ ID NO: 530453 - DNA, 25 bp, Mus musculus
gcacacgccctttgcgttgtgtgtg

SEQ ID NO: 530454 - DNA, 25 bp, Mus musculus
gcacacgccttgcatttcattcaat

SEQ ID NO: 530455 - DNA, 25 bp, Mus musculus
gcacacgccttggatttcattcaat

SEQ ID NO: 530456 - DNA, 25 bp, Mus musculus
gcacacgctcagatacagacgcata

SEQ ID NO: 530457 - DNA, 25 bp, Mus musculus
gcacacgctcagttacagacgcata

SEQ ID NO: 530458 - DNA, 25 bp, Mus musculus
gcacacgctgacacttggaacaggt

SEQ ID NO: 530459 - DNA, 25 bp, Mus musculus
gcacacgctgactcttggaacaggt

SEQ ID NO: 530460 - DNA, 25 bp, Mus musculus
gcacacggagccaacatgacgaagt

SEQ ID NO: 530461 - DNA, 25 bp, Mus musculus
gcacacggagcctacatgacgaagt

SEQ ID NO: 530462 - DNA, 25 bp, Mus musculus
gcacacggcactctcctttattcat

SEQ ID NO: 530463 - DNA, 25 bp, Mus musculus
gcacacggcactgtcctttattcat

SEQ ID NO: 530464 - DNA, 25 bp, Mus musculus
gcacacggcagcatatctccgggag

SEQ ID NO: 530465 - DNA, 25 bp, Mus musculus
gcacacggcagcttatctccgggag

SEQ ID NO: 530466 - DNA, 25 bp, Mus musculus
gcacacggtacaagtggagtcccac

SEQ ID NO: 530467 - DNA, 25 bp, Mus musculus
gcacacggtacatgtggagtcccac

SEQ ID NO: 530468 - DNA, 25 bp, Mus musculus
gcacacggtcatagaggtagcaagt

SEQ ID NO: 530469 - DNA, 25 bp, Mus musculus
gcacacggtcattgaggtagcaagt

SEQ ID NO: 530470 - DNA, 25 bp, Mus musculus
gcacacgtacggacttggctggtaa

SEQ ID NO: 530471 - DNA, 25 bp, Mus musculus
gcacacgtacggtcttggctggtaa

SEQ ID NO: 530472 - DNA, 25 bp, Mus musculus
gcacacgtagcacacacacacagga

SEQ ID NO: 530473 - DNA, 25 bp, Mus musculus
gcacacgtagcagacacacacagga

SEQ ID NO: 530474 - DNA, 25 bp, Mus musculus
gcacacgtatcacatcttctatttg

SEQ ID NO: 530475 - DNA, 25 bp, Mus musculus
gcacacgtatcagatcttctatttg

SEQ ID NO: 530476 - DNA, 25 bp, Mus musculus
gcacacgtatggcttaggttcagtc

SEQ ID NO: 530477 - DNA, 25 bp, Mus musculus
gcacacgtatgggttaggttcagtc

SEQ ID NO: 530478 - DNA, 25 bp, Mus musculus
gcacacgtcaccatggactgcaggg

SEQ ID NO: 530479 - DNA, 25 bp, Mus musculus
gcacacgtcaccttggactgcaggg

SEQ ID NO: 530480 - DNA, 25 bp, Mus musculus
gcacacgtcatgaggtttgtttcat

SEQ ID NO: 530481 - DNA, 25 bp, Mus musculus
gcacacgtcatgtggtttgtttcat

SEQ ID NO: 530482 - DNA, 25 bp, Mus musculus
gcacacgtcctaaaagaatgttaat

SEQ ID NO: 530483 - DNA, 25 bp, Mus musculus
gcacacgtcctataagaatgttaat

SEQ ID NO: 530484 - DNA, 25 bp, Mus musculus
gcacacgtgtacaaaagctcactca

SEQ ID NO: 530485 - DNA, 25 bp, Mus musculus
gcacacgtgtactaaagctcactca

SEQ ID NO: 530486 - DNA, 25 bp, Mus musculus
gcacacgtgtgcaacttaagttttt

SEQ ID NO: 530487 - DNA, 25 bp, Mus musculus
gcacacgtgtgcagtggcacagcat

SEQ ID NO: 530488 - DNA, 25 bp, Mus musculus
gcacacgtgtgcattcttgttagaa

SEQ ID NO: 530489 - DNA, 25 bp, Mus musculus
gcacacgtgtgctacttaagttttt

SEQ ID NO: 530490 - DNA, 25 bp, Mus musculus
gcacacgtgtgctgtggcacagcat

SEQ ID NO: 530491 - DNA, 25 bp, Mus musculus
gcacacgtgtgctttcttgttagaa

SEQ ID NO: 530492 - DNA, 25 bp, Mus musculus
gcacacgttataattcaagggcttg

SEQ ID NO: 530493 - DNA, 25 bp, Mus musculus
gcacacgttatatttcaagggcttg

SEQ ID NO: 530494 - DNA, 25 bp, Mus musculus
gcacactaaaccctcaagacttgtt

SEQ ID NO: 530495 - DNA, 25 bp, Mus musculus
gcacactaaaccgtcaagacttgtt

SEQ ID NO: 530496 - DNA, 25 bp, Mus musculus
gcacactagacaagccatctaacgc

SEQ ID NO: 530497 - DNA, 25 bp, Mus musculus
gcacactagacatgccatctaacgc

SEQ ID NO: 530498 - DNA, 25 bp, Mus musculus
gcacactatggaactttatgacaat

SEQ ID NO: 530499 - DNA, 25 bp, Mus musculus
gcacactatggatctttatgacaat

SEQ ID NO: 530500 - DNA, 25 bp, Mus musculus
gcacactatgtaatattgagcctat

SEQ ID NO: 530501 - DNA, 25 bp, Mus musculus
gcacactatgtattattgagcctat

SEQ ID NO: 530502 - DNA, 25 bp, Mus musculus
gcacactcaaaaactgtgagcttgg

SEQ ID NO: 530503 - DNA, 25 bp, Mus musculus
gcacactcaaaatctgtgagcttgg

SEQ ID NO: 530504 - DNA, 25 bp, Mus musculus
gcacactcacaccagtttgcacata

SEQ ID NO: 530505 - DNA, 25 bp, Mus musculus
gcacactcacacgagtttgcacata

SEQ ID NO: 530506 - DNA, 25 bp, Mus musculus
gcacactcaggtactgacttctgct

SEQ ID NO: 530507 - DNA, 25 bp, Mus musculus
gcacactcaggttctgacttctgct

SEQ ID NO: 530508 - DNA, 25 bp, Mus musculus
gcacactcatcaacctatgcaagtc

SEQ ID NO: 530509 - DNA, 25 bp, Mus musculus
gcacactcatcatcctatgcaagtc

SEQ ID NO: 530510 - DNA, 25 bp, Mus musculus
gcacactcatccacttgtcagaagg

SEQ ID NO: 530511 - DNA, 25 bp, Mus musculus
gcacactcatcccaggttctggtag

SEQ ID NO: 530512 - DNA, 25 bp, Mus musculus
gcacactcatccgaggttctggtag

SEQ ID NO: 530513 - DNA, 25 bp, Mus musculus
gcacactcatcctcttgtcagaagg

SEQ ID NO: 530514 - DNA, 25 bp, Mus musculus
gcacactcatttctatcgtttttgt

SEQ ID NO: 530515 - DNA, 25 bp, Mus musculus
gcacactcatttgtatcgtttttgt

SEQ ID NO: 530516 - DNA, 25 bp, Mus musculus
gcacactcccatctttgcagaatga

SEQ ID NO: 530517 - DNA, 25 bp, Mus musculus
gcacactcccatgtttgcagaatga

SEQ ID NO: 530518 - DNA, 25 bp, Mus musculus
gcacactccctcagcagaaggaata

SEQ ID NO: 530519 - DNA, 25 bp, Mus musculus
gcacactccctctgcagaaggaata

SEQ ID NO: 530520 - DNA, 25 bp, Mus musculus
gcacactcgttgcaatctttcccag

SEQ ID NO: 530521 - DNA, 25 bp, Mus musculus
gcacactcgttggaatctttcccag

SEQ ID NO: 530522 - DNA, 25 bp, Mus musculus
gcacactctatgcaaaacttttgta

SEQ ID NO: 530523 - DNA, 25 bp, Mus musculus
gcacactctatggaaaacttttgta

SEQ ID NO: 530524 - DNA, 25 bp, Mus musculus
gcacactcttgccacagtgtacatg

SEQ ID NO: 530525 - DNA, 25 bp, Mus musculus
gcacactcttgcgacagtgtacatg

SEQ ID NO: 530526 - DNA, 25 bp, Mus musculus
gcacactgaaaccttacttgaacag

SEQ ID NO: 530527 - DNA, 25 bp, Mus musculus
gcacactgaaacgttacttgaacag

SEQ ID NO: 530528 - DNA, 25 bp, Mus musculus
gcacactgaattccccagtgtatgt

SEQ ID NO: 530529 - DNA, 25 bp, Mus musculus
gcacactgaattgcccagtgtatgt

SEQ ID NO: 530530 - DNA, 25 bp, Mus musculus
gcacactgacatcaccaagcaaggt

SEQ ID NO: 530531 - DNA, 25 bp, Mus musculus
gcacactgacatgaccaagcaaggt

SEQ ID NO: 530532 - DNA, 25 bp, Mus musculus
gcacactgagtgctggtattctctc

SEQ ID NO: 530533 - DNA, 25 bp, Mus musculus
gcacactgagtggtggtattctctc

SEQ ID NO: 530534 - DNA, 25 bp, Mus musculus
gcacactgatgaaagattaacactt

SEQ ID NO: 530535 - DNA, 25 bp, Mus musculus
gcacactgatgatagattaacactt

SEQ ID NO: 530536 - DNA, 25 bp, Mus musculus
gcacactgccttacattcgtattat

SEQ ID NO: 530537 - DNA, 25 bp, Mus musculus
gcacactgcctttcattcgtattat

SEQ ID NO: 530538 - DNA, 25 bp, Mus musculus
gcacactgctaacacttgttctggt

SEQ ID NO: 530539 - DNA, 25 bp, Mus musculus
gcacactgctaagacttgttctggt

SEQ ID NO: 530540 - DNA, 25 bp, Mus musculus
gcacactgctacagaaagccatgca

SEQ ID NO: 530541 - DNA, 25 bp, Mus musculus
gcacactgctactgaaagccatgca

SEQ ID NO: 530542 - DNA, 25 bp, Mus musculus
gcacactgctttagtttcatgggct

SEQ ID NO: 530543 - DNA, 25 bp, Mus musculus
gcacactgcttttgtttcatgggct

SEQ ID NO: 530544 - DNA, 25 bp, Mus musculus
gcacactggcaacgctgtacatcat

SEQ ID NO: 530545 - DNA, 25 bp, Mus musculus
gcacactggcaaggctgtacatcat

SEQ ID NO: 530546 - DNA, 25 bp, Mus musculus
gcacactggcagacgggccttgaat

SEQ ID NO: 530547 - DNA, 25 bp, Mus musculus
gcacactggcagtcgggccttgaat

SEQ ID NO: 530548 - DNA, 25 bp, Mus musculus
gcacactgtaagaaccattgtggct

SEQ ID NO: 530549 - DNA, 25 bp, Mus musculus
gcacactgtaagtaccattgtggct

SEQ ID NO: 530550 - DNA, 25 bp, Mus musculus
gcacactgtgctaacctatagctgt

SEQ ID NO: 530551 - DNA, 25 bp, Mus musculus
gcacactgtgcttacctatagctgt

SEQ ID NO: 530552 - DNA, 25 bp, Mus musculus
gcacactgttggactaccggttcag

SEQ ID NO: 530553 - DNA, 25 bp, Mus musculus
gcacactgttggtctaccggttcag

SEQ ID NO: 530554 - DNA, 25 bp, Mus musculus
gcacactgtttcatttcaggagttt

SEQ ID NO: 530555 - DNA, 25 bp, Mus musculus
gcacactgtttcttttcaggagttt

SEQ ID NO: 530556 - DNA, 25 bp, Mus musculus
gcacactgtttgatttggtctctcc

SEQ ID NO: 530557 - DNA, 25 bp, Mus musculus
gcacactgtttgttttggtctctcc

SEQ ID NO: 530558 - DNA, 25 bp, Mus musculus
gcacacttaaagctcctgcaaagga

SEQ ID NO: 530559 - DNA, 25 bp, Mus musculus
gcacacttaaaggtcctgcaaagga

SEQ ID NO: 530560 - DNA, 25 bp, Mus musculus
gcacacttaaggcatgggatggtca

SEQ ID NO: 530561 - DNA, 25 bp, Mus musculus
gcacacttaagggatgggatggtca

SEQ ID NO: 530562 - DNA, 25 bp, Mus musculus
gcacacttagccaccgaatcaggaa

SEQ ID NO: 530563 - DNA, 25 bp, Mus musculus
gcacacttagcctccgaatcaggaa

SEQ ID NO: 530564 - DNA, 25 bp, Mus musculus
gcacacttcaggataatcggcacac

SEQ ID NO: 530565 - DNA, 25 bp, Mus musculus
gcacacttcaggttaatcggcacac

SEQ ID NO: 530566 - DNA, 25 bp, Mus musculus
gcacacttcccaaaagtagccgaaa

SEQ ID NO: 530567 - DNA, 25 bp, Mus musculus
gcacacttcccataagtagccgaaa

SEQ ID NO: 530568 - DNA, 25 bp, Mus musculus
gcacacttcttgctttctattgcaa

SEQ ID NO: 530569 - DNA, 25 bp, Mus musculus
gcacacttcttggtttctattgcaa

SEQ ID NO: 530570 - DNA, 25 bp, Mus musculus
gcacacttgagtcagcacacatcat

SEQ ID NO: 530571 - DNA, 25 bp, Mus musculus
gcacacttgagtgagcacacatcat

SEQ ID NO: 530572 - DNA, 25 bp, Mus musculus
gcacacttgcgaagcttcatggtca

SEQ ID NO: 530573 - DNA, 25 bp, Mus musculus
gcacacttgcgatgcttcatggtca

SEQ ID NO: 530574 - DNA, 25 bp, Mus musculus
gcacacttgctgctggtcataaaac

SEQ ID NO: 530575 - DNA, 25 bp, Mus musculus
gcacacttgctggtggtcataaaac

SEQ ID NO: 530576 - DNA, 25 bp, Mus musculus
gcacacttgtaaatggccttgggct

SEQ ID NO: 530577 - DNA, 25 bp, Mus musculus
gcacacttgtaattggccttgggct

SEQ ID NO: 530578 - DNA, 25 bp, Mus musculus
gcacacttgtctcggaagggagcat

SEQ ID NO: 530579 - DNA, 25 bp, Mus musculus
gcacacttgtctgggaagggagcat

SEQ ID NO: 530580 - DNA, 25 bp, Mus musculus
gcacacttgttacgcagctggttaa

SEQ ID NO: 530581 - DNA, 25 bp, Mus musculus
gcacacttgttaggcagctggttaa

SEQ ID NO: 530582 - DNA, 25 bp, Mus musculus
gcacacttgtttcagatagccattg

SEQ ID NO: 530583 - DNA, 25 bp, Mus musculus
gcacacttgtttgagatagccattg

SEQ ID NO: 530584 - DNA, 25 bp, Mus musculus
gcacactttgtgagaaccaatggga

SEQ ID NO: 530585 - DNA, 25 bp, Mus musculus
gcacactttgtgcattctaggcagg

SEQ ID NO: 530586 - DNA, 25 bp, Mus musculus
gcacactttgtggattctaggcagg

SEQ ID NO: 530587 - DNA, 25 bp, Mus musculus
gcacactttgtgtgaaccaatggga

SEQ ID NO: 530588 - DNA, 25 bp, Mus musculus
gcacacttttaaatctaggagttgg

SEQ ID NO: 530589 - DNA, 25 bp, Mus musculus
gcacacttttaattctaggagttgg

SEQ ID NO: 530590 - DNA, 25 bp, Mus musculus
gcacacttttgcatgtgttctgata

SEQ ID NO: 530591 - DNA, 25 bp, Mus musculus
gcacacttttgcttgtgttctgata

SEQ ID NO: 530592 - DNA, 25 bp, Mus musculus
gcacacttttggctttgcactgtat

SEQ ID NO: 530593 - DNA, 25 bp, Mus musculus
gcacacttttgggtttgcactgtat

SEQ ID NO: 530594 - DNA, 25 bp, Mus musculus
gcacagaaacccaaaataccctttg

SEQ ID NO: 530595 - DNA, 25 bp, Mus musculus
gcacagaaaccctaaataccctttg

SEQ ID NO: 530596 - DNA, 25 bp, Mus musculus
gcacagaaacgtatctttgggctca

SEQ ID NO: 530597 - DNA, 25 bp, Mus musculus
gcacagaaacgtttctttgggctca

SEQ ID NO: 530598 - DNA, 25 bp, Mus musculus
gcacagaaagccaatatgctgcccc

SEQ ID NO: 530599 - DNA, 25 bp, Mus musculus
gcacagaaagccaggacagtgagag

SEQ ID NO: 530600 - DNA, 25 bp, Mus musculus
gcacagaaagcctatatgctgcccc

SEQ ID NO: 530601 - DNA, 25 bp, Mus musculus
gcacagaaagcctggacagtgagag

SEQ ID NO: 530602 - DNA, 25 bp, Mus musculus
gcacagaaatgtacatcacaccaat

SEQ ID NO: 530603 - DNA, 25 bp, Mus musculus
gcacagaaatgttcatcacaccaat

SEQ ID NO: 530604 - DNA, 25 bp, Mus musculus
gcacagaaattgaacatggtacttt

SEQ ID NO: 530605 - DNA, 25 bp, Mus musculus
gcacagaaattgaggccactcctgt

SEQ ID NO: 530606 - DNA, 25 bp, Mus musculus
gcacagaaattgtacatggtacttt

SEQ ID NO: 530607 - DNA, 25 bp, Mus musculus
gcacagaaattgtggccactcctgt

SEQ ID NO: 530608 - DNA, 25 bp, Mus musculus
gcacagaaatttagcagctgttcaa

SEQ ID NO: 530609 - DNA, 25 bp, Mus musculus
gcacagaaattttgcagctgttcaa

SEQ ID NO: 530610 - DNA, 25 bp, Mus musculus
gcacagaacctcaccattgaacata

SEQ ID NO: 530611 - DNA, 25 bp, Mus musculus
gcacagaacctctccattgaacata

SEQ ID NO: 530612 - DNA, 25 bp, Mus musculus
gcacagaacctgatattatgggcta

SEQ ID NO: 530613 - DNA, 25 bp, Mus musculus
gcacagaacctgttattatgggcta

SEQ ID NO: 530614 - DNA, 25 bp, Mus musculus
gcacagaactgtagtaagcaagtga

SEQ ID NO: 530615 - DNA, 25 bp, Mus musculus
gcacagaactgttgtaagcaagtga

SEQ ID NO: 530616 - DNA, 25 bp, Mus musculus
gcacagaacttgacggcagctactc

SEQ ID NO: 530617 - DNA, 25 bp, Mus musculus
gcacagaacttgtcggcagctactc

SEQ ID NO: 530618 - DNA, 25 bp, Mus musculus
gcacagaatgccatgggcttgtttt

SEQ ID NO: 530619 - DNA, 25 bp, Mus musculus
gcacagaatgccttgggcttgtttt

SEQ ID NO: 530620 - DNA, 25 bp, Mus musculus
gcacagaattctccacagtgcctgc

SEQ ID NO: 530621 - DNA, 25 bp, Mus musculus
gcacagaattctgcacagtgcctgc

SEQ ID NO: 530622 - DNA, 25 bp, Mus musculus
gcacagaattgacctgaccctatta

SEQ ID NO: 530623 - DNA, 25 bp, Mus musculus
gcacagaattgagctgaccctatta

SEQ ID NO: 530624 - DNA, 25 bp, Mus musculus
gcacagaattttaccatctagaact

SEQ ID NO: 530625 - DNA, 25 bp, Mus musculus
gcacagaatttttccatctagaact

SEQ ID NO: 530626 - DNA, 25 bp, Mus musculus
gcacagacacacaactgaggcgtat

SEQ ID NO: 530627 - DNA, 25 bp, Mus musculus
gcacagacacactactgaggcgtat

SEQ ID NO: 530628 - DNA, 25 bp, Mus musculus
gcacagaccctcacctctgtgactt

SEQ ID NO: 530629 - DNA, 25 bp, Mus musculus
gcacagaccctctcctctgtgactt

SEQ ID NO: 530630 - DNA, 25 bp, Mus musculus
gcacagacccttcatcttgatgttc

SEQ ID NO: 530631 - DNA, 25 bp, Mus musculus
gcacagacccttgatcttgatgttc

SEQ ID NO: 530632 - DNA, 25 bp, Mus musculus
gcacagactatcaaaaaggcttgag

SEQ ID NO: 530633 - DNA, 25 bp, Mus musculus
gcacagactatctaaaaggcttgag

SEQ ID NO: 530634 - DNA, 25 bp, Mus musculus
gcacagactattacatgcctggctt

SEQ ID NO: 530635 - DNA, 25 bp, Mus musculus
gcacagactatttcatgcctggctt

SEQ ID NO: 530636 - DNA, 25 bp, Mus musculus
gcacagactcacagagacagcgtgt

SEQ ID NO: 530637 - DNA, 25 bp, Mus musculus
gcacagactcactgagacagcgtgt

SEQ ID NO: 530638 - DNA, 25 bp, Mus musculus
gcacagactgccacttcgctttatg

SEQ ID NO: 530639 - DNA, 25 bp, Mus musculus
gcacagactgcctcttcgctttatg

SEQ ID NO: 530640 - DNA, 25 bp, Mus musculus
gcacagactgctatgagtcgtacaa

SEQ ID NO: 530641 - DNA, 25 bp, Mus musculus
gcacagactgctttgagtcgtacaa

SEQ ID NO: 530642 - DNA, 25 bp, Mus musculus
gcacagactggtccatcagggcaat

SEQ ID NO: 530643 - DNA, 25 bp, Mus musculus
gcacagactggtgcatcagggcaat

SEQ ID NO: 530644 - DNA, 25 bp, Mus musculus
gcacagactttcaactctgtgtgag

SEQ ID NO: 530645 - DNA, 25 bp, Mus musculus
gcacagactttcagaccattttgga

SEQ ID NO: 530646 - DNA, 25 bp, Mus musculus
gcacagactttctactctgtgtgag

SEQ ID NO: 530647 - DNA, 25 bp, Mus musculus
gcacagactttctgaccattttgga

SEQ ID NO: 530648 - DNA, 25 bp, Mus musculus
gcacagagaacaccgccatcttgag

SEQ ID NO: 530649 - DNA, 25 bp, Mus musculus
gcacagagaacagcgccatcttgag

SEQ ID NO: 530650 - DNA, 25 bp, Mus musculus
gcacagagactaaaattttcccaga

SEQ ID NO: 530651 - DNA, 25 bp, Mus musculus
gcacagagactataattttcccaga

SEQ ID NO: 530652 - DNA, 25 bp, Mus musculus
gcacagagataaccttttggacaga

SEQ ID NO: 530653 - DNA, 25 bp, Mus musculus
gcacagagataagcttttggacaga

SEQ ID NO: 530654 - DNA, 25 bp, Mus musculus
gcacagagcagaccaaggtcgcact

SEQ ID NO: 530655 - DNA, 25 bp, Mus musculus
gcacagagcagagcaaggtcgcact

SEQ ID NO: 530656 - DNA, 25 bp, Mus musculus
gcacagagccatcggtttgaacccc

SEQ ID NO: 530657 - DNA, 25 bp, Mus musculus
gcacagagccatgggtttgaacccc

SEQ ID NO: 530658 - DNA, 25 bp, Mus musculus
gcacagagccggatctctaaattct

SEQ ID NO: 530659 - DNA, 25 bp, Mus musculus
gcacagagccggttctctaaattct

SEQ ID NO: 530660 - DNA, 25 bp, Mus musculus
gcacagagcttgatgttttggtata

SEQ ID NO: 530661 - DNA, 25 bp, Mus musculus
gcacagagcttgttgttttggtata

SEQ ID NO: 530662 - DNA, 25 bp, Mus musculus
gcacagaggaatcaacttgtggctc

SEQ ID NO: 530663 - DNA, 25 bp, Mus musculus
gcacagaggaatgaacttgtggctc

SEQ ID NO: 530664 - DNA, 25 bp, Mus musculus
gcacagaggcagctttttcctgcag

SEQ ID NO: 530665 - DNA, 25 bp, Mus musculus
gcacagaggcaggtttttcctgcag

SEQ ID NO: 530666 - DNA, 25 bp, Mus musculus
gcacagaggctcagcctattcgtgg

SEQ ID NO: 530667 - DNA, 25 bp, Mus musculus
gcacagaggctctgcctattcgtgg

SEQ ID NO: 530668 - DNA, 25 bp, Mus musculus
gcacagaggtctccatggtcagtga

SEQ ID NO: 530669 - DNA, 25 bp, Mus musculus
gcacagaggtctgcatggtcagtga

SEQ ID NO: 530670 - DNA, 25 bp, Mus musculus
gcacagatatctcgttctccttgag

SEQ ID NO: 530671 - DNA, 25 bp, Mus musculus
gcacagatatctggttctccttgag

SEQ ID NO: 530672 - DNA, 25 bp, Mus musculus
gcacagatcctgagaacgggcatat

SEQ ID NO: 530673 - DNA, 25 bp, Mus musculus
gcacagatcctgtgaacgggcatat

SEQ ID NO: 530674 - DNA, 25 bp, Mus musculus
gcacagatctcactttttggttaca

SEQ ID NO: 530675 - DNA, 25 bp, Mus musculus
gcacagatctcagtttttggttaca

SEQ ID NO: 530676 - DNA, 25 bp, Mus musculus
gcacagatcttaagaccgagagagt

SEQ ID NO: 530677 - DNA, 25 bp, Mus musculus
gcacagatcttatgaccgagagagt

SEQ ID NO: 530678 - DNA, 25 bp, Mus musculus
gcacagatgctgcagaaggcctttg

SEQ ID NO: 530679 - DNA, 25 bp, Mus musculus
gcacagatgctgcagtctccaaaga

SEQ ID NO: 530680 - DNA, 25 bp, Mus musculus
gcacagatgctggagaaggcctttg

SEQ ID NO: 530681 - DNA, 25 bp, Mus musculus
gcacagatgctggagtctccaaaga

SEQ ID NO: 530682 - DNA, 25 bp, Mus musculus
gcacagatggacagatttgagcttt

SEQ ID NO: 530683 - DNA, 25 bp, Mus musculus
gcacagatggactgatttgagcttt

SEQ ID NO: 530684 - DNA, 25 bp, Mus musculus
gcacagatggatacagccttccaga

SEQ ID NO: 530685 - DNA, 25 bp, Mus musculus
gcacagatggattcagccttccaga

SEQ ID NO: 530686 - DNA, 25 bp, Mus musculus
gcacagatggcccaggctctccagg

SEQ ID NO: 530687 - DNA, 25 bp, Mus musculus
gcacagatggccgaggctctccagg

SEQ ID NO: 530688 - DNA, 25 bp, Mus musculus
gcacagatgggaaatgcagctttca

SEQ ID NO: 530689 - DNA, 25 bp, Mus musculus
gcacagatgggatatgcagctttca

SEQ ID NO: 530690 - DNA, 25 bp, Mus musculus
gcacagatgggcaggcctggccatg

SEQ ID NO: 530691 - DNA, 25 bp, Mus musculus
gcacagatgggctggcctggccatg

SEQ ID NO: 530692 - DNA, 25 bp, Mus musculus
gcacagatgtcactcttgagagcaa

SEQ ID NO: 530693 - DNA, 25 bp, Mus musculus
gcacagatgtcagtcttgagagcaa

SEQ ID NO: 530694 - DNA, 25 bp, Mus musculus
gcacagatttgcaagtcctacgctt

SEQ ID NO: 530695 - DNA, 25 bp, Mus musculus
gcacagatttgctagtcctacgctt

SEQ ID NO: 530696 - DNA, 25 bp, Mus musculus
gcacagcacaaaatagttatatatg

SEQ ID NO: 530697 - DNA, 25 bp, Mus musculus
gcacagcacaaattagttatatatg

SEQ ID NO: 530698 - DNA, 25 bp, Mus musculus
gcacagcacagacgttgctcagtat

SEQ ID NO: 530699 - DNA, 25 bp, Mus musculus
gcacagcacagaggttgctcagtat

SEQ ID NO: 530700 - DNA, 25 bp, Mus musculus
gcacagcaccttacagtttgcagag

SEQ ID NO: 530701 - DNA, 25 bp, Mus musculus
gcacagcacctttcagtttgcagag

SEQ ID NO: 530702 - DNA, 25 bp, Mus musculus
gcacagcacgtgaagaccgccaaat

SEQ ID NO: 530703 - DNA, 25 bp, Mus musculus
gcacagcacgtgtagaccgccaaat

SEQ ID NO: 530704 - DNA, 25 bp, Mus musculus
gcacagcagacacgctgaggctcct

SEQ ID NO: 530705 - DNA, 25 bp, Mus musculus
gcacagcagacaggctgaggctcct

SEQ ID NO: 530706 - DNA, 25 bp, Mus musculus
gcacagcagcagatgattgtggaac

SEQ ID NO: 530707 - DNA, 25 bp, Mus musculus
gcacagcagcagttgattgtggaac

SEQ ID NO: 530708 - DNA, 25 bp, Mus musculus
gcacagcagtgtatatggagttaac

SEQ ID NO: 530709 - DNA, 25 bp, Mus musculus
gcacagcagtgtttatggagttaac

SEQ ID NO: 530710 - DNA, 25 bp, Mus musculus
gcacagcatgctaaactataacttg

SEQ ID NO: 530711 - DNA, 25 bp, Mus musculus
gcacagcatgcttaactataacttg

SEQ ID NO: 530712 - DNA, 25 bp, Mus musculus
gcacagcatggacagacttcctaac

SEQ ID NO: 530713 - DNA, 25 bp, Mus musculus
gcacagcatggagagacttcctaac

SEQ ID NO: 530714 - DNA, 25 bp, Mus musculus
gcacagcatgtaacacatactcctg

SEQ ID NO: 530715 - DNA, 25 bp, Mus musculus
gcacagcatgtaacagatggtggtt

SEQ ID NO: 530716 - DNA, 25 bp, Mus musculus
gcacagcatgtatcacatactcctg

SEQ ID NO: 530717 - DNA, 25 bp, Mus musculus
gcacagcatgtatcagatggtggtt

SEQ ID NO: 530718 - DNA, 25 bp, Mus musculus
gcacagcatgtgaacctcaaagggc

SEQ ID NO: 530719 - DNA, 25 bp, Mus musculus
gcacagcatgtgtacctcaaagggc

SEQ ID NO: 530720 - DNA, 25 bp, Mus musculus
gcacagcattttcgcaatcgttggt

SEQ ID NO: 530721 - DNA, 25 bp, Mus musculus
gcacagcattttggcaatcgttggt

SEQ ID NO: 530722 - DNA, 25 bp, Mus musculus
gcacagccaagaagtgagatcatgg

SEQ ID NO: 530723 - DNA, 25 bp, Mus musculus
gcacagccaagatgtgagatcatgg

SEQ ID NO: 530724 - DNA, 25 bp, Mus musculus
gcacagccactcacttagagactag

SEQ ID NO: 530725 - DNA, 25 bp, Mus musculus
gcacagccactctcttagagactag

SEQ ID NO: 530726 - DNA, 25 bp, Mus musculus
gcacagccagacctaaagcaccaag

SEQ ID NO: 530727 - DNA, 25 bp, Mus musculus
gcacagccagacgtaaagcaccaag

SEQ ID NO: 530728 - DNA, 25 bp, Mus musculus
gcacagccaggaagaatgcagcgta

SEQ ID NO: 530729 - DNA, 25 bp, Mus musculus
gcacagccaggatgaatgcagcgta

SEQ ID NO: 530730 - DNA, 25 bp, Mus musculus
gcacagccagggattctcagtcagt

SEQ ID NO: 530731 - DNA, 25 bp, Mus musculus
gcacagccagggtttctcagtcagt

SEQ ID NO: 530732 - DNA, 25 bp, Mus musculus
gcacagcccggaattaagttcttga

SEQ ID NO: 530733 - DNA, 25 bp, Mus musculus
gcacagcccggatttaagttcttga

SEQ ID NO: 530734 - DNA, 25 bp, Mus musculus
gcacagcccttgaagcacaggtgct

SEQ ID NO: 530735 - DNA, 25 bp, Mus musculus
gcacagcccttgtagcacaggtgct

SEQ ID NO: 530736 - DNA, 25 bp, Mus musculus
gcacagccctttccacttgtttgct

SEQ ID NO: 530737 - DNA, 25 bp, Mus musculus
gcacagccctttgcacttgtttgct

SEQ ID NO: 530738 - DNA, 25 bp, Mus musculus
gcacagccgtgtcaagctcatttta

SEQ ID NO: 530739 - DNA, 25 bp, Mus musculus
gcacagccgtgtgaagctcatttta

SEQ ID NO: 530740 - DNA, 25 bp, Mus musculus
gcacagcctaaactcacctgagagg

SEQ ID NO: 530741 - DNA, 25 bp, Mus musculus
gcacagcctaaagtcacctgagagg

SEQ ID NO: 530742 - DNA, 25 bp, Mus musculus
gcacagcctggtcatcgatacactg

SEQ ID NO: 530743 - DNA, 25 bp, Mus musculus
gcacagcctggtgatcgatacactg

SEQ ID NO: 530744 - DNA, 25 bp, Mus musculus
gcacagcctgtgaggttacctatcg

SEQ ID NO: 530745 - DNA, 25 bp, Mus musculus
gcacagcctgtgcagctcgcagaag

SEQ ID NO: 530746 - DNA, 25 bp, Mus musculus
gcacagcctgtggagctcgcagaag

SEQ ID NO: 530747 - DNA, 25 bp, Mus musculus
gcacagcctgtgtggttacctatcg

SEQ ID NO: 530748 - DNA, 25 bp, Mus musculus
gcacagccttgacaagtcggagact

SEQ ID NO: 530749 - DNA, 25 bp, Mus musculus
gcacagccttgagaagtcggagact

SEQ ID NO: 530750 - DNA, 25 bp, Mus musculus
gcacagcctttacagttctagcatg

SEQ ID NO: 530751 - DNA, 25 bp, Mus musculus
gcacagcctttagagttctagcatg

SEQ ID NO: 530752 - DNA, 25 bp, Mus musculus
gcacagcgcactccatgtttattct

SEQ ID NO: 530753 - DNA, 25 bp, Mus musculus
gcacagcgcactgcatgtttattct

SEQ ID NO: 530754 - DNA, 25 bp, Mus musculus
gcacagcggcaacatcatggccatg

SEQ ID NO: 530755 - DNA, 25 bp, Mus musculus
gcacagcggcaagatcatggccatg

SEQ ID NO: 530756 - DNA, 25 bp, Mus musculus
gcacagcggttacacgtgttagaat

SEQ ID NO: 530757 - DNA, 25 bp, Mus musculus
gcacagcggttagacgtgttagaat

SEQ ID NO: 530758 - DNA, 25 bp, Mus musculus
gcacagctcagcaatggagttactc

SEQ ID NO: 530759 - DNA, 25 bp, Mus musculus
gcacagctcagctatggagttactc

SEQ ID NO: 530760 - DNA, 25 bp, Mus musculus
gcacagctcataaggcccatgaaca

SEQ ID NO: 530761 - DNA, 25 bp, Mus musculus
gcacagctcatatggcccatgaaca

SEQ ID NO: 530762 - DNA, 25 bp, Mus musculus
gcacagctctcactagctagcttaa

SEQ ID NO: 530763 - DNA, 25 bp, Mus musculus
gcacagctctcagtagctagcttaa

SEQ ID NO: 530764 - DNA, 25 bp, Mus musculus
gcacagctcttgacgatcggcatag

SEQ ID NO: 530765 - DNA, 25 bp, Mus musculus
gcacagctcttgtcgatcggcatag

SEQ ID NO: 530766 - DNA, 25 bp, Mus musculus
gcacagctgagaactacaacacaca

SEQ ID NO: 530767 - DNA, 25 bp, Mus musculus
gcacagctgagacatgcttgtactt

SEQ ID NO: 530768 - DNA, 25 bp, Mus musculus
gcacagctgagagatgcttgtactt

SEQ ID NO: 530769 - DNA, 25 bp, Mus musculus
gcacagctgagatctacaacacaca

SEQ ID NO: 530770 - DNA, 25 bp, Mus musculus
gcacagctgcaactgggctttcgat

SEQ ID NO: 530771 - DNA, 25 bp, Mus musculus
gcacagctgcaagtgggctttcgat

SEQ ID NO: 530772 - DNA, 25 bp, Mus musculus
gcacagctgcagactgatgaaaggg

SEQ ID NO: 530773 - DNA, 25 bp, Mus musculus
gcacagctgcagtctgatgaaaggg

SEQ ID NO: 530774 - DNA, 25 bp, Mus musculus
gcacagctggatccttacaatgcaa

SEQ ID NO: 530775 - DNA, 25 bp, Mus musculus
gcacagctggatgcttacaatgcaa

SEQ ID NO: 530776 - DNA, 25 bp, Mus musculus
gcacagctggcgaattgtatagtac

SEQ ID NO: 530777 - DNA, 25 bp, Mus musculus
gcacagctggcgtattgtatagtac

SEQ ID NO: 530778 - DNA, 25 bp, Mus musculus
gcacagctggctaaaaggcacatcc

SEQ ID NO: 530779 - DNA, 25 bp, Mus musculus
gcacagctggcttaaaggcacatcc

SEQ ID NO: 530780 - DNA, 25 bp, Mus musculus
gcacagctgtagactgagggctgaa

SEQ ID NO: 530781 - DNA, 25 bp, Mus musculus
gcacagctgtagtctgagggctgaa

SEQ ID NO: 530782 - DNA, 25 bp, Mus musculus
gcacagcttcctcataaggagacgg

SEQ ID NO: 530783 - DNA, 25 bp, Mus musculus
gcacagcttcctgataaggagacgg

SEQ ID NO: 530784 - DNA, 25 bp, Mus musculus
gcacagctttaaagaggatttcctc

SEQ ID NO: 530785 - DNA, 25 bp, Mus musculus
gcacagctttaatgaggatttcctc

SEQ ID NO: 530786 - DNA, 25 bp, Mus musculus
gcacagctttcacccaggtggctgt

SEQ ID NO: 530787 - DNA, 25 bp, Mus musculus
gcacagctttcactatgccataggc

SEQ ID NO: 530788 - DNA, 25 bp, Mus musculus
gcacagctttcagccaggtggctgt

SEQ ID NO: 530789 - DNA, 25 bp, Mus musculus
gcacagctttcagtatgccataggc

SEQ ID NO: 530790 - DNA, 25 bp, Mus musculus
gcacagcttttacgtgatcacagga

SEQ ID NO: 530791 - DNA, 25 bp, Mus musculus
gcacagcttttaggtgatcacagga

SEQ ID NO: 530792 - DNA, 25 bp, Mus musculus
gcacaggaaaccattctcgggacct

SEQ ID NO: 530793 - DNA, 25 bp, Mus musculus
gcacaggaaacctttctcgggacct

SEQ ID NO: 530794 - DNA, 25 bp, Mus musculus
gcacaggaaagcagatcctgcctct

SEQ ID NO: 530795 - DNA, 25 bp, Mus musculus
gcacaggaaagccttttcttccaag

SEQ ID NO: 530796 - DNA, 25 bp, Mus musculus
gcacaggaaagcgttttcttccaag

SEQ ID NO: 530797 - DNA, 25 bp, Mus musculus
gcacaggaaagctgatcctgcctct

SEQ ID NO: 530798 - DNA, 25 bp, Mus musculus
gcacaggaaccaagatatttttaat

SEQ ID NO: 530799 - DNA, 25 bp, Mus musculus
gcacaggaaccatgatatttttaat

SEQ ID NO: 530800 - DNA, 25 bp, Mus musculus
gcacaggaaggcaccgttgacaccg

SEQ ID NO: 530801 - DNA, 25 bp, Mus musculus
gcacaggaaggctccgttgacaccg

SEQ ID NO: 530802 - DNA, 25 bp, Mus musculus
gcacaggaattaaagaagcaggctt

SEQ ID NO: 530803 - DNA, 25 bp, Mus musculus
gcacaggaattatagaagcaggctt

SEQ ID NO: 530804 - DNA, 25 bp, Mus musculus
gcacaggacctgaactttttaattt

SEQ ID NO: 530805 - DNA, 25 bp, Mus musculus
gcacaggacctgtactttttaattt

SEQ ID NO: 530806 - DNA, 25 bp, Mus musculus
gcacaggactgaagctaaggaagga

SEQ ID NO: 530807 - DNA, 25 bp, Mus musculus
gcacaggactgatgctaaggaagga

SEQ ID NO: 530808 - DNA, 25 bp, Mus musculus
gcacaggagtctcaccacaggcagg

SEQ ID NO: 530809 - DNA, 25 bp, Mus musculus
gcacaggagtctgaccacaggcagg

SEQ ID NO: 530810 - DNA, 25 bp, Mus musculus
gcacaggatgctatagtccccaggg

SEQ ID NO: 530811 - DNA, 25 bp, Mus musculus
gcacaggatgctttagtccccaggg

SEQ ID NO: 530812 - DNA, 25 bp, Mus musculus
gcacaggatgtacttggtatttagt

SEQ ID NO: 530813 - DNA, 25 bp, Mus musculus
gcacaggatgtagttggtatttagt

SEQ ID NO: 530814 - DNA, 25 bp, Mus musculus
gcacaggattttacataggctctca

SEQ ID NO: 530815 - DNA, 25 bp, Mus musculus
gcacaggatttttcataggctctca

SEQ ID NO: 530816 - DNA, 25 bp, Mus musculus
gcacaggcaacaagtctttcatcag

SEQ ID NO: 530817 - DNA, 25 bp, Mus musculus
gcacaggcaacatgtctttcatcag

SEQ ID NO: 530818 - DNA, 25 bp, Mus musculus
gcacaggcaaccacctagacaagga

SEQ ID NO: 530819 - DNA, 25 bp, Mus musculus
gcacaggcaacctcctagacaagga

SEQ ID NO: 530820 - DNA, 25 bp, Mus musculus
gcacaggcaccgagacagtctttga

SEQ ID NO: 530821 - DNA, 25 bp, Mus musculus
gcacaggcaccgtgacagtctttga

SEQ ID NO: 530822 - DNA, 25 bp, Mus musculus
gcacaggcccaaagaatttatttat

SEQ ID NO: 530823 - DNA, 25 bp, Mus musculus
gcacaggcccaatgaatttatttat

SEQ ID NO: 530824 - DNA, 25 bp, Mus musculus
gcacaggcctttctggcacaggtga

SEQ ID NO: 530825 - DNA, 25 bp, Mus musculus
gcacaggcctttgtggcacaggtga

SEQ ID NO: 530826 - DNA, 25 bp, Mus musculus
gcacaggcgctaagggagttccaga

SEQ ID NO: 530827 - DNA, 25 bp, Mus musculus
gcacaggcgctatgggagttccaga

SEQ ID NO: 530828 - DNA, 25 bp, Mus musculus
gcacaggcgtttcagcagttgatgg

SEQ ID NO: 530829 - DNA, 25 bp, Mus musculus
gcacaggcgtttgagcagttgatgg

SEQ ID NO: 530830 - DNA, 25 bp, Mus musculus
gcacaggctaccctcactgtacaag

SEQ ID NO: 530831 - DNA, 25 bp, Mus musculus
gcacaggctaccgtcactgtacaag

SEQ ID NO: 530832 - DNA, 25 bp, Mus musculus
gcacaggctacgaagtgcagctgtt

SEQ ID NO: 530833 - DNA, 25 bp, Mus musculus
gcacaggctacgtagtgcagctgtt

SEQ ID NO: 530834 - DNA, 25 bp, Mus musculus
gcacaggctctgaagttgggtaaag

SEQ ID NO: 530835 - DNA, 25 bp, Mus musculus
gcacaggctctgtagttgggtaaag

SEQ ID NO: 530836 - DNA, 25 bp, Mus musculus
gcacaggctggtattggagtgtcaa

SEQ ID NO: 530837 - DNA, 25 bp, Mus musculus
gcacaggctggttttggagtgtcaa

SEQ ID NO: 530838 - DNA, 25 bp, Mus musculus
gcacaggctgtgaagtttattcctc

SEQ ID NO: 530839 - DNA, 25 bp, Mus musculus
gcacaggctgtgtagtttattcctc

SEQ ID NO: 530840 - DNA, 25 bp, Mus musculus
gcacaggcttatctcaccagggtac

SEQ ID NO: 530841 - DNA, 25 bp, Mus musculus
gcacaggcttatgtcaccagggtac

SEQ ID NO: 530842 - DNA, 25 bp, Mus musculus
gcacagggaagtatctcattttagt

SEQ ID NO: 530843 - DNA, 25 bp, Mus musculus
gcacagggaagtttctcattttagt

SEQ ID NO: 530844 - DNA, 25 bp, Mus musculus
gcacagggatttcgcttgttcttcc

SEQ ID NO: 530845 - DNA, 25 bp, Mus musculus
gcacagggatttggcttgttcttcc

SEQ ID NO: 530846 - DNA, 25 bp, Mus musculus
gcacagggcatgcagtaagttcagt

SEQ ID NO: 530847 - DNA, 25 bp, Mus musculus
gcacagggcatggagtaagttcagt

SEQ ID NO: 530848 - DNA, 25 bp, Mus musculus
gcacagggcctgctactatgatgag

SEQ ID NO: 530849 - DNA, 25 bp, Mus musculus
gcacagggcctggtactatgatgag

SEQ ID NO: 530850 - DNA, 25 bp, Mus musculus
gcacagggctagaagcctcttttca

SEQ ID NO: 530851 - DNA, 25 bp, Mus musculus
gcacagggctagtagcctcttttca

SEQ ID NO: 530852 - DNA, 25 bp, Mus musculus
gcacagggctttccccaactgtaac

SEQ ID NO: 530853 - DNA, 25 bp, Mus musculus
gcacagggctttgcccaactgtaac

SEQ ID NO: 530854 - DNA, 25 bp, Mus musculus
gcacagggtcttaaccttgcacctt

SEQ ID NO: 530855 - DNA, 25 bp, Mus musculus
gcacagggtctttaccttgcacctt

SEQ ID NO: 530856 - DNA, 25 bp, Mus musculus
gcacaggtacgtcagtttgattcct

SEQ ID NO: 530857 - DNA, 25 bp, Mus musculus
gcacaggtacgtgagtttgattcct

SEQ ID NO: 530858 - DNA, 25 bp, Mus musculus
gcacaggtagacagctggtttgaca

SEQ ID NO: 530859 - DNA, 25 bp, Mus musculus
gcacaggtagactgctggtttgaca

SEQ ID NO: 530860 - DNA, 25 bp, Mus musculus
gcacaggtccacagatggtttggta

SEQ ID NO: 530861 - DNA, 25 bp, Mus musculus
gcacaggtccactgatggtttggta

SEQ ID NO: 530862 - DNA, 25 bp, Mus musculus
gcacaggtcgcactcagaactcagg

SEQ ID NO: 530863 - DNA, 25 bp, Mus musculus
gcacaggtcgcagtcagaactcagg

SEQ ID NO: 530864 - DNA, 25 bp, Mus musculus
gcacaggtggttaccaaggttctct

SEQ ID NO: 530865 - DNA, 25 bp, Mus musculus
gcacaggtggtttccaaggttctct

SEQ ID NO: 530866 - DNA, 25 bp, Mus musculus
gcacaggtgtccctctgatcttttg

SEQ ID NO: 530867 - DNA, 25 bp, Mus musculus
gcacaggtgtccgtctgatcttttg

SEQ ID NO: 530868 - DNA, 25 bp, Mus musculus
gcacaggtgtgtaaatctctgcaag

SEQ ID NO: 530869 - DNA, 25 bp, Mus musculus
gcacaggtgtgttaatctctgcaag

SEQ ID NO: 530870 - DNA, 25 bp, Mus musculus
gcacaggttagactgcctttccttt

SEQ ID NO: 530871 - DNA, 25 bp, Mus musculus
gcacaggttagagtgcctttccttt

SEQ ID NO: 530872 - DNA, 25 bp, Mus musculus
gcacaggttctccataaatgttagt

SEQ ID NO: 530873 - DNA, 25 bp, Mus musculus
gcacaggttctcgataaatgttagt

SEQ ID NO: 530874 - DNA, 25 bp, Mus musculus
gcacaggtttccattgtgagcagtg

SEQ ID NO: 530875 - DNA, 25 bp, Mus musculus
gcacaggtttcctttgtgagcagtg

SEQ ID NO: 530876 - DNA, 25 bp, Mus musculus
gcacagtaactcaacatcaaaaggt

SEQ ID NO: 530877 - DNA, 25 bp, Mus musculus
gcacagtaactctacatcaaaaggt

SEQ ID NO: 530878 - DNA, 25 bp, Mus musculus
gcacagtaactgatgtaacttgggc

SEQ ID NO: 530879 - DNA, 25 bp, Mus musculus
gcacagtaactgttgtaacttgggc

SEQ ID NO: 530880 - DNA, 25 bp, Mus musculus
gcacagtaagcacattggccgtccg

SEQ ID NO: 530881 - DNA, 25 bp, Mus musculus
gcacagtaagcagattggccgtccg

SEQ ID NO: 530882 - DNA, 25 bp, Mus musculus
gcacagtaccggatgtcatgggaga

SEQ ID NO: 530883 - DNA, 25 bp, Mus musculus
gcacagtaccggttgtcatgggaga

SEQ ID NO: 530884 - DNA, 25 bp, Mus musculus
gcacagtactagagagggcatggct

SEQ ID NO: 530885 - DNA, 25 bp, Mus musculus
gcacagtactagtgagggcatggct

SEQ ID NO: 530886 - DNA, 25 bp, Mus musculus
gcacagtagtcaccggtgttgacat

SEQ ID NO: 530887 - DNA, 25 bp, Mus musculus
gcacagtagtcagcggtgttgacat

SEQ ID NO: 530888 - DNA, 25 bp, Mus musculus
gcacagtataacatcatccttgttg

SEQ ID NO: 530889 - DNA, 25 bp, Mus musculus
gcacagtataacttcatccttgttg

SEQ ID NO: 530890 - DNA, 25 bp, Mus musculus
gcacagtatcataggcacacacctt

SEQ ID NO: 530891 - DNA, 25 bp, Mus musculus
gcacagtatcattggcacacacctt

SEQ ID NO: 530892 - DNA, 25 bp, Mus musculus
gcacagtcaggcaaactgtccttgt

SEQ ID NO: 530893 - DNA, 25 bp, Mus musculus
gcacagtcaggctaactgtccttgt

SEQ ID NO: 530894 - DNA, 25 bp, Mus musculus
gcacagtcagtcctttgttccaaaa

SEQ ID NO: 530895 - DNA, 25 bp, Mus musculus
gcacagtcagtcgtttgttccaaaa

SEQ ID NO: 530896 - DNA, 25 bp, Mus musculus
gcacagtccattagtctcagaggta

SEQ ID NO: 530897 - DNA, 25 bp, Mus musculus
gcacagtccatttgtctcagaggta

SEQ ID NO: 530898 - DNA, 25 bp, Mus musculus
gcacagtcctaaattcataaggtca

SEQ ID NO: 530899 - DNA, 25 bp, Mus musculus
gcacagtcctaatttcataaggtca

SEQ ID NO: 530900 - DNA, 25 bp, Mus musculus
gcacagtcctgacaggtctggatct

SEQ ID NO: 530901 - DNA, 25 bp, Mus musculus
gcacagtcctgagaggtctggatct

SEQ ID NO: 530902 - DNA, 25 bp, Mus musculus
gcacagtctatccatgatgtcctta

SEQ ID NO: 530903 - DNA, 25 bp, Mus musculus
gcacagtctatcgatgatgtcctta

SEQ ID NO: 530904 - DNA, 25 bp, Mus musculus
gcacagtctattaattctgcccagc

SEQ ID NO: 530905 - DNA, 25 bp, Mus musculus
gcacagtctatttattctgcccagc

SEQ ID NO: 530906 - DNA, 25 bp, Mus musculus
gcacagtctctgctttctcattaac

SEQ ID NO: 530907 - DNA, 25 bp, Mus musculus
gcacagtctctggtttctcattaac

SEQ ID NO: 530908 - DNA, 25 bp, Mus musculus
gcacagtctgcccaaaagcctaaca

SEQ ID NO: 530909 - DNA, 25 bp, Mus musculus
gcacagtctgccgaaaagcctaaca

SEQ ID NO: 530910 - DNA, 25 bp, Mus musculus
gcacagtctggtaaaatatctgcca

SEQ ID NO: 530911 - DNA, 25 bp, Mus musculus
gcacagtctggttaaatatctgcca

SEQ ID NO: 530912 - DNA, 25 bp, Mus musculus
gcacagtctgtcactctatcgctgg

SEQ ID NO: 530913 - DNA, 25 bp, Mus musculus
gcacagtctgtcactgctgtcgctg

SEQ ID NO: 530914 - DNA, 25 bp, Mus musculus
gcacagtctgtctctctatcgctgg

SEQ ID NO: 530915 - DNA, 25 bp, Mus musculus
gcacagtctgtctctgctgtcgctg

SEQ ID NO: 530916 - DNA, 25 bp, Mus musculus
gcacagtgacataaaccaaagaggt

SEQ ID NO: 530917 - DNA, 25 bp, Mus musculus
gcacagtgacattaaccaaagaggt

SEQ ID NO: 530918 - DNA, 25 bp, Mus musculus
gcacagtgagctctggcaggcacaa

SEQ ID NO: 530919 - DNA, 25 bp, Mus musculus
gcacagtgagctgtggcaggcacaa

SEQ ID NO: 530920 - DNA, 25 bp, Mus musculus
gcacagtgaggaagcgtccctggct

SEQ ID NO: 530921 - DNA, 25 bp, Mus musculus
gcacagtgaggacggcctgctcttt

SEQ ID NO: 530922 - DNA, 25 bp, Mus musculus
gcacagtgaggagggcctgctcttt

SEQ ID NO: 530923 - DNA, 25 bp, Mus musculus
gcacagtgaggatgcgtccctggct

SEQ ID NO: 530924 - DNA, 25 bp, Mus musculus
gcacagtgattaacctctagcatga

SEQ ID NO: 530925 - DNA, 25 bp, Mus musculus
gcacagtgattatcctctagcatga

SEQ ID NO: 530926 - DNA, 25 bp, Mus musculus
gcacagtgatttaatgccggccatc

SEQ ID NO: 530927 - DNA, 25 bp, Mus musculus
gcacagtgattttatgccggccatc

SEQ ID NO: 530928 - DNA, 25 bp, Mus musculus
gcacagtgccaacgtcctgagtgtt

SEQ ID NO: 530929 - DNA, 25 bp, Mus musculus
gcacagtgccaaggtcctgagtgtt

SEQ ID NO: 530930 - DNA, 25 bp, Mus musculus
gcacagtgccatctagctgggctat

SEQ ID NO: 530931 - DNA, 25 bp, Mus musculus
gcacagtgccatgtagctgggctat

SEQ ID NO: 530932 - DNA, 25 bp, Mus musculus
gcacagtgccctcagggtaggaaca

SEQ ID NO: 530933 - DNA, 25 bp, Mus musculus
gcacagtgccctgagggtaggaaca

SEQ ID NO: 530934 - DNA, 25 bp, Mus musculus
gcacagtggacaaggctagcagaca

SEQ ID NO: 530935 - DNA, 25 bp, Mus musculus
gcacagtggacaatcatggcgcaga

SEQ ID NO: 530936 - DNA, 25 bp, Mus musculus
gcacagtggacatggctagcagaca

SEQ ID NO: 530937 - DNA, 25 bp, Mus musculus
gcacagtggacattcatggcgcaga

SEQ ID NO: 530938 - DNA, 25 bp, Mus musculus
gcacagtggagtagccatcacccaa

SEQ ID NO: 530939 - DNA, 25 bp, Mus musculus
gcacagtggagttgccatcacccaa

SEQ ID NO: 530940 - DNA, 25 bp, Mus musculus
gcacagtggcacatattctaataag

SEQ ID NO: 530941 - DNA, 25 bp, Mus musculus
gcacagtggcacttattctaataag

SEQ ID NO: 530942 - DNA, 25 bp, Mus musculus
gcacagtggctgacaaaattcataa

SEQ ID NO: 530943 - DNA, 25 bp, Mus musculus
gcacagtggctgtcaaaattcataa

SEQ ID NO: 530944 - DNA, 25 bp, Mus musculus
gcacagtgggcactttactctccag

SEQ ID NO: 530945 - DNA, 25 bp, Mus musculus
gcacagtgggcagtttactctccag

SEQ ID NO: 530946 - DNA, 25 bp, Mus musculus
gcacagtgggtgctctgccagtcaa

SEQ ID NO: 530947 - DNA, 25 bp, Mus musculus
gcacagtgggtggtctgccagtcaa

SEQ ID NO: 530948 - DNA, 25 bp, Mus musculus
gcacagtggtaaagccgtccagtct

SEQ ID NO: 530949 - DNA, 25 bp, Mus musculus
gcacagtggtaatgccgtccagtct

SEQ ID NO: 530950 - DNA, 25 bp, Mus musculus
gcacagtggtagcttatgctttaaa

SEQ ID NO: 530951 - DNA, 25 bp, Mus musculus
gcacagtggtaggttatgctttaaa

SEQ ID NO: 530952 - DNA, 25 bp, Mus musculus
gcacagtggtttcttgaatggtcaa

SEQ ID NO: 530953 - DNA, 25 bp, Mus musculus
gcacagtggtttgttgaatggtcaa

SEQ ID NO: 530954 - DNA, 25 bp, Mus musculus
gcacagtgtccaacatgccatttaa

SEQ ID NO: 530955 - DNA, 25 bp, Mus musculus
gcacagtgtccatcatgccatttaa

SEQ ID NO: 530956 - DNA, 25 bp, Mus musculus
gcacagtgtgcaccccttgaaatca

SEQ ID NO: 530957 - DNA, 25 bp, Mus musculus
gcacagtgtgcagcccttgaaatca

SEQ ID NO: 530958 - DNA, 25 bp, Mus musculus
gcacagtgtgtgctatggtcctcct

SEQ ID NO: 530959 - DNA, 25 bp, Mus musculus
gcacagtgtgtggtatggtcctcct

SEQ ID NO: 530960 - DNA, 25 bp, Mus musculus
gcacagttaatacctgttaatcagg

SEQ ID NO: 530961 - DNA, 25 bp, Mus musculus
gcacagttaatagctgttaatcagg

SEQ ID NO: 530962 - DNA, 25 bp, Mus musculus
gcacagttacctaaatatcagagaa

SEQ ID NO: 530963 - DNA, 25 bp, Mus musculus
gcacagttaccttaatatcagagaa

SEQ ID NO: 530964 - DNA, 25 bp, Mus musculus
gcacagttagttaagctgtcttctg

SEQ ID NO: 530965 - DNA, 25 bp, Mus musculus
gcacagttagtttagctgtcttctg

SEQ ID NO: 530966 - DNA, 25 bp, Mus musculus
gcacagttcaagaggcgcagctgcc

SEQ ID NO: 530967 - DNA, 25 bp, Mus musculus
gcacagttcaagtggcgcagctgcc

SEQ ID NO: 530968 - DNA, 25 bp, Mus musculus
gcacagttcctgatgtaggtttcgc

SEQ ID NO: 530969 - DNA, 25 bp, Mus musculus
gcacagttcctgctatgtatgcttt

SEQ ID NO: 530970 - DNA, 25 bp, Mus musculus
gcacagttcctggtatgtatgcttt

SEQ ID NO: 530971 - DNA, 25 bp, Mus musculus
gcacagttcctgttgtaggtttcgc

SEQ ID NO: 530972 - DNA, 25 bp, Mus musculus
gcacagttcgtgcaaatgtggccaa

SEQ ID NO: 530973 - DNA, 25 bp, Mus musculus
gcacagttcgtggaaatgtggccaa

SEQ ID NO: 530974 - DNA, 25 bp, Mus musculus
gcacagttctaacctatacaacttg

SEQ ID NO: 530975 - DNA, 25 bp, Mus musculus
gcacagttctaagctatacaacttg

SEQ ID NO: 530976 - DNA, 25 bp, Mus musculus
gcacagttctgcacaatgtcagttg

SEQ ID NO: 530977 - DNA, 25 bp, Mus musculus
gcacagttctgctcaatgtcagttg

SEQ ID NO: 530978 - DNA, 25 bp, Mus musculus
gcacagttcttaaagtaccctaaca

SEQ ID NO: 530979 - DNA, 25 bp, Mus musculus
gcacagttcttatagtaccctaaca

SEQ ID NO: 530980 - DNA, 25 bp, Mus musculus
gcacagttctttcagattttcctcc

SEQ ID NO: 530981 - DNA, 25 bp, Mus musculus
gcacagttctttgagattttcctcc

SEQ ID NO: 530982 - DNA, 25 bp, Mus musculus
gcacagttgcacctgggtgacccat

SEQ ID NO: 530983 - DNA, 25 bp, Mus musculus
gcacagttgcacgtgggtgacccat

SEQ ID NO: 530984 - DNA, 25 bp, Mus musculus
gcacagtttgcccttagcttagatc

SEQ ID NO: 530985 - DNA, 25 bp, Mus musculus
gcacagtttgccgttagcttagatc

SEQ ID NO: 530986 - DNA, 25 bp, Mus musculus
gcacagtttgtcagtccccgttgga

SEQ ID NO: 530987 - DNA, 25 bp, Mus musculus
gcacagtttgtctgtccccgttgga

SEQ ID NO: 530988 - DNA, 25 bp, Mus musculus
gcacataaaattctgatgcctttct

SEQ ID NO: 530989 - DNA, 25 bp, Mus musculus
gcacataaaattgtgatgcctttct

SEQ ID NO: 530990 - DNA, 25 bp, Mus musculus
gcacataaactgctctcttaacttc

SEQ ID NO: 530991 - DNA, 25 bp, Mus musculus
gcacataaactggtctcttaacttc

SEQ ID NO: 530992 - DNA, 25 bp, Mus musculus
gcacataaggagctggcccacactt

SEQ ID NO: 530993 - DNA, 25 bp, Mus musculus
gcacataaggaggtggcccacactt

SEQ ID NO: 530994 - DNA, 25 bp, Mus musculus
gcacataattggcaagagctctccc

SEQ ID NO: 530995 - DNA, 25 bp, Mus musculus
gcacataattgggaagagctctccc

SEQ ID NO: 530996 - DNA, 25 bp, Mus musculus
gcacatacagaacgcacaactccaa

SEQ ID NO: 530997 - DNA, 25 bp, Mus musculus
gcacatacagaaggcacaactccaa

SEQ ID NO: 530998 - DNA, 25 bp, Mus musculus
gcacatacagatatcccactctcat

SEQ ID NO: 530999 - DNA, 25 bp, Mus musculus
gcacatacagatttcccactctcat

SEQ ID NO: 531000 - DNA, 25 bp, Mus musculus
gcacatacatgtatcgtcattcagt

SEQ ID NO: 531001 - DNA, 25 bp, Mus musculus
gcacatacatgtttcgtcattcagt

SEQ ID NO: 531002 - DNA, 25 bp, Mus musculus
gcacataccagcacacagatcaaat

SEQ ID NO: 531003 - DNA, 25 bp, Mus musculus
gcacataccagctcacagatcaaat

SEQ ID NO: 531004 - DNA, 25 bp, Mus musculus
gcacatacctgtaaaccaagcactc

SEQ ID NO: 531005 - DNA, 25 bp, Mus musculus
gcacatacctgttaaccaagcactc

SEQ ID NO: 531006 - DNA, 25 bp, Mus musculus
gcacatacgccaaggcgtgctgtgg

SEQ ID NO: 531007 - DNA, 25 bp, Mus musculus
gcacatacgccatggcgtgctgtgg

SEQ ID NO: 531008 - DNA, 25 bp, Mus musculus
gcacatactgctatagaaatcactc

SEQ ID NO: 531009 - DNA, 25 bp, Mus musculus
gcacatactgctttagaaatcactc

SEQ ID NO: 531010 - DNA, 25 bp, Mus musculus
gcacatactttgctgaatataatta

SEQ ID NO: 531011 - DNA, 25 bp, Mus musculus
gcacatactttggtgaatataatta

SEQ ID NO: 531012 - DNA, 25 bp, Mus musculus
gcacatagaaggatcctccagtcac

SEQ ID NO: 531013 - DNA, 25 bp, Mus musculus
gcacatagaaggttcctccagtcac

SEQ ID NO: 531014 - DNA, 25 bp, Mus musculus
gcacatagacataccctgattccta

SEQ ID NO: 531015 - DNA, 25 bp, Mus musculus
gcacatagacattccctgattccta

SEQ ID NO: 531016 - DNA, 25 bp, Mus musculus
gcacatagcagtcatttattcgttt

SEQ ID NO: 531017 - DNA, 25 bp, Mus musculus
gcacatagcagtgatttattcgttt

SEQ ID NO: 531018 - DNA, 25 bp, Mus musculus
gcacatagcctaaagtcatattaat

SEQ ID NO: 531019 - DNA, 25 bp, Mus musculus
gcacatagcctatagtcatattaat

SEQ ID NO: 531020 - DNA, 25 bp, Mus musculus
gcacatagctgaaggcacttggtgt

SEQ ID NO: 531021 - DNA, 25 bp, Mus musculus
gcacatagctgatggcacttggtgt

SEQ ID NO: 531022 - DNA, 25 bp, Mus musculus
gcacataggattacgaagtgttcag

SEQ ID NO: 531023 - DNA, 25 bp, Mus musculus
gcacataggatttcgaagtgttcag

SEQ ID NO: 531024 - DNA, 25 bp, Mus musculus
gcacatagggacacacgggagctca

SEQ ID NO: 531025 - DNA, 25 bp, Mus musculus
gcacatagggactcacgggagctca

SEQ ID NO: 531026 - DNA, 25 bp, Mus musculus
gcacatagggctcaagtattttgtt

SEQ ID NO: 531027 - DNA, 25 bp, Mus musculus
gcacatagggctgaagtattttgtt

SEQ ID NO: 531028 - DNA, 25 bp, Mus musculus
gcacatagtcagagcactcagcact

SEQ ID NO: 531029 - DNA, 25 bp, Mus musculus
gcacatagtcagtgcactcagcact

SEQ ID NO: 531030 - DNA, 25 bp, Mus musculus
gcacatagtccaaatttcctgttca

SEQ ID NO: 531031 - DNA, 25 bp, Mus musculus
gcacatagtccatatttcctgttca

SEQ ID NO: 531032 - DNA, 25 bp, Mus musculus
gcacatagtggcatctggtcaagga

SEQ ID NO: 531033 - DNA, 25 bp, Mus musculus
gcacatagtggcttctggtcaagga

SEQ ID NO: 531034 - DNA, 25 bp, Mus musculus
gcacatataatgacatctctctggt

SEQ ID NO: 531035 - DNA, 25 bp, Mus musculus
gcacatataatgatcctttttctat

SEQ ID NO: 531036 - DNA, 25 bp, Mus musculus
gcacatataatgtcatctctctggt

SEQ ID NO: 531037 - DNA, 25 bp, Mus musculus
gcacatataatgttcctttttctat

SEQ ID NO: 531038 - DNA, 25 bp, Mus musculus
gcacatatacaacgcaagctctctg

SEQ ID NO: 531039 - DNA, 25 bp, Mus musculus
gcacatatacaaggcaagctctctg

SEQ ID NO: 531040 - DNA, 25 bp, Mus musculus
gcacatatcagtcggctcgtggcag

SEQ ID NO: 531041 - DNA, 25 bp, Mus musculus
gcacatatcagtgggctcgtggcag

SEQ ID NO: 531042 - DNA, 25 bp, Mus musculus
gcacatatcatgagccgttcgaaag

SEQ ID NO: 531043 - DNA, 25 bp, Mus musculus
gcacatatcatgagctacccaaaga

SEQ ID NO: 531044 - DNA, 25 bp, Mus musculus
gcacatatcatgtgccgttcgaaag

SEQ ID NO: 531045 - DNA, 25 bp, Mus musculus
gcacatatcatgtgctacccaaaga

SEQ ID NO: 531046 - DNA, 25 bp, Mus musculus
gcacatatccatatgtgcgttaatg

SEQ ID NO: 531047 - DNA, 25 bp, Mus musculus
gcacatatccatttgtgcgttaatg

SEQ ID NO: 531048 - DNA, 25 bp, Mus musculus
gcacatatgcctaatctggactcag

SEQ ID NO: 531049 - DNA, 25 bp, Mus musculus
gcacatatgccttatctggactcag

SEQ ID NO: 531050 - DNA, 25 bp, Mus musculus
gcacatatggtcagatgaagccttt

SEQ ID NO: 531051 - DNA, 25 bp, Mus musculus
gcacatatggtctgatgaagccttt

SEQ ID NO: 531052 - DNA, 25 bp, Mus musculus
gcacatatggtgcaggacagagaac

SEQ ID NO: 531053 - DNA, 25 bp, Mus musculus
gcacatatggtggaggacagagaac

SEQ ID NO: 531054 - DNA, 25 bp, Mus musculus
gcacatatgttcattctaaatccca

SEQ ID NO: 531055 - DNA, 25 bp, Mus musculus
gcacatatgttctttctaaatccca

SEQ ID NO: 531056 - DNA, 25 bp, Mus musculus
gcacatatgtttataaccacacaga

SEQ ID NO: 531057 - DNA, 25 bp, Mus musculus
gcacatatgtttttaaccacacaga

SEQ ID NO: 531058 - DNA, 25 bp, Mus musculus
gcacatattactacttatagcacat

SEQ ID NO: 531059 - DNA, 25 bp, Mus musculus
gcacatattacttcttatagcacat

SEQ ID NO: 531060 - DNA, 25 bp, Mus musculus
gcacatattcagctcagcatcagcg

SEQ ID NO: 531061 - DNA, 25 bp, Mus musculus
gcacatattcaggtcagcatcagcg

SEQ ID NO: 531062 - DNA, 25 bp, Mus musculus
gcacatatttttcgactcaaccctc

SEQ ID NO: 531063 - DNA, 25 bp, Mus musculus
gcacatatttttggactcaaccctc

SEQ ID NO: 531064 - DNA, 25 bp, Mus musculus
gcacatcaagacaagggccccggag

SEQ ID NO: 531065 - DNA, 25 bp, Mus musculus
gcacatcaagactagggccccggag

SEQ ID NO: 531066 - DNA, 25 bp, Mus musculus
gcacatcaccataccttgtttttaa

SEQ ID NO: 531067 - DNA, 25 bp, Mus musculus
gcacatcaccattccttgtttttaa

SEQ ID NO: 531068 - DNA, 25 bp, Mus musculus
gcacatcacctcattctgggatgag

SEQ ID NO: 531069 - DNA, 25 bp, Mus musculus
gcacatcacctctttctgggatgag

SEQ ID NO: 531070 - DNA, 25 bp, Mus musculus
gcacatcactgtcttcagagctgga

SEQ ID NO: 531071 - DNA, 25 bp, Mus musculus
gcacatcactgtgttcagagctgga

SEQ ID NO: 531072 - DNA, 25 bp, Mus musculus
gcacatcagacaatcttagggcaat

SEQ ID NO: 531073 - DNA, 25 bp, Mus musculus
gcacatcagacattcttagggcaat

SEQ ID NO: 531074 - DNA, 25 bp, Mus musculus
gcacatcagccgcaacaaggagaaa

SEQ ID NO: 531075 - DNA, 25 bp, Mus musculus
gcacatcagccggaacaaggagaaa

SEQ ID NO: 531076 - DNA, 25 bp, Mus musculus
gcacatcagcgtccatgtcttatac

SEQ ID NO: 531077 - DNA, 25 bp, Mus musculus
gcacatcagcgtgcatgtcttatac

SEQ ID NO: 531078 - DNA, 25 bp, Mus musculus
gcacatcatcccagaaatgaactct

SEQ ID NO: 531079 - DNA, 25 bp, Mus musculus
gcacatcatccctgaaatgaactct

SEQ ID NO: 531080 - DNA, 25 bp, Mus musculus
gcacatcatgctcacttcatgcaca

SEQ ID NO: 531081 - DNA, 25 bp, Mus musculus
gcacatcatgctgacttcatgcaca

SEQ ID NO: 531082 - DNA, 25 bp, Mus musculus
gcacatcattaaatcactatggtcg

SEQ ID NO: 531083 - DNA, 25 bp, Mus musculus
gcacatcattaattcactatggtcg

SEQ ID NO: 531084 - DNA, 25 bp, Mus musculus
gcacatccaatccttctgttgagag

SEQ ID NO: 531085 - DNA, 25 bp, Mus musculus
gcacatccaatcgttctgttgagag

SEQ ID NO: 531086 - DNA, 25 bp, Mus musculus
gcacatccacaaagtagggccaaag

SEQ ID NO: 531087 - DNA, 25 bp, Mus musculus
gcacatccacaatgtagggccaaag

SEQ ID NO: 531088 - DNA, 25 bp, Mus musculus
gcacatccacatatattggttttct

SEQ ID NO: 531089 - DNA, 25 bp, Mus musculus
gcacatccacatttattggttttct

SEQ ID NO: 531090 - DNA, 25 bp, Mus musculus
gcacatccaggaagctgcctgtaga

SEQ ID NO: 531091 - DNA, 25 bp, Mus musculus
gcacatccaggatgctgcctgtaga

SEQ ID NO: 531092 - DNA, 25 bp, Mus musculus
gcacatcccaaaccctacgaatgat

SEQ ID NO: 531093 - DNA, 25 bp, Mus musculus
gcacatcccaaagcctacgaatgat

SEQ ID NO: 531094 - DNA, 25 bp, Mus musculus
gcacatcccagcaaaggcatggcta

SEQ ID NO: 531095 - DNA, 25 bp, Mus musculus
gcacatcccagctaaggcatggcta

SEQ ID NO: 531096 - DNA, 25 bp, Mus musculus
gcacatcccggactgatgggacctt

SEQ ID NO: 531097 - DNA, 25 bp, Mus musculus
gcacatcccggagtgatgggacctt

SEQ ID NO: 531098 - DNA, 25 bp, Mus musculus
gcacatccctttaggaggcagagac

SEQ ID NO: 531099 - DNA, 25 bp, Mus musculus
gcacatcccttttggaggcagagac

SEQ ID NO: 531100 - DNA, 25 bp, Mus musculus
gcacatccgtagcactgaagtatca

SEQ ID NO: 531101 - DNA, 25 bp, Mus musculus
gcacatccgtaggactgaagtatca

SEQ ID NO: 531102 - DNA, 25 bp, Mus musculus
gcacatcctacgctttgcattttat

SEQ ID NO: 531103 - DNA, 25 bp, Mus musculus
gcacatcctacggtttgcattttat

SEQ ID NO: 531104 - DNA, 25 bp, Mus musculus
gcacatcctagactttgagcagagc

SEQ ID NO: 531105 - DNA, 25 bp, Mus musculus
gcacatcctagagtttgagcagagc

SEQ ID NO: 531106 - DNA, 25 bp, Mus musculus
gcacatccttagagccaacaactac

SEQ ID NO: 531107 - DNA, 25 bp, Mus musculus
gcacatccttagtgccaacaactac

SEQ ID NO: 531108 - DNA, 25 bp, Mus musculus
gcacatcgtcgtattgggggaagtc

SEQ ID NO: 531109 - DNA, 25 bp, Mus musculus
gcacatcgtcgttttgggggaagtc

SEQ ID NO: 531110 - DNA, 25 bp, Mus musculus
gcacatctaggtctgttgggatcaa

SEQ ID NO: 531111 - DNA, 25 bp, Mus musculus
gcacatctaggtgtgttgggatcaa

SEQ ID NO: 531112 - DNA, 25 bp, Mus musculus
gcacatctatcacctggactgtata

SEQ ID NO: 531113 - DNA, 25 bp, Mus musculus
gcacatctatcagctggactgtata

SEQ ID NO: 531114 - DNA, 25 bp, Mus musculus
gcacatctatgtagccaggctttct

SEQ ID NO: 531115 - DNA, 25 bp, Mus musculus
gcacatctatgtcgtagagcacttt

SEQ ID NO: 531116 - DNA, 25 bp, Mus musculus
gcacatctatgtggtagagcacttt

SEQ ID NO: 531117 - DNA, 25 bp, Mus musculus
gcacatctatgttgccaggctttct

SEQ ID NO: 531118 - DNA, 25 bp, Mus musculus
gcacatctccctatgccatatttaa

SEQ ID NO: 531119 - DNA, 25 bp, Mus musculus
gcacatctccctttgccatatttaa

SEQ ID NO: 531120 - DNA, 25 bp, Mus musculus
gcacatctcggcacgctacgttggg

SEQ ID NO: 531121 - DNA, 25 bp, Mus musculus
gcacatctcggctcgctacgttggg

SEQ ID NO: 531122 - DNA, 25 bp, Mus musculus
gcacatctctctatgacatgagtta

SEQ ID NO: 531123 - DNA, 25 bp, Mus musculus
gcacatctctctttgacatgagtta

SEQ ID NO: 531124 - DNA, 25 bp, Mus musculus
gcacatctctggaaaatcctgctga

SEQ ID NO: 531125 - DNA, 25 bp, Mus musculus
gcacatctctggtaaatcctgctga

SEQ ID NO: 531126 - DNA, 25 bp, Mus musculus
gcacatctctgtaagcgctgactct

SEQ ID NO: 531127 - DNA, 25 bp, Mus musculus
gcacatctctgttagcgctgactct

SEQ ID NO: 531128 - DNA, 25 bp, Mus musculus
gcacatctgctgacatttgtaactc

SEQ ID NO: 531129 - DNA, 25 bp, Mus musculus
gcacatctgctgtcatttgtaactc

SEQ ID NO: 531130 - DNA, 25 bp, Mus musculus
gcacatctggccagttttttgccaa

SEQ ID NO: 531131 - DNA, 25 bp, Mus musculus
gcacatctggcctgttttttgccaa

SEQ ID NO: 531132 - DNA, 25 bp, Mus musculus
gcacatctgtcacagctgaagccga

SEQ ID NO: 531133 - DNA, 25 bp, Mus musculus
gcacatctgtcagagctgaagccga

SEQ ID NO: 531134 - DNA, 25 bp, Mus musculus
gcacatctgtgaatccagaatttgg

SEQ ID NO: 531135 - DNA, 25 bp, Mus musculus
gcacatctgtgattccagaatttgg

SEQ ID NO: 531136 - DNA, 25 bp, Mus musculus
gcacatctgttacatcatggcggag

SEQ ID NO: 531137 - DNA, 25 bp, Mus musculus
gcacatctgttagatcatggcggag

SEQ ID NO: 531138 - DNA, 25 bp, Mus musculus
gcacatcttgcacatttccttgaca

SEQ ID NO: 531139 - DNA, 25 bp, Mus musculus
gcacatcttgcagatttccttgaca

SEQ ID NO: 531140 - DNA, 25 bp, Mus musculus
gcacatctttaaacagtcctcggga

SEQ ID NO: 531141 - DNA, 25 bp, Mus musculus
gcacatctttaatcagtcctcggga

SEQ ID NO: 531142 - DNA, 25 bp, Mus musculus
gcacatctttgtcatctagccttgt

SEQ ID NO: 531143 - DNA, 25 bp, Mus musculus
gcacatctttgtgatctagccttgt

SEQ ID NO: 531144 - DNA, 25 bp, Mus musculus
gcacatgaactcaaggcacacactc

SEQ ID NO: 531145 - DNA, 25 bp, Mus musculus
gcacatgaactctaggcacacactc

SEQ ID NO: 531146 - DNA, 25 bp, Mus musculus
gcacatgaagaaccacacagccgag

SEQ ID NO: 531147 - DNA, 25 bp, Mus musculus
gcacatgaagaagcacacagccgag

SEQ ID NO: 531148 - DNA, 25 bp, Mus musculus
gcacatgaagtaaatgtcctgggaa

SEQ ID NO: 531149 - DNA, 25 bp, Mus musculus
gcacatgaagtatatgtcctgggaa

SEQ ID NO: 531150 - DNA, 25 bp, Mus musculus
gcacatgaatacaggactgttcctt

SEQ ID NO: 531151 - DNA, 25 bp, Mus musculus
gcacatgaatactggactgttcctt

SEQ ID NO: 531152 - DNA, 25 bp, Mus musculus
gcacatgaatgcactacaactaagt

SEQ ID NO: 531153 - DNA, 25 bp, Mus musculus
gcacatgaatgctctacaactaagt

SEQ ID NO: 531154 - DNA, 25 bp, Mus musculus
gcacatgagcacctgggcaggccca

SEQ ID NO: 531155 - DNA, 25 bp, Mus musculus
gcacatgagcacgtgggcaggccca

SEQ ID NO: 531156 - DNA, 25 bp, Mus musculus
gcacatgatgctctatttattgtag

SEQ ID NO: 531157 - DNA, 25 bp, Mus musculus
gcacatgatgctgtatttattgtag

SEQ ID NO: 531158 - DNA, 25 bp, Mus musculus
gcacatgcacccctgtatgcttgtg

SEQ ID NO: 531159 - DNA, 25 bp, Mus musculus
gcacatgcacccgtgtatgcttgtg

SEQ ID NO: 531160 - DNA, 25 bp, Mus musculus
gcacatgcaggacgcatccgagcaa

SEQ ID NO: 531161 - DNA, 25 bp, Mus musculus
gcacatgcaggaggcatccgagcaa

SEQ ID NO: 531162 - DNA, 25 bp, Mus musculus
gcacatgcatgtctaccatggtatc

SEQ ID NO: 531163 - DNA, 25 bp, Mus musculus
gcacatgcatgtgtaccatggtatc

SEQ ID NO: 531164 - DNA, 25 bp, Mus musculus
gcacatgccaagattcaggaggatt

SEQ ID NO: 531165 - DNA, 25 bp, Mus musculus
gcacatgccaagtttcaggaggatt

SEQ ID NO: 531166 - DNA, 25 bp, Mus musculus
gcacatgccacaaatgagacccttg

SEQ ID NO: 531167 - DNA, 25 bp, Mus musculus
gcacatgccacatatgagacccttg

SEQ ID NO: 531168 - DNA, 25 bp, Mus musculus
gcacatgccaccattcctggtaata

SEQ ID NO: 531169 - DNA, 25 bp, Mus musculus
gcacatgccacctttcctggtaata

SEQ ID NO: 531170 - DNA, 25 bp, Mus musculus
gcacatgcccagcaaaatacttaga

SEQ ID NO: 531171 - DNA, 25 bp, Mus musculus
gcacatgcccaggaaaatacttaga

SEQ ID NO: 531172 - DNA, 25 bp, Mus musculus
gcacatgcctgtccatgcctgtagt

SEQ ID NO: 531173 - DNA, 25 bp, Mus musculus
gcacatgcctgtgcatgcctgtagt

SEQ ID NO: 531174 - DNA, 25 bp, Mus musculus
gcacatgcgctaaaaccgagactgg

SEQ ID NO: 531175 - DNA, 25 bp, Mus musculus
gcacatgcgctataaccgagactgg

SEQ ID NO: 531176 - DNA, 25 bp, Mus musculus
gcacatgcgtatacatcaacttgtt

SEQ ID NO: 531177 - DNA, 25 bp, Mus musculus
gcacatgcgtattcatcaacttgtt

SEQ ID NO: 531178 - DNA, 25 bp, Mus musculus
gcacatgctaagaatccaacccatt

SEQ ID NO: 531179 - DNA, 25 bp, Mus musculus
gcacatgctaagtatccaacccatt

SEQ ID NO: 531180 - DNA, 25 bp, Mus musculus
gcacatgctcacaaggatttagagc

SEQ ID NO: 531181 - DNA, 25 bp, Mus musculus
gcacatgctcactaggatttagagc

SEQ ID NO: 531182 - DNA, 25 bp, Mus musculus
gcacatgctggtctgaacttactat

SEQ ID NO: 531183 - DNA, 25 bp, Mus musculus
gcacatgctggtgtgaacttactat

SEQ ID NO: 531184 - DNA, 25 bp, Mus musculus
gcacatgcttatatttaaggcttat

SEQ ID NO: 531185 - DNA, 25 bp, Mus musculus
gcacatgcttatttttaaggcttat

SEQ ID NO: 531186 - DNA, 25 bp, Mus musculus
gcacatgcttgcatgcagcccttgg

SEQ ID NO: 531187 - DNA, 25 bp, Mus musculus
gcacatgcttgcttgcagcccttgg

SEQ ID NO: 531188 - DNA, 25 bp, Mus musculus
gcacatgcttggacagcctcaacct

SEQ ID NO: 531189 - DNA, 25 bp, Mus musculus
gcacatgcttggtcagcctcaacct

SEQ ID NO: 531190 - DNA, 25 bp, Mus musculus
gcacatgcttgtcatttcaacacga

SEQ ID NO: 531191 - DNA, 25 bp, Mus musculus
gcacatgcttgtgatttcaacacga

SEQ ID NO: 531192 - DNA, 25 bp, Mus musculus
gcacatggaagcctgcaccacaagc

SEQ ID NO: 531193 - DNA, 25 bp, Mus musculus
gcacatggaagcgtgcaccacaagc

SEQ ID NO: 531194 - DNA, 25 bp, Mus musculus
gcacatggactgaaaggcactcctt

SEQ ID NO: 531195 - DNA, 25 bp, Mus musculus
gcacatggactgtaaggcactcctt

SEQ ID NO: 531196 - DNA, 25 bp, Mus musculus
gcacatggatcgcagtgtgttccag

SEQ ID NO: 531197 - DNA, 25 bp, Mus musculus
gcacatggatcggagtgtgttccag

SEQ ID NO: 531198 - DNA, 25 bp, Mus musculus
gcacatggatttctggacctcctaa

SEQ ID NO: 531199 - DNA, 25 bp, Mus musculus
gcacatggatttgtggacctcctaa

SEQ ID NO: 531200 - DNA, 25 bp, Mus musculus
gcacatggcaggcatatctgttcaa

SEQ ID NO: 531201 - DNA, 25 bp, Mus musculus
gcacatggcagggatatctgttcaa

SEQ ID NO: 531202 - DNA, 25 bp, Mus musculus
gcacatggctatatctttatggatt

SEQ ID NO: 531203 - DNA, 25 bp, Mus musculus
gcacatggctatttctttatggatt

SEQ ID NO: 531204 - DNA, 25 bp, Mus musculus
gcacatggctgcattgagttaacaa

SEQ ID NO: 531205 - DNA, 25 bp, Mus musculus
gcacatggctgctttgagttaacaa

SEQ ID NO: 531206 - DNA, 25 bp, Mus musculus
gcacatgggcagagattttatttta

SEQ ID NO: 531207 - DNA, 25 bp, Mus musculus
gcacatgggcagtgattttatttta

SEQ ID NO: 531208 - DNA, 25 bp, Mus musculus
gcacatgggcggattgtaatccagt

SEQ ID NO: 531209 - DNA, 25 bp, Mus musculus
gcacatgggcggtttgtaatccagt

SEQ ID NO: 531210 - DNA, 25 bp, Mus musculus
gcacatggtcatcttcataactata

SEQ ID NO: 531211 - DNA, 25 bp, Mus musculus
gcacatggtcatgttcataactata

SEQ ID NO: 531212 - DNA, 25 bp, Mus musculus
gcacatggtgaaataagaggctgta

SEQ ID NO: 531213 - DNA, 25 bp, Mus musculus
gcacatggtgaattaagaggctgta

SEQ ID NO: 531214 - DNA, 25 bp, Mus musculus
gcacatgtatctcattggctttgga

SEQ ID NO: 531215 - DNA, 25 bp, Mus musculus
gcacatgtatctgattggctttgga

SEQ ID NO: 531216 - DNA, 25 bp, Mus musculus
gcacatgtatgcacaggcctgagtg

SEQ ID NO: 531217 - DNA, 25 bp, Mus musculus
gcacatgtatgctcaggcctgagtg

SEQ ID NO: 531218 - DNA, 25 bp, Mus musculus
gcacatgtcatgatggtcagcttca

SEQ ID NO: 531219 - DNA, 25 bp, Mus musculus
gcacatgtcatgttggtcagcttca

SEQ ID NO: 531220 - DNA, 25 bp, Mus musculus
gcacatgtctgtcagagccactcag

SEQ ID NO: 531221 - DNA, 25 bp, Mus musculus
gcacatgtctgtgagagccactcag

SEQ ID NO: 531222 - DNA, 25 bp, Mus musculus
gcacatgtgcagctgttaggtacaa

SEQ ID NO: 531223 - DNA, 25 bp, Mus musculus
gcacatgtgcaggtgttaggtacaa

SEQ ID NO: 531224 - DNA, 25 bp, Mus musculus
gcacatgtgctgatttccatgggtt

SEQ ID NO: 531225 - DNA, 25 bp, Mus musculus
gcacatgtgctgttttccatgggtt

SEQ ID NO: 531226 - DNA, 25 bp, Mus musculus
gcacatgtggacactcaataaatgt

SEQ ID NO: 531227 - DNA, 25 bp, Mus musculus
gcacatgtggactctcaataaatgt

SEQ ID NO: 531228 - DNA, 25 bp, Mus musculus
gcacatgtggatatgcttctattgt

SEQ ID NO: 531229 - DNA, 25 bp, Mus musculus
gcacatgtggatttgcttctattgt

SEQ ID NO: 531230 - DNA, 25 bp, Mus musculus
gcacatgtgggtcctgaacaactca

SEQ ID NO: 531231 - DNA, 25 bp, Mus musculus
gcacatgtgggtgctgaacaactca

SEQ ID NO: 531232 - DNA, 25 bp, Mus musculus
gcacatgtgtgaagccttgggaaca

SEQ ID NO: 531233 - DNA, 25 bp, Mus musculus
gcacatgtgtgatgccttgggaaca

SEQ ID NO: 531234 - DNA, 25 bp, Mus musculus
gcacatgtgtgcaggctagagctca

SEQ ID NO: 531235 - DNA, 25 bp, Mus musculus
gcacatgtgtgctggctagagctca

SEQ ID NO: 531236 - DNA, 25 bp, Mus musculus
gcacatgttcaaacccagatctcct

SEQ ID NO: 531237 - DNA, 25 bp, Mus musculus
gcacatgttcaatcccagatctcct

SEQ ID NO: 531238 - DNA, 25 bp, Mus musculus
gcacatgttcatatagcaatgtaaa

SEQ ID NO: 531239 - DNA, 25 bp, Mus musculus
gcacatgttcatttagcaatgtaaa

SEQ ID NO: 531240 - DNA, 25 bp, Mus musculus
gcacatgttctcattttactggctc

SEQ ID NO: 531241 - DNA, 25 bp, Mus musculus
gcacatgttctctttttactggctc

SEQ ID NO: 531242 - DNA, 25 bp, Mus musculus
gcacatgttcttcatctttttgtaa

SEQ ID NO: 531243 - DNA, 25 bp, Mus musculus
gcacatgttcttgatctttttgtaa

SEQ ID NO: 531244 - DNA, 25 bp, Mus musculus
gcacatgttgaccaaatcaccgaga

SEQ ID NO: 531245 - DNA, 25 bp, Mus musculus
gcacatgttgacgaaatcaccgaga

SEQ ID NO: 531246 - DNA, 25 bp, Mus musculus
gcacatgttgccacatttactcatt

SEQ ID NO: 531247 - DNA, 25 bp, Mus musculus
gcacatgttgcctcatttactcatt

SEQ ID NO: 531248 - DNA, 25 bp, Mus musculus
gcacattaaatgactcttccctcaa

SEQ ID NO: 531249 - DNA, 25 bp, Mus musculus
gcacattaaatgtctcttccctcaa

SEQ ID NO: 531250 - DNA, 25 bp, Mus musculus
gcacattacagacagtaactcattg

SEQ ID NO: 531251 - DNA, 25 bp, Mus musculus
gcacattacagagagtaactcattg

SEQ ID NO: 531252 - DNA, 25 bp, Mus musculus
gcacattacctcagattggactcat

SEQ ID NO: 531253 - DNA, 25 bp, Mus musculus
gcacattacctctgattggactcat

SEQ ID NO: 531254 - DNA, 25 bp, Mus musculus
gcacattactggcatatcttaagtt

SEQ ID NO: 531255 - DNA, 25 bp, Mus musculus
gcacattactgggatatcttaagtt

SEQ ID NO: 531256 - DNA, 25 bp, Mus musculus
gcacattatcacaacagagggtact

SEQ ID NO: 531257 - DNA, 25 bp, Mus musculus
gcacattatcactacagagggtact

SEQ ID NO: 531258 - DNA, 25 bp, Mus musculus
gcacattatcccattgtatgagcag

SEQ ID NO: 531259 - DNA, 25 bp, Mus musculus
gcacattatccctttgtatgagcag

SEQ ID NO: 531260 - DNA, 25 bp, Mus musculus
gcacattattaaacctgtatttttg

SEQ ID NO: 531261 - DNA, 25 bp, Mus musculus
gcacattattaatcctgtatttttg

SEQ ID NO: 531262 - DNA, 25 bp, Mus musculus
gcacattcaccaatattttacttag

SEQ ID NO: 531263 - DNA, 25 bp, Mus musculus
gcacattcaccattattttacttag

SEQ ID NO: 531264 - DNA, 25 bp, Mus musculus
gcacattcaggaccactgggcactt

SEQ ID NO: 531265 - DNA, 25 bp, Mus musculus
gcacattcaggagcactgggcactt

SEQ ID NO: 531266 - DNA, 25 bp, Mus musculus
gcacattcagtgaattggtccttta

SEQ ID NO: 531267 - DNA, 25 bp, Mus musculus
gcacattcagtgtattggtccttta

SEQ ID NO: 531268 - DNA, 25 bp, Mus musculus
gcacattcatgcagatcatatccca

SEQ ID NO: 531269 - DNA, 25 bp, Mus musculus
gcacattcatgctgatcatatccca

SEQ ID NO: 531270 - DNA, 25 bp, Mus musculus
gcacattcattgactgattctagca

SEQ ID NO: 531271 - DNA, 25 bp, Mus musculus
gcacattcattgtctgattctagca

SEQ ID NO: 531272 - DNA, 25 bp, Mus musculus
gcacattcccaaacaaagcatcaga

SEQ ID NO: 531273 - DNA, 25 bp, Mus musculus
gcacattcccaatcaaagcatcaga

SEQ ID NO: 531274 - DNA, 25 bp, Mus musculus
gcacattcctaaatgatgtaacaga

SEQ ID NO: 531275 - DNA, 25 bp, Mus musculus
gcacattcctaattgatgtaacaga

SEQ ID NO: 531276 - DNA, 25 bp, Mus musculus
gcacattctgtgctagtattcagtg

SEQ ID NO: 531277 - DNA, 25 bp, Mus musculus
gcacattctgtggtagtattcagtg

SEQ ID NO: 531278 - DNA, 25 bp, Mus musculus
gcacattgaattacagggccaccag

SEQ ID NO: 531279 - DNA, 25 bp, Mus musculus
gcacattgaatttcagggccaccag

SEQ ID NO: 531280 - DNA, 25 bp, Mus musculus
gcacattgagcaatcctaaattgtt

SEQ ID NO: 531281 - DNA, 25 bp, Mus musculus
gcacattgagcattcctaaattgtt

SEQ ID NO: 531282 - DNA, 25 bp, Mus musculus
gcacattgatccatagctttaactg

SEQ ID NO: 531283 - DNA, 25 bp, Mus musculus
gcacattgatccttagctttaactg

SEQ ID NO: 531284 - DNA, 25 bp, Mus musculus
gcacattgattgattctgttctgta

SEQ ID NO: 531285 - DNA, 25 bp, Mus musculus
gcacattgattgtttctgttctgta

SEQ ID NO: 531286 - DNA, 25 bp, Mus musculus
gcacattgcaatcagctcttaaata

SEQ ID NO: 531287 - DNA, 25 bp, Mus musculus
gcacattgcaatgagctcttaaata

SEQ ID NO: 531288 - DNA, 25 bp, Mus musculus
gcacattgcactacctttgaatcat

SEQ ID NO: 531289 - DNA, 25 bp, Mus musculus
gcacattgcacttcctttgaatcat

SEQ ID NO: 531290 - DNA, 25 bp, Mus musculus
gcacattgcatgaactcctcaggct

SEQ ID NO: 531291 - DNA, 25 bp, Mus musculus
gcacattgcatgtactcctcaggct

SEQ ID NO: 531292 - DNA, 25 bp, Mus musculus
gcacattgcgtccttgcagtacatt

SEQ ID NO: 531293 - DNA, 25 bp, Mus musculus
gcacattgcgtcgttgcagtacatt

SEQ ID NO: 531294 - DNA, 25 bp, Mus musculus
gcacattggactaaagcatgaaaaa

SEQ ID NO: 531295 - DNA, 25 bp, Mus musculus
gcacattggacttaagcatgaaaaa

SEQ ID NO: 531296 - DNA, 25 bp, Mus musculus
gcacattggcttacatggatctgga

SEQ ID NO: 531297 - DNA, 25 bp, Mus musculus
gcacattggctttcatggatctgga

SEQ ID NO: 531298 - DNA, 25 bp, Mus musculus
gcacattgtaacaggcttttaagaa

SEQ ID NO: 531299 - DNA, 25 bp, Mus musculus
gcacattgtaactggcttttaagaa

SEQ ID NO: 531300 - DNA, 25 bp, Mus musculus
gcacattgtactacctagtttttat

SEQ ID NO: 531301 - DNA, 25 bp, Mus musculus
gcacattgtacttcctagtttttat

SEQ ID NO: 531302 - DNA, 25 bp, Mus musculus
gcacattgtatgaagcacacacggc

SEQ ID NO: 531303 - DNA, 25 bp, Mus musculus
gcacattgtatgtagcacacacggc

SEQ ID NO: 531304 - DNA, 25 bp, Mus musculus
gcacatttagatccaacgtttcaag

SEQ ID NO: 531305 - DNA, 25 bp, Mus musculus
gcacatttagatccatactccctgt

SEQ ID NO: 531306 - DNA, 25 bp, Mus musculus
gcacatttagatcctgcatgccaga

SEQ ID NO: 531307 - DNA, 25 bp, Mus musculus
gcacatttagatgcaacgtttcaag

SEQ ID NO: 531308 - DNA, 25 bp, Mus musculus
gcacatttagatgcatactccctgt

SEQ ID NO: 531309 - DNA, 25 bp, Mus musculus
gcacatttagatgctgcatgccaga

SEQ ID NO: 531310 - DNA, 25 bp, Mus musculus
gcacatttatgcaattgagcctgag

SEQ ID NO: 531311 - DNA, 25 bp, Mus musculus
gcacatttatgcagaatcaacactc

SEQ ID NO: 531312 - DNA, 25 bp, Mus musculus
gcacatttatgctattgagcctgag

SEQ ID NO: 531313 - DNA, 25 bp, Mus musculus
gcacatttatgctgaatcaacactc

SEQ ID NO: 531314 - DNA, 25 bp, Mus musculus
gcacatttatgtacttcagtggaac

SEQ ID NO: 531315 - DNA, 25 bp, Mus musculus
gcacatttatgttcttcagtggaac

SEQ ID NO: 531316 - DNA, 25 bp, Mus musculus
gcacatttattcctgacatcatggt

SEQ ID NO: 531317 - DNA, 25 bp, Mus musculus
gcacatttattcgtgacatcatggt

SEQ ID NO: 531318 - DNA, 25 bp, Mus musculus
gcacatttcacaagcgttcgtggag

SEQ ID NO: 531319 - DNA, 25 bp, Mus musculus
gcacatttcacatgcgttcgtggag

SEQ ID NO: 531320 - DNA, 25 bp, Mus musculus
gcacatttcagtcatgtggtgtgat

SEQ ID NO: 531321 - DNA, 25 bp, Mus musculus
gcacatttcagtgatgtggtgtgat

SEQ ID NO: 531322 - DNA, 25 bp, Mus musculus
gcacatttcccaacagttggaatta

SEQ ID NO: 531323 - DNA, 25 bp, Mus musculus
gcacatttcccatcagttggaatta

SEQ ID NO: 531324 - DNA, 25 bp, Mus musculus
gcacatttctccaccagaaaagcga

SEQ ID NO: 531325 - DNA, 25 bp, Mus musculus
gcacatttctcctccagaaaagcga

SEQ ID NO: 531326 - DNA, 25 bp, Mus musculus
gcacatttgagcagaactttgcgca

SEQ ID NO: 531327 - DNA, 25 bp, Mus musculus
gcacatttgagctgaactttgcgca

SEQ ID NO: 531328 - DNA, 25 bp, Mus musculus
gcacatttgcatacccaacgtacgg

SEQ ID NO: 531329 - DNA, 25 bp, Mus musculus
gcacatttgcattcccaacgtacgg

SEQ ID NO: 531330 - DNA, 25 bp, Mus musculus
gcacattttacaagctatgctatat

SEQ ID NO: 531331 - DNA, 25 bp, Mus musculus
gcacattttacatgctatgctatat

SEQ ID NO: 531332 - DNA, 25 bp, Mus musculus
gcacattttgtacacctgctcttgt

SEQ ID NO: 531333 - DNA, 25 bp, Mus musculus
gcacattttgtagacctgctcttgt

SEQ ID NO: 531334 - DNA, 25 bp, Mus musculus
gcacatttttgcaggcgtgcacaca

SEQ ID NO: 531335 - DNA, 25 bp, Mus musculus
gcacatttttgctggcgtgcacaca

SEQ ID NO: 531336 - DNA, 25 bp, Mus musculus
gcacattttttactgagcagcaccc

SEQ ID NO: 531337 - DNA, 25 bp, Mus musculus
gcacattttttagtgagcagcaccc

SEQ ID NO: 531338 - DNA, 25 bp, Mus musculus
gcaccaaaagagctttctgggattt

SEQ ID NO: 531339 - DNA, 25 bp, Mus musculus
gcaccaaaagaggtttctgggattt

SEQ ID NO: 531340 - DNA, 25 bp, Mus musculus
gcaccaaacgccagcgccgtagaaa

SEQ ID NO: 531341 - DNA, 25 bp, Mus musculus
gcaccaaacgcctgcgccgtagaaa

SEQ ID NO: 531342 - DNA, 25 bp, Mus musculus
gcaccaaagcagagccctgggtgat

SEQ ID NO: 531343 - DNA, 25 bp, Mus musculus
gcaccaaagcagtgccctgggtgat

SEQ ID NO: 531344 - DNA, 25 bp, Mus musculus
gcaccaaagcatctgtttcccaaag

SEQ ID NO: 531345 - DNA, 25 bp, Mus musculus
gcaccaaagcatgtgtttcccaaag

SEQ ID NO: 531346 - DNA, 25 bp, Mus musculus
gcaccaaagctaaggtgaatcttca

SEQ ID NO: 531347 - DNA, 25 bp, Mus musculus
gcaccaaagctatggtgaatcttca

SEQ ID NO: 531348 - DNA, 25 bp, Mus musculus
gcaccaaatatgcttgatcacatgt

SEQ ID NO: 531349 - DNA, 25 bp, Mus musculus
gcaccaaatatggttgatcacatgt

SEQ ID NO: 531350 - DNA, 25 bp, Mus musculus
gcaccaaattcgcaggaccatctat

SEQ ID NO: 531351 - DNA, 25 bp, Mus musculus
gcaccaaattcggaggaccatctat

SEQ ID NO: 531352 - DNA, 25 bp, Mus musculus
gcaccaaattgcactgaggcttgag

SEQ ID NO: 531353 - DNA, 25 bp, Mus musculus
gcaccaaattgctctgaggcttgag

SEQ ID NO: 531354 - DNA, 25 bp, Mus musculus
gcaccaacacacagttattccttgt

SEQ ID NO: 531355 - DNA, 25 bp, Mus musculus
gcaccaacacactgttattccttgt

SEQ ID NO: 531356 - DNA, 25 bp, Mus musculus
gcaccaacgggtacatttacttttg

SEQ ID NO: 531357 - DNA, 25 bp, Mus musculus
gcaccaacgggttcatttacttttg

SEQ ID NO: 531358 - DNA, 25 bp, Mus musculus
gcaccaactcaacttctgagctcta

SEQ ID NO: 531359 - DNA, 25 bp, Mus musculus
gcaccaactcaagttctgagctcta

SEQ ID NO: 531360 - DNA, 25 bp, Mus musculus
gcaccaactcctacggaacaatgtt

SEQ ID NO: 531361 - DNA, 25 bp, Mus musculus
gcaccaactccttcggaacaatgtt

SEQ ID NO: 531362 - DNA, 25 bp, Mus musculus
gcaccaactgaaacccgtgcaaact

SEQ ID NO: 531363 - DNA, 25 bp, Mus musculus
gcaccaactgaatcccgtgcaaact

SEQ ID NO: 531364 - DNA, 25 bp, Mus musculus
gcaccaactgtaatctgtacctttg

SEQ ID NO: 531365 - DNA, 25 bp, Mus musculus
gcaccaactgtattctgtacctttg

SEQ ID NO: 531366 - DNA, 25 bp, Mus musculus
gcaccaagaagcagtcacggaggaa

SEQ ID NO: 531367 - DNA, 25 bp, Mus musculus
gcaccaagaagctgtcacggaggaa

SEQ ID NO: 531368 - DNA, 25 bp, Mus musculus
gcaccaagaccactctgaggtattc

SEQ ID NO: 531369 - DNA, 25 bp, Mus musculus
gcaccaagaccagtctgaggtattc

SEQ ID NO: 531370 - DNA, 25 bp, Mus musculus
gcaccaagactgagaaaccctttcc

SEQ ID NO: 531371 - DNA, 25 bp, Mus musculus
gcaccaagactgtgaaaccctttcc

SEQ ID NO: 531372 - DNA, 25 bp, Mus musculus
gcaccaagatgcagtagacctcttc

SEQ ID NO: 531373 - DNA, 25 bp, Mus musculus
gcaccaagatgctgtagacctcttc

SEQ ID NO: 531374 - DNA, 25 bp, Mus musculus
gcaccaagccttctctgcagagata

SEQ ID NO: 531375 - DNA, 25 bp, Mus musculus
gcaccaagccttgtctgcagagata

SEQ ID NO: 531376 - DNA, 25 bp, Mus musculus
gcaccaagctttcgctgtttgttaa

SEQ ID NO: 531377 - DNA, 25 bp, Mus musculus
gcaccaagctttggctgtttgttaa

SEQ ID NO: 531378 - DNA, 25 bp, Mus musculus
gcaccaaggccacctctggattgga

SEQ ID NO: 531379 - DNA, 25 bp, Mus musculus
gcaccaaggccagctctggattgga

SEQ ID NO: 531380 - DNA, 25 bp, Mus musculus
gcaccaaggcgtctacagcatctta

SEQ ID NO: 531381 - DNA, 25 bp, Mus musculus
gcaccaaggcgtgtacagcatctta

SEQ ID NO: 531382 - DNA, 25 bp, Mus musculus
gcaccaagtgtacctttatttgcat

SEQ ID NO: 531383 - DNA, 25 bp, Mus musculus
gcaccaagtgtagctttatttgcat

SEQ ID NO: 531384 - DNA, 25 bp, Mus musculus
gcaccaagttctcgaagagccccag

SEQ ID NO: 531385 - DNA, 25 bp, Mus musculus
gcaccaagttctggaagagccccag

SEQ ID NO: 531386 - DNA, 25 bp, Mus musculus
gcaccaatcatgacagctatacaga

SEQ ID NO: 531387 - DNA, 25 bp, Mus musculus
gcaccaatcatgtcagctatacaga

SEQ ID NO: 531388 - DNA, 25 bp, Mus musculus
gcaccaatcctaatgttacttctgt

SEQ ID NO: 531389 - DNA, 25 bp, Mus musculus
gcaccaatcctattgttacttctgt

SEQ ID NO: 531390 - DNA, 25 bp, Mus musculus
gcaccaatcggaccaaaggtctcat

SEQ ID NO: 531391 - DNA, 25 bp, Mus musculus
gcaccaatcggagcaaaggtctcat

SEQ ID NO: 531392 - DNA, 25 bp, Mus musculus
gcaccaatgagaattcttcaggcga

SEQ ID NO: 531393 - DNA, 25 bp, Mus musculus
gcaccaatgagatttcttcaggcga

SEQ ID NO: 531394 - DNA, 25 bp, Mus musculus
gcaccaatgcagctccaaagatatt

SEQ ID NO: 531395 - DNA, 25 bp, Mus musculus
gcaccaatgcaggtccaaagatatt

SEQ ID NO: 531396 - DNA, 25 bp, Mus musculus
gcaccaatgctgattgtcactaatt

SEQ ID NO: 531397 - DNA, 25 bp, Mus musculus
gcaccaatgctgtttgtcactaatt

SEQ ID NO: 531398 - DNA, 25 bp, Mus musculus
gcaccaatgtagagaaatagtctta

SEQ ID NO: 531399 - DNA, 25 bp, Mus musculus
gcaccaatgtagtgaaatagtctta

SEQ ID NO: 531400 - DNA, 25 bp, Mus musculus
gcaccaatgtgtccctgtgaactaa

SEQ ID NO: 531401 - DNA, 25 bp, Mus musculus
gcaccaatgtgtgcctgtgaactaa

SEQ ID NO: 531402 - DNA, 25 bp, Mus musculus
gcaccaattcttccagttacgaaag

SEQ ID NO: 531403 - DNA, 25 bp, Mus musculus
gcaccaattcttgcagttacgaaag

SEQ ID NO: 531404 - DNA, 25 bp, Mus musculus
gcaccaattgggaaaggcttcgaca

SEQ ID NO: 531405 - DNA, 25 bp, Mus musculus
gcaccaattgggtaaggcttcgaca

SEQ ID NO: 531406 - DNA, 25 bp, Mus musculus
gcaccacaacacacaattatttcac

SEQ ID NO: 531407 - DNA, 25 bp, Mus musculus
gcaccacaacactcaattatttcac

SEQ ID NO: 531408 - DNA, 25 bp, Mus musculus
gcaccacaatgacctagcaggagga

SEQ ID NO: 531409 - DNA, 25 bp, Mus musculus
gcaccacaatgagctagcaggagga

SEQ ID NO: 531410 - DNA, 25 bp, Mus musculus
gcaccacacctgagtacagtgtctg

SEQ ID NO: 531411 - DNA, 25 bp, Mus musculus
gcaccacacctgtgtacagtgtctg

SEQ ID NO: 531412 - DNA, 25 bp, Mus musculus
gcaccacacgctcgtatttattttt

SEQ ID NO: 531413 - DNA, 25 bp, Mus musculus
gcaccacacgctggtatttattttt

SEQ ID NO: 531414 - DNA, 25 bp, Mus musculus
gcaccacacgtgactgagagctttt

SEQ ID NO: 531415 - DNA, 25 bp, Mus musculus
gcaccacacgtgctaacgctttgtg

SEQ ID NO: 531416 - DNA, 25 bp, Mus musculus
gcaccacacgtggtaacgctttgtg

SEQ ID NO: 531417 - DNA, 25 bp, Mus musculus
gcaccacacgtgtctgagagctttt

SEQ ID NO: 531418 - DNA, 25 bp, Mus musculus
gcaccacagagcacgctagtttgga

SEQ ID NO: 531419 - DNA, 25 bp, Mus musculus
gcaccacagagcagctaacaaccat

SEQ ID NO: 531420 - DNA, 25 bp, Mus musculus
gcaccacagagctcgctagtttgga

SEQ ID NO: 531421 - DNA, 25 bp, Mus musculus
gcaccacagagctgctaacaaccat

SEQ ID NO: 531422 - DNA, 25 bp, Mus musculus
gcaccacagatgcactggaaccgga

SEQ ID NO: 531423 - DNA, 25 bp, Mus musculus
gcaccacagatggactggaaccgga

SEQ ID NO: 531424 - DNA, 25 bp, Mus musculus
gcaccacagccactatggtatcggt

SEQ ID NO: 531425 - DNA, 25 bp, Mus musculus
gcaccacagccagtatggtatcggt

SEQ ID NO: 531426 - DNA, 25 bp, Mus musculus
gcaccacaggcgagttagcggaaga

SEQ ID NO: 531427 - DNA, 25 bp, Mus musculus
gcaccacaggcgtgttagcggaaga

SEQ ID NO: 531428 - DNA, 25 bp, Mus musculus
gcaccacagtccataatatatcagg

SEQ ID NO: 531429 - DNA, 25 bp, Mus musculus
gcaccacagtccttaatatatcagg

SEQ ID NO: 531430 - DNA, 25 bp, Mus musculus
gcaccacatattacatgtaccttcc

SEQ ID NO: 531431 - DNA, 25 bp, Mus musculus
gcaccacatatttcatgtaccttcc

SEQ ID NO: 531432 - DNA, 25 bp, Mus musculus
gcaccacatctaccgacttgtgaaa

SEQ ID NO: 531433 - DNA, 25 bp, Mus musculus
gcaccacatctagcgacttgtgaaa

SEQ ID NO: 531434 - DNA, 25 bp, Mus musculus
gcaccacatggtaaacaattacaga

SEQ ID NO: 531435 - DNA, 25 bp, Mus musculus
gcaccacatggttaacaattacaga

SEQ ID NO: 531436 - DNA, 25 bp, Mus musculus
gcaccacattgacagggctcggttt

SEQ ID NO: 531437 - DNA, 25 bp, Mus musculus
gcaccacattgagagggctcggttt

SEQ ID NO: 531438 - DNA, 25 bp, Mus musculus
gcaccaccaaccaaatgaatccatt

SEQ ID NO: 531439 - DNA, 25 bp, Mus musculus
gcaccaccaacctaatgaatccatt

SEQ ID NO: 531440 - DNA, 25 bp, Mus musculus
gcaccaccacaccttaatgatgatc

SEQ ID NO: 531441 - DNA, 25 bp, Mus musculus
gcaccaccacacgttaatgatgatc

SEQ ID NO: 531442 - DNA, 25 bp, Mus musculus
gcaccaccaggcagtagtctggagg

SEQ ID NO: 531443 - DNA, 25 bp, Mus musculus
gcaccaccaggctgtagtctggagg

SEQ ID NO: 531444 - DNA, 25 bp, Mus musculus
gcaccaccatggaacagtagctctg

SEQ ID NO: 531445 - DNA, 25 bp, Mus musculus
gcaccaccatggtacagtagctctg

SEQ ID NO: 531446 - DNA, 25 bp, Mus musculus
gcaccaccatgtctgatatatttga

SEQ ID NO: 531447 - DNA, 25 bp, Mus musculus
gcaccaccatgtgtgatatatttga

SEQ ID NO: 531448 - DNA, 25 bp, Mus musculus
gcaccacccacaatctttttgtaaa

SEQ ID NO: 531449 - DNA, 25 bp, Mus musculus
gcaccacccacattctttttgtaaa

SEQ ID NO: 531450 - DNA, 25 bp, Mus musculus
gcaccacccagcaagaaaatgcact

SEQ ID NO: 531451 - DNA, 25 bp, Mus musculus
gcaccacccagctagaaaatgcact

SEQ ID NO: 531452 - DNA, 25 bp, Mus musculus
gcaccacccatgcagaagcctgagg

SEQ ID NO: 531453 - DNA, 25 bp, Mus musculus
gcaccacccatggagaagcctgagg

SEQ ID NO: 531454 - DNA, 25 bp, Mus musculus
gcaccacccattcaaaggtttctat

SEQ ID NO: 531455 - DNA, 25 bp, Mus musculus
gcaccacccattgaaaggtttctat

SEQ ID NO: 531456 - DNA, 25 bp, Mus musculus
gcaccaccccagcaaatagatgtct

SEQ ID NO: 531457 - DNA, 25 bp, Mus musculus
gcaccaccccaggaaatagatgtct

SEQ ID NO: 531458 - DNA, 25 bp, Mus musculus
gcaccaccccttattcgtgttatta

SEQ ID NO: 531459 - DNA, 25 bp, Mus musculus
gcaccacccctttttcgtgttatta

SEQ ID NO: 531460 - DNA, 25 bp, Mus musculus
gcaccaccgaaaatctgtcttttac

SEQ ID NO: 531461 - DNA, 25 bp, Mus musculus
gcaccaccgaaattctgtcttttac

SEQ ID NO: 531462 - DNA, 25 bp, Mus musculus
gcaccaccggatcagtgactttgtt

SEQ ID NO: 531463 - DNA, 25 bp, Mus musculus
gcaccaccggatgagtgactttgtt

SEQ ID NO: 531464 - DNA, 25 bp, Mus musculus
gcaccaccgtgtaggagatggtcat

SEQ ID NO: 531465 - DNA, 25 bp, Mus musculus
gcaccaccgtgttggagatggtcat

SEQ ID NO: 531466 - DNA, 25 bp, Mus musculus
gcaccacctagaagttttccattgt

SEQ ID NO: 531467 - DNA, 25 bp, Mus musculus
gcaccacctagatgttttccattgt

SEQ ID NO: 531468 - DNA, 25 bp, Mus musculus
gcaccacctatacaagcacactttg

SEQ ID NO: 531469 - DNA, 25 bp, Mus musculus
gcaccacctatagaagcacactttg

SEQ ID NO: 531470 - DNA, 25 bp, Mus musculus
gcaccacctatgagtctggtgtcct

SEQ ID NO: 531471 - DNA, 25 bp, Mus musculus
gcaccacctatgtgtctggtgtcct

SEQ ID NO: 531472 - DNA, 25 bp, Mus musculus
gcaccaccttaaaatgtacttcctc

SEQ ID NO: 531473 - DNA, 25 bp, Mus musculus
gcaccaccttaatatgtacttcctc

SEQ ID NO: 531474 - DNA, 25 bp, Mus musculus
gcaccacgcgttcccaatgtgtaga

SEQ ID NO: 531475 - DNA, 25 bp, Mus musculus
gcaccacgcgttgccaatgtgtaga

SEQ ID NO: 531476 - DNA, 25 bp, Mus musculus
gcaccacgtggaatcagttttctaa

SEQ ID NO: 531477 - DNA, 25 bp, Mus musculus
gcaccacgtggattcagttttctaa

SEQ ID NO: 531478 - DNA, 25 bp, Mus musculus
gcaccacgtgtgaacccaaacattt

SEQ ID NO: 531479 - DNA, 25 bp, Mus musculus
gcaccacgtgtgtacccaaacattt

SEQ ID NO: 531480 - DNA, 25 bp, Mus musculus
gcaccactatgaagaaccactgtcc

SEQ ID NO: 531481 - DNA, 25 bp, Mus musculus
gcaccactatgatgaaccactgtcc

SEQ ID NO: 531482 - DNA, 25 bp, Mus musculus
gcaccactgcctagtatagactatg

SEQ ID NO: 531483 - DNA, 25 bp, Mus musculus
gcaccactgccttgtatagactatg

SEQ ID NO: 531484 - DNA, 25 bp, Mus musculus
gcaccactgggtctattcatttata

SEQ ID NO: 531485 - DNA, 25 bp, Mus musculus
gcaccactgggtgtattcatttata

SEQ ID NO: 531486 - DNA, 25 bp, Mus musculus
gcaccactggtgatggaacttgatt

SEQ ID NO: 531487 - DNA, 25 bp, Mus musculus
gcaccactggtgttggaacttgatt

SEQ ID NO: 531488 - DNA, 25 bp, Mus musculus
gcaccactgtcacactgggctctaa

SEQ ID NO: 531489 - DNA, 25 bp, Mus musculus
gcaccactgtcagactgggctctaa

SEQ ID NO: 531490 - DNA, 25 bp, Mus musculus
gcaccactgtgaaggcctctgcata

SEQ ID NO: 531491 - DNA, 25 bp, Mus musculus
gcaccactgtgatggcctctgcata

SEQ ID NO: 531492 - DNA, 25 bp, Mus musculus
gcaccacttcttcctgtggaggatg

SEQ ID NO: 531493 - DNA, 25 bp, Mus musculus
gcaccacttcttgctgtggaggatg

SEQ ID NO: 531494 - DNA, 25 bp, Mus musculus
gcaccacttggcaattaggttgctt

SEQ ID NO: 531495 - DNA, 25 bp, Mus musculus
gcaccacttggctattaggttgctt

SEQ ID NO: 531496 - DNA, 25 bp, Mus musculus
gcaccactttgacgaagtgcttctt

SEQ ID NO: 531497 - DNA, 25 bp, Mus musculus
gcaccactttgaggaagtgcttctt

SEQ ID NO: 531498 - DNA, 25 bp, Mus musculus
gcaccagaaaatatagccaaaacga

SEQ ID NO: 531499 - DNA, 25 bp, Mus musculus
gcaccagaaaatttagccaaaacga

SEQ ID NO: 531500 - DNA, 25 bp, Mus musculus
gcaccagaacctaggagaagctacc

SEQ ID NO: 531501 - DNA, 25 bp, Mus musculus
gcaccagaaccttggagaagctacc

SEQ ID NO: 531502 - DNA, 25 bp, Mus musculus
gcaccagaactcagtgtttctacag

SEQ ID NO: 531503 - DNA, 25 bp, Mus musculus
gcaccagaactctgtgtttctacag

SEQ ID NO: 531504 - DNA, 25 bp, Mus musculus
gcaccagaagctccttgaggctgta

SEQ ID NO: 531505 - DNA, 25 bp, Mus musculus
gcaccagaagctgcttgaggctgta

SEQ ID NO: 531506 - DNA, 25 bp, Mus musculus
gcaccagacaccaatcacagatatt

SEQ ID NO: 531507 - DNA, 25 bp, Mus musculus
gcaccagacacctatcacagatatt

SEQ ID NO: 531508 - DNA, 25 bp, Mus musculus
gcaccagaggcaacacactggagga

SEQ ID NO: 531509 - DNA, 25 bp, Mus musculus
gcaccagaggcatcacactggagga

SEQ ID NO: 531510 - DNA, 25 bp, Mus musculus
gcaccagatgggatactcttttcct

SEQ ID NO: 531511 - DNA, 25 bp, Mus musculus
gcaccagatgggttactcttttcct

SEQ ID NO: 531512 - DNA, 25 bp, Mus musculus
gcaccagatggtcaatcaggcacta

SEQ ID NO: 531513 - DNA, 25 bp, Mus musculus
gcaccagatggtgaatcaggcacta

SEQ ID NO: 531514 - DNA, 25 bp, Mus musculus
gcaccagatgtgatcagtgtctgca

SEQ ID NO: 531515 - DNA, 25 bp, Mus musculus
gcaccagatgtgttcagtgtctgca

SEQ ID NO: 531516 - DNA, 25 bp, Mus musculus
gcaccagcagcaactatttccaaag

SEQ ID NO: 531517 - DNA, 25 bp, Mus musculus
gcaccagcagcatctatttccaaag

SEQ ID NO: 531518 - DNA, 25 bp, Mus musculus
gcaccagcagctcttgtaaatttgt

SEQ ID NO: 531519 - DNA, 25 bp, Mus musculus
gcaccagcagctgttgtaaatttgt

SEQ ID NO: 531520 - DNA, 25 bp, Mus musculus
gcaccagcaggactgaaccaaactg

SEQ ID NO: 531521 - DNA, 25 bp, Mus musculus
gcaccagcaggactgtggccagctc

SEQ ID NO: 531522 - DNA, 25 bp, Mus musculus
gcaccagcaggagtgaaccaaactg

SEQ ID NO: 531523 - DNA, 25 bp, Mus musculus
gcaccagcaggagtgtggccagctc

SEQ ID NO: 531524 - DNA, 25 bp, Mus musculus
gcaccagcccagacgaggacgagga

SEQ ID NO: 531525 - DNA, 25 bp, Mus musculus
gcaccagcccagtcgaggacgagga

SEQ ID NO: 531526 - DNA, 25 bp, Mus musculus
gcaccagctacaagttacccaagga

SEQ ID NO: 531527 - DNA, 25 bp, Mus musculus
gcaccagctacatgttacccaagga

SEQ ID NO: 531528 - DNA, 25 bp, Mus musculus
gcaccagctactcaatctgctaatt

SEQ ID NO: 531529 - DNA, 25 bp, Mus musculus
gcaccagctactgaatctgctaatt

SEQ ID NO: 531530 - DNA, 25 bp, Mus musculus
gcaccagctcttcatttgatggaat

SEQ ID NO: 531531 - DNA, 25 bp, Mus musculus
gcaccagctcttgatttgatggaat

SEQ ID NO: 531532 - DNA, 25 bp, Mus musculus
gcaccagctgttacccagtttctag

SEQ ID NO: 531533 - DNA, 25 bp, Mus musculus
gcaccagctgtttcccagtttctag

SEQ ID NO: 531534 - DNA, 25 bp, Mus musculus
gcaccagcttttcctttcagtgact

SEQ ID NO: 531535 - DNA, 25 bp, Mus musculus
gcaccagcttttgctttcagtgact

SEQ ID NO: 531536 - DNA, 25 bp, Mus musculus
gcaccaggactgctgagatagaaaa

SEQ ID NO: 531537 - DNA, 25 bp, Mus musculus
gcaccaggactggtgagatagaaaa

SEQ ID NO: 531538 - DNA, 25 bp, Mus musculus
gcaccaggagtcattaatcagagca

SEQ ID NO: 531539 - DNA, 25 bp, Mus musculus
gcaccaggagtctttaatcagagca

SEQ ID NO: 531540 - DNA, 25 bp, Mus musculus
gcaccaggatttattcgcacggata

SEQ ID NO: 531541 - DNA, 25 bp, Mus musculus
gcaccaggattttttcgcacggata

SEQ ID NO: 531542 - DNA, 25 bp, Mus musculus
gcaccaggcatgcattttcaagcta

SEQ ID NO: 531543 - DNA, 25 bp, Mus musculus
gcaccaggcatggattttcaagcta

SEQ ID NO: 531544 - DNA, 25 bp, Mus musculus
gcaccaggctaactgacttcggatt

SEQ ID NO: 531545 - DNA, 25 bp, Mus musculus
gcaccaggctaagtgacttcggatt

SEQ ID NO: 531546 - DNA, 25 bp, Mus musculus
gcaccaggctatcgctgaggtacaa

SEQ ID NO: 531547 - DNA, 25 bp, Mus musculus
gcaccaggctatggctgaggtacaa

SEQ ID NO: 531548 - DNA, 25 bp, Mus musculus
gcaccaggctcccaatgatgtacat

SEQ ID NO: 531549 - DNA, 25 bp, Mus musculus
gcaccaggctccgaatgatgtacat

SEQ ID NO: 531550 - DNA, 25 bp, Mus musculus
gcaccaggctttcctcacttaaaaa

SEQ ID NO: 531551 - DNA, 25 bp, Mus musculus
gcaccaggctttgctcacttaaaaa

SEQ ID NO: 531552 - DNA, 25 bp, Mus musculus
gcaccagggagaaaatagccattac

SEQ ID NO: 531553 - DNA, 25 bp, Mus musculus
gcaccagggagataatagccattac

SEQ ID NO: 531554 - DNA, 25 bp, Mus musculus
gcaccagggcccaaccaggaagtaa

SEQ ID NO: 531555 - DNA, 25 bp, Mus musculus
gcaccagggccctaccaggaagtaa

SEQ ID NO: 531556 - DNA, 25 bp, Mus musculus
gcaccaggggacactttgcaggctt

SEQ ID NO: 531557 - DNA, 25 bp, Mus musculus
gcaccaggggactctttgcaggctt

SEQ ID NO: 531558 - DNA, 25 bp, Mus musculus
gcaccaggtctgcaaatattctcca

SEQ ID NO: 531559 - DNA, 25 bp, Mus musculus
gcaccaggtctggaaatattctcca

SEQ ID NO: 531560 - DNA, 25 bp, Mus musculus
gcaccaggtgtgatgggagccatta

SEQ ID NO: 531561 - DNA, 25 bp, Mus musculus
gcaccaggtgtgttgggagccatta

SEQ ID NO: 531562 - DNA, 25 bp, Mus musculus
gcaccaggttccctgagaggcctta

SEQ ID NO: 531563 - DNA, 25 bp, Mus musculus
gcaccaggttccgtgagaggcctta

SEQ ID NO: 531564 - DNA, 25 bp, Mus musculus
gcaccaggttctagggtttctcagg

SEQ ID NO: 531565 - DNA, 25 bp, Mus musculus
gcaccaggttcttgggtttctcagg

SEQ ID NO: 531566 - DNA, 25 bp, Mus musculus
gcaccagtaccactttctagatgtg

SEQ ID NO: 531567 - DNA, 25 bp, Mus musculus
gcaccagtaccagtttctagatgtg

SEQ ID NO: 531568 - DNA, 25 bp, Mus musculus
gcaccagtacgtataagttctaatt

SEQ ID NO: 531569 - DNA, 25 bp, Mus musculus
gcaccagtacgtttaagttctaatt

SEQ ID NO: 531570 - DNA, 25 bp, Mus musculus
gcaccagtatcgatgatctcaggga

SEQ ID NO: 531571 - DNA, 25 bp, Mus musculus
gcaccagtatcgttgatctcaggga

SEQ ID NO: 531572 - DNA, 25 bp, Mus musculus
gcaccagtcgcaccagtcgcagtaa

SEQ ID NO: 531573 - DNA, 25 bp, Mus musculus
gcaccagtcgcagcagtcgcagtaa

SEQ ID NO: 531574 - DNA, 25 bp, Mus musculus
gcaccagtctctaatatgtctctta

SEQ ID NO: 531575 - DNA, 25 bp, Mus musculus
gcaccagtctcttatatgtctctta

SEQ ID NO: 531576 - DNA, 25 bp, Mus musculus
gcaccagtctgacgctgtataccta

SEQ ID NO: 531577 - DNA, 25 bp, Mus musculus
gcaccagtctgaggctgtataccta

SEQ ID NO: 531578 - DNA, 25 bp, Mus musculus
gcaccagtcttgaggctggcccctc

SEQ ID NO: 531579 - DNA, 25 bp, Mus musculus
gcaccagtcttgtggctggcccctc

SEQ ID NO: 531580 - DNA, 25 bp, Mus musculus
gcaccagtgcctatccaaaaacatg

SEQ ID NO: 531581 - DNA, 25 bp, Mus musculus
gcaccagtgcctttccaaaaacatg

SEQ ID NO: 531582 - DNA, 25 bp, Mus musculus
gcaccagttcaaaatgagactacct

SEQ ID NO: 531583 - DNA, 25 bp, Mus musculus
gcaccagttcaatatgagactacct

SEQ ID NO: 531584 - DNA, 25 bp, Mus musculus
gcaccagttgtcagaccccagacgt

SEQ ID NO: 531585 - DNA, 25 bp, Mus musculus
gcaccagttgtctgaccccagacgt

SEQ ID NO: 531586 - DNA, 25 bp, Mus musculus
gcaccatagaaaaccagatgtggct

SEQ ID NO: 531587 - DNA, 25 bp, Mus musculus
gcaccatagaaatccagatgtggct

SEQ ID NO: 531588 - DNA, 25 bp, Mus musculus
gcaccatagtgaagtcaatgtccta

SEQ ID NO: 531589 - DNA, 25 bp, Mus musculus
gcaccatagtgatgtcaatgtccta

SEQ ID NO: 531590 - DNA, 25 bp, Mus musculus
gcaccatagtgtattccatttctca

SEQ ID NO: 531591 - DNA, 25 bp, Mus musculus
gcaccatagtgttttccatttctca

SEQ ID NO: 531592 - DNA, 25 bp, Mus musculus
gcaccatatttaaactgctgcttct

SEQ ID NO: 531593 - DNA, 25 bp, Mus musculus
gcaccatatttatactgctgcttct

SEQ ID NO: 531594 - DNA, 25 bp, Mus musculus
gcaccatcaaggcttacaacgctga

SEQ ID NO: 531595 - DNA, 25 bp, Mus musculus
gcaccatcaagggttacaacgctga

SEQ ID NO: 531596 - DNA, 25 bp, Mus musculus
gcaccatcacggaggcacagaagca

SEQ ID NO: 531597 - DNA, 25 bp, Mus musculus
gcaccatcacggtggcacagaagca

SEQ ID NO: 531598 - DNA, 25 bp, Mus musculus
gcaccatcactactaccacaaaaaa

SEQ ID NO: 531599 - DNA, 25 bp, Mus musculus
gcaccatcactagtaccacaaaaaa

SEQ ID NO: 531600 - DNA, 25 bp, Mus musculus
gcaccatcagcacgaggacagatat

SEQ ID NO: 531601 - DNA, 25 bp, Mus musculus
gcaccatcagcaggaggacagatat

SEQ ID NO: 531602 - DNA, 25 bp, Mus musculus
gcaccatcatgaaaccttggactgt

SEQ ID NO: 531603 - DNA, 25 bp, Mus musculus
gcaccatcatgataccttggactgt

SEQ ID NO: 531604 - DNA, 25 bp, Mus musculus
gcaccatcattaacaaatgtacaaa

SEQ ID NO: 531605 - DNA, 25 bp, Mus musculus
gcaccatcattatcaaatgtacaaa

SEQ ID NO: 531606 - DNA, 25 bp, Mus musculus
gcaccatccaaaccagcagcataaa

SEQ ID NO: 531607 - DNA, 25 bp, Mus musculus
gcaccatccaaagcagcagcataaa

SEQ ID NO: 531608 - DNA, 25 bp, Mus musculus
gcaccatccggaagtttttagtgat

SEQ ID NO: 531609 - DNA, 25 bp, Mus musculus
gcaccatccggatgtttttagtgat

SEQ ID NO: 531610 - DNA, 25 bp, Mus musculus
gcaccatcgggcacaaggattcggt

SEQ ID NO: 531611 - DNA, 25 bp, Mus musculus
gcaccatcgggctcaaggattcggt

SEQ ID NO: 531612 - DNA, 25 bp, Mus musculus
gcaccatctttccacatgtttacaa

SEQ ID NO: 531613 - DNA, 25 bp, Mus musculus
gcaccatctttcgacatgtttacaa

SEQ ID NO: 531614 - DNA, 25 bp, Mus musculus
gcaccatctttgacagtggtcctgg

SEQ ID NO: 531615 - DNA, 25 bp, Mus musculus
gcaccatctttgtcagtggtcctgg

SEQ ID NO: 531616 - DNA, 25 bp, Mus musculus
gcaccatgaaccagaggacaaccgg

SEQ ID NO: 531617 - DNA, 25 bp, Mus musculus
gcaccatgaacctgaggacaaccgg

SEQ ID NO: 531618 - DNA, 25 bp, Mus musculus
gcaccatgacagacctagtcttgta

SEQ ID NO: 531619 - DNA, 25 bp, Mus musculus
gcaccatgacagtcctagtcttgta

SEQ ID NO: 531620 - DNA, 25 bp, Mus musculus
gcaccatgaccaaaagcagcttcag

SEQ ID NO: 531621 - DNA, 25 bp, Mus musculus
gcaccatgaccataagcagcttcag

SEQ ID NO: 531622 - DNA, 25 bp, Mus musculus
gcaccatgagggaaccaggccttgc

SEQ ID NO: 531623 - DNA, 25 bp, Mus musculus
gcaccatgagggtaccaggccttgc

SEQ ID NO: 531624 - DNA, 25 bp, Mus musculus
gcaccatgcacacacattcttctaa

SEQ ID NO: 531625 - DNA, 25 bp, Mus musculus
gcaccatgcacagacattcttctaa

SEQ ID NO: 531626 - DNA, 25 bp, Mus musculus
gcaccatgcatgatttaggccagtg

SEQ ID NO: 531627 - DNA, 25 bp, Mus musculus
gcaccatgcatgttttaggccagtg

SEQ ID NO: 531628 - DNA, 25 bp, Mus musculus
gcaccatgctacagactttacactt

SEQ ID NO: 531629 - DNA, 25 bp, Mus musculus
gcaccatgctactgactttacactt

SEQ ID NO: 531630 - DNA, 25 bp, Mus musculus
gcaccatggaagcagaccctaagcc

SEQ ID NO: 531631 - DNA, 25 bp, Mus musculus
gcaccatggaaggagaccctaagcc

SEQ ID NO: 531632 - DNA, 25 bp, Mus musculus
gcaccatggctcacacgtaaataca

SEQ ID NO: 531633 - DNA, 25 bp, Mus musculus
gcaccatggctctcacgtaaataca

SEQ ID NO: 531634 - DNA, 25 bp, Mus musculus
gcaccatgggccaagctacagagaa

SEQ ID NO: 531635 - DNA, 25 bp, Mus musculus
gcaccatgggcctagctacagagaa

SEQ ID NO: 531636 - DNA, 25 bp, Mus musculus
gcaccatggtctccccacagaaaaa

SEQ ID NO: 531637 - DNA, 25 bp, Mus musculus
gcaccatggtctgcccacagaaaaa

SEQ ID NO: 531638 - DNA, 25 bp, Mus musculus
gcaccatggttgcaatgactgtcct

SEQ ID NO: 531639 - DNA, 25 bp, Mus musculus
gcaccatggttggaatgactgtcct

SEQ ID NO: 531640 - DNA, 25 bp, Mus musculus
gcaccatgtgcaagtttatgcttgt

SEQ ID NO: 531641 - DNA, 25 bp, Mus musculus
gcaccatgtgcatgtttatgcttgt

SEQ ID NO: 531642 - DNA, 25 bp, Mus musculus
gcaccatgttcacttttaccgggat

SEQ ID NO: 531643 - DNA, 25 bp, Mus musculus
gcaccatgttcagttttaccgggat

SEQ ID NO: 531644 - DNA, 25 bp, Mus musculus
gcaccatgttcccaaggctctataa

SEQ ID NO: 531645 - DNA, 25 bp, Mus musculus
gcaccatgttccgaaggctctataa

SEQ ID NO: 531646 - DNA, 25 bp, Mus musculus
gcaccatgttctccattgtaactga

SEQ ID NO: 531647 - DNA, 25 bp, Mus musculus
gcaccatgttctgcattgtaactga

SEQ ID NO: 531648 - DNA, 25 bp, Mus musculus
gcaccatgttggcaaacctctgact

SEQ ID NO: 531649 - DNA, 25 bp, Mus musculus
gcaccatgttgggaaacctctgact

SEQ ID NO: 531650 - DNA, 25 bp, Mus musculus
gcaccatgtttccagattcgatgtg

SEQ ID NO: 531651 - DNA, 25 bp, Mus musculus
gcaccatgtttcgagattcgatgtg

SEQ ID NO: 531652 - DNA, 25 bp, Mus musculus
gcaccattaggccaggaacccatat

SEQ ID NO: 531653 - DNA, 25 bp, Mus musculus
gcaccattaggcgaggaacccatat

SEQ ID NO: 531654 - DNA, 25 bp, Mus musculus
gcaccattatgtatggaatctgata

SEQ ID NO: 531655 - DNA, 25 bp, Mus musculus
gcaccattatgtttggaatctgata

SEQ ID NO: 531656 - DNA, 25 bp, Mus musculus
gcaccattcagtacttcttctctga

SEQ ID NO: 531657 - DNA, 25 bp, Mus musculus
gcaccattcagttcttcttctctga

SEQ ID NO: 531658 - DNA, 25 bp, Mus musculus
gcaccattccctagacataaggtcc

SEQ ID NO: 531659 - DNA, 25 bp, Mus musculus
gcaccattcccttgacataaggtcc

SEQ ID NO: 531660 - DNA, 25 bp, Mus musculus
gcaccattgccactgcgctggaata

SEQ ID NO: 531661 - DNA, 25 bp, Mus musculus
gcaccattgccagtgcgctggaata

SEQ ID NO: 531662 - DNA, 25 bp, Mus musculus
gcaccattgcgaattctgaaaccac

SEQ ID NO: 531663 - DNA, 25 bp, Mus musculus
gcaccattgcgatttctgaaaccac

SEQ ID NO: 531664 - DNA, 25 bp, Mus musculus
gcaccattggttaccagtgacttca

SEQ ID NO: 531665 - DNA, 25 bp, Mus musculus
gcaccattggtttccagtgacttca

SEQ ID NO: 531666 - DNA, 25 bp, Mus musculus
gcaccattgtggaagaagttcagga

SEQ ID NO: 531667 - DNA, 25 bp, Mus musculus
gcaccattgtggtagaagttcagga

SEQ ID NO: 531668 - DNA, 25 bp, Mus musculus
gcaccatttgctaatctggaggaca

SEQ ID NO: 531669 - DNA, 25 bp, Mus musculus
gcaccatttgctacttactaacgag

SEQ ID NO: 531670 - DNA, 25 bp, Mus musculus
gcaccatttgcttatctggaggaca

SEQ ID NO: 531671 - DNA, 25 bp, Mus musculus
gcaccatttgcttcttactaacgag

SEQ ID NO: 531672 - DNA, 25 bp, Mus musculus
gcaccatttggtaagacttcagcac

SEQ ID NO: 531673 - DNA, 25 bp, Mus musculus
gcaccatttggttagacttcagcac

SEQ ID NO: 531674 - DNA, 25 bp, Mus musculus
gcaccattttacacgaaggctgaag

SEQ ID NO: 531675 - DNA, 25 bp, Mus musculus
gcaccattttactcgaaggctgaag

SEQ ID NO: 531676 - DNA, 25 bp, Mus musculus
gcaccattttgcagttctatctttt

SEQ ID NO: 531677 - DNA, 25 bp, Mus musculus
gcaccattttgctgttctatctttt

SEQ ID NO: 531678 - DNA, 25 bp, Mus musculus
gcacccaaagcaactgccaaggaga

SEQ ID NO: 531679 - DNA, 25 bp, Mus musculus
gcacccaaagcatctgccaaggaga

SEQ ID NO: 531680 - DNA, 25 bp, Mus musculus
gcacccaacatccagtctgggagta

SEQ ID NO: 531681 - DNA, 25 bp, Mus musculus
gcacccaacatcgagtctgggagta

SEQ ID NO: 531682 - DNA, 25 bp, Mus musculus
gcacccaacggaaacccaaggcaag

SEQ ID NO: 531683 - DNA, 25 bp, Mus musculus
gcacccaacggatacccaaggcaag

SEQ ID NO: 531684 - DNA, 25 bp, Mus musculus
gcacccaatggtctgaaactctagt

SEQ ID NO: 531685 - DNA, 25 bp, Mus musculus
gcacccaatggtgtgaaactctagt

SEQ ID NO: 531686 - DNA, 25 bp, Mus musculus
gcacccaatttcaatcagccagaag

SEQ ID NO: 531687 - DNA, 25 bp, Mus musculus
gcacccaatttctatcagccagaag

SEQ ID NO: 531688 - DNA, 25 bp, Mus musculus
gcacccacaaggaagttcatagctg

SEQ ID NO: 531689 - DNA, 25 bp, Mus musculus
gcacccacaaggtagttcatagctg

SEQ ID NO: 531690 - DNA, 25 bp, Mus musculus
gcacccacagaacgcatcggaggaa

SEQ ID NO: 531691 - DNA, 25 bp, Mus musculus
gcacccacagaaggcatcggaggaa

SEQ ID NO: 531692 - DNA, 25 bp, Mus musculus
gcacccacagagagcttctggttgc

SEQ ID NO: 531693 - DNA, 25 bp, Mus musculus
gcacccacagagtgcttctggttgc

SEQ ID NO: 531694 - DNA, 25 bp, Mus musculus
gcacccacagtgaaggacagttttg

SEQ ID NO: 531695 - DNA, 25 bp, Mus musculus
gcacccacagtgtaggacagttttg

SEQ ID NO: 531696 - DNA, 25 bp, Mus musculus
gcacccacatacagctatggctaag

SEQ ID NO: 531697 - DNA, 25 bp, Mus musculus
gcacccacatactgctatggctaag

SEQ ID NO: 531698 - DNA, 25 bp, Mus musculus
gcacccacatgaaaggtttctcaga

SEQ ID NO: 531699 - DNA, 25 bp, Mus musculus
gcacccacatgataggtttctcaga

SEQ ID NO: 531700 - DNA, 25 bp, Mus musculus
gcacccacatggaaactagttccaa

SEQ ID NO: 531701 - DNA, 25 bp, Mus musculus
gcacccacatggtaactagttccaa

SEQ ID NO: 531702 - DNA, 25 bp, Mus musculus
gcacccacattgagcctcaaacaaa

SEQ ID NO: 531703 - DNA, 25 bp, Mus musculus
gcacccacattgtgcctcaaacaaa

SEQ ID NO: 531704 - DNA, 25 bp, Mus musculus
gcacccacatttactccataaggaa

SEQ ID NO: 531705 - DNA, 25 bp, Mus musculus
gcacccacattttctccataaggaa

SEQ ID NO: 531706 - DNA, 25 bp, Mus musculus
gcacccacccgacagagaggaggaa

SEQ ID NO: 531707 - DNA, 25 bp, Mus musculus
gcacccacccgagagagaggaggaa

SEQ ID NO: 531708 - DNA, 25 bp, Mus musculus
gcacccacctgcagctcatgaagag

SEQ ID NO: 531709 - DNA, 25 bp, Mus musculus
gcacccacctgctgctcatgaagag

SEQ ID NO: 531710 - DNA, 25 bp, Mus musculus
gcacccacgcccacaggaaaaggat

SEQ ID NO: 531711 - DNA, 25 bp, Mus musculus
gcacccacgccctcaggaaaaggat

SEQ ID NO: 531712 - DNA, 25 bp, Mus musculus
gcacccacttctctctgagtgattc

SEQ ID NO: 531713 - DNA, 25 bp, Mus musculus
gcacccacttctgtctgagtgattc

SEQ ID NO: 531714 - DNA, 25 bp, Mus musculus
gcacccagactgctctttgtacaga

SEQ ID NO: 531715 - DNA, 25 bp, Mus musculus
gcacccagactggtctttgtacaga

SEQ ID NO: 531716 - DNA, 25 bp, Mus musculus
gcacccagatcgagcctgtgtgatg

SEQ ID NO: 531717 - DNA, 25 bp, Mus musculus
gcacccagatcgtgcctgtgtgatg

SEQ ID NO: 531718 - DNA, 25 bp, Mus musculus
gcacccagcaccaatgtatttcaaa

SEQ ID NO: 531719 - DNA, 25 bp, Mus musculus
gcacccagcacctatgtatttcaaa

SEQ ID NO: 531720 - DNA, 25 bp, Mus musculus
gcacccagcagtataagcccaatga

SEQ ID NO: 531721 - DNA, 25 bp, Mus musculus
gcacccagcagtttaagcccaatga

SEQ ID NO: 531722 - DNA, 25 bp, Mus musculus
gcacccagctgactgtaagaatgga

SEQ ID NO: 531723 - DNA, 25 bp, Mus musculus
gcacccagctgagtgtaagaatgga

SEQ ID NO: 531724 - DNA, 25 bp, Mus musculus
gcacccagctggattgacaccggac

SEQ ID NO: 531725 - DNA, 25 bp, Mus musculus
gcacccagctggtttgacaccggac

SEQ ID NO: 531726 - DNA, 25 bp, Mus musculus
gcacccaggctgactttcacaaaaa

SEQ ID NO: 531727 - DNA, 25 bp, Mus musculus
gcacccaggctgtctttcacaaaaa

SEQ ID NO: 531728 - DNA, 25 bp, Mus musculus
gcacccagtcctactacaatttgat

SEQ ID NO: 531729 - DNA, 25 bp, Mus musculus
gcacccagtccttctacaatttgat

SEQ ID NO: 531730 - DNA, 25 bp, Mus musculus
gcacccagtgccatatctttggctg

SEQ ID NO: 531731 - DNA, 25 bp, Mus musculus
gcacccagtgccttatctttggctg

SEQ ID NO: 531732 - DNA, 25 bp, Mus musculus
gcacccatacttcttaaagtaccta

SEQ ID NO: 531733 - DNA, 25 bp, Mus musculus
gcacccatacttgttaaagtaccta

SEQ ID NO: 531734 - DNA, 25 bp, Mus musculus
gcacccatatctcttcgagttactt

SEQ ID NO: 531735 - DNA, 25 bp, Mus musculus
gcacccatatctgttcgagttactt

SEQ ID NO: 531736 - DNA, 25 bp, Mus musculus
gcacccatcatgaatgagaacttct

SEQ ID NO: 531737 - DNA, 25 bp, Mus musculus
gcacccatcatgtatgagaacttct

SEQ ID NO: 531738 - DNA, 25 bp, Mus musculus
gcacccatcccaaaagtacttactg

SEQ ID NO: 531739 - DNA, 25 bp, Mus musculus
gcacccatcccataagtacttactg

SEQ ID NO: 531740 - DNA, 25 bp, Mus musculus
gcacccatcctcatacctgataagt

SEQ ID NO: 531741 - DNA, 25 bp, Mus musculus
gcacccatcctcttacctgataagt

SEQ ID NO: 531742 - DNA, 25 bp, Mus musculus
gcacccatgaagcttactggaccgt

SEQ ID NO: 531743 - DNA, 25 bp, Mus musculus
gcacccatgaaggttactggaccgt

SEQ ID NO: 531744 - DNA, 25 bp, Mus musculus
gcacccatgggcaaccttgtggagt

SEQ ID NO: 531745 - DNA, 25 bp, Mus musculus
gcacccatgggctaccttgtggagt

SEQ ID NO: 531746 - DNA, 25 bp, Mus musculus
gcacccatgtggctttgatcaattg

SEQ ID NO: 531747 - DNA, 25 bp, Mus musculus
gcacccatgtgggtttgatcaattg

SEQ ID NO: 531748 - DNA, 25 bp, Mus musculus
gcacccatgtgtacaatgttgctga

SEQ ID NO: 531749 - DNA, 25 bp, Mus musculus
gcacccatgtgttcaatgttgctga

SEQ ID NO: 531750 - DNA, 25 bp, Mus musculus
gcacccattagtaagccactgtatt

SEQ ID NO: 531751 - DNA, 25 bp, Mus musculus
gcacccattagttagccactgtatt

SEQ ID NO: 531752 - DNA, 25 bp, Mus musculus
gcacccattcagaatcctggcttta

SEQ ID NO: 531753 - DNA, 25 bp, Mus musculus
gcacccattcagtatcctggcttta

SEQ ID NO: 531754 - DNA, 25 bp, Mus musculus
gcacccattcatatgattcaataaa

SEQ ID NO: 531755 - DNA, 25 bp, Mus musculus
gcacccattcatttgattcaataaa

SEQ ID NO: 531756 - DNA, 25 bp, Mus musculus
gcacccattctgcagcaatttttca

SEQ ID NO: 531757 - DNA, 25 bp, Mus musculus
gcacccattctggagcaatttttca

SEQ ID NO: 531758 - DNA, 25 bp, Mus musculus
gcacccattcttagtaaccgtatag

SEQ ID NO: 531759 - DNA, 25 bp, Mus musculus
gcacccattctttgtaaccgtatag

SEQ ID NO: 531760 - DNA, 25 bp, Mus musculus
gcacccattgtaccaatgtccacag

SEQ ID NO: 531761 - DNA, 25 bp, Mus musculus
gcacccattgtagcaatgtccacag

SEQ ID NO: 531762 - DNA, 25 bp, Mus musculus
gcaccccaaagccattttcaatata

SEQ ID NO: 531763 - DNA, 25 bp, Mus musculus
gcaccccaaagcgattttcaatata

SEQ ID NO: 531764 - DNA, 25 bp, Mus musculus
gcaccccaattaaaattcatggacc

SEQ ID NO: 531765 - DNA, 25 bp, Mus musculus
gcaccccaattataattcatggacc

SEQ ID NO: 531766 - DNA, 25 bp, Mus musculus
gcaccccaccagcaactgattttag

SEQ ID NO: 531767 - DNA, 25 bp, Mus musculus
gcaccccaccaggaactgattttag

SEQ ID NO: 531768 - DNA, 25 bp, Mus musculus
gcaccccagagtatcctagagagca

SEQ ID NO: 531769 - DNA, 25 bp, Mus musculus
gcaccccagagtttcctagagagca

SEQ ID NO: 531770 - DNA, 25 bp, Mus musculus
gcaccccagggcactaggaggataa

SEQ ID NO: 531771 - DNA, 25 bp, Mus musculus
gcaccccagggctctaggaggataa

SEQ ID NO: 531772 - DNA, 25 bp, Mus musculus
gcaccccgtgtgattggatcataag

SEQ ID NO: 531773 - DNA, 25 bp, Mus musculus
gcaccccgtgtgtttggatcataag

SEQ ID NO: 531774 - DNA, 25 bp, Mus musculus
gcacccctaccaactttctaagaat

SEQ ID NO: 531775 - DNA, 25 bp, Mus musculus
gcacccctaccatctttctaagaat

SEQ ID NO: 531776 - DNA, 25 bp, Mus musculus
gcacccctataaaggctcacagtca

SEQ ID NO: 531777 - DNA, 25 bp, Mus musculus
gcacccctataacaagccgtacatg

SEQ ID NO: 531778 - DNA, 25 bp, Mus musculus
gcacccctataagaagccgtacatg

SEQ ID NO: 531779 - DNA, 25 bp, Mus musculus
gcacccctataatggctcacagtca

SEQ ID NO: 531780 - DNA, 25 bp, Mus musculus
gcacccctcatgcatgccctgaaac

SEQ ID NO: 531781 - DNA, 25 bp, Mus musculus
gcacccctcatggatgccctgaaac

SEQ ID NO: 531782 - DNA, 25 bp, Mus musculus
gcacccctctttcatgtactaaaat

SEQ ID NO: 531783 - DNA, 25 bp, Mus musculus
gcacccctctttgatgtactaaaat

SEQ ID NO: 531784 - DNA, 25 bp, Mus musculus
gcacccctggtgaatccttggtgat

SEQ ID NO: 531785 - DNA, 25 bp, Mus musculus
gcacccctggtgtatccttggtgat

SEQ ID NO: 531786 - DNA, 25 bp, Mus musculus
gcacccctgttcattaatgggtaag

SEQ ID NO: 531787 - DNA, 25 bp, Mus musculus
gcacccctgttctttaatgggtaag

SEQ ID NO: 531788 - DNA, 25 bp, Mus musculus
gcacccctgttgcatctgtagttag

SEQ ID NO: 531789 - DNA, 25 bp, Mus musculus
gcacccctgttggatctgtagttag

SEQ ID NO: 531790 - DNA, 25 bp, Mus musculus
gcaccccttggactgttcagtcaaa

SEQ ID NO: 531791 - DNA, 25 bp, Mus musculus
gcaccccttggagtgttcagtcaaa

SEQ ID NO: 531792 - DNA, 25 bp, Mus musculus
gcacccgagtttcccaattgattct

SEQ ID NO: 531793 - DNA, 25 bp, Mus musculus
gcacccgagtttgccaattgattct

SEQ ID NO: 531794 - DNA, 25 bp, Mus musculus
gcacccgatgggactgaagcacagt

SEQ ID NO: 531795 - DNA, 25 bp, Mus musculus
gcacccgatgggtctgaagcacagt

SEQ ID NO: 531796 - DNA, 25 bp, Mus musculus
gcacccgcacgacaacagaactttt

SEQ ID NO: 531797 - DNA, 25 bp, Mus musculus
gcacccgcacgagaacagaactttt

SEQ ID NO: 531798 - DNA, 25 bp, Mus musculus
gcacccgcagataacatccctaaag

SEQ ID NO: 531799 - DNA, 25 bp, Mus musculus
gcacccgcagattacatccctaaag

SEQ ID NO: 531800 - DNA, 25 bp, Mus musculus
gcacccggagtgcttgtggccctca

SEQ ID NO: 531801 - DNA, 25 bp, Mus musculus
gcacccggagtggttgtggccctca

SEQ ID NO: 531802 - DNA, 25 bp, Mus musculus
gcacccggtagaagctgaatccatt

SEQ ID NO: 531803 - DNA, 25 bp, Mus musculus
gcacccggtagatgctgaatccatt

SEQ ID NO: 531804 - DNA, 25 bp, Mus musculus
gcacccgtctgaatgtaaggtctgt

SEQ ID NO: 531805 - DNA, 25 bp, Mus musculus
gcacccgtctgattgtaaggtctgt

SEQ ID NO: 531806 - DNA, 25 bp, Mus musculus
gcacccgtctgtaactgttgttcca

SEQ ID NO: 531807 - DNA, 25 bp, Mus musculus
gcacccgtctgttactgttgttcca

SEQ ID NO: 531808 - DNA, 25 bp, Mus musculus
gcacccgtgagaactgtgacagact

SEQ ID NO: 531809 - DNA, 25 bp, Mus musculus
gcacccgtgagatctgtgacagact

SEQ ID NO: 531810 - DNA, 25 bp, Mus musculus
gcacccgtggctatttccagggcag

SEQ ID NO: 531811 - DNA, 25 bp, Mus musculus
gcacccgtggctttttccagggcag

SEQ ID NO: 531812 - DNA, 25 bp, Mus musculus
gcacccgtttctcaaatgactctga

SEQ ID NO: 531813 - DNA, 25 bp, Mus musculus
gcacccgtttctgaaatgactctga

SEQ ID NO: 531814 - DNA, 25 bp, Mus musculus
gcaccctacactagtcaggctgtaa

SEQ ID NO: 531815 - DNA, 25 bp, Mus musculus
gcaccctacacttgtcaggctgtaa

SEQ ID NO: 531816 - DNA, 25 bp, Mus musculus
gcaccctagactaagttgttacatt

SEQ ID NO: 531817 - DNA, 25 bp, Mus musculus
gcaccctagacttagttgttacatt

SEQ ID NO: 531818 - DNA, 25 bp, Mus musculus
gcaccctagggacagcagcttacat

SEQ ID NO: 531819 - DNA, 25 bp, Mus musculus
gcaccctagggagagcagcttacat

SEQ ID NO: 531820 - DNA, 25 bp, Mus musculus
gcaccctataaccagagagcacatt

SEQ ID NO: 531821 - DNA, 25 bp, Mus musculus
gcaccctataacgagagagcacatt

SEQ ID NO: 531822 - DNA, 25 bp, Mus musculus
gcaccctattcacgtcagggacact

SEQ ID NO: 531823 - DNA, 25 bp, Mus musculus
gcaccctattcaggtcagggacact

SEQ ID NO: 531824 - DNA, 25 bp, Mus musculus
gcaccctcaaaacaagctatgaagc

SEQ ID NO: 531825 - DNA, 25 bp, Mus musculus
gcaccctcaaaagaagctatgaagc

SEQ ID NO: 531826 - DNA, 25 bp, Mus musculus
gcaccctcaattacatagcatcaga

SEQ ID NO: 531827 - DNA, 25 bp, Mus musculus
gcaccctcaatttcatagcatcaga

SEQ ID NO: 531828 - DNA, 25 bp, Mus musculus
gcaccctcaggccttgtagtttaaa

SEQ ID NO: 531829 - DNA, 25 bp, Mus musculus
gcaccctcaggcgttgtagtttaaa

SEQ ID NO: 531830 - DNA, 25 bp, Mus musculus
gcaccctcataactaatgctgtgaa

SEQ ID NO: 531831 - DNA, 25 bp, Mus musculus
gcaccctcataagtaatgctgtgaa

SEQ ID NO: 531832 - DNA, 25 bp, Mus musculus
gcaccctccagtatccaggaagtta

SEQ ID NO: 531833 - DNA, 25 bp, Mus musculus
gcaccctccagtttccaggaagtta

SEQ ID NO: 531834 - DNA, 25 bp, Mus musculus
gcaccctctcacagaaaggccatga

SEQ ID NO: 531835 - DNA, 25 bp, Mus musculus
gcaccctctcactgaaaggccatga

SEQ ID NO: 531836 - DNA, 25 bp, Mus musculus
gcaccctgaggtctaaaccgttaat

SEQ ID NO: 531837 - DNA, 25 bp, Mus musculus
gcaccctgaggtgtaaaccgttaat

SEQ ID NO: 531838 - DNA, 25 bp, Mus musculus
gcaccctgataaatggtttccctga

SEQ ID NO: 531839 - DNA, 25 bp, Mus musculus
gcaccctgataattggtttccctga

SEQ ID NO: 531840 - DNA, 25 bp, Mus musculus
gcaccctgatatctcggtcacaagg

SEQ ID NO: 531841 - DNA, 25 bp, Mus musculus
gcaccctgatatgtcggtcacaagg

SEQ ID NO: 531842 - DNA, 25 bp, Mus musculus
gcaccctgatgcagattcactgtat

SEQ ID NO: 531843 - DNA, 25 bp, Mus musculus
gcaccctgatgctgattcactgtat

SEQ ID NO: 531844 - DNA, 25 bp, Mus musculus
gcaccctgccagctttggttacatg

SEQ ID NO: 531845 - DNA, 25 bp, Mus musculus
gcaccctgccaggtttggttacatg

SEQ ID NO: 531846 - DNA, 25 bp, Mus musculus
gcaccctgcgtaacactgtggagga

SEQ ID NO: 531847 - DNA, 25 bp, Mus musculus
gcaccctgcgtatcactgtggagga

SEQ ID NO: 531848 - DNA, 25 bp, Mus musculus
gcaccctggccccaaggtagagagt

SEQ ID NO: 531849 - DNA, 25 bp, Mus musculus
gcaccctggcccgaaggtagagagt

SEQ ID NO: 531850 - DNA, 25 bp, Mus musculus
gcaccctgtagacttcttttaccta

SEQ ID NO: 531851 - DNA, 25 bp, Mus musculus
gcaccctgtagagttcttttaccta

SEQ ID NO: 531852 - DNA, 25 bp, Mus musculus
gcaccctgtgaaatcttcattctga

SEQ ID NO: 531853 - DNA, 25 bp, Mus musculus
gcaccctgtgaattcttcattctga

SEQ ID NO: 531854 - DNA, 25 bp, Mus musculus
gcacccttagggacagcggcatatt

SEQ ID NO: 531855 - DNA, 25 bp, Mus musculus
gcacccttagggtcagcggcatatt

SEQ ID NO: 531856 - DNA, 25 bp, Mus musculus
gcacccttcaggcttaactgtctta

SEQ ID NO: 531857 - DNA, 25 bp, Mus musculus
gcacccttcagggttaactgtctta

SEQ ID NO: 531858 - DNA, 25 bp, Mus musculus
gcacccttccttatggtaataagag

SEQ ID NO: 531859 - DNA, 25 bp, Mus musculus
gcacccttccttttggtaataagag

SEQ ID NO: 531860 - DNA, 25 bp, Mus musculus
gcacccttctttaatctgtctgaaa

SEQ ID NO: 531861 - DNA, 25 bp, Mus musculus
gcacccttcttttatctgtctgaaa

SEQ ID NO: 531862 - DNA, 25 bp, Mus musculus
gcacccttgggcatgatgttctttt

SEQ ID NO: 531863 - DNA, 25 bp, Mus musculus
gcacccttgggcttgatgttctttt

SEQ ID NO: 531864 - DNA, 25 bp, Mus musculus
gcacccttgtcaaactcaggataca

SEQ ID NO: 531865 - DNA, 25 bp, Mus musculus
gcacccttgtcatactcaggataca

SEQ ID NO: 531866 - DNA, 25 bp, Mus musculus
gcaccctttgctatggtttacagac

SEQ ID NO: 531867 - DNA, 25 bp, Mus musculus
gcaccctttgctttggtttacagac

SEQ ID NO: 531868 - DNA, 25 bp, Mus musculus
gcacccttttgcaaggaagggtcca

SEQ ID NO: 531869 - DNA, 25 bp, Mus musculus
gcacccttttgctaggaagggtcca

SEQ ID NO: 531870 - DNA, 25 bp, Mus musculus
gcaccgacgatgactccgagcagga

SEQ ID NO: 531871 - DNA, 25 bp, Mus musculus
gcaccgacgatgtctccgagcagga

SEQ ID NO: 531872 - DNA, 25 bp, Mus musculus
gcaccgacggacaatttctcttttt

SEQ ID NO: 531873 - DNA, 25 bp, Mus musculus
gcaccgacggactatttctcttttt

SEQ ID NO: 531874 - DNA, 25 bp, Mus musculus
gcaccgactgcaattcaaggttttc

SEQ ID NO: 531875 - DNA, 25 bp, Mus musculus
gcaccgactgcatttcaaggttttc

SEQ ID NO: 531876 - DNA, 25 bp, Mus musculus
gcaccgagaataacatcttcatggg

SEQ ID NO: 531877 - DNA, 25 bp, Mus musculus
gcaccgagaatatcatcttcatggg

SEQ ID NO: 531878 - DNA, 25 bp, Mus musculus
gcaccgagaggtatgtgtcaagccc

SEQ ID NO: 531879 - DNA, 25 bp, Mus musculus
gcaccgagaggtttgtgtcaagccc

SEQ ID NO: 531880 - DNA, 25 bp, Mus musculus
gcaccgagattccaggtgactctgt

SEQ ID NO: 531881 - DNA, 25 bp, Mus musculus
gcaccgagattcgaggtgactctgt

SEQ ID NO: 531882 - DNA, 25 bp, Mus musculus
gcaccgagcattaactaggagccat

SEQ ID NO: 531883 - DNA, 25 bp, Mus musculus
gcaccgagcattagctactgaagga

SEQ ID NO: 531884 - DNA, 25 bp, Mus musculus
gcaccgagcatttactaggagccat

SEQ ID NO: 531885 - DNA, 25 bp, Mus musculus
gcaccgagcatttgctactgaagga

SEQ ID NO: 531886 - DNA, 25 bp, Mus musculus
gcaccgagccccacaaatgtatgaa

SEQ ID NO: 531887 - DNA, 25 bp, Mus musculus
gcaccgagcccctcaaatgtatgaa

SEQ ID NO: 531888 - DNA, 25 bp, Mus musculus
gcaccgaggttcaggctaggagtac

SEQ ID NO: 531889 - DNA, 25 bp, Mus musculus
gcaccgaggttctggctaggagtac

SEQ ID NO: 531890 - DNA, 25 bp, Mus musculus
gcaccgagtcctcaagatccatgaa

SEQ ID NO: 531891 - DNA, 25 bp, Mus musculus
gcaccgagtcctgaagatccatgaa

SEQ ID NO: 531892 - DNA, 25 bp, Mus musculus
gcaccgatgtgcatttttcattcag

SEQ ID NO: 531893 - DNA, 25 bp, Mus musculus
gcaccgatgtgcttttttcattcag

SEQ ID NO: 531894 - DNA, 25 bp, Mus musculus
gcaccgattactctcaaggttattt

SEQ ID NO: 531895 - DNA, 25 bp, Mus musculus
gcaccgattactgtcaaggttattt

SEQ ID NO: 531896 - DNA, 25 bp, Mus musculus
gcaccgattcttaatccctgtgttg

SEQ ID NO: 531897 - DNA, 25 bp, Mus musculus
gcaccgattcttcaggtatgagcca

SEQ ID NO: 531898 - DNA, 25 bp, Mus musculus
gcaccgattcttgaggtatgagcca

SEQ ID NO: 531899 - DNA, 25 bp, Mus musculus
gcaccgattctttatccctgtgttg

SEQ ID NO: 531900 - DNA, 25 bp, Mus musculus
gcaccgattggtcagcaaaagcttc

SEQ ID NO: 531901 - DNA, 25 bp, Mus musculus
gcaccgattggtgagcaaaagcttc

SEQ ID NO: 531902 - DNA, 25 bp, Mus musculus
gcaccgcaatcgaaggcttgtgttt

SEQ ID NO: 531903 - DNA, 25 bp, Mus musculus
gcaccgcaatcgtaggcttgtgttt

SEQ ID NO: 531904 - DNA, 25 bp, Mus musculus
gcaccgcacctgaacattatacatt

SEQ ID NO: 531905 - DNA, 25 bp, Mus musculus
gcaccgcacctgtacattatacatt

SEQ ID NO: 531906 - DNA, 25 bp, Mus musculus
gcaccgcatcggctgcattgtggtg

SEQ ID NO: 531907 - DNA, 25 bp, Mus musculus
gcaccgcatcgggtgcattgtggtg

SEQ ID NO: 531908 - DNA, 25 bp, Mus musculus
gcaccgcgccggaggtactttgaag

SEQ ID NO: 531909 - DNA, 25 bp, Mus musculus
gcaccgcgccggtggtactttgaag

SEQ ID NO: 531910 - DNA, 25 bp, Mus musculus
gcaccgctcgcactattttgagggt

SEQ ID NO: 531911 - DNA, 25 bp, Mus musculus
gcaccgctcgcagtattttgagggt

SEQ ID NO: 531912 - DNA, 25 bp, Mus musculus
gcaccgctcggcagatgtagatctt

SEQ ID NO: 531913 - DNA, 25 bp, Mus musculus
gcaccgctcggctgatgtagatctt

SEQ ID NO: 531914 - DNA, 25 bp, Mus musculus
gcaccgctgggccatatactcatgc

SEQ ID NO: 531915 - DNA, 25 bp, Mus musculus
gcaccgctgggcgatatactcatgc

SEQ ID NO: 531916 - DNA, 25 bp, Mus musculus
gcaccgctgtggctatgatggacca

SEQ ID NO: 531917 - DNA, 25 bp, Mus musculus
gcaccgctgtgggtatgatggacca

SEQ ID NO: 531918 - DNA, 25 bp, Mus musculus
gcaccgcttttgagggaggatagct

SEQ ID NO: 531919 - DNA, 25 bp, Mus musculus
gcaccgcttttgtgggaggatagct

SEQ ID NO: 531920 - DNA, 25 bp, Mus musculus
gcaccggaagagacgcgcccttgag

SEQ ID NO: 531921 - DNA, 25 bp, Mus musculus
gcaccggaagagtcgcgcccttgag

SEQ ID NO: 531922 - DNA, 25 bp, Mus musculus
gcaccggaccaaactcaaggaccta

SEQ ID NO: 531923 - DNA, 25 bp, Mus musculus
gcaccggaccaatctcaaggaccta

SEQ ID NO: 531924 - DNA, 25 bp, Mus musculus
gcaccggagcagcaaaacttcgtca

SEQ ID NO: 531925 - DNA, 25 bp, Mus musculus
gcaccggagcaggaaaacttcgtca

SEQ ID NO: 531926 - DNA, 25 bp, Mus musculus
gcaccggcagatacaccagcattaa

SEQ ID NO: 531927 - DNA, 25 bp, Mus musculus
gcaccggcagattcaccagcattaa

SEQ ID NO: 531928 - DNA, 25 bp, Mus musculus
gcaccggcatgacggagcgctacca

SEQ ID NO: 531929 - DNA, 25 bp, Mus musculus
gcaccggcatgagggagcgctacca

SEQ ID NO: 531930 - DNA, 25 bp, Mus musculus
gcaccggcattaagtgacttcctga

SEQ ID NO: 531931 - DNA, 25 bp, Mus musculus
gcaccggcattatgtgacttcctga

SEQ ID NO: 531932 - DNA, 25 bp, Mus musculus
gcaccggcgccgatttcataaacgg

SEQ ID NO: 531933 - DNA, 25 bp, Mus musculus
gcaccggcgccgttttcataaacgg

SEQ ID NO: 531934 - DNA, 25 bp, Mus musculus
gcaccggctggcactaaagaacatt

SEQ ID NO: 531935 - DNA, 25 bp, Mus musculus
gcaccggctggctctaaagaacatt

SEQ ID NO: 531936 - DNA, 25 bp, Mus musculus
gcaccggctttcaacggcagggagc

SEQ ID NO: 531937 - DNA, 25 bp, Mus musculus
gcaccggctttctacggcagggagc

SEQ ID NO: 531938 - DNA, 25 bp, Mus musculus
gcaccgggaatcaatgcctggacat

SEQ ID NO: 531939 - DNA, 25 bp, Mus musculus
gcaccgggaatctatgcctggacat

SEQ ID NO: 531940 - DNA, 25 bp, Mus musculus
gcaccgggcactcactgtctgtttt

SEQ ID NO: 531941 - DNA, 25 bp, Mus musculus
gcaccgggcactgactgtctgtttt

SEQ ID NO: 531942 - DNA, 25 bp, Mus musculus
gcaccgggcagcactactttggtga

SEQ ID NO: 531943 - DNA, 25 bp, Mus musculus
gcaccgggcagctctactttggtga

SEQ ID NO: 531944 - DNA, 25 bp, Mus musculus
gcaccgggccacagatgggcaatgt

SEQ ID NO: 531945 - DNA, 25 bp, Mus musculus
gcaccgggccactgatgggcaatgt

SEQ ID NO: 531946 - DNA, 25 bp, Mus musculus
gcaccgggtctaactgatttcatca

SEQ ID NO: 531947 - DNA, 25 bp, Mus musculus
gcaccgggtctatctgatttcatca

SEQ ID NO: 531948 - DNA, 25 bp, Mus musculus
gcaccgggttccagcggaaaggcac

SEQ ID NO: 531949 - DNA, 25 bp, Mus musculus
gcaccgggttcctgcggaaaggcac

SEQ ID NO: 531950 - DNA, 25 bp, Mus musculus
gcaccggtccatattgagacagcac

SEQ ID NO: 531951 - DNA, 25 bp, Mus musculus
gcaccggtccattttgagacagcac

SEQ ID NO: 531952 - DNA, 25 bp, Mus musculus
gcaccggtctcaccacaaggttata

SEQ ID NO: 531953 - DNA, 25 bp, Mus musculus
gcaccggtctcagcacaaggttata

SEQ ID NO: 531954 - DNA, 25 bp, Mus musculus
gcaccgtaacgtacctgaaccagat

SEQ ID NO: 531955 - DNA, 25 bp, Mus musculus
gcaccgtaacgttcctgaaccagat

SEQ ID NO: 531956 - DNA, 25 bp, Mus musculus
gcaccgtactgaagtatgccactgg

SEQ ID NO: 531957 - DNA, 25 bp, Mus musculus
gcaccgtactgatgtatgccactgg

SEQ ID NO: 531958 - DNA, 25 bp, Mus musculus
gcaccgtcttgcaggacacacagat

SEQ ID NO: 531959 - DNA, 25 bp, Mus musculus
gcaccgtcttgctggacacacagat

SEQ ID NO: 531960 - DNA, 25 bp, Mus musculus
gcaccgtgaaggactggacatgcta

SEQ ID NO: 531961 - DNA, 25 bp, Mus musculus
gcaccgtgaaggtctggacatgcta

SEQ ID NO: 531962 - DNA, 25 bp, Mus musculus
gcaccgtgcttcagctgcgacgagg

SEQ ID NO: 531963 - DNA, 25 bp, Mus musculus
gcaccgtgcttctgctgcgacgagg

SEQ ID NO: 531964 - DNA, 25 bp, Mus musculus
gcaccgtgtgcgaggagccatttcc

SEQ ID NO: 531965 - DNA, 25 bp, Mus musculus
gcaccgtgtgcgtggagccatttcc

SEQ ID NO: 531966 - DNA, 25 bp, Mus musculus
gcaccgtgttcgaactgaagcgcat

SEQ ID NO: 531967 - DNA, 25 bp, Mus musculus
gcaccgtgttcgtactgaagcgcat

SEQ ID NO: 531968 - DNA, 25 bp, Mus musculus
gcaccgttgcttctttttggtctga

SEQ ID NO: 531969 - DNA, 25 bp, Mus musculus
gcaccgttgcttgtttttggtctga

SEQ ID NO: 531970 - DNA, 25 bp, Mus musculus
gcaccgttgtatctggcataaatct

SEQ ID NO: 531971 - DNA, 25 bp, Mus musculus
gcaccgttgtatgtggcataaatct

SEQ ID NO: 531972 - DNA, 25 bp, Mus musculus
gcaccgttgtgcctgacacagtgta

SEQ ID NO: 531973 - DNA, 25 bp, Mus musculus
gcaccgttgtgcgtgacacagtgta

SEQ ID NO: 531974 - DNA, 25 bp, Mus musculus
gcacctaaaccactataactcttac

SEQ ID NO: 531975 - DNA, 25 bp, Mus musculus
gcacctaaaccagtataactcttac

SEQ ID NO: 531976 - DNA, 25 bp, Mus musculus
gcacctaagatgcgccgacgaacct

SEQ ID NO: 531977 - DNA, 25 bp, Mus musculus
gcacctaagatgggccgacgaacct

SEQ ID NO: 531978 - DNA, 25 bp, Mus musculus
gcacctaaggagaggagaccagact

SEQ ID NO: 531979 - DNA, 25 bp, Mus musculus
gcacctaaggagtggagaccagact

SEQ ID NO: 531980 - DNA, 25 bp, Mus musculus
gcacctaatatgcatctcacacctg

SEQ ID NO: 531981 - DNA, 25 bp, Mus musculus
gcacctaatatggatctcacacctg

SEQ ID NO: 531982 - DNA, 25 bp, Mus musculus
gcacctaccagtagtgcgcttgcaa

SEQ ID NO: 531983 - DNA, 25 bp, Mus musculus
gcacctaccagttgtgcgcttgcaa

SEQ ID NO: 531984 - DNA, 25 bp, Mus musculus
gcacctaccataacttcctttttat

SEQ ID NO: 531985 - DNA, 25 bp, Mus musculus
gcacctaccatatcttcctttttat

SEQ ID NO: 531986 - DNA, 25 bp, Mus musculus
gcacctacccttagaaccatataac

SEQ ID NO: 531987 - DNA, 25 bp, Mus musculus
gcacctaccctttgaaccatataac

SEQ ID NO: 531988 - DNA, 25 bp, Mus musculus
gcacctaccgaaagccatatagact

SEQ ID NO: 531989 - DNA, 25 bp, Mus musculus
gcacctaccgaatgccatatagact

SEQ ID NO: 531990 - DNA, 25 bp, Mus musculus
gcacctacctaaaagtgtatgcaga

SEQ ID NO: 531991 - DNA, 25 bp, Mus musculus
gcacctacctaatagtgtatgcaga

SEQ ID NO: 531992 - DNA, 25 bp, Mus musculus
gcacctactaggcatcatctacaga

SEQ ID NO: 531993 - DNA, 25 bp, Mus musculus
gcacctactagggatcatctacaga

SEQ ID NO: 531994 - DNA, 25 bp, Mus musculus
gcacctactatcactacttcagaaa

SEQ ID NO: 531995 - DNA, 25 bp, Mus musculus
gcacctactatctctacttcagaaa

SEQ ID NO: 531996 - DNA, 25 bp, Mus musculus
gcacctactattcttgaatattgaa

SEQ ID NO: 531997 - DNA, 25 bp, Mus musculus
gcacctactattgttgaatattgaa

SEQ ID NO: 531998 - DNA, 25 bp, Mus musculus
gcacctactctaagtttcttcagat

SEQ ID NO: 531999 - DNA, 25 bp, Mus musculus
gcacctactctatgtttcttcagat

SEQ ID NO: 532000 - DNA, 25 bp, Mus musculus
gcacctactggcagggatcggagat

SEQ ID NO: 532001 - DNA, 25 bp, Mus musculus
gcacctactggctgggatcggagat

SEQ ID NO: 532002 - DNA, 25 bp, Mus musculus
gcacctactgtacccatactgacat

SEQ ID NO: 532003 - DNA, 25 bp, Mus musculus
gcacctactgtagccatactgacat

SEQ ID NO: 532004 - DNA, 25 bp, Mus musculus
gcacctagaagtaccagcattcact

SEQ ID NO: 532005 - DNA, 25 bp, Mus musculus
gcacctagaagttccagcattcact

SEQ ID NO: 532006 - DNA, 25 bp, Mus musculus
gcacctaggcttctctgcacacaga

SEQ ID NO: 532007 - DNA, 25 bp, Mus musculus
gcacctaggcttgtctgcacacaga

SEQ ID NO: 532008 - DNA, 25 bp, Mus musculus
gcacctaggtgcagcatgtttctga

SEQ ID NO: 532009 - DNA, 25 bp, Mus musculus
gcacctaggtgctgcatgtttctga

SEQ ID NO: 532010 - DNA, 25 bp, Mus musculus
gcacctagtgcccagaagggttcag

SEQ ID NO: 532011 - DNA, 25 bp, Mus musculus
gcacctagtgccgagaagggttcag

SEQ ID NO: 532012 - DNA, 25 bp, Mus musculus
gcacctagttgtcttgatttctacc

SEQ ID NO: 532013 - DNA, 25 bp, Mus musculus
gcacctagttgtgttgatttctacc

SEQ ID NO: 532014 - DNA, 25 bp, Mus musculus
gcacctatagatcgcattcgctcat

SEQ ID NO: 532015 - DNA, 25 bp, Mus musculus
gcacctatagatggcattcgctcat

SEQ ID NO: 532016 - DNA, 25 bp, Mus musculus
gcacctatagctcccaaagttgggt

SEQ ID NO: 532017 - DNA, 25 bp, Mus musculus
gcacctatagctgccaaagttgggt

SEQ ID NO: 532018 - DNA, 25 bp, Mus musculus
gcacctatcagactgcttactcaga

SEQ ID NO: 532019 - DNA, 25 bp, Mus musculus
gcacctatcagagtgcttactcaga

SEQ ID NO: 532020 - DNA, 25 bp, Mus musculus
gcacctatcggccataacagagact

SEQ ID NO: 532021 - DNA, 25 bp, Mus musculus
gcacctatcggcgataacagagact

SEQ ID NO: 532022 - DNA, 25 bp, Mus musculus
gcacctatgattaatacctaactga

SEQ ID NO: 532023 - DNA, 25 bp, Mus musculus
gcacctatgattccatctccatggt

SEQ ID NO: 532024 - DNA, 25 bp, Mus musculus
gcacctatgattgcatctccatggt

SEQ ID NO: 532025 - DNA, 25 bp, Mus musculus
gcacctatgatttatacctaactga

SEQ ID NO: 532026 - DNA, 25 bp, Mus musculus
gcacctatgcgcagtgtttctgaga

SEQ ID NO: 532027 - DNA, 25 bp, Mus musculus
gcacctatgcgctgtgtttctgaga

SEQ ID NO: 532028 - DNA, 25 bp, Mus musculus
gcacctatgggacacagattggctg

SEQ ID NO: 532029 - DNA, 25 bp, Mus musculus
gcacctatgggagacagattggctg

SEQ ID NO: 532030 - DNA, 25 bp, Mus musculus
gcacctatgggtctcagtattacct

SEQ ID NO: 532031 - DNA, 25 bp, Mus musculus
gcacctatgggtgtcagtattacct

SEQ ID NO: 532032 - DNA, 25 bp, Mus musculus
gcacctattttcctaaccctgaaag

SEQ ID NO: 532033 - DNA, 25 bp, Mus musculus
gcacctattttcgtaaccctgaaag

SEQ ID NO: 532034 - DNA, 25 bp, Mus musculus
gcacctcaaaaaacgggtcagcagt

SEQ ID NO: 532035 - DNA, 25 bp, Mus musculus
gcacctcaaaaatcgggtcagcagt

SEQ ID NO: 532036 - DNA, 25 bp, Mus musculus
gcacctcaaaatccactctgacttg

SEQ ID NO: 532037 - DNA, 25 bp, Mus musculus
gcacctcaaaatgcactctgacttg

SEQ ID NO: 532038 - DNA, 25 bp, Mus musculus
gcacctcacctgaatagtcgttctg

SEQ ID NO: 532039 - DNA, 25 bp, Mus musculus
gcacctcacctgtatagtcgttctg

SEQ ID NO: 532040 - DNA, 25 bp, Mus musculus
gcacctcacttacttgacttagtca

SEQ ID NO: 532041 - DNA, 25 bp, Mus musculus
gcacctcacttagttgacttagtca

SEQ ID NO: 532042 - DNA, 25 bp, Mus musculus
gcacctcagagaaagcaatagcttg

SEQ ID NO: 532043 - DNA, 25 bp, Mus musculus
gcacctcagagacaactgggccagg

SEQ ID NO: 532044 - DNA, 25 bp, Mus musculus
gcacctcagagagaactgggccagg

SEQ ID NO: 532045 - DNA, 25 bp, Mus musculus
gcacctcagagatagcaatagcttg

SEQ ID NO: 532046 - DNA, 25 bp, Mus musculus
gcacctcagagcctttgcagattag

SEQ ID NO: 532047 - DNA, 25 bp, Mus musculus
gcacctcagagcgtttgcagattag

SEQ ID NO: 532048 - DNA, 25 bp, Mus musculus
gcacctcagcagctaacagaaggga

SEQ ID NO: 532049 - DNA, 25 bp, Mus musculus
gcacctcagcaggtaacagaaggga

SEQ ID NO: 532050 - DNA, 25 bp, Mus musculus
gcacctcagtttcccgagaagtctg

SEQ ID NO: 532051 - DNA, 25 bp, Mus musculus
gcacctcagtttgccgagaagtctg

SEQ ID NO: 532052 - DNA, 25 bp, Mus musculus
gcacctcatcagaagttggtgactc

SEQ ID NO: 532053 - DNA, 25 bp, Mus musculus
gcacctcatcagtagttggtgactc

SEQ ID NO: 532054 - DNA, 25 bp, Mus musculus
gcacctcatcatcatatgcttagaa

SEQ ID NO: 532055 - DNA, 25 bp, Mus musculus
gcacctcatcatgatatgcttagaa

SEQ ID NO: 532056 - DNA, 25 bp, Mus musculus
gcacctcattatcgcctttccatct

SEQ ID NO: 532057 - DNA, 25 bp, Mus musculus
gcacctcattatggcctttccatct

SEQ ID NO: 532058 - DNA, 25 bp, Mus musculus
gcacctccacctacaatagaagaga

SEQ ID NO: 532059 - DNA, 25 bp, Mus musculus
gcacctccaccttcaatagaagaga

SEQ ID NO: 532060 - DNA, 25 bp, Mus musculus
gcacctccacttacagggatccagt

SEQ ID NO: 532061 - DNA, 25 bp, Mus musculus
gcacctccactttcagggatccagt

SEQ ID NO: 532062 - DNA, 25 bp, Mus musculus
gcacctccccgaactggatgatgag

SEQ ID NO: 532063 - DNA, 25 bp, Mus musculus
gcacctccccgatctggatgatgag

SEQ ID NO: 532064 - DNA, 25 bp, Mus musculus
gcacctccctcgagttaagttgaaa

SEQ ID NO: 532065 - DNA, 25 bp, Mus musculus
gcacctccctcgtgttaagttgaaa

SEQ ID NO: 532066 - DNA, 25 bp, Mus musculus
gcacctccgcttctaagaggctcta

SEQ ID NO: 532067 - DNA, 25 bp, Mus musculus
gcacctccgcttgtaagaggctcta

SEQ ID NO: 532068 - DNA, 25 bp, Mus musculus
gcacctcctaatcgcaactttgcag

SEQ ID NO: 532069 - DNA, 25 bp, Mus musculus
gcacctcctaatggcaactttgcag

SEQ ID NO: 532070 - DNA, 25 bp, Mus musculus
gcacctcctaccatcagttctagtg

SEQ ID NO: 532071 - DNA, 25 bp, Mus musculus
gcacctcctaccttcagttctagtg

SEQ ID NO: 532072 - DNA, 25 bp, Mus musculus
gcacctcctgagctgaattgtctgt

SEQ ID NO: 532073 - DNA, 25 bp, Mus musculus
gcacctcctgaggtgaattgtctgt

SEQ ID NO: 532074 - DNA, 25 bp, Mus musculus
gcacctccttggatgaccccagaaa

SEQ ID NO: 532075 - DNA, 25 bp, Mus musculus
gcacctccttggttgaccccagaaa

SEQ ID NO: 532076 - DNA, 25 bp, Mus musculus
gcacctcgacagacctaggagatct

SEQ ID NO: 532077 - DNA, 25 bp, Mus musculus
gcacctcgacagtcctaggagatct

SEQ ID NO: 532078 - DNA, 25 bp, Mus musculus
gcacctcggaatattgcagaagcaa

SEQ ID NO: 532079 - DNA, 25 bp, Mus musculus
gcacctcggaattttgcagaagcaa

SEQ ID NO: 532080 - DNA, 25 bp, Mus musculus
gcacctcggatgaaggtctctctag

SEQ ID NO: 532081 - DNA, 25 bp, Mus musculus
gcacctcggatgtaggtctctctag

SEQ ID NO: 532082 - DNA, 25 bp, Mus musculus
gcacctcgtgcccagtcagaagagg

SEQ ID NO: 532083 - DNA, 25 bp, Mus musculus
gcacctcgtgccgagtcagaagagg

SEQ ID NO: 532084 - DNA, 25 bp, Mus musculus
gcacctctcgttatttaccacattt

SEQ ID NO: 532085 - DNA, 25 bp, Mus musculus
gcacctctcgttttttaccacattt

SEQ ID NO: 532086 - DNA, 25 bp, Mus musculus
gcacctctcttgacactcaaaagaa

SEQ ID NO: 532087 - DNA, 25 bp, Mus musculus
gcacctctcttgtcactcaaaagaa

SEQ ID NO: 532088 - DNA, 25 bp, Mus musculus
gcacctctgaccatgttggaactgt

SEQ ID NO: 532089 - DNA, 25 bp, Mus musculus
gcacctctgaccttgttggaactgt

SEQ ID NO: 532090 - DNA, 25 bp, Mus musculus
gcacctctgcttacaagaaaggaag

SEQ ID NO: 532091 - DNA, 25 bp, Mus musculus
gcacctctgctttcaagaaaggaag

SEQ ID NO: 532092 - DNA, 25 bp, Mus musculus
gcacctctggagcactcaagagaag

SEQ ID NO: 532093 - DNA, 25 bp, Mus musculus
gcacctctggaggactcaagagaag

SEQ ID NO: 532094 - DNA, 25 bp, Mus musculus
gcacctctggcaaactcacactttg

SEQ ID NO: 532095 - DNA, 25 bp, Mus musculus
gcacctctggcatactcacactttg

SEQ ID NO: 532096 - DNA, 25 bp, Mus musculus
gcacctctgggtcatgatcgtactg

SEQ ID NO: 532097 - DNA, 25 bp, Mus musculus
gcacctctgggtgatgatcgtactg

SEQ ID NO: 532098 - DNA, 25 bp, Mus musculus
gcacctctgtaacctatttcttaaa

SEQ ID NO: 532099 - DNA, 25 bp, Mus musculus
gcacctctgtaagctatttcttaaa

SEQ ID NO: 532100 - DNA, 25 bp, Mus musculus
gcacctcttactcgaactgaagcca

SEQ ID NO: 532101 - DNA, 25 bp, Mus musculus
gcacctcttactggaactgaagcca

SEQ ID NO: 532102 - DNA, 25 bp, Mus musculus
gcacctcttcagaatgggctttcga

SEQ ID NO: 532103 - DNA, 25 bp, Mus musculus
gcacctcttcagtatgggctttcga

SEQ ID NO: 532104 - DNA, 25 bp, Mus musculus
gcacctctttggatgcagtgcagaa

SEQ ID NO: 532105 - DNA, 25 bp, Mus musculus
gcacctctttggttgcagtgcagaa

SEQ ID NO: 532106 - DNA, 25 bp, Mus musculus
gcacctgaaaacagccctgggagtt

SEQ ID NO: 532107 - DNA, 25 bp, Mus musculus
gcacctgaaaactgccctgggagtt

SEQ ID NO: 532108 - DNA, 25 bp, Mus musculus
gcacctgaaagacagtgcactccct

SEQ ID NO: 532109 - DNA, 25 bp, Mus musculus
gcacctgaaagagagtgcactccct

SEQ ID NO: 532110 - DNA, 25 bp, Mus musculus
gcacctgaaccaaaacctggagcta

SEQ ID NO: 532111 - DNA, 25 bp, Mus musculus
gcacctgaaccataacctggagcta

SEQ ID NO: 532112 - DNA, 25 bp, Mus musculus
gcacctgaacttagattttacatga

SEQ ID NO: 532113 - DNA, 25 bp, Mus musculus
gcacctgaactttgattttacatga

SEQ ID NO: 532114 - DNA, 25 bp, Mus musculus
gcacctgacaggctaagactgaagt

SEQ ID NO: 532115 - DNA, 25 bp, Mus musculus
gcacctgacagggtaagactgaagt

SEQ ID NO: 532116 - DNA, 25 bp, Mus musculus
gcacctgactagatgcctgcatagg

SEQ ID NO: 532117 - DNA, 25 bp, Mus musculus
gcacctgactagttgcctgcatagg

SEQ ID NO: 532118 - DNA, 25 bp, Mus musculus
gcacctgactgaacatcggagtact

SEQ ID NO: 532119 - DNA, 25 bp, Mus musculus
gcacctgactgatcatcggagtact

SEQ ID NO: 532120 - DNA, 25 bp, Mus musculus
gcacctgacttcctctgacactagg

SEQ ID NO: 532121 - DNA, 25 bp, Mus musculus
gcacctgacttcgtctgacactagg

SEQ ID NO: 532122 - DNA, 25 bp, Mus musculus
gcacctgagaacaaagttgtgactt

SEQ ID NO: 532123 - DNA, 25 bp, Mus musculus
gcacctgagaactaagttgtgactt

SEQ ID NO: 532124 - DNA, 25 bp, Mus musculus
gcacctgaggacagagaccttcgtg

SEQ ID NO: 532125 - DNA, 25 bp, Mus musculus
gcacctgaggactgagaccttcgtg

SEQ ID NO: 532126 - DNA, 25 bp, Mus musculus
gcacctgaggcaacaatgtattctg

SEQ ID NO: 532127 - DNA, 25 bp, Mus musculus
gcacctgaggcatcaatgtattctg

SEQ ID NO: 532128 - DNA, 25 bp, Mus musculus
gcacctgaggctaatgtgggacgat

SEQ ID NO: 532129 - DNA, 25 bp, Mus musculus
gcacctgaggctctaggcttagttt

SEQ ID NO: 532130 - DNA, 25 bp, Mus musculus
gcacctgaggctgtaggcttagttt

SEQ ID NO: 532131 - DNA, 25 bp, Mus musculus
gcacctgaggcttatgtgggacgat

SEQ ID NO: 532132 - DNA, 25 bp, Mus musculus
gcacctgatcctccaacagttaaaa

SEQ ID NO: 532133 - DNA, 25 bp, Mus musculus
gcacctgatcctgcaacagttaaaa

SEQ ID NO: 532134 - DNA, 25 bp, Mus musculus
gcacctgatgggattgcctttttaa

SEQ ID NO: 532135 - DNA, 25 bp, Mus musculus
gcacctgatgggtttgcctttttaa

SEQ ID NO: 532136 - DNA, 25 bp, Mus musculus
gcacctgattttaatccttgagtct

SEQ ID NO: 532137 - DNA, 25 bp, Mus musculus
gcacctgatttttatccttgagtct

SEQ ID NO: 532138 - DNA, 25 bp, Mus musculus
gcacctgcacggaaacagagccata

SEQ ID NO: 532139 - DNA, 25 bp, Mus musculus
gcacctgcacggtaacagagccata

SEQ ID NO: 532140 - DNA, 25 bp, Mus musculus
gcacctgcagataccatgcatgtgt

SEQ ID NO: 532141 - DNA, 25 bp, Mus musculus
gcacctgcagattccatgcatgtgt

SEQ ID NO: 532142 - DNA, 25 bp, Mus musculus
gcacctgcaggactgaaatacatat

SEQ ID NO: 532143 - DNA, 25 bp, Mus musculus
gcacctgcaggagtgaaatacatat

SEQ ID NO: 532144 - DNA, 25 bp, Mus musculus
gcacctgcctgaattggcattcgaa

SEQ ID NO: 532145 - DNA, 25 bp, Mus musculus
gcacctgcctgatttggcattcgaa

SEQ ID NO: 532146 - DNA, 25 bp, Mus musculus
gcacctgcgcatcgtcatcgagaat

SEQ ID NO: 532147 - DNA, 25 bp, Mus musculus
gcacctgcgcatggtcatcgagaat

SEQ ID NO: 532148 - DNA, 25 bp, Mus musculus
gcacctgcggacactttgtgttcaa

SEQ ID NO: 532149 - DNA, 25 bp, Mus musculus
gcacctgcggactctttgtgttcaa

SEQ ID NO: 532150 - DNA, 25 bp, Mus musculus
gcacctgcggagattgcttctgttt

SEQ ID NO: 532151 - DNA, 25 bp, Mus musculus
gcacctgcggagtttgcttctgttt

SEQ ID NO: 532152 - DNA, 25 bp, Mus musculus
gcacctgctaaaaggttttgtgtat

SEQ ID NO: 532153 - DNA, 25 bp, Mus musculus
gcacctgctaaatggttttgtgtat

SEQ ID NO: 532154 - DNA, 25 bp, Mus musculus
gcacctgctaatactctaaaccttg

SEQ ID NO: 532155 - DNA, 25 bp, Mus musculus
gcacctgctaattctctaaaccttg

SEQ ID NO: 532156 - DNA, 25 bp, Mus musculus
gcacctgctattcaccatgctagcg

SEQ ID NO: 532157 - DNA, 25 bp, Mus musculus
gcacctgctattgaccatgctagcg

SEQ ID NO: 532158 - DNA, 25 bp, Mus musculus
gcacctgctcaaactttttgcacaa

SEQ ID NO: 532159 - DNA, 25 bp, Mus musculus
gcacctgctcaatctttttgcacaa

SEQ ID NO: 532160 - DNA, 25 bp, Mus musculus
gcacctgctcggacaaatgcaagtg

SEQ ID NO: 532161 - DNA, 25 bp, Mus musculus
gcacctgctcggtcaaatgcaagtg

SEQ ID NO: 532162 - DNA, 25 bp, Mus musculus
gcacctgctgctcgacgaagtagta

SEQ ID NO: 532163 - DNA, 25 bp, Mus musculus
gcacctgctgctggacgaagtagta

SEQ ID NO: 532164 - DNA, 25 bp, Mus musculus
gcacctgctgtcatagcttaggcta

SEQ ID NO: 532165 - DNA, 25 bp, Mus musculus
gcacctgctgtcttagcttaggcta

SEQ ID NO: 532166 - DNA, 25 bp, Mus musculus
gcacctgctttgagtagtgtaacat

SEQ ID NO: 532167 - DNA, 25 bp, Mus musculus
gcacctgctttgtgtagtgtaacat

SEQ ID NO: 532168 - DNA, 25 bp, Mus musculus
gcacctggacctacatggtttattt

SEQ ID NO: 532169 - DNA, 25 bp, Mus musculus
gcacctggaccttcatggtttattt

SEQ ID NO: 532170 - DNA, 25 bp, Mus musculus
gcacctggagtacccaggaaggcct

SEQ ID NO: 532171 - DNA, 25 bp, Mus musculus
gcacctggagtagccaggaaggcct

SEQ ID NO: 532172 - DNA, 25 bp, Mus musculus
gcacctggattgctcagctaagcca

SEQ ID NO: 532173 - DNA, 25 bp, Mus musculus
gcacctggattggtcagctaagcca

SEQ ID NO: 532174 - DNA, 25 bp, Mus musculus
gcacctggcttgactggagtggttt

SEQ ID NO: 532175 - DNA, 25 bp, Mus musculus
gcacctggcttgtctggagtggttt

SEQ ID NO: 532176 - DNA, 25 bp, Mus musculus
gcacctgggtacaggggcactgtta

SEQ ID NO: 532177 - DNA, 25 bp, Mus musculus
gcacctgggtactggggcactgtta

SEQ ID NO: 532178 - DNA, 25 bp, Mus musculus
gcacctggtagcagatgatgcacac

SEQ ID NO: 532179 - DNA, 25 bp, Mus musculus
gcacctggtagctgatgatgcacac

SEQ ID NO: 532180 - DNA, 25 bp, Mus musculus
gcacctggtatgaaaatgtctgcca

SEQ ID NO: 532181 - DNA, 25 bp, Mus musculus
gcacctggtatgtaaatgtctgcca

SEQ ID NO: 532182 - DNA, 25 bp, Mus musculus
gcacctggtgatacagcctccagat

SEQ ID NO: 532183 - DNA, 25 bp, Mus musculus
gcacctggtgattcagcctccagat

SEQ ID NO: 532184 - DNA, 25 bp, Mus musculus
gcacctggttacaattcctggagaa

SEQ ID NO: 532185 - DNA, 25 bp, Mus musculus
gcacctggttactattcctggagaa

SEQ ID NO: 532186 - DNA, 25 bp, Mus musculus
gcacctgtacaaacacaattgattt

SEQ ID NO: 532187 - DNA, 25 bp, Mus musculus
gcacctgtacaatcacaattgattt

SEQ ID NO: 532188 - DNA, 25 bp, Mus musculus
gcacctgtagttctgtttattggtc

SEQ ID NO: 532189 - DNA, 25 bp, Mus musculus
gcacctgtagttgtgtttattggtc

SEQ ID NO: 532190 - DNA, 25 bp, Mus musculus
gcacctgtatggaagagggcctgcc

SEQ ID NO: 532191 - DNA, 25 bp, Mus musculus
gcacctgtatggtagagggcctgcc

SEQ ID NO: 532192 - DNA, 25 bp, Mus musculus
gcacctgtcagtcctgcacattaga

SEQ ID NO: 532193 - DNA, 25 bp, Mus musculus
gcacctgtcagtgctgcacattaga

SEQ ID NO: 532194 - DNA, 25 bp, Mus musculus
gcacctgtcatcaatccagtggttt

SEQ ID NO: 532195 - DNA, 25 bp, Mus musculus
gcacctgtcatctatccagtggttt

SEQ ID NO: 532196 - DNA, 25 bp, Mus musculus
gcacctgtccaccaatttgctggga

SEQ ID NO: 532197 - DNA, 25 bp, Mus musculus
gcacctgtccacgaatttgctggga

SEQ ID NO: 532198 - DNA, 25 bp, Mus musculus
gcacctgtcctacccggtggagact

SEQ ID NO: 532199 - DNA, 25 bp, Mus musculus
gcacctgtcctagccggtggagact

SEQ ID NO: 532200 - DNA, 25 bp, Mus musculus
gcacctgtctacacccaagttaaga

SEQ ID NO: 532201 - DNA, 25 bp, Mus musculus
gcacctgtctactcccaagttaaga

SEQ ID NO: 532202 - DNA, 25 bp, Mus musculus
gcacctgtgactcaaccttggagaa

SEQ ID NO: 532203 - DNA, 25 bp, Mus musculus
gcacctgtgactcttgcagcctggt

SEQ ID NO: 532204 - DNA, 25 bp, Mus musculus
gcacctgtgactgaaccttggagaa

SEQ ID NO: 532205 - DNA, 25 bp, Mus musculus
gcacctgtgactgttgcagcctggt

SEQ ID NO: 532206 - DNA, 25 bp, Mus musculus
gcacctgtgcagccctacctgcaca

SEQ ID NO: 532207 - DNA, 25 bp, Mus musculus
gcacctgtgcaggcctacctgcaca

SEQ ID NO: 532208 - DNA, 25 bp, Mus musculus
gcacctgtgctacatgcctgagcat

SEQ ID NO: 532209 - DNA, 25 bp, Mus musculus
gcacctgtgctacgtattcatggca

SEQ ID NO: 532210 - DNA, 25 bp, Mus musculus
gcacctgtgctagatgcctgagcat

SEQ ID NO: 532211 - DNA, 25 bp, Mus musculus
gcacctgtgctaggtattcatggca

SEQ ID NO: 532212 - DNA, 25 bp, Mus musculus
gcacctgtggaaactgtctcagcat

SEQ ID NO: 532213 - DNA, 25 bp, Mus musculus
gcacctgtggaatctgtctcagcat

SEQ ID NO: 532214 - DNA, 25 bp, Mus musculus
gcacctgtgttaaatcacacccatc

SEQ ID NO: 532215 - DNA, 25 bp, Mus musculus
gcacctgtgttatatcacacccatc

SEQ ID NO: 532216 - DNA, 25 bp, Mus musculus
gcacctgtgtttaaggattgtcctt

SEQ ID NO: 532217 - DNA, 25 bp, Mus musculus
gcacctgtgttttaggattgtcctt

SEQ ID NO: 532218 - DNA, 25 bp, Mus musculus
gcacctgttgggattctgtactggc

SEQ ID NO: 532219 - DNA, 25 bp, Mus musculus
gcacctgttgggtttctgtactggc

SEQ ID NO: 532220 - DNA, 25 bp, Mus musculus
gcacctgttgtacctaaattgggca

SEQ ID NO: 532221 - DNA, 25 bp, Mus musculus
gcacctgttgtagctaaattgggca

SEQ ID NO: 532222 - DNA, 25 bp, Mus musculus
gcacctgtttgcataccttatagag

SEQ ID NO: 532223 - DNA, 25 bp, Mus musculus
gcacctgtttgcttaccttatagag

SEQ ID NO: 532224 - DNA, 25 bp, Mus musculus
gcaccttaatctcgctgctcgttat

SEQ ID NO: 532225 - DNA, 25 bp, Mus musculus
gcaccttaatctggctgctcgttat

SEQ ID NO: 532226 - DNA, 25 bp, Mus musculus
gcaccttaattcagcaggatcttat

SEQ ID NO: 532227 - DNA, 25 bp, Mus musculus
gcaccttaattctgcaggatcttat

SEQ ID NO: 532228 - DNA, 25 bp, Mus musculus
gcaccttagcaacctgaggaacagt

SEQ ID NO: 532229 - DNA, 25 bp, Mus musculus
gcaccttagcaagctgaggaacagt

SEQ ID NO: 532230 - DNA, 25 bp, Mus musculus
gcaccttagcccatgatagctgaca

SEQ ID NO: 532231 - DNA, 25 bp, Mus musculus
gcaccttagcccttgatagctgaca

SEQ ID NO: 532232 - DNA, 25 bp, Mus musculus
gcaccttaggtcacattatgggcat

SEQ ID NO: 532233 - DNA, 25 bp, Mus musculus
gcaccttaggtctcattatgggcat

SEQ ID NO: 532234 - DNA, 25 bp, Mus musculus
gcaccttatgctacttgcactgtga

SEQ ID NO: 532235 - DNA, 25 bp, Mus musculus
gcaccttatgcttcttgcactgtga

SEQ ID NO: 532236 - DNA, 25 bp, Mus musculus
gcaccttcagctacaaatacatcat

SEQ ID NO: 532237 - DNA, 25 bp, Mus musculus
gcaccttcagcttcaaatacatcat

SEQ ID NO: 532238 - DNA, 25 bp, Mus musculus
gcaccttccactcatgtgtttctta

SEQ ID NO: 532239 - DNA, 25 bp, Mus musculus
gcaccttccactgatgtgtttctta

SEQ ID NO: 532240 - DNA, 25 bp, Mus musculus
gcaccttctatcaacaaaaattttt

SEQ ID NO: 532241 - DNA, 25 bp, Mus musculus
gcaccttctatctacaaaaattttt

SEQ ID NO: 532242 - DNA, 25 bp, Mus musculus
gcaccttctgacatcatgggagcag

SEQ ID NO: 532243 - DNA, 25 bp, Mus musculus
gcaccttctgacttcatgggagcag

SEQ ID NO: 532244 - DNA, 25 bp, Mus musculus
gcaccttgatgcattgaaagagacc

SEQ ID NO: 532245 - DNA, 25 bp, Mus musculus
gcaccttgatgctttgaaagagacc

SEQ ID NO: 532246 - DNA, 25 bp, Mus musculus
gcaccttgatttaaggtttgctgca

SEQ ID NO: 532247 - DNA, 25 bp, Mus musculus
gcaccttgattttaggtttgctgca

SEQ ID NO: 532248 - DNA, 25 bp, Mus musculus
gcaccttgcacaatgaaccaacctg

SEQ ID NO: 532249 - DNA, 25 bp, Mus musculus
gcaccttgcacattgaaccaacctg

SEQ ID NO: 532250 - DNA, 25 bp, Mus musculus
gcaccttgcacgaacacatgcattg

SEQ ID NO: 532251 - DNA, 25 bp, Mus musculus
gcaccttgcacgtacacatgcattg

SEQ ID NO: 532252 - DNA, 25 bp, Mus musculus
gcaccttggagaccactggacaaaa

SEQ ID NO: 532253 - DNA, 25 bp, Mus musculus
gcaccttggagagcactggacaaaa

SEQ ID NO: 532254 - DNA, 25 bp, Mus musculus
gcaccttggtgtcgagttaaaagta

SEQ ID NO: 532255 - DNA, 25 bp, Mus musculus
gcaccttggtgtggagttaaaagta

SEQ ID NO: 532256 - DNA, 25 bp, Mus musculus
gcaccttgtagtaagtttccttaga

SEQ ID NO: 532257 - DNA, 25 bp, Mus musculus
gcaccttgtagttagtttccttaga

SEQ ID NO: 532258 - DNA, 25 bp, Mus musculus
gcaccttgtatcatatattttggga

SEQ ID NO: 532259 - DNA, 25 bp, Mus musculus
gcaccttgtatcttatattttggga

SEQ ID NO: 532260 - DNA, 25 bp, Mus musculus
gcaccttgtattacaatatgacctg

SEQ ID NO: 532261 - DNA, 25 bp, Mus musculus
gcaccttgtatttcaatatgacctg

SEQ ID NO: 532262 - DNA, 25 bp, Mus musculus
gcacctttagaactcacagcttgac

SEQ ID NO: 532263 - DNA, 25 bp, Mus musculus
gcacctttagaactcagcagctgga

SEQ ID NO: 532264 - DNA, 25 bp, Mus musculus
gcacctttagaagtcacagcttgac

SEQ ID NO: 532265 - DNA, 25 bp, Mus musculus
gcacctttagaagtcagcagctgga

SEQ ID NO: 532266 - DNA, 25 bp, Mus musculus
gcacctttagctcctttgacaatga

SEQ ID NO: 532267 - DNA, 25 bp, Mus musculus
gcacctttagctgctttgacaatga

SEQ ID NO: 532268 - DNA, 25 bp, Mus musculus
gcacctttcactatctgctgtgtta

SEQ ID NO: 532269 - DNA, 25 bp, Mus musculus
gcacctttcactttctgctgtgtta

SEQ ID NO: 532270 - DNA, 25 bp, Mus musculus
gcacctttcagaagtctgtatctga

SEQ ID NO: 532271 - DNA, 25 bp, Mus musculus
gcacctttcagatgtctgtatctga

SEQ ID NO: 532272 - DNA, 25 bp, Mus musculus
gcacctttcatacctgggttttaag

SEQ ID NO: 532273 - DNA, 25 bp, Mus musculus
gcacctttcatagctgggttttaag

SEQ ID NO: 532274 - DNA, 25 bp, Mus musculus
gcacctttcttgaccttgctgaaat

SEQ ID NO: 532275 - DNA, 25 bp, Mus musculus
gcacctttcttgtccttgctgaaat

SEQ ID NO: 532276 - DNA, 25 bp, Mus musculus
gcacctttgacaaactaagccactg

SEQ ID NO: 532277 - DNA, 25 bp, Mus musculus
gcacctttgacatactaagccactg

SEQ ID NO: 532278 - DNA, 25 bp, Mus musculus
gcacctttgcaaacacatgggcttt

SEQ ID NO: 532279 - DNA, 25 bp, Mus musculus
gcacctttgcaatcacatgggcttt

SEQ ID NO: 532280 - DNA, 25 bp, Mus musculus
gcacctttggaacctgtttctgttc

SEQ ID NO: 532281 - DNA, 25 bp, Mus musculus
gcacctttggaagctgtttctgttc

SEQ ID NO: 532282 - DNA, 25 bp, Mus musculus
gcacctttgtggctttgagagatta

SEQ ID NO: 532283 - DNA, 25 bp, Mus musculus
gcacctttgtgggtttgagagatta

SEQ ID NO: 532284 - DNA, 25 bp, Mus musculus
gcacctttgtgtcaagccccacttg

SEQ ID NO: 532285 - DNA, 25 bp, Mus musculus
gcacctttgtgtctattcagctcaa

SEQ ID NO: 532286 - DNA, 25 bp, Mus musculus
gcacctttgtgtgaagccccacttg

SEQ ID NO: 532287 - DNA, 25 bp, Mus musculus
gcacctttgtgtgtattcagctcaa

SEQ ID NO: 532288 - DNA, 25 bp, Mus musculus
gcaccttttcccaaggattggtcaa

SEQ ID NO: 532289 - DNA, 25 bp, Mus musculus
gcaccttttccctaggattggtcaa

SEQ ID NO: 532290 - DNA, 25 bp, Mus musculus
gcacctttttctaatcatcatagct

SEQ ID NO: 532291 - DNA, 25 bp, Mus musculus
gcacctttttcttatcatcatagct

SEQ ID NO: 532292 - DNA, 25 bp, Mus musculus
gcacgaacactcctaataccatttg

SEQ ID NO: 532293 - DNA, 25 bp, Mus musculus
gcacgaacactcgtaataccatttg

SEQ ID NO: 532294 - DNA, 25 bp, Mus musculus
gcacgaacgaggaggacacctggat

SEQ ID NO: 532295 - DNA, 25 bp, Mus musculus
gcacgaacgaggtggacacctggat

SEQ ID NO: 532296 - DNA, 25 bp, Mus musculus
gcacgaagttccacagtgttgactt

SEQ ID NO: 532297 - DNA, 25 bp, Mus musculus
gcacgaagttcctcagtgttgactt

SEQ ID NO: 532298 - DNA, 25 bp, Mus musculus
gcacgacacaaacacattatgggat

SEQ ID NO: 532299 - DNA, 25 bp, Mus musculus
gcacgacacaaagacattatgggat

SEQ ID NO: 532300 - DNA, 25 bp, Mus musculus
gcacgaccttgcacggtggctgctt

SEQ ID NO: 532301 - DNA, 25 bp, Mus musculus
gcacgaccttgctcggtggctgctt

SEQ ID NO: 532302 - DNA, 25 bp, Mus musculus
gcacgacgaggaataacctctccag

SEQ ID NO: 532303 - DNA, 25 bp, Mus musculus
gcacgacgaggattaacctctccag

SEQ ID NO: 532304 - DNA, 25 bp, Mus musculus
gcacgactgttaatagaagccactt

SEQ ID NO: 532305 - DNA, 25 bp, Mus musculus
gcacgactgttattagaagccactt

SEQ ID NO: 532306 - DNA, 25 bp, Mus musculus
gcacgacttcatcttgagttccata

SEQ ID NO: 532307 - DNA, 25 bp, Mus musculus
gcacgacttcatgttgagttccata

SEQ ID NO: 532308 - DNA, 25 bp, Mus musculus
gcacgagaagatccacaccactgga

SEQ ID NO: 532309 - DNA, 25 bp, Mus musculus
gcacgagaagatgcacaccactgga

SEQ ID NO: 532310 - DNA, 25 bp, Mus musculus
gcacgagacatacagctgccagcag

SEQ ID NO: 532311 - DNA, 25 bp, Mus musculus
gcacgagacatagagctgccagcag

SEQ ID NO: 532312 - DNA, 25 bp, Mus musculus
gcacgagactgcattgttgacatct

SEQ ID NO: 532313 - DNA, 25 bp, Mus musculus
gcacgagactgctttgttgacatct

SEQ ID NO: 532314 - DNA, 25 bp, Mus musculus
gcacgagagcatcgacttatcttca

SEQ ID NO: 532315 - DNA, 25 bp, Mus musculus
gcacgagagcatggacttatcttca

SEQ ID NO: 532316 - DNA, 25 bp, Mus musculus
gcacgagagtagataccaaggactc

SEQ ID NO: 532317 - DNA, 25 bp, Mus musculus
gcacgagagtagttaccaaggactc

SEQ ID NO: 532318 - DNA, 25 bp, Mus musculus
gcacgagcacgtacagagtcttacc

SEQ ID NO: 532319 - DNA, 25 bp, Mus musculus
gcacgagcacgttcagagtcttacc

SEQ ID NO: 532320 - DNA, 25 bp, Mus musculus
gcacgagccgccacagctggacggt

SEQ ID NO: 532321 - DNA, 25 bp, Mus musculus
gcacgagccgcctcagctggacggt

SEQ ID NO: 532322 - DNA, 25 bp, Mus musculus
gcacgagctcgtctcgcgagattcc

SEQ ID NO: 532323 - DNA, 25 bp, Mus musculus
gcacgagctcgtgtcgcgagattcc

SEQ ID NO: 532324 - DNA, 25 bp, Mus musculus
gcacgagctgccctataggctttga

SEQ ID NO: 532325 - DNA, 25 bp, Mus musculus
gcacgagctgccgtataggctttga

SEQ ID NO: 532326 - DNA, 25 bp, Mus musculus
gcacgaggacacagcgcctgagtaa

SEQ ID NO: 532327 - DNA, 25 bp, Mus musculus
gcacgaggacactgcgcctgagtaa

SEQ ID NO: 532328 - DNA, 25 bp, Mus musculus
gcacgaggagagcacagccatctag

SEQ ID NO: 532329 - DNA, 25 bp, Mus musculus
gcacgaggagaggacagccatctag

SEQ ID NO: 532330 - DNA, 25 bp, Mus musculus
gcacgaggccttacttggtaatttg

SEQ ID NO: 532331 - DNA, 25 bp, Mus musculus
gcacgaggcctttcttggtaatttg

SEQ ID NO: 532332 - DNA, 25 bp, Mus musculus
gcacgaggcgttagagaagtccaca

SEQ ID NO: 532333 - DNA, 25 bp, Mus musculus
gcacgaggcgtttgagaagtccaca

SEQ ID NO: 532334 - DNA, 25 bp, Mus musculus
gcacgagttaaaacccttccaggcg

SEQ ID NO: 532335 - DNA, 25 bp, Mus musculus
gcacgagttaaatcccttccaggcg

SEQ ID NO: 532336 - DNA, 25 bp, Mus musculus
gcacgagttacacaggttggcccag

SEQ ID NO: 532337 - DNA, 25 bp, Mus musculus
gcacgagttacagaggttggcccag

SEQ ID NO: 532338 - DNA, 25 bp, Mus musculus
gcacgagttcgccagaactttggca

SEQ ID NO: 532339 - DNA, 25 bp, Mus musculus
gcacgagttcgcgagaactttggca

SEQ ID NO: 532340 - DNA, 25 bp, Mus musculus
gcacgatacatacaatgtaaccaag

SEQ ID NO: 532341 - DNA, 25 bp, Mus musculus
gcacgatacatagaatgtaaccaag

SEQ ID NO: 532342 - DNA, 25 bp, Mus musculus
gcacgatcctttacaattttacctt

SEQ ID NO: 532343 - DNA, 25 bp, Mus musculus
gcacgatccttttcaattttacctt

SEQ ID NO: 532344 - DNA, 25 bp, Mus musculus
gcacgatgatatccttaactcattt

SEQ ID NO: 532345 - DNA, 25 bp, Mus musculus
gcacgatgatatgcttaactcattt

SEQ ID NO: 532346 - DNA, 25 bp, Mus musculus
gcacgatgcccgcagttactgtaaa

SEQ ID NO: 532347 - DNA, 25 bp, Mus musculus
gcacgatgcccggagttactgtaaa

SEQ ID NO: 532348 - DNA, 25 bp, Mus musculus
gcacgatgctggaactgctcaatca

SEQ ID NO: 532349 - DNA, 25 bp, Mus musculus
gcacgatgctggtactgctcaatca

SEQ ID NO: 532350 - DNA, 25 bp, Mus musculus
gcacgatggaatagtgttttgcatt

SEQ ID NO: 532351 - DNA, 25 bp, Mus musculus
gcacgatggaattgtgttttgcatt

SEQ ID NO: 532352 - DNA, 25 bp, Mus musculus
gcacgatggtgcatgttaaggatca

SEQ ID NO: 532353 - DNA, 25 bp, Mus musculus
gcacgatggtgcttgttaaggatca

SEQ ID NO: 532354 - DNA, 25 bp, Mus musculus
gcacgattagctcctctggatattc

SEQ ID NO: 532355 - DNA, 25 bp, Mus musculus
gcacgattagctgctctggatattc

SEQ ID NO: 532356 - DNA, 25 bp, Mus musculus
gcacgattctaaccacggtctcagt

SEQ ID NO: 532357 - DNA, 25 bp, Mus musculus
gcacgattctaagcacggtctcagt

SEQ ID NO: 532358 - DNA, 25 bp, Mus musculus
gcacgattgaagaggctaccggctt

SEQ ID NO: 532359 - DNA, 25 bp, Mus musculus
gcacgattgaagtggctaccggctt

SEQ ID NO: 532360 - DNA, 25 bp, Mus musculus
gcacgatttataacagcctccaata

SEQ ID NO: 532361 - DNA, 25 bp, Mus musculus
gcacgatttatatcagcctccaata

SEQ ID NO: 532362 - DNA, 25 bp, Mus musculus
gcacgatttcatattctgccaatgg

SEQ ID NO: 532363 - DNA, 25 bp, Mus musculus
gcacgatttcattttctgccaatgg

SEQ ID NO: 532364 - DNA, 25 bp, Mus musculus
gcacgcaagcatactatgttgttca

SEQ ID NO: 532365 - DNA, 25 bp, Mus musculus
gcacgcaagcattctatgttgttca

SEQ ID NO: 532366 - DNA, 25 bp, Mus musculus
gcacgcacacatcaggattagcagt

SEQ ID NO: 532367 - DNA, 25 bp, Mus musculus
gcacgcacacatgaggattagcagt

SEQ ID NO: 532368 - DNA, 25 bp, Mus musculus
gcacgcacacgaagcacaggatggt

SEQ ID NO: 532369 - DNA, 25 bp, Mus musculus
gcacgcacacgatgcacaggatggt

SEQ ID NO: 532370 - DNA, 25 bp, Mus musculus
gcacgcacacggaggagaagctgca

SEQ ID NO: 532371 - DNA, 25 bp, Mus musculus
gcacgcacacggtggagaagctgca

SEQ ID NO: 532372 - DNA, 25 bp, Mus musculus
gcacgcaccaggacgcgcacgaatt

SEQ ID NO: 532373 - DNA, 25 bp, Mus musculus
gcacgcaccaggtcgcgcacgaatt

SEQ ID NO: 532374 - DNA, 25 bp, Mus musculus
gcacgcacgatcagcggcgccgaga

SEQ ID NO: 532375 - DNA, 25 bp, Mus musculus
gcacgcacgatctgcggcgccgaga

SEQ ID NO: 532376 - DNA, 25 bp, Mus musculus
gcacgcacgtagagaggttccacga

SEQ ID NO: 532377 - DNA, 25 bp, Mus musculus
gcacgcacgtagtgaggttccacga

SEQ ID NO: 532378 - DNA, 25 bp, Mus musculus
gcacgcagagttccaattcctcttg

SEQ ID NO: 532379 - DNA, 25 bp, Mus musculus
gcacgcagagttgcaattcctcttg

SEQ ID NO: 532380 - DNA, 25 bp, Mus musculus
gcacgcaggctgagagcatctgata

SEQ ID NO: 532381 - DNA, 25 bp, Mus musculus
gcacgcaggctgtgagcatctgata

SEQ ID NO: 532382 - DNA, 25 bp, Mus musculus
gcacgcagggcaagcagctggccag

SEQ ID NO: 532383 - DNA, 25 bp, Mus musculus
gcacgcagggcatgcagctggccag

SEQ ID NO: 532384 - DNA, 25 bp, Mus musculus
gcacgcatacgcaagtgtgcatatg

SEQ ID NO: 532385 - DNA, 25 bp, Mus musculus
gcacgcatacgctagtgtgcatatg

SEQ ID NO: 532386 - DNA, 25 bp, Mus musculus
gcacgcatcttgcaggaccggatgt

SEQ ID NO: 532387 - DNA, 25 bp, Mus musculus
gcacgcatcttggaggaccggatgt

SEQ ID NO: 532388 - DNA, 25 bp, Mus musculus
gcacgccaaagcagacagtattagg

SEQ ID NO: 532389 - DNA, 25 bp, Mus musculus
gcacgccaaagctgacagtattagg

SEQ ID NO: 532390 - DNA, 25 bp, Mus musculus
gcacgccaagcaaccgcctcacatg

SEQ ID NO: 532391 - DNA, 25 bp, Mus musculus
gcacgccaagcatccgcctcacatg

SEQ ID NO: 532392 - DNA, 25 bp, Mus musculus
gcacgccactcacgcatacattgaa

SEQ ID NO: 532393 - DNA, 25 bp, Mus musculus
gcacgccactcaggcatacattgaa

SEQ ID NO: 532394 - DNA, 25 bp, Mus musculus
gcacgcccgaatctctttttgagat

SEQ ID NO: 532395 - DNA, 25 bp, Mus musculus
gcacgcccgaatgtctttttgagat

SEQ ID NO: 532396 - DNA, 25 bp, Mus musculus
gcacgccctcaaattgctgggacaa

SEQ ID NO: 532397 - DNA, 25 bp, Mus musculus
gcacgccctcaatttgctgggacaa

SEQ ID NO: 532398 - DNA, 25 bp, Mus musculus
gcacgcctactgcttcaggataagc

SEQ ID NO: 532399 - DNA, 25 bp, Mus musculus
gcacgcctactggttcaggataagc

SEQ ID NO: 532400 - DNA, 25 bp, Mus musculus
gcacgcctcctaattggatgctggg

SEQ ID NO: 532401 - DNA, 25 bp, Mus musculus
gcacgcctcctatttggatgctggg

SEQ ID NO: 532402 - DNA, 25 bp, Mus musculus
gcacgcctctctatgagttacagga

SEQ ID NO: 532403 - DNA, 25 bp, Mus musculus
gcacgcctctctttgagttacagga

SEQ ID NO: 532404 - DNA, 25 bp, Mus musculus
gcacgcctgggcacctggtagacaa

SEQ ID NO: 532405 - DNA, 25 bp, Mus musculus
gcacgcctgggctcctggtagacaa

SEQ ID NO: 532406 - DNA, 25 bp, Mus musculus
gcacgccttgacagctgcggaagat

SEQ ID NO: 532407 - DNA, 25 bp, Mus musculus
gcacgccttgactgctgcggaagat

SEQ ID NO: 532408 - DNA, 25 bp, Mus musculus
gcacgcctttgtcagaagcctttaa

SEQ ID NO: 532409 - DNA, 25 bp, Mus musculus
gcacgcctttgtgagaagcctttaa

SEQ ID NO: 532410 - DNA, 25 bp, Mus musculus
gcacgcgcagagaccttatccagga

SEQ ID NO: 532411 - DNA, 25 bp, Mus musculus
gcacgcgcagagtccttatccagga

SEQ ID NO: 532412 - DNA, 25 bp, Mus musculus
gcacgcgtgatgacagtacacgttc

SEQ ID NO: 532413 - DNA, 25 bp, Mus musculus
gcacgcgtgatgtcagtacacgttc

SEQ ID NO: 532414 - DNA, 25 bp, Mus musculus
gcacgcgtgtgcatgtgttgctaga

SEQ ID NO: 532415 - DNA, 25 bp, Mus musculus
gcacgcgtgtgcttgtgttgctaga

SEQ ID NO: 532416 - DNA, 25 bp, Mus musculus
gcacgctaccagattcggtagagta

SEQ ID NO: 532417 - DNA, 25 bp, Mus musculus
gcacgctaccagtttcggtagagta

SEQ ID NO: 532418 - DNA, 25 bp, Mus musculus
gcacgctacctgaatgttgctgtgg

SEQ ID NO: 532419 - DNA, 25 bp, Mus musculus
gcacgctacctgtatgttgctgtgg

SEQ ID NO: 532420 - DNA, 25 bp, Mus musculus
gcacgctattggattcgaatgcact

SEQ ID NO: 532421 - DNA, 25 bp, Mus musculus
gcacgctattggtttcgaatgcact

SEQ ID NO: 532422 - DNA, 25 bp, Mus musculus
gcacgctattttccctgagtggtgg

SEQ ID NO: 532423 - DNA, 25 bp, Mus musculus
gcacgctattttgcctgagtggtgg

SEQ ID NO: 532424 - DNA, 25 bp, Mus musculus
gcacgctcaacaaggaccgcggtga

SEQ ID NO: 532425 - DNA, 25 bp, Mus musculus
gcacgctcaacatggaccgcggtga

SEQ ID NO: 532426 - DNA, 25 bp, Mus musculus
gcacgctcacttactgtgtatacag

SEQ ID NO: 532427 - DNA, 25 bp, Mus musculus
gcacgctcactttctgtgtatacag

SEQ ID NO: 532428 - DNA, 25 bp, Mus musculus
gcacgctcagccaggacatgcgagg

SEQ ID NO: 532429 - DNA, 25 bp, Mus musculus
gcacgctcagcctggacatgcgagg

SEQ ID NO: 532430 - DNA, 25 bp, Mus musculus
gcacgctcccttcaaaggcagtaaa

SEQ ID NO: 532431 - DNA, 25 bp, Mus musculus
gcacgctcccttgaaaggcagtaaa

SEQ ID NO: 532432 - DNA, 25 bp, Mus musculus
gcacgctcgttcagggcatggtcat

SEQ ID NO: 532433 - DNA, 25 bp, Mus musculus
gcacgctcgttctgggcatggtcat

SEQ ID NO: 532434 - DNA, 25 bp, Mus musculus
gcacgctgagtacatggtcacccca

SEQ ID NO: 532435 - DNA, 25 bp, Mus musculus
gcacgctgagtagatggtcacccca

SEQ ID NO: 532436 - DNA, 25 bp, Mus musculus
gcacgctgctacaggaagggtaatt

SEQ ID NO: 532437 - DNA, 25 bp, Mus musculus
gcacgctgctactggaagggtaatt

SEQ ID NO: 532438 - DNA, 25 bp, Mus musculus
gcacgctggaggaacagatgctcag

SEQ ID NO: 532439 - DNA, 25 bp, Mus musculus
gcacgctggaggtacagatgctcag

SEQ ID NO: 532440 - DNA, 25 bp, Mus musculus
gcacgctggcgtatctcttggttgg

SEQ ID NO: 532441 - DNA, 25 bp, Mus musculus
gcacgctggcgtttctcttggttgg

SEQ ID NO: 532442 - DNA, 25 bp, Mus musculus
gcacgcttcatacagcctggctcag

SEQ ID NO: 532443 - DNA, 25 bp, Mus musculus
gcacgcttcatagagcctggctcag

SEQ ID NO: 532444 - DNA, 25 bp, Mus musculus
gcacgcttgactcctggcggaagat

SEQ ID NO: 532445 - DNA, 25 bp, Mus musculus
gcacgcttgactgctggcggaagat

SEQ ID NO: 532446 - DNA, 25 bp, Mus musculus
gcacggaagaggaactgatcagcaa

SEQ ID NO: 532447 - DNA, 25 bp, Mus musculus
gcacggaagaggtactgatcagcaa

SEQ ID NO: 532448 - DNA, 25 bp, Mus musculus
gcacggaagccgacataactttact

SEQ ID NO: 532449 - DNA, 25 bp, Mus musculus
gcacggaagccgtcataactttact

SEQ ID NO: 532450 - DNA, 25 bp, Mus musculus
gcacggaaggagagaatgacagctt

SEQ ID NO: 532451 - DNA, 25 bp, Mus musculus
gcacggaaggagtgaatgacagctt

SEQ ID NO: 532452 - DNA, 25 bp, Mus musculus
gcacggaatagcattttattccgct

SEQ ID NO: 532453 - DNA, 25 bp, Mus musculus
gcacggaatagctttttattccgct

SEQ ID NO: 532454 - DNA, 25 bp, Mus musculus
gcacggaatccacagggttcctcgt

SEQ ID NO: 532455 - DNA, 25 bp, Mus musculus
gcacggaatccagagggttcctcgt

SEQ ID NO: 532456 - DNA, 25 bp, Mus musculus
gcacggacacttactgtacttacga

SEQ ID NO: 532457 - DNA, 25 bp, Mus musculus
gcacggacactttctgtacttacga

SEQ ID NO: 532458 - DNA, 25 bp, Mus musculus
gcacggactcctataacaatgaact

SEQ ID NO: 532459 - DNA, 25 bp, Mus musculus
gcacggactcctttaacaatgaact

SEQ ID NO: 532460 - DNA, 25 bp, Mus musculus
gcacggactctaaggaactcagcta

SEQ ID NO: 532461 - DNA, 25 bp, Mus musculus
gcacggactctatggaactcagcta

SEQ ID NO: 532462 - DNA, 25 bp, Mus musculus
gcacggacttctccaaaacagctga

SEQ ID NO: 532463 - DNA, 25 bp, Mus musculus
gcacggacttctgcaaaacagctga

SEQ ID NO: 532464 - DNA, 25 bp, Mus musculus
gcacggagacaacagtccgcagtca

SEQ ID NO: 532465 - DNA, 25 bp, Mus musculus
gcacggagacaagagtccgcagtca

SEQ ID NO: 532466 - DNA, 25 bp, Mus musculus
gcacggagagtcatgttcaggcgct

SEQ ID NO: 532467 - DNA, 25 bp, Mus musculus
gcacggagagtcttgttcaggcgct

SEQ ID NO: 532468 - DNA, 25 bp, Mus musculus
gcacggagctcaaacatctgatgaa

SEQ ID NO: 532469 - DNA, 25 bp, Mus musculus
gcacggagctcatacatctgatgaa

SEQ ID NO: 532470 - DNA, 25 bp, Mus musculus
gcacggagctccagctaagggaagc

SEQ ID NO: 532471 - DNA, 25 bp, Mus musculus
gcacggagctcctgctaagggaagc

SEQ ID NO: 532472 - DNA, 25 bp, Mus musculus
gcacggagctcgcattcaacaagag

SEQ ID NO: 532473 - DNA, 25 bp, Mus musculus
gcacggagctcggattcaacaagag

SEQ ID NO: 532474 - DNA, 25 bp, Mus musculus
gcacggagtcttcatagtcgctgat

SEQ ID NO: 532475 - DNA, 25 bp, Mus musculus
gcacggagtcttgatagtcgctgat

SEQ ID NO: 532476 - DNA, 25 bp, Mus musculus
gcacggatacctacgtcaagctgga

SEQ ID NO: 532477 - DNA, 25 bp, Mus musculus
gcacggataccttcgtcaagctgga

SEQ ID NO: 532478 - DNA, 25 bp, Mus musculus
gcacggatagctatttattccagct

SEQ ID NO: 532479 - DNA, 25 bp, Mus musculus
gcacggatagctttttattccagct

SEQ ID NO: 532480 - DNA, 25 bp, Mus musculus
gcacggatgctaatcagcttggctg

SEQ ID NO: 532481 - DNA, 25 bp, Mus musculus
gcacggatgctattcagcttggctg

SEQ ID NO: 532482 - DNA, 25 bp, Mus musculus
gcacggatgggcacacatatgaaaa

SEQ ID NO: 532483 - DNA, 25 bp, Mus musculus
gcacggatgggctcacatatgaaaa

SEQ ID NO: 532484 - DNA, 25 bp, Mus musculus
gcacggatgttcatattgcattctg

SEQ ID NO: 532485 - DNA, 25 bp, Mus musculus
gcacggatgttcttattgcattctg

SEQ ID NO: 532486 - DNA, 25 bp, Mus musculus
gcacggcaaatgaacagtgaactgc

SEQ ID NO: 532487 - DNA, 25 bp, Mus musculus
gcacggcaaatgtacagtgaactgc

SEQ ID NO: 532488 - DNA, 25 bp, Mus musculus
gcacggcagcaaacatggtaaccat

SEQ ID NO: 532489 - DNA, 25 bp, Mus musculus
gcacggcagcaatcatggtaaccat

SEQ ID NO: 532490 - DNA, 25 bp, Mus musculus
gcacggcagcggcagtttttacaca

SEQ ID NO: 532491 - DNA, 25 bp, Mus musculus
gcacggcagcgggagtttttacaca

SEQ ID NO: 532492 - DNA, 25 bp, Mus musculus
gcacggcaggacagatcatcggtaa

SEQ ID NO: 532493 - DNA, 25 bp, Mus musculus
gcacggcaggactgatcatcggtaa

SEQ ID NO: 532494 - DNA, 25 bp, Mus musculus
gcacggcagggaattgtaccgctgt

SEQ ID NO: 532495 - DNA, 25 bp, Mus musculus
gcacggcagggatttgtaccgctgt

SEQ ID NO: 532496 - DNA, 25 bp, Mus musculus
gcacggcatgctatgcagggtgacc

SEQ ID NO: 532497 - DNA, 25 bp, Mus musculus
gcacggcatgctttgcagggtgacc

SEQ ID NO: 532498 - DNA, 25 bp, Mus musculus
gcacggccactgagaacaacttcaa

SEQ ID NO: 532499 - DNA, 25 bp, Mus musculus
gcacggccactgtgaacaacttcaa

SEQ ID NO: 532500 - DNA, 25 bp, Mus musculus
gcacggccctttcaggccttctatt

SEQ ID NO: 532501 - DNA, 25 bp, Mus musculus
gcacggccctttgaggccttctatt

SEQ ID NO: 532502 - DNA, 25 bp, Mus musculus
gcacggccgctgaacacagggaagt

SEQ ID NO: 532503 - DNA, 25 bp, Mus musculus
gcacggccgctgtacacagggaagt

SEQ ID NO: 532504 - DNA, 25 bp, Mus musculus
gcacggcctcagaattcacacaaaa

SEQ ID NO: 532505 - DNA, 25 bp, Mus musculus
gcacggcctcagtattcacacaaaa

SEQ ID NO: 532506 - DNA, 25 bp, Mus musculus
gcacggcggagcatctctatgagaa

SEQ ID NO: 532507 - DNA, 25 bp, Mus musculus
gcacggcggagcttctctatgagaa

SEQ ID NO: 532508 - DNA, 25 bp, Mus musculus
gcacggcgggtcaacgaggtctctc

SEQ ID NO: 532509 - DNA, 25 bp, Mus musculus
gcacggcgggtctacgaggtctctc

SEQ ID NO: 532510 - DNA, 25 bp, Mus musculus
gcacggctacatcatagtcttggta

SEQ ID NO: 532511 - DNA, 25 bp, Mus musculus
gcacggctacatgatagtcttggta

SEQ ID NO: 532512 - DNA, 25 bp, Mus musculus
gcacggctaccaagaagtctggcaa

SEQ ID NO: 532513 - DNA, 25 bp, Mus musculus
gcacggctaccatgaagtctggcaa

SEQ ID NO: 532514 - DNA, 25 bp, Mus musculus
gcacggctctgcaggcgttgaatat

SEQ ID NO: 532515 - DNA, 25 bp, Mus musculus
gcacggctctgctggcgttgaatat

SEQ ID NO: 532516 - DNA, 25 bp, Mus musculus
gcacggctgctgattggtcttctat

SEQ ID NO: 532517 - DNA, 25 bp, Mus musculus
gcacggctgctgtttggtcttctat

SEQ ID NO: 532518 - DNA, 25 bp, Mus musculus
gcacggctggctaatgtcgaggacc

SEQ ID NO: 532519 - DNA, 25 bp, Mus musculus
gcacggctggcttatgtcgaggacc

SEQ ID NO: 532520 - DNA, 25 bp, Mus musculus
gcacggcttacaagggtgtcacaaa

SEQ ID NO: 532521 - DNA, 25 bp, Mus musculus
gcacggcttacatgggtgtcacaaa

SEQ ID NO: 532522 - DNA, 25 bp, Mus musculus
gcacggcttagcagtctgtcttctg

SEQ ID NO: 532523 - DNA, 25 bp, Mus musculus
gcacggcttagctgtctgtcttctg

SEQ ID NO: 532524 - DNA, 25 bp, Mus musculus
gcacgggagctactactttgttttc

SEQ ID NO: 532525 - DNA, 25 bp, Mus musculus
gcacgggagctagtactttgttttc

SEQ ID NO: 532526 - DNA, 25 bp, Mus musculus
gcacgggatcatccttttccatgtg

SEQ ID NO: 532527 - DNA, 25 bp, Mus musculus
gcacgggatcatgcttttccatgtg

SEQ ID NO: 532528 - DNA, 25 bp, Mus musculus
gcacgggcacaccagactgaagctc

SEQ ID NO: 532529 - DNA, 25 bp, Mus musculus
gcacgggcacacgagactgaagctc

SEQ ID NO: 532530 - DNA, 25 bp, Mus musculus
gcacgggcatcaagcatttcttcac

SEQ ID NO: 532531 - DNA, 25 bp, Mus musculus
gcacgggcatcatgcatttcttcac

SEQ ID NO: 532532 - DNA, 25 bp, Mus musculus
gcacgggttgccaaagaagctaaaa

SEQ ID NO: 532533 - DNA, 25 bp, Mus musculus
gcacgggttgcctaagaagctaaaa

SEQ ID NO: 532534 - DNA, 25 bp, Mus musculus
gcacggtaaagacttactgcctttt

SEQ ID NO: 532535 - DNA, 25 bp, Mus musculus
gcacggtaaagagttactgcctttt

SEQ ID NO: 532536 - DNA, 25 bp, Mus musculus
gcacggtaccttaactttgtgtctt

SEQ ID NO: 532537 - DNA, 25 bp, Mus musculus
gcacggtacctttactttgtgtctt

SEQ ID NO: 532538 - DNA, 25 bp, Mus musculus
gcacggtagtgtaaggcttggttcc

SEQ ID NO: 532539 - DNA, 25 bp, Mus musculus
gcacggtagtgttaggcttggttcc

SEQ ID NO: 532540 - DNA, 25 bp, Mus musculus
gcacggtatgaactccagtctgtta

SEQ ID NO: 532541 - DNA, 25 bp, Mus musculus
gcacggtatgaagtccagtctgtta

SEQ ID NO: 532542 - DNA, 25 bp, Mus musculus
gcacggtcacatcatcacttcactt

SEQ ID NO: 532543 - DNA, 25 bp, Mus musculus
gcacggtcacatgatcacttcactt

SEQ ID NO: 532544 - DNA, 25 bp, Mus musculus
gcacggtgcctgcaaacaagctcta

SEQ ID NO: 532545 - DNA, 25 bp, Mus musculus
gcacggtgcctggaaacaagctcta

SEQ ID NO: 532546 - DNA, 25 bp, Mus musculus
gcacggtgctcccagtgaaattcgg

SEQ ID NO: 532547 - DNA, 25 bp, Mus musculus
gcacggtgctccgagtgaaattcgg

SEQ ID NO: 532548 - DNA, 25 bp, Mus musculus
gcacggtgggcaaccttatatccaa

SEQ ID NO: 532549 - DNA, 25 bp, Mus musculus
gcacggtgggcatccttatatccaa

SEQ ID NO: 532550 - DNA, 25 bp, Mus musculus
gcacggtgggttcccatgctacaga

SEQ ID NO: 532551 - DNA, 25 bp, Mus musculus
gcacggtgggttgccatgctacaga

SEQ ID NO: 532552 - DNA, 25 bp, Mus musculus
gcacggttccataacatcatgtcca

SEQ ID NO: 532553 - DNA, 25 bp, Mus musculus
gcacggttccattacatcatgtcca

SEQ ID NO: 532554 - DNA, 25 bp, Mus musculus
gcacggttgctcacgtcatgatgtg

SEQ ID NO: 532555 - DNA, 25 bp, Mus musculus
gcacggttgctctcgtcatgatgtg

SEQ ID NO: 532556 - DNA, 25 bp, Mus musculus
gcacggtttcgactttgcagtaaag

SEQ ID NO: 532557 - DNA, 25 bp, Mus musculus
gcacggtttcgagtttgcagtaaag

SEQ ID NO: 532558 - DNA, 25 bp, Mus musculus
gcacgtaagcacattacagagagag

SEQ ID NO: 532559 - DNA, 25 bp, Mus musculus
gcacgtaagcactttacagagagag

SEQ ID NO: 532560 - DNA, 25 bp, Mus musculus
gcacgtacacagagacaaacacata

SEQ ID NO: 532561 - DNA, 25 bp, Mus musculus
gcacgtacacagtgacaaacacata

SEQ ID NO: 532562 - DNA, 25 bp, Mus musculus
gcacgtatctgcactcaaacttggt

SEQ ID NO: 532563 - DNA, 25 bp, Mus musculus
gcacgtatctgctctcaaacttggt

SEQ ID NO: 532564 - DNA, 25 bp, Mus musculus
gcacgtcacagtagcatttgctgta

SEQ ID NO: 532565 - DNA, 25 bp, Mus musculus
gcacgtcacagttgcatttgctgta

SEQ ID NO: 532566 - DNA, 25 bp, Mus musculus
gcacgtcagaatctccagaacctat

SEQ ID NO: 532567 - DNA, 25 bp, Mus musculus
gcacgtcagaatgtccagaacctat

SEQ ID NO: 532568 - DNA, 25 bp, Mus musculus
gcacgtccatcgaggtgggtgtcaa

SEQ ID NO: 532569 - DNA, 25 bp, Mus musculus
gcacgtccatcgtggtgggtgtcaa

SEQ ID NO: 532570 - DNA, 25 bp, Mus musculus
gcacgtccatctattaagtcaggca

SEQ ID NO: 532571 - DNA, 25 bp, Mus musculus
gcacgtccatcttttaagtcaggca

SEQ ID NO: 532572 - DNA, 25 bp, Mus musculus
gcacgtcgatgaagctcgcattcaa

SEQ ID NO: 532573 - DNA, 25 bp, Mus musculus
gcacgtcgatgatgctcgcattcaa

SEQ ID NO: 532574 - DNA, 25 bp, Mus musculus
gcacgtctaagcaaggtcacccgaa

SEQ ID NO: 532575 - DNA, 25 bp, Mus musculus
gcacgtctaagctaggtcacccgaa

SEQ ID NO: 532576 - DNA, 25 bp, Mus musculus
gcacgtctcattataatcaggcttt

SEQ ID NO: 532577 - DNA, 25 bp, Mus musculus
gcacgtctcattttaatcaggcttt

SEQ ID NO: 532578 - DNA, 25 bp, Mus musculus
gcacgtctctcacttggttcagtcc

SEQ ID NO: 532579 - DNA, 25 bp, Mus musculus
gcacgtctctcagttggttcagtcc

SEQ ID NO: 532580 - DNA, 25 bp, Mus musculus
gcacgtctgtacatctgcatgtttg

SEQ ID NO: 532581 - DNA, 25 bp, Mus musculus
gcacgtctgtacttctgcatgtttg

SEQ ID NO: 532582 - DNA, 25 bp, Mus musculus
gcacgtgaaccccaagtacattgtt

SEQ ID NO: 532583 - DNA, 25 bp, Mus musculus
gcacgtgaacccgaagtacattgtt

SEQ ID NO: 532584 - DNA, 25 bp, Mus musculus
gcacgtgagcaaaggccagctttcc

SEQ ID NO: 532585 - DNA, 25 bp, Mus musculus
gcacgtgagcaatggccagctttcc

SEQ ID NO: 532586 - DNA, 25 bp, Mus musculus
gcacgtgagcttcagtactccagaa

SEQ ID NO: 532587 - DNA, 25 bp, Mus musculus
gcacgtgagcttgagtactccagaa

SEQ ID NO: 532588 - DNA, 25 bp, Mus musculus
gcacgtgagtgcagttgcccacaga

SEQ ID NO: 532589 - DNA, 25 bp, Mus musculus
gcacgtgagtgctgttgcccacaga

SEQ ID NO: 532590 - DNA, 25 bp, Mus musculus
gcacgtgatgagatcagtgagctca

SEQ ID NO: 532591 - DNA, 25 bp, Mus musculus
gcacgtgatgagttcagtgagctca

SEQ ID NO: 532592 - DNA, 25 bp, Mus musculus
gcacgtgatgcaaggtaacaaagac

SEQ ID NO: 532593 - DNA, 25 bp, Mus musculus
gcacgtgatgcatggtaacaaagac

SEQ ID NO: 532594 - DNA, 25 bp, Mus musculus
gcacgtgcagctcaatgactaccta

SEQ ID NO: 532595 - DNA, 25 bp, Mus musculus
gcacgtgcagctgaatgactaccta

SEQ ID NO: 532596 - DNA, 25 bp, Mus musculus
gcacgtgcataacagcctgtaccaa

SEQ ID NO: 532597 - DNA, 25 bp, Mus musculus
gcacgtgcataagagcctgtaccaa

SEQ ID NO: 532598 - DNA, 25 bp, Mus musculus
gcacgtgcccgcatacacagtaata

SEQ ID NO: 532599 - DNA, 25 bp, Mus musculus
gcacgtgcccgcttacacagtaata

SEQ ID NO: 532600 - DNA, 25 bp, Mus musculus
gcacgtgctctgctcagtagagtga

SEQ ID NO: 532601 - DNA, 25 bp, Mus musculus
gcacgtgctctggtcagtagagtga

SEQ ID NO: 532602 - DNA, 25 bp, Mus musculus
gcacgtgctgctctactaaaagaac

SEQ ID NO: 532603 - DNA, 25 bp, Mus musculus
gcacgtgctgctgtactaaaagaac

SEQ ID NO: 532604 - DNA, 25 bp, Mus musculus
gcacgtgctgttccctgaatttgga

SEQ ID NO: 532605 - DNA, 25 bp, Mus musculus
gcacgtgctgttgcctgaatttgga

SEQ ID NO: 532606 - DNA, 25 bp, Mus musculus
gcacgtggccggctcactcattcat

SEQ ID NO: 532607 - DNA, 25 bp, Mus musculus
gcacgtggccgggtcactcattcat

SEQ ID NO: 532608 - DNA, 25 bp, Mus musculus
gcacgtggcctgctatggatttcgc

SEQ ID NO: 532609 - DNA, 25 bp, Mus musculus
gcacgtggcctggtatggatttcgc

SEQ ID NO: 532610 - DNA, 25 bp, Mus musculus
gcacgtgggcaactgtactggtctt

SEQ ID NO: 532611 - DNA, 25 bp, Mus musculus
gcacgtgggcaagtgtactggtctt

SEQ ID NO: 532612 - DNA, 25 bp, Mus musculus
gcacgtgggcacctcatattggaaa

SEQ ID NO: 532613 - DNA, 25 bp, Mus musculus
gcacgtgggcacgtcatattggaaa

SEQ ID NO: 532614 - DNA, 25 bp, Mus musculus
gcacgtgggtgtacaagcagcaaaa

SEQ ID NO: 532615 - DNA, 25 bp, Mus musculus
gcacgtgggtgttcaagcagcaaaa

SEQ ID NO: 532616 - DNA, 25 bp, Mus musculus
gcacgtgtacagcatgctcttataa

SEQ ID NO: 532617 - DNA, 25 bp, Mus musculus
gcacgtgtacaggatgctcttataa

SEQ ID NO: 532618 - DNA, 25 bp, Mus musculus
gcacgtgtacatccatgcgtacata

SEQ ID NO: 532619 - DNA, 25 bp, Mus musculus
gcacgtgtacatgcatgcgtacata

SEQ ID NO: 532620 - DNA, 25 bp, Mus musculus
gcacgtgtcacacatgctgcttgga

SEQ ID NO: 532621 - DNA, 25 bp, Mus musculus
gcacgtgtcacagatgctgcttgga

SEQ ID NO: 532622 - DNA, 25 bp, Mus musculus
gcacgtgtgaggaccctagttcaat

SEQ ID NO: 532623 - DNA, 25 bp, Mus musculus
gcacgtgtgaggtccctagttcaat

SEQ ID NO: 532624 - DNA, 25 bp, Mus musculus
gcacgtgtgcgcagacatacgcata

SEQ ID NO: 532625 - DNA, 25 bp, Mus musculus
gcacgtgtgcgctgacatacgcata

SEQ ID NO: 532626 - DNA, 25 bp, Mus musculus
gcacgtgtgtacagtccctagggag

SEQ ID NO: 532627 - DNA, 25 bp, Mus musculus
gcacgtgtgtactgtccctagggag

SEQ ID NO: 532628 - DNA, 25 bp, Mus musculus
gcacgtgtgtgtcagttctgacaga

SEQ ID NO: 532629 - DNA, 25 bp, Mus musculus
gcacgtgtgtgtgagttctgacaga

SEQ ID NO: 532630 - DNA, 25 bp, Mus musculus
gcacgtgttaccatgtggaatctta

SEQ ID NO: 532631 - DNA, 25 bp, Mus musculus
gcacgtgttaccttgtggaatctta

SEQ ID NO: 532632 - DNA, 25 bp, Mus musculus
gcacgtgttcctcactagaagaaaa

SEQ ID NO: 532633 - DNA, 25 bp, Mus musculus
gcacgtgttcctgactagaagaaaa

SEQ ID NO: 532634 - DNA, 25 bp, Mus musculus
gcacgtgttcggaagttttacaaga

SEQ ID NO: 532635 - DNA, 25 bp, Mus musculus
gcacgtgttcggtagttttacaaga

SEQ ID NO: 532636 - DNA, 25 bp, Mus musculus
gcacgtgttctacaatcttctcaca

SEQ ID NO: 532637 - DNA, 25 bp, Mus musculus
gcacgtgttctagaatcttctcaca

SEQ ID NO: 532638 - DNA, 25 bp, Mus musculus
gcacgtgtttgactccagaggctga

SEQ ID NO: 532639 - DNA, 25 bp, Mus musculus
gcacgtgtttgagtccagaggctga

SEQ ID NO: 532640 - DNA, 25 bp, Mus musculus
gcacgtgttttacagtatatggcat

SEQ ID NO: 532641 - DNA, 25 bp, Mus musculus
gcacgtgttttagagtatatggcat

SEQ ID NO: 532642 - DNA, 25 bp, Mus musculus
gcacgttacaccagtgagatgcgga

SEQ ID NO: 532643 - DNA, 25 bp, Mus musculus
gcacgttacacctgtgagatgcgga

SEQ ID NO: 532644 - DNA, 25 bp, Mus musculus
gcacgttagcacacattcagaggat

SEQ ID NO: 532645 - DNA, 25 bp, Mus musculus
gcacgttagcactcattcagaggat

SEQ ID NO: 532646 - DNA, 25 bp, Mus musculus
gcacgttattccctctagagcttaa

SEQ ID NO: 532647 - DNA, 25 bp, Mus musculus
gcacgttattccgtctagagcttaa

SEQ ID NO: 532648 - DNA, 25 bp, Mus musculus
gcacgttcaattacttcagccgcga

SEQ ID NO: 532649 - DNA, 25 bp, Mus musculus
gcacgttcaatttcttcagccgcga

SEQ ID NO: 532650 - DNA, 25 bp, Mus musculus
gcacgttcacgtattctttcatata

SEQ ID NO: 532651 - DNA, 25 bp, Mus musculus
gcacgttcacgttttctttcatata

SEQ ID NO: 532652 - DNA, 25 bp, Mus musculus
gcacgttcgcctcctgtttttgtga

SEQ ID NO: 532653 - DNA, 25 bp, Mus musculus
gcacgttcgcctgctgtttttgtga

SEQ ID NO: 532654 - DNA, 25 bp, Mus musculus
gcacgttcttataacatctgatggt

SEQ ID NO: 532655 - DNA, 25 bp, Mus musculus
gcacgttcttattacatctgatggt

SEQ ID NO: 532656 - DNA, 25 bp, Mus musculus
gcacgttggcccaaaaacagacttg

SEQ ID NO: 532657 - DNA, 25 bp, Mus musculus
gcacgttggccctaaaacagacttg

SEQ ID NO: 532658 - DNA, 25 bp, Mus musculus
gcacgtttacagatttcttcccaag

SEQ ID NO: 532659 - DNA, 25 bp, Mus musculus
gcacgtttacagttttcttcccaag

SEQ ID NO: 532660 - DNA, 25 bp, Mus musculus
gcacgtttcatgcagcatatgacct

SEQ ID NO: 532661 - DNA, 25 bp, Mus musculus
gcacgtttcatggagcatatgacct

SEQ ID NO: 532662 - DNA, 25 bp, Mus musculus
gcacgtttgcacagtttgttgagta

SEQ ID NO: 532663 - DNA, 25 bp, Mus musculus
gcacgtttgcactgtttgttgagta

SEQ ID NO: 532664 - DNA, 25 bp, Mus musculus
gcacgtttggtcaggctgcatccct

SEQ ID NO: 532665 - DNA, 25 bp, Mus musculus
gcacgtttggtctggctgcatccct

SEQ ID NO: 532666 - DNA, 25 bp, Mus musculus
gcacgttttaagcaacctggactgg

SEQ ID NO: 532667 - DNA, 25 bp, Mus musculus
gcacgttttaaggaacctggactgg

SEQ ID NO: 532668 - DNA, 25 bp, Mus musculus
gcacgttttctgcttaagtaaacat

SEQ ID NO: 532669 - DNA, 25 bp, Mus musculus
gcacgttttctggttaagtaaacat

SEQ ID NO: 532670 - DNA, 25 bp, Mus musculus
gcacgttttcttatctggttataga

SEQ ID NO: 532671 - DNA, 25 bp, Mus musculus
gcacgttttcttttctggttataga

SEQ ID NO: 532672 - DNA, 25 bp, Mus musculus
gcactaaatgagacctattcccaaa

SEQ ID NO: 532673 - DNA, 25 bp, Mus musculus
gcactaaatgagtcctattcccaaa

SEQ ID NO: 532674 - DNA, 25 bp, Mus musculus
gcactaaatgccaccagaagagagt

SEQ ID NO: 532675 - DNA, 25 bp, Mus musculus
gcactaaatgcctccagaagagagt

SEQ ID NO: 532676 - DNA, 25 bp, Mus musculus
gcactaaccacacccactaggaaat

SEQ ID NO: 532677 - DNA, 25 bp, Mus musculus
gcactaaccacagccactaggaaat

SEQ ID NO: 532678 - DNA, 25 bp, Mus musculus
gcactaacccctccatttattatga

SEQ ID NO: 532679 - DNA, 25 bp, Mus musculus
gcactaacccctgcatttattatga

SEQ ID NO: 532680 - DNA, 25 bp, Mus musculus
gcactaacccttagtactcttgttt

SEQ ID NO: 532681 - DNA, 25 bp, Mus musculus
gcactaaccctttgtactcttgttt

SEQ ID NO: 532682 - DNA, 25 bp, Mus musculus
gcactaacggagattgccaccacaa

SEQ ID NO: 532683 - DNA, 25 bp, Mus musculus
gcactaacggagtttgccaccacaa

SEQ ID NO: 532684 - DNA, 25 bp, Mus musculus
gcactaacgggaaaaatggctttat

SEQ ID NO: 532685 - DNA, 25 bp, Mus musculus
gcactaacgggataaatggctttat

SEQ ID NO: 532686 - DNA, 25 bp, Mus musculus
gcactaactgatcaatttagcctag

SEQ ID NO: 532687 - DNA, 25 bp, Mus musculus
gcactaactgatgaatttagcctag

SEQ ID NO: 532688 - DNA, 25 bp, Mus musculus
gcactaactttgaaactattggaag

SEQ ID NO: 532689 - DNA, 25 bp, Mus musculus
gcactaactttgtaactattggaag

SEQ ID NO: 532690 - DNA, 25 bp, Mus musculus
gcactaagagttcctttctctcgtt

SEQ ID NO: 532691 - DNA, 25 bp, Mus musculus
gcactaagagttgctttctctcgtt

SEQ ID NO: 532692 - DNA, 25 bp, Mus musculus
gcactaagatgcaggtactctgaat

SEQ ID NO: 532693 - DNA, 25 bp, Mus musculus
gcactaagatgctggtactctgaat

SEQ ID NO: 532694 - DNA, 25 bp, Mus musculus
gcactaagcagcaacttttggctat

SEQ ID NO: 532695 - DNA, 25 bp, Mus musculus
gcactaagcagctacttttggctat

SEQ ID NO: 532696 - DNA, 25 bp, Mus musculus
gcactaaggaagcaggttggtcaca

SEQ ID NO: 532697 - DNA, 25 bp, Mus musculus
gcactaaggaaggaggttggtcaca

SEQ ID NO: 532698 - DNA, 25 bp, Mus musculus
gcactaatcgtgctccatatttgaa

SEQ ID NO: 532699 - DNA, 25 bp, Mus musculus
gcactaatcgtggtccatatttgaa

SEQ ID NO: 532700 - DNA, 25 bp, Mus musculus
gcactaatgagcaacacacccagat

SEQ ID NO: 532701 - DNA, 25 bp, Mus musculus
gcactaatgagctacacacccagat

SEQ ID NO: 532702 - DNA, 25 bp, Mus musculus
gcactaattccacactttgatcttc

SEQ ID NO: 532703 - DNA, 25 bp, Mus musculus
gcactaattccagactttgatcttc

SEQ ID NO: 532704 - DNA, 25 bp, Mus musculus
gcactaattgctcagccctatagta

SEQ ID NO: 532705 - DNA, 25 bp, Mus musculus
gcactaattgctgagccctatagta

SEQ ID NO: 532706 - DNA, 25 bp, Mus musculus
gcactaattggtaaatcagatcgtt

SEQ ID NO: 532707 - DNA, 25 bp, Mus musculus
gcactaattggttaatcagatcgtt

SEQ ID NO: 532708 - DNA, 25 bp, Mus musculus
gcactaatttatatggcagtctgtg

SEQ ID NO: 532709 - DNA, 25 bp, Mus musculus
gcactaatttatttggcagtctgtg

SEQ ID NO: 532710 - DNA, 25 bp, Mus musculus
gcactacacagaaaaggctggctga

SEQ ID NO: 532711 - DNA, 25 bp, Mus musculus
gcactacacagataaggctggctga

SEQ ID NO: 532712 - DNA, 25 bp, Mus musculus
gcactacactggaatctgatatcag

SEQ ID NO: 532713 - DNA, 25 bp, Mus musculus
gcactacactggctggattctgttc

SEQ ID NO: 532714 - DNA, 25 bp, Mus musculus
gcactacactgggtggattctgttc

SEQ ID NO: 532715 - DNA, 25 bp, Mus musculus
gcactacactggtatctgatatcag

SEQ ID NO: 532716 - DNA, 25 bp, Mus musculus
gcactacagaatctgactctctctt

SEQ ID NO: 532717 - DNA, 25 bp, Mus musculus
gcactacagaatgtgactctctctt

SEQ ID NO: 532718 - DNA, 25 bp, Mus musculus
gcactacaggcaaggatggcggcat

SEQ ID NO: 532719 - DNA, 25 bp, Mus musculus
gcactacaggcatggatggcggcat

SEQ ID NO: 532720 - DNA, 25 bp, Mus musculus
gcactacaggtcattttgctcttag

SEQ ID NO: 532721 - DNA, 25 bp, Mus musculus
gcactacaggtctttttgctcttag

SEQ ID NO: 532722 - DNA, 25 bp, Mus musculus
gcactacagtgcatatctatccaag

SEQ ID NO: 532723 - DNA, 25 bp, Mus musculus
gcactacagtgcttatctatccaag

SEQ ID NO: 532724 - DNA, 25 bp, Mus musculus
gcactacatttaactgacaacggga

SEQ ID NO: 532725 - DNA, 25 bp, Mus musculus
gcactacatttatctgacaacggga

SEQ ID NO: 532726 - DNA, 25 bp, Mus musculus
gcactacatttcaagcttgattccc

SEQ ID NO: 532727 - DNA, 25 bp, Mus musculus
gcactacatttctagcttgattccc

SEQ ID NO: 532728 - DNA, 25 bp, Mus musculus
gcactacatttgactcacatcaagg

SEQ ID NO: 532729 - DNA, 25 bp, Mus musculus
gcactacatttgtctcacatcaagg

SEQ ID NO: 532730 - DNA, 25 bp, Mus musculus
gcactaccacccagaggtgtcgaaa

SEQ ID NO: 532731 - DNA, 25 bp, Mus musculus
gcactaccaccctgaggtgtcgaaa

SEQ ID NO: 532732 - DNA, 25 bp, Mus musculus
gcactaccgtttcttgttggctata

SEQ ID NO: 532733 - DNA, 25 bp, Mus musculus
gcactaccgtttgttgttggctata

SEQ ID NO: 532734 - DNA, 25 bp, Mus musculus
gcactacctacaatgcatcaggcta

SEQ ID NO: 532735 - DNA, 25 bp, Mus musculus
gcactacctacattgcatcaggcta

SEQ ID NO: 532736 - DNA, 25 bp, Mus musculus
gcactacctataaatagcccttgag

SEQ ID NO: 532737 - DNA, 25 bp, Mus musculus
gcactacctatatatagcccttgag

SEQ ID NO: 532738 - DNA, 25 bp, Mus musculus
gcactacctctcaagcaagaagctt

SEQ ID NO: 532739 - DNA, 25 bp, Mus musculus
gcactacctctctagcaagaagctt

SEQ ID NO: 532740 - DNA, 25 bp, Mus musculus
gcactacggcccagtaggatcagat

SEQ ID NO: 532741 - DNA, 25 bp, Mus musculus
gcactacggccctgtaggatcagat

SEQ ID NO: 532742 - DNA, 25 bp, Mus musculus
gcactacgtattcctgagctcaaag

SEQ ID NO: 532743 - DNA, 25 bp, Mus musculus
gcactacgtattgctgagctcaaag

SEQ ID NO: 532744 - DNA, 25 bp, Mus musculus
gcactactaataaacagctcttact

SEQ ID NO: 532745 - DNA, 25 bp, Mus musculus
gcactactaatatacagctcttact

SEQ ID NO: 532746 - DNA, 25 bp, Mus musculus
gcactactagaacgtgtggtcctgt

SEQ ID NO: 532747 - DNA, 25 bp, Mus musculus
gcactactagaaggtgtggtcctgt

SEQ ID NO: 532748 - DNA, 25 bp, Mus musculus
gcactactatagcactccggcgctt

SEQ ID NO: 532749 - DNA, 25 bp, Mus musculus
gcactactataggactccggcgctt

SEQ ID NO: 532750 - DNA, 25 bp, Mus musculus
gcactactccacctcagttgttgag

SEQ ID NO: 532751 - DNA, 25 bp, Mus musculus
gcactactccacgtcagttgttgag

SEQ ID NO: 532752 - DNA, 25 bp, Mus musculus
gcactactcttcacagagagggaga

SEQ ID NO: 532753 - DNA, 25 bp, Mus musculus
gcactactcttctcagagagggaga

SEQ ID NO: 532754 - DNA, 25 bp, Mus musculus
gcactactgcaaaaaagacggtttt

SEQ ID NO: 532755 - DNA, 25 bp, Mus musculus
gcactactgcaataaagacggtttt

SEQ ID NO: 532756 - DNA, 25 bp, Mus musculus
gcactactgcctcccaatattaatg

SEQ ID NO: 532757 - DNA, 25 bp, Mus musculus
gcactactgcctgccaatattaatg

SEQ ID NO: 532758 - DNA, 25 bp, Mus musculus
gcactacttctaaaggtctctctgg

SEQ ID NO: 532759 - DNA, 25 bp, Mus musculus
gcactacttctataggtctctctgg

SEQ ID NO: 532760 - DNA, 25 bp, Mus musculus
gcactactttacactttctcctggg

SEQ ID NO: 532761 - DNA, 25 bp, Mus musculus
gcactactttactctttctcctggg

SEQ ID NO: 532762 - DNA, 25 bp, Mus musculus
gcactagaacgaaggctcagcaggt

SEQ ID NO: 532763 - DNA, 25 bp, Mus musculus
gcactagaacgatggctcagcaggt

SEQ ID NO: 532764 - DNA, 25 bp, Mus musculus
gcactagaagtcagaggtcatccca

SEQ ID NO: 532765 - DNA, 25 bp, Mus musculus
gcactagaagtctgaggtcatccca

SEQ ID NO: 532766 - DNA, 25 bp, Mus musculus
gcactagaagttattgctgttccca

SEQ ID NO: 532767 - DNA, 25 bp, Mus musculus
gcactagaagtttttgctgttccca

SEQ ID NO: 532768 - DNA, 25 bp, Mus musculus
gcactagacaaaatggtgagctctg

SEQ ID NO: 532769 - DNA, 25 bp, Mus musculus
gcactagacaaattggtgagctctg

SEQ ID NO: 532770 - DNA, 25 bp, Mus musculus
gcactagagggacacagctgaacta

SEQ ID NO: 532771 - DNA, 25 bp, Mus musculus
gcactagagggagacagctgaacta

SEQ ID NO: 532772 - DNA, 25 bp, Mus musculus
gcactagcaattagtgtgatagcaa

SEQ ID NO: 532773 - DNA, 25 bp, Mus musculus
gcactagcaatttgtgtgatagcaa

SEQ ID NO: 532774 - DNA, 25 bp, Mus musculus
gcactaggacctacgaaagggtgta

SEQ ID NO: 532775 - DNA, 25 bp, Mus musculus
gcactaggaccttcgaaagggtgta

SEQ ID NO: 532776 - DNA, 25 bp, Mus musculus
gcactaggagtgacaattcgaacca

SEQ ID NO: 532777 - DNA, 25 bp, Mus musculus
gcactaggagtgtcaattcgaacca

SEQ ID NO: 532778 - DNA, 25 bp, Mus musculus
gcactaggatggaaaagcaagagaa

SEQ ID NO: 532779 - DNA, 25 bp, Mus musculus
gcactaggatggtaaagcaagagaa

SEQ ID NO: 532780 - DNA, 25 bp, Mus musculus
gcactaggcaggagctataccactg

SEQ ID NO: 532781 - DNA, 25 bp, Mus musculus
gcactaggcaggtgctataccactg

SEQ ID NO: 532782 - DNA, 25 bp, Mus musculus
gcactaggcgctacttagggcgttt

SEQ ID NO: 532783 - DNA, 25 bp, Mus musculus
gcactaggcgcttcttagggcgttt

SEQ ID NO: 532784 - DNA, 25 bp, Mus musculus
gcactagggctcacaggcattgcta

SEQ ID NO: 532785 - DNA, 25 bp, Mus musculus
gcactagggctctcaggcattgcta

SEQ ID NO: 532786 - DNA, 25 bp, Mus musculus
gcactagggttaagggttccatccc

SEQ ID NO: 532787 - DNA, 25 bp, Mus musculus
gcactagggttatgggttccatccc

SEQ ID NO: 532788 - DNA, 25 bp, Mus musculus
gcactaggtgtgctcagttatgcac

SEQ ID NO: 532789 - DNA, 25 bp, Mus musculus
gcactaggtgtggtcagttatgcac

SEQ ID NO: 532790 - DNA, 25 bp, Mus musculus
gcactaggtttcaaccacacagcga

SEQ ID NO: 532791 - DNA, 25 bp, Mus musculus
gcactaggtttctaccacacagcga

SEQ ID NO: 532792 - DNA, 25 bp, Mus musculus
gcactagtaagaaattggcactcaa

SEQ ID NO: 532793 - DNA, 25 bp, Mus musculus
gcactagtaagatattggcactcaa

SEQ ID NO: 532794 - DNA, 25 bp, Mus musculus
gcactagtattccagacttttttat

SEQ ID NO: 532795 - DNA, 25 bp, Mus musculus
gcactagtattcgagacttttttat

SEQ ID NO: 532796 - DNA, 25 bp, Mus musculus
gcactagtctctccttcattgatat

SEQ ID NO: 532797 - DNA, 25 bp, Mus musculus
gcactagtctctgcttcattgatat

SEQ ID NO: 532798 - DNA, 25 bp, Mus musculus
gcactagtctggatttgctacagta

SEQ ID NO: 532799 - DNA, 25 bp, Mus musculus
gcactagtctggttttgctacagta

SEQ ID NO: 532800 - DNA, 25 bp, Mus musculus
gcactagtcttaccatttctgtaga

SEQ ID NO: 532801 - DNA, 25 bp, Mus musculus
gcactagtcttagcatttctgtaga

SEQ ID NO: 532802 - DNA, 25 bp, Mus musculus
gcactagtgctaacagatgtctctc

SEQ ID NO: 532803 - DNA, 25 bp, Mus musculus
gcactagtgctatcagatgtctctc

SEQ ID NO: 532804 - DNA, 25 bp, Mus musculus
gcactagtgtccctaggagtcttga

SEQ ID NO: 532805 - DNA, 25 bp, Mus musculus
gcactagtgtccgtaggagtcttga

SEQ ID NO: 532806 - DNA, 25 bp, Mus musculus
gcactagttaatcctactggctcag

SEQ ID NO: 532807 - DNA, 25 bp, Mus musculus
gcactagttaatgctactggctcag

SEQ ID NO: 532808 - DNA, 25 bp, Mus musculus
gcactagttcatcgacgttctttgt

SEQ ID NO: 532809 - DNA, 25 bp, Mus musculus
gcactagttcatggacgttctttgt

SEQ ID NO: 532810 - DNA, 25 bp, Mus musculus
gcactagttctacaggtctttacat

SEQ ID NO: 532811 - DNA, 25 bp, Mus musculus
gcactagttctagaggtctttacat

SEQ ID NO: 532812 - DNA, 25 bp, Mus musculus
gcactagtttttaagcccacatgct

SEQ ID NO: 532813 - DNA, 25 bp, Mus musculus
gcactagttttttagcccacatgct

SEQ ID NO: 532814 - DNA, 25 bp, Mus musculus
gcactatagcggcttcgcaggtatc

SEQ ID NO: 532815 - DNA, 25 bp, Mus musculus
gcactatagcgggttcgcaggtatc

SEQ ID NO: 532816 - DNA, 25 bp, Mus musculus
gcactataggctccttgtatgtttg

SEQ ID NO: 532817 - DNA, 25 bp, Mus musculus
gcactataggctgcttgtatgtttg

SEQ ID NO: 532818 - DNA, 25 bp, Mus musculus
gcactatatttgctcagtatgtatt

SEQ ID NO: 532819 - DNA, 25 bp, Mus musculus
gcactatatttggtcagtatgtatt

SEQ ID NO: 532820 - DNA, 25 bp, Mus musculus
gcactatcaatcactttcctcttga

SEQ ID NO: 532821 - DNA, 25 bp, Mus musculus
gcactatcaatctctttcctcttga

SEQ ID NO: 532822 - DNA, 25 bp, Mus musculus
gcactatcagacagatttttcatct

SEQ ID NO: 532823 - DNA, 25 bp, Mus musculus
gcactatcagactgatttttcatct

SEQ ID NO: 532824 - DNA, 25 bp, Mus musculus
gcactatcgggtactctgaagtcat

SEQ ID NO: 532825 - DNA, 25 bp, Mus musculus
gcactatcgggttctctgaagtcat

SEQ ID NO: 532826 - DNA, 25 bp, Mus musculus
gcactatgatttatactcatcccat

SEQ ID NO: 532827 - DNA, 25 bp, Mus musculus
gcactatgatttttactcatcccat

SEQ ID NO: 532828 - DNA, 25 bp, Mus musculus
gcactatggagaatcccttgtggtt

SEQ ID NO: 532829 - DNA, 25 bp, Mus musculus
gcactatggagattcccttgtggtt

SEQ ID NO: 532830 - DNA, 25 bp, Mus musculus
gcactatggtttcttgcctgccgag

SEQ ID NO: 532831 - DNA, 25 bp, Mus musculus
gcactatggtttgttgcctgccgag

SEQ ID NO: 532832 - DNA, 25 bp, Mus musculus
gcactatgtctccaactttacatca

SEQ ID NO: 532833 - DNA, 25 bp, Mus musculus
gcactatgtctcgaactttacatca

SEQ ID NO: 532834 - DNA, 25 bp, Mus musculus
gcactatgtcttaaactggtgggtt

SEQ ID NO: 532835 - DNA, 25 bp, Mus musculus
gcactatgtctttaactggtgggtt

SEQ ID NO: 532836 - DNA, 25 bp, Mus musculus
gcactatgtttacttcttacttggg

SEQ ID NO: 532837 - DNA, 25 bp, Mus musculus
gcactatgtttagttcttacttggg

SEQ ID NO: 532838 - DNA, 25 bp, Mus musculus
gcactattacctaccgcacagagat

SEQ ID NO: 532839 - DNA, 25 bp, Mus musculus
gcactattaccttccgcacagagat

SEQ ID NO: 532840 - DNA, 25 bp, Mus musculus
gcactattaggcaagggtgtacctc

SEQ ID NO: 532841 - DNA, 25 bp, Mus musculus
gcactattaggctagggtgtacctc

SEQ ID NO: 532842 - DNA, 25 bp, Mus musculus
gcactattgagacagccaatgggct

SEQ ID NO: 532843 - DNA, 25 bp, Mus musculus
gcactattgagagagccaatgggct

SEQ ID NO: 532844 - DNA, 25 bp, Mus musculus
gcactattgctgcaatactgggttt

SEQ ID NO: 532845 - DNA, 25 bp, Mus musculus
gcactattgctggaatactgggttt

SEQ ID NO: 532846 - DNA, 25 bp, Mus musculus
gcactattgtgacaaggagcaacat

SEQ ID NO: 532847 - DNA, 25 bp, Mus musculus
gcactattgtgagaaggagcaacat

SEQ ID NO: 532848 - DNA, 25 bp, Mus musculus
gcactattgttcagcttccgggaga

SEQ ID NO: 532849 - DNA, 25 bp, Mus musculus
gcactattgttctgcttccgggaga

SEQ ID NO: 532850 - DNA, 25 bp, Mus musculus
gcactatttgggaagttcagccttg

SEQ ID NO: 532851 - DNA, 25 bp, Mus musculus
gcactatttgggtagttcagccttg

SEQ ID NO: 532852 - DNA, 25 bp, Mus musculus
gcactattttatagggttacttgta

SEQ ID NO: 532853 - DNA, 25 bp, Mus musculus
gcactattttattgggttacttgta

SEQ ID NO: 532854 - DNA, 25 bp, Mus musculus
gcactcaaaagccttagcaggtata

SEQ ID NO: 532855 - DNA, 25 bp, Mus musculus
gcactcaaaagcgttagcaggtata

SEQ ID NO: 532856 - DNA, 25 bp, Mus musculus
gcactcaaactcagattgctgtttc

SEQ ID NO: 532857 - DNA, 25 bp, Mus musculus
gcactcaaactctgattgctgtttc

SEQ ID NO: 532858 - DNA, 25 bp, Mus musculus
gcactcaaagacaggttcagagacg

SEQ ID NO: 532859 - DNA, 25 bp, Mus musculus
gcactcaaagactggttcagagacg

SEQ ID NO: 532860 - DNA, 25 bp, Mus musculus
gcactcaaaggcctccagggtgaag

SEQ ID NO: 532861 - DNA, 25 bp, Mus musculus
gcactcaaaggcgtccagggtgaag

SEQ ID NO: 532862 - DNA, 25 bp, Mus musculus
gcactcaagaatccaactggccaca

SEQ ID NO: 532863 - DNA, 25 bp, Mus musculus
gcactcaagaatgcaactggccaca

SEQ ID NO: 532864 - DNA, 25 bp, Mus musculus
gcactcaaggctcgttctggtaaat

SEQ ID NO: 532865 - DNA, 25 bp, Mus musculus
gcactcaaggctggttctggtaaat

SEQ ID NO: 532866 - DNA, 25 bp, Mus musculus
gcactcaatgctcttgcagaaaaga

SEQ ID NO: 532867 - DNA, 25 bp, Mus musculus
gcactcaatgctgttgcagaaaaga

SEQ ID NO: 532868 - DNA, 25 bp, Mus musculus
gcactcacaggaacttgctatcact

SEQ ID NO: 532869 - DNA, 25 bp, Mus musculus
gcactcacaggatcttgctatcact

SEQ ID NO: 532870 - DNA, 25 bp, Mus musculus
gcactcacatccagtgcattaagga

SEQ ID NO: 532871 - DNA, 25 bp, Mus musculus
gcactcacatcctgtgcattaagga

SEQ ID NO: 532872 - DNA, 25 bp, Mus musculus
gcactcaccacaacacctggtgaaa

SEQ ID NO: 532873 - DNA, 25 bp, Mus musculus
gcactcaccacatcacctggtgaaa

SEQ ID NO: 532874 - DNA, 25 bp, Mus musculus
gcactcacccgcagggctgagatta

SEQ ID NO: 532875 - DNA, 25 bp, Mus musculus
gcactcacccgctgggctgagatta

SEQ ID NO: 532876 - DNA, 25 bp, Mus musculus
gcactcaccctcatgggtgtgtgta

SEQ ID NO: 532877 - DNA, 25 bp, Mus musculus
gcactcaccctcttgggtgtgtgta

SEQ ID NO: 532878 - DNA, 25 bp, Mus musculus
gcactcaccctgaaacgggcaaagt

SEQ ID NO: 532879 - DNA, 25 bp, Mus musculus
gcactcaccctgtaacgggcaaagt

SEQ ID NO: 532880 - DNA, 25 bp, Mus musculus
gcactcaccgagattttggtctgta

SEQ ID NO: 532881 - DNA, 25 bp, Mus musculus
gcactcaccgagtttttggtctgta

SEQ ID NO: 532882 - DNA, 25 bp, Mus musculus
gcactcacctctcgtagtgacttga

SEQ ID NO: 532883 - DNA, 25 bp, Mus musculus
gcactcacctctggtagtgacttga

SEQ ID NO: 532884 - DNA, 25 bp, Mus musculus
gcactcacctttcttattgtacatg

SEQ ID NO: 532885 - DNA, 25 bp, Mus musculus
gcactcacctttgttattgtacatg

SEQ ID NO: 532886 - DNA, 25 bp, Mus musculus
gcactcactgagaatgctgggcatt

SEQ ID NO: 532887 - DNA, 25 bp, Mus musculus
gcactcactgagtatgctgggcatt

SEQ ID NO: 532888 - DNA, 25 bp, Mus musculus
gcactcacttggaggaaagttgaat

SEQ ID NO: 532889 - DNA, 25 bp, Mus musculus
gcactcacttggcagatcacactag

SEQ ID NO: 532890 - DNA, 25 bp, Mus musculus
gcactcacttgggagatcacactag

SEQ ID NO: 532891 - DNA, 25 bp, Mus musculus
gcactcacttggtggaaagttgaat

SEQ ID NO: 532892 - DNA, 25 bp, Mus musculus
gcactcagaaacaaaaacagaacat

SEQ ID NO: 532893 - DNA, 25 bp, Mus musculus
gcactcagaaactaaaacagaacat

SEQ ID NO: 532894 - DNA, 25 bp, Mus musculus
gcactcagagggaagacaccagaga

SEQ ID NO: 532895 - DNA, 25 bp, Mus musculus
gcactcagagggtagacaccagaga

SEQ ID NO: 532896 - DNA, 25 bp, Mus musculus
gcactcagcgtcagtttagatggca

SEQ ID NO: 532897 - DNA, 25 bp, Mus musculus
gcactcagcgtctgtttagatggca

SEQ ID NO: 532898 - DNA, 25 bp, Mus musculus
gcactcagcgttcagttttagatgg

SEQ ID NO: 532899 - DNA, 25 bp, Mus musculus
gcactcagcgttgagttttagatgg

SEQ ID NO: 532900 - DNA, 25 bp, Mus musculus
gcactcagctttagttaccagatct

SEQ ID NO: 532901 - DNA, 25 bp, Mus musculus
gcactcagcttttgttaccagatct

SEQ ID NO: 532902 - DNA, 25 bp, Mus musculus
gcactcaggaaacatcagtctccag

SEQ ID NO: 532903 - DNA, 25 bp, Mus musculus
gcactcaggaaagatcagtctccag

SEQ ID NO: 532904 - DNA, 25 bp, Mus musculus
gcactcaggagaaagccagatgtga

SEQ ID NO: 532905 - DNA, 25 bp, Mus musculus
gcactcaggagatagccagatgtga

SEQ ID NO: 532906 - DNA, 25 bp, Mus musculus
gcactcaggagtcatctgcaggcat

SEQ ID NO: 532907 - DNA, 25 bp, Mus musculus
gcactcaggagtgatctgcaggcat

SEQ ID NO: 532908 - DNA, 25 bp, Mus musculus
gcactcaggatgctccagcgtttga

SEQ ID NO: 532909 - DNA, 25 bp, Mus musculus
gcactcaggatggtccagcgtttga

SEQ ID NO: 532910 - DNA, 25 bp, Mus musculus
gcactcaggtgaaagatgtgactct

SEQ ID NO: 532911 - DNA, 25 bp, Mus musculus
gcactcaggtgatagatgtgactct

SEQ ID NO: 532912 - DNA, 25 bp, Mus musculus
gcactcagtgagctttctttttaaa

SEQ ID NO: 532913 - DNA, 25 bp, Mus musculus
gcactcagtgaggtttctttttaaa

SEQ ID NO: 532914 - DNA, 25 bp, Mus musculus
gcactcagtgctctttgtaacacat

SEQ ID NO: 532915 - DNA, 25 bp, Mus musculus
gcactcagtgctgtttgtaacacat

SEQ ID NO: 532916 - DNA, 25 bp, Mus musculus
gcactcagttttcagtctctgttag

SEQ ID NO: 532917 - DNA, 25 bp, Mus musculus
gcactcagttttgagtctctgttag

SEQ ID NO: 532918 - DNA, 25 bp, Mus musculus
gcactcatcaaaaacctggctgaca

SEQ ID NO: 532919 - DNA, 25 bp, Mus musculus
gcactcatcaaatacctggctgaca

SEQ ID NO: 532920 - DNA, 25 bp, Mus musculus
gcactcatgaacatgcagtagctat

SEQ ID NO: 532921 - DNA, 25 bp, Mus musculus
gcactcatgaacttgcagtagctat

SEQ ID NO: 532922 - DNA, 25 bp, Mus musculus
gcactcatgaagctgtttcccatta

SEQ ID NO: 532923 - DNA, 25 bp, Mus musculus
gcactcatgaaggtgtttcccatta

SEQ ID NO: 532924 - DNA, 25 bp, Mus musculus
gcactcatggtaaactttgtttcta

SEQ ID NO: 532925 - DNA, 25 bp, Mus musculus
gcactcatggtatactttgtttcta

SEQ ID NO: 532926 - DNA, 25 bp, Mus musculus
gcactcatgtggagaggctagagat

SEQ ID NO: 532927 - DNA, 25 bp, Mus musculus
gcactcatgtggtgaggctagagat

SEQ ID NO: 532928 - DNA, 25 bp, Mus musculus
gcactcattgtgctgggaattcatg

SEQ ID NO: 532929 - DNA, 25 bp, Mus musculus
gcactcattgtggtgggaattcatg

SEQ ID NO: 532930 - DNA, 25 bp, Mus musculus
gcactccaaaaaaccgttgtgaact

SEQ ID NO: 532931 - DNA, 25 bp, Mus musculus
gcactccaaaaatccgttgtgaact

SEQ ID NO: 532932 - DNA, 25 bp, Mus musculus
gcactccaaggaagacagtaccccg

SEQ ID NO: 532933 - DNA, 25 bp, Mus musculus
gcactccaaggatgacagtaccccg

SEQ ID NO: 532934 - DNA, 25 bp, Mus musculus
gcactccacaatcctagagctgatt

SEQ ID NO: 532935 - DNA, 25 bp, Mus musculus
gcactccacaatgctagagctgatt

SEQ ID NO: 532936 - DNA, 25 bp, Mus musculus
gcactccactaactagggcaactgg

SEQ ID NO: 532937 - DNA, 25 bp, Mus musculus
gcactccactaagtagggcaactgg

SEQ ID NO: 532938 - DNA, 25 bp, Mus musculus
gcactccagaccatggtgtgggcta

SEQ ID NO: 532939 - DNA, 25 bp, Mus musculus
gcactccagaccttggtgtgggcta

SEQ ID NO: 532940 - DNA, 25 bp, Mus musculus
gcactccagaggcatagtcaagagg

SEQ ID NO: 532941 - DNA, 25 bp, Mus musculus
gcactccagagggatagtcaagagg

SEQ ID NO: 532942 - DNA, 25 bp, Mus musculus
gcactccagccaagatttcagacaa

SEQ ID NO: 532943 - DNA, 25 bp, Mus musculus
gcactccagccatgatttcagacaa

SEQ ID NO: 532944 - DNA, 25 bp, Mus musculus
gcactccagggactctttgcaagaa

SEQ ID NO: 532945 - DNA, 25 bp, Mus musculus
gcactccagggagtctttgcaagaa

SEQ ID NO: 532946 - DNA, 25 bp, Mus musculus
gcactccagggcacctgtcagcgtt

SEQ ID NO: 532947 - DNA, 25 bp, Mus musculus
gcactccagggctcctgtcagcgtt

SEQ ID NO: 532948 - DNA, 25 bp, Mus musculus
gcactccataggcttccatcataga

SEQ ID NO: 532949 - DNA, 25 bp, Mus musculus
gcactccatagggttccatcataga

SEQ ID NO: 532950 - DNA, 25 bp, Mus musculus
gcactccattctcatgatcctgtaa

SEQ ID NO: 532951 - DNA, 25 bp, Mus musculus
gcactccattctgatgatcctgtaa

SEQ ID NO: 532952 - DNA, 25 bp, Mus musculus
gcactcccggcccaataattattgt

SEQ ID NO: 532953 - DNA, 25 bp, Mus musculus
gcactcccggccgaataattattgt

SEQ ID NO: 532954 - DNA, 25 bp, Mus musculus
gcactcccgtgtctggcagtcaaag

SEQ ID NO: 532955 - DNA, 25 bp, Mus musculus
gcactcccgtgtgtggcagtcaaag

SEQ ID NO: 532956 - DNA, 25 bp, Mus musculus
gcactccggattaacaccatctaat

SEQ ID NO: 532957 - DNA, 25 bp, Mus musculus
gcactccggatttacaccatctaat

SEQ ID NO: 532958 - DNA, 25 bp, Mus musculus
gcactcctaatcatctgctttttct

SEQ ID NO: 532959 - DNA, 25 bp, Mus musculus
gcactcctaatcttctgctttttct

SEQ ID NO: 532960 - DNA, 25 bp, Mus musculus
gcactcctaggtctttgttaataac

SEQ ID NO: 532961 - DNA, 25 bp, Mus musculus
gcactcctaggtgtttgttaataac

SEQ ID NO: 532962 - DNA, 25 bp, Mus musculus
gcactcctccacagtggatgacata

SEQ ID NO: 532963 - DNA, 25 bp, Mus musculus
gcactcctccactgtggatgacata

SEQ ID NO: 532964 - DNA, 25 bp, Mus musculus
gcactcctggctagaaacatcaact

SEQ ID NO: 532965 - DNA, 25 bp, Mus musculus
gcactcctggcttgaaacatcaact

SEQ ID NO: 532966 - DNA, 25 bp, Mus musculus
gcactccttttcattctgggatgta

SEQ ID NO: 532967 - DNA, 25 bp, Mus musculus
gcactccttttctttctgggatgta

SEQ ID NO: 532968 - DNA, 25 bp, Mus musculus
gcactcgaacggaagatggtgcctg

SEQ ID NO: 532969 - DNA, 25 bp, Mus musculus
gcactcgaacggtagatggtgcctg

SEQ ID NO: 532970 - DNA, 25 bp, Mus musculus
gcactcgaagatcgttctttccctc

SEQ ID NO: 532971 - DNA, 25 bp, Mus musculus
gcactcgaagatggttctttccctc

SEQ ID NO: 532972 - DNA, 25 bp, Mus musculus
gcactcgaagttacctgggtacaaa

SEQ ID NO: 532973 - DNA, 25 bp, Mus musculus
gcactcgaagtttcctgggtacaaa

SEQ ID NO: 532974 - DNA, 25 bp, Mus musculus
gcactcgatattatgcttcatttac

SEQ ID NO: 532975 - DNA, 25 bp, Mus musculus
gcactcgatattttgcttcatttac

SEQ ID NO: 532976 - DNA, 25 bp, Mus musculus
gcactcgcacaaagatgctctggag

SEQ ID NO: 532977 - DNA, 25 bp, Mus musculus
gcactcgcacaatgatgctctggag

SEQ ID NO: 532978 - DNA, 25 bp, Mus musculus
gcactcgctgctcttgtagatgatc

SEQ ID NO: 532979 - DNA, 25 bp, Mus musculus
gcactcgctgctgttgtagatgatc

SEQ ID NO: 532980 - DNA, 25 bp, Mus musculus
gcactcgcttagaagtaagctctga

SEQ ID NO: 532981 - DNA, 25 bp, Mus musculus
gcactcgcttagtagtaagctctga

SEQ ID NO: 532982 - DNA, 25 bp, Mus musculus
gcactcggagtgactggtatcagga

SEQ ID NO: 532983 - DNA, 25 bp, Mus musculus
gcactcggagtgtctggtatcagga

SEQ ID NO: 532984 - DNA, 25 bp, Mus musculus
gcactcggcagcaggatgcaagaga

SEQ ID NO: 532985 - DNA, 25 bp, Mus musculus
gcactcggcagctggatgcaagaga

SEQ ID NO: 532986 - DNA, 25 bp, Mus musculus
gcactcgggagacagcattcgaact

SEQ ID NO: 532987 - DNA, 25 bp, Mus musculus
gcactcgggagagagcattcgaact

SEQ ID NO: 532988 - DNA, 25 bp, Mus musculus
gcactcgggagcataggcagaatta

SEQ ID NO: 532989 - DNA, 25 bp, Mus musculus
gcactcgggagcttaggcagaatta

SEQ ID NO: 532990 - DNA, 25 bp, Mus musculus
gcactcgggcacagggcacgataga

SEQ ID NO: 532991 - DNA, 25 bp, Mus musculus
gcactcgggcactgggcacgataga

SEQ ID NO: 532992 - DNA, 25 bp, Mus musculus
gcactcgtctgaccctgtgatggca

SEQ ID NO: 532993 - DNA, 25 bp, Mus musculus
gcactcgtctgagcctgtgatggca

SEQ ID NO: 532994 - DNA, 25 bp, Mus musculus
gcactcgtgcccagtatgaagctaa

SEQ ID NO: 532995 - DNA, 25 bp, Mus musculus
gcactcgtgccctgtatgaagctaa

SEQ ID NO: 532996 - DNA, 25 bp, Mus musculus
gcactcgtgtaaaactcatcctatt

SEQ ID NO: 532997 - DNA, 25 bp, Mus musculus
gcactcgtgtaatactcatcctatt

SEQ ID NO: 532998 - DNA, 25 bp, Mus musculus
gcactctaacttatgtgaactgaga

SEQ ID NO: 532999 - DNA, 25 bp, Mus musculus
gcactctaacttttgtgaactgaga

SEQ ID NO: 533000 - DNA, 25 bp, Mus musculus
gcactctactctcgagaactccaag

SEQ ID NO: 533001 - DNA, 25 bp, Mus musculus
gcactctactctggagaactccaag

SEQ ID NO: 533002 - DNA, 25 bp, Mus musculus
gcactctagatgacccctctgcaga

SEQ ID NO: 533003 - DNA, 25 bp, Mus musculus
gcactctagatgtcccctctgcaga

SEQ ID NO: 533004 - DNA, 25 bp, Mus musculus
gcactctcacctatagttcttgtaa

SEQ ID NO: 533005 - DNA, 25 bp, Mus musculus
gcactctcacctttagttcttgtaa

SEQ ID NO: 533006 - DNA, 25 bp, Mus musculus
gcactctcacgtcaatgtttcctta

SEQ ID NO: 533007 - DNA, 25 bp, Mus musculus
gcactctcacgtgaatgtttcctta

SEQ ID NO: 533008 - DNA, 25 bp, Mus musculus
gcactctcacttactgtgttgacga

SEQ ID NO: 533009 - DNA, 25 bp, Mus musculus
gcactctcactttctgtgttgacga

SEQ ID NO: 533010 - DNA, 25 bp, Mus musculus
gcactctcaggacaaaagcctacct

SEQ ID NO: 533011 - DNA, 25 bp, Mus musculus
gcactctcaggagaaaagcctacct

SEQ ID NO: 533012 - DNA, 25 bp, Mus musculus
gcactctccacaaattagcacttga

SEQ ID NO: 533013 - DNA, 25 bp, Mus musculus
gcactctccacatattagcacttga

SEQ ID NO: 533014 - DNA, 25 bp, Mus musculus
gcactctcgtggattcgtacggtgg

SEQ ID NO: 533015 - DNA, 25 bp, Mus musculus
gcactctcgtggtttcgtacggtgg

SEQ ID NO: 533016 - DNA, 25 bp, Mus musculus
gcactctctcatattatgatgtttc

SEQ ID NO: 533017 - DNA, 25 bp, Mus musculus
gcactctctcattttatgatgtttc

SEQ ID NO: 533018 - DNA, 25 bp, Mus musculus
gcactctctgacatcaatttcacta

SEQ ID NO: 533019 - DNA, 25 bp, Mus musculus
gcactctctgacttcaatttcacta

SEQ ID NO: 533020 - DNA, 25 bp, Mus musculus
gcactctctttcatgcttatggcta

SEQ ID NO: 533021 - DNA, 25 bp, Mus musculus
gcactctctttcctggactgatgaa

SEQ ID NO: 533022 - DNA, 25 bp, Mus musculus
gcactctctttcgtggactgatgaa

SEQ ID NO: 533023 - DNA, 25 bp, Mus musculus
gcactctctttcttgcttatggcta

SEQ ID NO: 533024 - DNA, 25 bp, Mus musculus
gcactctgatggaagaagcagaact

SEQ ID NO: 533025 - DNA, 25 bp, Mus musculus
gcactctgatggtagaagcagaact

SEQ ID NO: 533026 - DNA, 25 bp, Mus musculus
gcactctgcaacctgctcaccagta

SEQ ID NO: 533027 - DNA, 25 bp, Mus musculus
gcactctgcaacgtgctcaccagta

SEQ ID NO: 533028 - DNA, 25 bp, Mus musculus
gcactctgccatagcactttgtaaa

SEQ ID NO: 533029 - DNA, 25 bp, Mus musculus
gcactctgccattgcactttgtaaa

SEQ ID NO: 533030 - DNA, 25 bp, Mus musculus
gcactctgctatatagccaaccttg

SEQ ID NO: 533031 - DNA, 25 bp, Mus musculus
gcactctgctatttagccaaccttg

SEQ ID NO: 533032 - DNA, 25 bp, Mus musculus
gcactctggaagctgtcaatctagg

SEQ ID NO: 533033 - DNA, 25 bp, Mus musculus
gcactctggaaggtgtcaatctagg

SEQ ID NO: 533034 - DNA, 25 bp, Mus musculus
gcactctgggttataatcttcccgg

SEQ ID NO: 533035 - DNA, 25 bp, Mus musculus
gcactctgggttttaatcttcccgg

SEQ ID NO: 533036 - DNA, 25 bp, Mus musculus
gcactctgtaatcctcacatgctga

SEQ ID NO: 533037 - DNA, 25 bp, Mus musculus
gcactctgtaatgctcacatgctga

SEQ ID NO: 533038 - DNA, 25 bp, Mus musculus
gcactcttaaggattcttgccttct

SEQ ID NO: 533039 - DNA, 25 bp, Mus musculus
gcactcttaaggtttcttgccttct

SEQ ID NO: 533040 - DNA, 25 bp, Mus musculus
gcactcttagtgaagtttcccatgg

SEQ ID NO: 533041 - DNA, 25 bp, Mus musculus
gcactcttagtgtagtttcccatgg

SEQ ID NO: 533042 - DNA, 25 bp, Mus musculus
gcactcttcagacataggcaggcca

SEQ ID NO: 533043 - DNA, 25 bp, Mus musculus
gcactcttcagagataggcaggcca

SEQ ID NO: 533044 - DNA, 25 bp, Mus musculus
gcactcttccaaaataggcagcatt

SEQ ID NO: 533045 - DNA, 25 bp, Mus musculus
gcactcttccaatataggcagcatt

SEQ ID NO: 533046 - DNA, 25 bp, Mus musculus
gcactcttccctaaacaagctctaa

SEQ ID NO: 533047 - DNA, 25 bp, Mus musculus
gcactcttcccttaacaagctctaa

SEQ ID NO: 533048 - DNA, 25 bp, Mus musculus
gcactcttgacaactgacgggcaga

SEQ ID NO: 533049 - DNA, 25 bp, Mus musculus
gcactcttgacatctgacgggcaga

SEQ ID NO: 533050 - DNA, 25 bp, Mus musculus
gcactcttgactaataattttataa

SEQ ID NO: 533051 - DNA, 25 bp, Mus musculus
gcactcttgacttataattttataa

SEQ ID NO: 533052 - DNA, 25 bp, Mus musculus
gcactcttgcgaccggcttttgtag

SEQ ID NO: 533053 - DNA, 25 bp, Mus musculus
gcactcttgcgagcggcttttgtag

SEQ ID NO: 533054 - DNA, 25 bp, Mus musculus
gcactcttgggcagcacgatgaaca

SEQ ID NO: 533055 - DNA, 25 bp, Mus musculus
gcactcttgggctgcacgatgaaca

SEQ ID NO: 533056 - DNA, 25 bp, Mus musculus
gcactctttaacaattgaaccacct

SEQ ID NO: 533057 - DNA, 25 bp, Mus musculus
gcactctttaactattgaaccacct

SEQ ID NO: 533058 - DNA, 25 bp, Mus musculus
gcactctttgagattctctattggg

SEQ ID NO: 533059 - DNA, 25 bp, Mus musculus
gcactctttgagtttctctattggg

SEQ ID NO: 533060 - DNA, 25 bp, Mus musculus
gcactctttggcagcatgcaggaca

SEQ ID NO: 533061 - DNA, 25 bp, Mus musculus
gcactctttggctgcatgcaggaca

SEQ ID NO: 533062 - DNA, 25 bp, Mus musculus
gcactgaaatttctagacagacatt

SEQ ID NO: 533063 - DNA, 25 bp, Mus musculus
gcactgaaatttgtagacagacatt

SEQ ID NO: 533064 - DNA, 25 bp, Mus musculus
gcactgaacacaagctctgagcctg

SEQ ID NO: 533065 - DNA, 25 bp, Mus musculus
gcactgaacacatgctctgagcctg

SEQ ID NO: 533066 - DNA, 25 bp, Mus musculus
gcactgaacagtcagtctggttaga

SEQ ID NO: 533067 - DNA, 25 bp, Mus musculus
gcactgaacagtgagtctggttaga

SEQ ID NO: 533068 - DNA, 25 bp, Mus musculus
gcactgaaggacagtttgcctccca

SEQ ID NO: 533069 - DNA, 25 bp, Mus musculus
gcactgaaggactgtttgcctccca

SEQ ID NO: 533070 - DNA, 25 bp, Mus musculus
gcactgaagtacaatggtctcccca

SEQ ID NO: 533071 - DNA, 25 bp, Mus musculus
gcactgaagtactatggtctcccca

SEQ ID NO: 533072 - DNA, 25 bp, Mus musculus
gcactgaagtagaaccaggtcacaa

SEQ ID NO: 533073 - DNA, 25 bp, Mus musculus
gcactgaagtagtaccaggtcacaa

SEQ ID NO: 533074 - DNA, 25 bp, Mus musculus
gcactgaagtttagaaatacctttg

SEQ ID NO: 533075 - DNA, 25 bp, Mus musculus
gcactgaagttttgaaatacctttg

SEQ ID NO: 533076 - DNA, 25 bp, Mus musculus
gcactgaatgctctgtataatctct

SEQ ID NO: 533077 - DNA, 25 bp, Mus musculus
gcactgaatgctgtgtataatctct

SEQ ID NO: 533078 - DNA, 25 bp, Mus musculus
gcactgaattataccttcttcattg

SEQ ID NO: 533079 - DNA, 25 bp, Mus musculus
gcactgaattattccttcttcattg

SEQ ID NO: 533080 - DNA, 25 bp, Mus musculus
gcactgacacccctatcactgagat

SEQ ID NO: 533081 - DNA, 25 bp, Mus musculus
gcactgacacccgtatcactgagat

SEQ ID NO: 533082 - DNA, 25 bp, Mus musculus
gcactgacatgcaattgcatagcac

SEQ ID NO: 533083 - DNA, 25 bp, Mus musculus
gcactgacatgctattgcatagcac

SEQ ID NO: 533084 - DNA, 25 bp, Mus musculus
gcactgacattgaacagacgtgtgt

SEQ ID NO: 533085 - DNA, 25 bp, Mus musculus
gcactgacattgtacagacgtgtgt

SEQ ID NO: 533086 - DNA, 25 bp, Mus musculus
gcactgacctgcatgcaggcctcag

SEQ ID NO: 533087 - DNA, 25 bp, Mus musculus
gcactgacctgcttgcaggcctcag

SEQ ID NO: 533088 - DNA, 25 bp, Mus musculus
gcactgacgcagcagctcgaggctt

SEQ ID NO: 533089 - DNA, 25 bp, Mus musculus
gcactgacgcaggagctcgaggctt

SEQ ID NO: 533090 - DNA, 25 bp, Mus musculus
gcactgacgctgatggcctcttttg

SEQ ID NO: 533091 - DNA, 25 bp, Mus musculus
gcactgacgctgttggcctcttttg

SEQ ID NO: 533092 - DNA, 25 bp, Mus musculus
gcactgactacaattggattcttgt

SEQ ID NO: 533093 - DNA, 25 bp, Mus musculus
gcactgactacaccaggtggagatg

SEQ ID NO: 533094 - DNA, 25 bp, Mus musculus
gcactgactacactgtgctcagaat

SEQ ID NO: 533095 - DNA, 25 bp, Mus musculus
gcactgactacagcaggtggagatg

SEQ ID NO: 533096 - DNA, 25 bp, Mus musculus
gcactgactacagtgtgctcagaat

SEQ ID NO: 533097 - DNA, 25 bp, Mus musculus
gcactgactacatttggattcttgt

SEQ ID NO: 533098 - DNA, 25 bp, Mus musculus
gcactgactattccattcacttttg

SEQ ID NO: 533099 - DNA, 25 bp, Mus musculus
gcactgactattgcattcacttttg

SEQ ID NO: 533100 - DNA, 25 bp, Mus musculus
gcactgactcgccaattacaattca

SEQ ID NO: 533101 - DNA, 25 bp, Mus musculus
gcactgactcgcgaattacaattca

SEQ ID NO: 533102 - DNA, 25 bp, Mus musculus
gcactgactgaacggtccggagtac

SEQ ID NO: 533103 - DNA, 25 bp, Mus musculus
gcactgactgaagggtccggagtac

SEQ ID NO: 533104 - DNA, 25 bp, Mus musculus
gcactgactgctattttaagggttc

SEQ ID NO: 533105 - DNA, 25 bp, Mus musculus
gcactgactgcttttttaagggttc

SEQ ID NO: 533106 - DNA, 25 bp, Mus musculus
gcactgactttgaatcgatcgctat

SEQ ID NO: 533107 - DNA, 25 bp, Mus musculus
gcactgactttgtatcgatcgctat

SEQ ID NO: 533108 - DNA, 25 bp, Mus musculus
gcactgagaaccacggaaggcgcct

SEQ ID NO: 533109 - DNA, 25 bp, Mus musculus
gcactgagaacctcggaaggcgcct

SEQ ID NO: 533110 - DNA, 25 bp, Mus musculus
gcactgagaattcgactctgggcct

SEQ ID NO: 533111 - DNA, 25 bp, Mus musculus
gcactgagaattggactctgggcct

SEQ ID NO: 533112 - DNA, 25 bp, Mus musculus
gcactgagaggacttactgccacct

SEQ ID NO: 533113 - DNA, 25 bp, Mus musculus
gcactgagaggagttactgccacct

SEQ ID NO: 533114 - DNA, 25 bp, Mus musculus
gcactgagagtcatcttgttcttga

SEQ ID NO: 533115 - DNA, 25 bp, Mus musculus
gcactgagagtcttcttgttcttga

SEQ ID NO: 533116 - DNA, 25 bp, Mus musculus
gcactgagatctaaggccctcttct

SEQ ID NO: 533117 - DNA, 25 bp, Mus musculus
gcactgagatcttaggccctcttct

SEQ ID NO: 533118 - DNA, 25 bp, Mus musculus
gcactgagatttcgttagggccatc

SEQ ID NO: 533119 - DNA, 25 bp, Mus musculus
gcactgagatttggttagggccatc

SEQ ID NO: 533120 - DNA, 25 bp, Mus musculus
gcactgagcagtcatctggagagtt

SEQ ID NO: 533121 - DNA, 25 bp, Mus musculus
gcactgagcagtgatctggagagtt

SEQ ID NO: 533122 - DNA, 25 bp, Mus musculus
gcactgaggacaacacttctccaca

SEQ ID NO: 533123 - DNA, 25 bp, Mus musculus
gcactgaggacatcacttctccaca

SEQ ID NO: 533124 - DNA, 25 bp, Mus musculus
gcactgaggcagaacttacacgaga

SEQ ID NO: 533125 - DNA, 25 bp, Mus musculus
gcactgaggcagtacttacacgaga

SEQ ID NO: 533126 - DNA, 25 bp, Mus musculus
gcactgaggctgaccaaggcatgtt

SEQ ID NO: 533127 - DNA, 25 bp, Mus musculus
gcactgaggctgtccaaggcatgtt

SEQ ID NO: 533128 - DNA, 25 bp, Mus musculus
gcactgaggtctcaccaaattttct

SEQ ID NO: 533129 - DNA, 25 bp, Mus musculus
gcactgaggtctgaccaaattttct

SEQ ID NO: 533130 - DNA, 25 bp, Mus musculus
gcactgaggttcatgctctcacaaa

SEQ ID NO: 533131 - DNA, 25 bp, Mus musculus
gcactgaggttcttgctctcacaaa

SEQ ID NO: 533132 - DNA, 25 bp, Mus musculus
gcactgagtacaacctccggctgaa

SEQ ID NO: 533133 - DNA, 25 bp, Mus musculus
gcactgagtacatcctccggctgaa

SEQ ID NO: 533134 - DNA, 25 bp, Mus musculus
gcactgagtagaaagaccatcccta

SEQ ID NO: 533135 - DNA, 25 bp, Mus musculus
gcactgagtagaacctgagcgggtt

SEQ ID NO: 533136 - DNA, 25 bp, Mus musculus
gcactgagtagatagaccatcccta

SEQ ID NO: 533137 - DNA, 25 bp, Mus musculus
gcactgagtagatcctgagcgggtt

SEQ ID NO: 533138 - DNA, 25 bp, Mus musculus
gcactgagtcaacgcctggaattct

SEQ ID NO: 533139 - DNA, 25 bp, Mus musculus
gcactgagtcaaggcctggaattct

SEQ ID NO: 533140 - DNA, 25 bp, Mus musculus
gcactgagtgagatttgttttccat

SEQ ID NO: 533141 - DNA, 25 bp, Mus musculus
gcactgagtgagttttgttttccat

SEQ ID NO: 533142 - DNA, 25 bp, Mus musculus
gcactgagtgatcttctccgtctaa

SEQ ID NO: 533143 - DNA, 25 bp, Mus musculus
gcactgagtgatgttctccgtctaa

SEQ ID NO: 533144 - DNA, 25 bp, Mus musculus
gcactgagtggcatccaccaggaat

SEQ ID NO: 533145 - DNA, 25 bp, Mus musculus
gcactgagtggcttccaccaggaat

SEQ ID NO: 533146 - DNA, 25 bp, Mus musculus
gcactgagttttaaaagcccactgt

SEQ ID NO: 533147 - DNA, 25 bp, Mus musculus
gcactgagtttttaaagcccactgt

SEQ ID NO: 533148 - DNA, 25 bp, Mus musculus
gcactgatatttctatacaggataa

SEQ ID NO: 533149 - DNA, 25 bp, Mus musculus
gcactgatatttgtatacaggataa

SEQ ID NO: 533150 - DNA, 25 bp, Mus musculus
gcactgatctagatgcatggttagt

SEQ ID NO: 533151 - DNA, 25 bp, Mus musculus
gcactgatctagttgcatggttagt

SEQ ID NO: 533152 - DNA, 25 bp, Mus musculus
gcactgatctgcaagagctgtaata

SEQ ID NO: 533153 - DNA, 25 bp, Mus musculus
gcactgatctgctagagctgtaata

SEQ ID NO: 533154 - DNA, 25 bp, Mus musculus
gcactgatcttcacggccagataaa

SEQ ID NO: 533155 - DNA, 25 bp, Mus musculus
gcactgatcttctcggccagataaa

SEQ ID NO: 533156 - DNA, 25 bp, Mus musculus
gcactgatgaccctaagggtatcac

SEQ ID NO: 533157 - DNA, 25 bp, Mus musculus
gcactgatgaccgtaagggtatcac

SEQ ID NO: 533158 - DNA, 25 bp, Mus musculus
gcactgatgactccatgaccctgca

SEQ ID NO: 533159 - DNA, 25 bp, Mus musculus
gcactgatgactgcatgaccctgca

SEQ ID NO: 533160 - DNA, 25 bp, Mus musculus
gcactgatgagtccccgtggccaga

SEQ ID NO: 533161 - DNA, 25 bp, Mus musculus
gcactgatgagtgcccgtggccaga

SEQ ID NO: 533162 - DNA, 25 bp, Mus musculus
gcactgatggctctgtaggcagtac

SEQ ID NO: 533163 - DNA, 25 bp, Mus musculus
gcactgatggctgtgtaggcagtac

SEQ ID NO: 533164 - DNA, 25 bp, Mus musculus
gcactgatgggcataaactttaact

SEQ ID NO: 533165 - DNA, 25 bp, Mus musculus
gcactgatgggcttaaactttaact

SEQ ID NO: 533166 - DNA, 25 bp, Mus musculus
gcactgatggtcacattattcctaa

SEQ ID NO: 533167 - DNA, 25 bp, Mus musculus
gcactgatggtctcattattcctaa

SEQ ID NO: 533168 - DNA, 25 bp, Mus musculus
gcactgatgtgaagagcatggagat

SEQ ID NO: 533169 - DNA, 25 bp, Mus musculus
gcactgatgtgatgagcatggagat

SEQ ID NO: 533170 - DNA, 25 bp, Mus musculus
gcactgatgttgaatcccctgaggg

SEQ ID NO: 533171 - DNA, 25 bp, Mus musculus
gcactgatgttgtatcccctgaggg

SEQ ID NO: 533172 - DNA, 25 bp, Mus musculus
gcactgattactcttccataggata

SEQ ID NO: 533173 - DNA, 25 bp, Mus musculus
gcactgattactgttccataggata

SEQ ID NO: 533174 - DNA, 25 bp, Mus musculus
gcactgattgttaatatccttgtta

SEQ ID NO: 533175 - DNA, 25 bp, Mus musculus
gcactgattgtttatatccttgtta

SEQ ID NO: 533176 - DNA, 25 bp, Mus musculus
gcactgatttcgaccaggttcgttc

SEQ ID NO: 533177 - DNA, 25 bp, Mus musculus
gcactgatttcgtccaggttcgttc

SEQ ID NO: 533178 - DNA, 25 bp, Mus musculus
gcactgatttgaccattgtgaattc

SEQ ID NO: 533179 - DNA, 25 bp, Mus musculus
gcactgatttgagcattgtgaattc

SEQ ID NO: 533180 - DNA, 25 bp, Mus musculus
gcactgcaattgcacttcacactaa

SEQ ID NO: 533181 - DNA, 25 bp, Mus musculus
gcactgcaattggacttcacactaa

SEQ ID NO: 533182 - DNA, 25 bp, Mus musculus
gcactgcaatttagcacccttggat

SEQ ID NO: 533183 - DNA, 25 bp, Mus musculus
gcactgcaattttgcacccttggat

SEQ ID NO: 533184 - DNA, 25 bp, Mus musculus
gcactgcacaggcatcctagcgagt

SEQ ID NO: 533185 - DNA, 25 bp, Mus musculus
gcactgcacagggatcctagcgagt

SEQ ID NO: 533186 - DNA, 25 bp, Mus musculus
gcactgcaccacatatggacttgta

SEQ ID NO: 533187 - DNA, 25 bp, Mus musculus
gcactgcaccacttatggacttgta

SEQ ID NO: 533188 - DNA, 25 bp, Mus musculus
gcactgcactgcctttggacttggg

SEQ ID NO: 533189 - DNA, 25 bp, Mus musculus
gcactgcactgcgtttggacttggg

SEQ ID NO: 533190 - DNA, 25 bp, Mus musculus
gcactgcagaaaagctccagggtgt

SEQ ID NO: 533191 - DNA, 25 bp, Mus musculus
gcactgcagaaatgctccagggtgt

SEQ ID NO: 533192 - DNA, 25 bp, Mus musculus
gcactgcagaatcacatagcccaaa

SEQ ID NO: 533193 - DNA, 25 bp, Mus musculus
gcactgcagaatgacatagcccaaa

SEQ ID NO: 533194 - DNA, 25 bp, Mus musculus
gcactgcagacaaggtacggctttg

SEQ ID NO: 533195 - DNA, 25 bp, Mus musculus
gcactgcagacatggtacggctttg

SEQ ID NO: 533196 - DNA, 25 bp, Mus musculus
gcactgcagagaagcgctacgtttt

SEQ ID NO: 533197 - DNA, 25 bp, Mus musculus
gcactgcagagatgcgctacgtttt

SEQ ID NO: 533198 - DNA, 25 bp, Mus musculus
gcactgcagcatccctaatgagagg

SEQ ID NO: 533199 - DNA, 25 bp, Mus musculus
gcactgcagcatgcctaatgagagg

SEQ ID NO: 533200 - DNA, 25 bp, Mus musculus
gcactgcagctccaagaagatgaat

SEQ ID NO: 533201 - DNA, 25 bp, Mus musculus
gcactgcagctcgaagaagatgaat

SEQ ID NO: 533202 - DNA, 25 bp, Mus musculus
gcactgcataatactatttgtcctg

SEQ ID NO: 533203 - DNA, 25 bp, Mus musculus
gcactgcataattctatttgtcctg

SEQ ID NO: 533204 - DNA, 25 bp, Mus musculus
gcactgcatgccctcagagatggaa

SEQ ID NO: 533205 - DNA, 25 bp, Mus musculus
gcactgcatgccgtcagagatggaa

SEQ ID NO: 533206 - DNA, 25 bp, Mus musculus
gcactgcattgtatacagtccaagc

SEQ ID NO: 533207 - DNA, 25 bp, Mus musculus
gcactgcattgtttacagtccaagc

SEQ ID NO: 533208 - DNA, 25 bp, Mus musculus
gcactgccagaacggtcattttgaa

SEQ ID NO: 533209 - DNA, 25 bp, Mus musculus
gcactgccagaagggtcattttgaa

SEQ ID NO: 533210 - DNA, 25 bp, Mus musculus
gcactgccaggaattttgagaccca

SEQ ID NO: 533211 - DNA, 25 bp, Mus musculus
gcactgccaggatttttgagaccca

SEQ ID NO: 533212 - DNA, 25 bp, Mus musculus
gcactgccagtgaatgtccctagta

SEQ ID NO: 533213 - DNA, 25 bp, Mus musculus
gcactgccagtgtatgtccctagta

SEQ ID NO: 533214 - DNA, 25 bp, Mus musculus
gcactgccatcactcagcaagaagt

SEQ ID NO: 533215 - DNA, 25 bp, Mus musculus
gcactgccatcagtcagcaagaagt

SEQ ID NO: 533216 - DNA, 25 bp, Mus musculus
gcactgccccttcagagtacaaatg

SEQ ID NO: 533217 - DNA, 25 bp, Mus musculus
gcactgccccttgagagtacaaatg

SEQ ID NO: 533218 - DNA, 25 bp, Mus musculus
gcactgcccgtgatgagctttgagg

SEQ ID NO: 533219 - DNA, 25 bp, Mus musculus
gcactgcccgtgttgagctttgagg

SEQ ID NO: 533220 - DNA, 25 bp, Mus musculus
gcactgcctaaaatgccacatacct

SEQ ID NO: 533221 - DNA, 25 bp, Mus musculus
gcactgcctaaattgccacatacct

SEQ ID NO: 533222 - DNA, 25 bp, Mus musculus
gcactgcctcttaactcagatcaga

SEQ ID NO: 533223 - DNA, 25 bp, Mus musculus
gcactgcctctttactcagatcaga

SEQ ID NO: 533224 - DNA, 25 bp, Mus musculus
gcactgcgtgccaattgcaacaaaa

SEQ ID NO: 533225 - DNA, 25 bp, Mus musculus
gcactgcgtgcctattgcaacaaaa

SEQ ID NO: 533226 - DNA, 25 bp, Mus musculus
gcactgctatcaatcagcacgtgta

SEQ ID NO: 533227 - DNA, 25 bp, Mus musculus
gcactgctatcattcagcacgtgta

SEQ ID NO: 533228 - DNA, 25 bp, Mus musculus
gcactgctattgacagcatctctta

SEQ ID NO: 533229 - DNA, 25 bp, Mus musculus
gcactgctattgtcagcatctctta

SEQ ID NO: 533230 - DNA, 25 bp, Mus musculus
gcactgctcagacgatttgtgtcca

SEQ ID NO: 533231 - DNA, 25 bp, Mus musculus
gcactgctcagaggatttgtgtcca

SEQ ID NO: 533232 - DNA, 25 bp, Mus musculus
gcactgctcgctcctggcgtggcta

SEQ ID NO: 533233 - DNA, 25 bp, Mus musculus
gcactgctcgctgctggcgtggcta

SEQ ID NO: 533234 - DNA, 25 bp, Mus musculus
gcactgctctaaaggtcctagctgg

SEQ ID NO: 533235 - DNA, 25 bp, Mus musculus
gcactgctctaatggtcctagctgg

SEQ ID NO: 533236 - DNA, 25 bp, Mus musculus
gcactgctctctatagaagcgggca

SEQ ID NO: 533237 - DNA, 25 bp, Mus musculus
gcactgctctctttagaagcgggca

SEQ ID NO: 533238 - DNA, 25 bp, Mus musculus
gcactgctgcatacaatgttggcga

SEQ ID NO: 533239 - DNA, 25 bp, Mus musculus
gcactgctgcattcaatgttggcga

SEQ ID NO: 533240 - DNA, 25 bp, Mus musculus
gcactgctgcttctaataagtatct

SEQ ID NO: 533241 - DNA, 25 bp, Mus musculus
gcactgctgcttgtaataagtatct

SEQ ID NO: 533242 - DNA, 25 bp, Mus musculus
gcactgctgggcataagaggttaca

SEQ ID NO: 533243 - DNA, 25 bp, Mus musculus
gcactgctgggcttaagaggttaca

SEQ ID NO: 533244 - DNA, 25 bp, Mus musculus
gcactgctgtgtaccttgcagaggg

SEQ ID NO: 533245 - DNA, 25 bp, Mus musculus
gcactgctgtgttccttgcagaggg

SEQ ID NO: 533246 - DNA, 25 bp, Mus musculus
gcactgctgtttcttctcatatcta

SEQ ID NO: 533247 - DNA, 25 bp, Mus musculus
gcactgctgtttgttctcatatcta

SEQ ID NO: 533248 - DNA, 25 bp, Mus musculus
gcactgcttactcccagtctgatgg

SEQ ID NO: 533249 - DNA, 25 bp, Mus musculus
gcactgcttactgccagtctgatgg

SEQ ID NO: 533250 - DNA, 25 bp, Mus musculus
gcactgcttagaacaacggctcact

SEQ ID NO: 533251 - DNA, 25 bp, Mus musculus
gcactgcttagatcaacggctcact

SEQ ID NO: 533252 - DNA, 25 bp, Mus musculus
gcactgcttataaaaccactgggag

SEQ ID NO: 533253 - DNA, 25 bp, Mus musculus
gcactgcttatataaccactgggag

SEQ ID NO: 533254 - DNA, 25 bp, Mus musculus
gcactgcttcccacatgtgtgcagt

SEQ ID NO: 533255 - DNA, 25 bp, Mus musculus
gcactgcttccctcatgtgtgcagt

SEQ ID NO: 533256 - DNA, 25 bp, Mus musculus
gcactgcttcttactagatacggta

SEQ ID NO: 533257 - DNA, 25 bp, Mus musculus
gcactgcttctttctagatacggta

SEQ ID NO: 533258 - DNA, 25 bp, Mus musculus
gcactgctttacatgtgttttctta

SEQ ID NO: 533259 - DNA, 25 bp, Mus musculus
gcactgctttacttgtgttttctta

SEQ ID NO: 533260 - DNA, 25 bp, Mus musculus
gcactgctttgaagatcgctctgga

SEQ ID NO: 533261 - DNA, 25 bp, Mus musculus
gcactgctttgatgatcgctctgga

SEQ ID NO: 533262 - DNA, 25 bp, Mus musculus
gcactggaaaacataactcgtactt

SEQ ID NO: 533263 - DNA, 25 bp, Mus musculus
gcactggaaaacttaactcgtactt

SEQ ID NO: 533264 - DNA, 25 bp, Mus musculus
gcactggaacataggatagcctcag

SEQ ID NO: 533265 - DNA, 25 bp, Mus musculus
gcactggaacattggatagcctcag

SEQ ID NO: 533266 - DNA, 25 bp, Mus musculus
gcactggaactactgctatgagcca

SEQ ID NO: 533267 - DNA, 25 bp, Mus musculus
gcactggaactagtgctatgagcca

SEQ ID NO: 533268 - DNA, 25 bp, Mus musculus
gcactggaagctacagagtcctgtt

SEQ ID NO: 533269 - DNA, 25 bp, Mus musculus
gcactggaagcttcagagtcctgtt

SEQ ID NO: 533270 - DNA, 25 bp, Mus musculus
gcactggaaggccacagcgaagaat

SEQ ID NO: 533271 - DNA, 25 bp, Mus musculus
gcactggaaggcgacagcgaagaat

SEQ ID NO: 533272 - DNA, 25 bp, Mus musculus
gcactggaagtcctccctgatagag

SEQ ID NO: 533273 - DNA, 25 bp, Mus musculus
gcactggaagtcgtccctgatagag

SEQ ID NO: 533274 - DNA, 25 bp, Mus musculus
gcactggacaggacactgtctccaa

SEQ ID NO: 533275 - DNA, 25 bp, Mus musculus
gcactggacaggtcactgtctccaa

SEQ ID NO: 533276 - DNA, 25 bp, Mus musculus
gcactggacattcttgatgtggtaa

SEQ ID NO: 533277 - DNA, 25 bp, Mus musculus
gcactggacattgttgatgtggtaa

SEQ ID NO: 533278 - DNA, 25 bp, Mus musculus
gcactggactgcagggccacatctt

SEQ ID NO: 533279 - DNA, 25 bp, Mus musculus
gcactggactgctgggccacatctt

SEQ ID NO: 533280 - DNA, 25 bp, Mus musculus
gcactggagcacaagtcgtcttata

SEQ ID NO: 533281 - DNA, 25 bp, Mus musculus
gcactggagcactagtcgtcttata

SEQ ID NO: 533282 - DNA, 25 bp, Mus musculus
gcactggatagaattgtacgacgag

SEQ ID NO: 533283 - DNA, 25 bp, Mus musculus
gcactggatagatttgtacgacgag

SEQ ID NO: 533284 - DNA, 25 bp, Mus musculus
gcactggatccaattatacatgttg

SEQ ID NO: 533285 - DNA, 25 bp, Mus musculus
gcactggatccacctgttgtaaata

SEQ ID NO: 533286 - DNA, 25 bp, Mus musculus
gcactggatccagctgttgtaaata

SEQ ID NO: 533287 - DNA, 25 bp, Mus musculus
gcactggatccatttatacatgttg

SEQ ID NO: 533288 - DNA, 25 bp, Mus musculus
gcactggatctcacggtgtagacca

SEQ ID NO: 533289 - DNA, 25 bp, Mus musculus
gcactggatctctcggtgtagacca

SEQ ID NO: 533290 - DNA, 25 bp, Mus musculus
gcactggatgctctaataatgttaa

SEQ ID NO: 533291 - DNA, 25 bp, Mus musculus
gcactggatgctgtaataatgttaa

SEQ ID NO: 533292 - DNA, 25 bp, Mus musculus
gcactggatgttctgcagaagttct

SEQ ID NO: 533293 - DNA, 25 bp, Mus musculus
gcactggatgttgtgcagaagttct

SEQ ID NO: 533294 - DNA, 25 bp, Mus musculus
gcactggattgcaatatttttaacc

SEQ ID NO: 533295 - DNA, 25 bp, Mus musculus
gcactggattgctatatttttaacc

SEQ ID NO: 533296 - DNA, 25 bp, Mus musculus
gcactggcaaagacacaccatgtga

SEQ ID NO: 533297 - DNA, 25 bp, Mus musculus
gcactggcaaagtcacaccatgtga

SEQ ID NO: 533298 - DNA, 25 bp, Mus musculus
gcactggcaattctcactttgtcat

SEQ ID NO: 533299 - DNA, 25 bp, Mus musculus
gcactggcaattgtcactttgtcat

SEQ ID NO: 533300 - DNA, 25 bp, Mus musculus
gcactggcacttccttcataaagat

SEQ ID NO: 533301 - DNA, 25 bp, Mus musculus
gcactggcacttgcttcataaagat

SEQ ID NO: 533302 - DNA, 25 bp, Mus musculus
gcactggccactctagttcgtaggg

SEQ ID NO: 533303 - DNA, 25 bp, Mus musculus
gcactggccactgtagttcgtaggg

SEQ ID NO: 533304 - DNA, 25 bp, Mus musculus
gcactggccatcatagagccgtatt

SEQ ID NO: 533305 - DNA, 25 bp, Mus musculus
gcactggccatcttagagccgtatt

SEQ ID NO: 533306 - DNA, 25 bp, Mus musculus
gcactggccattcgcttgtcctggt

SEQ ID NO: 533307 - DNA, 25 bp, Mus musculus
gcactggccattggcttgtcctggt

SEQ ID NO: 533308 - DNA, 25 bp, Mus musculus
gcactggcctggcactttcatggag

SEQ ID NO: 533309 - DNA, 25 bp, Mus musculus
gcactggcctgggactttcatggag

SEQ ID NO: 533310 - DNA, 25 bp, Mus musculus
gcactggccttcaagaagcttggca

SEQ ID NO: 533311 - DNA, 25 bp, Mus musculus
gcactggccttctagaagcttggca

SEQ ID NO: 533312 - DNA, 25 bp, Mus musculus
gcactggcgatgacctagatctgat

SEQ ID NO: 533313 - DNA, 25 bp, Mus musculus
gcactggcgatgtcctagatctgat

SEQ ID NO: 533314 - DNA, 25 bp, Mus musculus
gcactggctcggaggtgtccagcac

SEQ ID NO: 533315 - DNA, 25 bp, Mus musculus
gcactggctcggtggtgtccagcac

SEQ ID NO: 533316 - DNA, 25 bp, Mus musculus
gcactggctcttctgtaccaaatgg

SEQ ID NO: 533317 - DNA, 25 bp, Mus musculus
gcactggctcttgtgtaccaaatgg

SEQ ID NO: 533318 - DNA, 25 bp, Mus musculus
gcactggctgctctatcagagtcaa

SEQ ID NO: 533319 - DNA, 25 bp, Mus musculus
gcactggctgctgtatcagagtcaa

SEQ ID NO: 533320 - DNA, 25 bp, Mus musculus
gcactggcttttcaggtgaatatta

SEQ ID NO: 533321 - DNA, 25 bp, Mus musculus
gcactggcttttgaggtgaatatta

SEQ ID NO: 533322 - DNA, 25 bp, Mus musculus
gcactgggacttcggcatcattagt

SEQ ID NO: 533323 - DNA, 25 bp, Mus musculus
gcactgggacttgggcatcattagt

SEQ ID NO: 533324 - DNA, 25 bp, Mus musculus
gcactgggagttagaagagaaaacc

SEQ ID NO: 533325 - DNA, 25 bp, Mus musculus
gcactgggagtttgaagagaaaacc

SEQ ID NO: 533326 - DNA, 25 bp, Mus musculus
gcactgggatcaacgtgaccactag

SEQ ID NO: 533327 - DNA, 25 bp, Mus musculus
gcactgggatcatcgtgaccactag

SEQ ID NO: 533328 - DNA, 25 bp, Mus musculus
gcactgggcactctacttgggtgat

SEQ ID NO: 533329 - DNA, 25 bp, Mus musculus
gcactgggcactgtacttgggtgat

SEQ ID NO: 533330 - DNA, 25 bp, Mus musculus
gcactgggccacaagcgggaaagaa

SEQ ID NO: 533331 - DNA, 25 bp, Mus musculus
gcactgggccactagcgggaaagaa

SEQ ID NO: 533332 - DNA, 25 bp, Mus musculus
gcactgggcctgaaagagcatctct

SEQ ID NO: 533333 - DNA, 25 bp, Mus musculus
gcactgggcctgtaagagcatctct

SEQ ID NO: 533334 - DNA, 25 bp, Mus musculus
gcactgggctctaaagaaatgatgt

SEQ ID NO: 533335 - DNA, 25 bp, Mus musculus
gcactgggctcttaagaaatgatgt

SEQ ID NO: 533336 - DNA, 25 bp, Mus musculus
gcactgggcttgcagttgcctttcc

SEQ ID NO: 533337 - DNA, 25 bp, Mus musculus
gcactgggcttggagttgcctttcc

SEQ ID NO: 533338 - DNA, 25 bp, Mus musculus
gcactgggtatgaagctctctttcc

SEQ ID NO: 533339 - DNA, 25 bp, Mus musculus
gcactgggtatgtagctctctttcc

SEQ ID NO: 533340 - DNA, 25 bp, Mus musculus
gcactgggtcacatccttaggaaaa

SEQ ID NO: 533341 - DNA, 25 bp, Mus musculus
gcactgggtcacttccttaggaaaa

SEQ ID NO: 533342 - DNA, 25 bp, Mus musculus
gcactgggtcgcataaatgtcaaga

SEQ ID NO: 533343 - DNA, 25 bp, Mus musculus
gcactgggtcgcttaaatgtcaaga

SEQ ID NO: 533344 - DNA, 25 bp, Mus musculus
gcactgggtcgtacggcctggaaaa

SEQ ID NO: 533345 - DNA, 25 bp, Mus musculus
gcactgggtcgttcggcctggaaaa

SEQ ID NO: 533346 - DNA, 25 bp, Mus musculus
gcactgggtctgcacctcagggaaa

SEQ ID NO: 533347 - DNA, 25 bp, Mus musculus
gcactgggtctggacctcagggaaa

SEQ ID NO: 533348 - DNA, 25 bp, Mus musculus
gcactgggtgttagacgaagcctcc

SEQ ID NO: 533349 - DNA, 25 bp, Mus musculus
gcactgggtgtttgacgaagcctcc

SEQ ID NO: 533350 - DNA, 25 bp, Mus musculus
gcactggtgaaacactgggactgaa

SEQ ID NO: 533351 - DNA, 25 bp, Mus musculus
gcactggtgaaagactgggactgaa

SEQ ID NO: 533352 - DNA, 25 bp, Mus musculus
gcactggtgcagattctgggcctca

SEQ ID NO: 533353 - DNA, 25 bp, Mus musculus
gcactggtgcagtttctgggcctca

SEQ ID NO: 533354 - DNA, 25 bp, Mus musculus
gcactggtgccacagaggatagctt

SEQ ID NO: 533355 - DNA, 25 bp, Mus musculus
gcactggtgccagagaggatagctt

SEQ ID NO: 533356 - DNA, 25 bp, Mus musculus
gcactggtgctgcactatcttggtc

SEQ ID NO: 533357 - DNA, 25 bp, Mus musculus
gcactggtgctggactatcttggtc

SEQ ID NO: 533358 - DNA, 25 bp, Mus musculus
gcactggtggaacgcctctttatga

SEQ ID NO: 533359 - DNA, 25 bp, Mus musculus
gcactggtggaaggcctctttatga

SEQ ID NO: 533360 - DNA, 25 bp, Mus musculus
gcactggtggcaattcatcatggaa

SEQ ID NO: 533361 - DNA, 25 bp, Mus musculus
gcactggtggcatttcatcatggaa

SEQ ID NO: 533362 - DNA, 25 bp, Mus musculus
gcactggtgtgaactcgaagtattt

SEQ ID NO: 533363 - DNA, 25 bp, Mus musculus
gcactggtgtgatctcgaagtattt

SEQ ID NO: 533364 - DNA, 25 bp, Mus musculus
gcactggttccactttggactttta

SEQ ID NO: 533365 - DNA, 25 bp, Mus musculus
gcactggttccagtttggactttta

SEQ ID NO: 533366 - DNA, 25 bp, Mus musculus
gcactgtaaaggcactcaggcttct

SEQ ID NO: 533367 - DNA, 25 bp, Mus musculus
gcactgtaaagggactcaggcttct

SEQ ID NO: 533368 - DNA, 25 bp, Mus musculus
gcactgtaacatatgcatgtccaca

SEQ ID NO: 533369 - DNA, 25 bp, Mus musculus
gcactgtaacatttgcatgtccaca

SEQ ID NO: 533370 - DNA, 25 bp, Mus musculus
gcactgtaattccaatagggctgta

SEQ ID NO: 533371 - DNA, 25 bp, Mus musculus
gcactgtaattcgaatagggctgta

SEQ ID NO: 533372 - DNA, 25 bp, Mus musculus
gcactgtactgaatgaaattaaaga

SEQ ID NO: 533373 - DNA, 25 bp, Mus musculus
gcactgtactgactcggccagaggt

SEQ ID NO: 533374 - DNA, 25 bp, Mus musculus
gcactgtactgagtcggccagaggt

SEQ ID NO: 533375 - DNA, 25 bp, Mus musculus
gcactgtactgattgaaattaaaga

SEQ ID NO: 533376 - DNA, 25 bp, Mus musculus
gcactgtagaaaatgtatgtattgt

SEQ ID NO: 533377 - DNA, 25 bp, Mus musculus
gcactgtagaaattgtatgtattgt

SEQ ID NO: 533378 - DNA, 25 bp, Mus musculus
gcactgtagaatagagccccttatc

SEQ ID NO: 533379 - DNA, 25 bp, Mus musculus
gcactgtagaattgagccccttatc

SEQ ID NO: 533380 - DNA, 25 bp, Mus musculus
gcactgtagcttaggccctgggcaa

SEQ ID NO: 533381 - DNA, 25 bp, Mus musculus
gcactgtagctttggccctgggcaa

SEQ ID NO: 533382 - DNA, 25 bp, Mus musculus
gcactgtagggaacttgggtctcca

SEQ ID NO: 533383 - DNA, 25 bp, Mus musculus
gcactgtagggatcttgggtctcca

SEQ ID NO: 533384 - DNA, 25 bp, Mus musculus
gcactgtatacacttctcattcaga

SEQ ID NO: 533385 - DNA, 25 bp, Mus musculus
gcactgtatacagttctcattcaga

SEQ ID NO: 533386 - DNA, 25 bp, Mus musculus
gcactgtattctctttaccattgaa

SEQ ID NO: 533387 - DNA, 25 bp, Mus musculus
gcactgtattctgtttaccattgaa

SEQ ID NO: 533388 - DNA, 25 bp, Mus musculus
gcactgtcaaaaaagatattcctga

SEQ ID NO: 533389 - DNA, 25 bp, Mus musculus
gcactgtcaaaatagatattcctga

SEQ ID NO: 533390 - DNA, 25 bp, Mus musculus
gcactgtcacaactgtagtctatta

SEQ ID NO: 533391 - DNA, 25 bp, Mus musculus
gcactgtcacaagtgtagtctatta

SEQ ID NO: 533392 - DNA, 25 bp, Mus musculus
gcactgtcagcgacatgttgggtct

SEQ ID NO: 533393 - DNA, 25 bp, Mus musculus
gcactgtcagcgtcatgttgggtct

SEQ ID NO: 533394 - DNA, 25 bp, Mus musculus
gcactgtcagttcgactctgtattt

SEQ ID NO: 533395 - DNA, 25 bp, Mus musculus
gcactgtcagttggactctgtattt

SEQ ID NO: 533396 - DNA, 25 bp, Mus musculus
gcactgtcatgaccacgacaagcag

SEQ ID NO: 533397 - DNA, 25 bp, Mus musculus
gcactgtcatgagcacgacaagcag

SEQ ID NO: 533398 - DNA, 25 bp, Mus musculus
gcactgtccaacctgtaagcagtaa

SEQ ID NO: 533399 - DNA, 25 bp, Mus musculus
gcactgtccaacgtgtaagcagtaa

SEQ ID NO: 533400 - DNA, 25 bp, Mus musculus
gcactgtccttaatttaccgtagag

SEQ ID NO: 533401 - DNA, 25 bp, Mus musculus
gcactgtccttattttaccgtagag

SEQ ID NO: 533402 - DNA, 25 bp, Mus musculus
gcactgtcgactaccataaaacctt

SEQ ID NO: 533403 - DNA, 25 bp, Mus musculus
gcactgtcgacttccataaaacctt

SEQ ID NO: 533404 - DNA, 25 bp, Mus musculus
gcactgtctaatctgccttatgtga

SEQ ID NO: 533405 - DNA, 25 bp, Mus musculus
gcactgtctaatgtgccttatgtga

SEQ ID NO: 533406 - DNA, 25 bp, Mus musculus
gcactgtctatcactattctcagaa

SEQ ID NO: 533407 - DNA, 25 bp, Mus musculus
gcactgtctatctctattctcagaa

SEQ ID NO: 533408 - DNA, 25 bp, Mus musculus
gcactgtctattagaaagtctcaga

SEQ ID NO: 533409 - DNA, 25 bp, Mus musculus
gcactgtctatttgaaagtctcaga

SEQ ID NO: 533410 - DNA, 25 bp, Mus musculus
gcactgtctggcaaggtactggctc

SEQ ID NO: 533411 - DNA, 25 bp, Mus musculus
gcactgtctggctaggtactggctc

SEQ ID NO: 533412 - DNA, 25 bp, Mus musculus
gcactgtctgtaatgcactgagaaa

SEQ ID NO: 533413 - DNA, 25 bp, Mus musculus
gcactgtctgtattgcactgagaaa

SEQ ID NO: 533414 - DNA, 25 bp, Mus musculus
gcactgtgaaatataatgataggct

SEQ ID NO: 533415 - DNA, 25 bp, Mus musculus
gcactgtgaaatttaatgataggct

SEQ ID NO: 533416 - DNA, 25 bp, Mus musculus
gcactgtgaagcattagacaccttg

SEQ ID NO: 533417 - DNA, 25 bp, Mus musculus
gcactgtgaagctttagacaccttg

SEQ ID NO: 533418 - DNA, 25 bp, Mus musculus
gcactgtgaatgaccctactctgga

SEQ ID NO: 533419 - DNA, 25 bp, Mus musculus
gcactgtgaatgtccctactctgga

SEQ ID NO: 533420 - DNA, 25 bp, Mus musculus
gcactgtgacatacatctctaggtt

SEQ ID NO: 533421 - DNA, 25 bp, Mus musculus
gcactgtgacattcatctctaggtt

SEQ ID NO: 533422 - DNA, 25 bp, Mus musculus
gcactgtgacctacatgtatactaa

SEQ ID NO: 533423 - DNA, 25 bp, Mus musculus
gcactgtgaccttcatgtatactaa

SEQ ID NO: 533424 - DNA, 25 bp, Mus musculus
gcactgtgagcaataatgccatgag

SEQ ID NO: 533425 - DNA, 25 bp, Mus musculus
gcactgtgagcattaatgccatgag

SEQ ID NO: 533426 - DNA, 25 bp, Mus musculus
gcactgtgaggcaggacctgttgat

SEQ ID NO: 533427 - DNA, 25 bp, Mus musculus
gcactgtgaggctggacctgttgat

SEQ ID NO: 533428 - DNA, 25 bp, Mus musculus
gcactgtgatctctccaaggcagag

SEQ ID NO: 533429 - DNA, 25 bp, Mus musculus
gcactgtgatctgtccaaggcagag

SEQ ID NO: 533430 - DNA, 25 bp, Mus musculus
gcactgtgattgcatggctatcttt

SEQ ID NO: 533431 - DNA, 25 bp, Mus musculus
gcactgtgattggatggctatcttt

SEQ ID NO: 533432 - DNA, 25 bp, Mus musculus
gcactgtgcaatcacgcatctctga

SEQ ID NO: 533433 - DNA, 25 bp, Mus musculus
gcactgtgcaatgacgcatctctga

SEQ ID NO: 533434 - DNA, 25 bp, Mus musculus
gcactgtgccttactaaaggctttt

SEQ ID NO: 533435 - DNA, 25 bp, Mus musculus
gcactgtgcctttctaaaggctttt

SEQ ID NO: 533436 - DNA, 25 bp, Mus musculus
gcactgtgctctcggtaaactgtaa

SEQ ID NO: 533437 - DNA, 25 bp, Mus musculus
gcactgtgctctgggtaaactgtaa

SEQ ID NO: 533438 - DNA, 25 bp, Mus musculus
gcactgtgctgaaattaatctctaa

SEQ ID NO: 533439 - DNA, 25 bp, Mus musculus
gcactgtgctgatattaatctctaa

SEQ ID NO: 533440 - DNA, 25 bp, Mus musculus
gcactgtgcttgctcctaagcagaa

SEQ ID NO: 533441 - DNA, 25 bp, Mus musculus
gcactgtgcttgctttgtacttttt

SEQ ID NO: 533442 - DNA, 25 bp, Mus musculus
gcactgtgcttggtcctaagcagaa

SEQ ID NO: 533443 - DNA, 25 bp, Mus musculus
gcactgtgcttggtttgtacttttt

SEQ ID NO: 533444 - DNA, 25 bp, Mus musculus
gcactgtggactagcagattacagt

SEQ ID NO: 533445 - DNA, 25 bp, Mus musculus
gcactgtggactatctgtggattct

SEQ ID NO: 533446 - DNA, 25 bp, Mus musculus
gcactgtggacttgcagattacagt

SEQ ID NO: 533447 - DNA, 25 bp, Mus musculus
gcactgtggactttctgtggattct

SEQ ID NO: 533448 - DNA, 25 bp, Mus musculus
gcactgtggccgacttttggcgcat

SEQ ID NO: 533449 - DNA, 25 bp, Mus musculus
gcactgtggccgtcttttggcgcat

SEQ ID NO: 533450 - DNA, 25 bp, Mus musculus
gcactgtggtgcaattctgtttagc

SEQ ID NO: 533451 - DNA, 25 bp, Mus musculus
gcactgtggtgctattctgtttagc

SEQ ID NO: 533452 - DNA, 25 bp, Mus musculus
gcactgtggtgtcagccgcacgcat

SEQ ID NO: 533453 - DNA, 25 bp, Mus musculus
gcactgtggtgtgagccgcacgcat

SEQ ID NO: 533454 - DNA, 25 bp, Mus musculus
gcactgtgtatgcttctcaggaact

SEQ ID NO: 533455 - DNA, 25 bp, Mus musculus
gcactgtgtatggttctcaggaact

SEQ ID NO: 533456 - DNA, 25 bp, Mus musculus
gcactgtgtattatgaagagactta

SEQ ID NO: 533457 - DNA, 25 bp, Mus musculus
gcactgtgtattttgaagagactta

SEQ ID NO: 533458 - DNA, 25 bp, Mus musculus
gcactgtgttaaaactgttcggaat

SEQ ID NO: 533459 - DNA, 25 bp, Mus musculus
gcactgtgttaatactgttcggaat

SEQ ID NO: 533460 - DNA, 25 bp, Mus musculus
gcactgttactacttttccatattt

SEQ ID NO: 533461 - DNA, 25 bp, Mus musculus
gcactgttactagttttccatattt

SEQ ID NO: 533462 - DNA, 25 bp, Mus musculus
gcactgttcgcaagctgcagagctg

SEQ ID NO: 533463 - DNA, 25 bp, Mus musculus
gcactgttcgcatgctgcagagctg

SEQ ID NO: 533464 - DNA, 25 bp, Mus musculus
gcactgttgggcatctgcagagagt

SEQ ID NO: 533465 - DNA, 25 bp, Mus musculus
gcactgttgggcttctgcagagagt

SEQ ID NO: 533466 - DNA, 25 bp, Mus musculus
gcactgttggtaaccggtactactt

SEQ ID NO: 533467 - DNA, 25 bp, Mus musculus
gcactgttggtatccggtactactt

SEQ ID NO: 533468 - DNA, 25 bp, Mus musculus
gcactgttgtccctggaggatgata

SEQ ID NO: 533469 - DNA, 25 bp, Mus musculus
gcactgttgtccgtggaggatgata

SEQ ID NO: 533470 - DNA, 25 bp, Mus musculus
gcactgtttcatcccaaagttctga

SEQ ID NO: 533471 - DNA, 25 bp, Mus musculus
gcactgtttcatgccaaagttctga

SEQ ID NO: 533472 - DNA, 25 bp, Mus musculus
gcactgtttccacggctgaagttgc

SEQ ID NO: 533473 - DNA, 25 bp, Mus musculus
gcactgtttccagggctgaagttgc

SEQ ID NO: 533474 - DNA, 25 bp, Mus musculus
gcactgtttccgactaaacattcaa

SEQ ID NO: 533475 - DNA, 25 bp, Mus musculus
gcactgtttccgtctaaacattcaa

SEQ ID NO: 533476 - DNA, 25 bp, Mus musculus
gcactgtttgatatcacggtgagtt

SEQ ID NO: 533477 - DNA, 25 bp, Mus musculus
gcactgtttgatttcacggtgagtt

SEQ ID NO: 533478 - DNA, 25 bp, Mus musculus
gcactgttttccaaagatgctcttg

SEQ ID NO: 533479 - DNA, 25 bp, Mus musculus
gcactgttttcctaagatgctcttg

SEQ ID NO: 533480 - DNA, 25 bp, Mus musculus
gcactgttttgcatcgatatgagga

SEQ ID NO: 533481 - DNA, 25 bp, Mus musculus
gcactgttttgcttcgatatgagga

SEQ ID NO: 533482 - DNA, 25 bp, Mus musculus
gcacttaaaccacctttgtctattg

SEQ ID NO: 533483 - DNA, 25 bp, Mus musculus
gcacttaaaccagctttgtctattg

SEQ ID NO: 533484 - DNA, 25 bp, Mus musculus
gcacttaaatcaatactgcaaaaga

SEQ ID NO: 533485 - DNA, 25 bp, Mus musculus
gcacttaaatcattactgcaaaaga

SEQ ID NO: 533486 - DNA, 25 bp, Mus musculus
gcacttaactgcctatgtgtgataa

SEQ ID NO: 533487 - DNA, 25 bp, Mus musculus
gcacttaactgcgtatgtgtgataa

SEQ ID NO: 533488 - DNA, 25 bp, Mus musculus
gcacttaagaggatatcgagcacga

SEQ ID NO: 533489 - DNA, 25 bp, Mus musculus
gcacttaagaggttatcgagcacga

SEQ ID NO: 533490 - DNA, 25 bp, Mus musculus
gcacttaagcacctacttttgacag

SEQ ID NO: 533491 - DNA, 25 bp, Mus musculus
gcacttaagcacgtacttttgacag

SEQ ID NO: 533492 - DNA, 25 bp, Mus musculus
gcacttaagtttccaggactgcttt

SEQ ID NO: 533493 - DNA, 25 bp, Mus musculus
gcacttaagtttgcaggactgcttt

SEQ ID NO: 533494 - DNA, 25 bp, Mus musculus
gcacttaataagagtcccacaaagt

SEQ ID NO: 533495 - DNA, 25 bp, Mus musculus
gcacttaataagtgtcccacaaagt

SEQ ID NO: 533496 - DNA, 25 bp, Mus musculus
gcacttacacccacttctatagaag

SEQ ID NO: 533497 - DNA, 25 bp, Mus musculus
gcacttacaccctcttctatagaag

SEQ ID NO: 533498 - DNA, 25 bp, Mus musculus
gcacttacatatatgatcagtatag

SEQ ID NO: 533499 - DNA, 25 bp, Mus musculus
gcacttacatatttgatcagtatag

SEQ ID NO: 533500 - DNA, 25 bp, Mus musculus
gcacttaccattctaatagcttcta

SEQ ID NO: 533501 - DNA, 25 bp, Mus musculus
gcacttaccattgtaatagcttcta

SEQ ID NO: 533502 - DNA, 25 bp, Mus musculus
gcacttaccctgacgttttctgaaa

SEQ ID NO: 533503 - DNA, 25 bp, Mus musculus
gcacttaccctgtcgttttctgaaa

SEQ ID NO: 533504 - DNA, 25 bp, Mus musculus
gcacttactagcattcaattacact

SEQ ID NO: 533505 - DNA, 25 bp, Mus musculus
gcacttactagctttcaattacact

SEQ ID NO: 533506 - DNA, 25 bp, Mus musculus
gcacttactgtacatggcttttcaa

SEQ ID NO: 533507 - DNA, 25 bp, Mus musculus
gcacttactgtagatggcttttcaa

SEQ ID NO: 533508 - DNA, 25 bp, Mus musculus
gcacttactgtgattgttattggca

SEQ ID NO: 533509 - DNA, 25 bp, Mus musculus
gcacttactgtgtttgttattggca

SEQ ID NO: 533510 - DNA, 25 bp, Mus musculus
gcacttactttgctaatgtatgccc

SEQ ID NO: 533511 - DNA, 25 bp, Mus musculus
gcacttactttggtaatgtatgccc

SEQ ID NO: 533512 - DNA, 25 bp, Mus musculus
gcacttagaaatacggtcctccagc

SEQ ID NO: 533513 - DNA, 25 bp, Mus musculus
gcacttagaaattcggtcctccagc

SEQ ID NO: 533514 - DNA, 25 bp, Mus musculus
gcacttagaaccacagctgtcttct

SEQ ID NO: 533515 - DNA, 25 bp, Mus musculus
gcacttagaacctcagctgtcttct

SEQ ID NO: 533516 - DNA, 25 bp, Mus musculus
gcacttagaagaaatgcgctcacta

SEQ ID NO: 533517 - DNA, 25 bp, Mus musculus
gcacttagaagatatgcgctcacta

SEQ ID NO: 533518 - DNA, 25 bp, Mus musculus
gcacttagactaagcactttttctg

SEQ ID NO: 533519 - DNA, 25 bp, Mus musculus
gcacttagactatgcactttttctg

SEQ ID NO: 533520 - DNA, 25 bp, Mus musculus
gcacttagcactaaaaacgggcaga

SEQ ID NO: 533521 - DNA, 25 bp, Mus musculus
gcacttagcacttaaaacgggcaga

SEQ ID NO: 533522 - DNA, 25 bp, Mus musculus
gcacttagtgaaaatccctcatcag

SEQ ID NO: 533523 - DNA, 25 bp, Mus musculus
gcacttagtgaatatccctcatcag

SEQ ID NO: 533524 - DNA, 25 bp, Mus musculus
gcacttagttttagttgctgtcttg

SEQ ID NO: 533525 - DNA, 25 bp, Mus musculus
gcacttagtttttgttgctgtcttg

SEQ ID NO: 533526 - DNA, 25 bp, Mus musculus
gcacttataattcgcctatggtgtt

SEQ ID NO: 533527 - DNA, 25 bp, Mus musculus
gcacttataattggcctatggtgtt

SEQ ID NO: 533528 - DNA, 25 bp, Mus musculus
gcacttatagtcacatcttgtctta

SEQ ID NO: 533529 - DNA, 25 bp, Mus musculus
gcacttatagtctcatcttgtctta

SEQ ID NO: 533530 - DNA, 25 bp, Mus musculus
gcacttatcaaactccaattccctt

SEQ ID NO: 533531 - DNA, 25 bp, Mus musculus
gcacttatcaaagtccaattccctt

SEQ ID NO: 533532 - DNA, 25 bp, Mus musculus
gcacttatgcaccaggctggaagag

SEQ ID NO: 533533 - DNA, 25 bp, Mus musculus
gcacttatgcacgaggctggaagag

SEQ ID NO: 533534 - DNA, 25 bp, Mus musculus
gcacttattcatctgaaggctcgat

SEQ ID NO: 533535 - DNA, 25 bp, Mus musculus
gcacttattcatgtgaaggctcgat

SEQ ID NO: 533536 - DNA, 25 bp, Mus musculus
gcacttattcttattacaggcattt

SEQ ID NO: 533537 - DNA, 25 bp, Mus musculus
gcacttattctttttacaggcattt

SEQ ID NO: 533538 - DNA, 25 bp, Mus musculus
gcacttatttcaaggattaatttac

SEQ ID NO: 533539 - DNA, 25 bp, Mus musculus
gcacttatttcatggattaatttac

SEQ ID NO: 533540 - DNA, 25 bp, Mus musculus
gcacttcaaattaaccaggagtctc

SEQ ID NO: 533541 - DNA, 25 bp, Mus musculus
gcacttcaaatttaccaggagtctc

SEQ ID NO: 533542 - DNA, 25 bp, Mus musculus
gcacttcaatgcatttgcacttaaa

SEQ ID NO: 533543 - DNA, 25 bp, Mus musculus
gcacttcaatgcttttgcacttaaa

SEQ ID NO: 533544 - DNA, 25 bp, Mus musculus
gcacttcacagaaagcctcaaaatg

SEQ ID NO: 533545 - DNA, 25 bp, Mus musculus
gcacttcacagatagcctcaaaatg

SEQ ID NO: 533546 - DNA, 25 bp, Mus musculus
gcacttcacattattggaacatctt

SEQ ID NO: 533547 - DNA, 25 bp, Mus musculus
gcacttcacatttttggaacatctt

SEQ ID NO: 533548 - DNA, 25 bp, Mus musculus
gcacttcaccatatacctcaaagat

SEQ ID NO: 533549 - DNA, 25 bp, Mus musculus
gcacttcaccatttacctcaaagat

SEQ ID NO: 533550 - DNA, 25 bp, Mus musculus
gcacttcacttccagggaactacta

SEQ ID NO: 533551 - DNA, 25 bp, Mus musculus
gcacttcacttcgagggaactacta

SEQ ID NO: 533552 - DNA, 25 bp, Mus musculus
gcacttcagaccaggctcagtggaa

SEQ ID NO: 533553 - DNA, 25 bp, Mus musculus
gcacttcagacctggctcagtggaa

SEQ ID NO: 533554 - DNA, 25 bp, Mus musculus
gcacttcaggtcatgagtagctgaa

SEQ ID NO: 533555 - DNA, 25 bp, Mus musculus
gcacttcaggtcttgagtagctgaa

SEQ ID NO: 533556 - DNA, 25 bp, Mus musculus
gcacttcagtctatgggagaaaccc

SEQ ID NO: 533557 - DNA, 25 bp, Mus musculus
gcacttcagtctttgggagaaaccc

SEQ ID NO: 533558 - DNA, 25 bp, Mus musculus
gcacttcatcacatgttttattctg

SEQ ID NO: 533559 - DNA, 25 bp, Mus musculus
gcacttcatcacttgttttattctg

SEQ ID NO: 533560 - DNA, 25 bp, Mus musculus
gcacttcatctaattttacttgggt

SEQ ID NO: 533561 - DNA, 25 bp, Mus musculus
gcacttcatctatttttacttgggt

SEQ ID NO: 533562 - DNA, 25 bp, Mus musculus
gcacttcatctcagactgcatggaa

SEQ ID NO: 533563 - DNA, 25 bp, Mus musculus
gcacttcatctctgactgcatggaa

SEQ ID NO: 533564 - DNA, 25 bp, Mus musculus
gcacttcatggtcttgatgcgatct

SEQ ID NO: 533565 - DNA, 25 bp, Mus musculus
gcacttcatggtgttgatgcgatct

SEQ ID NO: 533566 - DNA, 25 bp, Mus musculus
gcacttcattagaacactcagttgt

SEQ ID NO: 533567 - DNA, 25 bp, Mus musculus
gcacttcattagtacactcagttgt

SEQ ID NO: 533568 - DNA, 25 bp, Mus musculus
gcacttccagtgcaagcgctgcaag

SEQ ID NO: 533569 - DNA, 25 bp, Mus musculus
gcacttccagtggaagcgctgcaag

SEQ ID NO: 533570 - DNA, 25 bp, Mus musculus
gcacttcccagcagatagcttgtta

SEQ ID NO: 533571 - DNA, 25 bp, Mus musculus
gcacttcccagctgatagcttgtta

SEQ ID NO: 533572 - DNA, 25 bp, Mus musculus
gcacttccctgtaaacctgttttag

SEQ ID NO: 533573 - DNA, 25 bp, Mus musculus
gcacttccctgttaacctgttttag

SEQ ID NO: 533574 - DNA, 25 bp, Mus musculus
gcacttcctgcacatgactgactgt

SEQ ID NO: 533575 - DNA, 25 bp, Mus musculus
gcacttcctgcagatgactgactgt

SEQ ID NO: 533576 - DNA, 25 bp, Mus musculus
gcacttcctgctcttaaccagaggt

SEQ ID NO: 533577 - DNA, 25 bp, Mus musculus
gcacttcctgctgttaaccagaggt

SEQ ID NO: 533578 - DNA, 25 bp, Mus musculus
gcacttccttctaggttttacttat

SEQ ID NO: 533579 - DNA, 25 bp, Mus musculus
gcacttccttcttggttttacttat

SEQ ID NO: 533580 - DNA, 25 bp, Mus musculus
gcacttcgatgacaaatccatgttt

SEQ ID NO: 533581 - DNA, 25 bp, Mus musculus
gcacttcgatgagaaatccatgttt

SEQ ID NO: 533582 - DNA, 25 bp, Mus musculus
gcacttcgccaaactgttgcagagt

SEQ ID NO: 533583 - DNA, 25 bp, Mus musculus
gcacttcgccaatctgttgcagagt

SEQ ID NO: 533584 - DNA, 25 bp, Mus musculus
gcacttcgcctaccacaaagtggtg

SEQ ID NO: 533585 - DNA, 25 bp, Mus musculus
gcacttcgcctagcacaaagtggtg

SEQ ID NO: 533586 - DNA, 25 bp, Mus musculus
gcacttcgctcacagcagtatttta

SEQ ID NO: 533587 - DNA, 25 bp, Mus musculus
gcacttcgctcagagcagtatttta

SEQ ID NO: 533588 - DNA, 25 bp, Mus musculus
gcacttctaactctacatccacgaa

SEQ ID NO: 533589 - DNA, 25 bp, Mus musculus
gcacttctaactgtacatccacgaa

SEQ ID NO: 533590 - DNA, 25 bp, Mus musculus
gcacttctagcaccagtctactgta

SEQ ID NO: 533591 - DNA, 25 bp, Mus musculus
gcacttctagcagcagtctactgta

SEQ ID NO: 533592 - DNA, 25 bp, Mus musculus
gcacttctagttcaggtgtatccat

SEQ ID NO: 533593 - DNA, 25 bp, Mus musculus
gcacttctagttgaggtgtatccat

SEQ ID NO: 533594 - DNA, 25 bp, Mus musculus
gcacttctcactaagcttcgtgtat

SEQ ID NO: 533595 - DNA, 25 bp, Mus musculus
gcacttctcacttagcttcgtgtat

SEQ ID NO: 533596 - DNA, 25 bp, Mus musculus
gcacttctctctcaaaacgcaggaa

SEQ ID NO: 533597 - DNA, 25 bp, Mus musculus
gcacttctctctgaaaacgcaggaa

SEQ ID NO: 533598 - DNA, 25 bp, Mus musculus
gcacttctctgaagggctgggacca

SEQ ID NO: 533599 - DNA, 25 bp, Mus musculus
gcacttctctgatgggctgggacca

SEQ ID NO: 533600 - DNA, 25 bp, Mus musculus
gcacttctctggctggtcaagtcaa

SEQ ID NO: 533601 - DNA, 25 bp, Mus musculus
gcacttctctgggtggtcaagtcaa

SEQ ID NO: 533602 - DNA, 25 bp, Mus musculus
gcacttctcttcagcattcagtttc

SEQ ID NO: 533603 - DNA, 25 bp, Mus musculus
gcacttctcttctgcattcagtttc

SEQ ID NO: 533604 - DNA, 25 bp, Mus musculus
gcacttctgcctaaaactagtcatg

SEQ ID NO: 533605 - DNA, 25 bp, Mus musculus
gcacttctgccttaaactagtcatg

SEQ ID NO: 533606 - DNA, 25 bp, Mus musculus
gcacttctgttaatacaggtcaaga

SEQ ID NO: 533607 - DNA, 25 bp, Mus musculus
gcacttctgttattacaggtcaaga

SEQ ID NO: 533608 - DNA, 25 bp, Mus musculus
gcacttcttcctataatcacgattg

SEQ ID NO: 533609 - DNA, 25 bp, Mus musculus
gcacttcttcctttaatcacgattg

SEQ ID NO: 533610 - DNA, 25 bp, Mus musculus
gcacttcttctcaggaatggacaaa

SEQ ID NO: 533611 - DNA, 25 bp, Mus musculus
gcacttcttctctggaatggacaaa

SEQ ID NO: 533612 - DNA, 25 bp, Mus musculus
gcacttcttggtagcagaatggaat

SEQ ID NO: 533613 - DNA, 25 bp, Mus musculus
gcacttcttggttgcagaatggaat

SEQ ID NO: 533614 - DNA, 25 bp, Mus musculus
gcacttcttgtaccagcttgaggac

SEQ ID NO: 533615 - DNA, 25 bp, Mus musculus
gcacttcttgtagcagcttgaggac

SEQ ID NO: 533616 - DNA, 25 bp, Mus musculus
gcacttctttagaaaggccctttgt

SEQ ID NO: 533617 - DNA, 25 bp, Mus musculus
gcacttctttagtaaggccctttgt

SEQ ID NO: 533618 - DNA, 25 bp, Mus musculus
gcacttctttccctgtggatagcaa

SEQ ID NO: 533619 - DNA, 25 bp, Mus musculus
gcacttctttccgtgtggatagcaa

SEQ ID NO: 533620 - DNA, 25 bp, Mus musculus
gcacttgaaacccaagactggtgga

SEQ ID NO: 533621 - DNA, 25 bp, Mus musculus
gcacttgaaaccgaagactggtgga

SEQ ID NO: 533622 - DNA, 25 bp, Mus musculus
gcacttgaaaggagacccactgata

SEQ ID NO: 533623 - DNA, 25 bp, Mus musculus
gcacttgaaaggtgacccactgata

SEQ ID NO: 533624 - DNA, 25 bp, Mus musculus
gcacttgaagggactgttctctctc

SEQ ID NO: 533625 - DNA, 25 bp, Mus musculus
gcacttgaagggtctgttctctctc

SEQ ID NO: 533626 - DNA, 25 bp, Mus musculus
gcacttgaagtgacggtattttgat

SEQ ID NO: 533627 - DNA, 25 bp, Mus musculus
gcacttgaagtgtcggtattttgat

SEQ ID NO: 533628 - DNA, 25 bp, Mus musculus
gcacttgaataaatctccccatggc

SEQ ID NO: 533629 - DNA, 25 bp, Mus musculus
gcacttgaataattctccccatggc

SEQ ID NO: 533630 - DNA, 25 bp, Mus musculus
gcacttgaatggaactgcactgtca

SEQ ID NO: 533631 - DNA, 25 bp, Mus musculus
gcacttgaatggtactgcactgtca

SEQ ID NO: 533632 - DNA, 25 bp, Mus musculus
gcacttgaatgtagtatcttttaaa

SEQ ID NO: 533633 - DNA, 25 bp, Mus musculus
gcacttgaatgttgtatcttttaaa

SEQ ID NO: 533634 - DNA, 25 bp, Mus musculus
gcacttgaattcaaaccgctcatgc

SEQ ID NO: 533635 - DNA, 25 bp, Mus musculus
gcacttgaattctaaccgctcatgc

SEQ ID NO: 533636 - DNA, 25 bp, Mus musculus
gcacttgacaagattccacaggcca

SEQ ID NO: 533637 - DNA, 25 bp, Mus musculus
gcacttgacaagtttccacaggcca

SEQ ID NO: 533638 - DNA, 25 bp, Mus musculus
gcacttgagaatctggctcgtgtga

SEQ ID NO: 533639 - DNA, 25 bp, Mus musculus
gcacttgagaatgtggctcgtgtga

SEQ ID NO: 533640 - DNA, 25 bp, Mus musculus
gcacttgagaggcttggaaacacca

SEQ ID NO: 533641 - DNA, 25 bp, Mus musculus
gcacttgagagggttggaaacacca

SEQ ID NO: 533642 - DNA, 25 bp, Mus musculus
gcacttgagctaattcagggtcgtt

SEQ ID NO: 533643 - DNA, 25 bp, Mus musculus
gcacttgagctatttcagggtcgtt

SEQ ID NO: 533644 - DNA, 25 bp, Mus musculus
gcacttgagctcaggtggtgtcaca

SEQ ID NO: 533645 - DNA, 25 bp, Mus musculus
gcacttgagctctggtggtgtcaca

SEQ ID NO: 533646 - DNA, 25 bp, Mus musculus
gcacttgaggtgctagtccaaaatt

SEQ ID NO: 533647 - DNA, 25 bp, Mus musculus
gcacttgaggtggtagtccaaaatt

SEQ ID NO: 533648 - DNA, 25 bp, Mus musculus
gcacttgatacacagaagcaaaggg

SEQ ID NO: 533649 - DNA, 25 bp, Mus musculus
gcacttgatacagagaagcaaaggg

SEQ ID NO: 533650 - DNA, 25 bp, Mus musculus
gcacttgattttcgcatttagggtc

SEQ ID NO: 533651 - DNA, 25 bp, Mus musculus
gcacttgattttggcatttagggtc

SEQ ID NO: 533652 - DNA, 25 bp, Mus musculus
gcacttgcaagtccacacatgcaca

SEQ ID NO: 533653 - DNA, 25 bp, Mus musculus
gcacttgcaagtgcacacatgcaca

SEQ ID NO: 533654 - DNA, 25 bp, Mus musculus
gcacttgcagcaaatgttttaaaat

SEQ ID NO: 533655 - DNA, 25 bp, Mus musculus
gcacttgcagcatatgttttaaaat

SEQ ID NO: 533656 - DNA, 25 bp, Mus musculus
gcacttgcagtaatgaggttaatca

SEQ ID NO: 533657 - DNA, 25 bp, Mus musculus
gcacttgcagtattgaggttaatca

SEQ ID NO: 533658 - DNA, 25 bp, Mus musculus
gcacttgcatggcaacctacagaca

SEQ ID NO: 533659 - DNA, 25 bp, Mus musculus
gcacttgcatgggaacctacagaca

SEQ ID NO: 533660 - DNA, 25 bp, Mus musculus
gcacttgcccgccactgaggtaggg

SEQ ID NO: 533661 - DNA, 25 bp, Mus musculus
gcacttgcccgcgactgaggtaggg

SEQ ID NO: 533662 - DNA, 25 bp, Mus musculus
gcacttgcccggcatgtacaaacaa

SEQ ID NO: 533663 - DNA, 25 bp, Mus musculus
gcacttgcccgggatgtacaaacaa

SEQ ID NO: 533664 - DNA, 25 bp, Mus musculus
gcacttgccgccaatgtttctatgg

SEQ ID NO: 533665 - DNA, 25 bp, Mus musculus
gcacttgccgcctatgtttctatgg

SEQ ID NO: 533666 - DNA, 25 bp, Mus musculus
gcacttgcctggacagaagacttca

SEQ ID NO: 533667 - DNA, 25 bp, Mus musculus
gcacttgcctggtcagaagacttca

SEQ ID NO: 533668 - DNA, 25 bp, Mus musculus
gcacttgccttgattccttttatta

SEQ ID NO: 533669 - DNA, 25 bp, Mus musculus
gcacttgccttgtttccttttatta

SEQ ID NO: 533670 - DNA, 25 bp, Mus musculus
gcacttgctagccagccagtctagc

SEQ ID NO: 533671 - DNA, 25 bp, Mus musculus
gcacttgctagcgagccagtctagc

SEQ ID NO: 533672 - DNA, 25 bp, Mus musculus
gcacttgctcaccaggaggccttga

SEQ ID NO: 533673 - DNA, 25 bp, Mus musculus
gcacttgctcacgaggaggccttga

SEQ ID NO: 533674 - DNA, 25 bp, Mus musculus
gcacttgctgcacacatagatgaca

SEQ ID NO: 533675 - DNA, 25 bp, Mus musculus
gcacttgctgcagacatagatgaca

SEQ ID NO: 533676 - DNA, 25 bp, Mus musculus
gcacttgctgctattgtaggttcct

SEQ ID NO: 533677 - DNA, 25 bp, Mus musculus
gcacttgctgctcttcttcctaagg

SEQ ID NO: 533678 - DNA, 25 bp, Mus musculus
gcacttgctgctgttcttcctaagg

SEQ ID NO: 533679 - DNA, 25 bp, Mus musculus
gcacttgctgcttttgtaggttcct

SEQ ID NO: 533680 - DNA, 25 bp, Mus musculus
gcacttgctgtgcagtggcctctga

SEQ ID NO: 533681 - DNA, 25 bp, Mus musculus
gcacttgctgtggagtggcctctga

SEQ ID NO: 533682 - DNA, 25 bp, Mus musculus
gcacttgcttgaattattacaaaag

SEQ ID NO: 533683 - DNA, 25 bp, Mus musculus
gcacttgcttgaattttgacttggg

SEQ ID NO: 533684 - DNA, 25 bp, Mus musculus
gcacttgcttgatttattacaaaag

SEQ ID NO: 533685 - DNA, 25 bp, Mus musculus
gcacttgcttgatttttgacttggg

SEQ ID NO: 533686 - DNA, 25 bp, Mus musculus
gcacttggaaaaagatgatcccagc

SEQ ID NO: 533687 - DNA, 25 bp, Mus musculus
gcacttggaaaatgatgatcccagc

SEQ ID NO: 533688 - DNA, 25 bp, Mus musculus
gcacttggaatcacctcacgaagag

SEQ ID NO: 533689 - DNA, 25 bp, Mus musculus
gcacttggaatctcctcacgaagag

SEQ ID NO: 533690 - DNA, 25 bp, Mus musculus
gcacttggaggcatcctttcagaaa

SEQ ID NO: 533691 - DNA, 25 bp, Mus musculus
gcacttggaggcttcctttcagaaa

SEQ ID NO: 533692 - DNA, 25 bp, Mus musculus
gcacttggctcactatgttatgaat

SEQ ID NO: 533693 - DNA, 25 bp, Mus musculus
gcacttggctcagtatgttatgaat

SEQ ID NO: 533694 - DNA, 25 bp, Mus musculus
gcacttggctttaattctacatttg

SEQ ID NO: 533695 - DNA, 25 bp, Mus musculus
gcacttggcttttattctacatttg

SEQ ID NO: 533696 - DNA, 25 bp, Mus musculus
gcacttgggactattgacattggtc

SEQ ID NO: 533697 - DNA, 25 bp, Mus musculus
gcacttgggactcgcacctgaattg

SEQ ID NO: 533698 - DNA, 25 bp, Mus musculus
gcacttgggactggcacctgaattg

SEQ ID NO: 533699 - DNA, 25 bp, Mus musculus
gcacttgggacttttgacattggtc

SEQ ID NO: 533700 - DNA, 25 bp, Mus musculus
gcacttgggcaaccacctgaaggct

SEQ ID NO: 533701 - DNA, 25 bp, Mus musculus
gcacttgggcaagcacctgaaggct

SEQ ID NO: 533702 - DNA, 25 bp, Mus musculus
gcacttggtctcatgtacttttacg

SEQ ID NO: 533703 - DNA, 25 bp, Mus musculus
gcacttggtctcttgtacttttacg

SEQ ID NO: 533704 - DNA, 25 bp, Mus musculus
gcacttggtgacatactactgctaa

SEQ ID NO: 533705 - DNA, 25 bp, Mus musculus
gcacttggtgacttactactgctaa

SEQ ID NO: 533706 - DNA, 25 bp, Mus musculus
gcacttggtgatctatgtgagcagt

SEQ ID NO: 533707 - DNA, 25 bp, Mus musculus
gcacttggtgatgtatgtgagcagt

SEQ ID NO: 533708 - DNA, 25 bp, Mus musculus
gcacttggtgcccacttggaaatca

SEQ ID NO: 533709 - DNA, 25 bp, Mus musculus
gcacttggtgccgacttggaaatca

SEQ ID NO: 533710 - DNA, 25 bp, Mus musculus
gcacttggtggtatagcatgtagct

SEQ ID NO: 533711 - DNA, 25 bp, Mus musculus
gcacttggtggtcaagtagccgcct

SEQ ID NO: 533712 - DNA, 25 bp, Mus musculus
gcacttggtggtgaagtagccgcct

SEQ ID NO: 533713 - DNA, 25 bp, Mus musculus
gcacttggtggtttagcatgtagct

SEQ ID NO: 533714 - DNA, 25 bp, Mus musculus
gcacttggttagcttggttactgac

SEQ ID NO: 533715 - DNA, 25 bp, Mus musculus
gcacttggttagctttaattgttct

SEQ ID NO: 533716 - DNA, 25 bp, Mus musculus
gcacttggttaggttggttactgac

SEQ ID NO: 533717 - DNA, 25 bp, Mus musculus
gcacttggttaggtttaattgttct

SEQ ID NO: 533718 - DNA, 25 bp, Mus musculus
gcacttgtaactaaactgtctatgt

SEQ ID NO: 533719 - DNA, 25 bp, Mus musculus
gcacttgtaacttaactgtctatgt

SEQ ID NO: 533720 - DNA, 25 bp, Mus musculus
gcacttgtaaggctagactggaaga

SEQ ID NO: 533721 - DNA, 25 bp, Mus musculus
gcacttgtaagggtagactggaaga

SEQ ID NO: 533722 - DNA, 25 bp, Mus musculus
gcacttgtagagcactggataccca

SEQ ID NO: 533723 - DNA, 25 bp, Mus musculus
gcacttgtagaggactggataccca

SEQ ID NO: 533724 - DNA, 25 bp, Mus musculus
gcacttgtattcagctgttaccttg

SEQ ID NO: 533725 - DNA, 25 bp, Mus musculus
gcacttgtattctgctgttaccttg

SEQ ID NO: 533726 - DNA, 25 bp, Mus musculus
gcacttgtcactccagtttactttg

SEQ ID NO: 533727 - DNA, 25 bp, Mus musculus
gcacttgtcactgcagtttactttg

SEQ ID NO: 533728 - DNA, 25 bp, Mus musculus
gcacttgtcctaagtctgtttgtag

SEQ ID NO: 533729 - DNA, 25 bp, Mus musculus
gcacttgtcctatgtctgtttgtag

SEQ ID NO: 533730 - DNA, 25 bp, Mus musculus
gcacttgtctggaagggaagtcctc

SEQ ID NO: 533731 - DNA, 25 bp, Mus musculus
gcacttgtctggtagggaagtcctc

SEQ ID NO: 533732 - DNA, 25 bp, Mus musculus
gcacttgtgactcaactcaatgaaa

SEQ ID NO: 533733 - DNA, 25 bp, Mus musculus
gcacttgtgactgaactcaatgaaa

SEQ ID NO: 533734 - DNA, 25 bp, Mus musculus
gcacttgtgcatacctaacctttaa

SEQ ID NO: 533735 - DNA, 25 bp, Mus musculus
gcacttgtgcattcctaacctttaa

SEQ ID NO: 533736 - DNA, 25 bp, Mus musculus
gcacttgtgctgctcgaggttttca

SEQ ID NO: 533737 - DNA, 25 bp, Mus musculus
gcacttgtgctggtcgaggttttca

SEQ ID NO: 533738 - DNA, 25 bp, Mus musculus
gcacttgtgggcaaccttggacaca

SEQ ID NO: 533739 - DNA, 25 bp, Mus musculus
gcacttgtgggctaccttggacaca

SEQ ID NO: 533740 - DNA, 25 bp, Mus musculus
gcacttgtgtgaatctagaaagcaa

SEQ ID NO: 533741 - DNA, 25 bp, Mus musculus
gcacttgtgtgattctagaaagcaa

SEQ ID NO: 533742 - DNA, 25 bp, Mus musculus
gcacttgtgttaacagctatgcaat

SEQ ID NO: 533743 - DNA, 25 bp, Mus musculus
gcacttgtgttatcagctatgcaat

SEQ ID NO: 533744 - DNA, 25 bp, Mus musculus
gcacttgtgtttcttgagacatcct

SEQ ID NO: 533745 - DNA, 25 bp, Mus musculus
gcacttgtgtttgttgagacatcct

SEQ ID NO: 533746 - DNA, 25 bp, Mus musculus
gcacttgttaacaccttattttggg

SEQ ID NO: 533747 - DNA, 25 bp, Mus musculus
gcacttgttaactccttattttggg

SEQ ID NO: 533748 - DNA, 25 bp, Mus musculus
gcacttgttacaagcagatctttgt

SEQ ID NO: 533749 - DNA, 25 bp, Mus musculus
gcacttgttacatgcagatctttgt

SEQ ID NO: 533750 - DNA, 25 bp, Mus musculus
gcacttgttctcagtaaacaagagt

SEQ ID NO: 533751 - DNA, 25 bp, Mus musculus
gcacttgttctctgtaaacaagagt

SEQ ID NO: 533752 - DNA, 25 bp, Mus musculus
gcacttgttgaaaaaacatccccag

SEQ ID NO: 533753 - DNA, 25 bp, Mus musculus
gcacttgttgaataaacatccccag

SEQ ID NO: 533754 - DNA, 25 bp, Mus musculus
gcacttgtttggaggtacggctccc

SEQ ID NO: 533755 - DNA, 25 bp, Mus musculus
gcacttgtttggtggtacggctccc

SEQ ID NO: 533756 - DNA, 25 bp, Mus musculus
gcactttaaaacaaatgcaggaaga

SEQ ID NO: 533757 - DNA, 25 bp, Mus musculus
gcactttaaaactaatgcaggaaga

SEQ ID NO: 533758 - DNA, 25 bp, Mus musculus
gcactttaaccaactaactagccca

SEQ ID NO: 533759 - DNA, 25 bp, Mus musculus
gcactttaaccatctaactagccca

SEQ ID NO: 533760 - DNA, 25 bp, Mus musculus
gcactttaaccccaggctggacact

SEQ ID NO: 533761 - DNA, 25 bp, Mus musculus
gcactttaaccccttatactataga

SEQ ID NO: 533762 - DNA, 25 bp, Mus musculus
gcactttaacccgaggctggacact

SEQ ID NO: 533763 - DNA, 25 bp, Mus musculus
gcactttaacccgttatactataga

SEQ ID NO: 533764 - DNA, 25 bp, Mus musculus
gcactttaactgcttgagcattatt

SEQ ID NO: 533765 - DNA, 25 bp, Mus musculus
gcactttaactggttgagcattatt

SEQ ID NO: 533766 - DNA, 25 bp, Mus musculus
gcactttacagaatacgctcgcgga

SEQ ID NO: 533767 - DNA, 25 bp, Mus musculus
gcactttacagattacgctcgcgga

SEQ ID NO: 533768 - DNA, 25 bp, Mus musculus
gcactttactctccagttcccagaa

SEQ ID NO: 533769 - DNA, 25 bp, Mus musculus
gcactttactctgcagttcccagaa

SEQ ID NO: 533770 - DNA, 25 bp, Mus musculus
gcactttactttcaacgcagatccc

SEQ ID NO: 533771 - DNA, 25 bp, Mus musculus
gcactttactttgaacgcagatccc

SEQ ID NO: 533772 - DNA, 25 bp, Mus musculus
gcactttaggaaaccccatggacag

SEQ ID NO: 533773 - DNA, 25 bp, Mus musculus
gcactttaggaatccccatggacag

SEQ ID NO: 533774 - DNA, 25 bp, Mus musculus
gcactttagtttattgctgctaact

SEQ ID NO: 533775 - DNA, 25 bp, Mus musculus
gcactttagttttttgctgctaact

SEQ ID NO: 533776 - DNA, 25 bp, Mus musculus
gcactttataatcttcaggcgcctt

SEQ ID NO: 533777 - DNA, 25 bp, Mus musculus
gcactttataatgttcaggcgcctt

SEQ ID NO: 533778 - DNA, 25 bp, Mus musculus
gcactttatgcccaaagagcaggga

SEQ ID NO: 533779 - DNA, 25 bp, Mus musculus
gcactttatgccgaaagagcaggga

SEQ ID NO: 533780 - DNA, 25 bp, Mus musculus
gcactttatggcctcaactttcaag

SEQ ID NO: 533781 - DNA, 25 bp, Mus musculus
gcactttatggcgtcaactttcaag

SEQ ID NO: 533782 - DNA, 25 bp, Mus musculus
gcactttatgttcctgcacaggcag

SEQ ID NO: 533783 - DNA, 25 bp, Mus musculus
gcactttatgttgctgcacaggcag

SEQ ID NO: 533784 - DNA, 25 bp, Mus musculus
gcactttattacacatcccggatag

SEQ ID NO: 533785 - DNA, 25 bp, Mus musculus
gcactttattactcatcccggatag

SEQ ID NO: 533786 - DNA, 25 bp, Mus musculus
gcactttattttaagctgctgaaat

SEQ ID NO: 533787 - DNA, 25 bp, Mus musculus
gcactttatttttagctgctgaaat

SEQ ID NO: 533788 - DNA, 25 bp, Mus musculus
gcactttcaagtcagctgttgcgta

SEQ ID NO: 533789 - DNA, 25 bp, Mus musculus
gcactttcaagtgagctgttgcgta

SEQ ID NO: 533790 - DNA, 25 bp, Mus musculus
gcactttcaatgagatccgcctggt

SEQ ID NO: 533791 - DNA, 25 bp, Mus musculus
gcactttcaatgtgatccgcctggt

SEQ ID NO: 533792 - DNA, 25 bp, Mus musculus
gcactttcagcacgcaaaaatgatc

SEQ ID NO: 533793 - DNA, 25 bp, Mus musculus
gcactttcagcaggcaaaaatgatc

SEQ ID NO: 533794 - DNA, 25 bp, Mus musculus
gcactttcaggaacttgtctcttca

SEQ ID NO: 533795 - DNA, 25 bp, Mus musculus
gcactttcaggatcttgtctcttca

SEQ ID NO: 533796 - DNA, 25 bp, Mus musculus
gcactttcagttcctccatttggaa

SEQ ID NO: 533797 - DNA, 25 bp, Mus musculus
gcactttcagttgctccatttggaa

SEQ ID NO: 533798 - DNA, 25 bp, Mus musculus
gcactttcattgactagttgggtaa

SEQ ID NO: 533799 - DNA, 25 bp, Mus musculus
gcactttcattgtctagttgggtaa

SEQ ID NO: 533800 - DNA, 25 bp, Mus musculus
gcactttcctaaacatgcagcctat

SEQ ID NO: 533801 - DNA, 25 bp, Mus musculus
gcactttcctaatcatgcagcctat

SEQ ID NO: 533802 - DNA, 25 bp, Mus musculus
gcactttcctgcaaagcacatttgt

SEQ ID NO: 533803 - DNA, 25 bp, Mus musculus
gcactttcctgctaagcacatttgt

SEQ ID NO: 533804 - DNA, 25 bp, Mus musculus
gcactttcgggacgaccggatgcct

SEQ ID NO: 533805 - DNA, 25 bp, Mus musculus
gcactttcgggaggaccggatgcct

SEQ ID NO: 533806 - DNA, 25 bp, Mus musculus
gcactttctaagacacgctacgagt

SEQ ID NO: 533807 - DNA, 25 bp, Mus musculus
gcactttctaagtcacgctacgagt

SEQ ID NO: 533808 - DNA, 25 bp, Mus musculus
gcactttctgaaatgaccctaaaca

SEQ ID NO: 533809 - DNA, 25 bp, Mus musculus
gcactttctgaattgaccctaaaca

SEQ ID NO: 533810 - DNA, 25 bp, Mus musculus
gcactttctggaagcgggtgccagc

SEQ ID NO: 533811 - DNA, 25 bp, Mus musculus
gcactttctggatgcgggtgccagc

SEQ ID NO: 533812 - DNA, 25 bp, Mus musculus
gcactttctgggaacctgctgctaa

SEQ ID NO: 533813 - DNA, 25 bp, Mus musculus
gcactttctgggtacctgctgctaa

SEQ ID NO: 533814 - DNA, 25 bp, Mus musculus
gcactttctggtagagcagctgtct

SEQ ID NO: 533815 - DNA, 25 bp, Mus musculus
gcactttctggttgagcagctgtct

SEQ ID NO: 533816 - DNA, 25 bp, Mus musculus
gcactttcttccaatgggtggtcca

SEQ ID NO: 533817 - DNA, 25 bp, Mus musculus
gcactttcttcctatgggtggtcca

SEQ ID NO: 533818 - DNA, 25 bp, Mus musculus
gcactttcttgtcgtgttccagaaa

SEQ ID NO: 533819 - DNA, 25 bp, Mus musculus
gcactttcttgtggtgttccagaaa

SEQ ID NO: 533820 - DNA, 25 bp, Mus musculus
gcactttctttgattacacttccat

SEQ ID NO: 533821 - DNA, 25 bp, Mus musculus
gcactttctttgtttacacttccat

SEQ ID NO: 533822 - DNA, 25 bp, Mus musculus
gcactttgacagaaaccgtcttcac

SEQ ID NO: 533823 - DNA, 25 bp, Mus musculus
gcactttgacagtaaccgtcttcac

SEQ ID NO: 533824 - DNA, 25 bp, Mus musculus
gcactttgattcatgttctcatctg

SEQ ID NO: 533825 - DNA, 25 bp, Mus musculus
gcactttgattcttgttctcatctg

SEQ ID NO: 533826 - DNA, 25 bp, Mus musculus
gcactttgctctatactgttgatgg

SEQ ID NO: 533827 - DNA, 25 bp, Mus musculus
gcactttgctctttactgttgatgg

SEQ ID NO: 533828 - DNA, 25 bp, Mus musculus
gcactttgctttcctaggagctttc

SEQ ID NO: 533829 - DNA, 25 bp, Mus musculus
gcactttgctttgctaggagctttc

SEQ ID NO: 533830 - DNA, 25 bp, Mus musculus
gcactttggcatatgcatggtgtct

SEQ ID NO: 533831 - DNA, 25 bp, Mus musculus
gcactttggcatcgcgcatttgttc

SEQ ID NO: 533832 - DNA, 25 bp, Mus musculus
gcactttggcatggcgcatttgttc

SEQ ID NO: 533833 - DNA, 25 bp, Mus musculus
gcactttggcatttgcatggtgtct

SEQ ID NO: 533834 - DNA, 25 bp, Mus musculus
gcactttggctcactcaagatgtgt

SEQ ID NO: 533835 - DNA, 25 bp, Mus musculus
gcactttggctctctcaagatgtgt

SEQ ID NO: 533836 - DNA, 25 bp, Mus musculus
gcactttgggcacaccaggttagct

SEQ ID NO: 533837 - DNA, 25 bp, Mus musculus
gcactttgggcagaccaggttagct

SEQ ID NO: 533838 - DNA, 25 bp, Mus musculus
gcactttggtgcaggttatcagctt

SEQ ID NO: 533839 - DNA, 25 bp, Mus musculus
gcactttggtgctggttatcagctt

SEQ ID NO: 533840 - DNA, 25 bp, Mus musculus
gcactttggtttctgcatcttgaaa

SEQ ID NO: 533841 - DNA, 25 bp, Mus musculus
gcactttggtttgtgcatcttgaaa

SEQ ID NO: 533842 - DNA, 25 bp, Mus musculus
gcactttgttctatcgtaactaact

SEQ ID NO: 533843 - DNA, 25 bp, Mus musculus
gcactttgttctttcgtaactaact

SEQ ID NO: 533844 - DNA, 25 bp, Mus musculus
gcactttgttttcacctctggtata

SEQ ID NO: 533845 - DNA, 25 bp, Mus musculus
gcactttgttttgacctctggtata

SEQ ID NO: 533846 - DNA, 25 bp, Mus musculus
gcacttttaaaaatcacggtgataa

SEQ ID NO: 533847 - DNA, 25 bp, Mus musculus
gcacttttaaaattcacggtgataa

SEQ ID NO: 533848 - DNA, 25 bp, Mus musculus
gcacttttaatgattacgccttcct

SEQ ID NO: 533849 - DNA, 25 bp, Mus musculus
gcacttttaatgtttacgccttcct

SEQ ID NO: 533850 - DNA, 25 bp, Mus musculus
gcacttttacaactggccacatcaa

SEQ ID NO: 533851 - DNA, 25 bp, Mus musculus
gcacttttacaagtggccacatcaa

SEQ ID NO: 533852 - DNA, 25 bp, Mus musculus
gcacttttcccactgataattgtct

SEQ ID NO: 533853 - DNA, 25 bp, Mus musculus
gcacttttcccagtgataattgtct

SEQ ID NO: 533854 - DNA, 25 bp, Mus musculus
gcacttttccctaaacaagctctaa

SEQ ID NO: 533855 - DNA, 25 bp, Mus musculus
gcacttttcccttaacaagctctaa

SEQ ID NO: 533856 - DNA, 25 bp, Mus musculus
gcacttttccggagccttcggatct

SEQ ID NO: 533857 - DNA, 25 bp, Mus musculus
gcacttttccggtgccttcggatct

SEQ ID NO: 533858 - DNA, 25 bp, Mus musculus
gcacttttcgtaattcctagcaggt

SEQ ID NO: 533859 - DNA, 25 bp, Mus musculus
gcacttttcgtatttcctagcaggt

SEQ ID NO: 533860 - DNA, 25 bp, Mus musculus
gcacttttgaatacccctgcaggtt

SEQ ID NO: 533861 - DNA, 25 bp, Mus musculus
gcacttttgaattcccctgcaggtt

SEQ ID NO: 533862 - DNA, 25 bp, Mus musculus
gcacttttgaccaagtcctgttact

SEQ ID NO: 533863 - DNA, 25 bp, Mus musculus
gcacttttgacctagtcctgttact

SEQ ID NO: 533864 - DNA, 25 bp, Mus musculus
gcacttttgcagctactagagataa

SEQ ID NO: 533865 - DNA, 25 bp, Mus musculus
gcacttttgcaggtactagagataa

SEQ ID NO: 533866 - DNA, 25 bp, Mus musculus
gcacttttgcccataaataccttgt

SEQ ID NO: 533867 - DNA, 25 bp, Mus musculus
gcacttttgcccttaaataccttgt

SEQ ID NO: 533868 - DNA, 25 bp, Mus musculus
gcacttttgcgtattcattagcctt

SEQ ID NO: 533869 - DNA, 25 bp, Mus musculus
gcacttttgcgttttcattagcctt

SEQ ID NO: 533870 - DNA, 25 bp, Mus musculus
gcacttttgggtatcctacaattga

SEQ ID NO: 533871 - DNA, 25 bp, Mus musculus
gcacttttgggtttcctacaattga

SEQ ID NO: 533872 - DNA, 25 bp, Mus musculus
gcacttttgttcatgctccaaagaa

SEQ ID NO: 533873 - DNA, 25 bp, Mus musculus
gcacttttgttcttgctccaaagaa

SEQ ID NO: 533874 - DNA, 25 bp, Mus musculus
gcactttttaagaccctctgctgat

SEQ ID NO: 533875 - DNA, 25 bp, Mus musculus
gcactttttaagtccctctgctgat

SEQ ID NO: 533876 - DNA, 25 bp, Mus musculus
gcactttttcatccttgaagctaga

SEQ ID NO: 533877 - DNA, 25 bp, Mus musculus
gcactttttcatgcttgaagctaga

SEQ ID NO: 533878 - DNA, 25 bp, Mus musculus
gcactttttgccctttttacctcat

SEQ ID NO: 533879 - DNA, 25 bp, Mus musculus
gcactttttgccgtttttacctcat

SEQ ID NO: 533880 - DNA, 25 bp, Mus musculus
gcagaaaaatctacaggtccctgga

SEQ ID NO: 533881 - DNA, 25 bp, Mus musculus
gcagaaaaatcttcaggtccctgga

SEQ ID NO: 533882 - DNA, 25 bp, Mus musculus
gcagaaaacactcccacagcggcgg

SEQ ID NO: 533883 - DNA, 25 bp, Mus musculus
gcagaaaacactgccacagcggcgg

SEQ ID NO: 533884 - DNA, 25 bp, Mus musculus
gcagaaaacggaagctctccccatg

SEQ ID NO: 533885 - DNA, 25 bp, Mus musculus
gcagaaaacggatgctctccccatg

SEQ ID NO: 533886 - DNA, 25 bp, Mus musculus
gcagaaaactgaaggcactaaatct

SEQ ID NO: 533887 - DNA, 25 bp, Mus musculus
gcagaaaactgatggcactaaatct

SEQ ID NO: 533888 - DNA, 25 bp, Mus musculus
gcagaaaagtgcctacgtgtacatg

SEQ ID NO: 533889 - DNA, 25 bp, Mus musculus
gcagaaaagtgcgtacgtgtacatg

SEQ ID NO: 533890 - DNA, 25 bp, Mus musculus
gcagaaaagttcagagagtgacttt

SEQ ID NO: 533891 - DNA, 25 bp, Mus musculus
gcagaaaagttctgagagtgacttt

SEQ ID NO: 533892 - DNA, 25 bp, Mus musculus
gcagaaacaagcaatggcctcaaac

SEQ ID NO: 533893 - DNA, 25 bp, Mus musculus
gcagaaacaagcctgctgcagaaga

SEQ ID NO: 533894 - DNA, 25 bp, Mus musculus
gcagaaacaagcgtgctgcagaaga

SEQ ID NO: 533895 - DNA, 25 bp, Mus musculus
gcagaaacaagctatggcctcaaac

SEQ ID NO: 533896 - DNA, 25 bp, Mus musculus
gcagaaacactgctatacatttttt

SEQ ID NO: 533897 - DNA, 25 bp, Mus musculus
gcagaaacactggtatacatttttt

SEQ ID NO: 533898 - DNA, 25 bp, Mus musculus
gcagaaacatctaaaagctaaaagt

SEQ ID NO: 533899 - DNA, 25 bp, Mus musculus
gcagaaacatcttaaagctaaaagt

SEQ ID NO: 533900 - DNA, 25 bp, Mus musculus
gcagaaacccaaactatggctcttg

SEQ ID NO: 533901 - DNA, 25 bp, Mus musculus
gcagaaacccaacctgctcgttgtt

SEQ ID NO: 533902 - DNA, 25 bp, Mus musculus
gcagaaacccaagctgctcgttgtt

SEQ ID NO: 533903 - DNA, 25 bp, Mus musculus
gcagaaacccaatctatggctcttg

SEQ ID NO: 533904 - DNA, 25 bp, Mus musculus
gcagaaaccccacgtgtgcgcgagt

SEQ ID NO: 533905 - DNA, 25 bp, Mus musculus
gcagaaaccccaggtgtgcgcgagt

SEQ ID NO: 533906 - DNA, 25 bp, Mus musculus
gcagaaacccgtcgcttgtttcttt

SEQ ID NO: 533907 - DNA, 25 bp, Mus musculus
gcagaaacccgtggcttgtttcttt

SEQ ID NO: 533908 - DNA, 25 bp, Mus musculus
gcagaaacctggcacttgggacaaa

SEQ ID NO: 533909 - DNA, 25 bp, Mus musculus
gcagaaacctgggacttgggacaaa

SEQ ID NO: 533910 - DNA, 25 bp, Mus musculus
gcagaaacggctcctttattaccaa

SEQ ID NO: 533911 - DNA, 25 bp, Mus musculus
gcagaaacggctgctttattaccaa

SEQ ID NO: 533912 - DNA, 25 bp, Mus musculus
gcagaaactcaaccagggacttgaa

SEQ ID NO: 533913 - DNA, 25 bp, Mus musculus
gcagaaactcaagcagggacttgaa

SEQ ID NO: 533914 - DNA, 25 bp, Mus musculus
gcagaaactccgaggtaaactctac

SEQ ID NO: 533915 - DNA, 25 bp, Mus musculus
gcagaaactccgtggtaaactctac

SEQ ID NO: 533916 - DNA, 25 bp, Mus musculus
gcagaaacttcaataaccccacata

SEQ ID NO: 533917 - DNA, 25 bp, Mus musculus
gcagaaacttcattaaccccacata

SEQ ID NO: 533918 - DNA, 25 bp, Mus musculus
gcagaaacttctctcctcaggagtt

SEQ ID NO: 533919 - DNA, 25 bp, Mus musculus
gcagaaacttctgtcctcaggagtt

SEQ ID NO: 533920 - DNA, 25 bp, Mus musculus
gcagaaactttgatcgggcaacact

SEQ ID NO: 533921 - DNA, 25 bp, Mus musculus
gcagaaactttgttcgggcaacact

SEQ ID NO: 533922 - DNA, 25 bp, Mus musculus
gcagaaagccagcatgggtgttcat

SEQ ID NO: 533923 - DNA, 25 bp, Mus musculus
gcagaaagccaggatgggtgttcat

SEQ ID NO: 533924 - DNA, 25 bp, Mus musculus
gcagaaagctctcccagaggcacct

SEQ ID NO: 533925 - DNA, 25 bp, Mus musculus
gcagaaagctctgccagaggcacct

SEQ ID NO: 533926 - DNA, 25 bp, Mus musculus
gcagaaaggccgatttcttacctat

SEQ ID NO: 533927 - DNA, 25 bp, Mus musculus
gcagaaaggccgattttttacctat

SEQ ID NO: 533928 - DNA, 25 bp, Mus musculus
gcagaaaggccgttttcttacctat

SEQ ID NO: 533929 - DNA, 25 bp, Mus musculus
gcagaaaggccgtttttttacctat

SEQ ID NO: 533930 - DNA, 25 bp, Mus musculus
gcagaaaggctacttcttcgtggag

SEQ ID NO: 533931 - DNA, 25 bp, Mus musculus
gcagaaaggctagttcttcgtggag

SEQ ID NO: 533932 - DNA, 25 bp, Mus musculus
gcagaaaggtccagcaaagcccagc

SEQ ID NO: 533933 - DNA, 25 bp, Mus musculus
gcagaaaggtcctgcaaagcccagc

SEQ ID NO: 533934 - DNA, 25 bp, Mus musculus
gcagaaagtcaaatggcgtccagtt

SEQ ID NO: 533935 - DNA, 25 bp, Mus musculus
gcagaaagtcaattggcgtccagtt

SEQ ID NO: 533936 - DNA, 25 bp, Mus musculus
gcagaaagtccgctttgccaaacag

SEQ ID NO: 533937 - DNA, 25 bp, Mus musculus
gcagaaagtccggtttgccaaacag

SEQ ID NO: 533938 - DNA, 25 bp, Mus musculus
gcagaaagtctaactaatgacactg

SEQ ID NO: 533939 - DNA, 25 bp, Mus musculus
gcagaaagtctatctaatgacactg

SEQ ID NO: 533940 - DNA, 25 bp, Mus musculus
gcagaaagtgcacagtatcttggac

SEQ ID NO: 533941 - DNA, 25 bp, Mus musculus
gcagaaagtgcagagtatcttggac

SEQ ID NO: 533942 - DNA, 25 bp, Mus musculus
gcagaaagtggcctttcacgtgact

SEQ ID NO: 533943 - DNA, 25 bp, Mus musculus
gcagaaagtggcgtttcacgtgact

SEQ ID NO: 533944 - DNA, 25 bp, Mus musculus
gcagaaagtgttatccctagcgttt

SEQ ID NO: 533945 - DNA, 25 bp, Mus musculus
gcagaaagtgttttccctagcgttt

SEQ ID NO: 533946 - DNA, 25 bp, Mus musculus
gcagaaagttgtaaacccattccct

SEQ ID NO: 533947 - DNA, 25 bp, Mus musculus
gcagaaagttgttaacccattccct

SEQ ID NO: 533948 - DNA, 25 bp, Mus musculus
gcagaaatcgccattcttaatcaga

SEQ ID NO: 533949 - DNA, 25 bp, Mus musculus
gcagaaatcgcctttcttaatcaga

SEQ ID NO: 533950 - DNA, 25 bp, Mus musculus
gcagaaatctaaaaggcctgttgta

SEQ ID NO: 533951 - DNA, 25 bp, Mus musculus
gcagaaatctaataggcctgttgta

SEQ ID NO: 533952 - DNA, 25 bp, Mus musculus
gcagaaatgatccttgcctgccact

SEQ ID NO: 533953 - DNA, 25 bp, Mus musculus
gcagaaatgatcgttgcctgccact

SEQ ID NO: 533954 - DNA, 25 bp, Mus musculus
gcagaaatggttattaccacctaag

SEQ ID NO: 533955 - DNA, 25 bp, Mus musculus
gcagaaatggtttttaccacctaag

SEQ ID NO: 533956 - DNA, 25 bp, Mus musculus
gcagaaattacacgagctgctattt

SEQ ID NO: 533957 - DNA, 25 bp, Mus musculus
gcagaaattacaggagctgctattt

SEQ ID NO: 533958 - DNA, 25 bp, Mus musculus
gcagaaattcaaccacagccacagg

SEQ ID NO: 533959 - DNA, 25 bp, Mus musculus
gcagaaattcaagcacagccacagg

SEQ ID NO: 533960 - DNA, 25 bp, Mus musculus
gcagaaattcgccaaggatgactcg

SEQ ID NO: 533961 - DNA, 25 bp, Mus musculus
gcagaaattcgcgaaggatgactcg

SEQ ID NO: 533962 - DNA, 25 bp, Mus musculus
gcagaaattgtaaccccattttggt

SEQ ID NO: 533963 - DNA, 25 bp, Mus musculus
gcagaaattgtatccccattttggt

SEQ ID NO: 533964 - DNA, 25 bp, Mus musculus
gcagaacaaagcaacgcctccgcat

SEQ ID NO: 533965 - DNA, 25 bp, Mus musculus
gcagaacaaagctacgcctccgcat

SEQ ID NO: 533966 - DNA, 25 bp, Mus musculus
gcagaacaatgacaacagccctact

SEQ ID NO: 533967 - DNA, 25 bp, Mus musculus
gcagaacaatgagaacagccctact

SEQ ID NO: 533968 - DNA, 25 bp, Mus musculus
gcagaacacacaatatcctcaaagt

SEQ ID NO: 533969 - DNA, 25 bp, Mus musculus
gcagaacacacattatcctcaaagt

SEQ ID NO: 533970 - DNA, 25 bp, Mus musculus
gcagaacacgtacaggtcccggacc

SEQ ID NO: 533971 - DNA, 25 bp, Mus musculus
gcagaacacgtagaggtcccggacc

SEQ ID NO: 533972 - DNA, 25 bp, Mus musculus
gcagaacactcacctagcatttaca

SEQ ID NO: 533973 - DNA, 25 bp, Mus musculus
gcagaacactcagctagcatttaca

SEQ ID NO: 533974 - DNA, 25 bp, Mus musculus
gcagaacagaaacatggcatatatc

SEQ ID NO: 533975 - DNA, 25 bp, Mus musculus
gcagaacagaaagatggcatatatc

SEQ ID NO: 533976 - DNA, 25 bp, Mus musculus
gcagaacagcccaataagaacgccg

SEQ ID NO: 533977 - DNA, 25 bp, Mus musculus
gcagaacagccctataagaacgccg

SEQ ID NO: 533978 - DNA, 25 bp, Mus musculus
gcagaacagctaagcctgctcgaat

SEQ ID NO: 533979 - DNA, 25 bp, Mus musculus
gcagaacagctatgcctgctcgaat

SEQ ID NO: 533980 - DNA, 25 bp, Mus musculus
gcagaacatcgcagggacatgcctg

SEQ ID NO: 533981 - DNA, 25 bp, Mus musculus
gcagaacatcgctgggacatgcctg

SEQ ID NO: 533982 - DNA, 25 bp, Mus musculus
gcagaacatgatacaggcacgccct

SEQ ID NO: 533983 - DNA, 25 bp, Mus musculus
gcagaacatgattcaggcacgccct

SEQ ID NO: 533984 - DNA, 25 bp, Mus musculus
gcagaaccagcgatcctcaagatgt

SEQ ID NO: 533985 - DNA, 25 bp, Mus musculus
gcagaaccagcgttcctcaagatgt

SEQ ID NO: 533986 - DNA, 25 bp, Mus musculus
gcagaaccatggctagcaggcgtct

SEQ ID NO: 533987 - DNA, 25 bp, Mus musculus
gcagaaccatgggtagcaggcgtct

SEQ ID NO: 533988 - DNA, 25 bp, Mus musculus
gcagaacccactctttggatgctga

SEQ ID NO: 533989 - DNA, 25 bp, Mus musculus
gcagaacccactgtttggatgctga

SEQ ID NO: 533990 - DNA, 25 bp, Mus musculus
gcagaacccattatcttagctggtc

SEQ ID NO: 533991 - DNA, 25 bp, Mus musculus
gcagaacccattttcttagctggtc

SEQ ID NO: 533992 - DNA, 25 bp, Mus musculus
gcagaaccccatcgcagggaggata

SEQ ID NO: 533993 - DNA, 25 bp, Mus musculus
gcagaaccccatggcagggaggata

SEQ ID NO: 533994 - DNA, 25 bp, Mus musculus
gcagaacccctacgccaggctggga

SEQ ID NO: 533995 - DNA, 25 bp, Mus musculus
gcagaacccctaggccaggctggga

SEQ ID NO: 533996 - DNA, 25 bp, Mus musculus
gcagaacccttgcttggggttccag

SEQ ID NO: 533997 - DNA, 25 bp, Mus musculus
gcagaacccttggttggggttccag

SEQ ID NO: 533998 - DNA, 25 bp, Mus musculus
gcagaaccggatacattggcaaata

SEQ ID NO: 533999 - DNA, 25 bp, Mus musculus
gcagaaccggattcattggcaaata

SEQ ID NO: 534000 - DNA, 25 bp, Mus musculus
gcagaacctgcccatacagatccaa

SEQ ID NO: 534001 - DNA, 25 bp, Mus musculus
gcagaacctgccgatacagatccaa

SEQ ID NO: 534002 - DNA, 25 bp, Mus musculus
gcagaacctgcgatgcatcttagca

SEQ ID NO: 534003 - DNA, 25 bp, Mus musculus
gcagaacctgcgttgcatcttagca

SEQ ID NO: 534004 - DNA, 25 bp, Mus musculus
gcagaacctggcacggctgacagag

SEQ ID NO: 534005 - DNA, 25 bp, Mus musculus
gcagaacctggctcggctgacagag

SEQ ID NO: 534006 - DNA, 25 bp, Mus musculus
gcagaacctgggagccgtggtgggc

SEQ ID NO: 534007 - DNA, 25 bp, Mus musculus
gcagaacctgggtgccgtggtgggc

SEQ ID NO: 534008 - DNA, 25 bp, Mus musculus
gcagaacctggtagcctttcaatat

SEQ ID NO: 534009 - DNA, 25 bp, Mus musculus
gcagaacctggttgcctttcaatat

SEQ ID NO: 534010 - DNA, 25 bp, Mus musculus
gcagaaccttcaattatctgtgcat

SEQ ID NO: 534011 - DNA, 25 bp, Mus musculus
gcagaaccttcatttatctgtgcat

SEQ ID NO: 534012 - DNA, 25 bp, Mus musculus
gcagaacctttgctcatgccagcga

SEQ ID NO: 534013 - DNA, 25 bp, Mus musculus
gcagaacctttgctttggacagttc

SEQ ID NO: 534014 - DNA, 25 bp, Mus musculus
gcagaacctttggtcatgccagcga

SEQ ID NO: 534015 - DNA, 25 bp, Mus musculus
gcagaacctttggtttggacagttc

SEQ ID NO: 534016 - DNA, 25 bp, Mus musculus
gcagaacgatctccactgagttcac

SEQ ID NO: 534017 - DNA, 25 bp, Mus musculus
gcagaacgatctgcactgagttcac

SEQ ID NO: 534018 - DNA, 25 bp, Mus musculus
gcagaacgcattcggactctcctta

SEQ ID NO: 534019 - DNA, 25 bp, Mus musculus
gcagaacgcattgggactctcctta

SEQ ID NO: 534020 - DNA, 25 bp, Mus musculus
gcagaacggatacaacaatttacaa

SEQ ID NO: 534021 - DNA, 25 bp, Mus musculus
gcagaacggatagaacaatttacaa

SEQ ID NO: 534022 - DNA, 25 bp, Mus musculus
gcagaacggcatctagcagctaaca

SEQ ID NO: 534023 - DNA, 25 bp, Mus musculus
gcagaacggcatgtagcagctaaca

SEQ ID NO: 534024 - DNA, 25 bp, Mus musculus
gcagaacgtctcacagctacgagta

SEQ ID NO: 534025 - DNA, 25 bp, Mus musculus
gcagaacgtctctcagctacgagta

SEQ ID NO: 534026 - DNA, 25 bp, Mus musculus
gcagaacgtctgcatggacacccat

SEQ ID NO: 534027 - DNA, 25 bp, Mus musculus
gcagaacgtctggatggacacccat

SEQ ID NO: 534028 - DNA, 25 bp, Mus musculus
gcagaactaatgacgtcatcccagt

SEQ ID NO: 534029 - DNA, 25 bp, Mus musculus
gcagaactaatgtcgtcatcccagt

SEQ ID NO: 534030 - DNA, 25 bp, Mus musculus
gcagaactactgacgatcacctaga

SEQ ID NO: 534031 - DNA, 25 bp, Mus musculus
gcagaactactgtcgatcacctaga

SEQ ID NO: 534032 - DNA, 25 bp, Mus musculus
gcagaactcctgcacctaaggtgta

SEQ ID NO: 534033 - DNA, 25 bp, Mus musculus
gcagaactcctggacctaaggtgta

SEQ ID NO: 534034 - DNA, 25 bp, Mus musculus
gcagaactcgtcagacatgctcctg

SEQ ID NO: 534035 - DNA, 25 bp, Mus musculus
gcagaactcgtctgacatgctcctg

SEQ ID NO: 534036 - DNA, 25 bp, Mus musculus
gcagaactctctcggtggcagtgcc

SEQ ID NO: 534037 - DNA, 25 bp, Mus musculus
gcagaactctctgggtggcagtgcc

SEQ ID NO: 534038 - DNA, 25 bp, Mus musculus
gcagaactctggcatcttttagtcc

SEQ ID NO: 534039 - DNA, 25 bp, Mus musculus
gcagaactctgggatcttttagtcc

SEQ ID NO: 534040 - DNA, 25 bp, Mus musculus
gcagaactgagccttctggaagctg

SEQ ID NO: 534041 - DNA, 25 bp, Mus musculus
gcagaactgagcgttctggaagctg

SEQ ID NO: 534042 - DNA, 25 bp, Mus musculus
gcagaactggagcgctttagacccg

SEQ ID NO: 534043 - DNA, 25 bp, Mus musculus
gcagaactggagggctttagacccg

SEQ ID NO: 534044 - DNA, 25 bp, Mus musculus
gcagaactgggtcagcagccctgtt

SEQ ID NO: 534045 - DNA, 25 bp, Mus musculus
gcagaactgggtgagcagccctgtt

SEQ ID NO: 534046 - DNA, 25 bp, Mus musculus
gcagaactggtacctgatccgatct

SEQ ID NO: 534047 - DNA, 25 bp, Mus musculus
gcagaactggtagctgatccgatct

SEQ ID NO: 534048 - DNA, 25 bp, Mus musculus
gcagaactgtcaacacttaacttag

SEQ ID NO: 534049 - DNA, 25 bp, Mus musculus
gcagaactgtcatcacttaacttag

SEQ ID NO: 534050 - DNA, 25 bp, Mus musculus
gcagaactgttactgtctttctcct

SEQ ID NO: 534051 - DNA, 25 bp, Mus musculus
gcagaactgttagtgtctttctcct

SEQ ID NO: 534052 - DNA, 25 bp, Mus musculus
gcagaacttccaacctcttcattgt

SEQ ID NO: 534053 - DNA, 25 bp, Mus musculus
gcagaacttccaccagcgacatgtt

SEQ ID NO: 534054 - DNA, 25 bp, Mus musculus
gcagaacttccagcagcgacatgtt

SEQ ID NO: 534055 - DNA, 25 bp, Mus musculus
gcagaacttccatcctcttcattgt

SEQ ID NO: 534056 - DNA, 25 bp, Mus musculus
gcagaacttgaaccctgatgccaac

SEQ ID NO: 534057 - DNA, 25 bp, Mus musculus
gcagaacttgaagcctgatgccaac

SEQ ID NO: 534058 - DNA, 25 bp, Mus musculus
gcagaacttgacacttacatttttt

SEQ ID NO: 534059 - DNA, 25 bp, Mus musculus
gcagaacttgactcttacatttttt

SEQ ID NO: 534060 - DNA, 25 bp, Mus musculus
gcagaacttgctacatagatatgtt

SEQ ID NO: 534061 - DNA, 25 bp, Mus musculus
gcagaacttgcttcatagatatgtt

SEQ ID NO: 534062 - DNA, 25 bp, Mus musculus
gcagaacttggcatcttgtggcaaa

SEQ ID NO: 534063 - DNA, 25 bp, Mus musculus
gcagaacttggcttcttgtggcaaa

SEQ ID NO: 534064 - DNA, 25 bp, Mus musculus
gcagaactttcaattgtgcaggtct

SEQ ID NO: 534065 - DNA, 25 bp, Mus musculus
gcagaactttcatttgtgcaggtct

SEQ ID NO: 534066 - DNA, 25 bp, Mus musculus
gcagaactttgactatggcgtgtta

SEQ ID NO: 534067 - DNA, 25 bp, Mus musculus
gcagaactttgagtatggcgtgtta

SEQ ID NO: 534068 - DNA, 25 bp, Mus musculus
gcagaacttttcagtacaaggcaga

SEQ ID NO: 534069 - DNA, 25 bp, Mus musculus
gcagaacttttcattgccttgggtt

SEQ ID NO: 534070 - DNA, 25 bp, Mus musculus
gcagaacttttctgtacaaggcaga

SEQ ID NO: 534071 - DNA, 25 bp, Mus musculus
gcagaacttttctttgccttgggtt

SEQ ID NO: 534072 - DNA, 25 bp, Mus musculus
gcagaagaatctccatgagttccag

SEQ ID NO: 534073 - DNA, 25 bp, Mus musculus
gcagaagaatctgcatgagttccag

SEQ ID NO: 534074 - DNA, 25 bp, Mus musculus
gcagaagaccagcttttgtccccaa

SEQ ID NO: 534075 - DNA, 25 bp, Mus musculus
gcagaagaccaggttttgtccccaa

SEQ ID NO: 534076 - DNA, 25 bp, Mus musculus
gcagaagacccgctttgtgagtcac

SEQ ID NO: 534077 - DNA, 25 bp, Mus musculus
gcagaagacccggtttgtgagtcac

SEQ ID NO: 534078 - DNA, 25 bp, Mus musculus
gcagaagactccactaaagtcagta

SEQ ID NO: 534079 - DNA, 25 bp, Mus musculus
gcagaagactcctctaaagtcagta

SEQ ID NO: 534080 - DNA, 25 bp, Mus musculus
gcagaagactgaactctgtggattc

SEQ ID NO: 534081 - DNA, 25 bp, Mus musculus
gcagaagactgatctctgtggattc

SEQ ID NO: 534082 - DNA, 25 bp, Mus musculus
gcagaagacttcattcttccagaca

SEQ ID NO: 534083 - DNA, 25 bp, Mus musculus
gcagaagacttcctgtgttttctgt

SEQ ID NO: 534084 - DNA, 25 bp, Mus musculus
gcagaagacttcgtgtgttttctgt

SEQ ID NO: 534085 - DNA, 25 bp, Mus musculus
gcagaagacttctttcttccagaca

SEQ ID NO: 534086 - DNA, 25 bp, Mus musculus
gcagaagagacgatgttccactttt

SEQ ID NO: 534087 - DNA, 25 bp, Mus musculus
gcagaagagacgttgttccactttt

SEQ ID NO: 534088 - DNA, 25 bp, Mus musculus
gcagaagaggcccatgttgtttgaa

SEQ ID NO: 534089 - DNA, 25 bp, Mus musculus
gcagaagaggccgatgttgtttgaa

SEQ ID NO: 534090 - DNA, 25 bp, Mus musculus
gcagaagatcgaccttcggctgcag

SEQ ID NO: 534091 - DNA, 25 bp, Mus musculus
gcagaagatcgagcttcggctgcag

SEQ ID NO: 534092 - DNA, 25 bp, Mus musculus
gcagaagatctgcagattgttgtaa

SEQ ID NO: 534093 - DNA, 25 bp, Mus musculus
gcagaagatctggagattgttgtaa

SEQ ID NO: 534094 - DNA, 25 bp, Mus musculus
gcagaagatggtccttgcccttgtc

SEQ ID NO: 534095 - DNA, 25 bp, Mus musculus
gcagaagatggtgcttgcccttgtc

SEQ ID NO: 534096 - DNA, 25 bp, Mus musculus
gcagaagcaaaaatgagcattgtta

SEQ ID NO: 534097 - DNA, 25 bp, Mus musculus
gcagaagcaaaattgagcattgtta

SEQ ID NO: 534098 - DNA, 25 bp, Mus musculus
gcagaagcaagaactccgagttgaa

SEQ ID NO: 534099 - DNA, 25 bp, Mus musculus
gcagaagcaagaagccttgcctctg

SEQ ID NO: 534100 - DNA, 25 bp, Mus musculus
gcagaagcaagatctccgagttgaa

SEQ ID NO: 534101 - DNA, 25 bp, Mus musculus
gcagaagcaagatgccttgcctctg

SEQ ID NO: 534102 - DNA, 25 bp, Mus musculus
gcagaagcacagatccaaacattag

SEQ ID NO: 534103 - DNA, 25 bp, Mus musculus
gcagaagcacagttccaaacattag

SEQ ID NO: 534104 - DNA, 25 bp, Mus musculus
gcagaagcaccacctgctggagcat

SEQ ID NO: 534105 - DNA, 25 bp, Mus musculus
gcagaagcaccagctgctggagcat

SEQ ID NO: 534106 - DNA, 25 bp, Mus musculus
gcagaagcacccagtgggtttaaaa

SEQ ID NO: 534107 - DNA, 25 bp, Mus musculus
gcagaagcaccctgtgggtttaaaa

SEQ ID NO: 534108 - DNA, 25 bp, Mus musculus
gcagaagcacttagagatcccaagt

SEQ ID NO: 534109 - DNA, 25 bp, Mus musculus
gcagaagcactttgagatcccaagt

SEQ ID NO: 534110 - DNA, 25 bp, Mus musculus
gcagaagcagaaagctggcagaact

SEQ ID NO: 534111 - DNA, 25 bp, Mus musculus
gcagaagcagaatgctggcagaact

SEQ ID NO: 534112 - DNA, 25 bp, Mus musculus
gcagaagcagatagcctgcctggtc

SEQ ID NO: 534113 - DNA, 25 bp, Mus musculus
gcagaagcagattgcctgcctggtc

SEQ ID NO: 534114 - DNA, 25 bp, Mus musculus
gcagaagcagcacatattatgtccc

SEQ ID NO: 534115 - DNA, 25 bp, Mus musculus
gcagaagcagcacctcactgtatat

SEQ ID NO: 534116 - DNA, 25 bp, Mus musculus
gcagaagcagcacttccatgaccac

SEQ ID NO: 534117 - DNA, 25 bp, Mus musculus
gcagaagcagcagatattatgtccc

SEQ ID NO: 534118 - DNA, 25 bp, Mus musculus
gcagaagcagcagctcactgtatat

SEQ ID NO: 534119 - DNA, 25 bp, Mus musculus
gcagaagcagcagttccatgaccac

SEQ ID NO: 534120 - DNA, 25 bp, Mus musculus
gcagaagcaggactccttaccgtca

SEQ ID NO: 534121 - DNA, 25 bp, Mus musculus
gcagaagcaggagtccttaccgtca

SEQ ID NO: 534122 - DNA, 25 bp, Mus musculus
gcagaagcagttcaaatctcagaca

SEQ ID NO: 534123 - DNA, 25 bp, Mus musculus
gcagaagcagttgaaatctcagaca

SEQ ID NO: 534124 - DNA, 25 bp, Mus musculus
gcagaagccaggcacttctcccaaa

SEQ ID NO: 534125 - DNA, 25 bp, Mus musculus
gcagaagccagggacttctcccaaa

SEQ ID NO: 534126 - DNA, 25 bp, Mus musculus
gcagaagccatcaggagaacccaca

SEQ ID NO: 534127 - DNA, 25 bp, Mus musculus
gcagaagccatctggagaacccaca

SEQ ID NO: 534128 - DNA, 25 bp, Mus musculus
gcagaagcccccagaaaacgaaggt

SEQ ID NO: 534129 - DNA, 25 bp, Mus musculus
gcagaagccccctgaaaacgaaggt

SEQ ID NO: 534130 - DNA, 25 bp, Mus musculus
gcagaagccgcacagtagtgtcata

SEQ ID NO: 534131 - DNA, 25 bp, Mus musculus
gcagaagccgcagagtagtgtcata

SEQ ID NO: 534132 - DNA, 25 bp, Mus musculus
gcagaagcctgcagtgctgagatct

SEQ ID NO: 534133 - DNA, 25 bp, Mus musculus
gcagaagcctgctgtgctgagatct

SEQ ID NO: 534134 - DNA, 25 bp, Mus musculus
gcagaagcctggagagacttctaga

SEQ ID NO: 534135 - DNA, 25 bp, Mus musculus
gcagaagcctggtgagacttctaga

SEQ ID NO: 534136 - DNA, 25 bp, Mus musculus
gcagaagcgtatatcctttcggagt

SEQ ID NO: 534137 - DNA, 25 bp, Mus musculus
gcagaagcgtatttcctttcggagt

SEQ ID NO: 534138 - DNA, 25 bp, Mus musculus
gcagaagctcgtcgcagcctttgga

SEQ ID NO: 534139 - DNA, 25 bp, Mus musculus
gcagaagctcgtggcagcctttgga

SEQ ID NO: 534140 - DNA, 25 bp, Mus musculus
gcagaagctctgcttgctactcaat

SEQ ID NO: 534141 - DNA, 25 bp, Mus musculus
gcagaagctctggttgctactcaat

SEQ ID NO: 534142 - DNA, 25 bp, Mus musculus
gcagaagctggcacctgtaaaagga

SEQ ID NO: 534143 - DNA, 25 bp, Mus musculus
gcagaagctggctcctgtaaaagga

SEQ ID NO: 534144 - DNA, 25 bp, Mus musculus
gcagaagctggtcacactatttgga

SEQ ID NO: 534145 - DNA, 25 bp, Mus musculus
gcagaagctggtgacactatttgga

SEQ ID NO: 534146 - DNA, 25 bp, Mus musculus
gcagaaggagttcactatcagcctg

SEQ ID NO: 534147 - DNA, 25 bp, Mus musculus
gcagaaggagttgactatcagcctg

SEQ ID NO: 534148 - DNA, 25 bp, Mus musculus
gcagaaggcaccaggaccctgtgta

SEQ ID NO: 534149 - DNA, 25 bp, Mus musculus
gcagaaggcacctggaccctgtgta

SEQ ID NO: 534150 - DNA, 25 bp, Mus musculus
gcagaaggcactcgacgacactgat

SEQ ID NO: 534151 - DNA, 25 bp, Mus musculus
gcagaaggcactggacgacactgat

SEQ ID NO: 534152 - DNA, 25 bp, Mus musculus
gcagaaggcattccaatccgaacaa

SEQ ID NO: 534153 - DNA, 25 bp, Mus musculus
gcagaaggcattgcaatccgaacaa

SEQ ID NO: 534154 - DNA, 25 bp, Mus musculus
gcagaaggctcacgacatacgggaa

SEQ ID NO: 534155 - DNA, 25 bp, Mus musculus
gcagaaggctcaggacatacgggaa

SEQ ID NO: 534156 - DNA, 25 bp, Mus musculus
gcagaaggcttcaacaccacaagtg

SEQ ID NO: 534157 - DNA, 25 bp, Mus musculus
gcagaaggcttctacaccacaagtg

SEQ ID NO: 534158 - DNA, 25 bp, Mus musculus
gcagaaggcttgactattggtgatg

SEQ ID NO: 534159 - DNA, 25 bp, Mus musculus
gcagaaggcttgtctattggtgatg

SEQ ID NO: 534160 - DNA, 25 bp, Mus musculus
gcagaagggactagtatctcagcaa

SEQ ID NO: 534161 - DNA, 25 bp, Mus musculus
gcagaagggacttgtatctcagcaa

SEQ ID NO: 534162 - DNA, 25 bp, Mus musculus
gcagaagggccacctgacgagttcc

SEQ ID NO: 534163 - DNA, 25 bp, Mus musculus
gcagaagggccagctgacgagttcc

SEQ ID NO: 534164 - DNA, 25 bp, Mus musculus
gcagaaggtacccagtccacctgct

SEQ ID NO: 534165 - DNA, 25 bp, Mus musculus
gcagaaggtaccgagtccacctgct

SEQ ID NO: 534166 - DNA, 25 bp, Mus musculus
gcagaaggtcctatcagtgtgtact

SEQ ID NO: 534167 - DNA, 25 bp, Mus musculus
gcagaaggtcctttcagtgtgtact

SEQ ID NO: 534168 - DNA, 25 bp, Mus musculus
gcagaaggtgatctgcacaccctgc

SEQ ID NO: 534169 - DNA, 25 bp, Mus musculus
gcagaaggtgatgtgcacaccctgc

SEQ ID NO: 534170 - DNA, 25 bp, Mus musculus
gcagaaggtgccctgtcctagcgac

SEQ ID NO: 534171 - DNA, 25 bp, Mus musculus
gcagaaggtgccgtgtcctagcgac

SEQ ID NO: 534172 - DNA, 25 bp, Mus musculus
gcagaagtaatgaacccttccccac

SEQ ID NO: 534173 - DNA, 25 bp, Mus musculus
gcagaagtaatgtacccttccccac

SEQ ID NO: 534174 - DNA, 25 bp, Mus musculus
gcagaagtacacatgccatgtggaa

SEQ ID NO: 534175 - DNA, 25 bp, Mus musculus
gcagaagtacacttgccatgtggaa

SEQ ID NO: 534176 - DNA, 25 bp, Mus musculus
gcagaagtagggaaaccaaaacaca

SEQ ID NO: 534177 - DNA, 25 bp, Mus musculus
gcagaagtagggacgccgctccccg

SEQ ID NO: 534178 - DNA, 25 bp, Mus musculus
gcagaagtagggtaaccaaaacaca

SEQ ID NO: 534179 - DNA, 25 bp, Mus musculus
gcagaagtagggtcgccgctccccg

SEQ ID NO: 534180 - DNA, 25 bp, Mus musculus
gcagaagtatatagactgtgcaaat

SEQ ID NO: 534181 - DNA, 25 bp, Mus musculus
gcagaagtatattgactgtgcaaat

SEQ ID NO: 534182 - DNA, 25 bp, Mus musculus
gcagaagtatcaaagttttcaacga

SEQ ID NO: 534183 - DNA, 25 bp, Mus musculus
gcagaagtatcatagttttcaacga

SEQ ID NO: 534184 - DNA, 25 bp, Mus musculus
gcagaagtattacggtagcagtgac

SEQ ID NO: 534185 - DNA, 25 bp, Mus musculus
gcagaagtattagggtagcagtgac

SEQ ID NO: 534186 - DNA, 25 bp, Mus musculus
gcagaagtatttatcaaagcaacat

SEQ ID NO: 534187 - DNA, 25 bp, Mus musculus
gcagaagtatttttcaaagcaacat

SEQ ID NO: 534188 - DNA, 25 bp, Mus musculus
gcagaagtcacacgctttatcatag

SEQ ID NO: 534189 - DNA, 25 bp, Mus musculus
gcagaagtcacaggctttatcatag

SEQ ID NO: 534190 - DNA, 25 bp, Mus musculus
gcagaagtcacgaggtaatacccct

SEQ ID NO: 534191 - DNA, 25 bp, Mus musculus
gcagaagtcacgtggtaatacccct

SEQ ID NO: 534192 - DNA, 25 bp, Mus musculus
gcagaagtccagctttcaccatcta

SEQ ID NO: 534193 - DNA, 25 bp, Mus musculus
gcagaagtccaggtttcaccatcta

SEQ ID NO: 534194 - DNA, 25 bp, Mus musculus
gcagaagtcttaagtccacccaata

SEQ ID NO: 534195 - DNA, 25 bp, Mus musculus
gcagaagtcttatgtccacccaata

SEQ ID NO: 534196 - DNA, 25 bp, Mus musculus
gcagaagtgaccacccaacaggtga

SEQ ID NO: 534197 - DNA, 25 bp, Mus musculus
gcagaagtgacctcccaacaggtga

SEQ ID NO: 534198 - DNA, 25 bp, Mus musculus
gcagaagtgagacgctatttcaaag

SEQ ID NO: 534199 - DNA, 25 bp, Mus musculus
gcagaagtgagaggctatttcaaag

SEQ ID NO: 534200 - DNA, 25 bp, Mus musculus
gcagaagtgcgcatctcagttctta

SEQ ID NO: 534201 - DNA, 25 bp, Mus musculus
gcagaagtgcgcttctcagttctta

SEQ ID NO: 534202 - DNA, 25 bp, Mus musculus
gcagaagtgctgcaaattcaaggca

SEQ ID NO: 534203 - DNA, 25 bp, Mus musculus
gcagaagtgctggaaattcaaggca

SEQ ID NO: 534204 - DNA, 25 bp, Mus musculus
gcagaagtgtacaaccagaagttta

SEQ ID NO: 534205 - DNA, 25 bp, Mus musculus
gcagaagtgtactaccagaagttta

SEQ ID NO: 534206 - DNA, 25 bp, Mus musculus
gcagaagtgttcaactacagggaat

SEQ ID NO: 534207 - DNA, 25 bp, Mus musculus
gcagaagtgttctactacagggaat

SEQ ID NO: 534208 - DNA, 25 bp, Mus musculus
gcagaagttaggcttgccccttttt

SEQ ID NO: 534209 - DNA, 25 bp, Mus musculus
gcagaagttagggttgccccttttt

SEQ ID NO: 534210 - DNA, 25 bp, Mus musculus
gcagaagttcaccaccaagtcagat

SEQ ID NO: 534211 - DNA, 25 bp, Mus musculus
gcagaagttcacgaccaagtcagat

SEQ ID NO: 534212 - DNA, 25 bp, Mus musculus
gcagaataagccactctagcgataa

SEQ ID NO: 534213 - DNA, 25 bp, Mus musculus
gcagaataagcctctctagcgataa

SEQ ID NO: 534214 - DNA, 25 bp, Mus musculus
gcagaatagttcagggcggtgacta

SEQ ID NO: 534215 - DNA, 25 bp, Mus musculus
gcagaatagttctgggcggtgacta

SEQ ID NO: 534216 - DNA, 25 bp, Mus musculus
gcagaatcgcctactttggttgcca

SEQ ID NO: 534217 - DNA, 25 bp, Mus musculus
gcagaatcgccttctttggttgcca

SEQ ID NO: 534218 - DNA, 25 bp, Mus musculus
gcagaatcggccagaatgacacaga

SEQ ID NO: 534219 - DNA, 25 bp, Mus musculus
gcagaatcggcctgaatgacacaga

SEQ ID NO: 534220 - DNA, 25 bp, Mus musculus
gcagaatcgtgacatcggccccaac

SEQ ID NO: 534221 - DNA, 25 bp, Mus musculus
gcagaatcgtgagatcggccccaac

SEQ ID NO: 534222 - DNA, 25 bp, Mus musculus
gcagaatctactacagctccgtgca

SEQ ID NO: 534223 - DNA, 25 bp, Mus musculus
gcagaatctacttcagctccgtgca

SEQ ID NO: 534224 - DNA, 25 bp, Mus musculus
gcagaatctgctagttggctttaaa

SEQ ID NO: 534225 - DNA, 25 bp, Mus musculus
gcagaatctgcttgttggctttaaa

SEQ ID NO: 534226 - DNA, 25 bp, Mus musculus
gcagaatctggaaggcacctgtgca

SEQ ID NO: 534227 - DNA, 25 bp, Mus musculus
gcagaatctggatggcacctgtgca

SEQ ID NO: 534228 - DNA, 25 bp, Mus musculus
gcagaatctgttacctgggtcatgt

SEQ ID NO: 534229 - DNA, 25 bp, Mus musculus
gcagaatctgtttcctgggtcatgt

SEQ ID NO: 534230 - DNA, 25 bp, Mus musculus
gcagaatgcaaaccgactgacctgg

SEQ ID NO: 534231 - DNA, 25 bp, Mus musculus
gcagaatgcaaagcgactgacctgg

SEQ ID NO: 534232 - DNA, 25 bp, Mus musculus
gcagaatggagtccttcctacaaga

SEQ ID NO: 534233 - DNA, 25 bp, Mus musculus
gcagaatggagtgcttcctacaaga

SEQ ID NO: 534234 - DNA, 25 bp, Mus musculus
gcagaatggatgatcttggtgtaca

SEQ ID NO: 534235 - DNA, 25 bp, Mus musculus
gcagaatggatgttcttggtgtaca

SEQ ID NO: 534236 - DNA, 25 bp, Mus musculus
gcagaatggtccctaactttagagt

SEQ ID NO: 534237 - DNA, 25 bp, Mus musculus
gcagaatggtccgtaactttagagt

SEQ ID NO: 534238 - DNA, 25 bp, Mus musculus
gcagaatgtgcaacgactcctgtga

SEQ ID NO: 534239 - DNA, 25 bp, Mus musculus
gcagaatgtgcatcgactcctgtga

SEQ ID NO: 534240 - DNA, 25 bp, Mus musculus
gcagaatgtggcctgtactttagaa

SEQ ID NO: 534241 - DNA, 25 bp, Mus musculus
gcagaatgtggcgtgtactttagaa

SEQ ID NO: 534242 - DNA, 25 bp, Mus musculus
gcagaatgttccagacttatgtcct

SEQ ID NO: 534243 - DNA, 25 bp, Mus musculus
gcagaatgttcctgacttatgtcct

SEQ ID NO: 534244 - DNA, 25 bp, Mus musculus
gcagaattcagtcgcgctccaagct

SEQ ID NO: 534245 - DNA, 25 bp, Mus musculus
gcagaattcagtggcgctccaagct

SEQ ID NO: 534246 - DNA, 25 bp, Mus musculus
gcagaattcatgctacccagtatta

SEQ ID NO: 534247 - DNA, 25 bp, Mus musculus
gcagaattcatggtacccagtatta

SEQ ID NO: 534248 - DNA, 25 bp, Mus musculus
gcagaattcctaattcacctcttga

SEQ ID NO: 534249 - DNA, 25 bp, Mus musculus
gcagaattcctacataacacagatg

SEQ ID NO: 534250 - DNA, 25 bp, Mus musculus
gcagaattcctagataacacagatg

SEQ ID NO: 534251 - DNA, 25 bp, Mus musculus
gcagaattcctatttcacctcttga

SEQ ID NO: 534252 - DNA, 25 bp, Mus musculus
gcagaattcctgagtaggctttcct

SEQ ID NO: 534253 - DNA, 25 bp, Mus musculus
gcagaattcctgtgtaggctttcct

SEQ ID NO: 534254 - DNA, 25 bp, Mus musculus
gcagaattcggtcaagaggacctct

SEQ ID NO: 534255 - DNA, 25 bp, Mus musculus
gcagaattcggtgaagaggacctct

SEQ ID NO: 534256 - DNA, 25 bp, Mus musculus
gcagaattcgtaacggtgtggcttt

SEQ ID NO: 534257 - DNA, 25 bp, Mus musculus
gcagaattcgtatcggtgtggcttt

SEQ ID NO: 534258 - DNA, 25 bp, Mus musculus
gcagaattctggatgtagcttccaa

SEQ ID NO: 534259 - DNA, 25 bp, Mus musculus
gcagaattctggttgtagcttccaa

SEQ ID NO: 534260 - DNA, 25 bp, Mus musculus
gcagaattcttgcattatgacacga

SEQ ID NO: 534261 - DNA, 25 bp, Mus musculus
gcagaattcttggattatgacacga

SEQ ID NO: 534262 - DNA, 25 bp, Mus musculus
gcagaattgtgcatttccagtccct

SEQ ID NO: 534263 - DNA, 25 bp, Mus musculus
gcagaattgtgcttttccagtccct

SEQ ID NO: 534264 - DNA, 25 bp, Mus musculus
gcagaatttaacatgtccatgataa

SEQ ID NO: 534265 - DNA, 25 bp, Mus musculus
gcagaatttaacttgtccatgataa

SEQ ID NO: 534266 - DNA, 25 bp, Mus musculus
gcagaatttcccaaggcacacgatt

SEQ ID NO: 534267 - DNA, 25 bp, Mus musculus
gcagaatttccctaggcacacgatt

SEQ ID NO: 534268 - DNA, 25 bp, Mus musculus
gcagacaaaagtaccctcaaagtaa

SEQ ID NO: 534269 - DNA, 25 bp, Mus musculus
gcagacaaaagttccctcaaagtaa

SEQ ID NO: 534270 - DNA, 25 bp, Mus musculus
gcagacaaaatcaacatggtcattt

SEQ ID NO: 534271 - DNA, 25 bp, Mus musculus
gcagacaaaatctacatggtcattt

SEQ ID NO: 534272 - DNA, 25 bp, Mus musculus
gcagacaaagcaatcctacattaaa

SEQ ID NO: 534273 - DNA, 25 bp, Mus musculus
gcagacaaagcattcctacattaaa

SEQ ID NO: 534274 - DNA, 25 bp, Mus musculus
gcagacaaatacaaaggcacataat

SEQ ID NO: 534275 - DNA, 25 bp, Mus musculus
gcagacaaatactaaggcacataat

SEQ ID NO: 534276 - DNA, 25 bp, Mus musculus
gcagacaacaagaggacctcctttg

SEQ ID NO: 534277 - DNA, 25 bp, Mus musculus
gcagacaacaagtggacctcctttg

SEQ ID NO: 534278 - DNA, 25 bp, Mus musculus
gcagacaacctaatttgatccttcg

SEQ ID NO: 534279 - DNA, 25 bp, Mus musculus
gcagacaacctattttgatccttcg

SEQ ID NO: 534280 - DNA, 25 bp, Mus musculus
gcagacaacggtcggtttgtttaat

SEQ ID NO: 534281 - DNA, 25 bp, Mus musculus
gcagacaacggtgggtttgtttaat

SEQ ID NO: 534282 - DNA, 25 bp, Mus musculus
gcagacaaggttatcctcatatagg

SEQ ID NO: 534283 - DNA, 25 bp, Mus musculus
gcagacaaggttttcctcatatagg

SEQ ID NO: 534284 - DNA, 25 bp, Mus musculus
gcagacaatgaacccagtctcacct

SEQ ID NO: 534285 - DNA, 25 bp, Mus musculus
gcagacaatgaagccagtctcacct

SEQ ID NO: 534286 - DNA, 25 bp, Mus musculus
gcagacacaaaccagttcctcactt

SEQ ID NO: 534287 - DNA, 25 bp, Mus musculus
gcagacacaaacgagttcctcactt

SEQ ID NO: 534288 - DNA, 25 bp, Mus musculus
gcagacacagggatgtttgtgtttc

SEQ ID NO: 534289 - DNA, 25 bp, Mus musculus
gcagacacagggttgtttgtgtttc

SEQ ID NO: 534290 - DNA, 25 bp, Mus musculus
gcagacacatgcaagcgaacccaga

SEQ ID NO: 534291 - DNA, 25 bp, Mus musculus
gcagacacatgctagcgaacccaga

SEQ ID NO: 534292 - DNA, 25 bp, Mus musculus
gcagacaccaatagcaagcatgtac

SEQ ID NO: 534293 - DNA, 25 bp, Mus musculus
gcagacaccaattgcaagcatgtac

SEQ ID NO: 534294 - DNA, 25 bp, Mus musculus
gcagacaccaggatgccgagctgta

SEQ ID NO: 534295 - DNA, 25 bp, Mus musculus
gcagacaccaggttgccgagctgta

SEQ ID NO: 534296 - DNA, 25 bp, Mus musculus
gcagacacctagaaatggcagctgt

SEQ ID NO: 534297 - DNA, 25 bp, Mus musculus
gcagacacctagtaatggcagctgt

SEQ ID NO: 534298 - DNA, 25 bp, Mus musculus
gcagacacgagcaccatcatcacag

SEQ ID NO: 534299 - DNA, 25 bp, Mus musculus
gcagacacgagctccatcatcacag

SEQ ID NO: 534300 - DNA, 25 bp, Mus musculus
gcagacactctgaacagttttttca

SEQ ID NO: 534301 - DNA, 25 bp, Mus musculus
gcagacactctgaagcacaatgaat

SEQ ID NO: 534302 - DNA, 25 bp, Mus musculus
gcagacactctgtacagttttttca

SEQ ID NO: 534303 - DNA, 25 bp, Mus musculus
gcagacactctgtagcacaatgaat

SEQ ID NO: 534304 - DNA, 25 bp, Mus musculus
gcagacactgcactattggttttgt

SEQ ID NO: 534305 - DNA, 25 bp, Mus musculus
gcagacactgcagtattggttttgt

SEQ ID NO: 534306 - DNA, 25 bp, Mus musculus
gcagacactgggatagctattcaga

SEQ ID NO: 534307 - DNA, 25 bp, Mus musculus
gcagacactgggttagctattcaga

SEQ ID NO: 534308 - DNA, 25 bp, Mus musculus
gcagacactggtctgcctcagtttc

SEQ ID NO: 534309 - DNA, 25 bp, Mus musculus
gcagacactggtgtgcctcagtttc

SEQ ID NO: 534310 - DNA, 25 bp, Mus musculus
gcagacactgtgaagcccacattta

SEQ ID NO: 534311 - DNA, 25 bp, Mus musculus
gcagacactgtgtagcccacattta

SEQ ID NO: 534312 - DNA, 25 bp, Mus musculus
gcagacacttttagggtggccagtc

SEQ ID NO: 534313 - DNA, 25 bp, Mus musculus
gcagacactttttgggtggccagtc

SEQ ID NO: 534314 - DNA, 25 bp, Mus musculus
gcagacagagcaccttttgatcaca

SEQ ID NO: 534315 - DNA, 25 bp, Mus musculus
gcagacagagcagcttttgatcaca

SEQ ID NO: 534316 - DNA, 25 bp, Mus musculus
gcagacagatacatttgctctcttg

SEQ ID NO: 534317 - DNA, 25 bp, Mus musculus
gcagacagatacttttgctctcttg

SEQ ID NO: 534318 - DNA, 25 bp, Mus musculus
gcagacagatgtccgtaagttccag

SEQ ID NO: 534319 - DNA, 25 bp, Mus musculus
gcagacagatgtgcgtaagttccag

SEQ ID NO: 534320 - DNA, 25 bp, Mus musculus
gcagacagattcagcggtggcccgc

SEQ ID NO: 534321 - DNA, 25 bp, Mus musculus
gcagacagattctgcggtggcccgc

SEQ ID NO: 534322 - DNA, 25 bp, Mus musculus
gcagacagatttccatccaaaccat

SEQ ID NO: 534323 - DNA, 25 bp, Mus musculus
gcagacagatttgcatccaaaccat

SEQ ID NO: 534324 - DNA, 25 bp, Mus musculus
gcagacagcagcactagcagacggt

SEQ ID NO: 534325 - DNA, 25 bp, Mus musculus
gcagacagcagctctagcagacggt

SEQ ID NO: 534326 - DNA, 25 bp, Mus musculus
gcagacagcagtccagaagaggaaa

SEQ ID NO: 534327 - DNA, 25 bp, Mus musculus
gcagacagcagtgcagaagaggaaa

SEQ ID NO: 534328 - DNA, 25 bp, Mus musculus
gcagacagcatcatccatcttgctg

SEQ ID NO: 534329 - DNA, 25 bp, Mus musculus
gcagacagcatcttccatcttgctg

SEQ ID NO: 534330 - DNA, 25 bp, Mus musculus
gcagacagcattaagacagagcaca

SEQ ID NO: 534331 - DNA, 25 bp, Mus musculus
gcagacagcatttagacagagcaca

SEQ ID NO: 534332 - DNA, 25 bp, Mus musculus
gcagacagcgtgagctttgcgaaca

SEQ ID NO: 534333 - DNA, 25 bp, Mus musculus
gcagacagcgtgtgctttgcgaaca

SEQ ID NO: 534334 - DNA, 25 bp, Mus musculus
gcagacagctacacctttgtgtttt

SEQ ID NO: 534335 - DNA, 25 bp, Mus musculus
gcagacagctactcctttgtgtttt

SEQ ID NO: 534336 - DNA, 25 bp, Mus musculus
gcagacagctatattcacaatcaca

SEQ ID NO: 534337 - DNA, 25 bp, Mus musculus
gcagacagctattttcacaatcaca

SEQ ID NO: 534338 - DNA, 25 bp, Mus musculus
gcagacagctgcagcgccagtgagt

SEQ ID NO: 534339 - DNA, 25 bp, Mus musculus
gcagacagctgctgcgccagtgagt

SEQ ID NO: 534340 - DNA, 25 bp, Mus musculus
gcagacagctttcctgatcacttga

SEQ ID NO: 534341 - DNA, 25 bp, Mus musculus
gcagacagctttgctgatcacttga

SEQ ID NO: 534342 - DNA, 25 bp, Mus musculus
gcagacaggaccacttgtgagtcat

SEQ ID NO: 534343 - DNA, 25 bp, Mus musculus
gcagacaggacctcttgtgagtcat

SEQ ID NO: 534344 - DNA, 25 bp, Mus musculus
gcagacaggcatcttcacctgtgaa

SEQ ID NO: 534345 - DNA, 25 bp, Mus musculus
gcagacaggcatgttcacctgtgaa

SEQ ID NO: 534346 - DNA, 25 bp, Mus musculus
gcagacaggctcaccaactgtatga

SEQ ID NO: 534347 - DNA, 25 bp, Mus musculus
gcagacaggctctccaactgtatga

SEQ ID NO: 534348 - DNA, 25 bp, Mus musculus
gcagacaggtccatattggccaact

SEQ ID NO: 534349 - DNA, 25 bp, Mus musculus
gcagacaggtccttattggccaact

SEQ ID NO: 534350 - DNA, 25 bp, Mus musculus
gcagacagtagcagcaacatccagt

SEQ ID NO: 534351 - DNA, 25 bp, Mus musculus
gcagacagtagctgcaacatccagt

SEQ ID NO: 534352 - DNA, 25 bp, Mus musculus
gcagacagtttaaagagtattccac

SEQ ID NO: 534353 - DNA, 25 bp, Mus musculus
gcagacagtttatagagtattccac

SEQ ID NO: 534354 - DNA, 25 bp, Mus musculus
gcagacatactgattttctatttga

SEQ ID NO: 534355 - DNA, 25 bp, Mus musculus
gcagacatactgtttttctatttga

SEQ ID NO: 534356 - DNA, 25 bp, Mus musculus
gcagacatagtgcaggtttcagctt

SEQ ID NO: 534357 - DNA, 25 bp, Mus musculus
gcagacatagtggaggtttcagctt

SEQ ID NO: 534358 - DNA, 25 bp, Mus musculus
gcagacatcagcagtaggcttccac

SEQ ID NO: 534359 - DNA, 25 bp, Mus musculus
gcagacatcagctgtaggcttccac

SEQ ID NO: 534360 - DNA, 25 bp, Mus musculus
gcagacatcattcaggtctccctga

SEQ ID NO: 534361 - DNA, 25 bp, Mus musculus
gcagacatcattgaggtctccctga

SEQ ID NO: 534362 - DNA, 25 bp, Mus musculus
gcagacatcgttatctctctaaatt

SEQ ID NO: 534363 - DNA, 25 bp, Mus musculus
gcagacatcgttttctctctaaatt

SEQ ID NO: 534364 - DNA, 25 bp, Mus musculus
gcagacatctaccttttatttcaac

SEQ ID NO: 534365 - DNA, 25 bp, Mus musculus
gcagacatctacgttttatttcaac

SEQ ID NO: 534366 - DNA, 25 bp, Mus musculus
gcagacatcttgatccagcatgggt

SEQ ID NO: 534367 - DNA, 25 bp, Mus musculus
gcagacatcttgctactgatcccta

SEQ ID NO: 534368 - DNA, 25 bp, Mus musculus
gcagacatcttggtactgatcccta

SEQ ID NO: 534369 - DNA, 25 bp, Mus musculus
gcagacatcttgttccagcatgggt

SEQ ID NO: 534370 - DNA, 25 bp, Mus musculus
gcagacatggatatcaaccagttag

SEQ ID NO: 534371 - DNA, 25 bp, Mus musculus
gcagacatggatttcaaccagttag

SEQ ID NO: 534372 - DNA, 25 bp, Mus musculus
gcagacatgtccagatggtggcaag

SEQ ID NO: 534373 - DNA, 25 bp, Mus musculus
gcagacatgtcctgatggtggcaag

SEQ ID NO: 534374 - DNA, 25 bp, Mus musculus
gcagacatgtgcattgtgaacattc

SEQ ID NO: 534375 - DNA, 25 bp, Mus musculus
gcagacatgtgctttgtgaacattc

SEQ ID NO: 534376 - DNA, 25 bp, Mus musculus
gcagacatgttacaagccttcccac

SEQ ID NO: 534377 - DNA, 25 bp, Mus musculus
gcagacatgttagaagccttcccac

SEQ ID NO: 534378 - DNA, 25 bp, Mus musculus
gcagacattactctagcattgtagt

SEQ ID NO: 534379 - DNA, 25 bp, Mus musculus
gcagacattactgtagcattgtagt

SEQ ID NO: 534380 - DNA, 25 bp, Mus musculus
gcagacattcacacgggacttagat

SEQ ID NO: 534381 - DNA, 25 bp, Mus musculus
gcagacattcacaggtgcacgcata

SEQ ID NO: 534382 - DNA, 25 bp, Mus musculus
gcagacattcactcgggacttagat

SEQ ID NO: 534383 - DNA, 25 bp, Mus musculus
gcagacattcactggtgcacgcata

SEQ ID NO: 534384 - DNA, 25 bp, Mus musculus
gcagacattgagataaaggccccat

SEQ ID NO: 534385 - DNA, 25 bp, Mus musculus
gcagacattgagttaaaggccccat

SEQ ID NO: 534386 - DNA, 25 bp, Mus musculus
gcagacattttcacagatgagagcg

SEQ ID NO: 534387 - DNA, 25 bp, Mus musculus
gcagacattttcatgaagctattga

SEQ ID NO: 534388 - DNA, 25 bp, Mus musculus
gcagacattttctcagatgagagcg

SEQ ID NO: 534389 - DNA, 25 bp, Mus musculus
gcagacattttcttgaagctattga

SEQ ID NO: 534390 - DNA, 25 bp, Mus musculus
gcagacatttttcagggatcctatt

SEQ ID NO: 534391 - DNA, 25 bp, Mus musculus
gcagacatttttgagggatcctatt

SEQ ID NO: 534392 - DNA, 25 bp, Mus musculus
gcagaccaagcaacgaggccagcag

SEQ ID NO: 534393 - DNA, 25 bp, Mus musculus
gcagaccaagcatcgaggccagcag

SEQ ID NO: 534394 - DNA, 25 bp, Mus musculus
gcagaccacagtatcagccgaacaa

SEQ ID NO: 534395 - DNA, 25 bp, Mus musculus
gcagaccacagtttcagccgaacaa

SEQ ID NO: 534396 - DNA, 25 bp, Mus musculus
gcagaccacataccactgactggta

SEQ ID NO: 534397 - DNA, 25 bp, Mus musculus
gcagaccacatagcactgactggta

SEQ ID NO: 534398 - DNA, 25 bp, Mus musculus
gcagaccacgcacagaaacaggcat

SEQ ID NO: 534399 - DNA, 25 bp, Mus musculus
gcagaccacgcagagaaacaggcat

SEQ ID NO: 534400 - DNA, 25 bp, Mus musculus
gcagaccagacaactttaggagctc

SEQ ID NO: 534401 - DNA, 25 bp, Mus musculus
gcagaccagacactgatgcagtctt

SEQ ID NO: 534402 - DNA, 25 bp, Mus musculus
gcagaccagacagtgatgcagtctt

SEQ ID NO: 534403 - DNA, 25 bp, Mus musculus
gcagaccagacatctttaggagctc

SEQ ID NO: 534404 - DNA, 25 bp, Mus musculus
gcagaccagccccttttaaggttgt

SEQ ID NO: 534405 - DNA, 25 bp, Mus musculus
gcagaccagcccgttttaaggttgt

SEQ ID NO: 534406 - DNA, 25 bp, Mus musculus
gcagaccagggcctgtcttgctata

SEQ ID NO: 534407 - DNA, 25 bp, Mus musculus
gcagaccagggcgtgtcttgctata

SEQ ID NO: 534408 - DNA, 25 bp, Mus musculus
gcagaccataacaggcttctatgag

SEQ ID NO: 534409 - DNA, 25 bp, Mus musculus
gcagaccataactggcttctatgag

SEQ ID NO: 534410 - DNA, 25 bp, Mus musculus
gcagaccataagatgattgatcaga

SEQ ID NO: 534411 - DNA, 25 bp, Mus musculus
gcagaccataagttgattgatcaga

SEQ ID NO: 534412 - DNA, 25 bp, Mus musculus
gcagaccatcaaagcctaacacaac

SEQ ID NO: 534413 - DNA, 25 bp, Mus musculus
gcagaccatcaatgcctaacacaac

SEQ ID NO: 534414 - DNA, 25 bp, Mus musculus
gcagaccatcctcactgagtggatg

SEQ ID NO: 534415 - DNA, 25 bp, Mus musculus
gcagaccatcctgactgagtggatg

SEQ ID NO: 534416 - DNA, 25 bp, Mus musculus
gcagaccatcgtcagcctagaggaa

SEQ ID NO: 534417 - DNA, 25 bp, Mus musculus
gcagaccatcgtgagcctagaggaa

SEQ ID NO: 534418 - DNA, 25 bp, Mus musculus
gcagaccatctaagtgcttgctctt

SEQ ID NO: 534419 - DNA, 25 bp, Mus musculus
gcagaccatctatgtgcttgctctt

SEQ ID NO: 534420 - DNA, 25 bp, Mus musculus
gcagaccatgatcgaagctcacgtt

SEQ ID NO: 534421 - DNA, 25 bp, Mus musculus
gcagaccatgatggaagctcacgtt

SEQ ID NO: 534422 - DNA, 25 bp, Mus musculus
gcagaccatgcgacctattctagaa

SEQ ID NO: 534423 - DNA, 25 bp, Mus musculus
gcagaccatgcgtcctattctagaa

SEQ ID NO: 534424 - DNA, 25 bp, Mus musculus
gcagaccatggccaggcctctggag

SEQ ID NO: 534425 - DNA, 25 bp, Mus musculus
gcagaccatggcgaggcctctggag

SEQ ID NO: 534426 - DNA, 25 bp, Mus musculus
gcagaccatggtcctatgcaatagt

SEQ ID NO: 534427 - DNA, 25 bp, Mus musculus
gcagaccatggtgctatgcaatagt

SEQ ID NO: 534428 - DNA, 25 bp, Mus musculus
gcagacccaagtcttaaagctatag

SEQ ID NO: 534429 - DNA, 25 bp, Mus musculus
gcagacccaagtgttaaagctatag

SEQ ID NO: 534430 - DNA, 25 bp, Mus musculus
gcagacccagcgctatctagaagtg

SEQ ID NO: 534431 - DNA, 25 bp, Mus musculus
gcagacccagcggtatctagaagtg

SEQ ID NO: 534432 - DNA, 25 bp, Mus musculus
gcagacccaggcattattggccaaa

SEQ ID NO: 534433 - DNA, 25 bp, Mus musculus
gcagacccaggctttattggccaaa

SEQ ID NO: 534434 - DNA, 25 bp, Mus musculus
gcagacccagttcccttacagggat

SEQ ID NO: 534435 - DNA, 25 bp, Mus musculus
gcagacccagttgccttacagggat

SEQ ID NO: 534436 - DNA, 25 bp, Mus musculus
gcagaccccaagaggcagaagacag

SEQ ID NO: 534437 - DNA, 25 bp, Mus musculus
gcagaccccaagtggcagaagacag

SEQ ID NO: 534438 - DNA, 25 bp, Mus musculus
gcagaccccagaaggagttcattgt

SEQ ID NO: 534439 - DNA, 25 bp, Mus musculus
gcagaccccagatggagttcattgt

SEQ ID NO: 534440 - DNA, 25 bp, Mus musculus
gcagaccccatacaaaggtgagcaa

SEQ ID NO: 534441 - DNA, 25 bp, Mus musculus
gcagaccccatagaaaggtgagcaa

SEQ ID NO: 534442 - DNA, 25 bp, Mus musculus
gcagaccctagtacgtggcgccaaa

SEQ ID NO: 534443 - DNA, 25 bp, Mus musculus
gcagaccctagtcggctgtactgta

SEQ ID NO: 534444 - DNA, 25 bp, Mus musculus
gcagaccctagtgggctgtactgta

SEQ ID NO: 534445 - DNA, 25 bp, Mus musculus
gcagaccctagttcgtggcgccaaa

SEQ ID NO: 534446 - DNA, 25 bp, Mus musculus
gcagaccctgatctgatggtcccca

SEQ ID NO: 534447 - DNA, 25 bp, Mus musculus
gcagaccctgatgtgatggtcccca

SEQ ID NO: 534448 - DNA, 25 bp, Mus musculus
gcagaccctgctctaagtgtaggct

SEQ ID NO: 534449 - DNA, 25 bp, Mus musculus
gcagaccctgctgtaagtgtaggct

SEQ ID NO: 534450 - DNA, 25 bp, Mus musculus
gcagaccctggacaagcatggcttc

SEQ ID NO: 534451 - DNA, 25 bp, Mus musculus
gcagaccctggaccaatatgaattc

SEQ ID NO: 534452 - DNA, 25 bp, Mus musculus
gcagaccctggagaagcatggcttc

SEQ ID NO: 534453 - DNA, 25 bp, Mus musculus
gcagaccctggagcaatatgaattc

SEQ ID NO: 534454 - DNA, 25 bp, Mus musculus
gcagaccggaagatgaagaactcaa

SEQ ID NO: 534455 - DNA, 25 bp, Mus musculus
gcagaccggaagttgaagaactcaa

SEQ ID NO: 534456 - DNA, 25 bp, Mus musculus
gcagaccggcatactcaaagctgga

SEQ ID NO: 534457 - DNA, 25 bp, Mus musculus
gcagaccggcattctcaaagctgga

SEQ ID NO: 534458 - DNA, 25 bp, Mus musculus
gcagaccgtagcaagctcttacata

SEQ ID NO: 534459 - DNA, 25 bp, Mus musculus
gcagaccgtagctagctcttacata

SEQ ID NO: 534460 - DNA, 25 bp, Mus musculus
gcagaccgtcctcgaggctgtgatc

SEQ ID NO: 534461 - DNA, 25 bp, Mus musculus
gcagaccgtcctggaggctgtgatc

SEQ ID NO: 534462 - DNA, 25 bp, Mus musculus
gcagacctacagacatccacgtgtg

SEQ ID NO: 534463 - DNA, 25 bp, Mus musculus
gcagacctacagtcatccacgtgtg

SEQ ID NO: 534464 - DNA, 25 bp, Mus musculus
gcagacctagtacacagctgtgcaa

SEQ ID NO: 534465 - DNA, 25 bp, Mus musculus
gcagacctagtagacagctgtgcaa

SEQ ID NO: 534466 - DNA, 25 bp, Mus musculus
gcagacctcaagattctggttgatg

SEQ ID NO: 534467 - DNA, 25 bp, Mus musculus
gcagacctcaagtttctggttgatg

SEQ ID NO: 534468 - DNA, 25 bp, Mus musculus
gcagacctcataaggcatcctacaa

SEQ ID NO: 534469 - DNA, 25 bp, Mus musculus
gcagacctcatatggcatcctacaa

SEQ ID NO: 534470 - DNA, 25 bp, Mus musculus
gcagacctccctctaaacggtgaat

SEQ ID NO: 534471 - DNA, 25 bp, Mus musculus
gcagacctccctgtaaacggtgaat

SEQ ID NO: 534472 - DNA, 25 bp, Mus musculus
gcagacctccggaagggaagcacat

SEQ ID NO: 534473 - DNA, 25 bp, Mus musculus
gcagacctccggtagggaagcacat

SEQ ID NO: 534474 - DNA, 25 bp, Mus musculus
gcagacctctgtaagctagccatga

SEQ ID NO: 534475 - DNA, 25 bp, Mus musculus
gcagacctctgttagctagccatga

SEQ ID NO: 534476 - DNA, 25 bp, Mus musculus
gcagacctgacactatagatacttg

SEQ ID NO: 534477 - DNA, 25 bp, Mus musculus
gcagacctgacagtatagatacttg

SEQ ID NO: 534478 - DNA, 25 bp, Mus musculus
gcagacctgagaaacgctgtgcaaa

SEQ ID NO: 534479 - DNA, 25 bp, Mus musculus
gcagacctgagacttcttagcaact

SEQ ID NO: 534480 - DNA, 25 bp, Mus musculus
gcagacctgagagttcttagcaact

SEQ ID NO: 534481 - DNA, 25 bp, Mus musculus
gcagacctgagatacgctgtgcaaa

SEQ ID NO: 534482 - DNA, 25 bp, Mus musculus
gcagacctgagtctgacagtcccat

SEQ ID NO: 534483 - DNA, 25 bp, Mus musculus
gcagacctgagtgtgacagtcccat

SEQ ID NO: 534484 - DNA, 25 bp, Mus musculus
gcagaccttgaacatttgtcatgat

SEQ ID NO: 534485 - DNA, 25 bp, Mus musculus
gcagaccttgaagatttgtcatgat

SEQ ID NO: 534486 - DNA, 25 bp, Mus musculus
gcagacgaacgtacttccttcatga

SEQ ID NO: 534487 - DNA, 25 bp, Mus musculus
gcagacgaacgttcttccttcatga

SEQ ID NO: 534488 - DNA, 25 bp, Mus musculus
gcagacgagcatcgcaccagcagaa

SEQ ID NO: 534489 - DNA, 25 bp, Mus musculus
gcagacgagcatggcaccagcagaa

SEQ ID NO: 534490 - DNA, 25 bp, Mus musculus
gcagacgccggtagatagtccagat

SEQ ID NO: 534491 - DNA, 25 bp, Mus musculus
gcagacgccggttgatagtccagat

SEQ ID NO: 534492 - DNA, 25 bp, Mus musculus
gcagacgcgcttaggcaagatccat

SEQ ID NO: 534493 - DNA, 25 bp, Mus musculus
gcagacgcgctttggcaagatccat

SEQ ID NO: 534494 - DNA, 25 bp, Mus musculus
gcagacgcggtgatacatgagtact

SEQ ID NO: 534495 - DNA, 25 bp, Mus musculus
gcagacgcggtgttacatgagtact

SEQ ID NO: 534496 - DNA, 25 bp, Mus musculus
gcagacgctccaacgtgtattcaga

SEQ ID NO: 534497 - DNA, 25 bp, Mus musculus
gcagacgctccatcgtgtattcaga

SEQ ID NO: 534498 - DNA, 25 bp, Mus musculus
gcagacggcgtgactttcggagatt

SEQ ID NO: 534499 - DNA, 25 bp, Mus musculus
gcagacggcgtgtctttcggagatt

SEQ ID NO: 534500 - DNA, 25 bp, Mus musculus
gcagacggtgtgactcaggagctct

SEQ ID NO: 534501 - DNA, 25 bp, Mus musculus
gcagacggtgtgtctcaggagctct

SEQ ID NO: 534502 - DNA, 25 bp, Mus musculus
gcagacgtacagcacggagccaaat

SEQ ID NO: 534503 - DNA, 25 bp, Mus musculus
gcagacgtacaggacggagccaaat

SEQ ID NO: 534504 - DNA, 25 bp, Mus musculus
gcagacgtacttattcgggaattgt

SEQ ID NO: 534505 - DNA, 25 bp, Mus musculus
gcagacgtactttttcgggaattgt

SEQ ID NO: 534506 - DNA, 25 bp, Mus musculus
gcagacgtcattctcacacacctga

SEQ ID NO: 534507 - DNA, 25 bp, Mus musculus
gcagacgtcattgtcacacacctga

SEQ ID NO: 534508 - DNA, 25 bp, Mus musculus
gcagacgtctctactttgttctaag

SEQ ID NO: 534509 - DNA, 25 bp, Mus musculus
gcagacgtctcttctttgttctaag

SEQ ID NO: 534510 - DNA, 25 bp, Mus musculus
gcagacgtgaacatggtgaacgcta

SEQ ID NO: 534511 - DNA, 25 bp, Mus musculus
gcagacgtgaacttggtgaacgcta

SEQ ID NO: 534512 - DNA, 25 bp, Mus musculus
gcagacgtgacaagataatgaaatc

SEQ ID NO: 534513 - DNA, 25 bp, Mus musculus
gcagacgtgacatgataatgaaatc

SEQ ID NO: 534514 - DNA, 25 bp, Mus musculus
gcagacgtggagaactcgggtaaaa

SEQ ID NO: 534515 - DNA, 25 bp, Mus musculus
gcagacgtggagtactcgggtaaaa

SEQ ID NO: 534516 - DNA, 25 bp, Mus musculus
gcagacgttatgacacccagactaa

SEQ ID NO: 534517 - DNA, 25 bp, Mus musculus
gcagacgttatgtcacccagactaa

SEQ ID NO: 534518 - DNA, 25 bp, Mus musculus
gcagactaaagcaaacttcagaact

SEQ ID NO: 534519 - DNA, 25 bp, Mus musculus
gcagactaaagctaacttcagaact

SEQ ID NO: 534520 - DNA, 25 bp, Mus musculus
gcagactaagccaattttccgcaaa

SEQ ID NO: 534521 - DNA, 25 bp, Mus musculus
gcagactaagcctattttccgcaaa

SEQ ID NO: 534522 - DNA, 25 bp, Mus musculus
gcagactacctaccatccaataatt

SEQ ID NO: 534523 - DNA, 25 bp, Mus musculus
gcagactacctagcatccaataatt

SEQ ID NO: 534524 - DNA, 25 bp, Mus musculus
gcagactatcagagaacatgttcct

SEQ ID NO: 534525 - DNA, 25 bp, Mus musculus
gcagactatcagtgaacatgttcct

SEQ ID NO: 534526 - DNA, 25 bp, Mus musculus
gcagactatgcccacgatggtgaga

SEQ ID NO: 534527 - DNA, 25 bp, Mus musculus
gcagactatgccgacgatggtgaga

SEQ ID NO: 534528 - DNA, 25 bp, Mus musculus
gcagactatgtcaagcggatcctaa

SEQ ID NO: 534529 - DNA, 25 bp, Mus musculus
gcagactatgtctagcggatcctaa

SEQ ID NO: 534530 - DNA, 25 bp, Mus musculus
gcagactcagcaaatgtccactgtg

SEQ ID NO: 534531 - DNA, 25 bp, Mus musculus
gcagactcagcatatgtccactgtg

SEQ ID NO: 534532 - DNA, 25 bp, Mus musculus
gcagactcagttagtatccaaagct

SEQ ID NO: 534533 - DNA, 25 bp, Mus musculus
gcagactcagtttgtatccaaagct

SEQ ID NO: 534534 - DNA, 25 bp, Mus musculus
gcagactccactaacactttattga

SEQ ID NO: 534535 - DNA, 25 bp, Mus musculus
gcagactccacttacactttattga

SEQ ID NO: 534536 - DNA, 25 bp, Mus musculus
gcagactccagaacggcgaacacga

SEQ ID NO: 534537 - DNA, 25 bp, Mus musculus
gcagactccagatcggcgaacacga

SEQ ID NO: 534538 - DNA, 25 bp, Mus musculus
gcagactcccctataaaatctcttg

SEQ ID NO: 534539 - DNA, 25 bp, Mus musculus
gcagactcccctttaaaatctcttg

SEQ ID NO: 534540 - DNA, 25 bp, Mus musculus
gcagactcgacacttcaagagcaag

SEQ ID NO: 534541 - DNA, 25 bp, Mus musculus
gcagactcgacagttcaagagcaag

SEQ ID NO: 534542 - DNA, 25 bp, Mus musculus
gcagactcggagctttgacctcagg

SEQ ID NO: 534543 - DNA, 25 bp, Mus musculus
gcagactcggaggtttgacctcagg

SEQ ID NO: 534544 - DNA, 25 bp, Mus musculus
gcagactctaccagacattttacct

SEQ ID NO: 534545 - DNA, 25 bp, Mus musculus
gcagactctacctgacattttacct

SEQ ID NO: 534546 - DNA, 25 bp, Mus musculus
gcagactctgagcatggcttcgctc

SEQ ID NO: 534547 - DNA, 25 bp, Mus musculus
gcagactctgaggatggcttcgctc

SEQ ID NO: 534548 - DNA, 25 bp, Mus musculus
gcagactctgtacccttcaggaaac

SEQ ID NO: 534549 - DNA, 25 bp, Mus musculus
gcagactctgtagccttcaggaaac

SEQ ID NO: 534550 - DNA, 25 bp, Mus musculus
gcagactgaactaggacacggcctt

SEQ ID NO: 534551 - DNA, 25 bp, Mus musculus
gcagactgaacttggacacggcctt

SEQ ID NO: 534552 - DNA, 25 bp, Mus musculus
gcagactgaagcagctgtttgtctt

SEQ ID NO: 534553 - DNA, 25 bp, Mus musculus
gcagactgaagctgctgtttgtctt

SEQ ID NO: 534554 - DNA, 25 bp, Mus musculus
gcagactgacacctgtccagatgtg

SEQ ID NO: 534555 - DNA, 25 bp, Mus musculus
gcagactgacacgtgtccagatgtg

SEQ ID NO: 534556 - DNA, 25 bp, Mus musculus
gcagactgagctaacatgtcgcttt

SEQ ID NO: 534557 - DNA, 25 bp, Mus musculus
gcagactgagcttacatgtcgcttt

SEQ ID NO: 534558 - DNA, 25 bp, Mus musculus
gcagactgcaccctcctatatgaag

SEQ ID NO: 534559 - DNA, 25 bp, Mus musculus
gcagactgcaccgtcctatatgaag

SEQ ID NO: 534560 - DNA, 25 bp, Mus musculus
gcagactgcactacagtcactggct

SEQ ID NO: 534561 - DNA, 25 bp, Mus musculus
gcagactgcacttcagtcactggct

SEQ ID NO: 534562 - DNA, 25 bp, Mus musculus
gcagactgcgcgaaacagggccaga

SEQ ID NO: 534563 - DNA, 25 bp, Mus musculus
gcagactgcgcgtaacagggccaga

SEQ ID NO: 534564 - DNA, 25 bp, Mus musculus
gcagactgcttacatattttccttt

SEQ ID NO: 534565 - DNA, 25 bp, Mus musculus
gcagactgcttaccctttcagtgca

SEQ ID NO: 534566 - DNA, 25 bp, Mus musculus
gcagactgcttagatattttccttt

SEQ ID NO: 534567 - DNA, 25 bp, Mus musculus
gcagactgcttagcctttcagtgca

SEQ ID NO: 534568 - DNA, 25 bp, Mus musculus
gcagactggattcgcatcagtgaga

SEQ ID NO: 534569 - DNA, 25 bp, Mus musculus
gcagactggattggcatcagtgaga

SEQ ID NO: 534570 - DNA, 25 bp, Mus musculus
gcagactgggaaagtttggctaaac

SEQ ID NO: 534571 - DNA, 25 bp, Mus musculus
gcagactgggaatgtttggctaaac

SEQ ID NO: 534572 - DNA, 25 bp, Mus musculus
gcagactgtaacaccagagctagtt

SEQ ID NO: 534573 - DNA, 25 bp, Mus musculus
gcagactgtaactccagagctagtt

SEQ ID NO: 534574 - DNA, 25 bp, Mus musculus
gcagactgtcaacaagcctagtaat

SEQ ID NO: 534575 - DNA, 25 bp, Mus musculus
gcagactgtcaagaagcctagtaat

SEQ ID NO: 534576 - DNA, 25 bp, Mus musculus
gcagactgtgaaacttacgattgat

SEQ ID NO: 534577 - DNA, 25 bp, Mus musculus
gcagactgtgaatcttacgattgat

SEQ ID NO: 534578 - DNA, 25 bp, Mus musculus
gcagactgtggcagcgtacaccttt

SEQ ID NO: 534579 - DNA, 25 bp, Mus musculus
gcagactgtggctgcgtacaccttt

SEQ ID NO: 534580 - DNA, 25 bp, Mus musculus
gcagactgtgttcaagacgcctctt

SEQ ID NO: 534581 - DNA, 25 bp, Mus musculus
gcagactgtgttgaagacgcctctt

SEQ ID NO: 534582 - DNA, 25 bp, Mus musculus
gcagactgttacattgttggcccta

SEQ ID NO: 534583 - DNA, 25 bp, Mus musculus
gcagactgttactttgttggcccta

SEQ ID NO: 534584 - DNA, 25 bp, Mus musculus
gcagacttagagctcctcagcctga

SEQ ID NO: 534585 - DNA, 25 bp, Mus musculus
gcagacttagaggtcctcagcctga

SEQ ID NO: 534586 - DNA, 25 bp, Mus musculus
gcagacttcaaaagcacttccagta

SEQ ID NO: 534587 - DNA, 25 bp, Mus musculus
gcagacttcaaatgcacttccagta

SEQ ID NO: 534588 - DNA, 25 bp, Mus musculus
gcagacttctgcatcgaaatcaaag

SEQ ID NO: 534589 - DNA, 25 bp, Mus musculus
gcagacttctgccattataaggctt

SEQ ID NO: 534590 - DNA, 25 bp, Mus musculus
gcagacttctgcgattataaggctt

SEQ ID NO: 534591 - DNA, 25 bp, Mus musculus
gcagacttctgcttcgaaatcaaag

SEQ ID NO: 534592 - DNA, 25 bp, Mus musculus
gcagacttctttccgatgcatacat

SEQ ID NO: 534593 - DNA, 25 bp, Mus musculus
gcagacttctttgcgatgcatacat

SEQ ID NO: 534594 - DNA, 25 bp, Mus musculus
gcagacttgaaaaccttaaccagct

SEQ ID NO: 534595 - DNA, 25 bp, Mus musculus
gcagacttgaaatccttaaccagct

SEQ ID NO: 534596 - DNA, 25 bp, Mus musculus
gcagacttggatatagcttcgcttt

SEQ ID NO: 534597 - DNA, 25 bp, Mus musculus
gcagacttggatttagcttcgcttt

SEQ ID NO: 534598 - DNA, 25 bp, Mus musculus
gcagactttattaccagatgttttc

SEQ ID NO: 534599 - DNA, 25 bp, Mus musculus
gcagactttattctgcttctttgct

SEQ ID NO: 534600 - DNA, 25 bp, Mus musculus
gcagactttattgtgcttctttgct

SEQ ID NO: 534601 - DNA, 25 bp, Mus musculus
gcagactttatttccagatgttttc

SEQ ID NO: 534602 - DNA, 25 bp, Mus musculus
gcagactttcaaatctagtgtgcac

SEQ ID NO: 534603 - DNA, 25 bp, Mus musculus
gcagactttcaattctagtgtgcac

SEQ ID NO: 534604 - DNA, 25 bp, Mus musculus
gcagactttcacatagcaagcacca

SEQ ID NO: 534605 - DNA, 25 bp, Mus musculus
gcagactttcacttagcaagcacca

SEQ ID NO: 534606 - DNA, 25 bp, Mus musculus
gcagactttgtgctgctcgacgaca

SEQ ID NO: 534607 - DNA, 25 bp, Mus musculus
gcagactttgtggtgctcgacgaca

SEQ ID NO: 534608 - DNA, 25 bp, Mus musculus
gcagacttttcacggaggcaacatt

SEQ ID NO: 534609 - DNA, 25 bp, Mus musculus
gcagacttttcagggaggcaacatt

SEQ ID NO: 534610 - DNA, 25 bp, Mus musculus
gcagacttttctagcaactactgtg

SEQ ID NO: 534611 - DNA, 25 bp, Mus musculus
gcagacttttcttgcaactactgtg

SEQ ID NO: 534612 - DNA, 25 bp, Mus musculus
gcagacttttgcaaacttaccatta

SEQ ID NO: 534613 - DNA, 25 bp, Mus musculus
gcagacttttgctaacttaccatta

SEQ ID NO: 534614 - DNA, 25 bp, Mus musculus
gcagacttttgtccgtcgatgcagt

SEQ ID NO: 534615 - DNA, 25 bp, Mus musculus
gcagacttttgtgcgtcgatgcagt

SEQ ID NO: 534616 - DNA, 25 bp, Mus musculus
gcagactttttgacagtattctcta

SEQ ID NO: 534617 - DNA, 25 bp, Mus musculus
gcagactttttgtcagtattctcta

SEQ ID NO: 534618 - DNA, 25 bp, Mus musculus
gcagagaaaaagatccccgccctgt

SEQ ID NO: 534619 - DNA, 25 bp, Mus musculus
gcagagaaaaagttccccgccctgt

SEQ ID NO: 534620 - DNA, 25 bp, Mus musculus
gcagagaaaatgatcaagggcaaac

SEQ ID NO: 534621 - DNA, 25 bp, Mus musculus
gcagagaaaatgttcaagggcaaac

SEQ ID NO: 534622 - DNA, 25 bp, Mus musculus
gcagagaaactgattcacatctctc

SEQ ID NO: 534623 - DNA, 25 bp, Mus musculus
gcagagaaactgtttcacatctctc

SEQ ID NO: 534624 - DNA, 25 bp, Mus musculus
gcagagaaatccaagaagggttccc

SEQ ID NO: 534625 - DNA, 25 bp, Mus musculus
gcagagaaatcctagaagggttccc

SEQ ID NO: 534626 - DNA, 25 bp, Mus musculus
gcagagaaatgcattttcacagaaa

SEQ ID NO: 534627 - DNA, 25 bp, Mus musculus
gcagagaaatgctttttcacagaaa

SEQ ID NO: 534628 - DNA, 25 bp, Mus musculus
gcagagaaccagcacctaaagaaca

SEQ ID NO: 534629 - DNA, 25 bp, Mus musculus
gcagagaaccaggacctaaagaaca

SEQ ID NO: 534630 - DNA, 25 bp, Mus musculus
gcagagaaccccaaactgtcgtgtt

SEQ ID NO: 534631 - DNA, 25 bp, Mus musculus
gcagagaacccctaactgtcgtgtt

SEQ ID NO: 534632 - DNA, 25 bp, Mus musculus
gcagagaacctacaagaccaggaac

SEQ ID NO: 534633 - DNA, 25 bp, Mus musculus
gcagagaacctagaagaccaggaac

SEQ ID NO: 534634 - DNA, 25 bp, Mus musculus
gcagagaacctcagttcattcccag

SEQ ID NO: 534635 - DNA, 25 bp, Mus musculus
gcagagaacctctgttcattcccag

SEQ ID NO: 534636 - DNA, 25 bp, Mus musculus
gcagagaacgcacccggcaagatcc

SEQ ID NO: 534637 - DNA, 25 bp, Mus musculus
gcagagaacgcagccggcaagatcc

SEQ ID NO: 534638 - DNA, 25 bp, Mus musculus
gcagagaacttcattatccttcgaa

SEQ ID NO: 534639 - DNA, 25 bp, Mus musculus
gcagagaacttctttatccttcgaa

SEQ ID NO: 534640 - DNA, 25 bp, Mus musculus
gcagagaagcaaatgtacccggaga

SEQ ID NO: 534641 - DNA, 25 bp, Mus musculus
gcagagaagcaattgtacccggaga

SEQ ID NO: 534642 - DNA, 25 bp, Mus musculus
gcagagaatcatcggttttacttta

SEQ ID NO: 534643 - DNA, 25 bp, Mus musculus
gcagagaatcatgggttttacttta

SEQ ID NO: 534644 - DNA, 25 bp, Mus musculus
gcagagaattttcccctcggagtgc

SEQ ID NO: 534645 - DNA, 25 bp, Mus musculus
gcagagaattttgccctcggagtgc

SEQ ID NO: 534646 - DNA, 25 bp, Mus musculus
gcagagacaaaaccaggagcttaca

SEQ ID NO: 534647 - DNA, 25 bp, Mus musculus
gcagagacaaaagcaggagcttaca

SEQ ID NO: 534648 - DNA, 25 bp, Mus musculus
gcagagacaccaaggaggatgagaa

SEQ ID NO: 534649 - DNA, 25 bp, Mus musculus
gcagagacaccatggaggatgagaa

SEQ ID NO: 534650 - DNA, 25 bp, Mus musculus
gcagagacagagaaacacgggccaa

SEQ ID NO: 534651 - DNA, 25 bp, Mus musculus
gcagagacagagagccgctacgccc

SEQ ID NO: 534652 - DNA, 25 bp, Mus musculus
gcagagacagagtaacacgggccaa

SEQ ID NO: 534653 - DNA, 25 bp, Mus musculus
gcagagacagagtgccgctacgccc

SEQ ID NO: 534654 - DNA, 25 bp, Mus musculus
gcagagacaggtcctagacctcagt

SEQ ID NO: 534655 - DNA, 25 bp, Mus musculus
gcagagacaggtgctagacctcagt

SEQ ID NO: 534656 - DNA, 25 bp, Mus musculus
gcagagacattacagacccttgtgt

SEQ ID NO: 534657 - DNA, 25 bp, Mus musculus
gcagagacattacggccagcacaag

SEQ ID NO: 534658 - DNA, 25 bp, Mus musculus
gcagagacattagagacccttgtgt

SEQ ID NO: 534659 - DNA, 25 bp, Mus musculus
gcagagacattagggccagcacaag

SEQ ID NO: 534660 - DNA, 25 bp, Mus musculus
gcagagaccatcacagcattccaca

SEQ ID NO: 534661 - DNA, 25 bp, Mus musculus
gcagagaccatctcagcattccaca

SEQ ID NO: 534662 - DNA, 25 bp, Mus musculus
gcagagacccggctctcttgccttg

SEQ ID NO: 534663 - DNA, 25 bp, Mus musculus
gcagagacccgggtctcttgccttg

SEQ ID NO: 534664 - DNA, 25 bp, Mus musculus
gcagagacccttaaaggcggttcct

SEQ ID NO: 534665 - DNA, 25 bp, Mus musculus
gcagagaccctttaaggcggttcct

SEQ ID NO: 534666 - DNA, 25 bp, Mus musculus
gcagagaccgcaatgctggatcaca

SEQ ID NO: 534667 - DNA, 25 bp, Mus musculus
gcagagaccgcattgctggatcaca

SEQ ID NO: 534668 - DNA, 25 bp, Mus musculus
gcagagacgagcaatggagagacta

SEQ ID NO: 534669 - DNA, 25 bp, Mus musculus
gcagagacgagctatggagagacta

SEQ ID NO: 534670 - DNA, 25 bp, Mus musculus
gcagagacgcgcatcctgcaggaaa

SEQ ID NO: 534671 - DNA, 25 bp, Mus musculus
gcagagacgcgcttcctgcaggaaa

SEQ ID NO: 534672 - DNA, 25 bp, Mus musculus
gcagagacgctgacatttcacatgt

SEQ ID NO: 534673 - DNA, 25 bp, Mus musculus
gcagagacgctgtcatttcacatgt

SEQ ID NO: 534674 - DNA, 25 bp, Mus musculus
gcagagacggtcatcgccatgaggc

SEQ ID NO: 534675 - DNA, 25 bp, Mus musculus
gcagagacggtcttcgccatgaggc

SEQ ID NO: 534676 - DNA, 25 bp, Mus musculus
gcagagacggttatttgggttccta

SEQ ID NO: 534677 - DNA, 25 bp, Mus musculus
gcagagacggttttttgggttccta

SEQ ID NO: 534678 - DNA, 25 bp, Mus musculus
gcagagactcaacgataggccatct

SEQ ID NO: 534679 - DNA, 25 bp, Mus musculus
gcagagactcaaggataggccatct

SEQ ID NO: 534680 - DNA, 25 bp, Mus musculus
gcagagactctcagtcacgtgaata

SEQ ID NO: 534681 - DNA, 25 bp, Mus musculus
gcagagactctcattgattatgaag

SEQ ID NO: 534682 - DNA, 25 bp, Mus musculus
gcagagactctctgtcacgtgaata

SEQ ID NO: 534683 - DNA, 25 bp, Mus musculus
gcagagactctctttgattatgaag

SEQ ID NO: 534684 - DNA, 25 bp, Mus musculus
gcagagactctgcagcaagtgcgta

SEQ ID NO: 534685 - DNA, 25 bp, Mus musculus
gcagagactctggagcaagtgcgta

SEQ ID NO: 534686 - DNA, 25 bp, Mus musculus
gcagagactgttagcagccctggcc

SEQ ID NO: 534687 - DNA, 25 bp, Mus musculus
gcagagactgtttgcagccctggcc

SEQ ID NO: 534688 - DNA, 25 bp, Mus musculus
gcagagacttttctttctccttttg

SEQ ID NO: 534689 - DNA, 25 bp, Mus musculus
gcagagacttttgtttctccttttg

SEQ ID NO: 534690 - DNA, 25 bp, Mus musculus
gcagagagaaaaccaccagacagaa

SEQ ID NO: 534691 - DNA, 25 bp, Mus musculus
gcagagagaaaagcaccagacagaa

SEQ ID NO: 534692 - DNA, 25 bp, Mus musculus
gcagagagactgaccctgtgctggt

SEQ ID NO: 534693 - DNA, 25 bp, Mus musculus
gcagagagactgtccctgtgctggt

SEQ ID NO: 534694 - DNA, 25 bp, Mus musculus
gcagagagcaccaaaggacaccttt

SEQ ID NO: 534695 - DNA, 25 bp, Mus musculus
gcagagagcacctaaggacaccttt

SEQ ID NO: 534696 - DNA, 25 bp, Mus musculus
gcagagagcactagaggctgacgtt

SEQ ID NO: 534697 - DNA, 25 bp, Mus musculus
gcagagagcactctgggtgttttta

SEQ ID NO: 534698 - DNA, 25 bp, Mus musculus
gcagagagcactgtgggtgttttta

SEQ ID NO: 534699 - DNA, 25 bp, Mus musculus
gcagagagcacttgaggctgacgtt

SEQ ID NO: 534700 - DNA, 25 bp, Mus musculus
gcagagagcaggcactgtagcaaca

SEQ ID NO: 534701 - DNA, 25 bp, Mus musculus
gcagagagcagggactgtagcaaca

SEQ ID NO: 534702 - DNA, 25 bp, Mus musculus
gcagagagcagtactatcgtatagt

SEQ ID NO: 534703 - DNA, 25 bp, Mus musculus
gcagagagcagttctatcgtatagt

SEQ ID NO: 534704 - DNA, 25 bp, Mus musculus
gcagagagctacatacatgatttga

SEQ ID NO: 534705 - DNA, 25 bp, Mus musculus
gcagagagctacttacatgatttga

SEQ ID NO: 534706 - DNA, 25 bp, Mus musculus
gcagagagctctcaccaggatagtc

SEQ ID NO: 534707 - DNA, 25 bp, Mus musculus
gcagagagctctgaccaggatagtc

SEQ ID NO: 534708 - DNA, 25 bp, Mus musculus
gcagagagcttcattccaggaatcc

SEQ ID NO: 534709 - DNA, 25 bp, Mus musculus
gcagagagcttcctgtgaccagtct

SEQ ID NO: 534710 - DNA, 25 bp, Mus musculus
gcagagagcttcgtgtgaccagtct

SEQ ID NO: 534711 - DNA, 25 bp, Mus musculus
gcagagagcttctttccaggaatcc

SEQ ID NO: 534712 - DNA, 25 bp, Mus musculus
gcagagagtctcatctaagtgttgt

SEQ ID NO: 534713 - DNA, 25 bp, Mus musculus
gcagagagtctcttctaagtgttgt

SEQ ID NO: 534714 - DNA, 25 bp, Mus musculus
gcagagatagtcctactgttccacg

SEQ ID NO: 534715 - DNA, 25 bp, Mus musculus
gcagagatagtcgtactgttccacg

SEQ ID NO: 534716 - DNA, 25 bp, Mus musculus
gcagagatcatcagccccaagaatg

SEQ ID NO: 534717 - DNA, 25 bp, Mus musculus
gcagagatcatctgccccaagaatg

SEQ ID NO: 534718 - DNA, 25 bp, Mus musculus
gcagagatccaacgagggccacact

SEQ ID NO: 534719 - DNA, 25 bp, Mus musculus
gcagagatccaaggagggccacact

SEQ ID NO: 534720 - DNA, 25 bp, Mus musculus
gcagagatccgcacagagacagaac

SEQ ID NO: 534721 - DNA, 25 bp, Mus musculus
gcagagatccgctcagagacagaac

SEQ ID NO: 534722 - DNA, 25 bp, Mus musculus
gcagagatcctgcaagagtcccgga

SEQ ID NO: 534723 - DNA, 25 bp, Mus musculus
gcagagatcctggaagagtcccgga

SEQ ID NO: 534724 - DNA, 25 bp, Mus musculus
gcagagatctatcggcccgacagaa

SEQ ID NO: 534725 - DNA, 25 bp, Mus musculus
gcagagatctatgggcccgacagaa

SEQ ID NO: 534726 - DNA, 25 bp, Mus musculus
gcagagatgaccacggtgagttcat

SEQ ID NO: 534727 - DNA, 25 bp, Mus musculus
gcagagatgacctcggtgagttcat

SEQ ID NO: 534728 - DNA, 25 bp, Mus musculus
gcagagatgagtactcacagtccat

SEQ ID NO: 534729 - DNA, 25 bp, Mus musculus
gcagagatgagttctcacagtccat

SEQ ID NO: 534730 - DNA, 25 bp, Mus musculus
gcagagatgcagacttagaggccct

SEQ ID NO: 534731 - DNA, 25 bp, Mus musculus
gcagagatgcagtcttagaggccct

SEQ ID NO: 534732 - DNA, 25 bp, Mus musculus
gcagagatgctgatccaattccatg

SEQ ID NO: 534733 - DNA, 25 bp, Mus musculus
gcagagatgctgttccaattccatg

SEQ ID NO: 534734 - DNA, 25 bp, Mus musculus
gcagagattaccataagcagcacat

SEQ ID NO: 534735 - DNA, 25 bp, Mus musculus
gcagagattaccttaagcagcacat

SEQ ID NO: 534736 - DNA, 25 bp, Mus musculus
gcagagattttaaaactactctcag

SEQ ID NO: 534737 - DNA, 25 bp, Mus musculus
gcagagattttataactactctcag

SEQ ID NO: 534738 - DNA, 25 bp, Mus musculus
gcagagcaaggaacccagaggacct

SEQ ID NO: 534739 - DNA, 25 bp, Mus musculus
gcagagcaaggatcccagaggacct

SEQ ID NO: 534740 - DNA, 25 bp, Mus musculus
gcagagcacagacgcccttgtgggg

SEQ ID NO: 534741 - DNA, 25 bp, Mus musculus
gcagagcacagaggcccttgtgggg

SEQ ID NO: 534742 - DNA, 25 bp, Mus musculus
gcagagcacattcaggcagctagaa

SEQ ID NO: 534743 - DNA, 25 bp, Mus musculus
gcagagcacattgaggcagctagaa

SEQ ID NO: 534744 - DNA, 25 bp, Mus musculus
gcagagcaccaaactcttcgcgagg

SEQ ID NO: 534745 - DNA, 25 bp, Mus musculus
gcagagcaccaatctcttcgcgagg

SEQ ID NO: 534746 - DNA, 25 bp, Mus musculus
gcagagcaccgtagccatctgggca

SEQ ID NO: 534747 - DNA, 25 bp, Mus musculus
gcagagcaccgttgccatctgggca

SEQ ID NO: 534748 - DNA, 25 bp, Mus musculus
gcagagcagaggctccaagagccaa

SEQ ID NO: 534749 - DNA, 25 bp, Mus musculus
gcagagcagagggtccaagagccaa

SEQ ID NO: 534750 - DNA, 25 bp, Mus musculus
gcagagcagctcaaatgtggataga

SEQ ID NO: 534751 - DNA, 25 bp, Mus musculus
gcagagcagctcattcgggtgtact

SEQ ID NO: 534752 - DNA, 25 bp, Mus musculus
gcagagcagctcattttaaacgaca

SEQ ID NO: 534753 - DNA, 25 bp, Mus musculus
gcagagcagctctaatgtggataga

SEQ ID NO: 534754 - DNA, 25 bp, Mus musculus
gcagagcagctctttcgggtgtact

SEQ ID NO: 534755 - DNA, 25 bp, Mus musculus
gcagagcagctctttttaaacgaca

SEQ ID NO: 534756 - DNA, 25 bp, Mus musculus
gcagagcaggagcactgttccccaa

SEQ ID NO: 534757 - DNA, 25 bp, Mus musculus
gcagagcaggaggactgttccccaa

SEQ ID NO: 534758 - DNA, 25 bp, Mus musculus
gcagagcaggcactaaggaagaaaa

SEQ ID NO: 534759 - DNA, 25 bp, Mus musculus
gcagagcaggcagtaaggaagaaaa

SEQ ID NO: 534760 - DNA, 25 bp, Mus musculus
gcagagcatcaaacagcaacaccag

SEQ ID NO: 534761 - DNA, 25 bp, Mus musculus
gcagagcatcaatcagcaacaccag

SEQ ID NO: 534762 - DNA, 25 bp, Mus musculus
gcagagcatcagctgaggctacaga

SEQ ID NO: 534763 - DNA, 25 bp, Mus musculus
gcagagcatcaggtgaggctacaga

SEQ ID NO: 534764 - DNA, 25 bp, Mus musculus
gcagagcattcaaaccttaccagga

SEQ ID NO: 534765 - DNA, 25 bp, Mus musculus
gcagagcattcacccttattagttg

SEQ ID NO: 534766 - DNA, 25 bp, Mus musculus
gcagagcattcagccttattagttg

SEQ ID NO: 534767 - DNA, 25 bp, Mus musculus
gcagagcattcataccttaccagga

SEQ ID NO: 534768 - DNA, 25 bp, Mus musculus
gcagagccaatgagcagccttcagg

SEQ ID NO: 534769 - DNA, 25 bp, Mus musculus
gcagagccaatgtgcagccttcagg

SEQ ID NO: 534770 - DNA, 25 bp, Mus musculus
gcagagccacttcgatttccagcca

SEQ ID NO: 534771 - DNA, 25 bp, Mus musculus
gcagagccacttggatttccagcca

SEQ ID NO: 534772 - DNA, 25 bp, Mus musculus
gcagagccagatagcttacaggaat

SEQ ID NO: 534773 - DNA, 25 bp, Mus musculus
gcagagccagattgcttacaggaat

SEQ ID NO: 534774 - DNA, 25 bp, Mus musculus
gcagagccatatattctgctcttaa

SEQ ID NO: 534775 - DNA, 25 bp, Mus musculus
gcagagccatattttctgctcttaa

SEQ ID NO: 534776 - DNA, 25 bp, Mus musculus
gcagagccatctctacacttttaga

SEQ ID NO: 534777 - DNA, 25 bp, Mus musculus
gcagagccatctgtacacttttaga

SEQ ID NO: 534778 - DNA, 25 bp, Mus musculus
gcagagccatggcattggcatacat

SEQ ID NO: 534779 - DNA, 25 bp, Mus musculus
gcagagccatgggattggcatacat

SEQ ID NO: 534780 - DNA, 25 bp, Mus musculus
gcagagccatgtactcttcaagcta

SEQ ID NO: 534781 - DNA, 25 bp, Mus musculus
gcagagccatgttctcttcaagcta

SEQ ID NO: 534782 - DNA, 25 bp, Mus musculus
gcagagcccagaagacgctgtcttt

SEQ ID NO: 534783 - DNA, 25 bp, Mus musculus
gcagagcccagatgacgctgtcttt

SEQ ID NO: 534784 - DNA, 25 bp, Mus musculus
gcagagcccaggctacctggattag

SEQ ID NO: 534785 - DNA, 25 bp, Mus musculus
gcagagcccagggtacctggattag

SEQ ID NO: 534786 - DNA, 25 bp, Mus musculus
gcagagcccgaaccgtgaatttgga

SEQ ID NO: 534787 - DNA, 25 bp, Mus musculus
gcagagcccgaagcgtgaatttgga

SEQ ID NO: 534788 - DNA, 25 bp, Mus musculus
gcagagcccggtagggacacattga

SEQ ID NO: 534789 - DNA, 25 bp, Mus musculus
gcagagcccggttgggacacattga

SEQ ID NO: 534790 - DNA, 25 bp, Mus musculus
gcagagcccttaaagagttatatat

SEQ ID NO: 534791 - DNA, 25 bp, Mus musculus
gcagagcccttatagagttatatat

SEQ ID NO: 534792 - DNA, 25 bp, Mus musculus
gcagagcctaccctagagaacttgg

SEQ ID NO: 534793 - DNA, 25 bp, Mus musculus
gcagagcctaccgtagagaacttgg

SEQ ID NO: 534794 - DNA, 25 bp, Mus musculus
gcagagcctatcaatgtctaaataa

SEQ ID NO: 534795 - DNA, 25 bp, Mus musculus
gcagagcctatctatgtctaaataa

SEQ ID NO: 534796 - DNA, 25 bp, Mus musculus
gcagagcctccgaatgtgtttataa

SEQ ID NO: 534797 - DNA, 25 bp, Mus musculus
gcagagcctccgtatgtgtttataa

SEQ ID NO: 534798 - DNA, 25 bp, Mus musculus
gcagagcctcttagccagtaggtat

SEQ ID NO: 534799 - DNA, 25 bp, Mus musculus
gcagagcctctttgccagtaggtat

SEQ ID NO: 534800 - DNA, 25 bp, Mus musculus
gcagagcctgacacctcagaggttc

SEQ ID NO: 534801 - DNA, 25 bp, Mus musculus
gcagagcctgactcctcagaggttc

SEQ ID NO: 534802 - DNA, 25 bp, Mus musculus
gcagagcctgcaatgatatcagcct

SEQ ID NO: 534803 - DNA, 25 bp, Mus musculus
gcagagcctgcattgatatcagcct

SEQ ID NO: 534804 - DNA, 25 bp, Mus musculus
gcagagcctggaaagacctaccatt

SEQ ID NO: 534805 - DNA, 25 bp, Mus musculus
gcagagcctggatagacctaccatt

SEQ ID NO: 534806 - DNA, 25 bp, Mus musculus
gcagagcctgtgaataatgccttct

SEQ ID NO: 534807 - DNA, 25 bp, Mus musculus
gcagagcctgtgtataatgccttct

SEQ ID NO: 534808 - DNA, 25 bp, Mus musculus
gcagagcgaagtcaccctgctgaga

SEQ ID NO: 534809 - DNA, 25 bp, Mus musculus
gcagagcgaagtgaccctgctgaga

SEQ ID NO: 534810 - DNA, 25 bp, Mus musculus
gcagagcgcctgaatgactatgtga

SEQ ID NO: 534811 - DNA, 25 bp, Mus musculus
gcagagcgcctgtatgactatgtga

SEQ ID NO: 534812 - DNA, 25 bp, Mus musculus
gcagagcggcaacagcgagatctcc

SEQ ID NO: 534813 - DNA, 25 bp, Mus musculus
gcagagcggcaagagcgagatctcc

SEQ ID NO: 534814 - DNA, 25 bp, Mus musculus
gcagagcggtgcagtttgaccctgt

SEQ ID NO: 534815 - DNA, 25 bp, Mus musculus
gcagagcggtgctgtttgaccctgt

SEQ ID NO: 534816 - DNA, 25 bp, Mus musculus
gcagagcgtcagacagtggcaccag

SEQ ID NO: 534817 - DNA, 25 bp, Mus musculus
gcagagcgtcagtcagtggcaccag

SEQ ID NO: 534818 - DNA, 25 bp, Mus musculus
gcagagcgtggtcgctatgccccat

SEQ ID NO: 534819 - DNA, 25 bp, Mus musculus
gcagagcgtggtggctatgccccat

SEQ ID NO: 534820 - DNA, 25 bp, Mus musculus
gcagagctaagcagtcctatcaaat

SEQ ID NO: 534821 - DNA, 25 bp, Mus musculus
gcagagctaagctgtcctatcaaat

SEQ ID NO: 534822 - DNA, 25 bp, Mus musculus
gcagagctaggactcaccagtgagt

SEQ ID NO: 534823 - DNA, 25 bp, Mus musculus
gcagagctaggagtcaccagtgagt

SEQ ID NO: 534824 - DNA, 25 bp, Mus musculus
gcagagctcaccacatatgaattct

SEQ ID NO: 534825 - DNA, 25 bp, Mus musculus
gcagagctcaccatgagggtgcaga

SEQ ID NO: 534826 - DNA, 25 bp, Mus musculus
gcagagctcacctcatatgaattct

SEQ ID NO: 534827 - DNA, 25 bp, Mus musculus
gcagagctcaccttgagggtgcaga

SEQ ID NO: 534828 - DNA, 25 bp, Mus musculus
gcagagctcgcaattggtgcagcac

SEQ ID NO: 534829 - DNA, 25 bp, Mus musculus
gcagagctcgcatttggtgcagcac

SEQ ID NO: 534830 - DNA, 25 bp, Mus musculus
gcagagctctcaaagctggtaaaga

SEQ ID NO: 534831 - DNA, 25 bp, Mus musculus
gcagagctctcatagctggtaaaga

SEQ ID NO: 534832 - DNA, 25 bp, Mus musculus
gcagagctctggcaaatctaatcca

SEQ ID NO: 534833 - DNA, 25 bp, Mus musculus
gcagagctctgggaaatctaatcca

SEQ ID NO: 534834 - DNA, 25 bp, Mus musculus
gcagagctgctacccaagtatggtt

SEQ ID NO: 534835 - DNA, 25 bp, Mus musculus
gcagagctgctagccaagtatggtt

SEQ ID NO: 534836 - DNA, 25 bp, Mus musculus
gcagagctgctcaagttggcaacca

SEQ ID NO: 534837 - DNA, 25 bp, Mus musculus
gcagagctgctctagttggcaacca

SEQ ID NO: 534838 - DNA, 25 bp, Mus musculus
gcagagctggcacagatccgctcag

SEQ ID NO: 534839 - DNA, 25 bp, Mus musculus
gcagagctggcagagatccgctcag

SEQ ID NO: 534840 - DNA, 25 bp, Mus musculus
gcagagctggccatcaattatacac

SEQ ID NO: 534841 - DNA, 25 bp, Mus musculus
gcagagctggccttcaattatacac

SEQ ID NO: 534842 - DNA, 25 bp, Mus musculus
gcagagctggcgattatgagatttt

SEQ ID NO: 534843 - DNA, 25 bp, Mus musculus
gcagagctggcgtttatgagatttt

SEQ ID NO: 534844 - DNA, 25 bp, Mus musculus
gcagagctggtgcttgttaatctca

SEQ ID NO: 534845 - DNA, 25 bp, Mus musculus
gcagagctggtggttgttaatctca

SEQ ID NO: 534846 - DNA, 25 bp, Mus musculus
gcagagctgtatatctccatggaga

SEQ ID NO: 534847 - DNA, 25 bp, Mus musculus
gcagagctgtatttctccatggaga

SEQ ID NO: 534848 - DNA, 25 bp, Mus musculus
gcagagcttagcagatgctgtctat

SEQ ID NO: 534849 - DNA, 25 bp, Mus musculus
gcagagcttagctgatgctgtctat

SEQ ID NO: 534850 - DNA, 25 bp, Mus musculus
gcagagcttatgatccagaactgga

SEQ ID NO: 534851 - DNA, 25 bp, Mus musculus
gcagagcttatgttccagaactgga

SEQ ID NO: 534852 - DNA, 25 bp, Mus musculus
gcagagcttcgaaatgatctaccag

SEQ ID NO: 534853 - DNA, 25 bp, Mus musculus
gcagagcttcgatatgatctaccag

SEQ ID NO: 534854 - DNA, 25 bp, Mus musculus
gcagagcttcgccatgtgatgacaa

SEQ ID NO: 534855 - DNA, 25 bp, Mus musculus
gcagagcttcgcgatgtgatgacaa

SEQ ID NO: 534856 - DNA, 25 bp, Mus musculus
gcagagcttgcacggcaggccctac

SEQ ID NO: 534857 - DNA, 25 bp, Mus musculus
gcagagcttgcagggcaggccctac

SEQ ID NO: 534858 - DNA, 25 bp, Mus musculus
gcagagcttgctaggtcattaaaca

SEQ ID NO: 534859 - DNA, 25 bp, Mus musculus
gcagagcttgcttggtcattaaaca

SEQ ID NO: 534860 - DNA, 25 bp, Mus musculus
gcagagctttctatcagggatgtaa

SEQ ID NO: 534861 - DNA, 25 bp, Mus musculus
gcagagctttctttcagggatgtaa

SEQ ID NO: 534862 - DNA, 25 bp, Mus musculus
gcagaggaacccaagacgaggtcta

SEQ ID NO: 534863 - DNA, 25 bp, Mus musculus
gcagaggaaccctagacgaggtcta

SEQ ID NO: 534864 - DNA, 25 bp, Mus musculus
gcagaggaactactagctatgttaa

SEQ ID NO: 534865 - DNA, 25 bp, Mus musculus
gcagaggaactagtagctatgttaa

SEQ ID NO: 534866 - DNA, 25 bp, Mus musculus
gcagaggaagctaggccaccagagt

SEQ ID NO: 534867 - DNA, 25 bp, Mus musculus
gcagaggaagcttggccaccagagt

SEQ ID NO: 534868 - DNA, 25 bp, Mus musculus
gcagaggaagggagtcactataaat

SEQ ID NO: 534869 - DNA, 25 bp, Mus musculus
gcagaggaagggtgtcactataaat

SEQ ID NO: 534870 - DNA, 25 bp, Mus musculus
gcagaggaatctccttcacctttca

SEQ ID NO: 534871 - DNA, 25 bp, Mus musculus
gcagaggaatctgcttcacctttca

SEQ ID NO: 534872 - DNA, 25 bp, Mus musculus
gcagaggaatgtaaatcaccaggat

SEQ ID NO: 534873 - DNA, 25 bp, Mus musculus
gcagaggaatgttaatcaccaggat

SEQ ID NO: 534874 - DNA, 25 bp, Mus musculus
gcagaggacccaaggtcttttccca

SEQ ID NO: 534875 - DNA, 25 bp, Mus musculus
gcagaggacccatggtcttttccca

SEQ ID NO: 534876 - DNA, 25 bp, Mus musculus
gcagaggaccctacggctgagcacc

SEQ ID NO: 534877 - DNA, 25 bp, Mus musculus
gcagaggacccttcggctgagcacc

SEQ ID NO: 534878 - DNA, 25 bp, Mus musculus
gcagaggactctcgtgtgccaccga

SEQ ID NO: 534879 - DNA, 25 bp, Mus musculus
gcagaggactctggtgtgccaccga

SEQ ID NO: 534880 - DNA, 25 bp, Mus musculus
gcagaggactgacttaacacacttg

SEQ ID NO: 534881 - DNA, 25 bp, Mus musculus
gcagaggactgagttaacacacttg

SEQ ID NO: 534882 - DNA, 25 bp, Mus musculus
gcagaggagggaccttttctcagta

SEQ ID NO: 534883 - DNA, 25 bp, Mus musculus
gcagaggagggagcttttctcagta

SEQ ID NO: 534884 - DNA, 25 bp, Mus musculus
gcagaggagtaactatagggctgga

SEQ ID NO: 534885 - DNA, 25 bp, Mus musculus
gcagaggagtaagtatagggctgga

SEQ ID NO: 534886 - DNA, 25 bp, Mus musculus
gcagaggagtacaaacggtgaaaca

SEQ ID NO: 534887 - DNA, 25 bp, Mus musculus
gcagaggagtactaacggtgaaaca

SEQ ID NO: 534888 - DNA, 25 bp, Mus musculus
gcagaggagtcaccagccacatcag

SEQ ID NO: 534889 - DNA, 25 bp, Mus musculus
gcagaggagtcagcagccacatcag

SEQ ID NO: 534890 - DNA, 25 bp, Mus musculus
gcagaggatcggaaggcagcatcaa

SEQ ID NO: 534891 - DNA, 25 bp, Mus musculus
gcagaggatcggtaggcagcatcaa

SEQ ID NO: 534892 - DNA, 25 bp, Mus musculus
gcagaggatctaagtcatacgatga

SEQ ID NO: 534893 - DNA, 25 bp, Mus musculus
gcagaggatctatgtcatacgatga

SEQ ID NO: 534894 - DNA, 25 bp, Mus musculus
gcagaggatgagatttgtggaattc

SEQ ID NO: 534895 - DNA, 25 bp, Mus musculus
gcagaggatgagttttgtggaattc

SEQ ID NO: 534896 - DNA, 25 bp, Mus musculus
gcagaggatttcaagtttccttcaa

SEQ ID NO: 534897 - DNA, 25 bp, Mus musculus
gcagaggatttctagtttccttcaa

SEQ ID NO: 534898 - DNA, 25 bp, Mus musculus
gcagaggcaggcacagtatttggtt

SEQ ID NO: 534899 - DNA, 25 bp, Mus musculus
gcagaggcaggctcagtatttggtt

SEQ ID NO: 534900 - DNA, 25 bp, Mus musculus
gcagaggcataaacttgtaccacat

SEQ ID NO: 534901 - DNA, 25 bp, Mus musculus
gcagaggcataatcttgtaccacat

SEQ ID NO: 534902 - DNA, 25 bp, Mus musculus
gcagaggcatagctgtgcattctaa

SEQ ID NO: 534903 - DNA, 25 bp, Mus musculus
gcagaggcataggtgtgcattctaa

SEQ ID NO: 534904 - DNA, 25 bp, Mus musculus
gcagaggccatcaaggccctggtga

SEQ ID NO: 534905 - DNA, 25 bp, Mus musculus
gcagaggccatctaggccctggtga

SEQ ID NO: 534906 - DNA, 25 bp, Mus musculus
gcagaggcctgcaggattgtcacaa

SEQ ID NO: 534907 - DNA, 25 bp, Mus musculus
gcagaggcctgctggattgtcacaa

SEQ ID NO: 534908 - DNA, 25 bp, Mus musculus
gcagaggccttgaatgctgtccaca

SEQ ID NO: 534909 - DNA, 25 bp, Mus musculus
gcagaggccttgtatgctgtccaca

SEQ ID NO: 534910 - DNA, 25 bp, Mus musculus
gcagaggcgtttatgttcccttttg

SEQ ID NO: 534911 - DNA, 25 bp, Mus musculus
gcagaggcgtttttgttcccttttg

SEQ ID NO: 534912 - DNA, 25 bp, Mus musculus
gcagaggctataatcccagaggagt

SEQ ID NO: 534913 - DNA, 25 bp, Mus musculus
gcagaggctatattcccagaggagt

SEQ ID NO: 534914 - DNA, 25 bp, Mus musculus
gcagaggctctaacactgagtcaca

SEQ ID NO: 534915 - DNA, 25 bp, Mus musculus
gcagaggctctatcactgagtcaca

SEQ ID NO: 534916 - DNA, 25 bp, Mus musculus
gcagaggctgcaacaggatggctaa

SEQ ID NO: 534917 - DNA, 25 bp, Mus musculus
gcagaggctgcatcaggatggctaa

SEQ ID NO: 534918 - DNA, 25 bp, Mus musculus
gcagaggcttagatctactatttct

SEQ ID NO: 534919 - DNA, 25 bp, Mus musculus
gcagaggcttagttctactatttct

SEQ ID NO: 534920 - DNA, 25 bp, Mus musculus
gcagagggaaccactactacctttt

SEQ ID NO: 534921 - DNA, 25 bp, Mus musculus
gcagagggaacctctactacctttt

SEQ ID NO: 534922 - DNA, 25 bp, Mus musculus
gcagagggaagcaagtgaccccgaa

SEQ ID NO: 534923 - DNA, 25 bp, Mus musculus
gcagagggaagctagtgaccccgaa

SEQ ID NO: 534924 - DNA, 25 bp, Mus musculus
gcagagggagagactgacacagact

SEQ ID NO: 534925 - DNA, 25 bp, Mus musculus
gcagagggagagtctgacacagact

SEQ ID NO: 534926 - DNA, 25 bp, Mus musculus
gcagagggcatcacatgtcaaccac

SEQ ID NO: 534927 - DNA, 25 bp, Mus musculus
gcagagggcatctcatgtcaaccac

SEQ ID NO: 534928 - DNA, 25 bp, Mus musculus
gcagagggcgttagcctcattgtga

SEQ ID NO: 534929 - DNA, 25 bp, Mus musculus
gcagagggcgtttgcctcattgtga

SEQ ID NO: 534930 - DNA, 25 bp, Mus musculus
gcagagggtaccatcagccttgagc

SEQ ID NO: 534931 - DNA, 25 bp, Mus musculus
gcagagggtaccttcagccttgagc

SEQ ID NO: 534932 - DNA, 25 bp, Mus musculus
gcagagggtgacagtgatatccagt

SEQ ID NO: 534933 - DNA, 25 bp, Mus musculus
gcagagggtgactgtgatatccagt

SEQ ID NO: 534934 - DNA, 25 bp, Mus musculus
gcagagggtgcactcattggctact

SEQ ID NO: 534935 - DNA, 25 bp, Mus musculus
gcagagggtgcagtcattggctact

SEQ ID NO: 534936 - DNA, 25 bp, Mus musculus
gcagaggtacacctaagagttcctg

SEQ ID NO: 534937 - DNA, 25 bp, Mus musculus
gcagaggtacacgtaagagttcctg

SEQ ID NO: 534938 - DNA, 25 bp, Mus musculus
gcagaggtacatcggaagcacatca

SEQ ID NO: 534939 - DNA, 25 bp, Mus musculus
gcagaggtacatgggaagcacatca

SEQ ID NO: 534940 - DNA, 25 bp, Mus musculus
gcagaggtacctccatagctgggac

SEQ ID NO: 534941 - DNA, 25 bp, Mus musculus
gcagaggtacctgcatagctgggac

SEQ ID NO: 534942 - DNA, 25 bp, Mus musculus
gcagaggtagatcgcctacatgagt

SEQ ID NO: 534943 - DNA, 25 bp, Mus musculus
gcagaggtagatggcctacatgagt

SEQ ID NO: 534944 - DNA, 25 bp, Mus musculus
gcagaggtagctctccagggttatt

SEQ ID NO: 534945 - DNA, 25 bp, Mus musculus
gcagaggtagctgtccagggttatt

SEQ ID NO: 534946 - DNA, 25 bp, Mus musculus
gcagaggtatatacagtaggcacct

SEQ ID NO: 534947 - DNA, 25 bp, Mus musculus
gcagaggtatattcagtaggcacct

SEQ ID NO: 534948 - DNA, 25 bp, Mus musculus
gcagaggtcaagcagttccaagact

SEQ ID NO: 534949 - DNA, 25 bp, Mus musculus
gcagaggtcaaggagttccaagact

SEQ ID NO: 534950 - DNA, 25 bp, Mus musculus
gcagaggtcagcctacaacacattc

SEQ ID NO: 534951 - DNA, 25 bp, Mus musculus
gcagaggtcagcgtacaacacattc

SEQ ID NO: 534952 - DNA, 25 bp, Mus musculus
gcagaggtcataaaggactcacctg

SEQ ID NO: 534953 - DNA, 25 bp, Mus musculus
gcagaggtcataatcgccttttctt

SEQ ID NO: 534954 - DNA, 25 bp, Mus musculus
gcagaggtcatataggactcacctg

SEQ ID NO: 534955 - DNA, 25 bp, Mus musculus
gcagaggtcatattcgccttttctt

SEQ ID NO: 534956 - DNA, 25 bp, Mus musculus
gcagaggtcatgatggtgatcgcca

SEQ ID NO: 534957 - DNA, 25 bp, Mus musculus
gcagaggtcatgttggtgatcgcca

SEQ ID NO: 534958 - DNA, 25 bp, Mus musculus
gcagaggtccaactaagccagcccg

SEQ ID NO: 534959 - DNA, 25 bp, Mus musculus
gcagaggtccaagtaagccagcccg

SEQ ID NO: 534960 - DNA, 25 bp, Mus musculus
gcagaggtctcaaccttaagactca

SEQ ID NO: 534961 - DNA, 25 bp, Mus musculus
gcagaggtctcatccttaagactca

SEQ ID NO: 534962 - DNA, 25 bp, Mus musculus
gcagaggtcttgaagccaatataag

SEQ ID NO: 534963 - DNA, 25 bp, Mus musculus
gcagaggtcttgagaaaaacctgct

SEQ ID NO: 534964 - DNA, 25 bp, Mus musculus
gcagaggtcttgtagccaatataag

SEQ ID NO: 534965 - DNA, 25 bp, Mus musculus
gcagaggtcttgtgaaaaacctgct

SEQ ID NO: 534966 - DNA, 25 bp, Mus musculus
gcagaggtgattccagagcgccaat

SEQ ID NO: 534967 - DNA, 25 bp, Mus musculus
gcagaggtgattgcagagcgccaat

SEQ ID NO: 534968 - DNA, 25 bp, Mus musculus
gcagaggtggcccaggatgtctttg

SEQ ID NO: 534969 - DNA, 25 bp, Mus musculus
gcagaggtggccgaggatgtctttg

SEQ ID NO: 534970 - DNA, 25 bp, Mus musculus
gcagaggtggctcaacttgacttct

SEQ ID NO: 534971 - DNA, 25 bp, Mus musculus
gcagaggtggctgaacttgacttct

SEQ ID NO: 534972 - DNA, 25 bp, Mus musculus
gcagaggttattatgatgctacatt

SEQ ID NO: 534973 - DNA, 25 bp, Mus musculus
gcagaggttattccttttctttact

SEQ ID NO: 534974 - DNA, 25 bp, Mus musculus
gcagaggttattgcttttctttact

SEQ ID NO: 534975 - DNA, 25 bp, Mus musculus
gcagaggttattttgatgctacatt

SEQ ID NO: 534976 - DNA, 25 bp, Mus musculus
gcagaggttcagacacctgtgttat

SEQ ID NO: 534977 - DNA, 25 bp, Mus musculus
gcagaggttcagtcacctgtgttat

SEQ ID NO: 534978 - DNA, 25 bp, Mus musculus
gcagaggttccactcacttcaatgt

SEQ ID NO: 534979 - DNA, 25 bp, Mus musculus
gcagaggttccagtcacttcaatgt

SEQ ID NO: 534980 - DNA, 25 bp, Mus musculus
gcagaggttctaactttggctccaa

SEQ ID NO: 534981 - DNA, 25 bp, Mus musculus
gcagaggttctatctttggctccaa

SEQ ID NO: 534982 - DNA, 25 bp, Mus musculus
gcagaggtttctcgccagaggaccc

SEQ ID NO: 534983 - DNA, 25 bp, Mus musculus
gcagaggtttctggccagaggaccc

SEQ ID NO: 534984 - DNA, 25 bp, Mus musculus
gcagagtaacacaacagttcaccag

SEQ ID NO: 534985 - DNA, 25 bp, Mus musculus
gcagagtaacactacagttcaccag

SEQ ID NO: 534986 - DNA, 25 bp, Mus musculus
gcagagtaagttatccatttcctaa

SEQ ID NO: 534987 - DNA, 25 bp, Mus musculus
gcagagtaagttttccatttcctaa

SEQ ID NO: 534988 - DNA, 25 bp, Mus musculus
gcagagtacgctcgacgatgccacg

SEQ ID NO: 534989 - DNA, 25 bp, Mus musculus
gcagagtacgctggacgatgccacg

SEQ ID NO: 534990 - DNA, 25 bp, Mus musculus
gcagagtacggccttggcatttaca

SEQ ID NO: 534991 - DNA, 25 bp, Mus musculus
gcagagtacggcgttggcatttaca

SEQ ID NO: 534992 - DNA, 25 bp, Mus musculus
gcagagtacttaattagcttggtat

SEQ ID NO: 534993 - DNA, 25 bp, Mus musculus
gcagagtacttatttagcttggtat

SEQ ID NO: 534994 - DNA, 25 bp, Mus musculus
gcagagtactttatgcctcggagga

SEQ ID NO: 534995 - DNA, 25 bp, Mus musculus
gcagagtactttttgcctcggagga

SEQ ID NO: 534996 - DNA, 25 bp, Mus musculus
gcagagtagcatacaggtcaggttt

SEQ ID NO: 534997 - DNA, 25 bp, Mus musculus
gcagagtagcattcaggtcaggttt

SEQ ID NO: 534998 - DNA, 25 bp, Mus musculus
gcagagtagccccagagatgacaga

SEQ ID NO: 534999 - DNA, 25 bp, Mus musculus
gcagagtagcccgagagatgacaga

SEQ ID NO: 535000 - DNA, 25 bp, Mus musculus
gcagagtagtctcacatggcatttt

SEQ ID NO: 535001 - DNA, 25 bp, Mus musculus
gcagagtagtctgacatggcatttt

SEQ ID NO: 535002 - DNA, 25 bp, Mus musculus
gcagagtatacaatgaccacgcaat

SEQ ID NO: 535003 - DNA, 25 bp, Mus musculus
gcagagtatacattgaccacgcaat

SEQ ID NO: 535004 - DNA, 25 bp, Mus musculus
gcagagtatctactgttcagaccaa

SEQ ID NO: 535005 - DNA, 25 bp, Mus musculus
gcagagtatctagtgttcagaccaa

SEQ ID NO: 535006 - DNA, 25 bp, Mus musculus
gcagagtattatcctttcttaccag

SEQ ID NO: 535007 - DNA, 25 bp, Mus musculus
gcagagtattatgctttcttaccag

SEQ ID NO: 535008 - DNA, 25 bp, Mus musculus
gcagagtcaaatatgccatttacaa

SEQ ID NO: 535009 - DNA, 25 bp, Mus musculus
gcagagtcaaatttgccatttacaa

SEQ ID NO: 535010 - DNA, 25 bp, Mus musculus
gcagagtcacatctcgagacaccaa

SEQ ID NO: 535011 - DNA, 25 bp, Mus musculus
gcagagtcacatgtcgagacaccaa

SEQ ID NO: 535012 - DNA, 25 bp, Mus musculus
gcagagtccaatatcctgacacttc

SEQ ID NO: 535013 - DNA, 25 bp, Mus musculus
gcagagtccaatttcctgacacttc

SEQ ID NO: 535014 - DNA, 25 bp, Mus musculus
gcagagtccattcataataggatag

SEQ ID NO: 535015 - DNA, 25 bp, Mus musculus
gcagagtccattgataataggatag

SEQ ID NO: 535016 - DNA, 25 bp, Mus musculus
gcagagtctgtaactcgggttgtat

SEQ ID NO: 535017 - DNA, 25 bp, Mus musculus
gcagagtctgtatctcgggttgtat

SEQ ID NO: 535018 - DNA, 25 bp, Mus musculus
gcagagtgaagcaagcctgagtcta

SEQ ID NO: 535019 - DNA, 25 bp, Mus musculus
gcagagtgaagctagcctgagtcta

SEQ ID NO: 535020 - DNA, 25 bp, Mus musculus
gcagagtgaatgattcctaactgat

SEQ ID NO: 535021 - DNA, 25 bp, Mus musculus
gcagagtgaatgtttcctaactgat

SEQ ID NO: 535022 - DNA, 25 bp, Mus musculus
gcagagtgaattccctccacaaggc

SEQ ID NO: 535023 - DNA, 25 bp, Mus musculus
gcagagtgaattgcctccacaaggc

SEQ ID NO: 535024 - DNA, 25 bp, Mus musculus
gcagagtgaccaacatcctggaccc

SEQ ID NO: 535025 - DNA, 25 bp, Mus musculus
gcagagtgaccactgaactttatgg

SEQ ID NO: 535026 - DNA, 25 bp, Mus musculus
gcagagtgaccagtgaactttatgg

SEQ ID NO: 535027 - DNA, 25 bp, Mus musculus
gcagagtgaccatcatcctggaccc

SEQ ID NO: 535028 - DNA, 25 bp, Mus musculus
gcagagtgactcagccctgggttgc

SEQ ID NO: 535029 - DNA, 25 bp, Mus musculus
gcagagtgactctgccctgggttgc

SEQ ID NO: 535030 - DNA, 25 bp, Mus musculus
gcagagtgagttacttctttttggc

SEQ ID NO: 535031 - DNA, 25 bp, Mus musculus
gcagagtgagtttcttctttttggc

SEQ ID NO: 535032 - DNA, 25 bp, Mus musculus
gcagagtgcaggagtaaagcccagt

SEQ ID NO: 535033 - DNA, 25 bp, Mus musculus
gcagagtgcaggtgtaaagcccagt

SEQ ID NO: 535034 - DNA, 25 bp, Mus musculus
gcagagtgcattatgctaccaggat

SEQ ID NO: 535035 - DNA, 25 bp, Mus musculus
gcagagtgcattttgctaccaggat

SEQ ID NO: 535036 - DNA, 25 bp, Mus musculus
gcagagtgcctgagatttggctcaa

SEQ ID NO: 535037 - DNA, 25 bp, Mus musculus
gcagagtgcctgatggatactttat

SEQ ID NO: 535038 - DNA, 25 bp, Mus musculus
gcagagtgcctgtgatttggctcaa

SEQ ID NO: 535039 - DNA, 25 bp, Mus musculus
gcagagtgcctgttggatactttat

SEQ ID NO: 535040 - DNA, 25 bp, Mus musculus
gcagagtgcgctcgcgcgcattctt

SEQ ID NO: 535041 - DNA, 25 bp, Mus musculus
gcagagtgcgctggcgcgcattctt

SEQ ID NO: 535042 - DNA, 25 bp, Mus musculus
gcagagtggaagatttcctggccta

SEQ ID NO: 535043 - DNA, 25 bp, Mus musculus
gcagagtggaagttttcctggccta

SEQ ID NO: 535044 - DNA, 25 bp, Mus musculus
gcagagtggagactcccatctttgg

SEQ ID NO: 535045 - DNA, 25 bp, Mus musculus
gcagagtggagagtcccatctttgg

SEQ ID NO: 535046 - DNA, 25 bp, Mus musculus
gcagagtggaggagcctatactgat

SEQ ID NO: 535047 - DNA, 25 bp, Mus musculus
gcagagtggaggtgcctatactgat

SEQ ID NO: 535048 - DNA, 25 bp, Mus musculus
gcagagtggcacattgtgaggtttt

SEQ ID NO: 535049 - DNA, 25 bp, Mus musculus
gcagagtggcactttgtgaggtttt

SEQ ID NO: 535050 - DNA, 25 bp, Mus musculus
gcagagtggggtatatgagttttac

SEQ ID NO: 535051 - DNA, 25 bp, Mus musculus
gcagagtggggtttatgagttttac

SEQ ID NO: 535052 - DNA, 25 bp, Mus musculus
gcagagtggtgcatacatttaattc

SEQ ID NO: 535053 - DNA, 25 bp, Mus musculus
gcagagtggtgcttacatttaattc

SEQ ID NO: 535054 - DNA, 25 bp, Mus musculus
gcagagtgtaatccgtggccccgaa

SEQ ID NO: 535055 - DNA, 25 bp, Mus musculus
gcagagtgtaatgcgtggccccgaa

SEQ ID NO: 535056 - DNA, 25 bp, Mus musculus
gcagagtgtaccagctgctgtgttc

SEQ ID NO: 535057 - DNA, 25 bp, Mus musculus
gcagagtgtacctgctgctgtgttc

SEQ ID NO: 535058 - DNA, 25 bp, Mus musculus
gcagagtgtcacagggcacaccgga

SEQ ID NO: 535059 - DNA, 25 bp, Mus musculus
gcagagtgtcactgggcacaccgga

SEQ ID NO: 535060 - DNA, 25 bp, Mus musculus
gcagagtgtcagataaatcgcccca

SEQ ID NO: 535061 - DNA, 25 bp, Mus musculus
gcagagtgtcagttaaatcgcccca

SEQ ID NO: 535062 - DNA, 25 bp, Mus musculus
gcagagtgtgatcttgtttgtactt

SEQ ID NO: 535063 - DNA, 25 bp, Mus musculus
gcagagtgtgatgttgtttgtactt

SEQ ID NO: 535064 - DNA, 25 bp, Mus musculus
gcagagtgtgcaaagctgaccataa

SEQ ID NO: 535065 - DNA, 25 bp, Mus musculus
gcagagtgtgcatagctgaccataa

SEQ ID NO: 535066 - DNA, 25 bp, Mus musculus
gcagagtgttatatcactgtccatt

SEQ ID NO: 535067 - DNA, 25 bp, Mus musculus
gcagagtgttatttcactgtccatt

SEQ ID NO: 535068 - DNA, 25 bp, Mus musculus
gcagagttacacaggctgccctcag

SEQ ID NO: 535069 - DNA, 25 bp, Mus musculus
gcagagttacactggctgccctcag

SEQ ID NO: 535070 - DNA, 25 bp, Mus musculus
gcagagttacatcctcaaatctaag

SEQ ID NO: 535071 - DNA, 25 bp, Mus musculus
gcagagttacatgctcaaatctaag

SEQ ID NO: 535072 - DNA, 25 bp, Mus musculus
gcagagttagaaaacctttgccttc

SEQ ID NO: 535073 - DNA, 25 bp, Mus musculus
gcagagttagaatacctttgccttc

SEQ ID NO: 535074 - DNA, 25 bp, Mus musculus
gcagagttcaccagtgagctcaggt

SEQ ID NO: 535075 - DNA, 25 bp, Mus musculus
gcagagttcacctgtgagctcaggt

SEQ ID NO: 535076 - DNA, 25 bp, Mus musculus
gcagagttcactaagaaggcccgtt

SEQ ID NO: 535077 - DNA, 25 bp, Mus musculus
gcagagttcacttagaaggcccgtt

SEQ ID NO: 535078 - DNA, 25 bp, Mus musculus
gcagagttcataaggccagcaatca

SEQ ID NO: 535079 - DNA, 25 bp, Mus musculus
gcagagttcatatggccagcaatca

SEQ ID NO: 535080 - DNA, 25 bp, Mus musculus
gcagagttcctcagaagttggttat

SEQ ID NO: 535081 - DNA, 25 bp, Mus musculus
gcagagttcctctgaagttggttat

SEQ ID NO: 535082 - DNA, 25 bp, Mus musculus
gcagagttcctgctgtgtaatggtt

SEQ ID NO: 535083 - DNA, 25 bp, Mus musculus
gcagagttcctggtgtgtaatggtt

SEQ ID NO: 535084 - DNA, 25 bp, Mus musculus
gcagagttcgacatgaacccagagc

SEQ ID NO: 535085 - DNA, 25 bp, Mus musculus
gcagagttcgacttgaacccagagc

SEQ ID NO: 535086 - DNA, 25 bp, Mus musculus
gcagagttctgtacatctccatgtc

SEQ ID NO: 535087 - DNA, 25 bp, Mus musculus
gcagagttctgttcatctccatgtc

SEQ ID NO: 535088 - DNA, 25 bp, Mus musculus
gcagagttgagaccacacatccttg

SEQ ID NO: 535089 - DNA, 25 bp, Mus musculus
gcagagttgagagcacacatccttg

SEQ ID NO: 535090 - DNA, 25 bp, Mus musculus
gcagagttggagagggacccagcag

SEQ ID NO: 535091 - DNA, 25 bp, Mus musculus
gcagagttggagtgggacccagcag

SEQ ID NO: 535092 - DNA, 25 bp, Mus musculus
gcagagttggccatagttcttttgc

SEQ ID NO: 535093 - DNA, 25 bp, Mus musculus
gcagagttggccttagttcttttgc

SEQ ID NO: 535094 - DNA, 25 bp, Mus musculus
gcagagtttcccaacatagccttga

SEQ ID NO: 535095 - DNA, 25 bp, Mus musculus
gcagagtttccctacatagccttga

SEQ ID NO: 535096 - DNA, 25 bp, Mus musculus
gcagagtttctgcacaccaaagaat

SEQ ID NO: 535097 - DNA, 25 bp, Mus musculus
gcagagtttctggacaccaaagaat

SEQ ID NO: 535098 - DNA, 25 bp, Mus musculus
gcagagttttacctgaaagtttgtt

SEQ ID NO: 535099 - DNA, 25 bp, Mus musculus
gcagagttttacgtgaaagtttgtt

SEQ ID NO: 535100 - DNA, 25 bp, Mus musculus
gcagagttttataaacacaggcctt

SEQ ID NO: 535101 - DNA, 25 bp, Mus musculus
gcagagttttattaacacaggcctt

SEQ ID NO: 535102 - DNA, 25 bp, Mus musculus
gcagataaagcgagagcctcaccgt

SEQ ID NO: 535103 - DNA, 25 bp, Mus musculus
gcagataaagcgtgagcctcaccgt

SEQ ID NO: 535104 - DNA, 25 bp, Mus musculus
gcagataaagtactgcctagtgagt

SEQ ID NO: 535105 - DNA, 25 bp, Mus musculus
gcagataaagtagtgcctagtgagt

SEQ ID NO: 535106 - DNA, 25 bp, Mus musculus
gcagataactacagtgattcctcat

SEQ ID NO: 535107 - DNA, 25 bp, Mus musculus
gcagataactactgtgattcctcat

SEQ ID NO: 535108 - DNA, 25 bp, Mus musculus
gcagataagacacctaacactcgat

SEQ ID NO: 535109 - DNA, 25 bp, Mus musculus
gcagataagacagctaacactcgat

SEQ ID NO: 535110 - DNA, 25 bp, Mus musculus
gcagataagagtactcatacatctt

SEQ ID NO: 535111 - DNA, 25 bp, Mus musculus
gcagataagagttctcatacatctt

SEQ ID NO: 535112 - DNA, 25 bp, Mus musculus
gcagataagttgacacctatggcct

SEQ ID NO: 535113 - DNA, 25 bp, Mus musculus
gcagataagttgtcacctatggcct

SEQ ID NO: 535114 - DNA, 25 bp, Mus musculus
gcagataatctgagtactttgtatt

SEQ ID NO: 535115 - DNA, 25 bp, Mus musculus
gcagataatctgtgtactttgtatt

SEQ ID NO: 535116 - DNA, 25 bp, Mus musculus
gcagataatgctagctgataatatt

SEQ ID NO: 535117 - DNA, 25 bp, Mus musculus
gcagataatgcttgctgataatatt

SEQ ID NO: 535118 - DNA, 25 bp, Mus musculus
gcagataattgtcgcccttaagctt

SEQ ID NO: 535119 - DNA, 25 bp, Mus musculus
gcagataattgtggcccttaagctt

SEQ ID NO: 535120 - DNA, 25 bp, Mus musculus
gcagatacacctcttgtgatagcat

SEQ ID NO: 535121 - DNA, 25 bp, Mus musculus
gcagatacacctgttgtgatagcat

SEQ ID NO: 535122 - DNA, 25 bp, Mus musculus
gcagatacactcatgtccagggtga

SEQ ID NO: 535123 - DNA, 25 bp, Mus musculus
gcagatacactcttgtccagggtga

SEQ ID NO: 535124 - DNA, 25 bp, Mus musculus
gcagatacagatcgccaagagcaat

SEQ ID NO: 535125 - DNA, 25 bp, Mus musculus
gcagatacagatggccaagagcaat

SEQ ID NO: 535126 - DNA, 25 bp, Mus musculus
gcagatacagtgcttggcaaggact

SEQ ID NO: 535127 - DNA, 25 bp, Mus musculus
gcagatacagtggttggcaaggact

SEQ ID NO: 535128 - DNA, 25 bp, Mus musculus
gcagataccaaacgacaggttcagt

SEQ ID NO: 535129 - DNA, 25 bp, Mus musculus
gcagataccaaaggacaggttcagt

SEQ ID NO: 535130 - DNA, 25 bp, Mus musculus
gcagataccctaagcctagaggcta

SEQ ID NO: 535131 - DNA, 25 bp, Mus musculus
gcagataccctatgcctagaggcta

SEQ ID NO: 535132 - DNA, 25 bp, Mus musculus
gcagatacgccactattgttgttaa

SEQ ID NO: 535133 - DNA, 25 bp, Mus musculus
gcagatacgccagtattgttgttaa

SEQ ID NO: 535134 - DNA, 25 bp, Mus musculus
gcagatactagaccaacactcttta

SEQ ID NO: 535135 - DNA, 25 bp, Mus musculus
gcagatactagagcaacactcttta

SEQ ID NO: 535136 - DNA, 25 bp, Mus musculus
gcagatactcacattgtacagcgct

SEQ ID NO: 535137 - DNA, 25 bp, Mus musculus
gcagatactcactttgtacagcgct

SEQ ID NO: 535138 - DNA, 25 bp, Mus musculus
gcagatactgaaatggttcccacat

SEQ ID NO: 535139 - DNA, 25 bp, Mus musculus
gcagatactgaattggttcccacat

SEQ ID NO: 535140 - DNA, 25 bp, Mus musculus
gcagatactgagaatagtccttcct

SEQ ID NO: 535141 - DNA, 25 bp, Mus musculus
gcagatactgagtatagtccttcct

SEQ ID NO: 535142 - DNA, 25 bp, Mus musculus
gcagatagaatgataccgccgagtg

SEQ ID NO: 535143 - DNA, 25 bp, Mus musculus
gcagatagaatgttaccgccgagtg

SEQ ID NO: 535144 - DNA, 25 bp, Mus musculus
gcagatagacagcatggactccaac

SEQ ID NO: 535145 - DNA, 25 bp, Mus musculus
gcagatagacaggatggactccaac

SEQ ID NO: 535146 - DNA, 25 bp, Mus musculus
gcagatagacatacagacccatttt

SEQ ID NO: 535147 - DNA, 25 bp, Mus musculus
gcagatagacattcagacccatttt

SEQ ID NO: 535148 - DNA, 25 bp, Mus musculus
gcagataggtgcactgttactcaag

SEQ ID NO: 535149 - DNA, 25 bp, Mus musculus
gcagataggtgctctgttactcaag

SEQ ID NO: 535150 - DNA, 25 bp, Mus musculus
gcagataggttgatctttccaccat

SEQ ID NO: 535151 - DNA, 25 bp, Mus musculus
gcagataggttgttctttccaccat

SEQ ID NO: 535152 - DNA, 25 bp, Mus musculus
gcagatagtctgaagcagcccaaat

SEQ ID NO: 535153 - DNA, 25 bp, Mus musculus
gcagatagtctgtagcagcccaaat

SEQ ID NO: 535154 - DNA, 25 bp, Mus musculus
gcagatatagaaaacttcctaactt

SEQ ID NO: 535155 - DNA, 25 bp, Mus musculus
gcagatatagaatacttcctaactt

SEQ ID NO: 535156 - DNA, 25 bp, Mus musculus
gcagatatcacaaggccgggccaga

SEQ ID NO: 535157 - DNA, 25 bp, Mus musculus
gcagatatcacatggccgggccaga

SEQ ID NO: 535158 - DNA, 25 bp, Mus musculus
gcagatatcccactgcaaacatgca

SEQ ID NO: 535159 - DNA, 25 bp, Mus musculus
gcagatatcccagtgcaaacatgca

SEQ ID NO: 535160 - DNA, 25 bp, Mus musculus
gcagatatctatagccaaggcggca

SEQ ID NO: 535161 - DNA, 25 bp, Mus musculus
gcagatatctattgccaaggcggca

SEQ ID NO: 535162 - DNA, 25 bp, Mus musculus
gcagatatgattcctgtattacacc

SEQ ID NO: 535163 - DNA, 25 bp, Mus musculus
gcagatatgattgctgtattacacc

SEQ ID NO: 535164 - DNA, 25 bp, Mus musculus
gcagatatggctaacttgggagttt

SEQ ID NO: 535165 - DNA, 25 bp, Mus musculus
gcagatatggcttacttgggagttt

SEQ ID NO: 535166 - DNA, 25 bp, Mus musculus
gcagatatgtttctcggcgctgtaa

SEQ ID NO: 535167 - DNA, 25 bp, Mus musculus
gcagatatgtttgtcggcgctgtaa

SEQ ID NO: 535168 - DNA, 25 bp, Mus musculus
gcagatattatgaccctgcagatat

SEQ ID NO: 535169 - DNA, 25 bp, Mus musculus
gcagatattatgtccctgcagatat

SEQ ID NO: 535170 - DNA, 25 bp, Mus musculus
gcagatattgtgcttcaggacagcc

SEQ ID NO: 535171 - DNA, 25 bp, Mus musculus
gcagatattgtggttcaggacagcc

SEQ ID NO: 535172 - DNA, 25 bp, Mus musculus
gcagatatttttcctcttgctctca

SEQ ID NO: 535173 - DNA, 25 bp, Mus musculus
gcagatatttttgctcttgctctca

SEQ ID NO: 535174 - DNA, 25 bp, Mus musculus
gcagatcaaagcacgcctgcatggc

SEQ ID NO: 535175 - DNA, 25 bp, Mus musculus
gcagatcaaagctcgcctgcatggc

SEQ ID NO: 535176 - DNA, 25 bp, Mus musculus
gcagatcaagaaactccccattttt

SEQ ID NO: 535177 - DNA, 25 bp, Mus musculus
gcagatcaagaatctccccattttt

SEQ ID NO: 535178 - DNA, 25 bp, Mus musculus
gcagatcacagtacttgaccacgat

SEQ ID NO: 535179 - DNA, 25 bp, Mus musculus
gcagatcacagttcttgaccacgat

SEQ ID NO: 535180 - DNA, 25 bp, Mus musculus
gcagatcacattcaagctaagccat

SEQ ID NO: 535181 - DNA, 25 bp, Mus musculus
gcagatcacattgaagctaagccat

SEQ ID NO: 535182 - DNA, 25 bp, Mus musculus
gcagatcaccaacgcacagacgaaa

SEQ ID NO: 535183 - DNA, 25 bp, Mus musculus
gcagatcaccaaggcacagacgaaa

SEQ ID NO: 535184 - DNA, 25 bp, Mus musculus
gcagatcaccccagaaggacatcga

SEQ ID NO: 535185 - DNA, 25 bp, Mus musculus
gcagatcacccctgaaggacatcga

SEQ ID NO: 535186 - DNA, 25 bp, Mus musculus
gcagatcaccggcttggttctcttc

SEQ ID NO: 535187 - DNA, 25 bp, Mus musculus
gcagatcaccgggttggttctcttc

SEQ ID NO: 535188 - DNA, 25 bp, Mus musculus
gcagatcactcacatcgccaatcag

SEQ ID NO: 535189 - DNA, 25 bp, Mus musculus
gcagatcactcagatcgccaatcag

SEQ ID NO: 535190 - DNA, 25 bp, Mus musculus
gcagatcacttgactagcatgtttg

SEQ ID NO: 535191 - DNA, 25 bp, Mus musculus
gcagatcacttgtctagcatgtttg

SEQ ID NO: 535192 - DNA, 25 bp, Mus musculus
gcagatcagatcagacagagtgtcc

SEQ ID NO: 535193 - DNA, 25 bp, Mus musculus
gcagatcagatctgacagagtgtcc

SEQ ID NO: 535194 - DNA, 25 bp, Mus musculus
gcagatcagtaaccaaggcctttct

SEQ ID NO: 535195 - DNA, 25 bp, Mus musculus
gcagatcagtaagcaaggcctttct

SEQ ID NO: 535196 - DNA, 25 bp, Mus musculus
gcagatcatctcattattttgtgga

SEQ ID NO: 535197 - DNA, 25 bp, Mus musculus
gcagatcatctctttattttgtgga

SEQ ID NO: 535198 - DNA, 25 bp, Mus musculus
gcagatcatcttagagacactgtct

SEQ ID NO: 535199 - DNA, 25 bp, Mus musculus
gcagatcatctttgagacactgtct

SEQ ID NO: 535200 - DNA, 25 bp, Mus musculus
gcagatcatgctccattcatttgtg

SEQ ID NO: 535201 - DNA, 25 bp, Mus musculus
gcagatcatgctgcattcatttgtg

SEQ ID NO: 535202 - DNA, 25 bp, Mus musculus
gcagatcatgttccaagccacattg

SEQ ID NO: 535203 - DNA, 25 bp, Mus musculus
gcagatcatgttgcaagccacattg

SEQ ID NO: 535204 - DNA, 25 bp, Mus musculus
gcagatccaagaacataagctagaa

SEQ ID NO: 535205 - DNA, 25 bp, Mus musculus
gcagatccaagatcataagctagaa

SEQ ID NO: 535206 - DNA, 25 bp, Mus musculus
gcagatccaagcaaggcaggcacat

SEQ ID NO: 535207 - DNA, 25 bp, Mus musculus
gcagatccaagctaggcaggcacat

SEQ ID NO: 535208 - DNA, 25 bp, Mus musculus
gcagatccagtcactttgtttccaa

SEQ ID NO: 535209 - DNA, 25 bp, Mus musculus
gcagatccagtctctttgtttccaa

SEQ ID NO: 535210 - DNA, 25 bp, Mus musculus
gcagatccatgcagaatgagccccg

SEQ ID NO: 535211 - DNA, 25 bp, Mus musculus
gcagatccatgcagttatggccaca

SEQ ID NO: 535212 - DNA, 25 bp, Mus musculus
gcagatccatgctgaatgagccccg

SEQ ID NO: 535213 - DNA, 25 bp, Mus musculus
gcagatccatgctgttatggccaca

SEQ ID NO: 535214 - DNA, 25 bp, Mus musculus
gcagatcccaagcagcttgagttac

SEQ ID NO: 535215 - DNA, 25 bp, Mus musculus
gcagatcccaaggagcttgagttac

SEQ ID NO: 535216 - DNA, 25 bp, Mus musculus
gcagatcccacaattatgatatgca

SEQ ID NO: 535217 - DNA, 25 bp, Mus musculus
gcagatcccacatttatgatatgca

SEQ ID NO: 535218 - DNA, 25 bp, Mus musculus
gcagatcccactctaccaaggaaga

SEQ ID NO: 535219 - DNA, 25 bp, Mus musculus
gcagatcccactgtaccaaggaaga

SEQ ID NO: 535220 - DNA, 25 bp, Mus musculus
gcagatccccagcttctaggaaaag

SEQ ID NO: 535221 - DNA, 25 bp, Mus musculus
gcagatccccaggttctaggaaaag

SEQ ID NO: 535222 - DNA, 25 bp, Mus musculus
gcagatccccatatgcagtaagatt

SEQ ID NO: 535223 - DNA, 25 bp, Mus musculus
gcagatccccatttgcagtaagatt

SEQ ID NO: 535224 - DNA, 25 bp, Mus musculus
gcagatccgactagcccagaaagaa

SEQ ID NO: 535225 - DNA, 25 bp, Mus musculus
gcagatccgacttgcccagaaagaa

SEQ ID NO: 535226 - DNA, 25 bp, Mus musculus
gcagatccgcagatacatcaatggg

SEQ ID NO: 535227 - DNA, 25 bp, Mus musculus
gcagatccgcagttacatcaatggg

SEQ ID NO: 535228 - DNA, 25 bp, Mus musculus
gcagatcctgagagcctttcagtaa

SEQ ID NO: 535229 - DNA, 25 bp, Mus musculus
gcagatcctgagtgcctttcagtaa

SEQ ID NO: 535230 - DNA, 25 bp, Mus musculus
gcagatccttgcctgagacggttat

SEQ ID NO: 535231 - DNA, 25 bp, Mus musculus
gcagatccttgcgtgagacggttat

SEQ ID NO: 535232 - DNA, 25 bp, Mus musculus
gcagatcgaaagagaggttgccaac

SEQ ID NO: 535233 - DNA, 25 bp, Mus musculus
gcagatcgaaagtgaggttgccaac

SEQ ID NO: 535234 - DNA, 25 bp, Mus musculus
gcagatcgacagctgtacctatgaa

SEQ ID NO: 535235 - DNA, 25 bp, Mus musculus
gcagatcgacaggtgtacctatgaa

SEQ ID NO: 535236 - DNA, 25 bp, Mus musculus
gcagatcgagcaaagcacatcgtca

SEQ ID NO: 535237 - DNA, 25 bp, Mus musculus
gcagatcgagcatagcacatcgtca

SEQ ID NO: 535238 - DNA, 25 bp, Mus musculus
gcagatcgagtgagctctacattca

SEQ ID NO: 535239 - DNA, 25 bp, Mus musculus
gcagatcgagtgtgctctacattca

SEQ ID NO: 535240 - DNA, 25 bp, Mus musculus
gcagatcgccagcacgagaacagag

SEQ ID NO: 535241 - DNA, 25 bp, Mus musculus
gcagatcgccaggacgagaacagag

SEQ ID NO: 535242 - DNA, 25 bp, Mus musculus
gcagatcgtgagcacagacctgtca

SEQ ID NO: 535243 - DNA, 25 bp, Mus musculus
gcagatcgtgaggacagacctgtca

SEQ ID NO: 535244 - DNA, 25 bp, Mus musculus
gcagatcgtttaatgctctttcatt

SEQ ID NO: 535245 - DNA, 25 bp, Mus musculus
gcagatcgtttattgctctttcatt

SEQ ID NO: 535246 - DNA, 25 bp, Mus musculus
gcagatctaaatcgccacgtggatg

SEQ ID NO: 535247 - DNA, 25 bp, Mus musculus
gcagatctaaatggccacgtggatg

SEQ ID NO: 535248 - DNA, 25 bp, Mus musculus
gcagatctcctcctgctaatgagga

SEQ ID NO: 535249 - DNA, 25 bp, Mus musculus
gcagatctcctcgtgctaatgagga

SEQ ID NO: 535250 - DNA, 25 bp, Mus musculus
gcagatctgcagcttgttccgtgga

SEQ ID NO: 535251 - DNA, 25 bp, Mus musculus
gcagatctgcaggttgttccgtgga

SEQ ID NO: 535252 - DNA, 25 bp, Mus musculus
gcagatctgcatacgctcactggtg

SEQ ID NO: 535253 - DNA, 25 bp, Mus musculus
gcagatctgcatcttcatctttcag

SEQ ID NO: 535254 - DNA, 25 bp, Mus musculus
gcagatctgcatgttcatctttcag

SEQ ID NO: 535255 - DNA, 25 bp, Mus musculus
gcagatctgcattcgctcactggtg

SEQ ID NO: 535256 - DNA, 25 bp, Mus musculus
gcagatctgcgcaggccatgtgcca

SEQ ID NO: 535257 - DNA, 25 bp, Mus musculus
gcagatctgcgctggccatgtgcca

SEQ ID NO: 535258 - DNA, 25 bp, Mus musculus
gcagatctggaaaatgctaccgaga

SEQ ID NO: 535259 - DNA, 25 bp, Mus musculus
gcagatctggaatatgctaccgaga

SEQ ID NO: 535260 - DNA, 25 bp, Mus musculus
gcagatctggataaagctgtggcaa

SEQ ID NO: 535261 - DNA, 25 bp, Mus musculus
gcagatctggattaagctgtggcaa

SEQ ID NO: 535262 - DNA, 25 bp, Mus musculus
gcagatctgttccacttaatagtat

SEQ ID NO: 535263 - DNA, 25 bp, Mus musculus
gcagatctgttcgacttaatagtat

SEQ ID NO: 535264 - DNA, 25 bp, Mus musculus
gcagatcttaccaaagtctgaacat

SEQ ID NO: 535265 - DNA, 25 bp, Mus musculus
gcagatcttacctaagtctgaacat

SEQ ID NO: 535266 - DNA, 25 bp, Mus musculus
gcagatcttctcaggttgatgtcca

SEQ ID NO: 535267 - DNA, 25 bp, Mus musculus
gcagatcttctctggttgatgtcca

SEQ ID NO: 535268 - DNA, 25 bp, Mus musculus
gcagatcttggccaggtccagcagc

SEQ ID NO: 535269 - DNA, 25 bp, Mus musculus
gcagatcttggcgaggtccagcagc

SEQ ID NO: 535270 - DNA, 25 bp, Mus musculus
gcagatcttggtcgagtgggtctac

SEQ ID NO: 535271 - DNA, 25 bp, Mus musculus
gcagatcttggtggagtgggtctac

SEQ ID NO: 535272 - DNA, 25 bp, Mus musculus
gcagatgaaagccagaccaccacga

SEQ ID NO: 535273 - DNA, 25 bp, Mus musculus
gcagatgaaagcgagaccaccacga

SEQ ID NO: 535274 - DNA, 25 bp, Mus musculus
gcagatgaatcaatgatgacttaca

SEQ ID NO: 535275 - DNA, 25 bp, Mus musculus
gcagatgaatcattgatgacttaca

SEQ ID NO: 535276 - DNA, 25 bp, Mus musculus
gcagatgaatcgcagatgttcgtag

SEQ ID NO: 535277 - DNA, 25 bp, Mus musculus
gcagatgaatcggagatgttcgtag

SEQ ID NO: 535278 - DNA, 25 bp, Mus musculus
gcagatgacaagcagccctatgaga

SEQ ID NO: 535279 - DNA, 25 bp, Mus musculus
gcagatgacaaggagccctatgaga

SEQ ID NO: 535280 - DNA, 25 bp, Mus musculus
gcagatgacaccatatgccaacagg

SEQ ID NO: 535281 - DNA, 25 bp, Mus musculus
gcagatgacaccttatgccaacagg

SEQ ID NO: 535282 - DNA, 25 bp, Mus musculus
gcagatgacctcaaggcacacccgt

SEQ ID NO: 535283 - DNA, 25 bp, Mus musculus
gcagatgacctctaggcacacccgt

SEQ ID NO: 535284 - DNA, 25 bp, Mus musculus
gcagatgactagcttcagttctgaa

SEQ ID NO: 535285 - DNA, 25 bp, Mus musculus
gcagatgactaggttcagttctgaa

SEQ ID NO: 535286 - DNA, 25 bp, Mus musculus
gcagatgactccctagtctacagtt

SEQ ID NO: 535287 - DNA, 25 bp, Mus musculus
gcagatgactccgtagtctacagtt

SEQ ID NO: 535288 - DNA, 25 bp, Mus musculus
gcagatgacttcagtgtctacaggt

SEQ ID NO: 535289 - DNA, 25 bp, Mus musculus
gcagatgacttctgtgtctacaggt

SEQ ID NO: 535290 - DNA, 25 bp, Mus musculus
gcagatgagacccagtcagaccagt

SEQ ID NO: 535291 - DNA, 25 bp, Mus musculus
gcagatgagaccgagtcagaccagt

SEQ ID NO: 535292 - DNA, 25 bp, Mus musculus
gcagatgagccaacacttttcagtg

SEQ ID NO: 535293 - DNA, 25 bp, Mus musculus
gcagatgagccatcacttttcagtg

SEQ ID NO: 535294 - DNA, 25 bp, Mus musculus
gcagatgaggcacgctctctgtcat

SEQ ID NO: 535295 - DNA, 25 bp, Mus musculus
gcagatgaggcaggctctctgtcat

SEQ ID NO: 535296 - DNA, 25 bp, Mus musculus
gcagatgaggctccccagtgctgaa

SEQ ID NO: 535297 - DNA, 25 bp, Mus musculus
gcagatgaggctgcccagtgctgaa

SEQ ID NO: 535298 - DNA, 25 bp, Mus musculus
gcagatgagtaactgagtccgttct

SEQ ID NO: 535299 - DNA, 25 bp, Mus musculus
gcagatgagtaagtgagtccgttct

SEQ ID NO: 535300 - DNA, 25 bp, Mus musculus
gcagatgagttgaccgtgcttttct

SEQ ID NO: 535301 - DNA, 25 bp, Mus musculus
gcagatgagttgtccgtgcttttct

SEQ ID NO: 535302 - DNA, 25 bp, Mus musculus
gcagatgatcacaaacagtttgcat

SEQ ID NO: 535303 - DNA, 25 bp, Mus musculus
gcagatgatcactaacagtttgcat

SEQ ID NO: 535304 - DNA, 25 bp, Mus musculus
gcagatgatgataggcctcccaggc

SEQ ID NO: 535305 - DNA, 25 bp, Mus musculus
gcagatgatgattggcctcccaggc

SEQ ID NO: 535306 - DNA, 25 bp, Mus musculus
gcagatgatgcaacacggcatcctc

SEQ ID NO: 535307 - DNA, 25 bp, Mus musculus
gcagatgatgcacacacatgataga

SEQ ID NO: 535308 - DNA, 25 bp, Mus musculus
gcagatgatgcagacacatgataga

SEQ ID NO: 535309 - DNA, 25 bp, Mus musculus
gcagatgatgcatcacggcatcctc

SEQ ID NO: 535310 - DNA, 25 bp, Mus musculus
gcagatgatggacacccagcttttg

SEQ ID NO: 535311 - DNA, 25 bp, Mus musculus
gcagatgatggagacccagcttttg

SEQ ID NO: 535312 - DNA, 25 bp, Mus musculus
gcagatgcaattaacccagctgcct

SEQ ID NO: 535313 - DNA, 25 bp, Mus musculus
gcagatgcaatttacccagctgcct

SEQ ID NO: 535314 - DNA, 25 bp, Mus musculus
gcagatgcacagcaatgctccgaga

SEQ ID NO: 535315 - DNA, 25 bp, Mus musculus
gcagatgcacaggaatgctccgaga

SEQ ID NO: 535316 - DNA, 25 bp, Mus musculus
gcagatgcacatactgctgagcagt

SEQ ID NO: 535317 - DNA, 25 bp, Mus musculus
gcagatgcacatcataggagaagag

SEQ ID NO: 535318 - DNA, 25 bp, Mus musculus
gcagatgcacatgataggagaagag

SEQ ID NO: 535319 - DNA, 25 bp, Mus musculus
gcagatgcacattctgctgagcagt

SEQ ID NO: 535320 - DNA, 25 bp, Mus musculus
gcagatgcagtcaactgaaaagact

SEQ ID NO: 535321 - DNA, 25 bp, Mus musculus
gcagatgcagtctactgaaaagact

SEQ ID NO: 535322 - DNA, 25 bp, Mus musculus
gcagatgccacaaaagccctaaaga

SEQ ID NO: 535323 - DNA, 25 bp, Mus musculus
gcagatgccacataagccctaaaga

SEQ ID NO: 535324 - DNA, 25 bp, Mus musculus
gcagatgcccctatgtgggatagaa

SEQ ID NO: 535325 - DNA, 25 bp, Mus musculus
gcagatgcccctttgtgggatagaa

SEQ ID NO: 535326 - DNA, 25 bp, Mus musculus
gcagatgccgcccatgacgaagatg

SEQ ID NO: 535327 - DNA, 25 bp, Mus musculus
gcagatgccgccgatgacgaagatg

SEQ ID NO: 535328 - DNA, 25 bp, Mus musculus
gcagatgccgttcaaaaggtcgatt

SEQ ID NO: 535329 - DNA, 25 bp, Mus musculus
gcagatgccgttgaaaaggtcgatt

SEQ ID NO: 535330 - DNA, 25 bp, Mus musculus
gcagatgcgaggcaattcttcaccc

SEQ ID NO: 535331 - DNA, 25 bp, Mus musculus
gcagatgcgagggaattcttcaccc

SEQ ID NO: 535332 - DNA, 25 bp, Mus musculus
gcagatgcggaaacacctggagcat

SEQ ID NO: 535333 - DNA, 25 bp, Mus musculus
gcagatgcggaatcacctggagcat

SEQ ID NO: 535334 - DNA, 25 bp, Mus musculus
gcagatgctaatcgacgctggcctc

SEQ ID NO: 535335 - DNA, 25 bp, Mus musculus
gcagatgctaatggacgctggcctc

SEQ ID NO: 535336 - DNA, 25 bp, Mus musculus
gcagatgctactacagttgttttca

SEQ ID NO: 535337 - DNA, 25 bp, Mus musculus
gcagatgctacttcagttgttttca

SEQ ID NO: 535338 - DNA, 25 bp, Mus musculus
gcagatgctcaacggagctgtcttc

SEQ ID NO: 535339 - DNA, 25 bp, Mus musculus
gcagatgctcaagggagctgtcttc

SEQ ID NO: 535340 - DNA, 25 bp, Mus musculus
gcagatgctgccaacatgacaccat

SEQ ID NO: 535341 - DNA, 25 bp, Mus musculus
gcagatgctgcctacatgacaccat

SEQ ID NO: 535342 - DNA, 25 bp, Mus musculus
gcagatgctgcgactcaacgccgac

SEQ ID NO: 535343 - DNA, 25 bp, Mus musculus
gcagatgctgcgtctcaacgccgac

SEQ ID NO: 535344 - DNA, 25 bp, Mus musculus
gcagatgctgggaactatttcctat

SEQ ID NO: 535345 - DNA, 25 bp, Mus musculus
gcagatgctgggtactatttcctat

SEQ ID NO: 535346 - DNA, 25 bp, Mus musculus
gcagatgctgttcgcatgagcacag

SEQ ID NO: 535347 - DNA, 25 bp, Mus musculus
gcagatgctgttggcatgagcacag

SEQ ID NO: 535348 - DNA, 25 bp, Mus musculus
gcagatggaaatcatcctcaggaga

SEQ ID NO: 535349 - DNA, 25 bp, Mus musculus
gcagatggaaatgatcctcaggaga

SEQ ID NO: 535350 - DNA, 25 bp, Mus musculus
gcagatggataccttcagcttccaa

SEQ ID NO: 535351 - DNA, 25 bp, Mus musculus
gcagatggatacgttcagcttccaa

SEQ ID NO: 535352 - DNA, 25 bp, Mus musculus
gcagatggatcccaacaaagtggtt

SEQ ID NO: 535353 - DNA, 25 bp, Mus musculus
gcagatggatcccagaacctgcagc

SEQ ID NO: 535354 - DNA, 25 bp, Mus musculus
gcagatggatccgaacaaagtggtt

SEQ ID NO: 535355 - DNA, 25 bp, Mus musculus
gcagatggatccgagaacctgcagc

SEQ ID NO: 535356 - DNA, 25 bp, Mus musculus
gcagatggattaattgtcgaccaaa

SEQ ID NO: 535357 - DNA, 25 bp, Mus musculus
gcagatggattatttgtcgaccaaa

SEQ ID NO: 535358 - DNA, 25 bp, Mus musculus
gcagatggcacactacacagcttct

SEQ ID NO: 535359 - DNA, 25 bp, Mus musculus
gcagatggcacagtacacagcttct

SEQ ID NO: 535360 - DNA, 25 bp, Mus musculus
gcagatggcagtctggagtccacaa

SEQ ID NO: 535361 - DNA, 25 bp, Mus musculus
gcagatggcagtgtggagtccacaa

SEQ ID NO: 535362 - DNA, 25 bp, Mus musculus
gcagatggccctcatctttgtagag

SEQ ID NO: 535363 - DNA, 25 bp, Mus musculus
gcagatggccctgatctttgtagag

SEQ ID NO: 535364 - DNA, 25 bp, Mus musculus
gcagatggccttcgagccttaagac

SEQ ID NO: 535365 - DNA, 25 bp, Mus musculus
gcagatggccttggagccttaagac

SEQ ID NO: 535366 - DNA, 25 bp, Mus musculus
gcagatggcggacaacatttacaat

SEQ ID NO: 535367 - DNA, 25 bp, Mus musculus
gcagatggcggagaacatttacaat

SEQ ID NO: 535368 - DNA, 25 bp, Mus musculus
gcagatggcggcacgctggcccaaa

SEQ ID NO: 535369 - DNA, 25 bp, Mus musculus
gcagatggcggctcgctggcccaaa

SEQ ID NO: 535370 - DNA, 25 bp, Mus musculus
gcagatggcgttaatggcgctcact

SEQ ID NO: 535371 - DNA, 25 bp, Mus musculus
gcagatggcgtttatggcgctcact

SEQ ID NO: 535372 - DNA, 25 bp, Mus musculus
gcagatggctaacagctatcagtat

SEQ ID NO: 535373 - DNA, 25 bp, Mus musculus
gcagatggctaagagctatcagtat

SEQ ID NO: 535374 - DNA, 25 bp, Mus musculus
gcagatggcttgacccttgttcagg

SEQ ID NO: 535375 - DNA, 25 bp, Mus musculus
gcagatggcttgtcccttgttcagg

SEQ ID NO: 535376 - DNA, 25 bp, Mus musculus
gcagatgggatacagctgccctctg

SEQ ID NO: 535377 - DNA, 25 bp, Mus musculus
gcagatgggatagagctgccctctg

SEQ ID NO: 535378 - DNA, 25 bp, Mus musculus
gcagatgggcctatttgatatgttt

SEQ ID NO: 535379 - DNA, 25 bp, Mus musculus
gcagatgggcctttttgatatgttt

SEQ ID NO: 535380 - DNA, 25 bp, Mus musculus
gcagatggtcctacgatgatgttcc

SEQ ID NO: 535381 - DNA, 25 bp, Mus musculus
gcagatggtccttcgatgatgttcc

SEQ ID NO: 535382 - DNA, 25 bp, Mus musculus
gcagatggtgacacattgtccctca

SEQ ID NO: 535383 - DNA, 25 bp, Mus musculus
gcagatggtgactcattgtccctca

SEQ ID NO: 535384 - DNA, 25 bp, Mus musculus
gcagatggttggaacctgcctggct

SEQ ID NO: 535385 - DNA, 25 bp, Mus musculus
gcagatggttggtacctgcctggct

SEQ ID NO: 535386 - DNA, 25 bp, Mus musculus
gcagatggttgtcattccttgttta

SEQ ID NO: 535387 - DNA, 25 bp, Mus musculus
gcagatggttgtgattccttgttta

SEQ ID NO: 535388 - DNA, 25 bp, Mus musculus
gcagatgtacaactcacccaggtcc

SEQ ID NO: 535389 - DNA, 25 bp, Mus musculus
gcagatgtacaagtcacccaggtcc

SEQ ID NO: 535390 - DNA, 25 bp, Mus musculus
gcagatgtcatcacaatagcccgat

SEQ ID NO: 535391 - DNA, 25 bp, Mus musculus
gcagatgtcatctcaatagcccgat

SEQ ID NO: 535392 - DNA, 25 bp, Mus musculus
gcagatgtccagaacaggtcttgta

SEQ ID NO: 535393 - DNA, 25 bp, Mus musculus
gcagatgtccagtacaggtcttgta

SEQ ID NO: 535394 - DNA, 25 bp, Mus musculus
gcagatgtccatcctgaggctgtag

SEQ ID NO: 535395 - DNA, 25 bp, Mus musculus
gcagatgtccatcctgtgggtgtca

SEQ ID NO: 535396 - DNA, 25 bp, Mus musculus
gcagatgtccatgctgaggctgtag

SEQ ID NO: 535397 - DNA, 25 bp, Mus musculus
gcagatgtccatgctgtgggtgtca

SEQ ID NO: 535398 - DNA, 25 bp, Mus musculus
gcagatgtctagcttctctagtctt

SEQ ID NO: 535399 - DNA, 25 bp, Mus musculus
gcagatgtctaggttctctagtctt

SEQ ID NO: 535400 - DNA, 25 bp, Mus musculus
gcagatgtctgcatgaacttcttgc

SEQ ID NO: 535401 - DNA, 25 bp, Mus musculus
gcagatgtctgcttgaacttcttgc

SEQ ID NO: 535402 - DNA, 25 bp, Mus musculus
gcagatgtcttcactcagggattat

SEQ ID NO: 535403 - DNA, 25 bp, Mus musculus
gcagatgtcttctctcagggattat

SEQ ID NO: 535404 - DNA, 25 bp, Mus musculus
gcagatgtgactacaaacatttctg

SEQ ID NO: 535405 - DNA, 25 bp, Mus musculus
gcagatgtgacttcaaacatttctg

SEQ ID NO: 535406 - DNA, 25 bp, Mus musculus
gcagatgtgagcagcaaccgaccat

SEQ ID NO: 535407 - DNA, 25 bp, Mus musculus
gcagatgtgagctgcaaccgaccat

SEQ ID NO: 535408 - DNA, 25 bp, Mus musculus
gcagatgtggttaatggctttgcat

SEQ ID NO: 535409 - DNA, 25 bp, Mus musculus
gcagatgtggtttatggctttgcat

SEQ ID NO: 535410 - DNA, 25 bp, Mus musculus
gcagatgtgtgtacattccgcagca

SEQ ID NO: 535411 - DNA, 25 bp, Mus musculus
gcagatgtgtgttcattccgcagca

SEQ ID NO: 535412 - DNA, 25 bp, Mus musculus
gcagatgtgtttcttcttactagaa

SEQ ID NO: 535413 - DNA, 25 bp, Mus musculus
gcagatgtgtttgttcttactagaa

SEQ ID NO: 535414 - DNA, 25 bp, Mus musculus
gcagatgttaccagtctgaggacaa

SEQ ID NO: 535415 - DNA, 25 bp, Mus musculus
gcagatgttacctgtctgaggacaa

SEQ ID NO: 535416 - DNA, 25 bp, Mus musculus
gcagatgttactcgttgggttcttt

SEQ ID NO: 535417 - DNA, 25 bp, Mus musculus
gcagatgttactggttgggttcttt

SEQ ID NO: 535418 - DNA, 25 bp, Mus musculus
gcagatgttcccagatgagtttctc

SEQ ID NO: 535419 - DNA, 25 bp, Mus musculus
gcagatgttccctgatgagtttctc

SEQ ID NO: 535420 - DNA, 25 bp, Mus musculus
gcagatgttcgtatctggtggaaat

SEQ ID NO: 535421 - DNA, 25 bp, Mus musculus
gcagatgttcgtttctggtggaaat

SEQ ID NO: 535422 - DNA, 25 bp, Mus musculus
gcagatgttctgagaagttctctct

SEQ ID NO: 535423 - DNA, 25 bp, Mus musculus
gcagatgttctgtgaagttctctct

SEQ ID NO: 535424 - DNA, 25 bp, Mus musculus
gcagatgtttgacgaacttctttcc

SEQ ID NO: 535425 - DNA, 25 bp, Mus musculus
gcagatgtttgaggaacttctttcc

SEQ ID NO: 535426 - DNA, 25 bp, Mus musculus
gcagatgtttgcacttggctcagta

SEQ ID NO: 535427 - DNA, 25 bp, Mus musculus
gcagatgtttgctcttggctcagta

SEQ ID NO: 535428 - DNA, 25 bp, Mus musculus
gcagatgtttggactttttcaagtt

SEQ ID NO: 535429 - DNA, 25 bp, Mus musculus
gcagatgtttggtctttttcaagtt

SEQ ID NO: 535430 - DNA, 25 bp, Mus musculus
gcagatgttttaccatgcttagtgg

SEQ ID NO: 535431 - DNA, 25 bp, Mus musculus
gcagatgttttagcatgcttagtgg

SEQ ID NO: 535432 - DNA, 25 bp, Mus musculus
gcagatgttttcactattccacaca

SEQ ID NO: 535433 - DNA, 25 bp, Mus musculus
gcagatgttttctctattccacaca

SEQ ID NO: 535434 - DNA, 25 bp, Mus musculus
gcagattaagcacatccttgctaat

SEQ ID NO: 535435 - DNA, 25 bp, Mus musculus
gcagattaagcagatccttgctaat

SEQ ID NO: 535436 - DNA, 25 bp, Mus musculus
gcagattacagtacagtttaatgtt

SEQ ID NO: 535437 - DNA, 25 bp, Mus musculus
gcagattacagttcagtttaatgtt

SEQ ID NO: 535438 - DNA, 25 bp, Mus musculus
gcagattactgcaaaggtggctatc

SEQ ID NO: 535439 - DNA, 25 bp, Mus musculus
gcagattactgctaaggtggctatc

SEQ ID NO: 535440 - DNA, 25 bp, Mus musculus
gcagattagcatatctcctggtaca

SEQ ID NO: 535441 - DNA, 25 bp, Mus musculus
gcagattagcatttctcctggtaca

SEQ ID NO: 535442 - DNA, 25 bp, Mus musculus
gcagattagcctaccaagatccaat

SEQ ID NO: 535443 - DNA, 25 bp, Mus musculus
gcagattagccttccaagatccaat

SEQ ID NO: 535444 - DNA, 25 bp, Mus musculus
gcagattagttcactaactccagaa

SEQ ID NO: 535445 - DNA, 25 bp, Mus musculus
gcagattagttctctaactccagaa

SEQ ID NO: 535446 - DNA, 25 bp, Mus musculus
gcagattatctcagctcttgatcct

SEQ ID NO: 535447 - DNA, 25 bp, Mus musculus
gcagattatctctgctcttgatcct

SEQ ID NO: 535448 - DNA, 25 bp, Mus musculus
gcagattcagttccagcacttacag

SEQ ID NO: 535449 - DNA, 25 bp, Mus musculus
gcagattcagttctccagctaagaa

SEQ ID NO: 535450 - DNA, 25 bp, Mus musculus
gcagattcagttgcagcacttacag

SEQ ID NO: 535451 - DNA, 25 bp, Mus musculus
gcagattcagttgtccagctaagaa

SEQ ID NO: 535452 - DNA, 25 bp, Mus musculus
gcagattcatcaatttttcccaggg

SEQ ID NO: 535453 - DNA, 25 bp, Mus musculus
gcagattcatcattttttcccaggg

SEQ ID NO: 535454 - DNA, 25 bp, Mus musculus
gcagattcatggagtccaggctatt

SEQ ID NO: 535455 - DNA, 25 bp, Mus musculus
gcagattcatggtgtccaggctatt

SEQ ID NO: 535456 - DNA, 25 bp, Mus musculus
gcagattcccttcgtattggtcaac

SEQ ID NO: 535457 - DNA, 25 bp, Mus musculus
gcagattcccttggtattggtcaac

SEQ ID NO: 535458 - DNA, 25 bp, Mus musculus
gcagattcctcaaatgttaatatgt

SEQ ID NO: 535459 - DNA, 25 bp, Mus musculus
gcagattcctcatatgttaatatgt

SEQ ID NO: 535460 - DNA, 25 bp, Mus musculus
gcagattcctctagtattgttatgt

SEQ ID NO: 535461 - DNA, 25 bp, Mus musculus
gcagattcctcttgtattgttatgt

SEQ ID NO: 535462 - DNA, 25 bp, Mus musculus
gcagattcgtttcgccctttggtac

SEQ ID NO: 535463 - DNA, 25 bp, Mus musculus
gcagattcgtttggccctttggtac

SEQ ID NO: 535464 - DNA, 25 bp, Mus musculus
gcagattctaagcaccaggtcattt

SEQ ID NO: 535465 - DNA, 25 bp, Mus musculus
gcagattctaaggaccaggtcattt

SEQ ID NO: 535466 - DNA, 25 bp, Mus musculus
gcagattctagactggtccttggtt

SEQ ID NO: 535467 - DNA, 25 bp, Mus musculus
gcagattctagagtggtccttggtt

SEQ ID NO: 535468 - DNA, 25 bp, Mus musculus
gcagattctcatagccaagtctcct

SEQ ID NO: 535469 - DNA, 25 bp, Mus musculus
gcagattctcattgccaagtctcct

SEQ ID NO: 535470 - DNA, 25 bp, Mus musculus
gcagattctccacatcgagttcaag

SEQ ID NO: 535471 - DNA, 25 bp, Mus musculus
gcagattctccagatcgagttcaag

SEQ ID NO: 535472 - DNA, 25 bp, Mus musculus
gcagattctcgaacatttgtttcat

SEQ ID NO: 535473 - DNA, 25 bp, Mus musculus
gcagattctcgatcatttgtttcat

SEQ ID NO: 535474 - DNA, 25 bp, Mus musculus
gcagattctgataaggttccaggac

SEQ ID NO: 535475 - DNA, 25 bp, Mus musculus
gcagattctgattaggttccaggac

SEQ ID NO: 535476 - DNA, 25 bp, Mus musculus
gcagattgcaataaaacctacagta

SEQ ID NO: 535477 - DNA, 25 bp, Mus musculus
gcagattgcaatagactatgaggct

SEQ ID NO: 535478 - DNA, 25 bp, Mus musculus
gcagattgcaattaaacctacagta

SEQ ID NO: 535479 - DNA, 25 bp, Mus musculus
gcagattgcaattgactatgaggct

SEQ ID NO: 535480 - DNA, 25 bp, Mus musculus
gcagattgcccaacgtgactacggc

SEQ ID NO: 535481 - DNA, 25 bp, Mus musculus
gcagattgcccatcgtgactacggc

SEQ ID NO: 535482 - DNA, 25 bp, Mus musculus
gcagattgccctaatgtatatacca

SEQ ID NO: 535483 - DNA, 25 bp, Mus musculus
gcagattgcccttatgtatatacca

SEQ ID NO: 535484 - DNA, 25 bp, Mus musculus
gcagattgctgccttacaggtatat

SEQ ID NO: 535485 - DNA, 25 bp, Mus musculus
gcagattgctgcgttacaggtatat

SEQ ID NO: 535486 - DNA, 25 bp, Mus musculus
gcagatttaataaagcccacagaat

SEQ ID NO: 535487 - DNA, 25 bp, Mus musculus
gcagatttaatatagcccacagaat

SEQ ID NO: 535488 - DNA, 25 bp, Mus musculus
gcagatttagagacctgggattact

SEQ ID NO: 535489 - DNA, 25 bp, Mus musculus
gcagatttagagtcctgggattact

SEQ ID NO: 535490 - DNA, 25 bp, Mus musculus
gcagatttagctagaccagcactga

SEQ ID NO: 535491 - DNA, 25 bp, Mus musculus
gcagatttagcttgaccagcactga

SEQ ID NO: 535492 - DNA, 25 bp, Mus musculus
gcagatttcagtaaggaagactatt

SEQ ID NO: 535493 - DNA, 25 bp, Mus musculus
gcagatttcagttaggaagactatt

SEQ ID NO: 535494 - DNA, 25 bp, Mus musculus
gcagatttcatcaaaggagttcctt

SEQ ID NO: 535495 - DNA, 25 bp, Mus musculus
gcagatttcatctaaggagttcctt

SEQ ID NO: 535496 - DNA, 25 bp, Mus musculus
gcagatttccgacgccttcaacagg

SEQ ID NO: 535497 - DNA, 25 bp, Mus musculus
gcagatttccgaggccttcaacagg

SEQ ID NO: 535498 - DNA, 25 bp, Mus musculus
gcagatttcctaaggccactatttt

SEQ ID NO: 535499 - DNA, 25 bp, Mus musculus
gcagatttcctatggccactatttt

SEQ ID NO: 535500 - DNA, 25 bp, Mus musculus
gcagatttcgtgacttcattttcca

SEQ ID NO: 535501 - DNA, 25 bp, Mus musculus
gcagatttcgtgtcttcattttcca

SEQ ID NO: 535502 - DNA, 25 bp, Mus musculus
gcagatttgaggacctgtgctcatg

SEQ ID NO: 535503 - DNA, 25 bp, Mus musculus
gcagatttgaggtcctgtgctcatg

SEQ ID NO: 535504 - DNA, 25 bp, Mus musculus
gcagatttgcttaacccagtttctt

SEQ ID NO: 535505 - DNA, 25 bp, Mus musculus
gcagatttgcttatggatatcccag

SEQ ID NO: 535506 - DNA, 25 bp, Mus musculus
gcagatttgctttacccagtttctt

SEQ ID NO: 535507 - DNA, 25 bp, Mus musculus
gcagatttgcttttggatatcccag

SEQ ID NO: 535508 - DNA, 25 bp, Mus musculus
gcagatttggacaccttccagagtg

SEQ ID NO: 535509 - DNA, 25 bp, Mus musculus
gcagatttggactccttccagagtg

SEQ ID NO: 535510 - DNA, 25 bp, Mus musculus
gcagatttgtagagttggttctcct

SEQ ID NO: 535511 - DNA, 25 bp, Mus musculus
gcagatttgtagtgttggttctcct

SEQ ID NO: 535512 - DNA, 25 bp, Mus musculus
gcagatttgtttatagcaccgagga

SEQ ID NO: 535513 - DNA, 25 bp, Mus musculus
gcagatttgtttttagcaccgagga

SEQ ID NO: 535514 - DNA, 25 bp, Mus musculus
gcagattttcagactttcatatcag

SEQ ID NO: 535515 - DNA, 25 bp, Mus musculus
gcagattttcagcacattgggagca

SEQ ID NO: 535516 - DNA, 25 bp, Mus musculus
gcagattttcaggacattgggagca

SEQ ID NO: 535517 - DNA, 25 bp, Mus musculus
gcagattttcagtctttcatatcag

SEQ ID NO: 535518 - DNA, 25 bp, Mus musculus
gcagattttgcgacgagatgacttt

SEQ ID NO: 535519 - DNA, 25 bp, Mus musculus
gcagattttgcgtcgagatgacttt

SEQ ID NO: 535520 - DNA, 25 bp, Mus musculus
gcagatttttaacccgaccttccca

SEQ ID NO: 535521 - DNA, 25 bp, Mus musculus
gcagatttttaagccgaccttccca

SEQ ID NO: 535522 - DNA, 25 bp, Mus musculus
gcagatttttcaacttggtttctga

SEQ ID NO: 535523 - DNA, 25 bp, Mus musculus
gcagatttttcatcttggtttctga

SEQ ID NO: 535524 - DNA, 25 bp, Mus musculus
gcagcaaaaatacagccagcctatg

SEQ ID NO: 535525 - DNA, 25 bp, Mus musculus
gcagcaaaaatagagccagcctatg

SEQ ID NO: 535526 - DNA, 25 bp, Mus musculus
gcagcaaaacacacactactttgaa

SEQ ID NO: 535527 - DNA, 25 bp, Mus musculus
gcagcaaaacactcactactttgaa

SEQ ID NO: 535528 - DNA, 25 bp, Mus musculus
gcagcaaaacgcacccctttttggg

SEQ ID NO: 535529 - DNA, 25 bp, Mus musculus
gcagcaaaacgctcccctttttggg

SEQ ID NO: 535530 - DNA, 25 bp, Mus musculus
gcagcaaaatacaaagttgtccctt

SEQ ID NO: 535531 - DNA, 25 bp, Mus musculus
gcagcaaaatactaagttgtccctt

SEQ ID NO: 535532 - DNA, 25 bp, Mus musculus
gcagcaaaatttctagcctgactga

SEQ ID NO: 535533 - DNA, 25 bp, Mus musculus
gcagcaaaatttgtagcctgactga

SEQ ID NO: 535534 - DNA, 25 bp, Mus musculus
gcagcaaacacaacgccacatttaa

SEQ ID NO: 535535 - DNA, 25 bp, Mus musculus
gcagcaaacacatcgccacatttaa

SEQ ID NO: 535536 - DNA, 25 bp, Mus musculus
gcagcaaacacccttaattctagca

SEQ ID NO: 535537 - DNA, 25 bp, Mus musculus
gcagcaaacaccgttaattctagca

SEQ ID NO: 535538 - DNA, 25 bp, Mus musculus
gcagcaaaccggaagatgccccttc

SEQ ID NO: 535539 - DNA, 25 bp, Mus musculus
gcagcaaaccggtagatgccccttc

SEQ ID NO: 535540 - DNA, 25 bp, Mus musculus
gcagcaaacctgatctttgcctgaa

SEQ ID NO: 535541 - DNA, 25 bp, Mus musculus
gcagcaaacctgttctttgcctgaa

SEQ ID NO: 535542 - DNA, 25 bp, Mus musculus
gcagcaaacgccaacaggtagaggt

SEQ ID NO: 535543 - DNA, 25 bp, Mus musculus
gcagcaaacgcctacaggtagaggt

SEQ ID NO: 535544 - DNA, 25 bp, Mus musculus
gcagcaaacggaatctgccgggcaa

SEQ ID NO: 535545 - DNA, 25 bp, Mus musculus
gcagcaaacggattctgccgggcaa

SEQ ID NO: 535546 - DNA, 25 bp, Mus musculus
gcagcaaacttcagctgagacctca

SEQ ID NO: 535547 - DNA, 25 bp, Mus musculus
gcagcaaacttctgctgagacctca

SEQ ID NO: 535548 - DNA, 25 bp, Mus musculus
gcagcaaagaacagagacccaagag

SEQ ID NO: 535549 - DNA, 25 bp, Mus musculus
gcagcaaagaactgagacccaagag

SEQ ID NO: 535550 - DNA, 25 bp, Mus musculus
gcagcaaagagcatatcccaagttc

SEQ ID NO: 535551 - DNA, 25 bp, Mus musculus
gcagcaaagagcttatcccaagttc

SEQ ID NO: 535552 - DNA, 25 bp, Mus musculus
gcagcaaaggatatcataggccttc

SEQ ID NO: 535553 - DNA, 25 bp, Mus musculus
gcagcaaaggatttcataggccttc

SEQ ID NO: 535554 - DNA, 25 bp, Mus musculus
gcagcaaaggttcattcctttacaa

SEQ ID NO: 535555 - DNA, 25 bp, Mus musculus
gcagcaaaggttgattcctttacaa

SEQ ID NO: 535556 - DNA, 25 bp, Mus musculus
gcagcaaagtttcatccttcttcga

SEQ ID NO: 535557 - DNA, 25 bp, Mus musculus
gcagcaaagtttgatccttcttcga

SEQ ID NO: 535558 - DNA, 25 bp, Mus musculus
gcagcaaataggcatgctggcacag

SEQ ID NO: 535559 - DNA, 25 bp, Mus musculus
gcagcaaatagggatgctggcacag

SEQ ID NO: 535560 - DNA, 25 bp, Mus musculus
gcagcaaatccaacattccctaatt

SEQ ID NO: 535561 - DNA, 25 bp, Mus musculus
gcagcaaatccaccgcctcagaatt

SEQ ID NO: 535562 - DNA, 25 bp, Mus musculus
gcagcaaatccagcgcctcagaatt

SEQ ID NO: 535563 - DNA, 25 bp, Mus musculus
gcagcaaatccatcattccctaatt

SEQ ID NO: 535564 - DNA, 25 bp, Mus musculus
gcagcaaatgccaggtatcccatca

SEQ ID NO: 535565 - DNA, 25 bp, Mus musculus
gcagcaaatgcctggtatcccatca

SEQ ID NO: 535566 - DNA, 25 bp, Mus musculus
gcagcaacaatgatactcaccgatg

SEQ ID NO: 535567 - DNA, 25 bp, Mus musculus
gcagcaacaatgttactcaccgatg

SEQ ID NO: 535568 - DNA, 25 bp, Mus musculus
gcagcaacactgagcatgaagatgt

SEQ ID NO: 535569 - DNA, 25 bp, Mus musculus
gcagcaacactgtgcatgaagatgt

SEQ ID NO: 535570 - DNA, 25 bp, Mus musculus
gcagcaacagccatcagcagtctgg

SEQ ID NO: 535571 - DNA, 25 bp, Mus musculus
gcagcaacagccttcagcagtctgg

SEQ ID NO: 535572 - DNA, 25 bp, Mus musculus
gcagcaacatgtatcccaaccagta

SEQ ID NO: 535573 - DNA, 25 bp, Mus musculus
gcagcaacatgtttcccaaccagta

SEQ ID NO: 535574 - DNA, 25 bp, Mus musculus
gcagcaaccgaccatccagtaggat

SEQ ID NO: 535575 - DNA, 25 bp, Mus musculus
gcagcaaccgacgatccagtaggat

SEQ ID NO: 535576 - DNA, 25 bp, Mus musculus
gcagcaacggcacatacttttaggg

SEQ ID NO: 535577 - DNA, 25 bp, Mus musculus
gcagcaacggcagatacttttaggg

SEQ ID NO: 535578 - DNA, 25 bp, Mus musculus
gcagcaactactacaacagctgaga

SEQ ID NO: 535579 - DNA, 25 bp, Mus musculus
gcagcaactacttcaacagctgaga

SEQ ID NO: 535580 - DNA, 25 bp, Mus musculus
gcagcaactattactctatcatttt

SEQ ID NO: 535581 - DNA, 25 bp, Mus musculus
gcagcaactatttctctatcatttt

SEQ ID NO: 535582 - DNA, 25 bp, Mus musculus
gcagcaactgctatgtaatatttca

SEQ ID NO: 535583 - DNA, 25 bp, Mus musculus
gcagcaactgctttgtaatatttca

SEQ ID NO: 535584 - DNA, 25 bp, Mus musculus
gcagcaactgggacaccgtggctct

SEQ ID NO: 535585 - DNA, 25 bp, Mus musculus
gcagcaactgggtcaccgtggctct

SEQ ID NO: 535586 - DNA, 25 bp, Mus musculus
gcagcaactttcagagactggccta

SEQ ID NO: 535587 - DNA, 25 bp, Mus musculus
gcagcaactttctgagactggccta

SEQ ID NO: 535588 - DNA, 25 bp, Mus musculus
gcagcaagacaaataaaactaactt

SEQ ID NO: 535589 - DNA, 25 bp, Mus musculus
gcagcaagacaattaaaactaactt

SEQ ID NO: 535590 - DNA, 25 bp, Mus musculus
gcagcaagacagcagcttgtactgt

SEQ ID NO: 535591 - DNA, 25 bp, Mus musculus
gcagcaagacaggagcttgtactgt

SEQ ID NO: 535592 - DNA, 25 bp, Mus musculus
gcagcaagacctccgcctgtgcgtg

SEQ ID NO: 535593 - DNA, 25 bp, Mus musculus
gcagcaagacctgcgcctgtgcgtg

SEQ ID NO: 535594 - DNA, 25 bp, Mus musculus
gcagcaagagccatgtgtactcttt

SEQ ID NO: 535595 - DNA, 25 bp, Mus musculus
gcagcaagagccttgtgtactcttt

SEQ ID NO: 535596 - DNA, 25 bp, Mus musculus
gcagcaagattcaaacgggtgtggt

SEQ ID NO: 535597 - DNA, 25 bp, Mus musculus
gcagcaagattctaacgggtgtggt

SEQ ID NO: 535598 - DNA, 25 bp, Mus musculus
gcagcaagcaacaaaagagcctgta

SEQ ID NO: 535599 - DNA, 25 bp, Mus musculus
gcagcaagcaactaaagagcctgta

SEQ ID NO: 535600 - DNA, 25 bp, Mus musculus
gcagcaagcctacaccatttaatta

SEQ ID NO: 535601 - DNA, 25 bp, Mus musculus
gcagcaagcctagaccatttaatta

SEQ ID NO: 535602 - DNA, 25 bp, Mus musculus
gcagcaagcgcaataggtggcacaa

SEQ ID NO: 535603 - DNA, 25 bp, Mus musculus
gcagcaagcgcattaggtggcacaa

SEQ ID NO: 535604 - DNA, 25 bp, Mus musculus
gcagcaagcttgaacagcctgttcg

SEQ ID NO: 535605 - DNA, 25 bp, Mus musculus
gcagcaagcttgtacagcctgttcg

SEQ ID NO: 535606 - DNA, 25 bp, Mus musculus
gcagcaagctttcccggcaaagtgc

SEQ ID NO: 535607 - DNA, 25 bp, Mus musculus
gcagcaagctttgccggcaaagtgc

SEQ ID NO: 535608 - DNA, 25 bp, Mus musculus
gcagcaaggccaaaaggcgggcact

SEQ ID NO: 535609 - DNA, 25 bp, Mus musculus
gcagcaaggccataaggcgggcact

SEQ ID NO: 535610 - DNA, 25 bp, Mus musculus
gcagcaagggctattgctcactaac

SEQ ID NO: 535611 - DNA, 25 bp, Mus musculus
gcagcaagggcttttgctcactaac

SEQ ID NO: 535612 - DNA, 25 bp, Mus musculus
gcagcaagggtgatcacctcctctt

SEQ ID NO: 535613 - DNA, 25 bp, Mus musculus
gcagcaagggtgttcacctcctctt

SEQ ID NO: 535614 - DNA, 25 bp, Mus musculus
gcagcaagtaagacacattccccgc

SEQ ID NO: 535615 - DNA, 25 bp, Mus musculus
gcagcaagtaagtcacattccccgc

SEQ ID NO: 535616 - DNA, 25 bp, Mus musculus
gcagcaagtccacgttgagcgccag

SEQ ID NO: 535617 - DNA, 25 bp, Mus musculus
gcagcaagtccaggttgagcgccag

SEQ ID NO: 535618 - DNA, 25 bp, Mus musculus
gcagcaagtctaccagcaaacgtat

SEQ ID NO: 535619 - DNA, 25 bp, Mus musculus
gcagcaagtctagcagcaaacgtat

SEQ ID NO: 535620 - DNA, 25 bp, Mus musculus
gcagcaagtgctctgttcactaaag

SEQ ID NO: 535621 - DNA, 25 bp, Mus musculus
gcagcaagtgctgtgttcactaaag

SEQ ID NO: 535622 - DNA, 25 bp, Mus musculus
gcagcaagttcaacatcaagacctt

SEQ ID NO: 535623 - DNA, 25 bp, Mus musculus
gcagcaagttcatcatcaagacctt

SEQ ID NO: 535624 - DNA, 25 bp, Mus musculus
gcagcaataaaaccctctgcttcta

SEQ ID NO: 535625 - DNA, 25 bp, Mus musculus
gcagcaataaaagcctctgcttcta

SEQ ID NO: 535626 - DNA, 25 bp, Mus musculus
gcagcaataagcaaatgaaccagag

SEQ ID NO: 535627 - DNA, 25 bp, Mus musculus
gcagcaataagctaatgaaccagag

SEQ ID NO: 535628 - DNA, 25 bp, Mus musculus
gcagcaatacccatttacggaagac

SEQ ID NO: 535629 - DNA, 25 bp, Mus musculus
gcagcaatacccttttacggaagac

SEQ ID NO: 535630 - DNA, 25 bp, Mus musculus
gcagcaatatacaactttgtgatgt

SEQ ID NO: 535631 - DNA, 25 bp, Mus musculus
gcagcaatatactactttgtgatgt

SEQ ID NO: 535632 - DNA, 25 bp, Mus musculus
gcagcaatgatacactgtcttgtca

SEQ ID NO: 535633 - DNA, 25 bp, Mus musculus
gcagcaatgatagactgtcttgtca

SEQ ID NO: 535634 - DNA, 25 bp, Mus musculus
gcagcaattagtaattctccgatca

SEQ ID NO: 535635 - DNA, 25 bp, Mus musculus
gcagcaattagttattctccgatca

SEQ ID NO: 535636 - DNA, 25 bp, Mus musculus
gcagcaattcctacagggttcttga

SEQ ID NO: 535637 - DNA, 25 bp, Mus musculus
gcagcaattccttcagggttcttga

SEQ ID NO: 535638 - DNA, 25 bp, Mus musculus
gcagcaattgtgagtcttaggagcc

SEQ ID NO: 535639 - DNA, 25 bp, Mus musculus
gcagcaattgtgtgtcttaggagcc

SEQ ID NO: 535640 - DNA, 25 bp, Mus musculus
gcagcacaacagattatattgaaat

SEQ ID NO: 535641 - DNA, 25 bp, Mus musculus
gcagcacaacagtttatattgaaat

SEQ ID NO: 535642 - DNA, 25 bp, Mus musculus
gcagcacaacatctcctggatcgag

SEQ ID NO: 535643 - DNA, 25 bp, Mus musculus
gcagcacaacatgtcctggatcgag

SEQ ID NO: 535644 - DNA, 25 bp, Mus musculus
gcagcacaaggaacagttgctccct

SEQ ID NO: 535645 - DNA, 25 bp, Mus musculus
gcagcacaaggatcagttgctccct

SEQ ID NO: 535646 - DNA, 25 bp, Mus musculus
gcagcacaatgcatgcaagtcaggg

SEQ ID NO: 535647 - DNA, 25 bp, Mus musculus
gcagcacaatgcttgcaagtcaggg

SEQ ID NO: 535648 - DNA, 25 bp, Mus musculus
gcagcacacaccaacttctgatgta

SEQ ID NO: 535649 - DNA, 25 bp, Mus musculus
gcagcacacacctacttctgatgta

SEQ ID NO: 535650 - DNA, 25 bp, Mus musculus
gcagcacacagtcattgccctgtta

SEQ ID NO: 535651 - DNA, 25 bp, Mus musculus
gcagcacacagtgattgccctgtta

SEQ ID NO: 535652 - DNA, 25 bp, Mus musculus
gcagcacacatgatgggcagtacac

SEQ ID NO: 535653 - DNA, 25 bp, Mus musculus
gcagcacacatgttgggcagtacac

SEQ ID NO: 535654 - DNA, 25 bp, Mus musculus
gcagcacactcgatggaatctttcc

SEQ ID NO: 535655 - DNA, 25 bp, Mus musculus
gcagcacactcgttggaatctttcc

SEQ ID NO: 535656 - DNA, 25 bp, Mus musculus
gcagcacactgaatgtcacctttga

SEQ ID NO: 535657 - DNA, 25 bp, Mus musculus
gcagcacactgattgtcacctttga

SEQ ID NO: 535658 - DNA, 25 bp, Mus musculus
gcagcacagagcaaaccttcggaga

SEQ ID NO: 535659 - DNA, 25 bp, Mus musculus
gcagcacagagctaaccttcggaga

SEQ ID NO: 535660 - DNA, 25 bp, Mus musculus
gcagcacagatgaaacccgggcaga

SEQ ID NO: 535661 - DNA, 25 bp, Mus musculus
gcagcacagatgtaacccgggcaga

SEQ ID NO: 535662 - DNA, 25 bp, Mus musculus
gcagcacagcatattctttactaga

SEQ ID NO: 535663 - DNA, 25 bp, Mus musculus
gcagcacagcatccttgttcctgta

SEQ ID NO: 535664 - DNA, 25 bp, Mus musculus
gcagcacagcatgcttgttcctgta

SEQ ID NO: 535665 - DNA, 25 bp, Mus musculus
gcagcacagcattttctttactaga

SEQ ID NO: 535666 - DNA, 25 bp, Mus musculus
gcagcacagcgtcatggtcaaaatc

SEQ ID NO: 535667 - DNA, 25 bp, Mus musculus
gcagcacagcgtgatggtcaaaatc

SEQ ID NO: 535668 - DNA, 25 bp, Mus musculus
gcagcacaggccaagattccataca

SEQ ID NO: 535669 - DNA, 25 bp, Mus musculus
gcagcacaggcctagattccataca

SEQ ID NO: 535670 - DNA, 25 bp, Mus musculus
gcagcacaggctagacatatcagtt

SEQ ID NO: 535671 - DNA, 25 bp, Mus musculus
gcagcacaggcttgacatatcagtt

SEQ ID NO: 535672 - DNA, 25 bp, Mus musculus
gcagcacagtgaccctctgtttaaa

SEQ ID NO: 535673 - DNA, 25 bp, Mus musculus
gcagcacagtgagcctctgtttaaa

SEQ ID NO: 535674 - DNA, 25 bp, Mus musculus
gcagcacatactccagatagccatt

SEQ ID NO: 535675 - DNA, 25 bp, Mus musculus
gcagcacatactgcagatagccatt

SEQ ID NO: 535676 - DNA, 25 bp, Mus musculus
gcagcacatattagtctgtaccatt

SEQ ID NO: 535677 - DNA, 25 bp, Mus musculus
gcagcacatatttgtctgtaccatt

SEQ ID NO: 535678 - DNA, 25 bp, Mus musculus
gcagcacatcataacccctttgtgt

SEQ ID NO: 535679 - DNA, 25 bp, Mus musculus
gcagcacatcataactgagctacat

SEQ ID NO: 535680 - DNA, 25 bp, Mus musculus
gcagcacatcattacccctttgtgt

SEQ ID NO: 535681 - DNA, 25 bp, Mus musculus
gcagcacatcattactgagctacat

SEQ ID NO: 535682 - DNA, 25 bp, Mus musculus
gcagcacatcccaataatcttaaca

SEQ ID NO: 535683 - DNA, 25 bp, Mus musculus
gcagcacatccctataatcttaaca

SEQ ID NO: 535684 - DNA, 25 bp, Mus musculus
gcagcacatcgaaaatgccctgttg

SEQ ID NO: 535685 - DNA, 25 bp, Mus musculus
gcagcacatcgataatgccctgttg

SEQ ID NO: 535686 - DNA, 25 bp, Mus musculus
gcagcacatctaccggactggaaga

SEQ ID NO: 535687 - DNA, 25 bp, Mus musculus
gcagcacatctagcggactggaaga

SEQ ID NO: 535688 - DNA, 25 bp, Mus musculus
gcagcacatgaaagttgtctcaatc

SEQ ID NO: 535689 - DNA, 25 bp, Mus musculus
gcagcacatgaatgttgtctcaatc

SEQ ID NO: 535690 - DNA, 25 bp, Mus musculus
gcagcacatgcaagtgggtcatcca

SEQ ID NO: 535691 - DNA, 25 bp, Mus musculus
gcagcacatgcatgtgggtcatcca

SEQ ID NO: 535692 - DNA, 25 bp, Mus musculus
gcagcacattctccactgtgacatt

SEQ ID NO: 535693 - DNA, 25 bp, Mus musculus
gcagcacattctgcactgtgacatt

SEQ ID NO: 535694 - DNA, 25 bp, Mus musculus
gcagcaccaaggagtgcagcacggt

SEQ ID NO: 535695 - DNA, 25 bp, Mus musculus
gcagcaccaaggtgtgcagcacggt

SEQ ID NO: 535696 - DNA, 25 bp, Mus musculus
gcagcaccacaccttctgtgtagtg

SEQ ID NO: 535697 - DNA, 25 bp, Mus musculus
gcagcaccacacgttctgtgtagtg

SEQ ID NO: 535698 - DNA, 25 bp, Mus musculus
gcagcaccaccaaacgagagttgat

SEQ ID NO: 535699 - DNA, 25 bp, Mus musculus
gcagcaccaccactcaaagtgacat

SEQ ID NO: 535700 - DNA, 25 bp, Mus musculus
gcagcaccaccagtcaaagtgacat

SEQ ID NO: 535701 - DNA, 25 bp, Mus musculus
gcagcaccaccatacgagagttgat

SEQ ID NO: 535702 - DNA, 25 bp, Mus musculus
gcagcaccagcgcttgtgatgacta

SEQ ID NO: 535703 - DNA, 25 bp, Mus musculus
gcagcaccagcggttgtgatgacta

SEQ ID NO: 535704 - DNA, 25 bp, Mus musculus
gcagcaccagctaataacggtcaca

SEQ ID NO: 535705 - DNA, 25 bp, Mus musculus
gcagcaccagcttataacggtcaca

SEQ ID NO: 535706 - DNA, 25 bp, Mus musculus
gcagcaccagtacccaagtggagga

SEQ ID NO: 535707 - DNA, 25 bp, Mus musculus
gcagcaccagtagccaagtggagga

SEQ ID NO: 535708 - DNA, 25 bp, Mus musculus
gcagcaccatcaccacaaaattctt

SEQ ID NO: 535709 - DNA, 25 bp, Mus musculus
gcagcaccatcagcacaaaattctt

SEQ ID NO: 535710 - DNA, 25 bp, Mus musculus
gcagcacccactattaacttctgag

SEQ ID NO: 535711 - DNA, 25 bp, Mus musculus
gcagcacccacttttaacttctgag

SEQ ID NO: 535712 - DNA, 25 bp, Mus musculus
gcagcacccagaatagtctgactaa

SEQ ID NO: 535713 - DNA, 25 bp, Mus musculus
gcagcacccagattagtctgactaa

SEQ ID NO: 535714 - DNA, 25 bp, Mus musculus
gcagcacccagcaggagcatatcgt

SEQ ID NO: 535715 - DNA, 25 bp, Mus musculus
gcagcacccagctggagcatatcgt

SEQ ID NO: 535716 - DNA, 25 bp, Mus musculus
gcagcacccaggacttagttttcac

SEQ ID NO: 535717 - DNA, 25 bp, Mus musculus
gcagcacccaggtcttagttttcac

SEQ ID NO: 535718 - DNA, 25 bp, Mus musculus
gcagcacccatgcattgcaggagat

SEQ ID NO: 535719 - DNA, 25 bp, Mus musculus
gcagcacccatggattgcaggagat

SEQ ID NO: 535720 - DNA, 25 bp, Mus musculus
gcagcacccgttcggatgaggtcat

SEQ ID NO: 535721 - DNA, 25 bp, Mus musculus
gcagcacccgttgggatgaggtcat

SEQ ID NO: 535722 - DNA, 25 bp, Mus musculus
gcagcaccctcacgttgaccaagga

SEQ ID NO: 535723 - DNA, 25 bp, Mus musculus
gcagcaccctcaggttgaccaagga

SEQ ID NO: 535724 - DNA, 25 bp, Mus musculus
gcagcaccgagaatatcatcttcat

SEQ ID NO: 535725 - DNA, 25 bp, Mus musculus
gcagcaccgagattatcatcttcat

SEQ ID NO: 535726 - DNA, 25 bp, Mus musculus
gcagcaccgataatataatttcagg

SEQ ID NO: 535727 - DNA, 25 bp, Mus musculus
gcagcaccgatattataatttcagg

SEQ ID NO: 535728 - DNA, 25 bp, Mus musculus
gcagcaccgcgacattatccagaag

SEQ ID NO: 535729 - DNA, 25 bp, Mus musculus
gcagcaccgcgagattatccagaag

SEQ ID NO: 535730 - DNA, 25 bp, Mus musculus
gcagcaccgctgcactaaggagacc

SEQ ID NO: 535731 - DNA, 25 bp, Mus musculus
gcagcaccgctggactaaggagacc

SEQ ID NO: 535732 - DNA, 25 bp, Mus musculus
gcagcacctccgaagcatcaatgca

SEQ ID NO: 535733 - DNA, 25 bp, Mus musculus
gcagcacctccgtagcatcaatgca

SEQ ID NO: 535734 - DNA, 25 bp, Mus musculus
gcagcacctctactatgaggctgaa

SEQ ID NO: 535735 - DNA, 25 bp, Mus musculus
gcagcacctctagtatgaggctgaa

SEQ ID NO: 535736 - DNA, 25 bp, Mus musculus
gcagcaccttcacaggcttttgatt

SEQ ID NO: 535737 - DNA, 25 bp, Mus musculus
gcagcaccttcagaggcttttgatt

SEQ ID NO: 535738 - DNA, 25 bp, Mus musculus
gcagcacgagtaaccggtcgagcac

SEQ ID NO: 535739 - DNA, 25 bp, Mus musculus
gcagcacgagtatccggtcgagcac

SEQ ID NO: 535740 - DNA, 25 bp, Mus musculus
gcagcacggctgacctctgcagaga

SEQ ID NO: 535741 - DNA, 25 bp, Mus musculus
gcagcacggctgtcctctgcagaga

SEQ ID NO: 535742 - DNA, 25 bp, Mus musculus
gcagcacgggagactagctatcagt

SEQ ID NO: 535743 - DNA, 25 bp, Mus musculus
gcagcacgggagtctagctatcagt

SEQ ID NO: 535744 - DNA, 25 bp, Mus musculus
gcagcacggtgcagcagttcctgaa

SEQ ID NO: 535745 - DNA, 25 bp, Mus musculus
gcagcacggtgctgcagttcctgaa

SEQ ID NO: 535746 - DNA, 25 bp, Mus musculus
gcagcacgtaccacggaggacttat

SEQ ID NO: 535747 - DNA, 25 bp, Mus musculus
gcagcacgtacctcggaggacttat

SEQ ID NO: 535748 - DNA, 25 bp, Mus musculus
gcagcacgtcatcgattacatcttg

SEQ ID NO: 535749 - DNA, 25 bp, Mus musculus
gcagcacgtcatggattacatcttg

SEQ ID NO: 535750 - DNA, 25 bp, Mus musculus
gcagcactccccagttgtgagtgaa

SEQ ID NO: 535751 - DNA, 25 bp, Mus musculus
gcagcactcccctgttgtgagtgaa

SEQ ID NO: 535752 - DNA, 25 bp, Mus musculus
gcagcactctacactcaaggcaaat

SEQ ID NO: 535753 - DNA, 25 bp, Mus musculus
gcagcactctactctcaaggcaaat

SEQ ID NO: 535754 - DNA, 25 bp, Mus musculus
gcagcactgagacacgagtccccta

SEQ ID NO: 535755 - DNA, 25 bp, Mus musculus
gcagcactgagagacgagtccccta

SEQ ID NO: 535756 - DNA, 25 bp, Mus musculus
gcagcactgattccacgaacagcaa

SEQ ID NO: 535757 - DNA, 25 bp, Mus musculus
gcagcactgattgcacgaacagcaa

SEQ ID NO: 535758 - DNA, 25 bp, Mus musculus
gcagcactgcacagatgtagccctt

SEQ ID NO: 535759 - DNA, 25 bp, Mus musculus
gcagcactgcactgatgtagccctt

SEQ ID NO: 535760 - DNA, 25 bp, Mus musculus
gcagcactgctgctctttggaggtc

SEQ ID NO: 535761 - DNA, 25 bp, Mus musculus
gcagcactgctggtctttggaggtc

SEQ ID NO: 535762 - DNA, 25 bp, Mus musculus
gcagcactgcttacatcctatgaga

SEQ ID NO: 535763 - DNA, 25 bp, Mus musculus
gcagcactgctttcatcctatgaga

SEQ ID NO: 535764 - DNA, 25 bp, Mus musculus
gcagcactgtcacgacatggcctgt

SEQ ID NO: 535765 - DNA, 25 bp, Mus musculus
gcagcactgtcaggacatggcctgt

SEQ ID NO: 535766 - DNA, 25 bp, Mus musculus
gcagcactgtctccatatctattcc

SEQ ID NO: 535767 - DNA, 25 bp, Mus musculus
gcagcactgtctgcatatctattcc

SEQ ID NO: 535768 - DNA, 25 bp, Mus musculus
gcagcacttcctatgcttaacattt

SEQ ID NO: 535769 - DNA, 25 bp, Mus musculus
gcagcacttcctttgcttaacattt

SEQ ID NO: 535770 - DNA, 25 bp, Mus musculus
gcagcacttgctcatgtccatgaca

SEQ ID NO: 535771 - DNA, 25 bp, Mus musculus
gcagcacttgctgatgtccatgaca

SEQ ID NO: 535772 - DNA, 25 bp, Mus musculus
gcagcacttgtcaaccatgattctt

SEQ ID NO: 535773 - DNA, 25 bp, Mus musculus
gcagcacttgtctaccatgattctt

SEQ ID NO: 535774 - DNA, 25 bp, Mus musculus
gcagcagaaatgcacctgtgactca

SEQ ID NO: 535775 - DNA, 25 bp, Mus musculus
gcagcagaaatggacctgtgactca

SEQ ID NO: 535776 - DNA, 25 bp, Mus musculus
gcagcagaaattaccagctggaaaa

SEQ ID NO: 535777 - DNA, 25 bp, Mus musculus
gcagcagaaatttccagctggaaaa

SEQ ID NO: 535778 - DNA, 25 bp, Mus musculus
gcagcagaacggagacttgaaagac

SEQ ID NO: 535779 - DNA, 25 bp, Mus musculus
gcagcagaacggtgacttgaaagac

SEQ ID NO: 535780 - DNA, 25 bp, Mus musculus
gcagcagacactctgtacagttttt

SEQ ID NO: 535781 - DNA, 25 bp, Mus musculus
gcagcagacactgtgtacagttttt

SEQ ID NO: 535782 - DNA, 25 bp, Mus musculus
gcagcagacagtactcctttggagg

SEQ ID NO: 535783 - DNA, 25 bp, Mus musculus
gcagcagacagttctcctttggagg

SEQ ID NO: 535784 - DNA, 25 bp, Mus musculus
gcagcagacattactaaacagtagc

SEQ ID NO: 535785 - DNA, 25 bp, Mus musculus
gcagcagacatttctaaacagtagc

SEQ ID NO: 535786 - DNA, 25 bp, Mus musculus
gcagcagaccacactagcctaaagg

SEQ ID NO: 535787 - DNA, 25 bp, Mus musculus
gcagcagaccactctagcctaaagg

SEQ ID NO: 535788 - DNA, 25 bp, Mus musculus
gcagcagaccagctaagcggtgttt

SEQ ID NO: 535789 - DNA, 25 bp, Mus musculus
gcagcagaccaggtaagcggtgttt

SEQ ID NO: 535790 - DNA, 25 bp, Mus musculus
gcagcagacgacaggctcctggtca

SEQ ID NO: 535791 - DNA, 25 bp, Mus musculus
gcagcagacgactggctcctggtca

SEQ ID NO: 535792 - DNA, 25 bp, Mus musculus
gcagcagagaccacatcttttacct

SEQ ID NO: 535793 - DNA, 25 bp, Mus musculus
gcagcagagacctcatcttttacct

SEQ ID NO: 535794 - DNA, 25 bp, Mus musculus
gcagcagagagtaccccgaaactag

SEQ ID NO: 535795 - DNA, 25 bp, Mus musculus
gcagcagagagttccccgaaactag

SEQ ID NO: 535796 - DNA, 25 bp, Mus musculus
gcagcagagataacacaggagaccc

SEQ ID NO: 535797 - DNA, 25 bp, Mus musculus
gcagcagagatatcacaggagaccc

SEQ ID NO: 535798 - DNA, 25 bp, Mus musculus
gcagcagagccaattctggtgtact

SEQ ID NO: 535799 - DNA, 25 bp, Mus musculus
gcagcagagccatttctggtgtact

SEQ ID NO: 535800 - DNA, 25 bp, Mus musculus
gcagcagagctaaccatggattctt

SEQ ID NO: 535801 - DNA, 25 bp, Mus musculus
gcagcagagctatccatggattctt

SEQ ID NO: 535802 - DNA, 25 bp, Mus musculus
gcagcagaggatactccttgatttt

SEQ ID NO: 535803 - DNA, 25 bp, Mus musculus
gcagcagaggattctccttgatttt

SEQ ID NO: 535804 - DNA, 25 bp, Mus musculus
gcagcagagtttcacaagccaggct

SEQ ID NO: 535805 - DNA, 25 bp, Mus musculus
gcagcagagtttgacaagccaggct

SEQ ID NO: 535806 - DNA, 25 bp, Mus musculus
gcagcagatcctacggaatttaaat

SEQ ID NO: 535807 - DNA, 25 bp, Mus musculus
gcagcagatccttcggaatttaaat

SEQ ID NO: 535808 - DNA, 25 bp, Mus musculus
gcagcagatctgaaataagagggag

SEQ ID NO: 535809 - DNA, 25 bp, Mus musculus
gcagcagatctgtaataagagggag

SEQ ID NO: 535810 - DNA, 25 bp, Mus musculus
gcagcagatcttcttgccacaaggc

SEQ ID NO: 535811 - DNA, 25 bp, Mus musculus
gcagcagatcttgttgccacaaggc

SEQ ID NO: 535812 - DNA, 25 bp, Mus musculus
gcagcagatgacattcaccgatcac

SEQ ID NO: 535813 - DNA, 25 bp, Mus musculus
gcagcagatgactttcaccgatcac

SEQ ID NO: 535814 - DNA, 25 bp, Mus musculus
gcagcagatgatcgcacctgtggct

SEQ ID NO: 535815 - DNA, 25 bp, Mus musculus
gcagcagatgatggcacctgtggct

SEQ ID NO: 535816 - DNA, 25 bp, Mus musculus
gcagcagatgcgctactcataacca

SEQ ID NO: 535817 - DNA, 25 bp, Mus musculus
gcagcagatgcggtactcataacca

SEQ ID NO: 535818 - DNA, 25 bp, Mus musculus
gcagcagatgctaacttcgtcatgg

SEQ ID NO: 535819 - DNA, 25 bp, Mus musculus
gcagcagatgcttacttcgtcatgg

SEQ ID NO: 535820 - DNA, 25 bp, Mus musculus
gcagcagcaaagctagcagcgtcct

SEQ ID NO: 535821 - DNA, 25 bp, Mus musculus
gcagcagcaaaggtagcagcgtcct

SEQ ID NO: 535822 - DNA, 25 bp, Mus musculus
gcagcagcaagacgagaccaccgct

SEQ ID NO: 535823 - DNA, 25 bp, Mus musculus
gcagcagcaagaggagaccaccgct

SEQ ID NO: 535824 - DNA, 25 bp, Mus musculus
gcagcagcacccaagggaagactgt

SEQ ID NO: 535825 - DNA, 25 bp, Mus musculus
gcagcagcaccctagggaagactgt

SEQ ID NO: 535826 - DNA, 25 bp, Mus musculus
gcagcagcactcctcattttcgaca

SEQ ID NO: 535827 - DNA, 25 bp, Mus musculus
gcagcagcactcgtcattttcgaca

SEQ ID NO: 535828 - DNA, 25 bp, Mus musculus
gcagcagcacttagcactcaggtga

SEQ ID NO: 535829 - DNA, 25 bp, Mus musculus
gcagcagcactttgcactcaggtga

SEQ ID NO: 535830 - DNA, 25 bp, Mus musculus
gcagcagcagaaccatgaagtgcag

SEQ ID NO: 535831 - DNA, 25 bp, Mus musculus
gcagcagcagaagcatgaagtgcag

SEQ ID NO: 535832 - DNA, 25 bp, Mus musculus
gcagcagcagaccatcagctttgct

SEQ ID NO: 535833 - DNA, 25 bp, Mus musculus
gcagcagcagacgatcagctttgct

SEQ ID NO: 535834 - DNA, 25 bp, Mus musculus
gcagcagcagagacatcgcagggca

SEQ ID NO: 535835 - DNA, 25 bp, Mus musculus
gcagcagcagagattgacaagccag

SEQ ID NO: 535836 - DNA, 25 bp, Mus musculus
gcagcagcagagccatccagaccct

SEQ ID NO: 535837 - DNA, 25 bp, Mus musculus
gcagcagcagaggcatccagaccct

SEQ ID NO: 535838 - DNA, 25 bp, Mus musculus
gcagcagcagagtcatcgcagggca

SEQ ID NO: 535839 - DNA, 25 bp, Mus musculus
gcagcagcagagtttgacaagccag

SEQ ID NO: 535840 - DNA, 25 bp, Mus musculus
gcagcagcagcaacagttccatgac

SEQ ID NO: 535841 - DNA, 25 bp, Mus musculus
gcagcagcagcatcagttccatgac

SEQ ID NO: 535842 - DNA, 25 bp, Mus musculus
gcagcagcaggacactgtcacacca

SEQ ID NO: 535843 - DNA, 25 bp, Mus musculus
gcagcagcaggagactgtcacacca

SEQ ID NO: 535844 - DNA, 25 bp, Mus musculus
gcagcagcaggtatcagatcacatt

SEQ ID NO: 535845 - DNA, 25 bp, Mus musculus
gcagcagcaggtcaacctcctgagt

SEQ ID NO: 535846 - DNA, 25 bp, Mus musculus
gcagcagcaggtgaacctcctgagt

SEQ ID NO: 535847 - DNA, 25 bp, Mus musculus
gcagcagcaggtttcagatcacatt

SEQ ID NO: 535848 - DNA, 25 bp, Mus musculus
gcagcagcagttccatgaccaccag

SEQ ID NO: 535849 - DNA, 25 bp, Mus musculus
gcagcagcagttcctaaagaagatc

SEQ ID NO: 535850 - DNA, 25 bp, Mus musculus
gcagcagcagttgcatgaccaccag

SEQ ID NO: 535851 - DNA, 25 bp, Mus musculus
gcagcagcagttgctaaagaagatc

SEQ ID NO: 535852 - DNA, 25 bp, Mus musculus
gcagcagcatccaaacttattcagc

SEQ ID NO: 535853 - DNA, 25 bp, Mus musculus
gcagcagcatcctaacttattcagc

SEQ ID NO: 535854 - DNA, 25 bp, Mus musculus
gcagcagcattaaacgccatacatt

SEQ ID NO: 535855 - DNA, 25 bp, Mus musculus
gcagcagcattatacgccatacatt

SEQ ID NO: 535856 - DNA, 25 bp, Mus musculus
gcagcagccaagaatcaacaggatt

SEQ ID NO: 535857 - DNA, 25 bp, Mus musculus
gcagcagccaagatccctctgcaaa

SEQ ID NO: 535858 - DNA, 25 bp, Mus musculus
gcagcagccaagtatcaacaggatt

SEQ ID NO: 535859 - DNA, 25 bp, Mus musculus
gcagcagccaagttccctctgcaaa

SEQ ID NO: 535860 - DNA, 25 bp, Mus musculus
gcagcagccaggaaccgatgcggaa

SEQ ID NO: 535861 - DNA, 25 bp, Mus musculus
gcagcagccaggtaccgatgcggaa

SEQ ID NO: 535862 - DNA, 25 bp, Mus musculus
gcagcagcccgtataggtattggtc

SEQ ID NO: 535863 - DNA, 25 bp, Mus musculus
gcagcagcccgtttaggtattggtc

SEQ ID NO: 535864 - DNA, 25 bp, Mus musculus
gcagcagcctcaagactcagtaaca

SEQ ID NO: 535865 - DNA, 25 bp, Mus musculus
gcagcagcctcatgactcagtaaca

SEQ ID NO: 535866 - DNA, 25 bp, Mus musculus
gcagcagcctgtcgtaaacttccat

SEQ ID NO: 535867 - DNA, 25 bp, Mus musculus
gcagcagcctgtggtaaacttccat

SEQ ID NO: 535868 - DNA, 25 bp, Mus musculus
gcagcagcgaagcaccatggagcca

SEQ ID NO: 535869 - DNA, 25 bp, Mus musculus
gcagcagcgaaggaccatggagcca

SEQ ID NO: 535870 - DNA, 25 bp, Mus musculus
gcagcagcgattcacgcccagttcc

SEQ ID NO: 535871 - DNA, 25 bp, Mus musculus
gcagcagcgattgacgcccagttcc

SEQ ID NO: 535872 - DNA, 25 bp, Mus musculus
gcagcagcgtttcgacagcagtgtt

SEQ ID NO: 535873 - DNA, 25 bp, Mus musculus
gcagcagcgtttggacagcagtgtt

SEQ ID NO: 535874 - DNA, 25 bp, Mus musculus
gcagcagctcacataggcaggaatg

SEQ ID NO: 535875 - DNA, 25 bp, Mus musculus
gcagcagctcacttaggcaggaatg

SEQ ID NO: 535876 - DNA, 25 bp, Mus musculus
gcagcagctcagcatgtgaggacac

SEQ ID NO: 535877 - DNA, 25 bp, Mus musculus
gcagcagctcaggatgtgaggacac

SEQ ID NO: 535878 - DNA, 25 bp, Mus musculus
gcagcagctgagacacatgtaagat

SEQ ID NO: 535879 - DNA, 25 bp, Mus musculus
gcagcagctgagtcacatgtaagat

SEQ ID NO: 535880 - DNA, 25 bp, Mus musculus
gcagcagctgatagacgagtaccac

SEQ ID NO: 535881 - DNA, 25 bp, Mus musculus
gcagcagctgatctctatcaaccac

SEQ ID NO: 535882 - DNA, 25 bp, Mus musculus
gcagcagctgatgtctatcaaccac

SEQ ID NO: 535883 - DNA, 25 bp, Mus musculus
gcagcagctgattgacgagtaccac

SEQ ID NO: 535884 - DNA, 25 bp, Mus musculus
gcagcagctgcaaccactgagtgga

SEQ ID NO: 535885 - DNA, 25 bp, Mus musculus
gcagcagctgcatccactgagtgga

SEQ ID NO: 535886 - DNA, 25 bp, Mus musculus
gcagcagctgctcgatctacagagt

SEQ ID NO: 535887 - DNA, 25 bp, Mus musculus
gcagcagctgctggatctacagagt

SEQ ID NO: 535888 - DNA, 25 bp, Mus musculus
gcagcagctgttagaatggcctcaa

SEQ ID NO: 535889 - DNA, 25 bp, Mus musculus
gcagcagctgtttgaatggcctcaa

SEQ ID NO: 535890 - DNA, 25 bp, Mus musculus
gcagcaggaactccatttgcaaaca

SEQ ID NO: 535891 - DNA, 25 bp, Mus musculus
gcagcaggaactgcatttgcaaaca

SEQ ID NO: 535892 - DNA, 25 bp, Mus musculus
gcagcaggacagactacatgaggaa

SEQ ID NO: 535893 - DNA, 25 bp, Mus musculus
gcagcaggacagcagatcaaacccc

SEQ ID NO: 535894 - DNA, 25 bp, Mus musculus
gcagcaggacaggagatcaaacccc

SEQ ID NO: 535895 - DNA, 25 bp, Mus musculus
gcagcaggacagtctacatgaggaa

SEQ ID NO: 535896 - DNA, 25 bp, Mus musculus
gcagcaggactgatacctcgcagat

SEQ ID NO: 535897 - DNA, 25 bp, Mus musculus
gcagcaggactgttacctcgcagat

SEQ ID NO: 535898 - DNA, 25 bp, Mus musculus
gcagcaggagacctcactactcagt

SEQ ID NO: 535899 - DNA, 25 bp, Mus musculus
gcagcaggagacgtcactactcagt

SEQ ID NO: 535900 - DNA, 25 bp, Mus musculus
gcagcaggagctagagagccagaat

SEQ ID NO: 535901 - DNA, 25 bp, Mus musculus
gcagcaggagcttgagagccagaat

SEQ ID NO: 535902 - DNA, 25 bp, Mus musculus
gcagcaggatcacactgcagtccaa

SEQ ID NO: 535903 - DNA, 25 bp, Mus musculus
gcagcaggatcagactgcagtccaa

SEQ ID NO: 535904 - DNA, 25 bp, Mus musculus
gcagcaggcccaagtacccattaac

SEQ ID NO: 535905 - DNA, 25 bp, Mus musculus
gcagcaggcccatgtacccattaac

SEQ ID NO: 535906 - DNA, 25 bp, Mus musculus
gcagcaggccgtcgactttcaggaa

SEQ ID NO: 535907 - DNA, 25 bp, Mus musculus
gcagcaggccgtggactttcaggaa

SEQ ID NO: 535908 - DNA, 25 bp, Mus musculus
gcagcaggcctgatgcttttttata

SEQ ID NO: 535909 - DNA, 25 bp, Mus musculus
gcagcaggcctgttgcttttttata

SEQ ID NO: 535910 - DNA, 25 bp, Mus musculus
gcagcaggcggcagccgcagcttct

SEQ ID NO: 535911 - DNA, 25 bp, Mus musculus
gcagcaggcggctgccgcagcttct

SEQ ID NO: 535912 - DNA, 25 bp, Mus musculus
gcagcaggctaccggacggcaggtt

SEQ ID NO: 535913 - DNA, 25 bp, Mus musculus
gcagcaggctacgggacggcaggtt

SEQ ID NO: 535914 - DNA, 25 bp, Mus musculus
gcagcaggctccctaaagtttgtaa

SEQ ID NO: 535915 - DNA, 25 bp, Mus musculus
gcagcaggctccgtaaagtttgtaa

SEQ ID NO: 535916 - DNA, 25 bp, Mus musculus
gcagcaggctggacactaaacccct

SEQ ID NO: 535917 - DNA, 25 bp, Mus musculus
gcagcaggctggtcactaaacccct

SEQ ID NO: 535918 - DNA, 25 bp, Mus musculus
gcagcagggaacaagcaggcagtta

SEQ ID NO: 535919 - DNA, 25 bp, Mus musculus
gcagcagggaactagcaggcagtta

SEQ ID NO: 535920 - DNA, 25 bp, Mus musculus
gcagcagggacacgacttgctccaa

SEQ ID NO: 535921 - DNA, 25 bp, Mus musculus
gcagcagggacaggacttgctccaa

SEQ ID NO: 535922 - DNA, 25 bp, Mus musculus
gcagcagggaccacttttccttcat

SEQ ID NO: 535923 - DNA, 25 bp, Mus musculus
gcagcagggacctcttttccttcat

SEQ ID NO: 535924 - DNA, 25 bp, Mus musculus
gcagcagggactccactttacctct

SEQ ID NO: 535925 - DNA, 25 bp, Mus musculus
gcagcagggactgcactttacctct

SEQ ID NO: 535926 - DNA, 25 bp, Mus musculus
gcagcagggcgacaaacagctgttt

SEQ ID NO: 535927 - DNA, 25 bp, Mus musculus
gcagcagggcgagaaacagctgttt

SEQ ID NO: 535928 - DNA, 25 bp, Mus musculus
gcagcagggcgccttgtatatgcta

SEQ ID NO: 535929 - DNA, 25 bp, Mus musculus
gcagcagggcgcgttgtatatgcta

SEQ ID NO: 535930 - DNA, 25 bp, Mus musculus
gcagcagggtgccaatgacctttat

SEQ ID NO: 535931 - DNA, 25 bp, Mus musculus
gcagcagggtgcgaatgacctttat

SEQ ID NO: 535932 - DNA, 25 bp, Mus musculus
gcagcaggtaacctttgacctctga

SEQ ID NO: 535933 - DNA, 25 bp, Mus musculus
gcagcaggtaacgtttgacctctga

SEQ ID NO: 535934 - DNA, 25 bp, Mus musculus
gcagcaggtccaacacacagcattt

SEQ ID NO: 535935 - DNA, 25 bp, Mus musculus
gcagcaggtccatcacacagcattt

SEQ ID NO: 535936 - DNA, 25 bp, Mus musculus
gcagcaggtgcacctcataactaat

SEQ ID NO: 535937 - DNA, 25 bp, Mus musculus
gcagcaggtgcagctcataactaat

SEQ ID NO: 535938 - DNA, 25 bp, Mus musculus
gcagcaggtggacccgtttctacac

SEQ ID NO: 535939 - DNA, 25 bp, Mus musculus
gcagcaggtggagccgtttctacac

SEQ ID NO: 535940 - DNA, 25 bp, Mus musculus
gcagcaggtgggaaccataacttat

SEQ ID NO: 535941 - DNA, 25 bp, Mus musculus
gcagcaggtgggtaccataacttat

SEQ ID NO: 535942 - DNA, 25 bp, Mus musculus
gcagcaggttaaataccagtacccc

SEQ ID NO: 535943 - DNA, 25 bp, Mus musculus
gcagcaggttaattaccagtacccc

SEQ ID NO: 535944 - DNA, 25 bp, Mus musculus
gcagcaggttatcagccagcagaaa

SEQ ID NO: 535945 - DNA, 25 bp, Mus musculus
gcagcaggttatgagccagcagaaa

SEQ ID NO: 535946 - DNA, 25 bp, Mus musculus
gcagcaggttccagtctggcacagt

SEQ ID NO: 535947 - DNA, 25 bp, Mus musculus
gcagcaggttcctgtctggcacagt

SEQ ID NO: 535948 - DNA, 25 bp, Mus musculus
gcagcaggttctatcttgcctaaca

SEQ ID NO: 535949 - DNA, 25 bp, Mus musculus
gcagcaggttctttcttgcctaaca

SEQ ID NO: 535950 - DNA, 25 bp, Mus musculus
gcagcaggttggaaagcccagtctt

SEQ ID NO: 535951 - DNA, 25 bp, Mus musculus
gcagcaggttggtaagcccagtctt

SEQ ID NO: 535952 - DNA, 25 bp, Mus musculus
gcagcagtacctcagtgtttccttt

SEQ ID NO: 535953 - DNA, 25 bp, Mus musculus
gcagcagtacctgagtgtttccttt

SEQ ID NO: 535954 - DNA, 25 bp, Mus musculus
gcagcagtacgacccttccacaggg

SEQ ID NO: 535955 - DNA, 25 bp, Mus musculus
gcagcagtacgagccttccacaggg

SEQ ID NO: 535956 - DNA, 25 bp, Mus musculus
gcagcagtacttattaaccaacgga

SEQ ID NO: 535957 - DNA, 25 bp, Mus musculus
gcagcagtactttttaaccaacgga

SEQ ID NO: 535958 - DNA, 25 bp, Mus musculus
gcagcagtagttctaagtctccata

SEQ ID NO: 535959 - DNA, 25 bp, Mus musculus
gcagcagtagttgtaagtctccata

SEQ ID NO: 535960 - DNA, 25 bp, Mus musculus
gcagcagtatctccaggccaaggta

SEQ ID NO: 535961 - DNA, 25 bp, Mus musculus
gcagcagtatctgcaggccaaggta

SEQ ID NO: 535962 - DNA, 25 bp, Mus musculus
gcagcagtatttacaataaccgagc

SEQ ID NO: 535963 - DNA, 25 bp, Mus musculus
gcagcagtattttcaataaccgagc

SEQ ID NO: 535964 - DNA, 25 bp, Mus musculus
gcagcagtcaagagccccggagcgc

SEQ ID NO: 535965 - DNA, 25 bp, Mus musculus
gcagcagtcaagtgccccggagcgc

SEQ ID NO: 535966 - DNA, 25 bp, Mus musculus
gcagcagtccagctgggaatcactt

SEQ ID NO: 535967 - DNA, 25 bp, Mus musculus
gcagcagtccaggtgggaatcactt

SEQ ID NO: 535968 - DNA, 25 bp, Mus musculus
gcagcagtccctaggaagccaagtg

SEQ ID NO: 535969 - DNA, 25 bp, Mus musculus
gcagcagtcccttggaagccaagtg

SEQ ID NO: 535970 - DNA, 25 bp, Mus musculus
gcagcagtcctgaatggtgtttcat

SEQ ID NO: 535971 - DNA, 25 bp, Mus musculus
gcagcagtcctgtatggtgtttcat

SEQ ID NO: 535972 - DNA, 25 bp, Mus musculus
gcagcagtccttctagggttgagct

SEQ ID NO: 535973 - DNA, 25 bp, Mus musculus
gcagcagtccttgtagggttgagct

SEQ ID NO: 535974 - DNA, 25 bp, Mus musculus
gcagcagtctgtacacttgggcgga

SEQ ID NO: 535975 - DNA, 25 bp, Mus musculus
gcagcagtctgttcacttgggcgga

SEQ ID NO: 535976 - DNA, 25 bp, Mus musculus
gcagcagtgaaacacccagagtgat

SEQ ID NO: 535977 - DNA, 25 bp, Mus musculus
gcagcagtgaaagacccagagtgat

SEQ ID NO: 535978 - DNA, 25 bp, Mus musculus
gcagcagtgaagagatgcgccccat

SEQ ID NO: 535979 - DNA, 25 bp, Mus musculus
gcagcagtgaagtgatgcgccccat

SEQ ID NO: 535980 - DNA, 25 bp, Mus musculus
gcagcagtgagcactttatctggga

SEQ ID NO: 535981 - DNA, 25 bp, Mus musculus
gcagcagtgagcagtgactgccctt

SEQ ID NO: 535982 - DNA, 25 bp, Mus musculus
gcagcagtgagcagtgactggcctt

SEQ ID NO: 535983 - DNA, 25 bp, Mus musculus
gcagcagtgagctctttatctggga

SEQ ID NO: 535984 - DNA, 25 bp, Mus musculus
gcagcagtgagctgtgactgccctt

SEQ ID NO: 535985 - DNA, 25 bp, Mus musculus
gcagcagtgagctgtgactggcctt

SEQ ID NO: 535986 - DNA, 25 bp, Mus musculus
gcagcagtgaggaagctatgccaca

SEQ ID NO: 535987 - DNA, 25 bp, Mus musculus
gcagcagtgaggtagctatgccaca

SEQ ID NO: 535988 - DNA, 25 bp, Mus musculus
gcagcagtgccgcatcttcctgtaa

SEQ ID NO: 535989 - DNA, 25 bp, Mus musculus
gcagcagtgccggatcttcctgtaa

SEQ ID NO: 535990 - DNA, 25 bp, Mus musculus
gcagcagtgctacagggaacagatt

SEQ ID NO: 535991 - DNA, 25 bp, Mus musculus
gcagcagtgctagagggaacagatt

SEQ ID NO: 535992 - DNA, 25 bp, Mus musculus
gcagcagtgtcaatcccattgggag

SEQ ID NO: 535993 - DNA, 25 bp, Mus musculus
gcagcagtgtcattcccattgggag

SEQ ID NO: 535994 - DNA, 25 bp, Mus musculus
gcagcagtgtctccgttttatgttt

SEQ ID NO: 535995 - DNA, 25 bp, Mus musculus
gcagcagtgtctgcgttttatgttt

SEQ ID NO: 535996 - DNA, 25 bp, Mus musculus
gcagcagtgtttatcggtagttcaa

SEQ ID NO: 535997 - DNA, 25 bp, Mus musculus
gcagcagtgtttttcggtagttcaa

SEQ ID NO: 535998 - DNA, 25 bp, Mus musculus
gcagcagttacactcttacaaatgg

SEQ ID NO: 535999 - DNA, 25 bp, Mus musculus
gcagcagttacagtcttacaaatgg

SEQ ID NO: 536000 - DNA, 25 bp, Mus musculus
gcagcagttagcattttatttcttc

SEQ ID NO: 536001 - DNA, 25 bp, Mus musculus
gcagcagttagctttttatttcttc

SEQ ID NO: 536002 - DNA, 25 bp, Mus musculus
gcagcagttcaaatggagcccacta

SEQ ID NO: 536003 - DNA, 25 bp, Mus musculus
gcagcagttcaattggagcccacta

SEQ ID NO: 536004 - DNA, 25 bp, Mus musculus
gcagcagttccgctttatctattac

SEQ ID NO: 536005 - DNA, 25 bp, Mus musculus
gcagcagttccggtttatctattac

SEQ ID NO: 536006 - DNA, 25 bp, Mus musculus
gcagcagttgagagctccagtctga

SEQ ID NO: 536007 - DNA, 25 bp, Mus musculus
gcagcagttgagtgctccagtctga

SEQ ID NO: 536008 - DNA, 25 bp, Mus musculus
gcagcagttggcacgggaaacctcc

SEQ ID NO: 536009 - DNA, 25 bp, Mus musculus
gcagcagttggctcgggaaacctcc

SEQ ID NO: 536010 - DNA, 25 bp, Mus musculus
gcagcagtttgacttcttgaaagac

SEQ ID NO: 536011 - DNA, 25 bp, Mus musculus
gcagcagtttgagttcttgaaagac

SEQ ID NO: 536012 - DNA, 25 bp, Mus musculus
gcagcagttttgactttcactattt

SEQ ID NO: 536013 - DNA, 25 bp, Mus musculus
gcagcagttttgtctttcactattt

SEQ ID NO: 536014 - DNA, 25 bp, Mus musculus
gcagcatacatgagagtgaaactaa

SEQ ID NO: 536015 - DNA, 25 bp, Mus musculus
gcagcatacatgtgagtgaaactaa

SEQ ID NO: 536016 - DNA, 25 bp, Mus musculus
gcagcatacttcatcactcaacaaa

SEQ ID NO: 536017 - DNA, 25 bp, Mus musculus
gcagcatacttcttcactcaacaaa

SEQ ID NO: 536018 - DNA, 25 bp, Mus musculus
gcagcatatttgatcttcctagagc

SEQ ID NO: 536019 - DNA, 25 bp, Mus musculus
gcagcatatttgttcttcctagagc

SEQ ID NO: 536020 - DNA, 25 bp, Mus musculus
gcagcatcaagtcatcctatccata

SEQ ID NO: 536021 - DNA, 25 bp, Mus musculus
gcagcatcaagtgatcctatccata

SEQ ID NO: 536022 - DNA, 25 bp, Mus musculus
gcagcatcacagctttgtgcttata

SEQ ID NO: 536023 - DNA, 25 bp, Mus musculus
gcagcatcacaggtttgtgcttata

SEQ ID NO: 536024 - DNA, 25 bp, Mus musculus
gcagcatcacccatgagctgaggtc

SEQ ID NO: 536025 - DNA, 25 bp, Mus musculus
gcagcatcacccttgagctgaggtc

SEQ ID NO: 536026 - DNA, 25 bp, Mus musculus
gcagcatcagcaccgaaagcttcca

SEQ ID NO: 536027 - DNA, 25 bp, Mus musculus
gcagcatcagcagcgaaagcttcca

SEQ ID NO: 536028 - DNA, 25 bp, Mus musculus
gcagcatcagctcggagcctaatga

SEQ ID NO: 536029 - DNA, 25 bp, Mus musculus
gcagcatcagctgggagcctaatga

SEQ ID NO: 536030 - DNA, 25 bp, Mus musculus
gcagcatcaggacttggaaatttct

SEQ ID NO: 536031 - DNA, 25 bp, Mus musculus
gcagcatcaggagttggaaatttct

SEQ ID NO: 536032 - DNA, 25 bp, Mus musculus
gcagcatcattaacagccacaggac

SEQ ID NO: 536033 - DNA, 25 bp, Mus musculus
gcagcatcattatcagccacaggac

SEQ ID NO: 536034 - DNA, 25 bp, Mus musculus
gcagcatccgagacctcagtaacaa

SEQ ID NO: 536035 - DNA, 25 bp, Mus musculus
gcagcatccgagtcctcagtaacaa

SEQ ID NO: 536036 - DNA, 25 bp, Mus musculus
gcagcatccgggatccagttcggaa

SEQ ID NO: 536037 - DNA, 25 bp, Mus musculus
gcagcatccgggttccagttcggaa

SEQ ID NO: 536038 - DNA, 25 bp, Mus musculus
gcagcatcctaacttattcagcatc

SEQ ID NO: 536039 - DNA, 25 bp, Mus musculus
gcagcatcctaagttattcagcatc

SEQ ID NO: 536040 - DNA, 25 bp, Mus musculus
gcagcatcctggctaggaaaagtcc

SEQ ID NO: 536041 - DNA, 25 bp, Mus musculus
gcagcatcctggctcaggactactg

SEQ ID NO: 536042 - DNA, 25 bp, Mus musculus
gcagcatcctgggtaggaaaagtcc

SEQ ID NO: 536043 - DNA, 25 bp, Mus musculus
gcagcatcctgggtcaggactactg

SEQ ID NO: 536044 - DNA, 25 bp, Mus musculus
gcagcatcgctcagtcttgtgatga

SEQ ID NO: 536045 - DNA, 25 bp, Mus musculus
gcagcatcgctctgtcttgtgatga

SEQ ID NO: 536046 - DNA, 25 bp, Mus musculus
gcagcatctaatccatcaagtgagt

SEQ ID NO: 536047 - DNA, 25 bp, Mus musculus
gcagcatctaatgcatcaagtgagt

SEQ ID NO: 536048 - DNA, 25 bp, Mus musculus
gcagcatctcctcaaaatggtgcca

SEQ ID NO: 536049 - DNA, 25 bp, Mus musculus
gcagcatctcctgaaaatggtgcca

SEQ ID NO: 536050 - DNA, 25 bp, Mus musculus
gcagcatctctgcttggatagattg

SEQ ID NO: 536051 - DNA, 25 bp, Mus musculus
gcagcatctctggttggatagattg

SEQ ID NO: 536052 - DNA, 25 bp, Mus musculus
gcagcatctgcaaagcttgcctttt

SEQ ID NO: 536053 - DNA, 25 bp, Mus musculus
gcagcatctgcatagcttgcctttt

SEQ ID NO: 536054 - DNA, 25 bp, Mus musculus
gcagcatcttagacacagtagggta

SEQ ID NO: 536055 - DNA, 25 bp, Mus musculus
gcagcatcttagtcacagtagggta

SEQ ID NO: 536056 - DNA, 25 bp, Mus musculus
gcagcatcttcgaaggcagggccca

SEQ ID NO: 536057 - DNA, 25 bp, Mus musculus
gcagcatcttcgtaggcagggccca

SEQ ID NO: 536058 - DNA, 25 bp, Mus musculus
gcagcatctttaccacagtgtggag

SEQ ID NO: 536059 - DNA, 25 bp, Mus musculus
gcagcatctttagcacagtgtggag

SEQ ID NO: 536060 - DNA, 25 bp, Mus musculus
gcagcatctttcagttcaccattaa

SEQ ID NO: 536061 - DNA, 25 bp, Mus musculus
gcagcatctttctgttcaccattaa

SEQ ID NO: 536062 - DNA, 25 bp, Mus musculus
gcagcatctttgacagggagggcat

SEQ ID NO: 536063 - DNA, 25 bp, Mus musculus
gcagcatctttgtcagggagggcat

SEQ ID NO: 536064 - DNA, 25 bp, Mus musculus
gcagcatcttttctagtttcagtga

SEQ ID NO: 536065 - DNA, 25 bp, Mus musculus
gcagcatcttttgtagtttcagtga

SEQ ID NO: 536066 - DNA, 25 bp, Mus musculus
gcagcatgaatacaagcctccagct

SEQ ID NO: 536067 - DNA, 25 bp, Mus musculus
gcagcatgaatagaagcctccagct

SEQ ID NO: 536068 - DNA, 25 bp, Mus musculus
gcagcatgaccccatggctctcaaa

SEQ ID NO: 536069 - DNA, 25 bp, Mus musculus
gcagcatgacccgatggctctcaaa

SEQ ID NO: 536070 - DNA, 25 bp, Mus musculus
gcagcatgagccaaggtccatatgt

SEQ ID NO: 536071 - DNA, 25 bp, Mus musculus
gcagcatgagcctaggtccatatgt

SEQ ID NO: 536072 - DNA, 25 bp, Mus musculus
gcagcatgaggccactttcaacagt

SEQ ID NO: 536073 - DNA, 25 bp, Mus musculus
gcagcatgaggcgactttcaacagt

SEQ ID NO: 536074 - DNA, 25 bp, Mus musculus
gcagcatgagtcaaaccccagtgga

SEQ ID NO: 536075 - DNA, 25 bp, Mus musculus
gcagcatgagtctaaccccagtgga

SEQ ID NO: 536076 - DNA, 25 bp, Mus musculus
gcagcatgatgtatgtgcacattct

SEQ ID NO: 536077 - DNA, 25 bp, Mus musculus
gcagcatgatgtttgtgcacattct

SEQ ID NO: 536078 - DNA, 25 bp, Mus musculus
gcagcatgcaataattacatcctaa

SEQ ID NO: 536079 - DNA, 25 bp, Mus musculus
gcagcatgcaattattacatcctaa

SEQ ID NO: 536080 - DNA, 25 bp, Mus musculus
gcagcatgcaggcaactgccctgtc

SEQ ID NO: 536081 - DNA, 25 bp, Mus musculus
gcagcatgcagggaactgccctgtc

SEQ ID NO: 536082 - DNA, 25 bp, Mus musculus
gcagcatgcagtctttggctattct

SEQ ID NO: 536083 - DNA, 25 bp, Mus musculus
gcagcatgcagtgtttggctattct

SEQ ID NO: 536084 - DNA, 25 bp, Mus musculus
gcagcatgccatcacagtgccaaaa

SEQ ID NO: 536085 - DNA, 25 bp, Mus musculus
gcagcatgccatgacagtgccaaaa

SEQ ID NO: 536086 - DNA, 25 bp, Mus musculus
gcagcatgccgacttgatctttgag

SEQ ID NO: 536087 - DNA, 25 bp, Mus musculus
gcagcatgccgagttgatctttgag

SEQ ID NO: 536088 - DNA, 25 bp, Mus musculus
gcagcatgcctgatatactcattaa

SEQ ID NO: 536089 - DNA, 25 bp, Mus musculus
gcagcatgcctgttatactcattaa

SEQ ID NO: 536090 - DNA, 25 bp, Mus musculus
gcagcatgcgcccatatcttctgag

SEQ ID NO: 536091 - DNA, 25 bp, Mus musculus
gcagcatgcgccgatatcttctgag

SEQ ID NO: 536092 - DNA, 25 bp, Mus musculus
gcagcatgctggaacttttgcggca

SEQ ID NO: 536093 - DNA, 25 bp, Mus musculus
gcagcatgctggtacttttgcggca

SEQ ID NO: 536094 - DNA, 25 bp, Mus musculus
gcagcatggtcactaacattgtgtc

SEQ ID NO: 536095 - DNA, 25 bp, Mus musculus
gcagcatggtcagtaacattgtgtc

SEQ ID NO: 536096 - DNA, 25 bp, Mus musculus
gcagcatgtctcagctgtgtggatg

SEQ ID NO: 536097 - DNA, 25 bp, Mus musculus
gcagcatgtctctgctgtgtggatg

SEQ ID NO: 536098 - DNA, 25 bp, Mus musculus
gcagcatgtggaagtcttcttccag

SEQ ID NO: 536099 - DNA, 25 bp, Mus musculus
gcagcatgtggatgtcttcttccag

SEQ ID NO: 536100 - DNA, 25 bp, Mus musculus
gcagcattactcaagatgtcataga

SEQ ID NO: 536101 - DNA, 25 bp, Mus musculus
gcagcattactctagatgtcataga

SEQ ID NO: 536102 - DNA, 25 bp, Mus musculus
gcagcattattcaagcagcatccgt

SEQ ID NO: 536103 - DNA, 25 bp, Mus musculus
gcagcattattctagcagcatccgt

SEQ ID NO: 536104 - DNA, 25 bp, Mus musculus
gcagcattcaaacctagtacagcgt

SEQ ID NO: 536105 - DNA, 25 bp, Mus musculus
gcagcattcaaagctagtacagcgt

SEQ ID NO: 536106 - DNA, 25 bp, Mus musculus
gcagcattcctgctctcaatgaaca

SEQ ID NO: 536107 - DNA, 25 bp, Mus musculus
gcagcattcctggtctcaatgaaca

SEQ ID NO: 536108 - DNA, 25 bp, Mus musculus
gcagcattctagagatttccttagt

SEQ ID NO: 536109 - DNA, 25 bp, Mus musculus
gcagcattctagtgatttccttagt

SEQ ID NO: 536110 - DNA, 25 bp, Mus musculus
gcagcattctggctaaagttactca

SEQ ID NO: 536111 - DNA, 25 bp, Mus musculus
gcagcattctgggtaaagttactca

SEQ ID NO: 536112 - DNA, 25 bp, Mus musculus
gcagcattcttgctaggtacacggt

SEQ ID NO: 536113 - DNA, 25 bp, Mus musculus
gcagcattcttggtaggtacacggt

SEQ ID NO: 536114 - DNA, 25 bp, Mus musculus
gcagcattgatgacgcctggcgttg

SEQ ID NO: 536115 - DNA, 25 bp, Mus musculus
gcagcattgatgtcgcctggcgttg

SEQ ID NO: 536116 - DNA, 25 bp, Mus musculus
gcagcattgctaaggtgttgtgtct

SEQ ID NO: 536117 - DNA, 25 bp, Mus musculus
gcagcattgctatggtgttgtgtct

SEQ ID NO: 536118 - DNA, 25 bp, Mus musculus
gcagcattggtcaaaacatggtgac

SEQ ID NO: 536119 - DNA, 25 bp, Mus musculus
gcagcattggtctaaacatggtgac

SEQ ID NO: 536120 - DNA, 25 bp, Mus musculus
gcagcattggttatgcatggccaga

SEQ ID NO: 536121 - DNA, 25 bp, Mus musculus
gcagcattggttttgcatggccaga

SEQ ID NO: 536122 - DNA, 25 bp, Mus musculus
gcagcatttaccaagtttgcagact

SEQ ID NO: 536123 - DNA, 25 bp, Mus musculus
gcagcatttacctagtttgcagact

SEQ ID NO: 536124 - DNA, 25 bp, Mus musculus
gcagcatttataatcgctcctctac

SEQ ID NO: 536125 - DNA, 25 bp, Mus musculus
gcagcatttatattcgctcctctac

SEQ ID NO: 536126 - DNA, 25 bp, Mus musculus
gcagcatttctgagatagacctttg

SEQ ID NO: 536127 - DNA, 25 bp, Mus musculus
gcagcatttctgtgatagacctttg

SEQ ID NO: 536128 - DNA, 25 bp, Mus musculus
gcagcatttcttctcaggcgtttat

SEQ ID NO: 536129 - DNA, 25 bp, Mus musculus
gcagcatttcttgtcaggcgtttat

SEQ ID NO: 536130 - DNA, 25 bp, Mus musculus
gcagcatttggtctagttgcacttt

SEQ ID NO: 536131 - DNA, 25 bp, Mus musculus
gcagcatttggtgtagttgcacttt

SEQ ID NO: 536132 - DNA, 25 bp, Mus musculus
gcagccaaaatccaggcgagtttcc

SEQ ID NO: 536133 - DNA, 25 bp, Mus musculus
gcagccaaaatcgaggcgagtttcc

SEQ ID NO: 536134 - DNA, 25 bp, Mus musculus
gcagccaaattgatctccttacgtt

SEQ ID NO: 536135 - DNA, 25 bp, Mus musculus
gcagccaaattgttctccttacgtt

SEQ ID NO: 536136 - DNA, 25 bp, Mus musculus
gcagccaaccagcaagtaccgagaa

SEQ ID NO: 536137 - DNA, 25 bp, Mus musculus
gcagccaaccaggaagtaccgagaa

SEQ ID NO: 536138 - DNA, 25 bp, Mus musculus
gcagccaacggcaagtggttcgaca

SEQ ID NO: 536139 - DNA, 25 bp, Mus musculus
gcagccaacggctagtggttcgaca

SEQ ID NO: 536140 - DNA, 25 bp, Mus musculus
gcagccaacgtgaactcgtcggcgg

SEQ ID NO: 536141 - DNA, 25 bp, Mus musculus
gcagccaacgtgtactcgtcggcgg

SEQ ID NO: 536142 - DNA, 25 bp, Mus musculus
gcagccaactcaagcttgtgccaga

SEQ ID NO: 536143 - DNA, 25 bp, Mus musculus
gcagccaactcatgcttgtgccaga

SEQ ID NO: 536144 - DNA, 25 bp, Mus musculus
gcagccaactgaacatacccaaaga

SEQ ID NO: 536145 - DNA, 25 bp, Mus musculus
gcagccaactgatcatacccaaaga

SEQ ID NO: 536146 - DNA, 25 bp, Mus musculus
gcagccaacttaatacctgtgctat

SEQ ID NO: 536147 - DNA, 25 bp, Mus musculus
gcagccaacttattacctgtgctat

SEQ ID NO: 536148 - DNA, 25 bp, Mus musculus
gcagccaactttataggcagatttg

SEQ ID NO: 536149 - DNA, 25 bp, Mus musculus
gcagccaactttttaggcagatttg

SEQ ID NO: 536150 - DNA, 25 bp, Mus musculus
gcagccaagatactttttacaattt

SEQ ID NO: 536151 - DNA, 25 bp, Mus musculus
gcagccaagatagtttttacaattt

SEQ ID NO: 536152 - DNA, 25 bp, Mus musculus
gcagccaagcgcactttactgagga

SEQ ID NO: 536153 - DNA, 25 bp, Mus musculus
gcagccaagcgctctttactgagga

SEQ ID NO: 536154 - DNA, 25 bp, Mus musculus
gcagccaaggaaagtgtccaagaca

SEQ ID NO: 536155 - DNA, 25 bp, Mus musculus
gcagccaaggaatgtgtccaagaca

SEQ ID NO: 536156 - DNA, 25 bp, Mus musculus
gcagccaaggctaacttagcagaag

SEQ ID NO: 536157 - DNA, 25 bp, Mus musculus
gcagccaaggcttacttagcagaag

SEQ ID NO: 536158 - DNA, 25 bp, Mus musculus
gcagccaagggtcatacctctggga

SEQ ID NO: 536159 - DNA, 25 bp, Mus musculus
gcagccaagggtgatacctctggga

SEQ ID NO: 536160 - DNA, 25 bp, Mus musculus
gcagccaagtacaagtcagaagcaa

SEQ ID NO: 536161 - DNA, 25 bp, Mus musculus
gcagccaagtactagtcagaagcaa

SEQ ID NO: 536162 - DNA, 25 bp, Mus musculus
gcagccaagtccatgtttgatgatg

SEQ ID NO: 536163 - DNA, 25 bp, Mus musculus
gcagccaagtccttgtttgatgatg

SEQ ID NO: 536164 - DNA, 25 bp, Mus musculus
gcagccaataaactcggtgaaaagc

SEQ ID NO: 536165 - DNA, 25 bp, Mus musculus
gcagccaataaagtcggtgaaaagc

SEQ ID NO: 536166 - DNA, 25 bp, Mus musculus
gcagccaatgaaatgttcatgtcaa

SEQ ID NO: 536167 - DNA, 25 bp, Mus musculus
gcagccaatgaattgttcatgtcaa

SEQ ID NO: 536168 - DNA, 25 bp, Mus musculus
gcagccaatttacacgacctgattt

SEQ ID NO: 536169 - DNA, 25 bp, Mus musculus
gcagccaatttagacgacctgattt

SEQ ID NO: 536170 - DNA, 25 bp, Mus musculus
gcagccacaagaatggttcgtgtct

SEQ ID NO: 536171 - DNA, 25 bp, Mus musculus
gcagccacaagattggttcgtgtct

SEQ ID NO: 536172 - DNA, 25 bp, Mus musculus
gcagccacagataaatcctgagttt

SEQ ID NO: 536173 - DNA, 25 bp, Mus musculus
gcagccacagattaatcctgagttt

SEQ ID NO: 536174 - DNA, 25 bp, Mus musculus
gcagccacaggcaggctcttctcag

SEQ ID NO: 536175 - DNA, 25 bp, Mus musculus
gcagccacaggctggctcttctcag

SEQ ID NO: 536176 - DNA, 25 bp, Mus musculus
gcagccacagtcattgaagccgttc

SEQ ID NO: 536177 - DNA, 25 bp, Mus musculus
gcagccacagtctttgaagccgttc

SEQ ID NO: 536178 - DNA, 25 bp, Mus musculus
gcagccacatagatgtcgcatacag

SEQ ID NO: 536179 - DNA, 25 bp, Mus musculus
gcagccacatagttgtcgcatacag

SEQ ID NO: 536180 - DNA, 25 bp, Mus musculus
gcagccaccgacatggatgcagagg

SEQ ID NO: 536181 - DNA, 25 bp, Mus musculus
gcagccaccgacttggatgcagagg

SEQ ID NO: 536182 - DNA, 25 bp, Mus musculus
gcagccacctgcaagaaactccatg

SEQ ID NO: 536183 - DNA, 25 bp, Mus musculus
gcagccacctgctagaaactccatg

SEQ ID NO: 536184 - DNA, 25 bp, Mus musculus
gcagccaccttcaagtttggccgca

SEQ ID NO: 536185 - DNA, 25 bp, Mus musculus
gcagccaccttctagtttggccgca

SEQ ID NO: 536186 - DNA, 25 bp, Mus musculus
gcagccactgagactcagcagcttg

SEQ ID NO: 536187 - DNA, 25 bp, Mus musculus
gcagccactgagtctcagcagcttg

SEQ ID NO: 536188 - DNA, 25 bp, Mus musculus
gcagccactggcaacggagactgga

SEQ ID NO: 536189 - DNA, 25 bp, Mus musculus
gcagccactggcagggatcttctga

SEQ ID NO: 536190 - DNA, 25 bp, Mus musculus
gcagccactggctacggagactgga

SEQ ID NO: 536191 - DNA, 25 bp, Mus musculus
gcagccactggctgggatcttctga

SEQ ID NO: 536192 - DNA, 25 bp, Mus musculus
gcagccactgtcattgaattttagt

SEQ ID NO: 536193 - DNA, 25 bp, Mus musculus
gcagccactgtctttgaattttagt

SEQ ID NO: 536194 - DNA, 25 bp, Mus musculus
gcagccactgttcgtgaagaccagt

SEQ ID NO: 536195 - DNA, 25 bp, Mus musculus
gcagccactgttggtgaagaccagt

SEQ ID NO: 536196 - DNA, 25 bp, Mus musculus
gcagccagacatcgtacctctagga

SEQ ID NO: 536197 - DNA, 25 bp, Mus musculus
gcagccagacatggtacctctagga

SEQ ID NO: 536198 - DNA, 25 bp, Mus musculus
gcagccagacctcagtaggcagcag

SEQ ID NO: 536199 - DNA, 25 bp, Mus musculus
gcagccagacctgagtaggcagcag

SEQ ID NO: 536200 - DNA, 25 bp, Mus musculus
gcagccagagctctctacaaaacag

SEQ ID NO: 536201 - DNA, 25 bp, Mus musculus
gcagccagagctgtctacaaaacag

SEQ ID NO: 536202 - DNA, 25 bp, Mus musculus
gcagccagagggattaaaagcacca

SEQ ID NO: 536203 - DNA, 25 bp, Mus musculus
gcagccagagggtttaaaagcacca

SEQ ID NO: 536204 - DNA, 25 bp, Mus musculus
gcagccagatctcactgtcagatga

SEQ ID NO: 536205 - DNA, 25 bp, Mus musculus
gcagccagatctgactgtcagatga

SEQ ID NO: 536206 - DNA, 25 bp, Mus musculus
gcagccagcaaaccagcagagttgt

SEQ ID NO: 536207 - DNA, 25 bp, Mus musculus
gcagccagcaaagcagcagagttgt

SEQ ID NO: 536208 - DNA, 25 bp, Mus musculus
gcagccagccctatataagcaagcg

SEQ ID NO: 536209 - DNA, 25 bp, Mus musculus
gcagccagccctttataagcaagcg

SEQ ID NO: 536210 - DNA, 25 bp, Mus musculus
gcagccaggactcttcgatagtgtt

SEQ ID NO: 536211 - DNA, 25 bp, Mus musculus
gcagccaggactgttcgatagtgtt

SEQ ID NO: 536212 - DNA, 25 bp, Mus musculus
gcagccaggagacgccttttctaca

SEQ ID NO: 536213 - DNA, 25 bp, Mus musculus
gcagccaggagaggccttttctaca

SEQ ID NO: 536214 - DNA, 25 bp, Mus musculus
gcagccaggccaagtccagtaagta

SEQ ID NO: 536215 - DNA, 25 bp, Mus musculus
gcagccaggccatgtccagtaagta

SEQ ID NO: 536216 - DNA, 25 bp, Mus musculus
gcagccagggcaaaggtcacacact

SEQ ID NO: 536217 - DNA, 25 bp, Mus musculus
gcagccagggcataggtcacacact

SEQ ID NO: 536218 - DNA, 25 bp, Mus musculus
gcagccaggttgacttctgtagagg

SEQ ID NO: 536219 - DNA, 25 bp, Mus musculus
gcagccaggttgtcttctgtagagg

SEQ ID NO: 536220 - DNA, 25 bp, Mus musculus
gcagccagtaacatctgagacttca

SEQ ID NO: 536221 - DNA, 25 bp, Mus musculus
gcagccagtaacttctgagacttca

SEQ ID NO: 536222 - DNA, 25 bp, Mus musculus
gcagccagtacaatctcatacacat

SEQ ID NO: 536223 - DNA, 25 bp, Mus musculus
gcagccagtacattctcatacacat

SEQ ID NO: 536224 - DNA, 25 bp, Mus musculus
gcagccagtaccactgcacatatat

SEQ ID NO: 536225 - DNA, 25 bp, Mus musculus
gcagccagtacctctgcacatatat

SEQ ID NO: 536226 - DNA, 25 bp, Mus musculus
gcagccagtatccagggacttctaa

SEQ ID NO: 536227 - DNA, 25 bp, Mus musculus
gcagccagtatcgagggacttctaa

SEQ ID NO: 536228 - DNA, 25 bp, Mus musculus
gcagccagtccactggatggcatga

SEQ ID NO: 536229 - DNA, 25 bp, Mus musculus
gcagccagtccagtggatggcatga

SEQ ID NO: 536230 - DNA, 25 bp, Mus musculus
gcagccagtcctcagcgattggtac

SEQ ID NO: 536231 - DNA, 25 bp, Mus musculus
gcagccagtcctgagcgattggtac

SEQ ID NO: 536232 - DNA, 25 bp, Mus musculus
gcagccagtctgataagtttctatt

SEQ ID NO: 536233 - DNA, 25 bp, Mus musculus
gcagccagtctgttaagtttctatt

SEQ ID NO: 536234 - DNA, 25 bp, Mus musculus
gcagccagtgcgaaccagtgaattt

SEQ ID NO: 536235 - DNA, 25 bp, Mus musculus
gcagccagtgcgtaccagtgaattt

SEQ ID NO: 536236 - DNA, 25 bp, Mus musculus
gcagccagtggtcccaagcccaaga

SEQ ID NO: 536237 - DNA, 25 bp, Mus musculus
gcagccagtggtgccaagcccaaga

SEQ ID NO: 536238 - DNA, 25 bp, Mus musculus
gcagccagtgttctttgtcaccagc

SEQ ID NO: 536239 - DNA, 25 bp, Mus musculus
gcagccagtgttgtttgtcaccagc

SEQ ID NO: 536240 - DNA, 25 bp, Mus musculus
gcagccagttcacacatatctactt

SEQ ID NO: 536241 - DNA, 25 bp, Mus musculus
gcagccagttcagacatatctactt

SEQ ID NO: 536242 - DNA, 25 bp, Mus musculus
gcagccagtttcaagccaaatacag

SEQ ID NO: 536243 - DNA, 25 bp, Mus musculus
gcagccagtttctagccaaatacag

SEQ ID NO: 536244 - DNA, 25 bp, Mus musculus
gcagccataagaagggctcgccggt

SEQ ID NO: 536245 - DNA, 25 bp, Mus musculus
gcagccataagatgggctcgccggt

SEQ ID NO: 536246 - DNA, 25 bp, Mus musculus
gcagccatacatctgtgccatgaga

SEQ ID NO: 536247 - DNA, 25 bp, Mus musculus
gcagccatacatgtgtgccatgaga

SEQ ID NO: 536248 - DNA, 25 bp, Mus musculus
gcagccatactcattgccaaactat

SEQ ID NO: 536249 - DNA, 25 bp, Mus musculus
gcagccatactctttgccaaactat

SEQ ID NO: 536250 - DNA, 25 bp, Mus musculus
gcagccatagcgacagcagcaggat

SEQ ID NO: 536251 - DNA, 25 bp, Mus musculus
gcagccatagcgtcagcagcaggat

SEQ ID NO: 536252 - DNA, 25 bp, Mus musculus
gcagccatagctacttttgctactg

SEQ ID NO: 536253 - DNA, 25 bp, Mus musculus
gcagccatagcttcttttgctactg

SEQ ID NO: 536254 - DNA, 25 bp, Mus musculus
gcagccatagtaacattgggccttt

SEQ ID NO: 536255 - DNA, 25 bp, Mus musculus
gcagccatagtatcattgggccttt

SEQ ID NO: 536256 - DNA, 25 bp, Mus musculus
gcagccatcaataaaatccgcatct

SEQ ID NO: 536257 - DNA, 25 bp, Mus musculus
gcagccatcaattaaatccgcatct

SEQ ID NO: 536258 - DNA, 25 bp, Mus musculus
gcagccatcacactaccaaaattgt

SEQ ID NO: 536259 - DNA, 25 bp, Mus musculus
gcagccatcacagtaccaaaattgt

SEQ ID NO: 536260 - DNA, 25 bp, Mus musculus
gcagccatcagactcagatttgcct

SEQ ID NO: 536261 - DNA, 25 bp, Mus musculus
gcagccatcagagtcagatttgcct

SEQ ID NO: 536262 - DNA, 25 bp, Mus musculus
gcagccatccacaggaaagccggat

SEQ ID NO: 536263 - DNA, 25 bp, Mus musculus
gcagccatccactggaaagccggat

SEQ ID NO: 536264 - DNA, 25 bp, Mus musculus
gcagccatccctcgatacatggttc

SEQ ID NO: 536265 - DNA, 25 bp, Mus musculus
gcagccatccctggatacatggttc

SEQ ID NO: 536266 - DNA, 25 bp, Mus musculus
gcagccatcgacactcgcaagctat

SEQ ID NO: 536267 - DNA, 25 bp, Mus musculus
gcagccatcgacactgagaatgtgg

SEQ ID NO: 536268 - DNA, 25 bp, Mus musculus
gcagccatcgactctcgcaagctat

SEQ ID NO: 536269 - DNA, 25 bp, Mus musculus
gcagccatcgactctgagaatgtgg

SEQ ID NO: 536270 - DNA, 25 bp, Mus musculus
gcagccatctaaaaagtttccattg

SEQ ID NO: 536271 - DNA, 25 bp, Mus musculus
gcagccatctaataagtttccattg

SEQ ID NO: 536272 - DNA, 25 bp, Mus musculus
gcagccatgaatctagcgccccagg

SEQ ID NO: 536273 - DNA, 25 bp, Mus musculus
gcagccatgaatgtagcgccccagg

SEQ ID NO: 536274 - DNA, 25 bp, Mus musculus
gcagccatgactacaagcacctgta

SEQ ID NO: 536275 - DNA, 25 bp, Mus musculus
gcagccatgacttcaagcacctgta

SEQ ID NO: 536276 - DNA, 25 bp, Mus musculus
gcagccatgattatgttacggcatc

SEQ ID NO: 536277 - DNA, 25 bp, Mus musculus
gcagccatgattttgttacggcatc

SEQ ID NO: 536278 - DNA, 25 bp, Mus musculus
gcagccatgggcaactttgtggacc

SEQ ID NO: 536279 - DNA, 25 bp, Mus musculus
gcagccatgggctactttgtggacc

SEQ ID NO: 536280 - DNA, 25 bp, Mus musculus
gcagccatgtccagtgatgatcaac

SEQ ID NO: 536281 - DNA, 25 bp, Mus musculus
gcagccatgtcctgtgatgatcaac

SEQ ID NO: 536282 - DNA, 25 bp, Mus musculus
gcagccattccgacgcttgaagaaa

SEQ ID NO: 536283 - DNA, 25 bp, Mus musculus
gcagccattccgtcgcttgaagaaa

SEQ ID NO: 536284 - DNA, 25 bp, Mus musculus
gcagccattctgaacacgttaaaga

SEQ ID NO: 536285 - DNA, 25 bp, Mus musculus
gcagccattctgcatagtcctgtcc

SEQ ID NO: 536286 - DNA, 25 bp, Mus musculus
gcagccattctggatagtcctgtcc

SEQ ID NO: 536287 - DNA, 25 bp, Mus musculus
gcagccattctgtacacgttaaaga

SEQ ID NO: 536288 - DNA, 25 bp, Mus musculus
gcagccattcttcagatcgtagcat

SEQ ID NO: 536289 - DNA, 25 bp, Mus musculus
gcagccattcttgagatcgtagcat

SEQ ID NO: 536290 - DNA, 25 bp, Mus musculus
gcagccattgaacttgattgtcttt

SEQ ID NO: 536291 - DNA, 25 bp, Mus musculus
gcagccattgaagttgattgtcttt

SEQ ID NO: 536292 - DNA, 25 bp, Mus musculus
gcagccattgagcacttcttcttgg

SEQ ID NO: 536293 - DNA, 25 bp, Mus musculus
gcagccattgaggacttcttcttgg

SEQ ID NO: 536294 - DNA, 25 bp, Mus musculus
gcagccattgctagtaattctttaa

SEQ ID NO: 536295 - DNA, 25 bp, Mus musculus
gcagccattgcttgtaattctttaa

SEQ ID NO: 536296 - DNA, 25 bp, Mus musculus
gcagccattgttattatcctagtat

SEQ ID NO: 536297 - DNA, 25 bp, Mus musculus
gcagccattgttctttctaccattg

SEQ ID NO: 536298 - DNA, 25 bp, Mus musculus
gcagccattgttgtttctaccattg

SEQ ID NO: 536299 - DNA, 25 bp, Mus musculus
gcagccattgtttttatcctagtat

SEQ ID NO: 536300 - DNA, 25 bp, Mus musculus
gcagcccaagaaagtctcttttact

SEQ ID NO: 536301 - DNA, 25 bp, Mus musculus
gcagcccaagaatgtctcttttact

SEQ ID NO: 536302 - DNA, 25 bp, Mus musculus
gcagcccaagccagttcttgaaggt

SEQ ID NO: 536303 - DNA, 25 bp, Mus musculus
gcagcccaagcctgttcttgaaggt

SEQ ID NO: 536304 - DNA, 25 bp, Mus musculus
gcagcccaccgacatagcagcttgg

SEQ ID NO: 536305 - DNA, 25 bp, Mus musculus
gcagcccaccgagatagcagcttgg

SEQ ID NO: 536306 - DNA, 25 bp, Mus musculus
gcagcccacctgagcaatcatagga

SEQ ID NO: 536307 - DNA, 25 bp, Mus musculus
gcagcccacctgtgcaatcatagga

SEQ ID NO: 536308 - DNA, 25 bp, Mus musculus
gcagcccacgaaactggccaaggta

SEQ ID NO: 536309 - DNA, 25 bp, Mus musculus
gcagcccacgaatctggccaaggta

SEQ ID NO: 536310 - DNA, 25 bp, Mus musculus
gcagcccacttcatttacatactga

SEQ ID NO: 536311 - DNA, 25 bp, Mus musculus
gcagcccacttcttttacatactga

SEQ ID NO: 536312 - DNA, 25 bp, Mus musculus
gcagcccagaacatggctcaaggag

SEQ ID NO: 536313 - DNA, 25 bp, Mus musculus
gcagcccagaacttggctcaaggag

SEQ ID NO: 536314 - DNA, 25 bp, Mus musculus
gcagcccagagaatcagcccaagaa

SEQ ID NO: 536315 - DNA, 25 bp, Mus musculus
gcagcccagagattcagcccaagaa

SEQ ID NO: 536316 - DNA, 25 bp, Mus musculus
gcagcccaggagcatgtacttaagt

SEQ ID NO: 536317 - DNA, 25 bp, Mus musculus
gcagcccaggaggatgtacttaagt

SEQ ID NO: 536318 - DNA, 25 bp, Mus musculus
gcagcccaggctcaaaacagttcaa

SEQ ID NO: 536319 - DNA, 25 bp, Mus musculus
gcagcccaggctgaaaacagttcaa

SEQ ID NO: 536320 - DNA, 25 bp, Mus musculus
gcagcccagggaatagaagaccatt

SEQ ID NO: 536321 - DNA, 25 bp, Mus musculus
gcagcccagggattagaagaccatt

SEQ ID NO: 536322 - DNA, 25 bp, Mus musculus
gcagcccagtgcaacgagaagtgtg

SEQ ID NO: 536323 - DNA, 25 bp, Mus musculus
gcagcccagtgctacgagaagtgtg

SEQ ID NO: 536324 - DNA, 25 bp, Mus musculus
gcagcccatattctgtctgaaatct

SEQ ID NO: 536325 - DNA, 25 bp, Mus musculus
gcagcccatattgtgtctgaaatct

SEQ ID NO: 536326 - DNA, 25 bp, Mus musculus
gcagcccatcacagctgtgaatgta

SEQ ID NO: 536327 - DNA, 25 bp, Mus musculus
gcagcccatcactgctgtgaatgta

SEQ ID NO: 536328 - DNA, 25 bp, Mus musculus
gcagcccatgcacattctaaaccgg

SEQ ID NO: 536329 - DNA, 25 bp, Mus musculus
gcagcccatgcagattctaaaccgg

SEQ ID NO: 536330 - DNA, 25 bp, Mus musculus
gcagcccatggcacggagctggaat

SEQ ID NO: 536331 - DNA, 25 bp, Mus musculus
gcagcccatggctcggagctggaat

SEQ ID NO: 536332 - DNA, 25 bp, Mus musculus
gcagcccatttgagccagtgaaact

SEQ ID NO: 536333 - DNA, 25 bp, Mus musculus
gcagcccatttgtgccagtgaaact

SEQ ID NO: 536334 - DNA, 25 bp, Mus musculus
gcagccccaacaagctcataatgta

SEQ ID NO: 536335 - DNA, 25 bp, Mus musculus
gcagccccaacatgctcataatgta

SEQ ID NO: 536336 - DNA, 25 bp, Mus musculus
gcagccccaagtacaattgctcctt

SEQ ID NO: 536337 - DNA, 25 bp, Mus musculus
gcagccccaagttcaattgctcctt

SEQ ID NO: 536338 - DNA, 25 bp, Mus musculus
gcagccccacagagatcccaggaga

SEQ ID NO: 536339 - DNA, 25 bp, Mus musculus
gcagccccacagtgatcccaggaga

SEQ ID NO: 536340 - DNA, 25 bp, Mus musculus
gcagccccagagagcaaggtcctga

SEQ ID NO: 536341 - DNA, 25 bp, Mus musculus
gcagccccagagtgcaaggtcctga

SEQ ID NO: 536342 - DNA, 25 bp, Mus musculus
gcagccccagcccttgaaggctatg

SEQ ID NO: 536343 - DNA, 25 bp, Mus musculus
gcagccccagccgttgaaggctatg

SEQ ID NO: 536344 - DNA, 25 bp, Mus musculus
gcagccccatttcctctgataagat

SEQ ID NO: 536345 - DNA, 25 bp, Mus musculus
gcagccccatttgctctgataagat

SEQ ID NO: 536346 - DNA, 25 bp, Mus musculus
gcagccccggacatccagaaagaaa

SEQ ID NO: 536347 - DNA, 25 bp, Mus musculus
gcagccccggacttccagaaagaaa

SEQ ID NO: 536348 - DNA, 25 bp, Mus musculus
gcagccccggagagcttttgatatg

SEQ ID NO: 536349 - DNA, 25 bp, Mus musculus
gcagccccggagtgcttttgatatg

SEQ ID NO: 536350 - DNA, 25 bp, Mus musculus
gcagccccgggaaactgttgtacat

SEQ ID NO: 536351 - DNA, 25 bp, Mus musculus
gcagccccgggatactgttgtacat

SEQ ID NO: 536352 - DNA, 25 bp, Mus musculus
gcagcccctcgaagaactatgtgat

SEQ ID NO: 536353 - DNA, 25 bp, Mus musculus
gcagcccctcgatgaactatgtgat

SEQ ID NO: 536354 - DNA, 25 bp, Mus musculus
gcagcccctgagatataagcacgct

SEQ ID NO: 536355 - DNA, 25 bp, Mus musculus
gcagcccctgagttataagcacgct

SEQ ID NO: 536356 - DNA, 25 bp, Mus musculus
gcagcccctgtactttgattcattt

SEQ ID NO: 536357 - DNA, 25 bp, Mus musculus
gcagcccctgtagtttgattcattt

SEQ ID NO: 536358 - DNA, 25 bp, Mus musculus
gcagccccttgtcgaaagcatggat

SEQ ID NO: 536359 - DNA, 25 bp, Mus musculus
gcagccccttgtggaaagcatggat

SEQ ID NO: 536360 - DNA, 25 bp, Mus musculus
gcagcccgacatccagcttgaacat

SEQ ID NO: 536361 - DNA, 25 bp, Mus musculus
gcagcccgacatgcagcttgaacat

SEQ ID NO: 536362 - DNA, 25 bp, Mus musculus
gcagcccgacgtcatatatttcatt

SEQ ID NO: 536363 - DNA, 25 bp, Mus musculus
gcagcccgacgtgatatatttcatt

SEQ ID NO: 536364 - DNA, 25 bp, Mus musculus
gcagcccgcagaattaaaggaaaag

SEQ ID NO: 536365 - DNA, 25 bp, Mus musculus
gcagcccgcagatttaaaggaaaag

SEQ ID NO: 536366 - DNA, 25 bp, Mus musculus
gcagcccgcataataggcgcagata

SEQ ID NO: 536367 - DNA, 25 bp, Mus musculus
gcagcccgcatattaggcgcagata

SEQ ID NO: 536368 - DNA, 25 bp, Mus musculus
gcagcccgggcactaatcagagatt

SEQ ID NO: 536369 - DNA, 25 bp, Mus musculus
gcagcccgggcagtaatcagagatt

SEQ ID NO: 536370 - DNA, 25 bp, Mus musculus
gcagcccgtggcacccaaagaagag

SEQ ID NO: 536371 - DNA, 25 bp, Mus musculus
gcagcccgtggctcccaaagaagag

SEQ ID NO: 536372 - DNA, 25 bp, Mus musculus
gcagccctacagatacctcatagag

SEQ ID NO: 536373 - DNA, 25 bp, Mus musculus
gcagccctacagttacctcatagag

SEQ ID NO: 536374 - DNA, 25 bp, Mus musculus
gcagccctagaccagcagatgctac

SEQ ID NO: 536375 - DNA, 25 bp, Mus musculus
gcagccctagacgagcagatgctac

SEQ ID NO: 536376 - DNA, 25 bp, Mus musculus
gcagccctagctagcatggcttaga

SEQ ID NO: 536377 - DNA, 25 bp, Mus musculus
gcagccctagcttgcatggcttaga

SEQ ID NO: 536378 - DNA, 25 bp, Mus musculus
gcagccctcaaaagttacctgttga

SEQ ID NO: 536379 - DNA, 25 bp, Mus musculus
gcagccctcaaacatattttcagtg

SEQ ID NO: 536380 - DNA, 25 bp, Mus musculus
gcagccctcaaagatattttcagtg

SEQ ID NO: 536381 - DNA, 25 bp, Mus musculus
gcagccctcaaatgttacctgttga

SEQ ID NO: 536382 - DNA, 25 bp, Mus musculus
gcagccctcactcttttggagaaga

SEQ ID NO: 536383 - DNA, 25 bp, Mus musculus
gcagccctcactgttttggagaaga

SEQ ID NO: 536384 - DNA, 25 bp, Mus musculus
gcagccctctttaaattgttttcgg

SEQ ID NO: 536385 - DNA, 25 bp, Mus musculus
gcagccctcttttaattgttttcgg

SEQ ID NO: 536386 - DNA, 25 bp, Mus musculus
gcagccctgacacgcgtcagacagg

SEQ ID NO: 536387 - DNA, 25 bp, Mus musculus
gcagccctgacaggcgtcagacagg

SEQ ID NO: 536388 - DNA, 25 bp, Mus musculus
gcagccctgagccaataggacaatc

SEQ ID NO: 536389 - DNA, 25 bp, Mus musculus
gcagccctgagcgaataggacaatc

SEQ ID NO: 536390 - DNA, 25 bp, Mus musculus
gcagccctgcaaaagtggaatcact

SEQ ID NO: 536391 - DNA, 25 bp, Mus musculus
gcagccctgcaatagtggaatcact

SEQ ID NO: 536392 - DNA, 25 bp, Mus musculus
gcagccctgcggcatgaacagtgaa

SEQ ID NO: 536393 - DNA, 25 bp, Mus musculus
gcagccctgcgggatgaacagtgaa

SEQ ID NO: 536394 - DNA, 25 bp, Mus musculus
gcagccctgtttacccagatgaaaa

SEQ ID NO: 536395 - DNA, 25 bp, Mus musculus
gcagccctgttttcccagatgaaaa

SEQ ID NO: 536396 - DNA, 25 bp, Mus musculus
gcagcccttagaactaggatactaa

SEQ ID NO: 536397 - DNA, 25 bp, Mus musculus
gcagcccttagatctaggatactaa

SEQ ID NO: 536398 - DNA, 25 bp, Mus musculus
gcagcccttagtatgactgttacat

SEQ ID NO: 536399 - DNA, 25 bp, Mus musculus
gcagcccttagtttgactgttacat

SEQ ID NO: 536400 - DNA, 25 bp, Mus musculus
gcagcccttcacacttgaattggtt

SEQ ID NO: 536401 - DNA, 25 bp, Mus musculus
gcagcccttcactcttgaattggtt

SEQ ID NO: 536402 - DNA, 25 bp, Mus musculus
gcagcccttcctacaagtttaagat

SEQ ID NO: 536403 - DNA, 25 bp, Mus musculus
gcagcccttccttcaagtttaagat

SEQ ID NO: 536404 - DNA, 25 bp, Mus musculus
gcagcccttcgcagtcaaggaaata

SEQ ID NO: 536405 - DNA, 25 bp, Mus musculus
gcagcccttcgctgtcaaggaaata

SEQ ID NO: 536406 - DNA, 25 bp, Mus musculus
gcagcccttggaagttacagccaat

SEQ ID NO: 536407 - DNA, 25 bp, Mus musculus
gcagcccttggaattgcagaatcta

SEQ ID NO: 536408 - DNA, 25 bp, Mus musculus
gcagcccttggatgttacagccaat

SEQ ID NO: 536409 - DNA, 25 bp, Mus musculus
gcagcccttggatttgcagaatcta

SEQ ID NO: 536410 - DNA, 25 bp, Mus musculus
gcagcccttggcaccagagacggat

SEQ ID NO: 536411 - DNA, 25 bp, Mus musculus
gcagcccttggctccagagacggat

SEQ ID NO: 536412 - DNA, 25 bp, Mus musculus
gcagccctttgccagaggacagatg

SEQ ID NO: 536413 - DNA, 25 bp, Mus musculus
gcagccctttgcgagaggacagatg

SEQ ID NO: 536414 - DNA, 25 bp, Mus musculus
gcagccgaaattctgcctacacgga

SEQ ID NO: 536415 - DNA, 25 bp, Mus musculus
gcagccgaaattgtgcctacacgga

SEQ ID NO: 536416 - DNA, 25 bp, Mus musculus
gcagccgaacagactaagtgccttt

SEQ ID NO: 536417 - DNA, 25 bp, Mus musculus
gcagccgaacagtctaagtgccttt

SEQ ID NO: 536418 - DNA, 25 bp, Mus musculus
gcagccgagccaatgttctaaacaa

SEQ ID NO: 536419 - DNA, 25 bp, Mus musculus
gcagccgagccattgttctaaacaa

SEQ ID NO: 536420 - DNA, 25 bp, Mus musculus
gcagccgagctgataccttaaacat

SEQ ID NO: 536421 - DNA, 25 bp, Mus musculus
gcagccgagctgttaccttaaacat

SEQ ID NO: 536422 - DNA, 25 bp, Mus musculus
gcagccgaggagagtcttccacaag

SEQ ID NO: 536423 - DNA, 25 bp, Mus musculus
gcagccgaggagtgtcttccacaag

SEQ ID NO: 536424 - DNA, 25 bp, Mus musculus
gcagccgaggtcaggtgagttacat

SEQ ID NO: 536425 - DNA, 25 bp, Mus musculus
gcagccgaggtctggtgagttacat

SEQ ID NO: 536426 - DNA, 25 bp, Mus musculus
gcagccgcactaaattctcttaaga

SEQ ID NO: 536427 - DNA, 25 bp, Mus musculus
gcagccgcactatattctcttaaga

SEQ ID NO: 536428 - DNA, 25 bp, Mus musculus
gcagccgccgcgatgttgatgccta

SEQ ID NO: 536429 - DNA, 25 bp, Mus musculus
gcagccgccgcgttgttgatgccta

SEQ ID NO: 536430 - DNA, 25 bp, Mus musculus
gcagccgcctccagatttagaacag

SEQ ID NO: 536431 - DNA, 25 bp, Mus musculus
gcagccgcctcctgatttagaacag

SEQ ID NO: 536432 - DNA, 25 bp, Mus musculus
gcagccgccttcctaggaaagtgta

SEQ ID NO: 536433 - DNA, 25 bp, Mus musculus
gcagccgccttcgtaggaaagtgta

SEQ ID NO: 536434 - DNA, 25 bp, Mus musculus
gcagccgcgaccacggatgacaaaa

SEQ ID NO: 536435 - DNA, 25 bp, Mus musculus
gcagccgcgacctcggatgacaaaa

SEQ ID NO: 536436 - DNA, 25 bp, Mus musculus
gcagccgctctgagtacatatttca

SEQ ID NO: 536437 - DNA, 25 bp, Mus musculus
gcagccgctctgtgtacatatttca

SEQ ID NO: 536438 - DNA, 25 bp, Mus musculus
gcagccgctgctcagtacacgagtt

SEQ ID NO: 536439 - DNA, 25 bp, Mus musculus
gcagccgctgctgagtacacgagtt

SEQ ID NO: 536440 - DNA, 25 bp, Mus musculus
gcagccgctggactcccacagagag

SEQ ID NO: 536441 - DNA, 25 bp, Mus musculus
gcagccgctggagtcccacagagag

SEQ ID NO: 536442 - DNA, 25 bp, Mus musculus
gcagccgctggcaatatgaccgata

SEQ ID NO: 536443 - DNA, 25 bp, Mus musculus
gcagccgctggctatatgaccgata

SEQ ID NO: 536444 - DNA, 25 bp, Mus musculus
gcagccggaactatacggtaggatt

SEQ ID NO: 536445 - DNA, 25 bp, Mus musculus
gcagccggaactttacggtaggatt

SEQ ID NO: 536446 - DNA, 25 bp, Mus musculus
gcagccggagctcagacctgctcat

SEQ ID NO: 536447 - DNA, 25 bp, Mus musculus
gcagccggagctgagacctgctcat

SEQ ID NO: 536448 - DNA, 25 bp, Mus musculus
gcagccgggtttaccctgaaggtag

SEQ ID NO: 536449 - DNA, 25 bp, Mus musculus
gcagccgggttttccctgaaggtag

SEQ ID NO: 536450 - DNA, 25 bp, Mus musculus
gcagccgtctatagcgaaccagtga

SEQ ID NO: 536451 - DNA, 25 bp, Mus musculus
gcagccgtctattgcgaaccagtga

SEQ ID NO: 536452 - DNA, 25 bp, Mus musculus
gcagccgtgtataagatgccatctg

SEQ ID NO: 536453 - DNA, 25 bp, Mus musculus
gcagccgtgtattagatgccatctg

SEQ ID NO: 536454 - DNA, 25 bp, Mus musculus
gcagccgtgtggagtcttgctttgc

SEQ ID NO: 536455 - DNA, 25 bp, Mus musculus
gcagccgtgtggtgtcttgctttgc

SEQ ID NO: 536456 - DNA, 25 bp, Mus musculus
gcagccgttcgtcgcgttattggta

SEQ ID NO: 536457 - DNA, 25 bp, Mus musculus
gcagccgttcgtggcgttattggta

SEQ ID NO: 536458 - DNA, 25 bp, Mus musculus
gcagcctaactgaagagagtatcaa

SEQ ID NO: 536459 - DNA, 25 bp, Mus musculus
gcagcctaactgaaggctggaggaa

SEQ ID NO: 536460 - DNA, 25 bp, Mus musculus
gcagcctaactgtagagagtatcaa

SEQ ID NO: 536461 - DNA, 25 bp, Mus musculus
gcagcctaactgtaggctggaggaa

SEQ ID NO: 536462 - DNA, 25 bp, Mus musculus
gcagcctacagtcctaccgcatcaa

SEQ ID NO: 536463 - DNA, 25 bp, Mus musculus
gcagcctacagtgctaccgcatcaa

SEQ ID NO: 536464 - DNA, 25 bp, Mus musculus
gcagcctactagagttggatatcct

SEQ ID NO: 536465 - DNA, 25 bp, Mus musculus
gcagcctactagtgttggatatcct

SEQ ID NO: 536466 - DNA, 25 bp, Mus musculus
gcagcctactggaggattcgaggaa

SEQ ID NO: 536467 - DNA, 25 bp, Mus musculus
gcagcctactggtggattcgaggaa

SEQ ID NO: 536468 - DNA, 25 bp, Mus musculus
gcagcctagattctagccagcctgg

SEQ ID NO: 536469 - DNA, 25 bp, Mus musculus
gcagcctagattgtagccagcctgg

SEQ ID NO: 536470 - DNA, 25 bp, Mus musculus
gcagcctagccccatagcattggct

SEQ ID NO: 536471 - DNA, 25 bp, Mus musculus
gcagcctagcccgatagcattggct

SEQ ID NO: 536472 - DNA, 25 bp, Mus musculus
gcagcctaggccctgggagacaaaa

SEQ ID NO: 536473 - DNA, 25 bp, Mus musculus
gcagcctaggccgtgggagacaaaa

SEQ ID NO: 536474 - DNA, 25 bp, Mus musculus
gcagcctagtagcttagacagttgg

SEQ ID NO: 536475 - DNA, 25 bp, Mus musculus
gcagcctagtaggttagacagttgg

SEQ ID NO: 536476 - DNA, 25 bp, Mus musculus
gcagcctatctgagaatactttctt

SEQ ID NO: 536477 - DNA, 25 bp, Mus musculus
gcagcctatctgtgaatactttctt

SEQ ID NO: 536478 - DNA, 25 bp, Mus musculus
gcagcctatgatctacacaacacag

SEQ ID NO: 536479 - DNA, 25 bp, Mus musculus
gcagcctatgatgtacacaacacag

SEQ ID NO: 536480 - DNA, 25 bp, Mus musculus
gcagcctatgtgcaatgctgtactc

SEQ ID NO: 536481 - DNA, 25 bp, Mus musculus
gcagcctatgtggaatgctgtactc

SEQ ID NO: 536482 - DNA, 25 bp, Mus musculus
gcagcctcaaaaccactcagttcaa

SEQ ID NO: 536483 - DNA, 25 bp, Mus musculus
gcagcctcaaaagcactcagttcaa

SEQ ID NO: 536484 - DNA, 25 bp, Mus musculus
gcagcctcaagtacttctctttttt

SEQ ID NO: 536485 - DNA, 25 bp, Mus musculus
gcagcctcaagttcttctctttttt

SEQ ID NO: 536486 - DNA, 25 bp, Mus musculus
gcagcctcacatctaatgcttacaa

SEQ ID NO: 536487 - DNA, 25 bp, Mus musculus
gcagcctcacatgtaatgcttacaa

SEQ ID NO: 536488 - DNA, 25 bp, Mus musculus
gcagcctcacctatcataggtttta

SEQ ID NO: 536489 - DNA, 25 bp, Mus musculus
gcagcctcacctttcataggtttta

SEQ ID NO: 536490 - DNA, 25 bp, Mus musculus
gcagcctcactcaggtgttagagct

SEQ ID NO: 536491 - DNA, 25 bp, Mus musculus
gcagcctcactctggtgttagagct

SEQ ID NO: 536492 - DNA, 25 bp, Mus musculus
gcagcctcagtgaagaacccagaga

SEQ ID NO: 536493 - DNA, 25 bp, Mus musculus
gcagcctcagtgtagaacccagaga

SEQ ID NO: 536494 - DNA, 25 bp, Mus musculus
gcagcctcagttcccgcctagaaga

SEQ ID NO: 536495 - DNA, 25 bp, Mus musculus
gcagcctcagttgccgcctagaaga

SEQ ID NO: 536496 - DNA, 25 bp, Mus musculus
gcagcctccaagattccagtgagct

SEQ ID NO: 536497 - DNA, 25 bp, Mus musculus
gcagcctccaagtttccagtgagct

SEQ ID NO: 536498 - DNA, 25 bp, Mus musculus
gcagcctcctgaaactagttttgta

SEQ ID NO: 536499 - DNA, 25 bp, Mus musculus
gcagcctcctgatactagttttgta

SEQ ID NO: 536500 - DNA, 25 bp, Mus musculus
gcagcctccttgcttgatttctggg

SEQ ID NO: 536501 - DNA, 25 bp, Mus musculus
gcagcctccttggttgatttctggg

SEQ ID NO: 536502 - DNA, 25 bp, Mus musculus
gcagcctcgagtcactatgcagtgg

SEQ ID NO: 536503 - DNA, 25 bp, Mus musculus
gcagcctcgagtgactatgcagtgg

SEQ ID NO: 536504 - DNA, 25 bp, Mus musculus
gcagcctcggacagttggatgacca

SEQ ID NO: 536505 - DNA, 25 bp, Mus musculus
gcagcctcggactgttggatgacca

SEQ ID NO: 536506 - DNA, 25 bp, Mus musculus
gcagcctcggctagtttgaacttga

SEQ ID NO: 536507 - DNA, 25 bp, Mus musculus
gcagcctcggcttgtttgaacttga

SEQ ID NO: 536508 - DNA, 25 bp, Mus musculus
gcagcctctctcatgaagggttatc

SEQ ID NO: 536509 - DNA, 25 bp, Mus musculus
gcagcctctctcttgaagggttatc

SEQ ID NO: 536510 - DNA, 25 bp, Mus musculus
gcagcctctgagatgggcagtccaa

SEQ ID NO: 536511 - DNA, 25 bp, Mus musculus
gcagcctctgagcaagggagattta

SEQ ID NO: 536512 - DNA, 25 bp, Mus musculus
gcagcctctgaggaagggagattta

SEQ ID NO: 536513 - DNA, 25 bp, Mus musculus
gcagcctctgagttgggcagtccaa

SEQ ID NO: 536514 - DNA, 25 bp, Mus musculus
gcagcctcttgaagtatgacatggg

SEQ ID NO: 536515 - DNA, 25 bp, Mus musculus
gcagcctcttgatgtatgacatggg

SEQ ID NO: 536516 - DNA, 25 bp, Mus musculus
gcagcctcttggataagttgctctc

SEQ ID NO: 536517 - DNA, 25 bp, Mus musculus
gcagcctcttggttaagttgctctc

SEQ ID NO: 536518 - DNA, 25 bp, Mus musculus
gcagcctgaaacagctggatcactg

SEQ ID NO: 536519 - DNA, 25 bp, Mus musculus
gcagcctgaaactgctggatcactg

SEQ ID NO: 536520 - DNA, 25 bp, Mus musculus
gcagcctgaaagaatcactctgtgt

SEQ ID NO: 536521 - DNA, 25 bp, Mus musculus
gcagcctgaaagtatcactctgtgt

SEQ ID NO: 536522 - DNA, 25 bp, Mus musculus
gcagcctgaatacggagtgcctcct

SEQ ID NO: 536523 - DNA, 25 bp, Mus musculus
gcagcctgaatagggagtgcctcct

SEQ ID NO: 536524 - DNA, 25 bp, Mus musculus
gcagcctgaatcctgatctgaggat

SEQ ID NO: 536525 - DNA, 25 bp, Mus musculus
gcagcctgaatcgtgatctgaggat

SEQ ID NO: 536526 - DNA, 25 bp, Mus musculus
gcagcctgatctacatttcaagttc

SEQ ID NO: 536527 - DNA, 25 bp, Mus musculus
gcagcctgatcttcatttcaagttc

SEQ ID NO: 536528 - DNA, 25 bp, Mus musculus
gcagcctgcacgattggaattagaa

SEQ ID NO: 536529 - DNA, 25 bp, Mus musculus
gcagcctgcacgtttggaattagaa

SEQ ID NO: 536530 - DNA, 25 bp, Mus musculus
gcagcctgcagccaggtttttattt

SEQ ID NO: 536531 - DNA, 25 bp, Mus musculus
gcagcctgcagcgaggtttttattt

SEQ ID NO: 536532 - DNA, 25 bp, Mus musculus
gcagcctgccaacgtgtccaaagag

SEQ ID NO: 536533 - DNA, 25 bp, Mus musculus
gcagcctgccaaggtgtccaaagag

SEQ ID NO: 536534 - DNA, 25 bp, Mus musculus
gcagcctgccatagtgaaagtctat

SEQ ID NO: 536535 - DNA, 25 bp, Mus musculus
gcagcctgccattgtgaaagtctat

SEQ ID NO: 536536 - DNA, 25 bp, Mus musculus
gcagcctgccgcagtggacgccgaa

SEQ ID NO: 536537 - DNA, 25 bp, Mus musculus
gcagcctgccgctgtggacgccgaa

SEQ ID NO: 536538 - DNA, 25 bp, Mus musculus
gcagcctgctttagaggtgtgccgc

SEQ ID NO: 536539 - DNA, 25 bp, Mus musculus
gcagcctgcttttgaggtgtgccgc

SEQ ID NO: 536540 - DNA, 25 bp, Mus musculus
gcagcctggagtcgtgccgaccctt

SEQ ID NO: 536541 - DNA, 25 bp, Mus musculus
gcagcctggagtggtgccgaccctt

SEQ ID NO: 536542 - DNA, 25 bp, Mus musculus
gcagcctgggagaaaagatgtcaga

SEQ ID NO: 536543 - DNA, 25 bp, Mus musculus
gcagcctgggagtaaagatgtcaga

SEQ ID NO: 536544 - DNA, 25 bp, Mus musculus
gcagcctgggccaacatagtgcaat

SEQ ID NO: 536545 - DNA, 25 bp, Mus musculus
gcagcctgggcccattcgagcagct

SEQ ID NO: 536546 - DNA, 25 bp, Mus musculus
gcagcctgggccgattcgagcagct

SEQ ID NO: 536547 - DNA, 25 bp, Mus musculus
gcagcctgggcctacatagtgcaat

SEQ ID NO: 536548 - DNA, 25 bp, Mus musculus
gcagcctggtatacaagcatttgtg

SEQ ID NO: 536549 - DNA, 25 bp, Mus musculus
gcagcctggtattcaagcatttgtg

SEQ ID NO: 536550 - DNA, 25 bp, Mus musculus
gcagcctggttcctcgtgagaaata

SEQ ID NO: 536551 - DNA, 25 bp, Mus musculus
gcagcctggttcgtcgtgagaaata

SEQ ID NO: 536552 - DNA, 25 bp, Mus musculus
gcagcctgtaccatagcgtgacaga

SEQ ID NO: 536553 - DNA, 25 bp, Mus musculus
gcagcctgtaccttagcgtgacaga

SEQ ID NO: 536554 - DNA, 25 bp, Mus musculus
gcagcctgtgctatggagtaagttc

SEQ ID NO: 536555 - DNA, 25 bp, Mus musculus
gcagcctgtgctttggagtaagttc

SEQ ID NO: 536556 - DNA, 25 bp, Mus musculus
gcagcctgtgtcattagaggaagca

SEQ ID NO: 536557 - DNA, 25 bp, Mus musculus
gcagcctgtgtctttagaggaagca

SEQ ID NO: 536558 - DNA, 25 bp, Mus musculus
gcagccttagaaagtgaagcacaat

SEQ ID NO: 536559 - DNA, 25 bp, Mus musculus
gcagccttagaatgtgaagcacaat

SEQ ID NO: 536560 - DNA, 25 bp, Mus musculus
gcagccttagcacccgaaatgaact

SEQ ID NO: 536561 - DNA, 25 bp, Mus musculus
gcagccttagcagccgaaatgaact

SEQ ID NO: 536562 - DNA, 25 bp, Mus musculus
gcagccttatgtcccaggaccatgg

SEQ ID NO: 536563 - DNA, 25 bp, Mus musculus
gcagccttatgtgccaggaccatgg

SEQ ID NO: 536564 - DNA, 25 bp, Mus musculus
gcagccttcacaaagctaagagtta

SEQ ID NO: 536565 - DNA, 25 bp, Mus musculus
gcagccttcacatagctaagagtta

SEQ ID NO: 536566 - DNA, 25 bp, Mus musculus
gcagccttcaggagtcataatcata

SEQ ID NO: 536567 - DNA, 25 bp, Mus musculus
gcagccttcaggtgtcataatcata

SEQ ID NO: 536568 - DNA, 25 bp, Mus musculus
gcagccttcatgaaattggacacac

SEQ ID NO: 536569 - DNA, 25 bp, Mus musculus
gcagccttcatgtaattggacacac

SEQ ID NO: 536570 - DNA, 25 bp, Mus musculus
gcagccttcccaaaattaggtgctt

SEQ ID NO: 536571 - DNA, 25 bp, Mus musculus
gcagccttcccataattaggtgctt

SEQ ID NO: 536572 - DNA, 25 bp, Mus musculus
gcagccttcctcaaaaagtccggga

SEQ ID NO: 536573 - DNA, 25 bp, Mus musculus
gcagccttcctctaaaagtccggga

SEQ ID NO: 536574 - DNA, 25 bp, Mus musculus
gcagccttccttacgaacatgtatt

SEQ ID NO: 536575 - DNA, 25 bp, Mus musculus
gcagccttccttcagtttctttatg

SEQ ID NO: 536576 - DNA, 25 bp, Mus musculus
gcagccttccttgagtttctttatg

SEQ ID NO: 536577 - DNA, 25 bp, Mus musculus
gcagccttcctttcgaacatgtatt

SEQ ID NO: 536578 - DNA, 25 bp, Mus musculus
gcagccttcgaacacaaaaggtgag

SEQ ID NO: 536579 - DNA, 25 bp, Mus musculus
gcagccttcgaagacaaaaggtgag

SEQ ID NO: 536580 - DNA, 25 bp, Mus musculus
gcagccttgattatattgctacaca

SEQ ID NO: 536581 - DNA, 25 bp, Mus musculus
gcagccttgattatggagcagcgta

SEQ ID NO: 536582 - DNA, 25 bp, Mus musculus
gcagccttgattttattgctacaca

SEQ ID NO: 536583 - DNA, 25 bp, Mus musculus
gcagccttgattttggagcagcgta

SEQ ID NO: 536584 - DNA, 25 bp, Mus musculus
gcagccttgctacgtcctaagaatt

SEQ ID NO: 536585 - DNA, 25 bp, Mus musculus
gcagccttgctaggtcctaagaatt

SEQ ID NO: 536586 - DNA, 25 bp, Mus musculus
gcagccttggcaacctttgaactat

SEQ ID NO: 536587 - DNA, 25 bp, Mus musculus
gcagccttggcatcctttgaactat

SEQ ID NO: 536588 - DNA, 25 bp, Mus musculus
gcagccttgtgtcgaacacagcttt

SEQ ID NO: 536589 - DNA, 25 bp, Mus musculus
gcagccttgtgtggaacacagcttt

SEQ ID NO: 536590 - DNA, 25 bp, Mus musculus
gcagcctttacccaaattatcaaca

SEQ ID NO: 536591 - DNA, 25 bp, Mus musculus
gcagcctttaccgaaattatcaaca

SEQ ID NO: 536592 - DNA, 25 bp, Mus musculus
gcagcctttagacccagagtaggta

SEQ ID NO: 536593 - DNA, 25 bp, Mus musculus
gcagcctttagagccagagtaggta

SEQ ID NO: 536594 - DNA, 25 bp, Mus musculus
gcagcctttatacgaaaccctcctg

SEQ ID NO: 536595 - DNA, 25 bp, Mus musculus
gcagcctttataggaaaccctcctg

SEQ ID NO: 536596 - DNA, 25 bp, Mus musculus
gcagcctttgaacccgcatacagat

SEQ ID NO: 536597 - DNA, 25 bp, Mus musculus
gcagcctttgaagccgcatacagat

SEQ ID NO: 536598 - DNA, 25 bp, Mus musculus
gcagcctttgtgaaccaacacctgt

SEQ ID NO: 536599 - DNA, 25 bp, Mus musculus
gcagcctttgtgtaccaacacctgt

SEQ ID NO: 536600 - DNA, 25 bp, Mus musculus
gcagcgaaactgatgcagaccatga

SEQ ID NO: 536601 - DNA, 25 bp, Mus musculus
gcagcgaaactgttgcagaccatga

SEQ ID NO: 536602 - DNA, 25 bp, Mus musculus
gcagcgaaagccctgtgacacgatg

SEQ ID NO: 536603 - DNA, 25 bp, Mus musculus
gcagcgaaagccgtgtgacacgatg

SEQ ID NO: 536604 - DNA, 25 bp, Mus musculus
gcagcgacagcaatgttgggacaga

SEQ ID NO: 536605 - DNA, 25 bp, Mus musculus
gcagcgacagcattgttgggacaga

SEQ ID NO: 536606 - DNA, 25 bp, Mus musculus
gcagcgacagctataaaacaccagg

SEQ ID NO: 536607 - DNA, 25 bp, Mus musculus
gcagcgacagctttaaaacaccagg

SEQ ID NO: 536608 - DNA, 25 bp, Mus musculus
gcagcgacgtttactgttttcctca

SEQ ID NO: 536609 - DNA, 25 bp, Mus musculus
gcagcgacgttttctgttttcctca

SEQ ID NO: 536610 - DNA, 25 bp, Mus musculus
gcagcgactctcctaagatactcag

SEQ ID NO: 536611 - DNA, 25 bp, Mus musculus
gcagcgactctcgtaagatactcag

SEQ ID NO: 536612 - DNA, 25 bp, Mus musculus
gcagcgagcagtacccgccggacta

SEQ ID NO: 536613 - DNA, 25 bp, Mus musculus
gcagcgagcagttcccgccggacta

SEQ ID NO: 536614 - DNA, 25 bp, Mus musculus
gcagcgagccggacccagaacagga

SEQ ID NO: 536615 - DNA, 25 bp, Mus musculus
gcagcgagccggtcccagaacagga

SEQ ID NO: 536616 - DNA, 25 bp, Mus musculus
gcagcgagtctaagtgttccctaag

SEQ ID NO: 536617 - DNA, 25 bp, Mus musculus
gcagcgagtctatgtgttccctaag

SEQ ID NO: 536618 - DNA, 25 bp, Mus musculus
gcagcgagttttcgtgttgcacttt

SEQ ID NO: 536619 - DNA, 25 bp, Mus musculus
gcagcgagttttggtgttgcacttt

SEQ ID NO: 536620 - DNA, 25 bp, Mus musculus
gcagcgatattgcaagccagtcctc

SEQ ID NO: 536621 - DNA, 25 bp, Mus musculus
gcagcgatattggaagccagtcctc

SEQ ID NO: 536622 - DNA, 25 bp, Mus musculus
gcagcgatctagattcattaaaaaa

SEQ ID NO: 536623 - DNA, 25 bp, Mus musculus
gcagcgatctagtttcattaaaaaa

SEQ ID NO: 536624 - DNA, 25 bp, Mus musculus
gcagcgatgaacagacgacttatca

SEQ ID NO: 536625 - DNA, 25 bp, Mus musculus
gcagcgatgaactgacgacttatca

SEQ ID NO: 536626 - DNA, 25 bp, Mus musculus
gcagcgatgaagatttcctaatgga

SEQ ID NO: 536627 - DNA, 25 bp, Mus musculus
gcagcgatgaagttttcctaatgga

SEQ ID NO: 536628 - DNA, 25 bp, Mus musculus
gcagcgatggctacggcagtcacga

SEQ ID NO: 536629 - DNA, 25 bp, Mus musculus
gcagcgatggcttcggcagtcacga

SEQ ID NO: 536630 - DNA, 25 bp, Mus musculus
gcagcgcaaagaaatccgtgagcaa

SEQ ID NO: 536631 - DNA, 25 bp, Mus musculus
gcagcgcaaagatatccgtgagcaa

SEQ ID NO: 536632 - DNA, 25 bp, Mus musculus
gcagcgcaatctccaacggaagcga

SEQ ID NO: 536633 - DNA, 25 bp, Mus musculus
gcagcgcaatctgcaacggaagcga

SEQ ID NO: 536634 - DNA, 25 bp, Mus musculus
gcagcgcaccctaaaaagttcgagt

SEQ ID NO: 536635 - DNA, 25 bp, Mus musculus
gcagcgcacccttaaaagttcgagt

SEQ ID NO: 536636 - DNA, 25 bp, Mus musculus
gcagcgcagggaacgttatgattct

SEQ ID NO: 536637 - DNA, 25 bp, Mus musculus
gcagcgcagggatcgttatgattct

SEQ ID NO: 536638 - DNA, 25 bp, Mus musculus
gcagcgcagtataagaaggccctag

SEQ ID NO: 536639 - DNA, 25 bp, Mus musculus
gcagcgcagtattagaaggccctag

SEQ ID NO: 536640 - DNA, 25 bp, Mus musculus
gcagcgcataatcgatgccctctga

SEQ ID NO: 536641 - DNA, 25 bp, Mus musculus
gcagcgcataatggatgccctctga

SEQ ID NO: 536642 - DNA, 25 bp, Mus musculus
gcagcgcatctaagctgagcgacga

SEQ ID NO: 536643 - DNA, 25 bp, Mus musculus
gcagcgcatctatgctgagcgacga

SEQ ID NO: 536644 - DNA, 25 bp, Mus musculus
gcagcgcatcttaccgtagggcagg

SEQ ID NO: 536645 - DNA, 25 bp, Mus musculus
gcagcgcatctttccgtagggcagg

SEQ ID NO: 536646 - DNA, 25 bp, Mus musculus
gcagcgccaatacctatagaacacc

SEQ ID NO: 536647 - DNA, 25 bp, Mus musculus
gcagcgccaatagctatagaacacc

SEQ ID NO: 536648 - DNA, 25 bp, Mus musculus
gcagcgcctggcctatccaagagct

SEQ ID NO: 536649 - DNA, 25 bp, Mus musculus
gcagcgcctggcgtatccaagagct

SEQ ID NO: 536650 - DNA, 25 bp, Mus musculus
gcagcgcctgggaagaagaattaac

SEQ ID NO: 536651 - DNA, 25 bp, Mus musculus
gcagcgcctgggtagaagaattaac

SEQ ID NO: 536652 - DNA, 25 bp, Mus musculus
gcagcgcgaaggctagcatcgccca

SEQ ID NO: 536653 - DNA, 25 bp, Mus musculus
gcagcgcgaagggtagcatcgccca

SEQ ID NO: 536654 - DNA, 25 bp, Mus musculus
gcagcgcgccggaatttgtagtctc

SEQ ID NO: 536655 - DNA, 25 bp, Mus musculus
gcagcgcgccggtatttgtagtctc

SEQ ID NO: 536656 - DNA, 25 bp, Mus musculus
gcagcgctatgcaattcttaatttt

SEQ ID NO: 536657 - DNA, 25 bp, Mus musculus
gcagcgctatgctattcttaatttt

SEQ ID NO: 536658 - DNA, 25 bp, Mus musculus
gcagcgctcagcacaattagaatat

SEQ ID NO: 536659 - DNA, 25 bp, Mus musculus
gcagcgctcagctcaattagaatat

SEQ ID NO: 536660 - DNA, 25 bp, Mus musculus
gcagcgctccatcagaggtggttac

SEQ ID NO: 536661 - DNA, 25 bp, Mus musculus
gcagcgctccatgagaggtggttac

SEQ ID NO: 536662 - DNA, 25 bp, Mus musculus
gcagcgctgaacaggaaagattttt

SEQ ID NO: 536663 - DNA, 25 bp, Mus musculus
gcagcgctgaactggaaagattttt

SEQ ID NO: 536664 - DNA, 25 bp, Mus musculus
gcagcgctggccaggatatcatcag

SEQ ID NO: 536665 - DNA, 25 bp, Mus musculus
gcagcgctggcctggatatcatcag

SEQ ID NO: 536666 - DNA, 25 bp, Mus musculus
gcagcgctgtgtcagctcatgccag

SEQ ID NO: 536667 - DNA, 25 bp, Mus musculus
gcagcgctgtgtgagctcatgccag

SEQ ID NO: 536668 - DNA, 25 bp, Mus musculus
gcagcgcttcatactatgttgttga

SEQ ID NO: 536669 - DNA, 25 bp, Mus musculus
gcagcgcttcattctatgttgttga

SEQ ID NO: 536670 - DNA, 25 bp, Mus musculus
gcagcggacgagcatgttttctccc

SEQ ID NO: 536671 - DNA, 25 bp, Mus musculus
gcagcggacgaggatgttttctccc

SEQ ID NO: 536672 - DNA, 25 bp, Mus musculus
gcagcggatagccaagttggtcatc

SEQ ID NO: 536673 - DNA, 25 bp, Mus musculus
gcagcggatagcgaagttggtcatc

SEQ ID NO: 536674 - DNA, 25 bp, Mus musculus
gcagcggcagctagaccacgagttg

SEQ ID NO: 536675 - DNA, 25 bp, Mus musculus
gcagcggcagcttgaccacgagttg

SEQ ID NO: 536676 - DNA, 25 bp, Mus musculus
gcagcggcatgcctttatccaatgg

SEQ ID NO: 536677 - DNA, 25 bp, Mus musculus
gcagcggcatgcgtttatccaatgg

SEQ ID NO: 536678 - DNA, 25 bp, Mus musculus
gcagcggcccttaagttatcacgag

SEQ ID NO: 536679 - DNA, 25 bp, Mus musculus
gcagcggccctttagttatcacgag

SEQ ID NO: 536680 - DNA, 25 bp, Mus musculus
gcagcggccgagctgagtgccaagg

SEQ ID NO: 536681 - DNA, 25 bp, Mus musculus
gcagcggccgaggtgagtgccaagg

SEQ ID NO: 536682 - DNA, 25 bp, Mus musculus
gcagcggcgatacttctacttgttc

SEQ ID NO: 536683 - DNA, 25 bp, Mus musculus
gcagcggcgatagttctacttgttc

SEQ ID NO: 536684 - DNA, 25 bp, Mus musculus
gcagcggctaaaacagtcacccaaa

SEQ ID NO: 536685 - DNA, 25 bp, Mus musculus
gcagcggctaaatcagtcacccaaa

SEQ ID NO: 536686 - DNA, 25 bp, Mus musculus
gcagcggctcatagtttatgtaaag

SEQ ID NO: 536687 - DNA, 25 bp, Mus musculus
gcagcggctcattgtttatgtaaag

SEQ ID NO: 536688 - DNA, 25 bp, Mus musculus
gcagcggctccactgtcaaatttgt

SEQ ID NO: 536689 - DNA, 25 bp, Mus musculus
gcagcggctccagtgtcaaatttgt

SEQ ID NO: 536690 - DNA, 25 bp, Mus musculus
gcagcggcttcacagacagtgtacc

SEQ ID NO: 536691 - DNA, 25 bp, Mus musculus
gcagcggcttcagagacagtgtacc

SEQ ID NO: 536692 - DNA, 25 bp, Mus musculus
gcagcggctttacaaggatgaccag

SEQ ID NO: 536693 - DNA, 25 bp, Mus musculus
gcagcggctttagaaggatgaccag

SEQ ID NO: 536694 - DNA, 25 bp, Mus musculus
gcagcgggagctacgcaagtatacc

SEQ ID NO: 536695 - DNA, 25 bp, Mus musculus
gcagcgggagcttcgcaagtatacc

SEQ ID NO: 536696 - DNA, 25 bp, Mus musculus
gcagcgggttccatttgtgcttcct

SEQ ID NO: 536697 - DNA, 25 bp, Mus musculus
gcagcgggttccttttgtgcttcct

SEQ ID NO: 536698 - DNA, 25 bp, Mus musculus
gcagcggtcatccatgtgggaataa

SEQ ID NO: 536699 - DNA, 25 bp, Mus musculus
gcagcggtcatcgatgtgggaataa

SEQ ID NO: 536700 - DNA, 25 bp, Mus musculus
gcagcggtccttacatgtacagtga

SEQ ID NO: 536701 - DNA, 25 bp, Mus musculus
gcagcggtcctttcatgtacagtga

SEQ ID NO: 536702 - DNA, 25 bp, Mus musculus
gcagcggtctgtcaacatcctggat

SEQ ID NO: 536703 - DNA, 25 bp, Mus musculus
gcagcggtctgtgaacatcctggat

SEQ ID NO: 536704 - DNA, 25 bp, Mus musculus
gcagcggtgaccaacatcaacgaga

SEQ ID NO: 536705 - DNA, 25 bp, Mus musculus
gcagcggtgacctacatcaacgaga

SEQ ID NO: 536706 - DNA, 25 bp, Mus musculus
gcagcggtgataaatttgatatggt

SEQ ID NO: 536707 - DNA, 25 bp, Mus musculus
gcagcggtgatatatttgatatggt

SEQ ID NO: 536708 - DNA, 25 bp, Mus musculus
gcagcggtgcgcatagcagcaaatt

SEQ ID NO: 536709 - DNA, 25 bp, Mus musculus
gcagcggtgcgcttagcagcaaatt

SEQ ID NO: 536710 - DNA, 25 bp, Mus musculus
gcagcggttttacatatgcaacaca

SEQ ID NO: 536711 - DNA, 25 bp, Mus musculus
gcagcggttttagatatgcaacaca

SEQ ID NO: 536712 - DNA, 25 bp, Mus musculus
gcagcgtaggccagttatgccctgc

SEQ ID NO: 536713 - DNA, 25 bp, Mus musculus
gcagcgtaggcctgttatgccctgc

SEQ ID NO: 536714 - DNA, 25 bp, Mus musculus
gcagcgtaggctagaaccacaccga

SEQ ID NO: 536715 - DNA, 25 bp, Mus musculus
gcagcgtaggcttgaaccacaccga

SEQ ID NO: 536716 - DNA, 25 bp, Mus musculus
gcagcgtcagcaaattcagcatctt

SEQ ID NO: 536717 - DNA, 25 bp, Mus musculus
gcagcgtcagcacgactggcagaaa

SEQ ID NO: 536718 - DNA, 25 bp, Mus musculus
gcagcgtcagcaggactggcagaaa

SEQ ID NO: 536719 - DNA, 25 bp, Mus musculus
gcagcgtcagcatattcagcatctt

SEQ ID NO: 536720 - DNA, 25 bp, Mus musculus
gcagcgtccaccagaacacagttat

SEQ ID NO: 536721 - DNA, 25 bp, Mus musculus
gcagcgtccacctgaacacagttat

SEQ ID NO: 536722 - DNA, 25 bp, Mus musculus
gcagcgtccatgcaccaagtgagaa

SEQ ID NO: 536723 - DNA, 25 bp, Mus musculus
gcagcgtccatggaccaagtgagaa

SEQ ID NO: 536724 - DNA, 25 bp, Mus musculus
gcagcgtctctccttactaagaata

SEQ ID NO: 536725 - DNA, 25 bp, Mus musculus
gcagcgtctctcgttactaagaata

SEQ ID NO: 536726 - DNA, 25 bp, Mus musculus
gcagcgtgctgaccgatctaaccca

SEQ ID NO: 536727 - DNA, 25 bp, Mus musculus
gcagcgtgctgagcgatctaaccca

SEQ ID NO: 536728 - DNA, 25 bp, Mus musculus
gcagcgtggcatatctgttatacaa

SEQ ID NO: 536729 - DNA, 25 bp, Mus musculus
gcagcgtggcatttctgttatacaa

SEQ ID NO: 536730 - DNA, 25 bp, Mus musculus
gcagcgtgtgcgacaacacgcgaca

SEQ ID NO: 536731 - DNA, 25 bp, Mus musculus
gcagcgtgtgcgtcaacacgcgaca

SEQ ID NO: 536732 - DNA, 25 bp, Mus musculus
gcagcgtgtgctatcttattcttat

SEQ ID NO: 536733 - DNA, 25 bp, Mus musculus
gcagcgtgtgctttcttattcttat

SEQ ID NO: 536734 - DNA, 25 bp, Mus musculus
gcagcgttacagactaagttagcaa

SEQ ID NO: 536735 - DNA, 25 bp, Mus musculus
gcagcgttacagtctaagttagcaa

SEQ ID NO: 536736 - DNA, 25 bp, Mus musculus
gcagcgttgtttccaagccacttat

SEQ ID NO: 536737 - DNA, 25 bp, Mus musculus
gcagcgttgtttgcaagccacttat

SEQ ID NO: 536738 - DNA, 25 bp, Mus musculus
gcagcgtttaatagaagtccaggat

SEQ ID NO: 536739 - DNA, 25 bp, Mus musculus
gcagcgtttaattgaagtccaggat

SEQ ID NO: 536740 - DNA, 25 bp, Mus musculus
gcagcgtttgaaagctcagttctta

SEQ ID NO: 536741 - DNA, 25 bp, Mus musculus
gcagcgtttgaatgctcagttctta

SEQ ID NO: 536742 - DNA, 25 bp, Mus musculus
gcagcgtttgacagtaaccatagtg

SEQ ID NO: 536743 - DNA, 25 bp, Mus musculus
gcagcgtttgactgtaaccatagtg

SEQ ID NO: 536744 - DNA, 25 bp, Mus musculus
gcagcgtttgggagtagacttgcca

SEQ ID NO: 536745 - DNA, 25 bp, Mus musculus
gcagcgtttgggtgtagacttgcca

SEQ ID NO: 536746 - DNA, 25 bp, Mus musculus
gcagcgtttgtaactttgtcacagt

SEQ ID NO: 536747 - DNA, 25 bp, Mus musculus
gcagcgtttgtatctttgtcacagt

SEQ ID NO: 536748 - DNA, 25 bp, Mus musculus
gcagctaaagtcctgttgtctccaa

SEQ ID NO: 536749 - DNA, 25 bp, Mus musculus
gcagctaaagtcgtgttgtctccaa

SEQ ID NO: 536750 - DNA, 25 bp, Mus musculus
gcagctaaagttcccagtggcacca

SEQ ID NO: 536751 - DNA, 25 bp, Mus musculus
gcagctaaagttgccagtggcacca

SEQ ID NO: 536752 - DNA, 25 bp, Mus musculus
gcagctaagcgaccctccagaattt

SEQ ID NO: 536753 - DNA, 25 bp, Mus musculus
gcagctaagcgagcctccagaattt

SEQ ID NO: 536754 - DNA, 25 bp, Mus musculus
gcagctaagctcatccagggacaga

SEQ ID NO: 536755 - DNA, 25 bp, Mus musculus
gcagctaagctcttccagggacaga

SEQ ID NO: 536756 - DNA, 25 bp, Mus musculus
gcagctaatagaaatctgctccgac

SEQ ID NO: 536757 - DNA, 25 bp, Mus musculus
gcagctaatagatatctgctccgac

SEQ ID NO: 536758 - DNA, 25 bp, Mus musculus
gcagctaatgcgcattctaatctac

SEQ ID NO: 536759 - DNA, 25 bp, Mus musculus
gcagctaatgcggattctaatctac

SEQ ID NO: 536760 - DNA, 25 bp, Mus musculus
gcagctaattgaaggtgtgatgtac

SEQ ID NO: 536761 - DNA, 25 bp, Mus musculus
gcagctaattgatggtgtgatgtac

SEQ ID NO: 536762 - DNA, 25 bp, Mus musculus
gcagctacacatctacaacttgcaa

SEQ ID NO: 536763 - DNA, 25 bp, Mus musculus
gcagctacacatgtacaacttgcaa

SEQ ID NO: 536764 - DNA, 25 bp, Mus musculus
gcagctacacttcctgtgttacagc

SEQ ID NO: 536765 - DNA, 25 bp, Mus musculus
gcagctacacttgctgtgttacagc

SEQ ID NO: 536766 - DNA, 25 bp, Mus musculus
gcagctacagagagatctgcagcaa

SEQ ID NO: 536767 - DNA, 25 bp, Mus musculus
gcagctacagagtgatctgcagcaa

SEQ ID NO: 536768 - DNA, 25 bp, Mus musculus
gcagctacagcaattatggcttaag

SEQ ID NO: 536769 - DNA, 25 bp, Mus musculus
gcagctacagcacatctatttttaa

SEQ ID NO: 536770 - DNA, 25 bp, Mus musculus
gcagctacagcagatctatttttaa

SEQ ID NO: 536771 - DNA, 25 bp, Mus musculus
gcagctacagcatttatggcttaag

SEQ ID NO: 536772 - DNA, 25 bp, Mus musculus
gcagctaccaatcatatgtccacaa

SEQ ID NO: 536773 - DNA, 25 bp, Mus musculus
gcagctaccaatgatatgtccacaa

SEQ ID NO: 536774 - DNA, 25 bp, Mus musculus
gcagctaccaggacaggccacgagt

SEQ ID NO: 536775 - DNA, 25 bp, Mus musculus
gcagctaccaggtcaggccacgagt

SEQ ID NO: 536776 - DNA, 25 bp, Mus musculus
gcagctacccttctaatttgtgatt

SEQ ID NO: 536777 - DNA, 25 bp, Mus musculus
gcagctacccttgtaatttgtgatt

SEQ ID NO: 536778 - DNA, 25 bp, Mus musculus
gcagctaccgagcagcgtttttaaa

SEQ ID NO: 536779 - DNA, 25 bp, Mus musculus
gcagctaccgaggagcgtttttaaa

SEQ ID NO: 536780 - DNA, 25 bp, Mus musculus
gcagctacctgaaggagttccgcga

SEQ ID NO: 536781 - DNA, 25 bp, Mus musculus
gcagctacctgatggagttccgcga

SEQ ID NO: 536782 - DNA, 25 bp, Mus musculus
gcagctactatgctttcttgaagtc

SEQ ID NO: 536783 - DNA, 25 bp, Mus musculus
gcagctactatggtttcttgaagtc

SEQ ID NO: 536784 - DNA, 25 bp, Mus musculus
gcagctactgcaagtgatcaagaag

SEQ ID NO: 536785 - DNA, 25 bp, Mus musculus
gcagctactgcatgtgatcaagaag

SEQ ID NO: 536786 - DNA, 25 bp, Mus musculus
gcagctactgcgagtagtgtctact

SEQ ID NO: 536787 - DNA, 25 bp, Mus musculus
gcagctactgcgtgtagtgtctact

SEQ ID NO: 536788 - DNA, 25 bp, Mus musculus
gcagctactgctaccgtgtgatgag

SEQ ID NO: 536789 - DNA, 25 bp, Mus musculus
gcagctactgcttccgtgtgatgag

SEQ ID NO: 536790 - DNA, 25 bp, Mus musculus
gcagctacttgaccatgggtaacaa

SEQ ID NO: 536791 - DNA, 25 bp, Mus musculus
gcagctacttgagcatgggtaacaa

SEQ ID NO: 536792 - DNA, 25 bp, Mus musculus
gcagctagaagccagacaccaagaa

SEQ ID NO: 536793 - DNA, 25 bp, Mus musculus
gcagctagaagcgagacaccaagaa

SEQ ID NO: 536794 - DNA, 25 bp, Mus musculus
gcagctagaattatcctatcccaac

SEQ ID NO: 536795 - DNA, 25 bp, Mus musculus
gcagctagaattttcctatcccaac

SEQ ID NO: 536796 - DNA, 25 bp, Mus musculus
gcagctagacctaggaaagtagatt

SEQ ID NO: 536797 - DNA, 25 bp, Mus musculus
gcagctagaccttggaaagtagatt

SEQ ID NO: 536798 - DNA, 25 bp, Mus musculus
gcagctagacttcatagactatgtt

SEQ ID NO: 536799 - DNA, 25 bp, Mus musculus
gcagctagacttgatagactatgtt

SEQ ID NO: 536800 - DNA, 25 bp, Mus musculus
gcagctagagcaattgagcaaccca

SEQ ID NO: 536801 - DNA, 25 bp, Mus musculus
gcagctagagcatttgagcaaccca

SEQ ID NO: 536802 - DNA, 25 bp, Mus musculus
gcagctagcgtccagctgtcatgga

SEQ ID NO: 536803 - DNA, 25 bp, Mus musculus
gcagctagcgtcgagctgtcatgga

SEQ ID NO: 536804 - DNA, 25 bp, Mus musculus
gcagctagctatcccaggcataaga

SEQ ID NO: 536805 - DNA, 25 bp, Mus musculus
gcagctagctatgccaggcataaga

SEQ ID NO: 536806 - DNA, 25 bp, Mus musculus
gcagctaggaagaggtgatgcacac

SEQ ID NO: 536807 - DNA, 25 bp, Mus musculus
gcagctaggaagtggtgatgcacac

SEQ ID NO: 536808 - DNA, 25 bp, Mus musculus
gcagctaggaatcttccctgcattg

SEQ ID NO: 536809 - DNA, 25 bp, Mus musculus
gcagctaggaatgttccctgcattg

SEQ ID NO: 536810 - DNA, 25 bp, Mus musculus
gcagctaggactcccctcagtgagg

SEQ ID NO: 536811 - DNA, 25 bp, Mus musculus
gcagctaggactgccctcagtgagg

SEQ ID NO: 536812 - DNA, 25 bp, Mus musculus
gcagctaggataagtcacccttcag

SEQ ID NO: 536813 - DNA, 25 bp, Mus musculus
gcagctaggatatgtcacccttcag

SEQ ID NO: 536814 - DNA, 25 bp, Mus musculus
gcagctaggcataaacttttgaaac

SEQ ID NO: 536815 - DNA, 25 bp, Mus musculus
gcagctaggcattaacttttgaaac

SEQ ID NO: 536816 - DNA, 25 bp, Mus musculus
gcagctagggccactggtcagctgt

SEQ ID NO: 536817 - DNA, 25 bp, Mus musculus
gcagctagggcctctggtcagctgt

SEQ ID NO: 536818 - DNA, 25 bp, Mus musculus
gcagctagtatgatcaaatctttca

SEQ ID NO: 536819 - DNA, 25 bp, Mus musculus
gcagctagtatgttcaaatctttca

SEQ ID NO: 536820 - DNA, 25 bp, Mus musculus
gcagctagtctacaaatatcgcaca

SEQ ID NO: 536821 - DNA, 25 bp, Mus musculus
gcagctagtctagaaatatcgcaca

SEQ ID NO: 536822 - DNA, 25 bp, Mus musculus
gcagctagtttaatcacaactgttc

SEQ ID NO: 536823 - DNA, 25 bp, Mus musculus
gcagctagtttattcacaactgttc

SEQ ID NO: 536824 - DNA, 25 bp, Mus musculus
gcagctataagtattcactctctaa

SEQ ID NO: 536825 - DNA, 25 bp, Mus musculus
gcagctataagttttcactctctaa

SEQ ID NO: 536826 - DNA, 25 bp, Mus musculus
gcagctatcagcactacctacaatg

SEQ ID NO: 536827 - DNA, 25 bp, Mus musculus
gcagctatcagctctacctacaatg

SEQ ID NO: 536828 - DNA, 25 bp, Mus musculus
gcagctatgccaacagcagacgcag

SEQ ID NO: 536829 - DNA, 25 bp, Mus musculus
gcagctatgccatcagcagacgcag

SEQ ID NO: 536830 - DNA, 25 bp, Mus musculus
gcagctatgcctcagatccatggta

SEQ ID NO: 536831 - DNA, 25 bp, Mus musculus
gcagctatgcctgagatccatggta

SEQ ID NO: 536832 - DNA, 25 bp, Mus musculus
gcagctatgctgcaacacgtttgaa

SEQ ID NO: 536833 - DNA, 25 bp, Mus musculus
gcagctatgctggaacacgtttgaa

SEQ ID NO: 536834 - DNA, 25 bp, Mus musculus
gcagctatgtgaagttgcatctcca

SEQ ID NO: 536835 - DNA, 25 bp, Mus musculus
gcagctatgtgatgttgcatctcca

SEQ ID NO: 536836 - DNA, 25 bp, Mus musculus
gcagctattcagactatcttcctgt

SEQ ID NO: 536837 - DNA, 25 bp, Mus musculus
gcagctattcagtctatcttcctgt

SEQ ID NO: 536838 - DNA, 25 bp, Mus musculus
gcagctattgctcaggtaggtctct

SEQ ID NO: 536839 - DNA, 25 bp, Mus musculus
gcagctattgctgaggtaggtctct

SEQ ID NO: 536840 - DNA, 25 bp, Mus musculus
gcagctatttcaactactattttcc

SEQ ID NO: 536841 - DNA, 25 bp, Mus musculus
gcagctatttcatctactattttcc

SEQ ID NO: 536842 - DNA, 25 bp, Mus musculus
gcagctatttctctggatcgacata

SEQ ID NO: 536843 - DNA, 25 bp, Mus musculus
gcagctatttctgtggatcgacata

SEQ ID NO: 536844 - DNA, 25 bp, Mus musculus
gcagctattttgacaccgttgggaa

SEQ ID NO: 536845 - DNA, 25 bp, Mus musculus
gcagctattttgtcaccgttgggaa

SEQ ID NO: 536846 - DNA, 25 bp, Mus musculus
gcagctcaaaaacacttcccagtct

SEQ ID NO: 536847 - DNA, 25 bp, Mus musculus
gcagctcaaaaagacttcccagtct

SEQ ID NO: 536848 - DNA, 25 bp, Mus musculus
gcagctcaaaagagccctaatggct

SEQ ID NO: 536849 - DNA, 25 bp, Mus musculus
gcagctcaaaagtgccctaatggct

SEQ ID NO: 536850 - DNA, 25 bp, Mus musculus
gcagctcaaattactagtgtcttct

SEQ ID NO: 536851 - DNA, 25 bp, Mus musculus
gcagctcaaatttctagtgtcttct

SEQ ID NO: 536852 - DNA, 25 bp, Mus musculus
gcagctcaagctcaatcacccagag

SEQ ID NO: 536853 - DNA, 25 bp, Mus musculus
gcagctcaagctcatattcaaaata

SEQ ID NO: 536854 - DNA, 25 bp, Mus musculus
gcagctcaagctcattggttcatgg

SEQ ID NO: 536855 - DNA, 25 bp, Mus musculus
gcagctcaagctgaatcacccagag

SEQ ID NO: 536856 - DNA, 25 bp, Mus musculus
gcagctcaagctgatattcaaaata

SEQ ID NO: 536857 - DNA, 25 bp, Mus musculus
gcagctcaagctgattggttcatgg

SEQ ID NO: 536858 - DNA, 25 bp, Mus musculus
gcagctcaaggtaaccatcagctac

SEQ ID NO: 536859 - DNA, 25 bp, Mus musculus
gcagctcaaggttaccatcagctac

SEQ ID NO: 536860 - DNA, 25 bp, Mus musculus
gcagctcacagccatatgtaatttg

SEQ ID NO: 536861 - DNA, 25 bp, Mus musculus
gcagctcacagcgatatgtaatttg

SEQ ID NO: 536862 - DNA, 25 bp, Mus musculus
gcagctcacagtctttgctggtttg

SEQ ID NO: 536863 - DNA, 25 bp, Mus musculus
gcagctcacagtgtttgctggtttg

SEQ ID NO: 536864 - DNA, 25 bp, Mus musculus
gcagctcacctacctggagaagtac

SEQ ID NO: 536865 - DNA, 25 bp, Mus musculus
gcagctcacctagctggagaagtac

SEQ ID NO: 536866 - DNA, 25 bp, Mus musculus
gcagctcactatcatgtttaacttc

SEQ ID NO: 536867 - DNA, 25 bp, Mus musculus
gcagctcactatgatgtttaacttc

SEQ ID NO: 536868 - DNA, 25 bp, Mus musculus
gcagctcactgtcctattcatttta

SEQ ID NO: 536869 - DNA, 25 bp, Mus musculus
gcagctcactgtgctattcatttta

SEQ ID NO: 536870 - DNA, 25 bp, Mus musculus
gcagctcacttgctgcagtgtcata

SEQ ID NO: 536871 - DNA, 25 bp, Mus musculus
gcagctcacttggtgcagtgtcata

SEQ ID NO: 536872 - DNA, 25 bp, Mus musculus
gcagctcagaatctcacctgggaat

SEQ ID NO: 536873 - DNA, 25 bp, Mus musculus
gcagctcagaatgtcacctgggaat

SEQ ID NO: 536874 - DNA, 25 bp, Mus musculus
gcagctcagctcagttgaaaagcca

SEQ ID NO: 536875 - DNA, 25 bp, Mus musculus
gcagctcagctctgttgaaaagcca

SEQ ID NO: 536876 - DNA, 25 bp, Mus musculus
gcagctcaggaacatgccgtgaagc

SEQ ID NO: 536877 - DNA, 25 bp, Mus musculus
gcagctcaggaagatgccgtgaagc

SEQ ID NO: 536878 - DNA, 25 bp, Mus musculus
gcagctcaggctaacattatgaact

SEQ ID NO: 536879 - DNA, 25 bp, Mus musculus
gcagctcaggcttacattatgaact

SEQ ID NO: 536880 - DNA, 25 bp, Mus musculus
gcagctcagggaatagcatgatgct

SEQ ID NO: 536881 - DNA, 25 bp, Mus musculus
gcagctcagggattagcatgatgct

SEQ ID NO: 536882 - DNA, 25 bp, Mus musculus
gcagctcaggtaaaatgccgtttat

SEQ ID NO: 536883 - DNA, 25 bp, Mus musculus
gcagctcaggtataatgccgtttat

SEQ ID NO: 536884 - DNA, 25 bp, Mus musculus
gcagctcatcctaaaagactccgga

SEQ ID NO: 536885 - DNA, 25 bp, Mus musculus
gcagctcatccttaaagactccgga

SEQ ID NO: 536886 - DNA, 25 bp, Mus musculus
gcagctcatgagcattggagtcatc

SEQ ID NO: 536887 - DNA, 25 bp, Mus musculus
gcagctcatgaggattggagtcatc

SEQ ID NO: 536888 - DNA, 25 bp, Mus musculus
gcagctcatgtcagtagggacagag

SEQ ID NO: 536889 - DNA, 25 bp, Mus musculus
gcagctcatgtctgtagggacagag

SEQ ID NO: 536890 - DNA, 25 bp, Mus musculus
gcagctcatttgcaggatgtctcca

SEQ ID NO: 536891 - DNA, 25 bp, Mus musculus
gcagctcatttggaggatgtctcca

SEQ ID NO: 536892 - DNA, 25 bp, Mus musculus
gcagctccaggccaggatccaagta

SEQ ID NO: 536893 - DNA, 25 bp, Mus musculus
gcagctccaggcgaggatccaagta

SEQ ID NO: 536894 - DNA, 25 bp, Mus musculus
gcagctccagtaccagagccttggt

SEQ ID NO: 536895 - DNA, 25 bp, Mus musculus
gcagctccagtagcagagccttggt

SEQ ID NO: 536896 - DNA, 25 bp, Mus musculus
gcagctccatcaagatcgtcaggca

SEQ ID NO: 536897 - DNA, 25 bp, Mus musculus
gcagctccatcatgatcgtcaggca

SEQ ID NO: 536898 - DNA, 25 bp, Mus musculus
gcagctcccagaaacacctaagtgt

SEQ ID NO: 536899 - DNA, 25 bp, Mus musculus
gcagctcccagatacacctaagtgt

SEQ ID NO: 536900 - DNA, 25 bp, Mus musculus
gcagctcccataaggtaaatccaag

SEQ ID NO: 536901 - DNA, 25 bp, Mus musculus
gcagctcccatatggtaaatccaag

SEQ ID NO: 536902 - DNA, 25 bp, Mus musculus
gcagctcccgataacagactggaca

SEQ ID NO: 536903 - DNA, 25 bp, Mus musculus
gcagctcccgattacagactggaca

SEQ ID NO: 536904 - DNA, 25 bp, Mus musculus
gcagctccgggaacttcagaggcat

SEQ ID NO: 536905 - DNA, 25 bp, Mus musculus
gcagctccgggatcttcagaggcat

SEQ ID NO: 536906 - DNA, 25 bp, Mus musculus
gcagctccgggtagcttttcttctg

SEQ ID NO: 536907 - DNA, 25 bp, Mus musculus
gcagctccgggttgcttttcttctg

SEQ ID NO: 536908 - DNA, 25 bp, Mus musculus
gcagctcctaaaatgatcttctctt

SEQ ID NO: 536909 - DNA, 25 bp, Mus musculus
gcagctcctaaattgatcttctctt

SEQ ID NO: 536910 - DNA, 25 bp, Mus musculus
gcagctcctgaacctactcagttta

SEQ ID NO: 536911 - DNA, 25 bp, Mus musculus
gcagctcctgaagctactcagttta

SEQ ID NO: 536912 - DNA, 25 bp, Mus musculus
gcagctcctgccaacattgaaagca

SEQ ID NO: 536913 - DNA, 25 bp, Mus musculus
gcagctcctgcctacattgaaagca

SEQ ID NO: 536914 - DNA, 25 bp, Mus musculus
gcagctcctggaatctatgatgttc

SEQ ID NO: 536915 - DNA, 25 bp, Mus musculus
gcagctcctggattctatgatgttc

SEQ ID NO: 536916 - DNA, 25 bp, Mus musculus
gcagctcctggtagatccatttact

SEQ ID NO: 536917 - DNA, 25 bp, Mus musculus
gcagctcctggttgatccatttact

SEQ ID NO: 536918 - DNA, 25 bp, Mus musculus
gcagctcctgtcaaaatggccccaa

SEQ ID NO: 536919 - DNA, 25 bp, Mus musculus
gcagctcctgtctaaatggccccaa

SEQ ID NO: 536920 - DNA, 25 bp, Mus musculus
gcagctcgcaggagattcgcactta

SEQ ID NO: 536921 - DNA, 25 bp, Mus musculus
gcagctcgcaggtgattcgcactta

SEQ ID NO: 536922 - DNA, 25 bp, Mus musculus
gcagctcgctggaattcccaaaatg

SEQ ID NO: 536923 - DNA, 25 bp, Mus musculus
gcagctcgctggacagagtatgcca

SEQ ID NO: 536924 - DNA, 25 bp, Mus musculus
gcagctcgctggtattcccaaaatg

SEQ ID NO: 536925 - DNA, 25 bp, Mus musculus
gcagctcgctggtcagagtatgcca

SEQ ID NO: 536926 - DNA, 25 bp, Mus musculus
gcagctcgggagacacaaagaacca

SEQ ID NO: 536927 - DNA, 25 bp, Mus musculus
gcagctcgggagtcacaaagaacca

SEQ ID NO: 536928 - DNA, 25 bp, Mus musculus
gcagctctaagtatcctcatggagc

SEQ ID NO: 536929 - DNA, 25 bp, Mus musculus
gcagctctaagtttcctcatggagc

SEQ ID NO: 536930 - DNA, 25 bp, Mus musculus
gcagctctaatgactcgaggttcca

SEQ ID NO: 536931 - DNA, 25 bp, Mus musculus
gcagctctaatgtctcgaggttcca

SEQ ID NO: 536932 - DNA, 25 bp, Mus musculus
gcagctctacttaggtgaaggctca

SEQ ID NO: 536933 - DNA, 25 bp, Mus musculus
gcagctctactttggtgaaggctca

SEQ ID NO: 536934 - DNA, 25 bp, Mus musculus
gcagctctagcccaggaaccaatgg

SEQ ID NO: 536935 - DNA, 25 bp, Mus musculus
gcagctctagccgaggaaccaatgg

SEQ ID NO: 536936 - DNA, 25 bp, Mus musculus
gcagctctagttctgagtctgacct

SEQ ID NO: 536937 - DNA, 25 bp, Mus musculus
gcagctctagttgtgagtctgacct

SEQ ID NO: 536938 - DNA, 25 bp, Mus musculus
gcagctctccagagcggcgtgctct

SEQ ID NO: 536939 - DNA, 25 bp, Mus musculus
gcagctctccagtgcggcgtgctct

SEQ ID NO: 536940 - DNA, 25 bp, Mus musculus
gcagctctcgagaagtccgtattta

SEQ ID NO: 536941 - DNA, 25 bp, Mus musculus
gcagctctcgagtagtccgtattta

SEQ ID NO: 536942 - DNA, 25 bp, Mus musculus
gcagctctctccatattagtggcta

SEQ ID NO: 536943 - DNA, 25 bp, Mus musculus
gcagctctctccttattagtggcta

SEQ ID NO: 536944 - DNA, 25 bp, Mus musculus
gcagctctctctcggcttagcagta

SEQ ID NO: 536945 - DNA, 25 bp, Mus musculus
gcagctctctctgggcttagcagta

SEQ ID NO: 536946 - DNA, 25 bp, Mus musculus
gcagctctctggatcttcgaacttg

SEQ ID NO: 536947 - DNA, 25 bp, Mus musculus
gcagctctctggttcttcgaacttg

SEQ ID NO: 536948 - DNA, 25 bp, Mus musculus
gcagctctctgtagcagggcagtgc

SEQ ID NO: 536949 - DNA, 25 bp, Mus musculus
gcagctctctgttgcagggcagtgc

SEQ ID NO: 536950 - DNA, 25 bp, Mus musculus
gcagctctgactatataaaacctaa

SEQ ID NO: 536951 - DNA, 25 bp, Mus musculus
gcagctctgactttataaaacctaa

SEQ ID NO: 536952 - DNA, 25 bp, Mus musculus
gcagctctgagcagtactttcacta

SEQ ID NO: 536953 - DNA, 25 bp, Mus musculus
gcagctctgagctgtactttcacta

SEQ ID NO: 536954 - DNA, 25 bp, Mus musculus
gcagctctgagtctttgtgctcaca

SEQ ID NO: 536955 - DNA, 25 bp, Mus musculus
gcagctctgagtgtttgtgctcaca

SEQ ID NO: 536956 - DNA, 25 bp, Mus musculus
gcagctctgatcactgggagtctgt

SEQ ID NO: 536957 - DNA, 25 bp, Mus musculus
gcagctctgatctctgggagtctgt

SEQ ID NO: 536958 - DNA, 25 bp, Mus musculus
gcagctctgcacagtacagcgtgtt

SEQ ID NO: 536959 - DNA, 25 bp, Mus musculus
gcagctctgcactgtacagcgtgtt

SEQ ID NO: 536960 - DNA, 25 bp, Mus musculus
gcagctctgcagaacattttcaaac

SEQ ID NO: 536961 - DNA, 25 bp, Mus musculus
gcagctctgcagtacattttcaaac

SEQ ID NO: 536962 - DNA, 25 bp, Mus musculus
gcagctctgcccaacaaagggagtt

SEQ ID NO: 536963 - DNA, 25 bp, Mus musculus
gcagctctgccctacaaagggagtt

SEQ ID NO: 536964 - DNA, 25 bp, Mus musculus
gcagctctgcctcctctgtggagca

SEQ ID NO: 536965 - DNA, 25 bp, Mus musculus
gcagctctgcctgctctgtggagca

SEQ ID NO: 536966 - DNA, 25 bp, Mus musculus
gcagctctgcgccattgatgacctg

SEQ ID NO: 536967 - DNA, 25 bp, Mus musculus
gcagctctgcgcgattgatgacctg

SEQ ID NO: 536968 - DNA, 25 bp, Mus musculus
gcagctctgctcaatggcatgtgca

SEQ ID NO: 536969 - DNA, 25 bp, Mus musculus
gcagctctgctctatggcatgtgca

SEQ ID NO: 536970 - DNA, 25 bp, Mus musculus
gcagctctggtacactcctgttgaa

SEQ ID NO: 536971 - DNA, 25 bp, Mus musculus
gcagctctggtagactcctgttgaa

SEQ ID NO: 536972 - DNA, 25 bp, Mus musculus
gcagctctggtgctcgggacttacc

SEQ ID NO: 536973 - DNA, 25 bp, Mus musculus
gcagctctggtggtcgggacttacc

SEQ ID NO: 536974 - DNA, 25 bp, Mus musculus
gcagctctgtaaatacatccttgca

SEQ ID NO: 536975 - DNA, 25 bp, Mus musculus
gcagctctgtaattacatccttgca

SEQ ID NO: 536976 - DNA, 25 bp, Mus musculus
gcagctctgtatatatgcctggcag

SEQ ID NO: 536977 - DNA, 25 bp, Mus musculus
gcagctctgtatttatgcctggcag

SEQ ID NO: 536978 - DNA, 25 bp, Mus musculus
gcagctctgtccaagcactttataa

SEQ ID NO: 536979 - DNA, 25 bp, Mus musculus
gcagctctgtcctagcactttataa

SEQ ID NO: 536980 - DNA, 25 bp, Mus musculus
gcagctctgtggaacttttcttgaa

SEQ ID NO: 536981 - DNA, 25 bp, Mus musculus
gcagctctgtggattagtcagtcaa

SEQ ID NO: 536982 - DNA, 25 bp, Mus musculus
gcagctctgtggtacttttcttgaa

SEQ ID NO: 536983 - DNA, 25 bp, Mus musculus
gcagctctgtggtttagtcagtcaa

SEQ ID NO: 536984 - DNA, 25 bp, Mus musculus
gcagctctgtttcagactggaaata

SEQ ID NO: 536985 - DNA, 25 bp, Mus musculus
gcagctctgtttgagactggaaata

SEQ ID NO: 536986 - DNA, 25 bp, Mus musculus
gcagctcttaagcacactgtcttac

SEQ ID NO: 536987 - DNA, 25 bp, Mus musculus
gcagctcttaaggacactgtcttac

SEQ ID NO: 536988 - DNA, 25 bp, Mus musculus
gcagctcttaggacacgtatgccat

SEQ ID NO: 536989 - DNA, 25 bp, Mus musculus
gcagctcttaggtcacgtatgccat

SEQ ID NO: 536990 - DNA, 25 bp, Mus musculus
gcagctcttcctagctgtcagaaga

SEQ ID NO: 536991 - DNA, 25 bp, Mus musculus
gcagctcttcctattactggcaggg

SEQ ID NO: 536992 - DNA, 25 bp, Mus musculus
gcagctcttccttgctgtcagaaga

SEQ ID NO: 536993 - DNA, 25 bp, Mus musculus
gcagctcttccttttactggcaggg

SEQ ID NO: 536994 - DNA, 25 bp, Mus musculus
gcagctcttcttaaaggaagaccat

SEQ ID NO: 536995 - DNA, 25 bp, Mus musculus
gcagctcttcttcacaggcacttgg

SEQ ID NO: 536996 - DNA, 25 bp, Mus musculus
gcagctcttcttgacaggcacttgg

SEQ ID NO: 536997 - DNA, 25 bp, Mus musculus
gcagctcttctttaaggaagaccat

SEQ ID NO: 536998 - DNA, 25 bp, Mus musculus
gcagctcttggaagccacgatcggg

SEQ ID NO: 536999 - DNA, 25 bp, Mus musculus
gcagctcttggatgccacgatcggg

SEQ ID NO: 537000 - DNA, 25 bp, Mus musculus
gcagctctttaaatgcctgtaagcc

SEQ ID NO: 537001 - DNA, 25 bp, Mus musculus
gcagctctttaattgcctgtaagcc

SEQ ID NO: 537002 - DNA, 25 bp, Mus musculus
gcagctctttggcatatctagagac

SEQ ID NO: 537003 - DNA, 25 bp, Mus musculus
gcagctctttgggatatctagagac

SEQ ID NO: 537004 - DNA, 25 bp, Mus musculus
gcagctgaacaaacgagcctcatgc

SEQ ID NO: 537005 - DNA, 25 bp, Mus musculus
gcagctgaacaatcgagcctcatgc

SEQ ID NO: 537006 - DNA, 25 bp, Mus musculus
gcagctgaagccacaccttagggag

SEQ ID NO: 537007 - DNA, 25 bp, Mus musculus
gcagctgaagcctcaccttagggag

SEQ ID NO: 537008 - DNA, 25 bp, Mus musculus
gcagctgaaggtacacgggttctaa

SEQ ID NO: 537009 - DNA, 25 bp, Mus musculus
gcagctgaaggttcacgggttctaa

SEQ ID NO: 537010 - DNA, 25 bp, Mus musculus
gcagctgaagtacctgactcaagtt

SEQ ID NO: 537011 - DNA, 25 bp, Mus musculus
gcagctgaagtagctgactcaagtt

SEQ ID NO: 537012 - DNA, 25 bp, Mus musculus
gcagctgaatatctccaggagtcca

SEQ ID NO: 537013 - DNA, 25 bp, Mus musculus
gcagctgaatatgtccaggagtcca

SEQ ID NO: 537014 - DNA, 25 bp, Mus musculus
gcagctgacaaccatggcaaaaaga

SEQ ID NO: 537015 - DNA, 25 bp, Mus musculus
gcagctgacaacgatggcaaaaaga

SEQ ID NO: 537016 - DNA, 25 bp, Mus musculus
gcagctgacattatcactcaggcac

SEQ ID NO: 537017 - DNA, 25 bp, Mus musculus
gcagctgacattttcactcaggcac

SEQ ID NO: 537018 - DNA, 25 bp, Mus musculus
gcagctgacgagacgtcttcaggga

SEQ ID NO: 537019 - DNA, 25 bp, Mus musculus
gcagctgacgagtcgtcttcaggga

SEQ ID NO: 537020 - DNA, 25 bp, Mus musculus
gcagctgactgacgaccagactgag

SEQ ID NO: 537021 - DNA, 25 bp, Mus musculus
gcagctgactgaggaccagactgag

SEQ ID NO: 537022 - DNA, 25 bp, Mus musculus
gcagctgagcacattgcatctatgt

SEQ ID NO: 537023 - DNA, 25 bp, Mus musculus
gcagctgagcactttgcatctatgt

SEQ ID NO: 537024 - DNA, 25 bp, Mus musculus
gcagctgagcctctctctgcagcag

SEQ ID NO: 537025 - DNA, 25 bp, Mus musculus
gcagctgagcctgtctctgcagcag

SEQ ID NO: 537026 - DNA, 25 bp, Mus musculus
gcagctgagcgtctcgatatcttac

SEQ ID NO: 537027 - DNA, 25 bp, Mus musculus
gcagctgagcgtgtcgatatcttac

SEQ ID NO: 537028 - DNA, 25 bp, Mus musculus
gcagctgaggcaatcagattaaact

SEQ ID NO: 537029 - DNA, 25 bp, Mus musculus
gcagctgaggcattcagattaaact

SEQ ID NO: 537030 - DNA, 25 bp, Mus musculus
gcagctgaggctcggcctgacctca

SEQ ID NO: 537031 - DNA, 25 bp, Mus musculus
gcagctgaggctgggcctgacctca

SEQ ID NO: 537032 - DNA, 25 bp, Mus musculus
gcagctgagggtaagatggctccat

SEQ ID NO: 537033 - DNA, 25 bp, Mus musculus
gcagctgagggttagatggctccat

SEQ ID NO: 537034 - DNA, 25 bp, Mus musculus
gcagctgaggtcagttatgaagtca

SEQ ID NO: 537035 - DNA, 25 bp, Mus musculus
gcagctgaggtctgttatgaagtca

SEQ ID NO: 537036 - DNA, 25 bp, Mus musculus
gcagctgagttcactggtgaaatga

SEQ ID NO: 537037 - DNA, 25 bp, Mus musculus
gcagctgagttctctggtgaaatga

SEQ ID NO: 537038 - DNA, 25 bp, Mus musculus
gcagctgatcctctatattcatgag

SEQ ID NO: 537039 - DNA, 25 bp, Mus musculus
gcagctgatcctgtatattcatgag

SEQ ID NO: 537040 - DNA, 25 bp, Mus musculus
gcagctgatcgaagccataagcaat

SEQ ID NO: 537041 - DNA, 25 bp, Mus musculus
gcagctgatcgatgccataagcaat

SEQ ID NO: 537042 - DNA, 25 bp, Mus musculus
gcagctgatctgctagactcttttt

SEQ ID NO: 537043 - DNA, 25 bp, Mus musculus
gcagctgatctggtagactcttttt

SEQ ID NO: 537044 - DNA, 25 bp, Mus musculus
gcagctgatggaccctcgaagccat

SEQ ID NO: 537045 - DNA, 25 bp, Mus musculus
gcagctgatggagcctcgaagccat

SEQ ID NO: 537046 - DNA, 25 bp, Mus musculus
gcagctgattacaacgattatgggc

SEQ ID NO: 537047 - DNA, 25 bp, Mus musculus
gcagctgattactacgattatgggc

SEQ ID NO: 537048 - DNA, 25 bp, Mus musculus
gcagctgattagagataatgaccaa

SEQ ID NO: 537049 - DNA, 25 bp, Mus musculus
gcagctgattagtgataatgaccaa

SEQ ID NO: 537050 - DNA, 25 bp, Mus musculus
gcagctgattatcggttaagatgat

SEQ ID NO: 537051 - DNA, 25 bp, Mus musculus
gcagctgattatgggttaagatgat

SEQ ID NO: 537052 - DNA, 25 bp, Mus musculus
gcagctgattctctggtgccagttt

SEQ ID NO: 537053 - DNA, 25 bp, Mus musculus
gcagctgattctgtggtgccagttt

SEQ ID NO: 537054 - DNA, 25 bp, Mus musculus
gcagctgattgcagtcgtgagctcg

SEQ ID NO: 537055 - DNA, 25 bp, Mus musculus
gcagctgattgctgtcgtgagctcg

SEQ ID NO: 537056 - DNA, 25 bp, Mus musculus
gcagctgattgtcctcaggtatgca

SEQ ID NO: 537057 - DNA, 25 bp, Mus musculus
gcagctgattgtgctcaggtatgca

SEQ ID NO: 537058 - DNA, 25 bp, Mus musculus
gcagctgcagacatgaaacagttct

SEQ ID NO: 537059 - DNA, 25 bp, Mus musculus
gcagctgcagacttgaaacagttct

SEQ ID NO: 537060 - DNA, 25 bp, Mus musculus
gcagctgcaggcagatcgcgacagc

SEQ ID NO: 537061 - DNA, 25 bp, Mus musculus
gcagctgcaggccattctaccggag

SEQ ID NO: 537062 - DNA, 25 bp, Mus musculus
gcagctgcaggcgattctaccggag

SEQ ID NO: 537063 - DNA, 25 bp, Mus musculus
gcagctgcaggctgatcgcgacagc

SEQ ID NO: 537064 - DNA, 25 bp, Mus musculus
gcagctgcagtaaggctggacagaa

SEQ ID NO: 537065 - DNA, 25 bp, Mus musculus
gcagctgcagtatggctggacagaa

SEQ ID NO: 537066 - DNA, 25 bp, Mus musculus
gcagctgcctagatcagatttctta

SEQ ID NO: 537067 - DNA, 25 bp, Mus musculus
gcagctgcctagttcagatttctta

SEQ ID NO: 537068 - DNA, 25 bp, Mus musculus
gcagctgcctgaccttgggactctt

SEQ ID NO: 537069 - DNA, 25 bp, Mus musculus
gcagctgcctgagcttgggactctt

SEQ ID NO: 537070 - DNA, 25 bp, Mus musculus
gcagctgcgcagcttttagctactg

SEQ ID NO: 537071 - DNA, 25 bp, Mus musculus
gcagctgcgcaggttttagctactg

SEQ ID NO: 537072 - DNA, 25 bp, Mus musculus
gcagctgcgcatccttcatcatcta

SEQ ID NO: 537073 - DNA, 25 bp, Mus musculus
gcagctgcgcatgcttcatcatcta

SEQ ID NO: 537074 - DNA, 25 bp, Mus musculus
gcagctgcgctgacaggagcaattt

SEQ ID NO: 537075 - DNA, 25 bp, Mus musculus
gcagctgcgctgtcaggagcaattt

SEQ ID NO: 537076 - DNA, 25 bp, Mus musculus
gcagctgctaatccttaagtgctat

SEQ ID NO: 537077 - DNA, 25 bp, Mus musculus
gcagctgctaatgcttaagtgctat

SEQ ID NO: 537078 - DNA, 25 bp, Mus musculus
gcagctgctacactcctgtactgtg

SEQ ID NO: 537079 - DNA, 25 bp, Mus musculus
gcagctgctacagtcctgtactgtg

SEQ ID NO: 537080 - DNA, 25 bp, Mus musculus
gcagctgctactcgaaatgctgacc

SEQ ID NO: 537081 - DNA, 25 bp, Mus musculus
gcagctgctactggaaatgctgacc

SEQ ID NO: 537082 - DNA, 25 bp, Mus musculus
gcagctgctgagaaattcaaagttc

SEQ ID NO: 537083 - DNA, 25 bp, Mus musculus
gcagctgctgagaagtaggccacca

SEQ ID NO: 537084 - DNA, 25 bp, Mus musculus
gcagctgctgagtaattcaaagttc

SEQ ID NO: 537085 - DNA, 25 bp, Mus musculus
gcagctgctgagtagtaggccacca

SEQ ID NO: 537086 - DNA, 25 bp, Mus musculus
gcagctgctgctcttagtacctctt

SEQ ID NO: 537087 - DNA, 25 bp, Mus musculus
gcagctgctgctgttagtacctctt

SEQ ID NO: 537088 - DNA, 25 bp, Mus musculus
gcagctgctggacttcacagataaa

SEQ ID NO: 537089 - DNA, 25 bp, Mus musculus
gcagctgctggagttcacagataaa

SEQ ID NO: 537090 - DNA, 25 bp, Mus musculus
gcagctgctggccattgaacagagc

SEQ ID NO: 537091 - DNA, 25 bp, Mus musculus
gcagctgctggcgattgaacagagc

SEQ ID NO: 537092 - DNA, 25 bp, Mus musculus
gcagctgctgggacacgacacccgt

SEQ ID NO: 537093 - DNA, 25 bp, Mus musculus
gcagctgctgggtcacgacacccgt

SEQ ID NO: 537094 - DNA, 25 bp, Mus musculus
gcagctgctgtcaccgggagcctcg

SEQ ID NO: 537095 - DNA, 25 bp, Mus musculus
gcagctgctgtcatgattgctactg

SEQ ID NO: 537096 - DNA, 25 bp, Mus musculus
gcagctgctgtctccgggagcctcg

SEQ ID NO: 537097 - DNA, 25 bp, Mus musculus
gcagctgctgtcttgattgctactg

SEQ ID NO: 537098 - DNA, 25 bp, Mus musculus
gcagctggacccacgtaaattgttg

SEQ ID NO: 537099 - DNA, 25 bp, Mus musculus
gcagctggaccctcgtaaattgttg

SEQ ID NO: 537100 - DNA, 25 bp, Mus musculus
gcagctggactgaaattccatcgct

SEQ ID NO: 537101 - DNA, 25 bp, Mus musculus
gcagctggactgtaattccatcgct

SEQ ID NO: 537102 - DNA, 25 bp, Mus musculus
gcagctggagagacgctctgtgata

SEQ ID NO: 537103 - DNA, 25 bp, Mus musculus
gcagctggagagtcgctctgtgata

SEQ ID NO: 537104 - DNA, 25 bp, Mus musculus
gcagctggagatatcccaccagaag

SEQ ID NO: 537105 - DNA, 25 bp, Mus musculus
gcagctggagatttcccaccagaag

SEQ ID NO: 537106 - DNA, 25 bp, Mus musculus
gcagctggagctcaactcggagtct

SEQ ID NO: 537107 - DNA, 25 bp, Mus musculus
gcagctggagctgaactcggagtct

SEQ ID NO: 537108 - DNA, 25 bp, Mus musculus
gcagctggaggaccttattaatcaa

SEQ ID NO: 537109 - DNA, 25 bp, Mus musculus
gcagctggaggagcttattaatcaa

SEQ ID NO: 537110 - DNA, 25 bp, Mus musculus
gcagctggagtcactactgggcgcc

SEQ ID NO: 537111 - DNA, 25 bp, Mus musculus
gcagctggagtctctactgggcgcc

SEQ ID NO: 537112 - DNA, 25 bp, Mus musculus
gcagctggatagatgtgtggtactt

SEQ ID NO: 537113 - DNA, 25 bp, Mus musculus
gcagctggatagttgtgtggtactt

SEQ ID NO: 537114 - DNA, 25 bp, Mus musculus
gcagctggatcacaagaatgccact

SEQ ID NO: 537115 - DNA, 25 bp, Mus musculus
gcagctggatcagaagaatgccact

SEQ ID NO: 537116 - DNA, 25 bp, Mus musculus
gcagctggatctactttgggagact

SEQ ID NO: 537117 - DNA, 25 bp, Mus musculus
gcagctggatcttctttgggagact

SEQ ID NO: 537118 - DNA, 25 bp, Mus musculus
gcagctggcaaacgttcatagtatc

SEQ ID NO: 537119 - DNA, 25 bp, Mus musculus
gcagctggcaaaggttcatagtatc

SEQ ID NO: 537120 - DNA, 25 bp, Mus musculus
gcagctggcaagattacagtggatt

SEQ ID NO: 537121 - DNA, 25 bp, Mus musculus
gcagctggcaagtttacagtggatt

SEQ ID NO: 537122 - DNA, 25 bp, Mus musculus
gcagctggcacaccggctagcctgt

SEQ ID NO: 537123 - DNA, 25 bp, Mus musculus
gcagctggcacagcggctagcctgt

SEQ ID NO: 537124 - DNA, 25 bp, Mus musculus
gcagctggcaggagtgcaacaagaa

SEQ ID NO: 537125 - DNA, 25 bp, Mus musculus
gcagctggcaggtgtgcaacaagaa

SEQ ID NO: 537126 - DNA, 25 bp, Mus musculus
gcagctggcattagctccaacaaaa

SEQ ID NO: 537127 - DNA, 25 bp, Mus musculus
gcagctggcatttgctccaacaaaa

SEQ ID NO: 537128 - DNA, 25 bp, Mus musculus
gcagctggccttcattgacctcaga

SEQ ID NO: 537129 - DNA, 25 bp, Mus musculus
gcagctggccttgattgacctcaga

SEQ ID NO: 537130 - DNA, 25 bp, Mus musculus
gcagctggctcacggaccacaagat

SEQ ID NO: 537131 - DNA, 25 bp, Mus musculus
gcagctggctcagggaccacaagat

SEQ ID NO: 537132 - DNA, 25 bp, Mus musculus
gcagctggcttaattaacaccatgg

SEQ ID NO: 537133 - DNA, 25 bp, Mus musculus
gcagctggcttatttaacaccatgg

SEQ ID NO: 537134 - DNA, 25 bp, Mus musculus
gcagctgggatcatctaatcttttt

SEQ ID NO: 537135 - DNA, 25 bp, Mus musculus
gcagctgggatcttctaatcttttt

SEQ ID NO: 537136 - DNA, 25 bp, Mus musculus
gcagctgggcaaatagaaacctttc

SEQ ID NO: 537137 - DNA, 25 bp, Mus musculus
gcagctgggcaattagaaacctttc

SEQ ID NO: 537138 - DNA, 25 bp, Mus musculus
gcagctgggcggcactgtcaccaac

SEQ ID NO: 537139 - DNA, 25 bp, Mus musculus
gcagctgggcgggactgtcaccaac

SEQ ID NO: 537140 - DNA, 25 bp, Mus musculus
gcagctgggctaatatttacaactt

SEQ ID NO: 537141 - DNA, 25 bp, Mus musculus
gcagctgggctattatttacaactt

SEQ ID NO: 537142 - DNA, 25 bp, Mus musculus
gcagctggtccacttgatgctcaac

SEQ ID NO: 537143 - DNA, 25 bp, Mus musculus
gcagctggtccagttgatgctcaac

SEQ ID NO: 537144 - DNA, 25 bp, Mus musculus
gcagctggttaaatcctctaactgt

SEQ ID NO: 537145 - DNA, 25 bp, Mus musculus
gcagctggttaattcctctaactgt

SEQ ID NO: 537146 - DNA, 25 bp, Mus musculus
gcagctggttcaatcatacttgttt

SEQ ID NO: 537147 - DNA, 25 bp, Mus musculus
gcagctggttcattcatacttgttt

SEQ ID NO: 537148 - DNA, 25 bp, Mus musculus
gcagctggttggcagattatcctga

SEQ ID NO: 537149 - DNA, 25 bp, Mus musculus
gcagctggttgggagattatcctga

SEQ ID NO: 537150 - DNA, 25 bp, Mus musculus
gcagctgtaaccaacatacctcctg

SEQ ID NO: 537151 - DNA, 25 bp, Mus musculus
gcagctgtaacccaagaccctaaga

SEQ ID NO: 537152 - DNA, 25 bp, Mus musculus
gcagctgtaaccgaagaccctaaga

SEQ ID NO: 537153 - DNA, 25 bp, Mus musculus
gcagctgtaacctacatacctcctg

SEQ ID NO: 537154 - DNA, 25 bp, Mus musculus
gcagctgtaagcagacttttgtcaa

SEQ ID NO: 537155 - DNA, 25 bp, Mus musculus
gcagctgtaagctgacttttgtcaa

SEQ ID NO: 537156 - DNA, 25 bp, Mus musculus
gcagctgtaatcaaaatgctttgat

SEQ ID NO: 537157 - DNA, 25 bp, Mus musculus
gcagctgtaatctaaatgctttgat

SEQ ID NO: 537158 - DNA, 25 bp, Mus musculus
gcagctgtcaatcgttatgctcttg

SEQ ID NO: 537159 - DNA, 25 bp, Mus musculus
gcagctgtcaatggttatgctcttg

SEQ ID NO: 537160 - DNA, 25 bp, Mus musculus
gcagctgtcactcggctcagaaaag

SEQ ID NO: 537161 - DNA, 25 bp, Mus musculus
gcagctgtcactgggctcagaaaag

SEQ ID NO: 537162 - DNA, 25 bp, Mus musculus
gcagctgtcagaaaggcagcctcgc

SEQ ID NO: 537163 - DNA, 25 bp, Mus musculus
gcagctgtcagataggcagcctcgc

SEQ ID NO: 537164 - DNA, 25 bp, Mus musculus
gcagctgtccctaagggaatacaga

SEQ ID NO: 537165 - DNA, 25 bp, Mus musculus
gcagctgtcccttagggaatacaga

SEQ ID NO: 537166 - DNA, 25 bp, Mus musculus
gcagctgtccttaaaactgttcaca

SEQ ID NO: 537167 - DNA, 25 bp, Mus musculus
gcagctgtcctttaaactgttcaca

SEQ ID NO: 537168 - DNA, 25 bp, Mus musculus
gcagctgtctgcatttgctatatgg

SEQ ID NO: 537169 - DNA, 25 bp, Mus musculus
gcagctgtctgcttttgctatatgg

SEQ ID NO: 537170 - DNA, 25 bp, Mus musculus
gcagctgtcttacgatgtcctacaa

SEQ ID NO: 537171 - DNA, 25 bp, Mus musculus
gcagctgtcttactacatttcccta

SEQ ID NO: 537172 - DNA, 25 bp, Mus musculus
gcagctgtcttaggatgtcctacaa

SEQ ID NO: 537173 - DNA, 25 bp, Mus musculus
gcagctgtcttagtacatttcccta

SEQ ID NO: 537174 - DNA, 25 bp, Mus musculus
gcagctgtgaatctgctgtcttcac

SEQ ID NO: 537175 - DNA, 25 bp, Mus musculus
gcagctgtgaatgtgctgtcttcac

SEQ ID NO: 537176 - DNA, 25 bp, Mus musculus
gcagctgtgagaaatcttgagaact

SEQ ID NO: 537177 - DNA, 25 bp, Mus musculus
gcagctgtgagatatcttgagaact

SEQ ID NO: 537178 - DNA, 25 bp, Mus musculus
gcagctgtgcgcctatgattggcta

SEQ ID NO: 537179 - DNA, 25 bp, Mus musculus
gcagctgtgcgcgtatgattggcta

SEQ ID NO: 537180 - DNA, 25 bp, Mus musculus
gcagctgtggctcgtgtctgactat

SEQ ID NO: 537181 - DNA, 25 bp, Mus musculus
gcagctgtggctggtgtctgactat

SEQ ID NO: 537182 - DNA, 25 bp, Mus musculus
gcagctgtgggtataatacgagcct

SEQ ID NO: 537183 - DNA, 25 bp, Mus musculus
gcagctgtgggtttaatacgagcct

SEQ ID NO: 537184 - DNA, 25 bp, Mus musculus
gcagctgtgtagacgcgtggacaca

SEQ ID NO: 537185 - DNA, 25 bp, Mus musculus
gcagctgtgtagtcgcgtggacaca

SEQ ID NO: 537186 - DNA, 25 bp, Mus musculus
gcagctgtgtataagtttggttctc

SEQ ID NO: 537187 - DNA, 25 bp, Mus musculus
gcagctgtgtattagtttggttctc

SEQ ID NO: 537188 - DNA, 25 bp, Mus musculus
gcagctgtgtccactcacgtgaaga

SEQ ID NO: 537189 - DNA, 25 bp, Mus musculus
gcagctgtgtcctctcacgtgaaga

SEQ ID NO: 537190 - DNA, 25 bp, Mus musculus
gcagctgtgtctaatttacttgttt

SEQ ID NO: 537191 - DNA, 25 bp, Mus musculus
gcagctgtgtcttatttacttgttt

SEQ ID NO: 537192 - DNA, 25 bp, Mus musculus
gcagctgtgtttcccttctttaaat

SEQ ID NO: 537193 - DNA, 25 bp, Mus musculus
gcagctgtgtttcctatgacctaca

SEQ ID NO: 537194 - DNA, 25 bp, Mus musculus
gcagctgtgtttgccttctttaaat

SEQ ID NO: 537195 - DNA, 25 bp, Mus musculus
gcagctgtgtttgctatgacctaca

SEQ ID NO: 537196 - DNA, 25 bp, Mus musculus
gcagctgttaggattgtgcacattt

SEQ ID NO: 537197 - DNA, 25 bp, Mus musculus
gcagctgttaggtttgtgcacattt

SEQ ID NO: 537198 - DNA, 25 bp, Mus musculus
gcagctgttataccccgaggcatgt

SEQ ID NO: 537199 - DNA, 25 bp, Mus musculus
gcagctgttatagcccgaggcatgt

SEQ ID NO: 537200 - DNA, 25 bp, Mus musculus
gcagctgttctgatggctcgataaa

SEQ ID NO: 537201 - DNA, 25 bp, Mus musculus
gcagctgttctgttggctcgataaa

SEQ ID NO: 537202 - DNA, 25 bp, Mus musculus
gcagctgttgaaccaaaactggaag

SEQ ID NO: 537203 - DNA, 25 bp, Mus musculus
gcagctgttgaagcaaaactggaag

SEQ ID NO: 537204 - DNA, 25 bp, Mus musculus
gcagctgttgacacgtgtccagtaa

SEQ ID NO: 537205 - DNA, 25 bp, Mus musculus
gcagctgttgactcgtgtccagtaa

SEQ ID NO: 537206 - DNA, 25 bp, Mus musculus
gcagctgttgcaattgcaggtcgct

SEQ ID NO: 537207 - DNA, 25 bp, Mus musculus
gcagctgttgcatttgcaggtcgct

SEQ ID NO: 537208 - DNA, 25 bp, Mus musculus
gcagctgttgctccagaaactattc

SEQ ID NO: 537209 - DNA, 25 bp, Mus musculus
gcagctgttgctgcagaaactattc

SEQ ID NO: 537210 - DNA, 25 bp, Mus musculus
gcagctgttggaactcctggtatta

SEQ ID NO: 537211 - DNA, 25 bp, Mus musculus
gcagctgttggatctcctggtatta

SEQ ID NO: 537212 - DNA, 25 bp, Mus musculus
gcagcttaacaacacttgatttcag

SEQ ID NO: 537213 - DNA, 25 bp, Mus musculus
gcagcttaacaagacttgatttcag

SEQ ID NO: 537214 - DNA, 25 bp, Mus musculus
gcagcttaagttagcactgggtgaa

SEQ ID NO: 537215 - DNA, 25 bp, Mus musculus
gcagcttaagtttgcactgggtgaa

SEQ ID NO: 537216 - DNA, 25 bp, Mus musculus
gcagcttacaggaggccatgaggcc

SEQ ID NO: 537217 - DNA, 25 bp, Mus musculus
gcagcttacaggtggccatgaggcc

SEQ ID NO: 537218 - DNA, 25 bp, Mus musculus
gcagcttacatcatctcagatcctg

SEQ ID NO: 537219 - DNA, 25 bp, Mus musculus
gcagcttacatcttctcagatcctg

SEQ ID NO: 537220 - DNA, 25 bp, Mus musculus
gcagcttactgacattgtccttctt

SEQ ID NO: 537221 - DNA, 25 bp, Mus musculus
gcagcttactgagattgtccttctt

SEQ ID NO: 537222 - DNA, 25 bp, Mus musculus
gcagcttagctactattcccttctt

SEQ ID NO: 537223 - DNA, 25 bp, Mus musculus
gcagcttagctagtattcccttctt

SEQ ID NO: 537224 - DNA, 25 bp, Mus musculus
gcagcttagtttattcatactttca

SEQ ID NO: 537225 - DNA, 25 bp, Mus musculus
gcagcttagttttttcatactttca

SEQ ID NO: 537226 - DNA, 25 bp, Mus musculus
gcagcttatagtatctgtcgggtac

SEQ ID NO: 537227 - DNA, 25 bp, Mus musculus
gcagcttatagtttctgtcgggtac

SEQ ID NO: 537228 - DNA, 25 bp, Mus musculus
gcagcttcaaataaggaaagcataa

SEQ ID NO: 537229 - DNA, 25 bp, Mus musculus
gcagcttcaaattaggaaagcataa

SEQ ID NO: 537230 - DNA, 25 bp, Mus musculus
gcagcttcaagcaaattgattctta

SEQ ID NO: 537231 - DNA, 25 bp, Mus musculus
gcagcttcaagctaattgattctta

SEQ ID NO: 537232 - DNA, 25 bp, Mus musculus
gcagcttcaagtatctagagatcga

SEQ ID NO: 537233 - DNA, 25 bp, Mus musculus
gcagcttcaagtttctagagatcga

SEQ ID NO: 537234 - DNA, 25 bp, Mus musculus
gcagcttcactgataaatttcacct

SEQ ID NO: 537235 - DNA, 25 bp, Mus musculus
gcagcttcactgttaaatttcacct

SEQ ID NO: 537236 - DNA, 25 bp, Mus musculus
gcagcttcagatacccttcagggaa

SEQ ID NO: 537237 - DNA, 25 bp, Mus musculus
gcagcttcagattcccttcagggaa

SEQ ID NO: 537238 - DNA, 25 bp, Mus musculus
gcagcttcaggcaccaaggaagacc

SEQ ID NO: 537239 - DNA, 25 bp, Mus musculus
gcagcttcaggctccaaggaagacc

SEQ ID NO: 537240 - DNA, 25 bp, Mus musculus
gcagcttcagttacgcttcagaata

SEQ ID NO: 537241 - DNA, 25 bp, Mus musculus
gcagcttcagttcaaaggacagtac

SEQ ID NO: 537242 - DNA, 25 bp, Mus musculus
gcagcttcagttgaaaggacagtac

SEQ ID NO: 537243 - DNA, 25 bp, Mus musculus
gcagcttcagtttcgcttcagaata

SEQ ID NO: 537244 - DNA, 25 bp, Mus musculus
gcagcttcatggagtgtggtcagtc

SEQ ID NO: 537245 - DNA, 25 bp, Mus musculus
gcagcttcatggtgtgtggtcagtc

SEQ ID NO: 537246 - DNA, 25 bp, Mus musculus
gcagcttcatttaggcacattttaa

SEQ ID NO: 537247 - DNA, 25 bp, Mus musculus
gcagcttcattttggcacattttaa

SEQ ID NO: 537248 - DNA, 25 bp, Mus musculus
gcagcttccaagaccattgttgttg

SEQ ID NO: 537249 - DNA, 25 bp, Mus musculus
gcagcttccaagtccattgttgttg

SEQ ID NO: 537250 - DNA, 25 bp, Mus musculus
gcagcttccacaacgtgtgagggat

SEQ ID NO: 537251 - DNA, 25 bp, Mus musculus
gcagcttccacatcgtgtgagggat

SEQ ID NO: 537252 - DNA, 25 bp, Mus musculus
gcagcttccagccttagagatttct

SEQ ID NO: 537253 - DNA, 25 bp, Mus musculus
gcagcttccagcgttagagatttct

SEQ ID NO: 537254 - DNA, 25 bp, Mus musculus
gcagcttccccgaggcaagtgtgtc

SEQ ID NO: 537255 - DNA, 25 bp, Mus musculus
gcagcttccccgtggcaagtgtgtc

SEQ ID NO: 537256 - DNA, 25 bp, Mus musculus
gcagcttccgcaaacaattacgcag

SEQ ID NO: 537257 - DNA, 25 bp, Mus musculus
gcagcttccgcatacaattacgcag

SEQ ID NO: 537258 - DNA, 25 bp, Mus musculus
gcagcttccttcaccccttttttat

SEQ ID NO: 537259 - DNA, 25 bp, Mus musculus
gcagcttccttctccccttttttat

SEQ ID NO: 537260 - DNA, 25 bp, Mus musculus
gcagcttcctttatcttgctgataa

SEQ ID NO: 537261 - DNA, 25 bp, Mus musculus
gcagcttcctttttcttgctgataa

SEQ ID NO: 537262 - DNA, 25 bp, Mus musculus
gcagcttcgaagctgttcattactt

SEQ ID NO: 537263 - DNA, 25 bp, Mus musculus
gcagcttcgaaggtgttcattactt

SEQ ID NO: 537264 - DNA, 25 bp, Mus musculus
gcagcttcgaatctatggctttcaa

SEQ ID NO: 537265 - DNA, 25 bp, Mus musculus
gcagcttcgaatgtatggctttcaa

SEQ ID NO: 537266 - DNA, 25 bp, Mus musculus
gcagcttcgcggaatttcacagaat

SEQ ID NO: 537267 - DNA, 25 bp, Mus musculus
gcagcttcgcggtatttcacagaat

SEQ ID NO: 537268 - DNA, 25 bp, Mus musculus
gcagcttcggaaaacagtcctctgt

SEQ ID NO: 537269 - DNA, 25 bp, Mus musculus
gcagcttcggaatacagtcctctgt

SEQ ID NO: 537270 - DNA, 25 bp, Mus musculus
gcagcttcggcacactgaggctata

SEQ ID NO: 537271 - DNA, 25 bp, Mus musculus
gcagcttcggcagactgaggctata

SEQ ID NO: 537272 - DNA, 25 bp, Mus musculus
gcagcttcgggcagttcatgaacaa

SEQ ID NO: 537273 - DNA, 25 bp, Mus musculus
gcagcttcgggctgttcatgaacaa

SEQ ID NO: 537274 - DNA, 25 bp, Mus musculus
gcagcttctaagcatgccgtcatgg

SEQ ID NO: 537275 - DNA, 25 bp, Mus musculus
gcagcttctaaggatgccgtcatgg

SEQ ID NO: 537276 - DNA, 25 bp, Mus musculus
gcagcttctcctcactgtagtaaag

SEQ ID NO: 537277 - DNA, 25 bp, Mus musculus
gcagcttctcctgactgtagtaaag

SEQ ID NO: 537278 - DNA, 25 bp, Mus musculus
gcagcttcttggacagcagagaccc

SEQ ID NO: 537279 - DNA, 25 bp, Mus musculus
gcagcttcttggtcagcagagaccc

SEQ ID NO: 537280 - DNA, 25 bp, Mus musculus
gcagcttgaacgactaaagcagaaa

SEQ ID NO: 537281 - DNA, 25 bp, Mus musculus
gcagcttgaacgtctaaagcagaaa

SEQ ID NO: 537282 - DNA, 25 bp, Mus musculus
gcagcttgaagtaaaccatgtgggt

SEQ ID NO: 537283 - DNA, 25 bp, Mus musculus
gcagcttgaagttaaccatgtgggt

SEQ ID NO: 537284 - DNA, 25 bp, Mus musculus
gcagcttgagagctttgtacttttc

SEQ ID NO: 537285 - DNA, 25 bp, Mus musculus
gcagcttgagaggtttgtacttttc

SEQ ID NO: 537286 - DNA, 25 bp, Mus musculus
gcagcttgcaaaaacagaagagtac

SEQ ID NO: 537287 - DNA, 25 bp, Mus musculus
gcagcttgcaaatacagaagagtac

SEQ ID NO: 537288 - DNA, 25 bp, Mus musculus
gcagcttgcaagagaactcgaatct

SEQ ID NO: 537289 - DNA, 25 bp, Mus musculus
gcagcttgcaagtgaactcgaatct

SEQ ID NO: 537290 - DNA, 25 bp, Mus musculus
gcagcttgcataacacgagggccat

SEQ ID NO: 537291 - DNA, 25 bp, Mus musculus
gcagcttgcatatcacgagggccat

SEQ ID NO: 537292 - DNA, 25 bp, Mus musculus
gcagcttgccctaaagtgatctcag

SEQ ID NO: 537293 - DNA, 25 bp, Mus musculus
gcagcttgcccttaagtgatctcag

SEQ ID NO: 537294 - DNA, 25 bp, Mus musculus
gcagcttgcctaaggtgtgacttaa

SEQ ID NO: 537295 - DNA, 25 bp, Mus musculus
gcagcttgcctatggtgtgacttaa

SEQ ID NO: 537296 - DNA, 25 bp, Mus musculus
gcagcttgctatacgtggagatgaa

SEQ ID NO: 537297 - DNA, 25 bp, Mus musculus
gcagcttgctattcgtggagatgaa

SEQ ID NO: 537298 - DNA, 25 bp, Mus musculus
gcagcttgctctcatcggagatgat

SEQ ID NO: 537299 - DNA, 25 bp, Mus musculus
gcagcttgctctgatcggagatgat

SEQ ID NO: 537300 - DNA, 25 bp, Mus musculus
gcagcttgcttgcttagcccagcag

SEQ ID NO: 537301 - DNA, 25 bp, Mus musculus
gcagcttgcttggttagcccagcag

SEQ ID NO: 537302 - DNA, 25 bp, Mus musculus
gcagcttggaccaggctagtactga

SEQ ID NO: 537303 - DNA, 25 bp, Mus musculus
gcagcttggacctggctagtactga

SEQ ID NO: 537304 - DNA, 25 bp, Mus musculus
gcagcttggacgcaactgtgctagt

SEQ ID NO: 537305 - DNA, 25 bp, Mus musculus
gcagcttggacggaactgtgctagt

SEQ ID NO: 537306 - DNA, 25 bp, Mus musculus
gcagcttggatgctcaacaactgga

SEQ ID NO: 537307 - DNA, 25 bp, Mus musculus
gcagcttggatggtcaacaactgga

SEQ ID NO: 537308 - DNA, 25 bp, Mus musculus
gcagcttggcccaggagagctagat

SEQ ID NO: 537309 - DNA, 25 bp, Mus musculus
gcagcttggccctggagagctagat

SEQ ID NO: 537310 - DNA, 25 bp, Mus musculus
gcagcttggcgactgtttttgtttt

SEQ ID NO: 537311 - DNA, 25 bp, Mus musculus
gcagcttggcgagtgtttttgtttt

SEQ ID NO: 537312 - DNA, 25 bp, Mus musculus
gcagcttggttgcacttgccccgtt

SEQ ID NO: 537313 - DNA, 25 bp, Mus musculus
gcagcttggttggacttgccccgtt

SEQ ID NO: 537314 - DNA, 25 bp, Mus musculus
gcagcttgtaggcttgcacaaagca

SEQ ID NO: 537315 - DNA, 25 bp, Mus musculus
gcagcttgtagggttgcacaaagca

SEQ ID NO: 537316 - DNA, 25 bp, Mus musculus
gcagcttgtagtagcaactttgggt

SEQ ID NO: 537317 - DNA, 25 bp, Mus musculus
gcagcttgtagttgcaactttgggt

SEQ ID NO: 537318 - DNA, 25 bp, Mus musculus
gcagcttgtatgacctatgagcaaa

SEQ ID NO: 537319 - DNA, 25 bp, Mus musculus
gcagcttgtatgtcctatgagcaaa

SEQ ID NO: 537320 - DNA, 25 bp, Mus musculus
gcagcttgtcatctggaagatccga

SEQ ID NO: 537321 - DNA, 25 bp, Mus musculus
gcagcttgtcatgtggaagatccga

SEQ ID NO: 537322 - DNA, 25 bp, Mus musculus
gcagcttgtgaacaccgactggaag

SEQ ID NO: 537323 - DNA, 25 bp, Mus musculus
gcagcttgtgaagaccgactggaag

SEQ ID NO: 537324 - DNA, 25 bp, Mus musculus
gcagcttgttaccagtaacttgttt

SEQ ID NO: 537325 - DNA, 25 bp, Mus musculus
gcagcttgttacgagtaacttgttt

SEQ ID NO: 537326 - DNA, 25 bp, Mus musculus
gcagctttagaactgagcccctcta

SEQ ID NO: 537327 - DNA, 25 bp, Mus musculus
gcagctttagaagtgagcccctcta

SEQ ID NO: 537328 - DNA, 25 bp, Mus musculus
gcagctttaggtatgtttccaggca

SEQ ID NO: 537329 - DNA, 25 bp, Mus musculus
gcagctttaggtttgtttccaggca

SEQ ID NO: 537330 - DNA, 25 bp, Mus musculus
gcagctttatctcagcacgtaccag

SEQ ID NO: 537331 - DNA, 25 bp, Mus musculus
gcagctttatctgagcacgtaccag

SEQ ID NO: 537332 - DNA, 25 bp, Mus musculus
gcagctttcagcctcaactgatggg

SEQ ID NO: 537333 - DNA, 25 bp, Mus musculus
gcagctttcagcgtcaactgatggg

SEQ ID NO: 537334 - DNA, 25 bp, Mus musculus
gcagctttcagtcatccgttctcct

SEQ ID NO: 537335 - DNA, 25 bp, Mus musculus
gcagctttcagtgatccgttctcct

SEQ ID NO: 537336 - DNA, 25 bp, Mus musculus
gcagctttccaaaaaagtgcagtat

SEQ ID NO: 537337 - DNA, 25 bp, Mus musculus
gcagctttccaataaagtgcagtat

SEQ ID NO: 537338 - DNA, 25 bp, Mus musculus
gcagctttccacatttaaaccaacc

SEQ ID NO: 537339 - DNA, 25 bp, Mus musculus
gcagctttccacttttaaaccaacc

SEQ ID NO: 537340 - DNA, 25 bp, Mus musculus
gcagctttccagacctatgagcaga

SEQ ID NO: 537341 - DNA, 25 bp, Mus musculus
gcagctttccagtcctatgagcaga

SEQ ID NO: 537342 - DNA, 25 bp, Mus musculus
gcagctttccctagcagaggttttt

SEQ ID NO: 537343 - DNA, 25 bp, Mus musculus
gcagctttcccttgcagaggttttt

SEQ ID NO: 537344 - DNA, 25 bp, Mus musculus
gcagctttcctgaatttgcctggaa

SEQ ID NO: 537345 - DNA, 25 bp, Mus musculus
gcagctttcctgtatttgcctggaa

SEQ ID NO: 537346 - DNA, 25 bp, Mus musculus
gcagctttcgggaaggccagcagtt

SEQ ID NO: 537347 - DNA, 25 bp, Mus musculus
gcagctttcgggtaggccagcagtt

SEQ ID NO: 537348 - DNA, 25 bp, Mus musculus
gcagctttctgcagaggagttggac

SEQ ID NO: 537349 - DNA, 25 bp, Mus musculus
gcagctttctgcatggaatgccaaa

SEQ ID NO: 537350 - DNA, 25 bp, Mus musculus
gcagctttctgctgaggagttggac

SEQ ID NO: 537351 - DNA, 25 bp, Mus musculus
gcagctttctgcttggaatgccaaa

SEQ ID NO: 537352 - DNA, 25 bp, Mus musculus
gcagctttctgtcacatatgaacat

SEQ ID NO: 537353 - DNA, 25 bp, Mus musculus
gcagctttctgtgacatatgaacat

SEQ ID NO: 537354 - DNA, 25 bp, Mus musculus
gcagctttctttatcatgggagaga

SEQ ID NO: 537355 - DNA, 25 bp, Mus musculus
gcagctttctttttcatgggagaga

SEQ ID NO: 537356 - DNA, 25 bp, Mus musculus
gcagctttgaccatatttagagtta

SEQ ID NO: 537357 - DNA, 25 bp, Mus musculus
gcagctttgaccttatttagagtta

SEQ ID NO: 537358 - DNA, 25 bp, Mus musculus
gcagctttgagtattctgagcagaa

SEQ ID NO: 537359 - DNA, 25 bp, Mus musculus
gcagctttgagttttctgagcagaa

SEQ ID NO: 537360 - DNA, 25 bp, Mus musculus
gcagctttgataagcgcaagacagc

SEQ ID NO: 537361 - DNA, 25 bp, Mus musculus
gcagctttgatatgcgcaagacagc

SEQ ID NO: 537362 - DNA, 25 bp, Mus musculus
gcagctttgatgacctccttacaaa

SEQ ID NO: 537363 - DNA, 25 bp, Mus musculus
gcagctttgatgtcctccttacaaa

SEQ ID NO: 537364 - DNA, 25 bp, Mus musculus
gcagctttgcccacagtagtagtga

SEQ ID NO: 537365 - DNA, 25 bp, Mus musculus
gcagctttgccctcagtagtagtga

SEQ ID NO: 537366 - DNA, 25 bp, Mus musculus
gcagctttggaaacaccatgtctga

SEQ ID NO: 537367 - DNA, 25 bp, Mus musculus
gcagctttggaatcaccatgtctga

SEQ ID NO: 537368 - DNA, 25 bp, Mus musculus
gcagctttggtaatcccacgagtaa

SEQ ID NO: 537369 - DNA, 25 bp, Mus musculus
gcagctttggtattcccacgagtaa

SEQ ID NO: 537370 - DNA, 25 bp, Mus musculus
gcagctttggtgctcttcagcgttg

SEQ ID NO: 537371 - DNA, 25 bp, Mus musculus
gcagctttggtggtcttcagcgttg

SEQ ID NO: 537372 - DNA, 25 bp, Mus musculus
gcagcttttaatccatggcaccatc

SEQ ID NO: 537373 - DNA, 25 bp, Mus musculus
gcagcttttaatgcatggcaccatc

SEQ ID NO: 537374 - DNA, 25 bp, Mus musculus
gcagcttttacaattcaggcagcag

SEQ ID NO: 537375 - DNA, 25 bp, Mus musculus
gcagcttttacatttcaggcagcag

SEQ ID NO: 537376 - DNA, 25 bp, Mus musculus
gcagcttttagacacccagggtggg

SEQ ID NO: 537377 - DNA, 25 bp, Mus musculus
gcagcttttagagacccagggtggg

SEQ ID NO: 537378 - DNA, 25 bp, Mus musculus
gcagcttttagccaagacatcaaca

SEQ ID NO: 537379 - DNA, 25 bp, Mus musculus
gcagcttttagcgaagacatcaaca

SEQ ID NO: 537380 - DNA, 25 bp, Mus musculus
gcagcttttattccctgtgcaacaa

SEQ ID NO: 537381 - DNA, 25 bp, Mus musculus
gcagcttttattgcctgtgcaacaa

SEQ ID NO: 537382 - DNA, 25 bp, Mus musculus
gcagcttttgcaccggtcaacatca

SEQ ID NO: 537383 - DNA, 25 bp, Mus musculus
gcagcttttgcagcggtcaacatca

SEQ ID NO: 537384 - DNA, 25 bp, Mus musculus
gcagcttttggaaaaccaatcaact

SEQ ID NO: 537385 - DNA, 25 bp, Mus musculus
gcagcttttggataaccaatcaact

SEQ ID NO: 537386 - DNA, 25 bp, Mus musculus
gcagcttttgttacaggttttactc

SEQ ID NO: 537387 - DNA, 25 bp, Mus musculus
gcagcttttgtttcaggttttactc

SEQ ID NO: 537388 - DNA, 25 bp, Mus musculus
gcagctttttgaaatgcaatggcaa

SEQ ID NO: 537389 - DNA, 25 bp, Mus musculus
gcagctttttgatatgcaatggcaa

SEQ ID NO: 537390 - DNA, 25 bp, Mus musculus
gcagctttttgtcaatactattgtt

SEQ ID NO: 537391 - DNA, 25 bp, Mus musculus
gcagctttttgtgaatactattgtt

SEQ ID NO: 537392 - DNA, 25 bp, Mus musculus
gcaggaaaaatacgtcaaatcagat

SEQ ID NO: 537393 - DNA, 25 bp, Mus musculus
gcaggaaaaataggtcaaatcagat

SEQ ID NO: 537394 - DNA, 25 bp, Mus musculus
gcaggaaaactgacttgagtgtcca

SEQ ID NO: 537395 - DNA, 25 bp, Mus musculus
gcaggaaaactgtcttgagtgtcca

SEQ ID NO: 537396 - DNA, 25 bp, Mus musculus
gcaggaaaatgtacctttcctttat

SEQ ID NO: 537397 - DNA, 25 bp, Mus musculus
gcaggaaaatgttcctttcctttat

SEQ ID NO: 537398 - DNA, 25 bp, Mus musculus
gcaggaaaatttctgtctctcccga

SEQ ID NO: 537399 - DNA, 25 bp, Mus musculus
gcaggaaaatttgtgtctctcccga

SEQ ID NO: 537400 - DNA, 25 bp, Mus musculus
gcaggaaacattaaaaatctccaag

SEQ ID NO: 537401 - DNA, 25 bp, Mus musculus
gcaggaaacatttaaaatctccaag

SEQ ID NO: 537402 - DNA, 25 bp, Mus musculus
gcaggaaaccagctttatcaccatt

SEQ ID NO: 537403 - DNA, 25 bp, Mus musculus
gcaggaaaccaggtttatcaccatt

SEQ ID NO: 537404 - DNA, 25 bp, Mus musculus
gcaggaaacctcaagtctgtgtggg

SEQ ID NO: 537405 - DNA, 25 bp, Mus musculus
gcaggaaacctctagtctgtgtggg

SEQ ID NO: 537406 - DNA, 25 bp, Mus musculus
gcaggaaactatccagccaaatact

SEQ ID NO: 537407 - DNA, 25 bp, Mus musculus
gcaggaaactatgcagccaaatact

SEQ ID NO: 537408 - DNA, 25 bp, Mus musculus
gcaggaaactggcttgttccatttc

SEQ ID NO: 537409 - DNA, 25 bp, Mus musculus
gcaggaaactgggttgttccatttc

SEQ ID NO: 537410 - DNA, 25 bp, Mus musculus
gcaggaaagagtactcagcaggctt

SEQ ID NO: 537411 - DNA, 25 bp, Mus musculus
gcaggaaagagttctcagcaggctt

SEQ ID NO: 537412 - DNA, 25 bp, Mus musculus
gcaggaaaggaccgctgtagtcttt

SEQ ID NO: 537413 - DNA, 25 bp, Mus musculus
gcaggaaaggacggctgtagtcttt

SEQ ID NO: 537414 - DNA, 25 bp, Mus musculus
gcaggaaaggttcgtcccagactca

SEQ ID NO: 537415 - DNA, 25 bp, Mus musculus
gcaggaaaggttggtcccagactca

SEQ ID NO: 537416 - DNA, 25 bp, Mus musculus
gcaggaaagtttctgcttttagtta

SEQ ID NO: 537417 - DNA, 25 bp, Mus musculus
gcaggaaagtttgtgcttttagtta

SEQ ID NO: 537418 - DNA, 25 bp, Mus musculus
gcaggaaatctcagtttctgtgggc

SEQ ID NO: 537419 - DNA, 25 bp, Mus musculus
gcaggaaatctctgtttctgtgggc

SEQ ID NO: 537420 - DNA, 25 bp, Mus musculus
gcaggaaatgataatcttacacttt

SEQ ID NO: 537421 - DNA, 25 bp, Mus musculus
gcaggaaatgattatcttacacttt

SEQ ID NO: 537422 - DNA, 25 bp, Mus musculus
gcaggaaatgtgattgccctaattg

SEQ ID NO: 537423 - DNA, 25 bp, Mus musculus
gcaggaaatgtgtttgccctaattg

SEQ ID NO: 537424 - DNA, 25 bp, Mus musculus
gcaggaacacacatcataaccaggg

SEQ ID NO: 537425 - DNA, 25 bp, Mus musculus
gcaggaacacacttcataaccaggg

SEQ ID NO: 537426 - DNA, 25 bp, Mus musculus
gcaggaacagacaatcccacctggc

SEQ ID NO: 537427 - DNA, 25 bp, Mus musculus
gcaggaacagactatcccacctggc

SEQ ID NO: 537428 - DNA, 25 bp, Mus musculus
gcaggaacagagacttcgccttcac

SEQ ID NO: 537429 - DNA, 25 bp, Mus musculus
gcaggaacagagtcttcgccttcac

SEQ ID NO: 537430 - DNA, 25 bp, Mus musculus
gcaggaacatgcacatctgtgtgat

SEQ ID NO: 537431 - DNA, 25 bp, Mus musculus
gcaggaacatgctcatctgtgtgat

SEQ ID NO: 537432 - DNA, 25 bp, Mus musculus
gcaggaaccggtctcacattgtgtt

SEQ ID NO: 537433 - DNA, 25 bp, Mus musculus
gcaggaaccggtgtcacattgtgtt

SEQ ID NO: 537434 - DNA, 25 bp, Mus musculus
gcaggaacctagaagttttctacat

SEQ ID NO: 537435 - DNA, 25 bp, Mus musculus
gcaggaacctagtagttttctacat

SEQ ID NO: 537436 - DNA, 25 bp, Mus musculus
gcaggaaccttgctgggctttgtca

SEQ ID NO: 537437 - DNA, 25 bp, Mus musculus
gcaggaaccttggtgggctttgtca

SEQ ID NO: 537438 - DNA, 25 bp, Mus musculus
gcaggaactaggatacgggtacact

SEQ ID NO: 537439 - DNA, 25 bp, Mus musculus
gcaggaactaggttacgggtacact

SEQ ID NO: 537440 - DNA, 25 bp, Mus musculus
gcaggaactcaaactcccacaggag

SEQ ID NO: 537441 - DNA, 25 bp, Mus musculus
gcaggaactcaacgatggcgtcatc

SEQ ID NO: 537442 - DNA, 25 bp, Mus musculus
gcaggaactcaaggatggcgtcatc

SEQ ID NO: 537443 - DNA, 25 bp, Mus musculus
gcaggaactcaatctcccacaggag

SEQ ID NO: 537444 - DNA, 25 bp, Mus musculus
gcaggaactgacatgcaacccacct

SEQ ID NO: 537445 - DNA, 25 bp, Mus musculus
gcaggaactgacttgcaacccacct

SEQ ID NO: 537446 - DNA, 25 bp, Mus musculus
gcaggaactgctagagggcgccggg

SEQ ID NO: 537447 - DNA, 25 bp, Mus musculus
gcaggaactgcttgagggcgccggg

SEQ ID NO: 537448 - DNA, 25 bp, Mus musculus
gcaggaactggccttttataaaatt

SEQ ID NO: 537449 - DNA, 25 bp, Mus musculus
gcaggaactggcgttttataaaatt

SEQ ID NO: 537450 - DNA, 25 bp, Mus musculus
gcaggaactgggacaagtcaccctg

SEQ ID NO: 537451 - DNA, 25 bp, Mus musculus
gcaggaactgggtcaagtcaccctg

SEQ ID NO: 537452 - DNA, 25 bp, Mus musculus
gcaggaacttccatgaggctggaaa

SEQ ID NO: 537453 - DNA, 25 bp, Mus musculus
gcaggaacttccttgaggctggaaa

SEQ ID NO: 537454 - DNA, 25 bp, Mus musculus
gcaggaacttctcaaacccgctgtc

SEQ ID NO: 537455 - DNA, 25 bp, Mus musculus
gcaggaacttctgaaacccgctgtc

SEQ ID NO: 537456 - DNA, 25 bp, Mus musculus
gcaggaactttccctgacccaagaa

SEQ ID NO: 537457 - DNA, 25 bp, Mus musculus
gcaggaactttcgctgacccaagaa

SEQ ID NO: 537458 - DNA, 25 bp, Mus musculus
gcaggaacttttccttgaaattaaa

SEQ ID NO: 537459 - DNA, 25 bp, Mus musculus
gcaggaacttttgcttgaaattaaa

SEQ ID NO: 537460 - DNA, 25 bp, Mus musculus
gcaggaagaccgcctaacgggttat

SEQ ID NO: 537461 - DNA, 25 bp, Mus musculus
gcaggaagaccggctaacgggttat

SEQ ID NO: 537462 - DNA, 25 bp, Mus musculus
gcaggaagagcgacacagacccaaa

SEQ ID NO: 537463 - DNA, 25 bp, Mus musculus
gcaggaagagcgtcacagacccaaa

SEQ ID NO: 537464 - DNA, 25 bp, Mus musculus
gcaggaagcacgaaggagccacact

SEQ ID NO: 537465 - DNA, 25 bp, Mus musculus
gcaggaagcacgtaggagccacact

SEQ ID NO: 537466 - DNA, 25 bp, Mus musculus
gcaggaagccctaagatcagtaact

SEQ ID NO: 537467 - DNA, 25 bp, Mus musculus
gcaggaagcccttagatcagtaact

SEQ ID NO: 537468 - DNA, 25 bp, Mus musculus
gcaggaaggattcccgaccagtttt

SEQ ID NO: 537469 - DNA, 25 bp, Mus musculus
gcaggaaggattgccgaccagtttt

SEQ ID NO: 537470 - DNA, 25 bp, Mus musculus
gcaggaagggcactgatgactccat

SEQ ID NO: 537471 - DNA, 25 bp, Mus musculus
gcaggaagggcagtgatgactccat

SEQ ID NO: 537472 - DNA, 25 bp, Mus musculus
gcaggaagggtcacccaggcacgct

SEQ ID NO: 537473 - DNA, 25 bp, Mus musculus
gcaggaagggtctcccaggcacgct

SEQ ID NO: 537474 - DNA, 25 bp, Mus musculus
gcaggaaggtaccagatcagtagct

SEQ ID NO: 537475 - DNA, 25 bp, Mus musculus
gcaggaaggtacgagatcagtagct

SEQ ID NO: 537476 - DNA, 25 bp, Mus musculus
gcaggaagtgctataaccacagctg

SEQ ID NO: 537477 - DNA, 25 bp, Mus musculus
gcaggaagtgctttaaccacagctg

SEQ ID NO: 537478 - DNA, 25 bp, Mus musculus
gcaggaagtggtccgatctgtctta

SEQ ID NO: 537479 - DNA, 25 bp, Mus musculus
gcaggaagtggtgcgatctgtctta

SEQ ID NO: 537480 - DNA, 25 bp, Mus musculus
gcaggaagttaactaaaagtgccgt

SEQ ID NO: 537481 - DNA, 25 bp, Mus musculus
gcaggaagttaagtaaaagtgccgt

SEQ ID NO: 537482 - DNA, 25 bp, Mus musculus
gcaggaagttccaattcatacttgt

SEQ ID NO: 537483 - DNA, 25 bp, Mus musculus
gcaggaagttcctattcatacttgt

SEQ ID NO: 537484 - DNA, 25 bp, Mus musculus
gcaggaagttgtatgcttgggctaa

SEQ ID NO: 537485 - DNA, 25 bp, Mus musculus
gcaggaagttgtttgcttgggctaa

SEQ ID NO: 537486 - DNA, 25 bp, Mus musculus
gcaggaatactacccctatgtgtat

SEQ ID NO: 537487 - DNA, 25 bp, Mus musculus
gcaggaatactagccctatgtgtat

SEQ ID NO: 537488 - DNA, 25 bp, Mus musculus
gcaggaatatatcgcggcagttaaa

SEQ ID NO: 537489 - DNA, 25 bp, Mus musculus
gcaggaatatatggcggcagttaaa

SEQ ID NO: 537490 - DNA, 25 bp, Mus musculus
gcaggaatattgccagaagatttta

SEQ ID NO: 537491 - DNA, 25 bp, Mus musculus
gcaggaatattggcagaagatttta

SEQ ID NO: 537492 - DNA, 25 bp, Mus musculus
gcaggaatcactacagcttcacaga

SEQ ID NO: 537493 - DNA, 25 bp, Mus musculus
gcaggaatcacttcagcttcacaga

SEQ ID NO: 537494 - DNA, 25 bp, Mus musculus
gcaggaatcagtcccgtagcctctt

SEQ ID NO: 537495 - DNA, 25 bp, Mus musculus
gcaggaatcagtgccgtagcctctt

SEQ ID NO: 537496 - DNA, 25 bp, Mus musculus
gcaggaatcatcatcattgaccgga

SEQ ID NO: 537497 - DNA, 25 bp, Mus musculus
gcaggaatcatcttcattgaccgga

SEQ ID NO: 537498 - DNA, 25 bp, Mus musculus
gcaggaatcatgaggagctcttctc

SEQ ID NO: 537499 - DNA, 25 bp, Mus musculus
gcaggaatcatgtggagctcttctc

SEQ ID NO: 537500 - DNA, 25 bp, Mus musculus
gcaggaatccgaaaggcacagacac

SEQ ID NO: 537501 - DNA, 25 bp, Mus musculus
gcaggaatccgataggcacagacac

SEQ ID NO: 537502 - DNA, 25 bp, Mus musculus
gcaggaatccgcatcttagttctag

SEQ ID NO: 537503 - DNA, 25 bp, Mus musculus
gcaggaatccgcttcttagttctag

SEQ ID NO: 537504 - DNA, 25 bp, Mus musculus
gcaggaatgaacatagtttgtcttt

SEQ ID NO: 537505 - DNA, 25 bp, Mus musculus
gcaggaatgaacttagtttgtcttt

SEQ ID NO: 537506 - DNA, 25 bp, Mus musculus
gcaggaatgctaattttacagtcaa

SEQ ID NO: 537507 - DNA, 25 bp, Mus musculus
gcaggaatgctatttttacagtcaa

SEQ ID NO: 537508 - DNA, 25 bp, Mus musculus
gcaggaatgctgaattgtttttccg

SEQ ID NO: 537509 - DNA, 25 bp, Mus musculus
gcaggaatgctgacccttcattgta

SEQ ID NO: 537510 - DNA, 25 bp, Mus musculus
gcaggaatgctgtattgtttttccg

SEQ ID NO: 537511 - DNA, 25 bp, Mus musculus
gcaggaatgctgtcccttcattgta

SEQ ID NO: 537512 - DNA, 25 bp, Mus musculus
gcaggaatgttcagtacttctattt

SEQ ID NO: 537513 - DNA, 25 bp, Mus musculus
gcaggaatgttctgtacttctattt

SEQ ID NO: 537514 - DNA, 25 bp, Mus musculus
gcaggaatgttgagtgcccttacca

SEQ ID NO: 537515 - DNA, 25 bp, Mus musculus
gcaggaatgttgtgtgcccttacca

SEQ ID NO: 537516 - DNA, 25 bp, Mus musculus
gcaggacaaacactgtcttgtgtgt

SEQ ID NO: 537517 - DNA, 25 bp, Mus musculus
gcaggacaaacagtgtcttgtgtgt

SEQ ID NO: 537518 - DNA, 25 bp, Mus musculus
gcaggacaacatcactgggcttgca

SEQ ID NO: 537519 - DNA, 25 bp, Mus musculus
gcaggacaacatgactgggcttgca

SEQ ID NO: 537520 - DNA, 25 bp, Mus musculus
gcaggacaagcccattacacaggga

SEQ ID NO: 537521 - DNA, 25 bp, Mus musculus
gcaggacaagccgattacacaggga

SEQ ID NO: 537522 - DNA, 25 bp, Mus musculus
gcaggacacaaaagatatcgcttag

SEQ ID NO: 537523 - DNA, 25 bp, Mus musculus
gcaggacacaaatgatatcgcttag

SEQ ID NO: 537524 - DNA, 25 bp, Mus musculus
gcaggacaccgcaaagacagccagt

SEQ ID NO: 537525 - DNA, 25 bp, Mus musculus
gcaggacaccgctaagacagccagt

SEQ ID NO: 537526 - DNA, 25 bp, Mus musculus
gcaggacacctcaattaaggccaga

SEQ ID NO: 537527 - DNA, 25 bp, Mus musculus
gcaggacacctctattaaggccaga

SEQ ID NO: 537528 - DNA, 25 bp, Mus musculus
gcaggacacctgctcaaaaccaagg

SEQ ID NO: 537529 - DNA, 25 bp, Mus musculus
gcaggacacctggtcaaaaccaagg

SEQ ID NO: 537530 - DNA, 25 bp, Mus musculus
gcaggacacgagagttacttgtctc

SEQ ID NO: 537531 - DNA, 25 bp, Mus musculus
gcaggacacgagtgttacttgtctc

SEQ ID NO: 537532 - DNA, 25 bp, Mus musculus
gcaggacaggctcttttgttctcat

SEQ ID NO: 537533 - DNA, 25 bp, Mus musculus
gcaggacaggctgttttgttctcat

SEQ ID NO: 537534 - DNA, 25 bp, Mus musculus
gcaggacagggcattaaccactaag

SEQ ID NO: 537535 - DNA, 25 bp, Mus musculus
gcaggacagggctttaaccactaag

SEQ ID NO: 537536 - DNA, 25 bp, Mus musculus
gcaggacagtcgattctcatcataa

SEQ ID NO: 537537 - DNA, 25 bp, Mus musculus
gcaggacagtcgtttctcatcataa

SEQ ID NO: 537538 - DNA, 25 bp, Mus musculus
gcaggacagtttcaatcaagtcaat

SEQ ID NO: 537539 - DNA, 25 bp, Mus musculus
gcaggacagtttgaatcaagtcaat

SEQ ID NO: 537540 - DNA, 25 bp, Mus musculus
gcaggacatcaacaacccaggaagt

SEQ ID NO: 537541 - DNA, 25 bp, Mus musculus
gcaggacatcaagaacccaggaagt

SEQ ID NO: 537542 - DNA, 25 bp, Mus musculus
gcaggacatcccaagtagctgtgga

SEQ ID NO: 537543 - DNA, 25 bp, Mus musculus
gcaggacatccctagtagctgtgga

SEQ ID NO: 537544 - DNA, 25 bp, Mus musculus
gcaggacatctgcttctcaaatggt

SEQ ID NO: 537545 - DNA, 25 bp, Mus musculus
gcaggacatctggttctcaaatggt

SEQ ID NO: 537546 - DNA, 25 bp, Mus musculus
gcaggaccacagacggacccaagca

SEQ ID NO: 537547 - DNA, 25 bp, Mus musculus
gcaggaccacagtcggacccaagca

SEQ ID NO: 537548 - DNA, 25 bp, Mus musculus
gcaggaccagtaagggaccttcaat

SEQ ID NO: 537549 - DNA, 25 bp, Mus musculus
gcaggaccagtatgggaccttcaat

SEQ ID NO: 537550 - DNA, 25 bp, Mus musculus
gcaggaccagtcacagagctcagag

SEQ ID NO: 537551 - DNA, 25 bp, Mus musculus
gcaggaccagtctcagagctcagag

SEQ ID NO: 537552 - DNA, 25 bp, Mus musculus
gcaggaccagttaagcatgtgtttg

SEQ ID NO: 537553 - DNA, 25 bp, Mus musculus
gcaggaccagtttagcatgtgtttg

SEQ ID NO: 537554 - DNA, 25 bp, Mus musculus
gcaggacccactcctggaaaagtgt

SEQ ID NO: 537555 - DNA, 25 bp, Mus musculus
gcaggacccactgctggaaaagtgt

SEQ ID NO: 537556 - DNA, 25 bp, Mus musculus
gcaggaccccagagcacaccagcac

SEQ ID NO: 537557 - DNA, 25 bp, Mus musculus
gcaggaccccagtgcacaccagcac

SEQ ID NO: 537558 - DNA, 25 bp, Mus musculus
gcaggaccctatctagtgtagcgta

SEQ ID NO: 537559 - DNA, 25 bp, Mus musculus
gcaggaccctatgtagtgtagcgta

SEQ ID NO: 537560 - DNA, 25 bp, Mus musculus
gcaggaccgatgaagtcttgcttgt

SEQ ID NO: 537561 - DNA, 25 bp, Mus musculus
gcaggaccgatgtagtcttgcttgt

SEQ ID NO: 537562 - DNA, 25 bp, Mus musculus
gcaggaccgtggacccaggcaagaa

SEQ ID NO: 537563 - DNA, 25 bp, Mus musculus
gcaggaccgtggtcccaggcaagaa

SEQ ID NO: 537564 - DNA, 25 bp, Mus musculus
gcaggacctcagattgtacctgccc

SEQ ID NO: 537565 - DNA, 25 bp, Mus musculus
gcaggacctcagtttgtacctgccc

SEQ ID NO: 537566 - DNA, 25 bp, Mus musculus
gcaggacctctcctgctgtgcttga

SEQ ID NO: 537567 - DNA, 25 bp, Mus musculus
gcaggacctctcgtgctgtgcttga

SEQ ID NO: 537568 - DNA, 25 bp, Mus musculus
gcaggacctgcgatcagacctataa

SEQ ID NO: 537569 - DNA, 25 bp, Mus musculus
gcaggacctgcgttcagacctataa

SEQ ID NO: 537570 - DNA, 25 bp, Mus musculus
gcaggacgccgacgcagcacacaag

SEQ ID NO: 537571 - DNA, 25 bp, Mus musculus
gcaggacgccgaggcagcacacaag

SEQ ID NO: 537572 - DNA, 25 bp, Mus musculus
gcaggacggactaggcttttggaca

SEQ ID NO: 537573 - DNA, 25 bp, Mus musculus
gcaggacggacttggcttttggaca

SEQ ID NO: 537574 - DNA, 25 bp, Mus musculus
gcaggacgggatactttaaagaaca

SEQ ID NO: 537575 - DNA, 25 bp, Mus musculus
gcaggacgggattctttaaagaaca

SEQ ID NO: 537576 - DNA, 25 bp, Mus musculus
gcaggactaaccaggcagaagccat

SEQ ID NO: 537577 - DNA, 25 bp, Mus musculus
gcaggactaacctggcagaagccat

SEQ ID NO: 537578 - DNA, 25 bp, Mus musculus
gcaggactaccaccacttcgtgaag

SEQ ID NO: 537579 - DNA, 25 bp, Mus musculus
gcaggactaccagcacttcgtgaag

SEQ ID NO: 537580 - DNA, 25 bp, Mus musculus
gcaggactagacatagaactgagtt

SEQ ID NO: 537581 - DNA, 25 bp, Mus musculus
gcaggactagacttagaactgagtt

SEQ ID NO: 537582 - DNA, 25 bp, Mus musculus
gcaggactcaggcttttacaacttt

SEQ ID NO: 537583 - DNA, 25 bp, Mus musculus
gcaggactcagggttttacaacttt

SEQ ID NO: 537584 - DNA, 25 bp, Mus musculus
gcaggactcccaagtttaccgtgga

SEQ ID NO: 537585 - DNA, 25 bp, Mus musculus
gcaggactcccatgtttaccgtgga

SEQ ID NO: 537586 - DNA, 25 bp, Mus musculus
gcaggactccccatcagttgatgtg

SEQ ID NO: 537587 - DNA, 25 bp, Mus musculus
gcaggactccccttcagttgatgtg

SEQ ID NO: 537588 - DNA, 25 bp, Mus musculus
gcaggactcctgaggacacccaaat

SEQ ID NO: 537589 - DNA, 25 bp, Mus musculus
gcaggactcctgtggacacccaaat

SEQ ID NO: 537590 - DNA, 25 bp, Mus musculus
gcaggactctgaagatggccccagg

SEQ ID NO: 537591 - DNA, 25 bp, Mus musculus
gcaggactctgatgatggccccagg

SEQ ID NO: 537592 - DNA, 25 bp, Mus musculus
gcaggactctgtctgtaaacagttt

SEQ ID NO: 537593 - DNA, 25 bp, Mus musculus
gcaggactctgtgtgtaaacagttt

SEQ ID NO: 537594 - DNA, 25 bp, Mus musculus
gcaggactgatcctgtgcaaaacgt

SEQ ID NO: 537595 - DNA, 25 bp, Mus musculus
gcaggactgatcgtgtgcaaaacgt

SEQ ID NO: 537596 - DNA, 25 bp, Mus musculus
gcaggactgcagatctgtgctggca

SEQ ID NO: 537597 - DNA, 25 bp, Mus musculus
gcaggactgcagttctgtgctggca

SEQ ID NO: 537598 - DNA, 25 bp, Mus musculus
gcaggactggacactatgggccaaa

SEQ ID NO: 537599 - DNA, 25 bp, Mus musculus
gcaggactggactctatgggccaaa

SEQ ID NO: 537600 - DNA, 25 bp, Mus musculus
gcaggactggcacatcctaggaagt

SEQ ID NO: 537601 - DNA, 25 bp, Mus musculus
gcaggactggcagatcctaggaagt

SEQ ID NO: 537602 - DNA, 25 bp, Mus musculus
gcaggactgttgctagcttatccgt

SEQ ID NO: 537603 - DNA, 25 bp, Mus musculus
gcaggactgttggtagcttatccgt

SEQ ID NO: 537604 - DNA, 25 bp, Mus musculus
gcaggacttcatcctaattcacaga

SEQ ID NO: 537605 - DNA, 25 bp, Mus musculus
gcaggacttcatgctaattcacaga

SEQ ID NO: 537606 - DNA, 25 bp, Mus musculus
gcaggacttctacccagaggcctct

SEQ ID NO: 537607 - DNA, 25 bp, Mus musculus
gcaggacttctagccagaggcctct

SEQ ID NO: 537608 - DNA, 25 bp, Mus musculus
gcaggacttgctcgcccactgtcag

SEQ ID NO: 537609 - DNA, 25 bp, Mus musculus
gcaggacttgctggcccactgtcag

SEQ ID NO: 537610 - DNA, 25 bp, Mus musculus
gcaggacttggaagcactgatagac

SEQ ID NO: 537611 - DNA, 25 bp, Mus musculus
gcaggacttggatgcactgatagac

SEQ ID NO: 537612 - DNA, 25 bp, Mus musculus
gcaggacttgtccactttaaagact

SEQ ID NO: 537613 - DNA, 25 bp, Mus musculus
gcaggacttgtcgactttaaagact

SEQ ID NO: 537614 - DNA, 25 bp, Mus musculus
gcaggactttgtacgtttcctttct

SEQ ID NO: 537615 - DNA, 25 bp, Mus musculus
gcaggactttgttcgtttcctttct

SEQ ID NO: 537616 - DNA, 25 bp, Mus musculus
gcaggagaaaacattaacatgtatc

SEQ ID NO: 537617 - DNA, 25 bp, Mus musculus
gcaggagaaaactttaacatgtatc

SEQ ID NO: 537618 - DNA, 25 bp, Mus musculus
gcaggagaactcattctacttcatt

SEQ ID NO: 537619 - DNA, 25 bp, Mus musculus
gcaggagaactctttctacttcatt

SEQ ID NO: 537620 - DNA, 25 bp, Mus musculus
gcaggagaagttagcgcccaccagg

SEQ ID NO: 537621 - DNA, 25 bp, Mus musculus
gcaggagaagtttgcgcccaccagg

SEQ ID NO: 537622 - DNA, 25 bp, Mus musculus
gcaggagacagacaaacagtttact

SEQ ID NO: 537623 - DNA, 25 bp, Mus musculus
gcaggagacagagaaacagtttact

SEQ ID NO: 537624 - DNA, 25 bp, Mus musculus
gcaggagacagtctgtgcttgtcaa

SEQ ID NO: 537625 - DNA, 25 bp, Mus musculus
gcaggagacagtgtgtgcttgtcaa

SEQ ID NO: 537626 - DNA, 25 bp, Mus musculus
gcaggagaccaactgtggactgaaa

SEQ ID NO: 537627 - DNA, 25 bp, Mus musculus
gcaggagaccaagtgtggactgaaa

SEQ ID NO: 537628 - DNA, 25 bp, Mus musculus
gcaggagaccaccacttctgagaaa

SEQ ID NO: 537629 - DNA, 25 bp, Mus musculus
gcaggagaccacgacttctgagaaa

SEQ ID NO: 537630 - DNA, 25 bp, Mus musculus
gcaggagactcaccccgaggaaatc

SEQ ID NO: 537631 - DNA, 25 bp, Mus musculus
gcaggagactcagcccgaggaaatc

SEQ ID NO: 537632 - DNA, 25 bp, Mus musculus
gcaggagagaacagaatgtcccaag

SEQ ID NO: 537633 - DNA, 25 bp, Mus musculus
gcaggagagaactgaatgtcccaag

SEQ ID NO: 537634 - DNA, 25 bp, Mus musculus
gcaggagataggcagaacaacttta

SEQ ID NO: 537635 - DNA, 25 bp, Mus musculus
gcaggagatagggagaacaacttta

SEQ ID NO: 537636 - DNA, 25 bp, Mus musculus
gcaggagatcacatatgataggcag

SEQ ID NO: 537637 - DNA, 25 bp, Mus musculus
gcaggagatcacttatgataggcag

SEQ ID NO: 537638 - DNA, 25 bp, Mus musculus
gcaggagatcctcagccagctcaag

SEQ ID NO: 537639 - DNA, 25 bp, Mus musculus
gcaggagatcctgagccagctcaag

SEQ ID NO: 537640 - DNA, 25 bp, Mus musculus
gcaggagatgctcttgagcaccatc

SEQ ID NO: 537641 - DNA, 25 bp, Mus musculus
gcaggagatgctgttgagcaccatc

SEQ ID NO: 537642 - DNA, 25 bp, Mus musculus
gcaggagattaacagattgtcttac

SEQ ID NO: 537643 - DNA, 25 bp, Mus musculus
gcaggagattaagagattgtcttac

SEQ ID NO: 537644 - DNA, 25 bp, Mus musculus
gcaggagattcgcacttactccacc

SEQ ID NO: 537645 - DNA, 25 bp, Mus musculus
gcaggagattcggacttactccacc

SEQ ID NO: 537646 - DNA, 25 bp, Mus musculus
gcaggagattgcaatgtaacccata

SEQ ID NO: 537647 - DNA, 25 bp, Mus musculus
gcaggagattgctatgtaacccata

SEQ ID NO: 537648 - DNA, 25 bp, Mus musculus
gcaggagcaataccaagtactctta

SEQ ID NO: 537649 - DNA, 25 bp, Mus musculus
gcaggagcaatagcaagtactctta

SEQ ID NO: 537650 - DNA, 25 bp, Mus musculus
gcaggagcacacaaaccgcaatgta

SEQ ID NO: 537651 - DNA, 25 bp, Mus musculus
gcaggagcacactaaccgcaatgta

SEQ ID NO: 537652 - DNA, 25 bp, Mus musculus
gcaggagcacgacgcagctgtcaca

SEQ ID NO: 537653 - DNA, 25 bp, Mus musculus
gcaggagcacgaggcagctgtcaca

SEQ ID NO: 537654 - DNA, 25 bp, Mus musculus
gcaggagcacggagcgcttagctca

SEQ ID NO: 537655 - DNA, 25 bp, Mus musculus
gcaggagcacggtgcgcttagctca

SEQ ID NO: 537656 - DNA, 25 bp, Mus musculus
gcaggagcacgtcatcaggttatat

SEQ ID NO: 537657 - DNA, 25 bp, Mus musculus
gcaggagcacgtgatcaggttatat

SEQ ID NO: 537658 - DNA, 25 bp, Mus musculus
gcaggagcacttccgctgtcagctg

SEQ ID NO: 537659 - DNA, 25 bp, Mus musculus
gcaggagcacttgcgctgtcagctg

SEQ ID NO: 537660 - DNA, 25 bp, Mus musculus
gcaggagcagttccgccagcatatg

SEQ ID NO: 537661 - DNA, 25 bp, Mus musculus
gcaggagcagttgcgccagcatatg

SEQ ID NO: 537662 - DNA, 25 bp, Mus musculus
gcaggagccaaactgagccttttct

SEQ ID NO: 537663 - DNA, 25 bp, Mus musculus
gcaggagccaaagtgagccttttct

SEQ ID NO: 537664 - DNA, 25 bp, Mus musculus
gcaggagccagacggtctatccaat

SEQ ID NO: 537665 - DNA, 25 bp, Mus musculus
gcaggagccagagggtctatccaat

SEQ ID NO: 537666 - DNA, 25 bp, Mus musculus
gcaggagccagcaaaccagccagtg

SEQ ID NO: 537667 - DNA, 25 bp, Mus musculus
gcaggagccagctaaccagccagtg

SEQ ID NO: 537668 - DNA, 25 bp, Mus musculus
gcaggagccccacaaacacatgttg

SEQ ID NO: 537669 - DNA, 25 bp, Mus musculus
gcaggagccccagaaacacatgttg

SEQ ID NO: 537670 - DNA, 25 bp, Mus musculus
gcaggagcccttccagaactagatg

SEQ ID NO: 537671 - DNA, 25 bp, Mus musculus
gcaggagcccttgcagaactagatg

SEQ ID NO: 537672 - DNA, 25 bp, Mus musculus
gcaggagcctgacctacctactaaa

SEQ ID NO: 537673 - DNA, 25 bp, Mus musculus
gcaggagcctgagctacctactaaa

SEQ ID NO: 537674 - DNA, 25 bp, Mus musculus
gcaggagcctgtcacctttgaggat

SEQ ID NO: 537675 - DNA, 25 bp, Mus musculus
gcaggagcctgtgacctttgaggat

SEQ ID NO: 537676 - DNA, 25 bp, Mus musculus
gcaggagcgattacatttggatcaa

SEQ ID NO: 537677 - DNA, 25 bp, Mus musculus
gcaggagcgatttcatttggatcaa

SEQ ID NO: 537678 - DNA, 25 bp, Mus musculus
gcaggagcgcaaccaggcactgtat

SEQ ID NO: 537679 - DNA, 25 bp, Mus musculus
gcaggagcgcaagcaggcactgtat

SEQ ID NO: 537680 - DNA, 25 bp, Mus musculus
gcaggagcgtccctcacggctcaga

SEQ ID NO: 537681 - DNA, 25 bp, Mus musculus
gcaggagcgtccgtcacggctcaga

SEQ ID NO: 537682 - DNA, 25 bp, Mus musculus
gcaggagctatgaaatccagagaaa

SEQ ID NO: 537683 - DNA, 25 bp, Mus musculus
gcaggagctatgtaatccagagaaa

SEQ ID NO: 537684 - DNA, 25 bp, Mus musculus
gcaggagctcaaagtcttccagatt

SEQ ID NO: 537685 - DNA, 25 bp, Mus musculus
gcaggagctcaatgtcttccagatt

SEQ ID NO: 537686 - DNA, 25 bp, Mus musculus
gcaggagctccaacagataatacag

SEQ ID NO: 537687 - DNA, 25 bp, Mus musculus
gcaggagctccatcagataatacag

SEQ ID NO: 537688 - DNA, 25 bp, Mus musculus
gcaggagctcccatgagaacatagc

SEQ ID NO: 537689 - DNA, 25 bp, Mus musculus
gcaggagctcccttgagaacatagc

SEQ ID NO: 537690 - DNA, 25 bp, Mus musculus
gcaggagctgctaggtttactttat

SEQ ID NO: 537691 - DNA, 25 bp, Mus musculus
gcaggagctgcttggtttactttat

SEQ ID NO: 537692 - DNA, 25 bp, Mus musculus
gcaggagcttcaagggtttaacgtc

SEQ ID NO: 537693 - DNA, 25 bp, Mus musculus
gcaggagcttcatgggtttaacgtc

SEQ ID NO: 537694 - DNA, 25 bp, Mus musculus
gcaggagcttgacgcctacaggtca

SEQ ID NO: 537695 - DNA, 25 bp, Mus musculus
gcaggagcttgaggcctacaggtca

SEQ ID NO: 537696 - DNA, 25 bp, Mus musculus
gcaggaggaacccaagggaacaaga

SEQ ID NO: 537697 - DNA, 25 bp, Mus musculus
gcaggaggaaccgaagggaacaaga

SEQ ID NO: 537698 - DNA, 25 bp, Mus musculus
gcaggaggagcacacattcaaagtt

SEQ ID NO: 537699 - DNA, 25 bp, Mus musculus
gcaggaggagcagacattcaaagtt

SEQ ID NO: 537700 - DNA, 25 bp, Mus musculus
gcaggaggataaacacagctatgaa

SEQ ID NO: 537701 - DNA, 25 bp, Mus musculus
gcaggaggataatcacagctatgaa

SEQ ID NO: 537702 - DNA, 25 bp, Mus musculus
gcaggaggattaacacagcaggcta

SEQ ID NO: 537703 - DNA, 25 bp, Mus musculus
gcaggaggattatcacagcaggcta

SEQ ID NO: 537704 - DNA, 25 bp, Mus musculus
gcaggaggcattacttttccccgcc

SEQ ID NO: 537705 - DNA, 25 bp, Mus musculus
gcaggaggcatttcttttccccgcc

SEQ ID NO: 537706 - DNA, 25 bp, Mus musculus
gcaggaggccatatcactgcaaatg

SEQ ID NO: 537707 - DNA, 25 bp, Mus musculus
gcaggaggccatttcactgcaaatg

SEQ ID NO: 537708 - DNA, 25 bp, Mus musculus
gcaggaggcgagaggctaccttcaa

SEQ ID NO: 537709 - DNA, 25 bp, Mus musculus
gcaggaggcgagtggctaccttcaa

SEQ ID NO: 537710 - DNA, 25 bp, Mus musculus
gcaggaggctgcatgccatacaaag

SEQ ID NO: 537711 - DNA, 25 bp, Mus musculus
gcaggaggctgcttgccatacaaag

SEQ ID NO: 537712 - DNA, 25 bp, Mus musculus
gcaggaggcttaactctggattcca

SEQ ID NO: 537713 - DNA, 25 bp, Mus musculus
gcaggaggcttatctctggattcca

SEQ ID NO: 537714 - DNA, 25 bp, Mus musculus
gcaggagggacaatttgacaagcac

SEQ ID NO: 537715 - DNA, 25 bp, Mus musculus
gcaggagggacattttgacaagcac

SEQ ID NO: 537716 - DNA, 25 bp, Mus musculus
gcaggagggcttagctcacctagat

SEQ ID NO: 537717 - DNA, 25 bp, Mus musculus
gcaggagggctttgctcacctagat

SEQ ID NO: 537718 - DNA, 25 bp, Mus musculus
gcaggaggtcctacattggctgaat

SEQ ID NO: 537719 - DNA, 25 bp, Mus musculus
gcaggaggtccttcattggctgaat

SEQ ID NO: 537720 - DNA, 25 bp, Mus musculus
gcaggaggtggactctactatccca

SEQ ID NO: 537721 - DNA, 25 bp, Mus musculus
gcaggaggtggagtctactatccca

SEQ ID NO: 537722 - DNA, 25 bp, Mus musculus
gcaggaggttcacggcttccttcat

SEQ ID NO: 537723 - DNA, 25 bp, Mus musculus
gcaggaggttcagggcttccttcat

SEQ ID NO: 537724 - DNA, 25 bp, Mus musculus
gcaggaggtttgacgctgaagccat

SEQ ID NO: 537725 - DNA, 25 bp, Mus musculus
gcaggaggtttgtcgctgaagccat

SEQ ID NO: 537726 - DNA, 25 bp, Mus musculus
gcaggagtccacattcaaacggccc

SEQ ID NO: 537727 - DNA, 25 bp, Mus musculus
gcaggagtccactttcaaacggccc

SEQ ID NO: 537728 - DNA, 25 bp, Mus musculus
gcaggagtcgcaccgtgtcctcatt

SEQ ID NO: 537729 - DNA, 25 bp, Mus musculus
gcaggagtcgcagcgtgtcctcatt

SEQ ID NO: 537730 - DNA, 25 bp, Mus musculus
gcaggagtctttcattaaccctact

SEQ ID NO: 537731 - DNA, 25 bp, Mus musculus
gcaggagtctttgattaaccctact

SEQ ID NO: 537732 - DNA, 25 bp, Mus musculus
gcaggagtgagtcctgtgctttcat

SEQ ID NO: 537733 - DNA, 25 bp, Mus musculus
gcaggagtgagtgctgtgctttcat

SEQ ID NO: 537734 - DNA, 25 bp, Mus musculus
gcaggagtgcacatcgctagtaccg

SEQ ID NO: 537735 - DNA, 25 bp, Mus musculus
gcaggagtgcacttcgctagtaccg

SEQ ID NO: 537736 - DNA, 25 bp, Mus musculus
gcaggagtgcccctgagagtcacca

SEQ ID NO: 537737 - DNA, 25 bp, Mus musculus
gcaggagtgcccgtgagagtcacca

SEQ ID NO: 537738 - DNA, 25 bp, Mus musculus
gcaggagtgcctacgacaggccagt

SEQ ID NO: 537739 - DNA, 25 bp, Mus musculus
gcaggagtgccttcgacaggccagt

SEQ ID NO: 537740 - DNA, 25 bp, Mus musculus
gcaggagtgtctagagatacagcta

SEQ ID NO: 537741 - DNA, 25 bp, Mus musculus
gcaggagtgtcttgagatacagcta

SEQ ID NO: 537742 - DNA, 25 bp, Mus musculus
gcaggagttcagaatgtattcatct

SEQ ID NO: 537743 - DNA, 25 bp, Mus musculus
gcaggagttcagatagcagacaaga

SEQ ID NO: 537744 - DNA, 25 bp, Mus musculus
gcaggagttcagtatgtattcatct

SEQ ID NO: 537745 - DNA, 25 bp, Mus musculus
gcaggagttcagttagcagacaaga

SEQ ID NO: 537746 - DNA, 25 bp, Mus musculus
gcaggagttggactgcccaagccaa

SEQ ID NO: 537747 - DNA, 25 bp, Mus musculus
gcaggagttggagtgcccaagccaa

SEQ ID NO: 537748 - DNA, 25 bp, Mus musculus
gcaggataatgccttcgattggctg

SEQ ID NO: 537749 - DNA, 25 bp, Mus musculus
gcaggataatgcgttcgattggctg

SEQ ID NO: 537750 - DNA, 25 bp, Mus musculus
gcaggatacacacatgcgactatga

SEQ ID NO: 537751 - DNA, 25 bp, Mus musculus
gcaggatacacagatgcgactatga

SEQ ID NO: 537752 - DNA, 25 bp, Mus musculus
gcaggatagaccaggcaagtcccct

SEQ ID NO: 537753 - DNA, 25 bp, Mus musculus
gcaggatagacctggcaagtcccct

SEQ ID NO: 537754 - DNA, 25 bp, Mus musculus
gcaggatagcaccttctttccactt

SEQ ID NO: 537755 - DNA, 25 bp, Mus musculus
gcaggatagcacgttctttccactt

SEQ ID NO: 537756 - DNA, 25 bp, Mus musculus
gcaggatatgccaagagccattttt

SEQ ID NO: 537757 - DNA, 25 bp, Mus musculus
gcaggatatgcctagagccattttt

SEQ ID NO: 537758 - DNA, 25 bp, Mus musculus
gcaggatcacacattctgagttaca

SEQ ID NO: 537759 - DNA, 25 bp, Mus musculus
gcaggatcacactttctgagttaca

SEQ ID NO: 537760 - DNA, 25 bp, Mus musculus
gcaggatcactgagcaaatgaccaa

SEQ ID NO: 537761 - DNA, 25 bp, Mus musculus
gcaggatcactgtgcaaatgaccaa

SEQ ID NO: 537762 - DNA, 25 bp, Mus musculus
gcaggatcatgacagacaggcacag

SEQ ID NO: 537763 - DNA, 25 bp, Mus musculus
gcaggatcatgagagacaggcacag

SEQ ID NO: 537764 - DNA, 25 bp, Mus musculus
gcaggatccaaaatgtatctatatc

SEQ ID NO: 537765 - DNA, 25 bp, Mus musculus
gcaggatccaaattgtatctatatc

SEQ ID NO: 537766 - DNA, 25 bp, Mus musculus
gcaggatccctcactaacctttagt

SEQ ID NO: 537767 - DNA, 25 bp, Mus musculus
gcaggatccctctctaacctttagt

SEQ ID NO: 537768 - DNA, 25 bp, Mus musculus
gcaggatcctgcaaagaccatcacg

SEQ ID NO: 537769 - DNA, 25 bp, Mus musculus
gcaggatcctgcagagcttgaggcc

SEQ ID NO: 537770 - DNA, 25 bp, Mus musculus
gcaggatcctgcatgttcgtttccg

SEQ ID NO: 537771 - DNA, 25 bp, Mus musculus
gcaggatcctgctaagaccatcacg

SEQ ID NO: 537772 - DNA, 25 bp, Mus musculus
gcaggatcctgctgagcttgaggcc

SEQ ID NO: 537773 - DNA, 25 bp, Mus musculus
gcaggatcctgcttgttcgtttccg

SEQ ID NO: 537774 - DNA, 25 bp, Mus musculus
gcaggatcctggagaatcagtccat

SEQ ID NO: 537775 - DNA, 25 bp, Mus musculus
gcaggatcctggtgaatcagtccat

SEQ ID NO: 537776 - DNA, 25 bp, Mus musculus
gcaggatcctttcctgcttgagcaa

SEQ ID NO: 537777 - DNA, 25 bp, Mus musculus
gcaggatcctttgctgcttgagcaa

SEQ ID NO: 537778 - DNA, 25 bp, Mus musculus
gcaggatctctaaagcatcgtgcgc

SEQ ID NO: 537779 - DNA, 25 bp, Mus musculus
gcaggatctctatagcatcgtgcgc

SEQ ID NO: 537780 - DNA, 25 bp, Mus musculus
gcaggatctgttctgatccattgat

SEQ ID NO: 537781 - DNA, 25 bp, Mus musculus
gcaggatctgttgtgatccattgat

SEQ ID NO: 537782 - DNA, 25 bp, Mus musculus
gcaggatcttgcatcataaacaaag

SEQ ID NO: 537783 - DNA, 25 bp, Mus musculus
gcaggatcttgcttcataaacaaag

SEQ ID NO: 537784 - DNA, 25 bp, Mus musculus
gcaggatgaacacgcccgacggcaa

SEQ ID NO: 537785 - DNA, 25 bp, Mus musculus
gcaggatgaacaggcccgacggcaa

SEQ ID NO: 537786 - DNA, 25 bp, Mus musculus
gcaggatgaagcaactcaccagcct

SEQ ID NO: 537787 - DNA, 25 bp, Mus musculus
gcaggatgaagctactcaccagcct

SEQ ID NO: 537788 - DNA, 25 bp, Mus musculus
gcaggatgacacaggctgatgatgt

SEQ ID NO: 537789 - DNA, 25 bp, Mus musculus
gcaggatgacactggctgatgatgt

SEQ ID NO: 537790 - DNA, 25 bp, Mus musculus
gcaggatgacatctatcaatgacaa

SEQ ID NO: 537791 - DNA, 25 bp, Mus musculus
gcaggatgacatgtatcaatgacaa

SEQ ID NO: 537792 - DNA, 25 bp, Mus musculus
gcaggatgaccgcagacagttactt

SEQ ID NO: 537793 - DNA, 25 bp, Mus musculus
gcaggatgaccggagacagttactt

SEQ ID NO: 537794 - DNA, 25 bp, Mus musculus
gcaggatgagatctccctcaaacgt

SEQ ID NO: 537795 - DNA, 25 bp, Mus musculus
gcaggatgagatgtccctcaaacgt

SEQ ID NO: 537796 - DNA, 25 bp, Mus musculus
gcaggatgagcacgcccatcttctt

SEQ ID NO: 537797 - DNA, 25 bp, Mus musculus
gcaggatgagcaggcccatcttctt

SEQ ID NO: 537798 - DNA, 25 bp, Mus musculus
gcaggatgatggagaccctcgtgac

SEQ ID NO: 537799 - DNA, 25 bp, Mus musculus
gcaggatgatggtgaccctcgtgac

SEQ ID NO: 537800 - DNA, 25 bp, Mus musculus
gcaggatgcagtcctgctccttttt

SEQ ID NO: 537801 - DNA, 25 bp, Mus musculus
gcaggatgcagtgctgctccttttt

SEQ ID NO: 537802 - DNA, 25 bp, Mus musculus
gcaggatgctccacaatgttctaat

SEQ ID NO: 537803 - DNA, 25 bp, Mus musculus
gcaggatgctcctcaatgttctaat

SEQ ID NO: 537804 - DNA, 25 bp, Mus musculus
gcaggatgctctctccaccacgaag

SEQ ID NO: 537805 - DNA, 25 bp, Mus musculus
gcaggatgctctgtccaccacgaag

SEQ ID NO: 537806 - DNA, 25 bp, Mus musculus
gcaggatggcaccagtcttggcaaa

SEQ ID NO: 537807 - DNA, 25 bp, Mus musculus
gcaggatggcacgagtcttggcaaa

SEQ ID NO: 537808 - DNA, 25 bp, Mus musculus
gcaggatggcctccagagccaagca

SEQ ID NO: 537809 - DNA, 25 bp, Mus musculus
gcaggatggcctgcagagccaagca

SEQ ID NO: 537810 - DNA, 25 bp, Mus musculus
gcaggatggttcagcacttgtgctc

SEQ ID NO: 537811 - DNA, 25 bp, Mus musculus
gcaggatggttctgcacttgtgctc

SEQ ID NO: 537812 - DNA, 25 bp, Mus musculus
gcaggatgtagcaaccttctcagag

SEQ ID NO: 537813 - DNA, 25 bp, Mus musculus
gcaggatgtagctaccttctcagag

SEQ ID NO: 537814 - DNA, 25 bp, Mus musculus
gcaggatgtataatcaagccccatt

SEQ ID NO: 537815 - DNA, 25 bp, Mus musculus
gcaggatgtataccttgcctttcaa

SEQ ID NO: 537816 - DNA, 25 bp, Mus musculus
gcaggatgtatagcttgcctttcaa

SEQ ID NO: 537817 - DNA, 25 bp, Mus musculus
gcaggatgtatattcaagccccatt

SEQ ID NO: 537818 - DNA, 25 bp, Mus musculus
gcaggatgtctgagttggactctaa

SEQ ID NO: 537819 - DNA, 25 bp, Mus musculus
gcaggatgtctgtgttggactctaa

SEQ ID NO: 537820 - DNA, 25 bp, Mus musculus
gcaggatgtgttagagtttcgctat

SEQ ID NO: 537821 - DNA, 25 bp, Mus musculus
gcaggatgtgtttgagtttcgctat

SEQ ID NO: 537822 - DNA, 25 bp, Mus musculus
gcaggatgttaaagtagttcaggcc

SEQ ID NO: 537823 - DNA, 25 bp, Mus musculus
gcaggatgttaatgtagttcaggcc

SEQ ID NO: 537824 - DNA, 25 bp, Mus musculus
gcaggattaagccagctcttatgca

SEQ ID NO: 537825 - DNA, 25 bp, Mus musculus
gcaggattaagcgagctcttatgca

SEQ ID NO: 537826 - DNA, 25 bp, Mus musculus
gcaggattactcagaccctaacaag

SEQ ID NO: 537827 - DNA, 25 bp, Mus musculus
gcaggattactctgaccctaacaag

SEQ ID NO: 537828 - DNA, 25 bp, Mus musculus
gcaggattactgagcgtttcatctc

SEQ ID NO: 537829 - DNA, 25 bp, Mus musculus
gcaggattactgtgcgtttcatctc

SEQ ID NO: 537830 - DNA, 25 bp, Mus musculus
gcaggattccaaattttagcttaat

SEQ ID NO: 537831 - DNA, 25 bp, Mus musculus
gcaggattccaatttttagcttaat

SEQ ID NO: 537832 - DNA, 25 bp, Mus musculus
gcaggattcctacgctgactaagct

SEQ ID NO: 537833 - DNA, 25 bp, Mus musculus
gcaggattcctactggtttgtcaca

SEQ ID NO: 537834 - DNA, 25 bp, Mus musculus
gcaggattcctaggctgactaagct

SEQ ID NO: 537835 - DNA, 25 bp, Mus musculus
gcaggattcctagtggtttgtcaca

SEQ ID NO: 537836 - DNA, 25 bp, Mus musculus
gcaggattcctgaggactttgagat

SEQ ID NO: 537837 - DNA, 25 bp, Mus musculus
gcaggattcctgctcaatatcatcg

SEQ ID NO: 537838 - DNA, 25 bp, Mus musculus
gcaggattcctggtcaatatcatcg

SEQ ID NO: 537839 - DNA, 25 bp, Mus musculus
gcaggattcctgtggactttgagat

SEQ ID NO: 537840 - DNA, 25 bp, Mus musculus
gcaggattccttccttgatcatatc

SEQ ID NO: 537841 - DNA, 25 bp, Mus musculus
gcaggattccttgcttgatcatatc

SEQ ID NO: 537842 - DNA, 25 bp, Mus musculus
gcaggattcgggacctctggactcc

SEQ ID NO: 537843 - DNA, 25 bp, Mus musculus
gcaggattcgggtcctctggactcc

SEQ ID NO: 537844 - DNA, 25 bp, Mus musculus
gcaggattctgaacagggtctccaa

SEQ ID NO: 537845 - DNA, 25 bp, Mus musculus
gcaggattctgatcagggtctccaa

SEQ ID NO: 537846 - DNA, 25 bp, Mus musculus
gcaggattgagtactccgagttcat

SEQ ID NO: 537847 - DNA, 25 bp, Mus musculus
gcaggattgagttctccgagttcat

SEQ ID NO: 537848 - DNA, 25 bp, Mus musculus
gcaggatttgccctctgtagcctcc

SEQ ID NO: 537849 - DNA, 25 bp, Mus musculus
gcaggatttgccgtctgtagcctcc

SEQ ID NO: 537850 - DNA, 25 bp, Mus musculus
gcaggatttttcagccttagcctcc

SEQ ID NO: 537851 - DNA, 25 bp, Mus musculus
gcaggatttttctgccttagcctcc

SEQ ID NO: 537852 - DNA, 25 bp, Mus musculus
gcaggcaaaaatcatccttgaaaat

SEQ ID NO: 537853 - DNA, 25 bp, Mus musculus
gcaggcaaaaatgatccttgaaaat

SEQ ID NO: 537854 - DNA, 25 bp, Mus musculus
gcaggcaaaagcaggtgcatctctt

SEQ ID NO: 537855 - DNA, 25 bp, Mus musculus
gcaggcaaaagctggtgcatctctt

SEQ ID NO: 537856 - DNA, 25 bp, Mus musculus
gcaggcaacaatattattggagtac

SEQ ID NO: 537857 - DNA, 25 bp, Mus musculus
gcaggcaacaattttattggagtac

SEQ ID NO: 537858 - DNA, 25 bp, Mus musculus
gcaggcaacacactttcagacaaga

SEQ ID NO: 537859 - DNA, 25 bp, Mus musculus
gcaggcaacacagtttcagacaaga

SEQ ID NO: 537860 - DNA, 25 bp, Mus musculus
gcaggcaaccctctcaacaggtgga

SEQ ID NO: 537861 - DNA, 25 bp, Mus musculus
gcaggcaaccctgtcaacaggtgga

SEQ ID NO: 537862 - DNA, 25 bp, Mus musculus
gcaggcaacctgcatggcctatgat

SEQ ID NO: 537863 - DNA, 25 bp, Mus musculus
gcaggcaacctggatggcctatgat

SEQ ID NO: 537864 - DNA, 25 bp, Mus musculus
gcaggcaacttcatctcatcataaa

SEQ ID NO: 537865 - DNA, 25 bp, Mus musculus
gcaggcaacttcttctcatcataaa

SEQ ID NO: 537866 - DNA, 25 bp, Mus musculus
gcaggcaagcttagagtttgtcata

SEQ ID NO: 537867 - DNA, 25 bp, Mus musculus
gcaggcaagctttgagtttgtcata

SEQ ID NO: 537868 - DNA, 25 bp, Mus musculus
gcaggcaattccaaactaaatcttg

SEQ ID NO: 537869 - DNA, 25 bp, Mus musculus
gcaggcaattcctaactaaatcttg

SEQ ID NO: 537870 - DNA, 25 bp, Mus musculus
gcaggcaatttcaaaagcttgtccc

SEQ ID NO: 537871 - DNA, 25 bp, Mus musculus
gcaggcaatttctaaagcttgtccc

SEQ ID NO: 537872 - DNA, 25 bp, Mus musculus
gcaggcaatttgacacttagttagg

SEQ ID NO: 537873 - DNA, 25 bp, Mus musculus
gcaggcaatttgtcacttagttagg

SEQ ID NO: 537874 - DNA, 25 bp, Mus musculus
gcaggcaattttatctcttcagtca

SEQ ID NO: 537875 - DNA, 25 bp, Mus musculus
gcaggcaattttttctcttcagtca

SEQ ID NO: 537876 - DNA, 25 bp, Mus musculus
gcaggcacaactctaactctggttc

SEQ ID NO: 537877 - DNA, 25 bp, Mus musculus
gcaggcacaactgtaactctggttc

SEQ ID NO: 537878 - DNA, 25 bp, Mus musculus
gcaggcacaatccacaagttccact

SEQ ID NO: 537879 - DNA, 25 bp, Mus musculus
gcaggcacaatcgacaagttccact

SEQ ID NO: 537880 - DNA, 25 bp, Mus musculus
gcaggcacaccccaaatttggttgg

SEQ ID NO: 537881 - DNA, 25 bp, Mus musculus
gcaggcacacccgaaatttggttgg

SEQ ID NO: 537882 - DNA, 25 bp, Mus musculus
gcaggcacagagacatgatccttct

SEQ ID NO: 537883 - DNA, 25 bp, Mus musculus
gcaggcacagagtcatgatccttct

SEQ ID NO: 537884 - DNA, 25 bp, Mus musculus
gcaggcacagcaactccggaaaaag

SEQ ID NO: 537885 - DNA, 25 bp, Mus musculus
gcaggcacagcatctccggaaaaag

SEQ ID NO: 537886 - DNA, 25 bp, Mus musculus
gcaggcacagtgaatcacgcaggaa

SEQ ID NO: 537887 - DNA, 25 bp, Mus musculus
gcaggcacagtgtatcacgcaggaa

SEQ ID NO: 537888 - DNA, 25 bp, Mus musculus
gcaggcaccaaaagctttattatag

SEQ ID NO: 537889 - DNA, 25 bp, Mus musculus
gcaggcaccaaatgctttattatag

SEQ ID NO: 537890 - DNA, 25 bp, Mus musculus
gcaggcaccataaacactaagactt

SEQ ID NO: 537891 - DNA, 25 bp, Mus musculus
gcaggcaccataatcatgaagaagt

SEQ ID NO: 537892 - DNA, 25 bp, Mus musculus
gcaggcaccatatacactaagactt

SEQ ID NO: 537893 - DNA, 25 bp, Mus musculus
gcaggcaccatattcatgaagaagt

SEQ ID NO: 537894 - DNA, 25 bp, Mus musculus
gcaggcaccatcactaagatggatt

SEQ ID NO: 537895 - DNA, 25 bp, Mus musculus
gcaggcaccatctctaagatggatt

SEQ ID NO: 537896 - DNA, 25 bp, Mus musculus
gcaggcaccctgaacaatcaagatc

SEQ ID NO: 537897 - DNA, 25 bp, Mus musculus
gcaggcaccctgacttacggcagaa

SEQ ID NO: 537898 - DNA, 25 bp, Mus musculus
gcaggcaccctgtacaatcaagatc

SEQ ID NO: 537899 - DNA, 25 bp, Mus musculus
gcaggcaccctgtcttacggcagaa

SEQ ID NO: 537900 - DNA, 25 bp, Mus musculus
gcaggcaccgtgacatgtcagagga

SEQ ID NO: 537901 - DNA, 25 bp, Mus musculus
gcaggcaccgtgtcatgtcagagga

SEQ ID NO: 537902 - DNA, 25 bp, Mus musculus
gcaggcacctcaaggtctggaaggt

SEQ ID NO: 537903 - DNA, 25 bp, Mus musculus
gcaggcacctcatggtctggaaggt

SEQ ID NO: 537904 - DNA, 25 bp, Mus musculus
gcaggcaccttaatgctgacttgtc

SEQ ID NO: 537905 - DNA, 25 bp, Mus musculus
gcaggcaccttattgctgacttgtc

SEQ ID NO: 537906 - DNA, 25 bp, Mus musculus
gcaggcacggatcgcttccggaaat

SEQ ID NO: 537907 - DNA, 25 bp, Mus musculus
gcaggcacggatggcttccggaaat

SEQ ID NO: 537908 - DNA, 25 bp, Mus musculus
gcaggcactaacctgcctgtctaac

SEQ ID NO: 537909 - DNA, 25 bp, Mus musculus
gcaggcactaacgtgcctgtctaac

SEQ ID NO: 537910 - DNA, 25 bp, Mus musculus
gcaggcactcagcattctgaacaga

SEQ ID NO: 537911 - DNA, 25 bp, Mus musculus
gcaggcactcaggattctgaacaga

SEQ ID NO: 537912 - DNA, 25 bp, Mus musculus
gcaggcactcctataactgtgtcta

SEQ ID NO: 537913 - DNA, 25 bp, Mus musculus
gcaggcactcctttaactgtgtcta

SEQ ID NO: 537914 - DNA, 25 bp, Mus musculus
gcaggcactgcaacacagatgcgac

SEQ ID NO: 537915 - DNA, 25 bp, Mus musculus
gcaggcactgcatcacagatgcgac

SEQ ID NO: 537916 - DNA, 25 bp, Mus musculus
gcaggcactgtgaatgaccataact

SEQ ID NO: 537917 - DNA, 25 bp, Mus musculus
gcaggcactgtgtatgaccataact

SEQ ID NO: 537918 - DNA, 25 bp, Mus musculus
gcaggcacttggaacagcagtctgt

SEQ ID NO: 537919 - DNA, 25 bp, Mus musculus
gcaggcacttggtacagcagtctgt

SEQ ID NO: 537920 - DNA, 25 bp, Mus musculus
gcaggcagacaccacatacaaccag

SEQ ID NO: 537921 - DNA, 25 bp, Mus musculus
gcaggcagacacgacatacaaccag

SEQ ID NO: 537922 - DNA, 25 bp, Mus musculus
gcaggcagacgaccagccctttgat

SEQ ID NO: 537923 - DNA, 25 bp, Mus musculus
gcaggcagacgagcagccctttgat

SEQ ID NO: 537924 - DNA, 25 bp, Mus musculus
gcaggcagagcaagggatatttcaa

SEQ ID NO: 537925 - DNA, 25 bp, Mus musculus
gcaggcagagcatgggatatttcaa

SEQ ID NO: 537926 - DNA, 25 bp, Mus musculus
gcaggcagatctcagtctaaggcta

SEQ ID NO: 537927 - DNA, 25 bp, Mus musculus
gcaggcagatctgagtctaaggcta

SEQ ID NO: 537928 - DNA, 25 bp, Mus musculus
gcaggcagcagacacccgggtctct

SEQ ID NO: 537929 - DNA, 25 bp, Mus musculus
gcaggcagcagagacccgggtctct

SEQ ID NO: 537930 - DNA, 25 bp, Mus musculus
gcaggcagcatgatgttttctaaac

SEQ ID NO: 537931 - DNA, 25 bp, Mus musculus
gcaggcagcatgttgttttctaaac

SEQ ID NO: 537932 - DNA, 25 bp, Mus musculus
gcaggcagcgagacacagcctgatt

SEQ ID NO: 537933 - DNA, 25 bp, Mus musculus
gcaggcagcgagtcacagcctgatt

SEQ ID NO: 537934 - DNA, 25 bp, Mus musculus
gcaggcaggatcaggtgtccacttt

SEQ ID NO: 537935 - DNA, 25 bp, Mus musculus
gcaggcaggatctggtgtccacttt

SEQ ID NO: 537936 - DNA, 25 bp, Mus musculus
gcaggcaggcaaacagtgatcactc

SEQ ID NO: 537937 - DNA, 25 bp, Mus musculus
gcaggcaggcaatcagtgatcactc

SEQ ID NO: 537938 - DNA, 25 bp, Mus musculus
gcaggcaggcatagaagcatgtcca

SEQ ID NO: 537939 - DNA, 25 bp, Mus musculus
gcaggcaggcattgaagcatgtcca

SEQ ID NO: 537940 - DNA, 25 bp, Mus musculus
gcaggcagggaacttcgcgctcatc

SEQ ID NO: 537941 - DNA, 25 bp, Mus musculus
gcaggcagggaagttcgcgctcatc

SEQ ID NO: 537942 - DNA, 25 bp, Mus musculus
gcaggcagggtgagtattccaactc

SEQ ID NO: 537943 - DNA, 25 bp, Mus musculus
gcaggcagggtgtgtattccaactc

SEQ ID NO: 537944 - DNA, 25 bp, Mus musculus
gcaggcagtaaccagaaacctcaga

SEQ ID NO: 537945 - DNA, 25 bp, Mus musculus
gcaggcagtaacgagaaacctcaga

SEQ ID NO: 537946 - DNA, 25 bp, Mus musculus
gcaggcagtaggcatgctttcaaag

SEQ ID NO: 537947 - DNA, 25 bp, Mus musculus
gcaggcagtagggatgctttcaaag

SEQ ID NO: 537948 - DNA, 25 bp, Mus musculus
gcaggcagtcagcattgaattctac

SEQ ID NO: 537949 - DNA, 25 bp, Mus musculus
gcaggcagtcaggattgaattctac

SEQ ID NO: 537950 - DNA, 25 bp, Mus musculus
gcaggcagtcccaagtggagtgaca

SEQ ID NO: 537951 - DNA, 25 bp, Mus musculus
gcaggcagtccctagtggagtgaca

SEQ ID NO: 537952 - DNA, 25 bp, Mus musculus
gcaggcagtctgactagtctgacta

SEQ ID NO: 537953 - DNA, 25 bp, Mus musculus
gcaggcagtctgtctagtctgacta

SEQ ID NO: 537954 - DNA, 25 bp, Mus musculus
gcaggcagtgtaaggtcttggctaa

SEQ ID NO: 537955 - DNA, 25 bp, Mus musculus
gcaggcagtgtatggtcttggctaa

SEQ ID NO: 537956 - DNA, 25 bp, Mus musculus
gcaggcagtgtgagccatgaacttg

SEQ ID NO: 537957 - DNA, 25 bp, Mus musculus
gcaggcagtgtgtgccatgaacttg

SEQ ID NO: 537958 - DNA, 25 bp, Mus musculus
gcaggcagttgtcttgattcttcat

SEQ ID NO: 537959 - DNA, 25 bp, Mus musculus
gcaggcagttgtgttgattcttcat

SEQ ID NO: 537960 - DNA, 25 bp, Mus musculus
gcaggcataccgagaacagctcttt

SEQ ID NO: 537961 - DNA, 25 bp, Mus musculus
gcaggcataccgtgaacagctcttt

SEQ ID NO: 537962 - DNA, 25 bp, Mus musculus
gcaggcatacgaatcatggccagaa

SEQ ID NO: 537963 - DNA, 25 bp, Mus musculus
gcaggcatacgattcatggccagaa

SEQ ID NO: 537964 - DNA, 25 bp, Mus musculus
gcaggcatatatacagacatttccc

SEQ ID NO: 537965 - DNA, 25 bp, Mus musculus
gcaggcatatattcagacatttccc

SEQ ID NO: 537966 - DNA, 25 bp, Mus musculus
gcaggcatatgcatcggagactcgg

SEQ ID NO: 537967 - DNA, 25 bp, Mus musculus
gcaggcatatgcttcggagactcgg

SEQ ID NO: 537968 - DNA, 25 bp, Mus musculus
gcaggcatatttaggttcttcatgc

SEQ ID NO: 537969 - DNA, 25 bp, Mus musculus
gcaggcatattttggttcttcatgc

SEQ ID NO: 537970 - DNA, 25 bp, Mus musculus
gcaggcatcagcataatggcacaga

SEQ ID NO: 537971 - DNA, 25 bp, Mus musculus
gcaggcatcagcttaatggcacaga

SEQ ID NO: 537972 - DNA, 25 bp, Mus musculus
gcaggcatccttagggagacttgga

SEQ ID NO: 537973 - DNA, 25 bp, Mus musculus
gcaggcatcctttgggagacttgga

SEQ ID NO: 537974 - DNA, 25 bp, Mus musculus
gcaggcatctctctctgagagcagt

SEQ ID NO: 537975 - DNA, 25 bp, Mus musculus
gcaggcatctctgtctgagagcagt

SEQ ID NO: 537976 - DNA, 25 bp, Mus musculus
gcaggcatctgtccagctaccagag

SEQ ID NO: 537977 - DNA, 25 bp, Mus musculus
gcaggcatctgtctggttgtactcc

SEQ ID NO: 537978 - DNA, 25 bp, Mus musculus
gcaggcatctgtgcagctaccagag

SEQ ID NO: 537979 - DNA, 25 bp, Mus musculus
gcaggcatctgtgtggttgtactcc

SEQ ID NO: 537980 - DNA, 25 bp, Mus musculus
gcaggcatgcagacgccagtgtgct

SEQ ID NO: 537981 - DNA, 25 bp, Mus musculus
gcaggcatgcagtcgccagtgtgct

SEQ ID NO: 537982 - DNA, 25 bp, Mus musculus
gcaggcatgctccaaaaatcaaaca

SEQ ID NO: 537983 - DNA, 25 bp, Mus musculus
gcaggcatgctcgaaaaatcaaaca

SEQ ID NO: 537984 - DNA, 25 bp, Mus musculus
gcaggcatggatatcccaggcgtgt

SEQ ID NO: 537985 - DNA, 25 bp, Mus musculus
gcaggcatggatttcccaggcgtgt

SEQ ID NO: 537986 - DNA, 25 bp, Mus musculus
gcaggcatggtgcttctagttgaat

SEQ ID NO: 537987 - DNA, 25 bp, Mus musculus
gcaggcatggtggttctagttgaat

SEQ ID NO: 537988 - DNA, 25 bp, Mus musculus
gcaggcatgtccaacactgttagat

SEQ ID NO: 537989 - DNA, 25 bp, Mus musculus
gcaggcatgtcctacactgttagat

SEQ ID NO: 537990 - DNA, 25 bp, Mus musculus
gcaggcattatactgttccattgag

SEQ ID NO: 537991 - DNA, 25 bp, Mus musculus
gcaggcattatagtgttccattgag

SEQ ID NO: 537992 - DNA, 25 bp, Mus musculus
gcaggcattattaggttagtgttac

SEQ ID NO: 537993 - DNA, 25 bp, Mus musculus
gcaggcattatttggttagtgttac

SEQ ID NO: 537994 - DNA, 25 bp, Mus musculus
gcaggcattcaacaagaggtctatt

SEQ ID NO: 537995 - DNA, 25 bp, Mus musculus
gcaggcattcaagaagaggtctatt

SEQ ID NO: 537996 - DNA, 25 bp, Mus musculus
gcaggcattcagatctggagcaggc

SEQ ID NO: 537997 - DNA, 25 bp, Mus musculus
gcaggcattcagttctggagcaggc

SEQ ID NO: 537998 - DNA, 25 bp, Mus musculus
gcaggcattcatcgagactgtgatg

SEQ ID NO: 537999 - DNA, 25 bp, Mus musculus
gcaggcattcatggagactgtgatg

SEQ ID NO: 538000 - DNA, 25 bp, Mus musculus
gcaggcattctgagggactaagttt

SEQ ID NO: 538001 - DNA, 25 bp, Mus musculus
gcaggcattctgctacccagttgta

SEQ ID NO: 538002 - DNA, 25 bp, Mus musculus
gcaggcattctggtacccagttgta

SEQ ID NO: 538003 - DNA, 25 bp, Mus musculus
gcaggcattctgtgggactaagttt

SEQ ID NO: 538004 - DNA, 25 bp, Mus musculus
gcaggcattgcacctgggtccatag

SEQ ID NO: 538005 - DNA, 25 bp, Mus musculus
gcaggcattgcagctgggtccatag

SEQ ID NO: 538006 - DNA, 25 bp, Mus musculus
gcaggcattgtcacgggcagctaca

SEQ ID NO: 538007 - DNA, 25 bp, Mus musculus
gcaggcattgtcacgtttagttcag

SEQ ID NO: 538008 - DNA, 25 bp, Mus musculus
gcaggcattgtctcgggcagctaca

SEQ ID NO: 538009 - DNA, 25 bp, Mus musculus
gcaggcattgtctcgtttagttcag

SEQ ID NO: 538010 - DNA, 25 bp, Mus musculus
gcaggcattgttccaaaaggcactc

SEQ ID NO: 538011 - DNA, 25 bp, Mus musculus
gcaggcattgttgcaaaaggcactc

SEQ ID NO: 538012 - DNA, 25 bp, Mus musculus
gcaggccaaacgatcatgtacataa

SEQ ID NO: 538013 - DNA, 25 bp, Mus musculus
gcaggccaaacgttcatgtacataa

SEQ ID NO: 538014 - DNA, 25 bp, Mus musculus
gcaggccacagcagagcctgtggat

SEQ ID NO: 538015 - DNA, 25 bp, Mus musculus
gcaggccacagctgagcctgtggat

SEQ ID NO: 538016 - DNA, 25 bp, Mus musculus
gcaggccacaggactcaggcttata

SEQ ID NO: 538017 - DNA, 25 bp, Mus musculus
gcaggccacaggtctcaggcttata

SEQ ID NO: 538018 - DNA, 25 bp, Mus musculus
gcaggccaccagatgaacgggacaa

SEQ ID NO: 538019 - DNA, 25 bp, Mus musculus
gcaggccaccagttgaacgggacaa

SEQ ID NO: 538020 - DNA, 25 bp, Mus musculus
gcaggccaccgaattggcacagtca

SEQ ID NO: 538021 - DNA, 25 bp, Mus musculus
gcaggccaccgatttggcacagtca

SEQ ID NO: 538022 - DNA, 25 bp, Mus musculus
gcaggccacctcaatggagtttatc

SEQ ID NO: 538023 - DNA, 25 bp, Mus musculus
gcaggccacctctatggagtttatc

SEQ ID NO: 538024 - DNA, 25 bp, Mus musculus
gcaggccacgtacctaatccgtaaa

SEQ ID NO: 538025 - DNA, 25 bp, Mus musculus
gcaggccacgtagctaatccgtaaa

SEQ ID NO: 538026 - DNA, 25 bp, Mus musculus
gcaggccacttcaatatgactattc

SEQ ID NO: 538027 - DNA, 25 bp, Mus musculus
gcaggccacttctatatgactattc

SEQ ID NO: 538028 - DNA, 25 bp, Mus musculus
gcaggccagaagatggccaagcatc

SEQ ID NO: 538029 - DNA, 25 bp, Mus musculus
gcaggccagaagttggccaagcatc

SEQ ID NO: 538030 - DNA, 25 bp, Mus musculus
gcaggccagagtagtcatccaacat

SEQ ID NO: 538031 - DNA, 25 bp, Mus musculus
gcaggccagagttgtcatccaacat

SEQ ID NO: 538032 - DNA, 25 bp, Mus musculus
gcaggccagcacacgaagagttgga

SEQ ID NO: 538033 - DNA, 25 bp, Mus musculus
gcaggccagcactcgaagagttgga

SEQ ID NO: 538034 - DNA, 25 bp, Mus musculus
gcaggccagcagacttacatcagat

SEQ ID NO: 538035 - DNA, 25 bp, Mus musculus
gcaggccagcagtcttacatcagat

SEQ ID NO: 538036 - DNA, 25 bp, Mus musculus
gcaggccatagtcgtgcatggtttt

SEQ ID NO: 538037 - DNA, 25 bp, Mus musculus
gcaggccatagtggtgcatggtttt

SEQ ID NO: 538038 - DNA, 25 bp, Mus musculus
gcaggccatcaaaatggaccggtat

SEQ ID NO: 538039 - DNA, 25 bp, Mus musculus
gcaggccatcaactgccctacaagg

SEQ ID NO: 538040 - DNA, 25 bp, Mus musculus
gcaggccatcaagtgccctacaagg

SEQ ID NO: 538041 - DNA, 25 bp, Mus musculus
gcaggccatcaatatggaccggtat

SEQ ID NO: 538042 - DNA, 25 bp, Mus musculus
gcaggccatgatacactcctataat

SEQ ID NO: 538043 - DNA, 25 bp, Mus musculus
gcaggccatgattcactcctataat

SEQ ID NO: 538044 - DNA, 25 bp, Mus musculus
gcaggcccaagtagccactggcagt

SEQ ID NO: 538045 - DNA, 25 bp, Mus musculus
gcaggcccaagttgccactggcagt

SEQ ID NO: 538046 - DNA, 25 bp, Mus musculus
gcaggcccaccaatttatgttccat

SEQ ID NO: 538047 - DNA, 25 bp, Mus musculus
gcaggcccaccattttatgttccat

SEQ ID NO: 538048 - DNA, 25 bp, Mus musculus
gcaggcccaccgaaggacacagcat

SEQ ID NO: 538049 - DNA, 25 bp, Mus musculus
gcaggcccaccgtaggacacagcat

SEQ ID NO: 538050 - DNA, 25 bp, Mus musculus
gcaggcccagcacagaatgacccag

SEQ ID NO: 538051 - DNA, 25 bp, Mus musculus
gcaggcccagcagagaatgacccag

SEQ ID NO: 538052 - DNA, 25 bp, Mus musculus
gcaggcccagccaataacaaagatt

SEQ ID NO: 538053 - DNA, 25 bp, Mus musculus
gcaggcccagcctataacaaagatt

SEQ ID NO: 538054 - DNA, 25 bp, Mus musculus
gcaggcccaggaacccgaaatgtgt

SEQ ID NO: 538055 - DNA, 25 bp, Mus musculus
gcaggcccaggatcccgaaatgtgt

SEQ ID NO: 538056 - DNA, 25 bp, Mus musculus
gcaggcccaggtatagcattcgcta

SEQ ID NO: 538057 - DNA, 25 bp, Mus musculus
gcaggcccaggtttagcattcgcta

SEQ ID NO: 538058 - DNA, 25 bp, Mus musculus
gcaggcccagtaatggccagtgcta

SEQ ID NO: 538059 - DNA, 25 bp, Mus musculus
gcaggcccagtattggccagtgcta

SEQ ID NO: 538060 - DNA, 25 bp, Mus musculus
gcaggccccttactgtttcttaagt

SEQ ID NO: 538061 - DNA, 25 bp, Mus musculus
gcaggccccttagtgtttcttaagt

SEQ ID NO: 538062 - DNA, 25 bp, Mus musculus
gcaggccccttcatgttgaggtaga

SEQ ID NO: 538063 - DNA, 25 bp, Mus musculus
gcaggccccttcttgttgaggtaga

SEQ ID NO: 538064 - DNA, 25 bp, Mus musculus
gcaggcccgactaagagtgaaccgt

SEQ ID NO: 538065 - DNA, 25 bp, Mus musculus
gcaggcccgacttagagtgaaccgt

SEQ ID NO: 538066 - DNA, 25 bp, Mus musculus
gcaggcccgggaatgtcacaagcta

SEQ ID NO: 538067 - DNA, 25 bp, Mus musculus
gcaggcccgggattgtcacaagcta

SEQ ID NO: 538068 - DNA, 25 bp, Mus musculus
gcaggccctcagaaattccgaagca

SEQ ID NO: 538069 - DNA, 25 bp, Mus musculus
gcaggccctcagtaattccgaagca

SEQ ID NO: 538070 - DNA, 25 bp, Mus musculus
gcaggccctgcacgaaagcctacag

SEQ ID NO: 538071 - DNA, 25 bp, Mus musculus
gcaggccctgcaggaaagcctacag

SEQ ID NO: 538072 - DNA, 25 bp, Mus musculus
gcaggccctggtactgactcaacaa

SEQ ID NO: 538073 - DNA, 25 bp, Mus musculus
gcaggccctggtattgacccaacag

SEQ ID NO: 538074 - DNA, 25 bp, Mus musculus
gcaggccctggttctgactcaacaa

SEQ ID NO: 538075 - DNA, 25 bp, Mus musculus
gcaggccctggttttgacccaacag

SEQ ID NO: 538076 - DNA, 25 bp, Mus musculus
gcaggcccttctagttgggctggat

SEQ ID NO: 538077 - DNA, 25 bp, Mus musculus
gcaggcccttcttgttgggctggat

SEQ ID NO: 538078 - DNA, 25 bp, Mus musculus
gcaggcccttgacaagtccagatgt

SEQ ID NO: 538079 - DNA, 25 bp, Mus musculus
gcaggcccttgagaagtccagatgt

SEQ ID NO: 538080 - DNA, 25 bp, Mus musculus
gcaggccgatgtagcattgccacaa

SEQ ID NO: 538081 - DNA, 25 bp, Mus musculus
gcaggccgatgttgcattgccacaa

SEQ ID NO: 538082 - DNA, 25 bp, Mus musculus
gcaggccggagcatcacaatttgag

SEQ ID NO: 538083 - DNA, 25 bp, Mus musculus
gcaggccggagcttcacaatttgag

SEQ ID NO: 538084 - DNA, 25 bp, Mus musculus
gcaggccgggaaacctaggttttat

SEQ ID NO: 538085 - DNA, 25 bp, Mus musculus
gcaggccgggaatcctaggttttat

SEQ ID NO: 538086 - DNA, 25 bp, Mus musculus
gcaggcctaagaccttgtattttca

SEQ ID NO: 538087 - DNA, 25 bp, Mus musculus
gcaggcctaagagcttgtattttca

SEQ ID NO: 538088 - DNA, 25 bp, Mus musculus
gcaggcctagcacaaagtccaagtt

SEQ ID NO: 538089 - DNA, 25 bp, Mus musculus
gcaggcctagcagaaagtccaagtt

SEQ ID NO: 538090 - DNA, 25 bp, Mus musculus
gcaggcctagggacaactatcaaaa

SEQ ID NO: 538091 - DNA, 25 bp, Mus musculus
gcaggcctagggtcaactatcaaaa

SEQ ID NO: 538092 - DNA, 25 bp, Mus musculus
gcaggcctcagacccacaggatgtg

SEQ ID NO: 538093 - DNA, 25 bp, Mus musculus
gcaggcctcagagccacaggatgtg

SEQ ID NO: 538094 - DNA, 25 bp, Mus musculus
gcaggcctccatagaactgttgtaa

SEQ ID NO: 538095 - DNA, 25 bp, Mus musculus
gcaggcctccattgaactgttgtaa

SEQ ID NO: 538096 - DNA, 25 bp, Mus musculus
gcaggcctcgagattggcacatgat

SEQ ID NO: 538097 - DNA, 25 bp, Mus musculus
gcaggcctcgagtttggcacatgat

SEQ ID NO: 538098 - DNA, 25 bp, Mus musculus
gcaggcctgaggaccaagagacttg

SEQ ID NO: 538099 - DNA, 25 bp, Mus musculus
gcaggcctgaggatgggactttcta

SEQ ID NO: 538100 - DNA, 25 bp, Mus musculus
gcaggcctgaggctttgagaactaa

SEQ ID NO: 538101 - DNA, 25 bp, Mus musculus
gcaggcctgagggtttgagaactaa

SEQ ID NO: 538102 - DNA, 25 bp, Mus musculus
gcaggcctgaggtccaagagacttg

SEQ ID NO: 538103 - DNA, 25 bp, Mus musculus
gcaggcctgaggttgggactttcta

SEQ ID NO: 538104 - DNA, 25 bp, Mus musculus
gcaggcctgcctagaaagaattgtc

SEQ ID NO: 538105 - DNA, 25 bp, Mus musculus
gcaggcctgcctcggcgggctgaga

SEQ ID NO: 538106 - DNA, 25 bp, Mus musculus
gcaggcctgcctgggcgggctgaga

SEQ ID NO: 538107 - DNA, 25 bp, Mus musculus
gcaggcctgccttgaaagaattgtc

SEQ ID NO: 538108 - DNA, 25 bp, Mus musculus
gcaggcctgctcactaaaaacttct

SEQ ID NO: 538109 - DNA, 25 bp, Mus musculus
gcaggcctgctctctaaaaacttct

SEQ ID NO: 538110 - DNA, 25 bp, Mus musculus
gcaggcctggataaagtatggtcct

SEQ ID NO: 538111 - DNA, 25 bp, Mus musculus
gcaggcctggattaagtatggtcct

SEQ ID NO: 538112 - DNA, 25 bp, Mus musculus
gcaggcctggtgaatttaaacacac

SEQ ID NO: 538113 - DNA, 25 bp, Mus musculus
gcaggcctggtgtatttaaacacac

SEQ ID NO: 538114 - DNA, 25 bp, Mus musculus
gcaggcctgtctaagcagcttggta

SEQ ID NO: 538115 - DNA, 25 bp, Mus musculus
gcaggcctgtcttagcagcttggta

SEQ ID NO: 538116 - DNA, 25 bp, Mus musculus
gcaggccttaaacttgacatttttt

SEQ ID NO: 538117 - DNA, 25 bp, Mus musculus
gcaggccttaaagttgacatttttt

SEQ ID NO: 538118 - DNA, 25 bp, Mus musculus
gcaggccttcaaccatcaaaataca

SEQ ID NO: 538119 - DNA, 25 bp, Mus musculus
gcaggccttcaagcatcaaaataca

SEQ ID NO: 538120 - DNA, 25 bp, Mus musculus
gcaggccttgctctgtaggcatcag

SEQ ID NO: 538121 - DNA, 25 bp, Mus musculus
gcaggccttgctgtgtaggcatcag

SEQ ID NO: 538122 - DNA, 25 bp, Mus musculus
gcaggccttgggaatctctgcagag

SEQ ID NO: 538123 - DNA, 25 bp, Mus musculus
gcaggccttgggtatctctgcagag

SEQ ID NO: 538124 - DNA, 25 bp, Mus musculus
gcaggcctttaacttgtattcaact

SEQ ID NO: 538125 - DNA, 25 bp, Mus musculus
gcaggcctttaagttgtattcaact

SEQ ID NO: 538126 - DNA, 25 bp, Mus musculus
gcaggcctttgtaggagagctcagc

SEQ ID NO: 538127 - DNA, 25 bp, Mus musculus
gcaggcctttgttggagagctcagc

SEQ ID NO: 538128 - DNA, 25 bp, Mus musculus
gcaggcgacaaacaccacttgacaa

SEQ ID NO: 538129 - DNA, 25 bp, Mus musculus
gcaggcgacaaagaccacttgacaa

SEQ ID NO: 538130 - DNA, 25 bp, Mus musculus
gcaggcgacacaagaagcggatcca

SEQ ID NO: 538131 - DNA, 25 bp, Mus musculus
gcaggcgacacatgaagcggatcca

SEQ ID NO: 538132 - DNA, 25 bp, Mus musculus
gcaggcgagtgcagttcccactaag

SEQ ID NO: 538133 - DNA, 25 bp, Mus musculus
gcaggcgagtgctgttcccactaag

SEQ ID NO: 538134 - DNA, 25 bp, Mus musculus
gcaggcgcacacagtatgtacctat

SEQ ID NO: 538135 - DNA, 25 bp, Mus musculus
gcaggcgcacactgtatgtacctat

SEQ ID NO: 538136 - DNA, 25 bp, Mus musculus
gcaggcgcagagctactacgcacag

SEQ ID NO: 538137 - DNA, 25 bp, Mus musculus
gcaggcgcagaggtactacgcacag

SEQ ID NO: 538138 - DNA, 25 bp, Mus musculus
gcaggcgcagcaccgctttcagcag

SEQ ID NO: 538139 - DNA, 25 bp, Mus musculus
gcaggcgcagcagcgctttcagcag

SEQ ID NO: 538140 - DNA, 25 bp, Mus musculus
gcaggcgcatacctcttggagagta

SEQ ID NO: 538141 - DNA, 25 bp, Mus musculus
gcaggcgcatacgtcttggagagta

SEQ ID NO: 538142 - DNA, 25 bp, Mus musculus
gcaggcgcgcccatctacaaggttt

SEQ ID NO: 538143 - DNA, 25 bp, Mus musculus
gcaggcgcgcccttctacaaggttt

SEQ ID NO: 538144 - DNA, 25 bp, Mus musculus
gcaggcgctagcaatttagtgacca

SEQ ID NO: 538145 - DNA, 25 bp, Mus musculus
gcaggcgctagctatttagtgacca

SEQ ID NO: 538146 - DNA, 25 bp, Mus musculus
gcaggcgctgaacattccttaattt

SEQ ID NO: 538147 - DNA, 25 bp, Mus musculus
gcaggcgctgaagattccttaattt

SEQ ID NO: 538148 - DNA, 25 bp, Mus musculus
gcaggcggccgtaccaaggccacta

SEQ ID NO: 538149 - DNA, 25 bp, Mus musculus
gcaggcggccgttccaaggccacta

SEQ ID NO: 538150 - DNA, 25 bp, Mus musculus
gcaggcggctgcaccgggaatcaat

SEQ ID NO: 538151 - DNA, 25 bp, Mus musculus
gcaggcggctgctccgggaatcaat

SEQ ID NO: 538152 - DNA, 25 bp, Mus musculus
gcaggcgggactactggcactgttt

SEQ ID NO: 538153 - DNA, 25 bp, Mus musculus
gcaggcgggacttctggcactgttt

SEQ ID NO: 538154 - DNA, 25 bp, Mus musculus
gcaggcgggcagagttgtaattctc

SEQ ID NO: 538155 - DNA, 25 bp, Mus musculus
gcaggcgggcagctatcagattcat

SEQ ID NO: 538156 - DNA, 25 bp, Mus musculus
gcaggcgggcaggtatcagattcat

SEQ ID NO: 538157 - DNA, 25 bp, Mus musculus
gcaggcgggcagtgttgtaattctc

SEQ ID NO: 538158 - DNA, 25 bp, Mus musculus
gcaggcgtccagacaatcatccagt

SEQ ID NO: 538159 - DNA, 25 bp, Mus musculus
gcaggcgtccagtcaatcatccagt

SEQ ID NO: 538160 - DNA, 25 bp, Mus musculus
gcaggcgtcctcaggtacagaccag

SEQ ID NO: 538161 - DNA, 25 bp, Mus musculus
gcaggcgtcctctggtacagaccag

SEQ ID NO: 538162 - DNA, 25 bp, Mus musculus
gcaggcgtcgcacgtatatttgcag

SEQ ID NO: 538163 - DNA, 25 bp, Mus musculus
gcaggcgtcgcaggtatatttgcag

SEQ ID NO: 538164 - DNA, 25 bp, Mus musculus
gcaggcgtctccaaggaaaggactt

SEQ ID NO: 538165 - DNA, 25 bp, Mus musculus
gcaggcgtctcctaggaaaggactt

SEQ ID NO: 538166 - DNA, 25 bp, Mus musculus
gcaggcgtgcctactccgagtgggc

SEQ ID NO: 538167 - DNA, 25 bp, Mus musculus
gcaggcgtgccttctccgagtgggc

SEQ ID NO: 538168 - DNA, 25 bp, Mus musculus
gcaggcgtttatatctgcagggctg

SEQ ID NO: 538169 - DNA, 25 bp, Mus musculus
gcaggcgtttatttctgcagggctg

SEQ ID NO: 538170 - DNA, 25 bp, Mus musculus
gcaggcgtttggattatacttcgat

SEQ ID NO: 538171 - DNA, 25 bp, Mus musculus
gcaggcgtttggtttatacttcgat

SEQ ID NO: 538172 - DNA, 25 bp, Mus musculus
gcaggctaacagatggtgtgacaca

SEQ ID NO: 538173 - DNA, 25 bp, Mus musculus
gcaggctaacagttggtgtgacaca

SEQ ID NO: 538174 - DNA, 25 bp, Mus musculus
gcaggctaagcactcacacacataa

SEQ ID NO: 538175 - DNA, 25 bp, Mus musculus
gcaggctaagcagtcacacacataa

SEQ ID NO: 538176 - DNA, 25 bp, Mus musculus
gcaggctaatcacgaggcccgagta

SEQ ID NO: 538177 - DNA, 25 bp, Mus musculus
gcaggctaatcaggaggcccgagta

SEQ ID NO: 538178 - DNA, 25 bp, Mus musculus
gcaggctactgcaacagagacaggt

SEQ ID NO: 538179 - DNA, 25 bp, Mus musculus
gcaggctactgctacagagacaggt

SEQ ID NO: 538180 - DNA, 25 bp, Mus musculus
gcaggctactttcctctgtgtaaat

SEQ ID NO: 538181 - DNA, 25 bp, Mus musculus
gcaggctactttgctctgtgtaaat

SEQ ID NO: 538182 - DNA, 25 bp, Mus musculus
gcaggctagctcattctaactctga

SEQ ID NO: 538183 - DNA, 25 bp, Mus musculus
gcaggctagctctttctaactctga

SEQ ID NO: 538184 - DNA, 25 bp, Mus musculus
gcaggctaggtgagtgctctaccaa

SEQ ID NO: 538185 - DNA, 25 bp, Mus musculus
gcaggctaggtgtgtgctctaccaa

SEQ ID NO: 538186 - DNA, 25 bp, Mus musculus
gcaggctagtgcacggtggtcccat

SEQ ID NO: 538187 - DNA, 25 bp, Mus musculus
gcaggctagtgctcggtggtcccat

SEQ ID NO: 538188 - DNA, 25 bp, Mus musculus
gcaggctagtggcattgtgtgtgtg

SEQ ID NO: 538189 - DNA, 25 bp, Mus musculus
gcaggctagtgggattgtgtgtgtg

SEQ ID NO: 538190 - DNA, 25 bp, Mus musculus
gcaggctatggaccgaaagattgtc

SEQ ID NO: 538191 - DNA, 25 bp, Mus musculus
gcaggctatggagcgaaagattgtc

SEQ ID NO: 538192 - DNA, 25 bp, Mus musculus
gcaggctatgtgagattttgttcta

SEQ ID NO: 538193 - DNA, 25 bp, Mus musculus
gcaggctatgtgtgattttgttcta

SEQ ID NO: 538194 - DNA, 25 bp, Mus musculus
gcaggctcaaggctgtcagcaaaac

SEQ ID NO: 538195 - DNA, 25 bp, Mus musculus
gcaggctcaagggtgtcagcaaaac

SEQ ID NO: 538196 - DNA, 25 bp, Mus musculus
gcaggctcaccactgattgccgctg

SEQ ID NO: 538197 - DNA, 25 bp, Mus musculus
gcaggctcaccagtgattgccgctg

SEQ ID NO: 538198 - DNA, 25 bp, Mus musculus
gcaggctccagaatgtgtcaggaag

SEQ ID NO: 538199 - DNA, 25 bp, Mus musculus
gcaggctccagattgtgtcaggaag

SEQ ID NO: 538200 - DNA, 25 bp, Mus musculus
gcaggctcccctagggaactaactg

SEQ ID NO: 538201 - DNA, 25 bp, Mus musculus
gcaggctccccttgggaactaactg

SEQ ID NO: 538202 - DNA, 25 bp, Mus musculus
gcaggctcctagagatactttgttt

SEQ ID NO: 538203 - DNA, 25 bp, Mus musculus
gcaggctcctagtgatactttgttt

SEQ ID NO: 538204 - DNA, 25 bp, Mus musculus
gcaggctctggtcaaaaattcccaa

SEQ ID NO: 538205 - DNA, 25 bp, Mus musculus
gcaggctctggtgaaaaattcccaa

SEQ ID NO: 538206 - DNA, 25 bp, Mus musculus
gcaggctctgtgactgttaggtgat

SEQ ID NO: 538207 - DNA, 25 bp, Mus musculus
gcaggctctgtgtctgttaggtgat

SEQ ID NO: 538208 - DNA, 25 bp, Mus musculus
gcaggctgaagaccttgcagattat

SEQ ID NO: 538209 - DNA, 25 bp, Mus musculus
gcaggctgaagagcttgcagattat

SEQ ID NO: 538210 - DNA, 25 bp, Mus musculus
gcaggctgactgcttgtgacttacc

SEQ ID NO: 538211 - DNA, 25 bp, Mus musculus
gcaggctgactggttgtgacttacc

SEQ ID NO: 538212 - DNA, 25 bp, Mus musculus
gcaggctgagtaacttggcaaatcc

SEQ ID NO: 538213 - DNA, 25 bp, Mus musculus
gcaggctgagtatcttggcaaatcc

SEQ ID NO: 538214 - DNA, 25 bp, Mus musculus
gcaggctgccagaaaggaacccgaa

SEQ ID NO: 538215 - DNA, 25 bp, Mus musculus
gcaggctgccagtaaggaacccgaa

SEQ ID NO: 538216 - DNA, 25 bp, Mus musculus
gcaggctgccataccaacttcagca

SEQ ID NO: 538217 - DNA, 25 bp, Mus musculus
gcaggctgccattccaacttcagca

SEQ ID NO: 538218 - DNA, 25 bp, Mus musculus
gcaggctgcccgagtccatgaggaa

SEQ ID NO: 538219 - DNA, 25 bp, Mus musculus
gcaggctgcccgtgtccatgaggaa

SEQ ID NO: 538220 - DNA, 25 bp, Mus musculus
gcaggctgcctgatggatagatgtc

SEQ ID NO: 538221 - DNA, 25 bp, Mus musculus
gcaggctgcctgattaaaatcccat

SEQ ID NO: 538222 - DNA, 25 bp, Mus musculus
gcaggctgcctgttggatagatgtc

SEQ ID NO: 538223 - DNA, 25 bp, Mus musculus
gcaggctgcctgtttaaaatcccat

SEQ ID NO: 538224 - DNA, 25 bp, Mus musculus
gcaggctgctgcacacagtagtgat

SEQ ID NO: 538225 - DNA, 25 bp, Mus musculus
gcaggctgctgcagtgacttcaaaa

SEQ ID NO: 538226 - DNA, 25 bp, Mus musculus
gcaggctgctgctcacagtagtgat

SEQ ID NO: 538227 - DNA, 25 bp, Mus musculus
gcaggctgctgctgtgacttcaaaa

SEQ ID NO: 538228 - DNA, 25 bp, Mus musculus
gcaggctgctggaatagcaactttg

SEQ ID NO: 538229 - DNA, 25 bp, Mus musculus
gcaggctgctggattggttttacaa

SEQ ID NO: 538230 - DNA, 25 bp, Mus musculus
gcaggctgctggtatagcaactttg

SEQ ID NO: 538231 - DNA, 25 bp, Mus musculus
gcaggctgctggtttggttttacaa

SEQ ID NO: 538232 - DNA, 25 bp, Mus musculus
gcaggctgctgtcacacatttaggc

SEQ ID NO: 538233 - DNA, 25 bp, Mus musculus
gcaggctgctgtgacacatttaggc

SEQ ID NO: 538234 - DNA, 25 bp, Mus musculus
gcaggctgcttgctatgtaggccat

SEQ ID NO: 538235 - DNA, 25 bp, Mus musculus
gcaggctgcttggtatgtaggccat

SEQ ID NO: 538236 - DNA, 25 bp, Mus musculus
gcaggctggaaaagtcttactatca

SEQ ID NO: 538237 - DNA, 25 bp, Mus musculus
gcaggctggaaatgtcttactatca

SEQ ID NO: 538238 - DNA, 25 bp, Mus musculus
gcaggctggagacacttggcatttt

SEQ ID NO: 538239 - DNA, 25 bp, Mus musculus
gcaggctggagacttcggccattat

SEQ ID NO: 538240 - DNA, 25 bp, Mus musculus
gcaggctggagagacttggcatttt

SEQ ID NO: 538241 - DNA, 25 bp, Mus musculus
gcaggctggagagttcggccattat

SEQ ID NO: 538242 - DNA, 25 bp, Mus musculus
gcaggctggatgacaaggattcctt

SEQ ID NO: 538243 - DNA, 25 bp, Mus musculus
gcaggctggatgtcaaggattcctt

SEQ ID NO: 538244 - DNA, 25 bp, Mus musculus
gcaggctggtcacagactgttacat

SEQ ID NO: 538245 - DNA, 25 bp, Mus musculus
gcaggctggtcagagactgttacat

SEQ ID NO: 538246 - DNA, 25 bp, Mus musculus
gcaggctggtttcttttccacataa

SEQ ID NO: 538247 - DNA, 25 bp, Mus musculus
gcaggctggtttgttttccacataa

SEQ ID NO: 538248 - DNA, 25 bp, Mus musculus
gcaggctgtcatcgaaatgatgagc

SEQ ID NO: 538249 - DNA, 25 bp, Mus musculus
gcaggctgtcatggaaatgatgagc

SEQ ID NO: 538250 - DNA, 25 bp, Mus musculus
gcaggctgtcctccatactgcagta

SEQ ID NO: 538251 - DNA, 25 bp, Mus musculus
gcaggctgtcctgcatactgcagta

SEQ ID NO: 538252 - DNA, 25 bp, Mus musculus
gcaggctgtggcaaaacctatacca

SEQ ID NO: 538253 - DNA, 25 bp, Mus musculus
gcaggctgtggctaaacctatacca

SEQ ID NO: 538254 - DNA, 25 bp, Mus musculus
gcaggcttaatcaagagcctttctg

SEQ ID NO: 538255 - DNA, 25 bp, Mus musculus
gcaggcttaatctagagcctttctg

SEQ ID NO: 538256 - DNA, 25 bp, Mus musculus
gcaggcttagccacaggttaatgga

SEQ ID NO: 538257 - DNA, 25 bp, Mus musculus
gcaggcttagcctcaggttaatgga

SEQ ID NO: 538258 - DNA, 25 bp, Mus musculus
gcaggcttattacaatggtgattct

SEQ ID NO: 538259 - DNA, 25 bp, Mus musculus
gcaggcttattagaatggtgattct

SEQ ID NO: 538260 - DNA, 25 bp, Mus musculus
gcaggcttcattcagtaagcaccat

SEQ ID NO: 538261 - DNA, 25 bp, Mus musculus
gcaggcttcattgagtaagcaccat

SEQ ID NO: 538262 - DNA, 25 bp, Mus musculus
gcaggcttccatctgcagatgttct

SEQ ID NO: 538263 - DNA, 25 bp, Mus musculus
gcaggcttccatgtgcagatgttct

SEQ ID NO: 538264 - DNA, 25 bp, Mus musculus
gcaggcttcctaccttgtggagtcc

SEQ ID NO: 538265 - DNA, 25 bp, Mus musculus
gcaggcttcctactcggaatatcta

SEQ ID NO: 538266 - DNA, 25 bp, Mus musculus
gcaggcttcctagcttgtggagtcc

SEQ ID NO: 538267 - DNA, 25 bp, Mus musculus
gcaggcttcctagtcggaatatcta

SEQ ID NO: 538268 - DNA, 25 bp, Mus musculus
gcaggcttcgatctccactatagag

SEQ ID NO: 538269 - DNA, 25 bp, Mus musculus
gcaggcttcgatgtccactatagag

SEQ ID NO: 538270 - DNA, 25 bp, Mus musculus
gcaggcttctctaggtctgtagcct

SEQ ID NO: 538271 - DNA, 25 bp, Mus musculus
gcaggcttctcttggtctgtagcct

SEQ ID NO: 538272 - DNA, 25 bp, Mus musculus
gcaggcttgagaagaatctgggtgt

SEQ ID NO: 538273 - DNA, 25 bp, Mus musculus
gcaggcttgagatgaatctgggtgt

SEQ ID NO: 538274 - DNA, 25 bp, Mus musculus
gcaggcttgatgctggttaccttta

SEQ ID NO: 538275 - DNA, 25 bp, Mus musculus
gcaggcttgatggtggttaccttta

SEQ ID NO: 538276 - DNA, 25 bp, Mus musculus
gcaggcttggcgaacaggaactaga

SEQ ID NO: 538277 - DNA, 25 bp, Mus musculus
gcaggcttggcgtacaggaactaga

SEQ ID NO: 538278 - DNA, 25 bp, Mus musculus
gcaggcttggttcttccagtagata

SEQ ID NO: 538279 - DNA, 25 bp, Mus musculus
gcaggcttggttgttccagtagata

SEQ ID NO: 538280 - DNA, 25 bp, Mus musculus
gcaggcttgtatagcaactcctcta

SEQ ID NO: 538281 - DNA, 25 bp, Mus musculus
gcaggcttgtattgcaactcctcta

SEQ ID NO: 538282 - DNA, 25 bp, Mus musculus
gcaggcttgtgcaacagatgacctt

SEQ ID NO: 538283 - DNA, 25 bp, Mus musculus
gcaggcttgtgctacagatgacctt

SEQ ID NO: 538284 - DNA, 25 bp, Mus musculus
gcaggctttaagctcacatgtctga

SEQ ID NO: 538285 - DNA, 25 bp, Mus musculus
gcaggctttaaggtcacatgtctga

SEQ ID NO: 538286 - DNA, 25 bp, Mus musculus
gcaggctttctaaactggctaaatc

SEQ ID NO: 538287 - DNA, 25 bp, Mus musculus
gcaggctttctatactggctaaatc

SEQ ID NO: 538288 - DNA, 25 bp, Mus musculus
gcaggctttcttcagtataccaacg

SEQ ID NO: 538289 - DNA, 25 bp, Mus musculus
gcaggctttcttgagtataccaacg

SEQ ID NO: 538290 - DNA, 25 bp, Mus musculus
gcaggctttgcaaatcaccaggtca

SEQ ID NO: 538291 - DNA, 25 bp, Mus musculus
gcaggctttgcatatcaccaggtca

SEQ ID NO: 538292 - DNA, 25 bp, Mus musculus
gcaggctttggtatggttccgtttg

SEQ ID NO: 538293 - DNA, 25 bp, Mus musculus
gcaggctttggtttggttccgtttg

SEQ ID NO: 538294 - DNA, 25 bp, Mus musculus
gcaggctttgtaaatggtcatctct

SEQ ID NO: 538295 - DNA, 25 bp, Mus musculus
gcaggctttgtatatggtcatctct

SEQ ID NO: 538296 - DNA, 25 bp, Mus musculus
gcaggctttgtgagagaggacctct

SEQ ID NO: 538297 - DNA, 25 bp, Mus musculus
gcaggctttgtgtgagaggacctct

SEQ ID NO: 538298 - DNA, 25 bp, Mus musculus
gcaggctttgttaatgttggagtca

SEQ ID NO: 538299 - DNA, 25 bp, Mus musculus
gcaggctttgtttatgttggagtca

SEQ ID NO: 538300 - DNA, 25 bp, Mus musculus
gcaggcttttgaataccgctaggtt

SEQ ID NO: 538301 - DNA, 25 bp, Mus musculus
gcaggcttttgattaccgctaggtt

SEQ ID NO: 538302 - DNA, 25 bp, Mus musculus
gcagggaaaaaaccccacatgcttt

SEQ ID NO: 538303 - DNA, 25 bp, Mus musculus
gcagggaaaaaagcccacatgcttt

SEQ ID NO: 538304 - DNA, 25 bp, Mus musculus
gcagggaaaacactcccgccgattt

SEQ ID NO: 538305 - DNA, 25 bp, Mus musculus
gcagggaaaacagtcccgccgattt

SEQ ID NO: 538306 - DNA, 25 bp, Mus musculus
gcagggaaactgctgcaggcactat

SEQ ID NO: 538307 - DNA, 25 bp, Mus musculus
gcagggaaactggtgcaggcactat

SEQ ID NO: 538308 - DNA, 25 bp, Mus musculus
gcagggaacaagcaggcagttatat

SEQ ID NO: 538309 - DNA, 25 bp, Mus musculus
gcagggaacaaggaggcagttatat

SEQ ID NO: 538310 - DNA, 25 bp, Mus musculus
gcagggaacctaaggtggctatttc

SEQ ID NO: 538311 - DNA, 25 bp, Mus musculus
gcagggaacctatggtggctatttc

SEQ ID NO: 538312 - DNA, 25 bp, Mus musculus
gcagggaacctcacagagctacaat

SEQ ID NO: 538313 - DNA, 25 bp, Mus musculus
gcagggaacctctcagagctacaat

SEQ ID NO: 538314 - DNA, 25 bp, Mus musculus
gcagggaactaaatctgtctttcat

SEQ ID NO: 538315 - DNA, 25 bp, Mus musculus
gcagggaactaattctgtctttcat

SEQ ID NO: 538316 - DNA, 25 bp, Mus musculus
gcagggaagacaccagtcctcagat

SEQ ID NO: 538317 - DNA, 25 bp, Mus musculus
gcagggaagacagcagtcctcagat

SEQ ID NO: 538318 - DNA, 25 bp, Mus musculus
gcagggaagcataagactcgtctct

SEQ ID NO: 538319 - DNA, 25 bp, Mus musculus
gcagggaagcatcctcagtaccaag

SEQ ID NO: 538320 - DNA, 25 bp, Mus musculus
gcagggaagcatgctcagtaccaag

SEQ ID NO: 538321 - DNA, 25 bp, Mus musculus
gcagggaagcattagactcgtctct

SEQ ID NO: 538322 - DNA, 25 bp, Mus musculus
gcagggaatactctgcatctcaggt

SEQ ID NO: 538323 - DNA, 25 bp, Mus musculus
gcagggaatactgtgcatctcaggt

SEQ ID NO: 538324 - DNA, 25 bp, Mus musculus
gcagggaatatacctatctgttctt

SEQ ID NO: 538325 - DNA, 25 bp, Mus musculus
gcagggaatatagctatctgttctt

SEQ ID NO: 538326 - DNA, 25 bp, Mus musculus
gcagggacaataccaaacatctctt

SEQ ID NO: 538327 - DNA, 25 bp, Mus musculus
gcagggacaatagcaaacatctctt

SEQ ID NO: 538328 - DNA, 25 bp, Mus musculus
gcagggacaatgatttctgtatgtt

SEQ ID NO: 538329 - DNA, 25 bp, Mus musculus
gcagggacaatgttttctgtatgtt

SEQ ID NO: 538330 - DNA, 25 bp, Mus musculus
gcagggacagttcctaagcccaatc

SEQ ID NO: 538331 - DNA, 25 bp, Mus musculus
gcagggacagttgctaagcccaatc

SEQ ID NO: 538332 - DNA, 25 bp, Mus musculus
gcagggaccacacattgagcccaaa

SEQ ID NO: 538333 - DNA, 25 bp, Mus musculus
gcagggaccacagattgagcccaaa

SEQ ID NO: 538334 - DNA, 25 bp, Mus musculus
gcagggaccatgatcagagccagtt

SEQ ID NO: 538335 - DNA, 25 bp, Mus musculus
gcagggaccatgttcagagccagtt

SEQ ID NO: 538336 - DNA, 25 bp, Mus musculus
gcagggaccgtcagtaagctcacag

SEQ ID NO: 538337 - DNA, 25 bp, Mus musculus
gcagggaccgtctgtaagctcacag

SEQ ID NO: 538338 - DNA, 25 bp, Mus musculus
gcagggaccttcaggcctgaacaga

SEQ ID NO: 538339 - DNA, 25 bp, Mus musculus
gcagggaccttctggcctgaacaga

SEQ ID NO: 538340 - DNA, 25 bp, Mus musculus
gcagggacgatcacactcccagctt

SEQ ID NO: 538341 - DNA, 25 bp, Mus musculus
gcagggacgatctcactcccagctt

SEQ ID NO: 538342 - DNA, 25 bp, Mus musculus
gcagggacgcccagctggaaatcaa

SEQ ID NO: 538343 - DNA, 25 bp, Mus musculus
gcagggacgccctgctggaaatcaa

SEQ ID NO: 538344 - DNA, 25 bp, Mus musculus
gcagggactatgcataaggctcacc

SEQ ID NO: 538345 - DNA, 25 bp, Mus musculus
gcagggactatggataaggctcacc

SEQ ID NO: 538346 - DNA, 25 bp, Mus musculus
gcagggactcgtcaaacagcaggat

SEQ ID NO: 538347 - DNA, 25 bp, Mus musculus
gcagggactcgtgaaacagcaggat

SEQ ID NO: 538348 - DNA, 25 bp, Mus musculus
gcagggactgtccaccgaggaaatt

SEQ ID NO: 538349 - DNA, 25 bp, Mus musculus
gcagggactgtcgaccgaggaaatt

SEQ ID NO: 538350 - DNA, 25 bp, Mus musculus
gcagggacttagaacttgaagactt

SEQ ID NO: 538351 - DNA, 25 bp, Mus musculus
gcagggacttagtacttgaagactt

SEQ ID NO: 538352 - DNA, 25 bp, Mus musculus
gcagggacttgaaccatcgtacatc

SEQ ID NO: 538353 - DNA, 25 bp, Mus musculus
gcagggacttgatccatcgtacatc

SEQ ID NO: 538354 - DNA, 25 bp, Mus musculus
gcagggagaaaacattgcatctgtt

SEQ ID NO: 538355 - DNA, 25 bp, Mus musculus
gcagggagaaaagattgcatctgtt

SEQ ID NO: 538356 - DNA, 25 bp, Mus musculus
gcagggagacttaggctactgtcct

SEQ ID NO: 538357 - DNA, 25 bp, Mus musculus
gcagggagactttggctactgtcct

SEQ ID NO: 538358 - DNA, 25 bp, Mus musculus
gcagggagaggcaaggacctatacc

SEQ ID NO: 538359 - DNA, 25 bp, Mus musculus
gcagggagaggctaggacctatacc

SEQ ID NO: 538360 - DNA, 25 bp, Mus musculus
gcagggagatgtaccatcagctcct

SEQ ID NO: 538361 - DNA, 25 bp, Mus musculus
gcagggagatgttccatcagctcct

SEQ ID NO: 538362 - DNA, 25 bp, Mus musculus
gcagggagatttcagcaggccttca

SEQ ID NO: 538363 - DNA, 25 bp, Mus musculus
gcagggagatttgagcaggccttca

SEQ ID NO: 538364 - DNA, 25 bp, Mus musculus
gcagggagccaaccttaagtccttt

SEQ ID NO: 538365 - DNA, 25 bp, Mus musculus
gcagggagccaagcttaagtccttt

SEQ ID NO: 538366 - DNA, 25 bp, Mus musculus
gcagggagccacactgagtctgtga

SEQ ID NO: 538367 - DNA, 25 bp, Mus musculus
gcagggagccactctgagtctgtga

SEQ ID NO: 538368 - DNA, 25 bp, Mus musculus
gcagggagcggtaatgcttcaagaa

SEQ ID NO: 538369 - DNA, 25 bp, Mus musculus
gcagggagcggttatgcttcaagaa

SEQ ID NO: 538370 - DNA, 25 bp, Mus musculus
gcagggagcgtcagacaaatccatt

SEQ ID NO: 538371 - DNA, 25 bp, Mus musculus
gcagggagcgtctgacaaatccatt

SEQ ID NO: 538372 - DNA, 25 bp, Mus musculus
gcagggagcttacccagtgctcagc

SEQ ID NO: 538373 - DNA, 25 bp, Mus musculus
gcagggagcttagccagtgctcagc

SEQ ID NO: 538374 - DNA, 25 bp, Mus musculus
gcagggagcttcatttttccaacag

SEQ ID NO: 538375 - DNA, 25 bp, Mus musculus
gcagggagcttcttttttccaacag

SEQ ID NO: 538376 - DNA, 25 bp, Mus musculus
gcagggagctttcgagttgactatt

SEQ ID NO: 538377 - DNA, 25 bp, Mus musculus
gcagggagctttggagttgactatt

SEQ ID NO: 538378 - DNA, 25 bp, Mus musculus
gcagggaggacactctccttactgc

SEQ ID NO: 538379 - DNA, 25 bp, Mus musculus
gcagggaggacagtctccttactgc

SEQ ID NO: 538380 - DNA, 25 bp, Mus musculus
gcagggagtcctcagggttcccaaa

SEQ ID NO: 538381 - DNA, 25 bp, Mus musculus
gcagggagtcctgagggttcccaaa

SEQ ID NO: 538382 - DNA, 25 bp, Mus musculus
gcagggagtggcactcgactgattt

SEQ ID NO: 538383 - DNA, 25 bp, Mus musculus
gcagggagtggctctcgactgattt

SEQ ID NO: 538384 - DNA, 25 bp, Mus musculus
gcagggatattgcttcattgctttt

SEQ ID NO: 538385 - DNA, 25 bp, Mus musculus
gcagggatattggttcattgctttt

SEQ ID NO: 538386 - DNA, 25 bp, Mus musculus
gcagggatatttaagcaccttttag

SEQ ID NO: 538387 - DNA, 25 bp, Mus musculus
gcagggatattttagcaccttttag

SEQ ID NO: 538388 - DNA, 25 bp, Mus musculus
gcagggatcaatagagattctggag

SEQ ID NO: 538389 - DNA, 25 bp, Mus musculus
gcagggatcaattgagattctggag

SEQ ID NO: 538390 - DNA, 25 bp, Mus musculus
gcagggatgacacacacagggccac

SEQ ID NO: 538391 - DNA, 25 bp, Mus musculus
gcagggatgacagacacagggccac

SEQ ID NO: 538392 - DNA, 25 bp, Mus musculus
gcagggatggtgaaagtaactaatt

SEQ ID NO: 538393 - DNA, 25 bp, Mus musculus
gcagggatggtgtaagtaactaatt

SEQ ID NO: 538394 - DNA, 25 bp, Mus musculus
gcagggattcggacctgtttgaaca

SEQ ID NO: 538395 - DNA, 25 bp, Mus musculus
gcagggattcggtcctgtttgaaca

SEQ ID NO: 538396 - DNA, 25 bp, Mus musculus
gcagggattgctccacagatgtgct

SEQ ID NO: 538397 - DNA, 25 bp, Mus musculus
gcagggattgctgcacagatgtgct

SEQ ID NO: 538398 - DNA, 25 bp, Mus musculus
gcagggatttacctttaattcagtc

SEQ ID NO: 538399 - DNA, 25 bp, Mus musculus
gcagggatttacgtttaattcagtc

SEQ ID NO: 538400 - DNA, 25 bp, Mus musculus
gcagggatttttctgtatagtttaa

SEQ ID NO: 538401 - DNA, 25 bp, Mus musculus
gcagggatttttgtgtatagtttaa

SEQ ID NO: 538402 - DNA, 25 bp, Mus musculus
gcagggcaaaagctggttgttttca

SEQ ID NO: 538403 - DNA, 25 bp, Mus musculus
gcagggcaaaaggtggttgttttca

SEQ ID NO: 538404 - DNA, 25 bp, Mus musculus
gcagggcaaagcagagctacttact

SEQ ID NO: 538405 - DNA, 25 bp, Mus musculus
gcagggcaaagctgagctacttact

SEQ ID NO: 538406 - DNA, 25 bp, Mus musculus
gcagggcaacagcaacagttctcca

SEQ ID NO: 538407 - DNA, 25 bp, Mus musculus
gcagggcaacaggaacagttctcca

SEQ ID NO: 538408 - DNA, 25 bp, Mus musculus
gcagggcaagcaaatttctgcctct

SEQ ID NO: 538409 - DNA, 25 bp, Mus musculus
gcagggcaagcatatttctgcctct

SEQ ID NO: 538410 - DNA, 25 bp, Mus musculus
gcagggcaagccaatgctacagaga

SEQ ID NO: 538411 - DNA, 25 bp, Mus musculus
gcagggcaagcctatgctacagaga

SEQ ID NO: 538412 - DNA, 25 bp, Mus musculus
gcagggcacattactggaaaccctt

SEQ ID NO: 538413 - DNA, 25 bp, Mus musculus
gcagggcacatttctggaaaccctt

SEQ ID NO: 538414 - DNA, 25 bp, Mus musculus
gcagggcacgttacatgcagcatat

SEQ ID NO: 538415 - DNA, 25 bp, Mus musculus
gcagggcacgtttcatgcagcatat

SEQ ID NO: 538416 - DNA, 25 bp, Mus musculus
gcagggcagacaatgcgatcccaat

SEQ ID NO: 538417 - DNA, 25 bp, Mus musculus
gcagggcagacattgcgatcccaat

SEQ ID NO: 538418 - DNA, 25 bp, Mus musculus
gcagggcagagcactcctgagataa

SEQ ID NO: 538419 - DNA, 25 bp, Mus musculus
gcagggcagagctctcctgagataa

SEQ ID NO: 538420 - DNA, 25 bp, Mus musculus
gcagggcaggccctacgctttacca

SEQ ID NO: 538421 - DNA, 25 bp, Mus musculus
gcagggcaggccgtacgctttacca

SEQ ID NO: 538422 - DNA, 25 bp, Mus musculus
gcagggcagggcagtttcccggcag

SEQ ID NO: 538423 - DNA, 25 bp, Mus musculus
gcagggcagggctgtttcccggcag

SEQ ID NO: 538424 - DNA, 25 bp, Mus musculus
gcagggcagtctccatctcttcttg

SEQ ID NO: 538425 - DNA, 25 bp, Mus musculus
gcagggcagtctgcatctcttcttg

SEQ ID NO: 538426 - DNA, 25 bp, Mus musculus
gcagggcagttcactgatcctaaga

SEQ ID NO: 538427 - DNA, 25 bp, Mus musculus
gcagggcagttctctgatcctaaga

SEQ ID NO: 538428 - DNA, 25 bp, Mus musculus
gcagggcatagcaacatcttagaca

SEQ ID NO: 538429 - DNA, 25 bp, Mus musculus
gcagggcatagctacatcttagaca

SEQ ID NO: 538430 - DNA, 25 bp, Mus musculus
gcagggcatattagtcatgtcttcc

SEQ ID NO: 538431 - DNA, 25 bp, Mus musculus
gcagggcatatttgtcatgtcttcc

SEQ ID NO: 538432 - DNA, 25 bp, Mus musculus
gcagggcatcacagtgcagttctct

SEQ ID NO: 538433 - DNA, 25 bp, Mus musculus
gcagggcatcactgtgcagttctct

SEQ ID NO: 538434 - DNA, 25 bp, Mus musculus
gcagggcatcatcgtggtgaacaca

SEQ ID NO: 538435 - DNA, 25 bp, Mus musculus
gcagggcatcatggtggtgaacaca

SEQ ID NO: 538436 - DNA, 25 bp, Mus musculus
gcagggcatccactgtaatgagaga

SEQ ID NO: 538437 - DNA, 25 bp, Mus musculus
gcagggcatccagtgtaatgagaga

SEQ ID NO: 538438 - DNA, 25 bp, Mus musculus
gcagggcatctcaaaacaggctgga

SEQ ID NO: 538439 - DNA, 25 bp, Mus musculus
gcagggcatctctaaacaggctgga

SEQ ID NO: 538440 - DNA, 25 bp, Mus musculus
gcagggcatggaacacttgtggtac

SEQ ID NO: 538441 - DNA, 25 bp, Mus musculus
gcagggcatggatcacttgtggtac

SEQ ID NO: 538442 - DNA, 25 bp, Mus musculus
gcagggcattagcaattagggctta

SEQ ID NO: 538443 - DNA, 25 bp, Mus musculus
gcagggcattaggaattagggctta

SEQ ID NO: 538444 - DNA, 25 bp, Mus musculus
gcagggccacggcccagctaacttt

SEQ ID NO: 538445 - DNA, 25 bp, Mus musculus
gcagggccacgggccagctaacttt

SEQ ID NO: 538446 - DNA, 25 bp, Mus musculus
gcagggccacgtatttgaggtaatc

SEQ ID NO: 538447 - DNA, 25 bp, Mus musculus
gcagggccacgtttttgaggtaatc

SEQ ID NO: 538448 - DNA, 25 bp, Mus musculus
gcagggccagcaccgagtcgtacat

SEQ ID NO: 538449 - DNA, 25 bp, Mus musculus
gcagggccagcagcgagtcgtacat

SEQ ID NO: 538450 - DNA, 25 bp, Mus musculus
gcagggccagctcaagtttaagttt

SEQ ID NO: 538451 - DNA, 25 bp, Mus musculus
gcagggccagctgaagtttaagttt

SEQ ID NO: 538452 - DNA, 25 bp, Mus musculus
gcagggccatagagagttagcaaat

SEQ ID NO: 538453 - DNA, 25 bp, Mus musculus
gcagggccatagtgagttagcaaat

SEQ ID NO: 538454 - DNA, 25 bp, Mus musculus
gcagggccattccttactttagaga

SEQ ID NO: 538455 - DNA, 25 bp, Mus musculus
gcagggccattcgttactttagaga

SEQ ID NO: 538456 - DNA, 25 bp, Mus musculus
gcagggcccgcgactgttaacgtga

SEQ ID NO: 538457 - DNA, 25 bp, Mus musculus
gcagggcccgcgtctgttaacgtga

SEQ ID NO: 538458 - DNA, 25 bp, Mus musculus
gcagggccctgaagtataggttgca

SEQ ID NO: 538459 - DNA, 25 bp, Mus musculus
gcagggccctgatgtataggttgca

SEQ ID NO: 538460 - DNA, 25 bp, Mus musculus
gcagggcctcatcgagttccgcgac

SEQ ID NO: 538461 - DNA, 25 bp, Mus musculus
gcagggcctcatggagttccgcgac

SEQ ID NO: 538462 - DNA, 25 bp, Mus musculus
gcagggcctgaactcgtgaagtcaa

SEQ ID NO: 538463 - DNA, 25 bp, Mus musculus
gcagggcctgaagtcgtgaagtcaa

SEQ ID NO: 538464 - DNA, 25 bp, Mus musculus
gcagggcctggtcagcacaatcagt

SEQ ID NO: 538465 - DNA, 25 bp, Mus musculus
gcagggcctggtgagcacaatcagt

SEQ ID NO: 538466 - DNA, 25 bp, Mus musculus
gcagggcctgttcctgtctctgtcg

SEQ ID NO: 538467 - DNA, 25 bp, Mus musculus
gcagggcctgttgctgtctctgtcg

SEQ ID NO: 538468 - DNA, 25 bp, Mus musculus
gcagggcgagccagcaaccaacagg

SEQ ID NO: 538469 - DNA, 25 bp, Mus musculus
gcagggcgagcctgcaaccaacagg

SEQ ID NO: 538470 - DNA, 25 bp, Mus musculus
gcagggcgttcaatgggtaaaaaca

SEQ ID NO: 538471 - DNA, 25 bp, Mus musculus
gcagggcgttcattgggtaaaaaca

SEQ ID NO: 538472 - DNA, 25 bp, Mus musculus
gcagggctaccaccacgagtacgta

SEQ ID NO: 538473 - DNA, 25 bp, Mus musculus
gcagggctaccaccaggctttggaa

SEQ ID NO: 538474 - DNA, 25 bp, Mus musculus
gcagggctaccagcacgagtacgta

SEQ ID NO: 538475 - DNA, 25 bp, Mus musculus
gcagggctaccagcaggctttggaa

SEQ ID NO: 538476 - DNA, 25 bp, Mus musculus
gcagggctcagcagatttctgtgaa

SEQ ID NO: 538477 - DNA, 25 bp, Mus musculus
gcagggctcagctgatttctgtgaa

SEQ ID NO: 538478 - DNA, 25 bp, Mus musculus
gcagggctccttacacttgtagtaa

SEQ ID NO: 538479 - DNA, 25 bp, Mus musculus
gcagggctcctttcacttgtagtaa

SEQ ID NO: 538480 - DNA, 25 bp, Mus musculus
gcagggctcgttcgtgtcttcatca

SEQ ID NO: 538481 - DNA, 25 bp, Mus musculus
gcagggctcgttggtgtcttcatca

SEQ ID NO: 538482 - DNA, 25 bp, Mus musculus
gcagggctctatccgtgaaacagta

SEQ ID NO: 538483 - DNA, 25 bp, Mus musculus
gcagggctctatgcgtgaaacagta

SEQ ID NO: 538484 - DNA, 25 bp, Mus musculus
gcagggctgaaaagttcccactgta

SEQ ID NO: 538485 - DNA, 25 bp, Mus musculus
gcagggctgaaatgttcccactgta

SEQ ID NO: 538486 - DNA, 25 bp, Mus musculus
gcagggctgagtctcctgacagtac

SEQ ID NO: 538487 - DNA, 25 bp, Mus musculus
gcagggctgagtgtcctgacagtac

SEQ ID NO: 538488 - DNA, 25 bp, Mus musculus
gcagggctgatccagctatgcccaa

SEQ ID NO: 538489 - DNA, 25 bp, Mus musculus
gcagggctgatcgagctatgcccaa

SEQ ID NO: 538490 - DNA, 25 bp, Mus musculus
gcagggctgcttatcaccgcaggag

SEQ ID NO: 538491 - DNA, 25 bp, Mus musculus
gcagggctgcttttcaccgcaggag

SEQ ID NO: 538492 - DNA, 25 bp, Mus musculus
gcagggctggatcacatttgagaac

SEQ ID NO: 538493 - DNA, 25 bp, Mus musculus
gcagggctggatgacatttgagaac

SEQ ID NO: 538494 - DNA, 25 bp, Mus musculus
gcagggctggcaaatcgcctctgtt

SEQ ID NO: 538495 - DNA, 25 bp, Mus musculus
gcagggctggcaaatttcctctatt

SEQ ID NO: 538496 - DNA, 25 bp, Mus musculus
gcagggctggcatatcgcctctgtt

SEQ ID NO: 538497 - DNA, 25 bp, Mus musculus
gcagggctggcatatttcctctatt

SEQ ID NO: 538498 - DNA, 25 bp, Mus musculus
gcagggctggtaacactttttaaat

SEQ ID NO: 538499 - DNA, 25 bp, Mus musculus
gcagggctggtatcactttttaaat

SEQ ID NO: 538500 - DNA, 25 bp, Mus musculus
gcagggctgtagaatgctttgttcc

SEQ ID NO: 538501 - DNA, 25 bp, Mus musculus
gcagggctgtagtatgctttgttcc

SEQ ID NO: 538502 - DNA, 25 bp, Mus musculus
gcagggctgtgcaaatgttttatac

SEQ ID NO: 538503 - DNA, 25 bp, Mus musculus
gcagggctgtgctaatgttttatac

SEQ ID NO: 538504 - DNA, 25 bp, Mus musculus
gcagggcttacgattcatgctaaca

SEQ ID NO: 538505 - DNA, 25 bp, Mus musculus
gcagggcttacgtttcatgctaaca

SEQ ID NO: 538506 - DNA, 25 bp, Mus musculus
gcagggcttagcagagactactgta

SEQ ID NO: 538507 - DNA, 25 bp, Mus musculus
gcagggcttagctgagactactgta

SEQ ID NO: 538508 - DNA, 25 bp, Mus musculus
gcagggcttgtactttgctttagta

SEQ ID NO: 538509 - DNA, 25 bp, Mus musculus
gcagggcttgtagtttgctttagta

SEQ ID NO: 538510 - DNA, 25 bp, Mus musculus
gcagggctttataggttgtgactac

SEQ ID NO: 538511 - DNA, 25 bp, Mus musculus
gcagggctttattggttgtgactac

SEQ ID NO: 538512 - DNA, 25 bp, Mus musculus
gcagggcttttcagtacagccatag

SEQ ID NO: 538513 - DNA, 25 bp, Mus musculus
gcagggcttttccagacaaattcca

SEQ ID NO: 538514 - DNA, 25 bp, Mus musculus
gcagggcttttcgagacaaattcca

SEQ ID NO: 538515 - DNA, 25 bp, Mus musculus
gcagggcttttctgtacagccatag

SEQ ID NO: 538516 - DNA, 25 bp, Mus musculus
gcagggctttttctgccacccgctg

SEQ ID NO: 538517 - DNA, 25 bp, Mus musculus
gcagggctttttgtgccacccgctg

SEQ ID NO: 538518 - DNA, 25 bp, Mus musculus
gcagggggctctcttcattcaggaa

SEQ ID NO: 538519 - DNA, 25 bp, Mus musculus
gcagggggctctgttcattcaggaa

SEQ ID NO: 538520 - DNA, 25 bp, Mus musculus
gcagggtaaaagcttcaaatcagat

SEQ ID NO: 538521 - DNA, 25 bp, Mus musculus
gcagggtaaaaggttcaaatcagat

SEQ ID NO: 538522 - DNA, 25 bp, Mus musculus
gcagggtaaaggaatcttttcttgc

SEQ ID NO: 538523 - DNA, 25 bp, Mus musculus
gcagggtaaaggtatcttttcttgc

SEQ ID NO: 538524 - DNA, 25 bp, Mus musculus
gcagggtaatccaatgctacttcag

SEQ ID NO: 538525 - DNA, 25 bp, Mus musculus
gcagggtaatcctatgctacttcag

SEQ ID NO: 538526 - DNA, 25 bp, Mus musculus
gcagggtacatcattggcccacagt

SEQ ID NO: 538527 - DNA, 25 bp, Mus musculus
gcagggtacatctttggcccacagt

SEQ ID NO: 538528 - DNA, 25 bp, Mus musculus
gcagggtaccacataggattttcta

SEQ ID NO: 538529 - DNA, 25 bp, Mus musculus
gcagggtaccacttaggattttcta

SEQ ID NO: 538530 - DNA, 25 bp, Mus musculus
gcagggtagaaactccgctagacag

SEQ ID NO: 538531 - DNA, 25 bp, Mus musculus
gcagggtagaaagtccgctagacag

SEQ ID NO: 538532 - DNA, 25 bp, Mus musculus
gcagggtattggctataagggactt

SEQ ID NO: 538533 - DNA, 25 bp, Mus musculus
gcagggtattgggtataagggactt

SEQ ID NO: 538534 - DNA, 25 bp, Mus musculus
gcagggtcagctagatgcttttgtt

SEQ ID NO: 538535 - DNA, 25 bp, Mus musculus
gcagggtcagcttgatgcttttgtt

SEQ ID NO: 538536 - DNA, 25 bp, Mus musculus
gcagggtccacaacgcacgctaatg

SEQ ID NO: 538537 - DNA, 25 bp, Mus musculus
gcagggtccacatcgcacgctaatg

SEQ ID NO: 538538 - DNA, 25 bp, Mus musculus
gcagggtccagcaataggcactctg

SEQ ID NO: 538539 - DNA, 25 bp, Mus musculus
gcagggtccagctataggcactctg

SEQ ID NO: 538540 - DNA, 25 bp, Mus musculus
gcagggtcccctataagatgtgtat

SEQ ID NO: 538541 - DNA, 25 bp, Mus musculus
gcagggtcccctttaagatgtgtat

SEQ ID NO: 538542 - DNA, 25 bp, Mus musculus
gcagggtcctccacggagtaacagt

SEQ ID NO: 538543 - DNA, 25 bp, Mus musculus
gcagggtcctcctcggagtaacagt

SEQ ID NO: 538544 - DNA, 25 bp, Mus musculus
gcagggtctcaacggagctaccaga

SEQ ID NO: 538545 - DNA, 25 bp, Mus musculus
gcagggtctcaagggagctaccaga

SEQ ID NO: 538546 - DNA, 25 bp, Mus musculus
gcagggtctgggaccacctaggaaa

SEQ ID NO: 538547 - DNA, 25 bp, Mus musculus
gcagggtctgggtccacctaggaaa

SEQ ID NO: 538548 - DNA, 25 bp, Mus musculus
gcagggtctgtcctactgcctacag

SEQ ID NO: 538549 - DNA, 25 bp, Mus musculus
gcagggtctgtcgtactgcctacag

SEQ ID NO: 538550 - DNA, 25 bp, Mus musculus
gcagggtctgtgactccctagtttg

SEQ ID NO: 538551 - DNA, 25 bp, Mus musculus
gcagggtctgtgtctccctagtttg

SEQ ID NO: 538552 - DNA, 25 bp, Mus musculus
gcagggtcttcaagggaaaagtaag

SEQ ID NO: 538553 - DNA, 25 bp, Mus musculus
gcagggtcttcatgggaaaagtaag

SEQ ID NO: 538554 - DNA, 25 bp, Mus musculus
gcagggtcttgccattacaactcag

SEQ ID NO: 538555 - DNA, 25 bp, Mus musculus
gcagggtcttgcgattacaactcag

SEQ ID NO: 538556 - DNA, 25 bp, Mus musculus
gcagggtgaatcattcccctttgcc

SEQ ID NO: 538557 - DNA, 25 bp, Mus musculus
gcagggtgaatctttcccctttgcc

SEQ ID NO: 538558 - DNA, 25 bp, Mus musculus
gcagggtgacatactttgcaggaat

SEQ ID NO: 538559 - DNA, 25 bp, Mus musculus
gcagggtgacattctttgcaggaat

SEQ ID NO: 538560 - DNA, 25 bp, Mus musculus
gcagggtgagcaagacatccttgaa

SEQ ID NO: 538561 - DNA, 25 bp, Mus musculus
gcagggtgagcatgacatccttgaa

SEQ ID NO: 538562 - DNA, 25 bp, Mus musculus
gcagggtgataccacttctctacaa

SEQ ID NO: 538563 - DNA, 25 bp, Mus musculus
gcagggtgatacgacttctctacaa

SEQ ID NO: 538564 - DNA, 25 bp, Mus musculus
gcagggtgcaaaatcattggctttt

SEQ ID NO: 538565 - DNA, 25 bp, Mus musculus
gcagggtgcaaattcattggctttt

SEQ ID NO: 538566 - DNA, 25 bp, Mus musculus
gcagggtgctgcaggcaacatgaaa

SEQ ID NO: 538567 - DNA, 25 bp, Mus musculus
gcagggtgctgctggcaacatgaaa

SEQ ID NO: 538568 - DNA, 25 bp, Mus musculus
gcagggtgggttaccaaatttgcat

SEQ ID NO: 538569 - DNA, 25 bp, Mus musculus
gcagggtgggtttccaaatttgcat

SEQ ID NO: 538570 - DNA, 25 bp, Mus musculus
gcagggtggttcagtctacctagag

SEQ ID NO: 538571 - DNA, 25 bp, Mus musculus
gcagggtggttctgtctacctagag

SEQ ID NO: 538572 - DNA, 25 bp, Mus musculus
gcagggttaattatccaatcttttt

SEQ ID NO: 538573 - DNA, 25 bp, Mus musculus
gcagggttaattttccaatcttttt

SEQ ID NO: 538574 - DNA, 25 bp, Mus musculus
gcagggttacagaggctacattagt

SEQ ID NO: 538575 - DNA, 25 bp, Mus musculus
gcagggttacagtggctacattagt

SEQ ID NO: 538576 - DNA, 25 bp, Mus musculus
gcagggttactgatgacattcgggt

SEQ ID NO: 538577 - DNA, 25 bp, Mus musculus
gcagggttactgttgacattcgggt

SEQ ID NO: 538578 - DNA, 25 bp, Mus musculus
gcagggttccctctctgaatagacg

SEQ ID NO: 538579 - DNA, 25 bp, Mus musculus
gcagggttccctgtctgaatagacg

SEQ ID NO: 538580 - DNA, 25 bp, Mus musculus
gcagggttccttcagagtcttgttc

SEQ ID NO: 538581 - DNA, 25 bp, Mus musculus
gcagggttccttgagagtcttgttc

SEQ ID NO: 538582 - DNA, 25 bp, Mus musculus
gcagggttcgatcttgaaaaagcca

SEQ ID NO: 538583 - DNA, 25 bp, Mus musculus
gcagggttcgatgttgaaaaagcca

SEQ ID NO: 538584 - DNA, 25 bp, Mus musculus
gcagggttctagacaagatgagctt

SEQ ID NO: 538585 - DNA, 25 bp, Mus musculus
gcagggttctagtcaagatgagctt

SEQ ID NO: 538586 - DNA, 25 bp, Mus musculus
gcagggttgactctgaagcccaaga

SEQ ID NO: 538587 - DNA, 25 bp, Mus musculus
gcagggttgactgtgaagcccaaga

SEQ ID NO: 538588 - DNA, 25 bp, Mus musculus
gcagggttgagcaaactgccccatt

SEQ ID NO: 538589 - DNA, 25 bp, Mus musculus
gcagggttgagctaactgccccatt

SEQ ID NO: 538590 - DNA, 25 bp, Mus musculus
gcagggttggaaatgaaggactttt

SEQ ID NO: 538591 - DNA, 25 bp, Mus musculus
gcagggttggaattgaaggactttt

SEQ ID NO: 538592 - DNA, 25 bp, Mus musculus
gcagggttgtcaaattcagcttcca

SEQ ID NO: 538593 - DNA, 25 bp, Mus musculus
gcagggttgtcatattcagcttcca

SEQ ID NO: 538594 - DNA, 25 bp, Mus musculus
gcagggtttaggctctgtgcccacc

SEQ ID NO: 538595 - DNA, 25 bp, Mus musculus
gcagggtttagggtctgtgcccacc

SEQ ID NO: 538596 - DNA, 25 bp, Mus musculus
gcagggtttcctaattgacacttcc

SEQ ID NO: 538597 - DNA, 25 bp, Mus musculus
gcagggtttcctcggatcactggct

SEQ ID NO: 538598 - DNA, 25 bp, Mus musculus
gcagggtttcctgggatcactggct

SEQ ID NO: 538599 - DNA, 25 bp, Mus musculus
gcagggtttccttattgacacttcc

SEQ ID NO: 538600 - DNA, 25 bp, Mus musculus
gcagggtttgtcaattcatagactg

SEQ ID NO: 538601 - DNA, 25 bp, Mus musculus
gcagggtttgtcactcggtctggat

SEQ ID NO: 538602 - DNA, 25 bp, Mus musculus
gcagggtttgtctattcatagactg

SEQ ID NO: 538603 - DNA, 25 bp, Mus musculus
gcagggtttgtctctcggtctggat

SEQ ID NO: 538604 - DNA, 25 bp, Mus musculus
gcagggttttgtaagcagcgatcta

SEQ ID NO: 538605 - DNA, 25 bp, Mus musculus
gcagggttttgttagcagcgatcta

SEQ ID NO: 538606 - DNA, 25 bp, Mus musculus
gcaggtaaaagcacacggcactcaa

SEQ ID NO: 538607 - DNA, 25 bp, Mus musculus
gcaggtaaaagctcacggcactcaa

SEQ ID NO: 538608 - DNA, 25 bp, Mus musculus
gcaggtaaaatacaggagccccttt

SEQ ID NO: 538609 - DNA, 25 bp, Mus musculus
gcaggtaaaataccactttggtagt

SEQ ID NO: 538610 - DNA, 25 bp, Mus musculus
gcaggtaaaatagaggagccccttt

SEQ ID NO: 538611 - DNA, 25 bp, Mus musculus
gcaggtaaaatagcactttggtagt

SEQ ID NO: 538612 - DNA, 25 bp, Mus musculus
gcaggtaacactagattttcttgaa

SEQ ID NO: 538613 - DNA, 25 bp, Mus musculus
gcaggtaacactatttcagctaagg

SEQ ID NO: 538614 - DNA, 25 bp, Mus musculus
gcaggtaacacttgattttcttgaa

SEQ ID NO: 538615 - DNA, 25 bp, Mus musculus
gcaggtaacactttttcagctaagg

SEQ ID NO: 538616 - DNA, 25 bp, Mus musculus
gcaggtaagaacagtgttgctctta

SEQ ID NO: 538617 - DNA, 25 bp, Mus musculus
gcaggtaagaactgtgttgctctta

SEQ ID NO: 538618 - DNA, 25 bp, Mus musculus
gcaggtaattttagcatatactcaa

SEQ ID NO: 538619 - DNA, 25 bp, Mus musculus
gcaggtaatttttgcatatactcaa

SEQ ID NO: 538620 - DNA, 25 bp, Mus musculus
gcaggtacaaaacagtcccatggga

SEQ ID NO: 538621 - DNA, 25 bp, Mus musculus
gcaggtacaaaagagtcccatggga

SEQ ID NO: 538622 - DNA, 25 bp, Mus musculus
gcaggtacaggaagcagctgagttc

SEQ ID NO: 538623 - DNA, 25 bp, Mus musculus
gcaggtacaggatgcagctgagttc

SEQ ID NO: 538624 - DNA, 25 bp, Mus musculus
gcaggtacatacaccatttttcaaa

SEQ ID NO: 538625 - DNA, 25 bp, Mus musculus
gcaggtacatactccatttttcaaa

SEQ ID NO: 538626 - DNA, 25 bp, Mus musculus
gcaggtaccaagcacatgcatagtt

SEQ ID NO: 538627 - DNA, 25 bp, Mus musculus
gcaggtaccaaggacatgcatagtt

SEQ ID NO: 538628 - DNA, 25 bp, Mus musculus
gcaggtaccagcattttgtcacttg

SEQ ID NO: 538629 - DNA, 25 bp, Mus musculus
gcaggtaccagctttttgtcacttg

SEQ ID NO: 538630 - DNA, 25 bp, Mus musculus
gcaggtaccatcattatcacagaga

SEQ ID NO: 538631 - DNA, 25 bp, Mus musculus
gcaggtaccatctttatcacagaga

SEQ ID NO: 538632 - DNA, 25 bp, Mus musculus
gcaggtaccctgagatctatagtta

SEQ ID NO: 538633 - DNA, 25 bp, Mus musculus
gcaggtaccctgtgatctatagtta

SEQ ID NO: 538634 - DNA, 25 bp, Mus musculus
gcaggtacctctcttaatacttgga

SEQ ID NO: 538635 - DNA, 25 bp, Mus musculus
gcaggtacctctgttaatacttgga

SEQ ID NO: 538636 - DNA, 25 bp, Mus musculus
gcaggtacctggagttgcttttaac

SEQ ID NO: 538637 - DNA, 25 bp, Mus musculus
gcaggtacctggtgttgcttttaac

SEQ ID NO: 538638 - DNA, 25 bp, Mus musculus
gcaggtactctcaagctcaatagcg

SEQ ID NO: 538639 - DNA, 25 bp, Mus musculus
gcaggtactctctagctcaatagcg

SEQ ID NO: 538640 - DNA, 25 bp, Mus musculus
gcaggtactgtgaatttcatcagga

SEQ ID NO: 538641 - DNA, 25 bp, Mus musculus
gcaggtactgtgtatttcatcagga

SEQ ID NO: 538642 - DNA, 25 bp, Mus musculus
gcaggtagactaatgcatgctctct

SEQ ID NO: 538643 - DNA, 25 bp, Mus musculus
gcaggtagactattgcatgctctct

SEQ ID NO: 538644 - DNA, 25 bp, Mus musculus
gcaggtagacttatgattcattctg

SEQ ID NO: 538645 - DNA, 25 bp, Mus musculus
gcaggtagacttttgattcattctg

SEQ ID NO: 538646 - DNA, 25 bp, Mus musculus
gcaggtagcctacttataagttgta

SEQ ID NO: 538647 - DNA, 25 bp, Mus musculus
gcaggtagcctagttataagttgta

SEQ ID NO: 538648 - DNA, 25 bp, Mus musculus
gcaggtagctgccacagagcctaat

SEQ ID NO: 538649 - DNA, 25 bp, Mus musculus
gcaggtagctgcgacagagcctaat

SEQ ID NO: 538650 - DNA, 25 bp, Mus musculus
gcaggtaggaggaagccccatgtta

SEQ ID NO: 538651 - DNA, 25 bp, Mus musculus
gcaggtaggaggtagccccatgtta

SEQ ID NO: 538652 - DNA, 25 bp, Mus musculus
gcaggtaggcagagactgagctaca

SEQ ID NO: 538653 - DNA, 25 bp, Mus musculus
gcaggtaggcagtgactgagctaca

SEQ ID NO: 538654 - DNA, 25 bp, Mus musculus
gcaggtaggctcatctgtgggaaaa

SEQ ID NO: 538655 - DNA, 25 bp, Mus musculus
gcaggtaggctcttctgtgggaaaa

SEQ ID NO: 538656 - DNA, 25 bp, Mus musculus
gcaggtagggttctaagcactttct

SEQ ID NO: 538657 - DNA, 25 bp, Mus musculus
gcaggtagggttgtaagcactttct

SEQ ID NO: 538658 - DNA, 25 bp, Mus musculus
gcaggtagttttaaagagcacataa

SEQ ID NO: 538659 - DNA, 25 bp, Mus musculus
gcaggtagtttttaagagcacataa

SEQ ID NO: 538660 - DNA, 25 bp, Mus musculus
gcaggtatactcaggtttcccaggg

SEQ ID NO: 538661 - DNA, 25 bp, Mus musculus
gcaggtatactctggtttcccaggg

SEQ ID NO: 538662 - DNA, 25 bp, Mus musculus
gcaggtatcggccaggctctcacac

SEQ ID NO: 538663 - DNA, 25 bp, Mus musculus
gcaggtatcggcgaggctctcacac

SEQ ID NO: 538664 - DNA, 25 bp, Mus musculus
gcaggtatctgtaagaggccagctt

SEQ ID NO: 538665 - DNA, 25 bp, Mus musculus
gcaggtatctgtatgtctttatgtg

SEQ ID NO: 538666 - DNA, 25 bp, Mus musculus
gcaggtatctgtccaagggcaacat

SEQ ID NO: 538667 - DNA, 25 bp, Mus musculus
gcaggtatctgtgcaagggcaacat

SEQ ID NO: 538668 - DNA, 25 bp, Mus musculus
gcaggtatctgttagaggccagctt

SEQ ID NO: 538669 - DNA, 25 bp, Mus musculus
gcaggtatctgtttgtctttatgtg

SEQ ID NO: 538670 - DNA, 25 bp, Mus musculus
gcaggtattcccatgattctcagag

SEQ ID NO: 538671 - DNA, 25 bp, Mus musculus
gcaggtattcccttgattctcagag

SEQ ID NO: 538672 - DNA, 25 bp, Mus musculus
gcaggtattgccctaggtgttcatt

SEQ ID NO: 538673 - DNA, 25 bp, Mus musculus
gcaggtattgccgtaggtgttcatt

SEQ ID NO: 538674 - DNA, 25 bp, Mus musculus
gcaggtattttgctagttcactata

SEQ ID NO: 538675 - DNA, 25 bp, Mus musculus
gcaggtattttggtagttcactata

SEQ ID NO: 538676 - DNA, 25 bp, Mus musculus
gcaggtcaaagcaagttaacttcta

SEQ ID NO: 538677 - DNA, 25 bp, Mus musculus
gcaggtcaaagctagttaacttcta

SEQ ID NO: 538678 - DNA, 25 bp, Mus musculus
gcaggtcaaggcaaagtcactccct

SEQ ID NO: 538679 - DNA, 25 bp, Mus musculus
gcaggtcaaggctaagtcactccct

SEQ ID NO: 538680 - DNA, 25 bp, Mus musculus
gcaggtcacatgcttatggagccct

SEQ ID NO: 538681 - DNA, 25 bp, Mus musculus
gcaggtcacatggttatggagccct

SEQ ID NO: 538682 - DNA, 25 bp, Mus musculus
gcaggtcaccatccttgcaaattaa

SEQ ID NO: 538683 - DNA, 25 bp, Mus musculus
gcaggtcaccatgcttgcaaattaa

SEQ ID NO: 538684 - DNA, 25 bp, Mus musculus
gcaggtcacctaaatgctgggccag

SEQ ID NO: 538685 - DNA, 25 bp, Mus musculus
gcaggtcacctaccaagacatcaag

SEQ ID NO: 538686 - DNA, 25 bp, Mus musculus
gcaggtcacctagcaagacatcaag

SEQ ID NO: 538687 - DNA, 25 bp, Mus musculus
gcaggtcacctatatgctgggccag

SEQ ID NO: 538688 - DNA, 25 bp, Mus musculus
gcaggtcactcgcttcacaaaaggt

SEQ ID NO: 538689 - DNA, 25 bp, Mus musculus
gcaggtcactcggttcacaaaaggt

SEQ ID NO: 538690 - DNA, 25 bp, Mus musculus
gcaggtcactgaagcattcacgcta

SEQ ID NO: 538691 - DNA, 25 bp, Mus musculus
gcaggtcactgatgcattcacgcta

SEQ ID NO: 538692 - DNA, 25 bp, Mus musculus
gcaggtcactttcaacctcatagga

SEQ ID NO: 538693 - DNA, 25 bp, Mus musculus
gcaggtcactttgaacctcatagga

SEQ ID NO: 538694 - DNA, 25 bp, Mus musculus
gcaggtcagcaccttgctgtcgatt

SEQ ID NO: 538695 - DNA, 25 bp, Mus musculus
gcaggtcagcacgttgctgtcgatt

SEQ ID NO: 538696 - DNA, 25 bp, Mus musculus
gcaggtcagcgcataggacttgtca

SEQ ID NO: 538697 - DNA, 25 bp, Mus musculus
gcaggtcagcgcttaggacttgtca

SEQ ID NO: 538698 - DNA, 25 bp, Mus musculus
gcaggtcatcaaccagtttcgcgat

SEQ ID NO: 538699 - DNA, 25 bp, Mus musculus
gcaggtcatcaactcaggctcagat

SEQ ID NO: 538700 - DNA, 25 bp, Mus musculus
gcaggtcatcaagcagtttcgcgat

SEQ ID NO: 538701 - DNA, 25 bp, Mus musculus
gcaggtcatcaagtcaggctcagat

SEQ ID NO: 538702 - DNA, 25 bp, Mus musculus
gcaggtcatctacaatgcaaccaga

SEQ ID NO: 538703 - DNA, 25 bp, Mus musculus
gcaggtcatctagaatgcaaccaga

SEQ ID NO: 538704 - DNA, 25 bp, Mus musculus
gcaggtcatgtaaacctcaggatga

SEQ ID NO: 538705 - DNA, 25 bp, Mus musculus
gcaggtcatgtatacctcaggatga

SEQ ID NO: 538706 - DNA, 25 bp, Mus musculus
gcaggtcatgttagtggcacttgtt

SEQ ID NO: 538707 - DNA, 25 bp, Mus musculus
gcaggtcatgtttgtggcacttgtt

SEQ ID NO: 538708 - DNA, 25 bp, Mus musculus
gcaggtccaaggactagcgatgaat

SEQ ID NO: 538709 - DNA, 25 bp, Mus musculus
gcaggtccaaggtctagcgatgaat

SEQ ID NO: 538710 - DNA, 25 bp, Mus musculus
gcaggtccacagattcctggaagag

SEQ ID NO: 538711 - DNA, 25 bp, Mus musculus
gcaggtccacagtttcctggaagag

SEQ ID NO: 538712 - DNA, 25 bp, Mus musculus
gcaggtccagctacaatcagaaata

SEQ ID NO: 538713 - DNA, 25 bp, Mus musculus
gcaggtccagcttcaatcagaaata

SEQ ID NO: 538714 - DNA, 25 bp, Mus musculus
gcaggtccagggaaaccagatccac

SEQ ID NO: 538715 - DNA, 25 bp, Mus musculus
gcaggtccagggtaaccagatccac

SEQ ID NO: 538716 - DNA, 25 bp, Mus musculus
gcaggtcccggacaagcttttatta

SEQ ID NO: 538717 - DNA, 25 bp, Mus musculus
gcaggtcccggagaagcttttatta

SEQ ID NO: 538718 - DNA, 25 bp, Mus musculus
gcaggtccctttatattatggtgta

SEQ ID NO: 538719 - DNA, 25 bp, Mus musculus
gcaggtccctttttattatggtgta

SEQ ID NO: 538720 - DNA, 25 bp, Mus musculus
gcaggtcctcccagggcaggcattt

SEQ ID NO: 538721 - DNA, 25 bp, Mus musculus
gcaggtcctccctgggcaggcattt

SEQ ID NO: 538722 - DNA, 25 bp, Mus musculus
gcaggtcctggactgtaccggtcat

SEQ ID NO: 538723 - DNA, 25 bp, Mus musculus
gcaggtcctggagtgtaccggtcat

SEQ ID NO: 538724 - DNA, 25 bp, Mus musculus
gcaggtcctgggaccactgtcagta

SEQ ID NO: 538725 - DNA, 25 bp, Mus musculus
gcaggtcctgggtccactgtcagta

SEQ ID NO: 538726 - DNA, 25 bp, Mus musculus
gcaggtcctgtgaatacgtttttaa

SEQ ID NO: 538727 - DNA, 25 bp, Mus musculus
gcaggtcctgtgtatacgtttttaa

SEQ ID NO: 538728 - DNA, 25 bp, Mus musculus
gcaggtccttgtctttgtatgttct

SEQ ID NO: 538729 - DNA, 25 bp, Mus musculus
gcaggtccttgtgtttgtatgttct

SEQ ID NO: 538730 - DNA, 25 bp, Mus musculus
gcaggtcgctcacaagacactgggc

SEQ ID NO: 538731 - DNA, 25 bp, Mus musculus
gcaggtcgctcagaagacactgggc

SEQ ID NO: 538732 - DNA, 25 bp, Mus musculus
gcaggtcgctgtacgatcgggaata

SEQ ID NO: 538733 - DNA, 25 bp, Mus musculus
gcaggtcgctgttcgatcgggaata

SEQ ID NO: 538734 - DNA, 25 bp, Mus musculus
gcaggtcggagcattgtacaatgag

SEQ ID NO: 538735 - DNA, 25 bp, Mus musculus
gcaggtcggagctttgtacaatgag

SEQ ID NO: 538736 - DNA, 25 bp, Mus musculus
gcaggtcgtcatcgtacctcatgaa

SEQ ID NO: 538737 - DNA, 25 bp, Mus musculus
gcaggtcgtcatggtacctcatgaa

SEQ ID NO: 538738 - DNA, 25 bp, Mus musculus
gcaggtctaaaccttggtgtctggt

SEQ ID NO: 538739 - DNA, 25 bp, Mus musculus
gcaggtctaaacgttggtgtctggt

SEQ ID NO: 538740 - DNA, 25 bp, Mus musculus
gcaggtctaacaatgcatgcatcaa

SEQ ID NO: 538741 - DNA, 25 bp, Mus musculus
gcaggtctaacattgcatgcatcaa

SEQ ID NO: 538742 - DNA, 25 bp, Mus musculus
gcaggtctaatgctctcctcaagag

SEQ ID NO: 538743 - DNA, 25 bp, Mus musculus
gcaggtctaatggtctcctcaagag

SEQ ID NO: 538744 - DNA, 25 bp, Mus musculus
gcaggtctcaagaactcagtgctta

SEQ ID NO: 538745 - DNA, 25 bp, Mus musculus
gcaggtctcaagtactcagtgctta

SEQ ID NO: 538746 - DNA, 25 bp, Mus musculus
gcaggtctcagtactcatcagcgtc

SEQ ID NO: 538747 - DNA, 25 bp, Mus musculus
gcaggtctcagttctcatcagcgtc

SEQ ID NO: 538748 - DNA, 25 bp, Mus musculus
gcaggtctcccaacaactagagtgg

SEQ ID NO: 538749 - DNA, 25 bp, Mus musculus
gcaggtctcccatcaactagagtgg

SEQ ID NO: 538750 - DNA, 25 bp, Mus musculus
gcaggtctcctgagcatacaacaag

SEQ ID NO: 538751 - DNA, 25 bp, Mus musculus
gcaggtctcctgagctccagatcag

SEQ ID NO: 538752 - DNA, 25 bp, Mus musculus
gcaggtctcctgtgcatacaacaag

SEQ ID NO: 538753 - DNA, 25 bp, Mus musculus
gcaggtctcctgtgctccagatcag

SEQ ID NO: 538754 - DNA, 25 bp, Mus musculus
gcaggtctccttagtcatcaactat

SEQ ID NO: 538755 - DNA, 25 bp, Mus musculus
gcaggtctcctttgtcatcaactat

SEQ ID NO: 538756 - DNA, 25 bp, Mus musculus
gcaggtctgacgcatttctatttat

SEQ ID NO: 538757 - DNA, 25 bp, Mus musculus
gcaggtctgacggatttctatttat

SEQ ID NO: 538758 - DNA, 25 bp, Mus musculus
gcaggtctgcaactcccaagaatat

SEQ ID NO: 538759 - DNA, 25 bp, Mus musculus
gcaggtctgcaagtcccaagaatat

SEQ ID NO: 538760 - DNA, 25 bp, Mus musculus
gcaggtctgcctcagcttagctgct

SEQ ID NO: 538761 - DNA, 25 bp, Mus musculus
gcaggtctgcctgagcttagctgct

SEQ ID NO: 538762 - DNA, 25 bp, Mus musculus
gcaggtctgctgactcgtagacaga

SEQ ID NO: 538763 - DNA, 25 bp, Mus musculus
gcaggtctgctgacttgctgagctt

SEQ ID NO: 538764 - DNA, 25 bp, Mus musculus
gcaggtctgctgtctcgtagacaga

SEQ ID NO: 538765 - DNA, 25 bp, Mus musculus
gcaggtctgctgtcttgctgagctt

SEQ ID NO: 538766 - DNA, 25 bp, Mus musculus
gcaggtctgggtcgcccccagaaac

SEQ ID NO: 538767 - DNA, 25 bp, Mus musculus
gcaggtctgggtggcccccagaaac

SEQ ID NO: 538768 - DNA, 25 bp, Mus musculus
gcaggtctgtagacagcgttttctc

SEQ ID NO: 538769 - DNA, 25 bp, Mus musculus
gcaggtctgtagtcagcgttttctc

SEQ ID NO: 538770 - DNA, 25 bp, Mus musculus
gcaggtctgtgcaatttgttaaaag

SEQ ID NO: 538771 - DNA, 25 bp, Mus musculus
gcaggtctgtgctatttgttaaaag

SEQ ID NO: 538772 - DNA, 25 bp, Mus musculus
gcaggtcttataaccccatatggga

SEQ ID NO: 538773 - DNA, 25 bp, Mus musculus
gcaggtcttatatccccatatggga

SEQ ID NO: 538774 - DNA, 25 bp, Mus musculus
gcaggtcttcagaggcttgtgatca

SEQ ID NO: 538775 - DNA, 25 bp, Mus musculus
gcaggtcttcagtggcttgtgatca

SEQ ID NO: 538776 - DNA, 25 bp, Mus musculus
gcaggtcttcatagcaaacagcaca

SEQ ID NO: 538777 - DNA, 25 bp, Mus musculus
gcaggtcttcattgcaaacagcaca

SEQ ID NO: 538778 - DNA, 25 bp, Mus musculus
gcaggtcttctgaagccaatagggt

SEQ ID NO: 538779 - DNA, 25 bp, Mus musculus
gcaggtcttctgtagccaatagggt

SEQ ID NO: 538780 - DNA, 25 bp, Mus musculus
gcaggtcttgatactgtgagggtca

SEQ ID NO: 538781 - DNA, 25 bp, Mus musculus
gcaggtcttgattctgtgagggtca

SEQ ID NO: 538782 - DNA, 25 bp, Mus musculus
gcaggtctttgcattataactcgta

SEQ ID NO: 538783 - DNA, 25 bp, Mus musculus
gcaggtctttgctttataactcgta

SEQ ID NO: 538784 - DNA, 25 bp, Mus musculus
gcaggtgaaaccatcaccgtgagcc

SEQ ID NO: 538785 - DNA, 25 bp, Mus musculus
gcaggtgaaaccttcaccgtgagcc

SEQ ID NO: 538786 - DNA, 25 bp, Mus musculus
gcaggtgaaaggatccaagctttaa

SEQ ID NO: 538787 - DNA, 25 bp, Mus musculus
gcaggtgaaaggttccaagctttaa

SEQ ID NO: 538788 - DNA, 25 bp, Mus musculus
gcaggtgaaccgaatgtaaccatca

SEQ ID NO: 538789 - DNA, 25 bp, Mus musculus
gcaggtgaaccgtatgtaaccatca

SEQ ID NO: 538790 - DNA, 25 bp, Mus musculus
gcaggtgaagccagtcatttctgtg

SEQ ID NO: 538791 - DNA, 25 bp, Mus musculus
gcaggtgaagcctgtcatttctgtg

SEQ ID NO: 538792 - DNA, 25 bp, Mus musculus
gcaggtgacaccctggcctactatc

SEQ ID NO: 538793 - DNA, 25 bp, Mus musculus
gcaggtgacaccgtggcctactatc

SEQ ID NO: 538794 - DNA, 25 bp, Mus musculus
gcaggtgacagaagaaagctactcc

SEQ ID NO: 538795 - DNA, 25 bp, Mus musculus
gcaggtgacagatgaaagctactcc

SEQ ID NO: 538796 - DNA, 25 bp, Mus musculus
gcaggtgacctacatgcttcagtaa

SEQ ID NO: 538797 - DNA, 25 bp, Mus musculus
gcaggtgacctagatgcttcagtaa

SEQ ID NO: 538798 - DNA, 25 bp, Mus musculus
gcaggtgacctgcattctatctttc

SEQ ID NO: 538799 - DNA, 25 bp, Mus musculus
gcaggtgacctgcttgcatagctag

SEQ ID NO: 538800 - DNA, 25 bp, Mus musculus
gcaggtgacctggattctatctttc

SEQ ID NO: 538801 - DNA, 25 bp, Mus musculus
gcaggtgacctggttgcatagctag

SEQ ID NO: 538802 - DNA, 25 bp, Mus musculus
gcaggtgactatactacttcaggga

SEQ ID NO: 538803 - DNA, 25 bp, Mus musculus
gcaggtgactattctacttcaggga

SEQ ID NO: 538804 - DNA, 25 bp, Mus musculus
gcaggtgacttgacttctctgtgct

SEQ ID NO: 538805 - DNA, 25 bp, Mus musculus
gcaggtgacttgtcttctctgtgct

SEQ ID NO: 538806 - DNA, 25 bp, Mus musculus
gcaggtgagatcaggaaccatcttt

SEQ ID NO: 538807 - DNA, 25 bp, Mus musculus
gcaggtgagatctggaaccatcttt

SEQ ID NO: 538808 - DNA, 25 bp, Mus musculus
gcaggtgagattccttacctcgcag

SEQ ID NO: 538809 - DNA, 25 bp, Mus musculus
gcaggtgagattgcttacctcgcag

SEQ ID NO: 538810 - DNA, 25 bp, Mus musculus
gcaggtgagcttaaggtcagtcata

SEQ ID NO: 538811 - DNA, 25 bp, Mus musculus
gcaggtgagctttaggtcagtcata

SEQ ID NO: 538812 - DNA, 25 bp, Mus musculus
gcaggtgagtgtacttttcggccag

SEQ ID NO: 538813 - DNA, 25 bp, Mus musculus
gcaggtgagtgttcttttcggccag

SEQ ID NO: 538814 - DNA, 25 bp, Mus musculus
gcaggtgatcctcggttcagtaaga

SEQ ID NO: 538815 - DNA, 25 bp, Mus musculus
gcaggtgatcctgggttcagtaaga

SEQ ID NO: 538816 - DNA, 25 bp, Mus musculus
gcaggtgatgccacgtgcttcagga

SEQ ID NO: 538817 - DNA, 25 bp, Mus musculus
gcaggtgatgcctcgtgcttcagga

SEQ ID NO: 538818 - DNA, 25 bp, Mus musculus
gcaggtgatggtagatgtagcccaa

SEQ ID NO: 538819 - DNA, 25 bp, Mus musculus
gcaggtgatggttgatgtagcccaa

SEQ ID NO: 538820 - DNA, 25 bp, Mus musculus
gcaggtgattagacgatcttgatta

SEQ ID NO: 538821 - DNA, 25 bp, Mus musculus
gcaggtgattagtcgatcttgatta

SEQ ID NO: 538822 - DNA, 25 bp, Mus musculus
gcaggtgcacagcaacatggatctt

SEQ ID NO: 538823 - DNA, 25 bp, Mus musculus
gcaggtgcacaggaacatggatctt

SEQ ID NO: 538824 - DNA, 25 bp, Mus musculus
gcaggtgcagtgagtggccttccat

SEQ ID NO: 538825 - DNA, 25 bp, Mus musculus
gcaggtgcagtgtgtggccttccat

SEQ ID NO: 538826 - DNA, 25 bp, Mus musculus
gcaggtgcatcgcagcttcatggat

SEQ ID NO: 538827 - DNA, 25 bp, Mus musculus
gcaggtgcatcgccagcatttcgat

SEQ ID NO: 538828 - DNA, 25 bp, Mus musculus
gcaggtgcatcggagcttcatggat

SEQ ID NO: 538829 - DNA, 25 bp, Mus musculus
gcaggtgcatcggcagcatttcgat

SEQ ID NO: 538830 - DNA, 25 bp, Mus musculus
gcaggtgccattaccacagaggact

SEQ ID NO: 538831 - DNA, 25 bp, Mus musculus
gcaggtgccatttccacagaggact

SEQ ID NO: 538832 - DNA, 25 bp, Mus musculus
gcaggtgcccctaaaagtgaacttg

SEQ ID NO: 538833 - DNA, 25 bp, Mus musculus
gcaggtgccccttaaagtgaacttg

SEQ ID NO: 538834 - DNA, 25 bp, Mus musculus
gcaggtgccgcacacaaacaatgca

SEQ ID NO: 538835 - DNA, 25 bp, Mus musculus
gcaggtgccgcagacaaacaatgca

SEQ ID NO: 538836 - DNA, 25 bp, Mus musculus
gcaggtgcctggaacagtcacacat

SEQ ID NO: 538837 - DNA, 25 bp, Mus musculus
gcaggtgcctggtacagtcacacat

SEQ ID NO: 538838 - DNA, 25 bp, Mus musculus
gcaggtgcctgtatactcagcaaat

SEQ ID NO: 538839 - DNA, 25 bp, Mus musculus
gcaggtgcctgtttactcagcaaat

SEQ ID NO: 538840 - DNA, 25 bp, Mus musculus
gcaggtgccttacttcgtggataaa

SEQ ID NO: 538841 - DNA, 25 bp, Mus musculus
gcaggtgccttagttcgtggataaa

SEQ ID NO: 538842 - DNA, 25 bp, Mus musculus
gcaggtgcctttcaggcctttgata

SEQ ID NO: 538843 - DNA, 25 bp, Mus musculus
gcaggtgcctttgaggcctttgata

SEQ ID NO: 538844 - DNA, 25 bp, Mus musculus
gcaggtgcgcctacagatgcgacgt

SEQ ID NO: 538845 - DNA, 25 bp, Mus musculus
gcaggtgcgccttcagatgcgacgt

SEQ ID NO: 538846 - DNA, 25 bp, Mus musculus
gcaggtgcgcttcgtgctgtcctta

SEQ ID NO: 538847 - DNA, 25 bp, Mus musculus
gcaggtgcgcttggtgctgtcctta

SEQ ID NO: 538848 - DNA, 25 bp, Mus musculus
gcaggtgctaacagtgtgctttcat

SEQ ID NO: 538849 - DNA, 25 bp, Mus musculus
gcaggtgctaactgtgtgctttcat

SEQ ID NO: 538850 - DNA, 25 bp, Mus musculus
gcaggtgctatcaaaacttggctga

SEQ ID NO: 538851 - DNA, 25 bp, Mus musculus
gcaggtgctatctaaacttggctga

SEQ ID NO: 538852 - DNA, 25 bp, Mus musculus
gcaggtgctattatggtgccttaat

SEQ ID NO: 538853 - DNA, 25 bp, Mus musculus
gcaggtgctattttggtgccttaat

SEQ ID NO: 538854 - DNA, 25 bp, Mus musculus
gcaggtgctcaaagggctgggcaat

SEQ ID NO: 538855 - DNA, 25 bp, Mus musculus
gcaggtgctcaatgggctgggcaat

SEQ ID NO: 538856 - DNA, 25 bp, Mus musculus
gcaggtgctgctctttactatgtaa

SEQ ID NO: 538857 - DNA, 25 bp, Mus musculus
gcaggtgctgctgtttactatgtaa

SEQ ID NO: 538858 - DNA, 25 bp, Mus musculus
gcaggtgctggtagctcactggcca

SEQ ID NO: 538859 - DNA, 25 bp, Mus musculus
gcaggtgctggttgctcactggcca

SEQ ID NO: 538860 - DNA, 25 bp, Mus musculus
gcaggtgcttccagggctagcctct

SEQ ID NO: 538861 - DNA, 25 bp, Mus musculus
gcaggtgcttcctgggctagcctct

SEQ ID NO: 538862 - DNA, 25 bp, Mus musculus
gcaggtgctttactcaaaggtgctt

SEQ ID NO: 538863 - DNA, 25 bp, Mus musculus
gcaggtgctttagtcaaaggtgctt

SEQ ID NO: 538864 - DNA, 25 bp, Mus musculus
gcaggtggacagaatctcacagtgt

SEQ ID NO: 538865 - DNA, 25 bp, Mus musculus
gcaggtggacagtatctcacagtgt

SEQ ID NO: 538866 - DNA, 25 bp, Mus musculus
gcaggtggcatgacattgcttcagt

SEQ ID NO: 538867 - DNA, 25 bp, Mus musculus
gcaggtggcatgtcattgcttcagt

SEQ ID NO: 538868 - DNA, 25 bp, Mus musculus
gcaggtggcattatcccagagtatc

SEQ ID NO: 538869 - DNA, 25 bp, Mus musculus
gcaggtggcattttcccagagtatc

SEQ ID NO: 538870 - DNA, 25 bp, Mus musculus
gcaggtggccggacggcttcttcct

SEQ ID NO: 538871 - DNA, 25 bp, Mus musculus
gcaggtggccggtcggcttcttcct

SEQ ID NO: 538872 - DNA, 25 bp, Mus musculus
gcaggtggctagacatgtgtacttc

SEQ ID NO: 538873 - DNA, 25 bp, Mus musculus
gcaggtggctagtcatgtgtacttc

SEQ ID NO: 538874 - DNA, 25 bp, Mus musculus
gcaggtggctcacataagagaacca

SEQ ID NO: 538875 - DNA, 25 bp, Mus musculus
gcaggtggctcagataagagaacca

SEQ ID NO: 538876 - DNA, 25 bp, Mus musculus
gcaggtggctccaggttgaaatatt

SEQ ID NO: 538877 - DNA, 25 bp, Mus musculus
gcaggtggctcctggttgaaatatt

SEQ ID NO: 538878 - DNA, 25 bp, Mus musculus
gcaggtgggcctaccaagtaagaga

SEQ ID NO: 538879 - DNA, 25 bp, Mus musculus
gcaggtgggccttccaagtaagaga

SEQ ID NO: 538880 - DNA, 25 bp, Mus musculus
gcaggtggtaggaattcactgttaa

SEQ ID NO: 538881 - DNA, 25 bp, Mus musculus
gcaggtggtaggtattcactgttaa

SEQ ID NO: 538882 - DNA, 25 bp, Mus musculus
gcaggtggtgaacgtctaaattaac

SEQ ID NO: 538883 - DNA, 25 bp, Mus musculus
gcaggtggtgaaggtctaaattaac

SEQ ID NO: 538884 - DNA, 25 bp, Mus musculus
gcaggtggtgctcccctgactcaga

SEQ ID NO: 538885 - DNA, 25 bp, Mus musculus
gcaggtggtgctgccctgactcaga

SEQ ID NO: 538886 - DNA, 25 bp, Mus musculus
gcaggtgtaagtccatccattgaca

SEQ ID NO: 538887 - DNA, 25 bp, Mus musculus
gcaggtgtaagtgcatccattgaca

SEQ ID NO: 538888 - DNA, 25 bp, Mus musculus
gcaggtgtacaaaggagggttcctc

SEQ ID NO: 538889 - DNA, 25 bp, Mus musculus
gcaggtgtacaatggagggttcctc

SEQ ID NO: 538890 - DNA, 25 bp, Mus musculus
gcaggtgtacacattgaaacttcta

SEQ ID NO: 538891 - DNA, 25 bp, Mus musculus
gcaggtgtacaccatgggttaacat

SEQ ID NO: 538892 - DNA, 25 bp, Mus musculus
gcaggtgtacacgatgggttaacat

SEQ ID NO: 538893 - DNA, 25 bp, Mus musculus
gcaggtgtacactttgaaacttcta

SEQ ID NO: 538894 - DNA, 25 bp, Mus musculus
gcaggtgtacctattccccaggctc

SEQ ID NO: 538895 - DNA, 25 bp, Mus musculus
gcaggtgtaccttttccccaggctc

SEQ ID NO: 538896 - DNA, 25 bp, Mus musculus
gcaggtgtactgctaacccctactg

SEQ ID NO: 538897 - DNA, 25 bp, Mus musculus
gcaggtgtactggtaacccctactg

SEQ ID NO: 538898 - DNA, 25 bp, Mus musculus
gcaggtgtatgaaagcgaggccaac

SEQ ID NO: 538899 - DNA, 25 bp, Mus musculus
gcaggtgtatgatagcgaggccaac

SEQ ID NO: 538900 - DNA, 25 bp, Mus musculus
gcaggtgtcacaactgctgccagag

SEQ ID NO: 538901 - DNA, 25 bp, Mus musculus
gcaggtgtcacatctgctgccagag

SEQ ID NO: 538902 - DNA, 25 bp, Mus musculus
gcaggtgtcaccagttgtcagcgtt

SEQ ID NO: 538903 - DNA, 25 bp, Mus musculus
gcaggtgtcacccttattagtcatg

SEQ ID NO: 538904 - DNA, 25 bp, Mus musculus
gcaggtgtcaccgttattagtcatg

SEQ ID NO: 538905 - DNA, 25 bp, Mus musculus
gcaggtgtcacctgttgtcagcgtt

SEQ ID NO: 538906 - DNA, 25 bp, Mus musculus
gcaggtgtcagaactggccaggtat

SEQ ID NO: 538907 - DNA, 25 bp, Mus musculus
gcaggtgtcagatctggccaggtat

SEQ ID NO: 538908 - DNA, 25 bp, Mus musculus
gcaggtgtcagccagctgtgcccat

SEQ ID NO: 538909 - DNA, 25 bp, Mus musculus
gcaggtgtcagcgagctgtgcccat

SEQ ID NO: 538910 - DNA, 25 bp, Mus musculus
gcaggtgtcaggaactccataggtc

SEQ ID NO: 538911 - DNA, 25 bp, Mus musculus
gcaggtgtcaggtactccataggtc

SEQ ID NO: 538912 - DNA, 25 bp, Mus musculus
gcaggtgtcattcatctcggtttgg

SEQ ID NO: 538913 - DNA, 25 bp, Mus musculus
gcaggtgtcattgatctcggtttgg

SEQ ID NO: 538914 - DNA, 25 bp, Mus musculus
gcaggtgtccatcgacgctaaaatt

SEQ ID NO: 538915 - DNA, 25 bp, Mus musculus
gcaggtgtccatggacgctaaaatt

SEQ ID NO: 538916 - DNA, 25 bp, Mus musculus
gcaggtgtccccagctataaaacaa

SEQ ID NO: 538917 - DNA, 25 bp, Mus musculus
gcaggtgtcccctgctataaaacaa

SEQ ID NO: 538918 - DNA, 25 bp, Mus musculus
gcaggtgtccttagaagagaagctt

SEQ ID NO: 538919 - DNA, 25 bp, Mus musculus
gcaggtgtcctttgaagagaagctt

SEQ ID NO: 538920 - DNA, 25 bp, Mus musculus
gcaggtgtctatcatgctcttaaga

SEQ ID NO: 538921 - DNA, 25 bp, Mus musculus
gcaggtgtctatgatgctcttaaga

SEQ ID NO: 538922 - DNA, 25 bp, Mus musculus
gcaggtgtctcgaaggatgtgtcca

SEQ ID NO: 538923 - DNA, 25 bp, Mus musculus
gcaggtgtctcgtaggatgtgtcca

SEQ ID NO: 538924 - DNA, 25 bp, Mus musculus
gcaggtgtgaaccttggcatccctc

SEQ ID NO: 538925 - DNA, 25 bp, Mus musculus
gcaggtgtgaacgttggcatccctc

SEQ ID NO: 538926 - DNA, 25 bp, Mus musculus
gcaggtgtgacactatttgggacta

SEQ ID NO: 538927 - DNA, 25 bp, Mus musculus
gcaggtgtgacagtatttgggacta

SEQ ID NO: 538928 - DNA, 25 bp, Mus musculus
gcaggtgtgctgatgtcaacagact

SEQ ID NO: 538929 - DNA, 25 bp, Mus musculus
gcaggtgtgctgttgtcaacagact

SEQ ID NO: 538930 - DNA, 25 bp, Mus musculus
gcaggtgtgtacaaattaccagtaa

SEQ ID NO: 538931 - DNA, 25 bp, Mus musculus
gcaggtgtgtactaattaccagtaa

SEQ ID NO: 538932 - DNA, 25 bp, Mus musculus
gcaggtgtttaaatgctcactaatc

SEQ ID NO: 538933 - DNA, 25 bp, Mus musculus
gcaggtgtttaattgctcactaatc

SEQ ID NO: 538934 - DNA, 25 bp, Mus musculus
gcaggtgtttagaaccccagctacc

SEQ ID NO: 538935 - DNA, 25 bp, Mus musculus
gcaggtgtttagtaccccagctacc

SEQ ID NO: 538936 - DNA, 25 bp, Mus musculus
gcaggtgtttctcatgacagtcaca

SEQ ID NO: 538937 - DNA, 25 bp, Mus musculus
gcaggtgtttctgatgacagtcaca

SEQ ID NO: 538938 - DNA, 25 bp, Mus musculus
gcaggttaaagcaggttaacacttg

SEQ ID NO: 538939 - DNA, 25 bp, Mus musculus
gcaggttaaagctggttaacacttg

SEQ ID NO: 538940 - DNA, 25 bp, Mus musculus
gcaggttaaattctttctttgctta

SEQ ID NO: 538941 - DNA, 25 bp, Mus musculus
gcaggttaaattgtttctttgctta

SEQ ID NO: 538942 - DNA, 25 bp, Mus musculus
gcaggttaacctcattgcttcaagg

SEQ ID NO: 538943 - DNA, 25 bp, Mus musculus
gcaggttaacctgattgcttcaagg

SEQ ID NO: 538944 - DNA, 25 bp, Mus musculus
gcaggttaagctagtctggtctaca

SEQ ID NO: 538945 - DNA, 25 bp, Mus musculus
gcaggttaagcttgtctggtctaca

SEQ ID NO: 538946 - DNA, 25 bp, Mus musculus
gcaggttaatacatctcggacacgg

SEQ ID NO: 538947 - DNA, 25 bp, Mus musculus
gcaggttaatacttctcggacacgg

SEQ ID NO: 538948 - DNA, 25 bp, Mus musculus
gcaggttacaccacaagcattcttg

SEQ ID NO: 538949 - DNA, 25 bp, Mus musculus
gcaggttacacctcaagcattcttg

SEQ ID NO: 538950 - DNA, 25 bp, Mus musculus
gcaggttacatgctaatgttcattc

SEQ ID NO: 538951 - DNA, 25 bp, Mus musculus
gcaggttacatggtaatgttcattc

SEQ ID NO: 538952 - DNA, 25 bp, Mus musculus
gcaggttactataccttgagtttaa

SEQ ID NO: 538953 - DNA, 25 bp, Mus musculus
gcaggttactattccttgagtttaa

SEQ ID NO: 538954 - DNA, 25 bp, Mus musculus
gcaggttagaccaccagacaccggc

SEQ ID NO: 538955 - DNA, 25 bp, Mus musculus
gcaggttagacctccagacaccggc

SEQ ID NO: 538956 - DNA, 25 bp, Mus musculus
gcaggttaggtaaggagtctccagt

SEQ ID NO: 538957 - DNA, 25 bp, Mus musculus
gcaggttaggtatggagtctccagt

SEQ ID NO: 538958 - DNA, 25 bp, Mus musculus
gcaggttataggagcatccccagat

SEQ ID NO: 538959 - DNA, 25 bp, Mus musculus
gcaggttataggtgcatccccagat

SEQ ID NO: 538960 - DNA, 25 bp, Mus musculus
gcaggttattatcagcaagttagct

SEQ ID NO: 538961 - DNA, 25 bp, Mus musculus
gcaggttattatgagcaagttagct

SEQ ID NO: 538962 - DNA, 25 bp, Mus musculus
gcaggttattcacgtcatttcttca

SEQ ID NO: 538963 - DNA, 25 bp, Mus musculus
gcaggttattcaggtcatttcttca

SEQ ID NO: 538964 - DNA, 25 bp, Mus musculus
gcaggttcaacgatatttacatgta

SEQ ID NO: 538965 - DNA, 25 bp, Mus musculus
gcaggttcaacgttatttacatgta

SEQ ID NO: 538966 - DNA, 25 bp, Mus musculus
gcaggttcaagcagcagcggtacct

SEQ ID NO: 538967 - DNA, 25 bp, Mus musculus
gcaggttcaagctgcagcggtacct

SEQ ID NO: 538968 - DNA, 25 bp, Mus musculus
gcaggttcaccgcaccaggaaggct

SEQ ID NO: 538969 - DNA, 25 bp, Mus musculus
gcaggttcaccggaccaggaaggct

SEQ ID NO: 538970 - DNA, 25 bp, Mus musculus
gcaggttcacttaacaaaaatatta

SEQ ID NO: 538971 - DNA, 25 bp, Mus musculus
gcaggttcactttacaaaaatatta

SEQ ID NO: 538972 - DNA, 25 bp, Mus musculus
gcaggttcaggaccaaagggctcct

SEQ ID NO: 538973 - DNA, 25 bp, Mus musculus
gcaggttcaggagcaaagggctcct

SEQ ID NO: 538974 - DNA, 25 bp, Mus musculus
gcaggttcatctcagcagcggagct

SEQ ID NO: 538975 - DNA, 25 bp, Mus musculus
gcaggttcatctgagcagcggagct

SEQ ID NO: 538976 - DNA, 25 bp, Mus musculus
gcaggttccaagactagtggtggca

SEQ ID NO: 538977 - DNA, 25 bp, Mus musculus
gcaggttccaagtctagtggtggca

SEQ ID NO: 538978 - DNA, 25 bp, Mus musculus
gcaggttccaggacaattagggcta

SEQ ID NO: 538979 - DNA, 25 bp, Mus musculus
gcaggttccaggtcaattagggcta

SEQ ID NO: 538980 - DNA, 25 bp, Mus musculus
gcaggttccagtcagagttcgagct

SEQ ID NO: 538981 - DNA, 25 bp, Mus musculus
gcaggttccagtgagagttcgagct

SEQ ID NO: 538982 - DNA, 25 bp, Mus musculus
gcaggttccgtgaagatgaaaccca

SEQ ID NO: 538983 - DNA, 25 bp, Mus musculus
gcaggttccgtgtagatgaaaccca

SEQ ID NO: 538984 - DNA, 25 bp, Mus musculus
gcaggttccttaagcacttcatgaa

SEQ ID NO: 538985 - DNA, 25 bp, Mus musculus
gcaggttccttatgcacttcatgaa

SEQ ID NO: 538986 - DNA, 25 bp, Mus musculus
gcaggttcgctgaggttgtcatctc

SEQ ID NO: 538987 - DNA, 25 bp, Mus musculus
gcaggttcgctgtggttgtcatctc

SEQ ID NO: 538988 - DNA, 25 bp, Mus musculus
gcaggttctgcaattcaaccacagg

SEQ ID NO: 538989 - DNA, 25 bp, Mus musculus
gcaggttctgcatttcaaccacagg

SEQ ID NO: 538990 - DNA, 25 bp, Mus musculus
gcaggttctgtgaacattgtccacc

SEQ ID NO: 538991 - DNA, 25 bp, Mus musculus
gcaggttctgtgtacattgtccacc

SEQ ID NO: 538992 - DNA, 25 bp, Mus musculus
gcaggttcttatatgccaccttcta

SEQ ID NO: 538993 - DNA, 25 bp, Mus musculus
gcaggttcttatttgccaccttcta

SEQ ID NO: 538994 - DNA, 25 bp, Mus musculus
gcaggttcttcgatgacaacggcta

SEQ ID NO: 538995 - DNA, 25 bp, Mus musculus
gcaggttcttcgttgacaacggcta

SEQ ID NO: 538996 - DNA, 25 bp, Mus musculus
gcaggttgaatgagccctctgtaac

SEQ ID NO: 538997 - DNA, 25 bp, Mus musculus
gcaggttgaatgtgccctctgtaac

SEQ ID NO: 538998 - DNA, 25 bp, Mus musculus
gcaggttgaccaagccatgaagagc

SEQ ID NO: 538999 - DNA, 25 bp, Mus musculus
gcaggttgaccatgccatgaagagc

SEQ ID NO: 539000 - DNA, 25 bp, Mus musculus
gcaggttgatgccttcattattgta

SEQ ID NO: 539001 - DNA, 25 bp, Mus musculus
gcaggttgatgcgttcattattgta

SEQ ID NO: 539002 - DNA, 25 bp, Mus musculus
gcaggttgcatcatttctgacacgc

SEQ ID NO: 539003 - DNA, 25 bp, Mus musculus
gcaggttgcatcttttctgacacgc

SEQ ID NO: 539004 - DNA, 25 bp, Mus musculus
gcaggttgctatcggtctttgttga

SEQ ID NO: 539005 - DNA, 25 bp, Mus musculus
gcaggttgctatgggtctttgttga

SEQ ID NO: 539006 - DNA, 25 bp, Mus musculus
gcaggttggaaacgcacaattggat

SEQ ID NO: 539007 - DNA, 25 bp, Mus musculus
gcaggttggaaaggcacaattggat

SEQ ID NO: 539008 - DNA, 25 bp, Mus musculus
gcaggttggctcaaatgctggaaac

SEQ ID NO: 539009 - DNA, 25 bp, Mus musculus
gcaggttggctctaatgctggaaac

SEQ ID NO: 539010 - DNA, 25 bp, Mus musculus
gcaggttgggtcatgttagcatttc

SEQ ID NO: 539011 - DNA, 25 bp, Mus musculus
gcaggttgggtcttgttagcatttc

SEQ ID NO: 539012 - DNA, 25 bp, Mus musculus
gcaggttggttcaacgctgagatcc

SEQ ID NO: 539013 - DNA, 25 bp, Mus musculus
gcaggttggttctacgctgagatcc

SEQ ID NO: 539014 - DNA, 25 bp, Mus musculus
gcaggttggtttaggcagttattca

SEQ ID NO: 539015 - DNA, 25 bp, Mus musculus
gcaggttggttttggcagttattca

SEQ ID NO: 539016 - DNA, 25 bp, Mus musculus
gcaggttgtaacaatctattcacaa

SEQ ID NO: 539017 - DNA, 25 bp, Mus musculus
gcaggttgtaactatctattcacaa

SEQ ID NO: 539018 - DNA, 25 bp, Mus musculus
gcaggttgtgacagagctccttcaa

SEQ ID NO: 539019 - DNA, 25 bp, Mus musculus
gcaggttgtgactgagctccttcaa

SEQ ID NO: 539020 - DNA, 25 bp, Mus musculus
gcaggttgttgcagggcctccaagt

SEQ ID NO: 539021 - DNA, 25 bp, Mus musculus
gcaggttgttgctgggcctccaagt

SEQ ID NO: 539022 - DNA, 25 bp, Mus musculus
gcaggttgtttaccatccgtgacta

SEQ ID NO: 539023 - DNA, 25 bp, Mus musculus
gcaggttgtttagcatccgtgacta

SEQ ID NO: 539024 - DNA, 25 bp, Mus musculus
gcaggtttaaaacttagggagctct

SEQ ID NO: 539025 - DNA, 25 bp, Mus musculus
gcaggtttaaaagttagggagctct

SEQ ID NO: 539026 - DNA, 25 bp, Mus musculus
gcaggtttaacactttcaaggtctt

SEQ ID NO: 539027 - DNA, 25 bp, Mus musculus
gcaggtttaacagtttcaaggtctt

SEQ ID NO: 539028 - DNA, 25 bp, Mus musculus
gcaggtttagcacttcaagcgcatg

SEQ ID NO: 539029 - DNA, 25 bp, Mus musculus
gcaggtttagcagttcaagcgcatg

SEQ ID NO: 539030 - DNA, 25 bp, Mus musculus
gcaggtttcactccatgattggtta

SEQ ID NO: 539031 - DNA, 25 bp, Mus musculus
gcaggtttcactgcatgattggtta

SEQ ID NO: 539032 - DNA, 25 bp, Mus musculus
gcaggtttccctctgtgttttaatt

SEQ ID NO: 539033 - DNA, 25 bp, Mus musculus
gcaggtttccctgtgtgttttaatt

SEQ ID NO: 539034 - DNA, 25 bp, Mus musculus
gcaggtttcctgaggacgttcacat

SEQ ID NO: 539035 - DNA, 25 bp, Mus musculus
gcaggtttcctgagtacccaatgga

SEQ ID NO: 539036 - DNA, 25 bp, Mus musculus
gcaggtttcctgtggacgttcacat

SEQ ID NO: 539037 - DNA, 25 bp, Mus musculus
gcaggtttcctgtgtacccaatgga

SEQ ID NO: 539038 - DNA, 25 bp, Mus musculus
gcaggtttccttatcatcttatcaa

SEQ ID NO: 539039 - DNA, 25 bp, Mus musculus
gcaggtttccttttcatcttatcaa

SEQ ID NO: 539040 - DNA, 25 bp, Mus musculus
gcaggtttcgcaagaggtttctatt

SEQ ID NO: 539041 - DNA, 25 bp, Mus musculus
gcaggtttcgcatgaggtttctatt

SEQ ID NO: 539042 - DNA, 25 bp, Mus musculus
gcaggtttctaactcatgtctcatg

SEQ ID NO: 539043 - DNA, 25 bp, Mus musculus
gcaggtttctaagtcatgtctcatg

SEQ ID NO: 539044 - DNA, 25 bp, Mus musculus
gcaggtttctccatgaagcaaacat

SEQ ID NO: 539045 - DNA, 25 bp, Mus musculus
gcaggtttctccttgaagcaaacat

SEQ ID NO: 539046 - DNA, 25 bp, Mus musculus
gcaggtttctgacgttgagcccaac

SEQ ID NO: 539047 - DNA, 25 bp, Mus musculus
gcaggtttctgaggttgagcccaac

SEQ ID NO: 539048 - DNA, 25 bp, Mus musculus
gcaggtttcttaagttgatccaaca

SEQ ID NO: 539049 - DNA, 25 bp, Mus musculus
gcaggtttcttatgttgatccaaca

SEQ ID NO: 539050 - DNA, 25 bp, Mus musculus
gcaggtttgaacatctttgcccttc

SEQ ID NO: 539051 - DNA, 25 bp, Mus musculus
gcaggtttgaacttctttgcccttc

SEQ ID NO: 539052 - DNA, 25 bp, Mus musculus
gcaggtttgacacagccggaattat

SEQ ID NO: 539053 - DNA, 25 bp, Mus musculus
gcaggtttgacagagccggaattat

SEQ ID NO: 539054 - DNA, 25 bp, Mus musculus
gcaggtttgaccattaggagttact

SEQ ID NO: 539055 - DNA, 25 bp, Mus musculus
gcaggtttgacctttaggagttact

SEQ ID NO: 539056 - DNA, 25 bp, Mus musculus
gcaggtttgaggctagcatcttaaa

SEQ ID NO: 539057 - DNA, 25 bp, Mus musculus
gcaggtttgagggtagcatcttaaa

SEQ ID NO: 539058 - DNA, 25 bp, Mus musculus
gcaggtttgcacactctgaagacgt

SEQ ID NO: 539059 - DNA, 25 bp, Mus musculus
gcaggtttgcactctctgaagacgt

SEQ ID NO: 539060 - DNA, 25 bp, Mus musculus
gcaggtttgcttaatgaatcacagg

SEQ ID NO: 539061 - DNA, 25 bp, Mus musculus
gcaggtttgctttatgaatcacagg

SEQ ID NO: 539062 - DNA, 25 bp, Mus musculus
gcaggtttggacactgtcccaggct

SEQ ID NO: 539063 - DNA, 25 bp, Mus musculus
gcaggtttggactctgtcccaggct

SEQ ID NO: 539064 - DNA, 25 bp, Mus musculus
gcaggtttggtcaaggctttcagaa

SEQ ID NO: 539065 - DNA, 25 bp, Mus musculus
gcaggtttggtctaggctttcagaa

SEQ ID NO: 539066 - DNA, 25 bp, Mus musculus
gcaggttttatacttcccagcgata

SEQ ID NO: 539067 - DNA, 25 bp, Mus musculus
gcaggttttatagttcccagcgata

SEQ ID NO: 539068 - DNA, 25 bp, Mus musculus
gcaggttttcccacatgtcagaaca

SEQ ID NO: 539069 - DNA, 25 bp, Mus musculus
gcaggttttccctcatgtcagaaca

SEQ ID NO: 539070 - DNA, 25 bp, Mus musculus
gcaggttttctgcagaacattaaca

SEQ ID NO: 539071 - DNA, 25 bp, Mus musculus
gcaggttttctggagaacattaaca

SEQ ID NO: 539072 - DNA, 25 bp, Mus musculus
gcaggttttcttctgttatccttta

SEQ ID NO: 539073 - DNA, 25 bp, Mus musculus
gcaggttttcttgtgttatccttta

SEQ ID NO: 539074 - DNA, 25 bp, Mus musculus
gcaggttttgcacttagaaatttct

SEQ ID NO: 539075 - DNA, 25 bp, Mus musculus
gcaggttttgcagttagaaatttct

SEQ ID NO: 539076 - DNA, 25 bp, Mus musculus
gcaggtttttctaggctatgtctaa

SEQ ID NO: 539077 - DNA, 25 bp, Mus musculus
gcaggtttttctatgtgggagccac

SEQ ID NO: 539078 - DNA, 25 bp, Mus musculus
gcaggtttttctcgttttagttcag

SEQ ID NO: 539079 - DNA, 25 bp, Mus musculus
gcaggtttttctggttttagttcag

SEQ ID NO: 539080 - DNA, 25 bp, Mus musculus
gcaggtttttcttggctatgtctaa

SEQ ID NO: 539081 - DNA, 25 bp, Mus musculus
gcaggtttttctttgtgggagccac

SEQ ID NO: 539082 - DNA, 25 bp, Mus musculus
gcagtaaaacccagttgcggccggc

SEQ ID NO: 539083 - DNA, 25 bp, Mus musculus
gcagtaaaaccctgttgcggccggc

SEQ ID NO: 539084 - DNA, 25 bp, Mus musculus
gcagtaaagaccctcatcttctgag

SEQ ID NO: 539085 - DNA, 25 bp, Mus musculus
gcagtaaagaccgtcatcttctgag

SEQ ID NO: 539086 - DNA, 25 bp, Mus musculus
gcagtaacagctaccacaactggta

SEQ ID NO: 539087 - DNA, 25 bp, Mus musculus
gcagtaacagcttccacaactggta

SEQ ID NO: 539088 - DNA, 25 bp, Mus musculus
gcagtaacagtaaccatgacctccc

SEQ ID NO: 539089 - DNA, 25 bp, Mus musculus
gcagtaacagtatccatgacctccc

SEQ ID NO: 539090 - DNA, 25 bp, Mus musculus
gcagtaacattgcagcgagctttta

SEQ ID NO: 539091 - DNA, 25 bp, Mus musculus
gcagtaacattggagcgagctttta

SEQ ID NO: 539092 - DNA, 25 bp, Mus musculus
gcagtaaccatcacctgttggaagt

SEQ ID NO: 539093 - DNA, 25 bp, Mus musculus
gcagtaaccatctcctgttggaagt

SEQ ID NO: 539094 - DNA, 25 bp, Mus musculus
gcagtaacccgaatcaccgaaaaag

SEQ ID NO: 539095 - DNA, 25 bp, Mus musculus
gcagtaacccgattcaccgaaaaag

SEQ ID NO: 539096 - DNA, 25 bp, Mus musculus
gcagtaaccgttaacagaagcaact

SEQ ID NO: 539097 - DNA, 25 bp, Mus musculus
gcagtaaccgtttacagaagcaact

SEQ ID NO: 539098 - DNA, 25 bp, Mus musculus
gcagtaactccaactatttacagaa

SEQ ID NO: 539099 - DNA, 25 bp, Mus musculus
gcagtaactccatctatttacagaa

SEQ ID NO: 539100 - DNA, 25 bp, Mus musculus
gcagtaactcttcctccaggagaac

SEQ ID NO: 539101 - DNA, 25 bp, Mus musculus
gcagtaactcttgctccaggagaac

SEQ ID NO: 539102 - DNA, 25 bp, Mus musculus
gcagtaactgcacacccaagattga

SEQ ID NO: 539103 - DNA, 25 bp, Mus musculus
gcagtaactgcagacccaagattga

SEQ ID NO: 539104 - DNA, 25 bp, Mus musculus
gcagtaactgcgagaaagctgttta

SEQ ID NO: 539105 - DNA, 25 bp, Mus musculus
gcagtaactgcgtgaaagctgttta

SEQ ID NO: 539106 - DNA, 25 bp, Mus musculus
gcagtaagaccaagccagtggcctc

SEQ ID NO: 539107 - DNA, 25 bp, Mus musculus
gcagtaagaccatgccagtggcctc

SEQ ID NO: 539108 - DNA, 25 bp, Mus musculus
gcagtaagcctcaaagatgacagtt

SEQ ID NO: 539109 - DNA, 25 bp, Mus musculus
gcagtaagcctctaagatgacagtt

SEQ ID NO: 539110 - DNA, 25 bp, Mus musculus
gcagtaagcctgcagtcggttattg

SEQ ID NO: 539111 - DNA, 25 bp, Mus musculus
gcagtaagcctgcttcggagtccat

SEQ ID NO: 539112 - DNA, 25 bp, Mus musculus
gcagtaagcctggagtcggttattg

SEQ ID NO: 539113 - DNA, 25 bp, Mus musculus
gcagtaagcctggttcggagtccat

SEQ ID NO: 539114 - DNA, 25 bp, Mus musculus
gcagtaaggactccagtctctttct

SEQ ID NO: 539115 - DNA, 25 bp, Mus musculus
gcagtaaggactgcagtctctttct

SEQ ID NO: 539116 - DNA, 25 bp, Mus musculus
gcagtaaggttcattaattgtccat

SEQ ID NO: 539117 - DNA, 25 bp, Mus musculus
gcagtaaggttctttaattgtccat

SEQ ID NO: 539118 - DNA, 25 bp, Mus musculus
gcagtaagtcacagctgctgctgct

SEQ ID NO: 539119 - DNA, 25 bp, Mus musculus
gcagtaagtcactgctgctgctgct

SEQ ID NO: 539120 - DNA, 25 bp, Mus musculus
gcagtaatagtacacgtcgccatga

SEQ ID NO: 539121 - DNA, 25 bp, Mus musculus
gcagtaatagtagacgtcgccatga

SEQ ID NO: 539122 - DNA, 25 bp, Mus musculus
gcagtaatccagacattcacaaaaa

SEQ ID NO: 539123 - DNA, 25 bp, Mus musculus
gcagtaatccagtcattcacaaaaa

SEQ ID NO: 539124 - DNA, 25 bp, Mus musculus
gcagtaatgccgacaatgtcttcct

SEQ ID NO: 539125 - DNA, 25 bp, Mus musculus
gcagtaatgccgtcaatgtcttcct

SEQ ID NO: 539126 - DNA, 25 bp, Mus musculus
gcagtaattcatctgtatacgtgtg

SEQ ID NO: 539127 - DNA, 25 bp, Mus musculus
gcagtaattcatgtgtatacgtgtg

SEQ ID NO: 539128 - DNA, 25 bp, Mus musculus
gcagtaattgttctccggctaagcc

SEQ ID NO: 539129 - DNA, 25 bp, Mus musculus
gcagtaattgttgtccggctaagcc

SEQ ID NO: 539130 - DNA, 25 bp, Mus musculus
gcagtaatttctaccctgcattgca

SEQ ID NO: 539131 - DNA, 25 bp, Mus musculus
gcagtaatttctacgctttgctggt

SEQ ID NO: 539132 - DNA, 25 bp, Mus musculus
gcagtaatttcttccctgcattgca

SEQ ID NO: 539133 - DNA, 25 bp, Mus musculus
gcagtaatttcttcgctttgctggt

SEQ ID NO: 539134 - DNA, 25 bp, Mus musculus
gcagtacaatgcctatcgctgtgag

SEQ ID NO: 539135 - DNA, 25 bp, Mus musculus
gcagtacaatgcgtatcgctgtgag

SEQ ID NO: 539136 - DNA, 25 bp, Mus musculus
gcagtacaccagagatgatggatcc

SEQ ID NO: 539137 - DNA, 25 bp, Mus musculus
gcagtacaccagtgatgatggatcc

SEQ ID NO: 539138 - DNA, 25 bp, Mus musculus
gcagtacactgtcctaatctccgta

SEQ ID NO: 539139 - DNA, 25 bp, Mus musculus
gcagtacactgtgctaatctccgta

SEQ ID NO: 539140 - DNA, 25 bp, Mus musculus
gcagtacagctcaggcacaggccac

SEQ ID NO: 539141 - DNA, 25 bp, Mus musculus
gcagtacagctctggcacaggccac

SEQ ID NO: 539142 - DNA, 25 bp, Mus musculus
gcagtacagttgatgctgaacattc

SEQ ID NO: 539143 - DNA, 25 bp, Mus musculus
gcagtacagttgttgctgaacattc

SEQ ID NO: 539144 - DNA, 25 bp, Mus musculus
gcagtacatggactcagcctatctg

SEQ ID NO: 539145 - DNA, 25 bp, Mus musculus
gcagtacatggagtcagcctatctg

SEQ ID NO: 539146 - DNA, 25 bp, Mus musculus
gcagtacattgcattaatgcccaca

SEQ ID NO: 539147 - DNA, 25 bp, Mus musculus
gcagtacattgctttaatgcccaca

SEQ ID NO: 539148 - DNA, 25 bp, Mus musculus
gcagtacatttcacccatgggcaat

SEQ ID NO: 539149 - DNA, 25 bp, Mus musculus
gcagtacatttctcccatgggcaat

SEQ ID NO: 539150 - DNA, 25 bp, Mus musculus
gcagtaccaagtccgaaggtgccaa

SEQ ID NO: 539151 - DNA, 25 bp, Mus musculus
gcagtaccaagtgcgaaggtgccaa

SEQ ID NO: 539152 - DNA, 25 bp, Mus musculus
gcagtaccagaaatagccgcttttt

SEQ ID NO: 539153 - DNA, 25 bp, Mus musculus
gcagtaccagaattagccgcttttt

SEQ ID NO: 539154 - DNA, 25 bp, Mus musculus
gcagtaccaggtcccatgacaaacc

SEQ ID NO: 539155 - DNA, 25 bp, Mus musculus
gcagtaccaggtgccatgacaaacc

SEQ ID NO: 539156 - DNA, 25 bp, Mus musculus
gcagtaccatgcaggtctagcgtct

SEQ ID NO: 539157 - DNA, 25 bp, Mus musculus
gcagtaccatgctggtctagcgtct

SEQ ID NO: 539158 - DNA, 25 bp, Mus musculus
gcagtacccggaagactcggatgat

SEQ ID NO: 539159 - DNA, 25 bp, Mus musculus
gcagtacccggatgactcggatgat

SEQ ID NO: 539160 - DNA, 25 bp, Mus musculus
gcagtaccgcagctactttatggag

SEQ ID NO: 539161 - DNA, 25 bp, Mus musculus
gcagtaccgcaggtactttatggag

SEQ ID NO: 539162 - DNA, 25 bp, Mus musculus
gcagtaccgctaagatgcacatctg

SEQ ID NO: 539163 - DNA, 25 bp, Mus musculus
gcagtaccgctatgatgcacatctg

SEQ ID NO: 539164 - DNA, 25 bp, Mus musculus
gcagtacctaggacaagcttatttt

SEQ ID NO: 539165 - DNA, 25 bp, Mus musculus
gcagtacctaggtcaagcttatttt

SEQ ID NO: 539166 - DNA, 25 bp, Mus musculus
gcagtactaccaccgcttcgatagg

SEQ ID NO: 539167 - DNA, 25 bp, Mus musculus
gcagtactaccagcgcttcgatagg

SEQ ID NO: 539168 - DNA, 25 bp, Mus musculus
gcagtactcacaaattttgggcata

SEQ ID NO: 539169 - DNA, 25 bp, Mus musculus
gcagtactcacatattttgggcata

SEQ ID NO: 539170 - DNA, 25 bp, Mus musculus
gcagtactgcccatagtgtgagatt

SEQ ID NO: 539171 - DNA, 25 bp, Mus musculus
gcagtactgcccttagtgtgagatt

SEQ ID NO: 539172 - DNA, 25 bp, Mus musculus
gcagtactggccctggactgtacaa

SEQ ID NO: 539173 - DNA, 25 bp, Mus musculus
gcagtactggccgtggactgtacaa

SEQ ID NO: 539174 - DNA, 25 bp, Mus musculus
gcagtactggtgatcatagttagcg

SEQ ID NO: 539175 - DNA, 25 bp, Mus musculus
gcagtactggtgttcatagttagcg

SEQ ID NO: 539176 - DNA, 25 bp, Mus musculus
gcagtactgtttatccttcccggag

SEQ ID NO: 539177 - DNA, 25 bp, Mus musculus
gcagtactgtttttccttcccggag

SEQ ID NO: 539178 - DNA, 25 bp, Mus musculus
gcagtacttaagagtgttgcattta

SEQ ID NO: 539179 - DNA, 25 bp, Mus musculus
gcagtacttaagtgtgttgcattta

SEQ ID NO: 539180 - DNA, 25 bp, Mus musculus
gcagtacttattaaccaacggaagt

SEQ ID NO: 539181 - DNA, 25 bp, Mus musculus
gcagtacttatttaccaacggaagt

SEQ ID NO: 539182 - DNA, 25 bp, Mus musculus
gcagtacttgggatcagggctacta

SEQ ID NO: 539183 - DNA, 25 bp, Mus musculus
gcagtacttgggttcagggctacta

SEQ ID NO: 539184 - DNA, 25 bp, Mus musculus
gcagtagacaccacacacaaatggg

SEQ ID NO: 539185 - DNA, 25 bp, Mus musculus
gcagtagacacctcacacaaatggg

SEQ ID NO: 539186 - DNA, 25 bp, Mus musculus
gcagtagagaccctttttcgtgtat

SEQ ID NO: 539187 - DNA, 25 bp, Mus musculus
gcagtagagaccgtttttcgtgtat

SEQ ID NO: 539188 - DNA, 25 bp, Mus musculus
gcagtagagcggcttaaagacctgt

SEQ ID NO: 539189 - DNA, 25 bp, Mus musculus
gcagtagagcgggttaaagacctgt

SEQ ID NO: 539190 - DNA, 25 bp, Mus musculus
gcagtagagggtccttgctgctctt

SEQ ID NO: 539191 - DNA, 25 bp, Mus musculus
gcagtagagggtgcttgctgctctt

SEQ ID NO: 539192 - DNA, 25 bp, Mus musculus
gcagtagattttaactgatctcaga

SEQ ID NO: 539193 - DNA, 25 bp, Mus musculus
gcagtagattttcgtggtgttgatt

SEQ ID NO: 539194 - DNA, 25 bp, Mus musculus
gcagtagattttggtggtgttgatt

SEQ ID NO: 539195 - DNA, 25 bp, Mus musculus
gcagtagatttttactgatctcaga

SEQ ID NO: 539196 - DNA, 25 bp, Mus musculus
gcagtagcatcccatttgtaccaaa

SEQ ID NO: 539197 - DNA, 25 bp, Mus musculus
gcagtagcatccgatttgtaccaaa

SEQ ID NO: 539198 - DNA, 25 bp, Mus musculus
gcagtagcctcccaagtcatgggat

SEQ ID NO: 539199 - DNA, 25 bp, Mus musculus
gcagtagcctccgaagtcatgggat

SEQ ID NO: 539200 - DNA, 25 bp, Mus musculus
gcagtagctagaacaagctctattt

SEQ ID NO: 539201 - DNA, 25 bp, Mus musculus
gcagtagctagatcaagctctattt

SEQ ID NO: 539202 - DNA, 25 bp, Mus musculus
gcagtagctagtctggttgctttat

SEQ ID NO: 539203 - DNA, 25 bp, Mus musculus
gcagtagctagtgtggttgctttat

SEQ ID NO: 539204 - DNA, 25 bp, Mus musculus
gcagtagctatcctggtcatctaga

SEQ ID NO: 539205 - DNA, 25 bp, Mus musculus
gcagtagctatcgtggtcatctaga

SEQ ID NO: 539206 - DNA, 25 bp, Mus musculus
gcagtagctgatacatccttgcctt

SEQ ID NO: 539207 - DNA, 25 bp, Mus musculus
gcagtagctgattcatccttgcctt

SEQ ID NO: 539208 - DNA, 25 bp, Mus musculus
gcagtagctgccagatgatgctaac

SEQ ID NO: 539209 - DNA, 25 bp, Mus musculus
gcagtagctgccatgtctaaagata

SEQ ID NO: 539210 - DNA, 25 bp, Mus musculus
gcagtagctgcctgatgatgctaac

SEQ ID NO: 539211 - DNA, 25 bp, Mus musculus
gcagtagctgccttgtctaaagata

SEQ ID NO: 539212 - DNA, 25 bp, Mus musculus
gcagtagctgtactgtgctaccaca

SEQ ID NO: 539213 - DNA, 25 bp, Mus musculus
gcagtagctgtagtgtgctaccaca

SEQ ID NO: 539214 - DNA, 25 bp, Mus musculus
gcagtagcttgcagacagtgagaca

SEQ ID NO: 539215 - DNA, 25 bp, Mus musculus
gcagtagcttgctgacagtgagaca

SEQ ID NO: 539216 - DNA, 25 bp, Mus musculus
gcagtagctttcagtgcggtgttaa

SEQ ID NO: 539217 - DNA, 25 bp, Mus musculus
gcagtagctttcccagcttcagttc

SEQ ID NO: 539218 - DNA, 25 bp, Mus musculus
gcagtagctttcgcagcttcagttc

SEQ ID NO: 539219 - DNA, 25 bp, Mus musculus
gcagtagctttctgtgcggtgttaa

SEQ ID NO: 539220 - DNA, 25 bp, Mus musculus
gcagtaggactgacagtgtgtcttt

SEQ ID NO: 539221 - DNA, 25 bp, Mus musculus
gcagtaggactgtcagtgtgtcttt

SEQ ID NO: 539222 - DNA, 25 bp, Mus musculus
gcagtaggcgaaagcaaccttcctt

SEQ ID NO: 539223 - DNA, 25 bp, Mus musculus
gcagtaggcgaatgcaaccttcctt

SEQ ID NO: 539224 - DNA, 25 bp, Mus musculus
gcagtaggtggcatccccagtgact

SEQ ID NO: 539225 - DNA, 25 bp, Mus musculus
gcagtaggtggcttccccagtgact

SEQ ID NO: 539226 - DNA, 25 bp, Mus musculus
gcagtagtaaaaagtctccgagaag

SEQ ID NO: 539227 - DNA, 25 bp, Mus musculus
gcagtagtaaaatgtctccgagaag

SEQ ID NO: 539228 - DNA, 25 bp, Mus musculus
gcagtagtatacattctcgtcttag

SEQ ID NO: 539229 - DNA, 25 bp, Mus musculus
gcagtagtatactttctcgtcttag

SEQ ID NO: 539230 - DNA, 25 bp, Mus musculus
gcagtagtattacccgccgtggaga

SEQ ID NO: 539231 - DNA, 25 bp, Mus musculus
gcagtagtattagccgccgtggaga

SEQ ID NO: 539232 - DNA, 25 bp, Mus musculus
gcagtagtcccaatatggcgcctgg

SEQ ID NO: 539233 - DNA, 25 bp, Mus musculus
gcagtagtcccattatggcgcctgg

SEQ ID NO: 539234 - DNA, 25 bp, Mus musculus
gcagtagtcggcaaatgtttccatg

SEQ ID NO: 539235 - DNA, 25 bp, Mus musculus
gcagtagtcggctaatgtttccatg

SEQ ID NO: 539236 - DNA, 25 bp, Mus musculus
gcagtagtgaccaaggacagtgctt

SEQ ID NO: 539237 - DNA, 25 bp, Mus musculus
gcagtagtgacctaggacagtgctt

SEQ ID NO: 539238 - DNA, 25 bp, Mus musculus
gcagtagtgcccactcaagattaga

SEQ ID NO: 539239 - DNA, 25 bp, Mus musculus
gcagtagtgccctctcaagattaga

SEQ ID NO: 539240 - DNA, 25 bp, Mus musculus
gcagtagtgctgacaatccaagaag

SEQ ID NO: 539241 - DNA, 25 bp, Mus musculus
gcagtagtgctgtcaatccaagaag

SEQ ID NO: 539242 - DNA, 25 bp, Mus musculus
gcagtagttaaaagctcttccaaaa

SEQ ID NO: 539243 - DNA, 25 bp, Mus musculus
gcagtagttaaatgctcttccaaaa

SEQ ID NO: 539244 - DNA, 25 bp, Mus musculus
gcagtagttatgcactctgagctcc

SEQ ID NO: 539245 - DNA, 25 bp, Mus musculus
gcagtagttatggactctgagctcc

SEQ ID NO: 539246 - DNA, 25 bp, Mus musculus
gcagtagtttcactctcctgcctca

SEQ ID NO: 539247 - DNA, 25 bp, Mus musculus
gcagtagtttcagtctcctgcctca

SEQ ID NO: 539248 - DNA, 25 bp, Mus musculus
gcagtagtttctaagggccaaggtt

SEQ ID NO: 539249 - DNA, 25 bp, Mus musculus
gcagtagtttcttagggccaaggtt

SEQ ID NO: 539250 - DNA, 25 bp, Mus musculus
gcagtataacatattttgagcaaca

SEQ ID NO: 539251 - DNA, 25 bp, Mus musculus
gcagtataacattttttgagcaaca

SEQ ID NO: 539252 - DNA, 25 bp, Mus musculus
gcagtataaccaagtccccagtgaa

SEQ ID NO: 539253 - DNA, 25 bp, Mus musculus
gcagtataaccatgtccccagtgaa

SEQ ID NO: 539254 - DNA, 25 bp, Mus musculus
gcagtataaccccaagatgcggccc

SEQ ID NO: 539255 - DNA, 25 bp, Mus musculus
gcagtataacccgaagatgcggccc

SEQ ID NO: 539256 - DNA, 25 bp, Mus musculus
gcagtataagttattcctacatagt

SEQ ID NO: 539257 - DNA, 25 bp, Mus musculus
gcagtataagtttttcctacatagt

SEQ ID NO: 539258 - DNA, 25 bp, Mus musculus
gcagtatccagtagaaaagtcctct

SEQ ID NO: 539259 - DNA, 25 bp, Mus musculus
gcagtatccagttgaaaagtcctct

SEQ ID NO: 539260 - DNA, 25 bp, Mus musculus
gcagtatccttactccagagcatcc

SEQ ID NO: 539261 - DNA, 25 bp, Mus musculus
gcagtatccttagtccagagcatcc

SEQ ID NO: 539262 - DNA, 25 bp, Mus musculus
gcagtatcgctgaagttatcatgtt

SEQ ID NO: 539263 - DNA, 25 bp, Mus musculus
gcagtatcgctgtagttatcatgtt

SEQ ID NO: 539264 - DNA, 25 bp, Mus musculus
gcagtatctcaacctcatcaattac

SEQ ID NO: 539265 - DNA, 25 bp, Mus musculus
gcagtatctcaagctcatcaattac

SEQ ID NO: 539266 - DNA, 25 bp, Mus musculus
gcagtatctcctaacttcagtgcac

SEQ ID NO: 539267 - DNA, 25 bp, Mus musculus
gcagtatctccttacttcagtgcac

SEQ ID NO: 539268 - DNA, 25 bp, Mus musculus
gcagtatctcttcttagggctctat

SEQ ID NO: 539269 - DNA, 25 bp, Mus musculus
gcagtatctcttgttagggctctat

SEQ ID NO: 539270 - DNA, 25 bp, Mus musculus
gcagtatctgcaactctgcaggcaa

SEQ ID NO: 539271 - DNA, 25 bp, Mus musculus
gcagtatctgcatctctgcaggcaa

SEQ ID NO: 539272 - DNA, 25 bp, Mus musculus
gcagtatctgttcggcggccagcac

SEQ ID NO: 539273 - DNA, 25 bp, Mus musculus
gcagtatctgttgggcggccagcac

SEQ ID NO: 539274 - DNA, 25 bp, Mus musculus
gcagtatgacaaactgtggaagcgg

SEQ ID NO: 539275 - DNA, 25 bp, Mus musculus
gcagtatgacaatctgtggaagcgg

SEQ ID NO: 539276 - DNA, 25 bp, Mus musculus
gcagtatgactcacgtggcaggttt

SEQ ID NO: 539277 - DNA, 25 bp, Mus musculus
gcagtatgactctcgtggcaggttt

SEQ ID NO: 539278 - DNA, 25 bp, Mus musculus
gcagtatgactgagggatcgtgttt

SEQ ID NO: 539279 - DNA, 25 bp, Mus musculus
gcagtatgactgtgggatcgtgttt

SEQ ID NO: 539280 - DNA, 25 bp, Mus musculus
gcagtatgaggaattgctgtttata

SEQ ID NO: 539281 - DNA, 25 bp, Mus musculus
gcagtatgaggatttgctgtttata

SEQ ID NO: 539282 - DNA, 25 bp, Mus musculus
gcagtatgatgaatgcaggcgtgca

SEQ ID NO: 539283 - DNA, 25 bp, Mus musculus
gcagtatgatgattgcaggcgtgca

SEQ ID NO: 539284 - DNA, 25 bp, Mus musculus
gcagtatgcacaatccagatcacag

SEQ ID NO: 539285 - DNA, 25 bp, Mus musculus
gcagtatgcacattccagatcacag

SEQ ID NO: 539286 - DNA, 25 bp, Mus musculus
gcagtatgccgacaggtgagtccca

SEQ ID NO: 539287 - DNA, 25 bp, Mus musculus
gcagtatgccgagaggtgagtccca

SEQ ID NO: 539288 - DNA, 25 bp, Mus musculus
gcagtatgcttgaccaattcagtca

SEQ ID NO: 539289 - DNA, 25 bp, Mus musculus
gcagtatgcttgtccaattcagtca

SEQ ID NO: 539290 - DNA, 25 bp, Mus musculus
gcagtatggtagcttgcaaccctca

SEQ ID NO: 539291 - DNA, 25 bp, Mus musculus
gcagtatggtaggttgcaaccctca

SEQ ID NO: 539292 - DNA, 25 bp, Mus musculus
gcagtatgttttaaagaggccagtg

SEQ ID NO: 539293 - DNA, 25 bp, Mus musculus
gcagtatgtttttaagaggccagtg

SEQ ID NO: 539294 - DNA, 25 bp, Mus musculus
gcagtattaagtcccttttcctctc

SEQ ID NO: 539295 - DNA, 25 bp, Mus musculus
gcagtattaagtgccttttcctctc

SEQ ID NO: 539296 - DNA, 25 bp, Mus musculus
gcagtattacgtccagaagtgcccc

SEQ ID NO: 539297 - DNA, 25 bp, Mus musculus
gcagtattacgtgcagaagtgcccc

SEQ ID NO: 539298 - DNA, 25 bp, Mus musculus
gcagtattatcaatgcagttgtaaa

SEQ ID NO: 539299 - DNA, 25 bp, Mus musculus
gcagtattatcattgcagttgtaaa

SEQ ID NO: 539300 - DNA, 25 bp, Mus musculus
gcagtattattgcagtagactttgt

SEQ ID NO: 539301 - DNA, 25 bp, Mus musculus
gcagtattattggagtagactttgt

SEQ ID NO: 539302 - DNA, 25 bp, Mus musculus
gcagtattcctgagggttgcacacc

SEQ ID NO: 539303 - DNA, 25 bp, Mus musculus
gcagtattcctgtgggttgcacacc

SEQ ID NO: 539304 - DNA, 25 bp, Mus musculus
gcagtattctgtactttcgcatagt

SEQ ID NO: 539305 - DNA, 25 bp, Mus musculus
gcagtattctgttctttcgcatagt

SEQ ID NO: 539306 - DNA, 25 bp, Mus musculus
gcagtattgatgagcctggcgctgt

SEQ ID NO: 539307 - DNA, 25 bp, Mus musculus
gcagtattgatgtgcctggcgctgt

SEQ ID NO: 539308 - DNA, 25 bp, Mus musculus
gcagtattgtacagatgggctcatg

SEQ ID NO: 539309 - DNA, 25 bp, Mus musculus
gcagtattgtactgatgggctcatg

SEQ ID NO: 539310 - DNA, 25 bp, Mus musculus
gcagtattgtgcaaagtcttgggca

SEQ ID NO: 539311 - DNA, 25 bp, Mus musculus
gcagtattgtgctaagtcttgggca

SEQ ID NO: 539312 - DNA, 25 bp, Mus musculus
gcagtatttccaatgtcgcagtaat

SEQ ID NO: 539313 - DNA, 25 bp, Mus musculus
gcagtatttccattgtcgcagtaat

SEQ ID NO: 539314 - DNA, 25 bp, Mus musculus
gcagtatttctcatgatgtctttta

SEQ ID NO: 539315 - DNA, 25 bp, Mus musculus
gcagtatttctcttgatgtctttta

SEQ ID NO: 539316 - DNA, 25 bp, Mus musculus
gcagtatttggcactagctggtaca

SEQ ID NO: 539317 - DNA, 25 bp, Mus musculus
gcagtatttggctctagctggtaca

SEQ ID NO: 539318 - DNA, 25 bp, Mus musculus
gcagtatttgtacggctgcatgccc

SEQ ID NO: 539319 - DNA, 25 bp, Mus musculus
gcagtatttgtagggctgcatgccc

SEQ ID NO: 539320 - DNA, 25 bp, Mus musculus
gcagtattttcactagctcagcatt

SEQ ID NO: 539321 - DNA, 25 bp, Mus musculus
gcagtattttcagtagctcagcatt

SEQ ID NO: 539322 - DNA, 25 bp, Mus musculus
gcagtcaaagcaccgccagaatttt

SEQ ID NO: 539323 - DNA, 25 bp, Mus musculus
gcagtcaaagcagcgccagaatttt

SEQ ID NO: 539324 - DNA, 25 bp, Mus musculus
gcagtcaaatatacgtggcaaacat

SEQ ID NO: 539325 - DNA, 25 bp, Mus musculus
gcagtcaaatattcgtggcaaacat

SEQ ID NO: 539326 - DNA, 25 bp, Mus musculus
gcagtcaaattccaaagcccatgtt

SEQ ID NO: 539327 - DNA, 25 bp, Mus musculus
gcagtcaaattcgaaagcccatgtt

SEQ ID NO: 539328 - DNA, 25 bp, Mus musculus
gcagtcaactttccaaggcacggtg

SEQ ID NO: 539329 - DNA, 25 bp, Mus musculus
gcagtcaactttgcaaggcacggtg

SEQ ID NO: 539330 - DNA, 25 bp, Mus musculus
gcagtcaaggctcttaagtgttcag

SEQ ID NO: 539331 - DNA, 25 bp, Mus musculus
gcagtcaaggctgttaagtgttcag

SEQ ID NO: 539332 - DNA, 25 bp, Mus musculus
gcagtcaatagcagagactctcttt

SEQ ID NO: 539333 - DNA, 25 bp, Mus musculus
gcagtcaatagctgagactctcttt

SEQ ID NO: 539334 - DNA, 25 bp, Mus musculus
gcagtcaattacctcctcagtagga

SEQ ID NO: 539335 - DNA, 25 bp, Mus musculus
gcagtcaattacgtcctcagtagga

SEQ ID NO: 539336 - DNA, 25 bp, Mus musculus
gcagtcacacagctagttggtggct

SEQ ID NO: 539337 - DNA, 25 bp, Mus musculus
gcagtcacacaggtagttggtggct

SEQ ID NO: 539338 - DNA, 25 bp, Mus musculus
gcagtcacacctcggcttacaagta

SEQ ID NO: 539339 - DNA, 25 bp, Mus musculus
gcagtcacacctgggcttacaagta

SEQ ID NO: 539340 - DNA, 25 bp, Mus musculus
gcagtcacaggtctctcttggagaa

SEQ ID NO: 539341 - DNA, 25 bp, Mus musculus
gcagtcacaggtgtctcttggagaa

SEQ ID NO: 539342 - DNA, 25 bp, Mus musculus
gcagtcacattcacatccaggttct

SEQ ID NO: 539343 - DNA, 25 bp, Mus musculus
gcagtcacattctcatccaggttct

SEQ ID NO: 539344 - DNA, 25 bp, Mus musculus
gcagtcaccaacaatgattaatcag

SEQ ID NO: 539345 - DNA, 25 bp, Mus musculus
gcagtcaccaactatgattaatcag

SEQ ID NO: 539346 - DNA, 25 bp, Mus musculus
gcagtcaccataccaataaagtgaa

SEQ ID NO: 539347 - DNA, 25 bp, Mus musculus
gcagtcaccatagcaataaagtgaa

SEQ ID NO: 539348 - DNA, 25 bp, Mus musculus
gcagtcacccggagttcctttaata

SEQ ID NO: 539349 - DNA, 25 bp, Mus musculus
gcagtcacccggtgttcctttaata

SEQ ID NO: 539350 - DNA, 25 bp, Mus musculus
gcagtcaccctgaagaaccgcaaag

SEQ ID NO: 539351 - DNA, 25 bp, Mus musculus
gcagtcaccctgtagaaccgcaaag

SEQ ID NO: 539352 - DNA, 25 bp, Mus musculus
gcagtcacgaccaccatactctgtg

SEQ ID NO: 539353 - DNA, 25 bp, Mus musculus
gcagtcacgacctccatactctgtg

SEQ ID NO: 539354 - DNA, 25 bp, Mus musculus
gcagtcacggacatggatcatttaa

SEQ ID NO: 539355 - DNA, 25 bp, Mus musculus
gcagtcacggacttggatcatttaa

SEQ ID NO: 539356 - DNA, 25 bp, Mus musculus
gcagtcacggcgatttcaatatcca

SEQ ID NO: 539357 - DNA, 25 bp, Mus musculus
gcagtcacggcgttttcaatatcca

SEQ ID NO: 539358 - DNA, 25 bp, Mus musculus
gcagtcactaggagaaaccttgatt

SEQ ID NO: 539359 - DNA, 25 bp, Mus musculus
gcagtcactaggtgaaaccttgatt

SEQ ID NO: 539360 - DNA, 25 bp, Mus musculus
gcagtcactgagaatgataggcttt

SEQ ID NO: 539361 - DNA, 25 bp, Mus musculus
gcagtcactgagtatgataggcttt

SEQ ID NO: 539362 - DNA, 25 bp, Mus musculus
gcagtcactgctcgcacagtgcgaa

SEQ ID NO: 539363 - DNA, 25 bp, Mus musculus
gcagtcactgctggcacagtgcgaa

SEQ ID NO: 539364 - DNA, 25 bp, Mus musculus
gcagtcactgggatttgaatttcac

SEQ ID NO: 539365 - DNA, 25 bp, Mus musculus
gcagtcactgggttttgaatttcac

SEQ ID NO: 539366 - DNA, 25 bp, Mus musculus
gcagtcactggtaatgttgattcat

SEQ ID NO: 539367 - DNA, 25 bp, Mus musculus
gcagtcactggtatgaagacctttc

SEQ ID NO: 539368 - DNA, 25 bp, Mus musculus
gcagtcactggttatgttgattcat

SEQ ID NO: 539369 - DNA, 25 bp, Mus musculus
gcagtcactggtttgaagacctttc

SEQ ID NO: 539370 - DNA, 25 bp, Mus musculus
gcagtcacttgaatttatggtacct

SEQ ID NO: 539371 - DNA, 25 bp, Mus musculus
gcagtcacttgattttatggtacct

SEQ ID NO: 539372 - DNA, 25 bp, Mus musculus
gcagtcacttggacatttctaggca

SEQ ID NO: 539373 - DNA, 25 bp, Mus musculus
gcagtcacttggtcatttctaggca

SEQ ID NO: 539374 - DNA, 25 bp, Mus musculus
gcagtcacttgtagtatccaaagat

SEQ ID NO: 539375 - DNA, 25 bp, Mus musculus
gcagtcacttgttgtatccaaagat

SEQ ID NO: 539376 - DNA, 25 bp, Mus musculus
gcagtcagactcagagcccaagttt

SEQ ID NO: 539377 - DNA, 25 bp, Mus musculus
gcagtcagactctgagcccaagttt

SEQ ID NO: 539378 - DNA, 25 bp, Mus musculus
gcagtcagatttcctgttgatgcag

SEQ ID NO: 539379 - DNA, 25 bp, Mus musculus
gcagtcagatttgctgttgatgcag

SEQ ID NO: 539380 - DNA, 25 bp, Mus musculus
gcagtcagccataccaacttttatt

SEQ ID NO: 539381 - DNA, 25 bp, Mus musculus
gcagtcagccattccaacttttatt

SEQ ID NO: 539382 - DNA, 25 bp, Mus musculus
gcagtcagcctgcagtgtgtatgat

SEQ ID NO: 539383 - DNA, 25 bp, Mus musculus
gcagtcagcctggagtgtgtatgat

SEQ ID NO: 539384 - DNA, 25 bp, Mus musculus
gcagtcagcggacatcaccattccg

SEQ ID NO: 539385 - DNA, 25 bp, Mus musculus
gcagtcagcggagatcaccattccg

SEQ ID NO: 539386 - DNA, 25 bp, Mus musculus
gcagtcaggttaagatcagcatcaa

SEQ ID NO: 539387 - DNA, 25 bp, Mus musculus
gcagtcaggttatgatcagcatcaa

SEQ ID NO: 539388 - DNA, 25 bp, Mus musculus
gcagtcagtctaattgtggatccag

SEQ ID NO: 539389 - DNA, 25 bp, Mus musculus
gcagtcagtctatttgtggatccag

SEQ ID NO: 539390 - DNA, 25 bp, Mus musculus
gcagtcagttacaccccacgttgaa

SEQ ID NO: 539391 - DNA, 25 bp, Mus musculus
gcagtcagttactccccacgttgaa

SEQ ID NO: 539392 - DNA, 25 bp, Mus musculus
gcagtcagttctattgtgaattcca

SEQ ID NO: 539393 - DNA, 25 bp, Mus musculus
gcagtcagttcttttgtgaattcca

SEQ ID NO: 539394 - DNA, 25 bp, Mus musculus
gcagtcataagaattggcaagtcat

SEQ ID NO: 539395 - DNA, 25 bp, Mus musculus
gcagtcataagatttggcaagtcat

SEQ ID NO: 539396 - DNA, 25 bp, Mus musculus
gcagtcatattaaccagccttggtt

SEQ ID NO: 539397 - DNA, 25 bp, Mus musculus
gcagtcatattatccagccttggtt

SEQ ID NO: 539398 - DNA, 25 bp, Mus musculus
gcagtcatcagaatggttcaccctt

SEQ ID NO: 539399 - DNA, 25 bp, Mus musculus
gcagtcatcagattggttcaccctt

SEQ ID NO: 539400 - DNA, 25 bp, Mus musculus
gcagtcatctgcattcgagggctca

SEQ ID NO: 539401 - DNA, 25 bp, Mus musculus
gcagtcatctgcattggcctggtca

SEQ ID NO: 539402 - DNA, 25 bp, Mus musculus
gcagtcatctgctttcgagggctca

SEQ ID NO: 539403 - DNA, 25 bp, Mus musculus
gcagtcatctgctttggcctggtca

SEQ ID NO: 539404 - DNA, 25 bp, Mus musculus
gcagtcatcttcaggcaaaggatga

SEQ ID NO: 539405 - DNA, 25 bp, Mus musculus
gcagtcatcttctggcaaaggatga

SEQ ID NO: 539406 - DNA, 25 bp, Mus musculus
gcagtcatcttgcagacagggctga

SEQ ID NO: 539407 - DNA, 25 bp, Mus musculus
gcagtcatcttggagacagggctga

SEQ ID NO: 539408 - DNA, 25 bp, Mus musculus
gcagtcatgcggagggcgttcttca

SEQ ID NO: 539409 - DNA, 25 bp, Mus musculus
gcagtcatgcggtgggcgttcttca

SEQ ID NO: 539410 - DNA, 25 bp, Mus musculus
gcagtcatggacaccctggctgaag

SEQ ID NO: 539411 - DNA, 25 bp, Mus musculus
gcagtcatggactccctggctgaag

SEQ ID NO: 539412 - DNA, 25 bp, Mus musculus
gcagtcatggccctctggcatgttt

SEQ ID NO: 539413 - DNA, 25 bp, Mus musculus
gcagtcatggccgtctggcatgttt

SEQ ID NO: 539414 - DNA, 25 bp, Mus musculus
gcagtcatgggtctctttctagcgc

SEQ ID NO: 539415 - DNA, 25 bp, Mus musculus
gcagtcatgggtgtctttctagcgc

SEQ ID NO: 539416 - DNA, 25 bp, Mus musculus
gcagtcattcaaaatggtagaacta

SEQ ID NO: 539417 - DNA, 25 bp, Mus musculus
gcagtcattcaatatggtagaacta

SEQ ID NO: 539418 - DNA, 25 bp, Mus musculus
gcagtcattctaattgatcagggtt

SEQ ID NO: 539419 - DNA, 25 bp, Mus musculus
gcagtcattctatttgatcagggtt

SEQ ID NO: 539420 - DNA, 25 bp, Mus musculus
gcagtcattgtgaataacttgagag

SEQ ID NO: 539421 - DNA, 25 bp, Mus musculus
gcagtcattgtgtataacttgagag

SEQ ID NO: 539422 - DNA, 25 bp, Mus musculus
gcagtcatttatacacctactttaa

SEQ ID NO: 539423 - DNA, 25 bp, Mus musculus
gcagtcatttattcacctactttaa

SEQ ID NO: 539424 - DNA, 25 bp, Mus musculus
gcagtcattttaattaagcggtcat

SEQ ID NO: 539425 - DNA, 25 bp, Mus musculus
gcagtcattttatttaagcggtcat

SEQ ID NO: 539426 - DNA, 25 bp, Mus musculus
gcagtcatttttctaccacagtcat

SEQ ID NO: 539427 - DNA, 25 bp, Mus musculus
gcagtcatttttgtaccacagtcat

SEQ ID NO: 539428 - DNA, 25 bp, Mus musculus
gcagtccacctgattgtaacttttt

SEQ ID NO: 539429 - DNA, 25 bp, Mus musculus
gcagtccacctgtttgtaacttttt

SEQ ID NO: 539430 - DNA, 25 bp, Mus musculus
gcagtccactgaatcataaagctgt

SEQ ID NO: 539431 - DNA, 25 bp, Mus musculus
gcagtccactgattcataaagctgt

SEQ ID NO: 539432 - DNA, 25 bp, Mus musculus
gcagtccagagacagcccaaaggct

SEQ ID NO: 539433 - DNA, 25 bp, Mus musculus
gcagtccagagagagcccaaaggct

SEQ ID NO: 539434 - DNA, 25 bp, Mus musculus
gcagtccagcgtagatgcctgtgac

SEQ ID NO: 539435 - DNA, 25 bp, Mus musculus
gcagtccagcgttgatgcctgtgac

SEQ ID NO: 539436 - DNA, 25 bp, Mus musculus
gcagtccagctcaatacagcataca

SEQ ID NO: 539437 - DNA, 25 bp, Mus musculus
gcagtccagctctatacagcataca

SEQ ID NO: 539438 - DNA, 25 bp, Mus musculus
gcagtccaggagagatccttcagtt

SEQ ID NO: 539439 - DNA, 25 bp, Mus musculus
gcagtccaggagtgatccttcagtt

SEQ ID NO: 539440 - DNA, 25 bp, Mus musculus
gcagtccaggtccacaaagccagag

SEQ ID NO: 539441 - DNA, 25 bp, Mus musculus
gcagtccaggtcgacaaagccagag

SEQ ID NO: 539442 - DNA, 25 bp, Mus musculus
gcagtccagtccataagacctgtgt

SEQ ID NO: 539443 - DNA, 25 bp, Mus musculus
gcagtccagtccttaagacctgtgt

SEQ ID NO: 539444 - DNA, 25 bp, Mus musculus
gcagtccattgtctatgaggcaaac

SEQ ID NO: 539445 - DNA, 25 bp, Mus musculus
gcagtccattgtgtatgaggcaaac

SEQ ID NO: 539446 - DNA, 25 bp, Mus musculus
gcagtcccacagcttgaaggtgaca

SEQ ID NO: 539447 - DNA, 25 bp, Mus musculus
gcagtcccacaggttgaaggtgaca

SEQ ID NO: 539448 - DNA, 25 bp, Mus musculus
gcagtcccatcgcaatatccagtgg

SEQ ID NO: 539449 - DNA, 25 bp, Mus musculus
gcagtcccatcggaatatccagtgg

SEQ ID NO: 539450 - DNA, 25 bp, Mus musculus
gcagtcccattgctgtagccagaat

SEQ ID NO: 539451 - DNA, 25 bp, Mus musculus
gcagtcccattggtgtagccagaat

SEQ ID NO: 539452 - DNA, 25 bp, Mus musculus
gcagtccccactcatggagactggt

SEQ ID NO: 539453 - DNA, 25 bp, Mus musculus
gcagtccccactgatggagactggt

SEQ ID NO: 539454 - DNA, 25 bp, Mus musculus
gcagtccctactactcacagaggag

SEQ ID NO: 539455 - DNA, 25 bp, Mus musculus
gcagtccctacttctcacagaggag

SEQ ID NO: 539456 - DNA, 25 bp, Mus musculus
gcagtccgagagctaatcaacatct

SEQ ID NO: 539457 - DNA, 25 bp, Mus musculus
gcagtccgagaggtaatcaacatct

SEQ ID NO: 539458 - DNA, 25 bp, Mus musculus
gcagtccgatacctcaatgcctaca

SEQ ID NO: 539459 - DNA, 25 bp, Mus musculus
gcagtccgatacgtcaatgcctaca

SEQ ID NO: 539460 - DNA, 25 bp, Mus musculus
gcagtccggtacatacacgtgacca

SEQ ID NO: 539461 - DNA, 25 bp, Mus musculus
gcagtccggtacttacacgtgacca

SEQ ID NO: 539462 - DNA, 25 bp, Mus musculus
gcagtcctactgatgttactacaca

SEQ ID NO: 539463 - DNA, 25 bp, Mus musculus
gcagtcctactgttgttactacaca

SEQ ID NO: 539464 - DNA, 25 bp, Mus musculus
gcagtcctaggtaccaagttctcag

SEQ ID NO: 539465 - DNA, 25 bp, Mus musculus
gcagtcctaggttccaagttctcag

SEQ ID NO: 539466 - DNA, 25 bp, Mus musculus
gcagtcctcacgcaaacgcacggtg

SEQ ID NO: 539467 - DNA, 25 bp, Mus musculus
gcagtcctcacggaaacgcacggtg

SEQ ID NO: 539468 - DNA, 25 bp, Mus musculus
gcagtcctcagcaggcccagggaaa

SEQ ID NO: 539469 - DNA, 25 bp, Mus musculus
gcagtcctcagctggcccagggaaa

SEQ ID NO: 539470 - DNA, 25 bp, Mus musculus
gcagtcctgccaagagtggcattct

SEQ ID NO: 539471 - DNA, 25 bp, Mus musculus
gcagtcctgccatgagtggcattct

SEQ ID NO: 539472 - DNA, 25 bp, Mus musculus
gcagtcctggctagcataggcactg

SEQ ID NO: 539473 - DNA, 25 bp, Mus musculus
gcagtcctggcttgcataggcactg

SEQ ID NO: 539474 - DNA, 25 bp, Mus musculus
gcagtcctgtgacaagcaacagcta

SEQ ID NO: 539475 - DNA, 25 bp, Mus musculus
gcagtcctgtgagaagcaacagcta

SEQ ID NO: 539476 - DNA, 25 bp, Mus musculus
gcagtcctgtgcaaaccgtgggtct

SEQ ID NO: 539477 - DNA, 25 bp, Mus musculus
gcagtcctgtgctaaccgtgggtct

SEQ ID NO: 539478 - DNA, 25 bp, Mus musculus
gcagtcctgttcagtagagtaggga

SEQ ID NO: 539479 - DNA, 25 bp, Mus musculus
gcagtcctgttctgtagagtaggga

SEQ ID NO: 539480 - DNA, 25 bp, Mus musculus
gcagtcctttgaaaacccatttcgg

SEQ ID NO: 539481 - DNA, 25 bp, Mus musculus
gcagtcctttgataacccatttcgg

SEQ ID NO: 539482 - DNA, 25 bp, Mus musculus
gcagtcctttgtatggcttattttg

SEQ ID NO: 539483 - DNA, 25 bp, Mus musculus
gcagtcctttgtattttgtggtagt

SEQ ID NO: 539484 - DNA, 25 bp, Mus musculus
gcagtcctttgtttggcttattttg

SEQ ID NO: 539485 - DNA, 25 bp, Mus musculus
gcagtcctttgttttttgtggtagt

SEQ ID NO: 539486 - DNA, 25 bp, Mus musculus
gcagtccttttcattcaatcatggt

SEQ ID NO: 539487 - DNA, 25 bp, Mus musculus
gcagtccttttctttcaatcatggt

SEQ ID NO: 539488 - DNA, 25 bp, Mus musculus
gcagtcgaatgcaccaggccatggg

SEQ ID NO: 539489 - DNA, 25 bp, Mus musculus
gcagtcgaatgctccaggccatggg

SEQ ID NO: 539490 - DNA, 25 bp, Mus musculus
gcagtcgagagactaggcctagcct

SEQ ID NO: 539491 - DNA, 25 bp, Mus musculus
gcagtcgagagagtaggcctagcct

SEQ ID NO: 539492 - DNA, 25 bp, Mus musculus
gcagtcgctactatgtgacccggaa

SEQ ID NO: 539493 - DNA, 25 bp, Mus musculus
gcagtcgctactttgtgacccggaa

SEQ ID NO: 539494 - DNA, 25 bp, Mus musculus
gcagtcggcagcagcttgctgcaga

SEQ ID NO: 539495 - DNA, 25 bp, Mus musculus
gcagtcggcagctgcttgctgcaga

SEQ ID NO: 539496 - DNA, 25 bp, Mus musculus
gcagtcgggacacccataggagtat

SEQ ID NO: 539497 - DNA, 25 bp, Mus musculus
gcagtcgggacagccataggagtat

SEQ ID NO: 539498 - DNA, 25 bp, Mus musculus
gcagtcggtagcacggagcagctct

SEQ ID NO: 539499 - DNA, 25 bp, Mus musculus
gcagtcggtagctcggagcagctct

SEQ ID NO: 539500 - DNA, 25 bp, Mus musculus
gcagtcgtacatcaacacaaaccat

SEQ ID NO: 539501 - DNA, 25 bp, Mus musculus
gcagtcgtacatgaacacaaaccat

SEQ ID NO: 539502 - DNA, 25 bp, Mus musculus
gcagtcgttgataatctcaggttct

SEQ ID NO: 539503 - DNA, 25 bp, Mus musculus
gcagtcgttgattatctcaggttct

SEQ ID NO: 539504 - DNA, 25 bp, Mus musculus
gcagtcgtttaactgcttgctttgc

SEQ ID NO: 539505 - DNA, 25 bp, Mus musculus
gcagtcgtttaagtgcttgctttgc

SEQ ID NO: 539506 - DNA, 25 bp, Mus musculus
gcagtctaagcccagaagccagtaa

SEQ ID NO: 539507 - DNA, 25 bp, Mus musculus
gcagtctaagccgagaagccagtaa

SEQ ID NO: 539508 - DNA, 25 bp, Mus musculus
gcagtctacatgattccgattctat

SEQ ID NO: 539509 - DNA, 25 bp, Mus musculus
gcagtctacatgtttccgattctat

SEQ ID NO: 539510 - DNA, 25 bp, Mus musculus
gcagtctacggaaccgcattgcagc

SEQ ID NO: 539511 - DNA, 25 bp, Mus musculus
gcagtctacggatccgcattgcagc

SEQ ID NO: 539512 - DNA, 25 bp, Mus musculus
gcagtctactctcagtctgggctta

SEQ ID NO: 539513 - DNA, 25 bp, Mus musculus
gcagtctactctgagtctgggctta

SEQ ID NO: 539514 - DNA, 25 bp, Mus musculus
gcagtctagaatagttcagagccag

SEQ ID NO: 539515 - DNA, 25 bp, Mus musculus
gcagtctagaattgttcagagccag

SEQ ID NO: 539516 - DNA, 25 bp, Mus musculus
gcagtctagacacccaatgcagtat

SEQ ID NO: 539517 - DNA, 25 bp, Mus musculus
gcagtctagacagccaatgcagtat

SEQ ID NO: 539518 - DNA, 25 bp, Mus musculus
gcagtctaggacagtggtttaaaac

SEQ ID NO: 539519 - DNA, 25 bp, Mus musculus
gcagtctaggactgtggtttaaaac

SEQ ID NO: 539520 - DNA, 25 bp, Mus musculus
gcagtctagggcacgttacaccagt

SEQ ID NO: 539521 - DNA, 25 bp, Mus musculus
gcagtctagggctcgttacaccagt

SEQ ID NO: 539522 - DNA, 25 bp, Mus musculus
gcagtctatgagcatgcctcttggg

SEQ ID NO: 539523 - DNA, 25 bp, Mus musculus
gcagtctatgaggatgcctcttggg

SEQ ID NO: 539524 - DNA, 25 bp, Mus musculus
gcagtctattgcaaggaccttcttt

SEQ ID NO: 539525 - DNA, 25 bp, Mus musculus
gcagtctattgctaggaccttcttt

SEQ ID NO: 539526 - DNA, 25 bp, Mus musculus
gcagtctcaaatctgctactcaggc

SEQ ID NO: 539527 - DNA, 25 bp, Mus musculus
gcagtctcaaatgtgctactcaggc

SEQ ID NO: 539528 - DNA, 25 bp, Mus musculus
gcagtctcaaccaggaatggccaga

SEQ ID NO: 539529 - DNA, 25 bp, Mus musculus
gcagtctcaacctggaatggccaga

SEQ ID NO: 539530 - DNA, 25 bp, Mus musculus
gcagtctcagttctccaggcaaaga

SEQ ID NO: 539531 - DNA, 25 bp, Mus musculus
gcagtctcagttgtccaggcaaaga

SEQ ID NO: 539532 - DNA, 25 bp, Mus musculus
gcagtctcataaagacaactcagga

SEQ ID NO: 539533 - DNA, 25 bp, Mus musculus
gcagtctcataatgacaactcagga

SEQ ID NO: 539534 - DNA, 25 bp, Mus musculus
gcagtctcatccagttttcagtgag

SEQ ID NO: 539535 - DNA, 25 bp, Mus musculus
gcagtctcatcctgttttcagtgag

SEQ ID NO: 539536 - DNA, 25 bp, Mus musculus
gcagtctcatcgaacacgtctttgt

SEQ ID NO: 539537 - DNA, 25 bp, Mus musculus
gcagtctcatcgtacacgtctttgt

SEQ ID NO: 539538 - DNA, 25 bp, Mus musculus
gcagtctcctccatctcatattttt

SEQ ID NO: 539539 - DNA, 25 bp, Mus musculus
gcagtctcctccttctcatattttt

SEQ ID NO: 539540 - DNA, 25 bp, Mus musculus
gcagtctcctgtcggcttcagaaga

SEQ ID NO: 539541 - DNA, 25 bp, Mus musculus
gcagtctcctgtgggcttcagaaga

SEQ ID NO: 539542 - DNA, 25 bp, Mus musculus
gcagtctctcaactctcgaggctac

SEQ ID NO: 539543 - DNA, 25 bp, Mus musculus
gcagtctctcaagtctcgaggctac

SEQ ID NO: 539544 - DNA, 25 bp, Mus musculus
gcagtctctgacacaaacaccaggg

SEQ ID NO: 539545 - DNA, 25 bp, Mus musculus
gcagtctctgactcaaacaccaggg

SEQ ID NO: 539546 - DNA, 25 bp, Mus musculus
gcagtctctgcccactctgttaact

SEQ ID NO: 539547 - DNA, 25 bp, Mus musculus
gcagtctctgccctagaagtattga

SEQ ID NO: 539548 - DNA, 25 bp, Mus musculus
gcagtctctgccgactctgttaact

SEQ ID NO: 539549 - DNA, 25 bp, Mus musculus
gcagtctctgccgtagaagtattga

SEQ ID NO: 539550 - DNA, 25 bp, Mus musculus
gcagtctctgctaagactttcgact

SEQ ID NO: 539551 - DNA, 25 bp, Mus musculus
gcagtctctgcttagactttcgact

SEQ ID NO: 539552 - DNA, 25 bp, Mus musculus
gcagtctcttccattagtctaggtt

SEQ ID NO: 539553 - DNA, 25 bp, Mus musculus
gcagtctcttcctttagtctaggtt

SEQ ID NO: 539554 - DNA, 25 bp, Mus musculus
gcagtctgaaaccattcccctgaga

SEQ ID NO: 539555 - DNA, 25 bp, Mus musculus
gcagtctgaaacgattcccctgaga

SEQ ID NO: 539556 - DNA, 25 bp, Mus musculus
gcagtctgaagtcgaaagctggctt

SEQ ID NO: 539557 - DNA, 25 bp, Mus musculus
gcagtctgaagtggaaagctggctt

SEQ ID NO: 539558 - DNA, 25 bp, Mus musculus
gcagtctgactactactagctggtg

SEQ ID NO: 539559 - DNA, 25 bp, Mus musculus
gcagtctgactagtactagctggtg

SEQ ID NO: 539560 - DNA, 25 bp, Mus musculus
gcagtctgcaaaccatcgatagagt

SEQ ID NO: 539561 - DNA, 25 bp, Mus musculus
gcagtctgcaaagcatcgatagagt

SEQ ID NO: 539562 - DNA, 25 bp, Mus musculus
gcagtctgctacatgatggtgtcat

SEQ ID NO: 539563 - DNA, 25 bp, Mus musculus
gcagtctgctacttgatggtgtcat

SEQ ID NO: 539564 - DNA, 25 bp, Mus musculus
gcagtctgctcaccccttcttggtg

SEQ ID NO: 539565 - DNA, 25 bp, Mus musculus
gcagtctgctcagcccttcttggtg

SEQ ID NO: 539566 - DNA, 25 bp, Mus musculus
gcagtctggactaacaccagtccaa

SEQ ID NO: 539567 - DNA, 25 bp, Mus musculus
gcagtctggactctacactatgagc

SEQ ID NO: 539568 - DNA, 25 bp, Mus musculus
gcagtctggactgtacactatgagc

SEQ ID NO: 539569 - DNA, 25 bp, Mus musculus
gcagtctggacttacaccagtccaa

SEQ ID NO: 539570 - DNA, 25 bp, Mus musculus
gcagtctgggtcaaatgagccttgg

SEQ ID NO: 539571 - DNA, 25 bp, Mus musculus
gcagtctgggtctaatgagccttgg

SEQ ID NO: 539572 - DNA, 25 bp, Mus musculus
gcagtctggttccttctgagaaaca

SEQ ID NO: 539573 - DNA, 25 bp, Mus musculus
gcagtctggttcgttctgagaaaca

SEQ ID NO: 539574 - DNA, 25 bp, Mus musculus
gcagtctgtaagactaaatgagtaa

SEQ ID NO: 539575 - DNA, 25 bp, Mus musculus
gcagtctgtaagtctaaatgagtaa

SEQ ID NO: 539576 - DNA, 25 bp, Mus musculus
gcagtctgtatgattgtgtcgagga

SEQ ID NO: 539577 - DNA, 25 bp, Mus musculus
gcagtctgtatgtttgtgtcgagga

SEQ ID NO: 539578 - DNA, 25 bp, Mus musculus
gcagtctgtcgcctcaaattgtagc

SEQ ID NO: 539579 - DNA, 25 bp, Mus musculus
gcagtctgtcgcgtcaaattgtagc

SEQ ID NO: 539580 - DNA, 25 bp, Mus musculus
gcagtctgtctgcgcctgatgccgg

SEQ ID NO: 539581 - DNA, 25 bp, Mus musculus
gcagtctgtctgggcctgatgccgg

SEQ ID NO: 539582 - DNA, 25 bp, Mus musculus
gcagtctgtgaaatcccaagaggaa

SEQ ID NO: 539583 - DNA, 25 bp, Mus musculus
gcagtctgtgaattcccaagaggaa

SEQ ID NO: 539584 - DNA, 25 bp, Mus musculus
gcagtctgttagcatgcagcctctc

SEQ ID NO: 539585 - DNA, 25 bp, Mus musculus
gcagtctgttaggatgcagcctctc

SEQ ID NO: 539586 - DNA, 25 bp, Mus musculus
gcagtctgttggctatagttcttta

SEQ ID NO: 539587 - DNA, 25 bp, Mus musculus
gcagtctgttgggtatagttcttta

SEQ ID NO: 539588 - DNA, 25 bp, Mus musculus
gcagtctgtttcaagagctctggaa

SEQ ID NO: 539589 - DNA, 25 bp, Mus musculus
gcagtctgtttctagagctctggaa

SEQ ID NO: 539590 - DNA, 25 bp, Mus musculus
gcagtcttaaccctttaagcggaag

SEQ ID NO: 539591 - DNA, 25 bp, Mus musculus
gcagtcttaaccgtttaagcggaag

SEQ ID NO: 539592 - DNA, 25 bp, Mus musculus
gcagtcttagttatcgtgctgacca

SEQ ID NO: 539593 - DNA, 25 bp, Mus musculus
gcagtcttagttttcgtgctgacca

SEQ ID NO: 539594 - DNA, 25 bp, Mus musculus
gcagtcttcattaggcctcaatggg

SEQ ID NO: 539595 - DNA, 25 bp, Mus musculus
gcagtcttcatttggcctcaatggg

SEQ ID NO: 539596 - DNA, 25 bp, Mus musculus
gcagtcttccacagttgagggtcat

SEQ ID NO: 539597 - DNA, 25 bp, Mus musculus
gcagtcttccactgttgagggtcat

SEQ ID NO: 539598 - DNA, 25 bp, Mus musculus
gcagtcttcgcgaggagcccaggtt

SEQ ID NO: 539599 - DNA, 25 bp, Mus musculus
gcagtcttcgcgtggagcccaggtt

SEQ ID NO: 539600 - DNA, 25 bp, Mus musculus
gcagtcttcgttctctgtagtcttg

SEQ ID NO: 539601 - DNA, 25 bp, Mus musculus
gcagtcttcgttgtctgtagtcttg

SEQ ID NO: 539602 - DNA, 25 bp, Mus musculus
gcagtcttctgtatgtggactatta

SEQ ID NO: 539603 - DNA, 25 bp, Mus musculus
gcagtcttctgtttgtggactatta

SEQ ID NO: 539604 - DNA, 25 bp, Mus musculus
gcagtcttcttgcaggcatggcact

SEQ ID NO: 539605 - DNA, 25 bp, Mus musculus
gcagtcttcttgcattgtttttcac

SEQ ID NO: 539606 - DNA, 25 bp, Mus musculus
gcagtcttcttggaggcatggcact

SEQ ID NO: 539607 - DNA, 25 bp, Mus musculus
gcagtcttcttggattgtttttcac

SEQ ID NO: 539608 - DNA, 25 bp, Mus musculus
gcagtctttgcaatagttcacctat

SEQ ID NO: 539609 - DNA, 25 bp, Mus musculus
gcagtctttgcattagttcacctat

SEQ ID NO: 539610 - DNA, 25 bp, Mus musculus
gcagtctttgtcacttgtagatcca

SEQ ID NO: 539611 - DNA, 25 bp, Mus musculus
gcagtctttgtctcttgtagatcca

SEQ ID NO: 539612 - DNA, 25 bp, Mus musculus
gcagtgaaatcaaagctgtcatttt

SEQ ID NO: 539613 - DNA, 25 bp, Mus musculus
gcagtgaaatcatagctgtcatttt

SEQ ID NO: 539614 - DNA, 25 bp, Mus musculus
gcagtgaacattcaatggcttatat

SEQ ID NO: 539615 - DNA, 25 bp, Mus musculus
gcagtgaacattgaatggcttatat

SEQ ID NO: 539616 - DNA, 25 bp, Mus musculus
gcagtgaacccaaggaggaatcaga

SEQ ID NO: 539617 - DNA, 25 bp, Mus musculus
gcagtgaacccatggaggaatcaga

SEQ ID NO: 539618 - DNA, 25 bp, Mus musculus
gcagtgaaccctccttctgggtgaa

SEQ ID NO: 539619 - DNA, 25 bp, Mus musculus
gcagtgaaccctgcttctgggtgaa

SEQ ID NO: 539620 - DNA, 25 bp, Mus musculus
gcagtgaagaataagggaccccatt

SEQ ID NO: 539621 - DNA, 25 bp, Mus musculus
gcagtgaagaattagggaccccatt

SEQ ID NO: 539622 - DNA, 25 bp, Mus musculus
gcagtgaagaccaggaccagcgatg

SEQ ID NO: 539623 - DNA, 25 bp, Mus musculus
gcagtgaagacctggaccagcgatg

SEQ ID NO: 539624 - DNA, 25 bp, Mus musculus
gcagtgaagggcaaacggttctctt

SEQ ID NO: 539625 - DNA, 25 bp, Mus musculus
gcagtgaagggctaacggttctctt

SEQ ID NO: 539626 - DNA, 25 bp, Mus musculus
gcagtgaatagacttgagtcctcaa

SEQ ID NO: 539627 - DNA, 25 bp, Mus musculus
gcagtgaatagagttgagtcctcaa

SEQ ID NO: 539628 - DNA, 25 bp, Mus musculus
gcagtgaatgtgataaaggctttgt

SEQ ID NO: 539629 - DNA, 25 bp, Mus musculus
gcagtgaatgtgttaaaggctttgt

SEQ ID NO: 539630 - DNA, 25 bp, Mus musculus
gcagtgaattcaaccgcaagcttag

SEQ ID NO: 539631 - DNA, 25 bp, Mus musculus
gcagtgaattcatccgcaagcttag

SEQ ID NO: 539632 - DNA, 25 bp, Mus musculus
gcagtgacaacaaaggcagccagga

SEQ ID NO: 539633 - DNA, 25 bp, Mus musculus
gcagtgacaacataggcagccagga

SEQ ID NO: 539634 - DNA, 25 bp, Mus musculus
gcagtgacaactctgcctagccggg

SEQ ID NO: 539635 - DNA, 25 bp, Mus musculus
gcagtgacaactgtgcctagccggg

SEQ ID NO: 539636 - DNA, 25 bp, Mus musculus
gcagtgacacaaagtaacctacagt

SEQ ID NO: 539637 - DNA, 25 bp, Mus musculus
gcagtgacacaatgtaacctacagt

SEQ ID NO: 539638 - DNA, 25 bp, Mus musculus
gcagtgacacagcaggcataacaat

SEQ ID NO: 539639 - DNA, 25 bp, Mus musculus
gcagtgacacaggaggcataacaat

SEQ ID NO: 539640 - DNA, 25 bp, Mus musculus
gcagtgacatctattgtgaaccctt

SEQ ID NO: 539641 - DNA, 25 bp, Mus musculus
gcagtgacatcttttgtgaaccctt

SEQ ID NO: 539642 - DNA, 25 bp, Mus musculus
gcagtgacccctactttttacaggt

SEQ ID NO: 539643 - DNA, 25 bp, Mus musculus
gcagtgaccccttctttttacaggt

SEQ ID NO: 539644 - DNA, 25 bp, Mus musculus
gcagtgacctgcagggataacggat

SEQ ID NO: 539645 - DNA, 25 bp, Mus musculus
gcagtgacctgctgggataacggat

SEQ ID NO: 539646 - DNA, 25 bp, Mus musculus
gcagtgaccttgatccagtcaagtt

SEQ ID NO: 539647 - DNA, 25 bp, Mus musculus
gcagtgaccttgttccagtcaagtt

SEQ ID NO: 539648 - DNA, 25 bp, Mus musculus
gcagtgactccccaaaagctattag

SEQ ID NO: 539649 - DNA, 25 bp, Mus musculus
gcagtgactcccgaaaagctattag

SEQ ID NO: 539650 - DNA, 25 bp, Mus musculus
gcagtgactccgaggcttttaaaat

SEQ ID NO: 539651 - DNA, 25 bp, Mus musculus
gcagtgactccgcaagagcaggcat

SEQ ID NO: 539652 - DNA, 25 bp, Mus musculus
gcagtgactccggaagagcaggcat

SEQ ID NO: 539653 - DNA, 25 bp, Mus musculus
gcagtgactccgtggcttttaaaat

SEQ ID NO: 539654 - DNA, 25 bp, Mus musculus
gcagtgactgcaaacatttaaagta

SEQ ID NO: 539655 - DNA, 25 bp, Mus musculus
gcagtgactgcatacatttaaagta

SEQ ID NO: 539656 - DNA, 25 bp, Mus musculus
gcagtgacttatagcctgctctcaa

SEQ ID NO: 539657 - DNA, 25 bp, Mus musculus
gcagtgacttattgcctgctctcaa

SEQ ID NO: 539658 - DNA, 25 bp, Mus musculus
gcagtgacttgaccttaccagtgat

SEQ ID NO: 539659 - DNA, 25 bp, Mus musculus
gcagtgacttgagcttaccagtgat

SEQ ID NO: 539660 - DNA, 25 bp, Mus musculus
gcagtgacttggaaatctttaaaaa

SEQ ID NO: 539661 - DNA, 25 bp, Mus musculus
gcagtgacttggtaatctttaaaaa

SEQ ID NO: 539662 - DNA, 25 bp, Mus musculus
gcagtgagagagagcccctgagtcc

SEQ ID NO: 539663 - DNA, 25 bp, Mus musculus
gcagtgagagagtgcccctgagtcc

SEQ ID NO: 539664 - DNA, 25 bp, Mus musculus
gcagtgagcagcaacccgcggatgt

SEQ ID NO: 539665 - DNA, 25 bp, Mus musculus
gcagtgagcagctacccgcggatgt

SEQ ID NO: 539666 - DNA, 25 bp, Mus musculus
gcagtgagcaggagcctcttgcccc

SEQ ID NO: 539667 - DNA, 25 bp, Mus musculus
gcagtgagcaggtgcctcttgcccc

SEQ ID NO: 539668 - DNA, 25 bp, Mus musculus
gcagtgagcccgcgctacatgtcca

SEQ ID NO: 539669 - DNA, 25 bp, Mus musculus
gcagtgagcccgggctacatgtcca

SEQ ID NO: 539670 - DNA, 25 bp, Mus musculus
gcagtgagctgtcaccatgccacag

SEQ ID NO: 539671 - DNA, 25 bp, Mus musculus
gcagtgagctgtgaccatgccacag

SEQ ID NO: 539672 - DNA, 25 bp, Mus musculus
gcagtgaggacacacctggactcaa

SEQ ID NO: 539673 - DNA, 25 bp, Mus musculus
gcagtgaggacagacctggactcaa

SEQ ID NO: 539674 - DNA, 25 bp, Mus musculus
gcagtgaggataatggaggccactt

SEQ ID NO: 539675 - DNA, 25 bp, Mus musculus
gcagtgaggatattggaggccactt

SEQ ID NO: 539676 - DNA, 25 bp, Mus musculus
gcagtgagggtcaccacatggtgct

SEQ ID NO: 539677 - DNA, 25 bp, Mus musculus
gcagtgagggtctccacatggtgct

SEQ ID NO: 539678 - DNA, 25 bp, Mus musculus
gcagtgagtcacatggttgtttcgg

SEQ ID NO: 539679 - DNA, 25 bp, Mus musculus
gcagtgagtcacttggttgtttcgg

SEQ ID NO: 539680 - DNA, 25 bp, Mus musculus
gcagtgagtttaaattgtggcttct

SEQ ID NO: 539681 - DNA, 25 bp, Mus musculus
gcagtgagtttatattgtggcttct

SEQ ID NO: 539682 - DNA, 25 bp, Mus musculus
gcagtgataactcctagtaacgaag

SEQ ID NO: 539683 - DNA, 25 bp, Mus musculus
gcagtgataactgctagtaacgaag

SEQ ID NO: 539684 - DNA, 25 bp, Mus musculus
gcagtgatacctagagttttccact

SEQ ID NO: 539685 - DNA, 25 bp, Mus musculus
gcagtgataccttgagttttccact

SEQ ID NO: 539686 - DNA, 25 bp, Mus musculus
gcagtgatactgagactcatggagt

SEQ ID NO: 539687 - DNA, 25 bp, Mus musculus
gcagtgatactgtgactcatggagt

SEQ ID NO: 539688 - DNA, 25 bp, Mus musculus
gcagtgatagcaaggagcttctcca

SEQ ID NO: 539689 - DNA, 25 bp, Mus musculus
gcagtgatagcactgtgcgccttta

SEQ ID NO: 539690 - DNA, 25 bp, Mus musculus
gcagtgatagcagtgtgcgccttta

SEQ ID NO: 539691 - DNA, 25 bp, Mus musculus
gcagtgatagcatggagcttctcca

SEQ ID NO: 539692 - DNA, 25 bp, Mus musculus
gcagtgatattcaaggcaggcccct

SEQ ID NO: 539693 - DNA, 25 bp, Mus musculus
gcagtgatattctaggcaggcccct

SEQ ID NO: 539694 - DNA, 25 bp, Mus musculus
gcagtgatcacaacggcttgcgtgt

SEQ ID NO: 539695 - DNA, 25 bp, Mus musculus
gcagtgatcacatcggcttgcgtgt

SEQ ID NO: 539696 - DNA, 25 bp, Mus musculus
gcagtgatcaggaatacccggagct

SEQ ID NO: 539697 - DNA, 25 bp, Mus musculus
gcagtgatcaggtatacccggagct

SEQ ID NO: 539698 - DNA, 25 bp, Mus musculus
gcagtgatcctcctaccagagagta

SEQ ID NO: 539699 - DNA, 25 bp, Mus musculus
gcagtgatcctcgtaccagagagta

SEQ ID NO: 539700 - DNA, 25 bp, Mus musculus
gcagtgatctccatctctcttataa

SEQ ID NO: 539701 - DNA, 25 bp, Mus musculus
gcagtgatctccttctctcttataa

SEQ ID NO: 539702 - DNA, 25 bp, Mus musculus
gcagtgatcttcattaactcattta

SEQ ID NO: 539703 - DNA, 25 bp, Mus musculus
gcagtgatcttctttaactcattta

SEQ ID NO: 539704 - DNA, 25 bp, Mus musculus
gcagtgatgagtctctcaggcagat

SEQ ID NO: 539705 - DNA, 25 bp, Mus musculus
gcagtgatgagtgtctcaggcagat

SEQ ID NO: 539706 - DNA, 25 bp, Mus musculus
gcagtgatgatgacaaccaccctcc

SEQ ID NO: 539707 - DNA, 25 bp, Mus musculus
gcagtgatgatgtcaaccaccctcc

SEQ ID NO: 539708 - DNA, 25 bp, Mus musculus
gcagtgatgcaaatggtcccatgaa

SEQ ID NO: 539709 - DNA, 25 bp, Mus musculus
gcagtgatgcaattggtcccatgaa

SEQ ID NO: 539710 - DNA, 25 bp, Mus musculus
gcagtgatgcagctctcttcttaat

SEQ ID NO: 539711 - DNA, 25 bp, Mus musculus
gcagtgatgcaggtctcttcttaat

SEQ ID NO: 539712 - DNA, 25 bp, Mus musculus
gcagtgatggctacttcaggtataa

SEQ ID NO: 539713 - DNA, 25 bp, Mus musculus
gcagtgatggcttcttcaggtataa

SEQ ID NO: 539714 - DNA, 25 bp, Mus musculus
gcagtgatggtgcaaaacgccttta

SEQ ID NO: 539715 - DNA, 25 bp, Mus musculus
gcagtgatggtgcttccaaagctct

SEQ ID NO: 539716 - DNA, 25 bp, Mus musculus
gcagtgatggtggaaaacgccttta

SEQ ID NO: 539717 - DNA, 25 bp, Mus musculus
gcagtgatggtggttccaaagctct

SEQ ID NO: 539718 - DNA, 25 bp, Mus musculus
gcagtgatgttaatccatcttacag

SEQ ID NO: 539719 - DNA, 25 bp, Mus musculus
gcagtgatgttattccatcttacag

SEQ ID NO: 539720 - DNA, 25 bp, Mus musculus
gcagtgattcagaggtccgcggtaa

SEQ ID NO: 539721 - DNA, 25 bp, Mus musculus
gcagtgattcagtggtccgcggtaa

SEQ ID NO: 539722 - DNA, 25 bp, Mus musculus
gcagtgattgagcttgcctttaatc

SEQ ID NO: 539723 - DNA, 25 bp, Mus musculus
gcagtgattgaggttgcctttaatc

SEQ ID NO: 539724 - DNA, 25 bp, Mus musculus
gcagtgattgatcgctggcctccat

SEQ ID NO: 539725 - DNA, 25 bp, Mus musculus
gcagtgattgatggctggcctccat

SEQ ID NO: 539726 - DNA, 25 bp, Mus musculus
gcagtgatttcactggcaggctaca

SEQ ID NO: 539727 - DNA, 25 bp, Mus musculus
gcagtgatttcagtggcaggctaca

SEQ ID NO: 539728 - DNA, 25 bp, Mus musculus
gcagtgcaacatagattcctgtttg

SEQ ID NO: 539729 - DNA, 25 bp, Mus musculus
gcagtgcaacattgattcctgtttg

SEQ ID NO: 539730 - DNA, 25 bp, Mus musculus
gcagtgcaagctacggaccacagtt

SEQ ID NO: 539731 - DNA, 25 bp, Mus musculus
gcagtgcaagcttcggaccacagtt

SEQ ID NO: 539732 - DNA, 25 bp, Mus musculus
gcagtgcaagggagacctcatccag

SEQ ID NO: 539733 - DNA, 25 bp, Mus musculus
gcagtgcaagggtgacctcatccag

SEQ ID NO: 539734 - DNA, 25 bp, Mus musculus
gcagtgcaatgtcgctatgcttggc

SEQ ID NO: 539735 - DNA, 25 bp, Mus musculus
gcagtgcaatgtggctatgcttggc

SEQ ID NO: 539736 - DNA, 25 bp, Mus musculus
gcagtgcactcacactagtgaggta

SEQ ID NO: 539737 - DNA, 25 bp, Mus musculus
gcagtgcactcagactagtgaggta

SEQ ID NO: 539738 - DNA, 25 bp, Mus musculus
gcagtgcagaccagtgttgcagtga

SEQ ID NO: 539739 - DNA, 25 bp, Mus musculus
gcagtgcagacctgtgttgcagtga

SEQ ID NO: 539740 - DNA, 25 bp, Mus musculus
gcagtgcagccaaatatttatcaga

SEQ ID NO: 539741 - DNA, 25 bp, Mus musculus
gcagtgcagccaagaatacccatta

SEQ ID NO: 539742 - DNA, 25 bp, Mus musculus
gcagtgcagccatatatttatcaga

SEQ ID NO: 539743 - DNA, 25 bp, Mus musculus
gcagtgcagccatgaatacccatta

SEQ ID NO: 539744 - DNA, 25 bp, Mus musculus
gcagtgcaggtgctgtacacactaa

SEQ ID NO: 539745 - DNA, 25 bp, Mus musculus
gcagtgcaggtggtgtacacactaa

SEQ ID NO: 539746 - DNA, 25 bp, Mus musculus
gcagtgcagtgaactgcctgacttc

SEQ ID NO: 539747 - DNA, 25 bp, Mus musculus
gcagtgcagtgaccccgggctacat

SEQ ID NO: 539748 - DNA, 25 bp, Mus musculus
gcagtgcagtgagcccgggctacat

SEQ ID NO: 539749 - DNA, 25 bp, Mus musculus
gcagtgcagtgatctgcctgacttc

SEQ ID NO: 539750 - DNA, 25 bp, Mus musculus
gcagtgcagtgcaactccagtggca

SEQ ID NO: 539751 - DNA, 25 bp, Mus musculus
gcagtgcagtgcctttgcttacatt

SEQ ID NO: 539752 - DNA, 25 bp, Mus musculus
gcagtgcagtgcgtttgcttacatt

SEQ ID NO: 539753 - DNA, 25 bp, Mus musculus
gcagtgcagtgctactccagtggca

SEQ ID NO: 539754 - DNA, 25 bp, Mus musculus
gcagtgcatgatcggcatttttctt

SEQ ID NO: 539755 - DNA, 25 bp, Mus musculus
gcagtgcatgatgggcatttttctt

SEQ ID NO: 539756 - DNA, 25 bp, Mus musculus
gcagtgcatgcgcaaccagccatgg

SEQ ID NO: 539757 - DNA, 25 bp, Mus musculus
gcagtgcatgcggaaccagccatgg

SEQ ID NO: 539758 - DNA, 25 bp, Mus musculus
gcagtgcatttacacaggcatctat

SEQ ID NO: 539759 - DNA, 25 bp, Mus musculus
gcagtgcatttagacaggcatctat

SEQ ID NO: 539760 - DNA, 25 bp, Mus musculus
gcagtgccaaagcatctacagcctg

SEQ ID NO: 539761 - DNA, 25 bp, Mus musculus
gcagtgccaaaggatctacagcctg

SEQ ID NO: 539762 - DNA, 25 bp, Mus musculus
gcagtgccaactacatggagcatat

SEQ ID NO: 539763 - DNA, 25 bp, Mus musculus
gcagtgccaacttcatggagcatat

SEQ ID NO: 539764 - DNA, 25 bp, Mus musculus
gcagtgccaagcaggtgtcccagga

SEQ ID NO: 539765 - DNA, 25 bp, Mus musculus
gcagtgccaagctggtgtcccagga

SEQ ID NO: 539766 - DNA, 25 bp, Mus musculus
gcagtgccaatgaacaagctgtgca

SEQ ID NO: 539767 - DNA, 25 bp, Mus musculus
gcagtgccaatgtacaagctgtgca

SEQ ID NO: 539768 - DNA, 25 bp, Mus musculus
gcagtgccagctcaagtgtaagttc

SEQ ID NO: 539769 - DNA, 25 bp, Mus musculus
gcagtgccagctcaattgtacgtta

SEQ ID NO: 539770 - DNA, 25 bp, Mus musculus
gcagtgccagctgaagtgtaagttc

SEQ ID NO: 539771 - DNA, 25 bp, Mus musculus
gcagtgccagctgaattgtacgtta

SEQ ID NO: 539772 - DNA, 25 bp, Mus musculus
gcagtgccatacatgtgggtttaca

SEQ ID NO: 539773 - DNA, 25 bp, Mus musculus
gcagtgccatacttgtgggtttaca

SEQ ID NO: 539774 - DNA, 25 bp, Mus musculus
gcagtgcccaagaaaaagggccctg

SEQ ID NO: 539775 - DNA, 25 bp, Mus musculus
gcagtgcccaagtaaaagggccctg

SEQ ID NO: 539776 - DNA, 25 bp, Mus musculus
gcagtgcccctcatgctaccttggg

SEQ ID NO: 539777 - DNA, 25 bp, Mus musculus
gcagtgcccctcttgctaccttggg

SEQ ID NO: 539778 - DNA, 25 bp, Mus musculus
gcagtgcccgtgagcaagtaagctc

SEQ ID NO: 539779 - DNA, 25 bp, Mus musculus
gcagtgcccgtgtgcaagtaagctc

SEQ ID NO: 539780 - DNA, 25 bp, Mus musculus
gcagtgccctgtcctgtttgaatga

SEQ ID NO: 539781 - DNA, 25 bp, Mus musculus
gcagtgccctgtgctgtttgaatga

SEQ ID NO: 539782 - DNA, 25 bp, Mus musculus
gcagtgcccttcacgcacgaggaca

SEQ ID NO: 539783 - DNA, 25 bp, Mus musculus
gcagtgcccttctcgcacgaggaca

SEQ ID NO: 539784 - DNA, 25 bp, Mus musculus
gcagtgcctacacaatccagagggt

SEQ ID NO: 539785 - DNA, 25 bp, Mus musculus
gcagtgcctacagaatccagagggt

SEQ ID NO: 539786 - DNA, 25 bp, Mus musculus
gcagtgcctactacatcatgtttct

SEQ ID NO: 539787 - DNA, 25 bp, Mus musculus
gcagtgcctacttcatcatgtttct

SEQ ID NO: 539788 - DNA, 25 bp, Mus musculus
gcagtgcctatgaaaatgccaggga

SEQ ID NO: 539789 - DNA, 25 bp, Mus musculus
gcagtgcctatgtaaatgccaggga

SEQ ID NO: 539790 - DNA, 25 bp, Mus musculus
gcagtgcctctccaaaatccagaaa

SEQ ID NO: 539791 - DNA, 25 bp, Mus musculus
gcagtgcctctcgaaaatccagaaa

SEQ ID NO: 539792 - DNA, 25 bp, Mus musculus
gcagtgcctctgatttacttttaaa

SEQ ID NO: 539793 - DNA, 25 bp, Mus musculus
gcagtgcctctgttttacttttaaa

SEQ ID NO: 539794 - DNA, 25 bp, Mus musculus
gcagtgcctgtcctcagtgatacaa

SEQ ID NO: 539795 - DNA, 25 bp, Mus musculus
gcagtgcctgtcgtcagtgatacaa

SEQ ID NO: 539796 - DNA, 25 bp, Mus musculus
gcagtgccttcacatgtatcccatg

SEQ ID NO: 539797 - DNA, 25 bp, Mus musculus
gcagtgccttcagatgtatcccatg

SEQ ID NO: 539798 - DNA, 25 bp, Mus musculus
gcagtgcgaacacctccatgaaaga

SEQ ID NO: 539799 - DNA, 25 bp, Mus musculus
gcagtgcgaacagctccatgaaaga

SEQ ID NO: 539800 - DNA, 25 bp, Mus musculus
gcagtgcgccttaactttatggtta

SEQ ID NO: 539801 - DNA, 25 bp, Mus musculus
gcagtgcgcctttactttatggtta

SEQ ID NO: 539802 - DNA, 25 bp, Mus musculus
gcagtgcggtgcattacagaatgct

SEQ ID NO: 539803 - DNA, 25 bp, Mus musculus
gcagtgcggtgctttacagaatgct

SEQ ID NO: 539804 - DNA, 25 bp, Mus musculus
gcagtgcgttcaaagcaagctgata

SEQ ID NO: 539805 - DNA, 25 bp, Mus musculus
gcagtgcgttcatagcaagctgata

SEQ ID NO: 539806 - DNA, 25 bp, Mus musculus
gcagtgctaacgacacggagtcgga

SEQ ID NO: 539807 - DNA, 25 bp, Mus musculus
gcagtgctaacgtcacggagtcgga

SEQ ID NO: 539808 - DNA, 25 bp, Mus musculus
gcagtgctaagcctaacgttctcat

SEQ ID NO: 539809 - DNA, 25 bp, Mus musculus
gcagtgctaagcgtaacgttctcat

SEQ ID NO: 539810 - DNA, 25 bp, Mus musculus
gcagtgctatgaatcttaggttgag

SEQ ID NO: 539811 - DNA, 25 bp, Mus musculus
gcagtgctatgattcttaggttgag

SEQ ID NO: 539812 - DNA, 25 bp, Mus musculus
gcagtgctcgagctgagtgactcat

SEQ ID NO: 539813 - DNA, 25 bp, Mus musculus
gcagtgctcgaggtgagtgactcat

SEQ ID NO: 539814 - DNA, 25 bp, Mus musculus
gcagtgctctaaactcatcaactta

SEQ ID NO: 539815 - DNA, 25 bp, Mus musculus
gcagtgctctaatctcatcaactta

SEQ ID NO: 539816 - DNA, 25 bp, Mus musculus
gcagtgctctgcagacaaaccaaag

SEQ ID NO: 539817 - DNA, 25 bp, Mus musculus
gcagtgctctgctgacaaaccaaag

SEQ ID NO: 539818 - DNA, 25 bp, Mus musculus
gcagtgctctggatacaaaatgtct

SEQ ID NO: 539819 - DNA, 25 bp, Mus musculus
gcagtgctctggttacaaaatgtct

SEQ ID NO: 539820 - DNA, 25 bp, Mus musculus
gcagtgctgaacaacgtgcctgtga

SEQ ID NO: 539821 - DNA, 25 bp, Mus musculus
gcagtgctgaactacgtgcctgtga

SEQ ID NO: 539822 - DNA, 25 bp, Mus musculus
gcagtgctgacgaagccgaagtttt

SEQ ID NO: 539823 - DNA, 25 bp, Mus musculus
gcagtgctgacgtagccgaagtttt

SEQ ID NO: 539824 - DNA, 25 bp, Mus musculus
gcagtgctgagaacattccttatct

SEQ ID NO: 539825 - DNA, 25 bp, Mus musculus
gcagtgctgagatcattccttatct

SEQ ID NO: 539826 - DNA, 25 bp, Mus musculus
gcagtgctgcaaatttttggctaat

SEQ ID NO: 539827 - DNA, 25 bp, Mus musculus
gcagtgctgcaattttttggctaat

SEQ ID NO: 539828 - DNA, 25 bp, Mus musculus
gcagtgctgcgtaatttaagactat

SEQ ID NO: 539829 - DNA, 25 bp, Mus musculus
gcagtgctgcgttatttaagactat

SEQ ID NO: 539830 - DNA, 25 bp, Mus musculus
gcagtgctggtactgcatcctgata

SEQ ID NO: 539831 - DNA, 25 bp, Mus musculus
gcagtgctggtagtgcatcctgata

SEQ ID NO: 539832 - DNA, 25 bp, Mus musculus
gcagtgctgtgtatcctgtacattt

SEQ ID NO: 539833 - DNA, 25 bp, Mus musculus
gcagtgctgtgtttcctgtacattt

SEQ ID NO: 539834 - DNA, 25 bp, Mus musculus
gcagtgcttagcatgtggttcaaat

SEQ ID NO: 539835 - DNA, 25 bp, Mus musculus
gcagtgcttagcttgtggttcaaat

SEQ ID NO: 539836 - DNA, 25 bp, Mus musculus
gcagtgcttcccacgggagtgaata

SEQ ID NO: 539837 - DNA, 25 bp, Mus musculus
gcagtgcttccctcgggagtgaata

SEQ ID NO: 539838 - DNA, 25 bp, Mus musculus
gcagtgcttcggagacggcttgaac

SEQ ID NO: 539839 - DNA, 25 bp, Mus musculus
gcagtgcttcggtgacggcttgaac

SEQ ID NO: 539840 - DNA, 25 bp, Mus musculus
gcagtgcttgctcaagtccattcca

SEQ ID NO: 539841 - DNA, 25 bp, Mus musculus
gcagtgcttgctgaagtccattcca

SEQ ID NO: 539842 - DNA, 25 bp, Mus musculus
gcagtgcttgtacttacctcgcttc

SEQ ID NO: 539843 - DNA, 25 bp, Mus musculus
gcagtgcttgtagttacctcgcttc

SEQ ID NO: 539844 - DNA, 25 bp, Mus musculus
gcagtgctttcaacgttggattgtt

SEQ ID NO: 539845 - DNA, 25 bp, Mus musculus
gcagtgctttcatcgttggattgtt

SEQ ID NO: 539846 - DNA, 25 bp, Mus musculus
gcagtggaaagacccctttgtgttc

SEQ ID NO: 539847 - DNA, 25 bp, Mus musculus
gcagtggaaagagccctttgtgttc

SEQ ID NO: 539848 - DNA, 25 bp, Mus musculus
gcagtggaaatacccggtcagacta

SEQ ID NO: 539849 - DNA, 25 bp, Mus musculus
gcagtggaaatagccggtcagacta

SEQ ID NO: 539850 - DNA, 25 bp, Mus musculus
gcagtggaacttcatccaagctggt

SEQ ID NO: 539851 - DNA, 25 bp, Mus musculus
gcagtggaacttgatccaagctggt

SEQ ID NO: 539852 - DNA, 25 bp, Mus musculus
gcagtggacactcagttatttactc

SEQ ID NO: 539853 - DNA, 25 bp, Mus musculus
gcagtggacactgagttatttactc

SEQ ID NO: 539854 - DNA, 25 bp, Mus musculus
gcagtggacagccagtaccctaaaa

SEQ ID NO: 539855 - DNA, 25 bp, Mus musculus
gcagtggacagcgagtaccctaaaa

SEQ ID NO: 539856 - DNA, 25 bp, Mus musculus
gcagtggacggaccacaaagccata

SEQ ID NO: 539857 - DNA, 25 bp, Mus musculus
gcagtggacggagcacaaagccata

SEQ ID NO: 539858 - DNA, 25 bp, Mus musculus
gcagtggactcccattgagcctaaa

SEQ ID NO: 539859 - DNA, 25 bp, Mus musculus
gcagtggactccgattgagcctaaa

SEQ ID NO: 539860 - DNA, 25 bp, Mus musculus
gcagtggagaacatacttgggattt

SEQ ID NO: 539861 - DNA, 25 bp, Mus musculus
gcagtggagaacttacttgggattt

SEQ ID NO: 539862 - DNA, 25 bp, Mus musculus
gcagtggagactaagccctattata

SEQ ID NO: 539863 - DNA, 25 bp, Mus musculus
gcagtggagacttagccctattata

SEQ ID NO: 539864 - DNA, 25 bp, Mus musculus
gcagtggagcacatgtttgagacag

SEQ ID NO: 539865 - DNA, 25 bp, Mus musculus
gcagtggagcacttgtttgagacag

SEQ ID NO: 539866 - DNA, 25 bp, Mus musculus
gcagtggagcttcctttagattgct

SEQ ID NO: 539867 - DNA, 25 bp, Mus musculus
gcagtggagcttgctttagattgct

SEQ ID NO: 539868 - DNA, 25 bp, Mus musculus
gcagtggagtagatacccactcacg

SEQ ID NO: 539869 - DNA, 25 bp, Mus musculus
gcagtggagtagttacccactcacg

SEQ ID NO: 539870 - DNA, 25 bp, Mus musculus
gcagtggagtgcacagctcatcgtg

SEQ ID NO: 539871 - DNA, 25 bp, Mus musculus
gcagtggagtgctcagctcatcgtg

SEQ ID NO: 539872 - DNA, 25 bp, Mus musculus
gcagtggatagaacccatgccttcc

SEQ ID NO: 539873 - DNA, 25 bp, Mus musculus
gcagtggatagatcccatgccttcc

SEQ ID NO: 539874 - DNA, 25 bp, Mus musculus
gcagtggatcagcttctgccatgga

SEQ ID NO: 539875 - DNA, 25 bp, Mus musculus
gcagtggatcaggttctgccatgga

SEQ ID NO: 539876 - DNA, 25 bp, Mus musculus
gcagtggatggcaccaacttttaaa

SEQ ID NO: 539877 - DNA, 25 bp, Mus musculus
gcagtggatggctccaacttttaaa

SEQ ID NO: 539878 - DNA, 25 bp, Mus musculus
gcagtggcagcaaaggcttcagctc

SEQ ID NO: 539879 - DNA, 25 bp, Mus musculus
gcagtggcagcataggcttcagctc

SEQ ID NO: 539880 - DNA, 25 bp, Mus musculus
gcagtggcagccaggtgtccatgca

SEQ ID NO: 539881 - DNA, 25 bp, Mus musculus
gcagtggcagccatggagttcaccc

SEQ ID NO: 539882 - DNA, 25 bp, Mus musculus
gcagtggcagcctggtgtccatgca

SEQ ID NO: 539883 - DNA, 25 bp, Mus musculus
gcagtggcagccttggagttcaccc

SEQ ID NO: 539884 - DNA, 25 bp, Mus musculus
gcagtggcagctatgtccaaggaca

SEQ ID NO: 539885 - DNA, 25 bp, Mus musculus
gcagtggcagctttgtccaaggaca

SEQ ID NO: 539886 - DNA, 25 bp, Mus musculus
gcagtggcaggacaccaatcagctt

SEQ ID NO: 539887 - DNA, 25 bp, Mus musculus
gcagtggcaggacgttctaattaca

SEQ ID NO: 539888 - DNA, 25 bp, Mus musculus
gcagtggcaggagaccaatcagctt

SEQ ID NO: 539889 - DNA, 25 bp, Mus musculus
gcagtggcaggaggttctaattaca

SEQ ID NO: 539890 - DNA, 25 bp, Mus musculus
gcagtggcatggcaggccctaaaaa

SEQ ID NO: 539891 - DNA, 25 bp, Mus musculus
gcagtggcatgggaggccctaaaaa

SEQ ID NO: 539892 - DNA, 25 bp, Mus musculus
gcagtggcccttcgccatgtgtgac

SEQ ID NO: 539893 - DNA, 25 bp, Mus musculus
gcagtggcccttggccatgtgtgac

SEQ ID NO: 539894 - DNA, 25 bp, Mus musculus
gcagtggccgctatgtgaacaggat

SEQ ID NO: 539895 - DNA, 25 bp, Mus musculus
gcagtggccgctttgtgaacaggat

SEQ ID NO: 539896 - DNA, 25 bp, Mus musculus
gcagtggcctcaacagtctgccagg

SEQ ID NO: 539897 - DNA, 25 bp, Mus musculus
gcagtggcctcactgaacaaagcct

SEQ ID NO: 539898 - DNA, 25 bp, Mus musculus
gcagtggcctcagtgaacaaagcct

SEQ ID NO: 539899 - DNA, 25 bp, Mus musculus
gcagtggcctcatcagtctgccagg

SEQ ID NO: 539900 - DNA, 25 bp, Mus musculus
gcagtggcctgacaatgtgatacct

SEQ ID NO: 539901 - DNA, 25 bp, Mus musculus
gcagtggcctgagaatgtgatacct

SEQ ID NO: 539902 - DNA, 25 bp, Mus musculus
gcagtggcctgtatggacagtacct

SEQ ID NO: 539903 - DNA, 25 bp, Mus musculus
gcagtggcctgtttggacagtacct

SEQ ID NO: 539904 - DNA, 25 bp, Mus musculus
gcagtggcgccactggcattatgat

SEQ ID NO: 539905 - DNA, 25 bp, Mus musculus
gcagtggcgccagtggcattatgat

SEQ ID NO: 539906 - DNA, 25 bp, Mus musculus
gcagtggcggctaagtctcctcgct

SEQ ID NO: 539907 - DNA, 25 bp, Mus musculus
gcagtggcggcttagtctcctcgct

SEQ ID NO: 539908 - DNA, 25 bp, Mus musculus
gcagtggctaggcagatacacctaa

SEQ ID NO: 539909 - DNA, 25 bp, Mus musculus
gcagtggctagggagatacacctaa

SEQ ID NO: 539910 - DNA, 25 bp, Mus musculus
gcagtggctggaaatcagcagcaac

SEQ ID NO: 539911 - DNA, 25 bp, Mus musculus
gcagtggctggaagtaaagcgccca

SEQ ID NO: 539912 - DNA, 25 bp, Mus musculus
gcagtggctggatatcagcagcaac

SEQ ID NO: 539913 - DNA, 25 bp, Mus musculus
gcagtggctggatgtaaagcgccca

SEQ ID NO: 539914 - DNA, 25 bp, Mus musculus
gcagtggctggcatggtgctcacca

SEQ ID NO: 539915 - DNA, 25 bp, Mus musculus
gcagtggctggcttggtgctcacca

SEQ ID NO: 539916 - DNA, 25 bp, Mus musculus
gcagtggcttttctgtttcactcac

SEQ ID NO: 539917 - DNA, 25 bp, Mus musculus
gcagtggcttttgtgtttcactcac

SEQ ID NO: 539918 - DNA, 25 bp, Mus musculus
gcagtgggaattaatgccatgtaaa

SEQ ID NO: 539919 - DNA, 25 bp, Mus musculus
gcagtgggaatttatgccatgtaaa

SEQ ID NO: 539920 - DNA, 25 bp, Mus musculus
gcagtgggacttccacacagtggta

SEQ ID NO: 539921 - DNA, 25 bp, Mus musculus
gcagtgggacttgcacacagtggta

SEQ ID NO: 539922 - DNA, 25 bp, Mus musculus
gcagtgggatctatgttttcaggcc

SEQ ID NO: 539923 - DNA, 25 bp, Mus musculus
gcagtgggatctttgttttcaggcc

SEQ ID NO: 539924 - DNA, 25 bp, Mus musculus
gcagtgggcagtacattgccattac

SEQ ID NO: 539925 - DNA, 25 bp, Mus musculus
gcagtgggcagttcattgccattac

SEQ ID NO: 539926 - DNA, 25 bp, Mus musculus
gcagtgggcatgcaaagcttactct

SEQ ID NO: 539927 - DNA, 25 bp, Mus musculus
gcagtgggcatggaaagcttactct

SEQ ID NO: 539928 - DNA, 25 bp, Mus musculus
gcagtgggcgttaattggcatctgt

SEQ ID NO: 539929 - DNA, 25 bp, Mus musculus
gcagtgggcgtttattggcatctgt

SEQ ID NO: 539930 - DNA, 25 bp, Mus musculus
gcagtgggtcagcagcttccagaat

SEQ ID NO: 539931 - DNA, 25 bp, Mus musculus
gcagtgggtcaggagcttccagaat

SEQ ID NO: 539932 - DNA, 25 bp, Mus musculus
gcagtgggtccacttatcagcagag

SEQ ID NO: 539933 - DNA, 25 bp, Mus musculus
gcagtgggtccagttatcagcagag

SEQ ID NO: 539934 - DNA, 25 bp, Mus musculus
gcagtgggtcctccccgtgaagaaa

SEQ ID NO: 539935 - DNA, 25 bp, Mus musculus
gcagtgggtcctgcccgtgaagaaa

SEQ ID NO: 539936 - DNA, 25 bp, Mus musculus
gcagtgggtgctattaactattaag

SEQ ID NO: 539937 - DNA, 25 bp, Mus musculus
gcagtgggtgcttttaactattaag

SEQ ID NO: 539938 - DNA, 25 bp, Mus musculus
gcagtgggtgttatcatgggataca

SEQ ID NO: 539939 - DNA, 25 bp, Mus musculus
gcagtgggtgttttcatgggataca

SEQ ID NO: 539940 - DNA, 25 bp, Mus musculus
gcagtggtaattcggagaaatgggt

SEQ ID NO: 539941 - DNA, 25 bp, Mus musculus
gcagtggtaattgggagaaatgggt

SEQ ID NO: 539942 - DNA, 25 bp, Mus musculus
gcagtggtaccaagcgggcacttat

SEQ ID NO: 539943 - DNA, 25 bp, Mus musculus
gcagtggtaccatgcgggcacttat

SEQ ID NO: 539944 - DNA, 25 bp, Mus musculus
gcagtggtagcacactccttcagtc

SEQ ID NO: 539945 - DNA, 25 bp, Mus musculus
gcagtggtagcagactccttcagtc

SEQ ID NO: 539946 - DNA, 25 bp, Mus musculus
gcagtggtcataattacatttttcc

SEQ ID NO: 539947 - DNA, 25 bp, Mus musculus
gcagtggtcatatttacatttttcc

SEQ ID NO: 539948 - DNA, 25 bp, Mus musculus
gcagtggtcatgaggccagctgaaa

SEQ ID NO: 539949 - DNA, 25 bp, Mus musculus
gcagtggtcatgtggccagctgaaa

SEQ ID NO: 539950 - DNA, 25 bp, Mus musculus
gcagtggtctgcattctactttttg

SEQ ID NO: 539951 - DNA, 25 bp, Mus musculus
gcagtggtctgctttctactttttg

SEQ ID NO: 539952 - DNA, 25 bp, Mus musculus
gcagtggtctttagtggtgctccct

SEQ ID NO: 539953 - DNA, 25 bp, Mus musculus
gcagtggtctttatggcagaacaat

SEQ ID NO: 539954 - DNA, 25 bp, Mus musculus
gcagtggtcttttgtggtgctccct

SEQ ID NO: 539955 - DNA, 25 bp, Mus musculus
gcagtggtctttttggcagaacaat

SEQ ID NO: 539956 - DNA, 25 bp, Mus musculus
gcagtggtgactacttgctagaatt

SEQ ID NO: 539957 - DNA, 25 bp, Mus musculus
gcagtggtgacttcttgctagaatt

SEQ ID NO: 539958 - DNA, 25 bp, Mus musculus
gcagtggtgcagatcttgaagagta

SEQ ID NO: 539959 - DNA, 25 bp, Mus musculus
gcagtggtgcagttcttgaagagta

SEQ ID NO: 539960 - DNA, 25 bp, Mus musculus
gcagtggtgcgtacgcccagtagat

SEQ ID NO: 539961 - DNA, 25 bp, Mus musculus
gcagtggtgcgttcgcccagtagat

SEQ ID NO: 539962 - DNA, 25 bp, Mus musculus
gcagtggtggcccattcctatgatc

SEQ ID NO: 539963 - DNA, 25 bp, Mus musculus
gcagtggtggccgattcctatgatc

SEQ ID NO: 539964 - DNA, 25 bp, Mus musculus
gcagtggtgtgaatgtacaatactt

SEQ ID NO: 539965 - DNA, 25 bp, Mus musculus
gcagtggtgtgaccagctgaactac

SEQ ID NO: 539966 - DNA, 25 bp, Mus musculus
gcagtggtgtgagcagctgaactac

SEQ ID NO: 539967 - DNA, 25 bp, Mus musculus
gcagtggtgtgattgtacaatactt

SEQ ID NO: 539968 - DNA, 25 bp, Mus musculus
gcagtggttcatcagccaagctgag

SEQ ID NO: 539969 - DNA, 25 bp, Mus musculus
gcagtggttcatgagccaagctgag

SEQ ID NO: 539970 - DNA, 25 bp, Mus musculus
gcagtggttgaaagccatgccagca

SEQ ID NO: 539971 - DNA, 25 bp, Mus musculus
gcagtggttgaatgccatgccagca

SEQ ID NO: 539972 - DNA, 25 bp, Mus musculus
gcagtggttgtgactcgtgtgccca

SEQ ID NO: 539973 - DNA, 25 bp, Mus musculus
gcagtggttgtgtctcgtgtgccca

SEQ ID NO: 539974 - DNA, 25 bp, Mus musculus
gcagtggtttccatagataactaca

SEQ ID NO: 539975 - DNA, 25 bp, Mus musculus
gcagtggtttccttagataactaca

SEQ ID NO: 539976 - DNA, 25 bp, Mus musculus
gcagtgtaacaaccgtggctgctgc

SEQ ID NO: 539977 - DNA, 25 bp, Mus musculus
gcagtgtaacaagcgtggctgctgc

SEQ ID NO: 539978 - DNA, 25 bp, Mus musculus
gcagtgtaacacacgcccatttgat

SEQ ID NO: 539979 - DNA, 25 bp, Mus musculus
gcagtgtaacactcgcccatttgat

SEQ ID NO: 539980 - DNA, 25 bp, Mus musculus
gcagtgtaacctacatcttggatgt

SEQ ID NO: 539981 - DNA, 25 bp, Mus musculus
gcagtgtaaccttcatcttggatgt

SEQ ID NO: 539982 - DNA, 25 bp, Mus musculus
gcagtgtaactgattcatgcaggct

SEQ ID NO: 539983 - DNA, 25 bp, Mus musculus
gcagtgtaactgtttcatgcaggct

SEQ ID NO: 539984 - DNA, 25 bp, Mus musculus
gcagtgtaatgacgttcctagcaca

SEQ ID NO: 539985 - DNA, 25 bp, Mus musculus
gcagtgtaatgaggttcctagcaca

SEQ ID NO: 539986 - DNA, 25 bp, Mus musculus
gcagtgtactgacatggatccattt

SEQ ID NO: 539987 - DNA, 25 bp, Mus musculus
gcagtgtactgagatggatccattt

SEQ ID NO: 539988 - DNA, 25 bp, Mus musculus
gcagtgtagcttcaaattctattgt

SEQ ID NO: 539989 - DNA, 25 bp, Mus musculus
gcagtgtagcttgaaattctattgt

SEQ ID NO: 539990 - DNA, 25 bp, Mus musculus
gcagtgtatctgatgtagcagctct

SEQ ID NO: 539991 - DNA, 25 bp, Mus musculus
gcagtgtatctgttgtagcagctct

SEQ ID NO: 539992 - DNA, 25 bp, Mus musculus
gcagtgtatcttaacaacagtttct

SEQ ID NO: 539993 - DNA, 25 bp, Mus musculus
gcagtgtatctttacaacagtttct

SEQ ID NO: 539994 - DNA, 25 bp, Mus musculus
gcagtgtatgctactcctgaaaata

SEQ ID NO: 539995 - DNA, 25 bp, Mus musculus
gcagtgtatgcttctcctgaaaata

SEQ ID NO: 539996 - DNA, 25 bp, Mus musculus
gcagtgtcactgcatcgtggtcaaa

SEQ ID NO: 539997 - DNA, 25 bp, Mus musculus
gcagtgtcactggatcgtggtcaaa

SEQ ID NO: 539998 - DNA, 25 bp, Mus musculus
gcagtgtcatagcaataaaatgtga

SEQ ID NO: 539999 - DNA, 25 bp, Mus musculus
gcagtgtcataggaataaaatgtga

SEQ ID NO: 540000 - DNA, 25 bp, Mus musculus
gcagtgtccaatcccagcaggagga

SEQ ID NO: 540001 - DNA, 25 bp, Mus musculus
gcagtgtccaatgccagcaggagga

SEQ ID NO: 540002 - DNA, 25 bp, Mus musculus
gcagtgtccctgagatcacgtcaag

SEQ ID NO: 540003 - DNA, 25 bp, Mus musculus
gcagtgtccctgtgatcacgtcaag

SEQ ID NO: 540004 - DNA, 25 bp, Mus musculus
gcagtgtccggaaagcttgtgtctt

SEQ ID NO: 540005 - DNA, 25 bp, Mus musculus
gcagtgtccggatagcttgtgtctt

SEQ ID NO: 540006 - DNA, 25 bp, Mus musculus
gcagtgtcctttcctttggtcctga

SEQ ID NO: 540007 - DNA, 25 bp, Mus musculus
gcagtgtcctttgctttggtcctga

SEQ ID NO: 540008 - DNA, 25 bp, Mus musculus
gcagtgtctaccatcttggtattac

SEQ ID NO: 540009 - DNA, 25 bp, Mus musculus
gcagtgtctaccttcttggtattac

SEQ ID NO: 540010 - DNA, 25 bp, Mus musculus
gcagtgtctcagcttgcctaggctg

SEQ ID NO: 540011 - DNA, 25 bp, Mus musculus
gcagtgtctcaggttgcctaggctg

SEQ ID NO: 540012 - DNA, 25 bp, Mus musculus
gcagtgtctgccctgggtttccttt

SEQ ID NO: 540013 - DNA, 25 bp, Mus musculus
gcagtgtctgccgtgggtttccttt

SEQ ID NO: 540014 - DNA, 25 bp, Mus musculus
gcagtgtcttaactcctgtcaggag

SEQ ID NO: 540015 - DNA, 25 bp, Mus musculus
gcagtgtcttaagtcctgtcaggag

SEQ ID NO: 540016 - DNA, 25 bp, Mus musculus
gcagtgtcttataaccagagatcct

SEQ ID NO: 540017 - DNA, 25 bp, Mus musculus
gcagtgtcttattaccagagatcct

SEQ ID NO: 540018 - DNA, 25 bp, Mus musculus
gcagtgtgacacacaagtcctggtc

SEQ ID NO: 540019 - DNA, 25 bp, Mus musculus
gcagtgtgacactcaagtcctggtc

SEQ ID NO: 540020 - DNA, 25 bp, Mus musculus
gcagtgtgagacataacgtatttct

SEQ ID NO: 540021 - DNA, 25 bp, Mus musculus
gcagtgtgagacttaacgtatttct

SEQ ID NO: 540022 - DNA, 25 bp, Mus musculus
gcagtgtgagtcattgaaggtttcc

SEQ ID NO: 540023 - DNA, 25 bp, Mus musculus
gcagtgtgagtctttgaaggtttcc

SEQ ID NO: 540024 - DNA, 25 bp, Mus musculus
gcagtgtgagtgatctctgaggaaa

SEQ ID NO: 540025 - DNA, 25 bp, Mus musculus
gcagtgtgagtgttctctgaggaaa

SEQ ID NO: 540026 - DNA, 25 bp, Mus musculus
gcagtgtgatccaggagtccgccag

SEQ ID NO: 540027 - DNA, 25 bp, Mus musculus
gcagtgtgatcctggagtccgccag

SEQ ID NO: 540028 - DNA, 25 bp, Mus musculus
gcagtgtgatgaagctcctccggat

SEQ ID NO: 540029 - DNA, 25 bp, Mus musculus
gcagtgtgatgatgctcctccggat

SEQ ID NO: 540030 - DNA, 25 bp, Mus musculus
gcagtgtgatggaagcctcaggcac

SEQ ID NO: 540031 - DNA, 25 bp, Mus musculus
gcagtgtgatggtagcctcaggcac

SEQ ID NO: 540032 - DNA, 25 bp, Mus musculus
gcagtgtgatttcttcccaggccct

SEQ ID NO: 540033 - DNA, 25 bp, Mus musculus
gcagtgtgatttgttcccaggccct

SEQ ID NO: 540034 - DNA, 25 bp, Mus musculus
gcagtgtgcaaacgaggtatgataa

SEQ ID NO: 540035 - DNA, 25 bp, Mus musculus
gcagtgtgcaaaggaggtatgataa

SEQ ID NO: 540036 - DNA, 25 bp, Mus musculus
gcagtgtgcactagtaattccagta

SEQ ID NO: 540037 - DNA, 25 bp, Mus musculus
gcagtgtgcacttgtaattccagta

SEQ ID NO: 540038 - DNA, 25 bp, Mus musculus
gcagtgtgcctgcagacatagtgtt

SEQ ID NO: 540039 - DNA, 25 bp, Mus musculus
gcagtgtgcctggagacatagtgtt

SEQ ID NO: 540040 - DNA, 25 bp, Mus musculus
gcagtgtgctcactccaagggcaga

SEQ ID NO: 540041 - DNA, 25 bp, Mus musculus
gcagtgtgctcagtccaagggcaga

SEQ ID NO: 540042 - DNA, 25 bp, Mus musculus
gcagtgtggcacatactctgtccct

SEQ ID NO: 540043 - DNA, 25 bp, Mus musculus
gcagtgtggcacttactctgtccct

SEQ ID NO: 540044 - DNA, 25 bp, Mus musculus
gcagtgtggcataagacccaaggtt

SEQ ID NO: 540045 - DNA, 25 bp, Mus musculus
gcagtgtggcattagacccaaggtt

SEQ ID NO: 540046 - DNA, 25 bp, Mus musculus
gcagtgtggtacaagtctctttgac

SEQ ID NO: 540047 - DNA, 25 bp, Mus musculus
gcagtgtggtactagtctctttgac

SEQ ID NO: 540048 - DNA, 25 bp, Mus musculus
gcagtgtggtgaccactcggactta

SEQ ID NO: 540049 - DNA, 25 bp, Mus musculus
gcagtgtggtgagcactcggactta

SEQ ID NO: 540050 - DNA, 25 bp, Mus musculus
gcagtgtgtataactaccagtgttt

SEQ ID NO: 540051 - DNA, 25 bp, Mus musculus
gcagtgtgtatatctaccagtgttt

SEQ ID NO: 540052 - DNA, 25 bp, Mus musculus
gcagtgtgtatcactaaagaacgtt

SEQ ID NO: 540053 - DNA, 25 bp, Mus musculus
gcagtgtgtatctctaaagaacgtt

SEQ ID NO: 540054 - DNA, 25 bp, Mus musculus
gcagtgtgtgcacgacagccttcaa

SEQ ID NO: 540055 - DNA, 25 bp, Mus musculus
gcagtgtgtgcaggacagccttcaa

SEQ ID NO: 540056 - DNA, 25 bp, Mus musculus
gcagtgttattaactcttgtcagct

SEQ ID NO: 540057 - DNA, 25 bp, Mus musculus
gcagtgttattatctcttgtcagct

SEQ ID NO: 540058 - DNA, 25 bp, Mus musculus
gcagtgttcccaactcaaagcaaaa

SEQ ID NO: 540059 - DNA, 25 bp, Mus musculus
gcagtgttcccatctcaaagcaaaa

SEQ ID NO: 540060 - DNA, 25 bp, Mus musculus
gcagtgttctatatgcagatatcta

SEQ ID NO: 540061 - DNA, 25 bp, Mus musculus
gcagtgttctatttgcagatatcta

SEQ ID NO: 540062 - DNA, 25 bp, Mus musculus
gcagtgttcttgctgcttttgctca

SEQ ID NO: 540063 - DNA, 25 bp, Mus musculus
gcagtgttcttggtgcttttgctca

SEQ ID NO: 540064 - DNA, 25 bp, Mus musculus
gcagtgttctttagcttgaagtata

SEQ ID NO: 540065 - DNA, 25 bp, Mus musculus
gcagtgttcttttgcttgaagtata

SEQ ID NO: 540066 - DNA, 25 bp, Mus musculus
gcagtgttgaaacgtgtccacagcc

SEQ ID NO: 540067 - DNA, 25 bp, Mus musculus
gcagtgttgaaaggtgtccacagcc

SEQ ID NO: 540068 - DNA, 25 bp, Mus musculus
gcagtgttgacaagcctggctttca

SEQ ID NO: 540069 - DNA, 25 bp, Mus musculus
gcagtgttgacatgcctggctttca

SEQ ID NO: 540070 - DNA, 25 bp, Mus musculus
gcagtgttgatcagtttgatgtctg

SEQ ID NO: 540071 - DNA, 25 bp, Mus musculus
gcagtgttgatctgtttgatgtctg

SEQ ID NO: 540072 - DNA, 25 bp, Mus musculus
gcagtgttggctatccgtgtagcaa

SEQ ID NO: 540073 - DNA, 25 bp, Mus musculus
gcagtgttggctttccgtgtagcaa

SEQ ID NO: 540074 - DNA, 25 bp, Mus musculus
gcagtgttgtataaatcccgccagc

SEQ ID NO: 540075 - DNA, 25 bp, Mus musculus
gcagtgttgtattaatcccgccagc

SEQ ID NO: 540076 - DNA, 25 bp, Mus musculus
gcagtgttgtcaaagcatttgggag

SEQ ID NO: 540077 - DNA, 25 bp, Mus musculus
gcagtgttgtcatagcatttgggag

SEQ ID NO: 540078 - DNA, 25 bp, Mus musculus
gcagtgtttactagagcgggtttat

SEQ ID NO: 540079 - DNA, 25 bp, Mus musculus
gcagtgtttacttgagcgggtttat

SEQ ID NO: 540080 - DNA, 25 bp, Mus musculus
gcagtgtttcaaaatatttcaagga

SEQ ID NO: 540081 - DNA, 25 bp, Mus musculus
gcagtgtttcaatatatttcaagga

SEQ ID NO: 540082 - DNA, 25 bp, Mus musculus
gcagtgtttctaatacttctttgtt

SEQ ID NO: 540083 - DNA, 25 bp, Mus musculus
gcagtgtttctattacttctttgtt

SEQ ID NO: 540084 - DNA, 25 bp, Mus musculus
gcagtgtttgtgattgctgaaaaca

SEQ ID NO: 540085 - DNA, 25 bp, Mus musculus
gcagtgtttgtgtttgctgaaaaca

SEQ ID NO: 540086 - DNA, 25 bp, Mus musculus
gcagtgttttccagtctccatgtgc

SEQ ID NO: 540087 - DNA, 25 bp, Mus musculus
gcagtgttttcctgtctccatgtgc

SEQ ID NO: 540088 - DNA, 25 bp, Mus musculus
gcagtgtttttcaatcagttttgtc

SEQ ID NO: 540089 - DNA, 25 bp, Mus musculus
gcagtgtttttctatcagttttgtc

SEQ ID NO: 540090 - DNA, 25 bp, Mus musculus
gcagttaaacacagtagaccaagaa

SEQ ID NO: 540091 - DNA, 25 bp, Mus musculus
gcagttaaacactgtagaccaagaa

SEQ ID NO: 540092 - DNA, 25 bp, Mus musculus
gcagttaacagtcagaaggatggct

SEQ ID NO: 540093 - DNA, 25 bp, Mus musculus
gcagttaacagtgagaaggatggct

SEQ ID NO: 540094 - DNA, 25 bp, Mus musculus
gcagttaacgtgatttttatgccat

SEQ ID NO: 540095 - DNA, 25 bp, Mus musculus
gcagttaacgtgttttttatgccat

SEQ ID NO: 540096 - DNA, 25 bp, Mus musculus
gcagttaagaacactcttctggaag

SEQ ID NO: 540097 - DNA, 25 bp, Mus musculus
gcagttaagaactctcttctggaag

SEQ ID NO: 540098 - DNA, 25 bp, Mus musculus
gcagttaagctgctgaacgctctga

SEQ ID NO: 540099 - DNA, 25 bp, Mus musculus
gcagttaagctggtgaacgctctga

SEQ ID NO: 540100 - DNA, 25 bp, Mus musculus
gcagttaagtgcaagttgctctcac

SEQ ID NO: 540101 - DNA, 25 bp, Mus musculus
gcagttaagtgctagttgctctcac

SEQ ID NO: 540102 - DNA, 25 bp, Mus musculus
gcagttacaacactaccaaaccacc

SEQ ID NO: 540103 - DNA, 25 bp, Mus musculus
gcagttacaacagtaccaaaccacc

SEQ ID NO: 540104 - DNA, 25 bp, Mus musculus
gcagttacactaccactattagaga

SEQ ID NO: 540105 - DNA, 25 bp, Mus musculus
gcagttacactagcactattagaga

SEQ ID NO: 540106 - DNA, 25 bp, Mus musculus
gcagttacagatatcttctaggttt

SEQ ID NO: 540107 - DNA, 25 bp, Mus musculus
gcagttacagatttcttctaggttt

SEQ ID NO: 540108 - DNA, 25 bp, Mus musculus
gcagttacagcaatgaaagatggat

SEQ ID NO: 540109 - DNA, 25 bp, Mus musculus
gcagttacagcattgaaagatggat

SEQ ID NO: 540110 - DNA, 25 bp, Mus musculus
gcagttacagctcccaggtcactca

SEQ ID NO: 540111 - DNA, 25 bp, Mus musculus
gcagttacagctgccaggtcactca

SEQ ID NO: 540112 - DNA, 25 bp, Mus musculus
gcagttacagtcatacaaatggttc

SEQ ID NO: 540113 - DNA, 25 bp, Mus musculus
gcagttacagtcttacaaatggttc

SEQ ID NO: 540114 - DNA, 25 bp, Mus musculus
gcagttacccacatagttgctgtta

SEQ ID NO: 540115 - DNA, 25 bp, Mus musculus
gcagttacccacttagttgctgtta

SEQ ID NO: 540116 - DNA, 25 bp, Mus musculus
gcagttaccggcagctgacaaggta

SEQ ID NO: 540117 - DNA, 25 bp, Mus musculus
gcagttaccggctgctgacaaggta

SEQ ID NO: 540118 - DNA, 25 bp, Mus musculus
gcagttacgctgagatatccatatt

SEQ ID NO: 540119 - DNA, 25 bp, Mus musculus
gcagttacgctgtgatatccatatt

SEQ ID NO: 540120 - DNA, 25 bp, Mus musculus
gcagttactttgagaatcatgcagt

SEQ ID NO: 540121 - DNA, 25 bp, Mus musculus
gcagttactttgtgaatcatgcagt

SEQ ID NO: 540122 - DNA, 25 bp, Mus musculus
gcagttacttttacaatttcttagc

SEQ ID NO: 540123 - DNA, 25 bp, Mus musculus
gcagttactttttcaatttcttagc

SEQ ID NO: 540124 - DNA, 25 bp, Mus musculus
gcagttagaataatcctctcttctt

SEQ ID NO: 540125 - DNA, 25 bp, Mus musculus
gcagttagaatattcctctcttctt

SEQ ID NO: 540126 - DNA, 25 bp, Mus musculus
gcagttagagcaccgatgtcttcgt

SEQ ID NO: 540127 - DNA, 25 bp, Mus musculus
gcagttagagcagcgatgtcttcgt

SEQ ID NO: 540128 - DNA, 25 bp, Mus musculus
gcagttagaggtcaatgccacactt

SEQ ID NO: 540129 - DNA, 25 bp, Mus musculus
gcagttagaggtgaatgccacactt

SEQ ID NO: 540130 - DNA, 25 bp, Mus musculus
gcagttagccctagaacaacttcat

SEQ ID NO: 540131 - DNA, 25 bp, Mus musculus
gcagttagcccttgaacaacttcat

SEQ ID NO: 540132 - DNA, 25 bp, Mus musculus
gcagttagctttcatgaccctactc

SEQ ID NO: 540133 - DNA, 25 bp, Mus musculus
gcagttagctttgatgaccctactc

SEQ ID NO: 540134 - DNA, 25 bp, Mus musculus
gcagttaggagcattcgttctttca

SEQ ID NO: 540135 - DNA, 25 bp, Mus musculus
gcagttaggagctttcgttctttca

SEQ ID NO: 540136 - DNA, 25 bp, Mus musculus
gcagttaggaggcaagagcctcact

SEQ ID NO: 540137 - DNA, 25 bp, Mus musculus
gcagttaggagggaagagcctcact

SEQ ID NO: 540138 - DNA, 25 bp, Mus musculus
gcagttagtttgagcctggtctgat

SEQ ID NO: 540139 - DNA, 25 bp, Mus musculus
gcagttagtttgtgcctggtctgat

SEQ ID NO: 540140 - DNA, 25 bp, Mus musculus
gcagttatattccaccacgggcatc

SEQ ID NO: 540141 - DNA, 25 bp, Mus musculus
gcagttatattcgaccacgggcatc

SEQ ID NO: 540142 - DNA, 25 bp, Mus musculus
gcagttatcgttatggtcgtcttga

SEQ ID NO: 540143 - DNA, 25 bp, Mus musculus
gcagttatcgttttggtcgtcttga

SEQ ID NO: 540144 - DNA, 25 bp, Mus musculus
gcagttatgactatgtctctcactc

SEQ ID NO: 540145 - DNA, 25 bp, Mus musculus
gcagttatgactttgtctctcactc

SEQ ID NO: 540146 - DNA, 25 bp, Mus musculus
gcagttatgagccacctgatatgtt

SEQ ID NO: 540147 - DNA, 25 bp, Mus musculus
gcagttatgagcgacctgatatgtt

SEQ ID NO: 540148 - DNA, 25 bp, Mus musculus
gcagttatgatcacttgtgctgttg

SEQ ID NO: 540149 - DNA, 25 bp, Mus musculus
gcagttatgatctcttgtgctgttg

SEQ ID NO: 540150 - DNA, 25 bp, Mus musculus
gcagttatgggtcttccttctagca

SEQ ID NO: 540151 - DNA, 25 bp, Mus musculus
gcagttatgggtgttccttctagca

SEQ ID NO: 540152 - DNA, 25 bp, Mus musculus
gcagttatgtctacatttgctctct

SEQ ID NO: 540153 - DNA, 25 bp, Mus musculus
gcagttatgtcttcatttgctctct

SEQ ID NO: 540154 - DNA, 25 bp, Mus musculus
gcagttatgtgacacctaaaggtac

SEQ ID NO: 540155 - DNA, 25 bp, Mus musculus
gcagttatgtgagacctaaaggtac

SEQ ID NO: 540156 - DNA, 25 bp, Mus musculus
gcagttattgtgaatacttctggga

SEQ ID NO: 540157 - DNA, 25 bp, Mus musculus
gcagttattgtgatgtagatggctc

SEQ ID NO: 540158 - DNA, 25 bp, Mus musculus
gcagttattgtgtatacttctggga

SEQ ID NO: 540159 - DNA, 25 bp, Mus musculus
gcagttattgtgttgtagatggctc

SEQ ID NO: 540160 - DNA, 25 bp, Mus musculus
gcagttattgttatggatcgctcga

SEQ ID NO: 540161 - DNA, 25 bp, Mus musculus
gcagttattgttttggatcgctcga

SEQ ID NO: 540162 - DNA, 25 bp, Mus musculus
gcagttcaactaatattgtgccaaa

SEQ ID NO: 540163 - DNA, 25 bp, Mus musculus
gcagttcaactattattgtgccaaa

SEQ ID NO: 540164 - DNA, 25 bp, Mus musculus
gcagttcaagaaccttctgctcttc

SEQ ID NO: 540165 - DNA, 25 bp, Mus musculus
gcagttcaagaagcttctgctcttc

SEQ ID NO: 540166 - DNA, 25 bp, Mus musculus
gcagttcaaggacttccagcgacga

SEQ ID NO: 540167 - DNA, 25 bp, Mus musculus
gcagttcaaggagttccagcgacga

SEQ ID NO: 540168 - DNA, 25 bp, Mus musculus
gcagttcaattgcatcccatttcca

SEQ ID NO: 540169 - DNA, 25 bp, Mus musculus
gcagttcaattggatcccatttcca

SEQ ID NO: 540170 - DNA, 25 bp, Mus musculus
gcagttcacaacacacagttcacaa

SEQ ID NO: 540171 - DNA, 25 bp, Mus musculus
gcagttcacaactcacagttcacaa

SEQ ID NO: 540172 - DNA, 25 bp, Mus musculus
gcagttcacacacgacagggacctt

SEQ ID NO: 540173 - DNA, 25 bp, Mus musculus
gcagttcacacaggacagggacctt

SEQ ID NO: 540174 - DNA, 25 bp, Mus musculus
gcagttcacataccacttactgttt

SEQ ID NO: 540175 - DNA, 25 bp, Mus musculus
gcagttcacatagcacttactgttt

SEQ ID NO: 540176 - DNA, 25 bp, Mus musculus
gcagttcaccatcctgtgcaacagg

SEQ ID NO: 540177 - DNA, 25 bp, Mus musculus
gcagttcaccatgctgtgcaacagg

SEQ ID NO: 540178 - DNA, 25 bp, Mus musculus
gcagttcactttattccctgggttt

SEQ ID NO: 540179 - DNA, 25 bp, Mus musculus
gcagttcactttattgtgagtcttt

SEQ ID NO: 540180 - DNA, 25 bp, Mus musculus
gcagttcacttttttccctgggttt

SEQ ID NO: 540181 - DNA, 25 bp, Mus musculus
gcagttcacttttttgtgagtcttt

SEQ ID NO: 540182 - DNA, 25 bp, Mus musculus
gcagttcagactctgttcacaggat

SEQ ID NO: 540183 - DNA, 25 bp, Mus musculus
gcagttcagactgtgttcacaggat

SEQ ID NO: 540184 - DNA, 25 bp, Mus musculus
gcagttcagtttcgttgtttgtaaa

SEQ ID NO: 540185 - DNA, 25 bp, Mus musculus
gcagttcagtttggttgtttgtaaa

SEQ ID NO: 540186 - DNA, 25 bp, Mus musculus
gcagttcatattcattattggctat

SEQ ID NO: 540187 - DNA, 25 bp, Mus musculus
gcagttcatattgattattggctat

SEQ ID NO: 540188 - DNA, 25 bp, Mus musculus
gcagttcatcacatggtcctcagaa

SEQ ID NO: 540189 - DNA, 25 bp, Mus musculus
gcagttcatcacttggtcctcagaa

SEQ ID NO: 540190 - DNA, 25 bp, Mus musculus
gcagttcattctctttatcccaggc

SEQ ID NO: 540191 - DNA, 25 bp, Mus musculus
gcagttcattctgtttatcccaggc

SEQ ID NO: 540192 - DNA, 25 bp, Mus musculus
gcagttccaaatatacattccacca

SEQ ID NO: 540193 - DNA, 25 bp, Mus musculus
gcagttccaaatttacattccacca

SEQ ID NO: 540194 - DNA, 25 bp, Mus musculus
gcagttccaactcggattttcagca

SEQ ID NO: 540195 - DNA, 25 bp, Mus musculus
gcagttccaactgggattttcagca

SEQ ID NO: 540196 - DNA, 25 bp, Mus musculus
gcagttccaagcatagacccaagat

SEQ ID NO: 540197 - DNA, 25 bp, Mus musculus
gcagttccaagcttagacccaagat

SEQ ID NO: 540198 - DNA, 25 bp, Mus musculus
gcagttccaccacggcaggtggtct

SEQ ID NO: 540199 - DNA, 25 bp, Mus musculus
gcagttccaccagggcaggtggtct

SEQ ID NO: 540200 - DNA, 25 bp, Mus musculus
gcagttccaggcatccaagtacgga

SEQ ID NO: 540201 - DNA, 25 bp, Mus musculus
gcagttccaggcattacattcgtta

SEQ ID NO: 540202 - DNA, 25 bp, Mus musculus
gcagttccaggcttccaagtacgga

SEQ ID NO: 540203 - DNA, 25 bp, Mus musculus
gcagttccaggctttacattcgtta

SEQ ID NO: 540204 - DNA, 25 bp, Mus musculus
gcagttccagttcgcgcgtgtaaaa

SEQ ID NO: 540205 - DNA, 25 bp, Mus musculus
gcagttccagttggcgcgtgtaaaa

SEQ ID NO: 540206 - DNA, 25 bp, Mus musculus
gcagttcccaatcagctcatagtct

SEQ ID NO: 540207 - DNA, 25 bp, Mus musculus
gcagttcccaatgagctcatagtct

SEQ ID NO: 540208 - DNA, 25 bp, Mus musculus
gcagttcccacgcaggcctgttgga

SEQ ID NO: 540209 - DNA, 25 bp, Mus musculus
gcagttcccacggaggcctgttgga

SEQ ID NO: 540210 - DNA, 25 bp, Mus musculus
gcagttcccataccaacccgtgttt

SEQ ID NO: 540211 - DNA, 25 bp, Mus musculus
gcagttcccatagcaacccgtgttt

SEQ ID NO: 540212 - DNA, 25 bp, Mus musculus
gcagttcccattacattgcaagtga

SEQ ID NO: 540213 - DNA, 25 bp, Mus musculus
gcagttcccatttcattgcaagtga

SEQ ID NO: 540214 - DNA, 25 bp, Mus musculus
gcagttcccgtgatggtttcaataa

SEQ ID NO: 540215 - DNA, 25 bp, Mus musculus
gcagttcccgtgttggtttcaataa

SEQ ID NO: 540216 - DNA, 25 bp, Mus musculus
gcagttccgagtccaggcagtgcaa

SEQ ID NO: 540217 - DNA, 25 bp, Mus musculus
gcagttccgagtgcaggcagtgcaa

SEQ ID NO: 540218 - DNA, 25 bp, Mus musculus
gcagttccgtgtctgtccgaaataa

SEQ ID NO: 540219 - DNA, 25 bp, Mus musculus
gcagttccgtgtgtgtccgaaataa

SEQ ID NO: 540220 - DNA, 25 bp, Mus musculus
gcagttcctccacaatctatgagtc

SEQ ID NO: 540221 - DNA, 25 bp, Mus musculus
gcagttcctccacgagagaatcaag

SEQ ID NO: 540222 - DNA, 25 bp, Mus musculus
gcagttcctccagaatctatgagtc

SEQ ID NO: 540223 - DNA, 25 bp, Mus musculus
gcagttcctccaggagagaatcaag

SEQ ID NO: 540224 - DNA, 25 bp, Mus musculus
gcagttcctctacatgggctttgat

SEQ ID NO: 540225 - DNA, 25 bp, Mus musculus
gcagttcctctagatgggctttgat

SEQ ID NO: 540226 - DNA, 25 bp, Mus musculus
gcagttcctgaaatactaccattat

SEQ ID NO: 540227 - DNA, 25 bp, Mus musculus
gcagttcctgaattactaccattat

SEQ ID NO: 540228 - DNA, 25 bp, Mus musculus
gcagttcctgacattatattatttg

SEQ ID NO: 540229 - DNA, 25 bp, Mus musculus
gcagttcctgactttatattatttg

SEQ ID NO: 540230 - DNA, 25 bp, Mus musculus
gcagttcctggactcctgagggtct

SEQ ID NO: 540231 - DNA, 25 bp, Mus musculus
gcagttcctggagtcctgagggtct

SEQ ID NO: 540232 - DNA, 25 bp, Mus musculus
gcagttccttgtatctactttcaga

SEQ ID NO: 540233 - DNA, 25 bp, Mus musculus
gcagttccttgtttctactttcaga

SEQ ID NO: 540234 - DNA, 25 bp, Mus musculus
gcagttcgaattagtgggctccgcc

SEQ ID NO: 540235 - DNA, 25 bp, Mus musculus
gcagttcgaatttgtgggctccgcc

SEQ ID NO: 540236 - DNA, 25 bp, Mus musculus
gcagttcgcatgatccagcgtggaa

SEQ ID NO: 540237 - DNA, 25 bp, Mus musculus
gcagttcgcatgttccagcgtggaa

SEQ ID NO: 540238 - DNA, 25 bp, Mus musculus
gcagttcggactattgatgcttcaa

SEQ ID NO: 540239 - DNA, 25 bp, Mus musculus
gcagttcggacttttgatgcttcaa

SEQ ID NO: 540240 - DNA, 25 bp, Mus musculus
gcagttctactgctctagctttatt

SEQ ID NO: 540241 - DNA, 25 bp, Mus musculus
gcagttctactggtctagctttatt

SEQ ID NO: 540242 - DNA, 25 bp, Mus musculus
gcagttctatctatttttccagtta

SEQ ID NO: 540243 - DNA, 25 bp, Mus musculus
gcagttctatctttttttccagtta

SEQ ID NO: 540244 - DNA, 25 bp, Mus musculus
gcagttctcagcagatggaatgaat

SEQ ID NO: 540245 - DNA, 25 bp, Mus musculus
gcagttctcagctgatggaatgaat

SEQ ID NO: 540246 - DNA, 25 bp, Mus musculus
gcagttctcagtcgtgaagtttcta

SEQ ID NO: 540247 - DNA, 25 bp, Mus musculus
gcagttctcagtggtgaagtttcta

SEQ ID NO: 540248 - DNA, 25 bp, Mus musculus
gcagttctcctaaatgatttctcaa

SEQ ID NO: 540249 - DNA, 25 bp, Mus musculus
gcagttctcctatatgatttctcaa

SEQ ID NO: 540250 - DNA, 25 bp, Mus musculus
gcagttctcctgagcaaaaagcaga

SEQ ID NO: 540251 - DNA, 25 bp, Mus musculus
gcagttctcctgtgcaaaaagcaga

SEQ ID NO: 540252 - DNA, 25 bp, Mus musculus
gcagttctctctcaggctgctttga

SEQ ID NO: 540253 - DNA, 25 bp, Mus musculus
gcagttctctctgaggctgctttga

SEQ ID NO: 540254 - DNA, 25 bp, Mus musculus
gcagttctctggatctagaatctgc

SEQ ID NO: 540255 - DNA, 25 bp, Mus musculus
gcagttctctggttctagaatctgc

SEQ ID NO: 540256 - DNA, 25 bp, Mus musculus
gcagttctgaagagcaggaccccaa

SEQ ID NO: 540257 - DNA, 25 bp, Mus musculus
gcagttctgaagtgcaggaccccaa

SEQ ID NO: 540258 - DNA, 25 bp, Mus musculus
gcagttctgcatcaataagttcttc

SEQ ID NO: 540259 - DNA, 25 bp, Mus musculus
gcagttctgcatgaataagttcttc

SEQ ID NO: 540260 - DNA, 25 bp, Mus musculus
gcagttctgcccatttaaatgtgac

SEQ ID NO: 540261 - DNA, 25 bp, Mus musculus
gcagttctgcccttttaaatgtgac

SEQ ID NO: 540262 - DNA, 25 bp, Mus musculus
gcagttctgctcacaggtcttttat

SEQ ID NO: 540263 - DNA, 25 bp, Mus musculus
gcagttctgctctcaggtcttttat

SEQ ID NO: 540264 - DNA, 25 bp, Mus musculus
gcagttctgggccttctccactggc

SEQ ID NO: 540265 - DNA, 25 bp, Mus musculus
gcagttctgggcgttctccactggc

SEQ ID NO: 540266 - DNA, 25 bp, Mus musculus
gcagttctgttgatgctctcaaagg

SEQ ID NO: 540267 - DNA, 25 bp, Mus musculus
gcagttctgttgttgctctcaaagg

SEQ ID NO: 540268 - DNA, 25 bp, Mus musculus
gcagttcttcccatgaatatttcat

SEQ ID NO: 540269 - DNA, 25 bp, Mus musculus
gcagttcttcccttgaatatttcat

SEQ ID NO: 540270 - DNA, 25 bp, Mus musculus
gcagttcttcggaccagggacacga

SEQ ID NO: 540271 - DNA, 25 bp, Mus musculus
gcagttcttcggtccagggacacga

SEQ ID NO: 540272 - DNA, 25 bp, Mus musculus
gcagttcttggcaaagcattctgac

SEQ ID NO: 540273 - DNA, 25 bp, Mus musculus
gcagttcttggcaacttgtgatcaa

SEQ ID NO: 540274 - DNA, 25 bp, Mus musculus
gcagttcttggctaagcattctgac

SEQ ID NO: 540275 - DNA, 25 bp, Mus musculus
gcagttcttggctacttgtgatcaa

SEQ ID NO: 540276 - DNA, 25 bp, Mus musculus
gcagttcttggtatacatcccaagg

SEQ ID NO: 540277 - DNA, 25 bp, Mus musculus
gcagttcttggtttacatcccaagg

SEQ ID NO: 540278 - DNA, 25 bp, Mus musculus
gcagttcttgtgcagttttggatgc

SEQ ID NO: 540279 - DNA, 25 bp, Mus musculus
gcagttcttgtggagttttggatgc

SEQ ID NO: 540280 - DNA, 25 bp, Mus musculus
gcagttctttttacaggtcttcata

SEQ ID NO: 540281 - DNA, 25 bp, Mus musculus
gcagttcttttttcaggtcttcata

SEQ ID NO: 540282 - DNA, 25 bp, Mus musculus
gcagttgaagcaccgttgcctaggt

SEQ ID NO: 540283 - DNA, 25 bp, Mus musculus
gcagttgaagcagcgttgcctaggt

SEQ ID NO: 540284 - DNA, 25 bp, Mus musculus
gcagttgaaggtactctcttctggt

SEQ ID NO: 540285 - DNA, 25 bp, Mus musculus
gcagttgaaggttctctcttctggt

SEQ ID NO: 540286 - DNA, 25 bp, Mus musculus
gcagttgaatccctctgaagcttat

SEQ ID NO: 540287 - DNA, 25 bp, Mus musculus
gcagttgaatccgtctgaagcttat

SEQ ID NO: 540288 - DNA, 25 bp, Mus musculus
gcagttgaatctcaaatactcattt

SEQ ID NO: 540289 - DNA, 25 bp, Mus musculus
gcagttgaatctgaaatactcattt

SEQ ID NO: 540290 - DNA, 25 bp, Mus musculus
gcagttgactgcatgcacactttac

SEQ ID NO: 540291 - DNA, 25 bp, Mus musculus
gcagttgactgcttgcacactttac

SEQ ID NO: 540292 - DNA, 25 bp, Mus musculus
gcagttgactgtacgtgaatctttt

SEQ ID NO: 540293 - DNA, 25 bp, Mus musculus
gcagttgactgttcgtgaatctttt

SEQ ID NO: 540294 - DNA, 25 bp, Mus musculus
gcagttgagagtcacaagcccttaa

SEQ ID NO: 540295 - DNA, 25 bp, Mus musculus
gcagttgagagtgacaagcccttaa

SEQ ID NO: 540296 - DNA, 25 bp, Mus musculus
gcagttgagctgctacagtaatttc

SEQ ID NO: 540297 - DNA, 25 bp, Mus musculus
gcagttgagctggtacagtaatttc

SEQ ID NO: 540298 - DNA, 25 bp, Mus musculus
gcagttgaggccagtcttgaattct

SEQ ID NO: 540299 - DNA, 25 bp, Mus musculus
gcagttgaggcctgtcttgaattct

SEQ ID NO: 540300 - DNA, 25 bp, Mus musculus
gcagttgataagatacagtgtcacc

SEQ ID NO: 540301 - DNA, 25 bp, Mus musculus
gcagttgataagttacagtgtcacc

SEQ ID NO: 540302 - DNA, 25 bp, Mus musculus
gcagttgatttcatccttcctatga

SEQ ID NO: 540303 - DNA, 25 bp, Mus musculus
gcagttgatttcttccttcctatga

SEQ ID NO: 540304 - DNA, 25 bp, Mus musculus
gcagttgcagcaaaggtgttatcct

SEQ ID NO: 540305 - DNA, 25 bp, Mus musculus
gcagttgcagcataggtgttatcct

SEQ ID NO: 540306 - DNA, 25 bp, Mus musculus
gcagttgcagtgaacttgtcaagta

SEQ ID NO: 540307 - DNA, 25 bp, Mus musculus
gcagttgcagtgtacttgtcaagta

SEQ ID NO: 540308 - DNA, 25 bp, Mus musculus
gcagttgcagttcgccattattgta

SEQ ID NO: 540309 - DNA, 25 bp, Mus musculus
gcagttgcagttggccattattgta

SEQ ID NO: 540310 - DNA, 25 bp, Mus musculus
gcagttgccaagctctcggagacaa

SEQ ID NO: 540311 - DNA, 25 bp, Mus musculus
gcagttgccaaggtctcggagacaa

SEQ ID NO: 540312 - DNA, 25 bp, Mus musculus
gcagttgcccaactatttattgact

SEQ ID NO: 540313 - DNA, 25 bp, Mus musculus
gcagttgcccaagtatttattgact

SEQ ID NO: 540314 - DNA, 25 bp, Mus musculus
gcagttgccttccacagatgttagt

SEQ ID NO: 540315 - DNA, 25 bp, Mus musculus
gcagttgccttcgacagatgttagt

SEQ ID NO: 540316 - DNA, 25 bp, Mus musculus
gcagttgctagtcctggacgctgct

SEQ ID NO: 540317 - DNA, 25 bp, Mus musculus
gcagttgctagtgctggacgctgct

SEQ ID NO: 540318 - DNA, 25 bp, Mus musculus
gcagttgctcagctcacatttgaaa

SEQ ID NO: 540319 - DNA, 25 bp, Mus musculus
gcagttgctcaggtcacatttgaaa

SEQ ID NO: 540320 - DNA, 25 bp, Mus musculus
gcagttgctgcgcatccaagactcg

SEQ ID NO: 540321 - DNA, 25 bp, Mus musculus
gcagttgctgcggatccaagactcg

SEQ ID NO: 540322 - DNA, 25 bp, Mus musculus
gcagttgcttaccacagttaaatga

SEQ ID NO: 540323 - DNA, 25 bp, Mus musculus
gcagttgcttacgacagttaaatga

SEQ ID NO: 540324 - DNA, 25 bp, Mus musculus
gcagttgcttgtaaagcccagagtt

SEQ ID NO: 540325 - DNA, 25 bp, Mus musculus
gcagttgcttgttaagcccagagtt

SEQ ID NO: 540326 - DNA, 25 bp, Mus musculus
gcagttggatacctggaactcttag

SEQ ID NO: 540327 - DNA, 25 bp, Mus musculus
gcagttggatacgtggaactcttag

SEQ ID NO: 540328 - DNA, 25 bp, Mus musculus
gcagttggcaaaatcttccttatga

SEQ ID NO: 540329 - DNA, 25 bp, Mus musculus
gcagttggcaaattcttccttatga

SEQ ID NO: 540330 - DNA, 25 bp, Mus musculus
gcagttggcactaagaaggccccac

SEQ ID NO: 540331 - DNA, 25 bp, Mus musculus
gcagttggcacttagaaggccccac

SEQ ID NO: 540332 - DNA, 25 bp, Mus musculus
gcagttggcagcaaaggctcctcag

SEQ ID NO: 540333 - DNA, 25 bp, Mus musculus
gcagttggcagctaaggctcctcag

SEQ ID NO: 540334 - DNA, 25 bp, Mus musculus
gcagttggccacctttgtgcagatt

SEQ ID NO: 540335 - DNA, 25 bp, Mus musculus
gcagttggccacgtttgtgcagatt

SEQ ID NO: 540336 - DNA, 25 bp, Mus musculus
gcagttggccctcggtttggcccca

SEQ ID NO: 540337 - DNA, 25 bp, Mus musculus
gcagttggccctgggtttggcccca

SEQ ID NO: 540338 - DNA, 25 bp, Mus musculus
gcagttggctttaagtacctgactt

SEQ ID NO: 540339 - DNA, 25 bp, Mus musculus
gcagttggcttttagtacctgactt

SEQ ID NO: 540340 - DNA, 25 bp, Mus musculus
gcagttgggactactacagactggt

SEQ ID NO: 540341 - DNA, 25 bp, Mus musculus
gcagttgggacttctacagactggt

SEQ ID NO: 540342 - DNA, 25 bp, Mus musculus
gcagttgggagccactcagtgttcc

SEQ ID NO: 540343 - DNA, 25 bp, Mus musculus
gcagttgggagcgactcagtgttcc

SEQ ID NO: 540344 - DNA, 25 bp, Mus musculus
gcagttgggcagagttcagttgtaa

SEQ ID NO: 540345 - DNA, 25 bp, Mus musculus
gcagttgggcagtgttcagttgtaa

SEQ ID NO: 540346 - DNA, 25 bp, Mus musculus
gcagttgggcctcacagacaatcaa

SEQ ID NO: 540347 - DNA, 25 bp, Mus musculus
gcagttgggcctgacagacaatcaa

SEQ ID NO: 540348 - DNA, 25 bp, Mus musculus
gcagttgggcgcacagaaccaaagc

SEQ ID NO: 540349 - DNA, 25 bp, Mus musculus
gcagttgggcgctcagaaccaaagc

SEQ ID NO: 540350 - DNA, 25 bp, Mus musculus
gcagttgggctcctatgatccacta

SEQ ID NO: 540351 - DNA, 25 bp, Mus musculus
gcagttgggctcgtatgatccacta

SEQ ID NO: 540352 - DNA, 25 bp, Mus musculus
gcagttgggtgcattcttaacgaat

SEQ ID NO: 540353 - DNA, 25 bp, Mus musculus
gcagttgggtgctttcttaacgaat

SEQ ID NO: 540354 - DNA, 25 bp, Mus musculus
gcagttggtcacctcacgaatctga

SEQ ID NO: 540355 - DNA, 25 bp, Mus musculus
gcagttggtcacgtcacgaatctga

SEQ ID NO: 540356 - DNA, 25 bp, Mus musculus
gcagttggtgcccagagcgactaac

SEQ ID NO: 540357 - DNA, 25 bp, Mus musculus
gcagttggtgccgagagcgactaac

SEQ ID NO: 540358 - DNA, 25 bp, Mus musculus
gcagttggtgttagctttgcacttc

SEQ ID NO: 540359 - DNA, 25 bp, Mus musculus
gcagttggtgtttgctttgcacttc

SEQ ID NO: 540360 - DNA, 25 bp, Mus musculus
gcagttggttggagcaaacatcccc

SEQ ID NO: 540361 - DNA, 25 bp, Mus musculus
gcagttggttggtgcaaacatcccc

SEQ ID NO: 540362 - DNA, 25 bp, Mus musculus
gcagttgtaaataaaagtcactact

SEQ ID NO: 540363 - DNA, 25 bp, Mus musculus
gcagttgtaaattaaagtcactact

SEQ ID NO: 540364 - DNA, 25 bp, Mus musculus
gcagttgtaataagtcttccacttt

SEQ ID NO: 540365 - DNA, 25 bp, Mus musculus
gcagttgtaatatgtcttccacttt

SEQ ID NO: 540366 - DNA, 25 bp, Mus musculus
gcagttgtacaacgagccaggccaa

SEQ ID NO: 540367 - DNA, 25 bp, Mus musculus
gcagttgtacaaggagccaggccaa

SEQ ID NO: 540368 - DNA, 25 bp, Mus musculus
gcagttgtactgacacagactggtg

SEQ ID NO: 540369 - DNA, 25 bp, Mus musculus
gcagttgtactgtcacagactggtg

SEQ ID NO: 540370 - DNA, 25 bp, Mus musculus
gcagttgtagaaaacacagttccat

SEQ ID NO: 540371 - DNA, 25 bp, Mus musculus
gcagttgtagaatacacagttccat

SEQ ID NO: 540372 - DNA, 25 bp, Mus musculus
gcagttgtaggacttagaccaccgt

SEQ ID NO: 540373 - DNA, 25 bp, Mus musculus
gcagttgtaggagttagaccaccgt

SEQ ID NO: 540374 - DNA, 25 bp, Mus musculus
gcagttgtatatcttgtttgtcagg

SEQ ID NO: 540375 - DNA, 25 bp, Mus musculus
gcagttgtatatgttgtttgtcagg

SEQ ID NO: 540376 - DNA, 25 bp, Mus musculus
gcagttgtatgcagcagatcggaac

SEQ ID NO: 540377 - DNA, 25 bp, Mus musculus
gcagttgtatgctgcagatcggaac

SEQ ID NO: 540378 - DNA, 25 bp, Mus musculus
gcagttgtatggatttcagggcttt

SEQ ID NO: 540379 - DNA, 25 bp, Mus musculus
gcagttgtatggttttcagggcttt

SEQ ID NO: 540380 - DNA, 25 bp, Mus musculus
gcagttgtcaggcatcagactccat

SEQ ID NO: 540381 - DNA, 25 bp, Mus musculus
gcagttgtcagggatcagactccat

SEQ ID NO: 540382 - DNA, 25 bp, Mus musculus
gcagttgtcagtaagcgctcagact

SEQ ID NO: 540383 - DNA, 25 bp, Mus musculus
gcagttgtcagttagcgctcagact

SEQ ID NO: 540384 - DNA, 25 bp, Mus musculus
gcagttgtccagaagcgctttggct

SEQ ID NO: 540385 - DNA, 25 bp, Mus musculus
gcagttgtccagtagcgctttggct

SEQ ID NO: 540386 - DNA, 25 bp, Mus musculus
gcagttgtccctctgatgactgtca

SEQ ID NO: 540387 - DNA, 25 bp, Mus musculus
gcagttgtccctgtgatgactgtca

SEQ ID NO: 540388 - DNA, 25 bp, Mus musculus
gcagttgtctgcacttgttgacatg

SEQ ID NO: 540389 - DNA, 25 bp, Mus musculus
gcagttgtctgctcttgttgacatg

SEQ ID NO: 540390 - DNA, 25 bp, Mus musculus
gcagttgtgcccaggtttttggaat

SEQ ID NO: 540391 - DNA, 25 bp, Mus musculus
gcagttgtgccctggtttttggaat

SEQ ID NO: 540392 - DNA, 25 bp, Mus musculus
gcagttgtgggtaagtgtgcataca

SEQ ID NO: 540393 - DNA, 25 bp, Mus musculus
gcagttgtgggttagtgtgcataca

SEQ ID NO: 540394 - DNA, 25 bp, Mus musculus
gcagttgtgtggctacacgatttta

SEQ ID NO: 540395 - DNA, 25 bp, Mus musculus
gcagttgtgtgggtacacgatttta

SEQ ID NO: 540396 - DNA, 25 bp, Mus musculus
gcagttgttagaagtcctctatgct

SEQ ID NO: 540397 - DNA, 25 bp, Mus musculus
gcagttgttagatgtcctctatgct

SEQ ID NO: 540398 - DNA, 25 bp, Mus musculus
gcagttgttccaagaatactcagag

SEQ ID NO: 540399 - DNA, 25 bp, Mus musculus
gcagttgttccactggtgaactgtc

SEQ ID NO: 540400 - DNA, 25 bp, Mus musculus
gcagttgttccagtggtgaactgtc

SEQ ID NO: 540401 - DNA, 25 bp, Mus musculus
gcagttgttccatgaatactcagag

SEQ ID NO: 540402 - DNA, 25 bp, Mus musculus
gcagttgttgtcagcagtgtgaaac

SEQ ID NO: 540403 - DNA, 25 bp, Mus musculus
gcagttgttgtctgcagtgtgaaac

SEQ ID NO: 540404 - DNA, 25 bp, Mus musculus
gcagttgtttcgcttggtagctttg

SEQ ID NO: 540405 - DNA, 25 bp, Mus musculus
gcagttgtttcggttggtagctttg

SEQ ID NO: 540406 - DNA, 25 bp, Mus musculus
gcagttgtttgcacatacgtatcag

SEQ ID NO: 540407 - DNA, 25 bp, Mus musculus
gcagttgtttgctcatacgtatcag

SEQ ID NO: 540408 - DNA, 25 bp, Mus musculus
gcagttgtttgtagaaggaagtaac

SEQ ID NO: 540409 - DNA, 25 bp, Mus musculus
gcagttgtttgttgaaggaagtaac

SEQ ID NO: 540410 - DNA, 25 bp, Mus musculus
gcagtttaaaggactggtgaaagcc

SEQ ID NO: 540411 - DNA, 25 bp, Mus musculus
gcagtttaaaggtctggtgaaagcc

SEQ ID NO: 540412 - DNA, 25 bp, Mus musculus
gcagtttaatggctacattatagat

SEQ ID NO: 540413 - DNA, 25 bp, Mus musculus
gcagtttaatgggtacattatagat

SEQ ID NO: 540414 - DNA, 25 bp, Mus musculus
gcagtttacaaacacagctcatcag

SEQ ID NO: 540415 - DNA, 25 bp, Mus musculus
gcagtttacaaagacagctcatcag

SEQ ID NO: 540416 - DNA, 25 bp, Mus musculus
gcagtttacattagtattgcctgaa

SEQ ID NO: 540417 - DNA, 25 bp, Mus musculus
gcagtttacatttgtattgcctgaa

SEQ ID NO: 540418 - DNA, 25 bp, Mus musculus
gcagtttactgccatgattattctt

SEQ ID NO: 540419 - DNA, 25 bp, Mus musculus
gcagtttactgcgatgattattctt

SEQ ID NO: 540420 - DNA, 25 bp, Mus musculus
gcagtttacttgcaggttctgacca

SEQ ID NO: 540421 - DNA, 25 bp, Mus musculus
gcagtttacttggaggttctgacca

SEQ ID NO: 540422 - DNA, 25 bp, Mus musculus
gcagtttactttatcatcctgtatg

SEQ ID NO: 540423 - DNA, 25 bp, Mus musculus
gcagtttactttttcatcctgtatg

SEQ ID NO: 540424 - DNA, 25 bp, Mus musculus
gcagtttagcagcatggagctgtct

SEQ ID NO: 540425 - DNA, 25 bp, Mus musculus
gcagtttagcaggatggagctgtct

SEQ ID NO: 540426 - DNA, 25 bp, Mus musculus
gcagtttagttgactgcctagtaaa

SEQ ID NO: 540427 - DNA, 25 bp, Mus musculus
gcagtttagttgtctgcctagtaaa

SEQ ID NO: 540428 - DNA, 25 bp, Mus musculus
gcagtttagtttattattcattgta

SEQ ID NO: 540429 - DNA, 25 bp, Mus musculus
gcagtttagttttttattcattgta

SEQ ID NO: 540430 - DNA, 25 bp, Mus musculus
gcagtttatagacgcccaagttcag

SEQ ID NO: 540431 - DNA, 25 bp, Mus musculus
gcagtttatagaggcccaagttcag

SEQ ID NO: 540432 - DNA, 25 bp, Mus musculus
gcagtttataggaaactgacctgag

SEQ ID NO: 540433 - DNA, 25 bp, Mus musculus
gcagtttataggtaactgacctgag

SEQ ID NO: 540434 - DNA, 25 bp, Mus musculus
gcagtttatgccaagattaccaaag

SEQ ID NO: 540435 - DNA, 25 bp, Mus musculus
gcagtttatgcctagattaccaaag

SEQ ID NO: 540436 - DNA, 25 bp, Mus musculus
gcagtttattgacctgatatttgta

SEQ ID NO: 540437 - DNA, 25 bp, Mus musculus
gcagtttattgagctgatatttgta

SEQ ID NO: 540438 - DNA, 25 bp, Mus musculus
gcagtttattttacttggccaacac

SEQ ID NO: 540439 - DNA, 25 bp, Mus musculus
gcagtttatttttcttggccaacac

SEQ ID NO: 540440 - DNA, 25 bp, Mus musculus
gcagtttcaagacccctacctaaag

SEQ ID NO: 540441 - DNA, 25 bp, Mus musculus
gcagtttcaagagccctacctaaag

SEQ ID NO: 540442 - DNA, 25 bp, Mus musculus
gcagtttcactaaggcctatatcat

SEQ ID NO: 540443 - DNA, 25 bp, Mus musculus
gcagtttcactatggcctatatcat

SEQ ID NO: 540444 - DNA, 25 bp, Mus musculus
gcagtttcagaactcaatgttacct

SEQ ID NO: 540445 - DNA, 25 bp, Mus musculus
gcagtttcagaagtcaatgttacct

SEQ ID NO: 540446 - DNA, 25 bp, Mus musculus
gcagtttcagtaatggtccagcatt

SEQ ID NO: 540447 - DNA, 25 bp, Mus musculus
gcagtttcagtattggtccagcatt

SEQ ID NO: 540448 - DNA, 25 bp, Mus musculus
gcagtttcatcaaggtttctacttt

SEQ ID NO: 540449 - DNA, 25 bp, Mus musculus
gcagtttcatcatggtttctacttt

SEQ ID NO: 540450 - DNA, 25 bp, Mus musculus
gcagtttcatcgacagtgccattga

SEQ ID NO: 540451 - DNA, 25 bp, Mus musculus
gcagtttcatcgtcagtgccattga

SEQ ID NO: 540452 - DNA, 25 bp, Mus musculus
gcagtttcatggagtttaggctgag

SEQ ID NO: 540453 - DNA, 25 bp, Mus musculus
gcagtttcatggtgtttaggctgag

SEQ ID NO: 540454 - DNA, 25 bp, Mus musculus
gcagtttccaaaaggcccaggtcat

SEQ ID NO: 540455 - DNA, 25 bp, Mus musculus
gcagtttccaaaccagtctagactt

SEQ ID NO: 540456 - DNA, 25 bp, Mus musculus
gcagtttccaaagcagtctagactt

SEQ ID NO: 540457 - DNA, 25 bp, Mus musculus
gcagtttccaaatggcccaggtcat

SEQ ID NO: 540458 - DNA, 25 bp, Mus musculus
gcagtttccataacattctgtgcat

SEQ ID NO: 540459 - DNA, 25 bp, Mus musculus
gcagtttccatatcattctgtgcat

SEQ ID NO: 540460 - DNA, 25 bp, Mus musculus
gcagtttccccgaggaggctgtaaa

SEQ ID NO: 540461 - DNA, 25 bp, Mus musculus
gcagtttccccgcttctgatggagg

SEQ ID NO: 540462 - DNA, 25 bp, Mus musculus
gcagtttccccggttctgatggagg

SEQ ID NO: 540463 - DNA, 25 bp, Mus musculus
gcagtttccccgtggaggctgtaaa

SEQ ID NO: 540464 - DNA, 25 bp, Mus musculus
gcagtttcccgacgagttgtccagg

SEQ ID NO: 540465 - DNA, 25 bp, Mus musculus
gcagtttcccgaggagttgtccagg

SEQ ID NO: 540466 - DNA, 25 bp, Mus musculus
gcagtttcccttatttgcaagctga

SEQ ID NO: 540467 - DNA, 25 bp, Mus musculus
gcagtttcccttttttgcaagctga

SEQ ID NO: 540468 - DNA, 25 bp, Mus musculus
gcagtttcctatacttggccttgac

SEQ ID NO: 540469 - DNA, 25 bp, Mus musculus
gcagtttcctattcttggccttgac

SEQ ID NO: 540470 - DNA, 25 bp, Mus musculus
gcagtttcctgccatgtataataaa

SEQ ID NO: 540471 - DNA, 25 bp, Mus musculus
gcagtttcctgcgatgtataataaa

SEQ ID NO: 540472 - DNA, 25 bp, Mus musculus
gcagtttctaagagggagacaggaa

SEQ ID NO: 540473 - DNA, 25 bp, Mus musculus
gcagtttctaagtgggagacaggaa

SEQ ID NO: 540474 - DNA, 25 bp, Mus musculus
gcagtttctataaaggctaccttgt

SEQ ID NO: 540475 - DNA, 25 bp, Mus musculus
gcagtttctatataggctaccttgt

SEQ ID NO: 540476 - DNA, 25 bp, Mus musculus
gcagtttctctcagcgatggtcaga

SEQ ID NO: 540477 - DNA, 25 bp, Mus musculus
gcagtttctctctgcgatggtcaga

SEQ ID NO: 540478 - DNA, 25 bp, Mus musculus
gcagtttctgaaatccattgtttct

SEQ ID NO: 540479 - DNA, 25 bp, Mus musculus
gcagtttctgaattccattgtttct

SEQ ID NO: 540480 - DNA, 25 bp, Mus musculus
gcagtttctgctcctagtcagctgc

SEQ ID NO: 540481 - DNA, 25 bp, Mus musculus
gcagtttctgctgctagtcagctgc

SEQ ID NO: 540482 - DNA, 25 bp, Mus musculus
gcagtttctgggagcttcactaagt

SEQ ID NO: 540483 - DNA, 25 bp, Mus musculus
gcagtttctgggtgcttcactaagt

SEQ ID NO: 540484 - DNA, 25 bp, Mus musculus
gcagtttcttcaccttggagactta

SEQ ID NO: 540485 - DNA, 25 bp, Mus musculus
gcagtttcttcagcttggagactta

SEQ ID NO: 540486 - DNA, 25 bp, Mus musculus
gcagtttcttctaggacttgtcggt

SEQ ID NO: 540487 - DNA, 25 bp, Mus musculus
gcagtttcttctccagcccttgcag

SEQ ID NO: 540488 - DNA, 25 bp, Mus musculus
gcagtttcttctgcagcccttgcag

SEQ ID NO: 540489 - DNA, 25 bp, Mus musculus
gcagtttcttcttggacttgtcggt

SEQ ID NO: 540490 - DNA, 25 bp, Mus musculus
gcagtttgagtgatctccagagcca

SEQ ID NO: 540491 - DNA, 25 bp, Mus musculus
gcagtttgagtgttctccagagcca

SEQ ID NO: 540492 - DNA, 25 bp, Mus musculus
gcagtttgatacagtaccggcttga

SEQ ID NO: 540493 - DNA, 25 bp, Mus musculus
gcagtttgatactgtaccggcttga

SEQ ID NO: 540494 - DNA, 25 bp, Mus musculus
gcagtttgccttactcctgggtata

SEQ ID NO: 540495 - DNA, 25 bp, Mus musculus
gcagtttgccttctgatctgggcta

SEQ ID NO: 540496 - DNA, 25 bp, Mus musculus
gcagtttgccttgtgatctgggcta

SEQ ID NO: 540497 - DNA, 25 bp, Mus musculus
gcagtttgcctttctcctgggtata

SEQ ID NO: 540498 - DNA, 25 bp, Mus musculus
gcagtttgctgacctctgagacaga

SEQ ID NO: 540499 - DNA, 25 bp, Mus musculus
gcagtttgctgagctctgagacaga

SEQ ID NO: 540500 - DNA, 25 bp, Mus musculus
gcagtttgcttacacctatttataa

SEQ ID NO: 540501 - DNA, 25 bp, Mus musculus
gcagtttgcttagacctatttataa

SEQ ID NO: 540502 - DNA, 25 bp, Mus musculus
gcagtttgcttcagtgtacttaaca

SEQ ID NO: 540503 - DNA, 25 bp, Mus musculus
gcagtttgcttctgtgtacttaaca

SEQ ID NO: 540504 - DNA, 25 bp, Mus musculus
gcagtttggtttctttccaggtgag

SEQ ID NO: 540505 - DNA, 25 bp, Mus musculus
gcagtttggtttgtttccaggtgag

SEQ ID NO: 540506 - DNA, 25 bp, Mus musculus
gcagtttgtctcctaccattatgta

SEQ ID NO: 540507 - DNA, 25 bp, Mus musculus
gcagtttgtctcgtaccattatgta

SEQ ID NO: 540508 - DNA, 25 bp, Mus musculus
gcagtttgtgagatccctgtagtga

SEQ ID NO: 540509 - DNA, 25 bp, Mus musculus
gcagtttgtgagatcctgggacttc

SEQ ID NO: 540510 - DNA, 25 bp, Mus musculus
gcagtttgtgagttccctgtagtga

SEQ ID NO: 540511 - DNA, 25 bp, Mus musculus
gcagtttgtgagttcctgggacttc

SEQ ID NO: 540512 - DNA, 25 bp, Mus musculus
gcagtttgtgcacgaatcctttgca

SEQ ID NO: 540513 - DNA, 25 bp, Mus musculus
gcagtttgtgcaggaatcctttgca

SEQ ID NO: 540514 - DNA, 25 bp, Mus musculus
gcagtttgtggcagtgtatctgtct

SEQ ID NO: 540515 - DNA, 25 bp, Mus musculus
gcagtttgtggctgtgtatctgtct

SEQ ID NO: 540516 - DNA, 25 bp, Mus musculus
gcagtttgttagaagttgtactcaa

SEQ ID NO: 540517 - DNA, 25 bp, Mus musculus
gcagtttgttagtagttgtactcaa

SEQ ID NO: 540518 - DNA, 25 bp, Mus musculus
gcagttttaacaactaggctctttg

SEQ ID NO: 540519 - DNA, 25 bp, Mus musculus
gcagttttaacatctaggctctttg

SEQ ID NO: 540520 - DNA, 25 bp, Mus musculus
gcagttttaagtcaatcctctacct

SEQ ID NO: 540521 - DNA, 25 bp, Mus musculus
gcagttttaagtgaatcctctacct

SEQ ID NO: 540522 - DNA, 25 bp, Mus musculus
gcagttttactaacaaatcaatcat

SEQ ID NO: 540523 - DNA, 25 bp, Mus musculus
gcagttttactatcaaatcaatcat

SEQ ID NO: 540524 - DNA, 25 bp, Mus musculus
gcagttttagagagatgaatccttt

SEQ ID NO: 540525 - DNA, 25 bp, Mus musculus
gcagttttagagtgatgaatccttt

SEQ ID NO: 540526 - DNA, 25 bp, Mus musculus
gcagttttaggtatagtacttgtat

SEQ ID NO: 540527 - DNA, 25 bp, Mus musculus
gcagttttaggtttagtacttgtat

SEQ ID NO: 540528 - DNA, 25 bp, Mus musculus
gcagttttagttagcattcctgata

SEQ ID NO: 540529 - DNA, 25 bp, Mus musculus
gcagttttagtttgcattcctgata

SEQ ID NO: 540530 - DNA, 25 bp, Mus musculus
gcagttttatcactagccagtccag

SEQ ID NO: 540531 - DNA, 25 bp, Mus musculus
gcagttttatcagtagccagtccag

SEQ ID NO: 540532 - DNA, 25 bp, Mus musculus
gcagttttatgcatgttgttgataa

SEQ ID NO: 540533 - DNA, 25 bp, Mus musculus
gcagttttatgcttgttgttgataa

SEQ ID NO: 540534 - DNA, 25 bp, Mus musculus
gcagttttcaaaattcttgccggtg

SEQ ID NO: 540535 - DNA, 25 bp, Mus musculus
gcagttttcaaaccttggatcagaa

SEQ ID NO: 540536 - DNA, 25 bp, Mus musculus
gcagttttcaaagcttggatcagaa

SEQ ID NO: 540537 - DNA, 25 bp, Mus musculus
gcagttttcaaatttcttgccggtg

SEQ ID NO: 540538 - DNA, 25 bp, Mus musculus
gcagttttcactcagtcccgagaat

SEQ ID NO: 540539 - DNA, 25 bp, Mus musculus
gcagttttcactgagtcccgagaat

SEQ ID NO: 540540 - DNA, 25 bp, Mus musculus
gcagttttcagcctggagagccagc

SEQ ID NO: 540541 - DNA, 25 bp, Mus musculus
gcagttttcagcgtggagagccagc

SEQ ID NO: 540542 - DNA, 25 bp, Mus musculus
gcagttttcaggcaaccctacaccg

SEQ ID NO: 540543 - DNA, 25 bp, Mus musculus
gcagttttcagggaaccctacaccg

SEQ ID NO: 540544 - DNA, 25 bp, Mus musculus
gcagttttccgacggcagtgtgcca

SEQ ID NO: 540545 - DNA, 25 bp, Mus musculus
gcagttttccgagggcagtgtgcca

SEQ ID NO: 540546 - DNA, 25 bp, Mus musculus
gcagttttccggacttcgccaggag

SEQ ID NO: 540547 - DNA, 25 bp, Mus musculus
gcagttttccggtcttcgccaggag

SEQ ID NO: 540548 - DNA, 25 bp, Mus musculus
gcagttttcgaaactttttcttcct

SEQ ID NO: 540549 - DNA, 25 bp, Mus musculus
gcagttttcgaatctttttcttcct

SEQ ID NO: 540550 - DNA, 25 bp, Mus musculus
gcagttttctgaacggtagccccag

SEQ ID NO: 540551 - DNA, 25 bp, Mus musculus
gcagttttctgatcggtagccccag

SEQ ID NO: 540552 - DNA, 25 bp, Mus musculus
gcagttttctgcagcgatgtcataa

SEQ ID NO: 540553 - DNA, 25 bp, Mus musculus
gcagttttctgctgcgatgtcataa

SEQ ID NO: 540554 - DNA, 25 bp, Mus musculus
gcagttttgactacaggaccggcaa

SEQ ID NO: 540555 - DNA, 25 bp, Mus musculus
gcagttttgacttcaggaccggcaa

SEQ ID NO: 540556 - DNA, 25 bp, Mus musculus
gcagttttgcaacagctttagccta

SEQ ID NO: 540557 - DNA, 25 bp, Mus musculus
gcagttttgcaagagctttagccta

SEQ ID NO: 540558 - DNA, 25 bp, Mus musculus
gcagttttgctgcttgtgccataaa

SEQ ID NO: 540559 - DNA, 25 bp, Mus musculus
gcagttttgctggttgtgccataaa

SEQ ID NO: 540560 - DNA, 25 bp, Mus musculus
gcagttttggcaatccagggaagca

SEQ ID NO: 540561 - DNA, 25 bp, Mus musculus
gcagttttggcattccagggaagca

SEQ ID NO: 540562 - DNA, 25 bp, Mus musculus
gcagttttgtttctccaggcggtaa

SEQ ID NO: 540563 - DNA, 25 bp, Mus musculus
gcagttttgtttctgtgccatgact

SEQ ID NO: 540564 - DNA, 25 bp, Mus musculus
gcagttttgtttgtccaggcggtaa

SEQ ID NO: 540565 - DNA, 25 bp, Mus musculus
gcagttttgtttgtgtgccatgact

SEQ ID NO: 540566 - DNA, 25 bp, Mus musculus
gcagtttttcagcacagtccacaat

SEQ ID NO: 540567 - DNA, 25 bp, Mus musculus
gcagtttttcagcagcgcaagatag

SEQ ID NO: 540568 - DNA, 25 bp, Mus musculus
gcagtttttcaggacagtccacaat

SEQ ID NO: 540569 - DNA, 25 bp, Mus musculus
gcagtttttcaggagcgcaagatag

SEQ ID NO: 540570 - DNA, 25 bp, Mus musculus
gcagtttttctaacttgttgctcat

SEQ ID NO: 540571 - DNA, 25 bp, Mus musculus
gcagtttttctatcttgttgctcat

SEQ ID NO: 540572 - DNA, 25 bp, Mus musculus
gcataaaagggactcgaggcttctg

SEQ ID NO: 540573 - DNA, 25 bp, Mus musculus
gcataaaagggagtcgaggcttctg

SEQ ID NO: 540574 - DNA, 25 bp, Mus musculus
gcataaaatacccagttaggaccat

SEQ ID NO: 540575 - DNA, 25 bp, Mus musculus
gcataaaataccgagttaggaccat

SEQ ID NO: 540576 - DNA, 25 bp, Mus musculus
gcataaacacaactccacagcaggt

SEQ ID NO: 540577 - DNA, 25 bp, Mus musculus
gcataaacacaagtccacagcaggt

SEQ ID NO: 540578 - DNA, 25 bp, Mus musculus
gcataaacacgactgcagggactgt

SEQ ID NO: 540579 - DNA, 25 bp, Mus musculus
gcataaacacgagtgcagggactgt

SEQ ID NO: 540580 - DNA, 25 bp, Mus musculus
gcataaacaggaaccatcattctgc

SEQ ID NO: 540581 - DNA, 25 bp, Mus musculus
gcataaacaggatccatcattctgc

SEQ ID NO: 540582 - DNA, 25 bp, Mus musculus
gcataaacatttactgaacttttgt

SEQ ID NO: 540583 - DNA, 25 bp, Mus musculus
gcataaacatttctctcagcaaata

SEQ ID NO: 540584 - DNA, 25 bp, Mus musculus
gcataaacatttgtctcagcaaata

SEQ ID NO: 540585 - DNA, 25 bp, Mus musculus
gcataaacattttctgaacttttgt

SEQ ID NO: 540586 - DNA, 25 bp, Mus musculus
gcataaaccggacactgcctcaaga

SEQ ID NO: 540587 - DNA, 25 bp, Mus musculus
gcataaaccggagactgcctcaaga

SEQ ID NO: 540588 - DNA, 25 bp, Mus musculus
gcataaactgatatatctcttcata

SEQ ID NO: 540589 - DNA, 25 bp, Mus musculus
gcataaactgatttatctcttcata

SEQ ID NO: 540590 - DNA, 25 bp, Mus musculus
gcataaacttatcccattgtatttt

SEQ ID NO: 540591 - DNA, 25 bp, Mus musculus
gcataaacttatgccattgtatttt

SEQ ID NO: 540592 - DNA, 25 bp, Mus musculus
gcataaactttacgcatggcagtgt

SEQ ID NO: 540593 - DNA, 25 bp, Mus musculus
gcataaactttaggcatggcagtgt

SEQ ID NO: 540594 - DNA, 25 bp, Mus musculus
gcataaagatgacagccaggctccc

SEQ ID NO: 540595 - DNA, 25 bp, Mus musculus
gcataaagatgagagccaggctccc

SEQ ID NO: 540596 - DNA, 25 bp, Mus musculus
gcataaagcagacgtttgggtaaac

SEQ ID NO: 540597 - DNA, 25 bp, Mus musculus
gcataaagcagaggtttgggtaaac

SEQ ID NO: 540598 - DNA, 25 bp, Mus musculus
gcataaagccccacagtcagacaga

SEQ ID NO: 540599 - DNA, 25 bp, Mus musculus
gcataaagcccctcagtcagacaga

SEQ ID NO: 540600 - DNA, 25 bp, Mus musculus
gcataaagtaccattcctgggcctt

SEQ ID NO: 540601 - DNA, 25 bp, Mus musculus
gcataaagtacctttcctgggcctt

SEQ ID NO: 540602 - DNA, 25 bp, Mus musculus
gcataaagtctgcatcaatgccatt

SEQ ID NO: 540603 - DNA, 25 bp, Mus musculus
gcataaagtctggatcaatgccatt

SEQ ID NO: 540604 - DNA, 25 bp, Mus musculus
gcataaatatgtccatagcagcttt

SEQ ID NO: 540605 - DNA, 25 bp, Mus musculus
gcataaatatgtgcatagcagcttt

SEQ ID NO: 540606 - DNA, 25 bp, Mus musculus
gcataaatcaaactccctgaagcag

SEQ ID NO: 540607 - DNA, 25 bp, Mus musculus
gcataaatcaaagtccctgaagcag

SEQ ID NO: 540608 - DNA, 25 bp, Mus musculus
gcataaatgaacctgaccctgaggt

SEQ ID NO: 540609 - DNA, 25 bp, Mus musculus
gcataaatgaacgtgaccctgaggt

SEQ ID NO: 540610 - DNA, 25 bp, Mus musculus
gcataaatggcaccttgttttcttg

SEQ ID NO: 540611 - DNA, 25 bp, Mus musculus
gcataaatggcagcttgttttcttg

SEQ ID NO: 540612 - DNA, 25 bp, Mus musculus
gcataaattataacctctaacacaa

SEQ ID NO: 540613 - DNA, 25 bp, Mus musculus
gcataaattatatcctctaacacaa

SEQ ID NO: 540614 - DNA, 25 bp, Mus musculus
gcataaattccaacctaagttctaa

SEQ ID NO: 540615 - DNA, 25 bp, Mus musculus
gcataaattccatcctaagttctaa

SEQ ID NO: 540616 - DNA, 25 bp, Mus musculus
gcataacaatggatcctggaggctt

SEQ ID NO: 540617 - DNA, 25 bp, Mus musculus
gcataacaatggttcctggaggctt

SEQ ID NO: 540618 - DNA, 25 bp, Mus musculus
gcataacactgaagttcaacacttt

SEQ ID NO: 540619 - DNA, 25 bp, Mus musculus
gcataacactgatgttcaacacttt

SEQ ID NO: 540620 - DNA, 25 bp, Mus musculus
gcataacctgtcatattcagaacta

SEQ ID NO: 540621 - DNA, 25 bp, Mus musculus
gcataacctgtcttattcagaacta

SEQ ID NO: 540622 - DNA, 25 bp, Mus musculus
gcataacgcagtcggaatttcttct

SEQ ID NO: 540623 - DNA, 25 bp, Mus musculus
gcataacgcagtgggaatttcttct

SEQ ID NO: 540624 - DNA, 25 bp, Mus musculus
gcataactcaacagacttgcctgct

SEQ ID NO: 540625 - DNA, 25 bp, Mus musculus
gcataactcaactgacttgcctgct

SEQ ID NO: 540626 - DNA, 25 bp, Mus musculus
gcataactcgtaatattttcctcat

SEQ ID NO: 540627 - DNA, 25 bp, Mus musculus
gcataactcgtattattttcctcat

SEQ ID NO: 540628 - DNA, 25 bp, Mus musculus
gcataactgactcatcctttgatat

SEQ ID NO: 540629 - DNA, 25 bp, Mus musculus
gcataactgactgatcctttgatat

SEQ ID NO: 540630 - DNA, 25 bp, Mus musculus
gcataactggtgaatacgcttcaaa

SEQ ID NO: 540631 - DNA, 25 bp, Mus musculus
gcataactggtgtatacgcttcaaa

SEQ ID NO: 540632 - DNA, 25 bp, Mus musculus
gcataagacaacacactttccttct

SEQ ID NO: 540633 - DNA, 25 bp, Mus musculus
gcataagacaactcactttccttct

SEQ ID NO: 540634 - DNA, 25 bp, Mus musculus
gcataagacagcattctgaccacac

SEQ ID NO: 540635 - DNA, 25 bp, Mus musculus
gcataagacagctttctgaccacac

SEQ ID NO: 540636 - DNA, 25 bp, Mus musculus
gcataagagggtcccacactccttt

SEQ ID NO: 540637 - DNA, 25 bp, Mus musculus
gcataagagggtgccacactccttt

SEQ ID NO: 540638 - DNA, 25 bp, Mus musculus
gcataagaggtaatacattcgctgt

SEQ ID NO: 540639 - DNA, 25 bp, Mus musculus
gcataagaggtattacattcgctgt

SEQ ID NO: 540640 - DNA, 25 bp, Mus musculus
gcataagaggtgatcttcccaggga

SEQ ID NO: 540641 - DNA, 25 bp, Mus musculus
gcataagaggtgttcttcccaggga

SEQ ID NO: 540642 - DNA, 25 bp, Mus musculus
gcataagagtttctgttatccctgg

SEQ ID NO: 540643 - DNA, 25 bp, Mus musculus
gcataagagtttgtgttatccctgg

SEQ ID NO: 540644 - DNA, 25 bp, Mus musculus
gcataagataagaggatttttccct

SEQ ID NO: 540645 - DNA, 25 bp, Mus musculus
gcataagataagtggatttttccct

SEQ ID NO: 540646 - DNA, 25 bp, Mus musculus
gcataagcaccaatacctgagattt

SEQ ID NO: 540647 - DNA, 25 bp, Mus musculus
gcataagcaccattacctgagattt

SEQ ID NO: 540648 - DNA, 25 bp, Mus musculus
gcataagcactaagtctccaacttt

SEQ ID NO: 540649 - DNA, 25 bp, Mus musculus
gcataagcactatgtctccaacttt

SEQ ID NO: 540650 - DNA, 25 bp, Mus musculus
gcataagcatagctttctgcactta

SEQ ID NO: 540651 - DNA, 25 bp, Mus musculus
gcataagcataggtttctgcactta

SEQ ID NO: 540652 - DNA, 25 bp, Mus musculus
gcataagctgctagtggtggtcaag

SEQ ID NO: 540653 - DNA, 25 bp, Mus musculus
gcataagctgcttgtggtggtcaag

SEQ ID NO: 540654 - DNA, 25 bp, Mus musculus
gcataagcttaacccgctgatgagt

SEQ ID NO: 540655 - DNA, 25 bp, Mus musculus
gcataagcttaagccgctgatgagt

SEQ ID NO: 540656 - DNA, 25 bp, Mus musculus
gcataaggaagcaagctctgactat

SEQ ID NO: 540657 - DNA, 25 bp, Mus musculus
gcataaggaagctagctctgactat

SEQ ID NO: 540658 - DNA, 25 bp, Mus musculus
gcataaggatgacacacacacacgt

SEQ ID NO: 540659 - DNA, 25 bp, Mus musculus
gcataaggatgagacacacacacgt

SEQ ID NO: 540660 - DNA, 25 bp, Mus musculus
gcataaggcactaaccgcaagcagt

SEQ ID NO: 540661 - DNA, 25 bp, Mus musculus
gcataaggcacttaccgcaagcagt

SEQ ID NO: 540662 - DNA, 25 bp, Mus musculus
gcataaggctataaggactgatcgt

SEQ ID NO: 540663 - DNA, 25 bp, Mus musculus
gcataaggctattaggactgatcgt

SEQ ID NO: 540664 - DNA, 25 bp, Mus musculus
gcataagtaggccaagttcctgtgt

SEQ ID NO: 540665 - DNA, 25 bp, Mus musculus
gcataagtaggcgaagttcctgtgt

SEQ ID NO: 540666 - DNA, 25 bp, Mus musculus
gcataagttaatatccactgtggtt

SEQ ID NO: 540667 - DNA, 25 bp, Mus musculus
gcataagttaatttccactgtggtt

SEQ ID NO: 540668 - DNA, 25 bp, Mus musculus
gcataagttctacttctctcctgaa

SEQ ID NO: 540669 - DNA, 25 bp, Mus musculus
gcataagttctagttctctcctgaa

SEQ ID NO: 540670 - DNA, 25 bp, Mus musculus
gcataataatacaacgactattctc

SEQ ID NO: 540671 - DNA, 25 bp, Mus musculus
gcataataatactacgactattctc

SEQ ID NO: 540672 - DNA, 25 bp, Mus musculus
gcataatacagtatgctcacacttt

SEQ ID NO: 540673 - DNA, 25 bp, Mus musculus
gcataatacagtttgctcacacttt

SEQ ID NO: 540674 - DNA, 25 bp, Mus musculus
gcataatatgccatgtgtaatagtt

SEQ ID NO: 540675 - DNA, 25 bp, Mus musculus
gcataatatgccttgtgtaatagtt

SEQ ID NO: 540676 - DNA, 25 bp, Mus musculus
gcataatattttatccatactcaga

SEQ ID NO: 540677 - DNA, 25 bp, Mus musculus
gcataatattttttccatactcaga

SEQ ID NO: 540678 - DNA, 25 bp, Mus musculus
gcataatcaatcaaatttggttcca

SEQ ID NO: 540679 - DNA, 25 bp, Mus musculus
gcataatcaatctaatttggttcca

SEQ ID NO: 540680 - DNA, 25 bp, Mus musculus
gcataatcccagaaccataaacatt

SEQ ID NO: 540681 - DNA, 25 bp, Mus musculus
gcataatcccagtaccataaacatt

SEQ ID NO: 540682 - DNA, 25 bp, Mus musculus
gcataatccttgattgctagggctc

SEQ ID NO: 540683 - DNA, 25 bp, Mus musculus
gcataatccttgctactacaccttc

SEQ ID NO: 540684 - DNA, 25 bp, Mus musculus
gcataatccttggtactacaccttc

SEQ ID NO: 540685 - DNA, 25 bp, Mus musculus
gcataatccttgtttgctagggctc

SEQ ID NO: 540686 - DNA, 25 bp, Mus musculus
gcataatctgggagttggttctagt

SEQ ID NO: 540687 - DNA, 25 bp, Mus musculus
gcataatctgggtgttggttctagt

SEQ ID NO: 540688 - DNA, 25 bp, Mus musculus
gcataatgatttccccttcctaatt

SEQ ID NO: 540689 - DNA, 25 bp, Mus musculus
gcataatgatttgcccttcctaatt

SEQ ID NO: 540690 - DNA, 25 bp, Mus musculus
gcataatgcatgcattctttgttca

SEQ ID NO: 540691 - DNA, 25 bp, Mus musculus
gcataatgcatggattctttgttca

SEQ ID NO: 540692 - DNA, 25 bp, Mus musculus
gcataatgcctaatcctaatttgaa

SEQ ID NO: 540693 - DNA, 25 bp, Mus musculus
gcataatgcctattcctaatttgaa

SEQ ID NO: 540694 - DNA, 25 bp, Mus musculus
gcataatgccttagatctgttttta

SEQ ID NO: 540695 - DNA, 25 bp, Mus musculus
gcataatgcctttgatctgttttta

SEQ ID NO: 540696 - DNA, 25 bp, Mus musculus
gcataatgctctcgcactgtatttt

SEQ ID NO: 540697 - DNA, 25 bp, Mus musculus
gcataatgctctggcactgtatttt

SEQ ID NO: 540698 - DNA, 25 bp, Mus musculus
gcataatggctgaagattcccctgg

SEQ ID NO: 540699 - DNA, 25 bp, Mus musculus
gcataatggctgtagattcccctgg

SEQ ID NO: 540700 - DNA, 25 bp, Mus musculus
gcataatggtatcgttgtaatttgt

SEQ ID NO: 540701 - DNA, 25 bp, Mus musculus
gcataatggtatggttgtaatttgt

SEQ ID NO: 540702 - DNA, 25 bp, Mus musculus
gcataattacccagacttcttacat

SEQ ID NO: 540703 - DNA, 25 bp, Mus musculus
gcataattaccctgacttcttacat

SEQ ID NO: 540704 - DNA, 25 bp, Mus musculus
gcataattatatctctttgtcccat

SEQ ID NO: 540705 - DNA, 25 bp, Mus musculus
gcataattatatgtctttgtcccat

SEQ ID NO: 540706 - DNA, 25 bp, Mus musculus
gcataattccataaacagcgggttt

SEQ ID NO: 540707 - DNA, 25 bp, Mus musculus
gcataattccattaacagcgggttt

SEQ ID NO: 540708 - DNA, 25 bp, Mus musculus
gcataatttaagcttcaagccccag

SEQ ID NO: 540709 - DNA, 25 bp, Mus musculus
gcataatttaaggttcaagccccag

SEQ ID NO: 540710 - DNA, 25 bp, Mus musculus
gcataattttagagccccttcttgc

SEQ ID NO: 540711 - DNA, 25 bp, Mus musculus
gcataattttagtgccccttcttgc

SEQ ID NO: 540712 - DNA, 25 bp, Mus musculus
gcataattttatcttgtacaagtaa

SEQ ID NO: 540713 - DNA, 25 bp, Mus musculus
gcataattttatgttgtacaagtaa

SEQ ID NO: 540714 - DNA, 25 bp, Mus musculus
gcatacaaaccaaccaggctactgt

SEQ ID NO: 540715 - DNA, 25 bp, Mus musculus
gcatacaaaccatccaggctactgt

SEQ ID NO: 540716 - DNA, 25 bp, Mus musculus
gcatacaaaggtcgcagtaactgat

SEQ ID NO: 540717 - DNA, 25 bp, Mus musculus
gcatacaaaggtggcagtaactgat

SEQ ID NO: 540718 - DNA, 25 bp, Mus musculus
gcatacaactccattactaagtttt

SEQ ID NO: 540719 - DNA, 25 bp, Mus musculus
gcatacaactcctttactaagtttt

SEQ ID NO: 540720 - DNA, 25 bp, Mus musculus
gcatacaagaccctgatcaagaaag

SEQ ID NO: 540721 - DNA, 25 bp, Mus musculus
gcatacaagaccgtgatcaagaaag

SEQ ID NO: 540722 - DNA, 25 bp, Mus musculus
gcatacaaggaaaagcatgcacaaa

SEQ ID NO: 540723 - DNA, 25 bp, Mus musculus
gcatacaaggaatagcatgcacaaa

SEQ ID NO: 540724 - DNA, 25 bp, Mus musculus
gcatacaatccacaacctgtatcag

SEQ ID NO: 540725 - DNA, 25 bp, Mus musculus
gcatacaatccagaacctgtatcag

SEQ ID NO: 540726 - DNA, 25 bp, Mus musculus
gcatacaatgaacctggtctcacct

SEQ ID NO: 540727 - DNA, 25 bp, Mus musculus
gcatacaatgaagctggtctcacct

SEQ ID NO: 540728 - DNA, 25 bp, Mus musculus
gcatacaatttcatatccccatgct

SEQ ID NO: 540729 - DNA, 25 bp, Mus musculus
gcatacaatttcttatccccatgct

SEQ ID NO: 540730 - DNA, 25 bp, Mus musculus
gcatacacacctactaactttacta

SEQ ID NO: 540731 - DNA, 25 bp, Mus musculus
gcatacacaccttctaactttacta

SEQ ID NO: 540732 - DNA, 25 bp, Mus musculus
gcatacacatggaaagggacaattt

SEQ ID NO: 540733 - DNA, 25 bp, Mus musculus
gcatacacatggtaagggacaattt

SEQ ID NO: 540734 - DNA, 25 bp, Mus musculus
gcatacacccttaaattgtgttgct

SEQ ID NO: 540735 - DNA, 25 bp, Mus musculus
gcatacaccctttaattgtgttgct

SEQ ID NO: 540736 - DNA, 25 bp, Mus musculus
gcatacacgaacaccggccaatcag

SEQ ID NO: 540737 - DNA, 25 bp, Mus musculus
gcatacacgaactccggccaatcag

SEQ ID NO: 540738 - DNA, 25 bp, Mus musculus
gcatacactctacagggctcacagg

SEQ ID NO: 540739 - DNA, 25 bp, Mus musculus
gcatacactctagagggctcacagg

SEQ ID NO: 540740 - DNA, 25 bp, Mus musculus
gcatacactgccatcatggaaatgt

SEQ ID NO: 540741 - DNA, 25 bp, Mus musculus
gcatacactgccttcatggaaatgt

SEQ ID NO: 540742 - DNA, 25 bp, Mus musculus
gcatacactgctaatggtttgttct

SEQ ID NO: 540743 - DNA, 25 bp, Mus musculus
gcatacactgcttatggtttgttct

SEQ ID NO: 540744 - DNA, 25 bp, Mus musculus
gcatacactgttattctcacgagaa

SEQ ID NO: 540745 - DNA, 25 bp, Mus musculus
gcatacactgtttttctcacgagaa

SEQ ID NO: 540746 - DNA, 25 bp, Mus musculus
gcatacagaattatcctcatattga

SEQ ID NO: 540747 - DNA, 25 bp, Mus musculus
gcatacagaattttcctcatattga

SEQ ID NO: 540748 - DNA, 25 bp, Mus musculus
gcatacagacaacttgcctgattgt

SEQ ID NO: 540749 - DNA, 25 bp, Mus musculus
gcatacagacaagttgcctgattgt

SEQ ID NO: 540750 - DNA, 25 bp, Mus musculus
gcatacagacccatacaagctagct

SEQ ID NO: 540751 - DNA, 25 bp, Mus musculus
gcatacagacccttacaagctagct

SEQ ID NO: 540752 - DNA, 25 bp, Mus musculus
gcatacagagttagaatttccacct

SEQ ID NO: 540753 - DNA, 25 bp, Mus musculus
gcatacagagtttgaatttccacct

SEQ ID NO: 540754 - DNA, 25 bp, Mus musculus
gcatacagatgcagactttcacctc

SEQ ID NO: 540755 - DNA, 25 bp, Mus musculus
gcatacagatgctgactttcacctc

SEQ ID NO: 540756 - DNA, 25 bp, Mus musculus
gcatacagctatacaggtgcccatg

SEQ ID NO: 540757 - DNA, 25 bp, Mus musculus
gcatacagctattcaggtgcccatg

SEQ ID NO: 540758 - DNA, 25 bp, Mus musculus
gcatacagctgtcttaccagcactt

SEQ ID NO: 540759 - DNA, 25 bp, Mus musculus
gcatacagctgtgttaccagcactt

SEQ ID NO: 540760 - DNA, 25 bp, Mus musculus
gcatacaggactcgagacgtggctc

SEQ ID NO: 540761 - DNA, 25 bp, Mus musculus
gcatacaggactggagacgtggctc

SEQ ID NO: 540762 - DNA, 25 bp, Mus musculus
gcatacagtcccacaggggccagaa

SEQ ID NO: 540763 - DNA, 25 bp, Mus musculus
gcatacagtccctcaggggccagaa

SEQ ID NO: 540764 - DNA, 25 bp, Mus musculus
gcatacagtttgacccagaactctt

SEQ ID NO: 540765 - DNA, 25 bp, Mus musculus
gcatacagtttgtcccagaactctt

SEQ ID NO: 540766 - DNA, 25 bp, Mus musculus
gcatacatatctcccatattgtttt

SEQ ID NO: 540767 - DNA, 25 bp, Mus musculus
gcatacatatctcttgtggtttcac

SEQ ID NO: 540768 - DNA, 25 bp, Mus musculus
gcatacatatctgccatattgtttt

SEQ ID NO: 540769 - DNA, 25 bp, Mus musculus
gcatacatatctgttgtggtttcac

SEQ ID NO: 540770 - DNA, 25 bp, Mus musculus
gcatacatattaatgagctcaggtt

SEQ ID NO: 540771 - DNA, 25 bp, Mus musculus
gcatacatattattgagctcaggtt

SEQ ID NO: 540772 - DNA, 25 bp, Mus musculus
gcatacatatttacttatttagggc

SEQ ID NO: 540773 - DNA, 25 bp, Mus musculus
gcatacatatttctcacttgctggt

SEQ ID NO: 540774 - DNA, 25 bp, Mus musculus
gcatacatatttgtcacttgctggt

SEQ ID NO: 540775 - DNA, 25 bp, Mus musculus
gcatacatattttcttatttagggc

SEQ ID NO: 540776 - DNA, 25 bp, Mus musculus
gcatacatgacacccagtacagcta

SEQ ID NO: 540777 - DNA, 25 bp, Mus musculus
gcatacatgacagccagtacagcta

SEQ ID NO: 540778 - DNA, 25 bp, Mus musculus
gcatacatggtgactgggcgctgaa

SEQ ID NO: 540779 - DNA, 25 bp, Mus musculus
gcatacatggtgtctgggcgctgaa

SEQ ID NO: 540780 - DNA, 25 bp, Mus musculus
gcatacattcaaagcactgttctca

SEQ ID NO: 540781 - DNA, 25 bp, Mus musculus
gcatacattcaatgcactgttctca

SEQ ID NO: 540782 - DNA, 25 bp, Mus musculus
gcatacattcggctcacacagtaca

SEQ ID NO: 540783 - DNA, 25 bp, Mus musculus
gcatacattcgggtcacacagtaca

SEQ ID NO: 540784 - DNA, 25 bp, Mus musculus
gcataccaacatattttgagctctg

SEQ ID NO: 540785 - DNA, 25 bp, Mus musculus
gcataccaacattttttgagctctg

SEQ ID NO: 540786 - DNA, 25 bp, Mus musculus
gcataccagaggagcactctaccta

SEQ ID NO: 540787 - DNA, 25 bp, Mus musculus
gcataccagaggtgcactctaccta

SEQ ID NO: 540788 - DNA, 25 bp, Mus musculus
gcataccagtatataaatccaccat

SEQ ID NO: 540789 - DNA, 25 bp, Mus musculus
gcataccagtatttaaatccaccat

SEQ ID NO: 540790 - DNA, 25 bp, Mus musculus
gcataccagtgccttttcaagtcag

SEQ ID NO: 540791 - DNA, 25 bp, Mus musculus
gcataccagtgcgttttcaagtcag

SEQ ID NO: 540792 - DNA, 25 bp, Mus musculus
gcataccattgcatctttgtctgat

SEQ ID NO: 540793 - DNA, 25 bp, Mus musculus
gcataccattgcttctttgtctgat

SEQ ID NO: 540794 - DNA, 25 bp, Mus musculus
gcataccatttcattcactgtatta

SEQ ID NO: 540795 - DNA, 25 bp, Mus musculus
gcataccatttctttcactgtatta

SEQ ID NO: 540796 - DNA, 25 bp, Mus musculus
gcatacccaatgagaggggagcatt

SEQ ID NO: 540797 - DNA, 25 bp, Mus musculus
gcatacccaatgatgccgttttgtg

SEQ ID NO: 540798 - DNA, 25 bp, Mus musculus
gcatacccaatgtgaggggagcatt

SEQ ID NO: 540799 - DNA, 25 bp, Mus musculus
gcatacccaatgttgccgttttgtg

SEQ ID NO: 540800 - DNA, 25 bp, Mus musculus
gcataccccagaaattggaggccag

SEQ ID NO: 540801 - DNA, 25 bp, Mus musculus
gcataccccagatattggaggccag

SEQ ID NO: 540802 - DNA, 25 bp, Mus musculus
gcatacccttcaagatgatgaccct

SEQ ID NO: 540803 - DNA, 25 bp, Mus musculus
gcatacccttcatgatgatgaccct

SEQ ID NO: 540804 - DNA, 25 bp, Mus musculus
gcataccgacagaaggcgcctccaa

SEQ ID NO: 540805 - DNA, 25 bp, Mus musculus
gcataccgacagtaggcgcctccaa

SEQ ID NO: 540806 - DNA, 25 bp, Mus musculus
gcataccgaggaaaaatgtcgttat

SEQ ID NO: 540807 - DNA, 25 bp, Mus musculus
gcataccgaggataaatgtcgttat

SEQ ID NO: 540808 - DNA, 25 bp, Mus musculus
gcataccgcgtcaggattgcagtgc

SEQ ID NO: 540809 - DNA, 25 bp, Mus musculus
gcataccgcgtctggattgcagtgc

SEQ ID NO: 540810 - DNA, 25 bp, Mus musculus
gcataccgtaaaagtggcctctgtg

SEQ ID NO: 540811 - DNA, 25 bp, Mus musculus
gcataccgtaaatgtggcctctgtg

SEQ ID NO: 540812 - DNA, 25 bp, Mus musculus
gcatacctataactccagcacttgg

SEQ ID NO: 540813 - DNA, 25 bp, Mus musculus
gcatacctataagtccagcacttgg

SEQ ID NO: 540814 - DNA, 25 bp, Mus musculus
gcatacctattaacctagcactcag

SEQ ID NO: 540815 - DNA, 25 bp, Mus musculus
gcatacctattatcctagcactcag

SEQ ID NO: 540816 - DNA, 25 bp, Mus musculus
gcatacctcatactagcagtgatgt

SEQ ID NO: 540817 - DNA, 25 bp, Mus musculus
gcatacctcatagtagcagtgatgt

SEQ ID NO: 540818 - DNA, 25 bp, Mus musculus
gcatacctccaacatgtgtgtcata

SEQ ID NO: 540819 - DNA, 25 bp, Mus musculus
gcatacctccaagatgtgtgtcata

SEQ ID NO: 540820 - DNA, 25 bp, Mus musculus
gcatacctcttactagtgtgttcct

SEQ ID NO: 540821 - DNA, 25 bp, Mus musculus
gcatacctcttagtagtgtgttcct

SEQ ID NO: 540822 - DNA, 25 bp, Mus musculus
gcataccttctgcacagagacccgg

SEQ ID NO: 540823 - DNA, 25 bp, Mus musculus
gcataccttctggacagagacccgg

SEQ ID NO: 540824 - DNA, 25 bp, Mus musculus
gcataccttgctagggagaataaaa

SEQ ID NO: 540825 - DNA, 25 bp, Mus musculus
gcataccttgcttgggagaataaaa

SEQ ID NO: 540826 - DNA, 25 bp, Mus musculus
gcataccttgttcgattggagaatt

SEQ ID NO: 540827 - DNA, 25 bp, Mus musculus
gcataccttgttggattggagaatt

SEQ ID NO: 540828 - DNA, 25 bp, Mus musculus
gcatacgaaggacaacctgccagga

SEQ ID NO: 540829 - DNA, 25 bp, Mus musculus
gcatacgaaggagaacctgccagga

SEQ ID NO: 540830 - DNA, 25 bp, Mus musculus
gcatacgacatgagctgctgaccat

SEQ ID NO: 540831 - DNA, 25 bp, Mus musculus
gcatacgacatgtgctgctgaccat

SEQ ID NO: 540832 - DNA, 25 bp, Mus musculus
gcatacgcatatcccagtctgttgt

SEQ ID NO: 540833 - DNA, 25 bp, Mus musculus
gcatacgcatatgccagtctgttgt

SEQ ID NO: 540834 - DNA, 25 bp, Mus musculus
gcatacgccacaaggtacgcaataa

SEQ ID NO: 540835 - DNA, 25 bp, Mus musculus
gcatacgccacatggtacgcaataa

SEQ ID NO: 540836 - DNA, 25 bp, Mus musculus
gcatacgcctcactgtgcttaaaat

SEQ ID NO: 540837 - DNA, 25 bp, Mus musculus
gcatacgcctcagtgtgcttaaaat

SEQ ID NO: 540838 - DNA, 25 bp, Mus musculus
gcatacgcctgtaatcctgatttgg

SEQ ID NO: 540839 - DNA, 25 bp, Mus musculus
gcatacgcctgttatcctgatttgg

SEQ ID NO: 540840 - DNA, 25 bp, Mus musculus
gcatacgcggagaacgtgcttaaga

SEQ ID NO: 540841 - DNA, 25 bp, Mus musculus
gcatacgcggagtacgtgcttaaga

SEQ ID NO: 540842 - DNA, 25 bp, Mus musculus
gcatacggactccagtgtaaactgt

SEQ ID NO: 540843 - DNA, 25 bp, Mus musculus
gcatacggactcgagtgtaaactgt

SEQ ID NO: 540844 - DNA, 25 bp, Mus musculus
gcatacggccacatttgattgctgc

SEQ ID NO: 540845 - DNA, 25 bp, Mus musculus
gcatacggccacttttgattgctgc

SEQ ID NO: 540846 - DNA, 25 bp, Mus musculus
gcatacggtcagacagatctcccct

SEQ ID NO: 540847 - DNA, 25 bp, Mus musculus
gcatacggtcagtcagatctcccct

SEQ ID NO: 540848 - DNA, 25 bp, Mus musculus
gcatacgtggctcacggcactgtgt

SEQ ID NO: 540849 - DNA, 25 bp, Mus musculus
gcatacgtggctgacggcactgtgt

SEQ ID NO: 540850 - DNA, 25 bp, Mus musculus
gcatacgtgttacgcaggtactcat

SEQ ID NO: 540851 - DNA, 25 bp, Mus musculus
gcatacgtgttaggcaggtactcat

SEQ ID NO: 540852 - DNA, 25 bp, Mus musculus
gcatacgtttgtcctgccaaaagct

SEQ ID NO: 540853 - DNA, 25 bp, Mus musculus
gcatacgtttgtgctgccaaaagct

SEQ ID NO: 540854 - DNA, 25 bp, Mus musculus
gcatactacagaccatagaaacaag

SEQ ID NO: 540855 - DNA, 25 bp, Mus musculus
gcatactacagagcatagaaacaag

SEQ ID NO: 540856 - DNA, 25 bp, Mus musculus
gcatactacattatttaatgtcagt

SEQ ID NO: 540857 - DNA, 25 bp, Mus musculus
gcatactacattttttaatgtcagt

SEQ ID NO: 540858 - DNA, 25 bp, Mus musculus
gcatactacctacatgtccaattaa

SEQ ID NO: 540859 - DNA, 25 bp, Mus musculus
gcatactacctagatgtccaattaa

SEQ ID NO: 540860 - DNA, 25 bp, Mus musculus
gcatactactgaatagagctttcta

SEQ ID NO: 540861 - DNA, 25 bp, Mus musculus
gcatactactgattagagctttcta

SEQ ID NO: 540862 - DNA, 25 bp, Mus musculus
gcatactattatacctggctttaca

SEQ ID NO: 540863 - DNA, 25 bp, Mus musculus
gcatactattattcctggctttaca

SEQ ID NO: 540864 - DNA, 25 bp, Mus musculus
gcatactcaaacaaccacaaagctc

SEQ ID NO: 540865 - DNA, 25 bp, Mus musculus
gcatactcaaactaccacaaagctc

SEQ ID NO: 540866 - DNA, 25 bp, Mus musculus
gcatactcaagtcaattctctccat

SEQ ID NO: 540867 - DNA, 25 bp, Mus musculus
gcatactcaagtgaattctctccat

SEQ ID NO: 540868 - DNA, 25 bp, Mus musculus
gcatactcccctctttgaatggtgg

SEQ ID NO: 540869 - DNA, 25 bp, Mus musculus
gcatactcccctgtttgaatggtgg

SEQ ID NO: 540870 - DNA, 25 bp, Mus musculus
gcatactcttagcaaataccaaaca

SEQ ID NO: 540871 - DNA, 25 bp, Mus musculus
gcatactcttaggaaataccaaaca

SEQ ID NO: 540872 - DNA, 25 bp, Mus musculus
gcatactcttgaatcttgtgtcatc

SEQ ID NO: 540873 - DNA, 25 bp, Mus musculus
gcatactcttgattcttgtgtcatc

SEQ ID NO: 540874 - DNA, 25 bp, Mus musculus
gcatactgcattctattctggatac

SEQ ID NO: 540875 - DNA, 25 bp, Mus musculus
gcatactgcattgtattctggatac

SEQ ID NO: 540876 - DNA, 25 bp, Mus musculus
gcatactggttaattagaggtttct

SEQ ID NO: 540877 - DNA, 25 bp, Mus musculus
gcatactggttatttagaggtttct

SEQ ID NO: 540878 - DNA, 25 bp, Mus musculus
gcatactgtaccaacagggtgtgga

SEQ ID NO: 540879 - DNA, 25 bp, Mus musculus
gcatactgtacctacagggtgtgga

SEQ ID NO: 540880 - DNA, 25 bp, Mus musculus
gcatactgtctgattaaacacaaac

SEQ ID NO: 540881 - DNA, 25 bp, Mus musculus
gcatactgtctgtttaaacacaaac

SEQ ID NO: 540882 - DNA, 25 bp, Mus musculus
gcatactgtgttcagtcccgggcaa

SEQ ID NO: 540883 - DNA, 25 bp, Mus musculus
gcatactgtgttgagtcccgggcaa

SEQ ID NO: 540884 - DNA, 25 bp, Mus musculus
gcatacttaatgcacactttatctt

SEQ ID NO: 540885 - DNA, 25 bp, Mus musculus
gcatacttaatggacactttatctt

SEQ ID NO: 540886 - DNA, 25 bp, Mus musculus
gcatacttacataaaccttcatctt

SEQ ID NO: 540887 - DNA, 25 bp, Mus musculus
gcatacttacatctagccatcctgt

SEQ ID NO: 540888 - DNA, 25 bp, Mus musculus
gcatacttacatgtagccatcctgt

SEQ ID NO: 540889 - DNA, 25 bp, Mus musculus
gcatacttacattaaccttcatctt

SEQ ID NO: 540890 - DNA, 25 bp, Mus musculus
gcatacttcacacttctactaacct

SEQ ID NO: 540891 - DNA, 25 bp, Mus musculus
gcatacttcacagttctactaacct

SEQ ID NO: 540892 - DNA, 25 bp, Mus musculus
gcatacttcatcataacccggcaga

SEQ ID NO: 540893 - DNA, 25 bp, Mus musculus
gcatacttcatcttaacccggcaga

SEQ ID NO: 540894 - DNA, 25 bp, Mus musculus
gcatacttgaacactggcatcggag

SEQ ID NO: 540895 - DNA, 25 bp, Mus musculus
gcatacttgaactctggcatcggag

SEQ ID NO: 540896 - DNA, 25 bp, Mus musculus
gcatacttggacacaacagagaggt

SEQ ID NO: 540897 - DNA, 25 bp, Mus musculus
gcatacttggactcaacagagaggt

SEQ ID NO: 540898 - DNA, 25 bp, Mus musculus
gcatacttgtttcggtctcacggaa

SEQ ID NO: 540899 - DNA, 25 bp, Mus musculus
gcatacttgtttgggtctcacggaa

SEQ ID NO: 540900 - DNA, 25 bp, Mus musculus
gcatacttttgcatagagactttaa

SEQ ID NO: 540901 - DNA, 25 bp, Mus musculus
gcatacttttgcttagagactttaa

SEQ ID NO: 540902 - DNA, 25 bp, Mus musculus
gcatagaaaaacactggtctcaaga

SEQ ID NO: 540903 - DNA, 25 bp, Mus musculus
gcatagaaaaactctggtctcaaga

SEQ ID NO: 540904 - DNA, 25 bp, Mus musculus
gcatagaactgcaggaagatgaaca

SEQ ID NO: 540905 - DNA, 25 bp, Mus musculus
gcatagaactgctggaagatgaaca

SEQ ID NO: 540906 - DNA, 25 bp, Mus musculus
gcatagaactggacattactggcga

SEQ ID NO: 540907 - DNA, 25 bp, Mus musculus
gcatagaactggtcattactggcga

SEQ ID NO: 540908 - DNA, 25 bp, Mus musculus
gcatagaactttactcctttttcat

SEQ ID NO: 540909 - DNA, 25 bp, Mus musculus
gcatagaacttttctcctttttcat

SEQ ID NO: 540910 - DNA, 25 bp, Mus musculus
gcatagaattttaactcacagctca

SEQ ID NO: 540911 - DNA, 25 bp, Mus musculus
gcatagaatttttactcacagctca

SEQ ID NO: 540912 - DNA, 25 bp, Mus musculus
gcatagacagtaagtacccctgaga

SEQ ID NO: 540913 - DNA, 25 bp, Mus musculus
gcatagacagtatgtacccctgaga

SEQ ID NO: 540914 - DNA, 25 bp, Mus musculus
gcatagactggcaatcactccaaaa

SEQ ID NO: 540915 - DNA, 25 bp, Mus musculus
gcatagactggctatcactccaaaa

SEQ ID NO: 540916 - DNA, 25 bp, Mus musculus
gcatagacttacaaccatgattgga

SEQ ID NO: 540917 - DNA, 25 bp, Mus musculus
gcatagacttactaccatgattgga

SEQ ID NO: 540918 - DNA, 25 bp, Mus musculus
gcatagagaacacccaacccagact

SEQ ID NO: 540919 - DNA, 25 bp, Mus musculus
gcatagagaacagccaacccagact

SEQ ID NO: 540920 - DNA, 25 bp, Mus musculus
gcatagagcgagagtgcacccacct

SEQ ID NO: 540921 - DNA, 25 bp, Mus musculus
gcatagagcgagtgtgcacccacct

SEQ ID NO: 540922 - DNA, 25 bp, Mus musculus
gcatagaggtacctttccaaagtcc

SEQ ID NO: 540923 - DNA, 25 bp, Mus musculus
gcatagaggtacgtttccaaagtcc

SEQ ID NO: 540924 - DNA, 25 bp, Mus musculus
gcatagatgcccatagagatcagaa

SEQ ID NO: 540925 - DNA, 25 bp, Mus musculus
gcatagatgcccttagagatcagaa

SEQ ID NO: 540926 - DNA, 25 bp, Mus musculus
gcatagattcggattttggagggtt

SEQ ID NO: 540927 - DNA, 25 bp, Mus musculus
gcatagattcggtttttggagggtt

SEQ ID NO: 540928 - DNA, 25 bp, Mus musculus
gcatagcacaacctggatgctcaat

SEQ ID NO: 540929 - DNA, 25 bp, Mus musculus
gcatagcacaacgtggatgctcaat

SEQ ID NO: 540930 - DNA, 25 bp, Mus musculus
gcatagcacgctcgctggaacacag

SEQ ID NO: 540931 - DNA, 25 bp, Mus musculus
gcatagcacgctggctggaacacag

SEQ ID NO: 540932 - DNA, 25 bp, Mus musculus
gcatagcagctaaaatgtcctgctt

SEQ ID NO: 540933 - DNA, 25 bp, Mus musculus
gcatagcagctataatgtcctgctt

SEQ ID NO: 540934 - DNA, 25 bp, Mus musculus
gcatagcagtttatctgttcataac

SEQ ID NO: 540935 - DNA, 25 bp, Mus musculus
gcatagcagtttttctgttcataac

SEQ ID NO: 540936 - DNA, 25 bp, Mus musculus
gcatagcatattacaggagctcaca

SEQ ID NO: 540937 - DNA, 25 bp, Mus musculus
gcatagcatatttcaggagctcaca

SEQ ID NO: 540938 - DNA, 25 bp, Mus musculus
gcatagcatgccctgggtacactaa

SEQ ID NO: 540939 - DNA, 25 bp, Mus musculus
gcatagcatgccgtgggtacactaa

SEQ ID NO: 540940 - DNA, 25 bp, Mus musculus
gcatagcattatacatggaaccaga

SEQ ID NO: 540941 - DNA, 25 bp, Mus musculus
gcatagcattattcatggaaccaga

SEQ ID NO: 540942 - DNA, 25 bp, Mus musculus
gcatagcattccacctatcatgagg

SEQ ID NO: 540943 - DNA, 25 bp, Mus musculus
gcatagcattccattgcatgaaaac

SEQ ID NO: 540944 - DNA, 25 bp, Mus musculus
gcatagcattcctcctatcatgagg

SEQ ID NO: 540945 - DNA, 25 bp, Mus musculus
gcatagcattcctttgcatgaaaac

SEQ ID NO: 540946 - DNA, 25 bp, Mus musculus
gcatagcattgtaccaactaacctt

SEQ ID NO: 540947 - DNA, 25 bp, Mus musculus
gcatagcattgttccaactaacctt

SEQ ID NO: 540948 - DNA, 25 bp, Mus musculus
gcatagccatgtagatccatttttg

SEQ ID NO: 540949 - DNA, 25 bp, Mus musculus
gcatagccatgttgatccatttttg

SEQ ID NO: 540950 - DNA, 25 bp, Mus musculus
gcatagccattgagcacatcctcct

SEQ ID NO: 540951 - DNA, 25 bp, Mus musculus
gcatagccattgtgcacatcctcct

SEQ ID NO: 540952 - DNA, 25 bp, Mus musculus
gcatagcccctcctgtgactgagag

SEQ ID NO: 540953 - DNA, 25 bp, Mus musculus
gcatagcccctcgtgtgactgagag

SEQ ID NO: 540954 - DNA, 25 bp, Mus musculus
gcatagccctttccttcatgttaat

SEQ ID NO: 540955 - DNA, 25 bp, Mus musculus
gcatagccctttgcttcatgttaat

SEQ ID NO: 540956 - DNA, 25 bp, Mus musculus
gcatagcctatactccaggtgacat

SEQ ID NO: 540957 - DNA, 25 bp, Mus musculus
gcatagcctatagtccaggtgacat

SEQ ID NO: 540958 - DNA, 25 bp, Mus musculus
gcatagcctggccttggaagaaccc

SEQ ID NO: 540959 - DNA, 25 bp, Mus musculus
gcatagcctggcgttggaagaaccc

SEQ ID NO: 540960 - DNA, 25 bp, Mus musculus
gcatagcctttcactacagttctta

SEQ ID NO: 540961 - DNA, 25 bp, Mus musculus
gcatagcctttctctacagttctta

SEQ ID NO: 540962 - DNA, 25 bp, Mus musculus
gcatagcgtcgtacacacggtgaaa

SEQ ID NO: 540963 - DNA, 25 bp, Mus musculus
gcatagcgtcgttcacacggtgaaa

SEQ ID NO: 540964 - DNA, 25 bp, Mus musculus
gcatagctatgacgagttggaagag

SEQ ID NO: 540965 - DNA, 25 bp, Mus musculus
gcatagctatgaggagttggaagag

SEQ ID NO: 540966 - DNA, 25 bp, Mus musculus
gcatagctgatgaaaacgtgtttta

SEQ ID NO: 540967 - DNA, 25 bp, Mus musculus
gcatagctgatgtaaacgtgtttta

SEQ ID NO: 540968 - DNA, 25 bp, Mus musculus
gcatagctgattcccattttattct

SEQ ID NO: 540969 - DNA, 25 bp, Mus musculus
gcatagctgattgccattttattct

SEQ ID NO: 540970 - DNA, 25 bp, Mus musculus
gcatagctgcagaggaatatacatt

SEQ ID NO: 540971 - DNA, 25 bp, Mus musculus
gcatagctgcagagtgtcctcgagt

SEQ ID NO: 540972 - DNA, 25 bp, Mus musculus
gcatagctgcagtggaatatacatt

SEQ ID NO: 540973 - DNA, 25 bp, Mus musculus
gcatagctgcagtgtgtcctcgagt

SEQ ID NO: 540974 - DNA, 25 bp, Mus musculus
gcatagctggctaaatgagcacaga

SEQ ID NO: 540975 - DNA, 25 bp, Mus musculus
gcatagctggcttaatgagcacaga

SEQ ID NO: 540976 - DNA, 25 bp, Mus musculus
gcatagctgggacaattaccttcat

SEQ ID NO: 540977 - DNA, 25 bp, Mus musculus
gcatagctgggagaattaccttcat

SEQ ID NO: 540978 - DNA, 25 bp, Mus musculus
gcatagctgtgtccaacgtcacgat

SEQ ID NO: 540979 - DNA, 25 bp, Mus musculus
gcatagctgtgtgcaacgtcacgat

SEQ ID NO: 540980 - DNA, 25 bp, Mus musculus
gcatagctgttgatctggctttcat

SEQ ID NO: 540981 - DNA, 25 bp, Mus musculus
gcatagctgttgttctggctttcat

SEQ ID NO: 540982 - DNA, 25 bp, Mus musculus
gcatagcttccaatatttcagttcc

SEQ ID NO: 540983 - DNA, 25 bp, Mus musculus
gcatagcttccattatttcagttcc

SEQ ID NO: 540984 - DNA, 25 bp, Mus musculus
gcatagcttttgagcccacatggac

SEQ ID NO: 540985 - DNA, 25 bp, Mus musculus
gcatagcttttgtgcccacatggac

SEQ ID NO: 540986 - DNA, 25 bp, Mus musculus
gcataggaaacgagtctccccgtgt

SEQ ID NO: 540987 - DNA, 25 bp, Mus musculus
gcataggaaacgtgtctccccgtgt

SEQ ID NO: 540988 - DNA, 25 bp, Mus musculus
gcataggaactgatacagattcttt

SEQ ID NO: 540989 - DNA, 25 bp, Mus musculus
gcataggaactgttacagattcttt

SEQ ID NO: 540990 - DNA, 25 bp, Mus musculus
gcataggagttgctgctttctgagc

SEQ ID NO: 540991 - DNA, 25 bp, Mus musculus
gcataggagttggtgctttctgagc

SEQ ID NO: 540992 - DNA, 25 bp, Mus musculus
gcataggatctaacttccagcactg

SEQ ID NO: 540993 - DNA, 25 bp, Mus musculus
gcataggatctatcttccagcactg

SEQ ID NO: 540994 - DNA, 25 bp, Mus musculus
gcataggattacaaccactgagcca

SEQ ID NO: 540995 - DNA, 25 bp, Mus musculus
gcataggattactaccactgagcca

SEQ ID NO: 540996 - DNA, 25 bp, Mus musculus
gcataggccgtactaacctgtcaga

SEQ ID NO: 540997 - DNA, 25 bp, Mus musculus
gcataggccgtagtaacctgtcaga

SEQ ID NO: 540998 - DNA, 25 bp, Mus musculus
gcataggcctgtctctttcgttaaa

SEQ ID NO: 540999 - DNA, 25 bp, Mus musculus
gcataggcctgtgtctttcgttaaa

SEQ ID NO: 541000 - DNA, 25 bp, Mus musculus
gcataggctaagagccacccctgag

SEQ ID NO: 541001 - DNA, 25 bp, Mus musculus
gcataggctaagtgccacccctgag

SEQ ID NO: 541002 - DNA, 25 bp, Mus musculus
gcataggctccaaattgagtatcat

SEQ ID NO: 541003 - DNA, 25 bp, Mus musculus
gcataggctccatattgagtatcat

SEQ ID NO: 541004 - DNA, 25 bp, Mus musculus
gcataggctctaatgaccatgtcca

SEQ ID NO: 541005 - DNA, 25 bp, Mus musculus
gcataggctctattgaccatgtcca

SEQ ID NO: 541006 - DNA, 25 bp, Mus musculus
gcataggctgtcacttatccttgaa

SEQ ID NO: 541007 - DNA, 25 bp, Mus musculus
gcataggctgtctcttatccttgaa

SEQ ID NO: 541008 - DNA, 25 bp, Mus musculus
gcatagggacagaggccagcttatt

SEQ ID NO: 541009 - DNA, 25 bp, Mus musculus
gcatagggacagtggccagcttatt

SEQ ID NO: 541010 - DNA, 25 bp, Mus musculus
gcatagggacctcggcatgtattta

SEQ ID NO: 541011 - DNA, 25 bp, Mus musculus
gcatagggacctgggcatgtattta

SEQ ID NO: 541012 - DNA, 25 bp, Mus musculus
gcatagggattaaaagctgttcagt

SEQ ID NO: 541013 - DNA, 25 bp, Mus musculus
gcatagggattataagctgttcagt

SEQ ID NO: 541014 - DNA, 25 bp, Mus musculus
gcatagggatttcttttgtttactt

SEQ ID NO: 541015 - DNA, 25 bp, Mus musculus
gcatagggatttgttttgtttactt

SEQ ID NO: 541016 - DNA, 25 bp, Mus musculus
gcatagggcactaagaacagggaac

SEQ ID NO: 541017 - DNA, 25 bp, Mus musculus
gcatagggcacttagaacagggaac

SEQ ID NO: 541018 - DNA, 25 bp, Mus musculus
gcatagggcattcttgtggctgtcc

SEQ ID NO: 541019 - DNA, 25 bp, Mus musculus
gcatagggcattgttgtggctgtcc

SEQ ID NO: 541020 - DNA, 25 bp, Mus musculus
gcatagggtcccacagacaagtgct

SEQ ID NO: 541021 - DNA, 25 bp, Mus musculus
gcatagggtccctcagacaagtgct

SEQ ID NO: 541022 - DNA, 25 bp, Mus musculus
gcatagggtttgctcccagtagcca

SEQ ID NO: 541023 - DNA, 25 bp, Mus musculus
gcatagggtttggtcccagtagcca

SEQ ID NO: 541024 - DNA, 25 bp, Mus musculus
gcataggtaaaacccctctcaagaa

SEQ ID NO: 541025 - DNA, 25 bp, Mus musculus
gcataggtaaaagccctctcaagaa

SEQ ID NO: 541026 - DNA, 25 bp, Mus musculus
gcataggtacgacatgtttagtaaa

SEQ ID NO: 541027 - DNA, 25 bp, Mus musculus
gcataggtacgagatgtttagtaaa

SEQ ID NO: 541028 - DNA, 25 bp, Mus musculus
gcataggtcattaacgttcacggtt

SEQ ID NO: 541029 - DNA, 25 bp, Mus musculus
gcataggtcatttacgttcacggtt

SEQ ID NO: 541030 - DNA, 25 bp, Mus musculus
gcataggtctgtactctgtagaatc

SEQ ID NO: 541031 - DNA, 25 bp, Mus musculus
gcataggtctgttctctgtagaatc

SEQ ID NO: 541032 - DNA, 25 bp, Mus musculus
gcataggtgattctgacagcttcag

SEQ ID NO: 541033 - DNA, 25 bp, Mus musculus
gcataggtgattgtgacagcttcag

SEQ ID NO: 541034 - DNA, 25 bp, Mus musculus
gcataggtgccaacgcaaggtcaca

SEQ ID NO: 541035 - DNA, 25 bp, Mus musculus
gcataggtgccatcgcaaggtcaca

SEQ ID NO: 541036 - DNA, 25 bp, Mus musculus
gcataggttcccagtcttgcatggg

SEQ ID NO: 541037 - DNA, 25 bp, Mus musculus
gcataggttccctgtcttgcatggg

SEQ ID NO: 541038 - DNA, 25 bp, Mus musculus
gcataggttggtaggttcaccggct

SEQ ID NO: 541039 - DNA, 25 bp, Mus musculus
gcataggttggttggttcaccggct

SEQ ID NO: 541040 - DNA, 25 bp, Mus musculus
gcatagtaccatacgtcgtacctat

SEQ ID NO: 541041 - DNA, 25 bp, Mus musculus
gcatagtaccattcgtcgtacctat

SEQ ID NO: 541042 - DNA, 25 bp, Mus musculus
gcatagtactttctgttgttttccc

SEQ ID NO: 541043 - DNA, 25 bp, Mus musculus
gcatagtactttgtgttgttttccc

SEQ ID NO: 541044 - DNA, 25 bp, Mus musculus
gcatagtatatactgggtagccaac

SEQ ID NO: 541045 - DNA, 25 bp, Mus musculus
gcatagtatatagtgggtagccaac

SEQ ID NO: 541046 - DNA, 25 bp, Mus musculus
gcatagtatctgattgtcccttctg

SEQ ID NO: 541047 - DNA, 25 bp, Mus musculus
gcatagtatctgtttgtcccttctg

SEQ ID NO: 541048 - DNA, 25 bp, Mus musculus
gcatagtattcacttgctacagcca

SEQ ID NO: 541049 - DNA, 25 bp, Mus musculus
gcatagtattcagttgctacagcca

SEQ ID NO: 541050 - DNA, 25 bp, Mus musculus
gcatagtcaaacacctagcccaaag

SEQ ID NO: 541051 - DNA, 25 bp, Mus musculus
gcatagtcaaactcctagcccaaag

SEQ ID NO: 541052 - DNA, 25 bp, Mus musculus
gcatagtcagctatgtaatccattt

SEQ ID NO: 541053 - DNA, 25 bp, Mus musculus
gcatagtcagctttgtaatccattt

SEQ ID NO: 541054 - DNA, 25 bp, Mus musculus
gcatagtctctaatctacctggaac

SEQ ID NO: 541055 - DNA, 25 bp, Mus musculus
gcatagtctctattctacctggaac

SEQ ID NO: 541056 - DNA, 25 bp, Mus musculus
gcatagtctcttactacctgattaa

SEQ ID NO: 541057 - DNA, 25 bp, Mus musculus
gcatagtctctttctacctgattaa

SEQ ID NO: 541058 - DNA, 25 bp, Mus musculus
gcatagtctgcaaaggagatcattg

SEQ ID NO: 541059 - DNA, 25 bp, Mus musculus
gcatagtctgcataggagatcattg

SEQ ID NO: 541060 - DNA, 25 bp, Mus musculus
gcatagtgacacaaccctttaatcc

SEQ ID NO: 541061 - DNA, 25 bp, Mus musculus
gcatagtgacactaccctttaatcc

SEQ ID NO: 541062 - DNA, 25 bp, Mus musculus
gcatagtgcaaacgtaggaaagtct

SEQ ID NO: 541063 - DNA, 25 bp, Mus musculus
gcatagtgcaaaggtaggaaagtct

SEQ ID NO: 541064 - DNA, 25 bp, Mus musculus
gcatagtgctaacataattcatgga

SEQ ID NO: 541065 - DNA, 25 bp, Mus musculus
gcatagtgctaagataattcatgga

SEQ ID NO: 541066 - DNA, 25 bp, Mus musculus
gcatagtgtgcccaattcctgtatt

SEQ ID NO: 541067 - DNA, 25 bp, Mus musculus
gcatagtgtgccgaattcctgtatt

SEQ ID NO: 541068 - DNA, 25 bp, Mus musculus
gcatagttgaaaccccttctacctg

SEQ ID NO: 541069 - DNA, 25 bp, Mus musculus
gcatagttgaaagcccttctacctg

SEQ ID NO: 541070 - DNA, 25 bp, Mus musculus
gcatagttgagtatttggaaagtcc

SEQ ID NO: 541071 - DNA, 25 bp, Mus musculus
gcatagttgagtttttggaaagtcc

SEQ ID NO: 541072 - DNA, 25 bp, Mus musculus
gcatagttggcgattagggtccctc

SEQ ID NO: 541073 - DNA, 25 bp, Mus musculus
gcatagttggcgtttagggtccctc

SEQ ID NO: 541074 - DNA, 25 bp, Mus musculus
gcatagtttgcccacatgcaagaat

SEQ ID NO: 541075 - DNA, 25 bp, Mus musculus
gcatagtttgccgacatgcaagaat

SEQ ID NO: 541076 - DNA, 25 bp, Mus musculus
gcatagttttgtatgtctatctgca

SEQ ID NO: 541077 - DNA, 25 bp, Mus musculus
gcatagttttgtttgtctatctgca

SEQ ID NO: 541078 - DNA, 25 bp, Mus musculus
gcatataaaatcatcatacctttga

SEQ ID NO: 541079 - DNA, 25 bp, Mus musculus
gcatataaaatcttcatacctttga

SEQ ID NO: 541080 - DNA, 25 bp, Mus musculus
gcatataaatgcaagggtcctgaga

SEQ ID NO: 541081 - DNA, 25 bp, Mus musculus
gcatataaatgctagggtcctgaga

SEQ ID NO: 541082 - DNA, 25 bp, Mus musculus
gcatatacacaaagcactgtggcat

SEQ ID NO: 541083 - DNA, 25 bp, Mus musculus
gcatatacacaatgcactgtggcat

SEQ ID NO: 541084 - DNA, 25 bp, Mus musculus
gcatatacactacctattgcctaac

SEQ ID NO: 541085 - DNA, 25 bp, Mus musculus
gcatatacactagctattgcctaac

SEQ ID NO: 541086 - DNA, 25 bp, Mus musculus
gcatataccactcggtgcttaataa

SEQ ID NO: 541087 - DNA, 25 bp, Mus musculus
gcatataccactgggtgcttaataa

SEQ ID NO: 541088 - DNA, 25 bp, Mus musculus
gcatatacgtaaagtcacctattta

SEQ ID NO: 541089 - DNA, 25 bp, Mus musculus
gcatatacgtaatgtcacctattta

SEQ ID NO: 541090 - DNA, 25 bp, Mus musculus
gcatatactgttccatagattgtaa

SEQ ID NO: 541091 - DNA, 25 bp, Mus musculus
gcatatactgttgcatagattgtaa

SEQ ID NO: 541092 - DNA, 25 bp, Mus musculus
gcatatagactccttattacaggtt

SEQ ID NO: 541093 - DNA, 25 bp, Mus musculus
gcatatagactcgttattacaggtt

SEQ ID NO: 541094 - DNA, 25 bp, Mus musculus
gcatatagatttctacccttgtcct

SEQ ID NO: 541095 - DNA, 25 bp, Mus musculus
gcatatagatttgtacccttgtcct

SEQ ID NO: 541096 - DNA, 25 bp, Mus musculus
gcatatagcatcatgcccagctttt

SEQ ID NO: 541097 - DNA, 25 bp, Mus musculus
gcatatagcatcttgcccagctttt

SEQ ID NO: 541098 - DNA, 25 bp, Mus musculus
gcatatagcccacgcttgatcacct

SEQ ID NO: 541099 - DNA, 25 bp, Mus musculus
gcatatagcccaggcttgatcacct

SEQ ID NO: 541100 - DNA, 25 bp, Mus musculus
gcatatagcgttcttccatagcatt

SEQ ID NO: 541101 - DNA, 25 bp, Mus musculus
gcatatagcgttgttccatagcatt

SEQ ID NO: 541102 - DNA, 25 bp, Mus musculus
gcatatagcttgctagaattaacat

SEQ ID NO: 541103 - DNA, 25 bp, Mus musculus
gcatatagcttggtagaattaacat

SEQ ID NO: 541104 - DNA, 25 bp, Mus musculus
gcatatagtttcattgcacccacta

SEQ ID NO: 541105 - DNA, 25 bp, Mus musculus
gcatatagtttctttgcacccacta

SEQ ID NO: 541106 - DNA, 25 bp, Mus musculus
gcatatagttttccaagagtgtacc

SEQ ID NO: 541107 - DNA, 25 bp, Mus musculus
gcatatagttttgcaagagtgtacc

SEQ ID NO: 541108 - DNA, 25 bp, Mus musculus
gcatatataaagagacgatcccaaa

SEQ ID NO: 541109 - DNA, 25 bp, Mus musculus
gcatatataaagtgacgatcccaaa

SEQ ID NO: 541110 - DNA, 25 bp, Mus musculus
gcatatatacacagtggctcccaac

SEQ ID NO: 541111 - DNA, 25 bp, Mus musculus
gcatatatacactgtggctcccaac

SEQ ID NO: 541112 - DNA, 25 bp, Mus musculus
gcatatatccatattcataactgtg

SEQ ID NO: 541113 - DNA, 25 bp, Mus musculus
gcatatatccattttcataactgtg

SEQ ID NO: 541114 - DNA, 25 bp, Mus musculus
gcatatatcccaatgtagggaagac

SEQ ID NO: 541115 - DNA, 25 bp, Mus musculus
gcatatatcccattgtagggaagac

SEQ ID NO: 541116 - DNA, 25 bp, Mus musculus
gcatatatctccacatcacatatca

SEQ ID NO: 541117 - DNA, 25 bp, Mus musculus
gcatatatctcctcatcacatatca

SEQ ID NO: 541118 - DNA, 25 bp, Mus musculus
gcatatatctctacatcacatctta

SEQ ID NO: 541119 - DNA, 25 bp, Mus musculus
gcatatatctcttcatcacatctta

SEQ ID NO: 541120 - DNA, 25 bp, Mus musculus
gcatatatgctacttgacactctga

SEQ ID NO: 541121 - DNA, 25 bp, Mus musculus
gcatatatgctagttgacactctga

SEQ ID NO: 541122 - DNA, 25 bp, Mus musculus
gcatatatggtgactgtctgcagac

SEQ ID NO: 541123 - DNA, 25 bp, Mus musculus
gcatatatggtgtctgtctgcagac

SEQ ID NO: 541124 - DNA, 25 bp, Mus musculus
gcatatatgtatccttggtgcctat

SEQ ID NO: 541125 - DNA, 25 bp, Mus musculus
gcatatatgtatgcttggtgcctat

SEQ ID NO: 541126 - DNA, 25 bp, Mus musculus
gcatatattctgaattcaagcttct

SEQ ID NO: 541127 - DNA, 25 bp, Mus musculus
gcatatattctgtattcaagcttct

SEQ ID NO: 541128 - DNA, 25 bp, Mus musculus
gcatatattgctcaacatttctttg

SEQ ID NO: 541129 - DNA, 25 bp, Mus musculus
gcatatattgctgaacatttctttg

SEQ ID NO: 541130 - DNA, 25 bp, Mus musculus
gcatatattgtaacatgggaatgtt

SEQ ID NO: 541131 - DNA, 25 bp, Mus musculus
gcatatattgtatcatgggaatgtt

SEQ ID NO: 541132 - DNA, 25 bp, Mus musculus
gcatatatttacagcctgcttgagt

SEQ ID NO: 541133 - DNA, 25 bp, Mus musculus
gcatatatttaccaattccaagtat

SEQ ID NO: 541134 - DNA, 25 bp, Mus musculus
gcatatatttacgaattccaagtat

SEQ ID NO: 541135 - DNA, 25 bp, Mus musculus
gcatatatttactgcctgcttgagt

SEQ ID NO: 541136 - DNA, 25 bp, Mus musculus
gcatatcaaacccttactcactaaa

SEQ ID NO: 541137 - DNA, 25 bp, Mus musculus
gcatatcaaaccgttactcactaaa

SEQ ID NO: 541138 - DNA, 25 bp, Mus musculus
gcatatcacctacgttgttttctgg

SEQ ID NO: 541139 - DNA, 25 bp, Mus musculus
gcatatcacctaggttgttttctgg

SEQ ID NO: 541140 - DNA, 25 bp, Mus musculus
gcatatcagaccacttgacaggtaa

SEQ ID NO: 541141 - DNA, 25 bp, Mus musculus
gcatatcagacctcttgacaggtaa

SEQ ID NO: 541142 - DNA, 25 bp, Mus musculus
gcatatcatatgcttgccatataca

SEQ ID NO: 541143 - DNA, 25 bp, Mus musculus
gcatatcatatggttgccatataca

SEQ ID NO: 541144 - DNA, 25 bp, Mus musculus
gcatatccctgtaacccatacactc

SEQ ID NO: 541145 - DNA, 25 bp, Mus musculus
gcatatccctgtcggctgaaagtta

SEQ ID NO: 541146 - DNA, 25 bp, Mus musculus
gcatatccctgtgggctgaaagtta

SEQ ID NO: 541147 - DNA, 25 bp, Mus musculus
gcatatccctgttacccatacactc

SEQ ID NO: 541148 - DNA, 25 bp, Mus musculus
gcatatccgcaaagccaccaagtat

SEQ ID NO: 541149 - DNA, 25 bp, Mus musculus
gcatatccgcaatgccaccaagtat

SEQ ID NO: 541150 - DNA, 25 bp, Mus musculus
gcatatccgtggagtctttatccta

SEQ ID NO: 541151 - DNA, 25 bp, Mus musculus
gcatatccgtggtgtctttatccta

SEQ ID NO: 541152 - DNA, 25 bp, Mus musculus
gcatatcctgtcctgaaagtgtgtg

SEQ ID NO: 541153 - DNA, 25 bp, Mus musculus
gcatatcctgtcgtgaaagtgtgtg

SEQ ID NO: 541154 - DNA, 25 bp, Mus musculus
gcatatccttttagtggatttcaag

SEQ ID NO: 541155 - DNA, 25 bp, Mus musculus
gcatatcctttttgtggatttcaag

SEQ ID NO: 541156 - DNA, 25 bp, Mus musculus
gcatatcgaagcacaaccggctgat

SEQ ID NO: 541157 - DNA, 25 bp, Mus musculus
gcatatcgaagctcaaccggctgat

SEQ ID NO: 541158 - DNA, 25 bp, Mus musculus
gcatatcggcatatgataaacagag

SEQ ID NO: 541159 - DNA, 25 bp, Mus musculus
gcatatcggcatttgataaacagag

SEQ ID NO: 541160 - DNA, 25 bp, Mus musculus
gcatatcgtgttatgtctgtacata

SEQ ID NO: 541161 - DNA, 25 bp, Mus musculus
gcatatcgtgttttgtctgtacata

SEQ ID NO: 541162 - DNA, 25 bp, Mus musculus
gcatatctactcctacgaatcatgt

SEQ ID NO: 541163 - DNA, 25 bp, Mus musculus
gcatatctactcgtacgaatcatgt

SEQ ID NO: 541164 - DNA, 25 bp, Mus musculus
gcatatctattgcagctgtggacat

SEQ ID NO: 541165 - DNA, 25 bp, Mus musculus
gcatatctattggagctgtggacat

SEQ ID NO: 541166 - DNA, 25 bp, Mus musculus
gcatatctcagtctttatctgtcag

SEQ ID NO: 541167 - DNA, 25 bp, Mus musculus
gcatatctcagtgtttatctgtcag

SEQ ID NO: 541168 - DNA, 25 bp, Mus musculus
gcatatctcctaatatggatctttt

SEQ ID NO: 541169 - DNA, 25 bp, Mus musculus
gcatatctcctattatggatctttt

SEQ ID NO: 541170 - DNA, 25 bp, Mus musculus
gcatatctctgtatataagcgtcga

SEQ ID NO: 541171 - DNA, 25 bp, Mus musculus
gcatatctctgtttataagcgtcga

SEQ ID NO: 541172 - DNA, 25 bp, Mus musculus
gcatatctgaatactaatcttagtc

SEQ ID NO: 541173 - DNA, 25 bp, Mus musculus
gcatatctgaattctaatcttagtc

SEQ ID NO: 541174 - DNA, 25 bp, Mus musculus
gcatatctgatgacctggatttgat

SEQ ID NO: 541175 - DNA, 25 bp, Mus musculus
gcatatctgatgtcctggatttgat

SEQ ID NO: 541176 - DNA, 25 bp, Mus musculus
gcatatctgcttacacatttggtta

SEQ ID NO: 541177 - DNA, 25 bp, Mus musculus
gcatatctgctttcacatttggtta

SEQ ID NO: 541178 - DNA, 25 bp, Mus musculus
gcatatctgtagcatatttctgtat

SEQ ID NO: 541179 - DNA, 25 bp, Mus musculus
gcatatctgtaggatatttctgtat

SEQ ID NO: 541180 - DNA, 25 bp, Mus musculus
gcatatcttaaacctgtatatttag

SEQ ID NO: 541181 - DNA, 25 bp, Mus musculus
gcatatcttaaagctgtatatttag

SEQ ID NO: 541182 - DNA, 25 bp, Mus musculus
gcatatcttcaaaaactggcaaagg

SEQ ID NO: 541183 - DNA, 25 bp, Mus musculus
gcatatcttcaataactggcaaagg

SEQ ID NO: 541184 - DNA, 25 bp, Mus musculus
gcatatcttcatagatttctcggaa

SEQ ID NO: 541185 - DNA, 25 bp, Mus musculus
gcatatcttcattgatttctcggaa

SEQ ID NO: 541186 - DNA, 25 bp, Mus musculus
gcatatcttcgcaactgtgtgtgaa

SEQ ID NO: 541187 - DNA, 25 bp, Mus musculus
gcatatcttcgctactgtgtgtgaa

SEQ ID NO: 541188 - DNA, 25 bp, Mus musculus
gcatatcttctgatgcttgcaaaca

SEQ ID NO: 541189 - DNA, 25 bp, Mus musculus
gcatatcttctgttgcttgcaaaca

SEQ ID NO: 541190 - DNA, 25 bp, Mus musculus
gcatatgacacaacacacatggtaa

SEQ ID NO: 541191 - DNA, 25 bp, Mus musculus
gcatatgacacatcacacatggtaa

SEQ ID NO: 541192 - DNA, 25 bp, Mus musculus
gcatatgacccaaatccatgtgcat

SEQ ID NO: 541193 - DNA, 25 bp, Mus musculus
gcatatgacccaaccccttaagaaa

SEQ ID NO: 541194 - DNA, 25 bp, Mus musculus
gcatatgacccatatccatgtgcat

SEQ ID NO: 541195 - DNA, 25 bp, Mus musculus
gcatatgacccatccccttaagaaa

SEQ ID NO: 541196 - DNA, 25 bp, Mus musculus
gcatatgaccctatattttatataa

SEQ ID NO: 541197 - DNA, 25 bp, Mus musculus
gcatatgaccctttattttatataa

SEQ ID NO: 541198 - DNA, 25 bp, Mus musculus
gcatatgatggtccttaccctggga

SEQ ID NO: 541199 - DNA, 25 bp, Mus musculus
gcatatgatggtgcttaccctggga

SEQ ID NO: 541200 - DNA, 25 bp, Mus musculus
gcatatgcacagactcattgttgta

SEQ ID NO: 541201 - DNA, 25 bp, Mus musculus
gcatatgcacagtctcattgttgta

SEQ ID NO: 541202 - DNA, 25 bp, Mus musculus
gcatatgcagcccgtgctaacatga

SEQ ID NO: 541203 - DNA, 25 bp, Mus musculus
gcatatgcagccggtgctaacatga

SEQ ID NO: 541204 - DNA, 25 bp, Mus musculus
gcatatgcagttcacgaaggccgct

SEQ ID NO: 541205 - DNA, 25 bp, Mus musculus
gcatatgcagttgacgaaggccgct

SEQ ID NO: 541206 - DNA, 25 bp, Mus musculus
gcatatgcatataccagatttttgt

SEQ ID NO: 541207 - DNA, 25 bp, Mus musculus
gcatatgcatattccagatttttgt

SEQ ID NO: 541208 - DNA, 25 bp, Mus musculus
gcatatgcatgccagcattgtacat

SEQ ID NO: 541209 - DNA, 25 bp, Mus musculus
gcatatgcatgcgagcattgtacat

SEQ ID NO: 541210 - DNA, 25 bp, Mus musculus
gcatatgcatgtagaggcttacggt

SEQ ID NO: 541211 - DNA, 25 bp, Mus musculus
gcatatgcatgtctaattcttccag

SEQ ID NO: 541212 - DNA, 25 bp, Mus musculus
gcatatgcatgtgtaattcttccag

SEQ ID NO: 541213 - DNA, 25 bp, Mus musculus
gcatatgcatgttgaggcttacggt

SEQ ID NO: 541214 - DNA, 25 bp, Mus musculus
gcatatgccactacatcctgtggta

SEQ ID NO: 541215 - DNA, 25 bp, Mus musculus
gcatatgccactcacacttttgtat

SEQ ID NO: 541216 - DNA, 25 bp, Mus musculus
gcatatgccactgacacttttgtat

SEQ ID NO: 541217 - DNA, 25 bp, Mus musculus
gcatatgccacttcatcctgtggta

SEQ ID NO: 541218 - DNA, 25 bp, Mus musculus
gcatatgcggacaaggcttattttt

SEQ ID NO: 541219 - DNA, 25 bp, Mus musculus
gcatatgcggactaggcttattttt

SEQ ID NO: 541220 - DNA, 25 bp, Mus musculus
gcatatgctcttagatatttttctt

SEQ ID NO: 541221 - DNA, 25 bp, Mus musculus
gcatatgctctttgatatttttctt

SEQ ID NO: 541222 - DNA, 25 bp, Mus musculus
gcatatgctggccagtgacacacaa

SEQ ID NO: 541223 - DNA, 25 bp, Mus musculus
gcatatgctggcgagtgacacacaa

SEQ ID NO: 541224 - DNA, 25 bp, Mus musculus
gcatatgcttcaaattaacacattt

SEQ ID NO: 541225 - DNA, 25 bp, Mus musculus
gcatatgcttcatattaacacattt

SEQ ID NO: 541226 - DNA, 25 bp, Mus musculus
gcatatggaattcagctcttggctt

SEQ ID NO: 541227 - DNA, 25 bp, Mus musculus
gcatatggaattgagctcttggctt

SEQ ID NO: 541228 - DNA, 25 bp, Mus musculus
gcatatggagtgcaggagaatcttt

SEQ ID NO: 541229 - DNA, 25 bp, Mus musculus
gcatatggagtggaggagaatcttt

SEQ ID NO: 541230 - DNA, 25 bp, Mus musculus
gcatatggcatgaagttgtcactgt

SEQ ID NO: 541231 - DNA, 25 bp, Mus musculus
gcatatggcatgtagttgtcactgt

SEQ ID NO: 541232 - DNA, 25 bp, Mus musculus
gcatatggccatagagctgaaatta

SEQ ID NO: 541233 - DNA, 25 bp, Mus musculus
gcatatggccattgagctgaaatta

SEQ ID NO: 541234 - DNA, 25 bp, Mus musculus
gcatatggctagcaccatggactat

SEQ ID NO: 541235 - DNA, 25 bp, Mus musculus
gcatatggctaggaccatggactat

SEQ ID NO: 541236 - DNA, 25 bp, Mus musculus
gcatatgggcaccttcagggatcag

SEQ ID NO: 541237 - DNA, 25 bp, Mus musculus
gcatatgggcacgttcagggatcag

SEQ ID NO: 541238 - DNA, 25 bp, Mus musculus
gcatatgggtaacatggagcctcta

SEQ ID NO: 541239 - DNA, 25 bp, Mus musculus
gcatatgggtaagatggagcctcta

SEQ ID NO: 541240 - DNA, 25 bp, Mus musculus
gcatatggtaacaacgacggctaca

SEQ ID NO: 541241 - DNA, 25 bp, Mus musculus
gcatatggtaactacgacggctaca

SEQ ID NO: 541242 - DNA, 25 bp, Mus musculus
gcatatggtttgactctgttgaata

SEQ ID NO: 541243 - DNA, 25 bp, Mus musculus
gcatatggtttgtctctgttgaata

SEQ ID NO: 541244 - DNA, 25 bp, Mus musculus
gcatatgtacccagtggattattta

SEQ ID NO: 541245 - DNA, 25 bp, Mus musculus
gcatatgtaccctgtggattattta

SEQ ID NO: 541246 - DNA, 25 bp, Mus musculus
gcatatgtagtgcttttgtctgtgt

SEQ ID NO: 541247 - DNA, 25 bp, Mus musculus
gcatatgtagtggttttgtctgtgt

SEQ ID NO: 541248 - DNA, 25 bp, Mus musculus
gcatatgtatataaccggatttcaa

SEQ ID NO: 541249 - DNA, 25 bp, Mus musculus
gcatatgtatattaccggatttcaa

SEQ ID NO: 541250 - DNA, 25 bp, Mus musculus
gcatatgtattgctatcccagaact

SEQ ID NO: 541251 - DNA, 25 bp, Mus musculus
gcatatgtattggtatcccagaact

SEQ ID NO: 541252 - DNA, 25 bp, Mus musculus
gcatatgtcaccacatacccatctt

SEQ ID NO: 541253 - DNA, 25 bp, Mus musculus
gcatatgtcacctcatacccatctt

SEQ ID NO: 541254 - DNA, 25 bp, Mus musculus
gcatatgtccagattggacttctgg

SEQ ID NO: 541255 - DNA, 25 bp, Mus musculus
gcatatgtccagtttggacttctgg

SEQ ID NO: 541256 - DNA, 25 bp, Mus musculus
gcatatgtctccaatttctatcaac

SEQ ID NO: 541257 - DNA, 25 bp, Mus musculus
gcatatgtctcctatttctatcaac

SEQ ID NO: 541258 - DNA, 25 bp, Mus musculus
gcatatgtgcacatatccagactga

SEQ ID NO: 541259 - DNA, 25 bp, Mus musculus
gcatatgtgcacttatccagactga

SEQ ID NO: 541260 - DNA, 25 bp, Mus musculus
gcatatgtgctgaattctcatccat

SEQ ID NO: 541261 - DNA, 25 bp, Mus musculus
gcatatgtgctgtattctcatccat

SEQ ID NO: 541262 - DNA, 25 bp, Mus musculus
gcatatgtgcttaggtgtacttgta

SEQ ID NO: 541263 - DNA, 25 bp, Mus musculus
gcatatgtgctttggtgtacttgta

SEQ ID NO: 541264 - DNA, 25 bp, Mus musculus
gcatatgtggacagaagtttcaact

SEQ ID NO: 541265 - DNA, 25 bp, Mus musculus
gcatatgtggactgaagtttcaact

SEQ ID NO: 541266 - DNA, 25 bp, Mus musculus
gcatatgtggttaggaatagcttca

SEQ ID NO: 541267 - DNA, 25 bp, Mus musculus
gcatatgtggtttggaatagcttca

SEQ ID NO: 541268 - DNA, 25 bp, Mus musculus
gcatatgtgtaaataggcttctgaa

SEQ ID NO: 541269 - DNA, 25 bp, Mus musculus
gcatatgtgtaattaggcttctgaa

SEQ ID NO: 541270 - DNA, 25 bp, Mus musculus
gcatatgtgttgcagaacgcccttc

SEQ ID NO: 541271 - DNA, 25 bp, Mus musculus
gcatatgtgttggagaacgcccttc

SEQ ID NO: 541272 - DNA, 25 bp, Mus musculus
gcatatgtttagatatcctgcagaa

SEQ ID NO: 541273 - DNA, 25 bp, Mus musculus
gcatatgtttagttatcctgcagaa

SEQ ID NO: 541274 - DNA, 25 bp, Mus musculus
gcatattaaggcactttctaaggga

SEQ ID NO: 541275 - DNA, 25 bp, Mus musculus
gcatattaaggctctttctaaggga

SEQ ID NO: 541276 - DNA, 25 bp, Mus musculus
gcatattaatatcttcctctataca

SEQ ID NO: 541277 - DNA, 25 bp, Mus musculus
gcatattaatatgttcctctataca

SEQ ID NO: 541278 - DNA, 25 bp, Mus musculus
gcatattacatgcttttaattagga

SEQ ID NO: 541279 - DNA, 25 bp, Mus musculus
gcatattacatggttttaattagga

SEQ ID NO: 541280 - DNA, 25 bp, Mus musculus
gcatattagactctgggatccccga

SEQ ID NO: 541281 - DNA, 25 bp, Mus musculus
gcatattagactgtgggatccccga

SEQ ID NO: 541282 - DNA, 25 bp, Mus musculus
gcatattagctgctatgaccttaat

SEQ ID NO: 541283 - DNA, 25 bp, Mus musculus
gcatattagctggtatgaccttaat

SEQ ID NO: 541284 - DNA, 25 bp, Mus musculus
gcatattagtaaacaccttggtggg

SEQ ID NO: 541285 - DNA, 25 bp, Mus musculus
gcatattagtaatcaccttggtggg

SEQ ID NO: 541286 - DNA, 25 bp, Mus musculus
gcatattagtggctgatcaaacgag

SEQ ID NO: 541287 - DNA, 25 bp, Mus musculus
gcatattagtgggtgatcaaacgag

SEQ ID NO: 541288 - DNA, 25 bp, Mus musculus
gcatattatatgattccatgtgcat

SEQ ID NO: 541289 - DNA, 25 bp, Mus musculus
gcatattatatgtttccatgtgcat

SEQ ID NO: 541290 - DNA, 25 bp, Mus musculus
gcatattatgctctggagatgttat

SEQ ID NO: 541291 - DNA, 25 bp, Mus musculus
gcatattatgctgtggagatgttat

SEQ ID NO: 541292 - DNA, 25 bp, Mus musculus
gcatattattagatcctgagacacc

SEQ ID NO: 541293 - DNA, 25 bp, Mus musculus
gcatattattagttcctgagacacc

SEQ ID NO: 541294 - DNA, 25 bp, Mus musculus
gcatattattccattttctccagcc

SEQ ID NO: 541295 - DNA, 25 bp, Mus musculus
gcatattattcctttttctccagcc

SEQ ID NO: 541296 - DNA, 25 bp, Mus musculus
gcatattcaaatagcgacgttttaa

SEQ ID NO: 541297 - DNA, 25 bp, Mus musculus
gcatattcaaattgcgacgttttaa

SEQ ID NO: 541298 - DNA, 25 bp, Mus musculus
gcatattcaacacgcatacaagagg

SEQ ID NO: 541299 - DNA, 25 bp, Mus musculus
gcatattcaacaggcatacaagagg

SEQ ID NO: 541300 - DNA, 25 bp, Mus musculus
gcatattccatcctcagtctgtttc

SEQ ID NO: 541301 - DNA, 25 bp, Mus musculus
gcatattccatcgtcagtctgtttc

SEQ ID NO: 541302 - DNA, 25 bp, Mus musculus
gcatattcccacagactctgggaga

SEQ ID NO: 541303 - DNA, 25 bp, Mus musculus
gcatattcccactgactctgggaga

SEQ ID NO: 541304 - DNA, 25 bp, Mus musculus
gcatattcctaacacaattaagatt

SEQ ID NO: 541305 - DNA, 25 bp, Mus musculus
gcatattcctaactactgtatttgt

SEQ ID NO: 541306 - DNA, 25 bp, Mus musculus
gcatattcctaagacaattaagatt

SEQ ID NO: 541307 - DNA, 25 bp, Mus musculus
gcatattcctaagtactgtatttgt

SEQ ID NO: 541308 - DNA, 25 bp, Mus musculus
gcatattcctaccacttctcagagt

SEQ ID NO: 541309 - DNA, 25 bp, Mus musculus
gcatattcctacgacttctcagagt

SEQ ID NO: 541310 - DNA, 25 bp, Mus musculus
gcatattcgttaatggcttaccact

SEQ ID NO: 541311 - DNA, 25 bp, Mus musculus
gcatattcgttattggcttaccact

SEQ ID NO: 541312 - DNA, 25 bp, Mus musculus
gcatattcttatccttaatttcttt

SEQ ID NO: 541313 - DNA, 25 bp, Mus musculus
gcatattcttatgcttaatttcttt

SEQ ID NO: 541314 - DNA, 25 bp, Mus musculus
gcatattcttcaatcacacttgtac

SEQ ID NO: 541315 - DNA, 25 bp, Mus musculus
gcatattcttcattcacacttgtac

SEQ ID NO: 541316 - DNA, 25 bp, Mus musculus
gcatattctttcaccgttttgactt

SEQ ID NO: 541317 - DNA, 25 bp, Mus musculus
gcatattctttctccgttttgactt

SEQ ID NO: 541318 - DNA, 25 bp, Mus musculus
gcatattcttttagtagcctaaatc

SEQ ID NO: 541319 - DNA, 25 bp, Mus musculus
gcatattctttttgtagcctaaatc

SEQ ID NO: 541320 - DNA, 25 bp, Mus musculus
gcatattgaccgaggttgcagctaa

SEQ ID NO: 541321 - DNA, 25 bp, Mus musculus
gcatattgaccgtggttgcagctaa

SEQ ID NO: 541322 - DNA, 25 bp, Mus musculus
gcatattgagctatggagaggttcc

SEQ ID NO: 541323 - DNA, 25 bp, Mus musculus
gcatattgagctttggagaggttcc

SEQ ID NO: 541324 - DNA, 25 bp, Mus musculus
gcatattgagttcatttagcccgat

SEQ ID NO: 541325 - DNA, 25 bp, Mus musculus
gcatattgagttgatttagcccgat

SEQ ID NO: 541326 - DNA, 25 bp, Mus musculus
gcatattgatgactgaaccacacga

SEQ ID NO: 541327 - DNA, 25 bp, Mus musculus
gcatattgatgagtgaaccacacga

SEQ ID NO: 541328 - DNA, 25 bp, Mus musculus
gcatattgcaccagtgtcttcagag

SEQ ID NO: 541329 - DNA, 25 bp, Mus musculus
gcatattgcacctgtgtcttcagag

SEQ ID NO: 541330 - DNA, 25 bp, Mus musculus
gcatattgctagctcttgaatcact

SEQ ID NO: 541331 - DNA, 25 bp, Mus musculus
gcatattgctaggtcttgaatcact

SEQ ID NO: 541332 - DNA, 25 bp, Mus musculus
gcatattgctttagtaaaggacctg

SEQ ID NO: 541333 - DNA, 25 bp, Mus musculus
gcatattgcttttgtaaaggacctg

SEQ ID NO: 541334 - DNA, 25 bp, Mus musculus
gcatattggtgaccgcacatggcga

SEQ ID NO: 541335 - DNA, 25 bp, Mus musculus
gcatattggtgagcgcacatggcga

SEQ ID NO: 541336 - DNA, 25 bp, Mus musculus
gcatattgtagcaagaccgcgccac

SEQ ID NO: 541337 - DNA, 25 bp, Mus musculus
gcatattgtagctagaccgcgccac

SEQ ID NO: 541338 - DNA, 25 bp, Mus musculus
gcatattgtcaaaagtgtcccacac

SEQ ID NO: 541339 - DNA, 25 bp, Mus musculus
gcatattgtcaatagtgtcccacac

SEQ ID NO: 541340 - DNA, 25 bp, Mus musculus
gcatatttacatcctctttttcccc

SEQ ID NO: 541341 - DNA, 25 bp, Mus musculus
gcatatttacatgctctttttcccc

SEQ ID NO: 541342 - DNA, 25 bp, Mus musculus
gcatatttagctctttggaacagag

SEQ ID NO: 541343 - DNA, 25 bp, Mus musculus
gcatatttagctgtttggaacagag

SEQ ID NO: 541344 - DNA, 25 bp, Mus musculus
gcatatttcagaagtggtcggcaac

SEQ ID NO: 541345 - DNA, 25 bp, Mus musculus
gcatatttcagatgtggtcggcaac

SEQ ID NO: 541346 - DNA, 25 bp, Mus musculus
gcatatttcaggatgggactcacac

SEQ ID NO: 541347 - DNA, 25 bp, Mus musculus
gcatatttcaggttgggactcacac

SEQ ID NO: 541348 - DNA, 25 bp, Mus musculus
gcatatttcatacactttgcccagt

SEQ ID NO: 541349 - DNA, 25 bp, Mus musculus
gcatatttcatagactttgcccagt

SEQ ID NO: 541350 - DNA, 25 bp, Mus musculus
gcatatttggttccctgttctacac

SEQ ID NO: 541351 - DNA, 25 bp, Mus musculus
gcatatttggttgcctgttctacac

SEQ ID NO: 541352 - DNA, 25 bp, Mus musculus
gcatattttaatcagctgttacctt

SEQ ID NO: 541353 - DNA, 25 bp, Mus musculus
gcatattttaatgagctgttacctt

SEQ ID NO: 541354 - DNA, 25 bp, Mus musculus
gcatattttacaccatatggtgcta

SEQ ID NO: 541355 - DNA, 25 bp, Mus musculus
gcatattttacagcatatggtgcta

SEQ ID NO: 541356 - DNA, 25 bp, Mus musculus
gcatattttatgagacagtgtcttc

SEQ ID NO: 541357 - DNA, 25 bp, Mus musculus
gcatattttatgatttgctgtatta

SEQ ID NO: 541358 - DNA, 25 bp, Mus musculus
gcatattttatgcatagcgtgctaa

SEQ ID NO: 541359 - DNA, 25 bp, Mus musculus
gcatattttatggatagcgtgctaa

SEQ ID NO: 541360 - DNA, 25 bp, Mus musculus
gcatattttatgtgacagtgtcttc

SEQ ID NO: 541361 - DNA, 25 bp, Mus musculus
gcatattttatgttttgctgtatta

SEQ ID NO: 541362 - DNA, 25 bp, Mus musculus
gcatattttgcacttgctggtacat

SEQ ID NO: 541363 - DNA, 25 bp, Mus musculus
gcatattttgcagttgctggtacat

SEQ ID NO: 541364 - DNA, 25 bp, Mus musculus
gcatatttttatcccaaacctaaat

SEQ ID NO: 541365 - DNA, 25 bp, Mus musculus
gcatatttttatgccaaacctaaat

SEQ ID NO: 541366 - DNA, 25 bp, Mus musculus
gcatcaaacaaccaagccggcataa

SEQ ID NO: 541367 - DNA, 25 bp, Mus musculus
gcatcaaacaacgaagccggcataa

SEQ ID NO: 541368 - DNA, 25 bp, Mus musculus
gcatcaaactttaggtaactttagg

SEQ ID NO: 541369 - DNA, 25 bp, Mus musculus
gcatcaaacttttggtaactttagg

SEQ ID NO: 541370 - DNA, 25 bp, Mus musculus
gcatcaaagactcagcggtcccgtt

SEQ ID NO: 541371 - DNA, 25 bp, Mus musculus
gcatcaaagactgagcggtcccgtt

SEQ ID NO: 541372 - DNA, 25 bp, Mus musculus
gcatcaaagccaacgtacaactggt

SEQ ID NO: 541373 - DNA, 25 bp, Mus musculus
gcatcaaagccatcgtacaactggt

SEQ ID NO: 541374 - DNA, 25 bp, Mus musculus
gcatcaaagtggaggccagcccgaa

SEQ ID NO: 541375 - DNA, 25 bp, Mus musculus
gcatcaaagtggtggccagcccgaa

SEQ ID NO: 541376 - DNA, 25 bp, Mus musculus
gcatcaacactgactttgaggaggt

SEQ ID NO: 541377 - DNA, 25 bp, Mus musculus
gcatcaacactgtctttgaggaggt

SEQ ID NO: 541378 - DNA, 25 bp, Mus musculus
gcatcaacccatagtctgcagagga

SEQ ID NO: 541379 - DNA, 25 bp, Mus musculus
gcatcaacccattgtctgcagagga

SEQ ID NO: 541380 - DNA, 25 bp, Mus musculus
gcatcaaccccgctgaatatgtgcg

SEQ ID NO: 541381 - DNA, 25 bp, Mus musculus
gcatcaaccccggtgaatatgtgcg

SEQ ID NO: 541382 - DNA, 25 bp, Mus musculus
gcatcaaccctcagagaataacttg

SEQ ID NO: 541383 - DNA, 25 bp, Mus musculus
gcatcaaccctctgagaataacttg

SEQ ID NO: 541384 - DNA, 25 bp, Mus musculus
gcatcaacctatctcatcattggag

SEQ ID NO: 541385 - DNA, 25 bp, Mus musculus
gcatcaacctatgtcatcattggag

SEQ ID NO: 541386 - DNA, 25 bp, Mus musculus
gcatcaacggtccagaaatctgcct

SEQ ID NO: 541387 - DNA, 25 bp, Mus musculus
gcatcaacggtcgagaaatctgcct

SEQ ID NO: 541388 - DNA, 25 bp, Mus musculus
gcatcaacgtaacctacactggaga

SEQ ID NO: 541389 - DNA, 25 bp, Mus musculus
gcatcaacgtaagctacactggaga

SEQ ID NO: 541390 - DNA, 25 bp, Mus musculus
gcatcaacgtgtatttgtcgcttat

SEQ ID NO: 541391 - DNA, 25 bp, Mus musculus
gcatcaacgtgtttttgtcgcttat

SEQ ID NO: 541392 - DNA, 25 bp, Mus musculus
gcatcaactggcaggacgtggtaca

SEQ ID NO: 541393 - DNA, 25 bp, Mus musculus
gcatcaactggccttatcggatcaa

SEQ ID NO: 541394 - DNA, 25 bp, Mus musculus
gcatcaactggcgttatcggatcaa

SEQ ID NO: 541395 - DNA, 25 bp, Mus musculus
gcatcaactggctggacgtggtaca

SEQ ID NO: 541396 - DNA, 25 bp, Mus musculus
gcatcaacttgcacactgtttgact

SEQ ID NO: 541397 - DNA, 25 bp, Mus musculus
gcatcaacttgctcactgtttgact

SEQ ID NO: 541398 - DNA, 25 bp, Mus musculus
gcatcaagaacgagctgacggtcca

SEQ ID NO: 541399 - DNA, 25 bp, Mus musculus
gcatcaagaacgtgctgacggtcca

SEQ ID NO: 541400 - DNA, 25 bp, Mus musculus
gcatcaagagctccgaatatcaata

SEQ ID NO: 541401 - DNA, 25 bp, Mus musculus
gcatcaagagctgcgaatatcaata

SEQ ID NO: 541402 - DNA, 25 bp, Mus musculus
gcatcaagcaggctcagactctctg

SEQ ID NO: 541403 - DNA, 25 bp, Mus musculus
gcatcaagcagggtcagactctctg

SEQ ID NO: 541404 - DNA, 25 bp, Mus musculus
gcatcaagcatgcacatggtgtaca

SEQ ID NO: 541405 - DNA, 25 bp, Mus musculus
gcatcaagcatggacatggtgtaca

SEQ ID NO: 541406 - DNA, 25 bp, Mus musculus
gcatcaagctagcagctaagaggtt

SEQ ID NO: 541407 - DNA, 25 bp, Mus musculus
gcatcaagctaggagctaagaggtt

SEQ ID NO: 541408 - DNA, 25 bp, Mus musculus
gcatcaaggattctctggaagatct

SEQ ID NO: 541409 - DNA, 25 bp, Mus musculus
gcatcaaggattgtctggaagatct

SEQ ID NO: 541410 - DNA, 25 bp, Mus musculus
gcatcaaggcagcataccacagctt

SEQ ID NO: 541411 - DNA, 25 bp, Mus musculus
gcatcaaggcaggataccacagctt

SEQ ID NO: 541412 - DNA, 25 bp, Mus musculus
gcatcaaggtagatatttctgagga

SEQ ID NO: 541413 - DNA, 25 bp, Mus musculus
gcatcaaggtagttatttctgagga

SEQ ID NO: 541414 - DNA, 25 bp, Mus musculus
gcatcaaggttcctgtatctgaccc

SEQ ID NO: 541415 - DNA, 25 bp, Mus musculus
gcatcaaggttcgtgtatctgaccc

SEQ ID NO: 541416 - DNA, 25 bp, Mus musculus
gcatcaagtgaaccccttgtgaaca

SEQ ID NO: 541417 - DNA, 25 bp, Mus musculus
gcatcaagtgaagcccttgtgaaca

SEQ ID NO: 541418 - DNA, 25 bp, Mus musculus
gcatcaatccttatcctcattggag

SEQ ID NO: 541419 - DNA, 25 bp, Mus musculus
gcatcaatccttttcctcattggag

SEQ ID NO: 541420 - DNA, 25 bp, Mus musculus
gcatcaatcttgaaaacccctcatg

SEQ ID NO: 541421 - DNA, 25 bp, Mus musculus
gcatcaatcttgtaaacccctcatg

SEQ ID NO: 541422 - DNA, 25 bp, Mus musculus
gcatcaatgaggactctggagcctg

SEQ ID NO: 541423 - DNA, 25 bp, Mus musculus
gcatcaatgaggtctctggagcctg

SEQ ID NO: 541424 - DNA, 25 bp, Mus musculus
gcatcaattaaacagcctccaggga

SEQ ID NO: 541425 - DNA, 25 bp, Mus musculus
gcatcaattaaagagcctccaggga

SEQ ID NO: 541426 - DNA, 25 bp, Mus musculus
gcatcaattgtgcatctaacatctg

SEQ ID NO: 541427 - DNA, 25 bp, Mus musculus
gcatcaattgtggatctaacatctg

SEQ ID NO: 541428 - DNA, 25 bp, Mus musculus
gcatcaatttctctatttgtgtgaa

SEQ ID NO: 541429 - DNA, 25 bp, Mus musculus
gcatcaatttctgtatttgtgtgaa

SEQ ID NO: 541430 - DNA, 25 bp, Mus musculus
gcatcacaaccacactgtagccagg

SEQ ID NO: 541431 - DNA, 25 bp, Mus musculus
gcatcacaaccagactgtagccagg

SEQ ID NO: 541432 - DNA, 25 bp, Mus musculus
gcatcacaaggcaagacacaaggga

SEQ ID NO: 541433 - DNA, 25 bp, Mus musculus
gcatcacaaggctagacacaaggga

SEQ ID NO: 541434 - DNA, 25 bp, Mus musculus
gcatcacacaaaaccaggcacaata

SEQ ID NO: 541435 - DNA, 25 bp, Mus musculus
gcatcacacaaatccaggcacaata

SEQ ID NO: 541436 - DNA, 25 bp, Mus musculus
gcatcacacacaacctattactttt

SEQ ID NO: 541437 - DNA, 25 bp, Mus musculus
gcatcacacacactcgagcaattga

SEQ ID NO: 541438 - DNA, 25 bp, Mus musculus
gcatcacacacagtcgagcaattga

SEQ ID NO: 541439 - DNA, 25 bp, Mus musculus
gcatcacacacatcctattactttt

SEQ ID NO: 541440 - DNA, 25 bp, Mus musculus
gcatcacagaaaacgagcaaggctc

SEQ ID NO: 541441 - DNA, 25 bp, Mus musculus
gcatcacagaaatcgagcaaggctc

SEQ ID NO: 541442 - DNA, 25 bp, Mus musculus
gcatcacagcaactcaaagctaaat

SEQ ID NO: 541443 - DNA, 25 bp, Mus musculus
gcatcacagcaagtcaaagctaaat

SEQ ID NO: 541444 - DNA, 25 bp, Mus musculus
gcatcacagcacaaactaccaaatt

SEQ ID NO: 541445 - DNA, 25 bp, Mus musculus
gcatcacagcactaactaccaaatt

SEQ ID NO: 541446 - DNA, 25 bp, Mus musculus
gcatcacagtctcatagcatcacag

SEQ ID NO: 541447 - DNA, 25 bp, Mus musculus
gcatcacagtctgatagcatcacag

SEQ ID NO: 541448 - DNA, 25 bp, Mus musculus
gcatcacagttaagtaccgccatac

SEQ ID NO: 541449 - DNA, 25 bp, Mus musculus
gcatcacagttatgtaccgccatac

SEQ ID NO: 541450 - DNA, 25 bp, Mus musculus
gcatcacatacacttgggcaagctt

SEQ ID NO: 541451 - DNA, 25 bp, Mus musculus
gcatcacatacagttgggcaagctt

SEQ ID NO: 541452 - DNA, 25 bp, Mus musculus
gcatcacatcgccaacttgtgtgac

SEQ ID NO: 541453 - DNA, 25 bp, Mus musculus
gcatcacatcgcgaacttgtgtgac

SEQ ID NO: 541454 - DNA, 25 bp, Mus musculus
gcatcacatggcatcatccatcaaa

SEQ ID NO: 541455 - DNA, 25 bp, Mus musculus
gcatcacatggcttcatccatcaaa

SEQ ID NO: 541456 - DNA, 25 bp, Mus musculus
gcatcaccaaggctgtagaggatac

SEQ ID NO: 541457 - DNA, 25 bp, Mus musculus
gcatcaccaagggtgtagaggatac

SEQ ID NO: 541458 - DNA, 25 bp, Mus musculus
gcatcaccacttatacacaattgtt

SEQ ID NO: 541459 - DNA, 25 bp, Mus musculus
gcatcaccacttttacacaattgtt

SEQ ID NO: 541460 - DNA, 25 bp, Mus musculus
gcatcaccagtgaaaccatgagcat

SEQ ID NO: 541461 - DNA, 25 bp, Mus musculus
gcatcaccagtgtaaccatgagcat

SEQ ID NO: 541462 - DNA, 25 bp, Mus musculus
gcatcaccagttcttgagtccgata

SEQ ID NO: 541463 - DNA, 25 bp, Mus musculus
gcatcaccagttgttgagtccgata

SEQ ID NO: 541464 - DNA, 25 bp, Mus musculus
gcatcaccatgtatgctgactacag

SEQ ID NO: 541465 - DNA, 25 bp, Mus musculus
gcatcaccatgtttgctgactacag

SEQ ID NO: 541466 - DNA, 25 bp, Mus musculus
gcatcacccataacacttgctggat

SEQ ID NO: 541467 - DNA, 25 bp, Mus musculus
gcatcacccatatcacttgctggat

SEQ ID NO: 541468 - DNA, 25 bp, Mus musculus
gcatcacccctgcttgaagtggata

SEQ ID NO: 541469 - DNA, 25 bp, Mus musculus
gcatcacccctggttgaagtggata

SEQ ID NO: 541470 - DNA, 25 bp, Mus musculus
gcatcaccgattcttccaggattgg

SEQ ID NO: 541471 - DNA, 25 bp, Mus musculus
gcatcaccgattgttccaggattgg

SEQ ID NO: 541472 - DNA, 25 bp, Mus musculus
gcatcaccggtcctgtgacaggcag

SEQ ID NO: 541473 - DNA, 25 bp, Mus musculus
gcatcaccggtcgtgtgacaggcag

SEQ ID NO: 541474 - DNA, 25 bp, Mus musculus
gcatcacctaagaagagagtctcaa

SEQ ID NO: 541475 - DNA, 25 bp, Mus musculus
gcatcacctaagtagagagtctcaa

SEQ ID NO: 541476 - DNA, 25 bp, Mus musculus
gcatcacctgcgaatactggatttc

SEQ ID NO: 541477 - DNA, 25 bp, Mus musculus
gcatcacctgcgtatactggatttc

SEQ ID NO: 541478 - DNA, 25 bp, Mus musculus
gcatcacgcccgaggaggccaagta

SEQ ID NO: 541479 - DNA, 25 bp, Mus musculus
gcatcacgcccgtggaggccaagta

SEQ ID NO: 541480 - DNA, 25 bp, Mus musculus
gcatcacgtgctaatgtttccttac

SEQ ID NO: 541481 - DNA, 25 bp, Mus musculus
gcatcacgtgcttatgtttccttac

SEQ ID NO: 541482 - DNA, 25 bp, Mus musculus
gcatcacgttctccctgaggaaaag

SEQ ID NO: 541483 - DNA, 25 bp, Mus musculus
gcatcacgttctgcctgaggaaaag

SEQ ID NO: 541484 - DNA, 25 bp, Mus musculus
gcatcacgttgacatatggcaggct

SEQ ID NO: 541485 - DNA, 25 bp, Mus musculus
gcatcacgttgagatatggcaggct

SEQ ID NO: 541486 - DNA, 25 bp, Mus musculus
gcatcactacctatgtattgaattt

SEQ ID NO: 541487 - DNA, 25 bp, Mus musculus
gcatcactacctttgtattgaattt

SEQ ID NO: 541488 - DNA, 25 bp, Mus musculus
gcatcactctgaaggagtctgtctt

SEQ ID NO: 541489 - DNA, 25 bp, Mus musculus
gcatcactctgatggagtctgtctt

SEQ ID NO: 541490 - DNA, 25 bp, Mus musculus
gcatcactctggctggtataccctt

SEQ ID NO: 541491 - DNA, 25 bp, Mus musculus
gcatcactctgggtggtataccctt

SEQ ID NO: 541492 - DNA, 25 bp, Mus musculus
gcatcactcttcaagcctcagaaag

SEQ ID NO: 541493 - DNA, 25 bp, Mus musculus
gcatcactcttctagcctcagaaag

SEQ ID NO: 541494 - DNA, 25 bp, Mus musculus
gcatcactgctcatgcctaagtaat

SEQ ID NO: 541495 - DNA, 25 bp, Mus musculus
gcatcactgctcttgcctaagtaat

SEQ ID NO: 541496 - DNA, 25 bp, Mus musculus
gcatcactgggacatagaacttagc

SEQ ID NO: 541497 - DNA, 25 bp, Mus musculus
gcatcactgggagatagaacttagc

SEQ ID NO: 541498 - DNA, 25 bp, Mus musculus
gcatcactggtgaccgacagcagat

SEQ ID NO: 541499 - DNA, 25 bp, Mus musculus
gcatcactggtgtccgacagcagat

SEQ ID NO: 541500 - DNA, 25 bp, Mus musculus
gcatcactgtgcactttgccatgaa

SEQ ID NO: 541501 - DNA, 25 bp, Mus musculus
gcatcactgtgctctttgccatgaa

SEQ ID NO: 541502 - DNA, 25 bp, Mus musculus
gcatcacttaagcctgcaccgctaa

SEQ ID NO: 541503 - DNA, 25 bp, Mus musculus
gcatcacttaaggctgcaccgctaa

SEQ ID NO: 541504 - DNA, 25 bp, Mus musculus
gcatcacttgcacagactgacccta

SEQ ID NO: 541505 - DNA, 25 bp, Mus musculus
gcatcacttgcagagactgacccta

SEQ ID NO: 541506 - DNA, 25 bp, Mus musculus
gcatcacttgttcagcttggttcag

SEQ ID NO: 541507 - DNA, 25 bp, Mus musculus
gcatcacttgttgagcttggttcag

SEQ ID NO: 541508 - DNA, 25 bp, Mus musculus
gcatcactttgtcaggccgagctca

SEQ ID NO: 541509 - DNA, 25 bp, Mus musculus
gcatcactttgtgaggccgagctca

SEQ ID NO: 541510 - DNA, 25 bp, Mus musculus
gcatcacttttgagcacaagaggaa

SEQ ID NO: 541511 - DNA, 25 bp, Mus musculus
gcatcacttttgtgcacaagaggaa

SEQ ID NO: 541512 - DNA, 25 bp, Mus musculus
gcatcagaagttccacagccagcag

SEQ ID NO: 541513 - DNA, 25 bp, Mus musculus
gcatcagaagttgcacagccagcag

SEQ ID NO: 541514 - DNA, 25 bp, Mus musculus
gcatcagaatctaaggttaaaacct

SEQ ID NO: 541515 - DNA, 25 bp, Mus musculus
gcatcagaatcttaggttaaaacct

SEQ ID NO: 541516 - DNA, 25 bp, Mus musculus
gcatcagagaccagggccatggcta

SEQ ID NO: 541517 - DNA, 25 bp, Mus musculus
gcatcagagaccatgcagggagcag

SEQ ID NO: 541518 - DNA, 25 bp, Mus musculus
gcatcagagacctgggccatggcta

SEQ ID NO: 541519 - DNA, 25 bp, Mus musculus
gcatcagagaccttgcagggagcag

SEQ ID NO: 541520 - DNA, 25 bp, Mus musculus
gcatcagagccactgagcgcttgat

SEQ ID NO: 541521 - DNA, 25 bp, Mus musculus
gcatcagagccagtgagcgcttgat

SEQ ID NO: 541522 - DNA, 25 bp, Mus musculus
gcatcagagtcacccgagggaccaa

SEQ ID NO: 541523 - DNA, 25 bp, Mus musculus
gcatcagagtcagccgagggaccaa

SEQ ID NO: 541524 - DNA, 25 bp, Mus musculus
gcatcagatcttccctaaggatcag

SEQ ID NO: 541525 - DNA, 25 bp, Mus musculus
gcatcagatcttgcctaaggatcag

SEQ ID NO: 541526 - DNA, 25 bp, Mus musculus
gcatcagatggcaactcctacgaga

SEQ ID NO: 541527 - DNA, 25 bp, Mus musculus
gcatcagatggcatcgcatccagaa

SEQ ID NO: 541528 - DNA, 25 bp, Mus musculus
gcatcagatggctactcctacgaga

SEQ ID NO: 541529 - DNA, 25 bp, Mus musculus
gcatcagatggcttcgcatccagaa

SEQ ID NO: 541530 - DNA, 25 bp, Mus musculus
gcatcagatggtatttacctgggta

SEQ ID NO: 541531 - DNA, 25 bp, Mus musculus
gcatcagatggtttttacctgggta

SEQ ID NO: 541532 - DNA, 25 bp, Mus musculus
gcatcagattgtattgtgcatcctg

SEQ ID NO: 541533 - DNA, 25 bp, Mus musculus
gcatcagattgttttgtgcatcctg

SEQ ID NO: 541534 - DNA, 25 bp, Mus musculus
gcatcagcaagaactccaatcttta

SEQ ID NO: 541535 - DNA, 25 bp, Mus musculus
gcatcagcaagatctccaatcttta

SEQ ID NO: 541536 - DNA, 25 bp, Mus musculus
gcatcagcaagcatcggcctttttg

SEQ ID NO: 541537 - DNA, 25 bp, Mus musculus
gcatcagcaagcatgagaggaacgt

SEQ ID NO: 541538 - DNA, 25 bp, Mus musculus
gcatcagcaagcttcggcctttttg

SEQ ID NO: 541539 - DNA, 25 bp, Mus musculus
gcatcagcaagcttgagaggaacgt

SEQ ID NO: 541540 - DNA, 25 bp, Mus musculus
gcatcagcacggctgacactacagg

SEQ ID NO: 541541 - DNA, 25 bp, Mus musculus
gcatcagcacgggtgacactacagg

SEQ ID NO: 541542 - DNA, 25 bp, Mus musculus
gcatcagcagaaatccttgaggttt

SEQ ID NO: 541543 - DNA, 25 bp, Mus musculus
gcatcagcagaattccttgaggttt

SEQ ID NO: 541544 - DNA, 25 bp, Mus musculus
gcatcagcagcgaaagcttccacga

SEQ ID NO: 541545 - DNA, 25 bp, Mus musculus
gcatcagcagcgtaagcttccacga

SEQ ID NO: 541546 - DNA, 25 bp, Mus musculus
gcatcagcatgcctgggctttggtc

SEQ ID NO: 541547 - DNA, 25 bp, Mus musculus
gcatcagcatgcgtgggctttggtc

SEQ ID NO: 541548 - DNA, 25 bp, Mus musculus
gcatcagccaaactcattgccatga

SEQ ID NO: 541549 - DNA, 25 bp, Mus musculus
gcatcagccaaagtcattgccatga

SEQ ID NO: 541550 - DNA, 25 bp, Mus musculus
gcatcagccaatcatcattccagat

SEQ ID NO: 541551 - DNA, 25 bp, Mus musculus
gcatcagccaatgatcattccagat

SEQ ID NO: 541552 - DNA, 25 bp, Mus musculus
gcatcagcccagacagtatcatcct

SEQ ID NO: 541553 - DNA, 25 bp, Mus musculus
gcatcagcccagtcagtatcatcct

SEQ ID NO: 541554 - DNA, 25 bp, Mus musculus
gcatcagcgttcagccagtgtgtgt

SEQ ID NO: 541555 - DNA, 25 bp, Mus musculus
gcatcagcgttctgccagtgtgtgt

SEQ ID NO: 541556 - DNA, 25 bp, Mus musculus
gcatcagctgtgacttacacacaca

SEQ ID NO: 541557 - DNA, 25 bp, Mus musculus
gcatcagctgtgtcttacacacaca

SEQ ID NO: 541558 - DNA, 25 bp, Mus musculus
gcatcagcttcccttggaagcttgt

SEQ ID NO: 541559 - DNA, 25 bp, Mus musculus
gcatcagcttccgttggaagcttgt

SEQ ID NO: 541560 - DNA, 25 bp, Mus musculus
gcatcaggacggatctggatgagac

SEQ ID NO: 541561 - DNA, 25 bp, Mus musculus
gcatcaggacggttctggatgagac

SEQ ID NO: 541562 - DNA, 25 bp, Mus musculus
gcatcaggactaaggccagcagagg

SEQ ID NO: 541563 - DNA, 25 bp, Mus musculus
gcatcaggactaccagcaacccaga

SEQ ID NO: 541564 - DNA, 25 bp, Mus musculus
gcatcaggactagcagcaacccaga

SEQ ID NO: 541565 - DNA, 25 bp, Mus musculus
gcatcaggactatggccagcagagg

SEQ ID NO: 541566 - DNA, 25 bp, Mus musculus
gcatcaggactgagaatttggccaa

SEQ ID NO: 541567 - DNA, 25 bp, Mus musculus
gcatcaggactgtgaatttggccaa

SEQ ID NO: 541568 - DNA, 25 bp, Mus musculus
gcatcaggacttcgaaatttctcag

SEQ ID NO: 541569 - DNA, 25 bp, Mus musculus
gcatcaggacttggaaatttctcag

SEQ ID NO: 541570 - DNA, 25 bp, Mus musculus
gcatcaggagaacgctacagtaact

SEQ ID NO: 541571 - DNA, 25 bp, Mus musculus
gcatcaggagaaggctacagtaact

SEQ ID NO: 541572 - DNA, 25 bp, Mus musculus
gcatcaggccagctttggaatgtat

SEQ ID NO: 541573 - DNA, 25 bp, Mus musculus
gcatcaggccaggtttggaatgtat

SEQ ID NO: 541574 - DNA, 25 bp, Mus musculus
gcatcaggccctcagaatatacagt

SEQ ID NO: 541575 - DNA, 25 bp, Mus musculus
gcatcaggccctgagaatatacagt

SEQ ID NO: 541576 - DNA, 25 bp, Mus musculus
gcatcaggcttcatgcagataccca

SEQ ID NO: 541577 - DNA, 25 bp, Mus musculus
gcatcaggcttcttgcagataccca

SEQ ID NO: 541578 - DNA, 25 bp, Mus musculus
gcatcagggatcatgacggtgctcc

SEQ ID NO: 541579 - DNA, 25 bp, Mus musculus
gcatcagggatcttgacggtgctcc

SEQ ID NO: 541580 - DNA, 25 bp, Mus musculus
gcatcagggtgccttatcaactgga

SEQ ID NO: 541581 - DNA, 25 bp, Mus musculus
gcatcagggtgcgttatcaactgga

SEQ ID NO: 541582 - DNA, 25 bp, Mus musculus
gcatcaggtcctaaacgccctggta

SEQ ID NO: 541583 - DNA, 25 bp, Mus musculus
gcatcaggtccttaacgccctggta

SEQ ID NO: 541584 - DNA, 25 bp, Mus musculus
gcatcaggtttacatatgggcacta

SEQ ID NO: 541585 - DNA, 25 bp, Mus musculus
gcatcaggtttagatatgggcacta

SEQ ID NO: 541586 - DNA, 25 bp, Mus musculus
gcatcagtaagaaccagctttctgg

SEQ ID NO: 541587 - DNA, 25 bp, Mus musculus
gcatcagtaagatccagctttctgg

SEQ ID NO: 541588 - DNA, 25 bp, Mus musculus
gcatcagtaagtatgcacaggcact

SEQ ID NO: 541589 - DNA, 25 bp, Mus musculus
gcatcagtaagtttgcacaggcact

SEQ ID NO: 541590 - DNA, 25 bp, Mus musculus
gcatcagtacatagccttgagacgg

SEQ ID NO: 541591 - DNA, 25 bp, Mus musculus
gcatcagtacattgccttgagacgg

SEQ ID NO: 541592 - DNA, 25 bp, Mus musculus
gcatcagtacggaacactatcctta

SEQ ID NO: 541593 - DNA, 25 bp, Mus musculus
gcatcagtacggtacactatcctta

SEQ ID NO: 541594 - DNA, 25 bp, Mus musculus
gcatcagtactaaaatctcaaggac

SEQ ID NO: 541595 - DNA, 25 bp, Mus musculus
gcatcagtactataatctcaaggac

SEQ ID NO: 541596 - DNA, 25 bp, Mus musculus
gcatcagtatggatgtgcttacctt

SEQ ID NO: 541597 - DNA, 25 bp, Mus musculus
gcatcagtatggttgtgcttacctt

SEQ ID NO: 541598 - DNA, 25 bp, Mus musculus
gcatcagtattgacaggtttcccaa

SEQ ID NO: 541599 - DNA, 25 bp, Mus musculus
gcatcagtattgtcaggtttcccaa

SEQ ID NO: 541600 - DNA, 25 bp, Mus musculus
gcatcagtcactatttctacgtgag

SEQ ID NO: 541601 - DNA, 25 bp, Mus musculus
gcatcagtcactttttctacgtgag

SEQ ID NO: 541602 - DNA, 25 bp, Mus musculus
gcatcagtcagtcatcttctgcttg

SEQ ID NO: 541603 - DNA, 25 bp, Mus musculus
gcatcagtcagtgatcttctgcttg

SEQ ID NO: 541604 - DNA, 25 bp, Mus musculus
gcatcagtcataaagtaccacccca

SEQ ID NO: 541605 - DNA, 25 bp, Mus musculus
gcatcagtcatatagtaccacccca

SEQ ID NO: 541606 - DNA, 25 bp, Mus musculus
gcatcagtcccgaggactgtgccag

SEQ ID NO: 541607 - DNA, 25 bp, Mus musculus
gcatcagtcccgtggactgtgccag

SEQ ID NO: 541608 - DNA, 25 bp, Mus musculus
gcatcagtccttactgtgaggctaa

SEQ ID NO: 541609 - DNA, 25 bp, Mus musculus
gcatcagtcctttctgtgaggctaa

SEQ ID NO: 541610 - DNA, 25 bp, Mus musculus
gcatcagtgtagcttcaggcaccat

SEQ ID NO: 541611 - DNA, 25 bp, Mus musculus
gcatcagtgtaggttcaggcaccat

SEQ ID NO: 541612 - DNA, 25 bp, Mus musculus
gcatcagtgttaactcggccagaga

SEQ ID NO: 541613 - DNA, 25 bp, Mus musculus
gcatcagtgttatctcggccagaga

SEQ ID NO: 541614 - DNA, 25 bp, Mus musculus
gcatcagttcccactggtttcaaga

SEQ ID NO: 541615 - DNA, 25 bp, Mus musculus
gcatcagttccctctggtttcaaga

SEQ ID NO: 541616 - DNA, 25 bp, Mus musculus
gcatcagtttctccctcaggaaata

SEQ ID NO: 541617 - DNA, 25 bp, Mus musculus
gcatcagtttctgcctcaggaaata

SEQ ID NO: 541618 - DNA, 25 bp, Mus musculus
gcatcataattcagcaacccgagat

SEQ ID NO: 541619 - DNA, 25 bp, Mus musculus
gcatcataattctgcaacccgagat

SEQ ID NO: 541620 - DNA, 25 bp, Mus musculus
gcatcataccctaagactgtgaccc

SEQ ID NO: 541621 - DNA, 25 bp, Mus musculus
gcatcatacccttagactgtgaccc

SEQ ID NO: 541622 - DNA, 25 bp, Mus musculus
gcatcataccgtacgcaggcttaga

SEQ ID NO: 541623 - DNA, 25 bp, Mus musculus
gcatcataccgttcgcaggcttaga

SEQ ID NO: 541624 - DNA, 25 bp, Mus musculus
gcatcatacgaaacgctctctctga

SEQ ID NO: 541625 - DNA, 25 bp, Mus musculus
gcatcatacgaatcgctctctctga

SEQ ID NO: 541626 - DNA, 25 bp, Mus musculus
gcatcatactgacccatctctacag

SEQ ID NO: 541627 - DNA, 25 bp, Mus musculus
gcatcatactgagccatctctacag

SEQ ID NO: 541628 - DNA, 25 bp, Mus musculus
gcatcatagatgctgttcctgctaa

SEQ ID NO: 541629 - DNA, 25 bp, Mus musculus
gcatcatagatggtgttcctgctaa

SEQ ID NO: 541630 - DNA, 25 bp, Mus musculus
gcatcatatctgcaaatcgccgtgc

SEQ ID NO: 541631 - DNA, 25 bp, Mus musculus
gcatcatatctggaaatcgccgtgc

SEQ ID NO: 541632 - DNA, 25 bp, Mus musculus
gcatcatatttacgactttctcttc

SEQ ID NO: 541633 - DNA, 25 bp, Mus musculus
gcatcatatttaggactttctcttc

SEQ ID NO: 541634 - DNA, 25 bp, Mus musculus
gcatcatcaagacccattacaaccg

SEQ ID NO: 541635 - DNA, 25 bp, Mus musculus
gcatcatcaagagccattacaaccg

SEQ ID NO: 541636 - DNA, 25 bp, Mus musculus
gcatcatcaaggaggctctgcggct

SEQ ID NO: 541637 - DNA, 25 bp, Mus musculus
gcatcatcaaggtggctctgcggct

SEQ ID NO: 541638 - DNA, 25 bp, Mus musculus
gcatcatcacagattgttcttcaca

SEQ ID NO: 541639 - DNA, 25 bp, Mus musculus
gcatcatcacagtttgttcttcaca

SEQ ID NO: 541640 - DNA, 25 bp, Mus musculus
gcatcatcaccgacaagcacttcta

SEQ ID NO: 541641 - DNA, 25 bp, Mus musculus
gcatcatcaccgtcaagcacttcta

SEQ ID NO: 541642 - DNA, 25 bp, Mus musculus
gcatcatcagcaagaggacccagct

SEQ ID NO: 541643 - DNA, 25 bp, Mus musculus
gcatcatcagcatgaggacccagct

SEQ ID NO: 541644 - DNA, 25 bp, Mus musculus
gcatcatcagtccaaaacggctgag

SEQ ID NO: 541645 - DNA, 25 bp, Mus musculus
gcatcatcagtcgaaaacggctgag

SEQ ID NO: 541646 - DNA, 25 bp, Mus musculus
gcatcatcataaatgttcaggctgg

SEQ ID NO: 541647 - DNA, 25 bp, Mus musculus
gcatcatcataattgttcaggctgg

SEQ ID NO: 541648 - DNA, 25 bp, Mus musculus
gcatcatcccgcaatttccaataaa

SEQ ID NO: 541649 - DNA, 25 bp, Mus musculus
gcatcatcccgctatttccaataaa

SEQ ID NO: 541650 - DNA, 25 bp, Mus musculus
gcatcatccctgctttgaggcggaa

SEQ ID NO: 541651 - DNA, 25 bp, Mus musculus
gcatcatccctggtttgaggcggaa

SEQ ID NO: 541652 - DNA, 25 bp, Mus musculus
gcatcatccgcaacagtgtagaaga

SEQ ID NO: 541653 - DNA, 25 bp, Mus musculus
gcatcatccgcatcagtgtagaaga

SEQ ID NO: 541654 - DNA, 25 bp, Mus musculus
gcatcatcctgaagatgacctgtgg

SEQ ID NO: 541655 - DNA, 25 bp, Mus musculus
gcatcatcctgatgatgacctgtgg

SEQ ID NO: 541656 - DNA, 25 bp, Mus musculus
gcatcatctactacctaacatgtca

SEQ ID NO: 541657 - DNA, 25 bp, Mus musculus
gcatcatctacttcctaacatgtca

SEQ ID NO: 541658 - DNA, 25 bp, Mus musculus
gcatcatctctgatctatgtcctaa

SEQ ID NO: 541659 - DNA, 25 bp, Mus musculus
gcatcatctctgttctatgtcctaa

SEQ ID NO: 541660 - DNA, 25 bp, Mus musculus
gcatcatgactcaccctgtatatat

SEQ ID NO: 541661 - DNA, 25 bp, Mus musculus
gcatcatgactctccctgtatatat

SEQ ID NO: 541662 - DNA, 25 bp, Mus musculus
gcatcatgagccaggtgacctctgt

SEQ ID NO: 541663 - DNA, 25 bp, Mus musculus
gcatcatgagcctggtgacctctgt

SEQ ID NO: 541664 - DNA, 25 bp, Mus musculus
gcatcatgatgcactgaagattcat

SEQ ID NO: 541665 - DNA, 25 bp, Mus musculus
gcatcatgatgctctgaagattcat

SEQ ID NO: 541666 - DNA, 25 bp, Mus musculus
gcatcatgcagacacctcagggctt

SEQ ID NO: 541667 - DNA, 25 bp, Mus musculus
gcatcatgcagagacctcagggctt

SEQ ID NO: 541668 - DNA, 25 bp, Mus musculus
gcatcatgcaggctatttgcgtaca

SEQ ID NO: 541669 - DNA, 25 bp, Mus musculus
gcatcatgcagggtatttgcgtaca

SEQ ID NO: 541670 - DNA, 25 bp, Mus musculus
gcatcatgctagagtgctggaatgt

SEQ ID NO: 541671 - DNA, 25 bp, Mus musculus
gcatcatgctagtgtgctggaatgt

SEQ ID NO: 541672 - DNA, 25 bp, Mus musculus
gcatcatggaaaaaccttgtgccaa

SEQ ID NO: 541673 - DNA, 25 bp, Mus musculus
gcatcatggaaataccttgtgccaa

SEQ ID NO: 541674 - DNA, 25 bp, Mus musculus
gcatcatggacaagggacaaaatgt

SEQ ID NO: 541675 - DNA, 25 bp, Mus musculus
gcatcatggacatgggacaaaatgt

SEQ ID NO: 541676 - DNA, 25 bp, Mus musculus
gcatcatggccacaagctgtctagt

SEQ ID NO: 541677 - DNA, 25 bp, Mus musculus
gcatcatggccacgtcagctgtgag

SEQ ID NO: 541678 - DNA, 25 bp, Mus musculus
gcatcatggccacgtttactaaagg

SEQ ID NO: 541679 - DNA, 25 bp, Mus musculus
gcatcatggccagaagctgtctagt

SEQ ID NO: 541680 - DNA, 25 bp, Mus musculus
gcatcatggccaggtcagctgtgag

SEQ ID NO: 541681 - DNA, 25 bp, Mus musculus
gcatcatggccaggtttactaaagg

SEQ ID NO: 541682 - DNA, 25 bp, Mus musculus
gcatcatgtagcctctcaggactgt

SEQ ID NO: 541683 - DNA, 25 bp, Mus musculus
gcatcatgtagcgtctcaggactgt

SEQ ID NO: 541684 - DNA, 25 bp, Mus musculus
gcatcatgtggaatctgcttcctga

SEQ ID NO: 541685 - DNA, 25 bp, Mus musculus
gcatcatgtggattctgcttcctga

SEQ ID NO: 541686 - DNA, 25 bp, Mus musculus
gcatcatgtgtacttggttattttt

SEQ ID NO: 541687 - DNA, 25 bp, Mus musculus
gcatcatgtgtagttggttattttt

SEQ ID NO: 541688 - DNA, 25 bp, Mus musculus
gcatcattaatgcacgggctgtgga

SEQ ID NO: 541689 - DNA, 25 bp, Mus musculus
gcatcattaatggacgggctgtgga

SEQ ID NO: 541690 - DNA, 25 bp, Mus musculus
gcatcattactgatagagctccctg

SEQ ID NO: 541691 - DNA, 25 bp, Mus musculus
gcatcattactgttagagctccctg

SEQ ID NO: 541692 - DNA, 25 bp, Mus musculus
gcatcattatgccttctgttgtcta

SEQ ID NO: 541693 - DNA, 25 bp, Mus musculus
gcatcattatgcgttctgttgtcta

SEQ ID NO: 541694 - DNA, 25 bp, Mus musculus
gcatcattattgacagccggacacc

SEQ ID NO: 541695 - DNA, 25 bp, Mus musculus
gcatcattattgtcagccggacacc

SEQ ID NO: 541696 - DNA, 25 bp, Mus musculus
gcatcattcccaaggagttcgtcaa

SEQ ID NO: 541697 - DNA, 25 bp, Mus musculus
gcatcattcccatggagttcgtcaa

SEQ ID NO: 541698 - DNA, 25 bp, Mus musculus
gcatcattctgaacatctactcaca

SEQ ID NO: 541699 - DNA, 25 bp, Mus musculus
gcatcattctgatcatctactcaca

SEQ ID NO: 541700 - DNA, 25 bp, Mus musculus
gcatcattctttaattcttgtacca

SEQ ID NO: 541701 - DNA, 25 bp, Mus musculus
gcatcattcttttattcttgtacca

SEQ ID NO: 541702 - DNA, 25 bp, Mus musculus
gcatcatttattctgcatctggcat

SEQ ID NO: 541703 - DNA, 25 bp, Mus musculus
gcatcatttattgtgcatctggcat

SEQ ID NO: 541704 - DNA, 25 bp, Mus musculus
gcatcatttccaactcaatagcaga

SEQ ID NO: 541705 - DNA, 25 bp, Mus musculus
gcatcatttccatctcaatagcaga

SEQ ID NO: 541706 - DNA, 25 bp, Mus musculus
gcatcatttggtaacaactttgtat

SEQ ID NO: 541707 - DNA, 25 bp, Mus musculus
gcatcatttggttacaactttgtat

SEQ ID NO: 541708 - DNA, 25 bp, Mus musculus
gcatcattttctatagttgccatgt

SEQ ID NO: 541709 - DNA, 25 bp, Mus musculus
gcatcattttctcattatgtaggtt

SEQ ID NO: 541710 - DNA, 25 bp, Mus musculus
gcatcattttctgattatgtaggtt

SEQ ID NO: 541711 - DNA, 25 bp, Mus musculus
gcatcattttctttagttgccatgt

SEQ ID NO: 541712 - DNA, 25 bp, Mus musculus
gcatcatttttacgcacttagggag

SEQ ID NO: 541713 - DNA, 25 bp, Mus musculus
gcatcatttttaggcacttagggag

SEQ ID NO: 541714 - DNA, 25 bp, Mus musculus
gcatccaaaattccatatctccatc

SEQ ID NO: 541715 - DNA, 25 bp, Mus musculus
gcatccaaaattgcatatctccatc

SEQ ID NO: 541716 - DNA, 25 bp, Mus musculus
gcatccaaagcaagttagtttctca

SEQ ID NO: 541717 - DNA, 25 bp, Mus musculus
gcatccaaagcatgttagtttctca

SEQ ID NO: 541718 - DNA, 25 bp, Mus musculus
gcatccaaattccaaataccagaga

SEQ ID NO: 541719 - DNA, 25 bp, Mus musculus
gcatccaaattcgaaataccagaga

SEQ ID NO: 541720 - DNA, 25 bp, Mus musculus
gcatccaacgcacgcagcattgcat

SEQ ID NO: 541721 - DNA, 25 bp, Mus musculus
gcatccaacgcaggcagcattgcat

SEQ ID NO: 541722 - DNA, 25 bp, Mus musculus
gcatccaattctaagacctgcaatt

SEQ ID NO: 541723 - DNA, 25 bp, Mus musculus
gcatccaattcttagacctgcaatt

SEQ ID NO: 541724 - DNA, 25 bp, Mus musculus
gcatccacagctcttgggtgttacc

SEQ ID NO: 541725 - DNA, 25 bp, Mus musculus
gcatccacagctgttgggtgttacc

SEQ ID NO: 541726 - DNA, 25 bp, Mus musculus
gcatccacatagagctgacaactgt

SEQ ID NO: 541727 - DNA, 25 bp, Mus musculus
gcatccacatagtgctgacaactgt

SEQ ID NO: 541728 - DNA, 25 bp, Mus musculus
gcatccacatttcaatctcactgat

SEQ ID NO: 541729 - DNA, 25 bp, Mus musculus
gcatccacatttgaatctcactgat

SEQ ID NO: 541730 - DNA, 25 bp, Mus musculus
gcatccacgggaactgatatgggga

SEQ ID NO: 541731 - DNA, 25 bp, Mus musculus
gcatccacgggatctgatatgggga

SEQ ID NO: 541732 - DNA, 25 bp, Mus musculus
gcatccactaggcaatctggggtcc

SEQ ID NO: 541733 - DNA, 25 bp, Mus musculus
gcatccactagggaatctggggtcc

SEQ ID NO: 541734 - DNA, 25 bp, Mus musculus
gcatccactatcaataccatctgta

SEQ ID NO: 541735 - DNA, 25 bp, Mus musculus
gcatccactatctataccatctgta

SEQ ID NO: 541736 - DNA, 25 bp, Mus musculus
gcatccactggtatctgttattcaa

SEQ ID NO: 541737 - DNA, 25 bp, Mus musculus
gcatccactggtttctgttattcaa

SEQ ID NO: 541738 - DNA, 25 bp, Mus musculus
gcatccactgttagcagggtgaagc

SEQ ID NO: 541739 - DNA, 25 bp, Mus musculus
gcatccactgttctcttctaatatc

SEQ ID NO: 541740 - DNA, 25 bp, Mus musculus
gcatccactgttgtcttctaatatc

SEQ ID NO: 541741 - DNA, 25 bp, Mus musculus
gcatccactgtttgcagggtgaagc

SEQ ID NO: 541742 - DNA, 25 bp, Mus musculus
gcatccacttccattttatgactca

SEQ ID NO: 541743 - DNA, 25 bp, Mus musculus
gcatccacttcctttttatgactca

SEQ ID NO: 541744 - DNA, 25 bp, Mus musculus
gcatccacttggcttcaattctgta

SEQ ID NO: 541745 - DNA, 25 bp, Mus musculus
gcatccacttgggttcaattctgta

SEQ ID NO: 541746 - DNA, 25 bp, Mus musculus
gcatccagaagacccttcatcagga

SEQ ID NO: 541747 - DNA, 25 bp, Mus musculus
gcatccagaagagccttcatcagga

SEQ ID NO: 541748 - DNA, 25 bp, Mus musculus
gcatccagacagagaagttcaggct

SEQ ID NO: 541749 - DNA, 25 bp, Mus musculus
gcatccagacagtgaagttcaggct

SEQ ID NO: 541750 - DNA, 25 bp, Mus musculus
gcatccagatgaagagcctcaccaa

SEQ ID NO: 541751 - DNA, 25 bp, Mus musculus
gcatccagatgatgagcctcaccaa

SEQ ID NO: 541752 - DNA, 25 bp, Mus musculus
gcatccagccacacatcataatggc

SEQ ID NO: 541753 - DNA, 25 bp, Mus musculus
gcatccagccactcatcataatggc

SEQ ID NO: 541754 - DNA, 25 bp, Mus musculus
gcatccagcccgaacttggagttca

SEQ ID NO: 541755 - DNA, 25 bp, Mus musculus
gcatccagcccgtacttggagttca

SEQ ID NO: 541756 - DNA, 25 bp, Mus musculus
gcatccagcgagagcatgtgctatg

SEQ ID NO: 541757 - DNA, 25 bp, Mus musculus
gcatccagcgagtgcatgtgctatg

SEQ ID NO: 541758 - DNA, 25 bp, Mus musculus
gcatccagctggagacagttcaaga

SEQ ID NO: 541759 - DNA, 25 bp, Mus musculus
gcatccagctggtgacagttcaaga

SEQ ID NO: 541760 - DNA, 25 bp, Mus musculus
gcatccaggactctttgtcagataa

SEQ ID NO: 541761 - DNA, 25 bp, Mus musculus
gcatccaggactgtttgtcagataa

SEQ ID NO: 541762 - DNA, 25 bp, Mus musculus
gcatccaggatgctctaagcactgt

SEQ ID NO: 541763 - DNA, 25 bp, Mus musculus
gcatccaggatggtctaagcactgt

SEQ ID NO: 541764 - DNA, 25 bp, Mus musculus
gcatccagggctaatcagagcaaga

SEQ ID NO: 541765 - DNA, 25 bp, Mus musculus
gcatccagggcttatcagagcaaga

SEQ ID NO: 541766 - DNA, 25 bp, Mus musculus
gcatccaggtacaacttcctttgga

SEQ ID NO: 541767 - DNA, 25 bp, Mus musculus
gcatccaggtactacttcctttgga

SEQ ID NO: 541768 - DNA, 25 bp, Mus musculus
gcatccagtcgcatgtacacgttga

SEQ ID NO: 541769 - DNA, 25 bp, Mus musculus
gcatccagtcgcttgtacacgttga

SEQ ID NO: 541770 - DNA, 25 bp, Mus musculus
gcatccagtctacccttttctttga

SEQ ID NO: 541771 - DNA, 25 bp, Mus musculus
gcatccagtctagccttttctttga

SEQ ID NO: 541772 - DNA, 25 bp, Mus musculus
gcatccagttcacctgtgacactga

SEQ ID NO: 541773 - DNA, 25 bp, Mus musculus
gcatccagttcagctgtgacactga

SEQ ID NO: 541774 - DNA, 25 bp, Mus musculus
gcatccagtttcatggcacagtgta

SEQ ID NO: 541775 - DNA, 25 bp, Mus musculus
gcatccagtttcttggcacagtgta

SEQ ID NO: 541776 - DNA, 25 bp, Mus musculus
gcatccatcagaagactgcagcata

SEQ ID NO: 541777 - DNA, 25 bp, Mus musculus
gcatccatcagatgactgcagcata

SEQ ID NO: 541778 - DNA, 25 bp, Mus musculus
gcatccatcggacagttttaaatac

SEQ ID NO: 541779 - DNA, 25 bp, Mus musculus
gcatccatcggagagttttaaatac

SEQ ID NO: 541780 - DNA, 25 bp, Mus musculus
gcatccatctataaaatttgagcct

SEQ ID NO: 541781 - DNA, 25 bp, Mus musculus
gcatccatctattaaatttgagcct

SEQ ID NO: 541782 - DNA, 25 bp, Mus musculus
gcatccatctgcaaggcatttgctc

SEQ ID NO: 541783 - DNA, 25 bp, Mus musculus
gcatccatctgctaggcatttgctc

SEQ ID NO: 541784 - DNA, 25 bp, Mus musculus
gcatccatgaatactgcatgtgcag

SEQ ID NO: 541785 - DNA, 25 bp, Mus musculus
gcatccatgaattctgcatgtgcag

SEQ ID NO: 541786 - DNA, 25 bp, Mus musculus
gcatccatgagaaggcgcgacccag

SEQ ID NO: 541787 - DNA, 25 bp, Mus musculus
gcatccatgagatggcgcgacccag

SEQ ID NO: 541788 - DNA, 25 bp, Mus musculus
gcatccatgcctccaggaagtccat

SEQ ID NO: 541789 - DNA, 25 bp, Mus musculus
gcatccatgcctgcaggaagtccat

SEQ ID NO: 541790 - DNA, 25 bp, Mus musculus
gcatccatggtgacatgaattctct

SEQ ID NO: 541791 - DNA, 25 bp, Mus musculus
gcatccatggtgtcatgaattctct

SEQ ID NO: 541792 - DNA, 25 bp, Mus musculus
gcatccatgtgacattacaagtgtt

SEQ ID NO: 541793 - DNA, 25 bp, Mus musculus
gcatccatgtgagattacaagtgtt

SEQ ID NO: 541794 - DNA, 25 bp, Mus musculus
gcatccatgttcagtaggatcttta

SEQ ID NO: 541795 - DNA, 25 bp, Mus musculus
gcatccatgttctgtaggatcttta

SEQ ID NO: 541796 - DNA, 25 bp, Mus musculus
gcatccattcggctaccatccttgt

SEQ ID NO: 541797 - DNA, 25 bp, Mus musculus
gcatccattcgggtaccatccttgt

SEQ ID NO: 541798 - DNA, 25 bp, Mus musculus
gcatccattgcgagagacagacagt

SEQ ID NO: 541799 - DNA, 25 bp, Mus musculus
gcatccattgcgtgagacagacagt

SEQ ID NO: 541800 - DNA, 25 bp, Mus musculus
gcatccatttcaccttaaaccattt

SEQ ID NO: 541801 - DNA, 25 bp, Mus musculus
gcatccatttcagcttaaaccattt

SEQ ID NO: 541802 - DNA, 25 bp, Mus musculus
gcatccattttacaaagccacattt

SEQ ID NO: 541803 - DNA, 25 bp, Mus musculus
gcatccattttagaaagccacattt

SEQ ID NO: 541804 - DNA, 25 bp, Mus musculus
gcatcccaacttcgcctggactgag

SEQ ID NO: 541805 - DNA, 25 bp, Mus musculus
gcatcccaacttggcctggactgag

SEQ ID NO: 541806 - DNA, 25 bp, Mus musculus
gcatcccaagtaatctgggcttgga

SEQ ID NO: 541807 - DNA, 25 bp, Mus musculus
gcatcccaagtattctgggcttgga

SEQ ID NO: 541808 - DNA, 25 bp, Mus musculus
gcatcccaatgcagctagcttattc

SEQ ID NO: 541809 - DNA, 25 bp, Mus musculus
gcatcccaatgctgctagcttattc

SEQ ID NO: 541810 - DNA, 25 bp, Mus musculus
gcatcccacctaacactcagtaagg

SEQ ID NO: 541811 - DNA, 25 bp, Mus musculus
gcatcccacctatcactcagtaagg

SEQ ID NO: 541812 - DNA, 25 bp, Mus musculus
gcatcccagacgcagaacctagagc

SEQ ID NO: 541813 - DNA, 25 bp, Mus musculus
gcatcccagacggagaacctagagc

SEQ ID NO: 541814 - DNA, 25 bp, Mus musculus
gcatcccagagcaatgctaactgag

SEQ ID NO: 541815 - DNA, 25 bp, Mus musculus
gcatcccagagctatgctaactgag

SEQ ID NO: 541816 - DNA, 25 bp, Mus musculus
gcatcccaggagagcttggagcagt

SEQ ID NO: 541817 - DNA, 25 bp, Mus musculus
gcatcccaggagtgcttggagcagt

SEQ ID NO: 541818 - DNA, 25 bp, Mus musculus
gcatcccagtctataacatcctaga

SEQ ID NO: 541819 - DNA, 25 bp, Mus musculus
gcatcccagtctttaacatcctaga

SEQ ID NO: 541820 - DNA, 25 bp, Mus musculus
gcatcccagtgcaggtaaatcttct

SEQ ID NO: 541821 - DNA, 25 bp, Mus musculus
gcatcccagtgctggtaaatcttct

SEQ ID NO: 541822 - DNA, 25 bp, Mus musculus
gcatcccatagtacagagacacaat

SEQ ID NO: 541823 - DNA, 25 bp, Mus musculus
gcatcccatagttcagagacacaat

SEQ ID NO: 541824 - DNA, 25 bp, Mus musculus
gcatcccatcctatgggagctgaaa

SEQ ID NO: 541825 - DNA, 25 bp, Mus musculus
gcatcccatcctttgggagctgaaa

SEQ ID NO: 541826 - DNA, 25 bp, Mus musculus
gcatcccatgggagacttctgaggc

SEQ ID NO: 541827 - DNA, 25 bp, Mus musculus
gcatcccatgggtgacttctgaggc

SEQ ID NO: 541828 - DNA, 25 bp, Mus musculus
gcatccccacgaagcctctggagag

SEQ ID NO: 541829 - DNA, 25 bp, Mus musculus
gcatccccacgatgcctctggagag

SEQ ID NO: 541830 - DNA, 25 bp, Mus musculus
gcatcccctgtcagcatagaggagg

SEQ ID NO: 541831 - DNA, 25 bp, Mus musculus
gcatcccctgtctgcatagaggagg

SEQ ID NO: 541832 - DNA, 25 bp, Mus musculus
gcatcccgacctacaatttttatta

SEQ ID NO: 541833 - DNA, 25 bp, Mus musculus
gcatcccgaccttcaatttttatta

SEQ ID NO: 541834 - DNA, 25 bp, Mus musculus
gcatcccgatagctcaaaaggtgta

SEQ ID NO: 541835 - DNA, 25 bp, Mus musculus
gcatcccgataggtcaaaaggtgta

SEQ ID NO: 541836 - DNA, 25 bp, Mus musculus
gcatcccgggacacagtaactcgga

SEQ ID NO: 541837 - DNA, 25 bp, Mus musculus
gcatcccgggactcagtaactcgga

SEQ ID NO: 541838 - DNA, 25 bp, Mus musculus
gcatccctaaggattgtgtctggtc

SEQ ID NO: 541839 - DNA, 25 bp, Mus musculus
gcatccctaaggtttgtgtctggtc

SEQ ID NO: 541840 - DNA, 25 bp, Mus musculus
gcatccctaccacaattttaaggaa

SEQ ID NO: 541841 - DNA, 25 bp, Mus musculus
gcatccctaccagaattttaaggaa

SEQ ID NO: 541842 - DNA, 25 bp, Mus musculus
gcatccctacctatgtggccgagga

SEQ ID NO: 541843 - DNA, 25 bp, Mus musculus
gcatccctacctttgtggccgagga

SEQ ID NO: 541844 - DNA, 25 bp, Mus musculus
gcatccctagtcagatactcaaacc

SEQ ID NO: 541845 - DNA, 25 bp, Mus musculus
gcatccctagtctgatactcaaacc

SEQ ID NO: 541846 - DNA, 25 bp, Mus musculus
gcatccctatctctttgtgagggtg

SEQ ID NO: 541847 - DNA, 25 bp, Mus musculus
gcatccctatctgtttgtgagggtg

SEQ ID NO: 541848 - DNA, 25 bp, Mus musculus
gcatccctatgtccaataactgata

SEQ ID NO: 541849 - DNA, 25 bp, Mus musculus
gcatccctatgtgcaataactgata

SEQ ID NO: 541850 - DNA, 25 bp, Mus musculus
gcatccctcagtaggtccattgtaa

SEQ ID NO: 541851 - DNA, 25 bp, Mus musculus
gcatccctcagttggtccattgtaa

SEQ ID NO: 541852 - DNA, 25 bp, Mus musculus
gcatccctcatcaactacaaagcta

SEQ ID NO: 541853 - DNA, 25 bp, Mus musculus
gcatccctcatctactacaaagcta

SEQ ID NO: 541854 - DNA, 25 bp, Mus musculus
gcatccctctggaaagaggcagtga

SEQ ID NO: 541855 - DNA, 25 bp, Mus musculus
gcatccctctggtaagaggcagtga

SEQ ID NO: 541856 - DNA, 25 bp, Mus musculus
gcatccctgatgagtctgatgacca

SEQ ID NO: 541857 - DNA, 25 bp, Mus musculus
gcatccctgatgtgtctgatgacca

SEQ ID NO: 541858 - DNA, 25 bp, Mus musculus
gcatccctgcatatgtggtcaatgg

SEQ ID NO: 541859 - DNA, 25 bp, Mus musculus
gcatccctgcatttgtggtcaatgg

SEQ ID NO: 541860 - DNA, 25 bp, Mus musculus
gcatccctgtccaggccgctgtgaa

SEQ ID NO: 541861 - DNA, 25 bp, Mus musculus
gcatccctgtcctggccgctgtgaa

SEQ ID NO: 541862 - DNA, 25 bp, Mus musculus
gcatccctgtgaaccgtagggcgct

SEQ ID NO: 541863 - DNA, 25 bp, Mus musculus
gcatccctgtgatccgtagggcgct

SEQ ID NO: 541864 - DNA, 25 bp, Mus musculus
gcatcccttctcaggtggcaatgat

SEQ ID NO: 541865 - DNA, 25 bp, Mus musculus
gcatcccttctctggtggcaatgat

SEQ ID NO: 541866 - DNA, 25 bp, Mus musculus
gcatcccttcttatgaactgtgttt

SEQ ID NO: 541867 - DNA, 25 bp, Mus musculus
gcatcccttcttttgaactgtgttt

SEQ ID NO: 541868 - DNA, 25 bp, Mus musculus
gcatcccttggcagtgtctgtcttt

SEQ ID NO: 541869 - DNA, 25 bp, Mus musculus
gcatcccttggctgtgtctgtcttt

SEQ ID NO: 541870 - DNA, 25 bp, Mus musculus
gcatcccttggtaattctcttgtat

SEQ ID NO: 541871 - DNA, 25 bp, Mus musculus
gcatcccttggtcttcttatatata

SEQ ID NO: 541872 - DNA, 25 bp, Mus musculus
gcatcccttggtgttcttatatata

SEQ ID NO: 541873 - DNA, 25 bp, Mus musculus
gcatcccttggttattctcttgtat

SEQ ID NO: 541874 - DNA, 25 bp, Mus musculus
gcatccctttggatgctcgaaatga

SEQ ID NO: 541875 - DNA, 25 bp, Mus musculus
gcatccctttggttgctcgaaatga

SEQ ID NO: 541876 - DNA, 25 bp, Mus musculus
gcatcccttttcctaatacctaata

SEQ ID NO: 541877 - DNA, 25 bp, Mus musculus
gcatcccttttcgtaatacctaata

SEQ ID NO: 541878 - DNA, 25 bp, Mus musculus
gcatccgaatgtacgaattggcgca

SEQ ID NO: 541879 - DNA, 25 bp, Mus musculus
gcatccgaatgttcgaattggcgca

SEQ ID NO: 541880 - DNA, 25 bp, Mus musculus
gcatccgaccttatcagaggctttt

SEQ ID NO: 541881 - DNA, 25 bp, Mus musculus
gcatccgaccttttcagaggctttt

SEQ ID NO: 541882 - DNA, 25 bp, Mus musculus
gcatccgactgtagagatcgccaca

SEQ ID NO: 541883 - DNA, 25 bp, Mus musculus
gcatccgactgttgagatcgccaca

SEQ ID NO: 541884 - DNA, 25 bp, Mus musculus
gcatccgaggacacttggagcactg

SEQ ID NO: 541885 - DNA, 25 bp, Mus musculus
gcatccgaggactcttggagcactg

SEQ ID NO: 541886 - DNA, 25 bp, Mus musculus
gcatccgaggagatatagccaacct

SEQ ID NO: 541887 - DNA, 25 bp, Mus musculus
gcatccgaggagttatagccaacct

SEQ ID NO: 541888 - DNA, 25 bp, Mus musculus
gcatccgatgccacctaggtttgaa

SEQ ID NO: 541889 - DNA, 25 bp, Mus musculus
gcatccgatgcctcctaggtttgaa

SEQ ID NO: 541890 - DNA, 25 bp, Mus musculus
gcatccgatggtagcgctcagcaga

SEQ ID NO: 541891 - DNA, 25 bp, Mus musculus
gcatccgatggttgcgctcagcaga

SEQ ID NO: 541892 - DNA, 25 bp, Mus musculus
gcatccgatgtgctcacagggctac

SEQ ID NO: 541893 - DNA, 25 bp, Mus musculus
gcatccgatgtggtcacagggctac

SEQ ID NO: 541894 - DNA, 25 bp, Mus musculus
gcatccgcattgcagtgggcacact

SEQ ID NO: 541895 - DNA, 25 bp, Mus musculus
gcatccgcattgctttgcactcagg

SEQ ID NO: 541896 - DNA, 25 bp, Mus musculus
gcatccgcattggagtgggcacact

SEQ ID NO: 541897 - DNA, 25 bp, Mus musculus
gcatccgcattggtttgcactcagg

SEQ ID NO: 541898 - DNA, 25 bp, Mus musculus
gcatccgccactatgtaattgacag

SEQ ID NO: 541899 - DNA, 25 bp, Mus musculus
gcatccgccactttgtaattgacag

SEQ ID NO: 541900 - DNA, 25 bp, Mus musculus
gcatccgcgaggaacgagccagaat

SEQ ID NO: 541901 - DNA, 25 bp, Mus musculus
gcatccgcgaggtacgagccagaat

SEQ ID NO: 541902 - DNA, 25 bp, Mus musculus
gcatccgcggcaccagtgcgcagaa

SEQ ID NO: 541903 - DNA, 25 bp, Mus musculus
gcatccgcggcagcagtgcgcagaa

SEQ ID NO: 541904 - DNA, 25 bp, Mus musculus
gcatccgctgctatcgggacatgca

SEQ ID NO: 541905 - DNA, 25 bp, Mus musculus
gcatccgctgctttcgggacatgca

SEQ ID NO: 541906 - DNA, 25 bp, Mus musculus
gcatccggcaaacagctacaattct

SEQ ID NO: 541907 - DNA, 25 bp, Mus musculus
gcatccggcaaagagctacaattct

SEQ ID NO: 541908 - DNA, 25 bp, Mus musculus
gcatccggcatccttttaacattga

SEQ ID NO: 541909 - DNA, 25 bp, Mus musculus
gcatccggcatcgttttaacattga

SEQ ID NO: 541910 - DNA, 25 bp, Mus musculus
gcatccggcgtgcagagatcctaga

SEQ ID NO: 541911 - DNA, 25 bp, Mus musculus
gcatccggcgtggagagatcctaga

SEQ ID NO: 541912 - DNA, 25 bp, Mus musculus
gcatccgggcagatgcctacttcag

SEQ ID NO: 541913 - DNA, 25 bp, Mus musculus
gcatccgggcagttgcctacttcag

SEQ ID NO: 541914 - DNA, 25 bp, Mus musculus
gcatccgggtgtaccggctgtccaa

SEQ ID NO: 541915 - DNA, 25 bp, Mus musculus
gcatccgggtgttccggctgtccaa

SEQ ID NO: 541916 - DNA, 25 bp, Mus musculus
gcatccggttacaacagtttgtcac

SEQ ID NO: 541917 - DNA, 25 bp, Mus musculus
gcatccggttactacagtttgtcac

SEQ ID NO: 541918 - DNA, 25 bp, Mus musculus
gcatccggttccagtacagatcttg

SEQ ID NO: 541919 - DNA, 25 bp, Mus musculus
gcatccggttcctgtacagatcttg

SEQ ID NO: 541920 - DNA, 25 bp, Mus musculus
gcatccgtctaactattgcctttaa

SEQ ID NO: 541921 - DNA, 25 bp, Mus musculus
gcatccgtctaagtattgcctttaa

SEQ ID NO: 541922 - DNA, 25 bp, Mus musculus
gcatccgttgctatgattttggcat

SEQ ID NO: 541923 - DNA, 25 bp, Mus musculus
gcatccgttgctttgattttggcat

SEQ ID NO: 541924 - DNA, 25 bp, Mus musculus
gcatccgttttaactttcttcttaa

SEQ ID NO: 541925 - DNA, 25 bp, Mus musculus
gcatccgttttatctttcttcttaa

SEQ ID NO: 541926 - DNA, 25 bp, Mus musculus
gcatccgttttgatgcctttagaaa

SEQ ID NO: 541927 - DNA, 25 bp, Mus musculus
gcatccgttttgttgcctttagaaa

SEQ ID NO: 541928 - DNA, 25 bp, Mus musculus
gcatcctaacttattcagcatcatg

SEQ ID NO: 541929 - DNA, 25 bp, Mus musculus
gcatcctaactttttcagcatcatg

SEQ ID NO: 541930 - DNA, 25 bp, Mus musculus
gcatcctagcatacagggttgtcaa

SEQ ID NO: 541931 - DNA, 25 bp, Mus musculus
gcatcctagcattcagggttgtcaa

SEQ ID NO: 541932 - DNA, 25 bp, Mus musculus
gcatcctagccgaagccgagcggga

SEQ ID NO: 541933 - DNA, 25 bp, Mus musculus
gcatcctagccgtagccgagcggga

SEQ ID NO: 541934 - DNA, 25 bp, Mus musculus
gcatcctaggtgctcaagcatcctt

SEQ ID NO: 541935 - DNA, 25 bp, Mus musculus
gcatcctaggtggtcaagcatcctt

SEQ ID NO: 541936 - DNA, 25 bp, Mus musculus
gcatcctatgcaattgtccatttgg

SEQ ID NO: 541937 - DNA, 25 bp, Mus musculus
gcatcctatgcatttgtccatttgg

SEQ ID NO: 541938 - DNA, 25 bp, Mus musculus
gcatcctattaaccctagtatataa

SEQ ID NO: 541939 - DNA, 25 bp, Mus musculus
gcatcctattaagcctagtatataa

SEQ ID NO: 541940 - DNA, 25 bp, Mus musculus
gcatcctattggctgcaggtgactt

SEQ ID NO: 541941 - DNA, 25 bp, Mus musculus
gcatcctattgggtgcaggtgactt

SEQ ID NO: 541942 - DNA, 25 bp, Mus musculus
gcatcctcaaacacggcgccaagga

SEQ ID NO: 541943 - DNA, 25 bp, Mus musculus
gcatcctcaaactcggcgccaagga

SEQ ID NO: 541944 - DNA, 25 bp, Mus musculus
gcatcctcaagtcttcttatccata

SEQ ID NO: 541945 - DNA, 25 bp, Mus musculus
gcatcctcaagtgttcttatccata

SEQ ID NO: 541946 - DNA, 25 bp, Mus musculus
gcatcctcaatgattctgctgtaga

SEQ ID NO: 541947 - DNA, 25 bp, Mus musculus
gcatcctcaatgtttctgctgtaga

SEQ ID NO: 541948 - DNA, 25 bp, Mus musculus
gcatcctcactgctttgagttgcta

SEQ ID NO: 541949 - DNA, 25 bp, Mus musculus
gcatcctcactggtttgagttgcta

SEQ ID NO: 541950 - DNA, 25 bp, Mus musculus
gcatcctcagcaacagagacattga

SEQ ID NO: 541951 - DNA, 25 bp, Mus musculus
gcatcctcagcatcagagacattga

SEQ ID NO: 541952 - DNA, 25 bp, Mus musculus
gcatcctcagtcacgggtgtggtca

SEQ ID NO: 541953 - DNA, 25 bp, Mus musculus
gcatcctcagtctcgggtgtggtca

SEQ ID NO: 541954 - DNA, 25 bp, Mus musculus
gcatcctcagttctcgtgggtaaaa

SEQ ID NO: 541955 - DNA, 25 bp, Mus musculus
gcatcctcagttgtcgtgggtaaaa

SEQ ID NO: 541956 - DNA, 25 bp, Mus musculus
gcatcctcattaacacagctgttag

SEQ ID NO: 541957 - DNA, 25 bp, Mus musculus
gcatcctcattatcacagctgttag

SEQ ID NO: 541958 - DNA, 25 bp, Mus musculus
gcatcctccagcactttaaacaata

SEQ ID NO: 541959 - DNA, 25 bp, Mus musculus
gcatcctccagctctttaaacaata

SEQ ID NO: 541960 - DNA, 25 bp, Mus musculus
gcatcctcctggctgtgatctgaaa

SEQ ID NO: 541961 - DNA, 25 bp, Mus musculus
gcatcctcctgggtgtgatctgaaa

SEQ ID NO: 541962 - DNA, 25 bp, Mus musculus
gcatcctcctgtaatcttagctatg

SEQ ID NO: 541963 - DNA, 25 bp, Mus musculus
gcatcctcctgttatcttagctatg

SEQ ID NO: 541964 - DNA, 25 bp, Mus musculus
gcatcctcgtaccttctttcagaaa

SEQ ID NO: 541965 - DNA, 25 bp, Mus musculus
gcatcctcgtacgttctttcagaaa

SEQ ID NO: 541966 - DNA, 25 bp, Mus musculus
gcatcctctaccatcaattattttg

SEQ ID NO: 541967 - DNA, 25 bp, Mus musculus
gcatcctctaccttcaattattttg

SEQ ID NO: 541968 - DNA, 25 bp, Mus musculus
gcatcctctcctaaaactgcagaat

SEQ ID NO: 541969 - DNA, 25 bp, Mus musculus
gcatcctctccttaaactgcagaat

SEQ ID NO: 541970 - DNA, 25 bp, Mus musculus
gcatcctctgacaaccttacaggat

SEQ ID NO: 541971 - DNA, 25 bp, Mus musculus
gcatcctctgactaccttacaggat

SEQ ID NO: 541972 - DNA, 25 bp, Mus musculus
gcatcctctgcgcttgcagatggtg

SEQ ID NO: 541973 - DNA, 25 bp, Mus musculus
gcatcctctgcggttgcagatggtg

SEQ ID NO: 541974 - DNA, 25 bp, Mus musculus
gcatcctcttcaaacagtagctttg

SEQ ID NO: 541975 - DNA, 25 bp, Mus musculus
gcatcctcttcatacagtagctttg

SEQ ID NO: 541976 - DNA, 25 bp, Mus musculus
gcatcctcttccagatcaatgggta

SEQ ID NO: 541977 - DNA, 25 bp, Mus musculus
gcatcctcttcctgatcaatgggta

SEQ ID NO: 541978 - DNA, 25 bp, Mus musculus
gcatcctgaaccacctaaagtacag

SEQ ID NO: 541979 - DNA, 25 bp, Mus musculus
gcatcctgaacctcctaaagtacag

SEQ ID NO: 541980 - DNA, 25 bp, Mus musculus
gcatcctgatcacacttgctgtttc

SEQ ID NO: 541981 - DNA, 25 bp, Mus musculus
gcatcctgatcagacttgctgtttc

SEQ ID NO: 541982 - DNA, 25 bp, Mus musculus
gcatcctgcgagctgaggagctcac

SEQ ID NO: 541983 - DNA, 25 bp, Mus musculus
gcatcctgcgaggtgaggagctcac

SEQ ID NO: 541984 - DNA, 25 bp, Mus musculus
gcatcctggagtagaataatccctt

SEQ ID NO: 541985 - DNA, 25 bp, Mus musculus
gcatcctggagtagcctcggtgtgt

SEQ ID NO: 541986 - DNA, 25 bp, Mus musculus
gcatcctggagttgaataatccctt

SEQ ID NO: 541987 - DNA, 25 bp, Mus musculus
gcatcctggagttgcctcggtgtgt

SEQ ID NO: 541988 - DNA, 25 bp, Mus musculus
gcatcctgggacaaggtggcgatta

SEQ ID NO: 541989 - DNA, 25 bp, Mus musculus
gcatcctgggactaggtggcgatta

SEQ ID NO: 541990 - DNA, 25 bp, Mus musculus
gcatcctgggccatgacgctcagtg

SEQ ID NO: 541991 - DNA, 25 bp, Mus musculus
gcatcctgggccttgacgctcagtg

SEQ ID NO: 541992 - DNA, 25 bp, Mus musculus
gcatcctggtttcctaaggacctga

SEQ ID NO: 541993 - DNA, 25 bp, Mus musculus
gcatcctggtttgctaaggacctga

SEQ ID NO: 541994 - DNA, 25 bp, Mus musculus
gcatcctgtaggaggtggctgccca

SEQ ID NO: 541995 - DNA, 25 bp, Mus musculus
gcatcctgtaggtggtggctgccca

SEQ ID NO: 541996 - DNA, 25 bp, Mus musculus
gcatcctgttctcctgaattgctgc

SEQ ID NO: 541997 - DNA, 25 bp, Mus musculus
gcatcctgttctgctgaattgctgc

SEQ ID NO: 541998 - DNA, 25 bp, Mus musculus
gcatcctgttggagagacctgacca

SEQ ID NO: 541999 - DNA, 25 bp, Mus musculus
gcatcctgttggtgagacctgacca

SEQ ID NO: 542000 - DNA, 25 bp, Mus musculus
gcatcctgtttcacagtcagtagga

SEQ ID NO: 542001 - DNA, 25 bp, Mus musculus
gcatcctgtttctcagtcagtagga

SEQ ID NO: 542002 - DNA, 25 bp, Mus musculus
gcatcctgtttgacccataggtaaa

SEQ ID NO: 542003 - DNA, 25 bp, Mus musculus
gcatcctgtttgtcccataggtaaa

SEQ ID NO: 542004 - DNA, 25 bp, Mus musculus
gcatccttagtaaatgtctttgttt

SEQ ID NO: 542005 - DNA, 25 bp, Mus musculus
gcatccttagtatatgtctttgttt

SEQ ID NO: 542006 - DNA, 25 bp, Mus musculus
gcatccttataaactctatatttga

SEQ ID NO: 542007 - DNA, 25 bp, Mus musculus
gcatccttataatctctatatttga

SEQ ID NO: 542008 - DNA, 25 bp, Mus musculus
gcatccttatcacagcttgtcagaa

SEQ ID NO: 542009 - DNA, 25 bp, Mus musculus
gcatccttatcagagcttgtcagaa

SEQ ID NO: 542010 - DNA, 25 bp, Mus musculus
gcatccttattgaactacagctccg

SEQ ID NO: 542011 - DNA, 25 bp, Mus musculus
gcatccttattgtactacagctccg

SEQ ID NO: 542012 - DNA, 25 bp, Mus musculus
gcatccttcacactgattggcgcag

SEQ ID NO: 542013 - DNA, 25 bp, Mus musculus
gcatccttcacagtgattggcgcag

SEQ ID NO: 542014 - DNA, 25 bp, Mus musculus
gcatccttcagacttgttgacagtt

SEQ ID NO: 542015 - DNA, 25 bp, Mus musculus
gcatccttcagagttgttgacagtt

SEQ ID NO: 542016 - DNA, 25 bp, Mus musculus
gcatccttctgtactatgatacctt

SEQ ID NO: 542017 - DNA, 25 bp, Mus musculus
gcatccttctgttctatgatacctt

SEQ ID NO: 542018 - DNA, 25 bp, Mus musculus
gcatccttgaatatccggacagcta

SEQ ID NO: 542019 - DNA, 25 bp, Mus musculus
gcatccttgaatttccggacagcta

SEQ ID NO: 542020 - DNA, 25 bp, Mus musculus
gcatccttgcagacacctgatgaag

SEQ ID NO: 542021 - DNA, 25 bp, Mus musculus
gcatccttgcagtcacctgatgaag

SEQ ID NO: 542022 - DNA, 25 bp, Mus musculus
gcatccttgcctacgggtggttgga

SEQ ID NO: 542023 - DNA, 25 bp, Mus musculus
gcatccttgccttcgggtggttgga

SEQ ID NO: 542024 - DNA, 25 bp, Mus musculus
gcatccttggatctcaatgttcctt

SEQ ID NO: 542025 - DNA, 25 bp, Mus musculus
gcatccttggatgtcaatgttcctt

SEQ ID NO: 542026 - DNA, 25 bp, Mus musculus
gcatcctttgatagcagtggtcgtc

SEQ ID NO: 542027 - DNA, 25 bp, Mus musculus
gcatcctttgattgcagtggtcgtc

SEQ ID NO: 542028 - DNA, 25 bp, Mus musculus
gcatccttttagagctgttgtgggt

SEQ ID NO: 542029 - DNA, 25 bp, Mus musculus
gcatccttttagtgctgttgtgggt

SEQ ID NO: 542030 - DNA, 25 bp, Mus musculus
gcatcctttttcattaggtggcaat

SEQ ID NO: 542031 - DNA, 25 bp, Mus musculus
gcatcctttttctttaggtggcaat

SEQ ID NO: 542032 - DNA, 25 bp, Mus musculus
gcatcgaattccatgtttcaactaa

SEQ ID NO: 542033 - DNA, 25 bp, Mus musculus
gcatcgaattccttgtttcaactaa

SEQ ID NO: 542034 - DNA, 25 bp, Mus musculus
gcatcgacactgaggtagcaccctt

SEQ ID NO: 542035 - DNA, 25 bp, Mus musculus
gcatcgacactgtggtagcaccctt

SEQ ID NO: 542036 - DNA, 25 bp, Mus musculus
gcatcgagattccatagtggctcct

SEQ ID NO: 542037 - DNA, 25 bp, Mus musculus
gcatcgagattcgatagtggctcct

SEQ ID NO: 542038 - DNA, 25 bp, Mus musculus
gcatcgagtacgaaaagaccaagta

SEQ ID NO: 542039 - DNA, 25 bp, Mus musculus
gcatcgagtacgtaaagaccaagta

SEQ ID NO: 542040 - DNA, 25 bp, Mus musculus
gcatcgagtactcgattgtccgaaa

SEQ ID NO: 542041 - DNA, 25 bp, Mus musculus
gcatcgagtactggattgtccgaaa

SEQ ID NO: 542042 - DNA, 25 bp, Mus musculus
gcatcgagtggacccatcgtgcagt

SEQ ID NO: 542043 - DNA, 25 bp, Mus musculus
gcatcgagtggagccatcgtgcagt

SEQ ID NO: 542044 - DNA, 25 bp, Mus musculus
gcatcgagtttcattctttatctaa

SEQ ID NO: 542045 - DNA, 25 bp, Mus musculus
gcatcgagtttctttctttatctaa

SEQ ID NO: 542046 - DNA, 25 bp, Mus musculus
gcatcgatagctaagtcactgccct

SEQ ID NO: 542047 - DNA, 25 bp, Mus musculus
gcatcgatagcttagtcactgccct

SEQ ID NO: 542048 - DNA, 25 bp, Mus musculus
gcatcgatgtagaccgagggttttt

SEQ ID NO: 542049 - DNA, 25 bp, Mus musculus
gcatcgatgtagtccgagggttttt

SEQ ID NO: 542050 - DNA, 25 bp, Mus musculus
gcatcgcaactcatattgcttcaac

SEQ ID NO: 542051 - DNA, 25 bp, Mus musculus
gcatcgcaactcttattgcttcaac

SEQ ID NO: 542052 - DNA, 25 bp, Mus musculus
gcatcgcagagaaagacaacaacct

SEQ ID NO: 542053 - DNA, 25 bp, Mus musculus
gcatcgcagagatagacaacaacct

SEQ ID NO: 542054 - DNA, 25 bp, Mus musculus
gcatcgccagcaattcgatcctcgt

SEQ ID NO: 542055 - DNA, 25 bp, Mus musculus
gcatcgccagcatttcgatcctcgt

SEQ ID NO: 542056 - DNA, 25 bp, Mus musculus
gcatcgcccagaccagagacaagca

SEQ ID NO: 542057 - DNA, 25 bp, Mus musculus
gcatcgcccagagcagagacaagca

SEQ ID NO: 542058 - DNA, 25 bp, Mus musculus
gcatcgcccgccattttgtctttta

SEQ ID NO: 542059 - DNA, 25 bp, Mus musculus
gcatcgcccgcctttttgtctttta

SEQ ID NO: 542060 - DNA, 25 bp, Mus musculus
gcatcgcctgctcggtaatcagttt

SEQ ID NO: 542061 - DNA, 25 bp, Mus musculus
gcatcgcctgctgggtaatcagttt

SEQ ID NO: 542062 - DNA, 25 bp, Mus musculus
gcatcgccttcccagagtttgacaa

SEQ ID NO: 542063 - DNA, 25 bp, Mus musculus
gcatcgccttccgagagtttgacaa

SEQ ID NO: 542064 - DNA, 25 bp, Mus musculus
gcatcgccttgcagttaggcttaca

SEQ ID NO: 542065 - DNA, 25 bp, Mus musculus
gcatcgccttgctgttaggcttaca

SEQ ID NO: 542066 - DNA, 25 bp, Mus musculus
gcatcgcctttgaccacatgaaggt

SEQ ID NO: 542067 - DNA, 25 bp, Mus musculus
gcatcgcctttgtccacatgaaggt

SEQ ID NO: 542068 - DNA, 25 bp, Mus musculus
gcatcgcggcatcagtatatatttt

SEQ ID NO: 542069 - DNA, 25 bp, Mus musculus
gcatcgcggcatgagtatatatttt

SEQ ID NO: 542070 - DNA, 25 bp, Mus musculus
gcatcgctgaacacctgggtttgga

SEQ ID NO: 542071 - DNA, 25 bp, Mus musculus
gcatcgctgaactcctgggtttgga

SEQ ID NO: 542072 - DNA, 25 bp, Mus musculus
gcatcggaagcgagctcgtcacaga

SEQ ID NO: 542073 - DNA, 25 bp, Mus musculus
gcatcggaagcgtgctcgtcacaga

SEQ ID NO: 542074 - DNA, 25 bp, Mus musculus
gcatcggagattcgcttttggccca

SEQ ID NO: 542075 - DNA, 25 bp, Mus musculus
gcatcggagattggcttttggccca

SEQ ID NO: 542076 - DNA, 25 bp, Mus musculus
gcatcggatcccatggcagacggtt

SEQ ID NO: 542077 - DNA, 25 bp, Mus musculus
gcatcggatcccttggcagacggtt

SEQ ID NO: 542078 - DNA, 25 bp, Mus musculus
gcatcggcaacaatgctgaagtgta

SEQ ID NO: 542079 - DNA, 25 bp, Mus musculus
gcatcggcaacattgctgaagtgta

SEQ ID NO: 542080 - DNA, 25 bp, Mus musculus
gcatcggcaagaacggtggtgccca

SEQ ID NO: 542081 - DNA, 25 bp, Mus musculus
gcatcggcaagatcggtggtgccca

SEQ ID NO: 542082 - DNA, 25 bp, Mus musculus
gcatcggcagccagcgctctggaag

SEQ ID NO: 542083 - DNA, 25 bp, Mus musculus
gcatcggcagcctgcgctctggaag

SEQ ID NO: 542084 - DNA, 25 bp, Mus musculus
gcatcggctgcaatgtggtggataa

SEQ ID NO: 542085 - DNA, 25 bp, Mus musculus
gcatcggctgcattgtggtggataa

SEQ ID NO: 542086 - DNA, 25 bp, Mus musculus
gcatcggctgtacttgtcagcgcgt

SEQ ID NO: 542087 - DNA, 25 bp, Mus musculus
gcatcggctgtagttgtcagcgcgt

SEQ ID NO: 542088 - DNA, 25 bp, Mus musculus
gcatcgggccttaggcattcctgac

SEQ ID NO: 542089 - DNA, 25 bp, Mus musculus
gcatcgggcctttggcattcctgac

SEQ ID NO: 542090 - DNA, 25 bp, Mus musculus
gcatcggtacggcagcttgagctca

SEQ ID NO: 542091 - DNA, 25 bp, Mus musculus
gcatcggtacgggagcttgagctca

SEQ ID NO: 542092 - DNA, 25 bp, Mus musculus
gcatcggtacttatatagtcatgat

SEQ ID NO: 542093 - DNA, 25 bp, Mus musculus
gcatcggtacttttatagtcatgat

SEQ ID NO: 542094 - DNA, 25 bp, Mus musculus
gcatcggtgtcacctcttgcacagt

SEQ ID NO: 542095 - DNA, 25 bp, Mus musculus
gcatcggtgtcagctcttgcacagt

SEQ ID NO: 542096 - DNA, 25 bp, Mus musculus
gcatcggtgtgtcgctatttttaaa

SEQ ID NO: 542097 - DNA, 25 bp, Mus musculus
gcatcggtgtgtggctatttttaaa

SEQ ID NO: 542098 - DNA, 25 bp, Mus musculus
gcatcgtaagtgatttctgtattct

SEQ ID NO: 542099 - DNA, 25 bp, Mus musculus
gcatcgtaagtgttttctgtattct

SEQ ID NO: 542100 - DNA, 25 bp, Mus musculus
gcatcgtctgctcttgtgttttgtc

SEQ ID NO: 542101 - DNA, 25 bp, Mus musculus
gcatcgtctgctgttgtgttttgtc

SEQ ID NO: 542102 - DNA, 25 bp, Mus musculus
gcatcgtgaacgactgtagcagctc

SEQ ID NO: 542103 - DNA, 25 bp, Mus musculus
gcatcgtgaacgtctgtagcagctc

SEQ ID NO: 542104 - DNA, 25 bp, Mus musculus
gcatcgtgccacaacataggtcaaa

SEQ ID NO: 542105 - DNA, 25 bp, Mus musculus
gcatcgtgccactacataggtcaaa

SEQ ID NO: 542106 - DNA, 25 bp, Mus musculus
gcatcgtgtaggaatcccaggtgat

SEQ ID NO: 542107 - DNA, 25 bp, Mus musculus
gcatcgtgtaggtatcccaggtgat

SEQ ID NO: 542108 - DNA, 25 bp, Mus musculus
gcatcgtgtcagagcccgggcgcct

SEQ ID NO: 542109 - DNA, 25 bp, Mus musculus
gcatcgtgtcagtgcccgggcgcct

SEQ ID NO: 542110 - DNA, 25 bp, Mus musculus
gcatcgttactaaaaggtgaccctt

SEQ ID NO: 542111 - DNA, 25 bp, Mus musculus
gcatcgttactataaggtgaccctt

SEQ ID NO: 542112 - DNA, 25 bp, Mus musculus
gcatcgttctacctgtcagtcaagg

SEQ ID NO: 542113 - DNA, 25 bp, Mus musculus
gcatcgttctacgtgtcagtcaagg

SEQ ID NO: 542114 - DNA, 25 bp, Mus musculus
gcatcgtttgtaacatgggccattc

SEQ ID NO: 542115 - DNA, 25 bp, Mus musculus
gcatcgtttgtatcatgggccattc

SEQ ID NO: 542116 - DNA, 25 bp, Mus musculus
gcatctaaacctcacaagcacctga

SEQ ID NO: 542117 - DNA, 25 bp, Mus musculus
gcatctaaacctgacaagcacctga

SEQ ID NO: 542118 - DNA, 25 bp, Mus musculus
gcatctaacagcatatcagaccact

SEQ ID NO: 542119 - DNA, 25 bp, Mus musculus
gcatctaacagcttatcagaccact

SEQ ID NO: 542120 - DNA, 25 bp, Mus musculus
gcatctaactctccagagctggatt

SEQ ID NO: 542121 - DNA, 25 bp, Mus musculus
gcatctaactctgcagagctggatt

SEQ ID NO: 542122 - DNA, 25 bp, Mus musculus
gcatctaagaaaccctaaacacaaa

SEQ ID NO: 542123 - DNA, 25 bp, Mus musculus
gcatctaagaaagcctaaacacaaa

SEQ ID NO: 542124 - DNA, 25 bp, Mus musculus
gcatctaagtccagttgcatccagt

SEQ ID NO: 542125 - DNA, 25 bp, Mus musculus
gcatctaagtcctgttgcatccagt

SEQ ID NO: 542126 - DNA, 25 bp, Mus musculus
gcatctaatccaacaagtgagtatt

SEQ ID NO: 542127 - DNA, 25 bp, Mus musculus
gcatctaatccatcaagtgagtatt

SEQ ID NO: 542128 - DNA, 25 bp, Mus musculus
gcatctacatacctttttgaagcta

SEQ ID NO: 542129 - DNA, 25 bp, Mus musculus
gcatctacatacgtttttgaagcta

SEQ ID NO: 542130 - DNA, 25 bp, Mus musculus
gcatctaccacgagattccagtttt

SEQ ID NO: 542131 - DNA, 25 bp, Mus musculus
gcatctaccacgtgattccagtttt

SEQ ID NO: 542132 - DNA, 25 bp, Mus musculus
gcatctacctgcctgaagccagaga

SEQ ID NO: 542133 - DNA, 25 bp, Mus musculus
gcatctacctgcgtgaagccagaga

SEQ ID NO: 542134 - DNA, 25 bp, Mus musculus
gcatctacgaccagggccttcggcg

SEQ ID NO: 542135 - DNA, 25 bp, Mus musculus
gcatctacgacctgggccttcggcg

SEQ ID NO: 542136 - DNA, 25 bp, Mus musculus
gcatctactgacaatgacttgtctg

SEQ ID NO: 542137 - DNA, 25 bp, Mus musculus
gcatctactgactatgacttgtctg

SEQ ID NO: 542138 - DNA, 25 bp, Mus musculus
gcatctactgcaatgttcatgtgat

SEQ ID NO: 542139 - DNA, 25 bp, Mus musculus
gcatctactgcattgttcatgtgat

SEQ ID NO: 542140 - DNA, 25 bp, Mus musculus
gcatctactgtgactttgatctgta

SEQ ID NO: 542141 - DNA, 25 bp, Mus musculus
gcatctactgtgtctttgatctgta

SEQ ID NO: 542142 - DNA, 25 bp, Mus musculus
gcatctactgttctcttatgggtac

SEQ ID NO: 542143 - DNA, 25 bp, Mus musculus
gcatctactgttgtcttatgggtac

SEQ ID NO: 542144 - DNA, 25 bp, Mus musculus
gcatctactttgatctggacccgag

SEQ ID NO: 542145 - DNA, 25 bp, Mus musculus
gcatctactttgttctggacccgag

SEQ ID NO: 542146 - DNA, 25 bp, Mus musculus
gcatctagacatagtactcagtaaa

SEQ ID NO: 542147 - DNA, 25 bp, Mus musculus
gcatctagacattgtactcagtaaa

SEQ ID NO: 542148 - DNA, 25 bp, Mus musculus
gcatctagagccaggtaggacagaa

SEQ ID NO: 542149 - DNA, 25 bp, Mus musculus
gcatctagagcctggtaggacagaa

SEQ ID NO: 542150 - DNA, 25 bp, Mus musculus
gcatctagccaccagatacctatta

SEQ ID NO: 542151 - DNA, 25 bp, Mus musculus
gcatctagccacgagatacctatta

SEQ ID NO: 542152 - DNA, 25 bp, Mus musculus
gcatctagccagcactattaacaga

SEQ ID NO: 542153 - DNA, 25 bp, Mus musculus
gcatctagccaggactattaacaga

SEQ ID NO: 542154 - DNA, 25 bp, Mus musculus
gcatctagcctgcttctatgggcaa

SEQ ID NO: 542155 - DNA, 25 bp, Mus musculus
gcatctagcctggttctatgggcaa

SEQ ID NO: 542156 - DNA, 25 bp, Mus musculus
gcatctagcgagactaagccgggag

SEQ ID NO: 542157 - DNA, 25 bp, Mus musculus
gcatctagcgagtctaagccgggag

SEQ ID NO: 542158 - DNA, 25 bp, Mus musculus
gcatctaggattagcactgcggtgc

SEQ ID NO: 542159 - DNA, 25 bp, Mus musculus
gcatctaggatttgcactgcggtgc

SEQ ID NO: 542160 - DNA, 25 bp, Mus musculus
gcatctagtagcaactttctggaat

SEQ ID NO: 542161 - DNA, 25 bp, Mus musculus
gcatctagtagctactttctggaat

SEQ ID NO: 542162 - DNA, 25 bp, Mus musculus
gcatctagtgtacctcaccagaggg

SEQ ID NO: 542163 - DNA, 25 bp, Mus musculus
gcatctagtgtagctcaccagaggg

SEQ ID NO: 542164 - DNA, 25 bp, Mus musculus
gcatctataaaacccatgactttta

SEQ ID NO: 542165 - DNA, 25 bp, Mus musculus
gcatctataaaagccatgactttta

SEQ ID NO: 542166 - DNA, 25 bp, Mus musculus
gcatctatatctcctgagctgtctc

SEQ ID NO: 542167 - DNA, 25 bp, Mus musculus
gcatctatatctgctgagctgtctc

SEQ ID NO: 542168 - DNA, 25 bp, Mus musculus
gcatctatcacgagctccgttttgg

SEQ ID NO: 542169 - DNA, 25 bp, Mus musculus
gcatctatcacgtgctccgttttgg

SEQ ID NO: 542170 - DNA, 25 bp, Mus musculus
gcatctatccagagcagcctgcaca

SEQ ID NO: 542171 - DNA, 25 bp, Mus musculus
gcatctatccagtgcagcctgcaca

SEQ ID NO: 542172 - DNA, 25 bp, Mus musculus
gcatctatctagacctgttcctaat

SEQ ID NO: 542173 - DNA, 25 bp, Mus musculus
gcatctatctagtcctgttcctaat

SEQ ID NO: 542174 - DNA, 25 bp, Mus musculus
gcatctatgctcaaaaacctctgta

SEQ ID NO: 542175 - DNA, 25 bp, Mus musculus
gcatctatgctctaaaacctctgta

SEQ ID NO: 542176 - DNA, 25 bp, Mus musculus
gcatctatggaaatctcttctctag

SEQ ID NO: 542177 - DNA, 25 bp, Mus musculus
gcatctatggaattctcttctctag

SEQ ID NO: 542178 - DNA, 25 bp, Mus musculus
gcatctcaaaggctgccttctgttg

SEQ ID NO: 542179 - DNA, 25 bp, Mus musculus
gcatctcaaagggtgccttctgttg

SEQ ID NO: 542180 - DNA, 25 bp, Mus musculus
gcatctcaaccaagggcccctgtgt

SEQ ID NO: 542181 - DNA, 25 bp, Mus musculus
gcatctcaaccatgggcccctgtgt

SEQ ID NO: 542182 - DNA, 25 bp, Mus musculus
gcatctcaaggtatcaagcgggact

SEQ ID NO: 542183 - DNA, 25 bp, Mus musculus
gcatctcaaggtttcaagcgggact

SEQ ID NO: 542184 - DNA, 25 bp, Mus musculus
gcatctcaatacaacagcactgcaa

SEQ ID NO: 542185 - DNA, 25 bp, Mus musculus
gcatctcaatactacagcactgcaa

SEQ ID NO: 542186 - DNA, 25 bp, Mus musculus
gcatctcaatgcataaggattttca

SEQ ID NO: 542187 - DNA, 25 bp, Mus musculus
gcatctcaatgcttaaggattttca

SEQ ID NO: 542188 - DNA, 25 bp, Mus musculus
gcatctcacatacaagggtgctagg

SEQ ID NO: 542189 - DNA, 25 bp, Mus musculus
gcatctcacatagaagggtgctagg

SEQ ID NO: 542190 - DNA, 25 bp, Mus musculus
gcatctcactgaagttccacatatt

SEQ ID NO: 542191 - DNA, 25 bp, Mus musculus
gcatctcactgatgttccacatatt

SEQ ID NO: 542192 - DNA, 25 bp, Mus musculus
gcatctcactgcagcaaagcgagtt

SEQ ID NO: 542193 - DNA, 25 bp, Mus musculus
gcatctcactgctgcaaagcgagtt

SEQ ID NO: 542194 - DNA, 25 bp, Mus musculus
gcatctcagcagatcaggcagaaac

SEQ ID NO: 542195 - DNA, 25 bp, Mus musculus
gcatctcagcagttcaggcagaaac

SEQ ID NO: 542196 - DNA, 25 bp, Mus musculus
gcatctcagctcctctttactgcat

SEQ ID NO: 542197 - DNA, 25 bp, Mus musculus
gcatctcagctcgtctttactgcat

SEQ ID NO: 542198 - DNA, 25 bp, Mus musculus
gcatctcaggaaaggtggctgccac

SEQ ID NO: 542199 - DNA, 25 bp, Mus musculus
gcatctcaggaatggtggctgccac

SEQ ID NO: 542200 - DNA, 25 bp, Mus musculus
gcatctcagttgattctgaatgtta

SEQ ID NO: 542201 - DNA, 25 bp, Mus musculus
gcatctcagttgctggtgcacgtca

SEQ ID NO: 542202 - DNA, 25 bp, Mus musculus
gcatctcagttggtggtgcacgtca

SEQ ID NO: 542203 - DNA, 25 bp, Mus musculus
gcatctcagttgtttctgaatgtta

SEQ ID NO: 542204 - DNA, 25 bp, Mus musculus
gcatctcatcatatcgtgggcagga

SEQ ID NO: 542205 - DNA, 25 bp, Mus musculus
gcatctcatcatttcgtgggcagga

SEQ ID NO: 542206 - DNA, 25 bp, Mus musculus
gcatctcatcgtatgtatgacattt

SEQ ID NO: 542207 - DNA, 25 bp, Mus musculus
gcatctcatcgtttgtatgacattt

SEQ ID NO: 542208 - DNA, 25 bp, Mus musculus
gcatctcatctcatcctggacaggt

SEQ ID NO: 542209 - DNA, 25 bp, Mus musculus
gcatctcatctcttcctggacaggt

SEQ ID NO: 542210 - DNA, 25 bp, Mus musculus
gcatctcattccacccaggagtaca

SEQ ID NO: 542211 - DNA, 25 bp, Mus musculus
gcatctcattcctcccaggagtaca

SEQ ID NO: 542212 - DNA, 25 bp, Mus musculus
gcatctcattgtagagtgttcttga

SEQ ID NO: 542213 - DNA, 25 bp, Mus musculus
gcatctcattgtccttgatagtatt

SEQ ID NO: 542214 - DNA, 25 bp, Mus musculus
gcatctcattgtctcttcattatta

SEQ ID NO: 542215 - DNA, 25 bp, Mus musculus
gcatctcattgtgcttgatagtatt

SEQ ID NO: 542216 - DNA, 25 bp, Mus musculus
gcatctcattgtgtcttcattatta

SEQ ID NO: 542217 - DNA, 25 bp, Mus musculus
gcatctcattgttgagtgttcttga

SEQ ID NO: 542218 - DNA, 25 bp, Mus musculus
gcatctcatttgcttcgtttattat

SEQ ID NO: 542219 - DNA, 25 bp, Mus musculus
gcatctcatttggttcgtttattat

SEQ ID NO: 542220 - DNA, 25 bp, Mus musculus
gcatctccaattatctctttagtga

SEQ ID NO: 542221 - DNA, 25 bp, Mus musculus
gcatctccaattttctctttagtga

SEQ ID NO: 542222 - DNA, 25 bp, Mus musculus
gcatctccagttactttaattctaa

SEQ ID NO: 542223 - DNA, 25 bp, Mus musculus
gcatctccagtttctttaattctaa

SEQ ID NO: 542224 - DNA, 25 bp, Mus musculus
gcatctccatgtctgagacactcgt

SEQ ID NO: 542225 - DNA, 25 bp, Mus musculus
gcatctccatgtgtgagacactcgt

SEQ ID NO: 542226 - DNA, 25 bp, Mus musculus
gcatctcccagtccttgcgtgaaga

SEQ ID NO: 542227 - DNA, 25 bp, Mus musculus
gcatctcccagtgcttgcgtgaaga

SEQ ID NO: 542228 - DNA, 25 bp, Mus musculus
gcatctccccagagtattttgtagc

SEQ ID NO: 542229 - DNA, 25 bp, Mus musculus
gcatctccccagtgtattttgtagc

SEQ ID NO: 542230 - DNA, 25 bp, Mus musculus
gcatctccctaaattttcctcttaa

SEQ ID NO: 542231 - DNA, 25 bp, Mus musculus
gcatctccctaatttttcctcttaa

SEQ ID NO: 542232 - DNA, 25 bp, Mus musculus
gcatctccctgaactaatacctagt

SEQ ID NO: 542233 - DNA, 25 bp, Mus musculus
gcatctccctgatctaatacctagt

SEQ ID NO: 542234 - DNA, 25 bp, Mus musculus
gcatctccgggtcggccttaaagga

SEQ ID NO: 542235 - DNA, 25 bp, Mus musculus
gcatctccgggtgggccttaaagga

SEQ ID NO: 542236 - DNA, 25 bp, Mus musculus
gcatctcctccaacgggtggtgggt

SEQ ID NO: 542237 - DNA, 25 bp, Mus musculus
gcatctcctccatcgggtggtgggt

SEQ ID NO: 542238 - DNA, 25 bp, Mus musculus
gcatctcctcctaatttcttgaaga

SEQ ID NO: 542239 - DNA, 25 bp, Mus musculus
gcatctcctccttatttcttgaaga

SEQ ID NO: 542240 - DNA, 25 bp, Mus musculus
gcatctcctgacaagcctcaaaaat

SEQ ID NO: 542241 - DNA, 25 bp, Mus musculus
gcatctcctgactagcctcaaaaat

SEQ ID NO: 542242 - DNA, 25 bp, Mus musculus
gcatctcctgctatgttaataagtc

SEQ ID NO: 542243 - DNA, 25 bp, Mus musculus
gcatctcctgctttgttaataagtc

SEQ ID NO: 542244 - DNA, 25 bp, Mus musculus
gcatctcgaactccagaccatagaa

SEQ ID NO: 542245 - DNA, 25 bp, Mus musculus
gcatctcgaactgcagaccatagaa

SEQ ID NO: 542246 - DNA, 25 bp, Mus musculus
gcatctcgagcaagaaggcctcaaa

SEQ ID NO: 542247 - DNA, 25 bp, Mus musculus
gcatctcgagcatgaaggcctcaaa

SEQ ID NO: 542248 - DNA, 25 bp, Mus musculus
gcatctcggagtaccagatccttga

SEQ ID NO: 542249 - DNA, 25 bp, Mus musculus
gcatctcggagttccagatccttga

SEQ ID NO: 542250 - DNA, 25 bp, Mus musculus
gcatctcgtcagcaaacaggtgaac

SEQ ID NO: 542251 - DNA, 25 bp, Mus musculus
gcatctcgtcaggaaacaggtgaac

SEQ ID NO: 542252 - DNA, 25 bp, Mus musculus
gcatctctaaatctgcagtgaggat

SEQ ID NO: 542253 - DNA, 25 bp, Mus musculus
gcatctctaaatgtgcagtgaggat

SEQ ID NO: 542254 - DNA, 25 bp, Mus musculus
gcatctctaatactacagaaccatg

SEQ ID NO: 542255 - DNA, 25 bp, Mus musculus
gcatctctaatagtacagaaccatg

SEQ ID NO: 542256 - DNA, 25 bp, Mus musculus
gcatctctatgaagattagttacat

SEQ ID NO: 542257 - DNA, 25 bp, Mus musculus
gcatctctatgatgattagttacat

SEQ ID NO: 542258 - DNA, 25 bp, Mus musculus
gcatctctcaccaggcaaagctatg

SEQ ID NO: 542259 - DNA, 25 bp, Mus musculus
gcatctctcacctggcaaagctatg

SEQ ID NO: 542260 - DNA, 25 bp, Mus musculus
gcatctctcaggagcctggaacgtg

SEQ ID NO: 542261 - DNA, 25 bp, Mus musculus
gcatctctcaggtgcctggaacgtg

SEQ ID NO: 542262 - DNA, 25 bp, Mus musculus
gcatctctcagtccctaaagcgtag

SEQ ID NO: 542263 - DNA, 25 bp, Mus musculus
gcatctctcagtgcctaaagcgtag

SEQ ID NO: 542264 - DNA, 25 bp, Mus musculus
gcatctctccttacctagtgaaaat

SEQ ID NO: 542265 - DNA, 25 bp, Mus musculus
gcatctctcctttcctagtgaaaat

SEQ ID NO: 542266 - DNA, 25 bp, Mus musculus
gcatctctcgggacaactggcacaa

SEQ ID NO: 542267 - DNA, 25 bp, Mus musculus
gcatctctcgggtcaactggcacaa

SEQ ID NO: 542268 - DNA, 25 bp, Mus musculus
gcatctctgaacagcagcctgagga

SEQ ID NO: 542269 - DNA, 25 bp, Mus musculus
gcatctctgaactgcagcctgagga

SEQ ID NO: 542270 - DNA, 25 bp, Mus musculus
gcatctctgccaaacacagttgctt

SEQ ID NO: 542271 - DNA, 25 bp, Mus musculus
gcatctctgccatacacagttgctt

SEQ ID NO: 542272 - DNA, 25 bp, Mus musculus
gcatctctgggcattatgagcttaa

SEQ ID NO: 542273 - DNA, 25 bp, Mus musculus
gcatctctgggctttatgagcttaa

SEQ ID NO: 542274 - DNA, 25 bp, Mus musculus
gcatctctgtcaatattctatccac

SEQ ID NO: 542275 - DNA, 25 bp, Mus musculus
gcatctctgtcaattgaatctggga

SEQ ID NO: 542276 - DNA, 25 bp, Mus musculus
gcatctctgtcattattctatccac

SEQ ID NO: 542277 - DNA, 25 bp, Mus musculus
gcatctctgtcatttgaatctggga

SEQ ID NO: 542278 - DNA, 25 bp, Mus musculus
gcatctctgtctccttagcaaggag

SEQ ID NO: 542279 - DNA, 25 bp, Mus musculus
gcatctctgtctgcttagcaaggag

SEQ ID NO: 542280 - DNA, 25 bp, Mus musculus
gcatctctgtgcattattgtaactg

SEQ ID NO: 542281 - DNA, 25 bp, Mus musculus
gcatctctgtgctttattgtaactg

SEQ ID NO: 542282 - DNA, 25 bp, Mus musculus
gcatctctgtggctaatttccccaa

SEQ ID NO: 542283 - DNA, 25 bp, Mus musculus
gcatctctgtgggtaatttccccaa

SEQ ID NO: 542284 - DNA, 25 bp, Mus musculus
gcatctcttaaaacctacctgcaag

SEQ ID NO: 542285 - DNA, 25 bp, Mus musculus
gcatctcttaaatcctacctgcaag

SEQ ID NO: 542286 - DNA, 25 bp, Mus musculus
gcatctcttagactatcttcttttc

SEQ ID NO: 542287 - DNA, 25 bp, Mus musculus
gcatctcttagagtatcttcttttc

SEQ ID NO: 542288 - DNA, 25 bp, Mus musculus
gcatctcttgtacgttctagaacta

SEQ ID NO: 542289 - DNA, 25 bp, Mus musculus
gcatctcttgtaggttctagaacta

SEQ ID NO: 542290 - DNA, 25 bp, Mus musculus
gcatctcttgtgacccagcactgct

SEQ ID NO: 542291 - DNA, 25 bp, Mus musculus
gcatctcttgtgtcccagcactgct

SEQ ID NO: 542292 - DNA, 25 bp, Mus musculus
gcatctctttgcctgtttatacaag

SEQ ID NO: 542293 - DNA, 25 bp, Mus musculus
gcatctctttgcgtgtttatacaag

SEQ ID NO: 542294 - DNA, 25 bp, Mus musculus
gcatctcttttacgtttagctagtg

SEQ ID NO: 542295 - DNA, 25 bp, Mus musculus
gcatctcttttaggtttagctagtg

SEQ ID NO: 542296 - DNA, 25 bp, Mus musculus
gcatctgaacacaccgggtagtgta

SEQ ID NO: 542297 - DNA, 25 bp, Mus musculus
gcatctgaacactccgggtagtgta

SEQ ID NO: 542298 - DNA, 25 bp, Mus musculus
gcatctgaactcaatgtctgctcat

SEQ ID NO: 542299 - DNA, 25 bp, Mus musculus
gcatctgaactcagtgactgttaca

SEQ ID NO: 542300 - DNA, 25 bp, Mus musculus
gcatctgaactctatgtctgctcat

SEQ ID NO: 542301 - DNA, 25 bp, Mus musculus
gcatctgaactctgtgactgttaca

SEQ ID NO: 542302 - DNA, 25 bp, Mus musculus
gcatctgaagccatgaaagccacta

SEQ ID NO: 542303 - DNA, 25 bp, Mus musculus
gcatctgaagccttgaaagccacta

SEQ ID NO: 542304 - DNA, 25 bp, Mus musculus
gcatctgaatgaatctctcaactta

SEQ ID NO: 542305 - DNA, 25 bp, Mus musculus
gcatctgaatgattctctcaactta

SEQ ID NO: 542306 - DNA, 25 bp, Mus musculus
gcatctgacattatctctgtgtatt

SEQ ID NO: 542307 - DNA, 25 bp, Mus musculus
gcatctgacattcttctacgtgtat

SEQ ID NO: 542308 - DNA, 25 bp, Mus musculus
gcatctgacattgttctacgtgtat

SEQ ID NO: 542309 - DNA, 25 bp, Mus musculus
gcatctgacattttctctgtgtatt

SEQ ID NO: 542310 - DNA, 25 bp, Mus musculus
gcatctgacccaagttacagttcta

SEQ ID NO: 542311 - DNA, 25 bp, Mus musculus
gcatctgacccatgttacagttcta

SEQ ID NO: 542312 - DNA, 25 bp, Mus musculus
gcatctgaccttctctatactattt

SEQ ID NO: 542313 - DNA, 25 bp, Mus musculus
gcatctgaccttgtctatactattt

SEQ ID NO: 542314 - DNA, 25 bp, Mus musculus
gcatctgacgttaccagtgaaggga

SEQ ID NO: 542315 - DNA, 25 bp, Mus musculus
gcatctgacgtttccagtgaaggga

SEQ ID NO: 542316 - DNA, 25 bp, Mus musculus
gcatctgactggaattccaaggact

SEQ ID NO: 542317 - DNA, 25 bp, Mus musculus
gcatctgactggtattccaaggact

SEQ ID NO: 542318 - DNA, 25 bp, Mus musculus
gcatctgagatcatgttttcagcct

SEQ ID NO: 542319 - DNA, 25 bp, Mus musculus
gcatctgagatcttgttttcagcct

SEQ ID NO: 542320 - DNA, 25 bp, Mus musculus
gcatctgagcatcctgttttcacag

SEQ ID NO: 542321 - DNA, 25 bp, Mus musculus
gcatctgagcatgctgttttcacag

SEQ ID NO: 542322 - DNA, 25 bp, Mus musculus
gcatctgaggaacgcagccggacta

SEQ ID NO: 542323 - DNA, 25 bp, Mus musculus
gcatctgaggaaggcagccggacta

SEQ ID NO: 542324 - DNA, 25 bp, Mus musculus
gcatctgagtcaaagcatggcctgc

SEQ ID NO: 542325 - DNA, 25 bp, Mus musculus
gcatctgagtcatagcatggcctgc

SEQ ID NO: 542326 - DNA, 25 bp, Mus musculus
gcatctgataaaaaccaaacccatt

SEQ ID NO: 542327 - DNA, 25 bp, Mus musculus
gcatctgataaataccaaacccatt

SEQ ID NO: 542328 - DNA, 25 bp, Mus musculus
gcatctgatccacaggaagccaggt

SEQ ID NO: 542329 - DNA, 25 bp, Mus musculus
gcatctgatccagaggaagccaggt

SEQ ID NO: 542330 - DNA, 25 bp, Mus musculus
gcatctgatggcctttaaaccattt

SEQ ID NO: 542331 - DNA, 25 bp, Mus musculus
gcatctgatggcgtttaaaccattt

SEQ ID NO: 542332 - DNA, 25 bp, Mus musculus
gcatctgattaccttgaattggaca

SEQ ID NO: 542333 - DNA, 25 bp, Mus musculus
gcatctgattacgttgaattggaca

SEQ ID NO: 542334 - DNA, 25 bp, Mus musculus
gcatctgattctcccctaaagaact

SEQ ID NO: 542335 - DNA, 25 bp, Mus musculus
gcatctgattctgccctaaagaact

SEQ ID NO: 542336 - DNA, 25 bp, Mus musculus
gcatctgatttgattctgtgggaga

SEQ ID NO: 542337 - DNA, 25 bp, Mus musculus
gcatctgatttgtttctgtgggaga

SEQ ID NO: 542338 - DNA, 25 bp, Mus musculus
gcatctgcacacactccggatgtac

SEQ ID NO: 542339 - DNA, 25 bp, Mus musculus
gcatctgcacactctccggatgtac

SEQ ID NO: 542340 - DNA, 25 bp, Mus musculus
gcatctgcacagacatgagctctca

SEQ ID NO: 542341 - DNA, 25 bp, Mus musculus
gcatctgcacagtcatgagctctca

SEQ ID NO: 542342 - DNA, 25 bp, Mus musculus
gcatctgcacataccttgtactgat

SEQ ID NO: 542343 - DNA, 25 bp, Mus musculus
gcatctgcacattccttgtactgat

SEQ ID NO: 542344 - DNA, 25 bp, Mus musculus
gcatctgcacctcgagacaaggctt

SEQ ID NO: 542345 - DNA, 25 bp, Mus musculus
gcatctgcacctggagacaaggctt

SEQ ID NO: 542346 - DNA, 25 bp, Mus musculus
gcatctgcagtcatcagaggttcat

SEQ ID NO: 542347 - DNA, 25 bp, Mus musculus
gcatctgcagtcttcagaggttcat

SEQ ID NO: 542348 - DNA, 25 bp, Mus musculus
gcatctgcatggactccggaggctt

SEQ ID NO: 542349 - DNA, 25 bp, Mus musculus
gcatctgcatggtctccggaggctt

SEQ ID NO: 542350 - DNA, 25 bp, Mus musculus
gcatctgcattaattggtctttaaa

SEQ ID NO: 542351 - DNA, 25 bp, Mus musculus
gcatctgcattatttggtctttaaa

SEQ ID NO: 542352 - DNA, 25 bp, Mus musculus
gcatctgcctggcacaggtatgccg

SEQ ID NO: 542353 - DNA, 25 bp, Mus musculus
gcatctgcctgggacaggtatgccg

SEQ ID NO: 542354 - DNA, 25 bp, Mus musculus
gcatctgcctgtctctcataggaaa

SEQ ID NO: 542355 - DNA, 25 bp, Mus musculus
gcatctgcctgtgtctcataggaaa

SEQ ID NO: 542356 - DNA, 25 bp, Mus musculus
gcatctgcctttactgttgttgaca

SEQ ID NO: 542357 - DNA, 25 bp, Mus musculus
gcatctgccttttctgttgttgaca

SEQ ID NO: 542358 - DNA, 25 bp, Mus musculus
gcatctgcggcgagatgttcatcat

SEQ ID NO: 542359 - DNA, 25 bp, Mus musculus
gcatctgcggcgtgatgttcatcat

SEQ ID NO: 542360 - DNA, 25 bp, Mus musculus
gcatctgcgttcacaaaaagtccta

SEQ ID NO: 542361 - DNA, 25 bp, Mus musculus
gcatctgcgttctcaaaaagtccta

SEQ ID NO: 542362 - DNA, 25 bp, Mus musculus
gcatctgctaagctgacccttttaa

SEQ ID NO: 542363 - DNA, 25 bp, Mus musculus
gcatctgctaaggtgacccttttaa

SEQ ID NO: 542364 - DNA, 25 bp, Mus musculus
gcatctgctccaagttaagcatctt

SEQ ID NO: 542365 - DNA, 25 bp, Mus musculus
gcatctgctccatgttaagcatctt

SEQ ID NO: 542366 - DNA, 25 bp, Mus musculus
gcatctgctcctcaaattcgaaact

SEQ ID NO: 542367 - DNA, 25 bp, Mus musculus
gcatctgctcctgaaattcgaaact

SEQ ID NO: 542368 - DNA, 25 bp, Mus musculus
gcatctgctgatcattgcctgcctt

SEQ ID NO: 542369 - DNA, 25 bp, Mus musculus
gcatctgctgatgattgcctgcctt

SEQ ID NO: 542370 - DNA, 25 bp, Mus musculus
gcatctgcttaaagggtgctgccct

SEQ ID NO: 542371 - DNA, 25 bp, Mus musculus
gcatctgcttaatgggtgctgccct

SEQ ID NO: 542372 - DNA, 25 bp, Mus musculus
gcatctgcttccaccaaagggttgg

SEQ ID NO: 542373 - DNA, 25 bp, Mus musculus
gcatctgcttcctccaaagggttgg

SEQ ID NO: 542374 - DNA, 25 bp, Mus musculus
gcatctgcttttctcatgttagaaa

SEQ ID NO: 542375 - DNA, 25 bp, Mus musculus
gcatctgcttttcttgcatcttgtc

SEQ ID NO: 542376 - DNA, 25 bp, Mus musculus
gcatctgcttttgtcatgttagaaa

SEQ ID NO: 542377 - DNA, 25 bp, Mus musculus
gcatctgcttttgttgcatcttgtc

SEQ ID NO: 542378 - DNA, 25 bp, Mus musculus
gcatctggagatcaggcccgccctt

SEQ ID NO: 542379 - DNA, 25 bp, Mus musculus
gcatctggagatgaggcccgccctt

SEQ ID NO: 542380 - DNA, 25 bp, Mus musculus
gcatctggagccaatagcaaggtct

SEQ ID NO: 542381 - DNA, 25 bp, Mus musculus
gcatctggagcctatagcaaggtct

SEQ ID NO: 542382 - DNA, 25 bp, Mus musculus
gcatctggatatcgccctcttgttg

SEQ ID NO: 542383 - DNA, 25 bp, Mus musculus
gcatctggatatggccctcttgttg

SEQ ID NO: 542384 - DNA, 25 bp, Mus musculus
gcatctggatgtacaactgtcacgt

SEQ ID NO: 542385 - DNA, 25 bp, Mus musculus
gcatctggatgtctcagggtgctcc

SEQ ID NO: 542386 - DNA, 25 bp, Mus musculus
gcatctggatgtgtcagggtgctcc

SEQ ID NO: 542387 - DNA, 25 bp, Mus musculus
gcatctggatgttcaactgtcacgt

SEQ ID NO: 542388 - DNA, 25 bp, Mus musculus
gcatctggattgactgctcaagcca

SEQ ID NO: 542389 - DNA, 25 bp, Mus musculus
gcatctggattgtctgctcaagcca

SEQ ID NO: 542390 - DNA, 25 bp, Mus musculus
gcatctggcaacctcagggtcagaa

SEQ ID NO: 542391 - DNA, 25 bp, Mus musculus
gcatctggcaacgtcagggtcagaa

SEQ ID NO: 542392 - DNA, 25 bp, Mus musculus
gcatctggccagataactacagccc

SEQ ID NO: 542393 - DNA, 25 bp, Mus musculus
gcatctggccagttaactacagccc

SEQ ID NO: 542394 - DNA, 25 bp, Mus musculus
gcatctggcggcctgtggagctgag

SEQ ID NO: 542395 - DNA, 25 bp, Mus musculus
gcatctggcggcgtgtggagctgag

SEQ ID NO: 542396 - DNA, 25 bp, Mus musculus
gcatctggctctcaagttctggaag

SEQ ID NO: 542397 - DNA, 25 bp, Mus musculus
gcatctggctctgaagttctggaag

SEQ ID NO: 542398 - DNA, 25 bp, Mus musculus
gcatctgggaaactccgagactttt

SEQ ID NO: 542399 - DNA, 25 bp, Mus musculus
gcatctgggaaagtccgagactttt

SEQ ID NO: 542400 - DNA, 25 bp, Mus musculus
gcatctgggaagcactgactacttg

SEQ ID NO: 542401 - DNA, 25 bp, Mus musculus
gcatctgggaaggactgactacttg

SEQ ID NO: 542402 - DNA, 25 bp, Mus musculus
gcatctgggacgaattctgtcgaga

SEQ ID NO: 542403 - DNA, 25 bp, Mus musculus
gcatctgggacgtattctgtcgaga

SEQ ID NO: 542404 - DNA, 25 bp, Mus musculus
gcatctgggagactccacacatacc

SEQ ID NO: 542405 - DNA, 25 bp, Mus musculus
gcatctgggagagtccacacatacc

SEQ ID NO: 542406 - DNA, 25 bp, Mus musculus
gcatctgggcttaaaggacatctcc

SEQ ID NO: 542407 - DNA, 25 bp, Mus musculus
gcatctgggctttaaggacatctcc

SEQ ID NO: 542408 - DNA, 25 bp, Mus musculus
gcatctggtcagataagcggaagtt

SEQ ID NO: 542409 - DNA, 25 bp, Mus musculus
gcatctggtcagttaagcggaagtt

SEQ ID NO: 542410 - DNA, 25 bp, Mus musculus
gcatctggttcacttgtacaaccca

SEQ ID NO: 542411 - DNA, 25 bp, Mus musculus
gcatctggttcagttgtacaaccca

SEQ ID NO: 542412 - DNA, 25 bp, Mus musculus
gcatctggttctcaagctcggtgaa

SEQ ID NO: 542413 - DNA, 25 bp, Mus musculus
gcatctggttctgaagctcggtgaa

SEQ ID NO: 542414 - DNA, 25 bp, Mus musculus
gcatctgtaaacagatgacagacat

SEQ ID NO: 542415 - DNA, 25 bp, Mus musculus
gcatctgtaaactgatgacagacat

SEQ ID NO: 542416 - DNA, 25 bp, Mus musculus
gcatctgtacgaagggtctgcgtca

SEQ ID NO: 542417 - DNA, 25 bp, Mus musculus
gcatctgtacgatgggtctgcgtca

SEQ ID NO: 542418 - DNA, 25 bp, Mus musculus
gcatctgtactgagttgtaggactt

SEQ ID NO: 542419 - DNA, 25 bp, Mus musculus
gcatctgtactgtgttgtaggactt

SEQ ID NO: 542420 - DNA, 25 bp, Mus musculus
gcatctgtacttacctgatcagaca

SEQ ID NO: 542421 - DNA, 25 bp, Mus musculus
gcatctgtactttcctgatcagaca

SEQ ID NO: 542422 - DNA, 25 bp, Mus musculus
gcatctgtagacactctctaaagct

SEQ ID NO: 542423 - DNA, 25 bp, Mus musculus
gcatctgtagactctctctaaagct

SEQ ID NO: 542424 - DNA, 25 bp, Mus musculus
gcatctgtagccattacctgttgga

SEQ ID NO: 542425 - DNA, 25 bp, Mus musculus
gcatctgtagcctttacctgttgga

SEQ ID NO: 542426 - DNA, 25 bp, Mus musculus
gcatctgtagctctcacaggctgag

SEQ ID NO: 542427 - DNA, 25 bp, Mus musculus
gcatctgtagctgtcacaggctgag

SEQ ID NO: 542428 - DNA, 25 bp, Mus musculus
gcatctgtagttcatagctgagaaa

SEQ ID NO: 542429 - DNA, 25 bp, Mus musculus
gcatctgtagttgatagctgagaaa

SEQ ID NO: 542430 - DNA, 25 bp, Mus musculus
gcatctgtattgaaccagctttata

SEQ ID NO: 542431 - DNA, 25 bp, Mus musculus
gcatctgtattgtaccagctttata

SEQ ID NO: 542432 - DNA, 25 bp, Mus musculus
gcatctgtcactagttaggcatgat

SEQ ID NO: 542433 - DNA, 25 bp, Mus musculus
gcatctgtcacttgttaggcatgat

SEQ ID NO: 542434 - DNA, 25 bp, Mus musculus
gcatctgtcagtcgagatgtacata

SEQ ID NO: 542435 - DNA, 25 bp, Mus musculus
gcatctgtcagtggagatgtacata

SEQ ID NO: 542436 - DNA, 25 bp, Mus musculus
gcatctgtcatgctattctgggaga

SEQ ID NO: 542437 - DNA, 25 bp, Mus musculus
gcatctgtcatggtattctgggaga

SEQ ID NO: 542438 - DNA, 25 bp, Mus musculus
gcatctgtccagctaccagagagaa

SEQ ID NO: 542439 - DNA, 25 bp, Mus musculus
gcatctgtccaggtaccagagagaa

SEQ ID NO: 542440 - DNA, 25 bp, Mus musculus
gcatctgtcttcaccctatgaagat

SEQ ID NO: 542441 - DNA, 25 bp, Mus musculus
gcatctgtcttctccctatgaagat

SEQ ID NO: 542442 - DNA, 25 bp, Mus musculus
gcatctgtgactaatgattatctta

SEQ ID NO: 542443 - DNA, 25 bp, Mus musculus
gcatctgtgacttatgattatctta

SEQ ID NO: 542444 - DNA, 25 bp, Mus musculus
gcatctgtgagactgctgctgaact

SEQ ID NO: 542445 - DNA, 25 bp, Mus musculus
gcatctgtgagagtgctgctgaact

SEQ ID NO: 542446 - DNA, 25 bp, Mus musculus
gcatctgtgagcattatcaaactag

SEQ ID NO: 542447 - DNA, 25 bp, Mus musculus
gcatctgtgagctttatcaaactag

SEQ ID NO: 542448 - DNA, 25 bp, Mus musculus
gcatctgtgatgaggccttcgctgg

SEQ ID NO: 542449 - DNA, 25 bp, Mus musculus
gcatctgtgatgtggccttcgctgg

SEQ ID NO: 542450 - DNA, 25 bp, Mus musculus
gcatctgtgattctagtgttttctt

SEQ ID NO: 542451 - DNA, 25 bp, Mus musculus
gcatctgtgattgtagtgttttctt

SEQ ID NO: 542452 - DNA, 25 bp, Mus musculus
gcatctgtgcacagcatttctgcag

SEQ ID NO: 542453 - DNA, 25 bp, Mus musculus
gcatctgtgcactgcatttctgcag

SEQ ID NO: 542454 - DNA, 25 bp, Mus musculus
gcatctgtgcagaagactactgccg

SEQ ID NO: 542455 - DNA, 25 bp, Mus musculus
gcatctgtgcagactggctgggaac

SEQ ID NO: 542456 - DNA, 25 bp, Mus musculus
gcatctgtgcagtagactactgccg

SEQ ID NO: 542457 - DNA, 25 bp, Mus musculus
gcatctgtgcagtctggctgggaac

SEQ ID NO: 542458 - DNA, 25 bp, Mus musculus
gcatctgtggaaaagtccccaggag

SEQ ID NO: 542459 - DNA, 25 bp, Mus musculus
gcatctgtggaatagtccccaggag

SEQ ID NO: 542460 - DNA, 25 bp, Mus musculus
gcatctgtggcaatatcttagttta

SEQ ID NO: 542461 - DNA, 25 bp, Mus musculus
gcatctgtggcattatcttagttta

SEQ ID NO: 542462 - DNA, 25 bp, Mus musculus
gcatctgtggccaatctcaaaactg

SEQ ID NO: 542463 - DNA, 25 bp, Mus musculus
gcatctgtggcctatctcaaaactg

SEQ ID NO: 542464 - DNA, 25 bp, Mus musculus
gcatctgtggctcgctgacttataa

SEQ ID NO: 542465 - DNA, 25 bp, Mus musculus
gcatctgtggctggctgacttataa

SEQ ID NO: 542466 - DNA, 25 bp, Mus musculus
gcatctgtggtcatctgccaacgaa

SEQ ID NO: 542467 - DNA, 25 bp, Mus musculus
gcatctgtggtcttctgccaacgaa

SEQ ID NO: 542468 - DNA, 25 bp, Mus musculus
gcatctgtgtatatgtgaaccagaa

SEQ ID NO: 542469 - DNA, 25 bp, Mus musculus
gcatctgtgtatttgtgaaccagaa

SEQ ID NO: 542470 - DNA, 25 bp, Mus musculus
gcatctgtgtgcctatgtatatatt

SEQ ID NO: 542471 - DNA, 25 bp, Mus musculus
gcatctgtgtgcgtatgtatatatt

SEQ ID NO: 542472 - DNA, 25 bp, Mus musculus
gcatctgttaaacctaccaccacat

SEQ ID NO: 542473 - DNA, 25 bp, Mus musculus
gcatctgttaaagctaccaccacat

SEQ ID NO: 542474 - DNA, 25 bp, Mus musculus
gcatctgttcctccttatccgaaca

SEQ ID NO: 542475 - DNA, 25 bp, Mus musculus
gcatctgttcctgcttatccgaaca

SEQ ID NO: 542476 - DNA, 25 bp, Mus musculus
gcatctgttcttaccaggctgaggt

SEQ ID NO: 542477 - DNA, 25 bp, Mus musculus
gcatctgttctttccaggctgaggt

SEQ ID NO: 542478 - DNA, 25 bp, Mus musculus
gcatctgttgatcgcatgtgctccc

SEQ ID NO: 542479 - DNA, 25 bp, Mus musculus
gcatctgttgatggcatgtgctccc

SEQ ID NO: 542480 - DNA, 25 bp, Mus musculus
gcatctgtttacagtttgccttcac

SEQ ID NO: 542481 - DNA, 25 bp, Mus musculus
gcatctgtttactgtttgccttcac

SEQ ID NO: 542482 - DNA, 25 bp, Mus musculus
gcatctgtttcgaatatttgccatg

SEQ ID NO: 542483 - DNA, 25 bp, Mus musculus
gcatctgtttcgtatatttgccatg

SEQ ID NO: 542484 - DNA, 25 bp, Mus musculus
gcatcttaacgtagagccagtgtga

SEQ ID NO: 542485 - DNA, 25 bp, Mus musculus
gcatcttaacgttgagccagtgtga

SEQ ID NO: 542486 - DNA, 25 bp, Mus musculus
gcatcttaagctatcgagagggttt

SEQ ID NO: 542487 - DNA, 25 bp, Mus musculus
gcatcttaagctttcgagagggttt

SEQ ID NO: 542488 - DNA, 25 bp, Mus musculus
gcatcttaaggtagctgttgaagcc

SEQ ID NO: 542489 - DNA, 25 bp, Mus musculus
gcatcttaaggttgctgttgaagcc

SEQ ID NO: 542490 - DNA, 25 bp, Mus musculus
gcatcttacacgagaacttgctaaa

SEQ ID NO: 542491 - DNA, 25 bp, Mus musculus
gcatcttacacgtgaacttgctaaa

SEQ ID NO: 542492 - DNA, 25 bp, Mus musculus
gcatcttacaggaggtgcctaggga

SEQ ID NO: 542493 - DNA, 25 bp, Mus musculus
gcatcttacaggtggtgcctaggga

SEQ ID NO: 542494 - DNA, 25 bp, Mus musculus
gcatcttacattcctgccttaactc

SEQ ID NO: 542495 - DNA, 25 bp, Mus musculus
gcatcttacattgctgccttaactc

SEQ ID NO: 542496 - DNA, 25 bp, Mus musculus
gcatcttaccttattcaacaacctt

SEQ ID NO: 542497 - DNA, 25 bp, Mus musculus
gcatcttacctttttcaacaacctt

SEQ ID NO: 542498 - DNA, 25 bp, Mus musculus
gcatcttactgtatcttagactagt

SEQ ID NO: 542499 - DNA, 25 bp, Mus musculus
gcatcttactgtttcttagactagt

SEQ ID NO: 542500 - DNA, 25 bp, Mus musculus
gcatcttagatgatcactacctttg

SEQ ID NO: 542501 - DNA, 25 bp, Mus musculus
gcatcttagatgttcactacctttg

SEQ ID NO: 542502 - DNA, 25 bp, Mus musculus
gcatcttagcagatggtgacagttt

SEQ ID NO: 542503 - DNA, 25 bp, Mus musculus
gcatcttagcagttggtgacagttt

SEQ ID NO: 542504 - DNA, 25 bp, Mus musculus
gcatcttagcatcccaggaagctga

SEQ ID NO: 542505 - DNA, 25 bp, Mus musculus
gcatcttagcatgccaggaagctga

SEQ ID NO: 542506 - DNA, 25 bp, Mus musculus
gcatcttagccaacttaaccatcag

SEQ ID NO: 542507 - DNA, 25 bp, Mus musculus
gcatcttagccatcttaaccatcag

SEQ ID NO: 542508 - DNA, 25 bp, Mus musculus
gcatcttaggaactatctaccttga

SEQ ID NO: 542509 - DNA, 25 bp, Mus musculus
gcatcttaggaagtatctaccttga

SEQ ID NO: 542510 - DNA, 25 bp, Mus musculus
gcatcttatcagatcctgtttcaag

SEQ ID NO: 542511 - DNA, 25 bp, Mus musculus
gcatcttatcagttcctgtttcaag

SEQ ID NO: 542512 - DNA, 25 bp, Mus musculus
gcatcttatccaccgactaccgaag

SEQ ID NO: 542513 - DNA, 25 bp, Mus musculus
gcatcttatccagcgactaccgaag

SEQ ID NO: 542514 - DNA, 25 bp, Mus musculus
gcatcttatcttagctcaactgtta

SEQ ID NO: 542515 - DNA, 25 bp, Mus musculus
gcatcttatctttgctcaactgtta

SEQ ID NO: 542516 - DNA, 25 bp, Mus musculus
gcatcttattatccagtcagagcca

SEQ ID NO: 542517 - DNA, 25 bp, Mus musculus
gcatcttattatgcagtcagagcca

SEQ ID NO: 542518 - DNA, 25 bp, Mus musculus
gcatcttcaaggatggccatcttgg

SEQ ID NO: 542519 - DNA, 25 bp, Mus musculus
gcatcttcaaggttggccatcttgg

SEQ ID NO: 542520 - DNA, 25 bp, Mus musculus
gcatcttcacacctgtatgactgta

SEQ ID NO: 542521 - DNA, 25 bp, Mus musculus
gcatcttcacacgtgtatgactgta

SEQ ID NO: 542522 - DNA, 25 bp, Mus musculus
gcatcttcacatatgagcttagcac

SEQ ID NO: 542523 - DNA, 25 bp, Mus musculus
gcatcttcacatttgagcttagcac

SEQ ID NO: 542524 - DNA, 25 bp, Mus musculus
gcatcttcaccccaaggactatttt

SEQ ID NO: 542525 - DNA, 25 bp, Mus musculus
gcatcttcacccgaaggactatttt

SEQ ID NO: 542526 - DNA, 25 bp, Mus musculus
gcatcttcagatcacacccttgtaa

SEQ ID NO: 542527 - DNA, 25 bp, Mus musculus
gcatcttcagatgacacccttgtaa

SEQ ID NO: 542528 - DNA, 25 bp, Mus musculus
gcatcttcagcaaaaactttaggca

SEQ ID NO: 542529 - DNA, 25 bp, Mus musculus
gcatcttcagcataaactttaggca

SEQ ID NO: 542530 - DNA, 25 bp, Mus musculus
gcatcttcagggaggatacttgtaa

SEQ ID NO: 542531 - DNA, 25 bp, Mus musculus
gcatcttcagggtggatacttgtaa

SEQ ID NO: 542532 - DNA, 25 bp, Mus musculus
gcatcttcatgacagctgtgtgctg

SEQ ID NO: 542533 - DNA, 25 bp, Mus musculus
gcatcttcatgagagctgtgtgctg

SEQ ID NO: 542534 - DNA, 25 bp, Mus musculus
gcatcttcccggctcgagagatcat

SEQ ID NO: 542535 - DNA, 25 bp, Mus musculus
gcatcttcccgggtcgagagatcat

SEQ ID NO: 542536 - DNA, 25 bp, Mus musculus
gcatcttccgaacatgagcaccaaa

SEQ ID NO: 542537 - DNA, 25 bp, Mus musculus
gcatcttccgaagatgagcaccaaa

SEQ ID NO: 542538 - DNA, 25 bp, Mus musculus
gcatcttcctgcctcaaggtcaaag

SEQ ID NO: 542539 - DNA, 25 bp, Mus musculus
gcatcttcctgcgtcaaggtcaaag

SEQ ID NO: 542540 - DNA, 25 bp, Mus musculus
gcatcttcctggcttaaaggcagtt

SEQ ID NO: 542541 - DNA, 25 bp, Mus musculus
gcatcttcctgggttaaaggcagtt

SEQ ID NO: 542542 - DNA, 25 bp, Mus musculus
gcatcttcttatcactgaaccactg

SEQ ID NO: 542543 - DNA, 25 bp, Mus musculus
gcatcttcttatgactgaaccactg

SEQ ID NO: 542544 - DNA, 25 bp, Mus musculus
gcatcttcttgcatacggaatgtgt

SEQ ID NO: 542545 - DNA, 25 bp, Mus musculus
gcatcttcttgcttacggaatgtgt

SEQ ID NO: 542546 - DNA, 25 bp, Mus musculus
gcatcttgaaggctacctgagtcat

SEQ ID NO: 542547 - DNA, 25 bp, Mus musculus
gcatcttgaagggtacctgagtcat

SEQ ID NO: 542548 - DNA, 25 bp, Mus musculus
gcatcttgacctatgttgggccaaa

SEQ ID NO: 542549 - DNA, 25 bp, Mus musculus
gcatcttgacctttgttgggccaaa

SEQ ID NO: 542550 - DNA, 25 bp, Mus musculus
gcatcttgaggcatttggttctttc

SEQ ID NO: 542551 - DNA, 25 bp, Mus musculus
gcatcttgaggcttttggttctttc

SEQ ID NO: 542552 - DNA, 25 bp, Mus musculus
gcatcttgcacaaccatggtgagga

SEQ ID NO: 542553 - DNA, 25 bp, Mus musculus
gcatcttgcacatccatggtgagga

SEQ ID NO: 542554 - DNA, 25 bp, Mus musculus
gcatcttgcatgctttgactgcctg

SEQ ID NO: 542555 - DNA, 25 bp, Mus musculus
gcatcttgcatggtttgactgcctg

SEQ ID NO: 542556 - DNA, 25 bp, Mus musculus
gcatcttgctttcttctgtaagact

SEQ ID NO: 542557 - DNA, 25 bp, Mus musculus
gcatcttgctttgttctgtaagact

SEQ ID NO: 542558 - DNA, 25 bp, Mus musculus
gcatcttggatacaagtactttacc

SEQ ID NO: 542559 - DNA, 25 bp, Mus musculus
gcatcttggatacagaagcatccgg

SEQ ID NO: 542560 - DNA, 25 bp, Mus musculus
gcatcttggatagaagtactttacc

SEQ ID NO: 542561 - DNA, 25 bp, Mus musculus
gcatcttggatagagaagcatccgg

SEQ ID NO: 542562 - DNA, 25 bp, Mus musculus
gcatcttgggatagtaacttttaac

SEQ ID NO: 542563 - DNA, 25 bp, Mus musculus
gcatcttgggattgtaacttttaac

SEQ ID NO: 542564 - DNA, 25 bp, Mus musculus
gcatcttgggccaggtctatttaaa

SEQ ID NO: 542565 - DNA, 25 bp, Mus musculus
gcatcttgggcctggtctatttaaa

SEQ ID NO: 542566 - DNA, 25 bp, Mus musculus
gcatcttgtactctgttctctgata

SEQ ID NO: 542567 - DNA, 25 bp, Mus musculus
gcatcttgtactgtgttctctgata

SEQ ID NO: 542568 - DNA, 25 bp, Mus musculus
gcatcttgtaggatcaggactcccg

SEQ ID NO: 542569 - DNA, 25 bp, Mus musculus
gcatcttgtaggttcaggactcccg

SEQ ID NO: 542570 - DNA, 25 bp, Mus musculus
gcatcttgtcatatggtttgctctc

SEQ ID NO: 542571 - DNA, 25 bp, Mus musculus
gcatcttgtcatttggtttgctctc

SEQ ID NO: 542572 - DNA, 25 bp, Mus musculus
gcatcttgtgtcagtggtgtccttg

SEQ ID NO: 542573 - DNA, 25 bp, Mus musculus
gcatcttgtgtctgtggtgtccttg

SEQ ID NO: 542574 - DNA, 25 bp, Mus musculus
gcatcttgttaaactgttctaactc

SEQ ID NO: 542575 - DNA, 25 bp, Mus musculus
gcatcttgttaatctgttctaactc

SEQ ID NO: 542576 - DNA, 25 bp, Mus musculus
gcatcttgttcaaccctgtaagaca

SEQ ID NO: 542577 - DNA, 25 bp, Mus musculus
gcatcttgttcatccctgtaagaca

SEQ ID NO: 542578 - DNA, 25 bp, Mus musculus
gcatcttgttccctatcttttcaga

SEQ ID NO: 542579 - DNA, 25 bp, Mus musculus
gcatcttgttccgtatcttttcaga

SEQ ID NO: 542580 - DNA, 25 bp, Mus musculus
gcatcttgttgcaaagtctaggact

SEQ ID NO: 542581 - DNA, 25 bp, Mus musculus
gcatcttgttgctaagtctaggact

SEQ ID NO: 542582 - DNA, 25 bp, Mus musculus
gcatctttaacacactgtgcctcag

SEQ ID NO: 542583 - DNA, 25 bp, Mus musculus
gcatctttaacagactgtgcctcag

SEQ ID NO: 542584 - DNA, 25 bp, Mus musculus
gcatctttacacacttgcacaaaaa

SEQ ID NO: 542585 - DNA, 25 bp, Mus musculus
gcatctttacactcttgcacaaaaa

SEQ ID NO: 542586 - DNA, 25 bp, Mus musculus
gcatctttacatacaggtttctttg

SEQ ID NO: 542587 - DNA, 25 bp, Mus musculus
gcatctttacattcaggtttctttg

SEQ ID NO: 542588 - DNA, 25 bp, Mus musculus
gcatctttaggcctcttatctatta

SEQ ID NO: 542589 - DNA, 25 bp, Mus musculus
gcatctttaggcgtcttatctatta

SEQ ID NO: 542590 - DNA, 25 bp, Mus musculus
gcatctttagtgataacgtatctga

SEQ ID NO: 542591 - DNA, 25 bp, Mus musculus
gcatctttagtgttaacgtatctga

SEQ ID NO: 542592 - DNA, 25 bp, Mus musculus
gcatctttatctacccagtatatct

SEQ ID NO: 542593 - DNA, 25 bp, Mus musculus
gcatctttatcttcccagtatatct

SEQ ID NO: 542594 - DNA, 25 bp, Mus musculus
gcatctttattcacatctccatgct

SEQ ID NO: 542595 - DNA, 25 bp, Mus musculus
gcatctttattcagctatggctgag

SEQ ID NO: 542596 - DNA, 25 bp, Mus musculus
gcatctttattctcatctccatgct

SEQ ID NO: 542597 - DNA, 25 bp, Mus musculus
gcatctttattctgctatggctgag

SEQ ID NO: 542598 - DNA, 25 bp, Mus musculus
gcatctttctatcagctccagctag

SEQ ID NO: 542599 - DNA, 25 bp, Mus musculus
gcatctttctatgagctccagctag

SEQ ID NO: 542600 - DNA, 25 bp, Mus musculus
gcatctttctggatgatgctcaggt

SEQ ID NO: 542601 - DNA, 25 bp, Mus musculus
gcatctttctggttgatgctcaggt

SEQ ID NO: 542602 - DNA, 25 bp, Mus musculus
gcatctttgcagcatttgtcatctc

SEQ ID NO: 542603 - DNA, 25 bp, Mus musculus
gcatctttgcaggatttgtcatctc

SEQ ID NO: 542604 - DNA, 25 bp, Mus musculus
gcatctttggctcaagactgcgtct

SEQ ID NO: 542605 - DNA, 25 bp, Mus musculus
gcatctttggctgaagactgcgtct

SEQ ID NO: 542606 - DNA, 25 bp, Mus musculus
gcatctttgtgacgctctagttggt

SEQ ID NO: 542607 - DNA, 25 bp, Mus musculus
gcatctttgtgaggctctagttggt

SEQ ID NO: 542608 - DNA, 25 bp, Mus musculus
gcatcttttggtaagttcttaggca

SEQ ID NO: 542609 - DNA, 25 bp, Mus musculus
gcatcttttggttagttcttaggca

SEQ ID NO: 542610 - DNA, 25 bp, Mus musculus
gcatctttttacaggagtgtgacac

SEQ ID NO: 542611 - DNA, 25 bp, Mus musculus
gcatctttttactggagtgtgacac

SEQ ID NO: 542612 - DNA, 25 bp, Mus musculus
gcatgaaactcacctctaataagca

SEQ ID NO: 542613 - DNA, 25 bp, Mus musculus
gcatgaaactcagctctaataagca

SEQ ID NO: 542614 - DNA, 25 bp, Mus musculus
gcatgaaattctattctacccaaag

SEQ ID NO: 542615 - DNA, 25 bp, Mus musculus
gcatgaaattctctataccccacac

SEQ ID NO: 542616 - DNA, 25 bp, Mus musculus
gcatgaaattctgtataccccacac

SEQ ID NO: 542617 - DNA, 25 bp, Mus musculus
gcatgaaattcttttctacccaaag

SEQ ID NO: 542618 - DNA, 25 bp, Mus musculus
gcatgaacaagcagggcacgcgcct

SEQ ID NO: 542619 - DNA, 25 bp, Mus musculus
gcatgaacaagccagtcctgctgtt

SEQ ID NO: 542620 - DNA, 25 bp, Mus musculus
gcatgaacaagcgagtcctgctgtt

SEQ ID NO: 542621 - DNA, 25 bp, Mus musculus
gcatgaacaagctgggcacgcgcct

SEQ ID NO: 542622 - DNA, 25 bp, Mus musculus
gcatgaacacttacatacacgtata

SEQ ID NO: 542623 - DNA, 25 bp, Mus musculus
gcatgaacacttagttacctccttg

SEQ ID NO: 542624 - DNA, 25 bp, Mus musculus
gcatgaacactttcatacacgtata

SEQ ID NO: 542625 - DNA, 25 bp, Mus musculus
gcatgaacactttgttacctccttg

SEQ ID NO: 542626 - DNA, 25 bp, Mus musculus
gcatgaacattcatgaagagcgctt

SEQ ID NO: 542627 - DNA, 25 bp, Mus musculus
gcatgaacattcttgaagagcgctt

SEQ ID NO: 542628 - DNA, 25 bp, Mus musculus
gcatgaacccctccatccgggttaa

SEQ ID NO: 542629 - DNA, 25 bp, Mus musculus
gcatgaacccctgcatccgggttaa

SEQ ID NO: 542630 - DNA, 25 bp, Mus musculus
gcatgaacctgcactgagtcaatta

SEQ ID NO: 542631 - DNA, 25 bp, Mus musculus
gcatgaacctgctctgagtcaatta

SEQ ID NO: 542632 - DNA, 25 bp, Mus musculus
gcatgaacggtactgcgtgtgcacc

SEQ ID NO: 542633 - DNA, 25 bp, Mus musculus
gcatgaacggtagtgcgtgtgcacc

SEQ ID NO: 542634 - DNA, 25 bp, Mus musculus
gcatgaacggtgattgtataatgtt

SEQ ID NO: 542635 - DNA, 25 bp, Mus musculus
gcatgaacggtgtttgtataatgtt

SEQ ID NO: 542636 - DNA, 25 bp, Mus musculus
gcatgaacgtggagttggcctttct

SEQ ID NO: 542637 - DNA, 25 bp, Mus musculus
gcatgaacgtggtgttggcctttct

SEQ ID NO: 542638 - DNA, 25 bp, Mus musculus
gcatgaactctcactcctataagga

SEQ ID NO: 542639 - DNA, 25 bp, Mus musculus
gcatgaactctctctcctataagga

SEQ ID NO: 542640 - DNA, 25 bp, Mus musculus
gcatgaactttcatctgtgattctt

SEQ ID NO: 542641 - DNA, 25 bp, Mus musculus
gcatgaactttcttctgtgattctt

SEQ ID NO: 542642 - DNA, 25 bp, Mus musculus
gcatgaagatacattctgcaatgtt

SEQ ID NO: 542643 - DNA, 25 bp, Mus musculus
gcatgaagatactttctgcaatgtt

SEQ ID NO: 542644 - DNA, 25 bp, Mus musculus
gcatgaagcagacgaccagggtttt

SEQ ID NO: 542645 - DNA, 25 bp, Mus musculus
gcatgaagcagaggaccagggtttt

SEQ ID NO: 542646 - DNA, 25 bp, Mus musculus
gcatgaagccacagaaccaagcctg

SEQ ID NO: 542647 - DNA, 25 bp, Mus musculus
gcatgaagccactgaaccaagcctg

SEQ ID NO: 542648 - DNA, 25 bp, Mus musculus
gcatgaagccctcgttcagtctcca

SEQ ID NO: 542649 - DNA, 25 bp, Mus musculus
gcatgaagccctggttcagtctcca

SEQ ID NO: 542650 - DNA, 25 bp, Mus musculus
gcatgaagcctcattggtaaggaat

SEQ ID NO: 542651 - DNA, 25 bp, Mus musculus
gcatgaagcctctttggtaaggaat

SEQ ID NO: 542652 - DNA, 25 bp, Mus musculus
gcatgaagccttcatctcaagagaa

SEQ ID NO: 542653 - DNA, 25 bp, Mus musculus
gcatgaagccttgatctcaagagaa

SEQ ID NO: 542654 - DNA, 25 bp, Mus musculus
gcatgaagcttcactgacagggtta

SEQ ID NO: 542655 - DNA, 25 bp, Mus musculus
gcatgaagcttctctgacagggtta

SEQ ID NO: 542656 - DNA, 25 bp, Mus musculus
gcatgaaggcatagtacatgatgca

SEQ ID NO: 542657 - DNA, 25 bp, Mus musculus
gcatgaaggcattgtacatgatgca

SEQ ID NO: 542658 - DNA, 25 bp, Mus musculus
gcatgaaggtccctgtttgtatcaa

SEQ ID NO: 542659 - DNA, 25 bp, Mus musculus
gcatgaaggtccgtgtttgtatcaa

SEQ ID NO: 542660 - DNA, 25 bp, Mus musculus
gcatgaaggtctcagtttgctttga

SEQ ID NO: 542661 - DNA, 25 bp, Mus musculus
gcatgaaggtctgagtttgctttga

SEQ ID NO: 542662 - DNA, 25 bp, Mus musculus
gcatgaaggttaaactctcattgaa

SEQ ID NO: 542663 - DNA, 25 bp, Mus musculus
gcatgaaggttatactctcattgaa

SEQ ID NO: 542664 - DNA, 25 bp, Mus musculus
gcatgaaggttcctgatgatccgga

SEQ ID NO: 542665 - DNA, 25 bp, Mus musculus
gcatgaaggttcgtgatgatccgga

SEQ ID NO: 542666 - DNA, 25 bp, Mus musculus
gcatgaagtcgaacaggagctgact

SEQ ID NO: 542667 - DNA, 25 bp, Mus musculus
gcatgaagtcgatcaggagctgact

SEQ ID NO: 542668 - DNA, 25 bp, Mus musculus
gcatgaagtctcaccattagctgag

SEQ ID NO: 542669 - DNA, 25 bp, Mus musculus
gcatgaagtctctccattagctgag

SEQ ID NO: 542670 - DNA, 25 bp, Mus musculus
gcatgaataatcaggtacaccccgt

SEQ ID NO: 542671 - DNA, 25 bp, Mus musculus
gcatgaataatctggtacaccccgt

SEQ ID NO: 542672 - DNA, 25 bp, Mus musculus
gcatgaataggtccaaccagctgta

SEQ ID NO: 542673 - DNA, 25 bp, Mus musculus
gcatgaataggtgcaaccagctgta

SEQ ID NO: 542674 - DNA, 25 bp, Mus musculus
gcatgaatccagctcgatcttttgg

SEQ ID NO: 542675 - DNA, 25 bp, Mus musculus
gcatgaatccaggtcgatcttttgg

SEQ ID NO: 542676 - DNA, 25 bp, Mus musculus
gcatgaatcctgcaatccaagacca

SEQ ID NO: 542677 - DNA, 25 bp, Mus musculus
gcatgaatcctggaatccaagacca

SEQ ID NO: 542678 - DNA, 25 bp, Mus musculus
gcatgaatcgcgatattttgtactt

SEQ ID NO: 542679 - DNA, 25 bp, Mus musculus
gcatgaatcgcgttattttgtactt

SEQ ID NO: 542680 - DNA, 25 bp, Mus musculus
gcatgaatctgactgacgagagcct

SEQ ID NO: 542681 - DNA, 25 bp, Mus musculus
gcatgaatctgagtgacgagagcct

SEQ ID NO: 542682 - DNA, 25 bp, Mus musculus
gcatgaatgcacatctgtatatttt

SEQ ID NO: 542683 - DNA, 25 bp, Mus musculus
gcatgaatgcacttctgtatatttt

SEQ ID NO: 542684 - DNA, 25 bp, Mus musculus
gcatgaatgcgaacaccatcaccaa

SEQ ID NO: 542685 - DNA, 25 bp, Mus musculus
gcatgaatgcgatcaccatcaccaa

SEQ ID NO: 542686 - DNA, 25 bp, Mus musculus
gcatgaatgcttcgtatctacccat

SEQ ID NO: 542687 - DNA, 25 bp, Mus musculus
gcatgaatgcttggtatctacccat

SEQ ID NO: 542688 - DNA, 25 bp, Mus musculus
gcatgaatgggaaacatgtctgcat

SEQ ID NO: 542689 - DNA, 25 bp, Mus musculus
gcatgaatgggatacatgtctgcat

SEQ ID NO: 542690 - DNA, 25 bp, Mus musculus
gcatgaatgtgtctcgactcagtca

SEQ ID NO: 542691 - DNA, 25 bp, Mus musculus
gcatgaatgtgtgtcgactcagtca

SEQ ID NO: 542692 - DNA, 25 bp, Mus musculus
gcatgaattctcacttaaacctacc

SEQ ID NO: 542693 - DNA, 25 bp, Mus musculus
gcatgaattctctcttaaacctacc

SEQ ID NO: 542694 - DNA, 25 bp, Mus musculus
gcatgaattcttatttctcaatcac

SEQ ID NO: 542695 - DNA, 25 bp, Mus musculus
gcatgaattcttttttctcaatcac

SEQ ID NO: 542696 - DNA, 25 bp, Mus musculus
gcatgaattgatctgtgcagttccc

SEQ ID NO: 542697 - DNA, 25 bp, Mus musculus
gcatgaattgatgtgtgcagttccc

SEQ ID NO: 542698 - DNA, 25 bp, Mus musculus
gcatgaatttaaagggttgtgtctt

SEQ ID NO: 542699 - DNA, 25 bp, Mus musculus
gcatgaatttaatgggttgtgtctt

SEQ ID NO: 542700 - DNA, 25 bp, Mus musculus
gcatgaatttcaagggacagctgct

SEQ ID NO: 542701 - DNA, 25 bp, Mus musculus
gcatgaatttcatgggacagctgct

SEQ ID NO: 542702 - DNA, 25 bp, Mus musculus
gcatgacaagcacaagaaaggcgag

SEQ ID NO: 542703 - DNA, 25 bp, Mus musculus
gcatgacaagcagaagaaaggcgag

SEQ ID NO: 542704 - DNA, 25 bp, Mus musculus
gcatgacaaggacgcttctgacaga

SEQ ID NO: 542705 - DNA, 25 bp, Mus musculus
gcatgacaaggaggcttctgacaga

SEQ ID NO: 542706 - DNA, 25 bp, Mus musculus
gcatgacaatgccatctgtgcttcc

SEQ ID NO: 542707 - DNA, 25 bp, Mus musculus
gcatgacaatgcgatctgtgcttcc

SEQ ID NO: 542708 - DNA, 25 bp, Mus musculus
gcatgacacatacaatgctaccagt

SEQ ID NO: 542709 - DNA, 25 bp, Mus musculus
gcatgacacatagaatgctaccagt

SEQ ID NO: 542710 - DNA, 25 bp, Mus musculus
gcatgacacatgctttgtttgcgca

SEQ ID NO: 542711 - DNA, 25 bp, Mus musculus
gcatgacacatggtttgtttgcgca

SEQ ID NO: 542712 - DNA, 25 bp, Mus musculus
gcatgacaccccctttagatactgt

SEQ ID NO: 542713 - DNA, 25 bp, Mus musculus
gcatgacaccccgtttagatactgt

SEQ ID NO: 542714 - DNA, 25 bp, Mus musculus
gcatgacacggccagcaagttgctt

SEQ ID NO: 542715 - DNA, 25 bp, Mus musculus
gcatgacacggcgagcaagttgctt

SEQ ID NO: 542716 - DNA, 25 bp, Mus musculus
gcatgacacgtacacgttctgcctg

SEQ ID NO: 542717 - DNA, 25 bp, Mus musculus
gcatgacacgtagacgttctgcctg

SEQ ID NO: 542718 - DNA, 25 bp, Mus musculus
gcatgacagagccaccagccagaga

SEQ ID NO: 542719 - DNA, 25 bp, Mus musculus
gcatgacagagcgaccagccagaga

SEQ ID NO: 542720 - DNA, 25 bp, Mus musculus
gcatgacagctccagaggtggtact

SEQ ID NO: 542721 - DNA, 25 bp, Mus musculus
gcatgacagctcgagaggtggtact

SEQ ID NO: 542722 - DNA, 25 bp, Mus musculus
gcatgacatgaaattccggttacca

SEQ ID NO: 542723 - DNA, 25 bp, Mus musculus
gcatgacatgaatttccggttacca

SEQ ID NO: 542724 - DNA, 25 bp, Mus musculus
gcatgacatgacatctgctagcata

SEQ ID NO: 542725 - DNA, 25 bp, Mus musculus
gcatgacatgacttctgctagcata

SEQ ID NO: 542726 - DNA, 25 bp, Mus musculus
gcatgacatgcaaaactacttctta

SEQ ID NO: 542727 - DNA, 25 bp, Mus musculus
gcatgacatgcataactacttctta

SEQ ID NO: 542728 - DNA, 25 bp, Mus musculus
gcatgacatggcaaggctctcaaaa

SEQ ID NO: 542729 - DNA, 25 bp, Mus musculus
gcatgacatggctaggctctcaaaa

SEQ ID NO: 542730 - DNA, 25 bp, Mus musculus
gcatgacattttaccagctgtgcag

SEQ ID NO: 542731 - DNA, 25 bp, Mus musculus
gcatgacattttccacatgacacaa

SEQ ID NO: 542732 - DNA, 25 bp, Mus musculus
gcatgacattttgcacatgacacaa

SEQ ID NO: 542733 - DNA, 25 bp, Mus musculus
gcatgacatttttccagctgtgcag

SEQ ID NO: 542734 - DNA, 25 bp, Mus musculus
gcatgaccagacaagcaggagacat

SEQ ID NO: 542735 - DNA, 25 bp, Mus musculus
gcatgaccagactagcaggagacat

SEQ ID NO: 542736 - DNA, 25 bp, Mus musculus
gcatgaccagtcattttgctatcaa

SEQ ID NO: 542737 - DNA, 25 bp, Mus musculus
gcatgaccagtctttttgctatcaa

SEQ ID NO: 542738 - DNA, 25 bp, Mus musculus
gcatgacccaacaaagcctgtattt

SEQ ID NO: 542739 - DNA, 25 bp, Mus musculus
gcatgacccaactaagcctgtattt

SEQ ID NO: 542740 - DNA, 25 bp, Mus musculus
gcatgacccaggcttcttatgaaaa

SEQ ID NO: 542741 - DNA, 25 bp, Mus musculus
gcatgacccagggttcttatgaaaa

SEQ ID NO: 542742 - DNA, 25 bp, Mus musculus
gcatgacccggccagacagataaga

SEQ ID NO: 542743 - DNA, 25 bp, Mus musculus
gcatgacccggcgagacagataaga

SEQ ID NO: 542744 - DNA, 25 bp, Mus musculus
gcatgaccgaacactggaagaacca

SEQ ID NO: 542745 - DNA, 25 bp, Mus musculus
gcatgaccgaactctggaagaacca

SEQ ID NO: 542746 - DNA, 25 bp, Mus musculus
gcatgaccgtgaagaccggcccaga

SEQ ID NO: 542747 - DNA, 25 bp, Mus musculus
gcatgaccgtgatgaccggcccaga

SEQ ID NO: 542748 - DNA, 25 bp, Mus musculus
gcatgaccgtggatgtttcgggaaa

SEQ ID NO: 542749 - DNA, 25 bp, Mus musculus
gcatgaccgtggttgtttcgggaaa

SEQ ID NO: 542750 - DNA, 25 bp, Mus musculus
gcatgacctacactcttcagtcctg

SEQ ID NO: 542751 - DNA, 25 bp, Mus musculus
gcatgacctacagtcttcagtcctg

SEQ ID NO: 542752 - DNA, 25 bp, Mus musculus
gcatgacctgtgctgagctctacga

SEQ ID NO: 542753 - DNA, 25 bp, Mus musculus
gcatgacctgtggtgagctctacga

SEQ ID NO: 542754 - DNA, 25 bp, Mus musculus
gcatgacctttactgtgttagcttt

SEQ ID NO: 542755 - DNA, 25 bp, Mus musculus
gcatgacctttagtgtgttagcttt

SEQ ID NO: 542756 - DNA, 25 bp, Mus musculus
gcatgacgacaaaccttactgagta

SEQ ID NO: 542757 - DNA, 25 bp, Mus musculus
gcatgacgacaatccttactgagta

SEQ ID NO: 542758 - DNA, 25 bp, Mus musculus
gcatgactactcactttctgtgctg

SEQ ID NO: 542759 - DNA, 25 bp, Mus musculus
gcatgactactctctttctgtgctg

SEQ ID NO: 542760 - DNA, 25 bp, Mus musculus
gcatgactagtcagcgctctacttg

SEQ ID NO: 542761 - DNA, 25 bp, Mus musculus
gcatgactagtctgcgctctacttg

SEQ ID NO: 542762 - DNA, 25 bp, Mus musculus
gcatgactccatattacctttcttg

SEQ ID NO: 542763 - DNA, 25 bp, Mus musculus
gcatgactccattttacctttcttg

SEQ ID NO: 542764 - DNA, 25 bp, Mus musculus
gcatgactcctgcacagctcaagag

SEQ ID NO: 542765 - DNA, 25 bp, Mus musculus
gcatgactcctggacagctcaagag

SEQ ID NO: 542766 - DNA, 25 bp, Mus musculus
gcatgactctgtatttattgtaagg

SEQ ID NO: 542767 - DNA, 25 bp, Mus musculus
gcatgactctgtttttattgtaagg

SEQ ID NO: 542768 - DNA, 25 bp, Mus musculus
gcatgactgaaacgccaacacttgg

SEQ ID NO: 542769 - DNA, 25 bp, Mus musculus
gcatgactgaaaggccaacacttgg

SEQ ID NO: 542770 - DNA, 25 bp, Mus musculus
gcatgactgctaaggttttgccatc

SEQ ID NO: 542771 - DNA, 25 bp, Mus musculus
gcatgactgctatggttttgccatc

SEQ ID NO: 542772 - DNA, 25 bp, Mus musculus
gcatgactgtacatcttaccttatt

SEQ ID NO: 542773 - DNA, 25 bp, Mus musculus
gcatgactgtacttcttaccttatt

SEQ ID NO: 542774 - DNA, 25 bp, Mus musculus
gcatgactgtggaagtgagaaccca

SEQ ID NO: 542775 - DNA, 25 bp, Mus musculus
gcatgactgtggtagtgagaaccca

SEQ ID NO: 542776 - DNA, 25 bp, Mus musculus
gcatgacttaacctgtgtgaacgca

SEQ ID NO: 542777 - DNA, 25 bp, Mus musculus
gcatgacttaacgtgtgtgaacgca

SEQ ID NO: 542778 - DNA, 25 bp, Mus musculus
gcatgacttcacatcacagatcttc

SEQ ID NO: 542779 - DNA, 25 bp, Mus musculus
gcatgacttcacttcacagatcttc

SEQ ID NO: 542780 - DNA, 25 bp, Mus musculus
gcatgacttcatactttggcaacac

SEQ ID NO: 542781 - DNA, 25 bp, Mus musculus
gcatgacttcattctttggcaacac

SEQ ID NO: 542782 - DNA, 25 bp, Mus musculus
gcatgacttcggactggatggctac

SEQ ID NO: 542783 - DNA, 25 bp, Mus musculus
gcatgacttcggtctggatggctac

SEQ ID NO: 542784 - DNA, 25 bp, Mus musculus
gcatgagaactcagggccccatcaa

SEQ ID NO: 542785 - DNA, 25 bp, Mus musculus
gcatgagaactctgggccccatcaa

SEQ ID NO: 542786 - DNA, 25 bp, Mus musculus
gcatgagaagcactcccagagatat

SEQ ID NO: 542787 - DNA, 25 bp, Mus musculus
gcatgagaagcagtcccagagatat

SEQ ID NO: 542788 - DNA, 25 bp, Mus musculus
gcatgagaaggtctggaagttccat

SEQ ID NO: 542789 - DNA, 25 bp, Mus musculus
gcatgagaaggtgtggaagttccat

SEQ ID NO: 542790 - DNA, 25 bp, Mus musculus
gcatgagaatgtatggcagagacaa

SEQ ID NO: 542791 - DNA, 25 bp, Mus musculus
gcatgagaatgtttggcagagacaa

SEQ ID NO: 542792 - DNA, 25 bp, Mus musculus
gcatgagacctgcagtctacaacta

SEQ ID NO: 542793 - DNA, 25 bp, Mus musculus
gcatgagacctggagtctacaacta

SEQ ID NO: 542794 - DNA, 25 bp, Mus musculus
gcatgagactttcctaaactatcta

SEQ ID NO: 542795 - DNA, 25 bp, Mus musculus
gcatgagactttgctaaactatcta

SEQ ID NO: 542796 - DNA, 25 bp, Mus musculus
gcatgagatattccctttccttagc

SEQ ID NO: 542797 - DNA, 25 bp, Mus musculus
gcatgagatattgcctttccttagc

SEQ ID NO: 542798 - DNA, 25 bp, Mus musculus
gcatgagattacaggcctgccagac

SEQ ID NO: 542799 - DNA, 25 bp, Mus musculus
gcatgagattactggcctgccagac

SEQ ID NO: 542800 - DNA, 25 bp, Mus musculus
gcatgagcacagacccagaagttat

SEQ ID NO: 542801 - DNA, 25 bp, Mus musculus
gcatgagcacagacccctaagatct

SEQ ID NO: 542802 - DNA, 25 bp, Mus musculus
gcatgagcacagtcccagaagttat

SEQ ID NO: 542803 - DNA, 25 bp, Mus musculus
gcatgagcacagtcccctaagatct

SEQ ID NO: 542804 - DNA, 25 bp, Mus musculus
gcatgagccactcttggctttgcta

SEQ ID NO: 542805 - DNA, 25 bp, Mus musculus
gcatgagccactgttggctttgcta

SEQ ID NO: 542806 - DNA, 25 bp, Mus musculus
gcatgagccagtcagcaagccagta

SEQ ID NO: 542807 - DNA, 25 bp, Mus musculus
gcatgagccagtgagcaagccagta

SEQ ID NO: 542808 - DNA, 25 bp, Mus musculus
gcatgagccctaagtggaccttgtg

SEQ ID NO: 542809 - DNA, 25 bp, Mus musculus
gcatgagccctaatctgccacagag

SEQ ID NO: 542810 - DNA, 25 bp, Mus musculus
gcatgagccctatgtggaccttgtg

SEQ ID NO: 542811 - DNA, 25 bp, Mus musculus
gcatgagccctattctgccacagag

SEQ ID NO: 542812 - DNA, 25 bp, Mus musculus
gcatgagccgacatcagcaatgaat

SEQ ID NO: 542813 - DNA, 25 bp, Mus musculus
gcatgagccgacttcagcaatgaat

SEQ ID NO: 542814 - DNA, 25 bp, Mus musculus
gcatgagctccaaggttcagacgac

SEQ ID NO: 542815 - DNA, 25 bp, Mus musculus
gcatgagctccatggttcagacgac

SEQ ID NO: 542816 - DNA, 25 bp, Mus musculus
gcatgagctcccagccctacatgaa

SEQ ID NO: 542817 - DNA, 25 bp, Mus musculus
gcatgagctccctgccctacatgaa

SEQ ID NO: 542818 - DNA, 25 bp, Mus musculus
gcatgagctcttctattctacttac

SEQ ID NO: 542819 - DNA, 25 bp, Mus musculus
gcatgagctcttgtattctacttac

SEQ ID NO: 542820 - DNA, 25 bp, Mus musculus
gcatgagctgcacgttctcacagca

SEQ ID NO: 542821 - DNA, 25 bp, Mus musculus
gcatgagctgcaggttctcacagca

SEQ ID NO: 542822 - DNA, 25 bp, Mus musculus
gcatgagctgccacttgaggttttg

SEQ ID NO: 542823 - DNA, 25 bp, Mus musculus
gcatgagctgcctcttgaggttttg

SEQ ID NO: 542824 - DNA, 25 bp, Mus musculus
gcatgagctgtaatcctgctgaaga

SEQ ID NO: 542825 - DNA, 25 bp, Mus musculus
gcatgagctgtattcctgctgaaga

SEQ ID NO: 542826 - DNA, 25 bp, Mus musculus
gcatgagctttaataccctcatcct

SEQ ID NO: 542827 - DNA, 25 bp, Mus musculus
gcatgagctttattaccctcatcct

SEQ ID NO: 542828 - DNA, 25 bp, Mus musculus
gcatgaggaaatccctggatgtgtt

SEQ ID NO: 542829 - DNA, 25 bp, Mus musculus
gcatgaggaaatgcctggatgtgtt

SEQ ID NO: 542830 - DNA, 25 bp, Mus musculus
gcatgaggacggacagctacaacag

SEQ ID NO: 542831 - DNA, 25 bp, Mus musculus
gcatgaggacggtcagctacaacag

SEQ ID NO: 542832 - DNA, 25 bp, Mus musculus
gcatgaggacgtcatccagattgtg

SEQ ID NO: 542833 - DNA, 25 bp, Mus musculus
gcatgaggacgtgatccagattgtg

SEQ ID NO: 542834 - DNA, 25 bp, Mus musculus
gcatgaggagatcccactgctgccc

SEQ ID NO: 542835 - DNA, 25 bp, Mus musculus
gcatgaggagatgccactgctgccc

SEQ ID NO: 542836 - DNA, 25 bp, Mus musculus
gcatgaggcatgctctgcttacttt

SEQ ID NO: 542837 - DNA, 25 bp, Mus musculus
gcatgaggcatggtctgcttacttt

SEQ ID NO: 542838 - DNA, 25 bp, Mus musculus
gcatgaggccttaataacattttca

SEQ ID NO: 542839 - DNA, 25 bp, Mus musculus
gcatgaggcctttataacattttca

SEQ ID NO: 542840 - DNA, 25 bp, Mus musculus
gcatgaggcggaacacctagacaat

SEQ ID NO: 542841 - DNA, 25 bp, Mus musculus
gcatgaggcggatcacctagacaat

SEQ ID NO: 542842 - DNA, 25 bp, Mus musculus
gcatgaggctctatttgccacatct

SEQ ID NO: 542843 - DNA, 25 bp, Mus musculus
gcatgaggctctttttgccacatct

SEQ ID NO: 542844 - DNA, 25 bp, Mus musculus
gcatgagggcacagggatttaagat

SEQ ID NO: 542845 - DNA, 25 bp, Mus musculus
gcatgagggcactgggatttaagat

SEQ ID NO: 542846 - DNA, 25 bp, Mus musculus
gcatgaggtcaaccctattcggaag

SEQ ID NO: 542847 - DNA, 25 bp, Mus musculus
gcatgaggtcaagcctattcggaag

SEQ ID NO: 542848 - DNA, 25 bp, Mus musculus
gcatgaggttcaccaatgagttcca

SEQ ID NO: 542849 - DNA, 25 bp, Mus musculus
gcatgaggttcagcaatgagttcca

SEQ ID NO: 542850 - DNA, 25 bp, Mus musculus
gcatgagtaattacaccaagcaaca

SEQ ID NO: 542851 - DNA, 25 bp, Mus musculus
gcatgagtaatttcaccaagcaaca

SEQ ID NO: 542852 - DNA, 25 bp, Mus musculus
gcatgagtacgtcagtcacaagttt

SEQ ID NO: 542853 - DNA, 25 bp, Mus musculus
gcatgagtacgtgagtcacaagttt

SEQ ID NO: 542854 - DNA, 25 bp, Mus musculus
gcatgagtataccagccttctttta

SEQ ID NO: 542855 - DNA, 25 bp, Mus musculus
gcatgagtatacgagccttctttta

SEQ ID NO: 542856 - DNA, 25 bp, Mus musculus
gcatgagtatgtaggcaggctgact

SEQ ID NO: 542857 - DNA, 25 bp, Mus musculus
gcatgagtatgttggcaggctgact

SEQ ID NO: 542858 - DNA, 25 bp, Mus musculus
gcatgagtcccactttggccattgt

SEQ ID NO: 542859 - DNA, 25 bp, Mus musculus
gcatgagtcccagtttggccattgt

SEQ ID NO: 542860 - DNA, 25 bp, Mus musculus
gcatgagtcgccacagttccaagga

SEQ ID NO: 542861 - DNA, 25 bp, Mus musculus
gcatgagtcgcctcagttccaagga

SEQ ID NO: 542862 - DNA, 25 bp, Mus musculus
gcatgagtgagtccacccacatcaa

SEQ ID NO: 542863 - DNA, 25 bp, Mus musculus
gcatgagtgagtgcacccacatcaa

SEQ ID NO: 542864 - DNA, 25 bp, Mus musculus
gcatgagtggatcaccacagcagca

SEQ ID NO: 542865 - DNA, 25 bp, Mus musculus
gcatgagtggatgaccacagcagca

SEQ ID NO: 542866 - DNA, 25 bp, Mus musculus
gcatgagtgtgcaataactaccttg

SEQ ID NO: 542867 - DNA, 25 bp, Mus musculus
gcatgagtgtgctataactaccttg

SEQ ID NO: 542868 - DNA, 25 bp, Mus musculus
gcatgagtgttgctagatagctcta

SEQ ID NO: 542869 - DNA, 25 bp, Mus musculus
gcatgagtgttggtagatagctcta

SEQ ID NO: 542870 - DNA, 25 bp, Mus musculus
gcatgagttccaatcagtgttcact

SEQ ID NO: 542871 - DNA, 25 bp, Mus musculus
gcatgagttccattcagtgttcact

SEQ ID NO: 542872 - DNA, 25 bp, Mus musculus
gcatgagttgctattgtacccttaa

SEQ ID NO: 542873 - DNA, 25 bp, Mus musculus
gcatgagttgcttttgtacccttaa

SEQ ID NO: 542874 - DNA, 25 bp, Mus musculus
gcatgagttggtcatttttcttcta

SEQ ID NO: 542875 - DNA, 25 bp, Mus musculus
gcatgagttggtgatttttcttcta

SEQ ID NO: 542876 - DNA, 25 bp, Mus musculus
gcatgagttgtgattctggactgtt

SEQ ID NO: 542877 - DNA, 25 bp, Mus musculus
gcatgagttgtgtttctggactgtt

SEQ ID NO: 542878 - DNA, 25 bp, Mus musculus
gcatgagtttccatagttcttttaa

SEQ ID NO: 542879 - DNA, 25 bp, Mus musculus
gcatgagtttccttagttcttttaa

SEQ ID NO: 542880 - DNA, 25 bp, Mus musculus
gcatgataacagacttcttccctga

SEQ ID NO: 542881 - DNA, 25 bp, Mus musculus
gcatgataacagtcttcttccctga

SEQ ID NO: 542882 - DNA, 25 bp, Mus musculus
gcatgataagctagttttcttggtt

SEQ ID NO: 542883 - DNA, 25 bp, Mus musculus
gcatgataagcttgttttcttggtt

SEQ ID NO: 542884 - DNA, 25 bp, Mus musculus
gcatgataatgcagttctccatctt

SEQ ID NO: 542885 - DNA, 25 bp, Mus musculus
gcatgataatgctgttctccatctt

SEQ ID NO: 542886 - DNA, 25 bp, Mus musculus
gcatgatacactatgattagcgttt

SEQ ID NO: 542887 - DNA, 25 bp, Mus musculus
gcatgatacactttgattagcgttt

SEQ ID NO: 542888 - DNA, 25 bp, Mus musculus
gcatgatatagcactgaaaattgaa

SEQ ID NO: 542889 - DNA, 25 bp, Mus musculus
gcatgatatagctctgaaaattgaa

SEQ ID NO: 542890 - DNA, 25 bp, Mus musculus
gcatgatatcatcacctcgtgtttt

SEQ ID NO: 542891 - DNA, 25 bp, Mus musculus
gcatgatatcatgacctcgtgtttt

SEQ ID NO: 542892 - DNA, 25 bp, Mus musculus
gcatgatatgtaatgcgctcagatg

SEQ ID NO: 542893 - DNA, 25 bp, Mus musculus
gcatgatatgtattgcgctcagatg

SEQ ID NO: 542894 - DNA, 25 bp, Mus musculus
gcatgatattctctgctggccataa

SEQ ID NO: 542895 - DNA, 25 bp, Mus musculus
gcatgatattctgtgctggccataa

SEQ ID NO: 542896 - DNA, 25 bp, Mus musculus
gcatgatatttcctcatatgtgcca

SEQ ID NO: 542897 - DNA, 25 bp, Mus musculus
gcatgatatttcgtcatatgtgcca

SEQ ID NO: 542898 - DNA, 25 bp, Mus musculus
gcatgatcatctagctgcttgacag

SEQ ID NO: 542899 - DNA, 25 bp, Mus musculus
gcatgatcatcttgctgcttgacag

SEQ ID NO: 542900 - DNA, 25 bp, Mus musculus
gcatgatcattaacacagctgactt

SEQ ID NO: 542901 - DNA, 25 bp, Mus musculus
gcatgatcattacctttgttgtcct

SEQ ID NO: 542902 - DNA, 25 bp, Mus musculus
gcatgatcattagctttgttgtcct

SEQ ID NO: 542903 - DNA, 25 bp, Mus musculus
gcatgatcattatcacagctgactt

SEQ ID NO: 542904 - DNA, 25 bp, Mus musculus
gcatgatcgaatccgcacgcacaca

SEQ ID NO: 542905 - DNA, 25 bp, Mus musculus
gcatgatcgaatgcgcacgcacaca

SEQ ID NO: 542906 - DNA, 25 bp, Mus musculus
gcatgatcttatactttccaggtaa

SEQ ID NO: 542907 - DNA, 25 bp, Mus musculus
gcatgatcttattctttccaggtaa

SEQ ID NO: 542908 - DNA, 25 bp, Mus musculus
gcatgatgaacaccttgtcccactc

SEQ ID NO: 542909 - DNA, 25 bp, Mus musculus
gcatgatgaacagcttgtcccactc

SEQ ID NO: 542910 - DNA, 25 bp, Mus musculus
gcatgatgacttcgattcaggtttt

SEQ ID NO: 542911 - DNA, 25 bp, Mus musculus
gcatgatgacttggattcaggtttt

SEQ ID NO: 542912 - DNA, 25 bp, Mus musculus
gcatgatgcaaaagattttctaact

SEQ ID NO: 542913 - DNA, 25 bp, Mus musculus
gcatgatgcaaatgattttctaact

SEQ ID NO: 542914 - DNA, 25 bp, Mus musculus
gcatgatgcagccttttgaacttct

SEQ ID NO: 542915 - DNA, 25 bp, Mus musculus
gcatgatgcagcgttttgaacttct

SEQ ID NO: 542916 - DNA, 25 bp, Mus musculus
gcatgatgctggctgttctgtgtac

SEQ ID NO: 542917 - DNA, 25 bp, Mus musculus
gcatgatgctgggtgttctgtgtac

SEQ ID NO: 542918 - DNA, 25 bp, Mus musculus
gcatgatggattctttgctagccac

SEQ ID NO: 542919 - DNA, 25 bp, Mus musculus
gcatgatggattgtttgctagccac

SEQ ID NO: 542920 - DNA, 25 bp, Mus musculus
gcatgatgttataggcagtctttgt

SEQ ID NO: 542921 - DNA, 25 bp, Mus musculus
gcatgatgttattggcagtctttgt

SEQ ID NO: 542922 - DNA, 25 bp, Mus musculus
gcatgatgttttacgaaagtgtttt

SEQ ID NO: 542923 - DNA, 25 bp, Mus musculus
gcatgatgtttttcgaaagtgtttt

SEQ ID NO: 542924 - DNA, 25 bp, Mus musculus
gcatgattaaacaaggcctgggcat

SEQ ID NO: 542925 - DNA, 25 bp, Mus musculus
gcatgattaaactaggcctgggcat

SEQ ID NO: 542926 - DNA, 25 bp, Mus musculus
gcatgattcctccaaattgtactct

SEQ ID NO: 542927 - DNA, 25 bp, Mus musculus
gcatgattcctcgaaattgtactct

SEQ ID NO: 542928 - DNA, 25 bp, Mus musculus
gcatgattgcagaatgagcttcata

SEQ ID NO: 542929 - DNA, 25 bp, Mus musculus
gcatgattgcagtatgagcttcata

SEQ ID NO: 542930 - DNA, 25 bp, Mus musculus
gcatgattggttcatttctctcgac

SEQ ID NO: 542931 - DNA, 25 bp, Mus musculus
gcatgattggttgatttctctcgac

SEQ ID NO: 542932 - DNA, 25 bp, Mus musculus
gcatgatttataactttccagacaa

SEQ ID NO: 542933 - DNA, 25 bp, Mus musculus
gcatgatttatatctttccagacaa

SEQ ID NO: 542934 - DNA, 25 bp, Mus musculus
gcatgatttctgcattcagtgctat

SEQ ID NO: 542935 - DNA, 25 bp, Mus musculus
gcatgatttctggattcagtgctat

SEQ ID NO: 542936 - DNA, 25 bp, Mus musculus
gcatgatttgggaaattgatcacta

SEQ ID NO: 542937 - DNA, 25 bp, Mus musculus
gcatgatttgggtaattgatcacta

SEQ ID NO: 542938 - DNA, 25 bp, Mus musculus
gcatgattttacacttctgttgaac

SEQ ID NO: 542939 - DNA, 25 bp, Mus musculus
gcatgattttactcttctgttgaac

SEQ ID NO: 542940 - DNA, 25 bp, Mus musculus
gcatgattttccatgggatgcaaat

SEQ ID NO: 542941 - DNA, 25 bp, Mus musculus
gcatgattttccttgggatgcaaat

SEQ ID NO: 542942 - DNA, 25 bp, Mus musculus
gcatgcaaatatcttggtacgttat

SEQ ID NO: 542943 - DNA, 25 bp, Mus musculus
gcatgcaaatatgttggtacgttat

SEQ ID NO: 542944 - DNA, 25 bp, Mus musculus
gcatgcaacaggatcaccttacttt

SEQ ID NO: 542945 - DNA, 25 bp, Mus musculus
gcatgcaacaggttcaccttacttt

SEQ ID NO: 542946 - DNA, 25 bp, Mus musculus
gcatgcaactttagctcagagcgta

SEQ ID NO: 542947 - DNA, 25 bp, Mus musculus
gcatgcaacttttgctcagagcgta

SEQ ID NO: 542948 - DNA, 25 bp, Mus musculus
gcatgcaagggccatctttctccca

SEQ ID NO: 542949 - DNA, 25 bp, Mus musculus
gcatgcaagggcgatctttctccca

SEQ ID NO: 542950 - DNA, 25 bp, Mus musculus
gcatgcaagtggaccacagttctat

SEQ ID NO: 542951 - DNA, 25 bp, Mus musculus
gcatgcaagtggtccacagttctat

SEQ ID NO: 542952 - DNA, 25 bp, Mus musculus
gcatgcaatgccctacaggccatta

SEQ ID NO: 542953 - DNA, 25 bp, Mus musculus
gcatgcaatgccgtacaggccatta

SEQ ID NO: 542954 - DNA, 25 bp, Mus musculus
gcatgcacaacaacctgggttccat

SEQ ID NO: 542955 - DNA, 25 bp, Mus musculus
gcatgcacaacatcctgggttccat

SEQ ID NO: 542956 - DNA, 25 bp, Mus musculus
gcatgcacagctcacgtcttatatt

SEQ ID NO: 542957 - DNA, 25 bp, Mus musculus
gcatgcacagctcagaggatcctgc

SEQ ID NO: 542958 - DNA, 25 bp, Mus musculus
gcatgcacagctgacgtcttatatt

SEQ ID NO: 542959 - DNA, 25 bp, Mus musculus
gcatgcacagctgagaggatcctgc

SEQ ID NO: 542960 - DNA, 25 bp, Mus musculus
gcatgcacatccacggagctttaaa

SEQ ID NO: 542961 - DNA, 25 bp, Mus musculus
gcatgcacatcctcggagctttaaa

SEQ ID NO: 542962 - DNA, 25 bp, Mus musculus
gcatgcacattgagagtatcctgga

SEQ ID NO: 542963 - DNA, 25 bp, Mus musculus
gcatgcacattgtgagtatcctgga

SEQ ID NO: 542964 - DNA, 25 bp, Mus musculus
gcatgcacatttcgcagcacttgtc

SEQ ID NO: 542965 - DNA, 25 bp, Mus musculus
gcatgcacatttggcagcacttgtc

SEQ ID NO: 542966 - DNA, 25 bp, Mus musculus
gcatgcaccaacatacccattttga

SEQ ID NO: 542967 - DNA, 25 bp, Mus musculus
gcatgcaccaacttacccattttga

SEQ ID NO: 542968 - DNA, 25 bp, Mus musculus
gcatgcaccatcatgttctgcttgt

SEQ ID NO: 542969 - DNA, 25 bp, Mus musculus
gcatgcaccatcttgttctgcttgt

SEQ ID NO: 542970 - DNA, 25 bp, Mus musculus
gcatgcacggagatctcagaatcct

SEQ ID NO: 542971 - DNA, 25 bp, Mus musculus
gcatgcacggagttctcagaatcct

SEQ ID NO: 542972 - DNA, 25 bp, Mus musculus
gcatgcacttatatcttgggaggta

SEQ ID NO: 542973 - DNA, 25 bp, Mus musculus
gcatgcacttatttcttgggaggta

SEQ ID NO: 542974 - DNA, 25 bp, Mus musculus
gcatgcacttgcctttaaactatat

SEQ ID NO: 542975 - DNA, 25 bp, Mus musculus
gcatgcacttgcgtttaaactatat

SEQ ID NO: 542976 - DNA, 25 bp, Mus musculus
gcatgcagaagcagagcacacccca

SEQ ID NO: 542977 - DNA, 25 bp, Mus musculus
gcatgcagaagctgagcacacccca

SEQ ID NO: 542978 - DNA, 25 bp, Mus musculus
gcatgcagaggcacccttttgtctc

SEQ ID NO: 542979 - DNA, 25 bp, Mus musculus
gcatgcagaggctcccttttgtctc

SEQ ID NO: 542980 - DNA, 25 bp, Mus musculus
gcatgcagccgcctatgtcacggtg

SEQ ID NO: 542981 - DNA, 25 bp, Mus musculus
gcatgcagccgcgtatgtcacggtg

SEQ ID NO: 542982 - DNA, 25 bp, Mus musculus
gcatgcagcctaccactaagcagtg

SEQ ID NO: 542983 - DNA, 25 bp, Mus musculus
gcatgcagcctagcactaagcagtg

SEQ ID NO: 542984 - DNA, 25 bp, Mus musculus
gcatgcagcgcaactggtgggatat

SEQ ID NO: 542985 - DNA, 25 bp, Mus musculus
gcatgcagcgcatctggtgggatat

SEQ ID NO: 542986 - DNA, 25 bp, Mus musculus
gcatgcagcttgatgattgagcaca

SEQ ID NO: 542987 - DNA, 25 bp, Mus musculus
gcatgcagcttgttgattgagcaca

SEQ ID NO: 542988 - DNA, 25 bp, Mus musculus
gcatgcaggcagacagatattgttg

SEQ ID NO: 542989 - DNA, 25 bp, Mus musculus
gcatgcaggcagtcagatattgttg

SEQ ID NO: 542990 - DNA, 25 bp, Mus musculus
gcatgcaggctaaataactcgagat

SEQ ID NO: 542991 - DNA, 25 bp, Mus musculus
gcatgcaggctatataactcgagat

SEQ ID NO: 542992 - DNA, 25 bp, Mus musculus
gcatgcagggaaactaccgagtgtt

SEQ ID NO: 542993 - DNA, 25 bp, Mus musculus
gcatgcagggaatctaccgagtgtt

SEQ ID NO: 542994 - DNA, 25 bp, Mus musculus
gcatgcaggttgatcactacacaag

SEQ ID NO: 542995 - DNA, 25 bp, Mus musculus
gcatgcaggttgttcactacacaag

SEQ ID NO: 542996 - DNA, 25 bp, Mus musculus
gcatgcaggtttaaattctcttgtt

SEQ ID NO: 542997 - DNA, 25 bp, Mus musculus
gcatgcaggttttaattctcttgtt

SEQ ID NO: 542998 - DNA, 25 bp, Mus musculus
gcatgcagtaccagtagaggtcaca

SEQ ID NO: 542999 - DNA, 25 bp, Mus musculus
gcatgcagtacctgtagaggtcaca

SEQ ID NO: 543000 - DNA, 25 bp, Mus musculus
gcatgcagtcagcagttgcagcatt

SEQ ID NO: 543001 - DNA, 25 bp, Mus musculus
gcatgcagtcaggagttgcagcatt

SEQ ID NO: 543002 - DNA, 25 bp, Mus musculus
gcatgcagtgacattttcagggcta

SEQ ID NO: 543003 - DNA, 25 bp, Mus musculus
gcatgcagtgactttttcagggcta

SEQ ID NO: 543004 - DNA, 25 bp, Mus musculus
gcatgcagtttgcttagccagtgta

SEQ ID NO: 543005 - DNA, 25 bp, Mus musculus
gcatgcagtttggttagccagtgta

SEQ ID NO: 543006 - DNA, 25 bp, Mus musculus
gcatgcataatcctgctcttggtaa

SEQ ID NO: 543007 - DNA, 25 bp, Mus musculus
gcatgcataatcgtgctcttggtaa

SEQ ID NO: 543008 - DNA, 25 bp, Mus musculus
gcatgcatacctcatgagtgattgt

SEQ ID NO: 543009 - DNA, 25 bp, Mus musculus
gcatgcatacctgatgagtgattgt

SEQ ID NO: 543010 - DNA, 25 bp, Mus musculus
gcatgcatagatcacataagttctt

SEQ ID NO: 543011 - DNA, 25 bp, Mus musculus
gcatgcatagatgacataagttctt

SEQ ID NO: 543012 - DNA, 25 bp, Mus musculus
gcatgcatatccagcctataacatt

SEQ ID NO: 543013 - DNA, 25 bp, Mus musculus
gcatgcatatcctgcctataacatt

SEQ ID NO: 543014 - DNA, 25 bp, Mus musculus
gcatgcatatgcagaggccaactat

SEQ ID NO: 543015 - DNA, 25 bp, Mus musculus
gcatgcatatgctgaggccaactat

SEQ ID NO: 543016 - DNA, 25 bp, Mus musculus
gcatgcatccagactgctagcctgt

SEQ ID NO: 543017 - DNA, 25 bp, Mus musculus
gcatgcatccagtctgctagcctgt

SEQ ID NO: 543018 - DNA, 25 bp, Mus musculus
gcatgcatccatacttggcctgtta

SEQ ID NO: 543019 - DNA, 25 bp, Mus musculus
gcatgcatccattcttggcctgtta

SEQ ID NO: 543020 - DNA, 25 bp, Mus musculus
gcatgcatctagaatgaaaccctgt

SEQ ID NO: 543021 - DNA, 25 bp, Mus musculus
gcatgcatctagtatgaaaccctgt

SEQ ID NO: 543022 - DNA, 25 bp, Mus musculus
gcatgcatctggagccatgtctgtg

SEQ ID NO: 543023 - DNA, 25 bp, Mus musculus
gcatgcatctggtgccatgtctgtg

SEQ ID NO: 543024 - DNA, 25 bp, Mus musculus
gcatgcatcttacccttgaatttga

SEQ ID NO: 543025 - DNA, 25 bp, Mus musculus
gcatgcatcttagccttgaatttga

SEQ ID NO: 543026 - DNA, 25 bp, Mus musculus
gcatgcatgaatacctgagttccat

SEQ ID NO: 543027 - DNA, 25 bp, Mus musculus
gcatgcatgaattcctgagttccat

SEQ ID NO: 543028 - DNA, 25 bp, Mus musculus
gcatgcatgagtccgcacacaagtt

SEQ ID NO: 543029 - DNA, 25 bp, Mus musculus
gcatgcatgagtgcgcacacaagtt

SEQ ID NO: 543030 - DNA, 25 bp, Mus musculus
gcatgcatgatcagacagctatcca

SEQ ID NO: 543031 - DNA, 25 bp, Mus musculus
gcatgcatgatctgacagctatcca

SEQ ID NO: 543032 - DNA, 25 bp, Mus musculus
gcatgcatgcaacagcactctttaa

SEQ ID NO: 543033 - DNA, 25 bp, Mus musculus
gcatgcatgcaagagcactctttaa

SEQ ID NO: 543034 - DNA, 25 bp, Mus musculus
gcatgcatgcacactagagatgaca

SEQ ID NO: 543035 - DNA, 25 bp, Mus musculus
gcatgcatgcactctagagatgaca

SEQ ID NO: 543036 - DNA, 25 bp, Mus musculus
gcatgcatgcagaaggcgctcagcc

SEQ ID NO: 543037 - DNA, 25 bp, Mus musculus
gcatgcatgcagtaggcgctcagcc

SEQ ID NO: 543038 - DNA, 25 bp, Mus musculus
gcatgcatgcttaatacaatccata

SEQ ID NO: 543039 - DNA, 25 bp, Mus musculus
gcatgcatgctttatacaatccata

SEQ ID NO: 543040 - DNA, 25 bp, Mus musculus
gcatgcatggcaaaagacagctttt

SEQ ID NO: 543041 - DNA, 25 bp, Mus musculus
gcatgcatggcataagacagctttt

SEQ ID NO: 543042 - DNA, 25 bp, Mus musculus
gcatgcatgggaaatttgtttgttt

SEQ ID NO: 543043 - DNA, 25 bp, Mus musculus
gcatgcatgggatatttgtttgttt

SEQ ID NO: 543044 - DNA, 25 bp, Mus musculus
gcatgcatgggcatagatcacttca

SEQ ID NO: 543045 - DNA, 25 bp, Mus musculus
gcatgcatgggcttagatcacttca

SEQ ID NO: 543046 - DNA, 25 bp, Mus musculus
gcatgcatggtgattaactcctaca

SEQ ID NO: 543047 - DNA, 25 bp, Mus musculus
gcatgcatggtgtttaactcctaca

SEQ ID NO: 543048 - DNA, 25 bp, Mus musculus
gcatgcattctcaaatactgctgtt

SEQ ID NO: 543049 - DNA, 25 bp, Mus musculus
gcatgcattctctaatactgctgtt

SEQ ID NO: 543050 - DNA, 25 bp, Mus musculus
gcatgcattcttactatcctagcct

SEQ ID NO: 543051 - DNA, 25 bp, Mus musculus
gcatgcattctttctatcctagcct

SEQ ID NO: 543052 - DNA, 25 bp, Mus musculus
gcatgcatttgcactggtggctcca

SEQ ID NO: 543053 - DNA, 25 bp, Mus musculus
gcatgcatttgctctggtggctcca

SEQ ID NO: 543054 - DNA, 25 bp, Mus musculus
gcatgcatttggaagcctttccaat

SEQ ID NO: 543055 - DNA, 25 bp, Mus musculus
gcatgcatttggtagcctttccaat

SEQ ID NO: 543056 - DNA, 25 bp, Mus musculus
gcatgccaaaacctgtgtgctccct

SEQ ID NO: 543057 - DNA, 25 bp, Mus musculus
gcatgccaaaacgtgtgtgctccct

SEQ ID NO: 543058 - DNA, 25 bp, Mus musculus
gcatgccaactactccaaaattctg

SEQ ID NO: 543059 - DNA, 25 bp, Mus musculus
gcatgccaactagtccaaaattctg

SEQ ID NO: 543060 - DNA, 25 bp, Mus musculus
gcatgccaatgacccaagtcctgga

SEQ ID NO: 543061 - DNA, 25 bp, Mus musculus
gcatgccaatgagccaagtcctgga

SEQ ID NO: 543062 - DNA, 25 bp, Mus musculus
gcatgccaccataacaatggactaa

SEQ ID NO: 543063 - DNA, 25 bp, Mus musculus
gcatgccaccattacaatggactaa

SEQ ID NO: 543064 - DNA, 25 bp, Mus musculus
gcatgccacttcctgtttgtatgac

SEQ ID NO: 543065 - DNA, 25 bp, Mus musculus
gcatgccacttcgtgtttgtatgac

SEQ ID NO: 543066 - DNA, 25 bp, Mus musculus
gcatgccagagtctgcagaggtcac

SEQ ID NO: 543067 - DNA, 25 bp, Mus musculus
gcatgccagagtgtgcagaggtcac

SEQ ID NO: 543068 - DNA, 25 bp, Mus musculus
gcatgccagcgacccaatacaggag

SEQ ID NO: 543069 - DNA, 25 bp, Mus musculus
gcatgccagcgagccaatacaggag

SEQ ID NO: 543070 - DNA, 25 bp, Mus musculus
gcatgccatctaatacatctctgta

SEQ ID NO: 543071 - DNA, 25 bp, Mus musculus
gcatgccatctattacatctctgta

SEQ ID NO: 543072 - DNA, 25 bp, Mus musculus
gcatgccatggcacacacggaaaat

SEQ ID NO: 543073 - DNA, 25 bp, Mus musculus
gcatgccatggctcacacggaaaat

SEQ ID NO: 543074 - DNA, 25 bp, Mus musculus
gcatgcccagcacatacagatgtta

SEQ ID NO: 543075 - DNA, 25 bp, Mus musculus
gcatgcccagcagatacagatgtta

SEQ ID NO: 543076 - DNA, 25 bp, Mus musculus
gcatgcccaggtacctcagtttttt

SEQ ID NO: 543077 - DNA, 25 bp, Mus musculus
gcatgcccaggttcctcagtttttt

SEQ ID NO: 543078 - DNA, 25 bp, Mus musculus
gcatgcccagtgaactatgtcatac

SEQ ID NO: 543079 - DNA, 25 bp, Mus musculus
gcatgcccagtgtactatgtcatac

SEQ ID NO: 543080 - DNA, 25 bp, Mus musculus
gcatgcccatgtaaagtactactag

SEQ ID NO: 543081 - DNA, 25 bp, Mus musculus
gcatgcccatgttaagtactactag

SEQ ID NO: 543082 - DNA, 25 bp, Mus musculus
gcatgccccatgcttgttcgagaaa

SEQ ID NO: 543083 - DNA, 25 bp, Mus musculus
gcatgccccatggttgttcgagaaa

SEQ ID NO: 543084 - DNA, 25 bp, Mus musculus
gcatgccctgaaaccgacatacaga

SEQ ID NO: 543085 - DNA, 25 bp, Mus musculus
gcatgccctgaatccgacatacaga

SEQ ID NO: 543086 - DNA, 25 bp, Mus musculus
gcatgcccttagagcatggtgtttt

SEQ ID NO: 543087 - DNA, 25 bp, Mus musculus
gcatgcccttagtgcatggtgtttt

SEQ ID NO: 543088 - DNA, 25 bp, Mus musculus
gcatgccggcaacagactggaaccc

SEQ ID NO: 543089 - DNA, 25 bp, Mus musculus
gcatgccggcaacgaagacctgctt

SEQ ID NO: 543090 - DNA, 25 bp, Mus musculus
gcatgccggcaagagactggaaccc

SEQ ID NO: 543091 - DNA, 25 bp, Mus musculus
gcatgccggcaaggaagacctgctt

SEQ ID NO: 543092 - DNA, 25 bp, Mus musculus
gcatgccggcatagcgatgtcagta

SEQ ID NO: 543093 - DNA, 25 bp, Mus musculus
gcatgccggcattgcgatgtcagta

SEQ ID NO: 543094 - DNA, 25 bp, Mus musculus
gcatgccgtgaacaaccgagttcca

SEQ ID NO: 543095 - DNA, 25 bp, Mus musculus
gcatgccgtgaagaaccgagttcca

SEQ ID NO: 543096 - DNA, 25 bp, Mus musculus
gcatgccgtttcagtagtgttgtta

SEQ ID NO: 543097 - DNA, 25 bp, Mus musculus
gcatgccgtttctgtagtgttgtta

SEQ ID NO: 543098 - DNA, 25 bp, Mus musculus
gcatgcctaactatacccctttatt

SEQ ID NO: 543099 - DNA, 25 bp, Mus musculus
gcatgcctaactttacccctttatt

SEQ ID NO: 543100 - DNA, 25 bp, Mus musculus
gcatgcctcgctatggatgagggat

SEQ ID NO: 543101 - DNA, 25 bp, Mus musculus
gcatgcctcgctttggatgagggat

SEQ ID NO: 543102 - DNA, 25 bp, Mus musculus
gcatgcctctttcttctgaggaaga

SEQ ID NO: 543103 - DNA, 25 bp, Mus musculus
gcatgcctctttgttctgaggaaga

SEQ ID NO: 543104 - DNA, 25 bp, Mus musculus
gcatgcctgcacaattggattaaat

SEQ ID NO: 543105 - DNA, 25 bp, Mus musculus
gcatgcctgcactattggattaaat

SEQ ID NO: 543106 - DNA, 25 bp, Mus musculus
gcatgcctgcctacatttctggttc

SEQ ID NO: 543107 - DNA, 25 bp, Mus musculus
gcatgcctgccttcatttctggttc

SEQ ID NO: 543108 - DNA, 25 bp, Mus musculus
gcatgcctgctgacatgatggagtc

SEQ ID NO: 543109 - DNA, 25 bp, Mus musculus
gcatgcctgctgaggagttcagaga

SEQ ID NO: 543110 - DNA, 25 bp, Mus musculus
gcatgcctgctgtcatgatggagtc

SEQ ID NO: 543111 - DNA, 25 bp, Mus musculus
gcatgcctgctgtggagttcagaga

SEQ ID NO: 543112 - DNA, 25 bp, Mus musculus
gcatgcctggtaactgacgtggttg

SEQ ID NO: 543113 - DNA, 25 bp, Mus musculus
gcatgcctggtatctgacgtggttg

SEQ ID NO: 543114 - DNA, 25 bp, Mus musculus
gcatgcctgtaacagatcaccttcg

SEQ ID NO: 543115 - DNA, 25 bp, Mus musculus
gcatgcctgtaagagatcaccttcg

SEQ ID NO: 543116 - DNA, 25 bp, Mus musculus
gcatgccttcagatgtaagtggcca

SEQ ID NO: 543117 - DNA, 25 bp, Mus musculus
gcatgccttcagttgtaagtggcca

SEQ ID NO: 543118 - DNA, 25 bp, Mus musculus
gcatgccttgcgctacttgtatgtg

SEQ ID NO: 543119 - DNA, 25 bp, Mus musculus
gcatgccttgcggtacttgtatgtg

SEQ ID NO: 543120 - DNA, 25 bp, Mus musculus
gcatgccttgtgctttactgaacaa

SEQ ID NO: 543121 - DNA, 25 bp, Mus musculus
gcatgccttgtggtttactgaacaa

SEQ ID NO: 543122 - DNA, 25 bp, Mus musculus
gcatgcctttgcagtgatagactgt

SEQ ID NO: 543123 - DNA, 25 bp, Mus musculus
gcatgcctttgctgtgatagactgt

SEQ ID NO: 543124 - DNA, 25 bp, Mus musculus
gcatgcgaagagacacagccctgga

SEQ ID NO: 543125 - DNA, 25 bp, Mus musculus
gcatgcgaagagtcacagccctgga

SEQ ID NO: 543126 - DNA, 25 bp, Mus musculus
gcatgcgaaggtctaaaacctccct

SEQ ID NO: 543127 - DNA, 25 bp, Mus musculus
gcatgcgaaggtgtaaaacctccct

SEQ ID NO: 543128 - DNA, 25 bp, Mus musculus
gcatgcgattttactgttccaagaa

SEQ ID NO: 543129 - DNA, 25 bp, Mus musculus
gcatgcgatttttctgttccaagaa

SEQ ID NO: 543130 - DNA, 25 bp, Mus musculus
gcatgcgcctgaagcctccatgtga

SEQ ID NO: 543131 - DNA, 25 bp, Mus musculus
gcatgcgcctgatgcctccatgtga

SEQ ID NO: 543132 - DNA, 25 bp, Mus musculus
gcatgcgcgctgagagcattgttaa

SEQ ID NO: 543133 - DNA, 25 bp, Mus musculus
gcatgcgcgctgtgagcattgttaa

SEQ ID NO: 543134 - DNA, 25 bp, Mus musculus
gcatgcgctgtaatcttcacagcaa

SEQ ID NO: 543135 - DNA, 25 bp, Mus musculus
gcatgcgctgtattcttcacagcaa

SEQ ID NO: 543136 - DNA, 25 bp, Mus musculus
gcatgcgcttctcgtgctgtgaaac

SEQ ID NO: 543137 - DNA, 25 bp, Mus musculus
gcatgcgcttctggtgctgtgaaac

SEQ ID NO: 543138 - DNA, 25 bp, Mus musculus
gcatgcggatgaaacacgcacacac

SEQ ID NO: 543139 - DNA, 25 bp, Mus musculus
gcatgcggatgatacacgcacacac

SEQ ID NO: 543140 - DNA, 25 bp, Mus musculus
gcatgcggctggaagaaggcaacct

SEQ ID NO: 543141 - DNA, 25 bp, Mus musculus
gcatgcggctggtagaaggcaacct

SEQ ID NO: 543142 - DNA, 25 bp, Mus musculus
gcatgcggtggcaggctgaaacatt

SEQ ID NO: 543143 - DNA, 25 bp, Mus musculus
gcatgcggtggctggctgaaacatt

SEQ ID NO: 543144 - DNA, 25 bp, Mus musculus
gcatgcggttgtacgcttcaagaat

SEQ ID NO: 543145 - DNA, 25 bp, Mus musculus
gcatgcggttgttcgcttcaagaat

SEQ ID NO: 543146 - DNA, 25 bp, Mus musculus
gcatgcgtaaagaccttttaaggaa

SEQ ID NO: 543147 - DNA, 25 bp, Mus musculus
gcatgcgtaaagtccttttaaggaa

SEQ ID NO: 543148 - DNA, 25 bp, Mus musculus
gcatgcgtacatctcaggtgttgtt

SEQ ID NO: 543149 - DNA, 25 bp, Mus musculus
gcatgcgtacatgtcaggtgttgtt

SEQ ID NO: 543150 - DNA, 25 bp, Mus musculus
gcatgcgtagtcagattacattata

SEQ ID NO: 543151 - DNA, 25 bp, Mus musculus
gcatgcgtagtctgattacattata

SEQ ID NO: 543152 - DNA, 25 bp, Mus musculus
gcatgcgtggaactcacaggtcaat

SEQ ID NO: 543153 - DNA, 25 bp, Mus musculus
gcatgcgtggaagtcacaggtcaat

SEQ ID NO: 543154 - DNA, 25 bp, Mus musculus
gcatgctacattagagtccggactc

SEQ ID NO: 543155 - DNA, 25 bp, Mus musculus
gcatgctacatttgagtccggactc

SEQ ID NO: 543156 - DNA, 25 bp, Mus musculus
gcatgctactggaaacacctcgagg

SEQ ID NO: 543157 - DNA, 25 bp, Mus musculus
gcatgctactggtaacacctcgagg

SEQ ID NO: 543158 - DNA, 25 bp, Mus musculus
gcatgctactttctctggtccaaat

SEQ ID NO: 543159 - DNA, 25 bp, Mus musculus
gcatgctactttgtctggtccaaat

SEQ ID NO: 543160 - DNA, 25 bp, Mus musculus
gcatgctagaacagtacttactgag

SEQ ID NO: 543161 - DNA, 25 bp, Mus musculus
gcatgctagaactgtacttactgag

SEQ ID NO: 543162 - DNA, 25 bp, Mus musculus
gcatgctagagccaccttttaagcc

SEQ ID NO: 543163 - DNA, 25 bp, Mus musculus
gcatgctagagcgaccttttaagcc

SEQ ID NO: 543164 - DNA, 25 bp, Mus musculus
gcatgctagatgaatctcacagcta

SEQ ID NO: 543165 - DNA, 25 bp, Mus musculus
gcatgctagatgtatctcacagcta

SEQ ID NO: 543166 - DNA, 25 bp, Mus musculus
gcatgctagattctgaacagttcca

SEQ ID NO: 543167 - DNA, 25 bp, Mus musculus
gcatgctagattgtgaacagttcca

SEQ ID NO: 543168 - DNA, 25 bp, Mus musculus
gcatgctaggaaagttatctgtgtc

SEQ ID NO: 543169 - DNA, 25 bp, Mus musculus
gcatgctaggaatgttatctgtgtc

SEQ ID NO: 543170 - DNA, 25 bp, Mus musculus
gcatgctaggcacgtgtccgctact

SEQ ID NO: 543171 - DNA, 25 bp, Mus musculus
gcatgctaggcaggtgtccgctact

SEQ ID NO: 543172 - DNA, 25 bp, Mus musculus
gcatgctatagcatgtgtgcgcaca

SEQ ID NO: 543173 - DNA, 25 bp, Mus musculus
gcatgctatagcttgtgtgcgcaca

SEQ ID NO: 543174 - DNA, 25 bp, Mus musculus
gcatgctatattatggataccgtta

SEQ ID NO: 543175 - DNA, 25 bp, Mus musculus
gcatgctatattttggataccgtta

SEQ ID NO: 543176 - DNA, 25 bp, Mus musculus
gcatgctatcataggctcatactct

SEQ ID NO: 543177 - DNA, 25 bp, Mus musculus
gcatgctatcattggctcatactct

SEQ ID NO: 543178 - DNA, 25 bp, Mus musculus
gcatgctattatattggcattctta

SEQ ID NO: 543179 - DNA, 25 bp, Mus musculus
gcatgctattattttggcattctta

SEQ ID NO: 543180 - DNA, 25 bp, Mus musculus
gcatgctcaagcaccagactctggt

SEQ ID NO: 543181 - DNA, 25 bp, Mus musculus
gcatgctcaagctccagactctggt

SEQ ID NO: 543182 - DNA, 25 bp, Mus musculus
gcatgctcagcaagggtttccatta

SEQ ID NO: 543183 - DNA, 25 bp, Mus musculus
gcatgctcagcatgggtttccatta

SEQ ID NO: 543184 - DNA, 25 bp, Mus musculus
gcatgctcagctcattaccatatgg

SEQ ID NO: 543185 - DNA, 25 bp, Mus musculus
gcatgctcagctgattaccatatgg

SEQ ID NO: 543186 - DNA, 25 bp, Mus musculus
gcatgctccacaaacatgtttccaa

SEQ ID NO: 543187 - DNA, 25 bp, Mus musculus
gcatgctccacatacatgtttccaa

SEQ ID NO: 543188 - DNA, 25 bp, Mus musculus
gcatgctccagtctttatagcacag

SEQ ID NO: 543189 - DNA, 25 bp, Mus musculus
gcatgctccagtgtttatagcacag

SEQ ID NO: 543190 - DNA, 25 bp, Mus musculus
gcatgctccctaaagtatgttgctt

SEQ ID NO: 543191 - DNA, 25 bp, Mus musculus
gcatgctccctatagtatgttgctt

SEQ ID NO: 543192 - DNA, 25 bp, Mus musculus
gcatgctccgccaggttggaacggt

SEQ ID NO: 543193 - DNA, 25 bp, Mus musculus
gcatgctccgcctggttggaacggt

SEQ ID NO: 543194 - DNA, 25 bp, Mus musculus
gcatgctcctttactgggatcaaca

SEQ ID NO: 543195 - DNA, 25 bp, Mus musculus
gcatgctccttttctgggatcaaca

SEQ ID NO: 543196 - DNA, 25 bp, Mus musculus
gcatgctcgctaaccacgtgtgtga

SEQ ID NO: 543197 - DNA, 25 bp, Mus musculus
gcatgctcgctatccacgtgtgtga

SEQ ID NO: 543198 - DNA, 25 bp, Mus musculus
gcatgctcggttactccagagggag

SEQ ID NO: 543199 - DNA, 25 bp, Mus musculus
gcatgctcggtttctccagagggag

SEQ ID NO: 543200 - DNA, 25 bp, Mus musculus
gcatgctctacactttcctgcataa

SEQ ID NO: 543201 - DNA, 25 bp, Mus musculus
gcatgctctacagtttcctgcataa

SEQ ID NO: 543202 - DNA, 25 bp, Mus musculus
gcatgctctctgatgtcagtacaga

SEQ ID NO: 543203 - DNA, 25 bp, Mus musculus
gcatgctctctgttgtcagtacaga

SEQ ID NO: 543204 - DNA, 25 bp, Mus musculus
gcatgctctggaaggacatggccat

SEQ ID NO: 543205 - DNA, 25 bp, Mus musculus
gcatgctctggatggacatggccat

SEQ ID NO: 543206 - DNA, 25 bp, Mus musculus
gcatgctctgtgcagatacttttga

SEQ ID NO: 543207 - DNA, 25 bp, Mus musculus
gcatgctctgtggagatacttttga

SEQ ID NO: 543208 - DNA, 25 bp, Mus musculus
gcatgctgaagcagtacgcgcacaa

SEQ ID NO: 543209 - DNA, 25 bp, Mus musculus
gcatgctgaagctgtacgcgcacaa

SEQ ID NO: 543210 - DNA, 25 bp, Mus musculus
gcatgctgaataccaacttgagata

SEQ ID NO: 543211 - DNA, 25 bp, Mus musculus
gcatgctgaatacgcgctcgatctt

SEQ ID NO: 543212 - DNA, 25 bp, Mus musculus
gcatgctgaatagcaacttgagata

SEQ ID NO: 543213 - DNA, 25 bp, Mus musculus
gcatgctgaataggcgctcgatctt

SEQ ID NO: 543214 - DNA, 25 bp, Mus musculus
gcatgctgacaaccagtttcaggct

SEQ ID NO: 543215 - DNA, 25 bp, Mus musculus
gcatgctgacaagcagtttcaggct

SEQ ID NO: 543216 - DNA, 25 bp, Mus musculus
gcatgctgcagacgttcgcaggaac

SEQ ID NO: 543217 - DNA, 25 bp, Mus musculus
gcatgctgcagaggttcgcaggaac

SEQ ID NO: 543218 - DNA, 25 bp, Mus musculus
gcatgctgcattatagtcctatctg

SEQ ID NO: 543219 - DNA, 25 bp, Mus musculus
gcatgctgcattttagtcctatctg

SEQ ID NO: 543220 - DNA, 25 bp, Mus musculus
gcatgctgcgttatatttatccacc

SEQ ID NO: 543221 - DNA, 25 bp, Mus musculus
gcatgctgcgttttatttatccacc

SEQ ID NO: 543222 - DNA, 25 bp, Mus musculus
gcatgctgctatccaccaagataga

SEQ ID NO: 543223 - DNA, 25 bp, Mus musculus
gcatgctgctatgcaccaagataga

SEQ ID NO: 543224 - DNA, 25 bp, Mus musculus
gcatgctgggaaagctttgacctcc

SEQ ID NO: 543225 - DNA, 25 bp, Mus musculus
gcatgctgggaatgctttgacctcc

SEQ ID NO: 543226 - DNA, 25 bp, Mus musculus
gcatgctgggatagcgaagtcacat

SEQ ID NO: 543227 - DNA, 25 bp, Mus musculus
gcatgctgggattgcgaagtcacat

SEQ ID NO: 543228 - DNA, 25 bp, Mus musculus
gcatgctgggtaattttagcttaca

SEQ ID NO: 543229 - DNA, 25 bp, Mus musculus
gcatgctgggtatttttagcttaca

SEQ ID NO: 543230 - DNA, 25 bp, Mus musculus
gcatgctgtagcctacaagtacaac

SEQ ID NO: 543231 - DNA, 25 bp, Mus musculus
gcatgctgtagcgtacaagtacaac

SEQ ID NO: 543232 - DNA, 25 bp, Mus musculus
gcatgctgtcccactgttaaacata

SEQ ID NO: 543233 - DNA, 25 bp, Mus musculus
gcatgctgtccctctgttaaacata

SEQ ID NO: 543234 - DNA, 25 bp, Mus musculus
gcatgctgtgctcgtgatcaagaaa

SEQ ID NO: 543235 - DNA, 25 bp, Mus musculus
gcatgctgtgctggtgatcaagaaa

SEQ ID NO: 543236 - DNA, 25 bp, Mus musculus
gcatgctgttagcaatgtaatttca

SEQ ID NO: 543237 - DNA, 25 bp, Mus musculus
gcatgctgttaggaatgtaatttca

SEQ ID NO: 543238 - DNA, 25 bp, Mus musculus
gcatgcttacacaggagtcatccga

SEQ ID NO: 543239 - DNA, 25 bp, Mus musculus
gcatgcttacactggagtcatccga

SEQ ID NO: 543240 - DNA, 25 bp, Mus musculus
gcatgcttacctcctaacttctgaa

SEQ ID NO: 543241 - DNA, 25 bp, Mus musculus
gcatgcttacctgctaacttctgaa

SEQ ID NO: 543242 - DNA, 25 bp, Mus musculus
gcatgcttacgcagcaagcacttta

SEQ ID NO: 543243 - DNA, 25 bp, Mus musculus
gcatgcttacgctgcaagcacttta

SEQ ID NO: 543244 - DNA, 25 bp, Mus musculus
gcatgcttcctaaaggcgtgtgatt

SEQ ID NO: 543245 - DNA, 25 bp, Mus musculus
gcatgcttcctataggcgtgtgatt

SEQ ID NO: 543246 - DNA, 25 bp, Mus musculus
gcatgcttcgcgagccctcataggg

SEQ ID NO: 543247 - DNA, 25 bp, Mus musculus
gcatgcttcgcgtgccctcataggg

SEQ ID NO: 543248 - DNA, 25 bp, Mus musculus
gcatgcttctctaacacgtctatat

SEQ ID NO: 543249 - DNA, 25 bp, Mus musculus
gcatgcttctcttacacgtctatat

SEQ ID NO: 543250 - DNA, 25 bp, Mus musculus
gcatgcttcttcctagcttatctaa

SEQ ID NO: 543251 - DNA, 25 bp, Mus musculus
gcatgcttcttcgtagcttatctaa

SEQ ID NO: 543252 - DNA, 25 bp, Mus musculus
gcatgcttgacgctaatgagctgaa

SEQ ID NO: 543253 - DNA, 25 bp, Mus musculus
gcatgcttgacggtaatgagctgaa

SEQ ID NO: 543254 - DNA, 25 bp, Mus musculus
gcatgcttgcctaacgacataggtt

SEQ ID NO: 543255 - DNA, 25 bp, Mus musculus
gcatgcttgccttacgacataggtt

SEQ ID NO: 543256 - DNA, 25 bp, Mus musculus
gcatgcttgtacagattgcctgcat

SEQ ID NO: 543257 - DNA, 25 bp, Mus musculus
gcatgcttgtactgattgcctgcat

SEQ ID NO: 543258 - DNA, 25 bp, Mus musculus
gcatgcttgtatctgcttatgcagt

SEQ ID NO: 543259 - DNA, 25 bp, Mus musculus
gcatgcttgtatgtgcttatgcagt

SEQ ID NO: 543260 - DNA, 25 bp, Mus musculus
gcatgcttgtcactgtgccatgtgt

SEQ ID NO: 543261 - DNA, 25 bp, Mus musculus
gcatgcttgtcagtgtgccatgtgt

SEQ ID NO: 543262 - DNA, 25 bp, Mus musculus
gcatgcttgtgtaattgtgtcccct

SEQ ID NO: 543263 - DNA, 25 bp, Mus musculus
gcatgcttgtgtccagtccttcgtg

SEQ ID NO: 543264 - DNA, 25 bp, Mus musculus
gcatgcttgtgtgcagtccttcgtg

SEQ ID NO: 543265 - DNA, 25 bp, Mus musculus
gcatgcttgtgttattgtgtcccct

SEQ ID NO: 543266 - DNA, 25 bp, Mus musculus
gcatgcttgttcctgtaactacaca

SEQ ID NO: 543267 - DNA, 25 bp, Mus musculus
gcatgcttgttcgtgtaactacaca

SEQ ID NO: 543268 - DNA, 25 bp, Mus musculus
gcatgcttgttgcatactgttactt

SEQ ID NO: 543269 - DNA, 25 bp, Mus musculus
gcatgcttgttggatactgttactt

SEQ ID NO: 543270 - DNA, 25 bp, Mus musculus
gcatgctttcaacagtccaggacgg

SEQ ID NO: 543271 - DNA, 25 bp, Mus musculus
gcatgctttcaagagtccaggacgg

SEQ ID NO: 543272 - DNA, 25 bp, Mus musculus
gcatgctttcatatcctgtaacttt

SEQ ID NO: 543273 - DNA, 25 bp, Mus musculus
gcatgctttcatttcctgtaacttt

SEQ ID NO: 543274 - DNA, 25 bp, Mus musculus
gcatgctttcccagttgctgttaga

SEQ ID NO: 543275 - DNA, 25 bp, Mus musculus
gcatgctttccctgttgctgttaga

SEQ ID NO: 543276 - DNA, 25 bp, Mus musculus
gcatgctttgctacagcgctgactt

SEQ ID NO: 543277 - DNA, 25 bp, Mus musculus
gcatgctttgcttcagcgctgactt

SEQ ID NO: 543278 - DNA, 25 bp, Mus musculus
gcatgctttggaatgtcagcgatac

SEQ ID NO: 543279 - DNA, 25 bp, Mus musculus
gcatgctttggattgtcagcgatac

SEQ ID NO: 543280 - DNA, 25 bp, Mus musculus
gcatgctttgggatagtgacattta

SEQ ID NO: 543281 - DNA, 25 bp, Mus musculus
gcatgctttgggttagtgacattta

SEQ ID NO: 543282 - DNA, 25 bp, Mus musculus
gcatgcttttatcatattcacccat

SEQ ID NO: 543283 - DNA, 25 bp, Mus musculus
gcatgcttttatgatattcacccat

SEQ ID NO: 543284 - DNA, 25 bp, Mus musculus
gcatggaaacttatatcaaagattc

SEQ ID NO: 543285 - DNA, 25 bp, Mus musculus
gcatggaaacttttatcaaagattc

SEQ ID NO: 543286 - DNA, 25 bp, Mus musculus
gcatggaaattactattgttgttca

SEQ ID NO: 543287 - DNA, 25 bp, Mus musculus
gcatggaaattagtattgttgttca

SEQ ID NO: 543288 - DNA, 25 bp, Mus musculus
gcatggaaccatctggagaatgtga

SEQ ID NO: 543289 - DNA, 25 bp, Mus musculus
gcatggaaccatgtggagaatgtga

SEQ ID NO: 543290 - DNA, 25 bp, Mus musculus
gcatggaacttgcaggacttgcaat

SEQ ID NO: 543291 - DNA, 25 bp, Mus musculus
gcatggaacttggaggacttgcaat

SEQ ID NO: 543292 - DNA, 25 bp, Mus musculus
gcatggaagaccacttagagatcct

SEQ ID NO: 543293 - DNA, 25 bp, Mus musculus
gcatggaagacctcttagagatcct

SEQ ID NO: 543294 - DNA, 25 bp, Mus musculus
gcatggaagactccctcacagattt

SEQ ID NO: 543295 - DNA, 25 bp, Mus musculus
gcatggaagactgcctcacagattt

SEQ ID NO: 543296 - DNA, 25 bp, Mus musculus
gcatggaagccacgtcttgtataaa

SEQ ID NO: 543297 - DNA, 25 bp, Mus musculus
gcatggaagccaggtcttgtataaa

SEQ ID NO: 543298 - DNA, 25 bp, Mus musculus
gcatggaaggtcactgtattggcaa

SEQ ID NO: 543299 - DNA, 25 bp, Mus musculus
gcatggaaggtctctgtattggcaa

SEQ ID NO: 543300 - DNA, 25 bp, Mus musculus
gcatggaagtgcatgtgtccattgg

SEQ ID NO: 543301 - DNA, 25 bp, Mus musculus
gcatggaagtgcttgtgtccattgg

SEQ ID NO: 543302 - DNA, 25 bp, Mus musculus
gcatggaataacagccctgtttctg

SEQ ID NO: 543303 - DNA, 25 bp, Mus musculus
gcatggaataactgccctgtttctg

SEQ ID NO: 543304 - DNA, 25 bp, Mus musculus
gcatggaataatatgccagctcttt

SEQ ID NO: 543305 - DNA, 25 bp, Mus musculus
gcatggaataatttgccagctcttt

SEQ ID NO: 543306 - DNA, 25 bp, Mus musculus
gcatggaatcagagagcacccagga

SEQ ID NO: 543307 - DNA, 25 bp, Mus musculus
gcatggaatcagtgagcacccagga

SEQ ID NO: 543308 - DNA, 25 bp, Mus musculus
gcatggaatcatcactcgttttaag

SEQ ID NO: 543309 - DNA, 25 bp, Mus musculus
gcatggaatcatgactcgttttaag

SEQ ID NO: 543310 - DNA, 25 bp, Mus musculus
gcatggaatttcctgactgtgccaa

SEQ ID NO: 543311 - DNA, 25 bp, Mus musculus
gcatggaatttcgtgactgtgccaa

SEQ ID NO: 543312 - DNA, 25 bp, Mus musculus
gcatggacaacacacccttttaaaa

SEQ ID NO: 543313 - DNA, 25 bp, Mus musculus
gcatggacaacagacccttttaaaa

SEQ ID NO: 543314 - DNA, 25 bp, Mus musculus
gcatggacaaggacagcccggatct

SEQ ID NO: 543315 - DNA, 25 bp, Mus musculus
gcatggacaaggtcagcccggatct

SEQ ID NO: 543316 - DNA, 25 bp, Mus musculus
gcatggacaatcacaactgtttttt

SEQ ID NO: 543317 - DNA, 25 bp, Mus musculus
gcatggacaatctcaactgtttttt

SEQ ID NO: 543318 - DNA, 25 bp, Mus musculus
gcatggacacaaactgcttctcaga

SEQ ID NO: 543319 - DNA, 25 bp, Mus musculus
gcatggacacaatctgcttctcaga

SEQ ID NO: 543320 - DNA, 25 bp, Mus musculus
gcatggacacagattagctgaatat

SEQ ID NO: 543321 - DNA, 25 bp, Mus musculus
gcatggacacagtttagctgaatat

SEQ ID NO: 543322 - DNA, 25 bp, Mus musculus
gcatggacagggagaaggtctccca

SEQ ID NO: 543323 - DNA, 25 bp, Mus musculus
gcatggacagggtgaaggtctccca

SEQ ID NO: 543324 - DNA, 25 bp, Mus musculus
gcatggacatgcattctcattgtaa

SEQ ID NO: 543325 - DNA, 25 bp, Mus musculus
gcatggacatgctttctcattgtaa

SEQ ID NO: 543326 - DNA, 25 bp, Mus musculus
gcatggacatttcttgttgcatact

SEQ ID NO: 543327 - DNA, 25 bp, Mus musculus
gcatggacatttgttgttgcatact

SEQ ID NO: 543328 - DNA, 25 bp, Mus musculus
gcatggaccactcgacagtgttcat

SEQ ID NO: 543329 - DNA, 25 bp, Mus musculus
gcatggaccactggacagtgttcat

SEQ ID NO: 543330 - DNA, 25 bp, Mus musculus
gcatggaccaggactcagcgtgaag

SEQ ID NO: 543331 - DNA, 25 bp, Mus musculus
gcatggaccaggtctcagcgtgaag

SEQ ID NO: 543332 - DNA, 25 bp, Mus musculus
gcatggacccgtacatatacttctt

SEQ ID NO: 543333 - DNA, 25 bp, Mus musculus
gcatggacccgttcatatacttctt

SEQ ID NO: 543334 - DNA, 25 bp, Mus musculus
gcatggacctgacggccaacctgaa

SEQ ID NO: 543335 - DNA, 25 bp, Mus musculus
gcatggacctgagggccaacctgaa

SEQ ID NO: 543336 - DNA, 25 bp, Mus musculus
gcatggaccttgaacatagttttat

SEQ ID NO: 543337 - DNA, 25 bp, Mus musculus
gcatggaccttgtacatagttttat

SEQ ID NO: 543338 - DNA, 25 bp, Mus musculus
gcatggacgtggatcaagtctttca

SEQ ID NO: 543339 - DNA, 25 bp, Mus musculus
gcatggacgtggttcaagtctttca

SEQ ID NO: 543340 - DNA, 25 bp, Mus musculus
gcatggactacacgaccagcatcct

SEQ ID NO: 543341 - DNA, 25 bp, Mus musculus
gcatggactacaggaccagcatcct

SEQ ID NO: 543342 - DNA, 25 bp, Mus musculus
gcatggactctaatctttacaggaa

SEQ ID NO: 543343 - DNA, 25 bp, Mus musculus
gcatggactctattctttacaggaa

SEQ ID NO: 543344 - DNA, 25 bp, Mus musculus
gcatggactctgacctcatatcgat

SEQ ID NO: 543345 - DNA, 25 bp, Mus musculus
gcatggactctgtcctcatatcgat

SEQ ID NO: 543346 - DNA, 25 bp, Mus musculus
gcatggactgctctagccatggtga

SEQ ID NO: 543347 - DNA, 25 bp, Mus musculus
gcatggactgctgtagccatggtga

SEQ ID NO: 543348 - DNA, 25 bp, Mus musculus
gcatggactgtaccgcacaacaggt

SEQ ID NO: 543349 - DNA, 25 bp, Mus musculus
gcatggactgtagcgcacaacaggt

SEQ ID NO: 543350 - DNA, 25 bp, Mus musculus
gcatggactgtcatctgtttggaac

SEQ ID NO: 543351 - DNA, 25 bp, Mus musculus
gcatggactgtcttctgtttggaac

SEQ ID NO: 543352 - DNA, 25 bp, Mus musculus
gcatggactttactagacttttgaa

SEQ ID NO: 543353 - DNA, 25 bp, Mus musculus
gcatggactttagtagacttttgaa

SEQ ID NO: 543354 - DNA, 25 bp, Mus musculus
gcatggagacctcctttctgagaac

SEQ ID NO: 543355 - DNA, 25 bp, Mus musculus
gcatggagacctgctttctgagaac

SEQ ID NO: 543356 - DNA, 25 bp, Mus musculus
gcatggagacttcacataaatctgt

SEQ ID NO: 543357 - DNA, 25 bp, Mus musculus
gcatggagacttgacataaatctgt

SEQ ID NO: 543358 - DNA, 25 bp, Mus musculus
gcatggagaggcacaaggcattgaa

SEQ ID NO: 543359 - DNA, 25 bp, Mus musculus
gcatggagaggctcaaggcattgaa

SEQ ID NO: 543360 - DNA, 25 bp, Mus musculus
gcatggagagttcgcagtttctttt

SEQ ID NO: 543361 - DNA, 25 bp, Mus musculus
gcatggagagttggcagtttctttt

SEQ ID NO: 543362 - DNA, 25 bp, Mus musculus
gcatggagatgcaggtggaacacca

SEQ ID NO: 543363 - DNA, 25 bp, Mus musculus
gcatggagatgctggtggaacacca

SEQ ID NO: 543364 - DNA, 25 bp, Mus musculus
gcatggagcaatctcgcagtgcagt

SEQ ID NO: 543365 - DNA, 25 bp, Mus musculus
gcatggagcaatgtcgcagtgcagt

SEQ ID NO: 543366 - DNA, 25 bp, Mus musculus
gcatggagcatgcagctaagcagat

SEQ ID NO: 543367 - DNA, 25 bp, Mus musculus
gcatggagcatggagctaagcagat

SEQ ID NO: 543368 - DNA, 25 bp, Mus musculus
gcatggagcgtcacagtgctaggtc

SEQ ID NO: 543369 - DNA, 25 bp, Mus musculus
gcatggagcgtctcagtgctaggtc

SEQ ID NO: 543370 - DNA, 25 bp, Mus musculus
gcatggaggactatgtcacctgggt

SEQ ID NO: 543371 - DNA, 25 bp, Mus musculus
gcatggaggactttgtcacctgggt

SEQ ID NO: 543372 - DNA, 25 bp, Mus musculus
gcatggagtaacaaccttgcttgta

SEQ ID NO: 543373 - DNA, 25 bp, Mus musculus
gcatggagtaactaccttgcttgta

SEQ ID NO: 543374 - DNA, 25 bp, Mus musculus
gcatggagtacaagggctacctggt

SEQ ID NO: 543375 - DNA, 25 bp, Mus musculus
gcatggagtacatgggctacctggt

SEQ ID NO: 543376 - DNA, 25 bp, Mus musculus
gcatggagttcaacactaacagaca

SEQ ID NO: 543377 - DNA, 25 bp, Mus musculus
gcatggagttcatcactaacagaca

SEQ ID NO: 543378 - DNA, 25 bp, Mus musculus
gcatggataagcctgggcctaagtt

SEQ ID NO: 543379 - DNA, 25 bp, Mus musculus
gcatggataagcgtgggcctaagtt

SEQ ID NO: 543380 - DNA, 25 bp, Mus musculus
gcatggatacatcggcatcacagca

SEQ ID NO: 543381 - DNA, 25 bp, Mus musculus
gcatggatacatgggcatcacagca

SEQ ID NO: 543382 - DNA, 25 bp, Mus musculus
gcatggataggtcctttctcctcaa

SEQ ID NO: 543383 - DNA, 25 bp, Mus musculus
gcatggataggtgctttctcctcaa

SEQ ID NO: 543384 - DNA, 25 bp, Mus musculus
gcatggatatgtcaaccacctaaag

SEQ ID NO: 543385 - DNA, 25 bp, Mus musculus
gcatggatatgtgaaccacctaaag

SEQ ID NO: 543386 - DNA, 25 bp, Mus musculus
gcatggatccatctgtgcgcattgg

SEQ ID NO: 543387 - DNA, 25 bp, Mus musculus
gcatggatccatgtgtgcgcattgg

SEQ ID NO: 543388 - DNA, 25 bp, Mus musculus
gcatggatccgcctttaacaaaccc

SEQ ID NO: 543389 - DNA, 25 bp, Mus musculus
gcatggatccgcgtttaacaaaccc

SEQ ID NO: 543390 - DNA, 25 bp, Mus musculus
gcatggatctgtcgacctgaggact

SEQ ID NO: 543391 - DNA, 25 bp, Mus musculus
gcatggatctgtggacctgaggact

SEQ ID NO: 543392 - DNA, 25 bp, Mus musculus
gcatggatgaccctgagtgttactt

SEQ ID NO: 543393 - DNA, 25 bp, Mus musculus
gcatggatgaccgtgagtgttactt

SEQ ID NO: 543394 - DNA, 25 bp, Mus musculus
gcatggatgcctatactgttttcta

SEQ ID NO: 543395 - DNA, 25 bp, Mus musculus
gcatggatgcctttactgttttcta

SEQ ID NO: 543396 - DNA, 25 bp, Mus musculus
gcatggatggatcacttgttcctgc

SEQ ID NO: 543397 - DNA, 25 bp, Mus musculus
gcatggatggatgacttgttcctgc

SEQ ID NO: 543398 - DNA, 25 bp, Mus musculus
gcatggatggtgacgatgtccctcc

SEQ ID NO: 543399 - DNA, 25 bp, Mus musculus
gcatggatggtgtcgatgtccctcc

SEQ ID NO: 543400 - DNA, 25 bp, Mus musculus
gcatggattacccttactggatgta

SEQ ID NO: 543401 - DNA, 25 bp, Mus musculus
gcatggattaccgttactggatgta

SEQ ID NO: 543402 - DNA, 25 bp, Mus musculus
gcatggcaagctagtcctgtatcag

SEQ ID NO: 543403 - DNA, 25 bp, Mus musculus
gcatggcaagcttgtcctgtatcag

SEQ ID NO: 543404 - DNA, 25 bp, Mus musculus
gcatggcaaggtagtgcgagcacat

SEQ ID NO: 543405 - DNA, 25 bp, Mus musculus
gcatggcaaggttgtgcgagcacat

SEQ ID NO: 543406 - DNA, 25 bp, Mus musculus
gcatggcaccaaagacattatgtta

SEQ ID NO: 543407 - DNA, 25 bp, Mus musculus
gcatggcaccaatgacattatgtta

SEQ ID NO: 543408 - DNA, 25 bp, Mus musculus
gcatggcagatgctcacccttatta

SEQ ID NO: 543409 - DNA, 25 bp, Mus musculus
gcatggcagatggtcacccttatta

SEQ ID NO: 543410 - DNA, 25 bp, Mus musculus
gcatggcagcctacaatcacagata

SEQ ID NO: 543411 - DNA, 25 bp, Mus musculus
gcatggcagccttcaatcacagata

SEQ ID NO: 543412 - DNA, 25 bp, Mus musculus
gcatggcagggcaagaccttgctca

SEQ ID NO: 543413 - DNA, 25 bp, Mus musculus
gcatggcagggctagaccttgctca

SEQ ID NO: 543414 - DNA, 25 bp, Mus musculus
gcatggcagtgaccaggtgcctctt

SEQ ID NO: 543415 - DNA, 25 bp, Mus musculus
gcatggcagtgagcaggtgcctctt

SEQ ID NO: 543416 - DNA, 25 bp, Mus musculus
gcatggcatcataaccagagactgt

SEQ ID NO: 543417 - DNA, 25 bp, Mus musculus
gcatggcatcattaccagagactgt

SEQ ID NO: 543418 - DNA, 25 bp, Mus musculus
gcatggcatcttcttgacttgtgtc

SEQ ID NO: 543419 - DNA, 25 bp, Mus musculus
gcatggcatcttgttgacttgtgtc

SEQ ID NO: 543420 - DNA, 25 bp, Mus musculus
gcatggcatgcacctcaataaacgc

SEQ ID NO: 543421 - DNA, 25 bp, Mus musculus
gcatggcatgcagctcaataaacgc

SEQ ID NO: 543422 - DNA, 25 bp, Mus musculus
gcatggcattaaatggctccttctg

SEQ ID NO: 543423 - DNA, 25 bp, Mus musculus
gcatggcattaattggctccttctg

SEQ ID NO: 543424 - DNA, 25 bp, Mus musculus
gcatggcattgcagactgtgagaaa

SEQ ID NO: 543425 - DNA, 25 bp, Mus musculus
gcatggcattgctgactgtgagaaa

SEQ ID NO: 543426 - DNA, 25 bp, Mus musculus
gcatggccaggcatcatttagctgt

SEQ ID NO: 543427 - DNA, 25 bp, Mus musculus
gcatggccaggcttcatttagctgt

SEQ ID NO: 543428 - DNA, 25 bp, Mus musculus
gcatggcccttgaagaaccacagat

SEQ ID NO: 543429 - DNA, 25 bp, Mus musculus
gcatggcccttgtagaaccacagat

SEQ ID NO: 543430 - DNA, 25 bp, Mus musculus
gcatggccgcacagcttgtacggag

SEQ ID NO: 543431 - DNA, 25 bp, Mus musculus
gcatggccgcactgcttgtacggag

SEQ ID NO: 543432 - DNA, 25 bp, Mus musculus
gcatggccgccacagttccaataga

SEQ ID NO: 543433 - DNA, 25 bp, Mus musculus
gcatggccgccagagttccaataga

SEQ ID NO: 543434 - DNA, 25 bp, Mus musculus
gcatggcctaggatgttaatgacat

SEQ ID NO: 543435 - DNA, 25 bp, Mus musculus
gcatggcctaggttgttaatgacat

SEQ ID NO: 543436 - DNA, 25 bp, Mus musculus
gcatggcctatccagaactgagttt

SEQ ID NO: 543437 - DNA, 25 bp, Mus musculus
gcatggcctatcgagaactgagttt

SEQ ID NO: 543438 - DNA, 25 bp, Mus musculus
gcatggcctctcagcttggtatgtg

SEQ ID NO: 543439 - DNA, 25 bp, Mus musculus
gcatggcctctctgcttggtatgtg

SEQ ID NO: 543440 - DNA, 25 bp, Mus musculus
gcatggcctgcaattttattgctaa

SEQ ID NO: 543441 - DNA, 25 bp, Mus musculus
gcatggcctgcatttttattgctaa

SEQ ID NO: 543442 - DNA, 25 bp, Mus musculus
gcatggcctggcatagccgagtgac

SEQ ID NO: 543443 - DNA, 25 bp, Mus musculus
gcatggcctggcttagccgagtgac

SEQ ID NO: 543444 - DNA, 25 bp, Mus musculus
gcatggccttatctggttgatggaa

SEQ ID NO: 543445 - DNA, 25 bp, Mus musculus
gcatggccttatgtggttgatggaa

SEQ ID NO: 543446 - DNA, 25 bp, Mus musculus
gcatggcgcagcctagagcaactag

SEQ ID NO: 543447 - DNA, 25 bp, Mus musculus
gcatggcgcagcgtagagcaactag

SEQ ID NO: 543448 - DNA, 25 bp, Mus musculus
gcatggcgccgacgtatatgcccca

SEQ ID NO: 543449 - DNA, 25 bp, Mus musculus
gcatggcgccgaggtatatgcccca

SEQ ID NO: 543450 - DNA, 25 bp, Mus musculus
gcatggcgtgaccttagcaggctta

SEQ ID NO: 543451 - DNA, 25 bp, Mus musculus
gcatggcgtgacgttagcaggctta

SEQ ID NO: 543452 - DNA, 25 bp, Mus musculus
gcatggctaactagaaaattgaact

SEQ ID NO: 543453 - DNA, 25 bp, Mus musculus
gcatggctaacttgaaaattgaact

SEQ ID NO: 543454 - DNA, 25 bp, Mus musculus
gcatggctacaacctaagctaggat

SEQ ID NO: 543455 - DNA, 25 bp, Mus musculus
gcatggctacaagctaagctaggat

SEQ ID NO: 543456 - DNA, 25 bp, Mus musculus
gcatggctcaaaatcttgcatttta

SEQ ID NO: 543457 - DNA, 25 bp, Mus musculus
gcatggctcaaattcttgcatttta

SEQ ID NO: 543458 - DNA, 25 bp, Mus musculus
gcatggctcatactcaaatttacca

SEQ ID NO: 543459 - DNA, 25 bp, Mus musculus
gcatggctcatagtcaaatttacca

SEQ ID NO: 543460 - DNA, 25 bp, Mus musculus
gcatggctccagcaaggtccaggaa

SEQ ID NO: 543461 - DNA, 25 bp, Mus musculus
gcatggctccaggaaggtccaggaa

SEQ ID NO: 543462 - DNA, 25 bp, Mus musculus
gcatggctccatcataagagcagtt

SEQ ID NO: 543463 - DNA, 25 bp, Mus musculus
gcatggctccatgataagagcagtt

SEQ ID NO: 543464 - DNA, 25 bp, Mus musculus
gcatggctcctaacagcactattaa

SEQ ID NO: 543465 - DNA, 25 bp, Mus musculus
gcatggctcctatcagcactattaa

SEQ ID NO: 543466 - DNA, 25 bp, Mus musculus
gcatggctcctgcattccaaacagc

SEQ ID NO: 543467 - DNA, 25 bp, Mus musculus
gcatggctcctggattccaaacagc

SEQ ID NO: 543468 - DNA, 25 bp, Mus musculus
gcatggctctaacattcttgctaaa

SEQ ID NO: 543469 - DNA, 25 bp, Mus musculus
gcatggctctaagattcttgctaaa

SEQ ID NO: 543470 - DNA, 25 bp, Mus musculus
gcatggctctgaaccagacttttta

SEQ ID NO: 543471 - DNA, 25 bp, Mus musculus
gcatggctctgatccagacttttta

SEQ ID NO: 543472 - DNA, 25 bp, Mus musculus
gcatggctctttcatataggactat

SEQ ID NO: 543473 - DNA, 25 bp, Mus musculus
gcatggctctttgatataggactat

SEQ ID NO: 543474 - DNA, 25 bp, Mus musculus
gcatggctgccaaagggttaatgaa

SEQ ID NO: 543475 - DNA, 25 bp, Mus musculus
gcatggctgccatagggttaatgaa

SEQ ID NO: 543476 - DNA, 25 bp, Mus musculus
gcatggctgctgcaatattaggact

SEQ ID NO: 543477 - DNA, 25 bp, Mus musculus
gcatggctgctggaatattaggact

SEQ ID NO: 543478 - DNA, 25 bp, Mus musculus
gcatggctggcaccagactgtaaat

SEQ ID NO: 543479 - DNA, 25 bp, Mus musculus
gcatggctggcagcagactgtaaat

SEQ ID NO: 543480 - DNA, 25 bp, Mus musculus
gcatggctggctcgtagtatgataa

SEQ ID NO: 543481 - DNA, 25 bp, Mus musculus
gcatggctggctggtagtatgataa

SEQ ID NO: 543482 - DNA, 25 bp, Mus musculus
gcatggctgtggacacgtgaacttt

SEQ ID NO: 543483 - DNA, 25 bp, Mus musculus
gcatggctgtggtcacgtgaacttt

SEQ ID NO: 543484 - DNA, 25 bp, Mus musculus
gcatggctgtttaaggcatctacct

SEQ ID NO: 543485 - DNA, 25 bp, Mus musculus
gcatggctgttttaggcatctacct

SEQ ID NO: 543486 - DNA, 25 bp, Mus musculus
gcatggcttagaagaggatcctcag

SEQ ID NO: 543487 - DNA, 25 bp, Mus musculus
gcatggcttagatgaggatcctcag

SEQ ID NO: 543488 - DNA, 25 bp, Mus musculus
gcatggcttattaccacatctactt

SEQ ID NO: 543489 - DNA, 25 bp, Mus musculus
gcatggcttatttccacatctactt

SEQ ID NO: 543490 - DNA, 25 bp, Mus musculus
gcatggcttcacacagcaatttctg

SEQ ID NO: 543491 - DNA, 25 bp, Mus musculus
gcatggcttcactcagcaatttctg

SEQ ID NO: 543492 - DNA, 25 bp, Mus musculus
gcatggcttcagattgcatcagtta

SEQ ID NO: 543493 - DNA, 25 bp, Mus musculus
gcatggcttcagtttgcatcagtta

SEQ ID NO: 543494 - DNA, 25 bp, Mus musculus
gcatggcttctacccttgagcagtt

SEQ ID NO: 543495 - DNA, 25 bp, Mus musculus
gcatggcttctagccttgagcagtt

SEQ ID NO: 543496 - DNA, 25 bp, Mus musculus
gcatggctttagaacccctgggtaa

SEQ ID NO: 543497 - DNA, 25 bp, Mus musculus
gcatggctttagtacccctgggtaa

SEQ ID NO: 543498 - DNA, 25 bp, Mus musculus
gcatggctttcactaagtgattagc

SEQ ID NO: 543499 - DNA, 25 bp, Mus musculus
gcatggctttcagtaagtgattagc

SEQ ID NO: 543500 - DNA, 25 bp, Mus musculus
gcatggctttctcctgaaactgaat

SEQ ID NO: 543501 - DNA, 25 bp, Mus musculus
gcatggctttctgctgaaactgaat

SEQ ID NO: 543502 - DNA, 25 bp, Mus musculus
gcatgggaagatccgtattacctat

SEQ ID NO: 543503 - DNA, 25 bp, Mus musculus
gcatgggaagatgcgtattacctat

SEQ ID NO: 543504 - DNA, 25 bp, Mus musculus
gcatgggaatgtatatgtctgcatt

SEQ ID NO: 543505 - DNA, 25 bp, Mus musculus
gcatgggaatgtttatgtctgcatt

SEQ ID NO: 543506 - DNA, 25 bp, Mus musculus
gcatgggaattaagccctgaactta

SEQ ID NO: 543507 - DNA, 25 bp, Mus musculus
gcatgggaattatgccctgaactta

SEQ ID NO: 543508 - DNA, 25 bp, Mus musculus
gcatgggacaacagggtagaagcta

SEQ ID NO: 543509 - DNA, 25 bp, Mus musculus
gcatgggacaactgggtagaagcta

SEQ ID NO: 543510 - DNA, 25 bp, Mus musculus
gcatgggacaccctggttccaaacc

SEQ ID NO: 543511 - DNA, 25 bp, Mus musculus
gcatgggacaccgtggttccaaacc

SEQ ID NO: 543512 - DNA, 25 bp, Mus musculus
gcatgggacatcatctcaaccagag

SEQ ID NO: 543513 - DNA, 25 bp, Mus musculus
gcatgggacatcttctcaaccagag

SEQ ID NO: 543514 - DNA, 25 bp, Mus musculus
gcatgggaccctccctgaaaagtct

SEQ ID NO: 543515 - DNA, 25 bp, Mus musculus
gcatgggaccctgcctgaaaagtct

SEQ ID NO: 543516 - DNA, 25 bp, Mus musculus
gcatgggaccgcaaacgcctcaact

SEQ ID NO: 543517 - DNA, 25 bp, Mus musculus
gcatgggaccgctaacgcctcaact

SEQ ID NO: 543518 - DNA, 25 bp, Mus musculus
gcatgggactcaacccgtcagaata

SEQ ID NO: 543519 - DNA, 25 bp, Mus musculus
gcatgggactcatcccgtcagaata

SEQ ID NO: 543520 - DNA, 25 bp, Mus musculus
gcatgggactggaccgcatgagctc

SEQ ID NO: 543521 - DNA, 25 bp, Mus musculus
gcatgggactggtccgcatgagctc

SEQ ID NO: 543522 - DNA, 25 bp, Mus musculus
gcatgggactttaacttctttactt

SEQ ID NO: 543523 - DNA, 25 bp, Mus musculus
gcatgggacttttacttctttactt

SEQ ID NO: 543524 - DNA, 25 bp, Mus musculus
gcatgggagcagactcctatacttt

SEQ ID NO: 543525 - DNA, 25 bp, Mus musculus
gcatgggagcagtctcctatacttt

SEQ ID NO: 543526 - DNA, 25 bp, Mus musculus
gcatgggagcatcctgggtccttca

SEQ ID NO: 543527 - DNA, 25 bp, Mus musculus
gcatgggagcatgctgggtccttca

SEQ ID NO: 543528 - DNA, 25 bp, Mus musculus
gcatgggaggatctgtctacttttc

SEQ ID NO: 543529 - DNA, 25 bp, Mus musculus
gcatgggaggatgtgtctacttttc

SEQ ID NO: 543530 - DNA, 25 bp, Mus musculus
gcatgggaggctaggaacttaacag

SEQ ID NO: 543531 - DNA, 25 bp, Mus musculus
gcatgggaggctattccctaagcca

SEQ ID NO: 543532 - DNA, 25 bp, Mus musculus
gcatgggaggcttggaacttaacag

SEQ ID NO: 543533 - DNA, 25 bp, Mus musculus
gcatgggaggcttttccctaagcca

SEQ ID NO: 543534 - DNA, 25 bp, Mus musculus
gcatgggaggtcaaactggtgacat

SEQ ID NO: 543535 - DNA, 25 bp, Mus musculus
gcatgggaggtctaactggtgacat

SEQ ID NO: 543536 - DNA, 25 bp, Mus musculus
gcatgggatcttcaaatgagcctgg

SEQ ID NO: 543537 - DNA, 25 bp, Mus musculus
gcatgggatcttgaaatgagcctgg

SEQ ID NO: 543538 - DNA, 25 bp, Mus musculus
gcatgggatgttccttgctctaagg

SEQ ID NO: 543539 - DNA, 25 bp, Mus musculus
gcatgggatgttgcttgctctaagg

SEQ ID NO: 543540 - DNA, 25 bp, Mus musculus
gcatgggcacacagacttcagagta

SEQ ID NO: 543541 - DNA, 25 bp, Mus musculus
gcatgggcacactgacttcagagta

SEQ ID NO: 543542 - DNA, 25 bp, Mus musculus
gcatgggcacctatctgcttctatc

SEQ ID NO: 543543 - DNA, 25 bp, Mus musculus
gcatgggcacctttctgcttctatc

SEQ ID NO: 543544 - DNA, 25 bp, Mus musculus
gcatgggcatagacagagctccttc

SEQ ID NO: 543545 - DNA, 25 bp, Mus musculus
gcatgggcatagtcagagctccttc

SEQ ID NO: 543546 - DNA, 25 bp, Mus musculus
gcatgggccaacagatccaccaaag

SEQ ID NO: 543547 - DNA, 25 bp, Mus musculus
gcatgggccaactgatccaccaaag

SEQ ID NO: 543548 - DNA, 25 bp, Mus musculus
gcatgggccacccaataccaagtgc

SEQ ID NO: 543549 - DNA, 25 bp, Mus musculus
gcatgggccaccgaataccaagtgc

SEQ ID NO: 543550 - DNA, 25 bp, Mus musculus
gcatgggccactctgctgttttttg

SEQ ID NO: 543551 - DNA, 25 bp, Mus musculus
gcatgggccactgtgctgttttttg

SEQ ID NO: 543552 - DNA, 25 bp, Mus musculus
gcatgggcctctcagagctttaaaa

SEQ ID NO: 543553 - DNA, 25 bp, Mus musculus
gcatgggcctctgagagctttaaaa

SEQ ID NO: 543554 - DNA, 25 bp, Mus musculus
gcatgggcctggcttaccagacctt

SEQ ID NO: 543555 - DNA, 25 bp, Mus musculus
gcatgggcctgggttaccagacctt

SEQ ID NO: 543556 - DNA, 25 bp, Mus musculus
gcatgggcgagcagatgacctctag

SEQ ID NO: 543557 - DNA, 25 bp, Mus musculus
gcatgggcgagctgatgacctctag

SEQ ID NO: 543558 - DNA, 25 bp, Mus musculus
gcatgggcgattagttgcagttcat

SEQ ID NO: 543559 - DNA, 25 bp, Mus musculus
gcatgggcgatttgttgcagttcat

SEQ ID NO: 543560 - DNA, 25 bp, Mus musculus
gcatgggctatgattctacaggatt

SEQ ID NO: 543561 - DNA, 25 bp, Mus musculus
gcatgggctatgtttctacaggatt

SEQ ID NO: 543562 - DNA, 25 bp, Mus musculus
gcatgggctcacaagaagatgactc

SEQ ID NO: 543563 - DNA, 25 bp, Mus musculus
gcatgggctcactagaagatgactc

SEQ ID NO: 543564 - DNA, 25 bp, Mus musculus
gcatgggctccaagattttaggatt

SEQ ID NO: 543565 - DNA, 25 bp, Mus musculus
gcatgggctccatgattttaggatt

SEQ ID NO: 543566 - DNA, 25 bp, Mus musculus
gcatgggctgcaatatctacagcat

SEQ ID NO: 543567 - DNA, 25 bp, Mus musculus
gcatgggctgcattatctacagcat

SEQ ID NO: 543568 - DNA, 25 bp, Mus musculus
gcatgggctttgcttccctcaacat

SEQ ID NO: 543569 - DNA, 25 bp, Mus musculus
gcatgggctttggttccctcaacat

SEQ ID NO: 543570 - DNA, 25 bp, Mus musculus
gcatgggtacacacaaccttcctaa

SEQ ID NO: 543571 - DNA, 25 bp, Mus musculus
gcatgggtacactcaaccttcctaa

SEQ ID NO: 543572 - DNA, 25 bp, Mus musculus
gcatgggtacttcaaagctgtatac

SEQ ID NO: 543573 - DNA, 25 bp, Mus musculus
gcatgggtacttgaaagctgtatac

SEQ ID NO: 543574 - DNA, 25 bp, Mus musculus
gcatgggtatatccattatttctgg

SEQ ID NO: 543575 - DNA, 25 bp, Mus musculus
gcatgggtatatgcattatttctgg

SEQ ID NO: 543576 - DNA, 25 bp, Mus musculus
gcatgggtgctgactacactgcaat

SEQ ID NO: 543577 - DNA, 25 bp, Mus musculus
gcatgggtgctgtctacactgcaat

SEQ ID NO: 543578 - DNA, 25 bp, Mus musculus
gcatgggtgcttacagcctaagaca

SEQ ID NO: 543579 - DNA, 25 bp, Mus musculus
gcatgggtgctttcagcctaagaca

SEQ ID NO: 543580 - DNA, 25 bp, Mus musculus
gcatgggtggtcatcatcctggccg

SEQ ID NO: 543581 - DNA, 25 bp, Mus musculus
gcatgggtggtcttcatcctggccg

SEQ ID NO: 543582 - DNA, 25 bp, Mus musculus
gcatgggtgttgcattgactttaat

SEQ ID NO: 543583 - DNA, 25 bp, Mus musculus
gcatgggtgttggattgactttaat

SEQ ID NO: 543584 - DNA, 25 bp, Mus musculus
gcatgggttaacacctacaactcat

SEQ ID NO: 543585 - DNA, 25 bp, Mus musculus
gcatgggttaactcctacaactcat

SEQ ID NO: 543586 - DNA, 25 bp, Mus musculus
gcatgggttctgagacctgcttgga

SEQ ID NO: 543587 - DNA, 25 bp, Mus musculus
gcatgggttctgtgacctgcttgga

SEQ ID NO: 543588 - DNA, 25 bp, Mus musculus
gcatgggttgacactgtaggcacct

SEQ ID NO: 543589 - DNA, 25 bp, Mus musculus
gcatgggttgactctgtaggcacct

SEQ ID NO: 543590 - DNA, 25 bp, Mus musculus
gcatgggtttttcagtactatggta

SEQ ID NO: 543591 - DNA, 25 bp, Mus musculus
gcatgggtttttgagtactatggta

SEQ ID NO: 543592 - DNA, 25 bp, Mus musculus
gcatggtaaactaacctgttttcca

SEQ ID NO: 543593 - DNA, 25 bp, Mus musculus
gcatggtaaacttacctgttttcca

SEQ ID NO: 543594 - DNA, 25 bp, Mus musculus
gcatggtaacacacacttttcattt

SEQ ID NO: 543595 - DNA, 25 bp, Mus musculus
gcatggtaacactcacttttcattt

SEQ ID NO: 543596 - DNA, 25 bp, Mus musculus
gcatggtaatgaaggtgtcacacat

SEQ ID NO: 543597 - DNA, 25 bp, Mus musculus
gcatggtaatgatggtgtcacacat

SEQ ID NO: 543598 - DNA, 25 bp, Mus musculus
gcatggtacaggagctaagacttct

SEQ ID NO: 543599 - DNA, 25 bp, Mus musculus
gcatggtacaggtgctaagacttct

SEQ ID NO: 543600 - DNA, 25 bp, Mus musculus
gcatggtacatgcatatgctgtaga

SEQ ID NO: 543601 - DNA, 25 bp, Mus musculus
gcatggtacatggatatgctgtaga

SEQ ID NO: 543602 - DNA, 25 bp, Mus musculus
gcatggtaccatacatcattattgc

SEQ ID NO: 543603 - DNA, 25 bp, Mus musculus
gcatggtaccattcatcattattgc

SEQ ID NO: 543604 - DNA, 25 bp, Mus musculus
gcatggtaccctagaaatgatcgtt

SEQ ID NO: 543605 - DNA, 25 bp, Mus musculus
gcatggtacccttgaaatgatcgtt

SEQ ID NO: 543606 - DNA, 25 bp, Mus musculus
gcatggtactccctgagcatggacc

SEQ ID NO: 543607 - DNA, 25 bp, Mus musculus
gcatggtactccgtgagcatggacc

SEQ ID NO: 543608 - DNA, 25 bp, Mus musculus
gcatggtagcagatgctcagtctca

SEQ ID NO: 543609 - DNA, 25 bp, Mus musculus
gcatggtagcagttgctcagtctca

SEQ ID NO: 543610 - DNA, 25 bp, Mus musculus
gcatggtatcatatgactgggtgtt

SEQ ID NO: 543611 - DNA, 25 bp, Mus musculus
gcatggtatcatttgactgggtgtt

SEQ ID NO: 543612 - DNA, 25 bp, Mus musculus
gcatggtatcctagtgctatggttt

SEQ ID NO: 543613 - DNA, 25 bp, Mus musculus
gcatggtatccttgtgctatggttt

SEQ ID NO: 543614 - DNA, 25 bp, Mus musculus
gcatggtatcttatctgccactagc

SEQ ID NO: 543615 - DNA, 25 bp, Mus musculus
gcatggtatcttttctgccactagc

SEQ ID NO: 543616 - DNA, 25 bp, Mus musculus
gcatggtattccaagctcctgatct

SEQ ID NO: 543617 - DNA, 25 bp, Mus musculus
gcatggtattcctagctcctgatct

SEQ ID NO: 543618 - DNA, 25 bp, Mus musculus
gcatggtattggagcattacactgt

SEQ ID NO: 543619 - DNA, 25 bp, Mus musculus
gcatggtattggtgcattacactgt

SEQ ID NO: 543620 - DNA, 25 bp, Mus musculus
gcatggtcaaatctctgtgtcttaa

SEQ ID NO: 543621 - DNA, 25 bp, Mus musculus
gcatggtcaaatgtctgtgtcttaa

SEQ ID NO: 543622 - DNA, 25 bp, Mus musculus
gcatggtcacagacttcatgcctga

SEQ ID NO: 543623 - DNA, 25 bp, Mus musculus
gcatggtcacagtcttcatgcctga

SEQ ID NO: 543624 - DNA, 25 bp, Mus musculus
gcatggtcaccaacataatgaatga

SEQ ID NO: 543625 - DNA, 25 bp, Mus musculus
gcatggtcaccatcataatgaatga

SEQ ID NO: 543626 - DNA, 25 bp, Mus musculus
gcatggtcagctatgtttgccttca

SEQ ID NO: 543627 - DNA, 25 bp, Mus musculus
gcatggtcagctttgtttgccttca

SEQ ID NO: 543628 - DNA, 25 bp, Mus musculus
gcatggtcatcacttgcacatcacc

SEQ ID NO: 543629 - DNA, 25 bp, Mus musculus
gcatggtcatcagttgcacatcacc

SEQ ID NO: 543630 - DNA, 25 bp, Mus musculus
gcatggtcatggagagtcccgagat

SEQ ID NO: 543631 - DNA, 25 bp, Mus musculus
gcatggtcatggtgagtcccgagat

SEQ ID NO: 543632 - DNA, 25 bp, Mus musculus
gcatggtcattgctctggaatctga

SEQ ID NO: 543633 - DNA, 25 bp, Mus musculus
gcatggtcattggtctggaatctga

SEQ ID NO: 543634 - DNA, 25 bp, Mus musculus
gcatggtcgacactctaaacagcac

SEQ ID NO: 543635 - DNA, 25 bp, Mus musculus
gcatggtcgacagtctaaacagcac

SEQ ID NO: 543636 - DNA, 25 bp, Mus musculus
gcatggtctcgtcctggatcctagg

SEQ ID NO: 543637 - DNA, 25 bp, Mus musculus
gcatggtctcgtgctggatcctagg

SEQ ID NO: 543638 - DNA, 25 bp, Mus musculus
gcatggtgaacacttcattttctcc

SEQ ID NO: 543639 - DNA, 25 bp, Mus musculus
gcatggtgaacagttcattttctcc

SEQ ID NO: 543640 - DNA, 25 bp, Mus musculus
gcatggtgacctcagatcagcaagt

SEQ ID NO: 543641 - DNA, 25 bp, Mus musculus
gcatggtgacctgagatcagcaagt

SEQ ID NO: 543642 - DNA, 25 bp, Mus musculus
gcatggtgattcacacctctattct

SEQ ID NO: 543643 - DNA, 25 bp, Mus musculus
gcatggtgattctcacctctattct

SEQ ID NO: 543644 - DNA, 25 bp, Mus musculus
gcatggtgcaaaaccggatctcaga

SEQ ID NO: 543645 - DNA, 25 bp, Mus musculus
gcatggtgcaaatccggatctcaga

SEQ ID NO: 543646 - DNA, 25 bp, Mus musculus
gcatggtgcctgagacctgcagaaa

SEQ ID NO: 543647 - DNA, 25 bp, Mus musculus
gcatggtgcctgtgacctgcagaaa

SEQ ID NO: 543648 - DNA, 25 bp, Mus musculus
gcatggtgctgaactctttatgtga

SEQ ID NO: 543649 - DNA, 25 bp, Mus musculus
gcatggtgctgatctctttatgtga

SEQ ID NO: 543650 - DNA, 25 bp, Mus musculus
gcatggtgctggaaacagttcaaca

SEQ ID NO: 543651 - DNA, 25 bp, Mus musculus
gcatggtgctggtaacagttcaaca

SEQ ID NO: 543652 - DNA, 25 bp, Mus musculus
gcatggtgcttaaggccccgcgaca

SEQ ID NO: 543653 - DNA, 25 bp, Mus musculus
gcatggtgcttatggccccgcgaca

SEQ ID NO: 543654 - DNA, 25 bp, Mus musculus
gcatggtgctttcataaagtgccag

SEQ ID NO: 543655 - DNA, 25 bp, Mus musculus
gcatggtgctttgataaagtgccag

SEQ ID NO: 543656 - DNA, 25 bp, Mus musculus
gcatggtggacgagatcttcgccga

SEQ ID NO: 543657 - DNA, 25 bp, Mus musculus
gcatggtggacgtgatcttcgccga

SEQ ID NO: 543658 - DNA, 25 bp, Mus musculus
gcatggtggagcagcgtgcctctaa

SEQ ID NO: 543659 - DNA, 25 bp, Mus musculus
gcatggtggagctgcgtgcctctaa

SEQ ID NO: 543660 - DNA, 25 bp, Mus musculus
gcatggtggtggattattcttgact

SEQ ID NO: 543661 - DNA, 25 bp, Mus musculus
gcatggtggtggtttattcttgact

SEQ ID NO: 543662 - DNA, 25 bp, Mus musculus
gcatggtgtcgcatctgttgtacct

SEQ ID NO: 543663 - DNA, 25 bp, Mus musculus
gcatggtgtcgcttctgttgtacct

SEQ ID NO: 543664 - DNA, 25 bp, Mus musculus
gcatggtgtctactcacttaggcaa

SEQ ID NO: 543665 - DNA, 25 bp, Mus musculus
gcatggtgtctagtcacttaggcaa

SEQ ID NO: 543666 - DNA, 25 bp, Mus musculus
gcatggtgtgaacgactggcaataa

SEQ ID NO: 543667 - DNA, 25 bp, Mus musculus
gcatggtgtgaaggactggcaataa

SEQ ID NO: 543668 - DNA, 25 bp, Mus musculus
gcatggtgttatcccaaggaataat

SEQ ID NO: 543669 - DNA, 25 bp, Mus musculus
gcatggtgttatgccaaggaataat

SEQ ID NO: 543670 - DNA, 25 bp, Mus musculus
gcatggtgtttacctctgctttgtt

SEQ ID NO: 543671 - DNA, 25 bp, Mus musculus
gcatggtgtttagctctgctttgtt

SEQ ID NO: 543672 - DNA, 25 bp, Mus musculus
gcatggttatgacgacttacggact

SEQ ID NO: 543673 - DNA, 25 bp, Mus musculus
gcatggttatgaggacttacggact

SEQ ID NO: 543674 - DNA, 25 bp, Mus musculus
gcatggttatgtcaagcacctaaat

SEQ ID NO: 543675 - DNA, 25 bp, Mus musculus
gcatggttatgtgaagcacctaaat

SEQ ID NO: 543676 - DNA, 25 bp, Mus musculus
gcatggttcaacacagtgttaggga

SEQ ID NO: 543677 - DNA, 25 bp, Mus musculus
gcatggttcaactcagtgttaggga

SEQ ID NO: 543678 - DNA, 25 bp, Mus musculus
gcatggttcagcagtggacctgcaa

SEQ ID NO: 543679 - DNA, 25 bp, Mus musculus
gcatggttcagctgtggacctgcaa

SEQ ID NO: 543680 - DNA, 25 bp, Mus musculus
gcatggttctgcatactgtgctgca

SEQ ID NO: 543681 - DNA, 25 bp, Mus musculus
gcatggttctgcttactgtgctgca

SEQ ID NO: 543682 - DNA, 25 bp, Mus musculus
gcatggttctggcttatctggtagc

SEQ ID NO: 543683 - DNA, 25 bp, Mus musculus
gcatggttctgggttatctggtagc

SEQ ID NO: 543684 - DNA, 25 bp, Mus musculus
gcatggttcttaacttctgaaggta

SEQ ID NO: 543685 - DNA, 25 bp, Mus musculus
gcatggttcttatcttctgaaggta

SEQ ID NO: 543686 - DNA, 25 bp, Mus musculus
gcatggttgattccccaggagccct

SEQ ID NO: 543687 - DNA, 25 bp, Mus musculus
gcatggttgattgcccaggagccct

SEQ ID NO: 543688 - DNA, 25 bp, Mus musculus
gcatggttggctcaatactctgata

SEQ ID NO: 543689 - DNA, 25 bp, Mus musculus
gcatggttggctgaatactctgata

SEQ ID NO: 543690 - DNA, 25 bp, Mus musculus
gcatggttgtaaatttttccccagc

SEQ ID NO: 543691 - DNA, 25 bp, Mus musculus
gcatggttgtaattttttccccagc

SEQ ID NO: 543692 - DNA, 25 bp, Mus musculus
gcatggtttttgaattattgcatta

SEQ ID NO: 543693 - DNA, 25 bp, Mus musculus
gcatggtttttgtattattgcatta

SEQ ID NO: 543694 - DNA, 25 bp, Mus musculus
gcatgtaagcacaagacctttgatt

SEQ ID NO: 543695 - DNA, 25 bp, Mus musculus
gcatgtaagcactagacctttgatt

SEQ ID NO: 543696 - DNA, 25 bp, Mus musculus
gcatgtaagttaatgcatttcagag

SEQ ID NO: 543697 - DNA, 25 bp, Mus musculus
gcatgtaagttattgcatttcagag

SEQ ID NO: 543698 - DNA, 25 bp, Mus musculus
gcatgtaatgtacacctagcccatc

SEQ ID NO: 543699 - DNA, 25 bp, Mus musculus
gcatgtaatgtagacctagcccatc

SEQ ID NO: 543700 - DNA, 25 bp, Mus musculus
gcatgtacaaccagctgggtcatat

SEQ ID NO: 543701 - DNA, 25 bp, Mus musculus
gcatgtacaacctgctgggtcatat

SEQ ID NO: 543702 - DNA, 25 bp, Mus musculus
gcatgtacaagactgttcgcgccaa

SEQ ID NO: 543703 - DNA, 25 bp, Mus musculus
gcatgtacaagagtgttcgcgccaa

SEQ ID NO: 543704 - DNA, 25 bp, Mus musculus
gcatgtacagccacatgaccgagtg

SEQ ID NO: 543705 - DNA, 25 bp, Mus musculus
gcatgtacagcctcatgaccgagtg

SEQ ID NO: 543706 - DNA, 25 bp, Mus musculus
gcatgtacagggatcaaagccatct

SEQ ID NO: 543707 - DNA, 25 bp, Mus musculus
gcatgtacagggttcaaagccatct

SEQ ID NO: 543708 - DNA, 25 bp, Mus musculus
gcatgtacataaattcacacgggac

SEQ ID NO: 543709 - DNA, 25 bp, Mus musculus
gcatgtacataatttcacacgggac

SEQ ID NO: 543710 - DNA, 25 bp, Mus musculus
gcatgtaccggtacattttgtttta

SEQ ID NO: 543711 - DNA, 25 bp, Mus musculus
gcatgtaccggttcattttgtttta

SEQ ID NO: 543712 - DNA, 25 bp, Mus musculus
gcatgtacgatgaaatgacaaccat

SEQ ID NO: 543713 - DNA, 25 bp, Mus musculus
gcatgtacgatgtaatgacaaccat

SEQ ID NO: 543714 - DNA, 25 bp, Mus musculus
gcatgtactgcaatgtccttctata

SEQ ID NO: 543715 - DNA, 25 bp, Mus musculus
gcatgtactgcattgtccttctata

SEQ ID NO: 543716 - DNA, 25 bp, Mus musculus
gcatgtactgtactccagagctgtt

SEQ ID NO: 543717 - DNA, 25 bp, Mus musculus
gcatgtactgtagtccagagctgtt

SEQ ID NO: 543718 - DNA, 25 bp, Mus musculus
gcatgtacttttcgcctgactggaa

SEQ ID NO: 543719 - DNA, 25 bp, Mus musculus
gcatgtacttttggcctgactggaa

SEQ ID NO: 543720 - DNA, 25 bp, Mus musculus
gcatgtagaccacggctcgtgagca

SEQ ID NO: 543721 - DNA, 25 bp, Mus musculus
gcatgtagaccagggctcgtgagca

SEQ ID NO: 543722 - DNA, 25 bp, Mus musculus
gcatgtagccttatttagtaacctt

SEQ ID NO: 543723 - DNA, 25 bp, Mus musculus
gcatgtagccttttttagtaacctt

SEQ ID NO: 543724 - DNA, 25 bp, Mus musculus
gcatgtagcgctagggacttttcaa

SEQ ID NO: 543725 - DNA, 25 bp, Mus musculus
gcatgtagcgcttgggacttttcaa

SEQ ID NO: 543726 - DNA, 25 bp, Mus musculus
gcatgtagctctagcttttttgctg

SEQ ID NO: 543727 - DNA, 25 bp, Mus musculus
gcatgtagctcttgcttttttgctg

SEQ ID NO: 543728 - DNA, 25 bp, Mus musculus
gcatgtagctgtcaggtgctctgca

SEQ ID NO: 543729 - DNA, 25 bp, Mus musculus
gcatgtagctgtgaggtgctctgca

SEQ ID NO: 543730 - DNA, 25 bp, Mus musculus
gcatgtaggacacacatccccaaga

SEQ ID NO: 543731 - DNA, 25 bp, Mus musculus
gcatgtaggacacacgtttttaaag

SEQ ID NO: 543732 - DNA, 25 bp, Mus musculus
gcatgtaggacagacatccccaaga

SEQ ID NO: 543733 - DNA, 25 bp, Mus musculus
gcatgtaggacagacgtttttaaag

SEQ ID NO: 543734 - DNA, 25 bp, Mus musculus
gcatgtagggtaaccaggtgagtca

SEQ ID NO: 543735 - DNA, 25 bp, Mus musculus
gcatgtagggtatccaggtgagtca

SEQ ID NO: 543736 - DNA, 25 bp, Mus musculus
gcatgtagtagccattcctgatcat

SEQ ID NO: 543737 - DNA, 25 bp, Mus musculus
gcatgtagtagcgattcctgatcat

SEQ ID NO: 543738 - DNA, 25 bp, Mus musculus
gcatgtagtcaactctcaaattatt

SEQ ID NO: 543739 - DNA, 25 bp, Mus musculus
gcatgtagtcaagtctcaaattatt

SEQ ID NO: 543740 - DNA, 25 bp, Mus musculus
gcatgtagtcccatttatagtctta

SEQ ID NO: 543741 - DNA, 25 bp, Mus musculus
gcatgtagtcccttttatagtctta

SEQ ID NO: 543742 - DNA, 25 bp, Mus musculus
gcatgtagtgccaaaagttttccct

SEQ ID NO: 543743 - DNA, 25 bp, Mus musculus
gcatgtagtgcctaaagttttccct

SEQ ID NO: 543744 - DNA, 25 bp, Mus musculus
gcatgtagttatatagtcccatatt

SEQ ID NO: 543745 - DNA, 25 bp, Mus musculus
gcatgtagttatttagtcccatatt

SEQ ID NO: 543746 - DNA, 25 bp, Mus musculus
gcatgtataaggctgtggcttcaac

SEQ ID NO: 543747 - DNA, 25 bp, Mus musculus
gcatgtataagggtgtggcttcaac

SEQ ID NO: 543748 - DNA, 25 bp, Mus musculus
gcatgtatcactcttgcctgagaat

SEQ ID NO: 543749 - DNA, 25 bp, Mus musculus
gcatgtatcactgttgcctgagaat

SEQ ID NO: 543750 - DNA, 25 bp, Mus musculus
gcatgtatcattactctgtattcag

SEQ ID NO: 543751 - DNA, 25 bp, Mus musculus
gcatgtatcatttctctgtattcag

SEQ ID NO: 543752 - DNA, 25 bp, Mus musculus
gcatgtatgcatcctttgcttaggg

SEQ ID NO: 543753 - DNA, 25 bp, Mus musculus
gcatgtatgcatgctttgcttaggg

SEQ ID NO: 543754 - DNA, 25 bp, Mus musculus
gcatgtatgctgcaaaatctctgaa

SEQ ID NO: 543755 - DNA, 25 bp, Mus musculus
gcatgtatgctggaaaatctctgaa

SEQ ID NO: 543756 - DNA, 25 bp, Mus musculus
gcatgtatggctccacatcataagc

SEQ ID NO: 543757 - DNA, 25 bp, Mus musculus
gcatgtatggctgcacatcataagc

SEQ ID NO: 543758 - DNA, 25 bp, Mus musculus
gcatgtatgtatagtcaacctaaca

SEQ ID NO: 543759 - DNA, 25 bp, Mus musculus
gcatgtatgtattgtcaacctaaca

SEQ ID NO: 543760 - DNA, 25 bp, Mus musculus
gcatgtattatgagttcagaaccta

SEQ ID NO: 543761 - DNA, 25 bp, Mus musculus
gcatgtattatgtgttcagaaccta

SEQ ID NO: 543762 - DNA, 25 bp, Mus musculus
gcatgtattccaatctaaacttctg

SEQ ID NO: 543763 - DNA, 25 bp, Mus musculus
gcatgtattccattctaaacttctg

SEQ ID NO: 543764 - DNA, 25 bp, Mus musculus
gcatgtattccgaaatcttcctcag

SEQ ID NO: 543765 - DNA, 25 bp, Mus musculus
gcatgtattccgtaatcttcctcag

SEQ ID NO: 543766 - DNA, 25 bp, Mus musculus
gcatgtattgataagccccacctta

SEQ ID NO: 543767 - DNA, 25 bp, Mus musculus
gcatgtattgattagccccacctta

SEQ ID NO: 543768 - DNA, 25 bp, Mus musculus
gcatgtattgctaaggctcctttct

SEQ ID NO: 543769 - DNA, 25 bp, Mus musculus
gcatgtattgctatgcctgacattt

SEQ ID NO: 543770 - DNA, 25 bp, Mus musculus
gcatgtattgcttaggctcctttct

SEQ ID NO: 543771 - DNA, 25 bp, Mus musculus
gcatgtattgctttgcctgacattt

SEQ ID NO: 543772 - DNA, 25 bp, Mus musculus
gcatgtcaacagcttttccttcttt

SEQ ID NO: 543773 - DNA, 25 bp, Mus musculus
gcatgtcaacaggttttccttcttt

SEQ ID NO: 543774 - DNA, 25 bp, Mus musculus
gcatgtcaccaactgaaaccgtttt

SEQ ID NO: 543775 - DNA, 25 bp, Mus musculus
gcatgtcaccaagtgaaaccgtttt

SEQ ID NO: 543776 - DNA, 25 bp, Mus musculus
gcatgtcactatccagatacctgta

SEQ ID NO: 543777 - DNA, 25 bp, Mus musculus
gcatgtcactatgcagatacctgta

SEQ ID NO: 543778 - DNA, 25 bp, Mus musculus
gcatgtcactgtcactttaggcccc

SEQ ID NO: 543779 - DNA, 25 bp, Mus musculus
gcatgtcactgtgactttaggcccc

SEQ ID NO: 543780 - DNA, 25 bp, Mus musculus
gcatgtcaggaactctccttcactg

SEQ ID NO: 543781 - DNA, 25 bp, Mus musculus
gcatgtcaggaagtctccttcactg

SEQ ID NO: 543782 - DNA, 25 bp, Mus musculus
gcatgtcatgtgatcgatactcagt

SEQ ID NO: 543783 - DNA, 25 bp, Mus musculus
gcatgtcatgtgttcgatactcagt

SEQ ID NO: 543784 - DNA, 25 bp, Mus musculus
gcatgtccacatatacacagaagat

SEQ ID NO: 543785 - DNA, 25 bp, Mus musculus
gcatgtccacatttacacagaagat

SEQ ID NO: 543786 - DNA, 25 bp, Mus musculus
gcatgtccactgactcagaagttcg

SEQ ID NO: 543787 - DNA, 25 bp, Mus musculus
gcatgtccactgtctcagaagttcg

SEQ ID NO: 543788 - DNA, 25 bp, Mus musculus
gcatgtccaggtctcacatagctag

SEQ ID NO: 543789 - DNA, 25 bp, Mus musculus
gcatgtccaggtgtcacatagctag

SEQ ID NO: 543790 - DNA, 25 bp, Mus musculus
gcatgtccatccaccagtgtaagat

SEQ ID NO: 543791 - DNA, 25 bp, Mus musculus
gcatgtccatcctccagtgtaagat

SEQ ID NO: 543792 - DNA, 25 bp, Mus musculus
gcatgtccatctctcagtgcaaaat

SEQ ID NO: 543793 - DNA, 25 bp, Mus musculus
gcatgtccatctgtcagtgcaaaat

SEQ ID NO: 543794 - DNA, 25 bp, Mus musculus
gcatgtccatgcatatcagactggt

SEQ ID NO: 543795 - DNA, 25 bp, Mus musculus
gcatgtccatgcttatcagactggt

SEQ ID NO: 543796 - DNA, 25 bp, Mus musculus
gcatgtccccagattgacttaatta

SEQ ID NO: 543797 - DNA, 25 bp, Mus musculus
gcatgtccccagtttgacttaatta

SEQ ID NO: 543798 - DNA, 25 bp, Mus musculus
gcatgtcccctgaagatggcattga

SEQ ID NO: 543799 - DNA, 25 bp, Mus musculus
gcatgtcccctgtagatggcattga

SEQ ID NO: 543800 - DNA, 25 bp, Mus musculus
gcatgtccctggagaagcggagatt

SEQ ID NO: 543801 - DNA, 25 bp, Mus musculus
gcatgtccctggtgaagcggagatt

SEQ ID NO: 543802 - DNA, 25 bp, Mus musculus
gcatgtcctgacatcaaggaaccgg

SEQ ID NO: 543803 - DNA, 25 bp, Mus musculus
gcatgtcctgacttcaaggaaccgg

SEQ ID NO: 543804 - DNA, 25 bp, Mus musculus
gcatgtcctgccacaggatttgcta

SEQ ID NO: 543805 - DNA, 25 bp, Mus musculus
gcatgtcctgcctcaggatttgcta

SEQ ID NO: 543806 - DNA, 25 bp, Mus musculus
gcatgtcctgtaacaatatcctgag

SEQ ID NO: 543807 - DNA, 25 bp, Mus musculus
gcatgtcctgtatcaatatcctgag

SEQ ID NO: 543808 - DNA, 25 bp, Mus musculus
gcatgtccttctcctgaatttgagt

SEQ ID NO: 543809 - DNA, 25 bp, Mus musculus
gcatgtccttctgctgaatttgagt

SEQ ID NO: 543810 - DNA, 25 bp, Mus musculus
gcatgtcgccatcacttaaaagttc

SEQ ID NO: 543811 - DNA, 25 bp, Mus musculus
gcatgtcgccatgacttaaaagttc

SEQ ID NO: 543812 - DNA, 25 bp, Mus musculus
gcatgtcgtgttccacttcaacgaa

SEQ ID NO: 543813 - DNA, 25 bp, Mus musculus
gcatgtcgtgttgcacttcaacgaa

SEQ ID NO: 543814 - DNA, 25 bp, Mus musculus
gcatgtctaataactgggagtctcc

SEQ ID NO: 543815 - DNA, 25 bp, Mus musculus
gcatgtctaatatctgggagtctcc

SEQ ID NO: 543816 - DNA, 25 bp, Mus musculus
gcatgtctactaatttttgtcttgt

SEQ ID NO: 543817 - DNA, 25 bp, Mus musculus
gcatgtctactattttttgtcttgt

SEQ ID NO: 543818 - DNA, 25 bp, Mus musculus
gcatgtctcataaacccgaaagcca

SEQ ID NO: 543819 - DNA, 25 bp, Mus musculus
gcatgtctcatatacccgaaagcca

SEQ ID NO: 543820 - DNA, 25 bp, Mus musculus
gcatgtctcgtcagagtgcccggat

SEQ ID NO: 543821 - DNA, 25 bp, Mus musculus
gcatgtctcgtctgagtgcccggat

SEQ ID NO: 543822 - DNA, 25 bp, Mus musculus
gcatgtctcttcctatttggctgat

SEQ ID NO: 543823 - DNA, 25 bp, Mus musculus
gcatgtctcttcgtatttggctgat

SEQ ID NO: 543824 - DNA, 25 bp, Mus musculus
gcatgtctgagccatgattatccta

SEQ ID NO: 543825 - DNA, 25 bp, Mus musculus
gcatgtctgagcgatgattatccta

SEQ ID NO: 543826 - DNA, 25 bp, Mus musculus
gcatgtctgcctagtgtctaaggag

SEQ ID NO: 543827 - DNA, 25 bp, Mus musculus
gcatgtctgccttgtgtctaaggag

SEQ ID NO: 543828 - DNA, 25 bp, Mus musculus
gcatgtctgcgcacatgtgtgaaca

SEQ ID NO: 543829 - DNA, 25 bp, Mus musculus
gcatgtctgcgctcatgtgtgaaca

SEQ ID NO: 543830 - DNA, 25 bp, Mus musculus
gcatgtctgtagatggtttttcaga

SEQ ID NO: 543831 - DNA, 25 bp, Mus musculus
gcatgtctgtagcagattgccttaa

SEQ ID NO: 543832 - DNA, 25 bp, Mus musculus
gcatgtctgtaggagattgccttaa

SEQ ID NO: 543833 - DNA, 25 bp, Mus musculus
gcatgtctgtagttggtttttcaga

SEQ ID NO: 543834 - DNA, 25 bp, Mus musculus
gcatgtctgtatagtgctggtggca

SEQ ID NO: 543835 - DNA, 25 bp, Mus musculus
gcatgtctgtattgtgctggtggca

SEQ ID NO: 543836 - DNA, 25 bp, Mus musculus
gcatgtctgtctatatgctgccatg

SEQ ID NO: 543837 - DNA, 25 bp, Mus musculus
gcatgtctgtctttatgctgccatg

SEQ ID NO: 543838 - DNA, 25 bp, Mus musculus
gcatgtctgtttctagtgttacact

SEQ ID NO: 543839 - DNA, 25 bp, Mus musculus
gcatgtctgtttgtagtgttacact

SEQ ID NO: 543840 - DNA, 25 bp, Mus musculus
gcatgtcttaccagcttgaggaaga

SEQ ID NO: 543841 - DNA, 25 bp, Mus musculus
gcatgtcttacctgcttgaggaaga

SEQ ID NO: 543842 - DNA, 25 bp, Mus musculus
gcatgtcttcacaaacctcaggtga

SEQ ID NO: 543843 - DNA, 25 bp, Mus musculus
gcatgtcttcactaacctcaggtga

SEQ ID NO: 543844 - DNA, 25 bp, Mus musculus
gcatgtcttgtaaataggctctagg

SEQ ID NO: 543845 - DNA, 25 bp, Mus musculus
gcatgtcttgtatataggctctagg

SEQ ID NO: 543846 - DNA, 25 bp, Mus musculus
gcatgtctttgcacagaataacaat

SEQ ID NO: 543847 - DNA, 25 bp, Mus musculus
gcatgtctttgctcagaataacaat

SEQ ID NO: 543848 - DNA, 25 bp, Mus musculus
gcatgtgaccaactctagccagctt

SEQ ID NO: 543849 - DNA, 25 bp, Mus musculus
gcatgtgaccaagtctagccagctt

SEQ ID NO: 543850 - DNA, 25 bp, Mus musculus
gcatgtgaccttcttaagcagttcc

SEQ ID NO: 543851 - DNA, 25 bp, Mus musculus
gcatgtgaccttgttaagcagttcc

SEQ ID NO: 543852 - DNA, 25 bp, Mus musculus
gcatgtgactcaatctgggaaggaa

SEQ ID NO: 543853 - DNA, 25 bp, Mus musculus
gcatgtgactcattctgggaaggaa

SEQ ID NO: 543854 - DNA, 25 bp, Mus musculus
gcatgtgactccacagaggccatgg

SEQ ID NO: 543855 - DNA, 25 bp, Mus musculus
gcatgtgactccagttgcagtgtca

SEQ ID NO: 543856 - DNA, 25 bp, Mus musculus
gcatgtgactcctcagaggccatgg

SEQ ID NO: 543857 - DNA, 25 bp, Mus musculus
gcatgtgactcctgttgcagtgtca

SEQ ID NO: 543858 - DNA, 25 bp, Mus musculus
gcatgtgactgtagaatgaggccat

SEQ ID NO: 543859 - DNA, 25 bp, Mus musculus
gcatgtgactgttgaatgaggccat

SEQ ID NO: 543860 - DNA, 25 bp, Mus musculus
gcatgtgagagtacacctttagcta

SEQ ID NO: 543861 - DNA, 25 bp, Mus musculus
gcatgtgagagttcacctttagcta

SEQ ID NO: 543862 - DNA, 25 bp, Mus musculus
gcatgtgagggtctttgaaatggac

SEQ ID NO: 543863 - DNA, 25 bp, Mus musculus
gcatgtgagggtgtttgaaatggac

SEQ ID NO: 543864 - DNA, 25 bp, Mus musculus
gcatgtgaggtacattcaaaacata

SEQ ID NO: 543865 - DNA, 25 bp, Mus musculus
gcatgtgaggtagattcaaaacata

SEQ ID NO: 543866 - DNA, 25 bp, Mus musculus
gcatgtgagtgcaaggcccagagct

SEQ ID NO: 543867 - DNA, 25 bp, Mus musculus
gcatgtgagtgctaggcccagagct

SEQ ID NO: 543868 - DNA, 25 bp, Mus musculus
gcatgtgatgcccactgtttagttg

SEQ ID NO: 543869 - DNA, 25 bp, Mus musculus
gcatgtgatgccgactgtttagttg

SEQ ID NO: 543870 - DNA, 25 bp, Mus musculus
gcatgtgatggcacaggctgaagaa

SEQ ID NO: 543871 - DNA, 25 bp, Mus musculus
gcatgtgatggctcaggctgaagaa

SEQ ID NO: 543872 - DNA, 25 bp, Mus musculus
gcatgtgcaagaatacggctctgat

SEQ ID NO: 543873 - DNA, 25 bp, Mus musculus
gcatgtgcaagattacggctctgat

SEQ ID NO: 543874 - DNA, 25 bp, Mus musculus
gcatgtgcaaggagctcaagcgaca

SEQ ID NO: 543875 - DNA, 25 bp, Mus musculus
gcatgtgcaaggtgctcaagcgaca

SEQ ID NO: 543876 - DNA, 25 bp, Mus musculus
gcatgtgcaagtaggctttttcata

SEQ ID NO: 543877 - DNA, 25 bp, Mus musculus
gcatgtgcaagtctgctccattggg

SEQ ID NO: 543878 - DNA, 25 bp, Mus musculus
gcatgtgcaagtgtgctccattggg

SEQ ID NO: 543879 - DNA, 25 bp, Mus musculus
gcatgtgcaagttggctttttcata

SEQ ID NO: 543880 - DNA, 25 bp, Mus musculus
gcatgtgcacatctagttttgtaac

SEQ ID NO: 543881 - DNA, 25 bp, Mus musculus
gcatgtgcacatctattggaataac

SEQ ID NO: 543882 - DNA, 25 bp, Mus musculus
gcatgtgcacatgtagttttgtaac

SEQ ID NO: 543883 - DNA, 25 bp, Mus musculus
gcatgtgcacatgtattggaataac

SEQ ID NO: 543884 - DNA, 25 bp, Mus musculus
gcatgtgcagccagggcgacagcat

SEQ ID NO: 543885 - DNA, 25 bp, Mus musculus
gcatgtgcagcctgggcgacagcat

SEQ ID NO: 543886 - DNA, 25 bp, Mus musculus
gcatgtgcataaacagactggaacg

SEQ ID NO: 543887 - DNA, 25 bp, Mus musculus
gcatgtgcataatcagactggaacg

SEQ ID NO: 543888 - DNA, 25 bp, Mus musculus
gcatgtgcatgaactcaagcaacgt

SEQ ID NO: 543889 - DNA, 25 bp, Mus musculus
gcatgtgcatgatctcaagcaacgt

SEQ ID NO: 543890 - DNA, 25 bp, Mus musculus
gcatgtgcattactgagcctttaaa

SEQ ID NO: 543891 - DNA, 25 bp, Mus musculus
gcatgtgcattagtgagcctttaaa

SEQ ID NO: 543892 - DNA, 25 bp, Mus musculus
gcatgtgccccaagaaccgttaaag

SEQ ID NO: 543893 - DNA, 25 bp, Mus musculus
gcatgtgccccatgaaccgttaaag

SEQ ID NO: 543894 - DNA, 25 bp, Mus musculus
gcatgtgcccttatatatccatatc

SEQ ID NO: 543895 - DNA, 25 bp, Mus musculus
gcatgtgcccttttatatccatatc

SEQ ID NO: 543896 - DNA, 25 bp, Mus musculus
gcatgtgcgtatagaagcagcttca

SEQ ID NO: 543897 - DNA, 25 bp, Mus musculus
gcatgtgcgtattgaagcagcttca

SEQ ID NO: 543898 - DNA, 25 bp, Mus musculus
gcatgtgcgttcattgaagtgtaat

SEQ ID NO: 543899 - DNA, 25 bp, Mus musculus
gcatgtgcgttctttgaagtgtaat

SEQ ID NO: 543900 - DNA, 25 bp, Mus musculus
gcatgtgctacacggtgtggccata

SEQ ID NO: 543901 - DNA, 25 bp, Mus musculus
gcatgtgctacagggtgtggccata

SEQ ID NO: 543902 - DNA, 25 bp, Mus musculus
gcatgtgctacgagacaacagtcta

SEQ ID NO: 543903 - DNA, 25 bp, Mus musculus
gcatgtgctacgtgacaacagtcta

SEQ ID NO: 543904 - DNA, 25 bp, Mus musculus
gcatgtgctagtcccaatggtcaga

SEQ ID NO: 543905 - DNA, 25 bp, Mus musculus
gcatgtgctagtgccaatggtcaga

SEQ ID NO: 543906 - DNA, 25 bp, Mus musculus
gcatgtgctcaacagtattcagctt

SEQ ID NO: 543907 - DNA, 25 bp, Mus musculus
gcatgtgctcaagagtattcagctt

SEQ ID NO: 543908 - DNA, 25 bp, Mus musculus
gcatgtgctcacagtaatttttaat

SEQ ID NO: 543909 - DNA, 25 bp, Mus musculus
gcatgtgctcactgtaatttttaat

SEQ ID NO: 543910 - DNA, 25 bp, Mus musculus
gcatgtgctgggaagacctatcaac

SEQ ID NO: 543911 - DNA, 25 bp, Mus musculus
gcatgtgctgggtagacctatcaac

SEQ ID NO: 543912 - DNA, 25 bp, Mus musculus
gcatgtgcttaacgatatgtctcac

SEQ ID NO: 543913 - DNA, 25 bp, Mus musculus
gcatgtgcttaaggatatgtctcac

SEQ ID NO: 543914 - DNA, 25 bp, Mus musculus
gcatgtgcttatagatgtgggaacc

SEQ ID NO: 543915 - DNA, 25 bp, Mus musculus
gcatgtgcttattgatgtgggaacc

SEQ ID NO: 543916 - DNA, 25 bp, Mus musculus
gcatgtgcttcaaaatcagaaccga

SEQ ID NO: 543917 - DNA, 25 bp, Mus musculus
gcatgtgcttcataatcagaaccga

SEQ ID NO: 543918 - DNA, 25 bp, Mus musculus
gcatgtgcttgcaatcagactgtaa

SEQ ID NO: 543919 - DNA, 25 bp, Mus musculus
gcatgtgcttgctatcagactgtaa

SEQ ID NO: 543920 - DNA, 25 bp, Mus musculus
gcatgtggagccacaagtaaaacaa

SEQ ID NO: 543921 - DNA, 25 bp, Mus musculus
gcatgtggagcctcaagtaaaacaa

SEQ ID NO: 543922 - DNA, 25 bp, Mus musculus
gcatgtggatcccaccaggtggtaa

SEQ ID NO: 543923 - DNA, 25 bp, Mus musculus
gcatgtggatccgaccaggtggtaa

SEQ ID NO: 543924 - DNA, 25 bp, Mus musculus
gcatgtggcactaagaataggtctg

SEQ ID NO: 543925 - DNA, 25 bp, Mus musculus
gcatgtggcacttagaataggtctg

SEQ ID NO: 543926 - DNA, 25 bp, Mus musculus
gcatgtggcccaaatatgagtatac

SEQ ID NO: 543927 - DNA, 25 bp, Mus musculus
gcatgtggcccatatatgagtatac

SEQ ID NO: 543928 - DNA, 25 bp, Mus musculus
gcatgtggcgagagtttattgttta

SEQ ID NO: 543929 - DNA, 25 bp, Mus musculus
gcatgtggcgagtgtttattgttta

SEQ ID NO: 543930 - DNA, 25 bp, Mus musculus
gcatgtggctccaggcgttgtgtct

SEQ ID NO: 543931 - DNA, 25 bp, Mus musculus
gcatgtggctcctggcgttgtgtct

SEQ ID NO: 543932 - DNA, 25 bp, Mus musculus
gcatgtgggcaccattttgtactta

SEQ ID NO: 543933 - DNA, 25 bp, Mus musculus
gcatgtgggcacgattttgtactta

SEQ ID NO: 543934 - DNA, 25 bp, Mus musculus
gcatgtgggccacattgcaaggcca

SEQ ID NO: 543935 - DNA, 25 bp, Mus musculus
gcatgtgggccagattgcaaggcca

SEQ ID NO: 543936 - DNA, 25 bp, Mus musculus
gcatgtggtcaaagtggacatccag

SEQ ID NO: 543937 - DNA, 25 bp, Mus musculus
gcatgtggtcaatgtggacatccag

SEQ ID NO: 543938 - DNA, 25 bp, Mus musculus
gcatgtggtgccactacttgtaaat

SEQ ID NO: 543939 - DNA, 25 bp, Mus musculus
gcatgtggtgcctctacttgtaaat

SEQ ID NO: 543940 - DNA, 25 bp, Mus musculus
gcatgtgtaccacgtacatacctag

SEQ ID NO: 543941 - DNA, 25 bp, Mus musculus
gcatgtgtaccaggtacatacctag

SEQ ID NO: 543942 - DNA, 25 bp, Mus musculus
gcatgtgtagctacagtattgactt

SEQ ID NO: 543943 - DNA, 25 bp, Mus musculus
gcatgtgtagcttcagtattgactt

SEQ ID NO: 543944 - DNA, 25 bp, Mus musculus
gcatgtgtccagaggcgagttctag

SEQ ID NO: 543945 - DNA, 25 bp, Mus musculus
gcatgtgtccagcaatcacactgag

SEQ ID NO: 543946 - DNA, 25 bp, Mus musculus
gcatgtgtccaggaatcacactgag

SEQ ID NO: 543947 - DNA, 25 bp, Mus musculus
gcatgtgtccagtggcgagttctag

SEQ ID NO: 543948 - DNA, 25 bp, Mus musculus
gcatgtgtcggtacttatttccttt

SEQ ID NO: 543949 - DNA, 25 bp, Mus musculus
gcatgtgtcggttcttatttccttt

SEQ ID NO: 543950 - DNA, 25 bp, Mus musculus
gcatgtgtcgtaattggctggctct

SEQ ID NO: 543951 - DNA, 25 bp, Mus musculus
gcatgtgtcgtatttggctggctct

SEQ ID NO: 543952 - DNA, 25 bp, Mus musculus
gcatgtgtctcaagttcccattttc

SEQ ID NO: 543953 - DNA, 25 bp, Mus musculus
gcatgtgtctcatgttcccattttc

SEQ ID NO: 543954 - DNA, 25 bp, Mus musculus
gcatgtgtctgtatccatcatggta

SEQ ID NO: 543955 - DNA, 25 bp, Mus musculus
gcatgtgtctgtccattctgattag

SEQ ID NO: 543956 - DNA, 25 bp, Mus musculus
gcatgtgtctgtgcattctgattag

SEQ ID NO: 543957 - DNA, 25 bp, Mus musculus
gcatgtgtctgtttccatcatggta

SEQ ID NO: 543958 - DNA, 25 bp, Mus musculus
gcatgtgtgactactctgggtttca

SEQ ID NO: 543959 - DNA, 25 bp, Mus musculus
gcatgtgtgacttctctgggtttca

SEQ ID NO: 543960 - DNA, 25 bp, Mus musculus
gcatgtgtgaggctctaaatttaaa

SEQ ID NO: 543961 - DNA, 25 bp, Mus musculus
gcatgtgtgagggtctaaatttaaa

SEQ ID NO: 543962 - DNA, 25 bp, Mus musculus
gcatgtgtgcgtctctggttgccac

SEQ ID NO: 543963 - DNA, 25 bp, Mus musculus
gcatgtgtgcgtgtctggttgccac

SEQ ID NO: 543964 - DNA, 25 bp, Mus musculus
gcatgtgtggctatgcctcacaaaa

SEQ ID NO: 543965 - DNA, 25 bp, Mus musculus
gcatgtgtggctttgcctcacaaaa

SEQ ID NO: 543966 - DNA, 25 bp, Mus musculus
gcatgtgtgttaaagtctacagcca

SEQ ID NO: 543967 - DNA, 25 bp, Mus musculus
gcatgtgtgttatagtctacagcca

SEQ ID NO: 543968 - DNA, 25 bp, Mus musculus
gcatgtgtgttcatgcctttagaga

SEQ ID NO: 543969 - DNA, 25 bp, Mus musculus
gcatgtgtgttcttgcctttagaga

SEQ ID NO: 543970 - DNA, 25 bp, Mus musculus
gcatgtgttagaaaccttgggcagt

SEQ ID NO: 543971 - DNA, 25 bp, Mus musculus
gcatgtgttagataccttgggcagt

SEQ ID NO: 543972 - DNA, 25 bp, Mus musculus
gcatgtgttattccgtatattccaa

SEQ ID NO: 543973 - DNA, 25 bp, Mus musculus
gcatgtgttattgcgtatattccaa

SEQ ID NO: 543974 - DNA, 25 bp, Mus musculus
gcatgtgttcatagatctctctctc

SEQ ID NO: 543975 - DNA, 25 bp, Mus musculus
gcatgtgttcattgatctctctctc

SEQ ID NO: 543976 - DNA, 25 bp, Mus musculus
gcatgtgttccaaggagagcgcccc

SEQ ID NO: 543977 - DNA, 25 bp, Mus musculus
gcatgtgttccacccgacgatcgca

SEQ ID NO: 543978 - DNA, 25 bp, Mus musculus
gcatgtgttccagccgacgatcgca

SEQ ID NO: 543979 - DNA, 25 bp, Mus musculus
gcatgtgttccatggagagcgcccc

SEQ ID NO: 543980 - DNA, 25 bp, Mus musculus
gcatgtgttcctagatggtcccaaa

SEQ ID NO: 543981 - DNA, 25 bp, Mus musculus
gcatgtgttccttgatggtcccaaa

SEQ ID NO: 543982 - DNA, 25 bp, Mus musculus
gcatgtgttgtgacacccaactgtc

SEQ ID NO: 543983 - DNA, 25 bp, Mus musculus
gcatgtgttgtgtcacccaactgtc

SEQ ID NO: 543984 - DNA, 25 bp, Mus musculus
gcatgttaaactaaccctagtcctt

SEQ ID NO: 543985 - DNA, 25 bp, Mus musculus
gcatgttaaactatccctgcatctc

SEQ ID NO: 543986 - DNA, 25 bp, Mus musculus
gcatgttaaacttaccctagtcctt

SEQ ID NO: 543987 - DNA, 25 bp, Mus musculus
gcatgttaaactttccctgcatctc

SEQ ID NO: 543988 - DNA, 25 bp, Mus musculus
gcatgttaacttaatggtacttatc

SEQ ID NO: 543989 - DNA, 25 bp, Mus musculus
gcatgttaactttatggtacttatc

SEQ ID NO: 543990 - DNA, 25 bp, Mus musculus
gcatgttaagcactgtagccaagaa

SEQ ID NO: 543991 - DNA, 25 bp, Mus musculus
gcatgttaagcagtgtagccaagaa

SEQ ID NO: 543992 - DNA, 25 bp, Mus musculus
gcatgttaatatctttcgttatggg

SEQ ID NO: 543993 - DNA, 25 bp, Mus musculus
gcatgttaatatgtttcgttatggg

SEQ ID NO: 543994 - DNA, 25 bp, Mus musculus
gcatgttaatctaatgtgaaacttc

SEQ ID NO: 543995 - DNA, 25 bp, Mus musculus
gcatgttaatcttatgtgaaacttc

SEQ ID NO: 543996 - DNA, 25 bp, Mus musculus
gcatgttaccccaaattagcttctc

SEQ ID NO: 543997 - DNA, 25 bp, Mus musculus
gcatgttacccctaattagcttctc

SEQ ID NO: 543998 - DNA, 25 bp, Mus musculus
gcatgttaccgaagactgtgtgttc

SEQ ID NO: 543999 - DNA, 25 bp, Mus musculus
gcatgttaccgatgactgtgtgttc

SEQ ID NO: 544000 - DNA, 25 bp, Mus musculus
gcatgttagcttcctctccccaagc

SEQ ID NO: 544001 - DNA, 25 bp, Mus musculus
gcatgttagcttgctctccccaagc

SEQ ID NO: 544002 - DNA, 25 bp, Mus musculus
gcatgttagtatacccagtactcac

SEQ ID NO: 544003 - DNA, 25 bp, Mus musculus
gcatgttagtattcccagtactcac

SEQ ID NO: 544004 - DNA, 25 bp, Mus musculus
gcatgttagtgtcggcacgctgtta

SEQ ID NO: 544005 - DNA, 25 bp, Mus musculus
gcatgttagtgtgggcacgctgtta

SEQ ID NO: 544006 - DNA, 25 bp, Mus musculus
gcatgttataccatgcccaacatca

SEQ ID NO: 544007 - DNA, 25 bp, Mus musculus
gcatgttataccttgcccaacatca

SEQ ID NO: 544008 - DNA, 25 bp, Mus musculus
gcatgttatagcacacattcctgga

SEQ ID NO: 544009 - DNA, 25 bp, Mus musculus
gcatgttatagctcacattcctgga

SEQ ID NO: 544010 - DNA, 25 bp, Mus musculus
gcatgttatgagaaggaaacttact

SEQ ID NO: 544011 - DNA, 25 bp, Mus musculus
gcatgttatgagtaggaaacttact

SEQ ID NO: 544012 - DNA, 25 bp, Mus musculus
gcatgttcaagtattctctctttac

SEQ ID NO: 544013 - DNA, 25 bp, Mus musculus
gcatgttcaagtattgatgttccga

SEQ ID NO: 544014 - DNA, 25 bp, Mus musculus
gcatgttcaagttttctctctttac

SEQ ID NO: 544015 - DNA, 25 bp, Mus musculus
gcatgttcaagttttgatgttccga

SEQ ID NO: 544016 - DNA, 25 bp, Mus musculus
gcatgttcacaactgtgcgcggaca

SEQ ID NO: 544017 - DNA, 25 bp, Mus musculus
gcatgttcacaagtgtgcgcggaca

SEQ ID NO: 544018 - DNA, 25 bp, Mus musculus
gcatgttcacctaaaacggttcctt

SEQ ID NO: 544019 - DNA, 25 bp, Mus musculus
gcatgttcaccttaaacggttcctt

SEQ ID NO: 544020 - DNA, 25 bp, Mus musculus
gcatgttcaggtccctgggttcatt

SEQ ID NO: 544021 - DNA, 25 bp, Mus musculus
gcatgttcaggtgcctgggttcatt

SEQ ID NO: 544022 - DNA, 25 bp, Mus musculus
gcatgttcatgaagagcaagctcat

SEQ ID NO: 544023 - DNA, 25 bp, Mus musculus
gcatgttcatgatgagcaagctcat

SEQ ID NO: 544024 - DNA, 25 bp, Mus musculus
gcatgttcctggacaacgcaagcct

SEQ ID NO: 544025 - DNA, 25 bp, Mus musculus
gcatgttcctggtcaacgcaagcct

SEQ ID NO: 544026 - DNA, 25 bp, Mus musculus
gcatgttcgctgaatataactcttg

SEQ ID NO: 544027 - DNA, 25 bp, Mus musculus
gcatgttcgctgtatataactcttg

SEQ ID NO: 544028 - DNA, 25 bp, Mus musculus
gcatgttcgttaattctaacagaca

SEQ ID NO: 544029 - DNA, 25 bp, Mus musculus
gcatgttcgttatttctaacagaca

SEQ ID NO: 544030 - DNA, 25 bp, Mus musculus
gcatgttctcatcacagactctgaa

SEQ ID NO: 544031 - DNA, 25 bp, Mus musculus
gcatgttctcatgacagactctgaa

SEQ ID NO: 544032 - DNA, 25 bp, Mus musculus
gcatgttctcttaactgctatgaaa

SEQ ID NO: 544033 - DNA, 25 bp, Mus musculus
gcatgttctctttactgctatgaaa

SEQ ID NO: 544034 - DNA, 25 bp, Mus musculus
gcatgttctgaaatagactctagat

SEQ ID NO: 544035 - DNA, 25 bp, Mus musculus
gcatgttctgaattagactctagat

SEQ ID NO: 544036 - DNA, 25 bp, Mus musculus
gcatgttctgatcgccttcctagta

SEQ ID NO: 544037 - DNA, 25 bp, Mus musculus
gcatgttctgatggccttcctagta

SEQ ID NO: 544038 - DNA, 25 bp, Mus musculus
gcatgttcttgtatccaaaacctca

SEQ ID NO: 544039 - DNA, 25 bp, Mus musculus
gcatgttcttgtttccaaaacctca

SEQ ID NO: 544040 - DNA, 25 bp, Mus musculus
gcatgttctttgcagctgtatcttg

SEQ ID NO: 544041 - DNA, 25 bp, Mus musculus
gcatgttctttggagctgtatcttg

SEQ ID NO: 544042 - DNA, 25 bp, Mus musculus
gcatgttcttttaccaccagcatat

SEQ ID NO: 544043 - DNA, 25 bp, Mus musculus
gcatgttctttttccaccagcatat

SEQ ID NO: 544044 - DNA, 25 bp, Mus musculus
gcatgttgagcacccgtaccacact

SEQ ID NO: 544045 - DNA, 25 bp, Mus musculus
gcatgttgagcagccgtaccacact

SEQ ID NO: 544046 - DNA, 25 bp, Mus musculus
gcatgttgaggtccttctgtgatgt

SEQ ID NO: 544047 - DNA, 25 bp, Mus musculus
gcatgttgaggtgcttctgtgatgt

SEQ ID NO: 544048 - DNA, 25 bp, Mus musculus
gcatgttgcaaactgatctatgtga

SEQ ID NO: 544049 - DNA, 25 bp, Mus musculus
gcatgttgcaaagtgatctatgtga

SEQ ID NO: 544050 - DNA, 25 bp, Mus musculus
gcatgttgccttctttctgcttaaa

SEQ ID NO: 544051 - DNA, 25 bp, Mus musculus
gcatgttgccttgtttctgcttaaa

SEQ ID NO: 544052 - DNA, 25 bp, Mus musculus
gcatgttgtaaactctctgcctctc

SEQ ID NO: 544053 - DNA, 25 bp, Mus musculus
gcatgttgtaaagtctctgcctctc

SEQ ID NO: 544054 - DNA, 25 bp, Mus musculus
gcatgtttaaatatgttccttatac

SEQ ID NO: 544055 - DNA, 25 bp, Mus musculus
gcatgtttaaatttgttccttatac

SEQ ID NO: 544056 - DNA, 25 bp, Mus musculus
gcatgtttaagcctttcatcccagt

SEQ ID NO: 544057 - DNA, 25 bp, Mus musculus
gcatgtttaagcgtttcatcccagt

SEQ ID NO: 544058 - DNA, 25 bp, Mus musculus
gcatgtttaccaaatgacaagcaga

SEQ ID NO: 544059 - DNA, 25 bp, Mus musculus
gcatgtttaccatatgacaagcaga

SEQ ID NO: 544060 - DNA, 25 bp, Mus musculus
gcatgtttaccccttttctgattgt

SEQ ID NO: 544061 - DNA, 25 bp, Mus musculus
gcatgtttacccgttttctgattgt

SEQ ID NO: 544062 - DNA, 25 bp, Mus musculus
gcatgtttaggaagcctcctgtctt

SEQ ID NO: 544063 - DNA, 25 bp, Mus musculus
gcatgtttaggatgcctcctgtctt

SEQ ID NO: 544064 - DNA, 25 bp, Mus musculus
gcatgtttctgacattctcatagtc

SEQ ID NO: 544065 - DNA, 25 bp, Mus musculus
gcatgtttctgagattctcatagtc

SEQ ID NO: 544066 - DNA, 25 bp, Mus musculus
gcatgtttgaagcatatctctagca

SEQ ID NO: 544067 - DNA, 25 bp, Mus musculus
gcatgtttgaaggatatctctagca

SEQ ID NO: 544068 - DNA, 25 bp, Mus musculus
gcatgtttgaccacactggctagaa

SEQ ID NO: 544069 - DNA, 25 bp, Mus musculus
gcatgtttgacctcactggctagaa

SEQ ID NO: 544070 - DNA, 25 bp, Mus musculus
gcatgtttgcgtctgtttcctcctt

SEQ ID NO: 544071 - DNA, 25 bp, Mus musculus
gcatgtttgcgtgtgtttcctcctt

SEQ ID NO: 544072 - DNA, 25 bp, Mus musculus
gcatgtttgcttatgatgtatccct

SEQ ID NO: 544073 - DNA, 25 bp, Mus musculus
gcatgtttgcttttgatgtatccct

SEQ ID NO: 544074 - DNA, 25 bp, Mus musculus
gcatgtttgttcactatcctgatat

SEQ ID NO: 544075 - DNA, 25 bp, Mus musculus
gcatgtttgttctctatcctgatat

SEQ ID NO: 544076 - DNA, 25 bp, Mus musculus
gcatgttttaaactctaccccacct

SEQ ID NO: 544077 - DNA, 25 bp, Mus musculus
gcatgttttaaagtctaccccacct

SEQ ID NO: 544078 - DNA, 25 bp, Mus musculus
gcatgttttattatgcccactaaaa

SEQ ID NO: 544079 - DNA, 25 bp, Mus musculus
gcatgttttattttgcccactaaaa

SEQ ID NO: 544080 - DNA, 25 bp, Mus musculus
gcatgttttcagacgactttggcag

SEQ ID NO: 544081 - DNA, 25 bp, Mus musculus
gcatgttttcagtcgactttggcag

SEQ ID NO: 544082 - DNA, 25 bp, Mus musculus
gcatgttttccacaacaattgctgt

SEQ ID NO: 544083 - DNA, 25 bp, Mus musculus
gcatgttttccagaacaattgctgt

SEQ ID NO: 544084 - DNA, 25 bp, Mus musculus
gcatgttttcttaatgtgaaactct

SEQ ID NO: 544085 - DNA, 25 bp, Mus musculus
gcatgttttcttacaggaaacgttt

SEQ ID NO: 544086 - DNA, 25 bp, Mus musculus
gcatgttttctttatgtgaaactct

SEQ ID NO: 544087 - DNA, 25 bp, Mus musculus
gcatgttttctttcaggaaacgttt

SEQ ID NO: 544088 - DNA, 25 bp, Mus musculus
gcattaaaaatgactccaagtaaat

SEQ ID NO: 544089 - DNA, 25 bp, Mus musculus
gcattaaaaatgtctccaagtaaat

SEQ ID NO: 544090 - DNA, 25 bp, Mus musculus
gcattaaaacctaacagagaccgtt

SEQ ID NO: 544091 - DNA, 25 bp, Mus musculus
gcattaaaaccttacagagaccgtt

SEQ ID NO: 544092 - DNA, 25 bp, Mus musculus
gcattaaacaaaactgcgctggcag

SEQ ID NO: 544093 - DNA, 25 bp, Mus musculus
gcattaaacaaatctgcgctggcag

SEQ ID NO: 544094 - DNA, 25 bp, Mus musculus
gcattaaacagccaccatcgcatag

SEQ ID NO: 544095 - DNA, 25 bp, Mus musculus
gcattaaacagcgaccatcgcatag

SEQ ID NO: 544096 - DNA, 25 bp, Mus musculus
gcattaaagataacccttctccttg

SEQ ID NO: 544097 - DNA, 25 bp, Mus musculus
gcattaaagatatcccttctccttg

SEQ ID NO: 544098 - DNA, 25 bp, Mus musculus
gcattaacaacccttcagcagttca

SEQ ID NO: 544099 - DNA, 25 bp, Mus musculus
gcattaacaaccgttcagcagttca

SEQ ID NO: 544100 - DNA, 25 bp, Mus musculus
gcattaacaagaacaggccaacagg

SEQ ID NO: 544101 - DNA, 25 bp, Mus musculus
gcattaacaagatcaggccaacagg

SEQ ID NO: 544102 - DNA, 25 bp, Mus musculus
gcattaagccaaacccacttcaggg

SEQ ID NO: 544103 - DNA, 25 bp, Mus musculus
gcattaagccaatcccacttcaggg

SEQ ID NO: 544104 - DNA, 25 bp, Mus musculus
gcattaagctaaaaccatatcctgg

SEQ ID NO: 544105 - DNA, 25 bp, Mus musculus
gcattaagctaataccatatcctgg

SEQ ID NO: 544106 - DNA, 25 bp, Mus musculus
gcattaaggaatcttgggaagctaa

SEQ ID NO: 544107 - DNA, 25 bp, Mus musculus
gcattaaggaatgttgggaagctaa

SEQ ID NO: 544108 - DNA, 25 bp, Mus musculus
gcattaaggacaaggcgggcctgct

SEQ ID NO: 544109 - DNA, 25 bp, Mus musculus
gcattaaggacatggcgggcctgct

SEQ ID NO: 544110 - DNA, 25 bp, Mus musculus
gcattaaggctgaccctgaaggagt

SEQ ID NO: 544111 - DNA, 25 bp, Mus musculus
gcattaaggctgtccctgaaggagt

SEQ ID NO: 544112 - DNA, 25 bp, Mus musculus
gcattaatactgctcatctcaggtt

SEQ ID NO: 544113 - DNA, 25 bp, Mus musculus
gcattaatactggtcatctcaggtt

SEQ ID NO: 544114 - DNA, 25 bp, Mus musculus
gcattaatccatattcctcaattcc

SEQ ID NO: 544115 - DNA, 25 bp, Mus musculus
gcattaatccattttcctcaattcc

SEQ ID NO: 544116 - DNA, 25 bp, Mus musculus
gcattaattcttccagactcgtagt

SEQ ID NO: 544117 - DNA, 25 bp, Mus musculus
gcattaattcttgcagactcgtagt

SEQ ID NO: 544118 - DNA, 25 bp, Mus musculus
gcattaattttccaaataggatggg

SEQ ID NO: 544119 - DNA, 25 bp, Mus musculus
gcattaattttcgaaataggatggg

SEQ ID NO: 544120 - DNA, 25 bp, Mus musculus
gcattacaaactaaccaaggcatca

SEQ ID NO: 544121 - DNA, 25 bp, Mus musculus
gcattacaaacttaccaaggcatca

SEQ ID NO: 544122 - DNA, 25 bp, Mus musculus
gcattacaacctaactacttcttag

SEQ ID NO: 544123 - DNA, 25 bp, Mus musculus
gcattacaaccttactacttcttag

SEQ ID NO: 544124 - DNA, 25 bp, Mus musculus
gcattacacaatactttgctaccac

SEQ ID NO: 544125 - DNA, 25 bp, Mus musculus
gcattacacaatcaacttttcctct

SEQ ID NO: 544126 - DNA, 25 bp, Mus musculus
gcattacacaatgaacttttcctct

SEQ ID NO: 544127 - DNA, 25 bp, Mus musculus
gcattacacaattctttgctaccac

SEQ ID NO: 544128 - DNA, 25 bp, Mus musculus
gcattacacattagcactctccaaa

SEQ ID NO: 544129 - DNA, 25 bp, Mus musculus
gcattacacatttgcactctccaaa

SEQ ID NO: 544130 - DNA, 25 bp, Mus musculus
gcattacacccgacaaatatgaata

SEQ ID NO: 544131 - DNA, 25 bp, Mus musculus
gcattacacccgtcaaatatgaata

SEQ ID NO: 544132 - DNA, 25 bp, Mus musculus
gcattacagcgtacccattgtgaag

SEQ ID NO: 544133 - DNA, 25 bp, Mus musculus
gcattacagcgttcccattgtgaag

SEQ ID NO: 544134 - DNA, 25 bp, Mus musculus
gcattacaggccaccagaagggact

SEQ ID NO: 544135 - DNA, 25 bp, Mus musculus
gcattacaggcctccagaagggact

SEQ ID NO: 544136 - DNA, 25 bp, Mus musculus
gcattaccacgaccaacaacttgaa

SEQ ID NO: 544137 - DNA, 25 bp, Mus musculus
gcattaccacgagcaacaacttgaa

SEQ ID NO: 544138 - DNA, 25 bp, Mus musculus
gcattaccacggcaaaatgattagg

SEQ ID NO: 544139 - DNA, 25 bp, Mus musculus
gcattaccacgggaaaatgattagg

SEQ ID NO: 544140 - DNA, 25 bp, Mus musculus
gcattaccacttaaaatgtccacct

SEQ ID NO: 544141 - DNA, 25 bp, Mus musculus
gcattaccactttaaatgtccacct

SEQ ID NO: 544142 - DNA, 25 bp, Mus musculus
gcattaccatgtatgcttgcaaagt

SEQ ID NO: 544143 - DNA, 25 bp, Mus musculus
gcattaccatgtttgcttgcaaagt

SEQ ID NO: 544144 - DNA, 25 bp, Mus musculus
gcattaccattcattaacagtagca

SEQ ID NO: 544145 - DNA, 25 bp, Mus musculus
gcattaccattctttaacagtagca

SEQ ID NO: 544146 - DNA, 25 bp, Mus musculus
gcattaccctataagtgccttaatt

SEQ ID NO: 544147 - DNA, 25 bp, Mus musculus
gcattaccctattagtgccttaatt

SEQ ID NO: 544148 - DNA, 25 bp, Mus musculus
gcattacctcagaaacctgaagtaa

SEQ ID NO: 544149 - DNA, 25 bp, Mus musculus
gcattacctcagtaacctgaagtaa

SEQ ID NO: 544150 - DNA, 25 bp, Mus musculus
gcattacctgtgattcagctgctgt

SEQ ID NO: 544151 - DNA, 25 bp, Mus musculus
gcattacctgtgtttcagctgctgt

SEQ ID NO: 544152 - DNA, 25 bp, Mus musculus
gcattactgcaaatcccaggcatgg

SEQ ID NO: 544153 - DNA, 25 bp, Mus musculus
gcattactgcaattcccaggcatgg

SEQ ID NO: 544154 - DNA, 25 bp, Mus musculus
gcattactgtgcaaggatggctgtt

SEQ ID NO: 544155 - DNA, 25 bp, Mus musculus
gcattactgtgctaggatggctgtt

SEQ ID NO: 544156 - DNA, 25 bp, Mus musculus
gcattactgtggcaagtgttgtctg

SEQ ID NO: 544157 - DNA, 25 bp, Mus musculus
gcattactgtgggaagtgttgtctg

SEQ ID NO: 544158 - DNA, 25 bp, Mus musculus
gcattacttgtaacatggtctctac

SEQ ID NO: 544159 - DNA, 25 bp, Mus musculus
gcattacttgtatcatggtctctac

SEQ ID NO: 544160 - DNA, 25 bp, Mus musculus
gcattagactgccagactgtcaggt

SEQ ID NO: 544161 - DNA, 25 bp, Mus musculus
gcattagactgcgagactgtcaggt

SEQ ID NO: 544162 - DNA, 25 bp, Mus musculus
gcattagagagcagaacccggaacc

SEQ ID NO: 544163 - DNA, 25 bp, Mus musculus
gcattagagagctgaacccggaacc

SEQ ID NO: 544164 - DNA, 25 bp, Mus musculus
gcattagagggcctcagcttcatcg

SEQ ID NO: 544165 - DNA, 25 bp, Mus musculus
gcattagagggcgtcagcttcatcg

SEQ ID NO: 544166 - DNA, 25 bp, Mus musculus
gcattagccatcctgcttaactaag

SEQ ID NO: 544167 - DNA, 25 bp, Mus musculus
gcattagccatcgtgcttaactaag

SEQ ID NO: 544168 - DNA, 25 bp, Mus musculus
gcattagcctaaacctccatgaaga

SEQ ID NO: 544169 - DNA, 25 bp, Mus musculus
gcattagcctaatcctccatgaaga

SEQ ID NO: 544170 - DNA, 25 bp, Mus musculus
gcattagcgctgcttttaagggccc

SEQ ID NO: 544171 - DNA, 25 bp, Mus musculus
gcattagcgctggttttaagggccc

SEQ ID NO: 544172 - DNA, 25 bp, Mus musculus
gcattagctggtctaactgcccgga

SEQ ID NO: 544173 - DNA, 25 bp, Mus musculus
gcattagctggtgtaactgcccgga

SEQ ID NO: 544174 - DNA, 25 bp, Mus musculus
gcattagcttagatgtgtgattctc

SEQ ID NO: 544175 - DNA, 25 bp, Mus musculus
gcattagcttagttgtgtgattctc

SEQ ID NO: 544176 - DNA, 25 bp, Mus musculus
gcattagctttgacaacgagcggaa

SEQ ID NO: 544177 - DNA, 25 bp, Mus musculus
gcattagctttgtcaacgagcggaa

SEQ ID NO: 544178 - DNA, 25 bp, Mus musculus
gcattaggaaagacgagtcccacta

SEQ ID NO: 544179 - DNA, 25 bp, Mus musculus
gcattaggaaagtcgagtcccacta

SEQ ID NO: 544180 - DNA, 25 bp, Mus musculus
gcattaggatgcaagaagacacttt

SEQ ID NO: 544181 - DNA, 25 bp, Mus musculus
gcattaggatgctagaagacacttt

SEQ ID NO: 544182 - DNA, 25 bp, Mus musculus
gcattagggttacctgcctccccta

SEQ ID NO: 544183 - DNA, 25 bp, Mus musculus
gcattagggttagctgcctccccta

SEQ ID NO: 544184 - DNA, 25 bp, Mus musculus
gcattaggttataggtgggctgaat

SEQ ID NO: 544185 - DNA, 25 bp, Mus musculus
gcattaggttattggtgggctgaat

SEQ ID NO: 544186 - DNA, 25 bp, Mus musculus
gcattagtaactacagcaatccagg

SEQ ID NO: 544187 - DNA, 25 bp, Mus musculus
gcattagtaacttcagcaatccagg

SEQ ID NO: 544188 - DNA, 25 bp, Mus musculus
gcattagtcaaacctcctgttggcc

SEQ ID NO: 544189 - DNA, 25 bp, Mus musculus
gcattagtcaaagctcctgttggcc

SEQ ID NO: 544190 - DNA, 25 bp, Mus musculus
gcattagtcaggacagtagctccct

SEQ ID NO: 544191 - DNA, 25 bp, Mus musculus
gcattagtcaggtcagtagctccct

SEQ ID NO: 544192 - DNA, 25 bp, Mus musculus
gcattagtgggaccaggacttctga

SEQ ID NO: 544193 - DNA, 25 bp, Mus musculus
gcattagtgggagcaggacttctga

SEQ ID NO: 544194 - DNA, 25 bp, Mus musculus
gcattagtgtttcgttcagcataaa

SEQ ID NO: 544195 - DNA, 25 bp, Mus musculus
gcattagtgtttggttcagcataaa

SEQ ID NO: 544196 - DNA, 25 bp, Mus musculus
gcattataaatcagcctgtctgtca

SEQ ID NO: 544197 - DNA, 25 bp, Mus musculus
gcattataaatctgcctgtctgtca

SEQ ID NO: 544198 - DNA, 25 bp, Mus musculus
gcattatcataaatctagacgccca

SEQ ID NO: 544199 - DNA, 25 bp, Mus musculus
gcattatcataattctagacgccca

SEQ ID NO: 544200 - DNA, 25 bp, Mus musculus
gcattatcatggcactatttcttat

SEQ ID NO: 544201 - DNA, 25 bp, Mus musculus
gcattatcatgggactatttcttat

SEQ ID NO: 544202 - DNA, 25 bp, Mus musculus
gcattatccatcctttcaaactgtg

SEQ ID NO: 544203 - DNA, 25 bp, Mus musculus
gcattatccatcgtttcaaactgtg

SEQ ID NO: 544204 - DNA, 25 bp, Mus musculus
gcattatcccacagtgtcaccaata

SEQ ID NO: 544205 - DNA, 25 bp, Mus musculus
gcattatcccactgtgtcaccaata

SEQ ID NO: 544206 - DNA, 25 bp, Mus musculus
gcattatcctttctctagttatcaa

SEQ ID NO: 544207 - DNA, 25 bp, Mus musculus
gcattatcctttgtctagttatcaa

SEQ ID NO: 544208 - DNA, 25 bp, Mus musculus
gcattatcgtatcgtgctcttcaat

SEQ ID NO: 544209 - DNA, 25 bp, Mus musculus
gcattatcgtatggtgctcttcaat

SEQ ID NO: 544210 - DNA, 25 bp, Mus musculus
gcattatctcagatttagctcctgg

SEQ ID NO: 544211 - DNA, 25 bp, Mus musculus
gcattatctcagttttagctcctgg

SEQ ID NO: 544212 - DNA, 25 bp, Mus musculus
gcattatctcatattgccaagcgaa

SEQ ID NO: 544213 - DNA, 25 bp, Mus musculus
gcattatctcattttgccaagcgaa

SEQ ID NO: 544214 - DNA, 25 bp, Mus musculus
gcattatcttggatcggactgccat

SEQ ID NO: 544215 - DNA, 25 bp, Mus musculus
gcattatcttggttcggactgccat

SEQ ID NO: 544216 - DNA, 25 bp, Mus musculus
gcattatgagtccaatctgcatgtg

SEQ ID NO: 544217 - DNA, 25 bp, Mus musculus
gcattatgagtcgaatctgcatgtg

SEQ ID NO: 544218 - DNA, 25 bp, Mus musculus
gcattatgtgggacaccgtagctta

SEQ ID NO: 544219 - DNA, 25 bp, Mus musculus
gcattatgtgggtcaccgtagctta

SEQ ID NO: 544220 - DNA, 25 bp, Mus musculus
gcattatgttcacactgtaacctgc

SEQ ID NO: 544221 - DNA, 25 bp, Mus musculus
gcattatgttcagactgtaacctgc

SEQ ID NO: 544222 - DNA, 25 bp, Mus musculus
gcattatgttgcaaactctgttgaa

SEQ ID NO: 544223 - DNA, 25 bp, Mus musculus
gcattatgttgctaactctgttgaa

SEQ ID NO: 544224 - DNA, 25 bp, Mus musculus
gcattattattccaccagtgagcta

SEQ ID NO: 544225 - DNA, 25 bp, Mus musculus
gcattattattcgaccagtgagcta

SEQ ID NO: 544226 - DNA, 25 bp, Mus musculus
gcattattccgcattttgtgagcag

SEQ ID NO: 544227 - DNA, 25 bp, Mus musculus
gcattattccgctttttgtgagcag

SEQ ID NO: 544228 - DNA, 25 bp, Mus musculus
gcattattctctcgagagcccgagt

SEQ ID NO: 544229 - DNA, 25 bp, Mus musculus
gcattattctctggagagcccgagt

SEQ ID NO: 544230 - DNA, 25 bp, Mus musculus
gcattatttaaacattggccacaat

SEQ ID NO: 544231 - DNA, 25 bp, Mus musculus
gcattatttaaagattggccacaat

SEQ ID NO: 544232 - DNA, 25 bp, Mus musculus
gcattatttatcacgaccttttagg

SEQ ID NO: 544233 - DNA, 25 bp, Mus musculus
gcattatttatctcgaccttttagg

SEQ ID NO: 544234 - DNA, 25 bp, Mus musculus
gcattatttcttcattcacctcact

SEQ ID NO: 544235 - DNA, 25 bp, Mus musculus
gcattatttcttgattcacctcact

SEQ ID NO: 544236 - DNA, 25 bp, Mus musculus
gcattatttggcacagattcatcgt

SEQ ID NO: 544237 - DNA, 25 bp, Mus musculus
gcattatttggcattttggtttttg

SEQ ID NO: 544238 - DNA, 25 bp, Mus musculus
gcattatttggctcagattcatcgt

SEQ ID NO: 544239 - DNA, 25 bp, Mus musculus
gcattatttggctttttggtttttg

SEQ ID NO: 544240 - DNA, 25 bp, Mus musculus
gcattattttgaattactctcttgt

SEQ ID NO: 544241 - DNA, 25 bp, Mus musculus
gcattattttgatttactctcttgt

SEQ ID NO: 544242 - DNA, 25 bp, Mus musculus
gcattatttttacgaattttggctt

SEQ ID NO: 544243 - DNA, 25 bp, Mus musculus
gcattatttttaggaattttggctt

SEQ ID NO: 544244 - DNA, 25 bp, Mus musculus
gcattcaaaatgctaggccaccttg

SEQ ID NO: 544245 - DNA, 25 bp, Mus musculus
gcattcaaaatggtaggccaccttg

SEQ ID NO: 544246 - DNA, 25 bp, Mus musculus
gcattcaaactcacatgtctgacta

SEQ ID NO: 544247 - DNA, 25 bp, Mus musculus
gcattcaaactctcatgtctgacta

SEQ ID NO: 544248 - DNA, 25 bp, Mus musculus
gcattcaagctactccttcagatta

SEQ ID NO: 544249 - DNA, 25 bp, Mus musculus
gcattcaagctagtccttcagatta

SEQ ID NO: 544250 - DNA, 25 bp, Mus musculus
gcattcaagtccatataaagagcag

SEQ ID NO: 544251 - DNA, 25 bp, Mus musculus
gcattcaagtccttataaagagcag

SEQ ID NO: 544252 - DNA, 25 bp, Mus musculus
gcattcaagtgcattcttgctatgt

SEQ ID NO: 544253 - DNA, 25 bp, Mus musculus
gcattcaagtgctttcttgctatgt

SEQ ID NO: 544254 - DNA, 25 bp, Mus musculus
gcattcaatgccagtgggttgctca

SEQ ID NO: 544255 - DNA, 25 bp, Mus musculus
gcattcaatgcctgtgggttgctca

SEQ ID NO: 544256 - DNA, 25 bp, Mus musculus
gcattcaatttgaagtcctgatttg

SEQ ID NO: 544257 - DNA, 25 bp, Mus musculus
gcattcaatttgtagtcctgatttg

SEQ ID NO: 544258 - DNA, 25 bp, Mus musculus
gcattcacaaagctgattcaattct

SEQ ID NO: 544259 - DNA, 25 bp, Mus musculus
gcattcacaaaggtgattcaattct

SEQ ID NO: 544260 - DNA, 25 bp, Mus musculus
gcattcacacatcttcacacatata

SEQ ID NO: 544261 - DNA, 25 bp, Mus musculus
gcattcacacatgttcacacatata

SEQ ID NO: 544262 - DNA, 25 bp, Mus musculus
gcattcacacgtaagcaggcaacaa

SEQ ID NO: 544263 - DNA, 25 bp, Mus musculus
gcattcacacgttagcaggcaacaa

SEQ ID NO: 544264 - DNA, 25 bp, Mus musculus
gcattcacatgaaggctttcctcgg

SEQ ID NO: 544265 - DNA, 25 bp, Mus musculus
gcattcacatgatggctttcctcgg

SEQ ID NO: 544266 - DNA, 25 bp, Mus musculus
gcattcaccatgatcatatgcccct

SEQ ID NO: 544267 - DNA, 25 bp, Mus musculus
gcattcaccatgttcatatgcccct

SEQ ID NO: 544268 - DNA, 25 bp, Mus musculus
gcattcacccttattagttggtggt

SEQ ID NO: 544269 - DNA, 25 bp, Mus musculus
gcattcaccctttttagttggtggt

SEQ ID NO: 544270 - DNA, 25 bp, Mus musculus
gcattcacctgactcatcctgtgtg

SEQ ID NO: 544271 - DNA, 25 bp, Mus musculus
gcattcacctgagtcatcctgtgtg

SEQ ID NO: 544272 - DNA, 25 bp, Mus musculus
gcattcacgcaccatcttgcttttg

SEQ ID NO: 544273 - DNA, 25 bp, Mus musculus
gcattcacgcacgatcttgcttttg

SEQ ID NO: 544274 - DNA, 25 bp, Mus musculus
gcattcacggatacacccaaatttc

SEQ ID NO: 544275 - DNA, 25 bp, Mus musculus
gcattcacggattcacccaaatttc

SEQ ID NO: 544276 - DNA, 25 bp, Mus musculus
gcattcactacacctgcatcagcat

SEQ ID NO: 544277 - DNA, 25 bp, Mus musculus
gcattcactacagctgcatcagcat

SEQ ID NO: 544278 - DNA, 25 bp, Mus musculus
gcattcactttcactatgattctga

SEQ ID NO: 544279 - DNA, 25 bp, Mus musculus
gcattcactttctctatgattctga

SEQ ID NO: 544280 - DNA, 25 bp, Mus musculus
gcattcagaagacaagagctttaga

SEQ ID NO: 544281 - DNA, 25 bp, Mus musculus
gcattcagaagagaagagctttaga

SEQ ID NO: 544282 - DNA, 25 bp, Mus musculus
gcattcagaatgcacctcagcctaa

SEQ ID NO: 544283 - DNA, 25 bp, Mus musculus
gcattcagaatggacctcagcctaa

SEQ ID NO: 544284 - DNA, 25 bp, Mus musculus
gcattcagatccacttcatttttag

SEQ ID NO: 544285 - DNA, 25 bp, Mus musculus
gcattcagatcctcttcatttttag

SEQ ID NO: 544286 - DNA, 25 bp, Mus musculus
gcattcagatttcttctgttctcag

SEQ ID NO: 544287 - DNA, 25 bp, Mus musculus
gcattcagatttgttctgttctcag

SEQ ID NO: 544288 - DNA, 25 bp, Mus musculus
gcattcagctcccacgacctttgtt

SEQ ID NO: 544289 - DNA, 25 bp, Mus musculus
gcattcagctccgacgacctttgtt

SEQ ID NO: 544290 - DNA, 25 bp, Mus musculus
gcattcaggattacagggtcaccct

SEQ ID NO: 544291 - DNA, 25 bp, Mus musculus
gcattcaggatttcagggtcaccct

SEQ ID NO: 544292 - DNA, 25 bp, Mus musculus
gcattcaggcagcaaattcatttta

SEQ ID NO: 544293 - DNA, 25 bp, Mus musculus
gcattcaggcaggaaattcatttta

SEQ ID NO: 544294 - DNA, 25 bp, Mus musculus
gcattcaggcatagctttgcattct

SEQ ID NO: 544295 - DNA, 25 bp, Mus musculus
gcattcaggcattgctttgcattct

SEQ ID NO: 544296 - DNA, 25 bp, Mus musculus
gcattcaggtcacagctgcagctct

SEQ ID NO: 544297 - DNA, 25 bp, Mus musculus
gcattcaggtcagagctgcagctct

SEQ ID NO: 544298 - DNA, 25 bp, Mus musculus
gcattcagtcagcacgttcacctta

SEQ ID NO: 544299 - DNA, 25 bp, Mus musculus
gcattcagtcaggacgttcacctta

SEQ ID NO: 544300 - DNA, 25 bp, Mus musculus
gcattcagtcatcgacagtgcctgt

SEQ ID NO: 544301 - DNA, 25 bp, Mus musculus
gcattcagtcatggacagtgcctgt

SEQ ID NO: 544302 - DNA, 25 bp, Mus musculus
gcattcagtgagaattccttaacta

SEQ ID NO: 544303 - DNA, 25 bp, Mus musculus
gcattcagtgagtattccttaacta

SEQ ID NO: 544304 - DNA, 25 bp, Mus musculus
gcattcagtgccctatatttagttg

SEQ ID NO: 544305 - DNA, 25 bp, Mus musculus
gcattcagtgccgtatatttagttg

SEQ ID NO: 544306 - DNA, 25 bp, Mus musculus
gcattcagtgtgcttgtgctagcca

SEQ ID NO: 544307 - DNA, 25 bp, Mus musculus
gcattcagtgtggttgtgctagcca

SEQ ID NO: 544308 - DNA, 25 bp, Mus musculus
gcattcagtgttcttgtctgcatct

SEQ ID NO: 544309 - DNA, 25 bp, Mus musculus
gcattcagtgttgttgtctgcatct

SEQ ID NO: 544310 - DNA, 25 bp, Mus musculus
gcattcatacgaagaccaccagcgg

SEQ ID NO: 544311 - DNA, 25 bp, Mus musculus
gcattcatacgatgaccaccagcgg

SEQ ID NO: 544312 - DNA, 25 bp, Mus musculus
gcattcatatccctctccctgtttg

SEQ ID NO: 544313 - DNA, 25 bp, Mus musculus
gcattcatatccgtctccctgtttg

SEQ ID NO: 544314 - DNA, 25 bp, Mus musculus
gcattcatcttcacggtgtcaggga

SEQ ID NO: 544315 - DNA, 25 bp, Mus musculus
gcattcatcttctcggtgtcaggga

SEQ ID NO: 544316 - DNA, 25 bp, Mus musculus
gcattcatgccccagctgaaggcta

SEQ ID NO: 544317 - DNA, 25 bp, Mus musculus
gcattcatgcccgagctgaaggcta

SEQ ID NO: 544318 - DNA, 25 bp, Mus musculus
gcattcatgcctaaacttgggttac

SEQ ID NO: 544319 - DNA, 25 bp, Mus musculus
gcattcatgccttaacttgggttac

SEQ ID NO: 544320 - DNA, 25 bp, Mus musculus
gcattcatgcttctaaaaaagtcat

SEQ ID NO: 544321 - DNA, 25 bp, Mus musculus
gcattcatgcttgtaaaaaagtcat

SEQ ID NO: 544322 - DNA, 25 bp, Mus musculus
gcattcatggctaccacttgtaaat

SEQ ID NO: 544323 - DNA, 25 bp, Mus musculus
gcattcatggcttccacttgtaaat

SEQ ID NO: 544324 - DNA, 25 bp, Mus musculus
gcattcatgggcactagggtctgtt

SEQ ID NO: 544325 - DNA, 25 bp, Mus musculus
gcattcatgggctctagggtctgtt

SEQ ID NO: 544326 - DNA, 25 bp, Mus musculus
gcattcatgtcaccacacaaagaca

SEQ ID NO: 544327 - DNA, 25 bp, Mus musculus
gcattcatgtcagcacacaaagaca

SEQ ID NO: 544328 - DNA, 25 bp, Mus musculus
gcattcattctaccagtggtcagtc

SEQ ID NO: 544329 - DNA, 25 bp, Mus musculus
gcattcattctagcagtggtcagtc

SEQ ID NO: 544330 - DNA, 25 bp, Mus musculus
gcattcattgggagtctagcctgac

SEQ ID NO: 544331 - DNA, 25 bp, Mus musculus
gcattcattgggtgtctagcctgac

SEQ ID NO: 544332 - DNA, 25 bp, Mus musculus
gcattcatttatcaccagcatattg

SEQ ID NO: 544333 - DNA, 25 bp, Mus musculus
gcattcatttatgaccagcatattg

SEQ ID NO: 544334 - DNA, 25 bp, Mus musculus
gcattccaaagcctgaacctgtaac

SEQ ID NO: 544335 - DNA, 25 bp, Mus musculus
gcattccaaagcgtgaacctgtaac

SEQ ID NO: 544336 - DNA, 25 bp, Mus musculus
gcattccaaggccagttgcgaaaga

SEQ ID NO: 544337 - DNA, 25 bp, Mus musculus
gcattccaaggcgagttgcgaaaga

SEQ ID NO: 544338 - DNA, 25 bp, Mus musculus
gcattccaaggtctttcagggcttc

SEQ ID NO: 544339 - DNA, 25 bp, Mus musculus
gcattccaaggtgtttcagggcttc

SEQ ID NO: 544340 - DNA, 25 bp, Mus musculus
gcattccacagtatccctgatggta

SEQ ID NO: 544341 - DNA, 25 bp, Mus musculus
gcattccacagtttccctgatggta

SEQ ID NO: 544342 - DNA, 25 bp, Mus musculus
gcattccacatacatcagtgcctca

SEQ ID NO: 544343 - DNA, 25 bp, Mus musculus
gcattccacatagatcagtgcctca

SEQ ID NO: 544344 - DNA, 25 bp, Mus musculus
gcattccaccagagagattccatgt

SEQ ID NO: 544345 - DNA, 25 bp, Mus musculus
gcattccaccagtgagattccatgt

SEQ ID NO: 544346 - DNA, 25 bp, Mus musculus
gcattccactctcacttcacattaa

SEQ ID NO: 544347 - DNA, 25 bp, Mus musculus
gcattccactctgacttcacattaa

SEQ ID NO: 544348 - DNA, 25 bp, Mus musculus
gcattccagaaactatgcagccctt

SEQ ID NO: 544349 - DNA, 25 bp, Mus musculus
gcattccagaaagtatgcagccctt

SEQ ID NO: 544350 - DNA, 25 bp, Mus musculus
gcattccagctaagatcatgttgat

SEQ ID NO: 544351 - DNA, 25 bp, Mus musculus
gcattccagctactgtctgctgtgg

SEQ ID NO: 544352 - DNA, 25 bp, Mus musculus
gcattccagctagtgtctgctgtgg

SEQ ID NO: 544353 - DNA, 25 bp, Mus musculus
gcattccagctatgatcatgttgat

SEQ ID NO: 544354 - DNA, 25 bp, Mus musculus
gcattccaggaccacagggtagtca

SEQ ID NO: 544355 - DNA, 25 bp, Mus musculus
gcattccaggacgacagggtagtca

SEQ ID NO: 544356 - DNA, 25 bp, Mus musculus
gcattccatgatatgagataattgt

SEQ ID NO: 544357 - DNA, 25 bp, Mus musculus
gcattccatgatttgagataattgt

SEQ ID NO: 544358 - DNA, 25 bp, Mus musculus
gcattccattccagttcattctaaa

SEQ ID NO: 544359 - DNA, 25 bp, Mus musculus
gcattccattcctgttcattctaaa

SEQ ID NO: 544360 - DNA, 25 bp, Mus musculus
gcattccatttcattggtgcaagct

SEQ ID NO: 544361 - DNA, 25 bp, Mus musculus
gcattccatttctttggtgcaagct

SEQ ID NO: 544362 - DNA, 25 bp, Mus musculus
gcattcccacaccaatattcagagg

SEQ ID NO: 544363 - DNA, 25 bp, Mus musculus
gcattcccacacgaatattcagagg

SEQ ID NO: 544364 - DNA, 25 bp, Mus musculus
gcattcccacgaaggagactactta

SEQ ID NO: 544365 - DNA, 25 bp, Mus musculus
gcattcccacgatggagactactta

SEQ ID NO: 544366 - DNA, 25 bp, Mus musculus
gcattcccagtactttaaacttcat

SEQ ID NO: 544367 - DNA, 25 bp, Mus musculus
gcattcccagtagtttaaacttcat

SEQ ID NO: 544368 - DNA, 25 bp, Mus musculus
gcattcccatggagtatttgtcaaa

SEQ ID NO: 544369 - DNA, 25 bp, Mus musculus
gcattcccatggtgtatttgtcaaa

SEQ ID NO: 544370 - DNA, 25 bp, Mus musculus
gcattcccgccaatggaacatgtat

SEQ ID NO: 544371 - DNA, 25 bp, Mus musculus
gcattcccgccattggaacatgtat

SEQ ID NO: 544372 - DNA, 25 bp, Mus musculus
gcattcccgtgaaatttttactttg

SEQ ID NO: 544373 - DNA, 25 bp, Mus musculus
gcattcccgtgatatttttactttg

SEQ ID NO: 544374 - DNA, 25 bp, Mus musculus
gcattccctgggaaggccaagccta

SEQ ID NO: 544375 - DNA, 25 bp, Mus musculus
gcattccctgggtaggccaagccta

SEQ ID NO: 544376 - DNA, 25 bp, Mus musculus
gcattccggcacctgtttactttgg

SEQ ID NO: 544377 - DNA, 25 bp, Mus musculus
gcattccggcacgtgtttactttgg

SEQ ID NO: 544378 - DNA, 25 bp, Mus musculus
gcattccgggaacaatctcctgggt

SEQ ID NO: 544379 - DNA, 25 bp, Mus musculus
gcattccgggaagaatctcctgggt

SEQ ID NO: 544380 - DNA, 25 bp, Mus musculus
gcattcctaagaagtcacagtcctt

SEQ ID NO: 544381 - DNA, 25 bp, Mus musculus
gcattcctaagatgtcacagtcctt

SEQ ID NO: 544382 - DNA, 25 bp, Mus musculus
gcattcctacagatcagacctggag

SEQ ID NO: 544383 - DNA, 25 bp, Mus musculus
gcattcctacagttcagacctggag

SEQ ID NO: 544384 - DNA, 25 bp, Mus musculus
gcattcctaggcaaactaaactgct

SEQ ID NO: 544385 - DNA, 25 bp, Mus musculus
gcattcctaggctaactaaactgct

SEQ ID NO: 544386 - DNA, 25 bp, Mus musculus
gcattcctccctataaatataaaat

SEQ ID NO: 544387 - DNA, 25 bp, Mus musculus
gcattcctccctttaaatataaaat

SEQ ID NO: 544388 - DNA, 25 bp, Mus musculus
gcattcctctctatttgtgggcaca

SEQ ID NO: 544389 - DNA, 25 bp, Mus musculus
gcattcctctctttttgtgggcaca

SEQ ID NO: 544390 - DNA, 25 bp, Mus musculus
gcattcctctttccttcactattta

SEQ ID NO: 544391 - DNA, 25 bp, Mus musculus
gcattcctctttgcttcactattta

SEQ ID NO: 544392 - DNA, 25 bp, Mus musculus
gcattcctgactcctcaaaccaaaa

SEQ ID NO: 544393 - DNA, 25 bp, Mus musculus
gcattcctgactgctcaaaccaaaa

SEQ ID NO: 544394 - DNA, 25 bp, Mus musculus
gcattcctgagacctctgaaggcag

SEQ ID NO: 544395 - DNA, 25 bp, Mus musculus
gcattcctgagagctctgaaggcag

SEQ ID NO: 544396 - DNA, 25 bp, Mus musculus
gcattcctgaggacgggttaccgag

SEQ ID NO: 544397 - DNA, 25 bp, Mus musculus
gcattcctgaggtcgggttaccgag

SEQ ID NO: 544398 - DNA, 25 bp, Mus musculus
gcattccttccacaacagggcaggg

SEQ ID NO: 544399 - DNA, 25 bp, Mus musculus
gcattccttccagaacagggcaggg

SEQ ID NO: 544400 - DNA, 25 bp, Mus musculus
gcattccttgctaagcagaggccca

SEQ ID NO: 544401 - DNA, 25 bp, Mus musculus
gcattccttgcttagcagaggccca

SEQ ID NO: 544402 - DNA, 25 bp, Mus musculus
gcattcgaagaaagattctgtgaac

SEQ ID NO: 544403 - DNA, 25 bp, Mus musculus
gcattcgaagaatgattctgtgaac

SEQ ID NO: 544404 - DNA, 25 bp, Mus musculus
gcattcgaattgagaagagacacct

SEQ ID NO: 544405 - DNA, 25 bp, Mus musculus
gcattcgaattgtgaagagacacct

SEQ ID NO: 544406 - DNA, 25 bp, Mus musculus
gcattcgcattcaaacgtttacaac

SEQ ID NO: 544407 - DNA, 25 bp, Mus musculus
gcattcgcattctaacgtttacaac

SEQ ID NO: 544408 - DNA, 25 bp, Mus musculus
gcattcgcgtttatgagattcttgt

SEQ ID NO: 544409 - DNA, 25 bp, Mus musculus
gcattcgcgtttttgagattcttgt

SEQ ID NO: 544410 - DNA, 25 bp, Mus musculus
gcattcggaagcatgtggcaacgga

SEQ ID NO: 544411 - DNA, 25 bp, Mus musculus
gcattcggaagcttgtggcaacgga

SEQ ID NO: 544412 - DNA, 25 bp, Mus musculus
gcattcggaatcagtgcttgcaatt

SEQ ID NO: 544413 - DNA, 25 bp, Mus musculus
gcattcggaatctgtgcttgcaatt

SEQ ID NO: 544414 - DNA, 25 bp, Mus musculus
gcattcgggataattatttggcttt

SEQ ID NO: 544415 - DNA, 25 bp, Mus musculus
gcattcgggatatttatttggcttt

SEQ ID NO: 544416 - DNA, 25 bp, Mus musculus
gcattcgtcgaaaccgctttaaata

SEQ ID NO: 544417 - DNA, 25 bp, Mus musculus
gcattcgtcgaatccgctttaaata

SEQ ID NO: 544418 - DNA, 25 bp, Mus musculus
gcattcgtctgcaggtggccatggt

SEQ ID NO: 544419 - DNA, 25 bp, Mus musculus
gcattcgtctgctggtggccatggt

SEQ ID NO: 544420 - DNA, 25 bp, Mus musculus
gcattcgtggcactgtgttgtcaaa

SEQ ID NO: 544421 - DNA, 25 bp, Mus musculus
gcattcgtggcagtgtgttgtcaaa

SEQ ID NO: 544422 - DNA, 25 bp, Mus musculus
gcattcgttcatacattaatcctcc

SEQ ID NO: 544423 - DNA, 25 bp, Mus musculus
gcattcgttcattcattaatcctcc

SEQ ID NO: 544424 - DNA, 25 bp, Mus musculus
gcattcgttggtacagatccttctg

SEQ ID NO: 544425 - DNA, 25 bp, Mus musculus
gcattcgttggttcagatccttctg

SEQ ID NO: 544426 - DNA, 25 bp, Mus musculus
gcattcgtttttacatttgttcctt

SEQ ID NO: 544427 - DNA, 25 bp, Mus musculus
gcattcgttttttcatttgttcctt

SEQ ID NO: 544428 - DNA, 25 bp, Mus musculus
gcattctaaactcatactgtaccaa

SEQ ID NO: 544429 - DNA, 25 bp, Mus musculus
gcattctaaactgatactgtaccaa

SEQ ID NO: 544430 - DNA, 25 bp, Mus musculus
gcattctacctcaaagggacactgt

SEQ ID NO: 544431 - DNA, 25 bp, Mus musculus
gcattctacctctaagggacactgt

SEQ ID NO: 544432 - DNA, 25 bp, Mus musculus
gcattctagtatcttgagcaggctg

SEQ ID NO: 544433 - DNA, 25 bp, Mus musculus
gcattctagtatgttgagcaggctg

SEQ ID NO: 544434 - DNA, 25 bp, Mus musculus
gcattctagttcagagctacttctg

SEQ ID NO: 544435 - DNA, 25 bp, Mus musculus
gcattctagttctgagctacttctg

SEQ ID NO: 544436 - DNA, 25 bp, Mus musculus
gcattctattctaagtgaccagatc

SEQ ID NO: 544437 - DNA, 25 bp, Mus musculus
gcattctattcttagtgaccagatc

SEQ ID NO: 544438 - DNA, 25 bp, Mus musculus
gcattctatttcatctcacatctaa

SEQ ID NO: 544439 - DNA, 25 bp, Mus musculus
gcattctatttcttctcacatctaa

SEQ ID NO: 544440 - DNA, 25 bp, Mus musculus
gcattctcaacaaacctggacaagc

SEQ ID NO: 544441 - DNA, 25 bp, Mus musculus
gcattctcaacatacctggacaagc

SEQ ID NO: 544442 - DNA, 25 bp, Mus musculus
gcattctcactgagcaactgcttaa

SEQ ID NO: 544443 - DNA, 25 bp, Mus musculus
gcattctcactgctcatgtcataat

SEQ ID NO: 544444 - DNA, 25 bp, Mus musculus
gcattctcactggtcatgtcataat

SEQ ID NO: 544445 - DNA, 25 bp, Mus musculus
gcattctcactgtgcaactgcttaa

SEQ ID NO: 544446 - DNA, 25 bp, Mus musculus
gcattctcaggaagagcagagccct

SEQ ID NO: 544447 - DNA, 25 bp, Mus musculus
gcattctcaggatgagcagagccct

SEQ ID NO: 544448 - DNA, 25 bp, Mus musculus
gcattctcagttcattggctatccc

SEQ ID NO: 544449 - DNA, 25 bp, Mus musculus
gcattctcagttcctgtctgtgata

SEQ ID NO: 544450 - DNA, 25 bp, Mus musculus
gcattctcagttgattggctatccc

SEQ ID NO: 544451 - DNA, 25 bp, Mus musculus
gcattctcagttgctgtctgtgata

SEQ ID NO: 544452 - DNA, 25 bp, Mus musculus
gcattctccaaactggccaaggatt

SEQ ID NO: 544453 - DNA, 25 bp, Mus musculus
gcattctccaaagtggccaaggatt

SEQ ID NO: 544454 - DNA, 25 bp, Mus musculus
gcattctccttcagcagacaaaagt

SEQ ID NO: 544455 - DNA, 25 bp, Mus musculus
gcattctccttctgcagacaaaagt

SEQ ID NO: 544456 - DNA, 25 bp, Mus musculus
gcattctctcaacatgtccaggctt

SEQ ID NO: 544457 - DNA, 25 bp, Mus musculus
gcattctctcaagatgtccaggctt

SEQ ID NO: 544458 - DNA, 25 bp, Mus musculus
gcattctctggaagcatctcattgc

SEQ ID NO: 544459 - DNA, 25 bp, Mus musculus
gcattctctggatgcatctcattgc

SEQ ID NO: 544460 - DNA, 25 bp, Mus musculus
gcattctctggcaatgtgatcgttt

SEQ ID NO: 544461 - DNA, 25 bp, Mus musculus
gcattctctggctatgtgatcgttt

SEQ ID NO: 544462 - DNA, 25 bp, Mus musculus
gcattctctgtcaccttacaaagtt

SEQ ID NO: 544463 - DNA, 25 bp, Mus musculus
gcattctctgtctccttacaaagtt

SEQ ID NO: 544464 - DNA, 25 bp, Mus musculus
gcattctcttttatccttactgttt

SEQ ID NO: 544465 - DNA, 25 bp, Mus musculus
gcattctcttttttccttactgttt

SEQ ID NO: 544466 - DNA, 25 bp, Mus musculus
gcattctgatatctgctcacgggaa

SEQ ID NO: 544467 - DNA, 25 bp, Mus musculus
gcattctgatatgtgctcacgggaa

SEQ ID NO: 544468 - DNA, 25 bp, Mus musculus
gcattctggaaccctggcatccttc

SEQ ID NO: 544469 - DNA, 25 bp, Mus musculus
gcattctggaacgctggcatccttc

SEQ ID NO: 544470 - DNA, 25 bp, Mus musculus
gcattctggactcgcaggtgctaga

SEQ ID NO: 544471 - DNA, 25 bp, Mus musculus
gcattctggactggcaggtgctaga

SEQ ID NO: 544472 - DNA, 25 bp, Mus musculus
gcattctggcacatggcataaccta

SEQ ID NO: 544473 - DNA, 25 bp, Mus musculus
gcattctggcacttggcataaccta

SEQ ID NO: 544474 - DNA, 25 bp, Mus musculus
gcattctggccactaaattccatgt

SEQ ID NO: 544475 - DNA, 25 bp, Mus musculus
gcattctggccagtaaattccatgt

SEQ ID NO: 544476 - DNA, 25 bp, Mus musculus
gcattctggcccaagcaatagggac

SEQ ID NO: 544477 - DNA, 25 bp, Mus musculus
gcattctggccctagcaatagggac

SEQ ID NO: 544478 - DNA, 25 bp, Mus musculus
gcattctggtcaacactttagcact

SEQ ID NO: 544479 - DNA, 25 bp, Mus musculus
gcattctggtcatcactttagcact

SEQ ID NO: 544480 - DNA, 25 bp, Mus musculus
gcattctgtacgagaaatcgtctgt

SEQ ID NO: 544481 - DNA, 25 bp, Mus musculus
gcattctgtacgtgaaatcgtctgt

SEQ ID NO: 544482 - DNA, 25 bp, Mus musculus
gcattctgtagaaaccaagccttgg

SEQ ID NO: 544483 - DNA, 25 bp, Mus musculus
gcattctgtagataccaagccttgg

SEQ ID NO: 544484 - DNA, 25 bp, Mus musculus
gcattctgtagtcgcgtttgcactc

SEQ ID NO: 544485 - DNA, 25 bp, Mus musculus
gcattctgtagtggcgtttgcactc

SEQ ID NO: 544486 - DNA, 25 bp, Mus musculus
gcattctgtgctagttgttaagtca

SEQ ID NO: 544487 - DNA, 25 bp, Mus musculus
gcattctgtgcttgttgttaagtca

SEQ ID NO: 544488 - DNA, 25 bp, Mus musculus
gcattctgttacctaccactcagga

SEQ ID NO: 544489 - DNA, 25 bp, Mus musculus
gcattctgttacgtaccactcagga

SEQ ID NO: 544490 - DNA, 25 bp, Mus musculus
gcattctgttgcctctgtatgttaa

SEQ ID NO: 544491 - DNA, 25 bp, Mus musculus
gcattctgttgcgtctgtatgttaa

SEQ ID NO: 544492 - DNA, 25 bp, Mus musculus
gcattcttaaatctctgttcacttt

SEQ ID NO: 544493 - DNA, 25 bp, Mus musculus
gcattcttaaatgtctgttcacttt

SEQ ID NO: 544494 - DNA, 25 bp, Mus musculus
gcattcttagaaacctctgcaaagt

SEQ ID NO: 544495 - DNA, 25 bp, Mus musculus
gcattcttagaatcctctgcaaagt

SEQ ID NO: 544496 - DNA, 25 bp, Mus musculus
gcattcttagtcacacattcactca

SEQ ID NO: 544497 - DNA, 25 bp, Mus musculus
gcattcttagtctcacattcactca

SEQ ID NO: 544498 - DNA, 25 bp, Mus musculus
gcattcttatatcaagtccgcttgg

SEQ ID NO: 544499 - DNA, 25 bp, Mus musculus
gcattcttatatgaagtccgcttgg

SEQ ID NO: 544500 - DNA, 25 bp, Mus musculus
gcattcttattgctaaaggctctgt

SEQ ID NO: 544501 - DNA, 25 bp, Mus musculus
gcattcttattggtaaaggctctgt

SEQ ID NO: 544502 - DNA, 25 bp, Mus musculus
gcattcttccctagtaaaatctttc

SEQ ID NO: 544503 - DNA, 25 bp, Mus musculus
gcattcttcccttgtaaaatctttc

SEQ ID NO: 544504 - DNA, 25 bp, Mus musculus
gcattcttgcctctgttgccagggc

SEQ ID NO: 544505 - DNA, 25 bp, Mus musculus
gcattcttgcctgtgttgccagggc

SEQ ID NO: 544506 - DNA, 25 bp, Mus musculus
gcattcttggtgaatcttcttgatt

SEQ ID NO: 544507 - DNA, 25 bp, Mus musculus
gcattcttggtgtatcttcttgatt

SEQ ID NO: 544508 - DNA, 25 bp, Mus musculus
gcattcttggttcaatgtttgtagg

SEQ ID NO: 544509 - DNA, 25 bp, Mus musculus
gcattcttggttgaatgtttgtagg

SEQ ID NO: 544510 - DNA, 25 bp, Mus musculus
gcattcttgtccagaggcagccagc

SEQ ID NO: 544511 - DNA, 25 bp, Mus musculus
gcattcttgtcctgaggcagccagc

SEQ ID NO: 544512 - DNA, 25 bp, Mus musculus
gcattcttgtgaacttgggtgagtc

SEQ ID NO: 544513 - DNA, 25 bp, Mus musculus
gcattcttgtgatcttgggtgagtc

SEQ ID NO: 544514 - DNA, 25 bp, Mus musculus
gcattcttgtgtatgctgatgatac

SEQ ID NO: 544515 - DNA, 25 bp, Mus musculus
gcattcttgtgtttgctgatgatac

SEQ ID NO: 544516 - DNA, 25 bp, Mus musculus
gcattctttatgactaactctttaa

SEQ ID NO: 544517 - DNA, 25 bp, Mus musculus
gcattctttatgtctaactctttaa

SEQ ID NO: 544518 - DNA, 25 bp, Mus musculus
gcattctttcccacgggatccatat

SEQ ID NO: 544519 - DNA, 25 bp, Mus musculus
gcattctttccctcgggatccatat

SEQ ID NO: 544520 - DNA, 25 bp, Mus musculus
gcattcttttgacagaccaaacctt

SEQ ID NO: 544521 - DNA, 25 bp, Mus musculus
gcattcttttgagagaccaaacctt

SEQ ID NO: 544522 - DNA, 25 bp, Mus musculus
gcattctttttaataaggccctcgg

SEQ ID NO: 544523 - DNA, 25 bp, Mus musculus
gcattctttttattaaggccctcgg

SEQ ID NO: 544524 - DNA, 25 bp, Mus musculus
gcattgaaaaagagcacctacccct

SEQ ID NO: 544525 - DNA, 25 bp, Mus musculus
gcattgaaaaagtgcacctacccct

SEQ ID NO: 544526 - DNA, 25 bp, Mus musculus
gcattgaacccaaaaaaattctgta

SEQ ID NO: 544527 - DNA, 25 bp, Mus musculus
gcattgaacccataaaaattctgta

SEQ ID NO: 544528 - DNA, 25 bp, Mus musculus
gcattgaaggatcactttctcagtt

SEQ ID NO: 544529 - DNA, 25 bp, Mus musculus
gcattgaaggatgactttctcagtt

SEQ ID NO: 544530 - DNA, 25 bp, Mus musculus
gcattgaatctgacattgccaaatt

SEQ ID NO: 544531 - DNA, 25 bp, Mus musculus
gcattgaatctgtcattgccaaatt

SEQ ID NO: 544532 - DNA, 25 bp, Mus musculus
gcattgaatgcaagtcctgcagcct

SEQ ID NO: 544533 - DNA, 25 bp, Mus musculus
gcattgaatgcatgtcctgcagcct

SEQ ID NO: 544534 - DNA, 25 bp, Mus musculus
gcattgaatttcaaccctgtcctta

SEQ ID NO: 544535 - DNA, 25 bp, Mus musculus
gcattgaatttctaccctgtcctta

SEQ ID NO: 544536 - DNA, 25 bp, Mus musculus
gcattgacagttccaaccgattaat

SEQ ID NO: 544537 - DNA, 25 bp, Mus musculus
gcattgacagttgcaaccgattaat

SEQ ID NO: 544538 - DNA, 25 bp, Mus musculus
gcattgacctctcgcttttggttta

SEQ ID NO: 544539 - DNA, 25 bp, Mus musculus
gcattgacctctggcttttggttta

SEQ ID NO: 544540 - DNA, 25 bp, Mus musculus
gcattgactatcaactgctgcagat

SEQ ID NO: 544541 - DNA, 25 bp, Mus musculus
gcattgactatctactgctgcagat

SEQ ID NO: 544542 - DNA, 25 bp, Mus musculus
gcattgactctgaagttctctctgt

SEQ ID NO: 544543 - DNA, 25 bp, Mus musculus
gcattgactctgtagttctctctgt

SEQ ID NO: 544544 - DNA, 25 bp, Mus musculus
gcattgactgtgacatggttgcacc

SEQ ID NO: 544545 - DNA, 25 bp, Mus musculus
gcattgactgtgtcatggttgcacc

SEQ ID NO: 544546 - DNA, 25 bp, Mus musculus
gcattgagaaacatcgcctgtctga

SEQ ID NO: 544547 - DNA, 25 bp, Mus musculus
gcattgagaaacttcgcctgtctga

SEQ ID NO: 544548 - DNA, 25 bp, Mus musculus
gcattgagctacacacttgacactg

SEQ ID NO: 544549 - DNA, 25 bp, Mus musculus
gcattgagctactcacttgacactg

SEQ ID NO: 544550 - DNA, 25 bp, Mus musculus
gcattgagcttcacttcttcagaaa

SEQ ID NO: 544551 - DNA, 25 bp, Mus musculus
gcattgagcttctcttcttcagaaa

SEQ ID NO: 544552 - DNA, 25 bp, Mus musculus
gcattgaggctgcttgagtctctca

SEQ ID NO: 544553 - DNA, 25 bp, Mus musculus
gcattgaggctggttgagtctctca

SEQ ID NO: 544554 - DNA, 25 bp, Mus musculus
gcattgaggtcaaagcacaagctta

SEQ ID NO: 544555 - DNA, 25 bp, Mus musculus
gcattgaggtcatagcacaagctta

SEQ ID NO: 544556 - DNA, 25 bp, Mus musculus
gcattgagttacaccctgatgggcg

SEQ ID NO: 544557 - DNA, 25 bp, Mus musculus
gcattgagttactccctgatgggcg

SEQ ID NO: 544558 - DNA, 25 bp, Mus musculus
gcattgatggccagactattattaa

SEQ ID NO: 544559 - DNA, 25 bp, Mus musculus
gcattgatggcctgactattattaa

SEQ ID NO: 544560 - DNA, 25 bp, Mus musculus
gcattgatttgtaagtttgacccac

SEQ ID NO: 544561 - DNA, 25 bp, Mus musculus
gcattgatttgttagtttgacccac

SEQ ID NO: 544562 - DNA, 25 bp, Mus musculus
gcattgcactacatcagtcatctaa

SEQ ID NO: 544563 - DNA, 25 bp, Mus musculus
gcattgcactacttcagtcatctaa

SEQ ID NO: 544564 - DNA, 25 bp, Mus musculus
gcattgcacttccatgcatgcagat

SEQ ID NO: 544565 - DNA, 25 bp, Mus musculus
gcattgcacttcgatgcatgcagat

SEQ ID NO: 544566 - DNA, 25 bp, Mus musculus
gcattgcagatgacgagcagccaga

SEQ ID NO: 544567 - DNA, 25 bp, Mus musculus
gcattgcagatgtcgagcagccaga

SEQ ID NO: 544568 - DNA, 25 bp, Mus musculus
gcattgcagcacatacagtcactaa

SEQ ID NO: 544569 - DNA, 25 bp, Mus musculus
gcattgcagcacttacagtcactaa

SEQ ID NO: 544570 - DNA, 25 bp, Mus musculus
gcattgcagctgcagcacctgaaat

SEQ ID NO: 544571 - DNA, 25 bp, Mus musculus
gcattgcagctggagcacctgaaat

SEQ ID NO: 544572 - DNA, 25 bp, Mus musculus
gcattgcaggtgacatggcgacgct

SEQ ID NO: 544573 - DNA, 25 bp, Mus musculus
gcattgcaggtgtcatggcgacgct

SEQ ID NO: 544574 - DNA, 25 bp, Mus musculus
gcattgcataaacctgacagccggc

SEQ ID NO: 544575 - DNA, 25 bp, Mus musculus
gcattgcataaagctgacagccggc

SEQ ID NO: 544576 - DNA, 25 bp, Mus musculus
gcattgcatacaaacctgcacacac

SEQ ID NO: 544577 - DNA, 25 bp, Mus musculus
gcattgcatacatacctgcacacac

SEQ ID NO: 544578 - DNA, 25 bp, Mus musculus
gcattgcatcttcccgagattccaa

SEQ ID NO: 544579 - DNA, 25 bp, Mus musculus
gcattgcatcttgccgagattccaa

SEQ ID NO: 544580 - DNA, 25 bp, Mus musculus
gcattgcatgacatcagctaactgg

SEQ ID NO: 544581 - DNA, 25 bp, Mus musculus
gcattgcatgacttcagctaactgg

SEQ ID NO: 544582 - DNA, 25 bp, Mus musculus
gcattgcatggaaagcctagtttag

SEQ ID NO: 544583 - DNA, 25 bp, Mus musculus
gcattgcatggatagcctagtttag

SEQ ID NO: 544584 - DNA, 25 bp, Mus musculus
gcattgcattgcaacagatttttgg

SEQ ID NO: 544585 - DNA, 25 bp, Mus musculus
gcattgcattgctacagatttttgg

SEQ ID NO: 544586 - DNA, 25 bp, Mus musculus
gcattgccaccactgtggatttcca

SEQ ID NO: 544587 - DNA, 25 bp, Mus musculus
gcattgccaccagtgtggatttcca

SEQ ID NO: 544588 - DNA, 25 bp, Mus musculus
gcattgccagaaatttcacagcttc

SEQ ID NO: 544589 - DNA, 25 bp, Mus musculus
gcattgccagaactggtggatccca

SEQ ID NO: 544590 - DNA, 25 bp, Mus musculus
gcattgccagaagtggtggatccca

SEQ ID NO: 544591 - DNA, 25 bp, Mus musculus
gcattgccagaattttcacagcttc

SEQ ID NO: 544592 - DNA, 25 bp, Mus musculus
gcattgccagctctgaagaagataa

SEQ ID NO: 544593 - DNA, 25 bp, Mus musculus
gcattgccagctgtgaagaagataa

SEQ ID NO: 544594 - DNA, 25 bp, Mus musculus
gcattgcccagtagttagtgtcggt

SEQ ID NO: 544595 - DNA, 25 bp, Mus musculus
gcattgcccagttgttagtgtcggt

SEQ ID NO: 544596 - DNA, 25 bp, Mus musculus
gcattgcctatgctcaatgaggcca

SEQ ID NO: 544597 - DNA, 25 bp, Mus musculus
gcattgcctatggtcaatgaggcca

SEQ ID NO: 544598 - DNA, 25 bp, Mus musculus
gcattgcctgatcccaggatgacta

SEQ ID NO: 544599 - DNA, 25 bp, Mus musculus
gcattgcctgatgccaggatgacta

SEQ ID NO: 544600 - DNA, 25 bp, Mus musculus
gcattgcctgctatgacaaggtcaa

SEQ ID NO: 544601 - DNA, 25 bp, Mus musculus
gcattgcctgctttgacaaggtcaa

SEQ ID NO: 544602 - DNA, 25 bp, Mus musculus
gcattgcctggcaaaagaggttctt

SEQ ID NO: 544603 - DNA, 25 bp, Mus musculus
gcattgcctggctaaagaggttctt

SEQ ID NO: 544604 - DNA, 25 bp, Mus musculus
gcattgccttccaagccactttagg

SEQ ID NO: 544605 - DNA, 25 bp, Mus musculus
gcattgccttcctagccactttagg

SEQ ID NO: 544606 - DNA, 25 bp, Mus musculus
gcattgcgagcaagtagacggttaa

SEQ ID NO: 544607 - DNA, 25 bp, Mus musculus
gcattgcgagcatgtagacggttaa

SEQ ID NO: 544608 - DNA, 25 bp, Mus musculus
gcattgcggtgacggctgtttaatt

SEQ ID NO: 544609 - DNA, 25 bp, Mus musculus
gcattgcggtgagggctgtttaatt

SEQ ID NO: 544610 - DNA, 25 bp, Mus musculus
gcattgctaaaaatgactcgacact

SEQ ID NO: 544611 - DNA, 25 bp, Mus musculus
gcattgctaaaattgactcgacact

SEQ ID NO: 544612 - DNA, 25 bp, Mus musculus
gcattgctaagaaatcgtctcccca

SEQ ID NO: 544613 - DNA, 25 bp, Mus musculus
gcattgctaagatatcgtctcccca

SEQ ID NO: 544614 - DNA, 25 bp, Mus musculus
gcattgctagagaacagtcctgggt

SEQ ID NO: 544615 - DNA, 25 bp, Mus musculus
gcattgctagagtacagtcctgggt

SEQ ID NO: 544616 - DNA, 25 bp, Mus musculus
gcattgctagatacaagctgctggt

SEQ ID NO: 544617 - DNA, 25 bp, Mus musculus
gcattgctagattcaagctgctggt

SEQ ID NO: 544618 - DNA, 25 bp, Mus musculus
gcattgctcatgcagtgcaaccaca

SEQ ID NO: 544619 - DNA, 25 bp, Mus musculus
gcattgctcatggagtgcaaccaca

SEQ ID NO: 544620 - DNA, 25 bp, Mus musculus
gcattgctctcaatgacaactttgt

SEQ ID NO: 544621 - DNA, 25 bp, Mus musculus
gcattgctctcattgacaactttgt

SEQ ID NO: 544622 - DNA, 25 bp, Mus musculus
gcattgctgagcatccacaggtgtt

SEQ ID NO: 544623 - DNA, 25 bp, Mus musculus
gcattgctgagcttccacaggtgtt

SEQ ID NO: 544624 - DNA, 25 bp, Mus musculus
gcattgctgatcactgctgagagga

SEQ ID NO: 544625 - DNA, 25 bp, Mus musculus
gcattgctgatctctgctgagagga

SEQ ID NO: 544626 - DNA, 25 bp, Mus musculus
gcattgctgcccacttgttttcata

SEQ ID NO: 544627 - DNA, 25 bp, Mus musculus
gcattgctgccctcttgttttcata

SEQ ID NO: 544628 - DNA, 25 bp, Mus musculus
gcattgctgctacaaatatttctat

SEQ ID NO: 544629 - DNA, 25 bp, Mus musculus
gcattgctgctagaaatatttctat

SEQ ID NO: 544630 - DNA, 25 bp, Mus musculus
gcattgctgcttagcaaaagtcctc

SEQ ID NO: 544631 - DNA, 25 bp, Mus musculus
gcattgctgctttgcaaaagtcctc

SEQ ID NO: 544632 - DNA, 25 bp, Mus musculus
gcattgctggagcaaatgtgtccct

SEQ ID NO: 544633 - DNA, 25 bp, Mus musculus
gcattgctggaggaaatgtgtccct

SEQ ID NO: 544634 - DNA, 25 bp, Mus musculus
gcattgctggcaatagactctttgc

SEQ ID NO: 544635 - DNA, 25 bp, Mus musculus
gcattgctggcattagactctttgc

SEQ ID NO: 544636 - DNA, 25 bp, Mus musculus
gcattgctggtgcaacgactttgat

SEQ ID NO: 544637 - DNA, 25 bp, Mus musculus
gcattgctggtggaacgactttgat

SEQ ID NO: 544638 - DNA, 25 bp, Mus musculus
gcattgctgtgacaccacttgagtt

SEQ ID NO: 544639 - DNA, 25 bp, Mus musculus
gcattgctgtgagaccacttgagtt

SEQ ID NO: 544640 - DNA, 25 bp, Mus musculus
gcattgcttcccagaggacatctta

SEQ ID NO: 544641 - DNA, 25 bp, Mus musculus
gcattgcttccctgaggacatctta

SEQ ID NO: 544642 - DNA, 25 bp, Mus musculus
gcattgcttctacaggagctctgag

SEQ ID NO: 544643 - DNA, 25 bp, Mus musculus
gcattgcttctagaggagctctgag

SEQ ID NO: 544644 - DNA, 25 bp, Mus musculus
gcattgcttgagaggttttctccta

SEQ ID NO: 544645 - DNA, 25 bp, Mus musculus
gcattgcttgagtggttttctccta

SEQ ID NO: 544646 - DNA, 25 bp, Mus musculus
gcattgcttggtcaattttgatttt

SEQ ID NO: 544647 - DNA, 25 bp, Mus musculus
gcattgcttggtgaattttgatttt

SEQ ID NO: 544648 - DNA, 25 bp, Mus musculus
gcattgctttcccactaaactaaac

SEQ ID NO: 544649 - DNA, 25 bp, Mus musculus
gcattgctttccgactaaactaaac

SEQ ID NO: 544650 - DNA, 25 bp, Mus musculus
gcattgcttttacttctttatgtca

SEQ ID NO: 544651 - DNA, 25 bp, Mus musculus
gcattgcttttagttctttatgtca

SEQ ID NO: 544652 - DNA, 25 bp, Mus musculus
gcattggaagtaccagtttgggttt

SEQ ID NO: 544653 - DNA, 25 bp, Mus musculus
gcattggaagtagcagtttgggttt

SEQ ID NO: 544654 - DNA, 25 bp, Mus musculus
gcattggaagtcctagcccctgggc

SEQ ID NO: 544655 - DNA, 25 bp, Mus musculus
gcattggaagtcgtagcccctgggc

SEQ ID NO: 544656 - DNA, 25 bp, Mus musculus
gcattggacagcacaaccatgttgt

SEQ ID NO: 544657 - DNA, 25 bp, Mus musculus
gcattggacagctcaaccatgttgt

SEQ ID NO: 544658 - DNA, 25 bp, Mus musculus
gcattggacattctagatctttctc

SEQ ID NO: 544659 - DNA, 25 bp, Mus musculus
gcattggacattgtagatctttctc

SEQ ID NO: 544660 - DNA, 25 bp, Mus musculus
gcattggactgcatatatttagttt

SEQ ID NO: 544661 - DNA, 25 bp, Mus musculus
gcattggactgcttatatttagttt

SEQ ID NO: 544662 - DNA, 25 bp, Mus musculus
gcattggactttaatataacatttt

SEQ ID NO: 544663 - DNA, 25 bp, Mus musculus
gcattggactttcttgttcaacgta

SEQ ID NO: 544664 - DNA, 25 bp, Mus musculus
gcattggactttgttgttcaacgta

SEQ ID NO: 544665 - DNA, 25 bp, Mus musculus
gcattggacttttatataacatttt

SEQ ID NO: 544666 - DNA, 25 bp, Mus musculus
gcattggagagtatgccatcccgaa

SEQ ID NO: 544667 - DNA, 25 bp, Mus musculus
gcattggagagtttgccatcccgaa

SEQ ID NO: 544668 - DNA, 25 bp, Mus musculus
gcattggagattatcgttcttgtaa

SEQ ID NO: 544669 - DNA, 25 bp, Mus musculus
gcattggagattttcgttcttgtaa

SEQ ID NO: 544670 - DNA, 25 bp, Mus musculus
gcattggagcctcactgcagtgttc

SEQ ID NO: 544671 - DNA, 25 bp, Mus musculus
gcattggagcctgactgcagtgttc

SEQ ID NO: 544672 - DNA, 25 bp, Mus musculus
gcattggaggcgatgttcacagcaa

SEQ ID NO: 544673 - DNA, 25 bp, Mus musculus
gcattggaggcgttgttcacagcaa

SEQ ID NO: 544674 - DNA, 25 bp, Mus musculus
gcattggataccctcagtagttgtt

SEQ ID NO: 544675 - DNA, 25 bp, Mus musculus
gcattggataccgtcagtagttgtt

SEQ ID NO: 544676 - DNA, 25 bp, Mus musculus
gcattggcaaatctcttggagcact

SEQ ID NO: 544677 - DNA, 25 bp, Mus musculus
gcattggcaaatgtcttggagcact

SEQ ID NO: 544678 - DNA, 25 bp, Mus musculus
gcattggcagtgaggctcacgaact

SEQ ID NO: 544679 - DNA, 25 bp, Mus musculus
gcattggcagtgtggctcacgaact

SEQ ID NO: 544680 - DNA, 25 bp, Mus musculus
gcattggcatggctttctaccaggg

SEQ ID NO: 544681 - DNA, 25 bp, Mus musculus
gcattggcatgggtttctaccaggg

SEQ ID NO: 544682 - DNA, 25 bp, Mus musculus
gcattggcatttataagctctctca

SEQ ID NO: 544683 - DNA, 25 bp, Mus musculus
gcattggcatttttaagctctctca

SEQ ID NO: 544684 - DNA, 25 bp, Mus musculus
gcattggcctctcaaaagagtcttg

SEQ ID NO: 544685 - DNA, 25 bp, Mus musculus
gcattggcctctgaaaagagtcttg

SEQ ID NO: 544686 - DNA, 25 bp, Mus musculus
gcattggctagcacgaggcaggact

SEQ ID NO: 544687 - DNA, 25 bp, Mus musculus
gcattggctagctcgaggcaggact

SEQ ID NO: 544688 - DNA, 25 bp, Mus musculus
gcattggctgctattgttggtagca

SEQ ID NO: 544689 - DNA, 25 bp, Mus musculus
gcattggctgcttttgttggtagca

SEQ ID NO: 544690 - DNA, 25 bp, Mus musculus
gcattggcttcaataattctaggta

SEQ ID NO: 544691 - DNA, 25 bp, Mus musculus
gcattggcttcattaattctaggta

SEQ ID NO: 544692 - DNA, 25 bp, Mus musculus
gcattggcttctagtgcagggcaga

SEQ ID NO: 544693 - DNA, 25 bp, Mus musculus
gcattggcttcttgtgcagggcaga

SEQ ID NO: 544694 - DNA, 25 bp, Mus musculus
gcattggctttaacctctttagagt

SEQ ID NO: 544695 - DNA, 25 bp, Mus musculus
gcattggctttatcctctttagagt

SEQ ID NO: 544696 - DNA, 25 bp, Mus musculus
gcattgggaacaattcttctggaat

SEQ ID NO: 544697 - DNA, 25 bp, Mus musculus
gcattgggaacatttcttctggaat

SEQ ID NO: 544698 - DNA, 25 bp, Mus musculus
gcattgggatgcctccacagatgca

SEQ ID NO: 544699 - DNA, 25 bp, Mus musculus
gcattgggatgcgtccacagatgca

SEQ ID NO: 544700 - DNA, 25 bp, Mus musculus
gcattgggcactacattcacagggt

SEQ ID NO: 544701 - DNA, 25 bp, Mus musculus
gcattgggcacttcattcacagggt

SEQ ID NO: 544702 - DNA, 25 bp, Mus musculus
gcattgggccagagccaaaaacact

SEQ ID NO: 544703 - DNA, 25 bp, Mus musculus
gcattgggccagtgccaaaaacact

SEQ ID NO: 544704 - DNA, 25 bp, Mus musculus
gcattgggcgcactgactgtcacca

SEQ ID NO: 544705 - DNA, 25 bp, Mus musculus
gcattgggcgcagtgactgtcacca

SEQ ID NO: 544706 - DNA, 25 bp, Mus musculus
gcattgggctgcaaagtgtctggca

SEQ ID NO: 544707 - DNA, 25 bp, Mus musculus
gcattgggctgctaagtgtctggca

SEQ ID NO: 544708 - DNA, 25 bp, Mus musculus
gcattgggtggtcagaaaatccatc

SEQ ID NO: 544709 - DNA, 25 bp, Mus musculus
gcattgggtggtgagaaaatccatc

SEQ ID NO: 544710 - DNA, 25 bp, Mus musculus
gcattggtaagcagagcatcctccc

SEQ ID NO: 544711 - DNA, 25 bp, Mus musculus
gcattggtaagctgagcatcctccc

SEQ ID NO: 544712 - DNA, 25 bp, Mus musculus
gcattggtacttcgtgccacataat

SEQ ID NO: 544713 - DNA, 25 bp, Mus musculus
gcattggtacttggtgccacataat

SEQ ID NO: 544714 - DNA, 25 bp, Mus musculus
gcattggtctagctgcacagtcctg

SEQ ID NO: 544715 - DNA, 25 bp, Mus musculus
gcattggtctaggtgcacagtcctg

SEQ ID NO: 544716 - DNA, 25 bp, Mus musculus
gcattggtctgtaccctgccaatta

SEQ ID NO: 544717 - DNA, 25 bp, Mus musculus
gcattggtctgttccctgccaatta

SEQ ID NO: 544718 - DNA, 25 bp, Mus musculus
gcattggtgacaaggcggagcttat

SEQ ID NO: 544719 - DNA, 25 bp, Mus musculus
gcattggtgacatggcggagcttat

SEQ ID NO: 544720 - DNA, 25 bp, Mus musculus
gcattggtgttaaagtgctgatgac

SEQ ID NO: 544721 - DNA, 25 bp, Mus musculus
gcattggtgttatagtgctgatgac

SEQ ID NO: 544722 - DNA, 25 bp, Mus musculus
gcattggttcttcggaggctgatca

SEQ ID NO: 544723 - DNA, 25 bp, Mus musculus
gcattggttcttgggaggctgatca

SEQ ID NO: 544724 - DNA, 25 bp, Mus musculus
gcattggtttagctccggttacaga

SEQ ID NO: 544725 - DNA, 25 bp, Mus musculus
gcattggtttaggtccggttacaga

SEQ ID NO: 544726 - DNA, 25 bp, Mus musculus
gcattggtttggatgtcattgtcta

SEQ ID NO: 544727 - DNA, 25 bp, Mus musculus
gcattggtttggttgtcattgtcta

SEQ ID NO: 544728 - DNA, 25 bp, Mus musculus
gcattgtaactcatgaacttggttt

SEQ ID NO: 544729 - DNA, 25 bp, Mus musculus
gcattgtaactcttgaacttggttt

SEQ ID NO: 544730 - DNA, 25 bp, Mus musculus
gcattgtaagaaaagtctccaaagg

SEQ ID NO: 544731 - DNA, 25 bp, Mus musculus
gcattgtaagaatagtctccaaagg

SEQ ID NO: 544732 - DNA, 25 bp, Mus musculus
gcattgtaagtcaatataccctagt

SEQ ID NO: 544733 - DNA, 25 bp, Mus musculus
gcattgtaagtctatataccctagt

SEQ ID NO: 544734 - DNA, 25 bp, Mus musculus
gcattgtaagtgatacatagcccta

SEQ ID NO: 544735 - DNA, 25 bp, Mus musculus
gcattgtaagtgttacatagcccta

SEQ ID NO: 544736 - DNA, 25 bp, Mus musculus
gcattgtaattgaaggtcctgtcct

SEQ ID NO: 544737 - DNA, 25 bp, Mus musculus
gcattgtaattgcactgaaagctta

SEQ ID NO: 544738 - DNA, 25 bp, Mus musculus
gcattgtaattggactgaaagctta

SEQ ID NO: 544739 - DNA, 25 bp, Mus musculus
gcattgtaattgtaggtcctgtcct

SEQ ID NO: 544740 - DNA, 25 bp, Mus musculus
gcattgtagactagtttgttcctta

SEQ ID NO: 544741 - DNA, 25 bp, Mus musculus
gcattgtagacttgtttgttcctta

SEQ ID NO: 544742 - DNA, 25 bp, Mus musculus
gcattgtagatcaaagctgctgttt

SEQ ID NO: 544743 - DNA, 25 bp, Mus musculus
gcattgtagatctaagctgctgttt

SEQ ID NO: 544744 - DNA, 25 bp, Mus musculus
gcattgtatagaaactatttcccct

SEQ ID NO: 544745 - DNA, 25 bp, Mus musculus
gcattgtatagatactatttcccct

SEQ ID NO: 544746 - DNA, 25 bp, Mus musculus
gcattgtatggcaagcatttgaaac

SEQ ID NO: 544747 - DNA, 25 bp, Mus musculus
gcattgtatggctagcatttgaaac

SEQ ID NO: 544748 - DNA, 25 bp, Mus musculus
gcattgtatgtgcaacctctgggaa

SEQ ID NO: 544749 - DNA, 25 bp, Mus musculus
gcattgtatgtggaacctctgggaa

SEQ ID NO: 544750 - DNA, 25 bp, Mus musculus
gcattgtattctcgatactaccaaa

SEQ ID NO: 544751 - DNA, 25 bp, Mus musculus
gcattgtattctggatactaccaaa

SEQ ID NO: 544752 - DNA, 25 bp, Mus musculus
gcattgtattgcattgacaactgta

SEQ ID NO: 544753 - DNA, 25 bp, Mus musculus
gcattgtattgctttgacaactgta

SEQ ID NO: 544754 - DNA, 25 bp, Mus musculus
gcattgtcaacaatgcagctccaac

SEQ ID NO: 544755 - DNA, 25 bp, Mus musculus
gcattgtcaacattgcagctccaac

SEQ ID NO: 544756 - DNA, 25 bp, Mus musculus
gcattgtcaacccactgagccaaag

SEQ ID NO: 544757 - DNA, 25 bp, Mus musculus
gcattgtcaaccgactgagccaaag

SEQ ID NO: 544758 - DNA, 25 bp, Mus musculus
gcattgtcaagcacccagagggctc

SEQ ID NO: 544759 - DNA, 25 bp, Mus musculus
gcattgtcaagctcccagagggctc

SEQ ID NO: 544760 - DNA, 25 bp, Mus musculus
gcattgtcacccagtgcaagattgg

SEQ ID NO: 544761 - DNA, 25 bp, Mus musculus
gcattgtcaccctgtgcaagattgg

SEQ ID NO: 544762 - DNA, 25 bp, Mus musculus
gcattgtcatggctctctaaggata

SEQ ID NO: 544763 - DNA, 25 bp, Mus musculus
gcattgtcatgggtctctaaggata

SEQ ID NO: 544764 - DNA, 25 bp, Mus musculus
gcattgtccaaaaaacatcaagtat

SEQ ID NO: 544765 - DNA, 25 bp, Mus musculus
gcattgtccaaataacatcaagtat

SEQ ID NO: 544766 - DNA, 25 bp, Mus musculus
gcattgtcgcatagacggactcaga

SEQ ID NO: 544767 - DNA, 25 bp, Mus musculus
gcattgtcgcattgacggactcaga

SEQ ID NO: 544768 - DNA, 25 bp, Mus musculus
gcattgtctctaatagggaagccat

SEQ ID NO: 544769 - DNA, 25 bp, Mus musculus
gcattgtctctattagggaagccat

SEQ ID NO: 544770 - DNA, 25 bp, Mus musculus
gcattgtctctgcagattctatttt

SEQ ID NO: 544771 - DNA, 25 bp, Mus musculus
gcattgtctctggagattctatttt

SEQ ID NO: 544772 - DNA, 25 bp, Mus musculus
gcattgtctggaaaaccactgtttt

SEQ ID NO: 544773 - DNA, 25 bp, Mus musculus
gcattgtctggataaccactgtttt

SEQ ID NO: 544774 - DNA, 25 bp, Mus musculus
gcattgtctggtctatggcccctga

SEQ ID NO: 544775 - DNA, 25 bp, Mus musculus
gcattgtctggtgtatggcccctga

SEQ ID NO: 544776 - DNA, 25 bp, Mus musculus
gcattgtctgtactattttccacaa

SEQ ID NO: 544777 - DNA, 25 bp, Mus musculus
gcattgtctgtagtattttccacaa

SEQ ID NO: 544778 - DNA, 25 bp, Mus musculus
gcattgtctttcaggttatgcccaa

SEQ ID NO: 544779 - DNA, 25 bp, Mus musculus
gcattgtctttctggttatgcccaa

SEQ ID NO: 544780 - DNA, 25 bp, Mus musculus
gcattgtgactgcagatacttcatg

SEQ ID NO: 544781 - DNA, 25 bp, Mus musculus
gcattgtgactggagatacttcatg

SEQ ID NO: 544782 - DNA, 25 bp, Mus musculus
gcattgtgagctacagagaccttag

SEQ ID NO: 544783 - DNA, 25 bp, Mus musculus
gcattgtgagcttcagagaccttag

SEQ ID NO: 544784 - DNA, 25 bp, Mus musculus
gcattgtgagtcattttgcttttac

SEQ ID NO: 544785 - DNA, 25 bp, Mus musculus
gcattgtgagtctttttgcttttac

SEQ ID NO: 544786 - DNA, 25 bp, Mus musculus
gcattgtgcggcatccaaaagccaa

SEQ ID NO: 544787 - DNA, 25 bp, Mus musculus
gcattgtgcggcttccaaaagccaa

SEQ ID NO: 544788 - DNA, 25 bp, Mus musculus
gcattgtgctggatgtatccggatc

SEQ ID NO: 544789 - DNA, 25 bp, Mus musculus
gcattgtgctggttgtatccggatc

SEQ ID NO: 544790 - DNA, 25 bp, Mus musculus
gcattgtggaaccttaacctttttg

SEQ ID NO: 544791 - DNA, 25 bp, Mus musculus
gcattgtggaacgttaacctttttg

SEQ ID NO: 544792 - DNA, 25 bp, Mus musculus
gcattgtggaagcatcgcggatcat

SEQ ID NO: 544793 - DNA, 25 bp, Mus musculus
gcattgtggaaggatcgcggatcat

SEQ ID NO: 544794 - DNA, 25 bp, Mus musculus
gcattgtggactacagtgggcaaca

SEQ ID NO: 544795 - DNA, 25 bp, Mus musculus
gcattgtggacttcagtgggcaaca

SEQ ID NO: 544796 - DNA, 25 bp, Mus musculus
gcattgtgggagcttctgttcctcc

SEQ ID NO: 544797 - DNA, 25 bp, Mus musculus
gcattgtgggaggttctgttcctcc

SEQ ID NO: 544798 - DNA, 25 bp, Mus musculus
gcattgtgggctaaggcgaaacggt

SEQ ID NO: 544799 - DNA, 25 bp, Mus musculus
gcattgtgggcttaggcgaaacggt

SEQ ID NO: 544800 - DNA, 25 bp, Mus musculus
gcattgtgtcttactacttccaaac

SEQ ID NO: 544801 - DNA, 25 bp, Mus musculus
gcattgtgtctttctacttccaaac

SEQ ID NO: 544802 - DNA, 25 bp, Mus musculus
gcattgtgtgcaagtttccccttac

SEQ ID NO: 544803 - DNA, 25 bp, Mus musculus
gcattgtgtgcatgtttccccttac

SEQ ID NO: 544804 - DNA, 25 bp, Mus musculus
gcattgtgtgtcatgtacatctctt

SEQ ID NO: 544805 - DNA, 25 bp, Mus musculus
gcattgtgtgtcttgtacatctctt

SEQ ID NO: 544806 - DNA, 25 bp, Mus musculus
gcattgtgttagataatgtggcaaa

SEQ ID NO: 544807 - DNA, 25 bp, Mus musculus
gcattgtgttagttaatgtggcaaa

SEQ ID NO: 544808 - DNA, 25 bp, Mus musculus
gcattgtgtttaactcctgctttat

SEQ ID NO: 544809 - DNA, 25 bp, Mus musculus
gcattgtgtttatctcctgctttat

SEQ ID NO: 544810 - DNA, 25 bp, Mus musculus
gcattgttaatgatagaagcctgaa

SEQ ID NO: 544811 - DNA, 25 bp, Mus musculus
gcattgttaatgttagaagcctgaa

SEQ ID NO: 544812 - DNA, 25 bp, Mus musculus
gcattgttaccacggctattgggac

SEQ ID NO: 544813 - DNA, 25 bp, Mus musculus
gcattgttaccagggctattgggac

SEQ ID NO: 544814 - DNA, 25 bp, Mus musculus
gcattgttactgcaatccggaccag

SEQ ID NO: 544815 - DNA, 25 bp, Mus musculus
gcattgttactggaatccggaccag

SEQ ID NO: 544816 - DNA, 25 bp, Mus musculus
gcattgttaggcaggatcccagatc

SEQ ID NO: 544817 - DNA, 25 bp, Mus musculus
gcattgttaggctggatcccagatc

SEQ ID NO: 544818 - DNA, 25 bp, Mus musculus
gcattgttattgatggtactaatca

SEQ ID NO: 544819 - DNA, 25 bp, Mus musculus
gcattgttattgttggtactaatca

SEQ ID NO: 544820 - DNA, 25 bp, Mus musculus
gcattgttcctcatcgttatgttaa

SEQ ID NO: 544821 - DNA, 25 bp, Mus musculus
gcattgttcctcttcgttatgttaa

SEQ ID NO: 544822 - DNA, 25 bp, Mus musculus
gcattgttcttaatgattatagtta

SEQ ID NO: 544823 - DNA, 25 bp, Mus musculus
gcattgttcttattgattatagtta

SEQ ID NO: 544824 - DNA, 25 bp, Mus musculus
gcattgttgggccttgacagttgca

SEQ ID NO: 544825 - DNA, 25 bp, Mus musculus
gcattgttgggcgttgacagttgca

SEQ ID NO: 544826 - DNA, 25 bp, Mus musculus
gcattgtttacccatcatcctaaat

SEQ ID NO: 544827 - DNA, 25 bp, Mus musculus
gcattgtttaccgatcatcctaaat

SEQ ID NO: 544828 - DNA, 25 bp, Mus musculus
gcattgtttagtctaacagccatga

SEQ ID NO: 544829 - DNA, 25 bp, Mus musculus
gcattgtttagtgtaacagccatga

SEQ ID NO: 544830 - DNA, 25 bp, Mus musculus
gcattgtttctactttattaacctt

SEQ ID NO: 544831 - DNA, 25 bp, Mus musculus
gcattgtttctagtttattaacctt

SEQ ID NO: 544832 - DNA, 25 bp, Mus musculus
gcattgtttcttatcaactgaagca

SEQ ID NO: 544833 - DNA, 25 bp, Mus musculus
gcattgtttcttttcaactgaagca

SEQ ID NO: 544834 - DNA, 25 bp, Mus musculus
gcattgtttgaccattgtgcacaga

SEQ ID NO: 544835 - DNA, 25 bp, Mus musculus
gcattgtttgacgattgtgcacaga

SEQ ID NO: 544836 - DNA, 25 bp, Mus musculus
gcattgtttgtaaacgtgcacgcga

SEQ ID NO: 544837 - DNA, 25 bp, Mus musculus
gcattgtttgtatacgtgcacgcga

SEQ ID NO: 544838 - DNA, 25 bp, Mus musculus
gcattgtttgttctagcagtgtgga

SEQ ID NO: 544839 - DNA, 25 bp, Mus musculus
gcattgtttgttgtagcagtgtgga

SEQ ID NO: 544840 - DNA, 25 bp, Mus musculus
gcattgtttttcaatcaggcacaga

SEQ ID NO: 544841 - DNA, 25 bp, Mus musculus
gcattgtttttctatcaggcacaga

SEQ ID NO: 544842 - DNA, 25 bp, Mus musculus
gcatttaaaactattttccaggcag

SEQ ID NO: 544843 - DNA, 25 bp, Mus musculus
gcatttaaaacttttttccaggcag

SEQ ID NO: 544844 - DNA, 25 bp, Mus musculus
gcatttaaaagcaggcttccctggg

SEQ ID NO: 544845 - DNA, 25 bp, Mus musculus
gcatttaaaagctggcttccctggg

SEQ ID NO: 544846 - DNA, 25 bp, Mus musculus
gcatttaaacacatgagcagggcag

SEQ ID NO: 544847 - DNA, 25 bp, Mus musculus
gcatttaaacacttgagcagggcag

SEQ ID NO: 544848 - DNA, 25 bp, Mus musculus
gcatttaaacagctgtgttctaact

SEQ ID NO: 544849 - DNA, 25 bp, Mus musculus
gcatttaaacaggtgtgttctaact

SEQ ID NO: 544850 - DNA, 25 bp, Mus musculus
gcatttaaagatacccaagtggcga

SEQ ID NO: 544851 - DNA, 25 bp, Mus musculus
gcatttaaagattcccaagtggcga

SEQ ID NO: 544852 - DNA, 25 bp, Mus musculus
gcatttaaattcaatcattggaagt

SEQ ID NO: 544853 - DNA, 25 bp, Mus musculus
gcatttaaattctatcattggaagt

SEQ ID NO: 544854 - DNA, 25 bp, Mus musculus
gcatttaactttctacacattcccg

SEQ ID NO: 544855 - DNA, 25 bp, Mus musculus
gcatttaactttgtacacattcccg

SEQ ID NO: 544856 - DNA, 25 bp, Mus musculus
gcatttaataacctaccttgagtct

SEQ ID NO: 544857 - DNA, 25 bp, Mus musculus
gcatttaataaccttcatacctgat

SEQ ID NO: 544858 - DNA, 25 bp, Mus musculus
gcatttaataacgtaccttgagtct

SEQ ID NO: 544859 - DNA, 25 bp, Mus musculus
gcatttaataacgttcatacctgat

SEQ ID NO: 544860 - DNA, 25 bp, Mus musculus
gcatttaataccatggcctatctgt

SEQ ID NO: 544861 - DNA, 25 bp, Mus musculus
gcatttaataccttggcctatctgt

SEQ ID NO: 544862 - DNA, 25 bp, Mus musculus
gcatttaatatacctgcatcctaaa

SEQ ID NO: 544863 - DNA, 25 bp, Mus musculus
gcatttaatatagctgcatcctaaa

SEQ ID NO: 544864 - DNA, 25 bp, Mus musculus
gcatttaatctgattaacccagtac

SEQ ID NO: 544865 - DNA, 25 bp, Mus musculus
gcatttaatctgtttaacccagtac

SEQ ID NO: 544866 - DNA, 25 bp, Mus musculus
gcatttaatggactggacttttccc

SEQ ID NO: 544867 - DNA, 25 bp, Mus musculus
gcatttaatggagtggacttttccc

SEQ ID NO: 544868 - DNA, 25 bp, Mus musculus
gcatttaatggcaaacctgactgac

SEQ ID NO: 544869 - DNA, 25 bp, Mus musculus
gcatttaatggctaacctgactgac

SEQ ID NO: 544870 - DNA, 25 bp, Mus musculus
gcatttaattgaaataccagtctgt

SEQ ID NO: 544871 - DNA, 25 bp, Mus musculus
gcatttaattgatataccagtctgt

SEQ ID NO: 544872 - DNA, 25 bp, Mus musculus
gcatttacacgtcgcaggtctgggt

SEQ ID NO: 544873 - DNA, 25 bp, Mus musculus
gcatttacacgtggcaggtctgggt

SEQ ID NO: 544874 - DNA, 25 bp, Mus musculus
gcatttacactacatactgtactgg

SEQ ID NO: 544875 - DNA, 25 bp, Mus musculus
gcatttacactagatactgtactgg

SEQ ID NO: 544876 - DNA, 25 bp, Mus musculus
gcatttacagtgagcccatagcata

SEQ ID NO: 544877 - DNA, 25 bp, Mus musculus
gcatttacagtgtgcccatagcata

SEQ ID NO: 544878 - DNA, 25 bp, Mus musculus
gcatttaccaacatgtatctgtcta

SEQ ID NO: 544879 - DNA, 25 bp, Mus musculus
gcatttaccaacttgtatctgtcta

SEQ ID NO: 544880 - DNA, 25 bp, Mus musculus
gcatttaccagtcgtcgatggcctg

SEQ ID NO: 544881 - DNA, 25 bp, Mus musculus
gcatttaccagtggtcgatggcctg

SEQ ID NO: 544882 - DNA, 25 bp, Mus musculus
gcatttacccatctggtgctgccca

SEQ ID NO: 544883 - DNA, 25 bp, Mus musculus
gcatttacccatgtggtgctgccca

SEQ ID NO: 544884 - DNA, 25 bp, Mus musculus
gcatttacccccaatttggtggact

SEQ ID NO: 544885 - DNA, 25 bp, Mus musculus
gcatttaccccctatttggtggact

SEQ ID NO: 544886 - DNA, 25 bp, Mus musculus
gcatttacctagcatatctttggaa

SEQ ID NO: 544887 - DNA, 25 bp, Mus musculus
gcatttacctaggatatctttggaa

SEQ ID NO: 544888 - DNA, 25 bp, Mus musculus
gcatttacctccaccaggatcaaag

SEQ ID NO: 544889 - DNA, 25 bp, Mus musculus
gcatttacctcctccaggatcaaag

SEQ ID NO: 544890 - DNA, 25 bp, Mus musculus
gcatttacgagcaactgtactgctg

SEQ ID NO: 544891 - DNA, 25 bp, Mus musculus
gcatttacgagctactgtactgctg

SEQ ID NO: 544892 - DNA, 25 bp, Mus musculus
gcatttactaacaggcagctttcac

SEQ ID NO: 544893 - DNA, 25 bp, Mus musculus
gcatttactaactggcagctttcac

SEQ ID NO: 544894 - DNA, 25 bp, Mus musculus
gcatttactgctacttgatctctaa

SEQ ID NO: 544895 - DNA, 25 bp, Mus musculus
gcatttactgcttcttgatctctaa

SEQ ID NO: 544896 - DNA, 25 bp, Mus musculus
gcatttagaattattgtctgggcta

SEQ ID NO: 544897 - DNA, 25 bp, Mus musculus
gcatttagaatttttgtctgggcta

SEQ ID NO: 544898 - DNA, 25 bp, Mus musculus
gcatttagacgtcgcatgatcaaat

SEQ ID NO: 544899 - DNA, 25 bp, Mus musculus
gcatttagacgtggcatgatcaaat

SEQ ID NO: 544900 - DNA, 25 bp, Mus musculus
gcatttagataaatcagcttcttaa

SEQ ID NO: 544901 - DNA, 25 bp, Mus musculus
gcatttagataattcagcttcttaa

SEQ ID NO: 544902 - DNA, 25 bp, Mus musculus
gcatttagctctaggtcattccatt

SEQ ID NO: 544903 - DNA, 25 bp, Mus musculus
gcatttagctcttggtcattccatt

SEQ ID NO: 544904 - DNA, 25 bp, Mus musculus
gcatttaggcttcacgtggttaacg

SEQ ID NO: 544905 - DNA, 25 bp, Mus musculus
gcatttaggcttgacgtggttaacg

SEQ ID NO: 544906 - DNA, 25 bp, Mus musculus
gcatttagtttgattctcggttacg

SEQ ID NO: 544907 - DNA, 25 bp, Mus musculus
gcatttagtttgtttctcggttacg

SEQ ID NO: 544908 - DNA, 25 bp, Mus musculus
gcatttataagaccatctgaagtat

SEQ ID NO: 544909 - DNA, 25 bp, Mus musculus
gcatttataagagcatctgaagtat

SEQ ID NO: 544910 - DNA, 25 bp, Mus musculus
gcatttatactcacctttgcggaaa

SEQ ID NO: 544911 - DNA, 25 bp, Mus musculus
gcatttatactctcctttgcggaaa

SEQ ID NO: 544912 - DNA, 25 bp, Mus musculus
gcatttatacttagcccagatcaat

SEQ ID NO: 544913 - DNA, 25 bp, Mus musculus
gcatttatactttgcccagatcaat

SEQ ID NO: 544914 - DNA, 25 bp, Mus musculus
gcatttatattacagtgcccttaac

SEQ ID NO: 544915 - DNA, 25 bp, Mus musculus
gcatttatattagagtgcccttaac

SEQ ID NO: 544916 - DNA, 25 bp, Mus musculus
gcatttatatttatgtggagtgtac

SEQ ID NO: 544917 - DNA, 25 bp, Mus musculus
gcatttatatttttgtggagtgtac

SEQ ID NO: 544918 - DNA, 25 bp, Mus musculus
gcatttatcacaattctcaggcata

SEQ ID NO: 544919 - DNA, 25 bp, Mus musculus
gcatttatcacatttctcaggcata

SEQ ID NO: 544920 - DNA, 25 bp, Mus musculus
gcatttatcagaacaaaaccaaccc

SEQ ID NO: 544921 - DNA, 25 bp, Mus musculus
gcatttatcagatcaaaaccaaccc

SEQ ID NO: 544922 - DNA, 25 bp, Mus musculus
gcatttatgcacatagggtccttca

SEQ ID NO: 544923 - DNA, 25 bp, Mus musculus
gcatttatgcacttagggtccttca

SEQ ID NO: 544924 - DNA, 25 bp, Mus musculus
gcatttatgctcatattcctactta

SEQ ID NO: 544925 - DNA, 25 bp, Mus musculus
gcatttatgctcttattcctactta

SEQ ID NO: 544926 - DNA, 25 bp, Mus musculus
gcatttatggcgcttctggttccaa

SEQ ID NO: 544927 - DNA, 25 bp, Mus musculus
gcatttatggcggttctggttccaa

SEQ ID NO: 544928 - DNA, 25 bp, Mus musculus
gcatttatggctctgactcagaaca

SEQ ID NO: 544929 - DNA, 25 bp, Mus musculus
gcatttatggctgtgactcagaaca

SEQ ID NO: 544930 - DNA, 25 bp, Mus musculus
gcatttatgtcaccttataaggtgc

SEQ ID NO: 544931 - DNA, 25 bp, Mus musculus
gcatttatgtcagcttataaggtgc

SEQ ID NO: 544932 - DNA, 25 bp, Mus musculus
gcatttattacaaacctgggtctct

SEQ ID NO: 544933 - DNA, 25 bp, Mus musculus
gcatttattacatacctgggtctct

SEQ ID NO: 544934 - DNA, 25 bp, Mus musculus
gcatttattagcctgcatttcacta

SEQ ID NO: 544935 - DNA, 25 bp, Mus musculus
gcatttattagcgtgcatttcacta

SEQ ID NO: 544936 - DNA, 25 bp, Mus musculus
gcatttattcagagtattgcactta

SEQ ID NO: 544937 - DNA, 25 bp, Mus musculus
gcatttattcagtgtattgcactta

SEQ ID NO: 544938 - DNA, 25 bp, Mus musculus
gcatttattgatcctcaaaagttac

SEQ ID NO: 544939 - DNA, 25 bp, Mus musculus
gcatttattgatgctcaaaagttac

SEQ ID NO: 544940 - DNA, 25 bp, Mus musculus
gcatttattgtacctcaacctttgt

SEQ ID NO: 544941 - DNA, 25 bp, Mus musculus
gcatttattgtagctcaacctttgt

SEQ ID NO: 544942 - DNA, 25 bp, Mus musculus
gcatttattgtgagttggctgccct

SEQ ID NO: 544943 - DNA, 25 bp, Mus musculus
gcatttattgtgtgttggctgccct

SEQ ID NO: 544944 - DNA, 25 bp, Mus musculus
gcatttcaaaagacacgccaggaca

SEQ ID NO: 544945 - DNA, 25 bp, Mus musculus
gcatttcaaaagtcacgccaggaca

SEQ ID NO: 544946 - DNA, 25 bp, Mus musculus
gcatttcaaaatacacttagcagcc

SEQ ID NO: 544947 - DNA, 25 bp, Mus musculus
gcatttcaaaattcacttagcagcc

SEQ ID NO: 544948 - DNA, 25 bp, Mus musculus
gcatttcaaacaaccttccaatgac

SEQ ID NO: 544949 - DNA, 25 bp, Mus musculus
gcatttcaaacatccttccaatgac

SEQ ID NO: 544950 - DNA, 25 bp, Mus musculus
gcatttcaaccactagtagtaacac

SEQ ID NO: 544951 - DNA, 25 bp, Mus musculus
gcatttcaaccagtagtagtaacac

SEQ ID NO: 544952 - DNA, 25 bp, Mus musculus
gcatttcaacttagctgtaggtttt

SEQ ID NO: 544953 - DNA, 25 bp, Mus musculus
gcatttcaactttgctgtaggtttt

SEQ ID NO: 544954 - DNA, 25 bp, Mus musculus
gcatttcaagagaagcgtggagttt

SEQ ID NO: 544955 - DNA, 25 bp, Mus musculus
gcatttcaagagtagcgtggagttt

SEQ ID NO: 544956 - DNA, 25 bp, Mus musculus
gcatttcacagtactctacgaaatc

SEQ ID NO: 544957 - DNA, 25 bp, Mus musculus
gcatttcacagttctctacgaaatc

SEQ ID NO: 544958 - DNA, 25 bp, Mus musculus
gcatttcacattagtataccaagat

SEQ ID NO: 544959 - DNA, 25 bp, Mus musculus
gcatttcacatttgtataccaagat

SEQ ID NO: 544960 - DNA, 25 bp, Mus musculus
gcatttcactatattttctcgatag

SEQ ID NO: 544961 - DNA, 25 bp, Mus musculus
gcatttcactattttttctcgatag

SEQ ID NO: 544962 - DNA, 25 bp, Mus musculus
gcatttcactcaacaaattgggtca

SEQ ID NO: 544963 - DNA, 25 bp, Mus musculus
gcatttcactcatcaaattgggtca

SEQ ID NO: 544964 - DNA, 25 bp, Mus musculus
gcatttcactgcagactgcaagttt

SEQ ID NO: 544965 - DNA, 25 bp, Mus musculus
gcatttcactgctgactgcaagttt

SEQ ID NO: 544966 - DNA, 25 bp, Mus musculus
gcatttcactggaagatcatcccta

SEQ ID NO: 544967 - DNA, 25 bp, Mus musculus
gcatttcactggcagcttgcactat

SEQ ID NO: 544968 - DNA, 25 bp, Mus musculus
gcatttcactgggagcttgcactat

SEQ ID NO: 544969 - DNA, 25 bp, Mus musculus
gcatttcactggtagatcatcccta

SEQ ID NO: 544970 - DNA, 25 bp, Mus musculus
gcatttcagcaactgacttctgcga

SEQ ID NO: 544971 - DNA, 25 bp, Mus musculus
gcatttcagcaagtgacttctgcga

SEQ ID NO: 544972 - DNA, 25 bp, Mus musculus
gcatttcagctgagttgacgtgggt

SEQ ID NO: 544973 - DNA, 25 bp, Mus musculus
gcatttcagctgtgttgacgtgggt

SEQ ID NO: 544974 - DNA, 25 bp, Mus musculus
gcatttcaggctagcttctttcaga

SEQ ID NO: 544975 - DNA, 25 bp, Mus musculus
gcatttcaggcttgcttctttcaga

SEQ ID NO: 544976 - DNA, 25 bp, Mus musculus
gcatttcagtatcgtagctcagtga

SEQ ID NO: 544977 - DNA, 25 bp, Mus musculus
gcatttcagtatggtagctcagtga

SEQ ID NO: 544978 - DNA, 25 bp, Mus musculus
gcatttcagttcctgtttatagcca

SEQ ID NO: 544979 - DNA, 25 bp, Mus musculus
gcatttcagttcgtgtttatagcca

SEQ ID NO: 544980 - DNA, 25 bp, Mus musculus
gcatttcatagtatggttgtatcca

SEQ ID NO: 544981 - DNA, 25 bp, Mus musculus
gcatttcatagtttggttgtatcca

SEQ ID NO: 544982 - DNA, 25 bp, Mus musculus
gcatttcatcagcaatccacaggac

SEQ ID NO: 544983 - DNA, 25 bp, Mus musculus
gcatttcatcaggaatccacaggac

SEQ ID NO: 544984 - DNA, 25 bp, Mus musculus
gcatttcatcccctttacattaaat

SEQ ID NO: 544985 - DNA, 25 bp, Mus musculus
gcatttcatcccgtttacattaaat

SEQ ID NO: 544986 - DNA, 25 bp, Mus musculus
gcatttcatccgcaagtctttgggt

SEQ ID NO: 544987 - DNA, 25 bp, Mus musculus
gcatttcatccggaagtctttgggt

SEQ ID NO: 544988 - DNA, 25 bp, Mus musculus
gcatttcatctgatgctcagcaaga

SEQ ID NO: 544989 - DNA, 25 bp, Mus musculus
gcatttcatctgttgctcagcaaga

SEQ ID NO: 544990 - DNA, 25 bp, Mus musculus
gcatttcattgtctgcagtctgcag

SEQ ID NO: 544991 - DNA, 25 bp, Mus musculus
gcatttcattgtcttacccttgaac

SEQ ID NO: 544992 - DNA, 25 bp, Mus musculus
gcatttcattgtgtgcagtctgcag

SEQ ID NO: 544993 - DNA, 25 bp, Mus musculus
gcatttcattgtgttacccttgaac

SEQ ID NO: 544994 - DNA, 25 bp, Mus musculus
gcatttcatttgcacttcacattga

SEQ ID NO: 544995 - DNA, 25 bp, Mus musculus
gcatttcatttggacttcacattga

SEQ ID NO: 544996 - DNA, 25 bp, Mus musculus
gcatttccacaaaggtcaagctgat

SEQ ID NO: 544997 - DNA, 25 bp, Mus musculus
gcatttccacaatggtcaagctgat

SEQ ID NO: 544998 - DNA, 25 bp, Mus musculus
gcatttccacagcagcagccaacat

SEQ ID NO: 544999 - DNA, 25 bp, Mus musculus
gcatttccacaggagcagccaacat

SEQ ID NO: 545000 - DNA, 25 bp, Mus musculus
gcatttccagaaacttttgtgcatg

SEQ ID NO: 545001 - DNA, 25 bp, Mus musculus
gcatttccagaatcttttgtgcatg

SEQ ID NO: 545002 - DNA, 25 bp, Mus musculus
gcatttccagagagtgcaggactca

SEQ ID NO: 545003 - DNA, 25 bp, Mus musculus
gcatttccagagtgtgcaggactca

SEQ ID NO: 545004 - DNA, 25 bp, Mus musculus
gcatttccagcacctgccaagattt

SEQ ID NO: 545005 - DNA, 25 bp, Mus musculus
gcatttccagcagctgccaagattt

SEQ ID NO: 545006 - DNA, 25 bp, Mus musculus
gcatttcccaagaagcagaactaat

SEQ ID NO: 545007 - DNA, 25 bp, Mus musculus
gcatttcccaagtagcagaactaat

SEQ ID NO: 545008 - DNA, 25 bp, Mus musculus
gcatttcccactccatagaacaaga

SEQ ID NO: 545009 - DNA, 25 bp, Mus musculus
gcatttcccactgcatagaacaaga

SEQ ID NO: 545010 - DNA, 25 bp, Mus musculus
gcatttcccagacaaacttttggac

SEQ ID NO: 545011 - DNA, 25 bp, Mus musculus
gcatttcccagagaaacttttggac

SEQ ID NO: 545012 - DNA, 25 bp, Mus musculus
gcatttcccatcctcttgaataggg

SEQ ID NO: 545013 - DNA, 25 bp, Mus musculus
gcatttcccatcgtcttgaataggg

SEQ ID NO: 545014 - DNA, 25 bp, Mus musculus
gcatttccccttcgatatttggcta

SEQ ID NO: 545015 - DNA, 25 bp, Mus musculus
gcatttccccttggatatttggcta

SEQ ID NO: 545016 - DNA, 25 bp, Mus musculus
gcatttccctcaatgcttaacaaac

SEQ ID NO: 545017 - DNA, 25 bp, Mus musculus
gcatttccctcattgcttaacaaac

SEQ ID NO: 545018 - DNA, 25 bp, Mus musculus
gcatttcctgatcacagctgtgttc

SEQ ID NO: 545019 - DNA, 25 bp, Mus musculus
gcatttcctgatgacagctgtgttc

SEQ ID NO: 545020 - DNA, 25 bp, Mus musculus
gcatttcctggacttagtcatatat

SEQ ID NO: 545021 - DNA, 25 bp, Mus musculus
gcatttcctggagttagtcatatat

SEQ ID NO: 545022 - DNA, 25 bp, Mus musculus
gcatttcctgtaccaccgtgatgag

SEQ ID NO: 545023 - DNA, 25 bp, Mus musculus
gcatttcctgtagcaccgtgatgag

SEQ ID NO: 545024 - DNA, 25 bp, Mus musculus
gcatttcctgttccttttaagaagt

SEQ ID NO: 545025 - DNA, 25 bp, Mus musculus
gcatttcctgttgcttttaagaagt

SEQ ID NO: 545026 - DNA, 25 bp, Mus musculus
gcatttcgaataaagacaaaccctc

SEQ ID NO: 545027 - DNA, 25 bp, Mus musculus
gcatttcgaatatagacaaaccctc

SEQ ID NO: 545028 - DNA, 25 bp, Mus musculus
gcatttcgatccacgtcaggtgcag

SEQ ID NO: 545029 - DNA, 25 bp, Mus musculus
gcatttcgatcctcgtcaggtgcag

SEQ ID NO: 545030 - DNA, 25 bp, Mus musculus
gcatttcggctgaggctttgagata

SEQ ID NO: 545031 - DNA, 25 bp, Mus musculus
gcatttcggctgtggctttgagata

SEQ ID NO: 545032 - DNA, 25 bp, Mus musculus
gcatttcgggcaactttataaaaca

SEQ ID NO: 545033 - DNA, 25 bp, Mus musculus
gcatttcgggcatctttataaaaca

SEQ ID NO: 545034 - DNA, 25 bp, Mus musculus
gcatttcgttccctggtgtaaaaag

SEQ ID NO: 545035 - DNA, 25 bp, Mus musculus
gcatttcgttccgtggtgtaaaaag

SEQ ID NO: 545036 - DNA, 25 bp, Mus musculus
gcatttctaaataacagtcattctg

SEQ ID NO: 545037 - DNA, 25 bp, Mus musculus
gcatttctaaattacagtcattctg

SEQ ID NO: 545038 - DNA, 25 bp, Mus musculus
gcatttctagttcttggctttcata

SEQ ID NO: 545039 - DNA, 25 bp, Mus musculus
gcatttctagttgttggctttcata

SEQ ID NO: 545040 - DNA, 25 bp, Mus musculus
gcatttctcaccaggcatcatagat

SEQ ID NO: 545041 - DNA, 25 bp, Mus musculus
gcatttctcacctggcatcatagat

SEQ ID NO: 545042 - DNA, 25 bp, Mus musculus
gcatttctcagtcggtgtgtaatca

SEQ ID NO: 545043 - DNA, 25 bp, Mus musculus
gcatttctcagtgggtgtgtaatca

SEQ ID NO: 545044 - DNA, 25 bp, Mus musculus
gcatttctcattaggctggcaaggc

SEQ ID NO: 545045 - DNA, 25 bp, Mus musculus
gcatttctcatttggctggcaaggc

SEQ ID NO: 545046 - DNA, 25 bp, Mus musculus
gcatttctctacaaagaactggctg

SEQ ID NO: 545047 - DNA, 25 bp, Mus musculus
gcatttctctactaagaactggctg

SEQ ID NO: 545048 - DNA, 25 bp, Mus musculus
gcatttctctagattgggacctcat

SEQ ID NO: 545049 - DNA, 25 bp, Mus musculus
gcatttctctagtttgggacctcat

SEQ ID NO: 545050 - DNA, 25 bp, Mus musculus
gcatttctctgtaaatcttataacc

SEQ ID NO: 545051 - DNA, 25 bp, Mus musculus
gcatttctctgtattttgcaagata

SEQ ID NO: 545052 - DNA, 25 bp, Mus musculus
gcatttctctgttaatcttataacc

SEQ ID NO: 545053 - DNA, 25 bp, Mus musculus
gcatttctctgttttttgcaagata

SEQ ID NO: 545054 - DNA, 25 bp, Mus musculus
gcatttctcttgatgtttcctgttt

SEQ ID NO: 545055 - DNA, 25 bp, Mus musculus
gcatttctcttgttgtttcctgttt

SEQ ID NO: 545056 - DNA, 25 bp, Mus musculus
gcatttctgaaaatccttgtctagt

SEQ ID NO: 545057 - DNA, 25 bp, Mus musculus
gcatttctgaaattccttgtctagt

SEQ ID NO: 545058 - DNA, 25 bp, Mus musculus
gcatttctgaataggcactctgatt

SEQ ID NO: 545059 - DNA, 25 bp, Mus musculus
gcatttctgaattggcactctgatt

SEQ ID NO: 545060 - DNA, 25 bp, Mus musculus
gcatttctgaccaattctgaggcca

SEQ ID NO: 545061 - DNA, 25 bp, Mus musculus
gcatttctgacctattctgaggcca

SEQ ID NO: 545062 - DNA, 25 bp, Mus musculus
gcatttctgatgaagggcgactgac

SEQ ID NO: 545063 - DNA, 25 bp, Mus musculus
gcatttctgatgtagggcgactgac

SEQ ID NO: 545064 - DNA, 25 bp, Mus musculus
gcatttctgccgatttacaaaaata

SEQ ID NO: 545065 - DNA, 25 bp, Mus musculus
gcatttctgccgttttacaaaaata

SEQ ID NO: 545066 - DNA, 25 bp, Mus musculus
gcatttctgtagatgcacaagaact

SEQ ID NO: 545067 - DNA, 25 bp, Mus musculus
gcatttctgtagttgcacaagaact

SEQ ID NO: 545068 - DNA, 25 bp, Mus musculus
gcatttctgtgcagaactgttaatt

SEQ ID NO: 545069 - DNA, 25 bp, Mus musculus
gcatttctgtgctgaactgttaatt

SEQ ID NO: 545070 - DNA, 25 bp, Mus musculus
gcatttcttaaaatcacctggaaaa

SEQ ID NO: 545071 - DNA, 25 bp, Mus musculus
gcatttcttaaattcacctggaaaa

SEQ ID NO: 545072 - DNA, 25 bp, Mus musculus
gcatttcttaatacacccctacaag

SEQ ID NO: 545073 - DNA, 25 bp, Mus musculus
gcatttcttaattcacccctacaag

SEQ ID NO: 545074 - DNA, 25 bp, Mus musculus
gcatttcttcatccagtccggtgaa

SEQ ID NO: 545075 - DNA, 25 bp, Mus musculus
gcatttcttcatgcagtccggtgaa

SEQ ID NO: 545076 - DNA, 25 bp, Mus musculus
gcatttcttcccatcagcaatgaga

SEQ ID NO: 545077 - DNA, 25 bp, Mus musculus
gcatttcttcccttcagcaatgaga

SEQ ID NO: 545078 - DNA, 25 bp, Mus musculus
gcatttcttctactctactctggca

SEQ ID NO: 545079 - DNA, 25 bp, Mus musculus
gcatttcttctacttactgaccagg

SEQ ID NO: 545080 - DNA, 25 bp, Mus musculus
gcatttcttctagtctactctggca

SEQ ID NO: 545081 - DNA, 25 bp, Mus musculus
gcatttcttctagttactgaccagg

SEQ ID NO: 545082 - DNA, 25 bp, Mus musculus
gcatttcttgttaacattcaacctg

SEQ ID NO: 545083 - DNA, 25 bp, Mus musculus
gcatttcttgtttacattcaacctg

SEQ ID NO: 545084 - DNA, 25 bp, Mus musculus
gcatttctttacagatacccacgtc

SEQ ID NO: 545085 - DNA, 25 bp, Mus musculus
gcatttctttactgatacccacgtc

SEQ ID NO: 545086 - DNA, 25 bp, Mus musculus
gcatttctttccagggtccgatgaa

SEQ ID NO: 545087 - DNA, 25 bp, Mus musculus
gcatttctttcctgggtccgatgaa

SEQ ID NO: 545088 - DNA, 25 bp, Mus musculus
gcatttcttttcactgctagatcac

SEQ ID NO: 545089 - DNA, 25 bp, Mus musculus
gcatttcttttctctgctagatcac

SEQ ID NO: 545090 - DNA, 25 bp, Mus musculus
gcatttcttttgcaagttacccatt

SEQ ID NO: 545091 - DNA, 25 bp, Mus musculus
gcatttcttttggaagttacccatt

SEQ ID NO: 545092 - DNA, 25 bp, Mus musculus
gcatttgaaaaaatggccctcccgg

SEQ ID NO: 545093 - DNA, 25 bp, Mus musculus
gcatttgaaaaattggccctcccgg

SEQ ID NO: 545094 - DNA, 25 bp, Mus musculus
gcatttgaaacacattgcctacaat

SEQ ID NO: 545095 - DNA, 25 bp, Mus musculus
gcatttgaaacagattgcctacaat

SEQ ID NO: 545096 - DNA, 25 bp, Mus musculus
gcatttgaaagcagaccctagtagt

SEQ ID NO: 545097 - DNA, 25 bp, Mus musculus
gcatttgaaagctgaccctagtagt

SEQ ID NO: 545098 - DNA, 25 bp, Mus musculus
gcatttgaaatcatgacctgaggtc

SEQ ID NO: 545099 - DNA, 25 bp, Mus musculus
gcatttgaaatcttgacctgaggtc

SEQ ID NO: 545100 - DNA, 25 bp, Mus musculus
gcatttgaacagagtgccatggcca

SEQ ID NO: 545101 - DNA, 25 bp, Mus musculus
gcatttgaacagtgtgccatggcca

SEQ ID NO: 545102 - DNA, 25 bp, Mus musculus
gcatttgaattcatgcagcgcgccc

SEQ ID NO: 545103 - DNA, 25 bp, Mus musculus
gcatttgaattcttgcagcgcgccc

SEQ ID NO: 545104 - DNA, 25 bp, Mus musculus
gcatttgacaagatgattcgcaagc

SEQ ID NO: 545105 - DNA, 25 bp, Mus musculus
gcatttgacaagttgattcgcaagc

SEQ ID NO: 545106 - DNA, 25 bp, Mus musculus
gcatttgacaggatttcagttgtta

SEQ ID NO: 545107 - DNA, 25 bp, Mus musculus
gcatttgacaggttttcagttgtta

SEQ ID NO: 545108 - DNA, 25 bp, Mus musculus
gcatttgaccctaaactggctccag

SEQ ID NO: 545109 - DNA, 25 bp, Mus musculus
gcatttgacccttaactggctccag

SEQ ID NO: 545110 - DNA, 25 bp, Mus musculus
gcatttgagacaacttctacctcac

SEQ ID NO: 545111 - DNA, 25 bp, Mus musculus
gcatttgagacatcttctacctcac

SEQ ID NO: 545112 - DNA, 25 bp, Mus musculus
gcatttgagatgactccggctgagt

SEQ ID NO: 545113 - DNA, 25 bp, Mus musculus
gcatttgagatgtctccggctgagt

SEQ ID NO: 545114 - DNA, 25 bp, Mus musculus
gcatttgagcacatatggcctacta

SEQ ID NO: 545115 - DNA, 25 bp, Mus musculus
gcatttgagcacttatggcctacta

SEQ ID NO: 545116 - DNA, 25 bp, Mus musculus
gcatttgatcaaactctgtcctatt

SEQ ID NO: 545117 - DNA, 25 bp, Mus musculus
gcatttgatcaatctctgtcctatt

SEQ ID NO: 545118 - DNA, 25 bp, Mus musculus
gcatttgatcatattgcatctgtgc

SEQ ID NO: 545119 - DNA, 25 bp, Mus musculus
gcatttgatcattttgcatctgtgc

SEQ ID NO: 545120 - DNA, 25 bp, Mus musculus
gcatttgatccaaacagctcttttg

SEQ ID NO: 545121 - DNA, 25 bp, Mus musculus
gcatttgatccatacagctcttttg

SEQ ID NO: 545122 - DNA, 25 bp, Mus musculus
gcatttgatgaactgctggccagta

SEQ ID NO: 545123 - DNA, 25 bp, Mus musculus
gcatttgatgaagtgctggccagta

SEQ ID NO: 545124 - DNA, 25 bp, Mus musculus
gcatttgattataagctgtgtcctg

SEQ ID NO: 545125 - DNA, 25 bp, Mus musculus
gcatttgattattagctgtgtcctg

SEQ ID NO: 545126 - DNA, 25 bp, Mus musculus
gcatttgcaagaatgccttgggacc

SEQ ID NO: 545127 - DNA, 25 bp, Mus musculus
gcatttgcaagattgccttgggacc

SEQ ID NO: 545128 - DNA, 25 bp, Mus musculus
gcatttgcacataactgtacacgtt

SEQ ID NO: 545129 - DNA, 25 bp, Mus musculus
gcatttgcacattactgtacacgtt

SEQ ID NO: 545130 - DNA, 25 bp, Mus musculus
gcatttgcaggtacttgggacacta

SEQ ID NO: 545131 - DNA, 25 bp, Mus musculus
gcatttgcaggttcttgggacacta

SEQ ID NO: 545132 - DNA, 25 bp, Mus musculus
gcatttgcagttccggcatggacaa

SEQ ID NO: 545133 - DNA, 25 bp, Mus musculus
gcatttgcagttgcggcatggacaa

SEQ ID NO: 545134 - DNA, 25 bp, Mus musculus
gcatttgcattcacttgatattctt

SEQ ID NO: 545135 - DNA, 25 bp, Mus musculus
gcatttgcattctcttgatattctt

SEQ ID NO: 545136 - DNA, 25 bp, Mus musculus
gcatttgcatttatcagagctgagc

SEQ ID NO: 545137 - DNA, 25 bp, Mus musculus
gcatttgcatttttcagagctgagc

SEQ ID NO: 545138 - DNA, 25 bp, Mus musculus
gcatttgccactctccaggatgaac

SEQ ID NO: 545139 - DNA, 25 bp, Mus musculus
gcatttgccactgtccaggatgaac

SEQ ID NO: 545140 - DNA, 25 bp, Mus musculus
gcatttgccaggacccagtaagtca

SEQ ID NO: 545141 - DNA, 25 bp, Mus musculus
gcatttgccaggtcccagtaagtca

SEQ ID NO: 545142 - DNA, 25 bp, Mus musculus
gcatttgccagtaatactgctttct

SEQ ID NO: 545143 - DNA, 25 bp, Mus musculus
gcatttgccagttatactgctttct

SEQ ID NO: 545144 - DNA, 25 bp, Mus musculus
gcatttgcccgtagcacacacaagg

SEQ ID NO: 545145 - DNA, 25 bp, Mus musculus
gcatttgcccgttgcacacacaagg

SEQ ID NO: 545146 - DNA, 25 bp, Mus musculus
gcatttgccttcctaagaactgagt

SEQ ID NO: 545147 - DNA, 25 bp, Mus musculus
gcatttgccttcgtaagaactgagt

SEQ ID NO: 545148 - DNA, 25 bp, Mus musculus
gcatttgcgcctcttcttcatttca

SEQ ID NO: 545149 - DNA, 25 bp, Mus musculus
gcatttgcgcctgttcttcatttca

SEQ ID NO: 545150 - DNA, 25 bp, Mus musculus
gcatttgcgctcattgttaaggact

SEQ ID NO: 545151 - DNA, 25 bp, Mus musculus
gcatttgcgctctttgttaaggact

SEQ ID NO: 545152 - DNA, 25 bp, Mus musculus
gcatttgcgtgcagttctcctttaa

SEQ ID NO: 545153 - DNA, 25 bp, Mus musculus
gcatttgcgtgctgttctcctttaa

SEQ ID NO: 545154 - DNA, 25 bp, Mus musculus
gcatttgctagtatcaataccatta

SEQ ID NO: 545155 - DNA, 25 bp, Mus musculus
gcatttgctagtttcaataccatta

SEQ ID NO: 545156 - DNA, 25 bp, Mus musculus
gcatttgctcttatagggcagccta

SEQ ID NO: 545157 - DNA, 25 bp, Mus musculus
gcatttgctcttttagggcagccta

SEQ ID NO: 545158 - DNA, 25 bp, Mus musculus
gcatttgctgctctctgaatctttc

SEQ ID NO: 545159 - DNA, 25 bp, Mus musculus
gcatttgctgctctgtctgttgtat

SEQ ID NO: 545160 - DNA, 25 bp, Mus musculus
gcatttgctgctgtctgaatctttc

SEQ ID NO: 545161 - DNA, 25 bp, Mus musculus
gcatttgctgctgtgtctgttgtat

SEQ ID NO: 545162 - DNA, 25 bp, Mus musculus
gcatttgctggcaagccccagggaa

SEQ ID NO: 545163 - DNA, 25 bp, Mus musculus
gcatttgctggcctgtctagggctc

SEQ ID NO: 545164 - DNA, 25 bp, Mus musculus
gcatttgctggcgtgtctagggctc

SEQ ID NO: 545165 - DNA, 25 bp, Mus musculus
gcatttgctggctagccccagggaa

SEQ ID NO: 545166 - DNA, 25 bp, Mus musculus
gcatttggacagaaagccgggacct

SEQ ID NO: 545167 - DNA, 25 bp, Mus musculus
gcatttggacagtaagccgggacct

SEQ ID NO: 545168 - DNA, 25 bp, Mus musculus
gcatttggatgtacagactgactgg

SEQ ID NO: 545169 - DNA, 25 bp, Mus musculus
gcatttggatgttcagactgactgg

SEQ ID NO: 545170 - DNA, 25 bp, Mus musculus
gcatttggcttcagagtcagctctt

SEQ ID NO: 545171 - DNA, 25 bp, Mus musculus
gcatttggcttctgagtcagctctt

SEQ ID NO: 545172 - DNA, 25 bp, Mus musculus
gcatttggcttgatgagatctctgc

SEQ ID NO: 545173 - DNA, 25 bp, Mus musculus
gcatttggcttgttgagatctctgc

SEQ ID NO: 545174 - DNA, 25 bp, Mus musculus
gcatttgggagtcaacgccctcttc

SEQ ID NO: 545175 - DNA, 25 bp, Mus musculus
gcatttgggagtgaacgccctcttc

SEQ ID NO: 545176 - DNA, 25 bp, Mus musculus
gcatttgggcagctaaaacactcag

SEQ ID NO: 545177 - DNA, 25 bp, Mus musculus
gcatttgggcaggtaaaacactcag

SEQ ID NO: 545178 - DNA, 25 bp, Mus musculus
gcatttggtactcgcttttgtgata

SEQ ID NO: 545179 - DNA, 25 bp, Mus musculus
gcatttggtactggcttttgtgata

SEQ ID NO: 545180 - DNA, 25 bp, Mus musculus
gcatttggttagctagtgagccctg

SEQ ID NO: 545181 - DNA, 25 bp, Mus musculus
gcatttggttaggtagtgagccctg

SEQ ID NO: 545182 - DNA, 25 bp, Mus musculus
gcatttgtacaacgagttcatcagc

SEQ ID NO: 545183 - DNA, 25 bp, Mus musculus
gcatttgtacaaggagttcatcagc

SEQ ID NO: 545184 - DNA, 25 bp, Mus musculus
gcatttgtagataatctagtcacat

SEQ ID NO: 545185 - DNA, 25 bp, Mus musculus
gcatttgtagattatctagtcacat

SEQ ID NO: 545186 - DNA, 25 bp, Mus musculus
gcatttgtagggacaacaagcacaa

SEQ ID NO: 545187 - DNA, 25 bp, Mus musculus
gcatttgtagggtcaacaagcacaa

SEQ ID NO: 545188 - DNA, 25 bp, Mus musculus
gcatttgtcactaaggtttaggtca

SEQ ID NO: 545189 - DNA, 25 bp, Mus musculus
gcatttgtcacttaggtttaggtca

SEQ ID NO: 545190 - DNA, 25 bp, Mus musculus
gcatttgtcatacgtttctacttaa

SEQ ID NO: 545191 - DNA, 25 bp, Mus musculus
gcatttgtcataggtttctacttaa

SEQ ID NO: 545192 - DNA, 25 bp, Mus musculus
gcatttgtcttaaattctctactta

SEQ ID NO: 545193 - DNA, 25 bp, Mus musculus
gcatttgtcttatattctctactta

SEQ ID NO: 545194 - DNA, 25 bp, Mus musculus
gcatttgtgaatagcttccttcctc

SEQ ID NO: 545195 - DNA, 25 bp, Mus musculus
gcatttgtgaattgcttccttcctc

SEQ ID NO: 545196 - DNA, 25 bp, Mus musculus
gcatttgtgcaaattcatttcatca

SEQ ID NO: 545197 - DNA, 25 bp, Mus musculus
gcatttgtgcaatttcatttcatca

SEQ ID NO: 545198 - DNA, 25 bp, Mus musculus
gcatttgtgcctatgcaggttatgt

SEQ ID NO: 545199 - DNA, 25 bp, Mus musculus
gcatttgtgcctttgcaggttatgt

SEQ ID NO: 545200 - DNA, 25 bp, Mus musculus
gcatttgtgctcatttgcaaggaca

SEQ ID NO: 545201 - DNA, 25 bp, Mus musculus
gcatttgtgctcttttgcaaggaca

SEQ ID NO: 545202 - DNA, 25 bp, Mus musculus
gcatttgtggtgcttcttgcatgat

SEQ ID NO: 545203 - DNA, 25 bp, Mus musculus
gcatttgtggtggttcttgcatgat

SEQ ID NO: 545204 - DNA, 25 bp, Mus musculus
gcatttgtggttctttgactgggaa

SEQ ID NO: 545205 - DNA, 25 bp, Mus musculus
gcatttgtggttgtttgactgggaa

SEQ ID NO: 545206 - DNA, 25 bp, Mus musculus
gcatttgtgtaactctatgtgaatt

SEQ ID NO: 545207 - DNA, 25 bp, Mus musculus
gcatttgtgtaagtctatgtgaatt

SEQ ID NO: 545208 - DNA, 25 bp, Mus musculus
gcatttgtgtctctacctgtttaat

SEQ ID NO: 545209 - DNA, 25 bp, Mus musculus
gcatttgtgtctgtacctgtttaat

SEQ ID NO: 545210 - DNA, 25 bp, Mus musculus
gcatttgttactacttacttccttg

SEQ ID NO: 545211 - DNA, 25 bp, Mus musculus
gcatttgttacttcttacttccttg

SEQ ID NO: 545212 - DNA, 25 bp, Mus musculus
gcatttgttgatcgctatctaccta

SEQ ID NO: 545213 - DNA, 25 bp, Mus musculus
gcatttgttgatggctatctaccta

SEQ ID NO: 545214 - DNA, 25 bp, Mus musculus
gcatttgtttcccattgagacttgt

SEQ ID NO: 545215 - DNA, 25 bp, Mus musculus
gcatttgtttccgattgagacttgt

SEQ ID NO: 545216 - DNA, 25 bp, Mus musculus
gcatttgtttgactgttttagaacc

SEQ ID NO: 545217 - DNA, 25 bp, Mus musculus
gcatttgtttgagtgttttagaacc

SEQ ID NO: 545218 - DNA, 25 bp, Mus musculus
gcattttaaatgcatgccctgcatc

SEQ ID NO: 545219 - DNA, 25 bp, Mus musculus
gcattttaaatggatgccctgcatc

SEQ ID NO: 545220 - DNA, 25 bp, Mus musculus
gcattttaacccacgcttcgatgaa

SEQ ID NO: 545221 - DNA, 25 bp, Mus musculus
gcattttaaccctcgcttcgatgaa

SEQ ID NO: 545222 - DNA, 25 bp, Mus musculus
gcattttaactgacacctcagggat

SEQ ID NO: 545223 - DNA, 25 bp, Mus musculus
gcattttaactgtcacctcagggat

SEQ ID NO: 545224 - DNA, 25 bp, Mus musculus
gcattttaagccagaaggttctcta

SEQ ID NO: 545225 - DNA, 25 bp, Mus musculus
gcattttaagcctgaaggttctcta

SEQ ID NO: 545226 - DNA, 25 bp, Mus musculus
gcattttaatgacctcttggctcac

SEQ ID NO: 545227 - DNA, 25 bp, Mus musculus
gcattttaatgagctcttggctcac

SEQ ID NO: 545228 - DNA, 25 bp, Mus musculus
gcattttagatgatgttgccatggt

SEQ ID NO: 545229 - DNA, 25 bp, Mus musculus
gcattttagatgttgttgccatggt

SEQ ID NO: 545230 - DNA, 25 bp, Mus musculus
gcattttagcacagtttgcactgtt

SEQ ID NO: 545231 - DNA, 25 bp, Mus musculus
gcattttagcactgtttgcactgtt

SEQ ID NO: 545232 - DNA, 25 bp, Mus musculus
gcattttagccacagtatacttcct

SEQ ID NO: 545233 - DNA, 25 bp, Mus musculus
gcattttagccagagtatacttcct

SEQ ID NO: 545234 - DNA, 25 bp, Mus musculus
gcattttagctaattttacccaagt

SEQ ID NO: 545235 - DNA, 25 bp, Mus musculus
gcattttagctatttttacccaagt

SEQ ID NO: 545236 - DNA, 25 bp, Mus musculus
gcattttagcttcagaacagtgata

SEQ ID NO: 545237 - DNA, 25 bp, Mus musculus
gcattttagcttgagaacagtgata

SEQ ID NO: 545238 - DNA, 25 bp, Mus musculus
gcattttaggaaaattgacaggtca

SEQ ID NO: 545239 - DNA, 25 bp, Mus musculus
gcattttaggaatattgacaggtca

SEQ ID NO: 545240 - DNA, 25 bp, Mus musculus
gcattttatctgagtctgaacgtaa

SEQ ID NO: 545241 - DNA, 25 bp, Mus musculus
gcattttatctgtgtctgaacgtaa

SEQ ID NO: 545242 - DNA, 25 bp, Mus musculus
gcattttatttgactctttaaacag

SEQ ID NO: 545243 - DNA, 25 bp, Mus musculus
gcattttatttgtctctttaaacag

SEQ ID NO: 545244 - DNA, 25 bp, Mus musculus
gcattttcaaatatctctcgtttca

SEQ ID NO: 545245 - DNA, 25 bp, Mus musculus
gcattttcaaatttctctcgtttca

SEQ ID NO: 545246 - DNA, 25 bp, Mus musculus
gcattttcaagcactaactttgtaa

SEQ ID NO: 545247 - DNA, 25 bp, Mus musculus
gcattttcaagctctaactttgtaa

SEQ ID NO: 545248 - DNA, 25 bp, Mus musculus
gcattttcacttacaacttttctag

SEQ ID NO: 545249 - DNA, 25 bp, Mus musculus
gcattttcactttcaacttttctag

SEQ ID NO: 545250 - DNA, 25 bp, Mus musculus
gcattttcagacactatccctgagt

SEQ ID NO: 545251 - DNA, 25 bp, Mus musculus
gcattttcagactctatccctgagt

SEQ ID NO: 545252 - DNA, 25 bp, Mus musculus
gcattttcagctatttgtcataggg

SEQ ID NO: 545253 - DNA, 25 bp, Mus musculus
gcattttcagctttttgtcataggg

SEQ ID NO: 545254 - DNA, 25 bp, Mus musculus
gcattttcaggcagtgtgtgtgaca

SEQ ID NO: 545255 - DNA, 25 bp, Mus musculus
gcattttcaggctgtgtgtgtgaca

SEQ ID NO: 545256 - DNA, 25 bp, Mus musculus
gcattttcagtcattcatttccaga

SEQ ID NO: 545257 - DNA, 25 bp, Mus musculus
gcattttcagtctttcatttccaga

SEQ ID NO: 545258 - DNA, 25 bp, Mus musculus
gcattttcatccaccctgagagaga

SEQ ID NO: 545259 - DNA, 25 bp, Mus musculus
gcattttcatcctccctgagagaga

SEQ ID NO: 545260 - DNA, 25 bp, Mus musculus
gcattttcatgcatagttcaggact

SEQ ID NO: 545261 - DNA, 25 bp, Mus musculus
gcattttcatgcttagttcaggact

SEQ ID NO: 545262 - DNA, 25 bp, Mus musculus
gcattttccacaagaagaccttgta

SEQ ID NO: 545263 - DNA, 25 bp, Mus musculus
gcattttccacatgaagaccttgta

SEQ ID NO: 545264 - DNA, 25 bp, Mus musculus
gcattttccacgaacgctttccttt

SEQ ID NO: 545265 - DNA, 25 bp, Mus musculus
gcattttccacgtacgctttccttt

SEQ ID NO: 545266 - DNA, 25 bp, Mus musculus
gcattttccagcattacaatgaggc

SEQ ID NO: 545267 - DNA, 25 bp, Mus musculus
gcattttccagctttacaatgaggc

SEQ ID NO: 545268 - DNA, 25 bp, Mus musculus
gcattttccccgagggtatgtcaag

SEQ ID NO: 545269 - DNA, 25 bp, Mus musculus
gcattttccccgtgggtatgtcaag

SEQ ID NO: 545270 - DNA, 25 bp, Mus musculus
gcattttccctaacacctatgtaga

SEQ ID NO: 545271 - DNA, 25 bp, Mus musculus
gcattttccctaacaggattattta

SEQ ID NO: 545272 - DNA, 25 bp, Mus musculus
gcattttccctatcacctatgtaga

SEQ ID NO: 545273 - DNA, 25 bp, Mus musculus
gcattttccctatcaggattattta

SEQ ID NO: 545274 - DNA, 25 bp, Mus musculus
gcattttcctgaatgatgcttcgtg

SEQ ID NO: 545275 - DNA, 25 bp, Mus musculus
gcattttcctgattgatgcttcgtg

SEQ ID NO: 545276 - DNA, 25 bp, Mus musculus
gcattttcctgtaaaccctgtgtag

SEQ ID NO: 545277 - DNA, 25 bp, Mus musculus
gcattttcctgtagcttaggtttgt

SEQ ID NO: 545278 - DNA, 25 bp, Mus musculus
gcattttcctgttaaccctgtgtag

SEQ ID NO: 545279 - DNA, 25 bp, Mus musculus
gcattttcctgttgcttaggtttgt

SEQ ID NO: 545280 - DNA, 25 bp, Mus musculus
gcattttctccacgctctatacaaa

SEQ ID NO: 545281 - DNA, 25 bp, Mus musculus
gcattttctccaggctctatacaaa

SEQ ID NO: 545282 - DNA, 25 bp, Mus musculus
gcattttctcccattcacagatgag

SEQ ID NO: 545283 - DNA, 25 bp, Mus musculus
gcattttctccctttcacagatgag

SEQ ID NO: 545284 - DNA, 25 bp, Mus musculus
gcattttctctcattggtcagtctg

SEQ ID NO: 545285 - DNA, 25 bp, Mus musculus
gcattttctctctttggtcagtctg

SEQ ID NO: 545286 - DNA, 25 bp, Mus musculus
gcattttctctgatgcctagattgt

SEQ ID NO: 545287 - DNA, 25 bp, Mus musculus
gcattttctctgttgcctagattgt

SEQ ID NO: 545288 - DNA, 25 bp, Mus musculus
gcattttctcttaacgttcgctcag

SEQ ID NO: 545289 - DNA, 25 bp, Mus musculus
gcattttctctttacgttcgctcag

SEQ ID NO: 545290 - DNA, 25 bp, Mus musculus
gcattttctgaacccagttgggtaa

SEQ ID NO: 545291 - DNA, 25 bp, Mus musculus
gcattttctgaagccagttgggtaa

SEQ ID NO: 545292 - DNA, 25 bp, Mus musculus
gcattttcttctcaattggaccatt

SEQ ID NO: 545293 - DNA, 25 bp, Mus musculus
gcattttcttctgaattggaccatt

SEQ ID NO: 545294 - DNA, 25 bp, Mus musculus
gcattttcttgtataataatcctgt

SEQ ID NO: 545295 - DNA, 25 bp, Mus musculus
gcattttcttgtttaataatcctgt

SEQ ID NO: 545296 - DNA, 25 bp, Mus musculus
gcattttctttactgttatatccat

SEQ ID NO: 545297 - DNA, 25 bp, Mus musculus
gcattttctttagtgttatatccat

SEQ ID NO: 545298 - DNA, 25 bp, Mus musculus
gcattttgaactacctagtggccaa

SEQ ID NO: 545299 - DNA, 25 bp, Mus musculus
gcattttgaacttcctagtggccaa

SEQ ID NO: 545300 - DNA, 25 bp, Mus musculus
gcattttgacaacatccacagggac

SEQ ID NO: 545301 - DNA, 25 bp, Mus musculus
gcattttgacaagatccacagggac

SEQ ID NO: 545302 - DNA, 25 bp, Mus musculus
gcattttgacccaagtgttttaact

SEQ ID NO: 545303 - DNA, 25 bp, Mus musculus
gcattttgaccctagtgttttaact

SEQ ID NO: 545304 - DNA, 25 bp, Mus musculus
gcattttgatgacagcttggcctac

SEQ ID NO: 545305 - DNA, 25 bp, Mus musculus
gcattttgatgagagcttggcctac

SEQ ID NO: 545306 - DNA, 25 bp, Mus musculus
gcattttgcaaacctctatgtctta

SEQ ID NO: 545307 - DNA, 25 bp, Mus musculus
gcattttgcaaagctctatgtctta

SEQ ID NO: 545308 - DNA, 25 bp, Mus musculus
gcattttgcaagatacactgattga

SEQ ID NO: 545309 - DNA, 25 bp, Mus musculus
gcattttgcaagttacactgattga

SEQ ID NO: 545310 - DNA, 25 bp, Mus musculus
gcattttgcactccacagagttttt

SEQ ID NO: 545311 - DNA, 25 bp, Mus musculus
gcattttgcactgcacagagttttt

SEQ ID NO: 545312 - DNA, 25 bp, Mus musculus
gcattttgcatgattctggagaaac

SEQ ID NO: 545313 - DNA, 25 bp, Mus musculus
gcattttgcatgtttctggagaaac

SEQ ID NO: 545314 - DNA, 25 bp, Mus musculus
gcattttgcgttcttcatgtgtaat

SEQ ID NO: 545315 - DNA, 25 bp, Mus musculus
gcattttgcgttgttcatgtgtaat

SEQ ID NO: 545316 - DNA, 25 bp, Mus musculus
gcattttgcttgacatggttcaatc

SEQ ID NO: 545317 - DNA, 25 bp, Mus musculus
gcattttgcttgacgagatctgtta

SEQ ID NO: 545318 - DNA, 25 bp, Mus musculus
gcattttgcttgtcatggttcaatc

SEQ ID NO: 545319 - DNA, 25 bp, Mus musculus
gcattttgcttgtcgagatctgtta

SEQ ID NO: 545320 - DNA, 25 bp, Mus musculus
gcattttggaagactgtgttctgta

SEQ ID NO: 545321 - DNA, 25 bp, Mus musculus
gcattttggaagtctgtgttctgta

SEQ ID NO: 545322 - DNA, 25 bp, Mus musculus
gcattttggattcacctgaggaaca

SEQ ID NO: 545323 - DNA, 25 bp, Mus musculus
gcattttggattgacctgaggaaca

SEQ ID NO: 545324 - DNA, 25 bp, Mus musculus
gcattttgggcaaagtcttgaactc

SEQ ID NO: 545325 - DNA, 25 bp, Mus musculus
gcattttgggcatagtcttgaactc

SEQ ID NO: 545326 - DNA, 25 bp, Mus musculus
gcattttgggtacgcacactcttag

SEQ ID NO: 545327 - DNA, 25 bp, Mus musculus
gcattttgggtaggcacactcttag

SEQ ID NO: 545328 - DNA, 25 bp, Mus musculus
gcattttgtcaactgggctgcatcc

SEQ ID NO: 545329 - DNA, 25 bp, Mus musculus
gcattttgtcaagtgggctgcatcc

SEQ ID NO: 545330 - DNA, 25 bp, Mus musculus
gcattttgtcatattctgttctttt

SEQ ID NO: 545331 - DNA, 25 bp, Mus musculus
gcattttgtcattttctgttctttt

SEQ ID NO: 545332 - DNA, 25 bp, Mus musculus
gcattttgtgaaagctcctctgatg

SEQ ID NO: 545333 - DNA, 25 bp, Mus musculus
gcattttgtgaatgctcctctgatg

SEQ ID NO: 545334 - DNA, 25 bp, Mus musculus
gcattttgtgggatacatcatttct

SEQ ID NO: 545335 - DNA, 25 bp, Mus musculus
gcattttgtgggttacatcatttct

SEQ ID NO: 545336 - DNA, 25 bp, Mus musculus
gcattttgtgtcaggcctggtgtaa

SEQ ID NO: 545337 - DNA, 25 bp, Mus musculus
gcattttgtgtctggcctggtgtaa

SEQ ID NO: 545338 - DNA, 25 bp, Mus musculus
gcattttgtgttaagttggtccctt

SEQ ID NO: 545339 - DNA, 25 bp, Mus musculus
gcattttgtgtttagttggtccctt

SEQ ID NO: 545340 - DNA, 25 bp, Mus musculus
gcattttgttctaggtacagctgaa

SEQ ID NO: 545341 - DNA, 25 bp, Mus musculus
gcattttgttcttggtacagctgaa

SEQ ID NO: 545342 - DNA, 25 bp, Mus musculus
gcattttgttttcaacctctgttcc

SEQ ID NO: 545343 - DNA, 25 bp, Mus musculus
gcattttgttttctctcgtgatggt

SEQ ID NO: 545344 - DNA, 25 bp, Mus musculus
gcattttgttttgaacctctgttcc

SEQ ID NO: 545345 - DNA, 25 bp, Mus musculus
gcattttgttttgtctcgtgatggt

SEQ ID NO: 545346 - DNA, 25 bp, Mus musculus
gcatttttatgcaagctaaacacat

SEQ ID NO: 545347 - DNA, 25 bp, Mus musculus
gcatttttatgctagctaaacacat

SEQ ID NO: 545348 - DNA, 25 bp, Mus musculus
gcatttttcatcaggctcagtggct

SEQ ID NO: 545349 - DNA, 25 bp, Mus musculus
gcatttttcatctggctcagtggct

SEQ ID NO: 545350 - DNA, 25 bp, Mus musculus
gcatttttctctccttattgtctaa

SEQ ID NO: 545351 - DNA, 25 bp, Mus musculus
gcatttttctctgcttattgtctaa

SEQ ID NO: 545352 - DNA, 25 bp, Mus musculus
gcatttttgaacattcatcttagta

SEQ ID NO: 545353 - DNA, 25 bp, Mus musculus
gcatttttgaactttcatcttagta

SEQ ID NO: 545354 - DNA, 25 bp, Mus musculus
gcatttttggtcactagctggaagg

SEQ ID NO: 545355 - DNA, 25 bp, Mus musculus
gcatttttggtctctagctggaagg

SEQ ID NO: 545356 - DNA, 25 bp, Mus musculus
gcatttttgtgtcactgtgttttgt

SEQ ID NO: 545357 - DNA, 25 bp, Mus musculus
gcatttttgtgtgactgtgttttgt

SEQ ID NO: 545358 - DNA, 25 bp, Mus musculus
gcattttttagtatgtcatgggcaa

SEQ ID NO: 545359 - DNA, 25 bp, Mus musculus
gcattttttagtttgtcatgggcaa

SEQ ID NO: 545360 - DNA, 25 bp, Mus musculus
gcattttttcctagtccaccagtgc

SEQ ID NO: 545361 - DNA, 25 bp, Mus musculus
gcattttttccttgtccaccagtgc

SEQ ID NO: 545362 - DNA, 25 bp, Mus musculus
gcattttttgtcatgtgtcagataa

SEQ ID NO: 545363 - DNA, 25 bp, Mus musculus
gcattttttgtcttgtgtcagataa

SEQ ID NO: 545364 - DNA, 25 bp, Mus musculus
gccaaaaagagtccttgtccacttc

SEQ ID NO: 545365 - DNA, 25 bp, Mus musculus
gccaaaaagagtgcttgtccacttc

SEQ ID NO: 545366 - DNA, 25 bp, Mus musculus
gccaaaaataccatctcctggagag

SEQ ID NO: 545367 - DNA, 25 bp, Mus musculus
gccaaaaataccttctcctggagag

SEQ ID NO: 545368 - DNA, 25 bp, Mus musculus
gccaaaaatatgatgggccagtcca

SEQ ID NO: 545369 - DNA, 25 bp, Mus musculus
gccaaaaatatgttgggccagtcca

SEQ ID NO: 545370 - DNA, 25 bp, Mus musculus
gccaaaaatattctggctgccccgg

SEQ ID NO: 545371 - DNA, 25 bp, Mus musculus
gccaaaaatattgtggctgccccgg

SEQ ID NO: 545372 - DNA, 25 bp, Mus musculus
gccaaaaatcctcggccattcagta

SEQ ID NO: 545373 - DNA, 25 bp, Mus musculus
gccaaaaatcctgggccattcagta

SEQ ID NO: 545374 - DNA, 25 bp, Mus musculus
gccaaaaccaatccgtgagatctca

SEQ ID NO: 545375 - DNA, 25 bp, Mus musculus
gccaaaaccaatgcgtgagatctca

SEQ ID NO: 545376 - DNA, 25 bp, Mus musculus
gccaaaaccgagagtgaaggtgaca

SEQ ID NO: 545377 - DNA, 25 bp, Mus musculus
gccaaaaccgagtgtgaaggtgaca

SEQ ID NO: 545378 - DNA, 25 bp, Mus musculus
gccaaaaccgttaaaacttgcacat

SEQ ID NO: 545379 - DNA, 25 bp, Mus musculus
gccaaaaccgtttaaacttgcacat

SEQ ID NO: 545380 - DNA, 25 bp, Mus musculus
gccaaaaccttgcatcgaattcctt

SEQ ID NO: 545381 - DNA, 25 bp, Mus musculus
gccaaaaccttggatcgaattcctt

SEQ ID NO: 545382 - DNA, 25 bp, Mus musculus
gccaaaagaccacctaccaaacaaa

SEQ ID NO: 545383 - DNA, 25 bp, Mus musculus
gccaaaagaccagctaccaaacaaa

SEQ ID NO: 545384 - DNA, 25 bp, Mus musculus
gccaaaagagctagcacagtcagaa

SEQ ID NO: 545385 - DNA, 25 bp, Mus musculus
gccaaaagagcttgcacagtcagaa

SEQ ID NO: 545386 - DNA, 25 bp, Mus musculus
gccaaaagcaggactgtcctttctg

SEQ ID NO: 545387 - DNA, 25 bp, Mus musculus
gccaaaagcaggtctgtcctttctg

SEQ ID NO: 545388 - DNA, 25 bp, Mus musculus
gccaaaagcgaacaacgaccagatc

SEQ ID NO: 545389 - DNA, 25 bp, Mus musculus
gccaaaagcgaagaacgaccagatc

SEQ ID NO: 545390 - DNA, 25 bp, Mus musculus
gccaaaagtgacaactgggccatgt

SEQ ID NO: 545391 - DNA, 25 bp, Mus musculus
gccaaaagtgactactgggccatgt

SEQ ID NO: 545392 - DNA, 25 bp, Mus musculus
gccaaaagtggaatgactgcccctt

SEQ ID NO: 545393 - DNA, 25 bp, Mus musculus
gccaaaagtggattgactgcccctt

SEQ ID NO: 545394 - DNA, 25 bp, Mus musculus
gccaaaagtgttaacaggtcaacct

SEQ ID NO: 545395 - DNA, 25 bp, Mus musculus
gccaaaagtgtttacaggtcaacct

SEQ ID NO: 545396 - DNA, 25 bp, Mus musculus
gccaaaatattaacagttctcaact

SEQ ID NO: 545397 - DNA, 25 bp, Mus musculus
gccaaaatattatcagttctcaact

SEQ ID NO: 545398 - DNA, 25 bp, Mus musculus
gccaaaatgatcaagcaccttccag

SEQ ID NO: 545399 - DNA, 25 bp, Mus musculus
gccaaaatgatctagcaccttccag

SEQ ID NO: 545400 - DNA, 25 bp, Mus musculus
gccaaaatgggccatcacctatatt

SEQ ID NO: 545401 - DNA, 25 bp, Mus musculus
gccaaaatgggcgatcacctatatt

SEQ ID NO: 545402 - DNA, 25 bp, Mus musculus
gccaaaatgtctctccaagggaatg

SEQ ID NO: 545403 - DNA, 25 bp, Mus musculus
gccaaaatgtctgtccaagggaatg

SEQ ID NO: 545404 - DNA, 25 bp, Mus musculus
gccaaaatttatctgtgtagcctgt

SEQ ID NO: 545405 - DNA, 25 bp, Mus musculus
gccaaaatttatgtgtgtagcctgt

SEQ ID NO: 545406 - DNA, 25 bp, Mus musculus
gccaaacaagaacccgcagaggagc

SEQ ID NO: 545407 - DNA, 25 bp, Mus musculus
gccaaacaagaagccgcagaggagc

SEQ ID NO: 545408 - DNA, 25 bp, Mus musculus
gccaaacaaggtcaatccgacccag

SEQ ID NO: 545409 - DNA, 25 bp, Mus musculus
gccaaacaaggtgaatccgacccag

SEQ ID NO: 545410 - DNA, 25 bp, Mus musculus
gccaaacaatatacagggactaccc

SEQ ID NO: 545411 - DNA, 25 bp, Mus musculus
gccaaacaatattcagggactaccc

SEQ ID NO: 545412 - DNA, 25 bp, Mus musculus
gccaaacaccatcggctttgctgat

SEQ ID NO: 545413 - DNA, 25 bp, Mus musculus
gccaaacaccatgggctttgctgat

SEQ ID NO: 545414 - DNA, 25 bp, Mus musculus
gccaaacacttcactgtctgaagga

SEQ ID NO: 545415 - DNA, 25 bp, Mus musculus
gccaaacacttctctgtctgaagga

SEQ ID NO: 545416 - DNA, 25 bp, Mus musculus
gccaaacaggtcactctgtggtaga

SEQ ID NO: 545417 - DNA, 25 bp, Mus musculus
gccaaacaggtctctctgtggtaga

SEQ ID NO: 545418 - DNA, 25 bp, Mus musculus
gccaaacatcgtcgtgtcaggctgt

SEQ ID NO: 545419 - DNA, 25 bp, Mus musculus
gccaaacatcgtggtgtcaggctgt

SEQ ID NO: 545420 - DNA, 25 bp, Mus musculus
gccaaacattggctggtcttcagaa

SEQ ID NO: 545421 - DNA, 25 bp, Mus musculus
gccaaacattgggtggtcttcagaa

SEQ ID NO: 545422 - DNA, 25 bp, Mus musculus
gccaaaccgctgatgcagaaatgtg

SEQ ID NO: 545423 - DNA, 25 bp, Mus musculus
gccaaaccgctgttgcagaaatgtg

SEQ ID NO: 545424 - DNA, 25 bp, Mus musculus
gccaaacctttaactgtgctctggg

SEQ ID NO: 545425 - DNA, 25 bp, Mus musculus
gccaaacctttatctgtgctctggg

SEQ ID NO: 545426 - DNA, 25 bp, Mus musculus
gccaaacgagtacagcttgccaagt

SEQ ID NO: 545427 - DNA, 25 bp, Mus musculus
gccaaacgagtagagcttgccaagt

SEQ ID NO: 545428 - DNA, 25 bp, Mus musculus
gccaaactcagtaatggtgaccttg

SEQ ID NO: 545429 - DNA, 25 bp, Mus musculus
gccaaactcagttatggtgaccttg

SEQ ID NO: 545430 - DNA, 25 bp, Mus musculus
gccaaactcggccaaacttaggttg

SEQ ID NO: 545431 - DNA, 25 bp, Mus musculus
gccaaactcggcgaaacttaggttg

SEQ ID NO: 545432 - DNA, 25 bp, Mus musculus
gccaaactcttactttccaagtgtt

SEQ ID NO: 545433 - DNA, 25 bp, Mus musculus
gccaaactcttagtttccaagtgtt

SEQ ID NO: 545434 - DNA, 25 bp, Mus musculus
gccaaactgcaaatagatgtgtctt

SEQ ID NO: 545435 - DNA, 25 bp, Mus musculus
gccaaactgcaattagatgtgtctt

SEQ ID NO: 545436 - DNA, 25 bp, Mus musculus
gccaaactggcacaagctagaacat

SEQ ID NO: 545437 - DNA, 25 bp, Mus musculus
gccaaactggcagaagctagaacat

SEQ ID NO: 545438 - DNA, 25 bp, Mus musculus
gccaaactggcccttgaaactaaca

SEQ ID NO: 545439 - DNA, 25 bp, Mus musculus
gccaaactggccgttgaaactaaca

SEQ ID NO: 545440 - DNA, 25 bp, Mus musculus
gccaaactgttgcagtacctgacaa

SEQ ID NO: 545441 - DNA, 25 bp, Mus musculus
gccaaactgttggagtacctgacaa

SEQ ID NO: 545442 - DNA, 25 bp, Mus musculus
gccaaacttctgacttcataaagca

SEQ ID NO: 545443 - DNA, 25 bp, Mus musculus
gccaaacttctgtcttcataaagca

SEQ ID NO: 545444 - DNA, 25 bp, Mus musculus
gccaaactttttctcatctttcatg

SEQ ID NO: 545445 - DNA, 25 bp, Mus musculus
gccaaactttttgtcatctttcatg

SEQ ID NO: 545446 - DNA, 25 bp, Mus musculus
gccaaagaatcaccacataaggatt

SEQ ID NO: 545447 - DNA, 25 bp, Mus musculus
gccaaagaatcagcacataaggatt

SEQ ID NO: 545448 - DNA, 25 bp, Mus musculus
gccaaagactggatgaccctctgtt

SEQ ID NO: 545449 - DNA, 25 bp, Mus musculus
gccaaagactggttgaccctctgtt

SEQ ID NO: 545450 - DNA, 25 bp, Mus musculus
gccaaagagcaacggtagtccatgt

SEQ ID NO: 545451 - DNA, 25 bp, Mus musculus
gccaaagagcaagggtagtccatgt

SEQ ID NO: 545452 - DNA, 25 bp, Mus musculus
gccaaagagtcactgtttacttgag

SEQ ID NO: 545453 - DNA, 25 bp, Mus musculus
gccaaagagtcagtgtttacttgag

SEQ ID NO: 545454 - DNA, 25 bp, Mus musculus
gccaaagataataatagcggtacta

SEQ ID NO: 545455 - DNA, 25 bp, Mus musculus
gccaaagataattatagcggtacta

SEQ ID NO: 545456 - DNA, 25 bp, Mus musculus
gccaaagatgctactgggtggttta

SEQ ID NO: 545457 - DNA, 25 bp, Mus musculus
gccaaagatgcttctgggtggttta

SEQ ID NO: 545458 - DNA, 25 bp, Mus musculus
gccaaagatggccttatttcaaaac

SEQ ID NO: 545459 - DNA, 25 bp, Mus musculus
gccaaagatggcgttatttcaaaac

SEQ ID NO: 545460 - DNA, 25 bp, Mus musculus
gccaaagatgttccaaagcagctga

SEQ ID NO: 545461 - DNA, 25 bp, Mus musculus
gccaaagatgttccagcctccaagt

SEQ ID NO: 545462 - DNA, 25 bp, Mus musculus
gccaaagatgttgcaaagcagctga

SEQ ID NO: 545463 - DNA, 25 bp, Mus musculus
gccaaagatgttgcagcctccaagt

SEQ ID NO: 545464 - DNA, 25 bp, Mus musculus
gccaaagattgcagcgggatcccaa

SEQ ID NO: 545465 - DNA, 25 bp, Mus musculus
gccaaagattgctgcgggatcccaa

SEQ ID NO: 545466 - DNA, 25 bp, Mus musculus
gccaaagcaatgatactacccatca

SEQ ID NO: 545467 - DNA, 25 bp, Mus musculus
gccaaagcaatgttactacccatca

SEQ ID NO: 545468 - DNA, 25 bp, Mus musculus
gccaaagcagtaccagaatttctca

SEQ ID NO: 545469 - DNA, 25 bp, Mus musculus
gccaaagcagtaccatcccatttgt

SEQ ID NO: 545470 - DNA, 25 bp, Mus musculus
gccaaagcagtagcagaatttctca

SEQ ID NO: 545471 - DNA, 25 bp, Mus musculus
gccaaagcagtagcatcccatttgt

SEQ ID NO: 545472 - DNA, 25 bp, Mus musculus
gccaaagcagtgagcccttaggcaa

SEQ ID NO: 545473 - DNA, 25 bp, Mus musculus
gccaaagcagtgtgcccttaggcaa

SEQ ID NO: 545474 - DNA, 25 bp, Mus musculus
gccaaagccctgatacaacacagtt

SEQ ID NO: 545475 - DNA, 25 bp, Mus musculus
gccaaagccctgttacaacacagtt

SEQ ID NO: 545476 - DNA, 25 bp, Mus musculus
gccaaagcctacctacataaagtca

SEQ ID NO: 545477 - DNA, 25 bp, Mus musculus
gccaaagcctacgtacataaagtca

SEQ ID NO: 545478 - DNA, 25 bp, Mus musculus
gccaaagcctggcaaagtacaggaa

SEQ ID NO: 545479 - DNA, 25 bp, Mus musculus
gccaaagcctgggaaagtacaggaa

SEQ ID NO: 545480 - DNA, 25 bp, Mus musculus
gccaaagcgcctatctcattgaaca

SEQ ID NO: 545481 - DNA, 25 bp, Mus musculus
gccaaagcgcctttctcattgaaca

SEQ ID NO: 545482 - DNA, 25 bp, Mus musculus
gccaaagcgctcatccaggaaacag

SEQ ID NO: 545483 - DNA, 25 bp, Mus musculus
gccaaagcgctcttccaggaaacag

SEQ ID NO: 545484 - DNA, 25 bp, Mus musculus
gccaaagctgccataatatatacct

SEQ ID NO: 545485 - DNA, 25 bp, Mus musculus
gccaaagctgccattgcggcggctg

SEQ ID NO: 545486 - DNA, 25 bp, Mus musculus
gccaaagctgccttaatatatacct

SEQ ID NO: 545487 - DNA, 25 bp, Mus musculus
gccaaagctgcctttgcggcggctg

SEQ ID NO: 545488 - DNA, 25 bp, Mus musculus
gccaaagctggcattaggtttccgt

SEQ ID NO: 545489 - DNA, 25 bp, Mus musculus
gccaaagctggctttaggtttccgt

SEQ ID NO: 545490 - DNA, 25 bp, Mus musculus
gccaaagcttgacagtcacctgcag

SEQ ID NO: 545491 - DNA, 25 bp, Mus musculus
gccaaagcttgagagtcacctgcag

SEQ ID NO: 545492 - DNA, 25 bp, Mus musculus
gccaaagcttgtatgaggcaccaaa

SEQ ID NO: 545493 - DNA, 25 bp, Mus musculus
gccaaagcttgtttgaggcaccaaa

SEQ ID NO: 545494 - DNA, 25 bp, Mus musculus
gccaaaggaagcatctaccgaaact

SEQ ID NO: 545495 - DNA, 25 bp, Mus musculus
gccaaaggaagcttctaccgaaact

SEQ ID NO: 545496 - DNA, 25 bp, Mus musculus
gccaaaggaataccagtgtcactct

SEQ ID NO: 545497 - DNA, 25 bp, Mus musculus
gccaaaggaatagcagtgtcactct

SEQ ID NO: 545498 - DNA, 25 bp, Mus musculus
gccaaaggcccacaggaaaagctct

SEQ ID NO: 545499 - DNA, 25 bp, Mus musculus
gccaaaggcccagaggaaaagctct

SEQ ID NO: 545500 - DNA, 25 bp, Mus musculus
gccaaagggcagcttattctgggct

SEQ ID NO: 545501 - DNA, 25 bp, Mus musculus
gccaaagggcaggttattctgggct

SEQ ID NO: 545502 - DNA, 25 bp, Mus musculus
gccaaagggtacactgcacatcact

SEQ ID NO: 545503 - DNA, 25 bp, Mus musculus
gccaaagggtactctgcacatcact

SEQ ID NO: 545504 - DNA, 25 bp, Mus musculus
gccaaaggttgcactgaaggtcccc

SEQ ID NO: 545505 - DNA, 25 bp, Mus musculus
gccaaaggttgctctgaaggtcccc

SEQ ID NO: 545506 - DNA, 25 bp, Mus musculus
gccaaagtagccattgaccgttcat

SEQ ID NO: 545507 - DNA, 25 bp, Mus musculus
gccaaagtagcctttgaccgttcat

SEQ ID NO: 545508 - DNA, 25 bp, Mus musculus
gccaaagtataaagcttcatctcag

SEQ ID NO: 545509 - DNA, 25 bp, Mus musculus
gccaaagtataatgcttcatctcag

SEQ ID NO: 545510 - DNA, 25 bp, Mus musculus
gccaaagtcctgagggtcactcaga

SEQ ID NO: 545511 - DNA, 25 bp, Mus musculus
gccaaagtcctgtgggtcactcaga

SEQ ID NO: 545512 - DNA, 25 bp, Mus musculus
gccaaagtccttcaatttctcattg

SEQ ID NO: 545513 - DNA, 25 bp, Mus musculus
gccaaagtccttgaatttctcattg

SEQ ID NO: 545514 - DNA, 25 bp, Mus musculus
gccaaagtgcatagggccctaggtt

SEQ ID NO: 545515 - DNA, 25 bp, Mus musculus
gccaaagtgcattgggccctaggtt

SEQ ID NO: 545516 - DNA, 25 bp, Mus musculus
gccaaagtgtgcaaggagtttaaag

SEQ ID NO: 545517 - DNA, 25 bp, Mus musculus
gccaaagtgtgctaggagtttaaag

SEQ ID NO: 545518 - DNA, 25 bp, Mus musculus
gccaaagtgtggagtctgtagcaac

SEQ ID NO: 545519 - DNA, 25 bp, Mus musculus
gccaaagtgtggtgtctgtagcaac

SEQ ID NO: 545520 - DNA, 25 bp, Mus musculus
gccaaagttcagagtcctagtgtta

SEQ ID NO: 545521 - DNA, 25 bp, Mus musculus
gccaaagttcagtgtcctagtgtta

SEQ ID NO: 545522 - DNA, 25 bp, Mus musculus
gccaaagtttggcacgggatcgttt

SEQ ID NO: 545523 - DNA, 25 bp, Mus musculus
gccaaagtttgggacgggatcgttt

SEQ ID NO: 545524 - DNA, 25 bp, Mus musculus
gccaaatacactcagaacaacctta

SEQ ID NO: 545525 - DNA, 25 bp, Mus musculus
gccaaatacactgagaacaacctta

SEQ ID NO: 545526 - DNA, 25 bp, Mus musculus
gccaaatactgaatttctcatgcag

SEQ ID NO: 545527 - DNA, 25 bp, Mus musculus
gccaaatactgattttctcatgcag

SEQ ID NO: 545528 - DNA, 25 bp, Mus musculus
gccaaatctcccctattttaaatat

SEQ ID NO: 545529 - DNA, 25 bp, Mus musculus
gccaaatctcccgtattttaaatat

SEQ ID NO: 545530 - DNA, 25 bp, Mus musculus
gccaaatcttctcagatcatagcag

SEQ ID NO: 545531 - DNA, 25 bp, Mus musculus
gccaaatcttctgagatcatagcag

SEQ ID NO: 545532 - DNA, 25 bp, Mus musculus
gccaaatcttggcaaactttcctct

SEQ ID NO: 545533 - DNA, 25 bp, Mus musculus
gccaaatcttgggaaactttcctct

SEQ ID NO: 545534 - DNA, 25 bp, Mus musculus
gccaaatgaggcacataccgagtca

SEQ ID NO: 545535 - DNA, 25 bp, Mus musculus
gccaaatgaggcatgtgatcccaat

SEQ ID NO: 545536 - DNA, 25 bp, Mus musculus
gccaaatgaggctcataccgagtca

SEQ ID NO: 545537 - DNA, 25 bp, Mus musculus
gccaaatgaggcttgtgatcccaat

SEQ ID NO: 545538 - DNA, 25 bp, Mus musculus
gccaaatgcatcctgaggagccttc

SEQ ID NO: 545539 - DNA, 25 bp, Mus musculus
gccaaatgcatcgtgaggagccttc

SEQ ID NO: 545540 - DNA, 25 bp, Mus musculus
gccaaatgccgccagttgaaagact

SEQ ID NO: 545541 - DNA, 25 bp, Mus musculus
gccaaatgccgcgagttgaaagact

SEQ ID NO: 545542 - DNA, 25 bp, Mus musculus
gccaaatggccccagtttaatcctg

SEQ ID NO: 545543 - DNA, 25 bp, Mus musculus
gccaaatggcccgagtttaatcctg

SEQ ID NO: 545544 - DNA, 25 bp, Mus musculus
gccaaattatcaatttctgccatgg

SEQ ID NO: 545545 - DNA, 25 bp, Mus musculus
gccaaattatcattttctgccatgg

SEQ ID NO: 545546 - DNA, 25 bp, Mus musculus
gccaaattcaaacgcgccgggcgcg

SEQ ID NO: 545547 - DNA, 25 bp, Mus musculus
gccaaattcaaaggcgccgggcgcg

SEQ ID NO: 545548 - DNA, 25 bp, Mus musculus
gccaaattccctcgttaagctggct

SEQ ID NO: 545549 - DNA, 25 bp, Mus musculus
gccaaattccctggttaagctggct

SEQ ID NO: 545550 - DNA, 25 bp, Mus musculus
gccaaattcggccatattaatagct

SEQ ID NO: 545551 - DNA, 25 bp, Mus musculus
gccaaattcggcgatattaatagct

SEQ ID NO: 545552 - DNA, 25 bp, Mus musculus
gccaaattctagaagcagcaccaaa

SEQ ID NO: 545553 - DNA, 25 bp, Mus musculus
gccaaattctagtagcagcaccaaa

SEQ ID NO: 545554 - DNA, 25 bp, Mus musculus
gccaaattggagcaagccctgagcc

SEQ ID NO: 545555 - DNA, 25 bp, Mus musculus
gccaaattggaggaagccctgagcc

SEQ ID NO: 545556 - DNA, 25 bp, Mus musculus
gccaaattggatatgtgtcccgaaa

SEQ ID NO: 545557 - DNA, 25 bp, Mus musculus
gccaaattggatttgtgtcccgaaa

SEQ ID NO: 545558 - DNA, 25 bp, Mus musculus
gccaaatttactaaaggcccatggt

SEQ ID NO: 545559 - DNA, 25 bp, Mus musculus
gccaaatttacttaaggcccatggt

SEQ ID NO: 545560 - DNA, 25 bp, Mus musculus
gccaaatttagactgatcgagctgc

SEQ ID NO: 545561 - DNA, 25 bp, Mus musculus
gccaaatttagagtgatcgagctgc

SEQ ID NO: 545562 - DNA, 25 bp, Mus musculus
gccaaatttgcacaagtgataccac

SEQ ID NO: 545563 - DNA, 25 bp, Mus musculus
gccaaatttgcagaagtgataccac

SEQ ID NO: 545564 - DNA, 25 bp, Mus musculus
gccaaatttgttcaccttcgactga

SEQ ID NO: 545565 - DNA, 25 bp, Mus musculus
gccaaatttgttgaccttcgactga

SEQ ID NO: 545566 - DNA, 25 bp, Mus musculus
gccaacaactagatccaaggttcgg

SEQ ID NO: 545567 - DNA, 25 bp, Mus musculus
gccaacaactagttccaaggttcgg

SEQ ID NO: 545568 - DNA, 25 bp, Mus musculus
gccaacaactgacagatgctctctt

SEQ ID NO: 545569 - DNA, 25 bp, Mus musculus
gccaacaactgagagatgctctctt

SEQ ID NO: 545570 - DNA, 25 bp, Mus musculus
gccaacaagaagctatccagtgagg

SEQ ID NO: 545571 - DNA, 25 bp, Mus musculus
gccaacaagaaggtatccagtgagg

SEQ ID NO: 545572 - DNA, 25 bp, Mus musculus
gccaacaagaatcctcattacattt

SEQ ID NO: 545573 - DNA, 25 bp, Mus musculus
gccaacaagaatgctcattacattt

SEQ ID NO: 545574 - DNA, 25 bp, Mus musculus
gccaacaagcctctgctggatgaga

SEQ ID NO: 545575 - DNA, 25 bp, Mus musculus
gccaacaagcctgtgctggatgaga

SEQ ID NO: 545576 - DNA, 25 bp, Mus musculus
gccaacacaagcagtctcacaaagg

SEQ ID NO: 545577 - DNA, 25 bp, Mus musculus
gccaacacaagctgtctcacaaagg

SEQ ID NO: 545578 - DNA, 25 bp, Mus musculus
gccaacaccactacgtctgaggagg

SEQ ID NO: 545579 - DNA, 25 bp, Mus musculus
gccaacaccacttcgtctgaggagg

SEQ ID NO: 545580 - DNA, 25 bp, Mus musculus
gccaacaccaggcttcggcatcaat

SEQ ID NO: 545581 - DNA, 25 bp, Mus musculus
gccaacaccagggttcggcatcaat

SEQ ID NO: 545582 - DNA, 25 bp, Mus musculus
gccaacacgtctcaactggaactgt

SEQ ID NO: 545583 - DNA, 25 bp, Mus musculus
gccaacacgtctgaactggaactgt

SEQ ID NO: 545584 - DNA, 25 bp, Mus musculus
gccaacactggaaagtttctagctg

SEQ ID NO: 545585 - DNA, 25 bp, Mus musculus
gccaacactggatagtttctagctg

SEQ ID NO: 545586 - DNA, 25 bp, Mus musculus
gccaacagagatcctcatccaaaga

SEQ ID NO: 545587 - DNA, 25 bp, Mus musculus
gccaacagagatgctcatccaaaga

SEQ ID NO: 545588 - DNA, 25 bp, Mus musculus
gccaacagagccattgtaaaggaga

SEQ ID NO: 545589 - DNA, 25 bp, Mus musculus
gccaacagagcctttgtaaaggaga

SEQ ID NO: 545590 - DNA, 25 bp, Mus musculus
gccaacagcagcaattagtctattt

SEQ ID NO: 545591 - DNA, 25 bp, Mus musculus
gccaacagcagctattagtctattt

SEQ ID NO: 545592 - DNA, 25 bp, Mus musculus
gccaacagcaggcagtaactgtaag

SEQ ID NO: 545593 - DNA, 25 bp, Mus musculus
gccaacagcagggagtaactgtaag

SEQ ID NO: 545594 - DNA, 25 bp, Mus musculus
gccaacagctggcacttctttatta

SEQ ID NO: 545595 - DNA, 25 bp, Mus musculus
gccaacagctgggacttctttatta

SEQ ID NO: 545596 - DNA, 25 bp, Mus musculus
gccaacaggattatacgcttccgtt

SEQ ID NO: 545597 - DNA, 25 bp, Mus musculus
gccaacaggattttacgcttccgtt

SEQ ID NO: 545598 - DNA, 25 bp, Mus musculus
gccaacaggctcagtttttcattgt

SEQ ID NO: 545599 - DNA, 25 bp, Mus musculus
gccaacaggctctgtttttcattgt

SEQ ID NO: 545600 - DNA, 25 bp, Mus musculus
gccaacagtacccatcagtttctaa

SEQ ID NO: 545601 - DNA, 25 bp, Mus musculus
gccaacagtaccgatcagtttctaa

SEQ ID NO: 545602 - DNA, 25 bp, Mus musculus
gccaacagtgggatgcctcctagaa

SEQ ID NO: 545603 - DNA, 25 bp, Mus musculus
gccaacagtgggttgcctcctagaa

SEQ ID NO: 545604 - DNA, 25 bp, Mus musculus
gccaacatactgctagtgcgcctgc

SEQ ID NO: 545605 - DNA, 25 bp, Mus musculus
gccaacatactggtagtgcgcctgc

SEQ ID NO: 545606 - DNA, 25 bp, Mus musculus
gccaacatgagcaccattgctgtaa

SEQ ID NO: 545607 - DNA, 25 bp, Mus musculus
gccaacatgagctccattgctgtaa

SEQ ID NO: 545608 - DNA, 25 bp, Mus musculus
gccaacatgggaaacctgagactct

SEQ ID NO: 545609 - DNA, 25 bp, Mus musculus
gccaacatgggatacctgagactct

SEQ ID NO: 545610 - DNA, 25 bp, Mus musculus
gccaacatgggcaacaacactagat

SEQ ID NO: 545611 - DNA, 25 bp, Mus musculus
gccaacatgggctacaacactagat

SEQ ID NO: 545612 - DNA, 25 bp, Mus musculus
gccaacatgttcactgcagctcagg

SEQ ID NO: 545613 - DNA, 25 bp, Mus musculus
gccaacatgttctctgcagctcagg

SEQ ID NO: 545614 - DNA, 25 bp, Mus musculus
gccaacattcttacactagagctag

SEQ ID NO: 545615 - DNA, 25 bp, Mus musculus
gccaacattctttcactagagctag

SEQ ID NO: 545616 - DNA, 25 bp, Mus musculus
gccaacattggcctcaccaaagcta

SEQ ID NO: 545617 - DNA, 25 bp, Mus musculus
gccaacattggcgtcaccaaagcta

SEQ ID NO: 545618 - DNA, 25 bp, Mus musculus
gccaacattgtgcacgacttcaaca

SEQ ID NO: 545619 - DNA, 25 bp, Mus musculus
gccaacattgtggacgacttcaaca

SEQ ID NO: 545620 - DNA, 25 bp, Mus musculus
gccaacatttcccatgccagaaagg

SEQ ID NO: 545621 - DNA, 25 bp, Mus musculus
gccaacatttccgatgccagaaagg

SEQ ID NO: 545622 - DNA, 25 bp, Mus musculus
gccaaccaagagataagaagtatat

SEQ ID NO: 545623 - DNA, 25 bp, Mus musculus
gccaaccaagagttaagaagtatat

SEQ ID NO: 545624 - DNA, 25 bp, Mus musculus
gccaaccaagctaccaaccttaagg

SEQ ID NO: 545625 - DNA, 25 bp, Mus musculus
gccaaccaagcttccaaccttaagg

SEQ ID NO: 545626 - DNA, 25 bp, Mus musculus
gccaaccaatcaaagccgtttattt

SEQ ID NO: 545627 - DNA, 25 bp, Mus musculus
gccaaccaatcatagccgtttattt

SEQ ID NO: 545628 - DNA, 25 bp, Mus musculus
gccaaccacccacagaggaaaagga

SEQ ID NO: 545629 - DNA, 25 bp, Mus musculus
gccaaccacccagagaggaaaagga

SEQ ID NO: 545630 - DNA, 25 bp, Mus musculus
gccaaccactgactatactgggtct

SEQ ID NO: 545631 - DNA, 25 bp, Mus musculus
gccaaccactgagtatactgggtct

SEQ ID NO: 545632 - DNA, 25 bp, Mus musculus
gccaaccagattaacctctgatgga

SEQ ID NO: 545633 - DNA, 25 bp, Mus musculus
gccaaccagatttacctctgatgga

SEQ ID NO: 545634 - DNA, 25 bp, Mus musculus
gccaaccatcatcgaggcattcgtt

SEQ ID NO: 545635 - DNA, 25 bp, Mus musculus
gccaaccatcatggaggcattcgtt

SEQ ID NO: 545636 - DNA, 25 bp, Mus musculus
gccaaccatggcatttatgtcagga

SEQ ID NO: 545637 - DNA, 25 bp, Mus musculus
gccaaccatggcttttatgtcagga

SEQ ID NO: 545638 - DNA, 25 bp, Mus musculus
gccaaccccaaacgtgtcagttgtg

SEQ ID NO: 545639 - DNA, 25 bp, Mus musculus
gccaaccccaaaggtgtcagttgtg

SEQ ID NO: 545640 - DNA, 25 bp, Mus musculus
gccaaccccaggagcgggcctgatt

SEQ ID NO: 545641 - DNA, 25 bp, Mus musculus
gccaaccccaggtgcgggcctgatt

SEQ ID NO: 545642 - DNA, 25 bp, Mus musculus
gccaaccccgttcggattcgtatca

SEQ ID NO: 545643 - DNA, 25 bp, Mus musculus
gccaaccccgttgggattcgtatca

SEQ ID NO: 545644 - DNA, 25 bp, Mus musculus
gccaacccctgaagatgctgtgtaa

SEQ ID NO: 545645 - DNA, 25 bp, Mus musculus
gccaacccctgatgatgctgtgtaa

SEQ ID NO: 545646 - DNA, 25 bp, Mus musculus
gccaacccgcagcaagcttttaaca

SEQ ID NO: 545647 - DNA, 25 bp, Mus musculus
gccaacccgcaggaagcttttaaca

SEQ ID NO: 545648 - DNA, 25 bp, Mus musculus
gccaacccgtttccagaataatctg

SEQ ID NO: 545649 - DNA, 25 bp, Mus musculus
gccaacccgtttgcagaataatctg

SEQ ID NO: 545650 - DNA, 25 bp, Mus musculus
gccaaccctagaagagctctgagtc

SEQ ID NO: 545651 - DNA, 25 bp, Mus musculus
gccaaccctagatgagctctgagtc

SEQ ID NO: 545652 - DNA, 25 bp, Mus musculus
gccaaccctgtgagaaatgctcaac

SEQ ID NO: 545653 - DNA, 25 bp, Mus musculus
gccaaccctgtgtgaaatgctcaac

SEQ ID NO: 545654 - DNA, 25 bp, Mus musculus
gccaaccctttacatgtactactaa

SEQ ID NO: 545655 - DNA, 25 bp, Mus musculus
gccaaccctttagatgtactactaa

SEQ ID NO: 545656 - DNA, 25 bp, Mus musculus
gccaaccgcttgagtggaactacag

SEQ ID NO: 545657 - DNA, 25 bp, Mus musculus
gccaaccgcttgtgtggaactacag

SEQ ID NO: 545658 - DNA, 25 bp, Mus musculus
gccaaccgtgggatggaccataacg

SEQ ID NO: 545659 - DNA, 25 bp, Mus musculus
gccaaccgtgggttggaccataacg

SEQ ID NO: 545660 - DNA, 25 bp, Mus musculus
gccaacctaaggcaccagagccttg

SEQ ID NO: 545661 - DNA, 25 bp, Mus musculus
gccaacctaagggaccagagccttg

SEQ ID NO: 545662 - DNA, 25 bp, Mus musculus
gccaacctagacagtctcgtctgtt

SEQ ID NO: 545663 - DNA, 25 bp, Mus musculus
gccaacctagactgtctcgtctgtt

SEQ ID NO: 545664 - DNA, 25 bp, Mus musculus
gccaacctcagcaatgtagtgagtt

SEQ ID NO: 545665 - DNA, 25 bp, Mus musculus
gccaacctcagctatgtagtgagtt

SEQ ID NO: 545666 - DNA, 25 bp, Mus musculus
gccaacctctgacaacgaagaggaa

SEQ ID NO: 545667 - DNA, 25 bp, Mus musculus
gccaacctctgagaacgaagaggaa

SEQ ID NO: 545668 - DNA, 25 bp, Mus musculus
gccaacctgggcaagactcaaagag

SEQ ID NO: 545669 - DNA, 25 bp, Mus musculus
gccaacctgggctagactcaaagag

SEQ ID NO: 545670 - DNA, 25 bp, Mus musculus
gccaaccttggtcttatgctgcatg

SEQ ID NO: 545671 - DNA, 25 bp, Mus musculus
gccaaccttggtgttatgctgcatg

SEQ ID NO: 545672 - DNA, 25 bp, Mus musculus
gccaaccttttacgcttaggagact

SEQ ID NO: 545673 - DNA, 25 bp, Mus musculus
gccaaccttttaggcttaggagact

SEQ ID NO: 545674 - DNA, 25 bp, Mus musculus
gccaacgagcatcgccccatttgat

SEQ ID NO: 545675 - DNA, 25 bp, Mus musculus
gccaacgagcatggccccatttgat

SEQ ID NO: 545676 - DNA, 25 bp, Mus musculus
gccaacgatttaacccttgatcggg

SEQ ID NO: 545677 - DNA, 25 bp, Mus musculus
gccaacgatttatcccttgatcggg

SEQ ID NO: 545678 - DNA, 25 bp, Mus musculus
gccaacgcacagaatgtctgaccaa

SEQ ID NO: 545679 - DNA, 25 bp, Mus musculus
gccaacgcacagtatgtctgaccaa

SEQ ID NO: 545680 - DNA, 25 bp, Mus musculus
gccaacgctttcatcaaaggtgctt

SEQ ID NO: 545681 - DNA, 25 bp, Mus musculus
gccaacgctttcttcaaaggtgctt

SEQ ID NO: 545682 - DNA, 25 bp, Mus musculus
gccaacgtggagaacaaaatagttt

SEQ ID NO: 545683 - DNA, 25 bp, Mus musculus
gccaacgtggagtacaaaatagttt

SEQ ID NO: 545684 - DNA, 25 bp, Mus musculus
gccaacgtgggcaggaacggttcca

SEQ ID NO: 545685 - DNA, 25 bp, Mus musculus
gccaacgtgggctggaacggttcca

SEQ ID NO: 545686 - DNA, 25 bp, Mus musculus
gccaacgtgtgcacgcagggaactt

SEQ ID NO: 545687 - DNA, 25 bp, Mus musculus
gccaacgtgtgctcgcagggaactt

SEQ ID NO: 545688 - DNA, 25 bp, Mus musculus
gccaacgttagcagcttaggatcta

SEQ ID NO: 545689 - DNA, 25 bp, Mus musculus
gccaacgttagctgcttaggatcta

SEQ ID NO: 545690 - DNA, 25 bp, Mus musculus
gccaactaacgtcggcgtgccctgg

SEQ ID NO: 545691 - DNA, 25 bp, Mus musculus
gccaactaacgtgggcgtgccctgg

SEQ ID NO: 545692 - DNA, 25 bp, Mus musculus
gccaactacgggagacgttttcatt

SEQ ID NO: 545693 - DNA, 25 bp, Mus musculus
gccaactacgggtgacgttttcatt

SEQ ID NO: 545694 - DNA, 25 bp, Mus musculus
gccaactacgtaaaaatcctgtcag

SEQ ID NO: 545695 - DNA, 25 bp, Mus musculus
gccaactacgtataaatcctgtcag

SEQ ID NO: 545696 - DNA, 25 bp, Mus musculus
gccaactagcagcaatgctgtattg

SEQ ID NO: 545697 - DNA, 25 bp, Mus musculus
gccaactagcaggaatgctgtattg

SEQ ID NO: 545698 - DNA, 25 bp, Mus musculus
gccaactaggttatcattcctgaag

SEQ ID NO: 545699 - DNA, 25 bp, Mus musculus
gccaactaggttttcattcctgaag

SEQ ID NO: 545700 - DNA, 25 bp, Mus musculus
gccaactatggccatgtgtatgcag

SEQ ID NO: 545701 - DNA, 25 bp, Mus musculus
gccaactatggcgatgtgtatgcag

SEQ ID NO: 545702 - DNA, 25 bp, Mus musculus
gccaactatgtgcagctgcggcagt

SEQ ID NO: 545703 - DNA, 25 bp, Mus musculus
gccaactatgtggagctgcggcagt

SEQ ID NO: 545704 - DNA, 25 bp, Mus musculus
gccaactcatcaatttgacttgttt

SEQ ID NO: 545705 - DNA, 25 bp, Mus musculus
gccaactcatcattttgacttgttt

SEQ ID NO: 545706 - DNA, 25 bp, Mus musculus
gccaactcccctatagctgtaaaag

SEQ ID NO: 545707 - DNA, 25 bp, Mus musculus
gccaactcccctttagctgtaaaag

SEQ ID NO: 545708 - DNA, 25 bp, Mus musculus
gccaactctataatcggtgtatcag

SEQ ID NO: 545709 - DNA, 25 bp, Mus musculus
gccaactctatattcggtgtatcag

SEQ ID NO: 545710 - DNA, 25 bp, Mus musculus
gccaactcttttctacaggtcaatc

SEQ ID NO: 545711 - DNA, 25 bp, Mus musculus
gccaactcttttgtacaggtcaatc

SEQ ID NO: 545712 - DNA, 25 bp, Mus musculus
gccaactgacagaagatccacccgg

SEQ ID NO: 545713 - DNA, 25 bp, Mus musculus
gccaactgacagtagatccacccgg

SEQ ID NO: 545714 - DNA, 25 bp, Mus musculus
gccaactgagttaccaatgtgacct

SEQ ID NO: 545715 - DNA, 25 bp, Mus musculus
gccaactgagtttccaatgtgacct

SEQ ID NO: 545716 - DNA, 25 bp, Mus musculus
gccaactgctacctaaaatgcaagg

SEQ ID NO: 545717 - DNA, 25 bp, Mus musculus
gccaactgctacgtaaaatgcaagg

SEQ ID NO: 545718 - DNA, 25 bp, Mus musculus
gccaactggaagatctcttctacaa

SEQ ID NO: 545719 - DNA, 25 bp, Mus musculus
gccaactggaagttctcttctacaa

SEQ ID NO: 545720 - DNA, 25 bp, Mus musculus
gccaactggatactgcctaacctaa

SEQ ID NO: 545721 - DNA, 25 bp, Mus musculus
gccaactggatagtgcctaacctaa

SEQ ID NO: 545722 - DNA, 25 bp, Mus musculus
gccaactggctcattattatttgct

SEQ ID NO: 545723 - DNA, 25 bp, Mus musculus
gccaactggctctttattatttgct

SEQ ID NO: 545724 - DNA, 25 bp, Mus musculus
gccaactgggagctgatgctactgt

SEQ ID NO: 545725 - DNA, 25 bp, Mus musculus
gccaactgggaggtgatgctactgt

SEQ ID NO: 545726 - DNA, 25 bp, Mus musculus
gccaactgggcacacttatgaaaca

SEQ ID NO: 545727 - DNA, 25 bp, Mus musculus
gccaactgggcagacttatgaaaca

SEQ ID NO: 545728 - DNA, 25 bp, Mus musculus
gccaactgtcagatttattatccat

SEQ ID NO: 545729 - DNA, 25 bp, Mus musculus
gccaactgtcagttttattatccat

SEQ ID NO: 545730 - DNA, 25 bp, Mus musculus
gccaactgtgatctcagtaatgcct

SEQ ID NO: 545731 - DNA, 25 bp, Mus musculus
gccaactgtgatgtcagtaatgcct

SEQ ID NO: 545732 - DNA, 25 bp, Mus musculus
gccaacttcaacatccgggaagacg

SEQ ID NO: 545733 - DNA, 25 bp, Mus musculus
gccaacttcaacttccgggaagacg

SEQ ID NO: 545734 - DNA, 25 bp, Mus musculus
gccaacttcaccataggcgaaccta

SEQ ID NO: 545735 - DNA, 25 bp, Mus musculus
gccaacttcaccttaggcgaaccta

SEQ ID NO: 545736 - DNA, 25 bp, Mus musculus
gccaacttcatgcagcatatccaac

SEQ ID NO: 545737 - DNA, 25 bp, Mus musculus
gccaacttcatggagcatatccaac

SEQ ID NO: 545738 - DNA, 25 bp, Mus musculus
gccaacttccctactctgataaaaa

SEQ ID NO: 545739 - DNA, 25 bp, Mus musculus
gccaacttcccttctctgataaaaa

SEQ ID NO: 545740 - DNA, 25 bp, Mus musculus
gccaacttgatacaacggcgacagt

SEQ ID NO: 545741 - DNA, 25 bp, Mus musculus
gccaacttgatagaacggcgacagt

SEQ ID NO: 545742 - DNA, 25 bp, Mus musculus
gccaacttgattatccatgtgtagc

SEQ ID NO: 545743 - DNA, 25 bp, Mus musculus
gccaacttgattttccatgtgtagc

SEQ ID NO: 545744 - DNA, 25 bp, Mus musculus
gccaacttgcccaaaacctaattgt

SEQ ID NO: 545745 - DNA, 25 bp, Mus musculus
gccaacttgccctaaacctaattgt

SEQ ID NO: 545746 - DNA, 25 bp, Mus musculus
gccaacttgggacagtagcctcctt

SEQ ID NO: 545747 - DNA, 25 bp, Mus musculus
gccaacttgggagagtagcctcctt

SEQ ID NO: 545748 - DNA, 25 bp, Mus musculus
gccaacttgtttagaagtgccacat

SEQ ID NO: 545749 - DNA, 25 bp, Mus musculus
gccaacttgttttgaagtgccacat

SEQ ID NO: 545750 - DNA, 25 bp, Mus musculus
gccaactttctcctataaattgtac

SEQ ID NO: 545751 - DNA, 25 bp, Mus musculus
gccaactttctcgtataaattgtac

SEQ ID NO: 545752 - DNA, 25 bp, Mus musculus
gccaactttgggattccggcagata

SEQ ID NO: 545753 - DNA, 25 bp, Mus musculus
gccaactttgggtttccggcagata

SEQ ID NO: 545754 - DNA, 25 bp, Mus musculus
gccaacttttgtatcaagctagata

SEQ ID NO: 545755 - DNA, 25 bp, Mus musculus
gccaacttttgtttcaagctagata

SEQ ID NO: 545756 - DNA, 25 bp, Mus musculus
gccaagaaaggcaggagtcactata

SEQ ID NO: 545757 - DNA, 25 bp, Mus musculus
gccaagaaaggctggagtcactata

SEQ ID NO: 545758 - DNA, 25 bp, Mus musculus
gccaagaacattaacctgcggctct

SEQ ID NO: 545759 - DNA, 25 bp, Mus musculus
gccaagaacatttacctgcggctct

SEQ ID NO: 545760 - DNA, 25 bp, Mus musculus
gccaagaaccctcttagttaaggca

SEQ ID NO: 545761 - DNA, 25 bp, Mus musculus
gccaagaaccctgttagttaaggca

SEQ ID NO: 545762 - DNA, 25 bp, Mus musculus
gccaagaactcccttcacaaagtag

SEQ ID NO: 545763 - DNA, 25 bp, Mus musculus
gccaagaactccgttcacaaagtag

SEQ ID NO: 545764 - DNA, 25 bp, Mus musculus
gccaagaagctgctagagtccctgc

SEQ ID NO: 545765 - DNA, 25 bp, Mus musculus
gccaagaagctggtagagtccctgc

SEQ ID NO: 545766 - DNA, 25 bp, Mus musculus
gccaagaataccctgacagcctgca

SEQ ID NO: 545767 - DNA, 25 bp, Mus musculus
gccaagaataccgtgacagcctgca

SEQ ID NO: 545768 - DNA, 25 bp, Mus musculus
gccaagaattgcagggtcctctaac

SEQ ID NO: 545769 - DNA, 25 bp, Mus musculus
gccaagaattgctgggtcctctaac

SEQ ID NO: 545770 - DNA, 25 bp, Mus musculus
gccaagacctatatatagaggccag

SEQ ID NO: 545771 - DNA, 25 bp, Mus musculus
gccaagacctatttatagaggccag

SEQ ID NO: 545772 - DNA, 25 bp, Mus musculus
gccaagacgtgtaagaatcctcaga

SEQ ID NO: 545773 - DNA, 25 bp, Mus musculus
gccaagacgtgttagaatcctcaga

SEQ ID NO: 545774 - DNA, 25 bp, Mus musculus
gccaagactacaacagaggaacact

SEQ ID NO: 545775 - DNA, 25 bp, Mus musculus
gccaagactacatcagaggaacact

SEQ ID NO: 545776 - DNA, 25 bp, Mus musculus
gccaagactatgagctttaaagcca

SEQ ID NO: 545777 - DNA, 25 bp, Mus musculus
gccaagactatgtgctttaaagcca

SEQ ID NO: 545778 - DNA, 25 bp, Mus musculus
gccaagacttctatatatgctcagg

SEQ ID NO: 545779 - DNA, 25 bp, Mus musculus
gccaagacttctttatatgctcagg

SEQ ID NO: 545780 - DNA, 25 bp, Mus musculus
gccaagacttgaattccttcgggaa

SEQ ID NO: 545781 - DNA, 25 bp, Mus musculus
gccaagacttgacctgtgaccaaca

SEQ ID NO: 545782 - DNA, 25 bp, Mus musculus
gccaagacttgagctgtgaccaaca

SEQ ID NO: 545783 - DNA, 25 bp, Mus musculus
gccaagacttgatttccttcgggaa

SEQ ID NO: 545784 - DNA, 25 bp, Mus musculus
gccaagactttgatccatgttcaca

SEQ ID NO: 545785 - DNA, 25 bp, Mus musculus
gccaagactttgttccatgttcaca

SEQ ID NO: 545786 - DNA, 25 bp, Mus musculus
gccaagagaatgaaggaagccaaag

SEQ ID NO: 545787 - DNA, 25 bp, Mus musculus
gccaagagaatgtaggaagccaaag

SEQ ID NO: 545788 - DNA, 25 bp, Mus musculus
gccaagagcaggattaattatgtgt

SEQ ID NO: 545789 - DNA, 25 bp, Mus musculus
gccaagagcaggtttaattatgtgt

SEQ ID NO: 545790 - DNA, 25 bp, Mus musculus
gccaagagttaacttctgttcttca

SEQ ID NO: 545791 - DNA, 25 bp, Mus musculus
gccaagagttaagttctgttcttca

SEQ ID NO: 545792 - DNA, 25 bp, Mus musculus
gccaagataataagccactaaaatg

SEQ ID NO: 545793 - DNA, 25 bp, Mus musculus
gccaagataatatgccactaaaatg

SEQ ID NO: 545794 - DNA, 25 bp, Mus musculus
gccaagatacacagctggtgcctga

SEQ ID NO: 545795 - DNA, 25 bp, Mus musculus
gccaagatacactgctggtgcctga

SEQ ID NO: 545796 - DNA, 25 bp, Mus musculus
gccaagatccacctcaagcaaaagg

SEQ ID NO: 545797 - DNA, 25 bp, Mus musculus
gccaagatccacgtcaagcaaaagg

SEQ ID NO: 545798 - DNA, 25 bp, Mus musculus
gccaagatctcaacagattcctcaa

SEQ ID NO: 545799 - DNA, 25 bp, Mus musculus
gccaagatctcatcagattcctcaa

SEQ ID NO: 545800 - DNA, 25 bp, Mus musculus
gccaagatgcacaatcggaagaaga

SEQ ID NO: 545801 - DNA, 25 bp, Mus musculus
gccaagatgcactatcggaagaaga

SEQ ID NO: 545802 - DNA, 25 bp, Mus musculus
gccaagatgcctcaatgcagactgg

SEQ ID NO: 545803 - DNA, 25 bp, Mus musculus
gccaagatgcctgaatgcagactgg

SEQ ID NO: 545804 - DNA, 25 bp, Mus musculus
gccaagatggcgctaccttaaatta

SEQ ID NO: 545805 - DNA, 25 bp, Mus musculus
gccaagatggcggtaccttaaatta

SEQ ID NO: 545806 - DNA, 25 bp, Mus musculus
gccaagatgtttctttttctccatt

SEQ ID NO: 545807 - DNA, 25 bp, Mus musculus
gccaagatgtttgtttttctccatt

SEQ ID NO: 545808 - DNA, 25 bp, Mus musculus
gccaagattgctcaggcccgcaaga

SEQ ID NO: 545809 - DNA, 25 bp, Mus musculus
gccaagattgctgaggcccgcaaga

SEQ ID NO: 545810 - DNA, 25 bp, Mus musculus
gccaagcaagctatttccttcatat

SEQ ID NO: 545811 - DNA, 25 bp, Mus musculus
gccaagcaagctttttccttcatat

SEQ ID NO: 545812 - DNA, 25 bp, Mus musculus
gccaagcaagtccttcccaggaaag

SEQ ID NO: 545813 - DNA, 25 bp, Mus musculus
gccaagcaagtcgttcccaggaaag

SEQ ID NO: 545814 - DNA, 25 bp, Mus musculus
gccaagcaagttactgttcatcgta

SEQ ID NO: 545815 - DNA, 25 bp, Mus musculus
gccaagcaagtttctgttcatcgta

SEQ ID NO: 545816 - DNA, 25 bp, Mus musculus
gccaagcaatggatcagtatgtaca

SEQ ID NO: 545817 - DNA, 25 bp, Mus musculus
gccaagcaatggttcagtatgtaca

SEQ ID NO: 545818 - DNA, 25 bp, Mus musculus
gccaagcacagtaggtgatcctgat

SEQ ID NO: 545819 - DNA, 25 bp, Mus musculus
gccaagcacagttggtgatcctgat

SEQ ID NO: 545820 - DNA, 25 bp, Mus musculus
gccaagcaccggaactggctttggt

SEQ ID NO: 545821 - DNA, 25 bp, Mus musculus
gccaagcaccggtactggctttggt

SEQ ID NO: 545822 - DNA, 25 bp, Mus musculus
gccaagcacgccaacaaggtcaaag

SEQ ID NO: 545823 - DNA, 25 bp, Mus musculus
gccaagcacgcctacaaggtcaaag

SEQ ID NO: 545824 - DNA, 25 bp, Mus musculus
gccaagcacgcgctgtcggagggca

SEQ ID NO: 545825 - DNA, 25 bp, Mus musculus
gccaagcacgcggtgtcggagggca

SEQ ID NO: 545826 - DNA, 25 bp, Mus musculus
gccaagcactaaatatttttgaatc

SEQ ID NO: 545827 - DNA, 25 bp, Mus musculus
gccaagcactaattatttttgaatc

SEQ ID NO: 545828 - DNA, 25 bp, Mus musculus
gccaagcagcgcagtttgcggtaac

SEQ ID NO: 545829 - DNA, 25 bp, Mus musculus
gccaagcagcgctgtttgcggtaac

SEQ ID NO: 545830 - DNA, 25 bp, Mus musculus
gccaagcatggcatctcaggccaag

SEQ ID NO: 545831 - DNA, 25 bp, Mus musculus
gccaagcatggcttctcaggccaag

SEQ ID NO: 545832 - DNA, 25 bp, Mus musculus
gccaagccatatagagttattttac

SEQ ID NO: 545833 - DNA, 25 bp, Mus musculus
gccaagccatattgagttattttac

SEQ ID NO: 545834 - DNA, 25 bp, Mus musculus
gccaagccccggagaatcagtacag

SEQ ID NO: 545835 - DNA, 25 bp, Mus musculus
gccaagccccggtgaatcagtacag

SEQ ID NO: 545836 - DNA, 25 bp, Mus musculus
gccaagcccgggaagcaggcagtat

SEQ ID NO: 545837 - DNA, 25 bp, Mus musculus
gccaagcccgggtagcaggcagtat

SEQ ID NO: 545838 - DNA, 25 bp, Mus musculus
gccaagccggagacctgaatctgat

SEQ ID NO: 545839 - DNA, 25 bp, Mus musculus
gccaagccggagtcctgaatctgat

SEQ ID NO: 545840 - DNA, 25 bp, Mus musculus
gccaagcctcgaaccactgggaaaa

SEQ ID NO: 545841 - DNA, 25 bp, Mus musculus
gccaagcctcgatccactgggaaaa

SEQ ID NO: 545842 - DNA, 25 bp, Mus musculus
gccaagcctgacatccaagctcgta

SEQ ID NO: 545843 - DNA, 25 bp, Mus musculus
gccaagcctgacttccaagctcgta

SEQ ID NO: 545844 - DNA, 25 bp, Mus musculus
gccaagcctggtaggatttgtcttt

SEQ ID NO: 545845 - DNA, 25 bp, Mus musculus
gccaagcctggttggatttgtcttt

SEQ ID NO: 545846 - DNA, 25 bp, Mus musculus
gccaagcgagcaagagcacctgact

SEQ ID NO: 545847 - DNA, 25 bp, Mus musculus
gccaagcgagcatgagcacctgact

SEQ ID NO: 545848 - DNA, 25 bp, Mus musculus
gccaagcggctgactgaactcagat

SEQ ID NO: 545849 - DNA, 25 bp, Mus musculus
gccaagcggctgtctgaactcagat

SEQ ID NO: 545850 - DNA, 25 bp, Mus musculus
gccaagctcagcctgttgttatgtt

SEQ ID NO: 545851 - DNA, 25 bp, Mus musculus
gccaagctcagcgtgttgttatgtt

SEQ ID NO: 545852 - DNA, 25 bp, Mus musculus
gccaagctcctacttaatctcaaag

SEQ ID NO: 545853 - DNA, 25 bp, Mus musculus
gccaagctcctagttaatctcaaag

SEQ ID NO: 545854 - DNA, 25 bp, Mus musculus
gccaagctcctgctgatttctggtg

SEQ ID NO: 545855 - DNA, 25 bp, Mus musculus
gccaagctcctggtgatttctggtg

SEQ ID NO: 545856 - DNA, 25 bp, Mus musculus
gccaagctctggatttctaaaagac

SEQ ID NO: 545857 - DNA, 25 bp, Mus musculus
gccaagctctggttttctaaaagac

SEQ ID NO: 545858 - DNA, 25 bp, Mus musculus
gccaagctctgtcattctggtctga

SEQ ID NO: 545859 - DNA, 25 bp, Mus musculus
gccaagctctgtgattctggtctga

SEQ ID NO: 545860 - DNA, 25 bp, Mus musculus
gccaagctggttactcaactgtctt

SEQ ID NO: 545861 - DNA, 25 bp, Mus musculus
gccaagctggttcctttgggacaat

SEQ ID NO: 545862 - DNA, 25 bp, Mus musculus
gccaagctggttgctttgggacaat

SEQ ID NO: 545863 - DNA, 25 bp, Mus musculus
gccaagctggtttctcaactgtctt

SEQ ID NO: 545864 - DNA, 25 bp, Mus musculus
gccaagctgtgcaactgagaaataa

SEQ ID NO: 545865 - DNA, 25 bp, Mus musculus
gccaagctgtgctactgagaaataa

SEQ ID NO: 545866 - DNA, 25 bp, Mus musculus
gccaagcttgctcgatcttaggatc

SEQ ID NO: 545867 - DNA, 25 bp, Mus musculus
gccaagcttgctggatcttaggatc

SEQ ID NO: 545868 - DNA, 25 bp, Mus musculus
gccaagcttgtccattgattctgtg

SEQ ID NO: 545869 - DNA, 25 bp, Mus musculus
gccaagcttgtcgattgattctgtg

SEQ ID NO: 545870 - DNA, 25 bp, Mus musculus
gccaagcttgtgcacttctggtatc

SEQ ID NO: 545871 - DNA, 25 bp, Mus musculus
gccaagcttgtggacttctggtatc

SEQ ID NO: 545872 - DNA, 25 bp, Mus musculus
gccaaggaacgacaccaggatgatc

SEQ ID NO: 545873 - DNA, 25 bp, Mus musculus
gccaaggaacgagaccaggatgatc

SEQ ID NO: 545874 - DNA, 25 bp, Mus musculus
gccaaggaatatatgtcgatgtttt

SEQ ID NO: 545875 - DNA, 25 bp, Mus musculus
gccaaggaatatttgtcgatgtttt

SEQ ID NO: 545876 - DNA, 25 bp, Mus musculus
gccaaggacacgcagcacgaggaat

SEQ ID NO: 545877 - DNA, 25 bp, Mus musculus
gccaaggacacggagcacgaggaat

SEQ ID NO: 545878 - DNA, 25 bp, Mus musculus
gccaaggacagaccttgcaggctaa

SEQ ID NO: 545879 - DNA, 25 bp, Mus musculus
gccaaggacagagcttgcaggctaa

SEQ ID NO: 545880 - DNA, 25 bp, Mus musculus
gccaaggacaggcttcaggttaact

SEQ ID NO: 545881 - DNA, 25 bp, Mus musculus
gccaaggacagggttcaggttaact

SEQ ID NO: 545882 - DNA, 25 bp, Mus musculus
gccaaggactcgcatttccaggagt

SEQ ID NO: 545883 - DNA, 25 bp, Mus musculus
gccaaggactcggatttccaggagt

SEQ ID NO: 545884 - DNA, 25 bp, Mus musculus
gccaaggacttcaaccggcttaaga

SEQ ID NO: 545885 - DNA, 25 bp, Mus musculus
gccaaggacttcagggagtatcaca

SEQ ID NO: 545886 - DNA, 25 bp, Mus musculus
gccaaggacttctaccggcttaaga

SEQ ID NO: 545887 - DNA, 25 bp, Mus musculus
gccaaggacttctgggagtatcaca

SEQ ID NO: 545888 - DNA, 25 bp, Mus musculus
gccaaggagcataaaatccctcaga

SEQ ID NO: 545889 - DNA, 25 bp, Mus musculus
gccaaggagcattaaatccctcaga

SEQ ID NO: 545890 - DNA, 25 bp, Mus musculus
gccaaggagtcaccccagaggccat

SEQ ID NO: 545891 - DNA, 25 bp, Mus musculus
gccaaggagtcagcccagaggccat

SEQ ID NO: 545892 - DNA, 25 bp, Mus musculus
gccaaggatagaccactgtacatag

SEQ ID NO: 545893 - DNA, 25 bp, Mus musculus
gccaaggatagagcactgtacatag

SEQ ID NO: 545894 - DNA, 25 bp, Mus musculus
gccaaggatgttcttttctacccac

SEQ ID NO: 545895 - DNA, 25 bp, Mus musculus
gccaaggatgttgttttctacccac

SEQ ID NO: 545896 - DNA, 25 bp, Mus musculus
gccaaggattgtcactgccagataa

SEQ ID NO: 545897 - DNA, 25 bp, Mus musculus
gccaaggattgtgactgccagataa

SEQ ID NO: 545898 - DNA, 25 bp, Mus musculus
gccaaggcacatagatctctgcggt

SEQ ID NO: 545899 - DNA, 25 bp, Mus musculus
gccaaggcacattgatctctgcggt

SEQ ID NO: 545900 - DNA, 25 bp, Mus musculus
gccaaggcacgaatagctgctctgg

SEQ ID NO: 545901 - DNA, 25 bp, Mus musculus
gccaaggcacgattagctgctctgg

SEQ ID NO: 545902 - DNA, 25 bp, Mus musculus
gccaaggcagcaatagtagggtcat

SEQ ID NO: 545903 - DNA, 25 bp, Mus musculus
gccaaggcagcattagtagggtcat

SEQ ID NO: 545904 - DNA, 25 bp, Mus musculus
gccaaggcaggaagatcggctacct

SEQ ID NO: 545905 - DNA, 25 bp, Mus musculus
gccaaggcaggatgatcggctacct

SEQ ID NO: 545906 - DNA, 25 bp, Mus musculus
gccaaggcccttctcagaatggtga

SEQ ID NO: 545907 - DNA, 25 bp, Mus musculus
gccaaggcccttgtcagaatggtga

SEQ ID NO: 545908 - DNA, 25 bp, Mus musculus
gccaaggccttgatccgaaacacta

SEQ ID NO: 545909 - DNA, 25 bp, Mus musculus
gccaaggccttgcactatgatgaag

SEQ ID NO: 545910 - DNA, 25 bp, Mus musculus
gccaaggccttggactatgatgaag

SEQ ID NO: 545911 - DNA, 25 bp, Mus musculus
gccaaggccttgttccgaaacacta

SEQ ID NO: 545912 - DNA, 25 bp, Mus musculus
gccaaggcggaacgctttatcactt

SEQ ID NO: 545913 - DNA, 25 bp, Mus musculus
gccaaggcggaaggctttatcactt

SEQ ID NO: 545914 - DNA, 25 bp, Mus musculus
gccaaggctgaacgagtctcggtca

SEQ ID NO: 545915 - DNA, 25 bp, Mus musculus
gccaaggctgaaggagtctcggtca

SEQ ID NO: 545916 - DNA, 25 bp, Mus musculus
gccaaggctgccacggacctgactg

SEQ ID NO: 545917 - DNA, 25 bp, Mus musculus
gccaaggctgcctcggacctgactg

SEQ ID NO: 545918 - DNA, 25 bp, Mus musculus
gccaaggctgctactgactcaatta

SEQ ID NO: 545919 - DNA, 25 bp, Mus musculus
gccaaggctgcttctgactcaatta

SEQ ID NO: 545920 - DNA, 25 bp, Mus musculus
gccaaggcttacaggattgttctca

SEQ ID NO: 545921 - DNA, 25 bp, Mus musculus
gccaaggcttactggattgttctca

SEQ ID NO: 545922 - DNA, 25 bp, Mus musculus
gccaagggaaaaaaagaccagccgt

SEQ ID NO: 545923 - DNA, 25 bp, Mus musculus
gccaagggaaaataagaccagccgt

SEQ ID NO: 545924 - DNA, 25 bp, Mus musculus
gccaagggaaggacccactgcagca

SEQ ID NO: 545925 - DNA, 25 bp, Mus musculus
gccaagggaaggtcccactgcagca

SEQ ID NO: 545926 - DNA, 25 bp, Mus musculus
gccaaggggatcagatttggtttct

SEQ ID NO: 545927 - DNA, 25 bp, Mus musculus
gccaaggggatctgatttggtttct

SEQ ID NO: 545928 - DNA, 25 bp, Mus musculus
gccaagggtacgcagcttttgctgt

SEQ ID NO: 545929 - DNA, 25 bp, Mus musculus
gccaagggtacggagcttttgctgt

SEQ ID NO: 545930 - DNA, 25 bp, Mus musculus
gccaagggtttcacataatcagaca

SEQ ID NO: 545931 - DNA, 25 bp, Mus musculus
gccaagggtttctcataatcagaca

SEQ ID NO: 545932 - DNA, 25 bp, Mus musculus
gccaaggtacatcagttactcaatg

SEQ ID NO: 545933 - DNA, 25 bp, Mus musculus
gccaaggtacatgagttactcaatg

SEQ ID NO: 545934 - DNA, 25 bp, Mus musculus
gccaaggtcacccagtaagatgaat

SEQ ID NO: 545935 - DNA, 25 bp, Mus musculus
gccaaggtcaccgagtaagatgaat

SEQ ID NO: 545936 - DNA, 25 bp, Mus musculus
gccaaggtgaggctcttcgagtcaa

SEQ ID NO: 545937 - DNA, 25 bp, Mus musculus
gccaaggtgagggtcttcgagtcaa

SEQ ID NO: 545938 - DNA, 25 bp, Mus musculus
gccaaggtgcctaataagcccttta

SEQ ID NO: 545939 - DNA, 25 bp, Mus musculus
gccaaggtgccttataagcccttta

SEQ ID NO: 545940 - DNA, 25 bp, Mus musculus
gccaaggtgctaagaggtctgtgac

SEQ ID NO: 545941 - DNA, 25 bp, Mus musculus
gccaaggtgctatgaggtctgtgac

SEQ ID NO: 545942 - DNA, 25 bp, Mus musculus
gccaaggtggctcgcaacgaaacca

SEQ ID NO: 545943 - DNA, 25 bp, Mus musculus
gccaaggtggctggcaacgaaacca

SEQ ID NO: 545944 - DNA, 25 bp, Mus musculus
gccaaggtggttataagccacttag

SEQ ID NO: 545945 - DNA, 25 bp, Mus musculus
gccaaggtggttttaagccacttag

SEQ ID NO: 545946 - DNA, 25 bp, Mus musculus
gccaaggtgtccaccatgctgctgg

SEQ ID NO: 545947 - DNA, 25 bp, Mus musculus
gccaaggtgtcctccatgctgctgg

SEQ ID NO: 545948 - DNA, 25 bp, Mus musculus
gccaaggtgttgatgttcccagcca

SEQ ID NO: 545949 - DNA, 25 bp, Mus musculus
gccaaggtgttgcaacgtcacataa

SEQ ID NO: 545950 - DNA, 25 bp, Mus musculus
gccaaggtgttggaacgtcacataa

SEQ ID NO: 545951 - DNA, 25 bp, Mus musculus
gccaaggtgttgttgttcccagcca

SEQ ID NO: 545952 - DNA, 25 bp, Mus musculus
gccaaggttctgaaacttttgacct

SEQ ID NO: 545953 - DNA, 25 bp, Mus musculus
gccaaggttctgtaacttttgacct

SEQ ID NO: 545954 - DNA, 25 bp, Mus musculus
gccaaggttttcaatttccgcaact

SEQ ID NO: 545955 - DNA, 25 bp, Mus musculus
gccaaggttttctatttccgcaact

SEQ ID NO: 545956 - DNA, 25 bp, Mus musculus
gccaagtaaacccagggctttcaat

SEQ ID NO: 545957 - DNA, 25 bp, Mus musculus
gccaagtaaaccgagggctttcaat

SEQ ID NO: 545958 - DNA, 25 bp, Mus musculus
gccaagtaacagctcttacatgtat

SEQ ID NO: 545959 - DNA, 25 bp, Mus musculus
gccaagtaacaggtcttacatgtat

SEQ ID NO: 545960 - DNA, 25 bp, Mus musculus
gccaagtaacggagtcccaggagtt

SEQ ID NO: 545961 - DNA, 25 bp, Mus musculus
gccaagtaacggtgtcccaggagtt

SEQ ID NO: 545962 - DNA, 25 bp, Mus musculus
gccaagtaactcagcagatgtcaca

SEQ ID NO: 545963 - DNA, 25 bp, Mus musculus
gccaagtaactctgcagatgtcaca

SEQ ID NO: 545964 - DNA, 25 bp, Mus musculus
gccaagtaaggcctgcttgcacctg

SEQ ID NO: 545965 - DNA, 25 bp, Mus musculus
gccaagtaaggcgtgcttgcacctg

SEQ ID NO: 545966 - DNA, 25 bp, Mus musculus
gccaagtagttacatgcattgctga

SEQ ID NO: 545967 - DNA, 25 bp, Mus musculus
gccaagtagttagatgcattgctga

SEQ ID NO: 545968 - DNA, 25 bp, Mus musculus
gccaagtatcacatgcagcgttgca

SEQ ID NO: 545969 - DNA, 25 bp, Mus musculus
gccaagtatcacttgcagcgttgca

SEQ ID NO: 545970 - DNA, 25 bp, Mus musculus
gccaagtcaaagcaggcctagtact

SEQ ID NO: 545971 - DNA, 25 bp, Mus musculus
gccaagtcaaaggaggcctagtact

SEQ ID NO: 545972 - DNA, 25 bp, Mus musculus
gccaagtcagaaacggcgagcgctt

SEQ ID NO: 545973 - DNA, 25 bp, Mus musculus
gccaagtcagaatcggcgagcgctt

SEQ ID NO: 545974 - DNA, 25 bp, Mus musculus
gccaagtcatatatgctttatacca

SEQ ID NO: 545975 - DNA, 25 bp, Mus musculus
gccaagtcatatttgctttatacca

SEQ ID NO: 545976 - DNA, 25 bp, Mus musculus
gccaagtcatcaaaaacagctccgt

SEQ ID NO: 545977 - DNA, 25 bp, Mus musculus
gccaagtcatcactattggcaacga

SEQ ID NO: 545978 - DNA, 25 bp, Mus musculus
gccaagtcatcagtattggcaacga

SEQ ID NO: 545979 - DNA, 25 bp, Mus musculus
gccaagtcatcataaacagctccgt

SEQ ID NO: 545980 - DNA, 25 bp, Mus musculus
gccaagtcatctcacatctcacatg

SEQ ID NO: 545981 - DNA, 25 bp, Mus musculus
gccaagtcatctgacatctcacatg

SEQ ID NO: 545982 - DNA, 25 bp, Mus musculus
gccaagtccaggaattgacagatca

SEQ ID NO: 545983 - DNA, 25 bp, Mus musculus
gccaagtccaggtattgacagatca

SEQ ID NO: 545984 - DNA, 25 bp, Mus musculus
gccaagtccatgatgtgtgctcaga

SEQ ID NO: 545985 - DNA, 25 bp, Mus musculus
gccaagtccatgttgtgtgctcaga

SEQ ID NO: 545986 - DNA, 25 bp, Mus musculus
gccaagtcggccatcagtggcaaga

SEQ ID NO: 545987 - DNA, 25 bp, Mus musculus
gccaagtcggccttcagtggcaaga

SEQ ID NO: 545988 - DNA, 25 bp, Mus musculus
gccaagtctgctcatctgagtttaa

SEQ ID NO: 545989 - DNA, 25 bp, Mus musculus
gccaagtctgctgatctgagtttaa

SEQ ID NO: 545990 - DNA, 25 bp, Mus musculus
gccaagtcttccattagaggtctga

SEQ ID NO: 545991 - DNA, 25 bp, Mus musculus
gccaagtcttcctttagaggtctga

SEQ ID NO: 545992 - DNA, 25 bp, Mus musculus
gccaagtgctgacccgcagagtgaa

SEQ ID NO: 545993 - DNA, 25 bp, Mus musculus
gccaagtgctgagccgcagagtgaa

SEQ ID NO: 545994 - DNA, 25 bp, Mus musculus
gccaagtggctgaatgatatggtat

SEQ ID NO: 545995 - DNA, 25 bp, Mus musculus
gccaagtggctgtatgatatggtat

SEQ ID NO: 545996 - DNA, 25 bp, Mus musculus
gccaagtgtactacactattatata

SEQ ID NO: 545997 - DNA, 25 bp, Mus musculus
gccaagtgtacttcactattatata

SEQ ID NO: 545998 - DNA, 25 bp, Mus musculus
gccaagtgtagtaattcaagtctgc

SEQ ID NO: 545999 - DNA, 25 bp, Mus musculus
gccaagtgtagttattcaagtctgc

SEQ ID NO: 546000 - DNA, 25 bp, Mus musculus
gccaagtgtctcaagtgatcaatac

SEQ ID NO: 546001 - DNA, 25 bp, Mus musculus
gccaagtgtctctagtgatcaatac

SEQ ID NO: 546002 - DNA, 25 bp, Mus musculus
gccaagtgtgaaacttccccagctc

SEQ ID NO: 546003 - DNA, 25 bp, Mus musculus
gccaagtgtgaatcttccccagctc

SEQ ID NO: 546004 - DNA, 25 bp, Mus musculus
gccaagtgtggactagcatgatgtt

SEQ ID NO: 546005 - DNA, 25 bp, Mus musculus
gccaagtgtggagtagcatgatgtt

SEQ ID NO: 546006 - DNA, 25 bp, Mus musculus
gccaagtgttatagatgtccagctg

SEQ ID NO: 546007 - DNA, 25 bp, Mus musculus
gccaagtgttattgatgtccagctg

SEQ ID NO: 546008 - DNA, 25 bp, Mus musculus
gccaagttcaacaccactggaaatt

SEQ ID NO: 546009 - DNA, 25 bp, Mus musculus
gccaagttcaactccactggaaatt

SEQ ID NO: 546010 - DNA, 25 bp, Mus musculus
gccaagttccatcttcgcgtggcct

SEQ ID NO: 546011 - DNA, 25 bp, Mus musculus
gccaagttccatgttcgcgtggcct

SEQ ID NO: 546012 - DNA, 25 bp, Mus musculus
gccaagttcccaactcacagaagaa

SEQ ID NO: 546013 - DNA, 25 bp, Mus musculus
gccaagttcccatctcacagaagaa

SEQ ID NO: 546014 - DNA, 25 bp, Mus musculus
gccaagttcccgatctacgagaaga

SEQ ID NO: 546015 - DNA, 25 bp, Mus musculus
gccaagttcccgttctacgagaaga

SEQ ID NO: 546016 - DNA, 25 bp, Mus musculus
gccaagttcgggctgttcgtgcact

SEQ ID NO: 546017 - DNA, 25 bp, Mus musculus
gccaagttcggggtgttcgtgcact

SEQ ID NO: 546018 - DNA, 25 bp, Mus musculus
gccaagttctagacctctgaggtaa

SEQ ID NO: 546019 - DNA, 25 bp, Mus musculus
gccaagttctagtcctctgaggtaa

SEQ ID NO: 546020 - DNA, 25 bp, Mus musculus
gccaagttgcaaaccactcagtaaa

SEQ ID NO: 546021 - DNA, 25 bp, Mus musculus
gccaagttgcaatccactcagtaaa

SEQ ID NO: 546022 - DNA, 25 bp, Mus musculus
gccaagttgtgcctggactatcatg

SEQ ID NO: 546023 - DNA, 25 bp, Mus musculus
gccaagttgtgcgtggactatcatg

SEQ ID NO: 546024 - DNA, 25 bp, Mus musculus
gccaagtttcagattgtggtttaaa

SEQ ID NO: 546025 - DNA, 25 bp, Mus musculus
gccaagtttcagtttgtggtttaaa

SEQ ID NO: 546026 - DNA, 25 bp, Mus musculus
gccaagtttcatcctattgtcaagt

SEQ ID NO: 546027 - DNA, 25 bp, Mus musculus
gccaagtttcatgctattgtcaagt

SEQ ID NO: 546028 - DNA, 25 bp, Mus musculus
gccaagtttggtccgcagagctaca

SEQ ID NO: 546029 - DNA, 25 bp, Mus musculus
gccaagtttggtgcgcagagctaca

SEQ ID NO: 546030 - DNA, 25 bp, Mus musculus
gccaagttttacatctttttcaatc

SEQ ID NO: 546031 - DNA, 25 bp, Mus musculus
gccaagttttacttctttttcaatc

SEQ ID NO: 546032 - DNA, 25 bp, Mus musculus
gccaataacttcacagcacactttt

SEQ ID NO: 546033 - DNA, 25 bp, Mus musculus
gccaataacttctcagcacactttt

SEQ ID NO: 546034 - DNA, 25 bp, Mus musculus
gccaataagcagacctcagagcatg

SEQ ID NO: 546035 - DNA, 25 bp, Mus musculus
gccaataagcagtcctcagagcatg

SEQ ID NO: 546036 - DNA, 25 bp, Mus musculus
gccaataataataacccctgggtat

SEQ ID NO: 546037 - DNA, 25 bp, Mus musculus
gccaataataattacccctgggtat

SEQ ID NO: 546038 - DNA, 25 bp, Mus musculus
gccaatacaattagagccaatccct

SEQ ID NO: 546039 - DNA, 25 bp, Mus musculus
gccaatacaatttgagccaatccct

SEQ ID NO: 546040 - DNA, 25 bp, Mus musculus
gccaatacccatacagtttttctag

SEQ ID NO: 546041 - DNA, 25 bp, Mus musculus
gccaatacccattcagtttttctag

SEQ ID NO: 546042 - DNA, 25 bp, Mus musculus
gccaatacttttcgccgtgtaccac

SEQ ID NO: 546043 - DNA, 25 bp, Mus musculus
gccaatacttttggccgtgtaccac

SEQ ID NO: 546044 - DNA, 25 bp, Mus musculus
gccaatagatgcctagtacgctgac

SEQ ID NO: 546045 - DNA, 25 bp, Mus musculus
gccaatagatgcgtagtacgctgac

SEQ ID NO: 546046 - DNA, 25 bp, Mus musculus
gccaatagcactcgatattttgctt

SEQ ID NO: 546047 - DNA, 25 bp, Mus musculus
gccaatagcactggatattttgctt

SEQ ID NO: 546048 - DNA, 25 bp, Mus musculus
gccaatagcagcctttaagctacag

SEQ ID NO: 546049 - DNA, 25 bp, Mus musculus
gccaatagcagcgtttaagctacag

SEQ ID NO: 546050 - DNA, 25 bp, Mus musculus
gccaataggctgaagttctacttta

SEQ ID NO: 546051 - DNA, 25 bp, Mus musculus
gccaataggctgtagttctacttta

SEQ ID NO: 546052 - DNA, 25 bp, Mus musculus
gccaatagtccacttgtctttttcc

SEQ ID NO: 546053 - DNA, 25 bp, Mus musculus
gccaatagtccagttgtctttttcc

SEQ ID NO: 546054 - DNA, 25 bp, Mus musculus
gccaatataccgacggccatatgaa

SEQ ID NO: 546055 - DNA, 25 bp, Mus musculus
gccaatataccgtcggccatatgaa

SEQ ID NO: 546056 - DNA, 25 bp, Mus musculus
gccaatatacgtctgttttctcttt

SEQ ID NO: 546057 - DNA, 25 bp, Mus musculus
gccaatatacgtgtgttttctcttt

SEQ ID NO: 546058 - DNA, 25 bp, Mus musculus
gccaatatcccacactcggaatgaa

SEQ ID NO: 546059 - DNA, 25 bp, Mus musculus
gccaatatcccagactcggaatgaa

SEQ ID NO: 546060 - DNA, 25 bp, Mus musculus
gccaatatggtaatacaggcccagt

SEQ ID NO: 546061 - DNA, 25 bp, Mus musculus
gccaatatggtattacaggcccagt

SEQ ID NO: 546062 - DNA, 25 bp, Mus musculus
gccaatattcctatcacagtcacag

SEQ ID NO: 546063 - DNA, 25 bp, Mus musculus
gccaatattcctttcacagtcacag

SEQ ID NO: 546064 - DNA, 25 bp, Mus musculus
gccaatatttccactcctccttttc

SEQ ID NO: 546065 - DNA, 25 bp, Mus musculus
gccaatatttcctctcctccttttc

SEQ ID NO: 546066 - DNA, 25 bp, Mus musculus
gccaatatttgaactgggctctcag

SEQ ID NO: 546067 - DNA, 25 bp, Mus musculus
gccaatatttgatctgggctctcag

SEQ ID NO: 546068 - DNA, 25 bp, Mus musculus
gccaatcaaaacacactgtgcaaag

SEQ ID NO: 546069 - DNA, 25 bp, Mus musculus
gccaatcaaaactcactgtgcaaag

SEQ ID NO: 546070 - DNA, 25 bp, Mus musculus
gccaatcaaagcaaggctgttttct

SEQ ID NO: 546071 - DNA, 25 bp, Mus musculus
gccaatcaaagctaggctgttttct

SEQ ID NO: 546072 - DNA, 25 bp, Mus musculus
gccaatcacacgcatttgttccaat

SEQ ID NO: 546073 - DNA, 25 bp, Mus musculus
gccaatcacacggatttgttccaat

SEQ ID NO: 546074 - DNA, 25 bp, Mus musculus
gccaatcacattagcctggacactg

SEQ ID NO: 546075 - DNA, 25 bp, Mus musculus
gccaatcacatttgcctggacactg

SEQ ID NO: 546076 - DNA, 25 bp, Mus musculus
gccaatcagcacctgaggctaggaa

SEQ ID NO: 546077 - DNA, 25 bp, Mus musculus
gccaatcagcacgtgaggctaggaa

SEQ ID NO: 546078 - DNA, 25 bp, Mus musculus
gccaatcagggaagcccagggatcc

SEQ ID NO: 546079 - DNA, 25 bp, Mus musculus
gccaatcagggatgcccagggatcc

SEQ ID NO: 546080 - DNA, 25 bp, Mus musculus
gccaatcatgcactttcacagggag

SEQ ID NO: 546081 - DNA, 25 bp, Mus musculus
gccaatcatgcagtttcacagggag

SEQ ID NO: 546082 - DNA, 25 bp, Mus musculus
gccaatcattgtccggtctcccgga

SEQ ID NO: 546083 - DNA, 25 bp, Mus musculus
gccaatcattgtgcggtctcccgga

SEQ ID NO: 546084 - DNA, 25 bp, Mus musculus
gccaatccgggacctgcatgcagtt

SEQ ID NO: 546085 - DNA, 25 bp, Mus musculus
gccaatccgggagctgcatgcagtt

SEQ ID NO: 546086 - DNA, 25 bp, Mus musculus
gccaatcctcaaaatcctagccaag

SEQ ID NO: 546087 - DNA, 25 bp, Mus musculus
gccaatcctcaatatcctagccaag

SEQ ID NO: 546088 - DNA, 25 bp, Mus musculus
gccaatcctcttacgggcagacgat

SEQ ID NO: 546089 - DNA, 25 bp, Mus musculus
gccaatcctctttcgggcagacgat

SEQ ID NO: 546090 - DNA, 25 bp, Mus musculus
gccaatccttccctgtactttatca

SEQ ID NO: 546091 - DNA, 25 bp, Mus musculus
gccaatccttccgtgtactttatca

SEQ ID NO: 546092 - DNA, 25 bp, Mus musculus
gccaatcgctgcatgtaagttccag

SEQ ID NO: 546093 - DNA, 25 bp, Mus musculus
gccaatcgctgcttgtaagttccag

SEQ ID NO: 546094 - DNA, 25 bp, Mus musculus
gccaatctacacaccaaagaataca

SEQ ID NO: 546095 - DNA, 25 bp, Mus musculus
gccaatctacactccaaagaataca

SEQ ID NO: 546096 - DNA, 25 bp, Mus musculus
gccaatctatggaacctatcttaat

SEQ ID NO: 546097 - DNA, 25 bp, Mus musculus
gccaatctatggtacctatcttaat

SEQ ID NO: 546098 - DNA, 25 bp, Mus musculus
gccaatctcatgctaggttcagtga

SEQ ID NO: 546099 - DNA, 25 bp, Mus musculus
gccaatctcatggtaggttcagtga

SEQ ID NO: 546100 - DNA, 25 bp, Mus musculus
gccaatctctgcaagatacagaatc

SEQ ID NO: 546101 - DNA, 25 bp, Mus musculus
gccaatctctgctagatacagaatc

SEQ ID NO: 546102 - DNA, 25 bp, Mus musculus
gccaatctgcaccatgaagtcctga

SEQ ID NO: 546103 - DNA, 25 bp, Mus musculus
gccaatctgcacgatgaagtcctga

SEQ ID NO: 546104 - DNA, 25 bp, Mus musculus
gccaatctgcggcaagccaatcaag

SEQ ID NO: 546105 - DNA, 25 bp, Mus musculus
gccaatctgcgggaagccaatcaag

SEQ ID NO: 546106 - DNA, 25 bp, Mus musculus
gccaatctggacacttctttatact

SEQ ID NO: 546107 - DNA, 25 bp, Mus musculus
gccaatctggactcttctttatact

SEQ ID NO: 546108 - DNA, 25 bp, Mus musculus
gccaatctggagaccataccctgaa

SEQ ID NO: 546109 - DNA, 25 bp, Mus musculus
gccaatctggagtccataccctgaa

SEQ ID NO: 546110 - DNA, 25 bp, Mus musculus
gccaatgaatgacttccgagcctta

SEQ ID NO: 546111 - DNA, 25 bp, Mus musculus
gccaatgaatgagttccgagcctta

SEQ ID NO: 546112 - DNA, 25 bp, Mus musculus
gccaatgacgacaggtgagttctct

SEQ ID NO: 546113 - DNA, 25 bp, Mus musculus
gccaatgacgactggtgagttctct

SEQ ID NO: 546114 - DNA, 25 bp, Mus musculus
gccaatgactttcggcaacacgttt

SEQ ID NO: 546115 - DNA, 25 bp, Mus musculus
gccaatgactttgggcaacacgttt

SEQ ID NO: 546116 - DNA, 25 bp, Mus musculus
gccaatgagatgattcaatccctaa

SEQ ID NO: 546117 - DNA, 25 bp, Mus musculus
gccaatgagatgtttcaatccctaa

SEQ ID NO: 546118 - DNA, 25 bp, Mus musculus
gccaatgatatgccagcttctacat

SEQ ID NO: 546119 - DNA, 25 bp, Mus musculus
gccaatgatatggcagcttctacat

SEQ ID NO: 546120 - DNA, 25 bp, Mus musculus
gccaatgatccaatcagagcatctg

SEQ ID NO: 546121 - DNA, 25 bp, Mus musculus
gccaatgatccattcagagcatctg

SEQ ID NO: 546122 - DNA, 25 bp, Mus musculus
gccaatgcactcatgaatttctcag

SEQ ID NO: 546123 - DNA, 25 bp, Mus musculus
gccaatgcactcttgaatttctcag

SEQ ID NO: 546124 - DNA, 25 bp, Mus musculus
gccaatgcatgtatggaaccaagct

SEQ ID NO: 546125 - DNA, 25 bp, Mus musculus
gccaatgcatgtttggaaccaagct

SEQ ID NO: 546126 - DNA, 25 bp, Mus musculus
gccaatgccttgcttagacctgact

SEQ ID NO: 546127 - DNA, 25 bp, Mus musculus
gccaatgccttggttagacctgact

SEQ ID NO: 546128 - DNA, 25 bp, Mus musculus
gccaatgctgagctacccagtacca

SEQ ID NO: 546129 - DNA, 25 bp, Mus musculus
gccaatgctgaggtacccagtacca

SEQ ID NO: 546130 - DNA, 25 bp, Mus musculus
gccaatgctggacgactgctgtaag

SEQ ID NO: 546131 - DNA, 25 bp, Mus musculus
gccaatgctggaggactgctgtaag

SEQ ID NO: 546132 - DNA, 25 bp, Mus musculus
gccaatgctgtcatttctgtgcctg

SEQ ID NO: 546133 - DNA, 25 bp, Mus musculus
gccaatgctgtcttttctgtgcctg

SEQ ID NO: 546134 - DNA, 25 bp, Mus musculus
gccaatggaaacctgcactacacat

SEQ ID NO: 546135 - DNA, 25 bp, Mus musculus
gccaatggaaacgtgcactacacat

SEQ ID NO: 546136 - DNA, 25 bp, Mus musculus
gccaatggcataaagggttcctaat

SEQ ID NO: 546137 - DNA, 25 bp, Mus musculus
gccaatggcatatagggttcctaat

SEQ ID NO: 546138 - DNA, 25 bp, Mus musculus
gccaatgggtttaccccacaagact

SEQ ID NO: 546139 - DNA, 25 bp, Mus musculus
gccaatgggttttccccacaagact

SEQ ID NO: 546140 - DNA, 25 bp, Mus musculus
gccaatggtgagaggcacccattct

SEQ ID NO: 546141 - DNA, 25 bp, Mus musculus
gccaatggtgagtggcacccattct

SEQ ID NO: 546142 - DNA, 25 bp, Mus musculus
gccaatggttttccacagggaacaa

SEQ ID NO: 546143 - DNA, 25 bp, Mus musculus
gccaatggttttgcacagggaacaa

SEQ ID NO: 546144 - DNA, 25 bp, Mus musculus
gccaatgtataaagcagtaaagact

SEQ ID NO: 546145 - DNA, 25 bp, Mus musculus
gccaatgtataatgcagtaaagact

SEQ ID NO: 546146 - DNA, 25 bp, Mus musculus
gccaatgtcaacagttagtcttcca

SEQ ID NO: 546147 - DNA, 25 bp, Mus musculus
gccaatgtcaactgttagtcttcca

SEQ ID NO: 546148 - DNA, 25 bp, Mus musculus
gccaatgtcaatcatcacctgaggt

SEQ ID NO: 546149 - DNA, 25 bp, Mus musculus
gccaatgtcaatgatcacctgaggt

SEQ ID NO: 546150 - DNA, 25 bp, Mus musculus
gccaatgtcagcatgatttagatct

SEQ ID NO: 546151 - DNA, 25 bp, Mus musculus
gccaatgtcagcttgatttagatct

SEQ ID NO: 546152 - DNA, 25 bp, Mus musculus
gccaatgtccatactgacttgcctt

SEQ ID NO: 546153 - DNA, 25 bp, Mus musculus
gccaatgtccattctgacttgcctt

SEQ ID NO: 546154 - DNA, 25 bp, Mus musculus
gccaatgtcgccagtgagtatctct

SEQ ID NO: 546155 - DNA, 25 bp, Mus musculus
gccaatgtcgcctgtgagtatctct

SEQ ID NO: 546156 - DNA, 25 bp, Mus musculus
gccaatgtctgaccaaataccacca

SEQ ID NO: 546157 - DNA, 25 bp, Mus musculus
gccaatgtctgagcaaataccacca

SEQ ID NO: 546158 - DNA, 25 bp, Mus musculus
gccaatgtctggaaccacttttgat

SEQ ID NO: 546159 - DNA, 25 bp, Mus musculus
gccaatgtctggtaccacttttgat

SEQ ID NO: 546160 - DNA, 25 bp, Mus musculus
gccaatgtttacaatctcctgttta

SEQ ID NO: 546161 - DNA, 25 bp, Mus musculus
gccaatgtttactatctcctgttta

SEQ ID NO: 546162 - DNA, 25 bp, Mus musculus
gccaattaagtactggccaccctga

SEQ ID NO: 546163 - DNA, 25 bp, Mus musculus
gccaattaagtagtggccaccctga

SEQ ID NO: 546164 - DNA, 25 bp, Mus musculus
gccaattacactctagcattgcact

SEQ ID NO: 546165 - DNA, 25 bp, Mus musculus
gccaattacactgtagcattgcact

SEQ ID NO: 546166 - DNA, 25 bp, Mus musculus
gccaattaccataaccataaagagg

SEQ ID NO: 546167 - DNA, 25 bp, Mus musculus
gccaattaccattaccataaagagg

SEQ ID NO: 546168 - DNA, 25 bp, Mus musculus
gccaattacggccagaataccaaca

SEQ ID NO: 546169 - DNA, 25 bp, Mus musculus
gccaattacggcgagaataccaaca

SEQ ID NO: 546170 - DNA, 25 bp, Mus musculus
gccaattaggcgcagtcacctgctg

SEQ ID NO: 546171 - DNA, 25 bp, Mus musculus
gccaattaggcggagtcacctgctg

SEQ ID NO: 546172 - DNA, 25 bp, Mus musculus
gccaattcagctactaatcggtcat

SEQ ID NO: 546173 - DNA, 25 bp, Mus musculus
gccaattcagcttctaatcggtcat

SEQ ID NO: 546174 - DNA, 25 bp, Mus musculus
gccaattcatggcttcatgggtaaa

SEQ ID NO: 546175 - DNA, 25 bp, Mus musculus
gccaattcatgggttcatgggtaaa

SEQ ID NO: 546176 - DNA, 25 bp, Mus musculus
gccaattcattgaacctattattta

SEQ ID NO: 546177 - DNA, 25 bp, Mus musculus
gccaattcattgtacctattattta

SEQ ID NO: 546178 - DNA, 25 bp, Mus musculus
gccaattcgcaacagagccttttac

SEQ ID NO: 546179 - DNA, 25 bp, Mus musculus
gccaattcgcaagagagccttttac

SEQ ID NO: 546180 - DNA, 25 bp, Mus musculus
gccaattctcggaagcaagaagcgg

SEQ ID NO: 546181 - DNA, 25 bp, Mus musculus
gccaattctcggtagcaagaagcgg

SEQ ID NO: 546182 - DNA, 25 bp, Mus musculus
gccaattctctgaatccatcagctg

SEQ ID NO: 546183 - DNA, 25 bp, Mus musculus
gccaattctctgtatccatcagctg

SEQ ID NO: 546184 - DNA, 25 bp, Mus musculus
gccaattcttttacctgaggccaag

SEQ ID NO: 546185 - DNA, 25 bp, Mus musculus
gccaattcttttcagtaggatcacc

SEQ ID NO: 546186 - DNA, 25 bp, Mus musculus
gccaattcttttgagtaggatcacc

SEQ ID NO: 546187 - DNA, 25 bp, Mus musculus
gccaattctttttcctgaggccaag

SEQ ID NO: 546188 - DNA, 25 bp, Mus musculus
gccaattggctccagtctgcagaag

SEQ ID NO: 546189 - DNA, 25 bp, Mus musculus
gccaattggctcgagtctgcagaag

SEQ ID NO: 546190 - DNA, 25 bp, Mus musculus
gccaattgggtaatttcttcgtgca

SEQ ID NO: 546191 - DNA, 25 bp, Mus musculus
gccaattgggtattttcttcgtgca

SEQ ID NO: 546192 - DNA, 25 bp, Mus musculus
gccaattggtcaaagaggtttgcct

SEQ ID NO: 546193 - DNA, 25 bp, Mus musculus
gccaattggtcatagaggtttgcct

SEQ ID NO: 546194 - DNA, 25 bp, Mus musculus
gccaattgtccactcatgtttctaa

SEQ ID NO: 546195 - DNA, 25 bp, Mus musculus
gccaattgtccagtcatgtttctaa

SEQ ID NO: 546196 - DNA, 25 bp, Mus musculus
gccaattgtgttagaagcaggtatt

SEQ ID NO: 546197 - DNA, 25 bp, Mus musculus
gccaattgtgtttgaagcaggtatt

SEQ ID NO: 546198 - DNA, 25 bp, Mus musculus
gccaatttacatcgattaaccctct

SEQ ID NO: 546199 - DNA, 25 bp, Mus musculus
gccaatttacatggattaaccctct

SEQ ID NO: 546200 - DNA, 25 bp, Mus musculus
gccaatttctcgactgtatgccaga

SEQ ID NO: 546201 - DNA, 25 bp, Mus musculus
gccaatttctcgtctgtatgccaga

SEQ ID NO: 546202 - DNA, 25 bp, Mus musculus
gccaatttcttactagtgctatttc

SEQ ID NO: 546203 - DNA, 25 bp, Mus musculus
gccaatttcttagtagtgctatttc

SEQ ID NO: 546204 - DNA, 25 bp, Mus musculus
gccaatttgggcaggaccctcaaag

SEQ ID NO: 546205 - DNA, 25 bp, Mus musculus
gccaatttgggctggaccctcaaag

SEQ ID NO: 546206 - DNA, 25 bp, Mus musculus
gccaatttggtgctttttgtacgag

SEQ ID NO: 546207 - DNA, 25 bp, Mus musculus
gccaatttggtggtttttgtacgag

SEQ ID NO: 546208 - DNA, 25 bp, Mus musculus
gccaattttgataatgtttctcgtg

SEQ ID NO: 546209 - DNA, 25 bp, Mus musculus
gccaattttgattatgtttctcgtg

SEQ ID NO: 546210 - DNA, 25 bp, Mus musculus
gccaattttgctacctgtactgaaa

SEQ ID NO: 546211 - DNA, 25 bp, Mus musculus
gccaattttgcttcctgtactgaaa

SEQ ID NO: 546212 - DNA, 25 bp, Mus musculus
gccaattttttaaggtgcgatgagc

SEQ ID NO: 546213 - DNA, 25 bp, Mus musculus
gccaattttttacaggagccactag

SEQ ID NO: 546214 - DNA, 25 bp, Mus musculus
gccaattttttagaggagccactag

SEQ ID NO: 546215 - DNA, 25 bp, Mus musculus
gccaattttttatggtgcgatgagc

SEQ ID NO: 546216 - DNA, 25 bp, Mus musculus
gccacaaactcaagaggtcatcctg

SEQ ID NO: 546217 - DNA, 25 bp, Mus musculus
gccacaaactcatgaggtcatcctg

SEQ ID NO: 546218 - DNA, 25 bp, Mus musculus
gccacaaagggcagcccagagaaag

SEQ ID NO: 546219 - DNA, 25 bp, Mus musculus
gccacaaagggctgcccagagaaag

SEQ ID NO: 546220 - DNA, 25 bp, Mus musculus
gccacaaatccacaagttgctatta

SEQ ID NO: 546221 - DNA, 25 bp, Mus musculus
gccacaaatccagaagttgctatta

SEQ ID NO: 546222 - DNA, 25 bp, Mus musculus
gccacaaatctcaacaagtgcctgt

SEQ ID NO: 546223 - DNA, 25 bp, Mus musculus
gccacaaatctctacaagtgcctgt

SEQ ID NO: 546224 - DNA, 25 bp, Mus musculus
gccacaaatgcaagcttgaagtcat

SEQ ID NO: 546225 - DNA, 25 bp, Mus musculus
gccacaaatgcaatttctccgttta

SEQ ID NO: 546226 - DNA, 25 bp, Mus musculus
gccacaaatgcatgcttgaagtcat

SEQ ID NO: 546227 - DNA, 25 bp, Mus musculus
gccacaaatgcattttctccgttta

SEQ ID NO: 546228 - DNA, 25 bp, Mus musculus
gccacaaatgttcttgcaaaccctt

SEQ ID NO: 546229 - DNA, 25 bp, Mus musculus
gccacaaatgttgttgcaaaccctt

SEQ ID NO: 546230 - DNA, 25 bp, Mus musculus
gccacaaattagatgaccccaccta

SEQ ID NO: 546231 - DNA, 25 bp, Mus musculus
gccacaaattagttgaccccaccta

SEQ ID NO: 546232 - DNA, 25 bp, Mus musculus
gccacaacaatcagcgtattacacg

SEQ ID NO: 546233 - DNA, 25 bp, Mus musculus
gccacaacaatctgcgtattacacg

SEQ ID NO: 546234 - DNA, 25 bp, Mus musculus
gccacaacagccctcgtcaaggaaa

SEQ ID NO: 546235 - DNA, 25 bp, Mus musculus
gccacaacagccgtcgtcaaggaaa

SEQ ID NO: 546236 - DNA, 25 bp, Mus musculus
gccacaacatgcaacacgaggtctc

SEQ ID NO: 546237 - DNA, 25 bp, Mus musculus
gccacaacatgctacacgaggtctc

SEQ ID NO: 546238 - DNA, 25 bp, Mus musculus
gccacaaccaagctacatgcataca

SEQ ID NO: 546239 - DNA, 25 bp, Mus musculus
gccacaaccaaggtacatgcataca

SEQ ID NO: 546240 - DNA, 25 bp, Mus musculus
gccacaaccatgatttgaagagaaa

SEQ ID NO: 546241 - DNA, 25 bp, Mus musculus
gccacaaccatgttttgaagagaaa

SEQ ID NO: 546242 - DNA, 25 bp, Mus musculus
gccacaaccccaaatagttctgatt

SEQ ID NO: 546243 - DNA, 25 bp, Mus musculus
gccacaaccccatatagttctgatt

SEQ ID NO: 546244 - DNA, 25 bp, Mus musculus
gccacaaccgagaggactagaggga

SEQ ID NO: 546245 - DNA, 25 bp, Mus musculus
gccacaaccgagtggactagaggga

SEQ ID NO: 546246 - DNA, 25 bp, Mus musculus
gccacaaccggcactagtgttaggt

SEQ ID NO: 546247 - DNA, 25 bp, Mus musculus
gccacaaccggctctagtgttaggt

SEQ ID NO: 546248 - DNA, 25 bp, Mus musculus
gccacaactgaaatggatcctcgtt

SEQ ID NO: 546249 - DNA, 25 bp, Mus musculus
gccacaactgaattggatcctcgtt

SEQ ID NO: 546250 - DNA, 25 bp, Mus musculus
gccacaactggaaatgctcaagaac

SEQ ID NO: 546251 - DNA, 25 bp, Mus musculus
gccacaactggatatgctcaagaac

SEQ ID NO: 546252 - DNA, 25 bp, Mus musculus
gccacaagaaagcagggtactgtta

SEQ ID NO: 546253 - DNA, 25 bp, Mus musculus
gccacaagaaaggagggtactgtta

SEQ ID NO: 546254 - DNA, 25 bp, Mus musculus
gccacaagacaaaagagcccctagt

SEQ ID NO: 546255 - DNA, 25 bp, Mus musculus
gccacaagacaatagagcccctagt

SEQ ID NO: 546256 - DNA, 25 bp, Mus musculus
gccacaagaccaccatctttacgga

SEQ ID NO: 546257 - DNA, 25 bp, Mus musculus
gccacaagaccagcatctttacgga

SEQ ID NO: 546258 - DNA, 25 bp, Mus musculus
gccacaagatctcacactttttcta

SEQ ID NO: 546259 - DNA, 25 bp, Mus musculus
gccacaagatctgacactttttcta

SEQ ID NO: 546260 - DNA, 25 bp, Mus musculus
gccacaagcatgaccttggtggaca

SEQ ID NO: 546261 - DNA, 25 bp, Mus musculus
gccacaagcatgtccttggtggaca

SEQ ID NO: 546262 - DNA, 25 bp, Mus musculus
gccacaagctctatctggtgttttc

SEQ ID NO: 546263 - DNA, 25 bp, Mus musculus
gccacaagctctttctggtgttttc

SEQ ID NO: 546264 - DNA, 25 bp, Mus musculus
gccacaaggaaacaagacgaagttt

SEQ ID NO: 546265 - DNA, 25 bp, Mus musculus
gccacaaggaaagaagacgaagttt

SEQ ID NO: 546266 - DNA, 25 bp, Mus musculus
gccacaaggaacatccctttttcaa

SEQ ID NO: 546267 - DNA, 25 bp, Mus musculus
gccacaaggaacttccctttttcaa

SEQ ID NO: 546268 - DNA, 25 bp, Mus musculus
gccacaagtttcacagccacaagga

SEQ ID NO: 546269 - DNA, 25 bp, Mus musculus
gccacaagtttctcagccacaagga

SEQ ID NO: 546270 - DNA, 25 bp, Mus musculus
gccacaatctccaagttacctgagg

SEQ ID NO: 546271 - DNA, 25 bp, Mus musculus
gccacaatctcctagttacctgagg

SEQ ID NO: 546272 - DNA, 25 bp, Mus musculus
gccacaatcttaatccttgtctgat

SEQ ID NO: 546273 - DNA, 25 bp, Mus musculus
gccacaatcttattccttgtctgat

SEQ ID NO: 546274 - DNA, 25 bp, Mus musculus
gccacaatgcaaaaactcgcgttga

SEQ ID NO: 546275 - DNA, 25 bp, Mus musculus
gccacaatgcaataactcgcgttga

SEQ ID NO: 546276 - DNA, 25 bp, Mus musculus
gccacaattcttcattgctgcagac

SEQ ID NO: 546277 - DNA, 25 bp, Mus musculus
gccacaattcttgattgctgcagac

SEQ ID NO: 546278 - DNA, 25 bp, Mus musculus
gccacaattgcacatgttcttccaa

SEQ ID NO: 546279 - DNA, 25 bp, Mus musculus
gccacaattgcagatgttcttccaa

SEQ ID NO: 546280 - DNA, 25 bp, Mus musculus
gccacacaaacaatgggacttcttt

SEQ ID NO: 546281 - DNA, 25 bp, Mus musculus
gccacacaaacattgggacttcttt

SEQ ID NO: 546282 - DNA, 25 bp, Mus musculus
gccacacacatgatcacttctgtag

SEQ ID NO: 546283 - DNA, 25 bp, Mus musculus
gccacacacatgttcacttctgtag

SEQ ID NO: 546284 - DNA, 25 bp, Mus musculus
gccacacaccacagagtatgcttgt

SEQ ID NO: 546285 - DNA, 25 bp, Mus musculus
gccacacaccactgagtatgcttgt

SEQ ID NO: 546286 - DNA, 25 bp, Mus musculus
gccacacaccctcatgactttggaa

SEQ ID NO: 546287 - DNA, 25 bp, Mus musculus
gccacacaccctgatgactttggaa

SEQ ID NO: 546288 - DNA, 25 bp, Mus musculus
gccacacactaacgtgctctctgta

SEQ ID NO: 546289 - DNA, 25 bp, Mus musculus
gccacacactaaggtgctctctgta

SEQ ID NO: 546290 - DNA, 25 bp, Mus musculus
gccacacagagcatgaggctgagtt

SEQ ID NO: 546291 - DNA, 25 bp, Mus musculus
gccacacagagcttgaggctgagtt

SEQ ID NO: 546292 - DNA, 25 bp, Mus musculus
gccacacagtggcttatgtttttca

SEQ ID NO: 546293 - DNA, 25 bp, Mus musculus
gccacacagtgggttatgtttttca

SEQ ID NO: 546294 - DNA, 25 bp, Mus musculus
gccacacatcagacccataaaatta

SEQ ID NO: 546295 - DNA, 25 bp, Mus musculus
gccacacatcagtcccataaaatta

SEQ ID NO: 546296 - DNA, 25 bp, Mus musculus
gccacacatccgaggtgtactttgt

SEQ ID NO: 546297 - DNA, 25 bp, Mus musculus
gccacacatccgtggtgtactttgt

SEQ ID NO: 546298 - DNA, 25 bp, Mus musculus
gccacacatgcacctaatttaaaat

SEQ ID NO: 546299 - DNA, 25 bp, Mus musculus
gccacacatgcagctaatttaaaat

SEQ ID NO: 546300 - DNA, 25 bp, Mus musculus
gccacaccacacctttatacggatt

SEQ ID NO: 546301 - DNA, 25 bp, Mus musculus
gccacaccacacgtttatacggatt

SEQ ID NO: 546302 - DNA, 25 bp, Mus musculus
gccacaccagcacaggacgatgagg

SEQ ID NO: 546303 - DNA, 25 bp, Mus musculus
gccacaccagcagaggacgatgagg

SEQ ID NO: 546304 - DNA, 25 bp, Mus musculus
gccacaccagcgaggctcacagtga

SEQ ID NO: 546305 - DNA, 25 bp, Mus musculus
gccacaccagcgtggctcacagtga

SEQ ID NO: 546306 - DNA, 25 bp, Mus musculus
gccacaccagtgcagtcagggttca

SEQ ID NO: 546307 - DNA, 25 bp, Mus musculus
gccacaccagtggagtcagggttca

SEQ ID NO: 546308 - DNA, 25 bp, Mus musculus
gccacacccacaaccttaggaagag

SEQ ID NO: 546309 - DNA, 25 bp, Mus musculus
gccacacccacatccttaggaagag

SEQ ID NO: 546310 - DNA, 25 bp, Mus musculus
gccacacccactctgaaggattatt

SEQ ID NO: 546311 - DNA, 25 bp, Mus musculus
gccacacccactgtgaaggattatt

SEQ ID NO: 546312 - DNA, 25 bp, Mus musculus
gccacaccccagaaaatatgaccat

SEQ ID NO: 546313 - DNA, 25 bp, Mus musculus
gccacaccccagtaaatatgaccat

SEQ ID NO: 546314 - DNA, 25 bp, Mus musculus
gccacacccgaacgtcttgatttga

SEQ ID NO: 546315 - DNA, 25 bp, Mus musculus
gccacacccgaaggtcttgatttga

SEQ ID NO: 546316 - DNA, 25 bp, Mus musculus
gccacaccgctgaatatgcatgatt

SEQ ID NO: 546317 - DNA, 25 bp, Mus musculus
gccacaccgctgtatatgcatgatt

SEQ ID NO: 546318 - DNA, 25 bp, Mus musculus
gccacaccgtgccaaaagaagctga

SEQ ID NO: 546319 - DNA, 25 bp, Mus musculus
gccacaccgtgcgaaaagaagctga

SEQ ID NO: 546320 - DNA, 25 bp, Mus musculus
gccacacctaccaacaaggtctaaa

SEQ ID NO: 546321 - DNA, 25 bp, Mus musculus
gccacacctacctacaaggtctaaa

SEQ ID NO: 546322 - DNA, 25 bp, Mus musculus
gccacacctagcataaccatgtttt

SEQ ID NO: 546323 - DNA, 25 bp, Mus musculus
gccacacctagcttaaccatgtttt

SEQ ID NO: 546324 - DNA, 25 bp, Mus musculus
gccacacctattcctatcttaataa

SEQ ID NO: 546325 - DNA, 25 bp, Mus musculus
gccacacctattgctatcttaataa

SEQ ID NO: 546326 - DNA, 25 bp, Mus musculus
gccacacctgaactgccaacatttg

SEQ ID NO: 546327 - DNA, 25 bp, Mus musculus
gccacacctgaagtgccaacatttg

SEQ ID NO: 546328 - DNA, 25 bp, Mus musculus
gccacacctgccatatttttacaaa

SEQ ID NO: 546329 - DNA, 25 bp, Mus musculus
gccacacctgccttatttttacaaa

SEQ ID NO: 546330 - DNA, 25 bp, Mus musculus
gccacaccttgaccctgaatgagga

SEQ ID NO: 546331 - DNA, 25 bp, Mus musculus
gccacaccttgagcctgaatgagga

SEQ ID NO: 546332 - DNA, 25 bp, Mus musculus
gccacacgagtgagtcattttccat

SEQ ID NO: 546333 - DNA, 25 bp, Mus musculus
gccacacgagtgtgtcattttccat

SEQ ID NO: 546334 - DNA, 25 bp, Mus musculus
gccacactaatcaatacctggagag

SEQ ID NO: 546335 - DNA, 25 bp, Mus musculus
gccacactaatctatacctggagag

SEQ ID NO: 546336 - DNA, 25 bp, Mus musculus
gccacactagacagagcaccggtga

SEQ ID NO: 546337 - DNA, 25 bp, Mus musculus
gccacactagactgagcaccggtga

SEQ ID NO: 546338 - DNA, 25 bp, Mus musculus
gccacactatacacagcttgaacat

SEQ ID NO: 546339 - DNA, 25 bp, Mus musculus
gccacactatactcagcttgaacat

SEQ ID NO: 546340 - DNA, 25 bp, Mus musculus
gccacactatgcaaggccattggta

SEQ ID NO: 546341 - DNA, 25 bp, Mus musculus
gccacactatgctaggccattggta

SEQ ID NO: 546342 - DNA, 25 bp, Mus musculus
gccacactcactaggtatctacgaa

SEQ ID NO: 546343 - DNA, 25 bp, Mus musculus
gccacactcacttggtatctacgaa

SEQ ID NO: 546344 - DNA, 25 bp, Mus musculus
gccacactccagatttggaccagta

SEQ ID NO: 546345 - DNA, 25 bp, Mus musculus
gccacactccagttttggaccagta

SEQ ID NO: 546346 - DNA, 25 bp, Mus musculus
gccacactctagacaagacagccat

SEQ ID NO: 546347 - DNA, 25 bp, Mus musculus
gccacactctagtcaagacagccat

SEQ ID NO: 546348 - DNA, 25 bp, Mus musculus
gccacactcttaaatcagaacctgt

SEQ ID NO: 546349 - DNA, 25 bp, Mus musculus
gccacactcttatatcagaacctgt

SEQ ID NO: 546350 - DNA, 25 bp, Mus musculus
gccacactgctaccaagctgcatga

SEQ ID NO: 546351 - DNA, 25 bp, Mus musculus
gccacactgctagcaagctgcatga

SEQ ID NO: 546352 - DNA, 25 bp, Mus musculus
gccacactggagaattagctgcgta

SEQ ID NO: 546353 - DNA, 25 bp, Mus musculus
gccacactggagcacttgatcttgt

SEQ ID NO: 546354 - DNA, 25 bp, Mus musculus
gccacactggaggacttgatcttgt

SEQ ID NO: 546355 - DNA, 25 bp, Mus musculus
gccacactggagtattagctgcgta

SEQ ID NO: 546356 - DNA, 25 bp, Mus musculus
gccacactggtgcagctttggtcag

SEQ ID NO: 546357 - DNA, 25 bp, Mus musculus
gccacactggtggagctttggtcag

SEQ ID NO: 546358 - DNA, 25 bp, Mus musculus
gccacactgtgacgaagagcacctt

SEQ ID NO: 546359 - DNA, 25 bp, Mus musculus
gccacactgtgaggaagagcacctt

SEQ ID NO: 546360 - DNA, 25 bp, Mus musculus
gccacactgttccaccaatagaaag

SEQ ID NO: 546361 - DNA, 25 bp, Mus musculus
gccacactgttcgaccaatagaaag

SEQ ID NO: 546362 - DNA, 25 bp, Mus musculus
gccacacttgtgcatgtttgcttag

SEQ ID NO: 546363 - DNA, 25 bp, Mus musculus
gccacacttgtggatgtttgcttag

SEQ ID NO: 546364 - DNA, 25 bp, Mus musculus
gccacactttcaagtagaccgaggt

SEQ ID NO: 546365 - DNA, 25 bp, Mus musculus
gccacactttcatgtagaccgaggt

SEQ ID NO: 546366 - DNA, 25 bp, Mus musculus
gccacagaaccaagtcctaaggagt

SEQ ID NO: 546367 - DNA, 25 bp, Mus musculus
gccacagaaccatgtcctaaggagt

SEQ ID NO: 546368 - DNA, 25 bp, Mus musculus
gccacagaagcccagtcatggagag

SEQ ID NO: 546369 - DNA, 25 bp, Mus musculus
gccacagaagccgagtcatggagag

SEQ ID NO: 546370 - DNA, 25 bp, Mus musculus
gccacagaagtccagttccctgtaa

SEQ ID NO: 546371 - DNA, 25 bp, Mus musculus
gccacagaagtcgagttccctgtaa

SEQ ID NO: 546372 - DNA, 25 bp, Mus musculus
gccacagaatagcacacttggtttc

SEQ ID NO: 546373 - DNA, 25 bp, Mus musculus
gccacagaataggacacttggtttc

SEQ ID NO: 546374 - DNA, 25 bp, Mus musculus
gccacagacttacaagctgccttgg

SEQ ID NO: 546375 - DNA, 25 bp, Mus musculus
gccacagacttagaagctgccttgg

SEQ ID NO: 546376 - DNA, 25 bp, Mus musculus
gccacagagagaaaatcgcattgca

SEQ ID NO: 546377 - DNA, 25 bp, Mus musculus
gccacagagagataatcgcattgca

SEQ ID NO: 546378 - DNA, 25 bp, Mus musculus
gccacagagatgcacattttctaga

SEQ ID NO: 546379 - DNA, 25 bp, Mus musculus
gccacagagatggacattttctaga

SEQ ID NO: 546380 - DNA, 25 bp, Mus musculus
gccacagaggccatcaaggagagtg

SEQ ID NO: 546381 - DNA, 25 bp, Mus musculus
gccacagaggccttcaaggagagtg

SEQ ID NO: 546382 - DNA, 25 bp, Mus musculus
gccacagagggaaaggtacagtcac

SEQ ID NO: 546383 - DNA, 25 bp, Mus musculus
gccacagagggacctaaagttaact

SEQ ID NO: 546384 - DNA, 25 bp, Mus musculus
gccacagagggagctaaagttaact

SEQ ID NO: 546385 - DNA, 25 bp, Mus musculus
gccacagagggataggtacagtcac

SEQ ID NO: 546386 - DNA, 25 bp, Mus musculus
gccacagagttgacgagttccctgg

SEQ ID NO: 546387 - DNA, 25 bp, Mus musculus
gccacagagttgtcgagttccctgg

SEQ ID NO: 546388 - DNA, 25 bp, Mus musculus
gccacagatctaagcctcatcctga

SEQ ID NO: 546389 - DNA, 25 bp, Mus musculus
gccacagatctatgcctcatcctga

SEQ ID NO: 546390 - DNA, 25 bp, Mus musculus
gccacagatcttcggtgagcaagtg

SEQ ID NO: 546391 - DNA, 25 bp, Mus musculus
gccacagatcttgggtgagcaagtg

SEQ ID NO: 546392 - DNA, 25 bp, Mus musculus
gccacagatggcattccgttagttt

SEQ ID NO: 546393 - DNA, 25 bp, Mus musculus
gccacagatggctttccgttagttt

SEQ ID NO: 546394 - DNA, 25 bp, Mus musculus
gccacagatggtatctgtcacacag

SEQ ID NO: 546395 - DNA, 25 bp, Mus musculus
gccacagatggtttctgtcacacag

SEQ ID NO: 546396 - DNA, 25 bp, Mus musculus
gccacagcaagaatcagctgcttgt

SEQ ID NO: 546397 - DNA, 25 bp, Mus musculus
gccacagcaagattcagctgcttgt

SEQ ID NO: 546398 - DNA, 25 bp, Mus musculus
gccacagcacagctcagggatccaa

SEQ ID NO: 546399 - DNA, 25 bp, Mus musculus
gccacagcacaggtcagggatccaa

SEQ ID NO: 546400 - DNA, 25 bp, Mus musculus
gccacagcagagcatataaggcttt

SEQ ID NO: 546401 - DNA, 25 bp, Mus musculus
gccacagcagaggatataaggcttt

SEQ ID NO: 546402 - DNA, 25 bp, Mus musculus
gccacagcaggcacagctatggaga

SEQ ID NO: 546403 - DNA, 25 bp, Mus musculus
gccacagcaggctcagctatggaga

SEQ ID NO: 546404 - DNA, 25 bp, Mus musculus
gccacagccagaagaagcccaaata

SEQ ID NO: 546405 - DNA, 25 bp, Mus musculus
gccacagccagatgaagcccaaata

SEQ ID NO: 546406 - DNA, 25 bp, Mus musculus
gccacagccctacagtgaagggctt

SEQ ID NO: 546407 - DNA, 25 bp, Mus musculus
gccacagccctagagtgaagggctt

SEQ ID NO: 546408 - DNA, 25 bp, Mus musculus
gccacagccgagcagcacagtgact

SEQ ID NO: 546409 - DNA, 25 bp, Mus musculus
gccacagccgaggagcacagtgact

SEQ ID NO: 546410 - DNA, 25 bp, Mus musculus
gccacagccgatcccttcaaagagg

SEQ ID NO: 546411 - DNA, 25 bp, Mus musculus
gccacagccgatgccttcaaagagg

SEQ ID NO: 546412 - DNA, 25 bp, Mus musculus
gccacagccgtaatttgcttgtttc

SEQ ID NO: 546413 - DNA, 25 bp, Mus musculus
gccacagccgtattttgcttgtttc

SEQ ID NO: 546414 - DNA, 25 bp, Mus musculus
gccacagctatcaacaactgcagtt

SEQ ID NO: 546415 - DNA, 25 bp, Mus musculus
gccacagctatctacaactgcagtt

SEQ ID NO: 546416 - DNA, 25 bp, Mus musculus
gccacagctccacttcggaaaactg

SEQ ID NO: 546417 - DNA, 25 bp, Mus musculus
gccacagctccagttcggaaaactg

SEQ ID NO: 546418 - DNA, 25 bp, Mus musculus
gccacagctctcactagaagactat

SEQ ID NO: 546419 - DNA, 25 bp, Mus musculus
gccacagctctctctagaagactat

SEQ ID NO: 546420 - DNA, 25 bp, Mus musculus
gccacaggaactactgtctgagcaa

SEQ ID NO: 546421 - DNA, 25 bp, Mus musculus
gccacaggaacttctgtctgagcaa

SEQ ID NO: 546422 - DNA, 25 bp, Mus musculus
gccacaggactaatctcacacagga

SEQ ID NO: 546423 - DNA, 25 bp, Mus musculus
gccacaggactattctcacacagga

SEQ ID NO: 546424 - DNA, 25 bp, Mus musculus
gccacaggccatatcagaaaggaag

SEQ ID NO: 546425 - DNA, 25 bp, Mus musculus
gccacaggccatttcagaaaggaag

SEQ ID NO: 546426 - DNA, 25 bp, Mus musculus
gccacaggccttctttctatggata

SEQ ID NO: 546427 - DNA, 25 bp, Mus musculus
gccacaggccttgtttctatggata

SEQ ID NO: 546428 - DNA, 25 bp, Mus musculus
gccacagggactctaccttaactgt

SEQ ID NO: 546429 - DNA, 25 bp, Mus musculus
gccacagggactgtaccttaactgt

SEQ ID NO: 546430 - DNA, 25 bp, Mus musculus
gccacagggagaaaagcaatcccga

SEQ ID NO: 546431 - DNA, 25 bp, Mus musculus
gccacagggagataagcaatcccga

SEQ ID NO: 546432 - DNA, 25 bp, Mus musculus
gccacagggcttcaccaattataaa

SEQ ID NO: 546433 - DNA, 25 bp, Mus musculus
gccacagggcttgaccaattataaa

SEQ ID NO: 546434 - DNA, 25 bp, Mus musculus
gccacaggtccgcaaagaacattct

SEQ ID NO: 546435 - DNA, 25 bp, Mus musculus
gccacaggtccggaaagaacattct

SEQ ID NO: 546436 - DNA, 25 bp, Mus musculus
gccacaggtgtgacttttgctcatc

SEQ ID NO: 546437 - DNA, 25 bp, Mus musculus
gccacaggtgtgtcttttgctcatc

SEQ ID NO: 546438 - DNA, 25 bp, Mus musculus
gccacagtaaagagtgttggtttgc

SEQ ID NO: 546439 - DNA, 25 bp, Mus musculus
gccacagtaaagtgtgttggtttgc

SEQ ID NO: 546440 - DNA, 25 bp, Mus musculus
gccacagtacccatgaggagatcag

SEQ ID NO: 546441 - DNA, 25 bp, Mus musculus
gccacagtacccttgaggagatcag

SEQ ID NO: 546442 - DNA, 25 bp, Mus musculus
gccacagtagtaacatctgtttctg

SEQ ID NO: 546443 - DNA, 25 bp, Mus musculus
gccacagtagtatcatctgtttctg

SEQ ID NO: 546444 - DNA, 25 bp, Mus musculus
gccacagtatacatcctgatgcaga

SEQ ID NO: 546445 - DNA, 25 bp, Mus musculus
gccacagtatacttcctgatgcaga

SEQ ID NO: 546446 - DNA, 25 bp, Mus musculus
gccacagtattacctttttaaggtc

SEQ ID NO: 546447 - DNA, 25 bp, Mus musculus
gccacagtattagctttttaaggtc

SEQ ID NO: 546448 - DNA, 25 bp, Mus musculus
gccacagtccagagtcactttctaa

SEQ ID NO: 546449 - DNA, 25 bp, Mus musculus
gccacagtccagtgtcactttctaa

SEQ ID NO: 546450 - DNA, 25 bp, Mus musculus
gccacagtccgcagccaataaagtc

SEQ ID NO: 546451 - DNA, 25 bp, Mus musculus
gccacagtccgctgccaataaagtc

SEQ ID NO: 546452 - DNA, 25 bp, Mus musculus
gccacagtctgtaaggagtcgcttt

SEQ ID NO: 546453 - DNA, 25 bp, Mus musculus
gccacagtctgttaggagtcgcttt

SEQ ID NO: 546454 - DNA, 25 bp, Mus musculus
gccacagtctttaaaatttcttaga

SEQ ID NO: 546455 - DNA, 25 bp, Mus musculus
gccacagtctttcaagccgttccta

SEQ ID NO: 546456 - DNA, 25 bp, Mus musculus
gccacagtctttgaagccgttccta

SEQ ID NO: 546457 - DNA, 25 bp, Mus musculus
gccacagtcttttaaatttcttaga

SEQ ID NO: 546458 - DNA, 25 bp, Mus musculus
gccacagtgaatatccatcccggaa

SEQ ID NO: 546459 - DNA, 25 bp, Mus musculus
gccacagtgaatttccatcccggaa

SEQ ID NO: 546460 - DNA, 25 bp, Mus musculus
gccacagtgcagacatgcatcatga

SEQ ID NO: 546461 - DNA, 25 bp, Mus musculus
gccacagtgcagatatctttagcaa

SEQ ID NO: 546462 - DNA, 25 bp, Mus musculus
gccacagtgcagtcatgcatcatga

SEQ ID NO: 546463 - DNA, 25 bp, Mus musculus
gccacagtgcagttatctttagcaa

SEQ ID NO: 546464 - DNA, 25 bp, Mus musculus
gccacagtggcaagggcttttgtaa

SEQ ID NO: 546465 - DNA, 25 bp, Mus musculus
gccacagtggcatgggcttttgtaa

SEQ ID NO: 546466 - DNA, 25 bp, Mus musculus
gccacagttaatccgaccaccaaga

SEQ ID NO: 546467 - DNA, 25 bp, Mus musculus
gccacagttaatgcgaccaccaaga

SEQ ID NO: 546468 - DNA, 25 bp, Mus musculus
gccacagttacgatcatctctaaaa

SEQ ID NO: 546469 - DNA, 25 bp, Mus musculus
gccacagttacgttcatctctaaaa

SEQ ID NO: 546470 - DNA, 25 bp, Mus musculus
gccacagttggaaagtagtgccttt

SEQ ID NO: 546471 - DNA, 25 bp, Mus musculus
gccacagttggatagtagtgccttt

SEQ ID NO: 546472 - DNA, 25 bp, Mus musculus
gccacagttgggatattggccaaga

SEQ ID NO: 546473 - DNA, 25 bp, Mus musculus
gccacagttgggttattggccaaga

SEQ ID NO: 546474 - DNA, 25 bp, Mus musculus
gccacagttgtgcatgctccttagg

SEQ ID NO: 546475 - DNA, 25 bp, Mus musculus
gccacagttgtggatgctccttagg

SEQ ID NO: 546476 - DNA, 25 bp, Mus musculus
gccacagtttcgaacactccaagga

SEQ ID NO: 546477 - DNA, 25 bp, Mus musculus
gccacagtttcgtacactccaagga

SEQ ID NO: 546478 - DNA, 25 bp, Mus musculus
gccacagtttctagtttctcaatat

SEQ ID NO: 546479 - DNA, 25 bp, Mus musculus
gccacagtttcttgtttctcaatat

SEQ ID NO: 546480 - DNA, 25 bp, Mus musculus
gccacataaggtagttcccttgaaa

SEQ ID NO: 546481 - DNA, 25 bp, Mus musculus
gccacataaggttgttcccttgaaa

SEQ ID NO: 546482 - DNA, 25 bp, Mus musculus
gccacatacaggatcctagacagga

SEQ ID NO: 546483 - DNA, 25 bp, Mus musculus
gccacatacaggttcctagacagga

SEQ ID NO: 546484 - DNA, 25 bp, Mus musculus
gccacatacgctagagaagctgaat

SEQ ID NO: 546485 - DNA, 25 bp, Mus musculus
gccacatacgcttgagaagctgaat

SEQ ID NO: 546486 - DNA, 25 bp, Mus musculus
gccacatactgtcttagccttgaaa

SEQ ID NO: 546487 - DNA, 25 bp, Mus musculus
gccacatactgtgttagccttgaaa

SEQ ID NO: 546488 - DNA, 25 bp, Mus musculus
gccacatagggcagtggttgtcccc

SEQ ID NO: 546489 - DNA, 25 bp, Mus musculus
gccacatagggctgtggttgtcccc

SEQ ID NO: 546490 - DNA, 25 bp, Mus musculus
gccacatagtcaatgtcctttcatt

SEQ ID NO: 546491 - DNA, 25 bp, Mus musculus
gccacatagtcattgtcctttcatt

SEQ ID NO: 546492 - DNA, 25 bp, Mus musculus
gccacatatcctcattcttgatctg

SEQ ID NO: 546493 - DNA, 25 bp, Mus musculus
gccacatatcctgattcttgatctg

SEQ ID NO: 546494 - DNA, 25 bp, Mus musculus
gccacatatctcataactacagctc

SEQ ID NO: 546495 - DNA, 25 bp, Mus musculus
gccacatatctcttaactacagctc

SEQ ID NO: 546496 - DNA, 25 bp, Mus musculus
gccacatatgcgagttctatattat

SEQ ID NO: 546497 - DNA, 25 bp, Mus musculus
gccacatatgcgtgttctatattat

SEQ ID NO: 546498 - DNA, 25 bp, Mus musculus
gccacatatgtgcacagtgccatgg

SEQ ID NO: 546499 - DNA, 25 bp, Mus musculus
gccacatatgtggacagtgccatgg

SEQ ID NO: 546500 - DNA, 25 bp, Mus musculus
gccacatatttacttagccccatga

SEQ ID NO: 546501 - DNA, 25 bp, Mus musculus
gccacatatttagttagccccatga

SEQ ID NO: 546502 - DNA, 25 bp, Mus musculus
gccacatcagccatgggtacctgga

SEQ ID NO: 546503 - DNA, 25 bp, Mus musculus
gccacatcagccttgggtacctgga

SEQ ID NO: 546504 - DNA, 25 bp, Mus musculus
gccacatcagggacctacagaagga

SEQ ID NO: 546505 - DNA, 25 bp, Mus musculus
gccacatcagggatgcagctgtgtg

SEQ ID NO: 546506 - DNA, 25 bp, Mus musculus
gccacatcagggtcctacagaagga

SEQ ID NO: 546507 - DNA, 25 bp, Mus musculus
gccacatcagggttgcagctgtgtg

SEQ ID NO: 546508 - DNA, 25 bp, Mus musculus
gccacatcaggtatgtcatttcaga

SEQ ID NO: 546509 - DNA, 25 bp, Mus musculus
gccacatcaggtttgtcatttcaga

SEQ ID NO: 546510 - DNA, 25 bp, Mus musculus
gccacatcccaaccctgtatttttt

SEQ ID NO: 546511 - DNA, 25 bp, Mus musculus
gccacatcccaagcctgtatttttt

SEQ ID NO: 546512 - DNA, 25 bp, Mus musculus
gccacatcccagctggagagagtta

SEQ ID NO: 546513 - DNA, 25 bp, Mus musculus
gccacatcccaggtggagagagtta

SEQ ID NO: 546514 - DNA, 25 bp, Mus musculus
gccacatcccggctagtgacaatag

SEQ ID NO: 546515 - DNA, 25 bp, Mus musculus
gccacatcccgggtagtgacaatag

SEQ ID NO: 546516 - DNA, 25 bp, Mus musculus
gccacatcctcacattgttccagag

SEQ ID NO: 546517 - DNA, 25 bp, Mus musculus
gccacatcctcagattgttccagag

SEQ ID NO: 546518 - DNA, 25 bp, Mus musculus
gccacatccttaccctatattcatt

SEQ ID NO: 546519 - DNA, 25 bp, Mus musculus
gccacatccttagcctatattcatt

SEQ ID NO: 546520 - DNA, 25 bp, Mus musculus
gccacatccttgatgggtctgttca

SEQ ID NO: 546521 - DNA, 25 bp, Mus musculus
gccacatccttgttgggtctgttca

SEQ ID NO: 546522 - DNA, 25 bp, Mus musculus
gccacatcgtggctatgttccggat

SEQ ID NO: 546523 - DNA, 25 bp, Mus musculus
gccacatcgtgggtatgttccggat

SEQ ID NO: 546524 - DNA, 25 bp, Mus musculus
gccacatctctaccccaaatatatt

SEQ ID NO: 546525 - DNA, 25 bp, Mus musculus
gccacatctctagcccaaatatatt

SEQ ID NO: 546526 - DNA, 25 bp, Mus musculus
gccacatctgtactgcagcggatga

SEQ ID NO: 546527 - DNA, 25 bp, Mus musculus
gccacatctgtagtgcagcggatga

SEQ ID NO: 546528 - DNA, 25 bp, Mus musculus
gccacatcttacatttctctgttga

SEQ ID NO: 546529 - DNA, 25 bp, Mus musculus
gccacatcttacttttctctgttga

SEQ ID NO: 546530 - DNA, 25 bp, Mus musculus
gccacatcttcactcctaatattat

SEQ ID NO: 546531 - DNA, 25 bp, Mus musculus
gccacatcttcagtcctaatattat

SEQ ID NO: 546532 - DNA, 25 bp, Mus musculus
gccacatgaaacactagaccacctg

SEQ ID NO: 546533 - DNA, 25 bp, Mus musculus
gccacatgaaactctagaccacctg

SEQ ID NO: 546534 - DNA, 25 bp, Mus musculus
gccacatgcttacaaggctaagtat

SEQ ID NO: 546535 - DNA, 25 bp, Mus musculus
gccacatgcttagaaggctaagtat

SEQ ID NO: 546536 - DNA, 25 bp, Mus musculus
gccacatgctttcaacgagttctgt

SEQ ID NO: 546537 - DNA, 25 bp, Mus musculus
gccacatgctttgaacgagttctgt

SEQ ID NO: 546538 - DNA, 25 bp, Mus musculus
gccacatggcctacataactgcttt

SEQ ID NO: 546539 - DNA, 25 bp, Mus musculus
gccacatggccttcataactgcttt

SEQ ID NO: 546540 - DNA, 25 bp, Mus musculus
gccacatggcggagaactgcagcaa

SEQ ID NO: 546541 - DNA, 25 bp, Mus musculus
gccacatggcggtgaactgcagcaa

SEQ ID NO: 546542 - DNA, 25 bp, Mus musculus
gccacatggctgctcctaagctttg

SEQ ID NO: 546543 - DNA, 25 bp, Mus musculus
gccacatggctggtcctaagctttg

SEQ ID NO: 546544 - DNA, 25 bp, Mus musculus
gccacatgggacctagcagtgcaga

SEQ ID NO: 546545 - DNA, 25 bp, Mus musculus
gccacatgggacgtagcagtgcaga

SEQ ID NO: 546546 - DNA, 25 bp, Mus musculus
gccacatgtagtatttctgtatttg

SEQ ID NO: 546547 - DNA, 25 bp, Mus musculus
gccacatgtagtttttctgtatttg

SEQ ID NO: 546548 - DNA, 25 bp, Mus musculus
gccacatgtatacctcatttgtctg

SEQ ID NO: 546549 - DNA, 25 bp, Mus musculus
gccacatgtatagctcatttgtctg

SEQ ID NO: 546550 - DNA, 25 bp, Mus musculus
gccacatgtcatcacttcactgaag

SEQ ID NO: 546551 - DNA, 25 bp, Mus musculus
gccacatgtcatgacttcactgaag

SEQ ID NO: 546552 - DNA, 25 bp, Mus musculus
gccacatgtctcaagcttctgaaac

SEQ ID NO: 546553 - DNA, 25 bp, Mus musculus
gccacatgtctctagcttctgaaac

SEQ ID NO: 546554 - DNA, 25 bp, Mus musculus
gccacatgtgtcaccttggcctggt

SEQ ID NO: 546555 - DNA, 25 bp, Mus musculus
gccacatgtgtctccttggcctggt

SEQ ID NO: 546556 - DNA, 25 bp, Mus musculus
gccacatgtgtgcagcatcacgtgc

SEQ ID NO: 546557 - DNA, 25 bp, Mus musculus
gccacatgtgtggagcatcacgtgc

SEQ ID NO: 546558 - DNA, 25 bp, Mus musculus
gccacattacaaacaagccaaaaga

SEQ ID NO: 546559 - DNA, 25 bp, Mus musculus
gccacattacaatcaagccaaaaga

SEQ ID NO: 546560 - DNA, 25 bp, Mus musculus
gccacattaccgaaagcacgttcga

SEQ ID NO: 546561 - DNA, 25 bp, Mus musculus
gccacattaccgtaagcacgttcga

SEQ ID NO: 546562 - DNA, 25 bp, Mus musculus
gccacattagcccactttagcagat

SEQ ID NO: 546563 - DNA, 25 bp, Mus musculus
gccacattagccgactttagcagat

SEQ ID NO: 546564 - DNA, 25 bp, Mus musculus
gccacattattgctttgaattgatg

SEQ ID NO: 546565 - DNA, 25 bp, Mus musculus
gccacattattggtttgaattgatg

SEQ ID NO: 546566 - DNA, 25 bp, Mus musculus
gccacattctctcctcaggatgaaa

SEQ ID NO: 546567 - DNA, 25 bp, Mus musculus
gccacattctctgctcaggatgaaa

SEQ ID NO: 546568 - DNA, 25 bp, Mus musculus
gccacattgagaagggccaggctgt

SEQ ID NO: 546569 - DNA, 25 bp, Mus musculus
gccacattgagatgggccaggctgt

SEQ ID NO: 546570 - DNA, 25 bp, Mus musculus
gccacattgagcagcgagggagcct

SEQ ID NO: 546571 - DNA, 25 bp, Mus musculus
gccacattgagctgcgagggagcct

SEQ ID NO: 546572 - DNA, 25 bp, Mus musculus
gccacattgggcatgagacttctaa

SEQ ID NO: 546573 - DNA, 25 bp, Mus musculus
gccacattgggcttgagacttctaa

SEQ ID NO: 546574 - DNA, 25 bp, Mus musculus
gccacatttcagagcatcctgcaga

SEQ ID NO: 546575 - DNA, 25 bp, Mus musculus
gccacatttcagcttaggaaacacc

SEQ ID NO: 546576 - DNA, 25 bp, Mus musculus
gccacatttcaggttaggaaacacc

SEQ ID NO: 546577 - DNA, 25 bp, Mus musculus
gccacatttcagtgcatcctgcaga

SEQ ID NO: 546578 - DNA, 25 bp, Mus musculus
gccacatttcgacagcatcatcagt

SEQ ID NO: 546579 - DNA, 25 bp, Mus musculus
gccacatttcgagagcatcatcagt

SEQ ID NO: 546580 - DNA, 25 bp, Mus musculus
gccacatttgtacctaagccctttt

SEQ ID NO: 546581 - DNA, 25 bp, Mus musculus
gccacatttgtagctaagccctttt

SEQ ID NO: 546582 - DNA, 25 bp, Mus musculus
gccacattttccaaggccaaggcga

SEQ ID NO: 546583 - DNA, 25 bp, Mus musculus
gccacattttcctaggccaaggcga

SEQ ID NO: 546584 - DNA, 25 bp, Mus musculus
gccacattttgtaaaactactgttg

SEQ ID NO: 546585 - DNA, 25 bp, Mus musculus
gccacattttgtctttgacgacaga

SEQ ID NO: 546586 - DNA, 25 bp, Mus musculus
gccacattttgtgtttgacgacaga

SEQ ID NO: 546587 - DNA, 25 bp, Mus musculus
gccacattttgttaaactactgttg

SEQ ID NO: 546588 - DNA, 25 bp, Mus musculus
gccaccaaaaggaagtatttgctgc

SEQ ID NO: 546589 - DNA, 25 bp, Mus musculus
gccaccaaaaggtagtatttgctgc

SEQ ID NO: 546590 - DNA, 25 bp, Mus musculus
gccaccaaaatgcaatgctcttcat

SEQ ID NO: 546591 - DNA, 25 bp, Mus musculus
gccaccaaaatggaatgctcttcat

SEQ ID NO: 546592 - DNA, 25 bp, Mus musculus
gccaccaaccaaaggacatacagga

SEQ ID NO: 546593 - DNA, 25 bp, Mus musculus
gccaccaaccaatggacatacagga

SEQ ID NO: 546594 - DNA, 25 bp, Mus musculus
gccaccaacttgcagatgctgttat

SEQ ID NO: 546595 - DNA, 25 bp, Mus musculus
gccaccaacttggagatgctgttat

SEQ ID NO: 546596 - DNA, 25 bp, Mus musculus
gccaccaagactctacatttgcagt

SEQ ID NO: 546597 - DNA, 25 bp, Mus musculus
gccaccaagactgtacatttgcagt

SEQ ID NO: 546598 - DNA, 25 bp, Mus musculus
gccaccaagcccagacttgtttaat

SEQ ID NO: 546599 - DNA, 25 bp, Mus musculus
gccaccaagccctgacttgtttaat

SEQ ID NO: 546600 - DNA, 25 bp, Mus musculus
gccaccaaggcacgatgttcttctt

SEQ ID NO: 546601 - DNA, 25 bp, Mus musculus
gccaccaaggcaggatgttcttctt

SEQ ID NO: 546602 - DNA, 25 bp, Mus musculus
gccaccaagtcccatgtgatagata

SEQ ID NO: 546603 - DNA, 25 bp, Mus musculus
gccaccaagtccgatgtgatagata

SEQ ID NO: 546604 - DNA, 25 bp, Mus musculus
gccaccaatgtgcaaaagtcaggaa

SEQ ID NO: 546605 - DNA, 25 bp, Mus musculus
gccaccaatgtgcttacgagtctac

SEQ ID NO: 546606 - DNA, 25 bp, Mus musculus
gccaccaatgtggaaaagtcaggaa

SEQ ID NO: 546607 - DNA, 25 bp, Mus musculus
gccaccaatgtggttacgagtctac

SEQ ID NO: 546608 - DNA, 25 bp, Mus musculus
gccaccacaatcaacatgcctgaga

SEQ ID NO: 546609 - DNA, 25 bp, Mus musculus
gccaccacaatctacatgcctgaga

SEQ ID NO: 546610 - DNA, 25 bp, Mus musculus
gccaccacaatgatcctgtcaggag

SEQ ID NO: 546611 - DNA, 25 bp, Mus musculus
gccaccacaatgttcctgtcaggag

SEQ ID NO: 546612 - DNA, 25 bp, Mus musculus
gccaccacacaaagctcagagttat

SEQ ID NO: 546613 - DNA, 25 bp, Mus musculus
gccaccacacaatgctcagagttat

SEQ ID NO: 546614 - DNA, 25 bp, Mus musculus
gccaccacacctagtgtttgtgtca

SEQ ID NO: 546615 - DNA, 25 bp, Mus musculus
gccaccacaccttgtgtttgtgtca

SEQ ID NO: 546616 - DNA, 25 bp, Mus musculus
gccaccacagatcacttggactaat

SEQ ID NO: 546617 - DNA, 25 bp, Mus musculus
gccaccacagatgacttggactaat

SEQ ID NO: 546618 - DNA, 25 bp, Mus musculus
gccaccacagcgcacttgagtaaca

SEQ ID NO: 546619 - DNA, 25 bp, Mus musculus
gccaccacagcggacttgagtaaca

SEQ ID NO: 546620 - DNA, 25 bp, Mus musculus
gccaccacataacagtcaaagcttt

SEQ ID NO: 546621 - DNA, 25 bp, Mus musculus
gccaccacataagagtcaaagcttt

SEQ ID NO: 546622 - DNA, 25 bp, Mus musculus
gccaccacatccaacctttttatgg

SEQ ID NO: 546623 - DNA, 25 bp, Mus musculus
gccaccacatcctacctttttatgg

SEQ ID NO: 546624 - DNA, 25 bp, Mus musculus
gccaccaccgaaaggacgagttctc

SEQ ID NO: 546625 - DNA, 25 bp, Mus musculus
gccaccaccgaatggacgagttctc

SEQ ID NO: 546626 - DNA, 25 bp, Mus musculus
gccaccacgaaaagcgaggcgctgt

SEQ ID NO: 546627 - DNA, 25 bp, Mus musculus
gccaccacgaaatgcgaggcgctgt

SEQ ID NO: 546628 - DNA, 25 bp, Mus musculus
gccaccagaagcacccagtgatggg

SEQ ID NO: 546629 - DNA, 25 bp, Mus musculus
gccaccagaagctcccagtgatggg

SEQ ID NO: 546630 - DNA, 25 bp, Mus musculus
gccaccagaaggcaggctgtgtctc

SEQ ID NO: 546631 - DNA, 25 bp, Mus musculus
gccaccagaagggaggctgtgtctc

SEQ ID NO: 546632 - DNA, 25 bp, Mus musculus
gccaccagactccagcagaatgaat

SEQ ID NO: 546633 - DNA, 25 bp, Mus musculus
gccaccagactcgagcagaatgaat

SEQ ID NO: 546634 - DNA, 25 bp, Mus musculus
gccaccagctgcaaaacatccattt

SEQ ID NO: 546635 - DNA, 25 bp, Mus musculus
gccaccagctgctaaacatccattt

SEQ ID NO: 546636 - DNA, 25 bp, Mus musculus
gccaccagctggaagcaccaagtat

SEQ ID NO: 546637 - DNA, 25 bp, Mus musculus
gccaccagctggtagcaccaagtat

SEQ ID NO: 546638 - DNA, 25 bp, Mus musculus
gccaccaggattacagagcgactct

SEQ ID NO: 546639 - DNA, 25 bp, Mus musculus
gccaccaggatttcagagcgactct

SEQ ID NO: 546640 - DNA, 25 bp, Mus musculus
gccaccaggtgtatgctcttagaca

SEQ ID NO: 546641 - DNA, 25 bp, Mus musculus
gccaccaggtgtttgctcttagaca

SEQ ID NO: 546642 - DNA, 25 bp, Mus musculus
gccaccagtcccagcttagaataac

SEQ ID NO: 546643 - DNA, 25 bp, Mus musculus
gccaccagtccctgcttagaataac

SEQ ID NO: 546644 - DNA, 25 bp, Mus musculus
gccaccagtggtagatggagaactc

SEQ ID NO: 546645 - DNA, 25 bp, Mus musculus
gccaccagtggttgatggagaactc

SEQ ID NO: 546646 - DNA, 25 bp, Mus musculus
gccaccagttggagtgcctgggaat

SEQ ID NO: 546647 - DNA, 25 bp, Mus musculus
gccaccagttggtgtgcctgggaat

SEQ ID NO: 546648 - DNA, 25 bp, Mus musculus
gccaccataactagcgtttcgaact

SEQ ID NO: 546649 - DNA, 25 bp, Mus musculus
gccaccataacttgcgtttcgaact

SEQ ID NO: 546650 - DNA, 25 bp, Mus musculus
gccaccatagatagtcttctcattg

SEQ ID NO: 546651 - DNA, 25 bp, Mus musculus
gccaccatagattgtcttctcattg

SEQ ID NO: 546652 - DNA, 25 bp, Mus musculus
gccaccatatgacgatggcctgaaa

SEQ ID NO: 546653 - DNA, 25 bp, Mus musculus
gccaccatatgaggatggcctgaaa

SEQ ID NO: 546654 - DNA, 25 bp, Mus musculus
gccaccatcgccagtcaaaaaataa

SEQ ID NO: 546655 - DNA, 25 bp, Mus musculus
gccaccatcgcctgtcaaaaaataa

SEQ ID NO: 546656 - DNA, 25 bp, Mus musculus
gccaccatgagactcgtctgagcag

SEQ ID NO: 546657 - DNA, 25 bp, Mus musculus
gccaccatgagagtcgtctgagcag

SEQ ID NO: 546658 - DNA, 25 bp, Mus musculus
gccaccatgcagagttcttttatga

SEQ ID NO: 546659 - DNA, 25 bp, Mus musculus
gccaccatgcagtgttcttttatga

SEQ ID NO: 546660 - DNA, 25 bp, Mus musculus
gccaccatgcttctagttttgactg

SEQ ID NO: 546661 - DNA, 25 bp, Mus musculus
gccaccatgcttgtagttttgactg

SEQ ID NO: 546662 - DNA, 25 bp, Mus musculus
gccaccatgtcacgtctgctaggat

SEQ ID NO: 546663 - DNA, 25 bp, Mus musculus
gccaccatgtcaggtctgctaggat

SEQ ID NO: 546664 - DNA, 25 bp, Mus musculus
gccaccattaagatgaccgtgtggt

SEQ ID NO: 546665 - DNA, 25 bp, Mus musculus
gccaccattaagttgaccgtgtggt

SEQ ID NO: 546666 - DNA, 25 bp, Mus musculus
gccaccattcttactgtaggaacta

SEQ ID NO: 546667 - DNA, 25 bp, Mus musculus
gccaccattctttctgtaggaacta

SEQ ID NO: 546668 - DNA, 25 bp, Mus musculus
gccaccattgcacaattttgtccta

SEQ ID NO: 546669 - DNA, 25 bp, Mus musculus
gccaccattgcagaattttgtccta

SEQ ID NO: 546670 - DNA, 25 bp, Mus musculus
gccaccattgctaccaggagaacca

SEQ ID NO: 546671 - DNA, 25 bp, Mus musculus
gccaccattgcttccaggagaacca

SEQ ID NO: 546672 - DNA, 25 bp, Mus musculus
gccaccattggcatctaaagtctta

SEQ ID NO: 546673 - DNA, 25 bp, Mus musculus
gccaccattggcttctaaagtctta

SEQ ID NO: 546674 - DNA, 25 bp, Mus musculus
gccacccaacagatctggtcaaata

SEQ ID NO: 546675 - DNA, 25 bp, Mus musculus
gccacccaacagttctggtcaaata

SEQ ID NO: 546676 - DNA, 25 bp, Mus musculus
gccacccaagcccaataagaggagt

SEQ ID NO: 546677 - DNA, 25 bp, Mus musculus
gccacccaagccgaataagaggagt

SEQ ID NO: 546678 - DNA, 25 bp, Mus musculus
gccacccacattatctataaaaggc

SEQ ID NO: 546679 - DNA, 25 bp, Mus musculus
gccacccacattttctataaaaggc

SEQ ID NO: 546680 - DNA, 25 bp, Mus musculus
gccacccacgaccatgagaacatat

SEQ ID NO: 546681 - DNA, 25 bp, Mus musculus
gccacccacgacgatgagaacatat

SEQ ID NO: 546682 - DNA, 25 bp, Mus musculus
gccacccagggcagcatattaaaac

SEQ ID NO: 546683 - DNA, 25 bp, Mus musculus
gccacccagggctgcatattaaaac

SEQ ID NO: 546684 - DNA, 25 bp, Mus musculus
gccacccatcagataatctgtgcag

SEQ ID NO: 546685 - DNA, 25 bp, Mus musculus
gccacccatcagttaatctgtgcag

SEQ ID NO: 546686 - DNA, 25 bp, Mus musculus
gccacccatcggctctgatgtggag

SEQ ID NO: 546687 - DNA, 25 bp, Mus musculus
gccacccatcgggtctgatgtggag

SEQ ID NO: 546688 - DNA, 25 bp, Mus musculus
gccacccatgccattgtattattgc

SEQ ID NO: 546689 - DNA, 25 bp, Mus musculus
gccacccatgcctttgtattattgc

SEQ ID NO: 546690 - DNA, 25 bp, Mus musculus
gccaccccgaggatgctggaaatca

SEQ ID NO: 546691 - DNA, 25 bp, Mus musculus
gccaccccgaggttgctggaaatca

SEQ ID NO: 546692 - DNA, 25 bp, Mus musculus
gccacccctggactgggttatgtaa

SEQ ID NO: 546693 - DNA, 25 bp, Mus musculus
gccacccctggagtgggttatgtaa

SEQ ID NO: 546694 - DNA, 25 bp, Mus musculus
gccacccctgtaattttgatgccta

SEQ ID NO: 546695 - DNA, 25 bp, Mus musculus
gccacccctgtatttttgatgccta

SEQ ID NO: 546696 - DNA, 25 bp, Mus musculus
gccacccctgtgctcagaggagaaa

SEQ ID NO: 546697 - DNA, 25 bp, Mus musculus
gccacccctgtggtcagaggagaaa

SEQ ID NO: 546698 - DNA, 25 bp, Mus musculus
gccacccctgttcttggagagggca

SEQ ID NO: 546699 - DNA, 25 bp, Mus musculus
gccacccctgttgttggagagggca

SEQ ID NO: 546700 - DNA, 25 bp, Mus musculus
gccaccctcgtcacctgaaggaaag

SEQ ID NO: 546701 - DNA, 25 bp, Mus musculus
gccaccctcgtctcctgaaggaaag

SEQ ID NO: 546702 - DNA, 25 bp, Mus musculus
gccaccctctaactgtactgagtta

SEQ ID NO: 546703 - DNA, 25 bp, Mus musculus
gccaccctctaagtgtactgagtta

SEQ ID NO: 546704 - DNA, 25 bp, Mus musculus
gccaccctggccctagtgcttccat

SEQ ID NO: 546705 - DNA, 25 bp, Mus musculus
gccaccctggccgtagtgcttccat

SEQ ID NO: 546706 - DNA, 25 bp, Mus musculus
gccaccctgggcaatagtatgagag

SEQ ID NO: 546707 - DNA, 25 bp, Mus musculus
gccaccctgggctatagtatgagag

SEQ ID NO: 546708 - DNA, 25 bp, Mus musculus
gccaccctgtatatttgaatgttca

SEQ ID NO: 546709 - DNA, 25 bp, Mus musculus
gccaccctgtatttttgaatgttca

SEQ ID NO: 546710 - DNA, 25 bp, Mus musculus
gccaccctgtgacatgccaacgaga

SEQ ID NO: 546711 - DNA, 25 bp, Mus musculus
gccaccctgtgagatgccaacgaga

SEQ ID NO: 546712 - DNA, 25 bp, Mus musculus
gccacccttcatagagtttaggcat

SEQ ID NO: 546713 - DNA, 25 bp, Mus musculus
gccacccttcattgagtttaggcat

SEQ ID NO: 546714 - DNA, 25 bp, Mus musculus
gccacccttctcaagattctagaaa

SEQ ID NO: 546715 - DNA, 25 bp, Mus musculus
gccacccttctctagattctagaaa

SEQ ID NO: 546716 - DNA, 25 bp, Mus musculus
gccaccgaagacaacttttagtaga

SEQ ID NO: 546717 - DNA, 25 bp, Mus musculus
gccaccgaagactacttttagtaga

SEQ ID NO: 546718 - DNA, 25 bp, Mus musculus
gccaccgacacactgattctgagaa

SEQ ID NO: 546719 - DNA, 25 bp, Mus musculus
gccaccgacacagtgattctgagaa

SEQ ID NO: 546720 - DNA, 25 bp, Mus musculus
gccaccgagaagaatgtagcagata

SEQ ID NO: 546721 - DNA, 25 bp, Mus musculus
gccaccgagaagtatgtagcagata

SEQ ID NO: 546722 - DNA, 25 bp, Mus musculus
gccaccgcaggacccttggaaagag

SEQ ID NO: 546723 - DNA, 25 bp, Mus musculus
gccaccgcaggagccttggaaagag

SEQ ID NO: 546724 - DNA, 25 bp, Mus musculus
gccaccgccgagagagactgaggac

SEQ ID NO: 546725 - DNA, 25 bp, Mus musculus
gccaccgccgagtgagactgaggac

SEQ ID NO: 546726 - DNA, 25 bp, Mus musculus
gccaccgcgctgagttgtatgcagt

SEQ ID NO: 546727 - DNA, 25 bp, Mus musculus
gccaccgcgctgtgttgtatgcagt

SEQ ID NO: 546728 - DNA, 25 bp, Mus musculus
gccaccgggcttagtacagtttgta

SEQ ID NO: 546729 - DNA, 25 bp, Mus musculus
gccaccgggctttgtacagtttgta

SEQ ID NO: 546730 - DNA, 25 bp, Mus musculus
gccaccgtcagcagagcttcaagaa

SEQ ID NO: 546731 - DNA, 25 bp, Mus musculus
gccaccgtcagctgagcttcaagaa

SEQ ID NO: 546732 - DNA, 25 bp, Mus musculus
gccaccgtcggaagctcaagacgta

SEQ ID NO: 546733 - DNA, 25 bp, Mus musculus
gccaccgtcggatgctcaagacgta

SEQ ID NO: 546734 - DNA, 25 bp, Mus musculus
gccaccgtcggcatagacttcagga

SEQ ID NO: 546735 - DNA, 25 bp, Mus musculus
gccaccgtcggcttagacttcagga

SEQ ID NO: 546736 - DNA, 25 bp, Mus musculus
gccaccgtgacaatggaagagcctg

SEQ ID NO: 546737 - DNA, 25 bp, Mus musculus
gccaccgtgacattggaagagcctg

SEQ ID NO: 546738 - DNA, 25 bp, Mus musculus
gccaccgtgcagacctgttctcgaa

SEQ ID NO: 546739 - DNA, 25 bp, Mus musculus
gccaccgtgcagtcctgttctcgaa

SEQ ID NO: 546740 - DNA, 25 bp, Mus musculus
gccaccgtgctgaaccaagggatga

SEQ ID NO: 546741 - DNA, 25 bp, Mus musculus
gccaccgtgctgtaccaagggatga

SEQ ID NO: 546742 - DNA, 25 bp, Mus musculus
gccacctaatttacaatctctgatg

SEQ ID NO: 546743 - DNA, 25 bp, Mus musculus
gccacctaattttcaatctctgatg

SEQ ID NO: 546744 - DNA, 25 bp, Mus musculus
gccacctactgtaagatttgtctct

SEQ ID NO: 546745 - DNA, 25 bp, Mus musculus
gccacctactgttagatttgtctct

SEQ ID NO: 546746 - DNA, 25 bp, Mus musculus
gccacctaggtgattactgcaggaa

SEQ ID NO: 546747 - DNA, 25 bp, Mus musculus
gccacctaggtgtttactgcaggaa

SEQ ID NO: 546748 - DNA, 25 bp, Mus musculus
gccacctattagagctgtgcttcag

SEQ ID NO: 546749 - DNA, 25 bp, Mus musculus
gccacctattagtgctgtgcttcag

SEQ ID NO: 546750 - DNA, 25 bp, Mus musculus
gccacctcaggaccttgttgaagag

SEQ ID NO: 546751 - DNA, 25 bp, Mus musculus
gccacctcaggagcttgttgaagag

SEQ ID NO: 546752 - DNA, 25 bp, Mus musculus
gccacctcaggtcctgaatctttag

SEQ ID NO: 546753 - DNA, 25 bp, Mus musculus
gccacctcaggtgctgaatctttag

SEQ ID NO: 546754 - DNA, 25 bp, Mus musculus
gccacctcatcactcagggtgagat

SEQ ID NO: 546755 - DNA, 25 bp, Mus musculus
gccacctcatcagtcagggtgagat

SEQ ID NO: 546756 - DNA, 25 bp, Mus musculus
gccacctcctcaacagtgatgttgg

SEQ ID NO: 546757 - DNA, 25 bp, Mus musculus
gccacctcctcatcagtgatgttgg

SEQ ID NO: 546758 - DNA, 25 bp, Mus musculus
gccacctcctgaatgaatctaacct

SEQ ID NO: 546759 - DNA, 25 bp, Mus musculus
gccacctcctgattgaatctaacct

SEQ ID NO: 546760 - DNA, 25 bp, Mus musculus
gccacctctcggctcagaatataga

SEQ ID NO: 546761 - DNA, 25 bp, Mus musculus
gccacctctcgggtcagaatataga

SEQ ID NO: 546762 - DNA, 25 bp, Mus musculus
gccacctcttcgctacttagaataa

SEQ ID NO: 546763 - DNA, 25 bp, Mus musculus
gccacctcttcggtacttagaataa

SEQ ID NO: 546764 - DNA, 25 bp, Mus musculus
gccacctctttgagcagagcagcgg

SEQ ID NO: 546765 - DNA, 25 bp, Mus musculus
gccacctctttgtgcagagcagcgg

SEQ ID NO: 546766 - DNA, 25 bp, Mus musculus
gccacctgacatcctacatatgtac

SEQ ID NO: 546767 - DNA, 25 bp, Mus musculus
gccacctgacatgctacatatgtac

SEQ ID NO: 546768 - DNA, 25 bp, Mus musculus
gccacctgagccaggtgctcaagca

SEQ ID NO: 546769 - DNA, 25 bp, Mus musculus
gccacctgagcctggtgctcaagca

SEQ ID NO: 546770 - DNA, 25 bp, Mus musculus
gccacctgaggaatgtgcctgcgat

SEQ ID NO: 546771 - DNA, 25 bp, Mus musculus
gccacctgaggattgtgcctgcgat

SEQ ID NO: 546772 - DNA, 25 bp, Mus musculus
gccacctgagggatgagggtttatt

SEQ ID NO: 546773 - DNA, 25 bp, Mus musculus
gccacctgagggttgagggtttatt

SEQ ID NO: 546774 - DNA, 25 bp, Mus musculus
gccacctgatgaaggacatattcct

SEQ ID NO: 546775 - DNA, 25 bp, Mus musculus
gccacctgatgatggacatattcct

SEQ ID NO: 546776 - DNA, 25 bp, Mus musculus
gccacctgatggacatgtcatgctg

SEQ ID NO: 546777 - DNA, 25 bp, Mus musculus
gccacctgatggtcatgtcatgctg

SEQ ID NO: 546778 - DNA, 25 bp, Mus musculus
gccacctgattgaagagcacggaca

SEQ ID NO: 546779 - DNA, 25 bp, Mus musculus
gccacctgattgtagagcacggaca

SEQ ID NO: 546780 - DNA, 25 bp, Mus musculus
gccacctgcctgaggtgtaacataa

SEQ ID NO: 546781 - DNA, 25 bp, Mus musculus
gccacctgcctgtggtgtaacataa

SEQ ID NO: 546782 - DNA, 25 bp, Mus musculus
gccacctgcttcaataaataacctt

SEQ ID NO: 546783 - DNA, 25 bp, Mus musculus
gccacctgcttctataaataacctt

SEQ ID NO: 546784 - DNA, 25 bp, Mus musculus
gccacctgtggcatcaagactgcaa

SEQ ID NO: 546785 - DNA, 25 bp, Mus musculus
gccacctgtggcttcaagactgcaa

SEQ ID NO: 546786 - DNA, 25 bp, Mus musculus
gccacctgttacacattcattttgt

SEQ ID NO: 546787 - DNA, 25 bp, Mus musculus
gccacctgttactcattcattttgt

SEQ ID NO: 546788 - DNA, 25 bp, Mus musculus
gccacctgttcaaagtccacaaagt

SEQ ID NO: 546789 - DNA, 25 bp, Mus musculus
gccacctgttcatagtccacaaagt

SEQ ID NO: 546790 - DNA, 25 bp, Mus musculus
gccaccttaccactgagccgtaaga

SEQ ID NO: 546791 - DNA, 25 bp, Mus musculus
gccaccttaccagtgagccgtaaga

SEQ ID NO: 546792 - DNA, 25 bp, Mus musculus
gccaccttcaggcaggagtcagaac

SEQ ID NO: 546793 - DNA, 25 bp, Mus musculus
gccaccttcagggaggagtcagaac

SEQ ID NO: 546794 - DNA, 25 bp, Mus musculus
gccaccttccaaatcaactgtatta

SEQ ID NO: 546795 - DNA, 25 bp, Mus musculus
gccaccttccaattcaactgtatta

SEQ ID NO: 546796 - DNA, 25 bp, Mus musculus
gccaccttctacaacagacaattgc

SEQ ID NO: 546797 - DNA, 25 bp, Mus musculus
gccaccttctactacagacaattgc

SEQ ID NO: 546798 - DNA, 25 bp, Mus musculus
gccaccttcttaagcatctggacaa

SEQ ID NO: 546799 - DNA, 25 bp, Mus musculus
gccaccttcttatgcatctggacaa

SEQ ID NO: 546800 - DNA, 25 bp, Mus musculus
gccaccttgctcagggatggactat

SEQ ID NO: 546801 - DNA, 25 bp, Mus musculus
gccaccttgctctgggatggactat

SEQ ID NO: 546802 - DNA, 25 bp, Mus musculus
gccaccttgcttcatgatttgatac

SEQ ID NO: 546803 - DNA, 25 bp, Mus musculus
gccaccttgcttgatgatttgatac

SEQ ID NO: 546804 - DNA, 25 bp, Mus musculus
gccaccttgggaagccatccttgag

SEQ ID NO: 546805 - DNA, 25 bp, Mus musculus
gccaccttgggatgccatccttgag

SEQ ID NO: 546806 - DNA, 25 bp, Mus musculus
gccaccttgggcagaatttgaagca

SEQ ID NO: 546807 - DNA, 25 bp, Mus musculus
gccaccttgggctgaatttgaagca

SEQ ID NO: 546808 - DNA, 25 bp, Mus musculus
gccaccttgtggctaataggaaccg

SEQ ID NO: 546809 - DNA, 25 bp, Mus musculus
gccaccttgtgggtaataggaaccg

SEQ ID NO: 546810 - DNA, 25 bp, Mus musculus
gccacctttgatcattttaagtcca

SEQ ID NO: 546811 - DNA, 25 bp, Mus musculus
gccacctttgatgattttaagtcca

SEQ ID NO: 546812 - DNA, 25 bp, Mus musculus
gccacgaaagtcatctctgccaaga

SEQ ID NO: 546813 - DNA, 25 bp, Mus musculus
gccacgaaagtcttctctgccaaga

SEQ ID NO: 546814 - DNA, 25 bp, Mus musculus
gccacgaacagaaacacttggtgaa

SEQ ID NO: 546815 - DNA, 25 bp, Mus musculus
gccacgaacagatacacttggtgaa

SEQ ID NO: 546816 - DNA, 25 bp, Mus musculus
gccacgaacgcaacgaggcgacatg

SEQ ID NO: 546817 - DNA, 25 bp, Mus musculus
gccacgaacgcatcgaggcgacatg

SEQ ID NO: 546818 - DNA, 25 bp, Mus musculus
gccacgaacttaattccatgactgt

SEQ ID NO: 546819 - DNA, 25 bp, Mus musculus
gccacgaacttatttccatgactgt

SEQ ID NO: 546820 - DNA, 25 bp, Mus musculus
gccacgaaggagatcctcgttgctt

SEQ ID NO: 546821 - DNA, 25 bp, Mus musculus
gccacgaaggagttcctcgttgctt

SEQ ID NO: 546822 - DNA, 25 bp, Mus musculus
gccacgaaggccacactgaaagagt

SEQ ID NO: 546823 - DNA, 25 bp, Mus musculus
gccacgaaggcctcactgaaagagt

SEQ ID NO: 546824 - DNA, 25 bp, Mus musculus
gccacgaagttaaccagttatgcta

SEQ ID NO: 546825 - DNA, 25 bp, Mus musculus
gccacgaagttatccagttatgcta

SEQ ID NO: 546826 - DNA, 25 bp, Mus musculus
gccacgacaaagcttgcactacttg

SEQ ID NO: 546827 - DNA, 25 bp, Mus musculus
gccacgacaaaggttgcactacttg

SEQ ID NO: 546828 - DNA, 25 bp, Mus musculus
gccacgacctggataatcaattgtt

SEQ ID NO: 546829 - DNA, 25 bp, Mus musculus
gccacgacctggatattgaagctat

SEQ ID NO: 546830 - DNA, 25 bp, Mus musculus
gccacgacctggttaatcaattgtt

SEQ ID NO: 546831 - DNA, 25 bp, Mus musculus
gccacgacctggttattgaagctat

SEQ ID NO: 546832 - DNA, 25 bp, Mus musculus
gccacgactggaactctctcaagag

SEQ ID NO: 546833 - DNA, 25 bp, Mus musculus
gccacgactggatctctctcaagag

SEQ ID NO: 546834 - DNA, 25 bp, Mus musculus
gccacgagaactctagagtgctcta

SEQ ID NO: 546835 - DNA, 25 bp, Mus musculus
gccacgagaactgtagagtgctcta

SEQ ID NO: 546836 - DNA, 25 bp, Mus musculus
gccacgagtggcattataatctaga

SEQ ID NO: 546837 - DNA, 25 bp, Mus musculus
gccacgagtggctttataatctaga

SEQ ID NO: 546838 - DNA, 25 bp, Mus musculus
gccacgagttttcagtctggacata

SEQ ID NO: 546839 - DNA, 25 bp, Mus musculus
gccacgagttttgagtctggacata

SEQ ID NO: 546840 - DNA, 25 bp, Mus musculus
gccacgatctggacgatgtcctctt

SEQ ID NO: 546841 - DNA, 25 bp, Mus musculus
gccacgatctggtcgatgtcctctt

SEQ ID NO: 546842 - DNA, 25 bp, Mus musculus
gccacgatttaacttttccatctgg

SEQ ID NO: 546843 - DNA, 25 bp, Mus musculus
gccacgatttaagttttccatctgg

SEQ ID NO: 546844 - DNA, 25 bp, Mus musculus
gccacgcaacggagaacgcgggtta

SEQ ID NO: 546845 - DNA, 25 bp, Mus musculus
gccacgcaacggtgaacgcgggtta

SEQ ID NO: 546846 - DNA, 25 bp, Mus musculus
gccacgcaagaacatcctcctaaaa

SEQ ID NO: 546847 - DNA, 25 bp, Mus musculus
gccacgcaagaagatcctcctaaaa

SEQ ID NO: 546848 - DNA, 25 bp, Mus musculus
gccacgcatgtgctaagtccctgta

SEQ ID NO: 546849 - DNA, 25 bp, Mus musculus
gccacgcatgtggtaagtccctgta

SEQ ID NO: 546850 - DNA, 25 bp, Mus musculus
gccacgcccacgaggcagaggatga

SEQ ID NO: 546851 - DNA, 25 bp, Mus musculus
gccacgcccacgtggcagaggatga

SEQ ID NO: 546852 - DNA, 25 bp, Mus musculus
gccacgccttgcatacgatgatgag

SEQ ID NO: 546853 - DNA, 25 bp, Mus musculus
gccacgccttgcttacgatgatgag

SEQ ID NO: 546854 - DNA, 25 bp, Mus musculus
gccacgcgattgagatgctcctgga

SEQ ID NO: 546855 - DNA, 25 bp, Mus musculus
gccacgcgattgtgatgctcctgga

SEQ ID NO: 546856 - DNA, 25 bp, Mus musculus
gccacgcgccagagtttcaagacaa

SEQ ID NO: 546857 - DNA, 25 bp, Mus musculus
gccacgcgccagtgtttcaagacaa

SEQ ID NO: 546858 - DNA, 25 bp, Mus musculus
gccacgctgagcaggcgcgaacaac

SEQ ID NO: 546859 - DNA, 25 bp, Mus musculus
gccacgctgagctggcgcgaacaac

SEQ ID NO: 546860 - DNA, 25 bp, Mus musculus
gccacgctgggacgaatgcactatt

SEQ ID NO: 546861 - DNA, 25 bp, Mus musculus
gccacgctgggaggaatgcactatt

SEQ ID NO: 546862 - DNA, 25 bp, Mus musculus
gccacgctgggtcagagactgacag

SEQ ID NO: 546863 - DNA, 25 bp, Mus musculus
gccacgctgggtgagagactgacag

SEQ ID NO: 546864 - DNA, 25 bp, Mus musculus
gccacggactgtcttgtcattaaag

SEQ ID NO: 546865 - DNA, 25 bp, Mus musculus
gccacggactgtgttgtcattaaag

SEQ ID NO: 546866 - DNA, 25 bp, Mus musculus
gccacggatgacatggttccttgtg

SEQ ID NO: 546867 - DNA, 25 bp, Mus musculus
gccacggatgacttggttccttgtg

SEQ ID NO: 546868 - DNA, 25 bp, Mus musculus
gccacggatgctacggagccataga

SEQ ID NO: 546869 - DNA, 25 bp, Mus musculus
gccacggatgcttcggagccataga

SEQ ID NO: 546870 - DNA, 25 bp, Mus musculus
gccacggatgtgccgatcaggttaa

SEQ ID NO: 546871 - DNA, 25 bp, Mus musculus
gccacggatgtggcgatcaggttaa

SEQ ID NO: 546872 - DNA, 25 bp, Mus musculus
gccacggcacgcagctgagggagga

SEQ ID NO: 546873 - DNA, 25 bp, Mus musculus
gccacggcacgctgctgagggagga

SEQ ID NO: 546874 - DNA, 25 bp, Mus musculus
gccacggcatgtacgagcataagcc

SEQ ID NO: 546875 - DNA, 25 bp, Mus musculus
gccacggcatgttcgagcataagcc

SEQ ID NO: 546876 - DNA, 25 bp, Mus musculus
gccacggcggcacgagttaaacaaa

SEQ ID NO: 546877 - DNA, 25 bp, Mus musculus
gccacggcggcaggagttaaacaaa

SEQ ID NO: 546878 - DNA, 25 bp, Mus musculus
gccacggctgtgaggagattcccca

SEQ ID NO: 546879 - DNA, 25 bp, Mus musculus
gccacggctgtgtggagattcccca

SEQ ID NO: 546880 - DNA, 25 bp, Mus musculus
gccacggcttacattcattatattt

SEQ ID NO: 546881 - DNA, 25 bp, Mus musculus
gccacggcttactttcattatattt

SEQ ID NO: 546882 - DNA, 25 bp, Mus musculus
gccacggcttcaattctatgcgtaa

SEQ ID NO: 546883 - DNA, 25 bp, Mus musculus
gccacggcttcatttctatgcgtaa

SEQ ID NO: 546884 - DNA, 25 bp, Mus musculus
gccacggcttccaggtgccaaggct

SEQ ID NO: 546885 - DNA, 25 bp, Mus musculus
gccacggcttcctggtgccaaggct

SEQ ID NO: 546886 - DNA, 25 bp, Mus musculus
gccacggctttgaggagtacatgaa

SEQ ID NO: 546887 - DNA, 25 bp, Mus musculus
gccacggctttgtggagtacatgaa

SEQ ID NO: 546888 - DNA, 25 bp, Mus musculus
gccacgggtaataagttagatttct

SEQ ID NO: 546889 - DNA, 25 bp, Mus musculus
gccacgggtaattagttagatttct

SEQ ID NO: 546890 - DNA, 25 bp, Mus musculus
gccacggtcggtcgagcctcctaag

SEQ ID NO: 546891 - DNA, 25 bp, Mus musculus
gccacggtcggtggagcctcctaag

SEQ ID NO: 546892 - DNA, 25 bp, Mus musculus
gccacggtcttgcacaacgcggaaa

SEQ ID NO: 546893 - DNA, 25 bp, Mus musculus
gccacggtcttggacaacgcggaaa

SEQ ID NO: 546894 - DNA, 25 bp, Mus musculus
gccacggtggacctggtattgtcaa

SEQ ID NO: 546895 - DNA, 25 bp, Mus musculus
gccacggtggacgtggtattgtcaa

SEQ ID NO: 546896 - DNA, 25 bp, Mus musculus
gccacggtggtgcaggaactcttca

SEQ ID NO: 546897 - DNA, 25 bp, Mus musculus
gccacggtggtggaggaactcttca

SEQ ID NO: 546898 - DNA, 25 bp, Mus musculus
gccacggttcaccatcaactttaaa

SEQ ID NO: 546899 - DNA, 25 bp, Mus musculus
gccacggttcacgatcaactttaaa

SEQ ID NO: 546900 - DNA, 25 bp, Mus musculus
gccacgtactaacccatttccagta

SEQ ID NO: 546901 - DNA, 25 bp, Mus musculus
gccacgtactaagccatttccagta

SEQ ID NO: 546902 - DNA, 25 bp, Mus musculus
gccacgtactgtctctgtaatttta

SEQ ID NO: 546903 - DNA, 25 bp, Mus musculus
gccacgtactgtgtctgtaatttta

SEQ ID NO: 546904 - DNA, 25 bp, Mus musculus
gccacgtcaaacatatctgcatgat

SEQ ID NO: 546905 - DNA, 25 bp, Mus musculus
gccacgtcaaacttatctgcatgat

SEQ ID NO: 546906 - DNA, 25 bp, Mus musculus
gccacgtcagctctggatactgaga

SEQ ID NO: 546907 - DNA, 25 bp, Mus musculus
gccacgtcagctgtggatactgaga

SEQ ID NO: 546908 - DNA, 25 bp, Mus musculus
gccacgtcctgcctttattaaattg

SEQ ID NO: 546909 - DNA, 25 bp, Mus musculus
gccacgtcctgcgtttattaaattg

SEQ ID NO: 546910 - DNA, 25 bp, Mus musculus
gccacgtgaaagctactgcagagaa

SEQ ID NO: 546911 - DNA, 25 bp, Mus musculus
gccacgtgaaaggtactgcagagaa

SEQ ID NO: 546912 - DNA, 25 bp, Mus musculus
gccacgtgacgactgcagaatacat

SEQ ID NO: 546913 - DNA, 25 bp, Mus musculus
gccacgtgacgagtgcagaatacat

SEQ ID NO: 546914 - DNA, 25 bp, Mus musculus
gccacgtgatcacgaagtagcatca

SEQ ID NO: 546915 - DNA, 25 bp, Mus musculus
gccacgtgatcaggaagtagcatca

SEQ ID NO: 546916 - DNA, 25 bp, Mus musculus
gccacgtgatgtcggaactgaacca

SEQ ID NO: 546917 - DNA, 25 bp, Mus musculus
gccacgtgatgtgggaactgaacca

SEQ ID NO: 546918 - DNA, 25 bp, Mus musculus
gccacgtgttagcttgtttctgtag

SEQ ID NO: 546919 - DNA, 25 bp, Mus musculus
gccacgtgttaggttgtttctgtag

SEQ ID NO: 546920 - DNA, 25 bp, Mus musculus
gccacgttctgtaaagcattgcctg

SEQ ID NO: 546921 - DNA, 25 bp, Mus musculus
gccacgttctgttaagcattgcctg

SEQ ID NO: 546922 - DNA, 25 bp, Mus musculus
gccacgttgcgtccttcaggaattg

SEQ ID NO: 546923 - DNA, 25 bp, Mus musculus
gccacgttgcgtgcttcaggaattg

SEQ ID NO: 546924 - DNA, 25 bp, Mus musculus
gccacgttgtggatgaagttattac

SEQ ID NO: 546925 - DNA, 25 bp, Mus musculus
gccacgttgtggcacctaagacaga

SEQ ID NO: 546926 - DNA, 25 bp, Mus musculus
gccacgttgtgggacctaagacaga

SEQ ID NO: 546927 - DNA, 25 bp, Mus musculus
gccacgttgtggttgaagttattac

SEQ ID NO: 546928 - DNA, 25 bp, Mus musculus
gccacgttttgaaatttcggagaca

SEQ ID NO: 546929 - DNA, 25 bp, Mus musculus
gccacgttttgatatttcggagaca

SEQ ID NO: 546930 - DNA, 25 bp, Mus musculus
gccactaacttcactcatcagattt

SEQ ID NO: 546931 - DNA, 25 bp, Mus musculus
gccactaacttctctcatcagattt

SEQ ID NO: 546932 - DNA, 25 bp, Mus musculus
gccactaagtttcctgcttgcagga

SEQ ID NO: 546933 - DNA, 25 bp, Mus musculus
gccactaagtttgctgcttgcagga

SEQ ID NO: 546934 - DNA, 25 bp, Mus musculus
gccactacacagctttggcatcttt

SEQ ID NO: 546935 - DNA, 25 bp, Mus musculus
gccactacacaggtttggcatcttt

SEQ ID NO: 546936 - DNA, 25 bp, Mus musculus
gccactacacccagcaagtgtgaaa

SEQ ID NO: 546937 - DNA, 25 bp, Mus musculus
gccactacaccctgcaagtgtgaaa

SEQ ID NO: 546938 - DNA, 25 bp, Mus musculus
gccactacactcagttttgcttaac

SEQ ID NO: 546939 - DNA, 25 bp, Mus musculus
gccactacactctgttttgcttaac

SEQ ID NO: 546940 - DNA, 25 bp, Mus musculus
gccactacagcacctactatggagg

SEQ ID NO: 546941 - DNA, 25 bp, Mus musculus
gccactacagcagctactatggagg

SEQ ID NO: 546942 - DNA, 25 bp, Mus musculus
gccactacagtactcattgcatata

SEQ ID NO: 546943 - DNA, 25 bp, Mus musculus
gccactacagtagtcattgcatata

SEQ ID NO: 546944 - DNA, 25 bp, Mus musculus
gccactacatgcactactgtgatgg

SEQ ID NO: 546945 - DNA, 25 bp, Mus musculus
gccactacatgctctactgtgatgg

SEQ ID NO: 546946 - DNA, 25 bp, Mus musculus
gccactaccacccatgaagagttat

SEQ ID NO: 546947 - DNA, 25 bp, Mus musculus
gccactaccaccgatgaagagttat

SEQ ID NO: 546948 - DNA, 25 bp, Mus musculus
gccactacccagaggtaacctctag

SEQ ID NO: 546949 - DNA, 25 bp, Mus musculus
gccactacccagtggtaacctctag

SEQ ID NO: 546950 - DNA, 25 bp, Mus musculus
gccactaccttcagactacaaattt

SEQ ID NO: 546951 - DNA, 25 bp, Mus musculus
gccactaccttctgactacaaattt

SEQ ID NO: 546952 - DNA, 25 bp, Mus musculus
gccactactataaagcacatgttaa

SEQ ID NO: 546953 - DNA, 25 bp, Mus musculus
gccactactatatagcacatgttaa

SEQ ID NO: 546954 - DNA, 25 bp, Mus musculus
gccactactattcaatgagacgttg

SEQ ID NO: 546955 - DNA, 25 bp, Mus musculus
gccactactattgaatgagacgttg

SEQ ID NO: 546956 - DNA, 25 bp, Mus musculus
gccactactcctcgtttaagagact

SEQ ID NO: 546957 - DNA, 25 bp, Mus musculus
gccactactcctggtttaagagact

SEQ ID NO: 546958 - DNA, 25 bp, Mus musculus
gccactactgaaaccagctcatgta

SEQ ID NO: 546959 - DNA, 25 bp, Mus musculus
gccactactgaatccagctcatgta

SEQ ID NO: 546960 - DNA, 25 bp, Mus musculus
gccactacttcaactttcttctgtt

SEQ ID NO: 546961 - DNA, 25 bp, Mus musculus
gccactacttcatctttcttctgtt

SEQ ID NO: 546962 - DNA, 25 bp, Mus musculus
gccactactttaaaatgcctcctaa

SEQ ID NO: 546963 - DNA, 25 bp, Mus musculus
gccactactttataatgcctcctaa

SEQ ID NO: 546964 - DNA, 25 bp, Mus musculus
gccactagaaccaaggcccagctgg

SEQ ID NO: 546965 - DNA, 25 bp, Mus musculus
gccactagaacctaggcccagctgg

SEQ ID NO: 546966 - DNA, 25 bp, Mus musculus
gccactagagaacatctgaagggaa

SEQ ID NO: 546967 - DNA, 25 bp, Mus musculus
gccactagagaagatctgaagggaa

SEQ ID NO: 546968 - DNA, 25 bp, Mus musculus
gccactagatagctcatttcactct

SEQ ID NO: 546969 - DNA, 25 bp, Mus musculus
gccactagataggtcatttcactct

SEQ ID NO: 546970 - DNA, 25 bp, Mus musculus
gccactagcaccatgtgtgtgtctg

SEQ ID NO: 546971 - DNA, 25 bp, Mus musculus
gccactagcaccttgtgtgtgtctg

SEQ ID NO: 546972 - DNA, 25 bp, Mus musculus
gccactagtattatgcttccatcac

SEQ ID NO: 546973 - DNA, 25 bp, Mus musculus
gccactagtattttgcttccatcac

SEQ ID NO: 546974 - DNA, 25 bp, Mus musculus
gccactagtgaacgtggatgccact

SEQ ID NO: 546975 - DNA, 25 bp, Mus musculus
gccactagtgaaggtggatgccact

SEQ ID NO: 546976 - DNA, 25 bp, Mus musculus
gccactagttaccaccactgtaggg

SEQ ID NO: 546977 - DNA, 25 bp, Mus musculus
gccactagttacgaccactgtaggg

SEQ ID NO: 546978 - DNA, 25 bp, Mus musculus
gccactatacctagcttagtaactg

SEQ ID NO: 546979 - DNA, 25 bp, Mus musculus
gccactataccttgcttagtaactg

SEQ ID NO: 546980 - DNA, 25 bp, Mus musculus
gccactatccttagcttcaacagaa

SEQ ID NO: 546981 - DNA, 25 bp, Mus musculus
gccactatcctttgcttcaacagaa

SEQ ID NO: 546982 - DNA, 25 bp, Mus musculus
gccactatgaaaactttctttgttg

SEQ ID NO: 546983 - DNA, 25 bp, Mus musculus
gccactatgaaatctttctttgttg

SEQ ID NO: 546984 - DNA, 25 bp, Mus musculus
gccactatgactccagacacatcct

SEQ ID NO: 546985 - DNA, 25 bp, Mus musculus
gccactatgactgcagacacatcct

SEQ ID NO: 546986 - DNA, 25 bp, Mus musculus
gccactattgcaactgtgggcagat

SEQ ID NO: 546987 - DNA, 25 bp, Mus musculus
gccactattgcatctgtgggcagat

SEQ ID NO: 546988 - DNA, 25 bp, Mus musculus
gccactatttgtaagcatctgtcat

SEQ ID NO: 546989 - DNA, 25 bp, Mus musculus
gccactatttgttagcatctgtcat

SEQ ID NO: 546990 - DNA, 25 bp, Mus musculus
gccactcaactgagcctcgcaggca

SEQ ID NO: 546991 - DNA, 25 bp, Mus musculus
gccactcaactgtgcctcgcaggca

SEQ ID NO: 546992 - DNA, 25 bp, Mus musculus
gccactcagcagataacgtctttag

SEQ ID NO: 546993 - DNA, 25 bp, Mus musculus
gccactcagcagttaacgtctttag

SEQ ID NO: 546994 - DNA, 25 bp, Mus musculus
gccactcatgtgcagagcagcgcat

SEQ ID NO: 546995 - DNA, 25 bp, Mus musculus
gccactcatgtggagagcagcgcat

SEQ ID NO: 546996 - DNA, 25 bp, Mus musculus
gccactccatttagttacctgttgg

SEQ ID NO: 546997 - DNA, 25 bp, Mus musculus
gccactccattttgttacctgttgg

SEQ ID NO: 546998 - DNA, 25 bp, Mus musculus
gccactcccaagcaggctgctgagg

SEQ ID NO: 546999 - DNA, 25 bp, Mus musculus
gccactcccaaggaggctgctgagg

SEQ ID NO: 547000 - DNA, 25 bp, Mus musculus
gccactcccagaaaaaaggcccagt

SEQ ID NO: 547001 - DNA, 25 bp, Mus musculus
gccactcccagataaaaggcccagt

SEQ ID NO: 547002 - DNA, 25 bp, Mus musculus
gccactccctcgaaaaattcttgat

SEQ ID NO: 547003 - DNA, 25 bp, Mus musculus
gccactccctcgtaaaattcttgat

SEQ ID NO: 547004 - DNA, 25 bp, Mus musculus
gccactccctggagctaaagacact

SEQ ID NO: 547005 - DNA, 25 bp, Mus musculus
gccactccctggtgctaaagacact

SEQ ID NO: 547006 - DNA, 25 bp, Mus musculus
gccactcccttaatcatagcaaatg

SEQ ID NO: 547007 - DNA, 25 bp, Mus musculus
gccactcccttattcatagcaaatg

SEQ ID NO: 547008 - DNA, 25 bp, Mus musculus
gccactcctggaacttactgcatat

SEQ ID NO: 547009 - DNA, 25 bp, Mus musculus
gccactcctggatcttactgcatat

SEQ ID NO: 547010 - DNA, 25 bp, Mus musculus
gccactccttggactgagcacagat

SEQ ID NO: 547011 - DNA, 25 bp, Mus musculus
gccactccttggtctgagcacagat

SEQ ID NO: 547012 - DNA, 25 bp, Mus musculus
gccactcctttactctcgaggttaa

SEQ ID NO: 547013 - DNA, 25 bp, Mus musculus
gccactcctttagtctcgaggttaa

SEQ ID NO: 547014 - DNA, 25 bp, Mus musculus
gccactcgagagaatcttgctctat

SEQ ID NO: 547015 - DNA, 25 bp, Mus musculus
gccactcgagagtatcttgctctat

SEQ ID NO: 547016 - DNA, 25 bp, Mus musculus
gccactcgctcactcatctgtaggg

SEQ ID NO: 547017 - DNA, 25 bp, Mus musculus
gccactcgctcagtcatctgtaggg

SEQ ID NO: 547018 - DNA, 25 bp, Mus musculus
gccactcgctgaaagcatcacacag

SEQ ID NO: 547019 - DNA, 25 bp, Mus musculus
gccactcgctgatagcatcacacag

SEQ ID NO: 547020 - DNA, 25 bp, Mus musculus
gccactcggaaaagcagctcatcaa

SEQ ID NO: 547021 - DNA, 25 bp, Mus musculus
gccactcggaaatgcagctcatcaa

SEQ ID NO: 547022 - DNA, 25 bp, Mus musculus
gccactcgtggccagacggacagca

SEQ ID NO: 547023 - DNA, 25 bp, Mus musculus
gccactcgtggcgagacggacagca

SEQ ID NO: 547024 - DNA, 25 bp, Mus musculus
gccactctgagaagattcctgtttt

SEQ ID NO: 547025 - DNA, 25 bp, Mus musculus
gccactctgagatgattcctgtttt

SEQ ID NO: 547026 - DNA, 25 bp, Mus musculus
gccactctgcaactagacgggacat

SEQ ID NO: 547027 - DNA, 25 bp, Mus musculus
gccactctgcaagtagacgggacat

SEQ ID NO: 547028 - DNA, 25 bp, Mus musculus
gccactctggcacgtataatatcga

SEQ ID NO: 547029 - DNA, 25 bp, Mus musculus
gccactctggcaggtataatatcga

SEQ ID NO: 547030 - DNA, 25 bp, Mus musculus
gccactctggctaaacacgggcaag

SEQ ID NO: 547031 - DNA, 25 bp, Mus musculus
gccactctggctattaatctcggct

SEQ ID NO: 547032 - DNA, 25 bp, Mus musculus
gccactctggcttaacacgggcaag

SEQ ID NO: 547033 - DNA, 25 bp, Mus musculus
gccactctggcttttaatctcggct

SEQ ID NO: 547034 - DNA, 25 bp, Mus musculus
gccactgaagaaatttcaagcacat

SEQ ID NO: 547035 - DNA, 25 bp, Mus musculus
gccactgaagaattttcaagcacat

SEQ ID NO: 547036 - DNA, 25 bp, Mus musculus
gccactgaagacacggccacaggat

SEQ ID NO: 547037 - DNA, 25 bp, Mus musculus
gccactgaagactcggccacaggat

SEQ ID NO: 547038 - DNA, 25 bp, Mus musculus
gccactgaatggaactctgaccttg

SEQ ID NO: 547039 - DNA, 25 bp, Mus musculus
gccactgaatggtactctgaccttg

SEQ ID NO: 547040 - DNA, 25 bp, Mus musculus
gccactgaattgctttatgattttt

SEQ ID NO: 547041 - DNA, 25 bp, Mus musculus
gccactgaattggtttatgattttt

SEQ ID NO: 547042 - DNA, 25 bp, Mus musculus
gccactgacaggcacaacgcatgta

SEQ ID NO: 547043 - DNA, 25 bp, Mus musculus
gccactgacagggacaacgcatgta

SEQ ID NO: 547044 - DNA, 25 bp, Mus musculus
gccactgaccatccacaattttgta

SEQ ID NO: 547045 - DNA, 25 bp, Mus musculus
gccactgaccatgcacaattttgta

SEQ ID NO: 547046 - DNA, 25 bp, Mus musculus
gccactgagacaacagtcactgttc

SEQ ID NO: 547047 - DNA, 25 bp, Mus musculus
gccactgagacatcagtcactgttc

SEQ ID NO: 547048 - DNA, 25 bp, Mus musculus
gccactgagaggcaggaacccgtta

SEQ ID NO: 547049 - DNA, 25 bp, Mus musculus
gccactgagagggaggaacccgtta

SEQ ID NO: 547050 - DNA, 25 bp, Mus musculus
gccactgagatcaagggctctgcaa

SEQ ID NO: 547051 - DNA, 25 bp, Mus musculus
gccactgagatctagggctctgcaa

SEQ ID NO: 547052 - DNA, 25 bp, Mus musculus
gccactgagatgaaggcctctctgt

SEQ ID NO: 547053 - DNA, 25 bp, Mus musculus
gccactgagatgtaggcctctctgt

SEQ ID NO: 547054 - DNA, 25 bp, Mus musculus
gccactgagcaacatggcaggtaca

SEQ ID NO: 547055 - DNA, 25 bp, Mus musculus
gccactgagcaaccagagcctgttg

SEQ ID NO: 547056 - DNA, 25 bp, Mus musculus
gccactgagcaagatggcaggtaca

SEQ ID NO: 547057 - DNA, 25 bp, Mus musculus
gccactgagcaagcagagcctgttg

SEQ ID NO: 547058 - DNA, 25 bp, Mus musculus
gccactgagcataactagagttatg

SEQ ID NO: 547059 - DNA, 25 bp, Mus musculus
gccactgagcattactagagttatg

SEQ ID NO: 547060 - DNA, 25 bp, Mus musculus
gccactgagttaatgagctctgtgt

SEQ ID NO: 547061 - DNA, 25 bp, Mus musculus
gccactgagttattgagctctgtgt

SEQ ID NO: 547062 - DNA, 25 bp, Mus musculus
gccactgatcctcaagacccaaatt

SEQ ID NO: 547063 - DNA, 25 bp, Mus musculus
gccactgatcctgaagacccaaatt

SEQ ID NO: 547064 - DNA, 25 bp, Mus musculus
gccactgatctgaggatgcttcact

SEQ ID NO: 547065 - DNA, 25 bp, Mus musculus
gccactgatctgtggatgcttcact

SEQ ID NO: 547066 - DNA, 25 bp, Mus musculus
gccactgcacagctatgaagagtca

SEQ ID NO: 547067 - DNA, 25 bp, Mus musculus
gccactgcacaggtatgaagagtca

SEQ ID NO: 547068 - DNA, 25 bp, Mus musculus
gccactgcactcagattccaatgta

SEQ ID NO: 547069 - DNA, 25 bp, Mus musculus
gccactgcactctgattccaatgta

SEQ ID NO: 547070 - DNA, 25 bp, Mus musculus
gccactgcaggtatttaaggctgtt

SEQ ID NO: 547071 - DNA, 25 bp, Mus musculus
gccactgcaggtttttaaggctgtt

SEQ ID NO: 547072 - DNA, 25 bp, Mus musculus
gccactgcatccctaaggtatcaga

SEQ ID NO: 547073 - DNA, 25 bp, Mus musculus
gccactgcatccgtaaggtatcaga

SEQ ID NO: 547074 - DNA, 25 bp, Mus musculus
gccactgccctgacattagcgcggg

SEQ ID NO: 547075 - DNA, 25 bp, Mus musculus
gccactgccctgtcattagcgcggg

SEQ ID NO: 547076 - DNA, 25 bp, Mus musculus
gccactgccgagaacgaatttgcca

SEQ ID NO: 547077 - DNA, 25 bp, Mus musculus
gccactgccgagtacgaatttgcca

SEQ ID NO: 547078 - DNA, 25 bp, Mus musculus
gccactgccgtccataagaacatta

SEQ ID NO: 547079 - DNA, 25 bp, Mus musculus
gccactgccgtcgataagaacatta

SEQ ID NO: 547080 - DNA, 25 bp, Mus musculus
gccactgccttcatcttagaatgca

SEQ ID NO: 547081 - DNA, 25 bp, Mus musculus
gccactgccttcttcttagaatgca

SEQ ID NO: 547082 - DNA, 25 bp, Mus musculus
gccactgctctcatgaaacggttgt

SEQ ID NO: 547083 - DNA, 25 bp, Mus musculus
gccactgctctcttgaaacggttgt

SEQ ID NO: 547084 - DNA, 25 bp, Mus musculus
gccactgctttccttgctggtgata

SEQ ID NO: 547085 - DNA, 25 bp, Mus musculus
gccactgctttcgttgctggtgata

SEQ ID NO: 547086 - DNA, 25 bp, Mus musculus
gccactggaactagaatgaattgaa

SEQ ID NO: 547087 - DNA, 25 bp, Mus musculus
gccactggaacttgaatgaattgaa

SEQ ID NO: 547088 - DNA, 25 bp, Mus musculus
gccactggacaaaccggtgctagga

SEQ ID NO: 547089 - DNA, 25 bp, Mus musculus
gccactggacaatccggtgctagga

SEQ ID NO: 547090 - DNA, 25 bp, Mus musculus
gccactggacccaaattaacttact

SEQ ID NO: 547091 - DNA, 25 bp, Mus musculus
gccactggaccctaattaacttact

SEQ ID NO: 547092 - DNA, 25 bp, Mus musculus
gccactggcacgcaattcttttcat

SEQ ID NO: 547093 - DNA, 25 bp, Mus musculus
gccactggcacggaattcttttcat

SEQ ID NO: 547094 - DNA, 25 bp, Mus musculus
gccactggccagacacaggcctgcc

SEQ ID NO: 547095 - DNA, 25 bp, Mus musculus
gccactggccagtcacaggcctgcc

SEQ ID NO: 547096 - DNA, 25 bp, Mus musculus
gccactggccccacatgaaataatg

SEQ ID NO: 547097 - DNA, 25 bp, Mus musculus
gccactggcccctcatgaaataatg

SEQ ID NO: 547098 - DNA, 25 bp, Mus musculus
gccactggctggctgcattttaaac

SEQ ID NO: 547099 - DNA, 25 bp, Mus musculus
gccactggctgggtgcattttaaac

SEQ ID NO: 547100 - DNA, 25 bp, Mus musculus
gccactgggaaaagccaccgattta

SEQ ID NO: 547101 - DNA, 25 bp, Mus musculus
gccactgggaaatgccaccgattta

SEQ ID NO: 547102 - DNA, 25 bp, Mus musculus
gccactgggacacagacgacactat

SEQ ID NO: 547103 - DNA, 25 bp, Mus musculus
gccactgggacagagacgacactat

SEQ ID NO: 547104 - DNA, 25 bp, Mus musculus
gccactggttctagggactgcagaa

SEQ ID NO: 547105 - DNA, 25 bp, Mus musculus
gccactggttcttgggactgcagaa

SEQ ID NO: 547106 - DNA, 25 bp, Mus musculus
gccactgtaccccaatcaagtgtaa

SEQ ID NO: 547107 - DNA, 25 bp, Mus musculus
gccactgtacccgaatcaagtgtaa

SEQ ID NO: 547108 - DNA, 25 bp, Mus musculus
gccactgtagctcagcaatgctcca

SEQ ID NO: 547109 - DNA, 25 bp, Mus musculus
gccactgtagctgagcaatgctcca

SEQ ID NO: 547110 - DNA, 25 bp, Mus musculus
gccactgtatccagaagtcccagga

SEQ ID NO: 547111 - DNA, 25 bp, Mus musculus
gccactgtatcctgaagtcccagga

SEQ ID NO: 547112 - DNA, 25 bp, Mus musculus
gccactgtccacacggatggagttg

SEQ ID NO: 547113 - DNA, 25 bp, Mus musculus
gccactgtccactcggatggagttg

SEQ ID NO: 547114 - DNA, 25 bp, Mus musculus
gccactgtccggctaaaggagcctc

SEQ ID NO: 547115 - DNA, 25 bp, Mus musculus
gccactgtccgggtaaaggagcctc

SEQ ID NO: 547116 - DNA, 25 bp, Mus musculus
gccactgtcctacaagacgttctta

SEQ ID NO: 547117 - DNA, 25 bp, Mus musculus
gccactgtcctagaagacgttctta

SEQ ID NO: 547118 - DNA, 25 bp, Mus musculus
gccactgtcttgaaatatcttccat

SEQ ID NO: 547119 - DNA, 25 bp, Mus musculus
gccactgtcttgtaatatcttccat

SEQ ID NO: 547120 - DNA, 25 bp, Mus musculus
gccactgtgaatagcagctctgcca

SEQ ID NO: 547121 - DNA, 25 bp, Mus musculus
gccactgtgaattgcagctctgcca

SEQ ID NO: 547122 - DNA, 25 bp, Mus musculus
gccactgtgagacttctctcctcca

SEQ ID NO: 547123 - DNA, 25 bp, Mus musculus
gccactgtgagagttctctcctcca

SEQ ID NO: 547124 - DNA, 25 bp, Mus musculus
gccactgtgcctcacgatatggatt

SEQ ID NO: 547125 - DNA, 25 bp, Mus musculus
gccactgtgcctgacgatatggatt

SEQ ID NO: 547126 - DNA, 25 bp, Mus musculus
gccactgtggtgatttgcataagga

SEQ ID NO: 547127 - DNA, 25 bp, Mus musculus
gccactgtggtgttttgcataagga

SEQ ID NO: 547128 - DNA, 25 bp, Mus musculus
gccactgtgtctatttggtgctaca

SEQ ID NO: 547129 - DNA, 25 bp, Mus musculus
gccactgtgtctttttggtgctaca

SEQ ID NO: 547130 - DNA, 25 bp, Mus musculus
gccactgttacacagcctaatgatg

SEQ ID NO: 547131 - DNA, 25 bp, Mus musculus
gccactgttacagagcctaatgatg

SEQ ID NO: 547132 - DNA, 25 bp, Mus musculus
gccactgttcaacccattgcttttg

SEQ ID NO: 547133 - DNA, 25 bp, Mus musculus
gccactgttcaagccattgcttttg

SEQ ID NO: 547134 - DNA, 25 bp, Mus musculus
gccactgttcctagatttaagtctc

SEQ ID NO: 547135 - DNA, 25 bp, Mus musculus
gccactgttccttgatttaagtctc

SEQ ID NO: 547136 - DNA, 25 bp, Mus musculus
gccactgttcttccatttcttcata

SEQ ID NO: 547137 - DNA, 25 bp, Mus musculus
gccactgttcttgcatttcttcata

SEQ ID NO: 547138 - DNA, 25 bp, Mus musculus
gccacttaaagaaaacctgctcatg

SEQ ID NO: 547139 - DNA, 25 bp, Mus musculus
gccacttaaagataacctgctcatg

SEQ ID NO: 547140 - DNA, 25 bp, Mus musculus
gccacttaagtgacttgattgttcc

SEQ ID NO: 547141 - DNA, 25 bp, Mus musculus
gccacttaagtgtcttgattgttcc

SEQ ID NO: 547142 - DNA, 25 bp, Mus musculus
gccacttaggttcttttaggaatca

SEQ ID NO: 547143 - DNA, 25 bp, Mus musculus
gccacttaggttgttttaggaatca

SEQ ID NO: 547144 - DNA, 25 bp, Mus musculus
gccacttagtggatgtcagcggtat

SEQ ID NO: 547145 - DNA, 25 bp, Mus musculus
gccacttagtggttgtcagcggtat

SEQ ID NO: 547146 - DNA, 25 bp, Mus musculus
gccacttatggccagtaaggctgaa

SEQ ID NO: 547147 - DNA, 25 bp, Mus musculus
gccacttatggcgagtaaggctgaa

SEQ ID NO: 547148 - DNA, 25 bp, Mus musculus
gccacttcaaccactgatggtcatt

SEQ ID NO: 547149 - DNA, 25 bp, Mus musculus
gccacttcaacctctgatggtcatt

SEQ ID NO: 547150 - DNA, 25 bp, Mus musculus
gccacttcaagcactacaaatatgt

SEQ ID NO: 547151 - DNA, 25 bp, Mus musculus
gccacttcaagctctacaaatatgt

SEQ ID NO: 547152 - DNA, 25 bp, Mus musculus
gccacttcacatcgagttcccgtaa

SEQ ID NO: 547153 - DNA, 25 bp, Mus musculus
gccacttcacatggagttcccgtaa

SEQ ID NO: 547154 - DNA, 25 bp, Mus musculus
gccacttcacctaaaacttttgcaa

SEQ ID NO: 547155 - DNA, 25 bp, Mus musculus
gccacttcaccttaaacttttgcaa

SEQ ID NO: 547156 - DNA, 25 bp, Mus musculus
gccacttcactaagtcctataacct

SEQ ID NO: 547157 - DNA, 25 bp, Mus musculus
gccacttcactatgtcctataacct

SEQ ID NO: 547158 - DNA, 25 bp, Mus musculus
gccacttccacaactgctttttgct

SEQ ID NO: 547159 - DNA, 25 bp, Mus musculus
gccacttccacatctgctttttgct

SEQ ID NO: 547160 - DNA, 25 bp, Mus musculus
gccacttccagaaagactacgacga

SEQ ID NO: 547161 - DNA, 25 bp, Mus musculus
gccacttccagacaaagcatgcagt

SEQ ID NO: 547162 - DNA, 25 bp, Mus musculus
gccacttccagagaaagcatgcagt

SEQ ID NO: 547163 - DNA, 25 bp, Mus musculus
gccacttccagatagactacgacga

SEQ ID NO: 547164 - DNA, 25 bp, Mus musculus
gccacttccaggcaactatggtttt

SEQ ID NO: 547165 - DNA, 25 bp, Mus musculus
gccacttccagggaactatggtttt

SEQ ID NO: 547166 - DNA, 25 bp, Mus musculus
gccacttctaaaatcctagcaatac

SEQ ID NO: 547167 - DNA, 25 bp, Mus musculus
gccacttctaaattcctagcaatac

SEQ ID NO: 547168 - DNA, 25 bp, Mus musculus
gccacttctaatcctctgtagcaat

SEQ ID NO: 547169 - DNA, 25 bp, Mus musculus
gccacttctaatgctctgtagcaat

SEQ ID NO: 547170 - DNA, 25 bp, Mus musculus
gccacttctacaacagggctcaagg

SEQ ID NO: 547171 - DNA, 25 bp, Mus musculus
gccacttctacaacctttgcttaag

SEQ ID NO: 547172 - DNA, 25 bp, Mus musculus
gccacttctacatcagggctcaagg

SEQ ID NO: 547173 - DNA, 25 bp, Mus musculus
gccacttctacatcctttgcttaag

SEQ ID NO: 547174 - DNA, 25 bp, Mus musculus
gccacttctcaaagggaatttactt

SEQ ID NO: 547175 - DNA, 25 bp, Mus musculus
gccacttctcaatgggaatttactt

SEQ ID NO: 547176 - DNA, 25 bp, Mus musculus
gccacttctgctatcggattgtgta

SEQ ID NO: 547177 - DNA, 25 bp, Mus musculus
gccacttctgctttcggattgtgta

SEQ ID NO: 547178 - DNA, 25 bp, Mus musculus
gccacttgaagcactgactgttgaa

SEQ ID NO: 547179 - DNA, 25 bp, Mus musculus
gccacttgaagctctgactgttgaa

SEQ ID NO: 547180 - DNA, 25 bp, Mus musculus
gccacttgaccaatgaggttctgta

SEQ ID NO: 547181 - DNA, 25 bp, Mus musculus
gccacttgaccattgaggttctgta

SEQ ID NO: 547182 - DNA, 25 bp, Mus musculus
gccacttgccatctctgttaaataa

SEQ ID NO: 547183 - DNA, 25 bp, Mus musculus
gccacttgccatgtctgttaaataa

SEQ ID NO: 547184 - DNA, 25 bp, Mus musculus
gccacttgccccaatttaagtttag

SEQ ID NO: 547185 - DNA, 25 bp, Mus musculus
gccacttgcccctatttaagtttag

SEQ ID NO: 547186 - DNA, 25 bp, Mus musculus
gccacttggcaaattcatttcaata

SEQ ID NO: 547187 - DNA, 25 bp, Mus musculus
gccacttggcaatttcatttcaata

SEQ ID NO: 547188 - DNA, 25 bp, Mus musculus
gccacttggtaaattagttccctca

SEQ ID NO: 547189 - DNA, 25 bp, Mus musculus
gccacttggtaatttagttccctca

SEQ ID NO: 547190 - DNA, 25 bp, Mus musculus
gccacttggtgaatgtgtacttcct

SEQ ID NO: 547191 - DNA, 25 bp, Mus musculus
gccacttggtgattgtgtacttcct

SEQ ID NO: 547192 - DNA, 25 bp, Mus musculus
gccacttggtgcaggaggcttagta

SEQ ID NO: 547193 - DNA, 25 bp, Mus musculus
gccacttggtgctggaggcttagta

SEQ ID NO: 547194 - DNA, 25 bp, Mus musculus
gccacttgtcataaactattgtaat

SEQ ID NO: 547195 - DNA, 25 bp, Mus musculus
gccacttgtcattaactattgtaat

SEQ ID NO: 547196 - DNA, 25 bp, Mus musculus
gccacttgtcccactaagaagttgg

SEQ ID NO: 547197 - DNA, 25 bp, Mus musculus
gccacttgtccctctaagaagttgg

SEQ ID NO: 547198 - DNA, 25 bp, Mus musculus
gccacttgtccgacttgcgcccaat

SEQ ID NO: 547199 - DNA, 25 bp, Mus musculus
gccacttgtccgtcttgcgcccaat

SEQ ID NO: 547200 - DNA, 25 bp, Mus musculus
gccacttgtctcaaaggatggaaag

SEQ ID NO: 547201 - DNA, 25 bp, Mus musculus
gccacttgtctctaaggatggaaag

SEQ ID NO: 547202 - DNA, 25 bp, Mus musculus
gccacttgtttcaacatctggtcac

SEQ ID NO: 547203 - DNA, 25 bp, Mus musculus
gccacttgtttctacatctggtcac

SEQ ID NO: 547204 - DNA, 25 bp, Mus musculus
gccactttccagcaacaggcaggaa

SEQ ID NO: 547205 - DNA, 25 bp, Mus musculus
gccactttccaggaacaggcaggaa

SEQ ID NO: 547206 - DNA, 25 bp, Mus musculus
gccactttctgtacagacctgaata

SEQ ID NO: 547207 - DNA, 25 bp, Mus musculus
gccactttctgttcagacctgaata

SEQ ID NO: 547208 - DNA, 25 bp, Mus musculus
gccactttgcaaaaaacatgctcat

SEQ ID NO: 547209 - DNA, 25 bp, Mus musculus
gccactttgcaataaacatgctcat

SEQ ID NO: 547210 - DNA, 25 bp, Mus musculus
gccactttgctgatgaaggttcaag

SEQ ID NO: 547211 - DNA, 25 bp, Mus musculus
gccactttgctgttgaaggttcaag

SEQ ID NO: 547212 - DNA, 25 bp, Mus musculus
gccactttggatctgaatagctcaa

SEQ ID NO: 547213 - DNA, 25 bp, Mus musculus
gccactttggatgtgaatagctcaa

SEQ ID NO: 547214 - DNA, 25 bp, Mus musculus
gccacttttcaccacaaactaattt

SEQ ID NO: 547215 - DNA, 25 bp, Mus musculus
gccacttttcacgacaaactaattt

SEQ ID NO: 547216 - DNA, 25 bp, Mus musculus
gccacttttccaaaactggttttca

SEQ ID NO: 547217 - DNA, 25 bp, Mus musculus
gccacttttccataactggttttca

SEQ ID NO: 547218 - DNA, 25 bp, Mus musculus
gccacttttcccagcgaatgaagag

SEQ ID NO: 547219 - DNA, 25 bp, Mus musculus
gccacttttccctgcgaatgaagag

SEQ ID NO: 547220 - DNA, 25 bp, Mus musculus
gccacttttctcatggtgagcttaa

SEQ ID NO: 547221 - DNA, 25 bp, Mus musculus
gccacttttctcttggtgagcttaa

SEQ ID NO: 547222 - DNA, 25 bp, Mus musculus
gccacttttctgactacagtgctgg

SEQ ID NO: 547223 - DNA, 25 bp, Mus musculus
gccacttttctgtctacagtgctgg

SEQ ID NO: 547224 - DNA, 25 bp, Mus musculus
gccacttttggcagtgatcttgaaa

SEQ ID NO: 547225 - DNA, 25 bp, Mus musculus
gccacttttggctgtgatcttgaaa

SEQ ID NO: 547226 - DNA, 25 bp, Mus musculus
gccagaaaatgtagttgctaaccca

SEQ ID NO: 547227 - DNA, 25 bp, Mus musculus
gccagaaaatgttgttgctaaccca

SEQ ID NO: 547228 - DNA, 25 bp, Mus musculus
gccagaaaccgacccagagaccgag

SEQ ID NO: 547229 - DNA, 25 bp, Mus musculus
gccagaaaccgagccagagaccgag

SEQ ID NO: 547230 - DNA, 25 bp, Mus musculus
gccagaaacgctaaggaaccctcca

SEQ ID NO: 547231 - DNA, 25 bp, Mus musculus
gccagaaacgcttaggaaccctcca

SEQ ID NO: 547232 - DNA, 25 bp, Mus musculus
gccagaaagactacgcctcttgtgc

SEQ ID NO: 547233 - DNA, 25 bp, Mus musculus
gccagaaagacttcgcctcttgtgc

SEQ ID NO: 547234 - DNA, 25 bp, Mus musculus
gccagaaagcacagattggacccaa

SEQ ID NO: 547235 - DNA, 25 bp, Mus musculus
gccagaaagcactgattggacccaa

SEQ ID NO: 547236 - DNA, 25 bp, Mus musculus
gccagaaagctgagtgatagaccaa

SEQ ID NO: 547237 - DNA, 25 bp, Mus musculus
gccagaaagctgatggaggagcact

SEQ ID NO: 547238 - DNA, 25 bp, Mus musculus
gccagaaagctgtgtgatagaccaa

SEQ ID NO: 547239 - DNA, 25 bp, Mus musculus
gccagaaagctgttggaggagcact

SEQ ID NO: 547240 - DNA, 25 bp, Mus musculus
gccagaaagtagaccagccaaacca

SEQ ID NO: 547241 - DNA, 25 bp, Mus musculus
gccagaaagtagtccagccaaacca

SEQ ID NO: 547242 - DNA, 25 bp, Mus musculus
gccagaaagtgcatactgatggaag

SEQ ID NO: 547243 - DNA, 25 bp, Mus musculus
gccagaaagtgcttactgatggaag

SEQ ID NO: 547244 - DNA, 25 bp, Mus musculus
gccagaaatactattcggcatgaaa

SEQ ID NO: 547245 - DNA, 25 bp, Mus musculus
gccagaaatacttttcggcatgaaa

SEQ ID NO: 547246 - DNA, 25 bp, Mus musculus
gccagaaatcttaaggcctgtggtt

SEQ ID NO: 547247 - DNA, 25 bp, Mus musculus
gccagaaatctttaggcctgtggtt

SEQ ID NO: 547248 - DNA, 25 bp, Mus musculus
gccagaaatggaaggtgcccagcac

SEQ ID NO: 547249 - DNA, 25 bp, Mus musculus
gccagaaatggatggtgcccagcac

SEQ ID NO: 547250 - DNA, 25 bp, Mus musculus
gccagaaccatgcaggtatgacctc

SEQ ID NO: 547251 - DNA, 25 bp, Mus musculus
gccagaaccatggaggtatgacctc

SEQ ID NO: 547252 - DNA, 25 bp, Mus musculus
gccagaacctgcaggaagataaagt

SEQ ID NO: 547253 - DNA, 25 bp, Mus musculus
gccagaacctgctggaagataaagt

SEQ ID NO: 547254 - DNA, 25 bp, Mus musculus
gccagaactaccacatgatgcactt

SEQ ID NO: 547255 - DNA, 25 bp, Mus musculus
gccagaactacctcatgatgcactt

SEQ ID NO: 547256 - DNA, 25 bp, Mus musculus
gccagaactctcaaggtattcttac

SEQ ID NO: 547257 - DNA, 25 bp, Mus musculus
gccagaactctctaggtattcttac

SEQ ID NO: 547258 - DNA, 25 bp, Mus musculus
gccagaactggtatggaagctgtta

SEQ ID NO: 547259 - DNA, 25 bp, Mus musculus
gccagaactggtttggaagctgtta

SEQ ID NO: 547260 - DNA, 25 bp, Mus musculus
gccagaactgtaaatctgaggagag

SEQ ID NO: 547261 - DNA, 25 bp, Mus musculus
gccagaactgtatatctgaggagag

SEQ ID NO: 547262 - DNA, 25 bp, Mus musculus
gccagaacttcacagcggagtccaa

SEQ ID NO: 547263 - DNA, 25 bp, Mus musculus
gccagaacttcagagcggagtccaa

SEQ ID NO: 547264 - DNA, 25 bp, Mus musculus
gccagaagagccaatctgagttttg

SEQ ID NO: 547265 - DNA, 25 bp, Mus musculus
gccagaagagcctatctgagttttg

SEQ ID NO: 547266 - DNA, 25 bp, Mus musculus
gccagaagagctcaacacaggaagt

SEQ ID NO: 547267 - DNA, 25 bp, Mus musculus
gccagaagagctgaacacaggaagt

SEQ ID NO: 547268 - DNA, 25 bp, Mus musculus
gccagaagatccacatctcaaagaa

SEQ ID NO: 547269 - DNA, 25 bp, Mus musculus
gccagaagatcctcatctcaaagaa

SEQ ID NO: 547270 - DNA, 25 bp, Mus musculus
gccagaagatggcatatgtggttcc

SEQ ID NO: 547271 - DNA, 25 bp, Mus musculus
gccagaagatgggatatgtggttcc

SEQ ID NO: 547272 - DNA, 25 bp, Mus musculus
gccagaagcacactgccagcttttt

SEQ ID NO: 547273 - DNA, 25 bp, Mus musculus
gccagaagcacagtgccagcttttt

SEQ ID NO: 547274 - DNA, 25 bp, Mus musculus
gccagaagcagaacaccgaagccag

SEQ ID NO: 547275 - DNA, 25 bp, Mus musculus
gccagaagcagatcaccgaagccag

SEQ ID NO: 547276 - DNA, 25 bp, Mus musculus
gccagaagcatgcagacttacagaa

SEQ ID NO: 547277 - DNA, 25 bp, Mus musculus
gccagaagcatggagacttacagaa

SEQ ID NO: 547278 - DNA, 25 bp, Mus musculus
gccagaagcattactcaggacacct

SEQ ID NO: 547279 - DNA, 25 bp, Mus musculus
gccagaagcatttctcaggacacct

SEQ ID NO: 547280 - DNA, 25 bp, Mus musculus
gccagaagccaaaccctagatagtg

SEQ ID NO: 547281 - DNA, 25 bp, Mus musculus
gccagaagccaatccctagatagtg

SEQ ID NO: 547282 - DNA, 25 bp, Mus musculus
gccagaagggagaactgcgtcgcta

SEQ ID NO: 547283 - DNA, 25 bp, Mus musculus
gccagaagggagtactgcgtcgcta

SEQ ID NO: 547284 - DNA, 25 bp, Mus musculus
gccagaagtaccaggcctccgcaga

SEQ ID NO: 547285 - DNA, 25 bp, Mus musculus
gccagaagtacctggcctccgcaga

SEQ ID NO: 547286 - DNA, 25 bp, Mus musculus
gccagaagtctgcactctcaaagag

SEQ ID NO: 547287 - DNA, 25 bp, Mus musculus
gccagaagtctggactctcaaagag

SEQ ID NO: 547288 - DNA, 25 bp, Mus musculus
gccagaagttcaatgtcagttttat

SEQ ID NO: 547289 - DNA, 25 bp, Mus musculus
gccagaagttcattgtcagttttat

SEQ ID NO: 547290 - DNA, 25 bp, Mus musculus
gccagaagttccctgccatggaata

SEQ ID NO: 547291 - DNA, 25 bp, Mus musculus
gccagaagttccgtgccatggaata

SEQ ID NO: 547292 - DNA, 25 bp, Mus musculus
gccagaatacacaaaacagaccaat

SEQ ID NO: 547293 - DNA, 25 bp, Mus musculus
gccagaatacactaaacagaccaat

SEQ ID NO: 547294 - DNA, 25 bp, Mus musculus
gccagaataccacctcctaagggaa

SEQ ID NO: 547295 - DNA, 25 bp, Mus musculus
gccagaataccagctcctaagggaa

SEQ ID NO: 547296 - DNA, 25 bp, Mus musculus
gccagaatattacctaacaacgttg

SEQ ID NO: 547297 - DNA, 25 bp, Mus musculus
gccagaatattagctaacaacgttg

SEQ ID NO: 547298 - DNA, 25 bp, Mus musculus
gccagaatcatgcagatccactcac

SEQ ID NO: 547299 - DNA, 25 bp, Mus musculus
gccagaatcatggagatccactcac

SEQ ID NO: 547300 - DNA, 25 bp, Mus musculus
gccagaatccacatagtagcacaca

SEQ ID NO: 547301 - DNA, 25 bp, Mus musculus
gccagaatccacttagtagcacaca

SEQ ID NO: 547302 - DNA, 25 bp, Mus musculus
gccagaatctgacggtgaccggcca

SEQ ID NO: 547303 - DNA, 25 bp, Mus musculus
gccagaatctgagggtgaccggcca

SEQ ID NO: 547304 - DNA, 25 bp, Mus musculus
gccagaatgctaatggagcacactt

SEQ ID NO: 547305 - DNA, 25 bp, Mus musculus
gccagaatgctattggagcacactt

SEQ ID NO: 547306 - DNA, 25 bp, Mus musculus
gccagaatggacagtttgctcttca

SEQ ID NO: 547307 - DNA, 25 bp, Mus musculus
gccagaatggactgtttgctcttca

SEQ ID NO: 547308 - DNA, 25 bp, Mus musculus
gccagaatgttcatccacaactgtg

SEQ ID NO: 547309 - DNA, 25 bp, Mus musculus
gccagaatgttcttccacaactgtg

SEQ ID NO: 547310 - DNA, 25 bp, Mus musculus
gccagaattcacatctgtcatccgg

SEQ ID NO: 547311 - DNA, 25 bp, Mus musculus
gccagaattcacttctgtcatccgg

SEQ ID NO: 547312 - DNA, 25 bp, Mus musculus
gccagaattcagaatataccaatgg

SEQ ID NO: 547313 - DNA, 25 bp, Mus musculus
gccagaattcagtatataccaatgg

SEQ ID NO: 547314 - DNA, 25 bp, Mus musculus
gccagaattttacttgctcctgatt

SEQ ID NO: 547315 - DNA, 25 bp, Mus musculus
gccagaattttagttgctcctgatt

SEQ ID NO: 547316 - DNA, 25 bp, Mus musculus
gccagaattttgaatctcctttgat

SEQ ID NO: 547317 - DNA, 25 bp, Mus musculus
gccagaattttgtatctcctttgat

SEQ ID NO: 547318 - DNA, 25 bp, Mus musculus
gccagacaactgaatatgagacact

SEQ ID NO: 547319 - DNA, 25 bp, Mus musculus
gccagacaactgtatatgagacact

SEQ ID NO: 547320 - DNA, 25 bp, Mus musculus
gccagacaagaacgtatccggaaga

SEQ ID NO: 547321 - DNA, 25 bp, Mus musculus
gccagacaagaaggtatccggaaga

SEQ ID NO: 547322 - DNA, 25 bp, Mus musculus
gccagacaagtgatgtgacttgact

SEQ ID NO: 547323 - DNA, 25 bp, Mus musculus
gccagacaagtgttgtgacttgact

SEQ ID NO: 547324 - DNA, 25 bp, Mus musculus
gccagacacttgcaagtgactgttt

SEQ ID NO: 547325 - DNA, 25 bp, Mus musculus
gccagacacttggaagtgactgttt

SEQ ID NO: 547326 - DNA, 25 bp, Mus musculus
gccagacagattataggcttctctt

SEQ ID NO: 547327 - DNA, 25 bp, Mus musculus
gccagacagattttaggcttctctt

SEQ ID NO: 547328 - DNA, 25 bp, Mus musculus
gccagacagcagaaccacggctcgg

SEQ ID NO: 547329 - DNA, 25 bp, Mus musculus
gccagacagcagacagggacatctt

SEQ ID NO: 547330 - DNA, 25 bp, Mus musculus
gccagacagcagtaccacggctcgg

SEQ ID NO: 547331 - DNA, 25 bp, Mus musculus
gccagacagcagtcagggacatctt

SEQ ID NO: 547332 - DNA, 25 bp, Mus musculus
gccagacaggatacacaaaacaaaa

SEQ ID NO: 547333 - DNA, 25 bp, Mus musculus
gccagacaggattcacaaaacaaaa

SEQ ID NO: 547334 - DNA, 25 bp, Mus musculus
gccagacatgctcgcacgtgtcttt

SEQ ID NO: 547335 - DNA, 25 bp, Mus musculus
gccagacatgctggcacgtgtcttt

SEQ ID NO: 547336 - DNA, 25 bp, Mus musculus
gccagaccactgcacagggttggat

SEQ ID NO: 547337 - DNA, 25 bp, Mus musculus
gccagaccactggacagggttggat

SEQ ID NO: 547338 - DNA, 25 bp, Mus musculus
gccagaccagagacagcatcatagg

SEQ ID NO: 547339 - DNA, 25 bp, Mus musculus
gccagaccagagtcagcatcatagg

SEQ ID NO: 547340 - DNA, 25 bp, Mus musculus
gccagaccatcaagacacatacttt

SEQ ID NO: 547341 - DNA, 25 bp, Mus musculus
gccagaccatcatgacacatacttt

SEQ ID NO: 547342 - DNA, 25 bp, Mus musculus
gccagaccatttcatccaggatcct

SEQ ID NO: 547343 - DNA, 25 bp, Mus musculus
gccagaccatttgatccaggatcct

SEQ ID NO: 547344 - DNA, 25 bp, Mus musculus
gccagacccttaatctttcgtaaga

SEQ ID NO: 547345 - DNA, 25 bp, Mus musculus
gccagacccttattctttcgtaaga

SEQ ID NO: 547346 - DNA, 25 bp, Mus musculus
gccagaccgtgcatacactggatgt

SEQ ID NO: 547347 - DNA, 25 bp, Mus musculus
gccagaccgtgcttacactggatgt

SEQ ID NO: 547348 - DNA, 25 bp, Mus musculus
gccagacctaagctccagcagtaaa

SEQ ID NO: 547349 - DNA, 25 bp, Mus musculus
gccagacctaaggtccagcagtaaa

SEQ ID NO: 547350 - DNA, 25 bp, Mus musculus
gccagacctcaaagttccctcgtga

SEQ ID NO: 547351 - DNA, 25 bp, Mus musculus
gccagacctcaatgttccctcgtga

SEQ ID NO: 547352 - DNA, 25 bp, Mus musculus
gccagacctcgacaagggagcctga

SEQ ID NO: 547353 - DNA, 25 bp, Mus musculus
gccagacctcgagaagggagcctga

SEQ ID NO: 547354 - DNA, 25 bp, Mus musculus
gccagacctcttcaagtcctctttt

SEQ ID NO: 547355 - DNA, 25 bp, Mus musculus
gccagacctcttgaagtcctctttt

SEQ ID NO: 547356 - DNA, 25 bp, Mus musculus
gccagaccttagaagtcagcctcag

SEQ ID NO: 547357 - DNA, 25 bp, Mus musculus
gccagaccttagtagtcagcctcag

SEQ ID NO: 547358 - DNA, 25 bp, Mus musculus
gccagaccttccaaaatccagttgt

SEQ ID NO: 547359 - DNA, 25 bp, Mus musculus
gccagaccttcctaaatccagttgt

SEQ ID NO: 547360 - DNA, 25 bp, Mus musculus
gccagacgctttaccggtaccaagg

SEQ ID NO: 547361 - DNA, 25 bp, Mus musculus
gccagacgcttttccggtaccaagg

SEQ ID NO: 547362 - DNA, 25 bp, Mus musculus
gccagacgtaaacagctccgaatta

SEQ ID NO: 547363 - DNA, 25 bp, Mus musculus
gccagacgtaaagagctccgaatta

SEQ ID NO: 547364 - DNA, 25 bp, Mus musculus
gccagactacggagtttctgccctt

SEQ ID NO: 547365 - DNA, 25 bp, Mus musculus
gccagactacggtgtttctgccctt

SEQ ID NO: 547366 - DNA, 25 bp, Mus musculus
gccagactcacacatgtttacaggt

SEQ ID NO: 547367 - DNA, 25 bp, Mus musculus
gccagactcacagatgtttacaggt

SEQ ID NO: 547368 - DNA, 25 bp, Mus musculus
gccagactcagtcagctatgtcgaa

SEQ ID NO: 547369 - DNA, 25 bp, Mus musculus
gccagactcagtgagctatgtcgaa

SEQ ID NO: 547370 - DNA, 25 bp, Mus musculus
gccagactcattctcatgactacta

SEQ ID NO: 547371 - DNA, 25 bp, Mus musculus
gccagactcattgtcatgactacta

SEQ ID NO: 547372 - DNA, 25 bp, Mus musculus
gccagactcctcactgaataaaccg

SEQ ID NO: 547373 - DNA, 25 bp, Mus musculus
gccagactcctctctgaataaaccg

SEQ ID NO: 547374 - DNA, 25 bp, Mus musculus
gccagactcctgaataatgttgcca

SEQ ID NO: 547375 - DNA, 25 bp, Mus musculus
gccagactcctgtataatgttgcca

SEQ ID NO: 547376 - DNA, 25 bp, Mus musculus
gccagactctgaaagtgatcatgaa

SEQ ID NO: 547377 - DNA, 25 bp, Mus musculus
gccagactctgatagtgatcatgaa

SEQ ID NO: 547378 - DNA, 25 bp, Mus musculus
gccagactggttcgcatgtctacaa

SEQ ID NO: 547379 - DNA, 25 bp, Mus musculus
gccagactggttggcatgtctacaa

SEQ ID NO: 547380 - DNA, 25 bp, Mus musculus
gccagactgtggaagattcttgctt

SEQ ID NO: 547381 - DNA, 25 bp, Mus musculus
gccagactgtggtagattcttgctt

SEQ ID NO: 547382 - DNA, 25 bp, Mus musculus
gccagactgtgtcgtatctcctgag

SEQ ID NO: 547383 - DNA, 25 bp, Mus musculus
gccagactgtgtggtatctcctgag

SEQ ID NO: 547384 - DNA, 25 bp, Mus musculus
gccagactgtttcccagagacttag

SEQ ID NO: 547385 - DNA, 25 bp, Mus musculus
gccagactgtttgccagagacttag

SEQ ID NO: 547386 - DNA, 25 bp, Mus musculus
gccagacttactagatgacccgaat

SEQ ID NO: 547387 - DNA, 25 bp, Mus musculus
gccagacttacttgatgacccgaat

SEQ ID NO: 547388 - DNA, 25 bp, Mus musculus
gccagacttagcattcctgtgagtg

SEQ ID NO: 547389 - DNA, 25 bp, Mus musculus
gccagacttagctttcctgtgagtg

SEQ ID NO: 547390 - DNA, 25 bp, Mus musculus
gccagacttggcaaacagcttcagc

SEQ ID NO: 547391 - DNA, 25 bp, Mus musculus
gccagacttggctaacagcttcagc

SEQ ID NO: 547392 - DNA, 25 bp, Mus musculus
gccagagaatgtaatgctttgagaa

SEQ ID NO: 547393 - DNA, 25 bp, Mus musculus
gccagagaatgttatgctttgagaa

SEQ ID NO: 547394 - DNA, 25 bp, Mus musculus
gccagagacagcacgaacatctaac

SEQ ID NO: 547395 - DNA, 25 bp, Mus musculus
gccagagacagctcgaacatctaac

SEQ ID NO: 547396 - DNA, 25 bp, Mus musculus
gccagagacagtcttgagtccgctt

SEQ ID NO: 547397 - DNA, 25 bp, Mus musculus
gccagagacagtgttgagtccgctt

SEQ ID NO: 547398 - DNA, 25 bp, Mus musculus
gccagagaccgacccagaaaccgag

SEQ ID NO: 547399 - DNA, 25 bp, Mus musculus
gccagagaccgagccagaaaccgag

SEQ ID NO: 547400 - DNA, 25 bp, Mus musculus
gccagagactaactctggaagcccc

SEQ ID NO: 547401 - DNA, 25 bp, Mus musculus
gccagagactaagtctggaagcccc

SEQ ID NO: 547402 - DNA, 25 bp, Mus musculus
gccagagactccagcgcagactgat

SEQ ID NO: 547403 - DNA, 25 bp, Mus musculus
gccagagactcctgcgcagactgat

SEQ ID NO: 547404 - DNA, 25 bp, Mus musculus
gccagagacttgactttcagaatag

SEQ ID NO: 547405 - DNA, 25 bp, Mus musculus
gccagagacttgtctttcagaatag

SEQ ID NO: 547406 - DNA, 25 bp, Mus musculus
gccagagactttccgttcagcctct

SEQ ID NO: 547407 - DNA, 25 bp, Mus musculus
gccagagactttgcgttcagcctct

SEQ ID NO: 547408 - DNA, 25 bp, Mus musculus
gccagagagctcaataagtcagtta

SEQ ID NO: 547409 - DNA, 25 bp, Mus musculus
gccagagagctctataagtcagtta

SEQ ID NO: 547410 - DNA, 25 bp, Mus musculus
gccagagaggagatttgcctgcatg

SEQ ID NO: 547411 - DNA, 25 bp, Mus musculus
gccagagaggagttttgcctgcatg

SEQ ID NO: 547412 - DNA, 25 bp, Mus musculus
gccagagattcaatgaacgctgcat

SEQ ID NO: 547413 - DNA, 25 bp, Mus musculus
gccagagattcattgaacgctgcat

SEQ ID NO: 547414 - DNA, 25 bp, Mus musculus
gccagagcacaaatttctcttctcc

SEQ ID NO: 547415 - DNA, 25 bp, Mus musculus
gccagagcacaattttctcttctcc

SEQ ID NO: 547416 - DNA, 25 bp, Mus musculus
gccagagcacctccggatgaatcta

SEQ ID NO: 547417 - DNA, 25 bp, Mus musculus
gccagagcacctgcggatgaatcta

SEQ ID NO: 547418 - DNA, 25 bp, Mus musculus
gccagagcacggacagtggaagaga

SEQ ID NO: 547419 - DNA, 25 bp, Mus musculus
gccagagcacggtcagtggaagaga

SEQ ID NO: 547420 - DNA, 25 bp, Mus musculus
gccagagcatgacgataccccggaa

SEQ ID NO: 547421 - DNA, 25 bp, Mus musculus
gccagagcatgaggataccccggaa

SEQ ID NO: 547422 - DNA, 25 bp, Mus musculus
gccagagccaccaaacgaagcagat

SEQ ID NO: 547423 - DNA, 25 bp, Mus musculus
gccagagccacctaacgaagcagat

SEQ ID NO: 547424 - DNA, 25 bp, Mus musculus
gccagagcccttagatcctgaattt

SEQ ID NO: 547425 - DNA, 25 bp, Mus musculus
gccagagccctttgatcctgaattt

SEQ ID NO: 547426 - DNA, 25 bp, Mus musculus
gccagagcctgcagtatatgctgag

SEQ ID NO: 547427 - DNA, 25 bp, Mus musculus
gccagagcctgctgtatatgctgag

SEQ ID NO: 547428 - DNA, 25 bp, Mus musculus
gccagagcgaagcaaagcccagaaa

SEQ ID NO: 547429 - DNA, 25 bp, Mus musculus
gccagagcgaaggaaagcccagaaa

SEQ ID NO: 547430 - DNA, 25 bp, Mus musculus
gccagagcgggacagaaacttcaat

SEQ ID NO: 547431 - DNA, 25 bp, Mus musculus
gccagagcgggagagaaacttcaat

SEQ ID NO: 547432 - DNA, 25 bp, Mus musculus
gccagagcgtgaaacggtgtccatt

SEQ ID NO: 547433 - DNA, 25 bp, Mus musculus
gccagagcgtgatacggtgtccatt

SEQ ID NO: 547434 - DNA, 25 bp, Mus musculus
gccagagctacaagatagaggtcct

SEQ ID NO: 547435 - DNA, 25 bp, Mus musculus
gccagagctacatgatagaggtcct

SEQ ID NO: 547436 - DNA, 25 bp, Mus musculus
gccagagctcatctttctctacaat

SEQ ID NO: 547437 - DNA, 25 bp, Mus musculus
gccagagctcatgtttctctacaat

SEQ ID NO: 547438 - DNA, 25 bp, Mus musculus
gccagagctcgcacagatagtccag

SEQ ID NO: 547439 - DNA, 25 bp, Mus musculus
gccagagctcgctcagatagtccag

SEQ ID NO: 547440 - DNA, 25 bp, Mus musculus
gccagagctcggcttgaacagccag

SEQ ID NO: 547441 - DNA, 25 bp, Mus musculus
gccagagctcgggttgaacagccag

SEQ ID NO: 547442 - DNA, 25 bp, Mus musculus
gccagagcttgtcaatgttaccatg

SEQ ID NO: 547443 - DNA, 25 bp, Mus musculus
gccagagcttgtgaatgttaccatg

SEQ ID NO: 547444 - DNA, 25 bp, Mus musculus
gccagaggacacacagggacactgt

SEQ ID NO: 547445 - DNA, 25 bp, Mus musculus
gccagaggacactcagggacactgt

SEQ ID NO: 547446 - DNA, 25 bp, Mus musculus
gccagaggacccatcactattagag

SEQ ID NO: 547447 - DNA, 25 bp, Mus musculus
gccagaggacccttcactattagag

SEQ ID NO: 547448 - DNA, 25 bp, Mus musculus
gccagaggacgtatgagtttcagct

SEQ ID NO: 547449 - DNA, 25 bp, Mus musculus
gccagaggacgtttgagtttcagct

SEQ ID NO: 547450 - DNA, 25 bp, Mus musculus
gccagaggactcagagagagactca

SEQ ID NO: 547451 - DNA, 25 bp, Mus musculus
gccagaggactctgagagagactca

SEQ ID NO: 547452 - DNA, 25 bp, Mus musculus
gccagaggatggctgttccatgact

SEQ ID NO: 547453 - DNA, 25 bp, Mus musculus
gccagaggatgggtgttccatgact

SEQ ID NO: 547454 - DNA, 25 bp, Mus musculus
gccagaggattaacaaagcccaaag

SEQ ID NO: 547455 - DNA, 25 bp, Mus musculus
gccagaggattatcaaagcccaaag

SEQ ID NO: 547456 - DNA, 25 bp, Mus musculus
gccagaggattcatgctttcccttc

SEQ ID NO: 547457 - DNA, 25 bp, Mus musculus
gccagaggattcttgctttcccttc

SEQ ID NO: 547458 - DNA, 25 bp, Mus musculus
gccagaggcaggaaaggtcccagca

SEQ ID NO: 547459 - DNA, 25 bp, Mus musculus
gccagaggcaggtaaggtcccagca

SEQ ID NO: 547460 - DNA, 25 bp, Mus musculus
gccagaggctacacaagaagattct

SEQ ID NO: 547461 - DNA, 25 bp, Mus musculus
gccagaggctactcaagaagattct

SEQ ID NO: 547462 - DNA, 25 bp, Mus musculus
gccagaggctcaattgtccaaattg

SEQ ID NO: 547463 - DNA, 25 bp, Mus musculus
gccagaggctcatttgtccaaattg

SEQ ID NO: 547464 - DNA, 25 bp, Mus musculus
gccagaggctggacctgccctacat

SEQ ID NO: 547465 - DNA, 25 bp, Mus musculus
gccagaggctggtcctgccctacat

SEQ ID NO: 547466 - DNA, 25 bp, Mus musculus
gccagagggaaaccccattttgaaa

SEQ ID NO: 547467 - DNA, 25 bp, Mus musculus
gccagagggaaagcccattttgaaa

SEQ ID NO: 547468 - DNA, 25 bp, Mus musculus
gccagagggcagatgtcctgagtta

SEQ ID NO: 547469 - DNA, 25 bp, Mus musculus
gccagagggcagttgtcctgagtta

SEQ ID NO: 547470 - DNA, 25 bp, Mus musculus
gccagagggcttatcaccaaggaat

SEQ ID NO: 547471 - DNA, 25 bp, Mus musculus
gccagagggcttttcaccaaggaat

SEQ ID NO: 547472 - DNA, 25 bp, Mus musculus
gccagagggtagcagagccaacctt

SEQ ID NO: 547473 - DNA, 25 bp, Mus musculus
gccagagggtaggagagccaacctt

SEQ ID NO: 547474 - DNA, 25 bp, Mus musculus
gccagagggttcatcgtttcatgat

SEQ ID NO: 547475 - DNA, 25 bp, Mus musculus
gccagagggttcttcgtttcatgat

SEQ ID NO: 547476 - DNA, 25 bp, Mus musculus
gccagaggtactcgagggccctact

SEQ ID NO: 547477 - DNA, 25 bp, Mus musculus
gccagaggtactggagggccctact

SEQ ID NO: 547478 - DNA, 25 bp, Mus musculus
gccagaggtcagacttaactgtcgt

SEQ ID NO: 547479 - DNA, 25 bp, Mus musculus
gccagaggtcagtcttaactgtcgt

SEQ ID NO: 547480 - DNA, 25 bp, Mus musculus
gccagaggtcccatgtccttggcag

SEQ ID NO: 547481 - DNA, 25 bp, Mus musculus
gccagaggtcccttgtccttggcag

SEQ ID NO: 547482 - DNA, 25 bp, Mus musculus
gccagaggtgcaactcgccatcgag

SEQ ID NO: 547483 - DNA, 25 bp, Mus musculus
gccagaggtgcatctcgccatcgag

SEQ ID NO: 547484 - DNA, 25 bp, Mus musculus
gccagagtcacaacagtcaccagtc

SEQ ID NO: 547485 - DNA, 25 bp, Mus musculus
gccagagtcacatcagtcaccagtc

SEQ ID NO: 547486 - DNA, 25 bp, Mus musculus
gccagagtcagcacatccatgaatg

SEQ ID NO: 547487 - DNA, 25 bp, Mus musculus
gccagagtcagctcatccatgaatg

SEQ ID NO: 547488 - DNA, 25 bp, Mus musculus
gccagagtcgccacaatgacgagct

SEQ ID NO: 547489 - DNA, 25 bp, Mus musculus
gccagagtcgcctcaatgacgagct

SEQ ID NO: 547490 - DNA, 25 bp, Mus musculus
gccagagtcgggatgctcgtttcaa

SEQ ID NO: 547491 - DNA, 25 bp, Mus musculus
gccagagtcgggttgctcgtttcaa

SEQ ID NO: 547492 - DNA, 25 bp, Mus musculus
gccagagtctatcatcctgaacagt

SEQ ID NO: 547493 - DNA, 25 bp, Mus musculus
gccagagtctatgatcctgaacagt

SEQ ID NO: 547494 - DNA, 25 bp, Mus musculus
gccagagtctccatctttgatgtga

SEQ ID NO: 547495 - DNA, 25 bp, Mus musculus
gccagagtctccttctttgatgtga

SEQ ID NO: 547496 - DNA, 25 bp, Mus musculus
gccagagtctcgatcgttatcggaa

SEQ ID NO: 547497 - DNA, 25 bp, Mus musculus
gccagagtctcgttcgttatcggaa

SEQ ID NO: 547498 - DNA, 25 bp, Mus musculus
gccagagtgcagaacagctcaggca

SEQ ID NO: 547499 - DNA, 25 bp, Mus musculus
gccagagtgcagtacagctcaggca

SEQ ID NO: 547500 - DNA, 25 bp, Mus musculus
gccagagtgtatccactttactaca

SEQ ID NO: 547501 - DNA, 25 bp, Mus musculus
gccagagtgtatgcactttactaca

SEQ ID NO: 547502 - DNA, 25 bp, Mus musculus
gccagagtgtggcaatcattttgag

SEQ ID NO: 547503 - DNA, 25 bp, Mus musculus
gccagagtgtgggaatcattttgag

SEQ ID NO: 547504 - DNA, 25 bp, Mus musculus
gccagagttccaaaagagctagaaa

SEQ ID NO: 547505 - DNA, 25 bp, Mus musculus
gccagagttccataagagctagaaa

SEQ ID NO: 547506 - DNA, 25 bp, Mus musculus
gccagagttgaaccaccgcgaggaa

SEQ ID NO: 547507 - DNA, 25 bp, Mus musculus
gccagagttgaagcaccgcgaggaa

SEQ ID NO: 547508 - DNA, 25 bp, Mus musculus
gccagagttgctcaataacaccaaa

SEQ ID NO: 547509 - DNA, 25 bp, Mus musculus
gccagagttgctgaataacaccaaa

SEQ ID NO: 547510 - DNA, 25 bp, Mus musculus
gccagagttgtcatccaacatcaga

SEQ ID NO: 547511 - DNA, 25 bp, Mus musculus
gccagagttgtcttccaacatcaga

SEQ ID NO: 547512 - DNA, 25 bp, Mus musculus
gccagagtttgtccggtgccagagt

SEQ ID NO: 547513 - DNA, 25 bp, Mus musculus
gccagagtttgtgcggtgccagagt

SEQ ID NO: 547514 - DNA, 25 bp, Mus musculus
gccagataaagtacccagggagctg

SEQ ID NO: 547515 - DNA, 25 bp, Mus musculus
gccagataaagttcccagggagctg

SEQ ID NO: 547516 - DNA, 25 bp, Mus musculus
gccagataacttatgttacccggag

SEQ ID NO: 547517 - DNA, 25 bp, Mus musculus
gccagataacttttgttacccggag

SEQ ID NO: 547518 - DNA, 25 bp, Mus musculus
gccagataagttatcccttgttgga

SEQ ID NO: 547519 - DNA, 25 bp, Mus musculus
gccagataagttttcccttgttgga

SEQ ID NO: 547520 - DNA, 25 bp, Mus musculus
gccagatacagtataccataagaaa

SEQ ID NO: 547521 - DNA, 25 bp, Mus musculus
gccagatacagtttaccataagaaa

SEQ ID NO: 547522 - DNA, 25 bp, Mus musculus
gccagatagaatcaattcgcacatt

SEQ ID NO: 547523 - DNA, 25 bp, Mus musculus
gccagatagaatgaattcgcacatt

SEQ ID NO: 547524 - DNA, 25 bp, Mus musculus
gccagatagagcagtgcttcaccaa

SEQ ID NO: 547525 - DNA, 25 bp, Mus musculus
gccagatagagctgtgcttcaccaa

SEQ ID NO: 547526 - DNA, 25 bp, Mus musculus
gccagatcagcaatctctaacttgt

SEQ ID NO: 547527 - DNA, 25 bp, Mus musculus
gccagatcagcattctctaacttgt

SEQ ID NO: 547528 - DNA, 25 bp, Mus musculus
gccagatccacaccccgttttgtag

SEQ ID NO: 547529 - DNA, 25 bp, Mus musculus
gccagatccacagcccgttttgtag

SEQ ID NO: 547530 - DNA, 25 bp, Mus musculus
gccagatcggccctcgagttgattg

SEQ ID NO: 547531 - DNA, 25 bp, Mus musculus
gccagatcggccgtcgagttgattg

SEQ ID NO: 547532 - DNA, 25 bp, Mus musculus
gccagatcggctacatgctgtgtag

SEQ ID NO: 547533 - DNA, 25 bp, Mus musculus
gccagatcggcttcatgctgtgtag

SEQ ID NO: 547534 - DNA, 25 bp, Mus musculus
gccagatgaaagacaaccttcctcc

SEQ ID NO: 547535 - DNA, 25 bp, Mus musculus
gccagatgaaagtcaaccttcctcc

SEQ ID NO: 547536 - DNA, 25 bp, Mus musculus
gccagatgaagcagctcttactaag

SEQ ID NO: 547537 - DNA, 25 bp, Mus musculus
gccagatgaagcctcttgctgtgta

SEQ ID NO: 547538 - DNA, 25 bp, Mus musculus
gccagatgaagcgtcttgctgtgta

SEQ ID NO: 547539 - DNA, 25 bp, Mus musculus
gccagatgaagctgctcttactaag

SEQ ID NO: 547540 - DNA, 25 bp, Mus musculus
gccagatgcagtatatgcctacaat

SEQ ID NO: 547541 - DNA, 25 bp, Mus musculus
gccagatgcagtttatgcctacaat

SEQ ID NO: 547542 - DNA, 25 bp, Mus musculus
gccagatgctccaggtgtatacacc

SEQ ID NO: 547543 - DNA, 25 bp, Mus musculus
gccagatgctcctggtgtatacacc

SEQ ID NO: 547544 - DNA, 25 bp, Mus musculus
gccagatggtttcttggaatgtata

SEQ ID NO: 547545 - DNA, 25 bp, Mus musculus
gccagatggtttgttggaatgtata

SEQ ID NO: 547546 - DNA, 25 bp, Mus musculus
gccagatgtgatcacgcaggcctgt

SEQ ID NO: 547547 - DNA, 25 bp, Mus musculus
gccagatgtgatgacgcaggcctgt

SEQ ID NO: 547548 - DNA, 25 bp, Mus musculus
gccagattacttatgatgacgacta

SEQ ID NO: 547549 - DNA, 25 bp, Mus musculus
gccagattacttttgatgacgacta

SEQ ID NO: 547550 - DNA, 25 bp, Mus musculus
gccagattaggcatgcttcttcgta

SEQ ID NO: 547551 - DNA, 25 bp, Mus musculus
gccagattaggcttgcttcttcgta

SEQ ID NO: 547552 - DNA, 25 bp, Mus musculus
gccagattcatgaaagagcttttta

SEQ ID NO: 547553 - DNA, 25 bp, Mus musculus
gccagattcatgtaagagcttttta

SEQ ID NO: 547554 - DNA, 25 bp, Mus musculus
gccagattctgcataggcacatatg

SEQ ID NO: 547555 - DNA, 25 bp, Mus musculus
gccagattctgcttaggcacatatg

SEQ ID NO: 547556 - DNA, 25 bp, Mus musculus
gccagattctttccagctcagatat

SEQ ID NO: 547557 - DNA, 25 bp, Mus musculus
gccagattctttgcagctcagatat

SEQ ID NO: 547558 - DNA, 25 bp, Mus musculus
gccagattgccgaatggttcctttg

SEQ ID NO: 547559 - DNA, 25 bp, Mus musculus
gccagattgccgtatggttcctttg

SEQ ID NO: 547560 - DNA, 25 bp, Mus musculus
gccagattggctagtgctgacatca

SEQ ID NO: 547561 - DNA, 25 bp, Mus musculus
gccagattggcttgtgctgacatca

SEQ ID NO: 547562 - DNA, 25 bp, Mus musculus
gccagatttattcccatcaggtcag

SEQ ID NO: 547563 - DNA, 25 bp, Mus musculus
gccagatttattgccatcaggtcag

SEQ ID NO: 547564 - DNA, 25 bp, Mus musculus
gccagatttcagcatatagccccga

SEQ ID NO: 547565 - DNA, 25 bp, Mus musculus
gccagatttcaggatatagccccga

SEQ ID NO: 547566 - DNA, 25 bp, Mus musculus
gccagatttcatcaggcggcctgat

SEQ ID NO: 547567 - DNA, 25 bp, Mus musculus
gccagatttcatgaggcggcctgat

SEQ ID NO: 547568 - DNA, 25 bp, Mus musculus
gccagatttgagatctgctcttatc

SEQ ID NO: 547569 - DNA, 25 bp, Mus musculus
gccagatttgagttctgctcttatc

SEQ ID NO: 547570 - DNA, 25 bp, Mus musculus
gccagcaactcgcaatatttcagat

SEQ ID NO: 547571 - DNA, 25 bp, Mus musculus
gccagcaactcggaatatttcagat

SEQ ID NO: 547572 - DNA, 25 bp, Mus musculus
gccagcaagatacctttaagctatt

SEQ ID NO: 547573 - DNA, 25 bp, Mus musculus
gccagcaagatagctttaagctatt

SEQ ID NO: 547574 - DNA, 25 bp, Mus musculus
gccagcaagcaaaattcctccaagg

SEQ ID NO: 547575 - DNA, 25 bp, Mus musculus
gccagcaagcaatattcctccaagg

SEQ ID NO: 547576 - DNA, 25 bp, Mus musculus
gccagcaaggcaaccctgggaaaac

SEQ ID NO: 547577 - DNA, 25 bp, Mus musculus
gccagcaaggcatccctgggaaaac

SEQ ID NO: 547578 - DNA, 25 bp, Mus musculus
gccagcaagggactttatttaaggt

SEQ ID NO: 547579 - DNA, 25 bp, Mus musculus
gccagcaagggagtttatttaaggt

SEQ ID NO: 547580 - DNA, 25 bp, Mus musculus
gccagcaaggtgactagcagtctca

SEQ ID NO: 547581 - DNA, 25 bp, Mus musculus
gccagcaaggtgtctagcagtctca

SEQ ID NO: 547582 - DNA, 25 bp, Mus musculus
gccagcaatcaaccatcatgtgttt

SEQ ID NO: 547583 - DNA, 25 bp, Mus musculus
gccagcaatcaagcatcatgtgttt

SEQ ID NO: 547584 - DNA, 25 bp, Mus musculus
gccagcaattataccatgggcccta

SEQ ID NO: 547585 - DNA, 25 bp, Mus musculus
gccagcaattattccatgggcccta

SEQ ID NO: 547586 - DNA, 25 bp, Mus musculus
gccagcacaacaaattgagccccaa

SEQ ID NO: 547587 - DNA, 25 bp, Mus musculus
gccagcacaacatattgagccccaa

SEQ ID NO: 547588 - DNA, 25 bp, Mus musculus
gccagcacacatcggtgtttggaga

SEQ ID NO: 547589 - DNA, 25 bp, Mus musculus
gccagcacacatgggtgtttggaga

SEQ ID NO: 547590 - DNA, 25 bp, Mus musculus
gccagcacattgctagctaatagtg

SEQ ID NO: 547591 - DNA, 25 bp, Mus musculus
gccagcacattggtagctaatagtg

SEQ ID NO: 547592 - DNA, 25 bp, Mus musculus
gccagcaccgtgcagagttactgtt

SEQ ID NO: 547593 - DNA, 25 bp, Mus musculus
gccagcaccgtggagagttactgtt

SEQ ID NO: 547594 - DNA, 25 bp, Mus musculus
gccagcactcacagactttacagta

SEQ ID NO: 547595 - DNA, 25 bp, Mus musculus
gccagcactcactgactttacagta

SEQ ID NO: 547596 - DNA, 25 bp, Mus musculus
gccagcactcgtcattttattcata

SEQ ID NO: 547597 - DNA, 25 bp, Mus musculus
gccagcactcgtgattttattcata

SEQ ID NO: 547598 - DNA, 25 bp, Mus musculus
gccagcactgaactgccatttcttc

SEQ ID NO: 547599 - DNA, 25 bp, Mus musculus
gccagcactgaagtgccatttcttc

SEQ ID NO: 547600 - DNA, 25 bp, Mus musculus
gccagcactgcaagagcctagccat

SEQ ID NO: 547601 - DNA, 25 bp, Mus musculus
gccagcactgcatgagcctagccat

SEQ ID NO: 547602 - DNA, 25 bp, Mus musculus
gccagcactgtgcatgtttcatggt

SEQ ID NO: 547603 - DNA, 25 bp, Mus musculus
gccagcactgtggatgtttcatggt

SEQ ID NO: 547604 - DNA, 25 bp, Mus musculus
gccagcacttggcagtgttatcaga

SEQ ID NO: 547605 - DNA, 25 bp, Mus musculus
gccagcacttgggagtgttatcaga

SEQ ID NO: 547606 - DNA, 25 bp, Mus musculus
gccagcagaaatctccatccaaaag

SEQ ID NO: 547607 - DNA, 25 bp, Mus musculus
gccagcagaaatgtccatccaaaag

SEQ ID NO: 547608 - DNA, 25 bp, Mus musculus
gccagcagacagaattaccaaagtg

SEQ ID NO: 547609 - DNA, 25 bp, Mus musculus
gccagcagacagtattaccaaagtg

SEQ ID NO: 547610 - DNA, 25 bp, Mus musculus
gccagcagacttcagcttggaactc

SEQ ID NO: 547611 - DNA, 25 bp, Mus musculus
gccagcagacttgagcttggaactc

SEQ ID NO: 547612 - DNA, 25 bp, Mus musculus
gccagcagagagaagagactccatc

SEQ ID NO: 547613 - DNA, 25 bp, Mus musculus
gccagcagagagtagagactccatc

SEQ ID NO: 547614 - DNA, 25 bp, Mus musculus
gccagcagcattacccaagctttgt

SEQ ID NO: 547615 - DNA, 25 bp, Mus musculus
gccagcagcattctctcagctctgt

SEQ ID NO: 547616 - DNA, 25 bp, Mus musculus
gccagcagcattgtctcagctctgt

SEQ ID NO: 547617 - DNA, 25 bp, Mus musculus
gccagcagcatttcccaagctttgt

SEQ ID NO: 547618 - DNA, 25 bp, Mus musculus
gccagcagccatcaattgtttcttt

SEQ ID NO: 547619 - DNA, 25 bp, Mus musculus
gccagcagccatgaattgtttcttt

SEQ ID NO: 547620 - DNA, 25 bp, Mus musculus
gccagcagcctgacaacagactatt

SEQ ID NO: 547621 - DNA, 25 bp, Mus musculus
gccagcagcctgtcaacagactatt

SEQ ID NO: 547622 - DNA, 25 bp, Mus musculus
gccagcagcggactgaggatcaact

SEQ ID NO: 547623 - DNA, 25 bp, Mus musculus
gccagcagcggagtgaggatcaact

SEQ ID NO: 547624 - DNA, 25 bp, Mus musculus
gccagcagctcccagagtcggaaaa

SEQ ID NO: 547625 - DNA, 25 bp, Mus musculus
gccagcagctccgagagtcggaaaa

SEQ ID NO: 547626 - DNA, 25 bp, Mus musculus
gccagcaggaaaactttacccttta

SEQ ID NO: 547627 - DNA, 25 bp, Mus musculus
gccagcaggaaatctttacccttta

SEQ ID NO: 547628 - DNA, 25 bp, Mus musculus
gccagcaggaccatgtccagagctt

SEQ ID NO: 547629 - DNA, 25 bp, Mus musculus
gccagcaggaccttgtccagagctt

SEQ ID NO: 547630 - DNA, 25 bp, Mus musculus
gccagcaggagactgcagacacctt

SEQ ID NO: 547631 - DNA, 25 bp, Mus musculus
gccagcaggagagtgcagacacctt

SEQ ID NO: 547632 - DNA, 25 bp, Mus musculus
gccagcaggaggagcttagctagct

SEQ ID NO: 547633 - DNA, 25 bp, Mus musculus
gccagcaggaggtgcttagctagct

SEQ ID NO: 547634 - DNA, 25 bp, Mus musculus
gccagcaggccaaggcgcagtcgct

SEQ ID NO: 547635 - DNA, 25 bp, Mus musculus
gccagcaggccatggcgcagtcgct

SEQ ID NO: 547636 - DNA, 25 bp, Mus musculus
gccagcaggcctatactgccaaaga

SEQ ID NO: 547637 - DNA, 25 bp, Mus musculus
gccagcaggcctttactgccaaaga

SEQ ID NO: 547638 - DNA, 25 bp, Mus musculus
gccagcagggtgagcatccgcccgt

SEQ ID NO: 547639 - DNA, 25 bp, Mus musculus
gccagcagggtgtgcatccgcccgt

SEQ ID NO: 547640 - DNA, 25 bp, Mus musculus
gccagcaggtgcatgtgtgtaacca

SEQ ID NO: 547641 - DNA, 25 bp, Mus musculus
gccagcaggtgcttgtgtgtaacca

SEQ ID NO: 547642 - DNA, 25 bp, Mus musculus
gccagcaggtgtacctattccccag

SEQ ID NO: 547643 - DNA, 25 bp, Mus musculus
gccagcaggtgttcctattccccag

SEQ ID NO: 547644 - DNA, 25 bp, Mus musculus
gccagcagtacaatagtccccaaga

SEQ ID NO: 547645 - DNA, 25 bp, Mus musculus
gccagcagtacattagtccccaaga

SEQ ID NO: 547646 - DNA, 25 bp, Mus musculus
gccagcagtgataccttgagttttc

SEQ ID NO: 547647 - DNA, 25 bp, Mus musculus
gccagcagtgattccttgagttttc

SEQ ID NO: 547648 - DNA, 25 bp, Mus musculus
gccagcagtgctctgcttgggtcac

SEQ ID NO: 547649 - DNA, 25 bp, Mus musculus
gccagcagtgctgtgcttgggtcac

SEQ ID NO: 547650 - DNA, 25 bp, Mus musculus
gccagcagtgtcagattctgtaagg

SEQ ID NO: 547651 - DNA, 25 bp, Mus musculus
gccagcagtgtctgattctgtaagg

SEQ ID NO: 547652 - DNA, 25 bp, Mus musculus
gccagcagttctatagtttgtacca

SEQ ID NO: 547653 - DNA, 25 bp, Mus musculus
gccagcagttctttagtttgtacca

SEQ ID NO: 547654 - DNA, 25 bp, Mus musculus
gccagcatagttagaaggttacctt

SEQ ID NO: 547655 - DNA, 25 bp, Mus musculus
gccagcatagtttgaaggttacctt

SEQ ID NO: 547656 - DNA, 25 bp, Mus musculus
gccagcatccatctcaattgtttct

SEQ ID NO: 547657 - DNA, 25 bp, Mus musculus
gccagcatccatgtcaattgtttct

SEQ ID NO: 547658 - DNA, 25 bp, Mus musculus
gccagcatcctcagtagatacatca

SEQ ID NO: 547659 - DNA, 25 bp, Mus musculus
gccagcatcctctgtagatacatca

SEQ ID NO: 547660 - DNA, 25 bp, Mus musculus
gccagcatctaaagtcatgttctta

SEQ ID NO: 547661 - DNA, 25 bp, Mus musculus
gccagcatctaatgtcatgttctta

SEQ ID NO: 547662 - DNA, 25 bp, Mus musculus
gccagcatctctattataggatcca

SEQ ID NO: 547663 - DNA, 25 bp, Mus musculus
gccagcatctcttttataggatcca

SEQ ID NO: 547664 - DNA, 25 bp, Mus musculus
gccagcatctttccacggacaaata

SEQ ID NO: 547665 - DNA, 25 bp, Mus musculus
gccagcatctttgcacggacaaata

SEQ ID NO: 547666 - DNA, 25 bp, Mus musculus
gccagcatgccaagaaacttctacc

SEQ ID NO: 547667 - DNA, 25 bp, Mus musculus
gccagcatgccatgaaacttctacc

SEQ ID NO: 547668 - DNA, 25 bp, Mus musculus
gccagcatgctgaaactcatgtgta

SEQ ID NO: 547669 - DNA, 25 bp, Mus musculus
gccagcatgctgtaactcatgtgta

SEQ ID NO: 547670 - DNA, 25 bp, Mus musculus
gccagcatggaacccggtgacgctt

SEQ ID NO: 547671 - DNA, 25 bp, Mus musculus
gccagcatggaagccggtgacgctt

SEQ ID NO: 547672 - DNA, 25 bp, Mus musculus
gccagcatggataatatttctcaga

SEQ ID NO: 547673 - DNA, 25 bp, Mus musculus
gccagcatggattatatttctcaga

SEQ ID NO: 547674 - DNA, 25 bp, Mus musculus
gccagcattctcatccatagacaag

SEQ ID NO: 547675 - DNA, 25 bp, Mus musculus
gccagcattctcttccatagacaag

SEQ ID NO: 547676 - DNA, 25 bp, Mus musculus
gccagcattgtacatagactcagtg

SEQ ID NO: 547677 - DNA, 25 bp, Mus musculus
gccagcattgtagatagactcagtg

SEQ ID NO: 547678 - DNA, 25 bp, Mus musculus
gccagcatttgcagccaatggccaa

SEQ ID NO: 547679 - DNA, 25 bp, Mus musculus
gccagcatttgctgccaatggccaa

SEQ ID NO: 547680 - DNA, 25 bp, Mus musculus
gccagccaaagtcttcacgtagatc

SEQ ID NO: 547681 - DNA, 25 bp, Mus musculus
gccagccaaagtgttcacgtagatc

SEQ ID NO: 547682 - DNA, 25 bp, Mus musculus
gccagccaacggctctgcaggagat

SEQ ID NO: 547683 - DNA, 25 bp, Mus musculus
gccagccaacgggtctgcaggagat

SEQ ID NO: 547684 - DNA, 25 bp, Mus musculus
gccagccacaccactgaagatcaag

SEQ ID NO: 547685 - DNA, 25 bp, Mus musculus
gccagccacacctctgaagatcaag

SEQ ID NO: 547686 - DNA, 25 bp, Mus musculus
gccagccacagcaaggtagaaaggt

SEQ ID NO: 547687 - DNA, 25 bp, Mus musculus
gccagccacagctaggtagaaaggt

SEQ ID NO: 547688 - DNA, 25 bp, Mus musculus
gccagccacattaaacatcatcttt

SEQ ID NO: 547689 - DNA, 25 bp, Mus musculus
gccagccacattctttttgggccag

SEQ ID NO: 547690 - DNA, 25 bp, Mus musculus
gccagccacattgtttttgggccag

SEQ ID NO: 547691 - DNA, 25 bp, Mus musculus
gccagccacatttaacatcatcttt

SEQ ID NO: 547692 - DNA, 25 bp, Mus musculus
gccagccaccttcagtgatagcata

SEQ ID NO: 547693 - DNA, 25 bp, Mus musculus
gccagccaccttgagtgatagcata

SEQ ID NO: 547694 - DNA, 25 bp, Mus musculus
gccagccacgctaggatatgccaga

SEQ ID NO: 547695 - DNA, 25 bp, Mus musculus
gccagccacgcttggatatgccaga

SEQ ID NO: 547696 - DNA, 25 bp, Mus musculus
gccagccacttaactgtgtcttgaa

SEQ ID NO: 547697 - DNA, 25 bp, Mus musculus
gccagccacttatctgtgtcttgaa

SEQ ID NO: 547698 - DNA, 25 bp, Mus musculus
gccagccagagcacatagctgtgat

SEQ ID NO: 547699 - DNA, 25 bp, Mus musculus
gccagccagagctcatagctgtgat

SEQ ID NO: 547700 - DNA, 25 bp, Mus musculus
gccagccagatgcaatgtgactctt

SEQ ID NO: 547701 - DNA, 25 bp, Mus musculus
gccagccagatggaatgtgactctt

SEQ ID NO: 547702 - DNA, 25 bp, Mus musculus
gccagccagattctctgggacattt

SEQ ID NO: 547703 - DNA, 25 bp, Mus musculus
gccagccagattgtctgggacattt

SEQ ID NO: 547704 - DNA, 25 bp, Mus musculus
gccagccagcctagggcgggacact

SEQ ID NO: 547705 - DNA, 25 bp, Mus musculus
gccagccagccttgggcgggacact

SEQ ID NO: 547706 - DNA, 25 bp, Mus musculus
gccagccagctgatccctgtgggat

SEQ ID NO: 547707 - DNA, 25 bp, Mus musculus
gccagccagctgatggcaattaaaa

SEQ ID NO: 547708 - DNA, 25 bp, Mus musculus
gccagccagctgttccctgtgggat

SEQ ID NO: 547709 - DNA, 25 bp, Mus musculus
gccagccagctgttggcaattaaaa

SEQ ID NO: 547710 - DNA, 25 bp, Mus musculus
gccagccaggcaatttagtgagtcc

SEQ ID NO: 547711 - DNA, 25 bp, Mus musculus
gccagccaggcattttagtgagtcc

SEQ ID NO: 547712 - DNA, 25 bp, Mus musculus
gccagccagggaagtgaagtcagtc

SEQ ID NO: 547713 - DNA, 25 bp, Mus musculus
gccagccagggatgtgaagtcagtc

SEQ ID NO: 547714 - DNA, 25 bp, Mus musculus
gccagccagggtctaccaggtgaaa

SEQ ID NO: 547715 - DNA, 25 bp, Mus musculus
gccagccagggtgtaccaggtgaaa

SEQ ID NO: 547716 - DNA, 25 bp, Mus musculus
gccagccaggtgaggagtccaaact

SEQ ID NO: 547717 - DNA, 25 bp, Mus musculus
gccagccaggtgtggagtccaaact

SEQ ID NO: 547718 - DNA, 25 bp, Mus musculus
gccagccaggttatgcggatcgatc

SEQ ID NO: 547719 - DNA, 25 bp, Mus musculus
gccagccaggttttgcggatcgatc

SEQ ID NO: 547720 - DNA, 25 bp, Mus musculus
gccagccagtacaggagatctttga

SEQ ID NO: 547721 - DNA, 25 bp, Mus musculus
gccagccagtacctgagagtaggaa

SEQ ID NO: 547722 - DNA, 25 bp, Mus musculus
gccagccagtacgtgagagtaggaa

SEQ ID NO: 547723 - DNA, 25 bp, Mus musculus
gccagccagtactggagatctttga

SEQ ID NO: 547724 - DNA, 25 bp, Mus musculus
gccagccatatcctgacattactgt

SEQ ID NO: 547725 - DNA, 25 bp, Mus musculus
gccagccatatcgtgacattactgt

SEQ ID NO: 547726 - DNA, 25 bp, Mus musculus
gccagccatgctaggaaaggcaaat

SEQ ID NO: 547727 - DNA, 25 bp, Mus musculus
gccagccatgcttggaaaggcaaat

SEQ ID NO: 547728 - DNA, 25 bp, Mus musculus
gccagccatggaatccaggctatat

SEQ ID NO: 547729 - DNA, 25 bp, Mus musculus
gccagccatggattccaggctatat

SEQ ID NO: 547730 - DNA, 25 bp, Mus musculus
gccagccatgtaaagggtgttttta

SEQ ID NO: 547731 - DNA, 25 bp, Mus musculus
gccagccatgtatagggtgttttta

SEQ ID NO: 547732 - DNA, 25 bp, Mus musculus
gccagccatttacagaagtcttaaa

SEQ ID NO: 547733 - DNA, 25 bp, Mus musculus
gccagccatttagagaagtcttaaa

SEQ ID NO: 547734 - DNA, 25 bp, Mus musculus
gccagcccaataaataaacgtccca

SEQ ID NO: 547735 - DNA, 25 bp, Mus musculus
gccagcccaatatataaacgtccca

SEQ ID NO: 547736 - DNA, 25 bp, Mus musculus
gccagcccactaaccaaattattta

SEQ ID NO: 547737 - DNA, 25 bp, Mus musculus
gccagcccactatccaaattattta

SEQ ID NO: 547738 - DNA, 25 bp, Mus musculus
gccagcccagaacagtgtatttttc

SEQ ID NO: 547739 - DNA, 25 bp, Mus musculus
gccagcccagaagagtgtatttttc

SEQ ID NO: 547740 - DNA, 25 bp, Mus musculus
gccagcccagagctggtaactgaca

SEQ ID NO: 547741 - DNA, 25 bp, Mus musculus
gccagcccagaggtggtaactgaca

SEQ ID NO: 547742 - DNA, 25 bp, Mus musculus
gccagcccatctcgtaataaacttg

SEQ ID NO: 547743 - DNA, 25 bp, Mus musculus
gccagcccatctggtaataaacttg

SEQ ID NO: 547744 - DNA, 25 bp, Mus musculus
gccagccccaataataagactttat

SEQ ID NO: 547745 - DNA, 25 bp, Mus musculus
gccagccccaattataagactttat

SEQ ID NO: 547746 - DNA, 25 bp, Mus musculus
gccagcccctctctgtgctcagcgc

SEQ ID NO: 547747 - DNA, 25 bp, Mus musculus
gccagcccctctgtgtgctcagcgc

SEQ ID NO: 547748 - DNA, 25 bp, Mus musculus
gccagccccttaatatatacactta

SEQ ID NO: 547749 - DNA, 25 bp, Mus musculus
gccagccccttattatatacactta

SEQ ID NO: 547750 - DNA, 25 bp, Mus musculus
gccagcccggtcaatctagcaagta

SEQ ID NO: 547751 - DNA, 25 bp, Mus musculus
gccagcccggtctatctagcaagta

SEQ ID NO: 547752 - DNA, 25 bp, Mus musculus
gccagcccgttcatgcgtttaaaga

SEQ ID NO: 547753 - DNA, 25 bp, Mus musculus
gccagcccgttcttgcgtttaaaga

SEQ ID NO: 547754 - DNA, 25 bp, Mus musculus
gccagccctacacatttgatatcaa

SEQ ID NO: 547755 - DNA, 25 bp, Mus musculus
gccagccctacagatttgatatcaa

SEQ ID NO: 547756 - DNA, 25 bp, Mus musculus
gccagccctctgcagaatagcaaaa

SEQ ID NO: 547757 - DNA, 25 bp, Mus musculus
gccagccctctggagaatagcaaaa

SEQ ID NO: 547758 - DNA, 25 bp, Mus musculus
gccagccctgctacagagagtttta

SEQ ID NO: 547759 - DNA, 25 bp, Mus musculus
gccagccctgcttcagagagtttta

SEQ ID NO: 547760 - DNA, 25 bp, Mus musculus
gccagccctggcaatgtattgaatt

SEQ ID NO: 547761 - DNA, 25 bp, Mus musculus
gccagccctggctatgtattgaatt

SEQ ID NO: 547762 - DNA, 25 bp, Mus musculus
gccagccctgtgctttcttttgtcc

SEQ ID NO: 547763 - DNA, 25 bp, Mus musculus
gccagccctgtggtttcttttgtcc

SEQ ID NO: 547764 - DNA, 25 bp, Mus musculus
gccagcccttgtctggtgttccaaa

SEQ ID NO: 547765 - DNA, 25 bp, Mus musculus
gccagcccttgtgtggtgttccaaa

SEQ ID NO: 547766 - DNA, 25 bp, Mus musculus
gccagccctttcagtaaacactcaa

SEQ ID NO: 547767 - DNA, 25 bp, Mus musculus
gccagccctttctgtaaacactcaa

SEQ ID NO: 547768 - DNA, 25 bp, Mus musculus
gccagccgggtcatatggctcagat

SEQ ID NO: 547769 - DNA, 25 bp, Mus musculus
gccagccgggtcttatggctcagat

SEQ ID NO: 547770 - DNA, 25 bp, Mus musculus
gccagccggtgtacacttacaacaa

SEQ ID NO: 547771 - DNA, 25 bp, Mus musculus
gccagccggtgttcacttacaacaa

SEQ ID NO: 547772 - DNA, 25 bp, Mus musculus
gccagccgtcaccattctggatagt

SEQ ID NO: 547773 - DNA, 25 bp, Mus musculus
gccagccgtcacgattctggatagt

SEQ ID NO: 547774 - DNA, 25 bp, Mus musculus
gccagcctaggcagacactatgtca

SEQ ID NO: 547775 - DNA, 25 bp, Mus musculus
gccagcctaggctgacactatgtca

SEQ ID NO: 547776 - DNA, 25 bp, Mus musculus
gccagcctagtgaaatcagcaaacg

SEQ ID NO: 547777 - DNA, 25 bp, Mus musculus
gccagcctagtgtaatcagcaaacg

SEQ ID NO: 547778 - DNA, 25 bp, Mus musculus
gccagcctatatagacagaccctgt

SEQ ID NO: 547779 - DNA, 25 bp, Mus musculus
gccagcctatattgacagaccctgt

SEQ ID NO: 547780 - DNA, 25 bp, Mus musculus
gccagcctcagtctttgtgttgtat

SEQ ID NO: 547781 - DNA, 25 bp, Mus musculus
gccagcctcagtgtttgtgttgtat

SEQ ID NO: 547782 - DNA, 25 bp, Mus musculus
gccagcctccctacattctttattt

SEQ ID NO: 547783 - DNA, 25 bp, Mus musculus
gccagcctcccttcattctttattt

SEQ ID NO: 547784 - DNA, 25 bp, Mus musculus
gccagcctcggcaatttagtgagaa

SEQ ID NO: 547785 - DNA, 25 bp, Mus musculus
gccagcctcggctatttagtgagaa

SEQ ID NO: 547786 - DNA, 25 bp, Mus musculus
gccagcctctgaatttgcacatttt

SEQ ID NO: 547787 - DNA, 25 bp, Mus musculus
gccagcctctgattttgcacatttt

SEQ ID NO: 547788 - DNA, 25 bp, Mus musculus
gccagcctctggaacataagcagct

SEQ ID NO: 547789 - DNA, 25 bp, Mus musculus
gccagcctctggtacataagcagct

SEQ ID NO: 547790 - DNA, 25 bp, Mus musculus
gccagcctgagccatataactgagc

SEQ ID NO: 547791 - DNA, 25 bp, Mus musculus
gccagcctgagcgatataactgagc

SEQ ID NO: 547792 - DNA, 25 bp, Mus musculus
gccagcctgcagatgaacctcaaaa

SEQ ID NO: 547793 - DNA, 25 bp, Mus musculus
gccagcctgcagttgaacctcaaaa

SEQ ID NO: 547794 - DNA, 25 bp, Mus musculus
gccagcctggcaaaaaagttccgtt

SEQ ID NO: 547795 - DNA, 25 bp, Mus musculus
gccagcctggcataaaagttccgtt

SEQ ID NO: 547796 - DNA, 25 bp, Mus musculus
gccagcctggctcaatttgctatga

SEQ ID NO: 547797 - DNA, 25 bp, Mus musculus
gccagcctggctgaatttgctatga

SEQ ID NO: 547798 - DNA, 25 bp, Mus musculus
gccagcctgggtaactgttgtgaga

SEQ ID NO: 547799 - DNA, 25 bp, Mus musculus
gccagcctgggtatcttaagaccaa

SEQ ID NO: 547800 - DNA, 25 bp, Mus musculus
gccagcctgggttactgttgtgaga

SEQ ID NO: 547801 - DNA, 25 bp, Mus musculus
gccagcctgggtttcttaagaccaa

SEQ ID NO: 547802 - DNA, 25 bp, Mus musculus
gccagcctggtgagccggaaacgaa

SEQ ID NO: 547803 - DNA, 25 bp, Mus musculus
gccagcctggtgtgccggaaacgaa

SEQ ID NO: 547804 - DNA, 25 bp, Mus musculus
gccagcctgtggaaactctttttga

SEQ ID NO: 547805 - DNA, 25 bp, Mus musculus
gccagcctgtggacctatcagtgaa

SEQ ID NO: 547806 - DNA, 25 bp, Mus musculus
gccagcctgtggtaactctttttga

SEQ ID NO: 547807 - DNA, 25 bp, Mus musculus
gccagcctgtggtcctatcagtgaa

SEQ ID NO: 547808 - DNA, 25 bp, Mus musculus
gccagcctgtgtccttgtgggaaca

SEQ ID NO: 547809 - DNA, 25 bp, Mus musculus
gccagcctgtgtgcttgtgggaaca

SEQ ID NO: 547810 - DNA, 25 bp, Mus musculus
gccagccttagaaaatagcaagaat

SEQ ID NO: 547811 - DNA, 25 bp, Mus musculus
gccagccttagactactctagcctg

SEQ ID NO: 547812 - DNA, 25 bp, Mus musculus
gccagccttagagtactctagcctg

SEQ ID NO: 547813 - DNA, 25 bp, Mus musculus
gccagccttagataatagcaagaat

SEQ ID NO: 547814 - DNA, 25 bp, Mus musculus
gccagccttcgacagtttctagaaa

SEQ ID NO: 547815 - DNA, 25 bp, Mus musculus
gccagccttcgagagtttctagaaa

SEQ ID NO: 547816 - DNA, 25 bp, Mus musculus
gccagccttggcatcacagcagatt

SEQ ID NO: 547817 - DNA, 25 bp, Mus musculus
gccagccttggccacattgagatgg

SEQ ID NO: 547818 - DNA, 25 bp, Mus musculus
gccagccttggcgacattgagatgg

SEQ ID NO: 547819 - DNA, 25 bp, Mus musculus
gccagccttggcttcacagcagatt

SEQ ID NO: 547820 - DNA, 25 bp, Mus musculus
gccagccttgtcaatacaaaagtga

SEQ ID NO: 547821 - DNA, 25 bp, Mus musculus
gccagccttgtcaatgtagcatgtt

SEQ ID NO: 547822 - DNA, 25 bp, Mus musculus
gccagccttgtctatacaaaagtga

SEQ ID NO: 547823 - DNA, 25 bp, Mus musculus
gccagccttgtctatgtagcatgtt

SEQ ID NO: 547824 - DNA, 25 bp, Mus musculus
gccagccttgtgattccagacgtaa

SEQ ID NO: 547825 - DNA, 25 bp, Mus musculus
gccagccttgtgtttccagacgtaa

SEQ ID NO: 547826 - DNA, 25 bp, Mus musculus
gccagcctttggatagcatcagcag

SEQ ID NO: 547827 - DNA, 25 bp, Mus musculus
gccagcctttggttagcatcagcag

SEQ ID NO: 547828 - DNA, 25 bp, Mus musculus
gccagcgagatgactcggcttgtaa

SEQ ID NO: 547829 - DNA, 25 bp, Mus musculus
gccagcgagatgtctcggcttgtaa

SEQ ID NO: 547830 - DNA, 25 bp, Mus musculus
gccagcgaggacataagcgcttcca

SEQ ID NO: 547831 - DNA, 25 bp, Mus musculus
gccagcgaggacttaagcgcttcca

SEQ ID NO: 547832 - DNA, 25 bp, Mus musculus
gccagcgatatgagtctgttaatca

SEQ ID NO: 547833 - DNA, 25 bp, Mus musculus
gccagcgatatgtgtctgttaatca

SEQ ID NO: 547834 - DNA, 25 bp, Mus musculus
gccagcgcacgtccatagatacctg

SEQ ID NO: 547835 - DNA, 25 bp, Mus musculus
gccagcgcacgtgcatagatacctg

SEQ ID NO: 547836 - DNA, 25 bp, Mus musculus
gccagcgcctgtcaccaaatagagt

SEQ ID NO: 547837 - DNA, 25 bp, Mus musculus
gccagcgcctgtgaccaaatagagt

SEQ ID NO: 547838 - DNA, 25 bp, Mus musculus
gccagcggaaatcccctcctgtcct

SEQ ID NO: 547839 - DNA, 25 bp, Mus musculus
gccagcggaaatgccctcctgtcct

SEQ ID NO: 547840 - DNA, 25 bp, Mus musculus
gccagcggagaacactagcccagtt

SEQ ID NO: 547841 - DNA, 25 bp, Mus musculus
gccagcggagaagactagcccagtt

SEQ ID NO: 547842 - DNA, 25 bp, Mus musculus
gccagcgggcctctagccaaaggaa

SEQ ID NO: 547843 - DNA, 25 bp, Mus musculus
gccagcgggcctgtagccaaaggaa

SEQ ID NO: 547844 - DNA, 25 bp, Mus musculus
gccagcgggttcaccagatcctgaa

SEQ ID NO: 547845 - DNA, 25 bp, Mus musculus
gccagcgggttctccagatcctgaa

SEQ ID NO: 547846 - DNA, 25 bp, Mus musculus
gccagcggttctacacagacaatgt

SEQ ID NO: 547847 - DNA, 25 bp, Mus musculus
gccagcggttcttcacagacaatgt

SEQ ID NO: 547848 - DNA, 25 bp, Mus musculus
gccagcgtacacatcagggcttagg

SEQ ID NO: 547849 - DNA, 25 bp, Mus musculus
gccagcgtacacttcagggcttagg

SEQ ID NO: 547850 - DNA, 25 bp, Mus musculus
gccagcgtcaagctaccaagatctt

SEQ ID NO: 547851 - DNA, 25 bp, Mus musculus
gccagcgtcaaggtaccaagatctt

SEQ ID NO: 547852 - DNA, 25 bp, Mus musculus
gccagcgtgacacgcctgaaagcat

SEQ ID NO: 547853 - DNA, 25 bp, Mus musculus
gccagcgtgacaggcctgaaagcat

SEQ ID NO: 547854 - DNA, 25 bp, Mus musculus
gccagcgtgcagcattcaggttatt

SEQ ID NO: 547855 - DNA, 25 bp, Mus musculus
gccagcgtgcaggattcaggttatt

SEQ ID NO: 547856 - DNA, 25 bp, Mus musculus
gccagcgtgggcaattttgagactc

SEQ ID NO: 547857 - DNA, 25 bp, Mus musculus
gccagcgtgggctattttgagactc

SEQ ID NO: 547858 - DNA, 25 bp, Mus musculus
gccagcgttaacagcatgtatctca

SEQ ID NO: 547859 - DNA, 25 bp, Mus musculus
gccagcgttaactgcatgtatctca

SEQ ID NO: 547860 - DNA, 25 bp, Mus musculus
gccagcgttcatccaatggaggttt

SEQ ID NO: 547861 - DNA, 25 bp, Mus musculus
gccagcgttcatgcaatggaggttt

SEQ ID NO: 547862 - DNA, 25 bp, Mus musculus
gccagctaatgtatctgccaaactg

SEQ ID NO: 547863 - DNA, 25 bp, Mus musculus
gccagctaatgtttctgccaaactg

SEQ ID NO: 547864 - DNA, 25 bp, Mus musculus
gccagctacattagtgacaccctgt

SEQ ID NO: 547865 - DNA, 25 bp, Mus musculus
gccagctacatttgtgacaccctgt

SEQ ID NO: 547866 - DNA, 25 bp, Mus musculus
gccagctaccagcttgcctattgag

SEQ ID NO: 547867 - DNA, 25 bp, Mus musculus
gccagctaccaggttgcctattgag

SEQ ID NO: 547868 - DNA, 25 bp, Mus musculus
gccagctacccaatgagaatgtgtt

SEQ ID NO: 547869 - DNA, 25 bp, Mus musculus
gccagctacccattgagaatgtgtt

SEQ ID NO: 547870 - DNA, 25 bp, Mus musculus
gccagctaccttattagtcaagaca

SEQ ID NO: 547871 - DNA, 25 bp, Mus musculus
gccagctacctttttagtcaagaca

SEQ ID NO: 547872 - DNA, 25 bp, Mus musculus
gccagctactggagggcagtcatct

SEQ ID NO: 547873 - DNA, 25 bp, Mus musculus
gccagctactggtgggcagtcatct

SEQ ID NO: 547874 - DNA, 25 bp, Mus musculus
gccagctagaaaaaagcccggcagc

SEQ ID NO: 547875 - DNA, 25 bp, Mus musculus
gccagctagaaataagcccggcagc

SEQ ID NO: 547876 - DNA, 25 bp, Mus musculus
gccagctagagtaatatgagacctt

SEQ ID NO: 547877 - DNA, 25 bp, Mus musculus
gccagctagagttatatgagacctt

SEQ ID NO: 547878 - DNA, 25 bp, Mus musculus
gccagctaggtgcaaaataacgcaa

SEQ ID NO: 547879 - DNA, 25 bp, Mus musculus
gccagctaggtggaaaataacgcaa

SEQ ID NO: 547880 - DNA, 25 bp, Mus musculus
gccagctatcaacttctgtctgttg

SEQ ID NO: 547881 - DNA, 25 bp, Mus musculus
gccagctatcaagttctgtctgttg

SEQ ID NO: 547882 - DNA, 25 bp, Mus musculus
gccagctatctgctctttataacaa

SEQ ID NO: 547883 - DNA, 25 bp, Mus musculus
gccagctatctggtctttataacaa

SEQ ID NO: 547884 - DNA, 25 bp, Mus musculus
gccagctcaattctacgttatatgt

SEQ ID NO: 547885 - DNA, 25 bp, Mus musculus
gccagctcaattgtacgttatatgt

SEQ ID NO: 547886 - DNA, 25 bp, Mus musculus
gccagctcacctagccattctttag

SEQ ID NO: 547887 - DNA, 25 bp, Mus musculus
gccagctcaccttgccattctttag

SEQ ID NO: 547888 - DNA, 25 bp, Mus musculus
gccagctcactgaagatctgattgg

SEQ ID NO: 547889 - DNA, 25 bp, Mus musculus
gccagctcactgtagatctgattgg

SEQ ID NO: 547890 - DNA, 25 bp, Mus musculus
gccagctcataacgatgcaccgggt

SEQ ID NO: 547891 - DNA, 25 bp, Mus musculus
gccagctcataaggatgcaccgggt

SEQ ID NO: 547892 - DNA, 25 bp, Mus musculus
gccagctcccaactgtatgttgaat

SEQ ID NO: 547893 - DNA, 25 bp, Mus musculus
gccagctcccaagtgtatgttgaat

SEQ ID NO: 547894 - DNA, 25 bp, Mus musculus
gccagctcctgccaaattaagtact

SEQ ID NO: 547895 - DNA, 25 bp, Mus musculus
gccagctcctgcgaaattaagtact

SEQ ID NO: 547896 - DNA, 25 bp, Mus musculus
gccagctcgggcaaatttgcggact

SEQ ID NO: 547897 - DNA, 25 bp, Mus musculus
gccagctcgggctaatttgcggact

SEQ ID NO: 547898 - DNA, 25 bp, Mus musculus
gccagctctcatctttgaagtctta

SEQ ID NO: 547899 - DNA, 25 bp, Mus musculus
gccagctctcatgtttgaagtctta

SEQ ID NO: 547900 - DNA, 25 bp, Mus musculus
gccagctctggaacagcttttcaaa

SEQ ID NO: 547901 - DNA, 25 bp, Mus musculus
gccagctctggatcagcttttcaaa

SEQ ID NO: 547902 - DNA, 25 bp, Mus musculus
gccagctctggcaatatgaacgaca

SEQ ID NO: 547903 - DNA, 25 bp, Mus musculus
gccagctctggctatatgaacgaca

SEQ ID NO: 547904 - DNA, 25 bp, Mus musculus
gccagctctgggagtcacctgtaat

SEQ ID NO: 547905 - DNA, 25 bp, Mus musculus
gccagctctgggtgtcacctgtaat

SEQ ID NO: 547906 - DNA, 25 bp, Mus musculus
gccagctgaagtcatccctcagaga

SEQ ID NO: 547907 - DNA, 25 bp, Mus musculus
gccagctgaagtgatccctcagaga

SEQ ID NO: 547908 - DNA, 25 bp, Mus musculus
gccagctgagacaggcgattgtgct

SEQ ID NO: 547909 - DNA, 25 bp, Mus musculus
gccagctgagactggcgattgtgct

SEQ ID NO: 547910 - DNA, 25 bp, Mus musculus
gccagctgatctatcctcagaaaca

SEQ ID NO: 547911 - DNA, 25 bp, Mus musculus
gccagctgatctttcctcagaaaca

SEQ ID NO: 547912 - DNA, 25 bp, Mus musculus
gccagctgcactactatacagaggc

SEQ ID NO: 547913 - DNA, 25 bp, Mus musculus
gccagctgcacttctatacagaggc

SEQ ID NO: 547914 - DNA, 25 bp, Mus musculus
gccagctgcgtgactagtttggagt

SEQ ID NO: 547915 - DNA, 25 bp, Mus musculus
gccagctgcgtgtctagtttggagt

SEQ ID NO: 547916 - DNA, 25 bp, Mus musculus
gccagctgctggaatcatataggtc

SEQ ID NO: 547917 - DNA, 25 bp, Mus musculus
gccagctgctggtatcatataggtc

SEQ ID NO: 547918 - DNA, 25 bp, Mus musculus
gccagctggagtatgcagccgagta

SEQ ID NO: 547919 - DNA, 25 bp, Mus musculus
gccagctggagtttgcagccgagta

SEQ ID NO: 547920 - DNA, 25 bp, Mus musculus
gccagctgggagcaacttttgcaac

SEQ ID NO: 547921 - DNA, 25 bp, Mus musculus
gccagctgggaggaacttttgcaac

SEQ ID NO: 547922 - DNA, 25 bp, Mus musculus
gccagctgggatcgagacccctgaa

SEQ ID NO: 547923 - DNA, 25 bp, Mus musculus
gccagctgggatggagacccctgaa

SEQ ID NO: 547924 - DNA, 25 bp, Mus musculus
gccagctgggctacacgaggctctg

SEQ ID NO: 547925 - DNA, 25 bp, Mus musculus
gccagctgggcttcacgaggctctg

SEQ ID NO: 547926 - DNA, 25 bp, Mus musculus
gccagctgtcttaaggtaggcagga

SEQ ID NO: 547927 - DNA, 25 bp, Mus musculus
gccagctgtcttagtctacatagaa

SEQ ID NO: 547928 - DNA, 25 bp, Mus musculus
gccagctgtctttaggtaggcagga

SEQ ID NO: 547929 - DNA, 25 bp, Mus musculus
gccagctgtctttgtctacatagaa

SEQ ID NO: 547930 - DNA, 25 bp, Mus musculus
gccagctgtggtcgaccttcctaag

SEQ ID NO: 547931 - DNA, 25 bp, Mus musculus
gccagctgtggtggaccttcctaag

SEQ ID NO: 547932 - DNA, 25 bp, Mus musculus
gccagctgttggcaattaaaaccca

SEQ ID NO: 547933 - DNA, 25 bp, Mus musculus
gccagctgttgggaattaaaaccca

SEQ ID NO: 547934 - DNA, 25 bp, Mus musculus
gccagcttaccaatcccatttgatg

SEQ ID NO: 547935 - DNA, 25 bp, Mus musculus
gccagcttaccattcccatttgatg

SEQ ID NO: 547936 - DNA, 25 bp, Mus musculus
gccagcttcctccaagatgaacttt

SEQ ID NO: 547937 - DNA, 25 bp, Mus musculus
gccagcttcctcgaagatgaacttt

SEQ ID NO: 547938 - DNA, 25 bp, Mus musculus
gccagcttcgataaggccaagctga

SEQ ID NO: 547939 - DNA, 25 bp, Mus musculus
gccagcttcgattaggccaagctga

SEQ ID NO: 547940 - DNA, 25 bp, Mus musculus
gccagcttcgcaagccatgtttaat

SEQ ID NO: 547941 - DNA, 25 bp, Mus musculus
gccagcttcgcatgccatgtttaat

SEQ ID NO: 547942 - DNA, 25 bp, Mus musculus
gccagcttctcgatgacagactatg

SEQ ID NO: 547943 - DNA, 25 bp, Mus musculus
gccagcttctcgttgacagactatg

SEQ ID NO: 547944 - DNA, 25 bp, Mus musculus
gccagcttctgtacgttacgtcctt

SEQ ID NO: 547945 - DNA, 25 bp, Mus musculus
gccagcttctgttcgttacgtcctt

SEQ ID NO: 547946 - DNA, 25 bp, Mus musculus
gccagcttcttaccgtgggtgaata

SEQ ID NO: 547947 - DNA, 25 bp, Mus musculus
gccagcttcttagcgtgggtgaata

SEQ ID NO: 547948 - DNA, 25 bp, Mus musculus
gccagcttcttgctttcctagggcc

SEQ ID NO: 547949 - DNA, 25 bp, Mus musculus
gccagcttcttggtttcctagggcc

SEQ ID NO: 547950 - DNA, 25 bp, Mus musculus
gccagcttctttatcgggaaatcca

SEQ ID NO: 547951 - DNA, 25 bp, Mus musculus
gccagcttctttttcgggaaatcca

SEQ ID NO: 547952 - DNA, 25 bp, Mus musculus
gccagcttgactagaaaaccaaacc

SEQ ID NO: 547953 - DNA, 25 bp, Mus musculus
gccagcttgacttgaaaaccaaacc

SEQ ID NO: 547954 - DNA, 25 bp, Mus musculus
gccagcttgatgaggaccgcagtct

SEQ ID NO: 547955 - DNA, 25 bp, Mus musculus
gccagcttgatgtggaccgcagtct

SEQ ID NO: 547956 - DNA, 25 bp, Mus musculus
gccagcttgctgatgtcaacaatct

SEQ ID NO: 547957 - DNA, 25 bp, Mus musculus
gccagcttgctgttgtcaacaatct

SEQ ID NO: 547958 - DNA, 25 bp, Mus musculus
gccagcttgggcaatttaatgagac

SEQ ID NO: 547959 - DNA, 25 bp, Mus musculus
gccagcttgggctatttaatgagac

SEQ ID NO: 547960 - DNA, 25 bp, Mus musculus
gccagctttgaaatcttggcttcta

SEQ ID NO: 547961 - DNA, 25 bp, Mus musculus
gccagctttgaattcttggcttcta

SEQ ID NO: 547962 - DNA, 25 bp, Mus musculus
gccagctttggtctcagatctgaaa

SEQ ID NO: 547963 - DNA, 25 bp, Mus musculus
gccagctttggtgtcagatctgaaa

SEQ ID NO: 547964 - DNA, 25 bp, Mus musculus
gccagctttgtgatctgaaccgagg

SEQ ID NO: 547965 - DNA, 25 bp, Mus musculus
gccagctttgtgttctgaaccgagg

SEQ ID NO: 547966 - DNA, 25 bp, Mus musculus
gccaggaaacataggatggcatttc

SEQ ID NO: 547967 - DNA, 25 bp, Mus musculus
gccaggaaacattggatggcatttc

SEQ ID NO: 547968 - DNA, 25 bp, Mus musculus
gccaggaacagaatgaagcccttct

SEQ ID NO: 547969 - DNA, 25 bp, Mus musculus
gccaggaacagaatgccaagagacg

SEQ ID NO: 547970 - DNA, 25 bp, Mus musculus
gccaggaacagattgaagcccttct

SEQ ID NO: 547971 - DNA, 25 bp, Mus musculus
gccaggaacagattgccaagagacg

SEQ ID NO: 547972 - DNA, 25 bp, Mus musculus
gccaggaacccaatctaaagaaagg

SEQ ID NO: 547973 - DNA, 25 bp, Mus musculus
gccaggaacccattctaaagaaagg

SEQ ID NO: 547974 - DNA, 25 bp, Mus musculus
gccaggaaccgaaagccaattgaaa

SEQ ID NO: 547975 - DNA, 25 bp, Mus musculus
gccaggaaccgatagccaattgaaa

SEQ ID NO: 547976 - DNA, 25 bp, Mus musculus
gccaggaacctcacctgctcatgag

SEQ ID NO: 547977 - DNA, 25 bp, Mus musculus
gccaggaacctcacttgagccatta

SEQ ID NO: 547978 - DNA, 25 bp, Mus musculus
gccaggaacctctcctgctcatgag

SEQ ID NO: 547979 - DNA, 25 bp, Mus musculus
gccaggaacctctcttgagccatta

SEQ ID NO: 547980 - DNA, 25 bp, Mus musculus
gccaggaactcccacataattatca

SEQ ID NO: 547981 - DNA, 25 bp, Mus musculus
gccaggaactccgacataattatca

SEQ ID NO: 547982 - DNA, 25 bp, Mus musculus
gccaggaacttgcaatttctgcctt

SEQ ID NO: 547983 - DNA, 25 bp, Mus musculus
gccaggaacttggaatttctgcctt

SEQ ID NO: 547984 - DNA, 25 bp, Mus musculus
gccaggaagggcaaatttcacagta

SEQ ID NO: 547985 - DNA, 25 bp, Mus musculus
gccaggaagggctaatttcacagta

SEQ ID NO: 547986 - DNA, 25 bp, Mus musculus
gccaggaagttaatttggaggtccg

SEQ ID NO: 547987 - DNA, 25 bp, Mus musculus
gccaggaagttattttggaggtccg

SEQ ID NO: 547988 - DNA, 25 bp, Mus musculus
gccaggaatcaaacagccatcttaa

SEQ ID NO: 547989 - DNA, 25 bp, Mus musculus
gccaggaatcaatcagccatcttaa

SEQ ID NO: 547990 - DNA, 25 bp, Mus musculus
gccaggaattctcaataaaattttt

SEQ ID NO: 547991 - DNA, 25 bp, Mus musculus
gccaggaattctgaataaaattttt

SEQ ID NO: 547992 - DNA, 25 bp, Mus musculus
gccaggacaatgatagctagacttt

SEQ ID NO: 547993 - DNA, 25 bp, Mus musculus
gccaggacaatgttagctagacttt

SEQ ID NO: 547994 - DNA, 25 bp, Mus musculus
gccaggacactgctgtagatgcctt

SEQ ID NO: 547995 - DNA, 25 bp, Mus musculus
gccaggacactggtgtagatgcctt

SEQ ID NO: 547996 - DNA, 25 bp, Mus musculus
gccaggacaggcatctgttcagagt

SEQ ID NO: 547997 - DNA, 25 bp, Mus musculus
gccaggacaggcttctgttcagagt

SEQ ID NO: 547998 - DNA, 25 bp, Mus musculus
gccaggacagtcagacatcactttg

SEQ ID NO: 547999 - DNA, 25 bp, Mus musculus
gccaggacagtctgacatcactttg

SEQ ID NO: 548000 - DNA, 25 bp, Mus musculus
gccaggacatgcaaccaggatacca

SEQ ID NO: 548001 - DNA, 25 bp, Mus musculus
gccaggacatgctaccaggatacca

SEQ ID NO: 548002 - DNA, 25 bp, Mus musculus
gccaggacatttcaagccatttgca

SEQ ID NO: 548003 - DNA, 25 bp, Mus musculus
gccaggacatttgaagccatttgca

SEQ ID NO: 548004 - DNA, 25 bp, Mus musculus
gccaggacctggacgtcagagcgca

SEQ ID NO: 548005 - DNA, 25 bp, Mus musculus
gccaggacctggcagtgagcagcat

SEQ ID NO: 548006 - DNA, 25 bp, Mus musculus
gccaggacctgggagtgagcagcat

SEQ ID NO: 548007 - DNA, 25 bp, Mus musculus
gccaggacctggtcgtcagagcgca

SEQ ID NO: 548008 - DNA, 25 bp, Mus musculus
gccaggacctttatgcttggacaga

SEQ ID NO: 548009 - DNA, 25 bp, Mus musculus
gccaggacctttctatttcatttca

SEQ ID NO: 548010 - DNA, 25 bp, Mus musculus
gccaggacctttctgcttcataaaa

SEQ ID NO: 548011 - DNA, 25 bp, Mus musculus
gccaggacctttgtatttcatttca

SEQ ID NO: 548012 - DNA, 25 bp, Mus musculus
gccaggacctttgtgcttcataaaa

SEQ ID NO: 548013 - DNA, 25 bp, Mus musculus
gccaggacctttttgcttggacaga

SEQ ID NO: 548014 - DNA, 25 bp, Mus musculus
gccaggactagtccatcccaaggga

SEQ ID NO: 548015 - DNA, 25 bp, Mus musculus
gccaggactagtgcatcccaaggga

SEQ ID NO: 548016 - DNA, 25 bp, Mus musculus
gccaggactgaaatctattagccaa

SEQ ID NO: 548017 - DNA, 25 bp, Mus musculus
gccaggactgaacagttgccagcca

SEQ ID NO: 548018 - DNA, 25 bp, Mus musculus
gccaggactgaagagttgccagcca

SEQ ID NO: 548019 - DNA, 25 bp, Mus musculus
gccaggactgaattctattagccaa

SEQ ID NO: 548020 - DNA, 25 bp, Mus musculus
gccaggactgcacgatcttcagcaa

SEQ ID NO: 548021 - DNA, 25 bp, Mus musculus
gccaggactgcaggatcttcagcaa

SEQ ID NO: 548022 - DNA, 25 bp, Mus musculus
gccaggacttggaatgtgcagagac

SEQ ID NO: 548023 - DNA, 25 bp, Mus musculus
gccaggacttggtatgtgcagagac

SEQ ID NO: 548024 - DNA, 25 bp, Mus musculus
gccaggagaattccttggtctgtgt

SEQ ID NO: 548025 - DNA, 25 bp, Mus musculus
gccaggagaattgcttggtctgtgt

SEQ ID NO: 548026 - DNA, 25 bp, Mus musculus
gccaggagaccaacaaagtgctgct

SEQ ID NO: 548027 - DNA, 25 bp, Mus musculus
gccaggagaccatcaaagtgctgct

SEQ ID NO: 548028 - DNA, 25 bp, Mus musculus
gccaggagacgaccactagaggaaa

SEQ ID NO: 548029 - DNA, 25 bp, Mus musculus
gccaggagacgagcactagaggaaa

SEQ ID NO: 548030 - DNA, 25 bp, Mus musculus
gccaggagactcaaaaggtgcccat

SEQ ID NO: 548031 - DNA, 25 bp, Mus musculus
gccaggagactctaaaggtgcccat

SEQ ID NO: 548032 - DNA, 25 bp, Mus musculus
gccaggagagcccactaatgtctta

SEQ ID NO: 548033 - DNA, 25 bp, Mus musculus
gccaggagagccgactaatgtctta

SEQ ID NO: 548034 - DNA, 25 bp, Mus musculus
gccaggagattaactttctataaat

SEQ ID NO: 548035 - DNA, 25 bp, Mus musculus
gccaggagattatctttctataaat

SEQ ID NO: 548036 - DNA, 25 bp, Mus musculus
gccaggagcacacccacttgagtgc

SEQ ID NO: 548037 - DNA, 25 bp, Mus musculus
gccaggagcacagccacttgagtgc

SEQ ID NO: 548038 - DNA, 25 bp, Mus musculus
gccaggagccaactgacaaagtcaa

SEQ ID NO: 548039 - DNA, 25 bp, Mus musculus
gccaggagccaagtgacaaagtcaa

SEQ ID NO: 548040 - DNA, 25 bp, Mus musculus
gccaggagctgtactgtagcaccat

SEQ ID NO: 548041 - DNA, 25 bp, Mus musculus
gccaggagctgttctgtagcaccat

SEQ ID NO: 548042 - DNA, 25 bp, Mus musculus
gccaggaggtctagactgtggttat

SEQ ID NO: 548043 - DNA, 25 bp, Mus musculus
gccaggaggtcttgactgtggttat

SEQ ID NO: 548044 - DNA, 25 bp, Mus musculus
gccaggagtagtattgcataccttt

SEQ ID NO: 548045 - DNA, 25 bp, Mus musculus
gccaggagtagttttgcataccttt

SEQ ID NO: 548046 - DNA, 25 bp, Mus musculus
gccaggagtctcaagttttgtgatt

SEQ ID NO: 548047 - DNA, 25 bp, Mus musculus
gccaggagtctctagttttgtgatt

SEQ ID NO: 548048 - DNA, 25 bp, Mus musculus
gccaggagtgagctgcccagaacaa

SEQ ID NO: 548049 - DNA, 25 bp, Mus musculus
gccaggagtgaggtgcccagaacaa

SEQ ID NO: 548050 - DNA, 25 bp, Mus musculus
gccaggagtgatcccacatgccttt

SEQ ID NO: 548051 - DNA, 25 bp, Mus musculus
gccaggagtgatgccacatgccttt

SEQ ID NO: 548052 - DNA, 25 bp, Mus musculus
gccaggagtttgatctactttgcca

SEQ ID NO: 548053 - DNA, 25 bp, Mus musculus
gccaggagtttgttctactttgcca

SEQ ID NO: 548054 - DNA, 25 bp, Mus musculus
gccaggatacctccagttagagcac

SEQ ID NO: 548055 - DNA, 25 bp, Mus musculus
gccaggatacctgcagttagagcac

SEQ ID NO: 548056 - DNA, 25 bp, Mus musculus
gccaggatagctctatcaactctat

SEQ ID NO: 548057 - DNA, 25 bp, Mus musculus
gccaggatagctgtatcaactctat

SEQ ID NO: 548058 - DNA, 25 bp, Mus musculus
gccaggataggtctagcttaagcat

SEQ ID NO: 548059 - DNA, 25 bp, Mus musculus
gccaggataggtgtagcttaagcat

SEQ ID NO: 548060 - DNA, 25 bp, Mus musculus
gccaggatatgcacatttcacccat

SEQ ID NO: 548061 - DNA, 25 bp, Mus musculus
gccaggatatgctcatttcacccat

SEQ ID NO: 548062 - DNA, 25 bp, Mus musculus
gccaggatcaaaaaccctatctcag

SEQ ID NO: 548063 - DNA, 25 bp, Mus musculus
gccaggatcaaataccctatctcag

SEQ ID NO: 548064 - DNA, 25 bp, Mus musculus
gccaggatcatccagcagatagttc

SEQ ID NO: 548065 - DNA, 25 bp, Mus musculus
gccaggatcatcgagcagatagttc

SEQ ID NO: 548066 - DNA, 25 bp, Mus musculus
gccaggatccagatgagcagcagag

SEQ ID NO: 548067 - DNA, 25 bp, Mus musculus
gccaggatccagttgagcagcagag

SEQ ID NO: 548068 - DNA, 25 bp, Mus musculus
gccaggatggatacactgctcattg

SEQ ID NO: 548069 - DNA, 25 bp, Mus musculus
gccaggatggattcactgctcattg

SEQ ID NO: 548070 - DNA, 25 bp, Mus musculus
gccaggatgtcaaatctctccatca

SEQ ID NO: 548071 - DNA, 25 bp, Mus musculus
gccaggatgtcatatctctccatca

SEQ ID NO: 548072 - DNA, 25 bp, Mus musculus
gccaggatgtgcaccttgaggtaga

SEQ ID NO: 548073 - DNA, 25 bp, Mus musculus
gccaggatgtgctccttgaggtaga

SEQ ID NO: 548074 - DNA, 25 bp, Mus musculus
gccaggattaccaagtgagatccta

SEQ ID NO: 548075 - DNA, 25 bp, Mus musculus
gccaggattacctagtgagatccta

SEQ ID NO: 548076 - DNA, 25 bp, Mus musculus
gccaggattctacccacttagtcag

SEQ ID NO: 548077 - DNA, 25 bp, Mus musculus
gccaggattctagccacttagtcag

SEQ ID NO: 548078 - DNA, 25 bp, Mus musculus
gccaggattgatcaacgccaccaac

SEQ ID NO: 548079 - DNA, 25 bp, Mus musculus
gccaggattgatgaacgccaccaac

SEQ ID NO: 548080 - DNA, 25 bp, Mus musculus
gccaggattttcacaatgccctaaa

SEQ ID NO: 548081 - DNA, 25 bp, Mus musculus
gccaggattttctcaatgccctaaa

SEQ ID NO: 548082 - DNA, 25 bp, Mus musculus
gccaggcaagaactgcactgtattc

SEQ ID NO: 548083 - DNA, 25 bp, Mus musculus
gccaggcaagaagtgcactgtattc

SEQ ID NO: 548084 - DNA, 25 bp, Mus musculus
gccaggcaaggaattcataggtgat

SEQ ID NO: 548085 - DNA, 25 bp, Mus musculus
gccaggcaaggatttcataggtgat

SEQ ID NO: 548086 - DNA, 25 bp, Mus musculus
gccaggcacaaaattagtctcctca

SEQ ID NO: 548087 - DNA, 25 bp, Mus musculus
gccaggcacaaatttagtctcctca

SEQ ID NO: 548088 - DNA, 25 bp, Mus musculus
gccaggcacggcatacaaatttcga

SEQ ID NO: 548089 - DNA, 25 bp, Mus musculus
gccaggcacggcttacaaatttcga

SEQ ID NO: 548090 - DNA, 25 bp, Mus musculus
gccaggcactggaacataattagtt

SEQ ID NO: 548091 - DNA, 25 bp, Mus musculus
gccaggcactggtacataattagtt

SEQ ID NO: 548092 - DNA, 25 bp, Mus musculus
gccaggcagccaaaaaatatcacgt

SEQ ID NO: 548093 - DNA, 25 bp, Mus musculus
gccaggcagccataaaatatcacgt

SEQ ID NO: 548094 - DNA, 25 bp, Mus musculus
gccaggcagctacctaagcaggttt

SEQ ID NO: 548095 - DNA, 25 bp, Mus musculus
gccaggcagctagctaagcaggttt

SEQ ID NO: 548096 - DNA, 25 bp, Mus musculus
gccaggcatacaacctacagctgtg

SEQ ID NO: 548097 - DNA, 25 bp, Mus musculus
gccaggcatacatcctacagctgtg

SEQ ID NO: 548098 - DNA, 25 bp, Mus musculus
gccaggcatagacgcatgtaatccc

SEQ ID NO: 548099 - DNA, 25 bp, Mus musculus
gccaggcatagaggcatgtaatccc

SEQ ID NO: 548100 - DNA, 25 bp, Mus musculus
gccaggcatgaaatagtctgtgcat

SEQ ID NO: 548101 - DNA, 25 bp, Mus musculus
gccaggcatgaattagtctgtgcat

SEQ ID NO: 548102 - DNA, 25 bp, Mus musculus
gccaggcatggtctttcatgtcagt

SEQ ID NO: 548103 - DNA, 25 bp, Mus musculus
gccaggcatggtgtttcatgtcagt

SEQ ID NO: 548104 - DNA, 25 bp, Mus musculus
gccaggcattctatatttcctgcaa

SEQ ID NO: 548105 - DNA, 25 bp, Mus musculus
gccaggcattctttatttcctgcaa

SEQ ID NO: 548106 - DNA, 25 bp, Mus musculus
gccaggccaaccagtgagacactat

SEQ ID NO: 548107 - DNA, 25 bp, Mus musculus
gccaggccaacctgtgagacactat

SEQ ID NO: 548108 - DNA, 25 bp, Mus musculus
gccaggccaaggagcagtcagttaa

SEQ ID NO: 548109 - DNA, 25 bp, Mus musculus
gccaggccaaggtgcagtcagttaa

SEQ ID NO: 548110 - DNA, 25 bp, Mus musculus
gccaggccagacacaacatcgttta

SEQ ID NO: 548111 - DNA, 25 bp, Mus musculus
gccaggccagactcaacatcgttta

SEQ ID NO: 548112 - DNA, 25 bp, Mus musculus
gccaggccagtgcattacttacaat

SEQ ID NO: 548113 - DNA, 25 bp, Mus musculus
gccaggccagtggattacttacaat

SEQ ID NO: 548114 - DNA, 25 bp, Mus musculus
gccaggcccagtcagtgctggtctt

SEQ ID NO: 548115 - DNA, 25 bp, Mus musculus
gccaggcccagtgagtgctggtctt

SEQ ID NO: 548116 - DNA, 25 bp, Mus musculus
gccaggccctcacttttgagatttg

SEQ ID NO: 548117 - DNA, 25 bp, Mus musculus
gccaggccctcagttttgagatttg

SEQ ID NO: 548118 - DNA, 25 bp, Mus musculus
gccaggccctcgctctgttgggaaa

SEQ ID NO: 548119 - DNA, 25 bp, Mus musculus
gccaggccctcggtctgttgggaaa

SEQ ID NO: 548120 - DNA, 25 bp, Mus musculus
gccaggcctacaaagtcagaccatg

SEQ ID NO: 548121 - DNA, 25 bp, Mus musculus
gccaggcctacatagtcagaccatg

SEQ ID NO: 548122 - DNA, 25 bp, Mus musculus
gccaggcctcacaggagggcagctc

SEQ ID NO: 548123 - DNA, 25 bp, Mus musculus
gccaggcctcactggagggcagctc

SEQ ID NO: 548124 - DNA, 25 bp, Mus musculus
gccaggcctgacacgtttgacagtg

SEQ ID NO: 548125 - DNA, 25 bp, Mus musculus
gccaggcctgactcgtttgacagtg

SEQ ID NO: 548126 - DNA, 25 bp, Mus musculus
gccaggcctggaactttgacagatt

SEQ ID NO: 548127 - DNA, 25 bp, Mus musculus
gccaggcctggatctttgacagatt

SEQ ID NO: 548128 - DNA, 25 bp, Mus musculus
gccaggcctggcatgaacataaagc

SEQ ID NO: 548129 - DNA, 25 bp, Mus musculus
gccaggcctggcttgaacataaagc

SEQ ID NO: 548130 - DNA, 25 bp, Mus musculus
gccaggccttcaattgtcttggaga

SEQ ID NO: 548131 - DNA, 25 bp, Mus musculus
gccaggccttcacctttcagcaggg

SEQ ID NO: 548132 - DNA, 25 bp, Mus musculus
gccaggccttcagctttcagcaggg

SEQ ID NO: 548133 - DNA, 25 bp, Mus musculus
gccaggccttcatttgtcttggaga

SEQ ID NO: 548134 - DNA, 25 bp, Mus musculus
gccaggcgcaggcaaaccttagcat

SEQ ID NO: 548135 - DNA, 25 bp, Mus musculus
gccaggcgcagggaaaccttagcat

SEQ ID NO: 548136 - DNA, 25 bp, Mus musculus
gccaggcggcctctgacagcagcgg

SEQ ID NO: 548137 - DNA, 25 bp, Mus musculus
gccaggcggcctgtgacagcagcgg

SEQ ID NO: 548138 - DNA, 25 bp, Mus musculus
gccaggcgggaaagcagcatctaga

SEQ ID NO: 548139 - DNA, 25 bp, Mus musculus
gccaggcgggaatgcagcatctaga

SEQ ID NO: 548140 - DNA, 25 bp, Mus musculus
gccaggcgggtgaggtacatttcca

SEQ ID NO: 548141 - DNA, 25 bp, Mus musculus
gccaggcgggtgtggtacatttcca

SEQ ID NO: 548142 - DNA, 25 bp, Mus musculus
gccaggcgtctactatagcatcagt

SEQ ID NO: 548143 - DNA, 25 bp, Mus musculus
gccaggcgtctagtatagcatcagt

SEQ ID NO: 548144 - DNA, 25 bp, Mus musculus
gccaggcgtcttcacaaaacttatt

SEQ ID NO: 548145 - DNA, 25 bp, Mus musculus
gccaggcgtcttgacaaaacttatt

SEQ ID NO: 548146 - DNA, 25 bp, Mus musculus
gccaggcgtggcaacacacaccttt

SEQ ID NO: 548147 - DNA, 25 bp, Mus musculus
gccaggcgtggctacacacaccttt

SEQ ID NO: 548148 - DNA, 25 bp, Mus musculus
gccaggcgttttctgagcatacctg

SEQ ID NO: 548149 - DNA, 25 bp, Mus musculus
gccaggcgttttgtgagcatacctg

SEQ ID NO: 548150 - DNA, 25 bp, Mus musculus
gccaggctacagatatgtatgtaat

SEQ ID NO: 548151 - DNA, 25 bp, Mus musculus
gccaggctacagttatgtatgtaat

SEQ ID NO: 548152 - DNA, 25 bp, Mus musculus
gccaggctagaaagcttacactcca

SEQ ID NO: 548153 - DNA, 25 bp, Mus musculus
gccaggctagaatgcttacactcca

SEQ ID NO: 548154 - DNA, 25 bp, Mus musculus
gccaggctagctcccaagggctgaa

SEQ ID NO: 548155 - DNA, 25 bp, Mus musculus
gccaggctagctgccaagggctgaa

SEQ ID NO: 548156 - DNA, 25 bp, Mus musculus
gccaggctagtccagaaccgattaa

SEQ ID NO: 548157 - DNA, 25 bp, Mus musculus
gccaggctagtcgagaaccgattaa

SEQ ID NO: 548158 - DNA, 25 bp, Mus musculus
gccaggctataacaagatacatgac

SEQ ID NO: 548159 - DNA, 25 bp, Mus musculus
gccaggctataagaagatacatgac

SEQ ID NO: 548160 - DNA, 25 bp, Mus musculus
gccaggctatgcagtgggatctcaa

SEQ ID NO: 548161 - DNA, 25 bp, Mus musculus
gccaggctatgctgtgggatctcaa

SEQ ID NO: 548162 - DNA, 25 bp, Mus musculus
gccaggctcgggatgtgtttgcttc

SEQ ID NO: 548163 - DNA, 25 bp, Mus musculus
gccaggctcgggttgtgtttgcttc

SEQ ID NO: 548164 - DNA, 25 bp, Mus musculus
gccaggctctcaagcaaatctgaaa

SEQ ID NO: 548165 - DNA, 25 bp, Mus musculus
gccaggctctcatgcaaatctgaaa

SEQ ID NO: 548166 - DNA, 25 bp, Mus musculus
gccaggctctgtagcagatggttct

SEQ ID NO: 548167 - DNA, 25 bp, Mus musculus
gccaggctctgttgcagatggttct

SEQ ID NO: 548168 - DNA, 25 bp, Mus musculus
gccaggctgagcacgataatcccag

SEQ ID NO: 548169 - DNA, 25 bp, Mus musculus
gccaggctgagctcgataatcccag

SEQ ID NO: 548170 - DNA, 25 bp, Mus musculus
gccaggctgaggacagaaaccagct

SEQ ID NO: 548171 - DNA, 25 bp, Mus musculus
gccaggctgaggtcagaaaccagct

SEQ ID NO: 548172 - DNA, 25 bp, Mus musculus
gccaggctgcaaaagaatgcgagca

SEQ ID NO: 548173 - DNA, 25 bp, Mus musculus
gccaggctgcaatagaatgcgagca

SEQ ID NO: 548174 - DNA, 25 bp, Mus musculus
gccaggctgggaagaagtttcaccc

SEQ ID NO: 548175 - DNA, 25 bp, Mus musculus
gccaggctgggatgaagtttcaccc

SEQ ID NO: 548176 - DNA, 25 bp, Mus musculus
gccaggctgtgcacagtggttgtta

SEQ ID NO: 548177 - DNA, 25 bp, Mus musculus
gccaggctgtgctcagtggttgtta

SEQ ID NO: 548178 - DNA, 25 bp, Mus musculus
gccaggctgtggacaaaatctctat

SEQ ID NO: 548179 - DNA, 25 bp, Mus musculus
gccaggctgtggtcaaaatctctat

SEQ ID NO: 548180 - DNA, 25 bp, Mus musculus
gccaggctgttaaggatccttccga

SEQ ID NO: 548181 - DNA, 25 bp, Mus musculus
gccaggctgttatggatccttccga

SEQ ID NO: 548182 - DNA, 25 bp, Mus musculus
gccaggctgttccacaaagtgagct

SEQ ID NO: 548183 - DNA, 25 bp, Mus musculus
gccaggctgttcgacaaagtgagct

SEQ ID NO: 548184 - DNA, 25 bp, Mus musculus
gccaggcttagccacaacaacttta

SEQ ID NO: 548185 - DNA, 25 bp, Mus musculus
gccaggcttagcgacaacaacttta

SEQ ID NO: 548186 - DNA, 25 bp, Mus musculus
gccaggcttaggagtcatcagagaa

SEQ ID NO: 548187 - DNA, 25 bp, Mus musculus
gccaggcttaggtgtcatcagagaa

SEQ ID NO: 548188 - DNA, 25 bp, Mus musculus
gccaggcttccgacaaaattcaata

SEQ ID NO: 548189 - DNA, 25 bp, Mus musculus
gccaggcttccgtcaaaattcaata

SEQ ID NO: 548190 - DNA, 25 bp, Mus musculus
gccaggcttgataagagttaaaaca

SEQ ID NO: 548191 - DNA, 25 bp, Mus musculus
gccaggcttgattagagttaaaaca

SEQ ID NO: 548192 - DNA, 25 bp, Mus musculus
gccaggcttgccaacaacatttgca

SEQ ID NO: 548193 - DNA, 25 bp, Mus musculus
gccaggcttgccaccaagtgggaat

SEQ ID NO: 548194 - DNA, 25 bp, Mus musculus
gccaggcttgcctacaacatttgca

SEQ ID NO: 548195 - DNA, 25 bp, Mus musculus
gccaggcttgcctccaagtgggaat

SEQ ID NO: 548196 - DNA, 25 bp, Mus musculus
gccaggcttggaaattctatactta

SEQ ID NO: 548197 - DNA, 25 bp, Mus musculus
gccaggcttggatattctatactta

SEQ ID NO: 548198 - DNA, 25 bp, Mus musculus
gccaggcttgggattctttttatag

SEQ ID NO: 548199 - DNA, 25 bp, Mus musculus
gccaggcttgggtttctttttatag

SEQ ID NO: 548200 - DNA, 25 bp, Mus musculus
gccaggctttggctcagagataaac

SEQ ID NO: 548201 - DNA, 25 bp, Mus musculus
gccaggctttgggtcagagataaac

SEQ ID NO: 548202 - DNA, 25 bp, Mus musculus
gccagggaaagtacaaatttacata

SEQ ID NO: 548203 - DNA, 25 bp, Mus musculus
gccagggaaagttcaaatttacata

SEQ ID NO: 548204 - DNA, 25 bp, Mus musculus
gccagggacagaacttcaggacata

SEQ ID NO: 548205 - DNA, 25 bp, Mus musculus
gccagggacagatcttcaggacata

SEQ ID NO: 548206 - DNA, 25 bp, Mus musculus
gccagggacagtctatactttcatc

SEQ ID NO: 548207 - DNA, 25 bp, Mus musculus
gccagggacagtgtatactttcatc

SEQ ID NO: 548208 - DNA, 25 bp, Mus musculus
gccagggactggatttaaccagcca

SEQ ID NO: 548209 - DNA, 25 bp, Mus musculus
gccagggactggttttaaccagcca

SEQ ID NO: 548210 - DNA, 25 bp, Mus musculus
gccagggagagtatcctctgctgct

SEQ ID NO: 548211 - DNA, 25 bp, Mus musculus
gccagggagagtttcctctgctgct

SEQ ID NO: 548212 - DNA, 25 bp, Mus musculus
gccagggaggctattaccaatccta

SEQ ID NO: 548213 - DNA, 25 bp, Mus musculus
gccagggaggcttttaccaatccta

SEQ ID NO: 548214 - DNA, 25 bp, Mus musculus
gccagggagggacgccatcttaacc

SEQ ID NO: 548215 - DNA, 25 bp, Mus musculus
gccagggagggaggccatcttaacc

SEQ ID NO: 548216 - DNA, 25 bp, Mus musculus
gccagggatccccagacttttaaga

SEQ ID NO: 548217 - DNA, 25 bp, Mus musculus
gccagggatcccgagacttttaaga

SEQ ID NO: 548218 - DNA, 25 bp, Mus musculus
gccagggcacatagaacattgctat

SEQ ID NO: 548219 - DNA, 25 bp, Mus musculus
gccagggcacattgaacattgctat

SEQ ID NO: 548220 - DNA, 25 bp, Mus musculus
gccagggcagccacatgaggaccaa

SEQ ID NO: 548221 - DNA, 25 bp, Mus musculus
gccagggcagcctcatgaggaccaa

SEQ ID NO: 548222 - DNA, 25 bp, Mus musculus
gccagggcaggacattacagttatt

SEQ ID NO: 548223 - DNA, 25 bp, Mus musculus
gccagggcaggagattacagttatt

SEQ ID NO: 548224 - DNA, 25 bp, Mus musculus
gccagggcatcaagtattccttcac

SEQ ID NO: 548225 - DNA, 25 bp, Mus musculus
gccagggcatcatgtattccttcac

SEQ ID NO: 548226 - DNA, 25 bp, Mus musculus
gccagggcatgaactgttggtcctt

SEQ ID NO: 548227 - DNA, 25 bp, Mus musculus
gccagggcatgatctgttggtcctt

SEQ ID NO: 548228 - DNA, 25 bp, Mus musculus
gccagggccaaaaagctatgcagaa

SEQ ID NO: 548229 - DNA, 25 bp, Mus musculus
gccagggccaaatagctatgcagaa

SEQ ID NO: 548230 - DNA, 25 bp, Mus musculus
gccagggccacaccttaatactggg

SEQ ID NO: 548231 - DNA, 25 bp, Mus musculus
gccagggccacagcttaatactggg

SEQ ID NO: 548232 - DNA, 25 bp, Mus musculus
gccagggccagtcccttgagcctat

SEQ ID NO: 548233 - DNA, 25 bp, Mus musculus
gccagggccagtgccttgagcctat

SEQ ID NO: 548234 - DNA, 25 bp, Mus musculus
gccagggccatgatgtagacacact

SEQ ID NO: 548235 - DNA, 25 bp, Mus musculus
gccagggccatgttgtagacacact

SEQ ID NO: 548236 - DNA, 25 bp, Mus musculus
gccagggcccaaatcctaagcatgg

SEQ ID NO: 548237 - DNA, 25 bp, Mus musculus
gccagggcccaattcctaagcatgg

SEQ ID NO: 548238 - DNA, 25 bp, Mus musculus
gccagggcccttcgatcccaaataa

SEQ ID NO: 548239 - DNA, 25 bp, Mus musculus
gccagggcccttggatcccaaataa

SEQ ID NO: 548240 - DNA, 25 bp, Mus musculus
gccagggcgcatactgggctcacat

SEQ ID NO: 548241 - DNA, 25 bp, Mus musculus
gccagggcgcattctgggctcacat

SEQ ID NO: 548242 - DNA, 25 bp, Mus musculus
gccagggctattcttgggttccaaa

SEQ ID NO: 548243 - DNA, 25 bp, Mus musculus
gccagggctattgttgggttccaaa

SEQ ID NO: 548244 - DNA, 25 bp, Mus musculus
gccagggctcccacagtgatgcaga

SEQ ID NO: 548245 - DNA, 25 bp, Mus musculus
gccagggctccctcagtgatgcaga

SEQ ID NO: 548246 - DNA, 25 bp, Mus musculus
gccagggctctgattgcttgggctt

SEQ ID NO: 548247 - DNA, 25 bp, Mus musculus
gccagggctctgtttgcttgggctt

SEQ ID NO: 548248 - DNA, 25 bp, Mus musculus
gccagggctggcatcttatttgctg

SEQ ID NO: 548249 - DNA, 25 bp, Mus musculus
gccagggctggcttcttatttgctg

SEQ ID NO: 548250 - DNA, 25 bp, Mus musculus
gccagggtagtgctccgccttttat

SEQ ID NO: 548251 - DNA, 25 bp, Mus musculus
gccagggtagtggtccgccttttat

SEQ ID NO: 548252 - DNA, 25 bp, Mus musculus
gccagggtagttaggtacttcctct

SEQ ID NO: 548253 - DNA, 25 bp, Mus musculus
gccagggtagtttggtacttcctct

SEQ ID NO: 548254 - DNA, 25 bp, Mus musculus
gccagggtcaggcagcactgtcctc

SEQ ID NO: 548255 - DNA, 25 bp, Mus musculus
gccagggtcagggagcactgtcctc

SEQ ID NO: 548256 - DNA, 25 bp, Mus musculus
gccagggtgcttataacattttaga

SEQ ID NO: 548257 - DNA, 25 bp, Mus musculus
gccagggtgcttttaacattttaga

SEQ ID NO: 548258 - DNA, 25 bp, Mus musculus
gccagggtggacatagcttaaatca

SEQ ID NO: 548259 - DNA, 25 bp, Mus musculus
gccagggtggacttagcttaaatca

SEQ ID NO: 548260 - DNA, 25 bp, Mus musculus
gccagggttatgatttccaagggat

SEQ ID NO: 548261 - DNA, 25 bp, Mus musculus
gccagggttatgttttccaagggat

SEQ ID NO: 548262 - DNA, 25 bp, Mus musculus
gccagggttcccatatgtatattaa

SEQ ID NO: 548263 - DNA, 25 bp, Mus musculus
gccagggttcccttatgtatattaa

SEQ ID NO: 548264 - DNA, 25 bp, Mus musculus
gccagggtttacagacaaaggacct

SEQ ID NO: 548265 - DNA, 25 bp, Mus musculus
gccagggtttactgacaaaggacct

SEQ ID NO: 548266 - DNA, 25 bp, Mus musculus
gccaggtaaattagatgcagcttat

SEQ ID NO: 548267 - DNA, 25 bp, Mus musculus
gccaggtaaatttgatgcagcttat

SEQ ID NO: 548268 - DNA, 25 bp, Mus musculus
gccaggtaacgccacaagtcgatac

SEQ ID NO: 548269 - DNA, 25 bp, Mus musculus
gccaggtaacgcgacaagtcgatac

SEQ ID NO: 548270 - DNA, 25 bp, Mus musculus
gccaggtaccatccatgatgcaggt

SEQ ID NO: 548271 - DNA, 25 bp, Mus musculus
gccaggtaccatgcatgatgcaggt

SEQ ID NO: 548272 - DNA, 25 bp, Mus musculus
gccaggtacttcacacgtcaatgaa

SEQ ID NO: 548273 - DNA, 25 bp, Mus musculus
gccaggtacttctcacgtcaatgaa

SEQ ID NO: 548274 - DNA, 25 bp, Mus musculus
gccaggtcaacaaggactgcttggt

SEQ ID NO: 548275 - DNA, 25 bp, Mus musculus
gccaggtcaacatggactgcttggt

SEQ ID NO: 548276 - DNA, 25 bp, Mus musculus
gccaggtcactccagaggcagtatt

SEQ ID NO: 548277 - DNA, 25 bp, Mus musculus
gccaggtcactcgagaggcagtatt

SEQ ID NO: 548278 - DNA, 25 bp, Mus musculus
gccaggtcaggcacttaggacgtgt

SEQ ID NO: 548279 - DNA, 25 bp, Mus musculus
gccaggtcaggctcttaggacgtgt

SEQ ID NO: 548280 - DNA, 25 bp, Mus musculus
gccaggtcatcaagcgaggtgcgca

SEQ ID NO: 548281 - DNA, 25 bp, Mus musculus
gccaggtcatcatgcgaggtgcgca

SEQ ID NO: 548282 - DNA, 25 bp, Mus musculus
gccaggtccctacgcggaagactaa

SEQ ID NO: 548283 - DNA, 25 bp, Mus musculus
gccaggtccctaggcggaagactaa

SEQ ID NO: 548284 - DNA, 25 bp, Mus musculus
gccaggtcctcacaagccagtaaag

SEQ ID NO: 548285 - DNA, 25 bp, Mus musculus
gccaggtcctcagaagccagtaaag

SEQ ID NO: 548286 - DNA, 25 bp, Mus musculus
gccaggtctgctatagtaagtaaaa

SEQ ID NO: 548287 - DNA, 25 bp, Mus musculus
gccaggtctgctttagtaagtaaaa

SEQ ID NO: 548288 - DNA, 25 bp, Mus musculus
gccaggtctgtgattgcattgctcc

SEQ ID NO: 548289 - DNA, 25 bp, Mus musculus
gccaggtctgtgtttgcattgctcc

SEQ ID NO: 548290 - DNA, 25 bp, Mus musculus
gccaggtcttccatgcaacgtggaa

SEQ ID NO: 548291 - DNA, 25 bp, Mus musculus
gccaggtcttccttgcaacgtggaa

SEQ ID NO: 548292 - DNA, 25 bp, Mus musculus
gccaggtgagatcgctaagtacatg

SEQ ID NO: 548293 - DNA, 25 bp, Mus musculus
gccaggtgagatggctaagtacatg

SEQ ID NO: 548294 - DNA, 25 bp, Mus musculus
gccaggtgcaatcacacatgccttt

SEQ ID NO: 548295 - DNA, 25 bp, Mus musculus
gccaggtgcaatgacacatgccttt

SEQ ID NO: 548296 - DNA, 25 bp, Mus musculus
gccaggtggcataggttattttcca

SEQ ID NO: 548297 - DNA, 25 bp, Mus musculus
gccaggtggcattggttattttcca

SEQ ID NO: 548298 - DNA, 25 bp, Mus musculus
gccaggtgggagatgccaatatcaa

SEQ ID NO: 548299 - DNA, 25 bp, Mus musculus
gccaggtgggagttgccaatatcaa

SEQ ID NO: 548300 - DNA, 25 bp, Mus musculus
gccaggtgtaatctcacaagtctct

SEQ ID NO: 548301 - DNA, 25 bp, Mus musculus
gccaggtgtaatgtcacaagtctct

SEQ ID NO: 548302 - DNA, 25 bp, Mus musculus
gccaggtgtagactgagacaataaa

SEQ ID NO: 548303 - DNA, 25 bp, Mus musculus
gccaggtgtagagtgagacaataaa

SEQ ID NO: 548304 - DNA, 25 bp, Mus musculus
gccaggtgtcatattcctgactaag

SEQ ID NO: 548305 - DNA, 25 bp, Mus musculus
gccaggtgtcatatttatcgcttcc

SEQ ID NO: 548306 - DNA, 25 bp, Mus musculus
gccaggtgtcattttcctgactaag

SEQ ID NO: 548307 - DNA, 25 bp, Mus musculus
gccaggtgtcatttttatcgcttcc

SEQ ID NO: 548308 - DNA, 25 bp, Mus musculus
gccaggtgtgcgagtcttgaaatta

SEQ ID NO: 548309 - DNA, 25 bp, Mus musculus
gccaggtgtgcgtgtcttgaaatta

SEQ ID NO: 548310 - DNA, 25 bp, Mus musculus
gccaggttatctagtattaatgtaa

SEQ ID NO: 548311 - DNA, 25 bp, Mus musculus
gccaggttatcttgtattaatgtaa

SEQ ID NO: 548312 - DNA, 25 bp, Mus musculus
gccaggttcaaaagttgcatagttt

SEQ ID NO: 548313 - DNA, 25 bp, Mus musculus
gccaggttcaaatgttgcatagttt

SEQ ID NO: 548314 - DNA, 25 bp, Mus musculus
gccaggttcgcaccaaagtcgtgga

SEQ ID NO: 548315 - DNA, 25 bp, Mus musculus
gccaggttcgcagcaaagtcgtgga

SEQ ID NO: 548316 - DNA, 25 bp, Mus musculus
gccaggttcgctacccctcaagggt

SEQ ID NO: 548317 - DNA, 25 bp, Mus musculus
gccaggttcgcttcccctcaagggt

SEQ ID NO: 548318 - DNA, 25 bp, Mus musculus
gccaggttctgcactggctgggccc

SEQ ID NO: 548319 - DNA, 25 bp, Mus musculus
gccaggttctgctctggctgggccc

SEQ ID NO: 548320 - DNA, 25 bp, Mus musculus
gccaggttgcttatagcactttaaa

SEQ ID NO: 548321 - DNA, 25 bp, Mus musculus
gccaggttgcttttagcactttaaa

SEQ ID NO: 548322 - DNA, 25 bp, Mus musculus
gccaggttggccacgcgctaaagga

SEQ ID NO: 548323 - DNA, 25 bp, Mus musculus
gccaggttggcctcgcgctaaagga

SEQ ID NO: 548324 - DNA, 25 bp, Mus musculus
gccaggttgggcatcagagcctcag

SEQ ID NO: 548325 - DNA, 25 bp, Mus musculus
gccaggttgggcttcagagcctcag

SEQ ID NO: 548326 - DNA, 25 bp, Mus musculus
gccaggttgtacaaagccaccctaa

SEQ ID NO: 548327 - DNA, 25 bp, Mus musculus
gccaggttgtactaagccaccctaa

SEQ ID NO: 548328 - DNA, 25 bp, Mus musculus
gccaggtttccaatgattcattcca

SEQ ID NO: 548329 - DNA, 25 bp, Mus musculus
gccaggtttccattgattcattcca

SEQ ID NO: 548330 - DNA, 25 bp, Mus musculus
gccaggtttctgaacaagcgttcgt

SEQ ID NO: 548331 - DNA, 25 bp, Mus musculus
gccaggtttctgtacaagcgttcgt

SEQ ID NO: 548332 - DNA, 25 bp, Mus musculus
gccaggtttggtcagcagactgtct

SEQ ID NO: 548333 - DNA, 25 bp, Mus musculus
gccaggtttggtgagcagactgtct

SEQ ID NO: 548334 - DNA, 25 bp, Mus musculus
gccaggttttataattgtaatgcaa

SEQ ID NO: 548335 - DNA, 25 bp, Mus musculus
gccaggttttattattgtaatgcaa

SEQ ID NO: 548336 - DNA, 25 bp, Mus musculus
gccaggtttttacagctttgacagg

SEQ ID NO: 548337 - DNA, 25 bp, Mus musculus
gccaggtttttagagctttgacagg

SEQ ID NO: 548338 - DNA, 25 bp, Mus musculus
gccagtaaaacacaccatccagaaa

SEQ ID NO: 548339 - DNA, 25 bp, Mus musculus
gccagtaaaacagaccatccagaaa

SEQ ID NO: 548340 - DNA, 25 bp, Mus musculus
gccagtaaactgagcttgggatttg

SEQ ID NO: 548341 - DNA, 25 bp, Mus musculus
gccagtaaactgtgcttgggatttg

SEQ ID NO: 548342 - DNA, 25 bp, Mus musculus
gccagtaactcaaaaagacccacct

SEQ ID NO: 548343 - DNA, 25 bp, Mus musculus
gccagtaactcataaagacccacct

SEQ ID NO: 548344 - DNA, 25 bp, Mus musculus
gccagtaagcaacacccttctgtgg

SEQ ID NO: 548345 - DNA, 25 bp, Mus musculus
gccagtaagcaagacccttctgtgg

SEQ ID NO: 548346 - DNA, 25 bp, Mus musculus
gccagtaatcaaataattcttgtga

SEQ ID NO: 548347 - DNA, 25 bp, Mus musculus
gccagtaatcaattaattcttgtga

SEQ ID NO: 548348 - DNA, 25 bp, Mus musculus
gccagtacacccaatattcttttta

SEQ ID NO: 548349 - DNA, 25 bp, Mus musculus
gccagtacaccctatattcttttta

SEQ ID NO: 548350 - DNA, 25 bp, Mus musculus
gccagtacacgtccatggtgacaaa

SEQ ID NO: 548351 - DNA, 25 bp, Mus musculus
gccagtacacgtgcatggtgacaaa

SEQ ID NO: 548352 - DNA, 25 bp, Mus musculus
gccagtacatctcagctgagtgttt

SEQ ID NO: 548353 - DNA, 25 bp, Mus musculus
gccagtacatctgagctgagtgttt

SEQ ID NO: 548354 - DNA, 25 bp, Mus musculus
gccagtaccatcagtccagaagtgt

SEQ ID NO: 548355 - DNA, 25 bp, Mus musculus
gccagtaccatctgtccagaagtgt

SEQ ID NO: 548356 - DNA, 25 bp, Mus musculus
gccagtagatgcacaggtgcgcctt

SEQ ID NO: 548357 - DNA, 25 bp, Mus musculus
gccagtagatgctcaggtgcgcctt

SEQ ID NO: 548358 - DNA, 25 bp, Mus musculus
gccagtagccgacctcatggataac

SEQ ID NO: 548359 - DNA, 25 bp, Mus musculus
gccagtagccgagctcatggataac

SEQ ID NO: 548360 - DNA, 25 bp, Mus musculus
gccagtagctttaagtcttgcctat

SEQ ID NO: 548361 - DNA, 25 bp, Mus musculus
gccagtagcttttagtcttgcctat

SEQ ID NO: 548362 - DNA, 25 bp, Mus musculus
gccagtaggtatacacttctgtctg

SEQ ID NO: 548363 - DNA, 25 bp, Mus musculus
gccagtaggtattcacttctgtctg

SEQ ID NO: 548364 - DNA, 25 bp, Mus musculus
gccagtagttagagaattcctttaa

SEQ ID NO: 548365 - DNA, 25 bp, Mus musculus
gccagtagttagtgaattcctttaa

SEQ ID NO: 548366 - DNA, 25 bp, Mus musculus
gccagtagttcaattcgataaaaac

SEQ ID NO: 548367 - DNA, 25 bp, Mus musculus
gccagtagttcatttcgataaaaac

SEQ ID NO: 548368 - DNA, 25 bp, Mus musculus
gccagtatatccaaactctgtcaga

SEQ ID NO: 548369 - DNA, 25 bp, Mus musculus
gccagtatatcctaactctgtcaga

SEQ ID NO: 548370 - DNA, 25 bp, Mus musculus
gccagtatctagacacacaagtgct

SEQ ID NO: 548371 - DNA, 25 bp, Mus musculus
gccagtatctagtcacacaagtgct

SEQ ID NO: 548372 - DNA, 25 bp, Mus musculus
gccagtatcttaatgggcatttcaa

SEQ ID NO: 548373 - DNA, 25 bp, Mus musculus
gccagtatcttattgggcatttcaa

SEQ ID NO: 548374 - DNA, 25 bp, Mus musculus
gccagtatctttagaaggttgcaac

SEQ ID NO: 548375 - DNA, 25 bp, Mus musculus
gccagtatcttttgaaggttgcaac

SEQ ID NO: 548376 - DNA, 25 bp, Mus musculus
gccagtatgagtctaagtttgtgta

SEQ ID NO: 548377 - DNA, 25 bp, Mus musculus
gccagtatgagtgtaagtttgtgta

SEQ ID NO: 548378 - DNA, 25 bp, Mus musculus
gccagtattaaaacaagtttatgca

SEQ ID NO: 548379 - DNA, 25 bp, Mus musculus
gccagtattaaatcaagtttatgca

SEQ ID NO: 548380 - DNA, 25 bp, Mus musculus
gccagtcaactcaccttggtaatga

SEQ ID NO: 548381 - DNA, 25 bp, Mus musculus
gccagtcaactctccttggtaatga

SEQ ID NO: 548382 - DNA, 25 bp, Mus musculus
gccagtcaagctagtatttgagcca

SEQ ID NO: 548383 - DNA, 25 bp, Mus musculus
gccagtcaagcttgtatttgagcca

SEQ ID NO: 548384 - DNA, 25 bp, Mus musculus
gccagtcaatccaagccaatatgca

SEQ ID NO: 548385 - DNA, 25 bp, Mus musculus
gccagtcaatcctagccaatatgca

SEQ ID NO: 548386 - DNA, 25 bp, Mus musculus
gccagtcaattacttgggtccctta

SEQ ID NO: 548387 - DNA, 25 bp, Mus musculus
gccagtcaattagttgggtccctta

SEQ ID NO: 548388 - DNA, 25 bp, Mus musculus
gccagtcacagtatgatgacaccat

SEQ ID NO: 548389 - DNA, 25 bp, Mus musculus
gccagtcacagtttgatgacaccat

SEQ ID NO: 548390 - DNA, 25 bp, Mus musculus
gccagtcaccgtaagcattcagttg

SEQ ID NO: 548391 - DNA, 25 bp, Mus musculus
gccagtcaccgttagcattcagttg

SEQ ID NO: 548392 - DNA, 25 bp, Mus musculus
gccagtcacgcaagagtaccaacat

SEQ ID NO: 548393 - DNA, 25 bp, Mus musculus
gccagtcacgcatgagtaccaacat

SEQ ID NO: 548394 - DNA, 25 bp, Mus musculus
gccagtcacgtgcaaggacagctga

SEQ ID NO: 548395 - DNA, 25 bp, Mus musculus
gccagtcacgtggaaggacagctga

SEQ ID NO: 548396 - DNA, 25 bp, Mus musculus
gccagtcagcaaactcaaggttcat

SEQ ID NO: 548397 - DNA, 25 bp, Mus musculus
gccagtcagcaatctcaaggttcat

SEQ ID NO: 548398 - DNA, 25 bp, Mus musculus
gccagtcagccaaggttatctacta

SEQ ID NO: 548399 - DNA, 25 bp, Mus musculus
gccagtcagccatggttatctacta

SEQ ID NO: 548400 - DNA, 25 bp, Mus musculus
gccagtcaggtaacataatatttta

SEQ ID NO: 548401 - DNA, 25 bp, Mus musculus
gccagtcaggtatcataatatttta

SEQ ID NO: 548402 - DNA, 25 bp, Mus musculus
gccagtcagtgtcaaggtatgtctt

SEQ ID NO: 548403 - DNA, 25 bp, Mus musculus
gccagtcagtgtgaaggtatgtctt

SEQ ID NO: 548404 - DNA, 25 bp, Mus musculus
gccagtcagttccatttacagctat

SEQ ID NO: 548405 - DNA, 25 bp, Mus musculus
gccagtcagttcgatttacagctat

SEQ ID NO: 548406 - DNA, 25 bp, Mus musculus
gccagtcatcatcgtatactactat

SEQ ID NO: 548407 - DNA, 25 bp, Mus musculus
gccagtcatcatggtatactactat

SEQ ID NO: 548408 - DNA, 25 bp, Mus musculus
gccagtcatgtgcaagccatttttt

SEQ ID NO: 548409 - DNA, 25 bp, Mus musculus
gccagtcatgtggaagccatttttt

SEQ ID NO: 548410 - DNA, 25 bp, Mus musculus
gccagtcattggattttgcctatag

SEQ ID NO: 548411 - DNA, 25 bp, Mus musculus
gccagtcattggtttttgcctatag

SEQ ID NO: 548412 - DNA, 25 bp, Mus musculus
gccagtcatttaattgtccttcgaa

SEQ ID NO: 548413 - DNA, 25 bp, Mus musculus
gccagtcatttatttgtccttcgaa

SEQ ID NO: 548414 - DNA, 25 bp, Mus musculus
gccagtccaattctgagtatgtgtg

SEQ ID NO: 548415 - DNA, 25 bp, Mus musculus
gccagtccaattgtgagtatgtgtg

SEQ ID NO: 548416 - DNA, 25 bp, Mus musculus
gccagtcccaacatgtatgagtctg

SEQ ID NO: 548417 - DNA, 25 bp, Mus musculus
gccagtcccaacttgtatgagtctg

SEQ ID NO: 548418 - DNA, 25 bp, Mus musculus
gccagtcccaagattttccaatgaa

SEQ ID NO: 548419 - DNA, 25 bp, Mus musculus
gccagtcccaagtttttccaatgaa

SEQ ID NO: 548420 - DNA, 25 bp, Mus musculus
gccagtccctgccaatcattgagca

SEQ ID NO: 548421 - DNA, 25 bp, Mus musculus
gccagtccctgcgaatcattgagca

SEQ ID NO: 548422 - DNA, 25 bp, Mus musculus
gccagtccctggatcagcatgtaga

SEQ ID NO: 548423 - DNA, 25 bp, Mus musculus
gccagtccctggttcagcatgtaga

SEQ ID NO: 548424 - DNA, 25 bp, Mus musculus
gccagtcctaaacgcttctgtgaag

SEQ ID NO: 548425 - DNA, 25 bp, Mus musculus
gccagtcctaaaggcttctgtgaag

SEQ ID NO: 548426 - DNA, 25 bp, Mus musculus
gccagtcctccaaagtcttcaggga

SEQ ID NO: 548427 - DNA, 25 bp, Mus musculus
gccagtcctccatagtcttcaggga

SEQ ID NO: 548428 - DNA, 25 bp, Mus musculus
gccagtcctgctagttcaataattg

SEQ ID NO: 548429 - DNA, 25 bp, Mus musculus
gccagtcctgcttgttcaataattg

SEQ ID NO: 548430 - DNA, 25 bp, Mus musculus
gccagtcctgggagctggcttaaga

SEQ ID NO: 548431 - DNA, 25 bp, Mus musculus
gccagtcctgggtgctggcttaaga

SEQ ID NO: 548432 - DNA, 25 bp, Mus musculus
gccagtccttggaaggttttctatt

SEQ ID NO: 548433 - DNA, 25 bp, Mus musculus
gccagtccttggtaggttttctatt

SEQ ID NO: 548434 - DNA, 25 bp, Mus musculus
gccagtcgccttacctataacaaaa

SEQ ID NO: 548435 - DNA, 25 bp, Mus musculus
gccagtcgcctttcctataacaaaa

SEQ ID NO: 548436 - DNA, 25 bp, Mus musculus
gccagtcgtcataagagatcgctct

SEQ ID NO: 548437 - DNA, 25 bp, Mus musculus
gccagtcgtcattagagatcgctct

SEQ ID NO: 548438 - DNA, 25 bp, Mus musculus
gccagtctactgcattaggtctaaa

SEQ ID NO: 548439 - DNA, 25 bp, Mus musculus
gccagtctactggattaggtctaaa

SEQ ID NO: 548440 - DNA, 25 bp, Mus musculus
gccagtctagccacaggatgtctaa

SEQ ID NO: 548441 - DNA, 25 bp, Mus musculus
gccagtctagcctcaggatgtctaa

SEQ ID NO: 548442 - DNA, 25 bp, Mus musculus
gccagtctatacatcaggctgaggt

SEQ ID NO: 548443 - DNA, 25 bp, Mus musculus
gccagtctatacttcaggctgaggt

SEQ ID NO: 548444 - DNA, 25 bp, Mus musculus
gccagtctcagcaataaaatgttca

SEQ ID NO: 548445 - DNA, 25 bp, Mus musculus
gccagtctcagctataaaatgttca

SEQ ID NO: 548446 - DNA, 25 bp, Mus musculus
gccagtctcctgagtaaattacagt

SEQ ID NO: 548447 - DNA, 25 bp, Mus musculus
gccagtctcctgtgtaaattacagt

SEQ ID NO: 548448 - DNA, 25 bp, Mus musculus
gccagtctcggcagaaaggttttat

SEQ ID NO: 548449 - DNA, 25 bp, Mus musculus
gccagtctcggctgaaaggttttat

SEQ ID NO: 548450 - DNA, 25 bp, Mus musculus
gccagtctctgcctccaagggaggg

SEQ ID NO: 548451 - DNA, 25 bp, Mus musculus
gccagtctctgcctgtagagttctg

SEQ ID NO: 548452 - DNA, 25 bp, Mus musculus
gccagtctctgcgtccaagggaggg

SEQ ID NO: 548453 - DNA, 25 bp, Mus musculus
gccagtctctgcgtgtagagttctg

SEQ ID NO: 548454 - DNA, 25 bp, Mus musculus
gccagtctgctacaaacgcttaggt

SEQ ID NO: 548455 - DNA, 25 bp, Mus musculus
gccagtctgctagaaacgcttaggt

SEQ ID NO: 548456 - DNA, 25 bp, Mus musculus
gccagtctgggaaatcattaggtat

SEQ ID NO: 548457 - DNA, 25 bp, Mus musculus
gccagtctgggaagctgtatgccat

SEQ ID NO: 548458 - DNA, 25 bp, Mus musculus
gccagtctgggatatcattaggtat

SEQ ID NO: 548459 - DNA, 25 bp, Mus musculus
gccagtctgggatgctgtatgccat

SEQ ID NO: 548460 - DNA, 25 bp, Mus musculus
gccagtctgtcaatcatccaaattg

SEQ ID NO: 548461 - DNA, 25 bp, Mus musculus
gccagtctgtcattcatccaaattg

SEQ ID NO: 548462 - DNA, 25 bp, Mus musculus
gccagtctgtgactgacagttgtca

SEQ ID NO: 548463 - DNA, 25 bp, Mus musculus
gccagtctgtgagtgacagttgtca

SEQ ID NO: 548464 - DNA, 25 bp, Mus musculus
gccagtcttatgctgtagcctacac

SEQ ID NO: 548465 - DNA, 25 bp, Mus musculus
gccagtcttatggtgtagcctacac

SEQ ID NO: 548466 - DNA, 25 bp, Mus musculus
gccagtcttggtaaactaattctat

SEQ ID NO: 548467 - DNA, 25 bp, Mus musculus
gccagtcttggtccaattagcgaca

SEQ ID NO: 548468 - DNA, 25 bp, Mus musculus
gccagtcttggtgcaattagcgaca

SEQ ID NO: 548469 - DNA, 25 bp, Mus musculus
gccagtcttggttaactaattctat

SEQ ID NO: 548470 - DNA, 25 bp, Mus musculus
gccagtctttagcactgctttatca

SEQ ID NO: 548471 - DNA, 25 bp, Mus musculus
gccagtctttaggactgctttatca

SEQ ID NO: 548472 - DNA, 25 bp, Mus musculus
gccagtgaaaatcaacagcctcatt

SEQ ID NO: 548473 - DNA, 25 bp, Mus musculus
gccagtgaaaatgaacagcctcatt

SEQ ID NO: 548474 - DNA, 25 bp, Mus musculus
gccagtgaaagaccgatttctgaag

SEQ ID NO: 548475 - DNA, 25 bp, Mus musculus
gccagtgaaagactctcctgtgctg

SEQ ID NO: 548476 - DNA, 25 bp, Mus musculus
gccagtgaaagagcgatttctgaag

SEQ ID NO: 548477 - DNA, 25 bp, Mus musculus
gccagtgaaagagtctcctgtgctg

SEQ ID NO: 548478 - DNA, 25 bp, Mus musculus
gccagtgaacttccctacctgagaa

SEQ ID NO: 548479 - DNA, 25 bp, Mus musculus
gccagtgaacttgcctacctgagaa

SEQ ID NO: 548480 - DNA, 25 bp, Mus musculus
gccagtgaagacacccgatgttcca

SEQ ID NO: 548481 - DNA, 25 bp, Mus musculus
gccagtgaagactcccgatgttcca

SEQ ID NO: 548482 - DNA, 25 bp, Mus musculus
gccagtgaaggactagcctgcacat

SEQ ID NO: 548483 - DNA, 25 bp, Mus musculus
gccagtgaaggagtagcctgcacat

SEQ ID NO: 548484 - DNA, 25 bp, Mus musculus
gccagtgaaggcctttaagtgtgaa

SEQ ID NO: 548485 - DNA, 25 bp, Mus musculus
gccagtgaaggcgtttaagtgtgaa

SEQ ID NO: 548486 - DNA, 25 bp, Mus musculus
gccagtgaagttagtgccacaggat

SEQ ID NO: 548487 - DNA, 25 bp, Mus musculus
gccagtgaagtttgtgccacaggat

SEQ ID NO: 548488 - DNA, 25 bp, Mus musculus
gccagtgacgctaatcctacaagtg

SEQ ID NO: 548489 - DNA, 25 bp, Mus musculus
gccagtgacgcttatcctacaagtg

SEQ ID NO: 548490 - DNA, 25 bp, Mus musculus
gccagtgacgttatcaatgctttgt

SEQ ID NO: 548491 - DNA, 25 bp, Mus musculus
gccagtgacgttatccacaggaatt

SEQ ID NO: 548492 - DNA, 25 bp, Mus musculus
gccagtgacgttttcaatgctttgt

SEQ ID NO: 548493 - DNA, 25 bp, Mus musculus
gccagtgacgttttccacaggaatt

SEQ ID NO: 548494 - DNA, 25 bp, Mus musculus
gccagtgactgacaagtacagaagc

SEQ ID NO: 548495 - DNA, 25 bp, Mus musculus
gccagtgactgagaagtacagaagc

SEQ ID NO: 548496 - DNA, 25 bp, Mus musculus
gccagtgagcaaagtcctgcttcca

SEQ ID NO: 548497 - DNA, 25 bp, Mus musculus
gccagtgagcaatgtcctgcttcca

SEQ ID NO: 548498 - DNA, 25 bp, Mus musculus
gccagtgagctcacatgtctctaaa

SEQ ID NO: 548499 - DNA, 25 bp, Mus musculus
gccagtgagctcacttttgcacact

SEQ ID NO: 548500 - DNA, 25 bp, Mus musculus
gccagtgagctctcatgtctctaaa

SEQ ID NO: 548501 - DNA, 25 bp, Mus musculus
gccagtgagctctcttttgcacact

SEQ ID NO: 548502 - DNA, 25 bp, Mus musculus
gccagtgagcttcttactgtgatca

SEQ ID NO: 548503 - DNA, 25 bp, Mus musculus
gccagtgagcttgttactgtgatca

SEQ ID NO: 548504 - DNA, 25 bp, Mus musculus
gccagtgagtttactctgtgctatc

SEQ ID NO: 548505 - DNA, 25 bp, Mus musculus
gccagtgagtttattctgtatcctt

SEQ ID NO: 548506 - DNA, 25 bp, Mus musculus
gccagtgagttttctctgtgctatc

SEQ ID NO: 548507 - DNA, 25 bp, Mus musculus
gccagtgagttttttctgtatcctt

SEQ ID NO: 548508 - DNA, 25 bp, Mus musculus
gccagtgatcttctttttccatttc

SEQ ID NO: 548509 - DNA, 25 bp, Mus musculus
gccagtgatcttgtttttccatttc

SEQ ID NO: 548510 - DNA, 25 bp, Mus musculus
gccagtgatgagagagttttccaat

SEQ ID NO: 548511 - DNA, 25 bp, Mus musculus
gccagtgatgagtgagttttccaat

SEQ ID NO: 548512 - DNA, 25 bp, Mus musculus
gccagtgatgctctaggttttcagt

SEQ ID NO: 548513 - DNA, 25 bp, Mus musculus
gccagtgatgctgtaggttttcagt

SEQ ID NO: 548514 - DNA, 25 bp, Mus musculus
gccagtgattggcttctcattagag

SEQ ID NO: 548515 - DNA, 25 bp, Mus musculus
gccagtgattgggttctcattagag

SEQ ID NO: 548516 - DNA, 25 bp, Mus musculus
gccagtgcaaaaccaccataaccgt

SEQ ID NO: 548517 - DNA, 25 bp, Mus musculus
gccagtgcaaaagcaccataaccgt

SEQ ID NO: 548518 - DNA, 25 bp, Mus musculus
gccagtgcacccagatgttctggag

SEQ ID NO: 548519 - DNA, 25 bp, Mus musculus
gccagtgcaccctgatgttctggag

SEQ ID NO: 548520 - DNA, 25 bp, Mus musculus
gccagtgccacaaggtttttgttat

SEQ ID NO: 548521 - DNA, 25 bp, Mus musculus
gccagtgccacatggtttttgttat

SEQ ID NO: 548522 - DNA, 25 bp, Mus musculus
gccagtgccagtcttgatgatgaaa

SEQ ID NO: 548523 - DNA, 25 bp, Mus musculus
gccagtgccagtgttgatgatgaaa

SEQ ID NO: 548524 - DNA, 25 bp, Mus musculus
gccagtgcccttaaatactgggcca

SEQ ID NO: 548525 - DNA, 25 bp, Mus musculus
gccagtgccctttaatactgggcca

SEQ ID NO: 548526 - DNA, 25 bp, Mus musculus
gccagtgcctacctaaaattccaat

SEQ ID NO: 548527 - DNA, 25 bp, Mus musculus
gccagtgcctacgtaaaattccaat

SEQ ID NO: 548528 - DNA, 25 bp, Mus musculus
gccagtgcctggatacacacaacgg

SEQ ID NO: 548529 - DNA, 25 bp, Mus musculus
gccagtgcctggttacacacaacgg

SEQ ID NO: 548530 - DNA, 25 bp, Mus musculus
gccagtgctcccaaagagttaaggt

SEQ ID NO: 548531 - DNA, 25 bp, Mus musculus
gccagtgctccctaagagttaaggt

SEQ ID NO: 548532 - DNA, 25 bp, Mus musculus
gccagtgctggcctgtgaagtatta

SEQ ID NO: 548533 - DNA, 25 bp, Mus musculus
gccagtgctggcgtgtgaagtatta

SEQ ID NO: 548534 - DNA, 25 bp, Mus musculus
gccagtgcttccatgtgtgtaacag

SEQ ID NO: 548535 - DNA, 25 bp, Mus musculus
gccagtgcttccttgtgtgtaacag

SEQ ID NO: 548536 - DNA, 25 bp, Mus musculus
gccagtggagccaagtgtatggaaa

SEQ ID NO: 548537 - DNA, 25 bp, Mus musculus
gccagtggagcctagtgtatggaaa

SEQ ID NO: 548538 - DNA, 25 bp, Mus musculus
gccagtggaggaactgacggctctc

SEQ ID NO: 548539 - DNA, 25 bp, Mus musculus
gccagtggaggaccttttacagaca

SEQ ID NO: 548540 - DNA, 25 bp, Mus musculus
gccagtggaggagcttttacagaca

SEQ ID NO: 548541 - DNA, 25 bp, Mus musculus
gccagtggaggatctgacggctctc

SEQ ID NO: 548542 - DNA, 25 bp, Mus musculus
gccagtggagtcatttgtcttttta

SEQ ID NO: 548543 - DNA, 25 bp, Mus musculus
gccagtggagtcttttgtcttttta

SEQ ID NO: 548544 - DNA, 25 bp, Mus musculus
gccagtggataccagatctctgtga

SEQ ID NO: 548545 - DNA, 25 bp, Mus musculus
gccagtggatacgagatctctgtga

SEQ ID NO: 548546 - DNA, 25 bp, Mus musculus
gccagtggcaccatctttaaagcgg

SEQ ID NO: 548547 - DNA, 25 bp, Mus musculus
gccagtggcaccttctttaaagcgg

SEQ ID NO: 548548 - DNA, 25 bp, Mus musculus
gccagtggcagaacgacaagcctga

SEQ ID NO: 548549 - DNA, 25 bp, Mus musculus
gccagtggcagatcgacaagcctga

SEQ ID NO: 548550 - DNA, 25 bp, Mus musculus
gccagtggcaggatctatttattta

SEQ ID NO: 548551 - DNA, 25 bp, Mus musculus
gccagtggcaggttctatttattta

SEQ ID NO: 548552 - DNA, 25 bp, Mus musculus
gccagtggcattctgttaaccgtaa

SEQ ID NO: 548553 - DNA, 25 bp, Mus musculus
gccagtggcattgtgttaaccgtaa

SEQ ID NO: 548554 - DNA, 25 bp, Mus musculus
gccagtggcgacaccagcaagggct

SEQ ID NO: 548555 - DNA, 25 bp, Mus musculus
gccagtggcgactccagcaagggct

SEQ ID NO: 548556 - DNA, 25 bp, Mus musculus
gccagtggctttctcatggagatta

SEQ ID NO: 548557 - DNA, 25 bp, Mus musculus
gccagtggctttgtcatggagatta

SEQ ID NO: 548558 - DNA, 25 bp, Mus musculus
gccagtgggccacattcataatgca

SEQ ID NO: 548559 - DNA, 25 bp, Mus musculus
gccagtgggccagattcataatgca

SEQ ID NO: 548560 - DNA, 25 bp, Mus musculus
gccagtgggtcccatagtgtcctca

SEQ ID NO: 548561 - DNA, 25 bp, Mus musculus
gccagtgggtccgatagtgtcctca

SEQ ID NO: 548562 - DNA, 25 bp, Mus musculus
gccagtgggtggatgtttctcaatc

SEQ ID NO: 548563 - DNA, 25 bp, Mus musculus
gccagtgggtggttgtttctcaatc

SEQ ID NO: 548564 - DNA, 25 bp, Mus musculus
gccagtggtacaatctacttatgtt

SEQ ID NO: 548565 - DNA, 25 bp, Mus musculus
gccagtggtacattctacttatgtt

SEQ ID NO: 548566 - DNA, 25 bp, Mus musculus
gccagtggtgtcatggaaagcctca

SEQ ID NO: 548567 - DNA, 25 bp, Mus musculus
gccagtggtgtcttggaaagcctca

SEQ ID NO: 548568 - DNA, 25 bp, Mus musculus
gccagtgtaattactctaacgttct

SEQ ID NO: 548569 - DNA, 25 bp, Mus musculus
gccagtgtaatttctctaacgttct

SEQ ID NO: 548570 - DNA, 25 bp, Mus musculus
gccagtgtaggtatgtagctttcag

SEQ ID NO: 548571 - DNA, 25 bp, Mus musculus
gccagtgtaggtttgtagctttcag

SEQ ID NO: 548572 - DNA, 25 bp, Mus musculus
gccagtgtatgacgaattctcttct

SEQ ID NO: 548573 - DNA, 25 bp, Mus musculus
gccagtgtatgaggaattctcttct

SEQ ID NO: 548574 - DNA, 25 bp, Mus musculus
gccagtgtatgcatagggaatatgc

SEQ ID NO: 548575 - DNA, 25 bp, Mus musculus
gccagtgtatgcttagggaatatgc

SEQ ID NO: 548576 - DNA, 25 bp, Mus musculus
gccagtgtattgctcatttcaacag

SEQ ID NO: 548577 - DNA, 25 bp, Mus musculus
gccagtgtattggtcatttcaacag

SEQ ID NO: 548578 - DNA, 25 bp, Mus musculus
gccagtgtcaccctatatgattgtt

SEQ ID NO: 548579 - DNA, 25 bp, Mus musculus
gccagtgtcaccgtatatgattgtt

SEQ ID NO: 548580 - DNA, 25 bp, Mus musculus
gccagtgtcccacgatttaaggctg

SEQ ID NO: 548581 - DNA, 25 bp, Mus musculus
gccagtgtcccaggatttaaggctg

SEQ ID NO: 548582 - DNA, 25 bp, Mus musculus
gccagtgtcctccatagcaaatgtg

SEQ ID NO: 548583 - DNA, 25 bp, Mus musculus
gccagtgtcctcgatagcaaatgtg

SEQ ID NO: 548584 - DNA, 25 bp, Mus musculus
gccagtgtccttacaactttaaagt

SEQ ID NO: 548585 - DNA, 25 bp, Mus musculus
gccagtgtcctttcaactttaaagt

SEQ ID NO: 548586 - DNA, 25 bp, Mus musculus
gccagtgtctctcaagtcaggcaga

SEQ ID NO: 548587 - DNA, 25 bp, Mus musculus
gccagtgtctctcggaggtcactaa

SEQ ID NO: 548588 - DNA, 25 bp, Mus musculus
gccagtgtctctgaagtcaggcaga

SEQ ID NO: 548589 - DNA, 25 bp, Mus musculus
gccagtgtctctgggaggtcactaa

SEQ ID NO: 548590 - DNA, 25 bp, Mus musculus
gccagtgtctgaatctcatctcact

SEQ ID NO: 548591 - DNA, 25 bp, Mus musculus
gccagtgtctgattctcatctcact

SEQ ID NO: 548592 - DNA, 25 bp, Mus musculus
gccagtgtctggcatcacagttgtg

SEQ ID NO: 548593 - DNA, 25 bp, Mus musculus
gccagtgtctgggatcacagttgtg

SEQ ID NO: 548594 - DNA, 25 bp, Mus musculus
gccagtgtctgtacaggcccactga

SEQ ID NO: 548595 - DNA, 25 bp, Mus musculus
gccagtgtctgttcaggcccactga

SEQ ID NO: 548596 - DNA, 25 bp, Mus musculus
gccagtgtcttaaattttgccttaa

SEQ ID NO: 548597 - DNA, 25 bp, Mus musculus
gccagtgtcttatattttgccttaa

SEQ ID NO: 548598 - DNA, 25 bp, Mus musculus
gccagtgtcttccttttgtatgcca

SEQ ID NO: 548599 - DNA, 25 bp, Mus musculus
gccagtgtcttcgttttgtatgcca

SEQ ID NO: 548600 - DNA, 25 bp, Mus musculus
gccagtgtgagtcagttcatgctgt

SEQ ID NO: 548601 - DNA, 25 bp, Mus musculus
gccagtgtgagtgagttcatgctgt

SEQ ID NO: 548602 - DNA, 25 bp, Mus musculus
gccagtgtgataagtgccgtttctc

SEQ ID NO: 548603 - DNA, 25 bp, Mus musculus
gccagtgtgatatgtgccgtttctc

SEQ ID NO: 548604 - DNA, 25 bp, Mus musculus
gccagtgtgcagcatgttacagcag

SEQ ID NO: 548605 - DNA, 25 bp, Mus musculus
gccagtgtgcaggatgttacagcag

SEQ ID NO: 548606 - DNA, 25 bp, Mus musculus
gccagtgtgccaaattcttgttgga

SEQ ID NO: 548607 - DNA, 25 bp, Mus musculus
gccagtgtgccatattcttgttgga

SEQ ID NO: 548608 - DNA, 25 bp, Mus musculus
gccagtgtgtggacgctaataaaga

SEQ ID NO: 548609 - DNA, 25 bp, Mus musculus
gccagtgtgtggtcgctaataaaga

SEQ ID NO: 548610 - DNA, 25 bp, Mus musculus
gccagtgttaagcttttgtagaact

SEQ ID NO: 548611 - DNA, 25 bp, Mus musculus
gccagtgttaaggttttgtagaact

SEQ ID NO: 548612 - DNA, 25 bp, Mus musculus
gccagtgttcagcaagttttctttt

SEQ ID NO: 548613 - DNA, 25 bp, Mus musculus
gccagtgttcaggaagttttctttt

SEQ ID NO: 548614 - DNA, 25 bp, Mus musculus
gccagtgttggaacacaggtctcta

SEQ ID NO: 548615 - DNA, 25 bp, Mus musculus
gccagtgttggatcacaggtctcta

SEQ ID NO: 548616 - DNA, 25 bp, Mus musculus
gccagtgttggtaataaaagatgat

SEQ ID NO: 548617 - DNA, 25 bp, Mus musculus
gccagtgttggttataaaagatgat

SEQ ID NO: 548618 - DNA, 25 bp, Mus musculus
gccagtgttgttaggatcagagctt

SEQ ID NO: 548619 - DNA, 25 bp, Mus musculus
gccagtgttgtttggatcagagctt

SEQ ID NO: 548620 - DNA, 25 bp, Mus musculus
gccagtgttttcagatttgtagatc

SEQ ID NO: 548621 - DNA, 25 bp, Mus musculus
gccagtgttttctgatttgtagatc

SEQ ID NO: 548622 - DNA, 25 bp, Mus musculus
gccagttaagcgcttgcatccaagt

SEQ ID NO: 548623 - DNA, 25 bp, Mus musculus
gccagttaagcggttgcatccaagt

SEQ ID NO: 548624 - DNA, 25 bp, Mus musculus
gccagttaatgcagttagtgaactc

SEQ ID NO: 548625 - DNA, 25 bp, Mus musculus
gccagttaatgctgttagtgaactc

SEQ ID NO: 548626 - DNA, 25 bp, Mus musculus
gccagttacatacaaggatcctgca

SEQ ID NO: 548627 - DNA, 25 bp, Mus musculus
gccagttacatagaaggatcctgca

SEQ ID NO: 548628 - DNA, 25 bp, Mus musculus
gccagttaccagattacacatctcc

SEQ ID NO: 548629 - DNA, 25 bp, Mus musculus
gccagttaccagtttacacatctcc

SEQ ID NO: 548630 - DNA, 25 bp, Mus musculus
gccagttaccataggctgttttaag

SEQ ID NO: 548631 - DNA, 25 bp, Mus musculus
gccagttaccattggctgttttaag

SEQ ID NO: 548632 - DNA, 25 bp, Mus musculus
gccagttagattactgtttccccta

SEQ ID NO: 548633 - DNA, 25 bp, Mus musculus
gccagttagatttctgtttccccta

SEQ ID NO: 548634 - DNA, 25 bp, Mus musculus
gccagttagctgagggacagaagca

SEQ ID NO: 548635 - DNA, 25 bp, Mus musculus
gccagttagctgtgggacagaagca

SEQ ID NO: 548636 - DNA, 25 bp, Mus musculus
gccagttatggcaataggtgctaca

SEQ ID NO: 548637 - DNA, 25 bp, Mus musculus
gccagttatggctataggtgctaca

SEQ ID NO: 548638 - DNA, 25 bp, Mus musculus
gccagttatgtgagaaaaggttagc

SEQ ID NO: 548639 - DNA, 25 bp, Mus musculus
gccagttatgtgtgaaaaggttagc

SEQ ID NO: 548640 - DNA, 25 bp, Mus musculus
gccagttattcacgtttaaatgggt

SEQ ID NO: 548641 - DNA, 25 bp, Mus musculus
gccagttattcaggtttaaatgggt

SEQ ID NO: 548642 - DNA, 25 bp, Mus musculus
gccagttattgaccggacattccct

SEQ ID NO: 548643 - DNA, 25 bp, Mus musculus
gccagttattgagcggacattccct

SEQ ID NO: 548644 - DNA, 25 bp, Mus musculus
gccagttcaaaaagtcctcgttgcc

SEQ ID NO: 548645 - DNA, 25 bp, Mus musculus
gccagttcaaaatgtcctcgttgcc

SEQ ID NO: 548646 - DNA, 25 bp, Mus musculus
gccagttcaaagacaccccgacgtg

SEQ ID NO: 548647 - DNA, 25 bp, Mus musculus
gccagttcaaagtcaccccgacgtg

SEQ ID NO: 548648 - DNA, 25 bp, Mus musculus
gccagttcagggatcttatgacaga

SEQ ID NO: 548649 - DNA, 25 bp, Mus musculus
gccagttcagggttcttatgacaga

SEQ ID NO: 548650 - DNA, 25 bp, Mus musculus
gccagttcagtcaaaaaccaaactt

SEQ ID NO: 548651 - DNA, 25 bp, Mus musculus
gccagttcagtctaaaaccaaactt

SEQ ID NO: 548652 - DNA, 25 bp, Mus musculus
gccagttcagttctgggtggctttt

SEQ ID NO: 548653 - DNA, 25 bp, Mus musculus
gccagttcagttgtgggtggctttt

SEQ ID NO: 548654 - DNA, 25 bp, Mus musculus
gccagttccaagatactagctttac

SEQ ID NO: 548655 - DNA, 25 bp, Mus musculus
gccagttccaagttactagctttac

SEQ ID NO: 548656 - DNA, 25 bp, Mus musculus
gccagttcctatctgttagctctac

SEQ ID NO: 548657 - DNA, 25 bp, Mus musculus
gccagttcctatgtgttagctctac

SEQ ID NO: 548658 - DNA, 25 bp, Mus musculus
gccagttcctcgcagacaaacaacg

SEQ ID NO: 548659 - DNA, 25 bp, Mus musculus
gccagttcctcggagacaaacaacg

SEQ ID NO: 548660 - DNA, 25 bp, Mus musculus
gccagttccttaagcattctgcatt

SEQ ID NO: 548661 - DNA, 25 bp, Mus musculus
gccagttccttatgcattctgcatt

SEQ ID NO: 548662 - DNA, 25 bp, Mus musculus
gccagttctatcattattgcagctt

SEQ ID NO: 548663 - DNA, 25 bp, Mus musculus
gccagttctatctttattgcagctt

SEQ ID NO: 548664 - DNA, 25 bp, Mus musculus
gccagttctcttctatcagagcaga

SEQ ID NO: 548665 - DNA, 25 bp, Mus musculus
gccagttctcttgtatcagagcaga

SEQ ID NO: 548666 - DNA, 25 bp, Mus musculus
gccagttctttcacgcaatacaaat

SEQ ID NO: 548667 - DNA, 25 bp, Mus musculus
gccagttctttcctgtgtcatggaa

SEQ ID NO: 548668 - DNA, 25 bp, Mus musculus
gccagttctttcgtgtgtcatggaa

SEQ ID NO: 548669 - DNA, 25 bp, Mus musculus
gccagttctttctcgcaatacaaat

SEQ ID NO: 548670 - DNA, 25 bp, Mus musculus
gccagttctttgattacttttcagg

SEQ ID NO: 548671 - DNA, 25 bp, Mus musculus
gccagttctttgtttacttttcagg

SEQ ID NO: 548672 - DNA, 25 bp, Mus musculus
gccagttgacaacatcaggtgccat

SEQ ID NO: 548673 - DNA, 25 bp, Mus musculus
gccagttgacaagatcaggtgccat

SEQ ID NO: 548674 - DNA, 25 bp, Mus musculus
gccagttgactgatctgtcagctga

SEQ ID NO: 548675 - DNA, 25 bp, Mus musculus
gccagttgactgttctgtcagctga

SEQ ID NO: 548676 - DNA, 25 bp, Mus musculus
gccagttgatatccagcccatgtat

SEQ ID NO: 548677 - DNA, 25 bp, Mus musculus
gccagttgatatgcagcccatgtat

SEQ ID NO: 548678 - DNA, 25 bp, Mus musculus
gccagttgcaccattaacacttcag

SEQ ID NO: 548679 - DNA, 25 bp, Mus musculus
gccagttgcacctttaacacttcag

SEQ ID NO: 548680 - DNA, 25 bp, Mus musculus
gccagttgcctgcaagtggctacta

SEQ ID NO: 548681 - DNA, 25 bp, Mus musculus
gccagttgcctggaagtggctacta

SEQ ID NO: 548682 - DNA, 25 bp, Mus musculus
gccagttgctaccatatgccataaa

SEQ ID NO: 548683 - DNA, 25 bp, Mus musculus
gccagttgctacgatatgccataaa

SEQ ID NO: 548684 - DNA, 25 bp, Mus musculus
gccagttggcatacattaccacagg

SEQ ID NO: 548685 - DNA, 25 bp, Mus musculus
gccagttggcattcattaccacagg

SEQ ID NO: 548686 - DNA, 25 bp, Mus musculus
gccagttggccaattctcctatccc

SEQ ID NO: 548687 - DNA, 25 bp, Mus musculus
gccagttggccatttctcctatccc

SEQ ID NO: 548688 - DNA, 25 bp, Mus musculus
gccagtttaagcaagccggtgaaat

SEQ ID NO: 548689 - DNA, 25 bp, Mus musculus
gccagtttaagctagccggtgaaat

SEQ ID NO: 548690 - DNA, 25 bp, Mus musculus
gccagtttactgcaagcaaacattt

SEQ ID NO: 548691 - DNA, 25 bp, Mus musculus
gccagtttactggaagcaaacattt

SEQ ID NO: 548692 - DNA, 25 bp, Mus musculus
gccagtttcacaaggcaagcgcaaa

SEQ ID NO: 548693 - DNA, 25 bp, Mus musculus
gccagtttcacatggcaagcgcaaa

SEQ ID NO: 548694 - DNA, 25 bp, Mus musculus
gccagtttctctcagtttgccaaag

SEQ ID NO: 548695 - DNA, 25 bp, Mus musculus
gccagtttctctccatcattagtga

SEQ ID NO: 548696 - DNA, 25 bp, Mus musculus
gccagtttctctgagtttgccaaag

SEQ ID NO: 548697 - DNA, 25 bp, Mus musculus
gccagtttctctgcatcattagtga

SEQ ID NO: 548698 - DNA, 25 bp, Mus musculus
gccagtttctgtatcttcctgtgat

SEQ ID NO: 548699 - DNA, 25 bp, Mus musculus
gccagtttctgtttcttcctgtgat

SEQ ID NO: 548700 - DNA, 25 bp, Mus musculus
gccagtttctttctattcgtgattt

SEQ ID NO: 548701 - DNA, 25 bp, Mus musculus
gccagtttctttgtattcgtgattt

SEQ ID NO: 548702 - DNA, 25 bp, Mus musculus
gccagtttgaacacccctgctgtaa

SEQ ID NO: 548703 - DNA, 25 bp, Mus musculus
gccagtttgaactcccctgctgtaa

SEQ ID NO: 548704 - DNA, 25 bp, Mus musculus
gccagtttgctcacatttacttgga

SEQ ID NO: 548705 - DNA, 25 bp, Mus musculus
gccagtttgctctcatttacttgga

SEQ ID NO: 548706 - DNA, 25 bp, Mus musculus
gccagttttcccctgtttgcttttg

SEQ ID NO: 548707 - DNA, 25 bp, Mus musculus
gccagttttcccgtgtttgcttttg

SEQ ID NO: 548708 - DNA, 25 bp, Mus musculus
gccagttttctaaacccagcagagg

SEQ ID NO: 548709 - DNA, 25 bp, Mus musculus
gccagttttctaagctttgtctact

SEQ ID NO: 548710 - DNA, 25 bp, Mus musculus
gccagttttctaccctcgggataga

SEQ ID NO: 548711 - DNA, 25 bp, Mus musculus
gccagttttctagcctcgggataga

SEQ ID NO: 548712 - DNA, 25 bp, Mus musculus
gccagttttctatacccagcagagg

SEQ ID NO: 548713 - DNA, 25 bp, Mus musculus
gccagttttctatgctttgtctact

SEQ ID NO: 548714 - DNA, 25 bp, Mus musculus
gccagttttgtgctagcagacttca

SEQ ID NO: 548715 - DNA, 25 bp, Mus musculus
gccagttttgtggtagcagacttca

SEQ ID NO: 548716 - DNA, 25 bp, Mus musculus
gccagtttttatatttctaccagaa

SEQ ID NO: 548717 - DNA, 25 bp, Mus musculus
gccagtttttatttttctaccagaa

SEQ ID NO: 548718 - DNA, 25 bp, Mus musculus
gccagtttttccaccaagagcggat

SEQ ID NO: 548719 - DNA, 25 bp, Mus musculus
gccagtttttcctccaagagcggat

SEQ ID NO: 548720 - DNA, 25 bp, Mus musculus
gccataaaattaccctttggatcaa

SEQ ID NO: 548721 - DNA, 25 bp, Mus musculus
gccataaaattagcctttggatcaa

SEQ ID NO: 548722 - DNA, 25 bp, Mus musculus
gccataaagcggcataccagcctat

SEQ ID NO: 548723 - DNA, 25 bp, Mus musculus
gccataaagcgggataccagcctat

SEQ ID NO: 548724 - DNA, 25 bp, Mus musculus
gccataaagtcccagccaatgatgg

SEQ ID NO: 548725 - DNA, 25 bp, Mus musculus
gccataaagtccgagccaatgatgg

SEQ ID NO: 548726 - DNA, 25 bp, Mus musculus
gccataacaaatcccatcaattagt

SEQ ID NO: 548727 - DNA, 25 bp, Mus musculus
gccataacaaatgccatcaattagt

SEQ ID NO: 548728 - DNA, 25 bp, Mus musculus
gccataacagacaacttttttcttg

SEQ ID NO: 548729 - DNA, 25 bp, Mus musculus
gccataacagactacttttttcttg

SEQ ID NO: 548730 - DNA, 25 bp, Mus musculus
gccataactggcactttagttctat

SEQ ID NO: 548731 - DNA, 25 bp, Mus musculus
gccataactggctctttagttctat

SEQ ID NO: 548732 - DNA, 25 bp, Mus musculus
gccataaggctgaatttgctggtat

SEQ ID NO: 548733 - DNA, 25 bp, Mus musculus
gccataaggctgtatttgctggtat

SEQ ID NO: 548734 - DNA, 25 bp, Mus musculus
gccataagtcacatttgtcttcaga

SEQ ID NO: 548735 - DNA, 25 bp, Mus musculus
gccataagtcacttttgtcttcaga

SEQ ID NO: 548736 - DNA, 25 bp, Mus musculus
gccataatactgatgaaagactgga

SEQ ID NO: 548737 - DNA, 25 bp, Mus musculus
gccataatactgttgaaagactgga

SEQ ID NO: 548738 - DNA, 25 bp, Mus musculus
gccataatgagcagggtttcccttt

SEQ ID NO: 548739 - DNA, 25 bp, Mus musculus
gccataatgagctgggtttcccttt

SEQ ID NO: 548740 - DNA, 25 bp, Mus musculus
gccataattgccacgagccacgtag

SEQ ID NO: 548741 - DNA, 25 bp, Mus musculus
gccataattgcctcgagccacgtag

SEQ ID NO: 548742 - DNA, 25 bp, Mus musculus
gccataattttgcatactgcatgcc

SEQ ID NO: 548743 - DNA, 25 bp, Mus musculus
gccataattttggatactgcatgcc

SEQ ID NO: 548744 - DNA, 25 bp, Mus musculus
gccatacaaacacctcctaaggatc

SEQ ID NO: 548745 - DNA, 25 bp, Mus musculus
gccatacaaacagctcctaaggatc

SEQ ID NO: 548746 - DNA, 25 bp, Mus musculus
gccatacaacaacgtgggtcccatt

SEQ ID NO: 548747 - DNA, 25 bp, Mus musculus
gccatacaacaaggtgggtcccatt

SEQ ID NO: 548748 - DNA, 25 bp, Mus musculus
gccatacaggctcgttttcatgcaa

SEQ ID NO: 548749 - DNA, 25 bp, Mus musculus
gccatacaggctggttttcatgcaa

SEQ ID NO: 548750 - DNA, 25 bp, Mus musculus
gccatacaggtactttgggacccct

SEQ ID NO: 548751 - DNA, 25 bp, Mus musculus
gccatacaggtagtttgggacccct

SEQ ID NO: 548752 - DNA, 25 bp, Mus musculus
gccatacatggacatttgcaaagga

SEQ ID NO: 548753 - DNA, 25 bp, Mus musculus
gccatacatggagatttgcaaagga

SEQ ID NO: 548754 - DNA, 25 bp, Mus musculus
gccataccaatgagtcagtcagcaa

SEQ ID NO: 548755 - DNA, 25 bp, Mus musculus
gccataccaatgtgtcagtcagcaa

SEQ ID NO: 548756 - DNA, 25 bp, Mus musculus
gccataccattcctcgttttcaagg

SEQ ID NO: 548757 - DNA, 25 bp, Mus musculus
gccataccattcgtcgttttcaagg

SEQ ID NO: 548758 - DNA, 25 bp, Mus musculus
gccatacccatcaatattgtaattt

SEQ ID NO: 548759 - DNA, 25 bp, Mus musculus
gccatacccatcaggcttttatatc

SEQ ID NO: 548760 - DNA, 25 bp, Mus musculus
gccatacccatctatattgtaattt

SEQ ID NO: 548761 - DNA, 25 bp, Mus musculus
gccatacccatctggcttttatatc

SEQ ID NO: 548762 - DNA, 25 bp, Mus musculus
gccataccctggctagaagtaagaa

SEQ ID NO: 548763 - DNA, 25 bp, Mus musculus
gccataccctgggtagaagtaagaa

SEQ ID NO: 548764 - DNA, 25 bp, Mus musculus
gccatacctacaacaactaagtctg

SEQ ID NO: 548765 - DNA, 25 bp, Mus musculus
gccatacctacatcaactaagtctg

SEQ ID NO: 548766 - DNA, 25 bp, Mus musculus
gccatacggagtcagcctgtgacta

SEQ ID NO: 548767 - DNA, 25 bp, Mus musculus
gccatacggagtgagcctgtgacta

SEQ ID NO: 548768 - DNA, 25 bp, Mus musculus
gccatacgtttgcacttgtactgta

SEQ ID NO: 548769 - DNA, 25 bp, Mus musculus
gccatacgtttggacttgtactgta

SEQ ID NO: 548770 - DNA, 25 bp, Mus musculus
gccatactcactccactgctgaaag

SEQ ID NO: 548771 - DNA, 25 bp, Mus musculus
gccatactcactgcactgctgaaag

SEQ ID NO: 548772 - DNA, 25 bp, Mus musculus
gccatactcctccttgatctatgag

SEQ ID NO: 548773 - DNA, 25 bp, Mus musculus
gccatactcctcgttgatctatgag

SEQ ID NO: 548774 - DNA, 25 bp, Mus musculus
gccatactctatacttttagctaaa

SEQ ID NO: 548775 - DNA, 25 bp, Mus musculus
gccatactctattcttttagctaaa

SEQ ID NO: 548776 - DNA, 25 bp, Mus musculus
gccatactggccaatagaattcctc

SEQ ID NO: 548777 - DNA, 25 bp, Mus musculus
gccatactggcctatagaattcctc

SEQ ID NO: 548778 - DNA, 25 bp, Mus musculus
gccatactgtctctgcttactgaaa

SEQ ID NO: 548779 - DNA, 25 bp, Mus musculus
gccatactgtctgtgcttactgaaa

SEQ ID NO: 548780 - DNA, 25 bp, Mus musculus
gccatactgtgtaaaactccaaccc

SEQ ID NO: 548781 - DNA, 25 bp, Mus musculus
gccatactgtgttaaactccaaccc

SEQ ID NO: 548782 - DNA, 25 bp, Mus musculus
gccatacttactataattacctcta

SEQ ID NO: 548783 - DNA, 25 bp, Mus musculus
gccatacttactttaattacctcta

SEQ ID NO: 548784 - DNA, 25 bp, Mus musculus
gccatacttcaactcatcaggattt

SEQ ID NO: 548785 - DNA, 25 bp, Mus musculus
gccatacttcaagtcatcaggattt

SEQ ID NO: 548786 - DNA, 25 bp, Mus musculus
gccatacttcaccagggctgtagat

SEQ ID NO: 548787 - DNA, 25 bp, Mus musculus
gccatacttcacgagggctgtagat

SEQ ID NO: 548788 - DNA, 25 bp, Mus musculus
gccatactttggaacgttttgcttt

SEQ ID NO: 548789 - DNA, 25 bp, Mus musculus
gccatactttggtacgttttgcttt

SEQ ID NO: 548790 - DNA, 25 bp, Mus musculus
gccatagaacccaagccctacgagg

SEQ ID NO: 548791 - DNA, 25 bp, Mus musculus
gccatagaaccctagccctacgagg

SEQ ID NO: 548792 - DNA, 25 bp, Mus musculus
gccatagaactaaagccaacccact

SEQ ID NO: 548793 - DNA, 25 bp, Mus musculus
gccatagaactatagccaacccact

SEQ ID NO: 548794 - DNA, 25 bp, Mus musculus
gccatagaagcccttggaagcaaag

SEQ ID NO: 548795 - DNA, 25 bp, Mus musculus
gccatagaagccgttggaagcaaag

SEQ ID NO: 548796 - DNA, 25 bp, Mus musculus
gccatagacctgcttcacagaacat

SEQ ID NO: 548797 - DNA, 25 bp, Mus musculus
gccatagacctggttcacagaacat

SEQ ID NO: 548798 - DNA, 25 bp, Mus musculus
gccatagagtctataattgcccgtt

SEQ ID NO: 548799 - DNA, 25 bp, Mus musculus
gccatagagtctttaattgcccgtt

SEQ ID NO: 548800 - DNA, 25 bp, Mus musculus
gccatagcatctagtcagttcatga

SEQ ID NO: 548801 - DNA, 25 bp, Mus musculus
gccatagcatcttgtcagttcatga

SEQ ID NO: 548802 - DNA, 25 bp, Mus musculus
gccatagcatgtctgagcctgtact

SEQ ID NO: 548803 - DNA, 25 bp, Mus musculus
gccatagcatgtgtgagcctgtact

SEQ ID NO: 548804 - DNA, 25 bp, Mus musculus
gccatagctggcaaattgctctctt

SEQ ID NO: 548805 - DNA, 25 bp, Mus musculus
gccatagctggctaattgctctctt

SEQ ID NO: 548806 - DNA, 25 bp, Mus musculus
gccataggaggcagaagttgacgtt

SEQ ID NO: 548807 - DNA, 25 bp, Mus musculus
gccataggaggctgaagttgacgtt

SEQ ID NO: 548808 - DNA, 25 bp, Mus musculus
gccataggatcacagtgctgcactt

SEQ ID NO: 548809 - DNA, 25 bp, Mus musculus
gccataggatcagagtgctgcactt

SEQ ID NO: 548810 - DNA, 25 bp, Mus musculus
gccataggccatacttctggctgag

SEQ ID NO: 548811 - DNA, 25 bp, Mus musculus
gccataggccattcttctggctgag

SEQ ID NO: 548812 - DNA, 25 bp, Mus musculus
gccatagtgtttacagtcagctttc

SEQ ID NO: 548813 - DNA, 25 bp, Mus musculus
gccatagtgttttcagtcagctttc

SEQ ID NO: 548814 - DNA, 25 bp, Mus musculus
gccatataattgctgcttggtttta

SEQ ID NO: 548815 - DNA, 25 bp, Mus musculus
gccatataattggtgcttggtttta

SEQ ID NO: 548816 - DNA, 25 bp, Mus musculus
gccatatagcttatagttgtcattg

SEQ ID NO: 548817 - DNA, 25 bp, Mus musculus
gccatatagcttttagttgtcattg

SEQ ID NO: 548818 - DNA, 25 bp, Mus musculus
gccatatcaggtaggcaagcctcct

SEQ ID NO: 548819 - DNA, 25 bp, Mus musculus
gccatatcaggttggcaagcctcct

SEQ ID NO: 548820 - DNA, 25 bp, Mus musculus
gccatatcatgtctgcacactgaag

SEQ ID NO: 548821 - DNA, 25 bp, Mus musculus
gccatatcatgtgtgcacactgaag

SEQ ID NO: 548822 - DNA, 25 bp, Mus musculus
gccatatctatgaactcgtgccttc

SEQ ID NO: 548823 - DNA, 25 bp, Mus musculus
gccatatctatgatgcttgtcagca

SEQ ID NO: 548824 - DNA, 25 bp, Mus musculus
gccatatctatgtactcgtgccttc

SEQ ID NO: 548825 - DNA, 25 bp, Mus musculus
gccatatctatgttgcttgtcagca

SEQ ID NO: 548826 - DNA, 25 bp, Mus musculus
gccatatctgtgaggagacagttca

SEQ ID NO: 548827 - DNA, 25 bp, Mus musculus
gccatatctgtgtggagacagttca

SEQ ID NO: 548828 - DNA, 25 bp, Mus musculus
gccatatgcccacaaggcctgttaa

SEQ ID NO: 548829 - DNA, 25 bp, Mus musculus
gccatatgcccagaaggcctgttaa

SEQ ID NO: 548830 - DNA, 25 bp, Mus musculus
gccatatgcttgagggcacgggccc

SEQ ID NO: 548831 - DNA, 25 bp, Mus musculus
gccatatgcttgtgggcacgggccc

SEQ ID NO: 548832 - DNA, 25 bp, Mus musculus
gccatatgtgtgagggtactctgga

SEQ ID NO: 548833 - DNA, 25 bp, Mus musculus
gccatatgtgtgtgggtactctgga

SEQ ID NO: 548834 - DNA, 25 bp, Mus musculus
gccatattaaatctaccgccagttc

SEQ ID NO: 548835 - DNA, 25 bp, Mus musculus
gccatattaaatgtaccgccagttc

SEQ ID NO: 548836 - DNA, 25 bp, Mus musculus
gccatattatcacgtattccttaga

SEQ ID NO: 548837 - DNA, 25 bp, Mus musculus
gccatattatcaggtattccttaga

SEQ ID NO: 548838 - DNA, 25 bp, Mus musculus
gccatattcaatatacctgcgatta

SEQ ID NO: 548839 - DNA, 25 bp, Mus musculus
gccatattcaatttacctgcgatta

SEQ ID NO: 548840 - DNA, 25 bp, Mus musculus
gccatattcctaaatatcagcagaa

SEQ ID NO: 548841 - DNA, 25 bp, Mus musculus
gccatattcctatatatcagcagaa

SEQ ID NO: 548842 - DNA, 25 bp, Mus musculus
gccatattctctcggttcatacaaa

SEQ ID NO: 548843 - DNA, 25 bp, Mus musculus
gccatattctctgggttcatacaaa

SEQ ID NO: 548844 - DNA, 25 bp, Mus musculus
gccatattgctaacctcaccaaaag

SEQ ID NO: 548845 - DNA, 25 bp, Mus musculus
gccatattgctatcctcaccaaaag

SEQ ID NO: 548846 - DNA, 25 bp, Mus musculus
gccatattggctctccagtgtggct

SEQ ID NO: 548847 - DNA, 25 bp, Mus musculus
gccatattggctgtccagtgtggct

SEQ ID NO: 548848 - DNA, 25 bp, Mus musculus
gccatattgtctctgtgaagctagg

SEQ ID NO: 548849 - DNA, 25 bp, Mus musculus
gccatattgtctgtgtgaagctagg

SEQ ID NO: 548850 - DNA, 25 bp, Mus musculus
gccatatttgccatataagctggga

SEQ ID NO: 548851 - DNA, 25 bp, Mus musculus
gccatatttgccttataagctggga

SEQ ID NO: 548852 - DNA, 25 bp, Mus musculus
gccatcaactccatgttggatcaga

SEQ ID NO: 548853 - DNA, 25 bp, Mus musculus
gccatcaactccttgttggatcaga

SEQ ID NO: 548854 - DNA, 25 bp, Mus musculus
gccatcaatctgcatacttggttat

SEQ ID NO: 548855 - DNA, 25 bp, Mus musculus
gccatcaatctggatacttggttat

SEQ ID NO: 548856 - DNA, 25 bp, Mus musculus
gccatcaatggtcttttattttcaa

SEQ ID NO: 548857 - DNA, 25 bp, Mus musculus
gccatcaatggtgttttattttcaa

SEQ ID NO: 548858 - DNA, 25 bp, Mus musculus
gccatcaatgtcaccaatcagtgcc

SEQ ID NO: 548859 - DNA, 25 bp, Mus musculus
gccatcaatgtctccaatcagtgcc

SEQ ID NO: 548860 - DNA, 25 bp, Mus musculus
gccatcacaaatctcgccaagatac

SEQ ID NO: 548861 - DNA, 25 bp, Mus musculus
gccatcacaaatgtcgccaagatac

SEQ ID NO: 548862 - DNA, 25 bp, Mus musculus
gccatcacaatgcataggctgacga

SEQ ID NO: 548863 - DNA, 25 bp, Mus musculus
gccatcacaatggataggctgacga

SEQ ID NO: 548864 - DNA, 25 bp, Mus musculus
gccatcacagccataacttaaacat

SEQ ID NO: 548865 - DNA, 25 bp, Mus musculus
gccatcacagccttaacttaaacat

SEQ ID NO: 548866 - DNA, 25 bp, Mus musculus
gccatcacatcaagacaagaaccat

SEQ ID NO: 548867 - DNA, 25 bp, Mus musculus
gccatcacatcatgacaagaaccat

SEQ ID NO: 548868 - DNA, 25 bp, Mus musculus
gccatcaccattcaggctgagccaa

SEQ ID NO: 548869 - DNA, 25 bp, Mus musculus
gccatcaccattgaggctgagccaa

SEQ ID NO: 548870 - DNA, 25 bp, Mus musculus
gccatcacccagattacttcttatt

SEQ ID NO: 548871 - DNA, 25 bp, Mus musculus
gccatcacccagtttacttcttatt

SEQ ID NO: 548872 - DNA, 25 bp, Mus musculus
gccatcacctgaccaaccgagaatt

SEQ ID NO: 548873 - DNA, 25 bp, Mus musculus
gccatcacctgagcaaccgagaatt

SEQ ID NO: 548874 - DNA, 25 bp, Mus musculus
gccatcacctgccaatttgtttttt

SEQ ID NO: 548875 - DNA, 25 bp, Mus musculus
gccatcacctgcgaatttgtttttt

SEQ ID NO: 548876 - DNA, 25 bp, Mus musculus
gccatcacctggaccggctctgaga

SEQ ID NO: 548877 - DNA, 25 bp, Mus musculus
gccatcacctggtccggctctgaga

SEQ ID NO: 548878 - DNA, 25 bp, Mus musculus
gccatcactaccatctatgctgaga

SEQ ID NO: 548879 - DNA, 25 bp, Mus musculus
gccatcactaccttctatgctgaga

SEQ ID NO: 548880 - DNA, 25 bp, Mus musculus
gccatcactgccattaagggcgtgg

SEQ ID NO: 548881 - DNA, 25 bp, Mus musculus
gccatcactgcctttaagggcgtgg

SEQ ID NO: 548882 - DNA, 25 bp, Mus musculus
gccatcactgtgaactttctcagtc

SEQ ID NO: 548883 - DNA, 25 bp, Mus musculus
gccatcactgtgtactttctcagtc

SEQ ID NO: 548884 - DNA, 25 bp, Mus musculus
gccatcacttcaacaggtcatttta

SEQ ID NO: 548885 - DNA, 25 bp, Mus musculus
gccatcacttcatcaggtcatttta

SEQ ID NO: 548886 - DNA, 25 bp, Mus musculus
gccatcacttgcagggccagtgggt

SEQ ID NO: 548887 - DNA, 25 bp, Mus musculus
gccatcacttgctgggccagtgggt

SEQ ID NO: 548888 - DNA, 25 bp, Mus musculus
gccatcagactcaccttagaacaag

SEQ ID NO: 548889 - DNA, 25 bp, Mus musculus
gccatcagactctccttagaacaag

SEQ ID NO: 548890 - DNA, 25 bp, Mus musculus
gccatcagcatcactagtcacaaat

SEQ ID NO: 548891 - DNA, 25 bp, Mus musculus
gccatcagcatctctagtcacaaat

SEQ ID NO: 548892 - DNA, 25 bp, Mus musculus
gccatcagccccagaagacgaagag

SEQ ID NO: 548893 - DNA, 25 bp, Mus musculus
gccatcagccccagtagaaggtgta

SEQ ID NO: 548894 - DNA, 25 bp, Mus musculus
gccatcagcccctgaagacgaagag

SEQ ID NO: 548895 - DNA, 25 bp, Mus musculus
gccatcagcccctgtagaaggtgta

SEQ ID NO: 548896 - DNA, 25 bp, Mus musculus
gccatcagctatctaagggaaccat

SEQ ID NO: 548897 - DNA, 25 bp, Mus musculus
gccatcagctatgtaagggaaccat

SEQ ID NO: 548898 - DNA, 25 bp, Mus musculus
gccatcagctcacatactctaattg

SEQ ID NO: 548899 - DNA, 25 bp, Mus musculus
gccatcagctcagatactctaattg

SEQ ID NO: 548900 - DNA, 25 bp, Mus musculus
gccatcagctcccactaatggttaa

SEQ ID NO: 548901 - DNA, 25 bp, Mus musculus
gccatcagctccgactaatggttaa

SEQ ID NO: 548902 - DNA, 25 bp, Mus musculus
gccatcagggcacttctacgtttga

SEQ ID NO: 548903 - DNA, 25 bp, Mus musculus
gccatcagggcagttctacgtttga

SEQ ID NO: 548904 - DNA, 25 bp, Mus musculus
gccatcagggccaagtataccgaga

SEQ ID NO: 548905 - DNA, 25 bp, Mus musculus
gccatcagggcctagtataccgaga

SEQ ID NO: 548906 - DNA, 25 bp, Mus musculus
gccatcaggtctcttgtggctgaaa

SEQ ID NO: 548907 - DNA, 25 bp, Mus musculus
gccatcaggtctgttgtggctgaaa

SEQ ID NO: 548908 - DNA, 25 bp, Mus musculus
gccatcagtgagagacagcgcttac

SEQ ID NO: 548909 - DNA, 25 bp, Mus musculus
gccatcagtgagtgacagcgcttac

SEQ ID NO: 548910 - DNA, 25 bp, Mus musculus
gccatcatacaaccaaatattcgac

SEQ ID NO: 548911 - DNA, 25 bp, Mus musculus
gccatcatacaagcaaatattcgac

SEQ ID NO: 548912 - DNA, 25 bp, Mus musculus
gccatcatactgctaattattttgt

SEQ ID NO: 548913 - DNA, 25 bp, Mus musculus
gccatcatactggtaattattttgt

SEQ ID NO: 548914 - DNA, 25 bp, Mus musculus
gccatcatagtgatagtacctttgt

SEQ ID NO: 548915 - DNA, 25 bp, Mus musculus
gccatcatagtgttagtacctttgt

SEQ ID NO: 548916 - DNA, 25 bp, Mus musculus
gccatcatcaacctggtggtcttca

SEQ ID NO: 548917 - DNA, 25 bp, Mus musculus
gccatcatcaacgtggtggtcttca

SEQ ID NO: 548918 - DNA, 25 bp, Mus musculus
gccatcatcataacctcatattttc

SEQ ID NO: 548919 - DNA, 25 bp, Mus musculus
gccatcatcatatcctcatattttc

SEQ ID NO: 548920 - DNA, 25 bp, Mus musculus
gccatcatccacagagcacataatg

SEQ ID NO: 548921 - DNA, 25 bp, Mus musculus
gccatcatccactgagcacataatg

SEQ ID NO: 548922 - DNA, 25 bp, Mus musculus
gccatcatcgtgagaatacggctgg

SEQ ID NO: 548923 - DNA, 25 bp, Mus musculus
gccatcatcgtgtgaatacggctgg

SEQ ID NO: 548924 - DNA, 25 bp, Mus musculus
gccatcatggtacagggccagttca

SEQ ID NO: 548925 - DNA, 25 bp, Mus musculus
gccatcatggtagagggccagttca

SEQ ID NO: 548926 - DNA, 25 bp, Mus musculus
gccatcattagtacctgtgttctaa

SEQ ID NO: 548927 - DNA, 25 bp, Mus musculus
gccatcattagttcctgtgttctaa

SEQ ID NO: 548928 - DNA, 25 bp, Mus musculus
gccatcattggcagcacttactact

SEQ ID NO: 548929 - DNA, 25 bp, Mus musculus
gccatcattggctgcacttactact

SEQ ID NO: 548930 - DNA, 25 bp, Mus musculus
gccatccaacacaccgagtttgaag

SEQ ID NO: 548931 - DNA, 25 bp, Mus musculus
gccatccaacactccgagtttgaag

SEQ ID NO: 548932 - DNA, 25 bp, Mus musculus
gccatccaacagacaaagcagagtc

SEQ ID NO: 548933 - DNA, 25 bp, Mus musculus
gccatccaacagtcaaagcagagtc

SEQ ID NO: 548934 - DNA, 25 bp, Mus musculus
gccatccaacctagcaattcatttg

SEQ ID NO: 548935 - DNA, 25 bp, Mus musculus
gccatccaaccttgcaattcatttg

SEQ ID NO: 548936 - DNA, 25 bp, Mus musculus
gccatccacattccctgatatttag

SEQ ID NO: 548937 - DNA, 25 bp, Mus musculus
gccatccacattgcctgatatttag

SEQ ID NO: 548938 - DNA, 25 bp, Mus musculus
gccatccactccaatgaacagactt

SEQ ID NO: 548939 - DNA, 25 bp, Mus musculus
gccatccactcctatgaacagactt

SEQ ID NO: 548940 - DNA, 25 bp, Mus musculus
gccatccacttccaagatgggttaa

SEQ ID NO: 548941 - DNA, 25 bp, Mus musculus
gccatccacttcgaagatgggttaa

SEQ ID NO: 548942 - DNA, 25 bp, Mus musculus
gccatccagcccagcgggttaggga

SEQ ID NO: 548943 - DNA, 25 bp, Mus musculus
gccatccagccctgcgggttaggga

SEQ ID NO: 548944 - DNA, 25 bp, Mus musculus
gccatccagtagaccatggtcatga

SEQ ID NO: 548945 - DNA, 25 bp, Mus musculus
gccatccagtagtccatggtcatga

SEQ ID NO: 548946 - DNA, 25 bp, Mus musculus
gccatcccaggcagtatctacagaa

SEQ ID NO: 548947 - DNA, 25 bp, Mus musculus
gccatcccaggctgtatctacagaa

SEQ ID NO: 548948 - DNA, 25 bp, Mus musculus
gccatcccgaagcacacacatgtga

SEQ ID NO: 548949 - DNA, 25 bp, Mus musculus
gccatcccgaaggacacacatgtga

SEQ ID NO: 548950 - DNA, 25 bp, Mus musculus
gccatccctgatcctctgtaaagaa

SEQ ID NO: 548951 - DNA, 25 bp, Mus musculus
gccatccctgatgctctgtaaagaa

SEQ ID NO: 548952 - DNA, 25 bp, Mus musculus
gccatccctgttctaaactctgtct

SEQ ID NO: 548953 - DNA, 25 bp, Mus musculus
gccatccctgttgtaaactctgtct

SEQ ID NO: 548954 - DNA, 25 bp, Mus musculus
gccatccgagaacaaacaggtagtc

SEQ ID NO: 548955 - DNA, 25 bp, Mus musculus
gccatccgagaagaaacaggtagtc

SEQ ID NO: 548956 - DNA, 25 bp, Mus musculus
gccatccgagatcctgagcgtgtaa

SEQ ID NO: 548957 - DNA, 25 bp, Mus musculus
gccatccgagatgctgagcgtgtaa

SEQ ID NO: 548958 - DNA, 25 bp, Mus musculus
gccatccgatatacctagcactata

SEQ ID NO: 548959 - DNA, 25 bp, Mus musculus
gccatccgatattcctagcactata

SEQ ID NO: 548960 - DNA, 25 bp, Mus musculus
gccatccgcgagattgcagagcaca

SEQ ID NO: 548961 - DNA, 25 bp, Mus musculus
gccatccgcgagtttgcagagcaca

SEQ ID NO: 548962 - DNA, 25 bp, Mus musculus
gccatccgcttactgttacgttgaa

SEQ ID NO: 548963 - DNA, 25 bp, Mus musculus
gccatccgcttagtgttacgttgaa

SEQ ID NO: 548964 - DNA, 25 bp, Mus musculus
gccatccgtaatccaacatgttcag

SEQ ID NO: 548965 - DNA, 25 bp, Mus musculus
gccatccgtaatgcaacatgttcag

SEQ ID NO: 548966 - DNA, 25 bp, Mus musculus
gccatccgtagtcagtatgctcatt

SEQ ID NO: 548967 - DNA, 25 bp, Mus musculus
gccatccgtagtgagtatgctcatt

SEQ ID NO: 548968 - DNA, 25 bp, Mus musculus
gccatccgttagagtgtcatatctt

SEQ ID NO: 548969 - DNA, 25 bp, Mus musculus
gccatccgttagtgtgtcatatctt

SEQ ID NO: 548970 - DNA, 25 bp, Mus musculus
gccatcctaagaccaaaggtccctg

SEQ ID NO: 548971 - DNA, 25 bp, Mus musculus
gccatcctaagagcaaaggtccctg

SEQ ID NO: 548972 - DNA, 25 bp, Mus musculus
gccatcctaattacgtttctgtacc

SEQ ID NO: 548973 - DNA, 25 bp, Mus musculus
gccatcctaatttcgtttctgtacc

SEQ ID NO: 548974 - DNA, 25 bp, Mus musculus
gccatcctacagaattactctgcgt

SEQ ID NO: 548975 - DNA, 25 bp, Mus musculus
gccatcctacagtattactctgcgt

SEQ ID NO: 548976 - DNA, 25 bp, Mus musculus
gccatcctaggaatatcggtgcaga

SEQ ID NO: 548977 - DNA, 25 bp, Mus musculus
gccatcctaggattatcggtgcaga

SEQ ID NO: 548978 - DNA, 25 bp, Mus musculus
gccatcctaggcagtgcatgcaata

SEQ ID NO: 548979 - DNA, 25 bp, Mus musculus
gccatcctaggctgtgcatgcaata

SEQ ID NO: 548980 - DNA, 25 bp, Mus musculus
gccatcctatggatttttatatctt

SEQ ID NO: 548981 - DNA, 25 bp, Mus musculus
gccatcctatggttttttatatctt

SEQ ID NO: 548982 - DNA, 25 bp, Mus musculus
gccatcctatttactgaaagactca

SEQ ID NO: 548983 - DNA, 25 bp, Mus musculus
gccatcctattttctgaaagactca

SEQ ID NO: 548984 - DNA, 25 bp, Mus musculus
gccatcctgattacaatccgcagaa

SEQ ID NO: 548985 - DNA, 25 bp, Mus musculus
gccatcctgatttcaatccgcagaa

SEQ ID NO: 548986 - DNA, 25 bp, Mus musculus
gccatcctttctaactcagtaactg

SEQ ID NO: 548987 - DNA, 25 bp, Mus musculus
gccatcctttcttactcagtaactg

SEQ ID NO: 548988 - DNA, 25 bp, Mus musculus
gccatcctttggctggttttaaagc

SEQ ID NO: 548989 - DNA, 25 bp, Mus musculus
gccatcctttgggtggttttaaagc

SEQ ID NO: 548990 - DNA, 25 bp, Mus musculus
gccatcgaaagacgacctctacttt

SEQ ID NO: 548991 - DNA, 25 bp, Mus musculus
gccatcgaaagaggacctctacttt

SEQ ID NO: 548992 - DNA, 25 bp, Mus musculus
gccatcgacttaattattcatctca

SEQ ID NO: 548993 - DNA, 25 bp, Mus musculus
gccatcgacttatttattcatctca

SEQ ID NO: 548994 - DNA, 25 bp, Mus musculus
gccatcgaggaacggtaccggctac

SEQ ID NO: 548995 - DNA, 25 bp, Mus musculus
gccatcgaggaagggtaccggctac

SEQ ID NO: 548996 - DNA, 25 bp, Mus musculus
gccatcgatcagacctacttcatag

SEQ ID NO: 548997 - DNA, 25 bp, Mus musculus
gccatcgatcagtcctacttcatag

SEQ ID NO: 548998 - DNA, 25 bp, Mus musculus
gccatcgatgcaatttcgttctgta

SEQ ID NO: 548999 - DNA, 25 bp, Mus musculus
gccatcgatgcattttcgttctgta

SEQ ID NO: 549000 - DNA, 25 bp, Mus musculus
gccatcgatgctagctggttgtgga

SEQ ID NO: 549001 - DNA, 25 bp, Mus musculus
gccatcgatgcttgctggttgtgga

SEQ ID NO: 549002 - DNA, 25 bp, Mus musculus
gccatcgcaaacctcacatgttgaa

SEQ ID NO: 549003 - DNA, 25 bp, Mus musculus
gccatcgcaaacgtcacatgttgaa

SEQ ID NO: 549004 - DNA, 25 bp, Mus musculus
gccatcgcccagcagatctatgtag

SEQ ID NO: 549005 - DNA, 25 bp, Mus musculus
gccatcgcccaggagatctatgtag

SEQ ID NO: 549006 - DNA, 25 bp, Mus musculus
gccatcgcggagaaactggacctta

SEQ ID NO: 549007 - DNA, 25 bp, Mus musculus
gccatcgcggagtaactggacctta

SEQ ID NO: 549008 - DNA, 25 bp, Mus musculus
gccatcgcgtttatcgtcaaaggac

SEQ ID NO: 549009 - DNA, 25 bp, Mus musculus
gccatcgcgtttttcgtcaaaggac

SEQ ID NO: 549010 - DNA, 25 bp, Mus musculus
gccatcggccggagtggtatgattt

SEQ ID NO: 549011 - DNA, 25 bp, Mus musculus
gccatcggccggtgtggtatgattt

SEQ ID NO: 549012 - DNA, 25 bp, Mus musculus
gccatcggtgttcggacttactaaa

SEQ ID NO: 549013 - DNA, 25 bp, Mus musculus
gccatcggtgttgggacttactaaa

SEQ ID NO: 549014 - DNA, 25 bp, Mus musculus
gccatcgtcatcatcctggtggtct

SEQ ID NO: 549015 - DNA, 25 bp, Mus musculus
gccatcgtcatcttcctggtggtct

SEQ ID NO: 549016 - DNA, 25 bp, Mus musculus
gccatcgtggagcacttggtgactt

SEQ ID NO: 549017 - DNA, 25 bp, Mus musculus
gccatcgtggaggacttggtgactt

SEQ ID NO: 549018 - DNA, 25 bp, Mus musculus
gccatcgtggctatgatttgggatt

SEQ ID NO: 549019 - DNA, 25 bp, Mus musculus
gccatcgtggctttgatttgggatt

SEQ ID NO: 549020 - DNA, 25 bp, Mus musculus
gccatcgttactatcttgaagccat

SEQ ID NO: 549021 - DNA, 25 bp, Mus musculus
gccatcgttactttcttgaagccat

SEQ ID NO: 549022 - DNA, 25 bp, Mus musculus
gccatcgttgtgatgttaatcctgt

SEQ ID NO: 549023 - DNA, 25 bp, Mus musculus
gccatcgttgtgttgttaatcctgt

SEQ ID NO: 549024 - DNA, 25 bp, Mus musculus
gccatctaaggcagctaattacgca

SEQ ID NO: 549025 - DNA, 25 bp, Mus musculus
gccatctaaggctgctaattacgca

SEQ ID NO: 549026 - DNA, 25 bp, Mus musculus
gccatctaatttaaatccttacaag

SEQ ID NO: 549027 - DNA, 25 bp, Mus musculus
gccatctaattttaatccttacaag

SEQ ID NO: 549028 - DNA, 25 bp, Mus musculus
gccatctaccttcggataaaacgga

SEQ ID NO: 549029 - DNA, 25 bp, Mus musculus
gccatctaccttgggataaaacgga

SEQ ID NO: 549030 - DNA, 25 bp, Mus musculus
gccatctagggtagaagaaaatgac

SEQ ID NO: 549031 - DNA, 25 bp, Mus musculus
gccatctagggttgaagaaaatgac

SEQ ID NO: 549032 - DNA, 25 bp, Mus musculus
gccatctatcatctcttggcacatg

SEQ ID NO: 549033 - DNA, 25 bp, Mus musculus
gccatctatcatgtcttggcacatg

SEQ ID NO: 549034 - DNA, 25 bp, Mus musculus
gccatctatgcccactagtgtttat

SEQ ID NO: 549035 - DNA, 25 bp, Mus musculus
gccatctatgccgactagtgtttat

SEQ ID NO: 549036 - DNA, 25 bp, Mus musculus
gccatctatgctatgcttgactcaa

SEQ ID NO: 549037 - DNA, 25 bp, Mus musculus
gccatctatgctttgcttgactcaa

SEQ ID NO: 549038 - DNA, 25 bp, Mus musculus
gccatctcaagaaaaggtaccagtg

SEQ ID NO: 549039 - DNA, 25 bp, Mus musculus
gccatctcaagataaggtaccagtg

SEQ ID NO: 549040 - DNA, 25 bp, Mus musculus
gccatctcaccaccgagaacatttt

SEQ ID NO: 549041 - DNA, 25 bp, Mus musculus
gccatctcaccagcgagaacatttt

SEQ ID NO: 549042 - DNA, 25 bp, Mus musculus
gccatctcactgaacaagagctgca

SEQ ID NO: 549043 - DNA, 25 bp, Mus musculus
gccatctcactgtacaagagctgca

SEQ ID NO: 549044 - DNA, 25 bp, Mus musculus
gccatctccaaacttgatctcaatg

SEQ ID NO: 549045 - DNA, 25 bp, Mus musculus
gccatctccaaagttgatctcaatg

SEQ ID NO: 549046 - DNA, 25 bp, Mus musculus
gccatctcctctagctaaaaatcta

SEQ ID NO: 549047 - DNA, 25 bp, Mus musculus
gccatctcctcttgctaaaaatcta

SEQ ID NO: 549048 - DNA, 25 bp, Mus musculus
gccatctccttcagtgctaggatgt

SEQ ID NO: 549049 - DNA, 25 bp, Mus musculus
gccatctccttctgtgctaggatgt

SEQ ID NO: 549050 - DNA, 25 bp, Mus musculus
gccatctctagaacacattgctgtt

SEQ ID NO: 549051 - DNA, 25 bp, Mus musculus
gccatctctagatcacattgctgtt

SEQ ID NO: 549052 - DNA, 25 bp, Mus musculus
gccatctctcatatctactgtacaa

SEQ ID NO: 549053 - DNA, 25 bp, Mus musculus
gccatctctcatttctactgtacaa

SEQ ID NO: 549054 - DNA, 25 bp, Mus musculus
gccatctctccaacattagctttaa

SEQ ID NO: 549055 - DNA, 25 bp, Mus musculus
gccatctctccatcattagctttaa

SEQ ID NO: 549056 - DNA, 25 bp, Mus musculus
gccatctctgtccttcctggaatac

SEQ ID NO: 549057 - DNA, 25 bp, Mus musculus
gccatctctgtcgttcctggaatac

SEQ ID NO: 549058 - DNA, 25 bp, Mus musculus
gccatctctgtgacagtttggattt

SEQ ID NO: 549059 - DNA, 25 bp, Mus musculus
gccatctctgtgtcagtttggattt

SEQ ID NO: 549060 - DNA, 25 bp, Mus musculus
gccatctctgttcctgatcagggtc

SEQ ID NO: 549061 - DNA, 25 bp, Mus musculus
gccatctctgttgctgatcagggtc

SEQ ID NO: 549062 - DNA, 25 bp, Mus musculus
gccatctcttcaataaacgtttctc

SEQ ID NO: 549063 - DNA, 25 bp, Mus musculus
gccatctcttcacgccattgtttaa

SEQ ID NO: 549064 - DNA, 25 bp, Mus musculus
gccatctcttcactctacaaagctt

SEQ ID NO: 549065 - DNA, 25 bp, Mus musculus
gccatctcttcaggccattgtttaa

SEQ ID NO: 549066 - DNA, 25 bp, Mus musculus
gccatctcttcagtctacaaagctt

SEQ ID NO: 549067 - DNA, 25 bp, Mus musculus
gccatctcttcattaaacgtttctc

SEQ ID NO: 549068 - DNA, 25 bp, Mus musculus
gccatctcttctaatgactgcatta

SEQ ID NO: 549069 - DNA, 25 bp, Mus musculus
gccatctcttcttatgactgcatta

SEQ ID NO: 549070 - DNA, 25 bp, Mus musculus
gccatctcttgaactagttttacgg

SEQ ID NO: 549071 - DNA, 25 bp, Mus musculus
gccatctcttgatctagttttacgg

SEQ ID NO: 549072 - DNA, 25 bp, Mus musculus
gccatctctttcacaaatagtcagt

SEQ ID NO: 549073 - DNA, 25 bp, Mus musculus
gccatctctttctcaaatagtcagt

SEQ ID NO: 549074 - DNA, 25 bp, Mus musculus
gccatctgcataatctttgctagca

SEQ ID NO: 549075 - DNA, 25 bp, Mus musculus
gccatctgcatattctttgctagca

SEQ ID NO: 549076 - DNA, 25 bp, Mus musculus
gccatctgccatcctgaggctttgt

SEQ ID NO: 549077 - DNA, 25 bp, Mus musculus
gccatctgccatgctgaggctttgt

SEQ ID NO: 549078 - DNA, 25 bp, Mus musculus
gccatctgcccacgattgagataca

SEQ ID NO: 549079 - DNA, 25 bp, Mus musculus
gccatctgcccaggattgagataca

SEQ ID NO: 549080 - DNA, 25 bp, Mus musculus
gccatctgccgactgactgatggga

SEQ ID NO: 549081 - DNA, 25 bp, Mus musculus
gccatctgccgagtgactgatggga

SEQ ID NO: 549082 - DNA, 25 bp, Mus musculus
gccatctgcctaagaaaccgtagaa

SEQ ID NO: 549083 - DNA, 25 bp, Mus musculus
gccatctgcctatgaaaccgtagaa

SEQ ID NO: 549084 - DNA, 25 bp, Mus musculus
gccatctgcctgaatgttgacatgc

SEQ ID NO: 549085 - DNA, 25 bp, Mus musculus
gccatctgcctgtatgttgacatgc

SEQ ID NO: 549086 - DNA, 25 bp, Mus musculus
gccatctgcgtgctcatagaccact

SEQ ID NO: 549087 - DNA, 25 bp, Mus musculus
gccatctgcgtggtcatagaccact

SEQ ID NO: 549088 - DNA, 25 bp, Mus musculus
gccatctggcaaaataaactctagg

SEQ ID NO: 549089 - DNA, 25 bp, Mus musculus
gccatctggcaatataaactctagg

SEQ ID NO: 549090 - DNA, 25 bp, Mus musculus
gccatctgtaaaacctaagcctgaa

SEQ ID NO: 549091 - DNA, 25 bp, Mus musculus
gccatctgtaaatcctaagcctgaa

SEQ ID NO: 549092 - DNA, 25 bp, Mus musculus
gccatctgtccaccctatgtattta

SEQ ID NO: 549093 - DNA, 25 bp, Mus musculus
gccatctgtccagcctatgtattta

SEQ ID NO: 549094 - DNA, 25 bp, Mus musculus
gccatctgtctcatatgatttataa

SEQ ID NO: 549095 - DNA, 25 bp, Mus musculus
gccatctgtctcttatgatttataa

SEQ ID NO: 549096 - DNA, 25 bp, Mus musculus
gccatctgtgcaatgagtgttccga

SEQ ID NO: 549097 - DNA, 25 bp, Mus musculus
gccatctgtgcattgagtgttccga

SEQ ID NO: 549098 - DNA, 25 bp, Mus musculus
gccatctgttgtactaactatcgta

SEQ ID NO: 549099 - DNA, 25 bp, Mus musculus
gccatctgttgttctaactatcgta

SEQ ID NO: 549100 - DNA, 25 bp, Mus musculus
gccatcttatcacatctttgccctg

SEQ ID NO: 549101 - DNA, 25 bp, Mus musculus
gccatcttatcagatctttgccctg

SEQ ID NO: 549102 - DNA, 25 bp, Mus musculus
gccatcttattgactgttacattgt

SEQ ID NO: 549103 - DNA, 25 bp, Mus musculus
gccatcttattgtctgttacattgt

SEQ ID NO: 549104 - DNA, 25 bp, Mus musculus
gccatcttcaccagtggatgctgaa

SEQ ID NO: 549105 - DNA, 25 bp, Mus musculus
gccatcttcacctgtggatgctgaa

SEQ ID NO: 549106 - DNA, 25 bp, Mus musculus
gccatcttcagaaccatttaatttt

SEQ ID NO: 549107 - DNA, 25 bp, Mus musculus
gccatcttcagatccatttaatttt

SEQ ID NO: 549108 - DNA, 25 bp, Mus musculus
gccatcttctagcagtcgtggttga

SEQ ID NO: 549109 - DNA, 25 bp, Mus musculus
gccatcttctaggagtcgtggttga

SEQ ID NO: 549110 - DNA, 25 bp, Mus musculus
gccatcttctgccacatatgtggac

SEQ ID NO: 549111 - DNA, 25 bp, Mus musculus
gccatcttctgcgacatatgtggac

SEQ ID NO: 549112 - DNA, 25 bp, Mus musculus
gccatcttctggagacgggtgtgtc

SEQ ID NO: 549113 - DNA, 25 bp, Mus musculus
gccatcttctggtgacgggtgtgtc

SEQ ID NO: 549114 - DNA, 25 bp, Mus musculus
gccatcttgaaaagtgccctttact

SEQ ID NO: 549115 - DNA, 25 bp, Mus musculus
gccatcttgaaatgtgccctttact

SEQ ID NO: 549116 - DNA, 25 bp, Mus musculus
gccatcttgattaacctgagttcca

SEQ ID NO: 549117 - DNA, 25 bp, Mus musculus
gccatcttgatttacctgagttcca

SEQ ID NO: 549118 - DNA, 25 bp, Mus musculus
gccatcttgctgctctgatgactat

SEQ ID NO: 549119 - DNA, 25 bp, Mus musculus
gccatcttgctggtctgatgactat

SEQ ID NO: 549120 - DNA, 25 bp, Mus musculus
gccatcttggctctcttggctgtga

SEQ ID NO: 549121 - DNA, 25 bp, Mus musculus
gccatcttggctgtcttggctgtga

SEQ ID NO: 549122 - DNA, 25 bp, Mus musculus
gccatcttgggcattcctgagggtc

SEQ ID NO: 549123 - DNA, 25 bp, Mus musculus
gccatcttgggctttcctgagggtc

SEQ ID NO: 549124 - DNA, 25 bp, Mus musculus
gccatcttggttccagtgctggaaa

SEQ ID NO: 549125 - DNA, 25 bp, Mus musculus
gccatcttggttgcagtgctggaaa

SEQ ID NO: 549126 - DNA, 25 bp, Mus musculus
gccatctttcataggctggtgtgga

SEQ ID NO: 549127 - DNA, 25 bp, Mus musculus
gccatctttcattggctggtgtgga

SEQ ID NO: 549128 - DNA, 25 bp, Mus musculus
gccatctttgagctgctggactaca

SEQ ID NO: 549129 - DNA, 25 bp, Mus musculus
gccatctttgaggtgctggactaca

SEQ ID NO: 549130 - DNA, 25 bp, Mus musculus
gccatcttttagctccaagactcgt

SEQ ID NO: 549131 - DNA, 25 bp, Mus musculus
gccatcttttaggtccaagactcgt

SEQ ID NO: 549132 - DNA, 25 bp, Mus musculus
gccatgaaaggcatctgcatcctga

SEQ ID NO: 549133 - DNA, 25 bp, Mus musculus
gccatgaaaggcttctgcatcctga

SEQ ID NO: 549134 - DNA, 25 bp, Mus musculus
gccatgaagcagactgggagccagt

SEQ ID NO: 549135 - DNA, 25 bp, Mus musculus
gccatgaagcagtctgggagccagt

SEQ ID NO: 549136 - DNA, 25 bp, Mus musculus
gccatgaagcatctggagcctcaag

SEQ ID NO: 549137 - DNA, 25 bp, Mus musculus
gccatgaagcatgtggagcctcaag

SEQ ID NO: 549138 - DNA, 25 bp, Mus musculus
gccatgaagccaacaagctgctggt

SEQ ID NO: 549139 - DNA, 25 bp, Mus musculus
gccatgaagccatcaagctgctggt

SEQ ID NO: 549140 - DNA, 25 bp, Mus musculus
gccatgaagggcagaactcacagaa

SEQ ID NO: 549141 - DNA, 25 bp, Mus musculus
gccatgaagggccagatctgaccat

SEQ ID NO: 549142 - DNA, 25 bp, Mus musculus
gccatgaagggcgagatctgaccat

SEQ ID NO: 549143 - DNA, 25 bp, Mus musculus
gccatgaagggctgaactcacagaa

SEQ ID NO: 549144 - DNA, 25 bp, Mus musculus
gccatgaagtgcagctggaacacct

SEQ ID NO: 549145 - DNA, 25 bp, Mus musculus
gccatgaagtgctgctggaacacct

SEQ ID NO: 549146 - DNA, 25 bp, Mus musculus
gccatgacaggacttgttgttcccc

SEQ ID NO: 549147 - DNA, 25 bp, Mus musculus
gccatgacaggagttgttgttcccc

SEQ ID NO: 549148 - DNA, 25 bp, Mus musculus
gccatgacgactactcttactttga

SEQ ID NO: 549149 - DNA, 25 bp, Mus musculus
gccatgacgacttctcttactttga

SEQ ID NO: 549150 - DNA, 25 bp, Mus musculus
gccatgagacagagccaagtgaaat

SEQ ID NO: 549151 - DNA, 25 bp, Mus musculus
gccatgagacagtgccaagtgaaat

SEQ ID NO: 549152 - DNA, 25 bp, Mus musculus
gccatgagacccaaggcagtaatag

SEQ ID NO: 549153 - DNA, 25 bp, Mus musculus
gccatgagaccctaggcagtaatag

SEQ ID NO: 549154 - DNA, 25 bp, Mus musculus
gccatgagactgcttctgagaacat

SEQ ID NO: 549155 - DNA, 25 bp, Mus musculus
gccatgagactggttctgagaacat

SEQ ID NO: 549156 - DNA, 25 bp, Mus musculus
gccatgagatttaagtagagcgcct

SEQ ID NO: 549157 - DNA, 25 bp, Mus musculus
gccatgagattttagtagagcgcct

SEQ ID NO: 549158 - DNA, 25 bp, Mus musculus
gccatgagcagaatctattaccggg

SEQ ID NO: 549159 - DNA, 25 bp, Mus musculus
gccatgagcagattctattaccggg

SEQ ID NO: 549160 - DNA, 25 bp, Mus musculus
gccatgagctgcctttgcgcggcaa

SEQ ID NO: 549161 - DNA, 25 bp, Mus musculus
gccatgagctgcgtttgcgcggcaa

SEQ ID NO: 549162 - DNA, 25 bp, Mus musculus
gccatgagtcccacgttcgaagccg

SEQ ID NO: 549163 - DNA, 25 bp, Mus musculus
gccatgagtccctcgttcgaagccg

SEQ ID NO: 549164 - DNA, 25 bp, Mus musculus
gccatgatagtacaagcctgctcct

SEQ ID NO: 549165 - DNA, 25 bp, Mus musculus
gccatgatagtagaagcctgctcct

SEQ ID NO: 549166 - DNA, 25 bp, Mus musculus
gccatgatatggctctgccttgaaa

SEQ ID NO: 549167 - DNA, 25 bp, Mus musculus
gccatgatatgggtctgccttgaaa

SEQ ID NO: 549168 - DNA, 25 bp, Mus musculus
gccatgatcggaatgtggtcaccat

SEQ ID NO: 549169 - DNA, 25 bp, Mus musculus
gccatgatcggattgtggtcaccat

SEQ ID NO: 549170 - DNA, 25 bp, Mus musculus
gccatgatgacccatgactgaccag

SEQ ID NO: 549171 - DNA, 25 bp, Mus musculus
gccatgatgaccgatgactgaccag

SEQ ID NO: 549172 - DNA, 25 bp, Mus musculus
gccatgatgaggagctacaaattga

SEQ ID NO: 549173 - DNA, 25 bp, Mus musculus
gccatgatgaggtgctacaaattga

SEQ ID NO: 549174 - DNA, 25 bp, Mus musculus
gccatgatgcatcccttagaagtgt

SEQ ID NO: 549175 - DNA, 25 bp, Mus musculus
gccatgatgcatgccttagaagtgt

SEQ ID NO: 549176 - DNA, 25 bp, Mus musculus
gccatgattatcagctacacacgga

SEQ ID NO: 549177 - DNA, 25 bp, Mus musculus
gccatgattatctgctacacacgga

SEQ ID NO: 549178 - DNA, 25 bp, Mus musculus
gccatgattgcaattctcctgggaa

SEQ ID NO: 549179 - DNA, 25 bp, Mus musculus
gccatgattgcatttctcctgggaa

SEQ ID NO: 549180 - DNA, 25 bp, Mus musculus
gccatgattgtaattgttttcattt

SEQ ID NO: 549181 - DNA, 25 bp, Mus musculus
gccatgattgtatttgttttcattt

SEQ ID NO: 549182 - DNA, 25 bp, Mus musculus
gccatgattttgaaagagagctaga

SEQ ID NO: 549183 - DNA, 25 bp, Mus musculus
gccatgattttgtaagagagctaga

SEQ ID NO: 549184 - DNA, 25 bp, Mus musculus
gccatgcaacttcagagtgactact

SEQ ID NO: 549185 - DNA, 25 bp, Mus musculus
gccatgcaacttgagagtgactact

SEQ ID NO: 549186 - DNA, 25 bp, Mus musculus
gccatgcacaacattgtccctattt

SEQ ID NO: 549187 - DNA, 25 bp, Mus musculus
gccatgcacaactttgtccctattt

SEQ ID NO: 549188 - DNA, 25 bp, Mus musculus
gccatgcacacacgcctgaagagct

SEQ ID NO: 549189 - DNA, 25 bp, Mus musculus
gccatgcacacaggcctgaagagct

SEQ ID NO: 549190 - DNA, 25 bp, Mus musculus
gccatgcactttaaattgctctcca

SEQ ID NO: 549191 - DNA, 25 bp, Mus musculus
gccatgcacttttaattgctctcca

SEQ ID NO: 549192 - DNA, 25 bp, Mus musculus
gccatgcagaacatcttccagaaga

SEQ ID NO: 549193 - DNA, 25 bp, Mus musculus
gccatgcagaacttcttccagaaga

SEQ ID NO: 549194 - DNA, 25 bp, Mus musculus
gccatgcagatgaccctgcagggaa

SEQ ID NO: 549195 - DNA, 25 bp, Mus musculus
gccatgcagatgtccctgcagggaa

SEQ ID NO: 549196 - DNA, 25 bp, Mus musculus
gccatgcagggccaggaagattatt

SEQ ID NO: 549197 - DNA, 25 bp, Mus musculus
gccatgcagggcgaggaagattatt

SEQ ID NO: 549198 - DNA, 25 bp, Mus musculus
gccatgcagtacatcaccaagggat

SEQ ID NO: 549199 - DNA, 25 bp, Mus musculus
gccatgcagtacttcaccaagggat

SEQ ID NO: 549200 - DNA, 25 bp, Mus musculus
gccatgcatacaactgggcagcaga

SEQ ID NO: 549201 - DNA, 25 bp, Mus musculus
gccatgcatacatctgggcagcaga

SEQ ID NO: 549202 - DNA, 25 bp, Mus musculus
gccatgcatctcaacattcagtggg

SEQ ID NO: 549203 - DNA, 25 bp, Mus musculus
gccatgcatctctacattcagtggg

SEQ ID NO: 549204 - DNA, 25 bp, Mus musculus
gccatgcatggcaagattataaact

SEQ ID NO: 549205 - DNA, 25 bp, Mus musculus
gccatgcatggctagattataaact

SEQ ID NO: 549206 - DNA, 25 bp, Mus musculus
gccatgcatttgatcgctgggtaac

SEQ ID NO: 549207 - DNA, 25 bp, Mus musculus
gccatgcatttgttcgctgggtaac

SEQ ID NO: 549208 - DNA, 25 bp, Mus musculus
gccatgcattttaaaacctaggaag

SEQ ID NO: 549209 - DNA, 25 bp, Mus musculus
gccatgcatttttaaacctaggaag

SEQ ID NO: 549210 - DNA, 25 bp, Mus musculus
gccatgccatggcttagttgtataa

SEQ ID NO: 549211 - DNA, 25 bp, Mus musculus
gccatgccatgggttagttgtataa

SEQ ID NO: 549212 - DNA, 25 bp, Mus musculus
gccatgcccaacatgtttttgactt

SEQ ID NO: 549213 - DNA, 25 bp, Mus musculus
gccatgcccaacttgtttttgactt

SEQ ID NO: 549214 - DNA, 25 bp, Mus musculus
gccatgcccatcaatagctttcgat

SEQ ID NO: 549215 - DNA, 25 bp, Mus musculus
gccatgcccatctatagctttcgat

SEQ ID NO: 549216 - DNA, 25 bp, Mus musculus
gccatgcccatgaaggtgttgctta

SEQ ID NO: 549217 - DNA, 25 bp, Mus musculus
gccatgcccatgtaggtgttgctta

SEQ ID NO: 549218 - DNA, 25 bp, Mus musculus
gccatgcccgatcaagccttgtgtg

SEQ ID NO: 549219 - DNA, 25 bp, Mus musculus
gccatgcccgatgaagccttgtgtg

SEQ ID NO: 549220 - DNA, 25 bp, Mus musculus
gccatgccttcaaaacacatcttga

SEQ ID NO: 549221 - DNA, 25 bp, Mus musculus
gccatgccttcataacacatcttga

SEQ ID NO: 549222 - DNA, 25 bp, Mus musculus
gccatgcgacggaggctttctgacc

SEQ ID NO: 549223 - DNA, 25 bp, Mus musculus
gccatgcgacggtggctttctgacc

SEQ ID NO: 549224 - DNA, 25 bp, Mus musculus
gccatgcgcagtcatcaagatctat

SEQ ID NO: 549225 - DNA, 25 bp, Mus musculus
gccatgcgcagtgatcaagatctat

SEQ ID NO: 549226 - DNA, 25 bp, Mus musculus
gccatgcggttaattcctgacttag

SEQ ID NO: 549227 - DNA, 25 bp, Mus musculus
gccatgcggttatttcctgacttag

SEQ ID NO: 549228 - DNA, 25 bp, Mus musculus
gccatgctaagaagtgtggccacat

SEQ ID NO: 549229 - DNA, 25 bp, Mus musculus
gccatgctaagatgtgtggccacat

SEQ ID NO: 549230 - DNA, 25 bp, Mus musculus
gccatgctaatcatacctgtacagt

SEQ ID NO: 549231 - DNA, 25 bp, Mus musculus
gccatgctaatcttacctgtacagt

SEQ ID NO: 549232 - DNA, 25 bp, Mus musculus
gccatgctatgtaagtaattttcaa

SEQ ID NO: 549233 - DNA, 25 bp, Mus musculus
gccatgctatgttagtaattttcaa

SEQ ID NO: 549234 - DNA, 25 bp, Mus musculus
gccatgctgaacctgtattacattg

SEQ ID NO: 549235 - DNA, 25 bp, Mus musculus
gccatgctgaacgtgtattacattg

SEQ ID NO: 549236 - DNA, 25 bp, Mus musculus
gccatgctgaatctgaatcatcttg

SEQ ID NO: 549237 - DNA, 25 bp, Mus musculus
gccatgctgaatgtgaatcatcttg

SEQ ID NO: 549238 - DNA, 25 bp, Mus musculus
gccatgctgctacaaagtcatgctt

SEQ ID NO: 549239 - DNA, 25 bp, Mus musculus
gccatgctgctagaaagtcatgctt

SEQ ID NO: 549240 - DNA, 25 bp, Mus musculus
gccatgctggccaatgtgtttcaga

SEQ ID NO: 549241 - DNA, 25 bp, Mus musculus
gccatgctggcctatgtgtttcaga

SEQ ID NO: 549242 - DNA, 25 bp, Mus musculus
gccatgctggttcatagagtccctg

SEQ ID NO: 549243 - DNA, 25 bp, Mus musculus
gccatgctggttgatagagtccctg

SEQ ID NO: 549244 - DNA, 25 bp, Mus musculus
gccatgctgtgaacttatcttcatc

SEQ ID NO: 549245 - DNA, 25 bp, Mus musculus
gccatgctgtgatcttatcttcatc

SEQ ID NO: 549246 - DNA, 25 bp, Mus musculus
gccatgcttaggagtgattcctcag

SEQ ID NO: 549247 - DNA, 25 bp, Mus musculus
gccatgcttaggtgtgattcctcag

SEQ ID NO: 549248 - DNA, 25 bp, Mus musculus
gccatgcttcataacatcgaccaag

SEQ ID NO: 549249 - DNA, 25 bp, Mus musculus
gccatgcttcattacatcgaccaag

SEQ ID NO: 549250 - DNA, 25 bp, Mus musculus
gccatgcttctcatcataactagta

SEQ ID NO: 549251 - DNA, 25 bp, Mus musculus
gccatgcttctcttcataactagta

SEQ ID NO: 549252 - DNA, 25 bp, Mus musculus
gccatgcttgcactcagtgtgaaca

SEQ ID NO: 549253 - DNA, 25 bp, Mus musculus
gccatgcttgcagtcagtgtgaaca

SEQ ID NO: 549254 - DNA, 25 bp, Mus musculus
gccatgctttctccctgaatgatac

SEQ ID NO: 549255 - DNA, 25 bp, Mus musculus
gccatgctttctgcctgaatgatac

SEQ ID NO: 549256 - DNA, 25 bp, Mus musculus
gccatggaacatcccagctctgtgg

SEQ ID NO: 549257 - DNA, 25 bp, Mus musculus
gccatggaacatgccagctctgtgg

SEQ ID NO: 549258 - DNA, 25 bp, Mus musculus
gccatggaagtcacaggagaggtct

SEQ ID NO: 549259 - DNA, 25 bp, Mus musculus
gccatggaagtctcaggagaggtct

SEQ ID NO: 549260 - DNA, 25 bp, Mus musculus
gccatggaatggagactgcctttct

SEQ ID NO: 549261 - DNA, 25 bp, Mus musculus
gccatggaatggtgactgcctttct

SEQ ID NO: 549262 - DNA, 25 bp, Mus musculus
gccatggactttaggtctaaaggac

SEQ ID NO: 549263 - DNA, 25 bp, Mus musculus
gccatggacttttggtctaaaggac

SEQ ID NO: 549264 - DNA, 25 bp, Mus musculus
gccatggagatcagaggccaacttt

SEQ ID NO: 549265 - DNA, 25 bp, Mus musculus
gccatggagatctgaggccaacttt

SEQ ID NO: 549266 - DNA, 25 bp, Mus musculus
gccatggagttgctcaaagtgtcca

SEQ ID NO: 549267 - DNA, 25 bp, Mus musculus
gccatggagttggtcaaagtgtcca

SEQ ID NO: 549268 - DNA, 25 bp, Mus musculus
gccatggatacacttctctgcttaa

SEQ ID NO: 549269 - DNA, 25 bp, Mus musculus
gccatggatacagttctctgcttaa

SEQ ID NO: 549270 - DNA, 25 bp, Mus musculus
gccatggatgagatggacgccgtcc

SEQ ID NO: 549271 - DNA, 25 bp, Mus musculus
gccatggatgagttggacgccgtcc

SEQ ID NO: 549272 - DNA, 25 bp, Mus musculus
gccatggatgtaacctaaaaagttt

SEQ ID NO: 549273 - DNA, 25 bp, Mus musculus
gccatggatgtatcctaaaaagttt

SEQ ID NO: 549274 - DNA, 25 bp, Mus musculus
gccatggattataaagcccctctgt

SEQ ID NO: 549275 - DNA, 25 bp, Mus musculus
gccatggattattaagcccctctgt

SEQ ID NO: 549276 - DNA, 25 bp, Mus musculus
gccatggattggacaagtcaccaat

SEQ ID NO: 549277 - DNA, 25 bp, Mus musculus
gccatggattggtcaagtcaccaat

SEQ ID NO: 549278 - DNA, 25 bp, Mus musculus
gccatggcaacacagatacaaagca

SEQ ID NO: 549279 - DNA, 25 bp, Mus musculus
gccatggcaacagagatacaaagca

SEQ ID NO: 549280 - DNA, 25 bp, Mus musculus
gccatggcaagcaaaccttccctaa

SEQ ID NO: 549281 - DNA, 25 bp, Mus musculus
gccatggcaagctaaccttccctaa

SEQ ID NO: 549282 - DNA, 25 bp, Mus musculus
gccatggcacagctacctgtatata

SEQ ID NO: 549283 - DNA, 25 bp, Mus musculus
gccatggcacaggtacctgtatata

SEQ ID NO: 549284 - DNA, 25 bp, Mus musculus
gccatggcactgattctcaaagtca

SEQ ID NO: 549285 - DNA, 25 bp, Mus musculus
gccatggcactgtttctcaaagtca

SEQ ID NO: 549286 - DNA, 25 bp, Mus musculus
gccatggcagcaaaatacgacgact

SEQ ID NO: 549287 - DNA, 25 bp, Mus musculus
gccatggcagcataatacgacgact

SEQ ID NO: 549288 - DNA, 25 bp, Mus musculus
gccatggcagctctcagactgatga

SEQ ID NO: 549289 - DNA, 25 bp, Mus musculus
gccatggcagctgtcagactgatga

SEQ ID NO: 549290 - DNA, 25 bp, Mus musculus
gccatggcatccagtgtcctagatt

SEQ ID NO: 549291 - DNA, 25 bp, Mus musculus
gccatggcatcctgtgtcctagatt

SEQ ID NO: 549292 - DNA, 25 bp, Mus musculus
gccatggcattgattgtgcaactct

SEQ ID NO: 549293 - DNA, 25 bp, Mus musculus
gccatggcattgtttgtgcaactct

SEQ ID NO: 549294 - DNA, 25 bp, Mus musculus
gccatggcccgcaatgtgcaagaat

SEQ ID NO: 549295 - DNA, 25 bp, Mus musculus
gccatggcccgctatgtgcaagaat

SEQ ID NO: 549296 - DNA, 25 bp, Mus musculus
gccatggcctgtctgaaacttgaat

SEQ ID NO: 549297 - DNA, 25 bp, Mus musculus
gccatggcctgtgtgaaacttgaat

SEQ ID NO: 549298 - DNA, 25 bp, Mus musculus
gccatggcgggcatcaaagctttaa

SEQ ID NO: 549299 - DNA, 25 bp, Mus musculus
gccatggcgggcttcaaagctttaa

SEQ ID NO: 549300 - DNA, 25 bp, Mus musculus
gccatggcgtaccaggaacagaacc

SEQ ID NO: 549301 - DNA, 25 bp, Mus musculus
gccatggcgtacgaggaacagaacc

SEQ ID NO: 549302 - DNA, 25 bp, Mus musculus
gccatggctcgtagccctgagcaat

SEQ ID NO: 549303 - DNA, 25 bp, Mus musculus
gccatggctcgttgccctgagcaat

SEQ ID NO: 549304 - DNA, 25 bp, Mus musculus
gccatggctgagcaagagcgcttcc

SEQ ID NO: 549305 - DNA, 25 bp, Mus musculus
gccatggctgaggaagagcgcttcc

SEQ ID NO: 549306 - DNA, 25 bp, Mus musculus
gccatggctttgctgacgaagactg

SEQ ID NO: 549307 - DNA, 25 bp, Mus musculus
gccatggctttggtgacgaagactg

SEQ ID NO: 549308 - DNA, 25 bp, Mus musculus
gccatgggaactcagcagcgtctaa

SEQ ID NO: 549309 - DNA, 25 bp, Mus musculus
gccatgggaactgagcagcgtctaa

SEQ ID NO: 549310 - DNA, 25 bp, Mus musculus
gccatgggattcatgaaccgtgaag

SEQ ID NO: 549311 - DNA, 25 bp, Mus musculus
gccatgggattcttgaaccgtgaag

SEQ ID NO: 549312 - DNA, 25 bp, Mus musculus
gccatgggccgacatctacagagtg

SEQ ID NO: 549313 - DNA, 25 bp, Mus musculus
gccatgggccgagatctacagagtg

SEQ ID NO: 549314 - DNA, 25 bp, Mus musculus
gccatgggccgtctcaatgtgaaga

SEQ ID NO: 549315 - DNA, 25 bp, Mus musculus
gccatgggccgtgtcaatgtgaaga

SEQ ID NO: 549316 - DNA, 25 bp, Mus musculus
gccatgggtccactagtgatttatt

SEQ ID NO: 549317 - DNA, 25 bp, Mus musculus
gccatgggtccagtagtgatttatt

SEQ ID NO: 549318 - DNA, 25 bp, Mus musculus
gccatggtaacccacagctgcatta

SEQ ID NO: 549319 - DNA, 25 bp, Mus musculus
gccatggtaaccgacagctgcatta

SEQ ID NO: 549320 - DNA, 25 bp, Mus musculus
gccatggtacacacaggtagcctta

SEQ ID NO: 549321 - DNA, 25 bp, Mus musculus
gccatggtacactcaggtagcctta

SEQ ID NO: 549322 - DNA, 25 bp, Mus musculus
gccatggtagagattgtgaagcttc

SEQ ID NO: 549323 - DNA, 25 bp, Mus musculus
gccatggtagagtttgtgaagcttc

SEQ ID NO: 549324 - DNA, 25 bp, Mus musculus
gccatggtatcacgcagcatttgct

SEQ ID NO: 549325 - DNA, 25 bp, Mus musculus
gccatggtatcaggcagcatttgct

SEQ ID NO: 549326 - DNA, 25 bp, Mus musculus
gccatggtcaggagtacagtgtgcc

SEQ ID NO: 549327 - DNA, 25 bp, Mus musculus
gccatggtcaggtgtacagtgtgcc

SEQ ID NO: 549328 - DNA, 25 bp, Mus musculus
gccatggtccggcacactgtcatga

SEQ ID NO: 549329 - DNA, 25 bp, Mus musculus
gccatggtccgggacactgtcatga

SEQ ID NO: 549330 - DNA, 25 bp, Mus musculus
gccatggtcgaacgcatctataagt

SEQ ID NO: 549331 - DNA, 25 bp, Mus musculus
gccatggtcgaaggcatctataagt

SEQ ID NO: 549332 - DNA, 25 bp, Mus musculus
gccatggtggacatcaactttaatt

SEQ ID NO: 549333 - DNA, 25 bp, Mus musculus
gccatggtggacttcaactttaatt

SEQ ID NO: 549334 - DNA, 25 bp, Mus musculus
gccatggtgtcacaggcatcttgat

SEQ ID NO: 549335 - DNA, 25 bp, Mus musculus
gccatggtgtcagaggcatcttgat

SEQ ID NO: 549336 - DNA, 25 bp, Mus musculus
gccatggtgttacttgcctgttcaa

SEQ ID NO: 549337 - DNA, 25 bp, Mus musculus
gccatggtgttagttgcctgttcaa

SEQ ID NO: 549338 - DNA, 25 bp, Mus musculus
gccatggttactatgtcttgcaact

SEQ ID NO: 549339 - DNA, 25 bp, Mus musculus
gccatggttactttgtcttgcaact

SEQ ID NO: 549340 - DNA, 25 bp, Mus musculus
gccatggttcctccacaagggagat

SEQ ID NO: 549341 - DNA, 25 bp, Mus musculus
gccatggttcctgcacaagggagat

SEQ ID NO: 549342 - DNA, 25 bp, Mus musculus
gccatggttgccagccctgaatgcc

SEQ ID NO: 549343 - DNA, 25 bp, Mus musculus
gccatggttgcctgccctgaatgcc

SEQ ID NO: 549344 - DNA, 25 bp, Mus musculus
gccatggttggcacttggttctaga

SEQ ID NO: 549345 - DNA, 25 bp, Mus musculus
gccatggttggctcttggttctaga

SEQ ID NO: 549346 - DNA, 25 bp, Mus musculus
gccatgtaaatgcaatactggcccc

SEQ ID NO: 549347 - DNA, 25 bp, Mus musculus
gccatgtaaatggaatactggcccc

SEQ ID NO: 549348 - DNA, 25 bp, Mus musculus
gccatgtaacataacagtgctcagt

SEQ ID NO: 549349 - DNA, 25 bp, Mus musculus
gccatgtaacattacagtgctcagt

SEQ ID NO: 549350 - DNA, 25 bp, Mus musculus
gccatgtaagcaacttcatgctcta

SEQ ID NO: 549351 - DNA, 25 bp, Mus musculus
gccatgtaagcatcttcatgctcta

SEQ ID NO: 549352 - DNA, 25 bp, Mus musculus
gccatgtaagttaaagcccttccgt

SEQ ID NO: 549353 - DNA, 25 bp, Mus musculus
gccatgtaagtttaagcccttccgt

SEQ ID NO: 549354 - DNA, 25 bp, Mus musculus
gccatgtaatgtatatagctgctgc

SEQ ID NO: 549355 - DNA, 25 bp, Mus musculus
gccatgtaatgtttatagctgctgc

SEQ ID NO: 549356 - DNA, 25 bp, Mus musculus
gccatgtagtggagcacctgtgctg

SEQ ID NO: 549357 - DNA, 25 bp, Mus musculus
gccatgtagtggtgcacctgtgctg

SEQ ID NO: 549358 - DNA, 25 bp, Mus musculus
gccatgtataaacctcttgctgtcc

SEQ ID NO: 549359 - DNA, 25 bp, Mus musculus
gccatgtataaagctcttgctgtcc

SEQ ID NO: 549360 - DNA, 25 bp, Mus musculus
gccatgtatattattgtcctgttat

SEQ ID NO: 549361 - DNA, 25 bp, Mus musculus
gccatgtatatttttgtcctgttat

SEQ ID NO: 549362 - DNA, 25 bp, Mus musculus
gccatgtatttaacctgcagagttg

SEQ ID NO: 549363 - DNA, 25 bp, Mus musculus
gccatgtatttatcctgcagagttg

SEQ ID NO: 549364 - DNA, 25 bp, Mus musculus
gccatgtcaagacctcctaagcagt

SEQ ID NO: 549365 - DNA, 25 bp, Mus musculus
gccatgtcaagagctcctaagcagt

SEQ ID NO: 549366 - DNA, 25 bp, Mus musculus
gccatgtcaccgctgagtaacaaca

SEQ ID NO: 549367 - DNA, 25 bp, Mus musculus
gccatgtcaccggtgagtaacaaca

SEQ ID NO: 549368 - DNA, 25 bp, Mus musculus
gccatgtcaggccaattgtttcttt

SEQ ID NO: 549369 - DNA, 25 bp, Mus musculus
gccatgtcaggcgaattgtttcttt

SEQ ID NO: 549370 - DNA, 25 bp, Mus musculus
gccatgtcggcccaaatcagagtaa

SEQ ID NO: 549371 - DNA, 25 bp, Mus musculus
gccatgtcggccgaaatcagagtaa

SEQ ID NO: 549372 - DNA, 25 bp, Mus musculus
gccatgtctacaccttgaccctgta

SEQ ID NO: 549373 - DNA, 25 bp, Mus musculus
gccatgtctacagcttgaccctgta

SEQ ID NO: 549374 - DNA, 25 bp, Mus musculus
gccatgtctctactgatccctgaga

SEQ ID NO: 549375 - DNA, 25 bp, Mus musculus
gccatgtctctagtgatccctgaga

SEQ ID NO: 549376 - DNA, 25 bp, Mus musculus
gccatgtctgccaaaagcacgaaca

SEQ ID NO: 549377 - DNA, 25 bp, Mus musculus
gccatgtctgcctaaagcacgaaca

SEQ ID NO: 549378 - DNA, 25 bp, Mus musculus
gccatgtcttaaacattttggttaa

SEQ ID NO: 549379 - DNA, 25 bp, Mus musculus
gccatgtcttaatcattttggttaa

SEQ ID NO: 549380 - DNA, 25 bp, Mus musculus
gccatgtgactaatgtggccttctt

SEQ ID NO: 549381 - DNA, 25 bp, Mus musculus
gccatgtgactattgtggccttctt

SEQ ID NO: 549382 - DNA, 25 bp, Mus musculus
gccatgtgatgcaaccttacagtca

SEQ ID NO: 549383 - DNA, 25 bp, Mus musculus
gccatgtgatgcatagagcctcttt

SEQ ID NO: 549384 - DNA, 25 bp, Mus musculus
gccatgtgatgctaccttacagtca

SEQ ID NO: 549385 - DNA, 25 bp, Mus musculus
gccatgtgatgcttagagcctcttt

SEQ ID NO: 549386 - DNA, 25 bp, Mus musculus
gccatgtgcaaaattctggtgtatg

SEQ ID NO: 549387 - DNA, 25 bp, Mus musculus
gccatgtgcaaatttctggtgtatg

SEQ ID NO: 549388 - DNA, 25 bp, Mus musculus
gccatgtgctaaaccagtattgtgt

SEQ ID NO: 549389 - DNA, 25 bp, Mus musculus
gccatgtgctaatccagtattgtgt

SEQ ID NO: 549390 - DNA, 25 bp, Mus musculus
gccatgtgctatacacttctagttc

SEQ ID NO: 549391 - DNA, 25 bp, Mus musculus
gccatgtgctattcacttctagttc

SEQ ID NO: 549392 - DNA, 25 bp, Mus musculus
gccatgtgctccatcgaacggacag

SEQ ID NO: 549393 - DNA, 25 bp, Mus musculus
gccatgtgctcccatagtgtgagga

SEQ ID NO: 549394 - DNA, 25 bp, Mus musculus
gccatgtgctccgatagtgtgagga

SEQ ID NO: 549395 - DNA, 25 bp, Mus musculus
gccatgtgctccttcgaacggacag

SEQ ID NO: 549396 - DNA, 25 bp, Mus musculus
gccatgtgctctccttcaagaggga

SEQ ID NO: 549397 - DNA, 25 bp, Mus musculus
gccatgtgctctgcttcaagaggga

SEQ ID NO: 549398 - DNA, 25 bp, Mus musculus
gccatgtggaatcagccggagactc

SEQ ID NO: 549399 - DNA, 25 bp, Mus musculus
gccatgtggaatgagccggagactc

SEQ ID NO: 549400 - DNA, 25 bp, Mus musculus
gccatgtggattaacctcaagcagt

SEQ ID NO: 549401 - DNA, 25 bp, Mus musculus
gccatgtggatttacctcaagcagt

SEQ ID NO: 549402 - DNA, 25 bp, Mus musculus
gccatgtggccgaatgctaaggtca

SEQ ID NO: 549403 - DNA, 25 bp, Mus musculus
gccatgtggccgtatgctaaggtca

SEQ ID NO: 549404 - DNA, 25 bp, Mus musculus
gccatgtgggtaatagcactcaaaa

SEQ ID NO: 549405 - DNA, 25 bp, Mus musculus
gccatgtgggtattagcactcaaaa

SEQ ID NO: 549406 - DNA, 25 bp, Mus musculus
gccatgtggtgcaagtaaggcatcc

SEQ ID NO: 549407 - DNA, 25 bp, Mus musculus
gccatgtggtgctagtaaggcatcc

SEQ ID NO: 549408 - DNA, 25 bp, Mus musculus
gccatgtgtgccacagaattcattg

SEQ ID NO: 549409 - DNA, 25 bp, Mus musculus
gccatgtgtgcctcagaattcattg

SEQ ID NO: 549410 - DNA, 25 bp, Mus musculus
gccatgttaccaatgatttcctgtg

SEQ ID NO: 549411 - DNA, 25 bp, Mus musculus
gccatgttaccattgatttcctgtg

SEQ ID NO: 549412 - DNA, 25 bp, Mus musculus
gccatgttagaaccagtcttctgtt

SEQ ID NO: 549413 - DNA, 25 bp, Mus musculus
gccatgttagaagcagtcttctgtt

SEQ ID NO: 549414 - DNA, 25 bp, Mus musculus
gccatgttaggccttaagcctcagt

SEQ ID NO: 549415 - DNA, 25 bp, Mus musculus
gccatgttaggcgttaagcctcagt

SEQ ID NO: 549416 - DNA, 25 bp, Mus musculus
gccatgttcaagctgcctagagtct

SEQ ID NO: 549417 - DNA, 25 bp, Mus musculus
gccatgttcaaggtgcctagagtct

SEQ ID NO: 549418 - DNA, 25 bp, Mus musculus
gccatgttcacccttttcttacaat

SEQ ID NO: 549419 - DNA, 25 bp, Mus musculus
gccatgttcaccgttttcttacaat

SEQ ID NO: 549420 - DNA, 25 bp, Mus musculus
gccatgttcatgctctgggatgtta

SEQ ID NO: 549421 - DNA, 25 bp, Mus musculus
gccatgttcatggtctgggatgtta

SEQ ID NO: 549422 - DNA, 25 bp, Mus musculus
gccatgttccagctgctctgtataa

SEQ ID NO: 549423 - DNA, 25 bp, Mus musculus
gccatgttccaggtgctctgtataa

SEQ ID NO: 549424 - DNA, 25 bp, Mus musculus
gccatgttccctattataccttgga

SEQ ID NO: 549425 - DNA, 25 bp, Mus musculus
gccatgttccctctcatgatgataa

SEQ ID NO: 549426 - DNA, 25 bp, Mus musculus
gccatgttccctgtcatgatgataa

SEQ ID NO: 549427 - DNA, 25 bp, Mus musculus
gccatgttcccttttataccttgga

SEQ ID NO: 549428 - DNA, 25 bp, Mus musculus
gccatgttggcgaccctgctgtgtg

SEQ ID NO: 549429 - DNA, 25 bp, Mus musculus
gccatgttggcgtccctgctgtgtg

SEQ ID NO: 549430 - DNA, 25 bp, Mus musculus
gccatgttgtgtaagagacctgctt

SEQ ID NO: 549431 - DNA, 25 bp, Mus musculus
gccatgttgtgttagagacctgctt

SEQ ID NO: 549432 - DNA, 25 bp, Mus musculus
gccatgtttccacgtgttcccggtt

SEQ ID NO: 549433 - DNA, 25 bp, Mus musculus
gccatgtttccaggtgttcccggtt

SEQ ID NO: 549434 - DNA, 25 bp, Mus musculus
gccatgtttggcactttttagacta

SEQ ID NO: 549435 - DNA, 25 bp, Mus musculus
gccatgtttggctctttttagacta

SEQ ID NO: 549436 - DNA, 25 bp, Mus musculus
gccattaaatggcatctcgtggatg

SEQ ID NO: 549437 - DNA, 25 bp, Mus musculus
gccattaaatgggatctcgtggatg

SEQ ID NO: 549438 - DNA, 25 bp, Mus musculus
gccattaacaagacctgagccctga

SEQ ID NO: 549439 - DNA, 25 bp, Mus musculus
gccattaacaagtcctgagccctga

SEQ ID NO: 549440 - DNA, 25 bp, Mus musculus
gccattaactaactcttcactttca

SEQ ID NO: 549441 - DNA, 25 bp, Mus musculus
gccattaactaagtcttcactttca

SEQ ID NO: 549442 - DNA, 25 bp, Mus musculus
gccattaagagccactgtagataga

SEQ ID NO: 549443 - DNA, 25 bp, Mus musculus
gccattaagagcgactgtagataga

SEQ ID NO: 549444 - DNA, 25 bp, Mus musculus
gccattaagtatcatcagtgtttct

SEQ ID NO: 549445 - DNA, 25 bp, Mus musculus
gccattaagtatgatcagtgtttct

SEQ ID NO: 549446 - DNA, 25 bp, Mus musculus
gccattacaagaacccctttagtca

SEQ ID NO: 549447 - DNA, 25 bp, Mus musculus
gccattacaagaaggtgctgatatc

SEQ ID NO: 549448 - DNA, 25 bp, Mus musculus
gccattacaagatcccctttagtca

SEQ ID NO: 549449 - DNA, 25 bp, Mus musculus
gccattacaagatggtgctgatatc

SEQ ID NO: 549450 - DNA, 25 bp, Mus musculus
gccattacacataggtaatcagaca

SEQ ID NO: 549451 - DNA, 25 bp, Mus musculus
gccattacacattggtaatcagaca

SEQ ID NO: 549452 - DNA, 25 bp, Mus musculus
gccattacatgaaggtggctattca

SEQ ID NO: 549453 - DNA, 25 bp, Mus musculus
gccattacatgatggtggctattca

SEQ ID NO: 549454 - DNA, 25 bp, Mus musculus
gccattaccattcgtttcttccaaa

SEQ ID NO: 549455 - DNA, 25 bp, Mus musculus
gccattaccattggtttcttccaaa

SEQ ID NO: 549456 - DNA, 25 bp, Mus musculus
gccattacctaccagattgctaaaa

SEQ ID NO: 549457 - DNA, 25 bp, Mus musculus
gccattacctacgagattgctaaaa

SEQ ID NO: 549458 - DNA, 25 bp, Mus musculus
gccattactccaaagtgacttctat

SEQ ID NO: 549459 - DNA, 25 bp, Mus musculus
gccattactccatagtgacttctat

SEQ ID NO: 549460 - DNA, 25 bp, Mus musculus
gccattactgttatttgctgatttt

SEQ ID NO: 549461 - DNA, 25 bp, Mus musculus
gccattactgttttttgctgatttt

SEQ ID NO: 549462 - DNA, 25 bp, Mus musculus
gccattagccatcatttcacagcgg

SEQ ID NO: 549463 - DNA, 25 bp, Mus musculus
gccattagccatgatttcacagcgg

SEQ ID NO: 549464 - DNA, 25 bp, Mus musculus
gccattagcctaaactgcacatttt

SEQ ID NO: 549465 - DNA, 25 bp, Mus musculus
gccattagcctatactgcacatttt

SEQ ID NO: 549466 - DNA, 25 bp, Mus musculus
gccattagtggcctgctagtcttaa

SEQ ID NO: 549467 - DNA, 25 bp, Mus musculus
gccattagtggcgtgctagtcttaa

SEQ ID NO: 549468 - DNA, 25 bp, Mus musculus
gccattatataactctcccatgtgt

SEQ ID NO: 549469 - DNA, 25 bp, Mus musculus
gccattatataagtctcccatgtgt

SEQ ID NO: 549470 - DNA, 25 bp, Mus musculus
gccattatccctcttcccagttgag

SEQ ID NO: 549471 - DNA, 25 bp, Mus musculus
gccattatccctgttcccagttgag

SEQ ID NO: 549472 - DNA, 25 bp, Mus musculus
gccattatgtggcagagtgattatg

SEQ ID NO: 549473 - DNA, 25 bp, Mus musculus
gccattatgtgggagagtgattatg

SEQ ID NO: 549474 - DNA, 25 bp, Mus musculus
gccattattgtccagagtagtcatt

SEQ ID NO: 549475 - DNA, 25 bp, Mus musculus
gccattattgtcgagagtagtcatt

SEQ ID NO: 549476 - DNA, 25 bp, Mus musculus
gccattatttggcatgcaaatcatt

SEQ ID NO: 549477 - DNA, 25 bp, Mus musculus
gccattatttgggatgcaaatcatt

SEQ ID NO: 549478 - DNA, 25 bp, Mus musculus
gccattattttcatgctggatccta

SEQ ID NO: 549479 - DNA, 25 bp, Mus musculus
gccattattttcttgctggatccta

SEQ ID NO: 549480 - DNA, 25 bp, Mus musculus
gccattattttgcacatccttcttt

SEQ ID NO: 549481 - DNA, 25 bp, Mus musculus
gccattattttggacatccttcttt

SEQ ID NO: 549482 - DNA, 25 bp, Mus musculus
gccattcaaaacatcagccaacatc

SEQ ID NO: 549483 - DNA, 25 bp, Mus musculus
gccattcaaaacttcagccaacatc

SEQ ID NO: 549484 - DNA, 25 bp, Mus musculus
gccattcaagagacttcttggcctg

SEQ ID NO: 549485 - DNA, 25 bp, Mus musculus
gccattcaagagtcttcttggcctg

SEQ ID NO: 549486 - DNA, 25 bp, Mus musculus
gccattcaaggtcactgtcagaccc

SEQ ID NO: 549487 - DNA, 25 bp, Mus musculus
gccattcaaggtgactgtcagaccc

SEQ ID NO: 549488 - DNA, 25 bp, Mus musculus
gccattcacaccaagactttgcaga

SEQ ID NO: 549489 - DNA, 25 bp, Mus musculus
gccattcacacctagactttgcaga

SEQ ID NO: 549490 - DNA, 25 bp, Mus musculus
gccattcagctaaccgttctgttga

SEQ ID NO: 549491 - DNA, 25 bp, Mus musculus
gccattcagctatccgttctgttga

SEQ ID NO: 549492 - DNA, 25 bp, Mus musculus
gccattcagtgtcgggtcaccaccg

SEQ ID NO: 549493 - DNA, 25 bp, Mus musculus
gccattcagtgtggggtcaccaccg

SEQ ID NO: 549494 - DNA, 25 bp, Mus musculus
gccattcatgcaatgtttcttttca

SEQ ID NO: 549495 - DNA, 25 bp, Mus musculus
gccattcatgcattgtttcttttca

SEQ ID NO: 549496 - DNA, 25 bp, Mus musculus
gccattcatttcattccagactttc

SEQ ID NO: 549497 - DNA, 25 bp, Mus musculus
gccattcatttctttccagactttc

SEQ ID NO: 549498 - DNA, 25 bp, Mus musculus
gccattccaaacaggctcactagaa

SEQ ID NO: 549499 - DNA, 25 bp, Mus musculus
gccattccaaactggctcactagaa

SEQ ID NO: 549500 - DNA, 25 bp, Mus musculus
gccattccagtgctaggaagactct

SEQ ID NO: 549501 - DNA, 25 bp, Mus musculus
gccattccagtggtaggaagactct

SEQ ID NO: 549502 - DNA, 25 bp, Mus musculus
gccattccatccagtgcgttgaagt

SEQ ID NO: 549503 - DNA, 25 bp, Mus musculus
gccattccatcctgtgcgttgaagt

SEQ ID NO: 549504 - DNA, 25 bp, Mus musculus
gccattcccctacatgctggagaaa

SEQ ID NO: 549505 - DNA, 25 bp, Mus musculus
gccattcccctagatgctggagaaa

SEQ ID NO: 549506 - DNA, 25 bp, Mus musculus
gccattcccctgacagtggttctgt

SEQ ID NO: 549507 - DNA, 25 bp, Mus musculus
gccattcccctgtcagtggttctgt

SEQ ID NO: 549508 - DNA, 25 bp, Mus musculus
gccattccgaataaccaggttttgg

SEQ ID NO: 549509 - DNA, 25 bp, Mus musculus
gccattccgaattaccaggttttgg

SEQ ID NO: 549510 - DNA, 25 bp, Mus musculus
gccattccggttatcactttgaaca

SEQ ID NO: 549511 - DNA, 25 bp, Mus musculus
gccattccggttttcactttgaaca

SEQ ID NO: 549512 - DNA, 25 bp, Mus musculus
gccattccgtacaacagttcttgaa

SEQ ID NO: 549513 - DNA, 25 bp, Mus musculus
gccattccgtactacagttcttgaa

SEQ ID NO: 549514 - DNA, 25 bp, Mus musculus
gccattcctggaacaatcgtgattt

SEQ ID NO: 549515 - DNA, 25 bp, Mus musculus
gccattcctggatcaatcgtgattt

SEQ ID NO: 549516 - DNA, 25 bp, Mus musculus
gccattcctgtcaagccatttggaa

SEQ ID NO: 549517 - DNA, 25 bp, Mus musculus
gccattcctgtctagccatttggaa

SEQ ID NO: 549518 - DNA, 25 bp, Mus musculus
gccattccttcgacctttctcaccc

SEQ ID NO: 549519 - DNA, 25 bp, Mus musculus
gccattccttcgtcctttctcaccc

SEQ ID NO: 549520 - DNA, 25 bp, Mus musculus
gccattcctttcaccattaaagcag

SEQ ID NO: 549521 - DNA, 25 bp, Mus musculus
gccattcctttctccattaaagcag

SEQ ID NO: 549522 - DNA, 25 bp, Mus musculus
gccattcgaatgcagccttaaaggg

SEQ ID NO: 549523 - DNA, 25 bp, Mus musculus
gccattcgaatggagccttaaaggg

SEQ ID NO: 549524 - DNA, 25 bp, Mus musculus
gccattcgcgtgctgtaatccgaga

SEQ ID NO: 549525 - DNA, 25 bp, Mus musculus
gccattcgcgtggtgtaatccgaga

SEQ ID NO: 549526 - DNA, 25 bp, Mus musculus
gccattcgtcctcttacacattaaa

SEQ ID NO: 549527 - DNA, 25 bp, Mus musculus
gccattcgtcctgttacacattaaa

SEQ ID NO: 549528 - DNA, 25 bp, Mus musculus
gccattctaactattcacccaatat

SEQ ID NO: 549529 - DNA, 25 bp, Mus musculus
gccattctaacttttcacccaatat

SEQ ID NO: 549530 - DNA, 25 bp, Mus musculus
gccattctaatcaccactgattcat

SEQ ID NO: 549531 - DNA, 25 bp, Mus musculus
gccattctaatctccactgattcat

SEQ ID NO: 549532 - DNA, 25 bp, Mus musculus
gccattctggcgctataatgcaccc

SEQ ID NO: 549533 - DNA, 25 bp, Mus musculus
gccattctggcggtataatgcaccc

SEQ ID NO: 549534 - DNA, 25 bp, Mus musculus
gccattctggtgatgtcataagaaa

SEQ ID NO: 549535 - DNA, 25 bp, Mus musculus
gccattctggtgttgtcataagaaa

SEQ ID NO: 549536 - DNA, 25 bp, Mus musculus
gccattctggttacaaatgtatcct

SEQ ID NO: 549537 - DNA, 25 bp, Mus musculus
gccattctggtttcaaatgtatcct

SEQ ID NO: 549538 - DNA, 25 bp, Mus musculus
gccattctgtagatcattctggttg

SEQ ID NO: 549539 - DNA, 25 bp, Mus musculus
gccattctgtagttcattctggttg

SEQ ID NO: 549540 - DNA, 25 bp, Mus musculus
gccattcttagaagcttcaacgcca

SEQ ID NO: 549541 - DNA, 25 bp, Mus musculus
gccattcttagatgcttcaacgcca

SEQ ID NO: 549542 - DNA, 25 bp, Mus musculus
gccattcttcacctcatatattcta

SEQ ID NO: 549543 - DNA, 25 bp, Mus musculus
gccattcttcacgtcatatattcta

SEQ ID NO: 549544 - DNA, 25 bp, Mus musculus
gccattctttccaagggagtgtcct

SEQ ID NO: 549545 - DNA, 25 bp, Mus musculus
gccattctttcctagggagtgtcct

SEQ ID NO: 549546 - DNA, 25 bp, Mus musculus
gccattgaactgctaattcccctgc

SEQ ID NO: 549547 - DNA, 25 bp, Mus musculus
gccattgaactggtaattcccctgc

SEQ ID NO: 549548 - DNA, 25 bp, Mus musculus
gccattgaccaaaaagcttcgaagc

SEQ ID NO: 549549 - DNA, 25 bp, Mus musculus
gccattgaccaataagcttcgaagc

SEQ ID NO: 549550 - DNA, 25 bp, Mus musculus
gccattgaccacactgcagctgtat

SEQ ID NO: 549551 - DNA, 25 bp, Mus musculus
gccattgaccactctgcagctgtat

SEQ ID NO: 549552 - DNA, 25 bp, Mus musculus
gccattgagcacacctgaacagcca

SEQ ID NO: 549553 - DNA, 25 bp, Mus musculus
gccattgagcactcctgaacagcca

SEQ ID NO: 549554 - DNA, 25 bp, Mus musculus
gccattgaggcgactcagtgggaaa

SEQ ID NO: 549555 - DNA, 25 bp, Mus musculus
gccattgaggcgtctcagtgggaaa

SEQ ID NO: 549556 - DNA, 25 bp, Mus musculus
gccattgatggacggacagctgtat

SEQ ID NO: 549557 - DNA, 25 bp, Mus musculus
gccattgatggagggacagctgtat

SEQ ID NO: 549558 - DNA, 25 bp, Mus musculus
gccattgatttaccagtttaacgtt

SEQ ID NO: 549559 - DNA, 25 bp, Mus musculus
gccattgatttagcagtttaacgtt

SEQ ID NO: 549560 - DNA, 25 bp, Mus musculus
gccattgcaccacagtatgaaatag

SEQ ID NO: 549561 - DNA, 25 bp, Mus musculus
gccattgcaccagagtatgaaatag

SEQ ID NO: 549562 - DNA, 25 bp, Mus musculus
gccattgccagcacaacggtggaga

SEQ ID NO: 549563 - DNA, 25 bp, Mus musculus
gccattgccagcagtttactaattc

SEQ ID NO: 549564 - DNA, 25 bp, Mus musculus
gccattgccagctcaacggtggaga

SEQ ID NO: 549565 - DNA, 25 bp, Mus musculus
gccattgccagctgtttactaattc

SEQ ID NO: 549566 - DNA, 25 bp, Mus musculus
gccattgcccatcgagatctgaaga

SEQ ID NO: 549567 - DNA, 25 bp, Mus musculus
gccattgcccatggagatctgaaga

SEQ ID NO: 549568 - DNA, 25 bp, Mus musculus
gccattgccgagaacgagagcaaag

SEQ ID NO: 549569 - DNA, 25 bp, Mus musculus
gccattgccgagtacgagagcaaag

SEQ ID NO: 549570 - DNA, 25 bp, Mus musculus
gccattgctcataggtcaacatgaa

SEQ ID NO: 549571 - DNA, 25 bp, Mus musculus
gccattgctcattggtcaacatgaa

SEQ ID NO: 549572 - DNA, 25 bp, Mus musculus
gccattgctctcatagagtggtcta

SEQ ID NO: 549573 - DNA, 25 bp, Mus musculus
gccattgctctcttagagtggtcta

SEQ ID NO: 549574 - DNA, 25 bp, Mus musculus
gccattgctctgagattgactggat

SEQ ID NO: 549575 - DNA, 25 bp, Mus musculus
gccattgctctgtgattgactggat

SEQ ID NO: 549576 - DNA, 25 bp, Mus musculus
gccattgctggcatcgtgattggag

SEQ ID NO: 549577 - DNA, 25 bp, Mus musculus
gccattgctggcttcgtgattggag

SEQ ID NO: 549578 - DNA, 25 bp, Mus musculus
gccattgcttctagcacatctatgg

SEQ ID NO: 549579 - DNA, 25 bp, Mus musculus
gccattgcttctctggaagcggcag

SEQ ID NO: 549580 - DNA, 25 bp, Mus musculus
gccattgcttctgtggaagcggcag

SEQ ID NO: 549581 - DNA, 25 bp, Mus musculus
gccattgcttcttgcacatctatgg

SEQ ID NO: 549582 - DNA, 25 bp, Mus musculus
gccattggaaccaactggggaaaat

SEQ ID NO: 549583 - DNA, 25 bp, Mus musculus
gccattggaacctactggggaaaat

SEQ ID NO: 549584 - DNA, 25 bp, Mus musculus
gccattggaatgattctacacgatc

SEQ ID NO: 549585 - DNA, 25 bp, Mus musculus
gccattggaatgtttctacacgatc

SEQ ID NO: 549586 - DNA, 25 bp, Mus musculus
gccattggacttaccctgggactca

SEQ ID NO: 549587 - DNA, 25 bp, Mus musculus
gccattggactttccctgggactca

SEQ ID NO: 549588 - DNA, 25 bp, Mus musculus
gccattggagctatgctttgtagct

SEQ ID NO: 549589 - DNA, 25 bp, Mus musculus
gccattggagctttgctttgtagct

SEQ ID NO: 549590 - DNA, 25 bp, Mus musculus
gccattggcctcagcagaagtgtca

SEQ ID NO: 549591 - DNA, 25 bp, Mus musculus
gccattggcctctgcagaagtgtca

SEQ ID NO: 549592 - DNA, 25 bp, Mus musculus
gccattggctctcgtactggaattc

SEQ ID NO: 549593 - DNA, 25 bp, Mus musculus
gccattggctctggtactggaattc

SEQ ID NO: 549594 - DNA, 25 bp, Mus musculus
gccattgggaaaatggcccgggtct

SEQ ID NO: 549595 - DNA, 25 bp, Mus musculus
gccattgggaaattggcccgggtct

SEQ ID NO: 549596 - DNA, 25 bp, Mus musculus
gccattggtgaaaacccctgtggat

SEQ ID NO: 549597 - DNA, 25 bp, Mus musculus
gccattggtgaatacccctgtggat

SEQ ID NO: 549598 - DNA, 25 bp, Mus musculus
gccattggtggtctgcatgcttcaa

SEQ ID NO: 549599 - DNA, 25 bp, Mus musculus
gccattggtggtgtgcatgcttcaa

SEQ ID NO: 549600 - DNA, 25 bp, Mus musculus
gccattgtaaacacttgtatatggg

SEQ ID NO: 549601 - DNA, 25 bp, Mus musculus
gccattgtaaactcttgtatatggg

SEQ ID NO: 549602 - DNA, 25 bp, Mus musculus
gccattgtaagtacagcatcccgat

SEQ ID NO: 549603 - DNA, 25 bp, Mus musculus
gccattgtaagttcagcatcccgat

SEQ ID NO: 549604 - DNA, 25 bp, Mus musculus
gccattgtacatcttcctgtgttgc

SEQ ID NO: 549605 - DNA, 25 bp, Mus musculus
gccattgtacatgttcctgtgttgc

SEQ ID NO: 549606 - DNA, 25 bp, Mus musculus
gccattgtactcacagctgttatta

SEQ ID NO: 549607 - DNA, 25 bp, Mus musculus
gccattgtactcaggtcctaggaat

SEQ ID NO: 549608 - DNA, 25 bp, Mus musculus
gccattgtactcatactctctataa

SEQ ID NO: 549609 - DNA, 25 bp, Mus musculus
gccattgtactctcagctgttatta

SEQ ID NO: 549610 - DNA, 25 bp, Mus musculus
gccattgtactctggtcctaggaat

SEQ ID NO: 549611 - DNA, 25 bp, Mus musculus
gccattgtactcttactctctataa

SEQ ID NO: 549612 - DNA, 25 bp, Mus musculus
gccattgtagctcgtggccattttc

SEQ ID NO: 549613 - DNA, 25 bp, Mus musculus
gccattgtagctggtggccattttc

SEQ ID NO: 549614 - DNA, 25 bp, Mus musculus
gccattgtatgaaaggttctcttga

SEQ ID NO: 549615 - DNA, 25 bp, Mus musculus
gccattgtatgataggttctcttga

SEQ ID NO: 549616 - DNA, 25 bp, Mus musculus
gccattgtctggatagctagccttc

SEQ ID NO: 549617 - DNA, 25 bp, Mus musculus
gccattgtctggttagctagccttc

SEQ ID NO: 549618 - DNA, 25 bp, Mus musculus
gccattgtgcaacctgtgaaaggcc

SEQ ID NO: 549619 - DNA, 25 bp, Mus musculus
gccattgtgcaagctgtgaaaggcc

SEQ ID NO: 549620 - DNA, 25 bp, Mus musculus
gccattgtgtataaaggatgacata

SEQ ID NO: 549621 - DNA, 25 bp, Mus musculus
gccattgtgtattaaggatgacata

SEQ ID NO: 549622 - DNA, 25 bp, Mus musculus
gccattgtgtcaagatgccagttca

SEQ ID NO: 549623 - DNA, 25 bp, Mus musculus
gccattgtgtcatgatgccagttca

SEQ ID NO: 549624 - DNA, 25 bp, Mus musculus
gccattgttccaatggcagcaacaa

SEQ ID NO: 549625 - DNA, 25 bp, Mus musculus
gccattgttccattggcagcaacaa

SEQ ID NO: 549626 - DNA, 25 bp, Mus musculus
gccattgtttagattctgctctgca

SEQ ID NO: 549627 - DNA, 25 bp, Mus musculus
gccattgtttagtttctgctctgca

SEQ ID NO: 549628 - DNA, 25 bp, Mus musculus
gccatttaattgagttaactagctg

SEQ ID NO: 549629 - DNA, 25 bp, Mus musculus
gccatttaattgtgttaactagctg

SEQ ID NO: 549630 - DNA, 25 bp, Mus musculus
gccatttacatgcatattaacacgt

SEQ ID NO: 549631 - DNA, 25 bp, Mus musculus
gccatttacatggatattaacacgt

SEQ ID NO: 549632 - DNA, 25 bp, Mus musculus
gccatttaccggagtattgtacata

SEQ ID NO: 549633 - DNA, 25 bp, Mus musculus
gccatttaccggtgtattgtacata

SEQ ID NO: 549634 - DNA, 25 bp, Mus musculus
gccatttactgacaaacctggtttt

SEQ ID NO: 549635 - DNA, 25 bp, Mus musculus
gccatttactgagaaacctggtttt

SEQ ID NO: 549636 - DNA, 25 bp, Mus musculus
gccatttatcaacttcccagctctg

SEQ ID NO: 549637 - DNA, 25 bp, Mus musculus
gccatttatcaagttcccagctctg

SEQ ID NO: 549638 - DNA, 25 bp, Mus musculus
gccatttatgctactgccttttata

SEQ ID NO: 549639 - DNA, 25 bp, Mus musculus
gccatttatgcttctgccttttata

SEQ ID NO: 549640 - DNA, 25 bp, Mus musculus
gccatttcaccactcccaacatgac

SEQ ID NO: 549641 - DNA, 25 bp, Mus musculus
gccatttcaccagtcccaacatgac

SEQ ID NO: 549642 - DNA, 25 bp, Mus musculus
gccatttcatccacagacttgtaga

SEQ ID NO: 549643 - DNA, 25 bp, Mus musculus
gccatttcatcctcagacttgtaga

SEQ ID NO: 549644 - DNA, 25 bp, Mus musculus
gccatttcatctcaggttgctgtct

SEQ ID NO: 549645 - DNA, 25 bp, Mus musculus
gccatttcatctgaggttgctgtct

SEQ ID NO: 549646 - DNA, 25 bp, Mus musculus
gccatttcatggctcctaggatctg

SEQ ID NO: 549647 - DNA, 25 bp, Mus musculus
gccatttcatgggtcctaggatctg

SEQ ID NO: 549648 - DNA, 25 bp, Mus musculus
gccatttccccacaatttcttttat

SEQ ID NO: 549649 - DNA, 25 bp, Mus musculus
gccatttccccactgtgtaaacaca

SEQ ID NO: 549650 - DNA, 25 bp, Mus musculus
gccatttccccagaatttcttttat

SEQ ID NO: 549651 - DNA, 25 bp, Mus musculus
gccatttccccagtgtgtaaacaca

SEQ ID NO: 549652 - DNA, 25 bp, Mus musculus
gccatttcctcaccaaaagaagtta

SEQ ID NO: 549653 - DNA, 25 bp, Mus musculus
gccatttcctcagcaaaagaagtta

SEQ ID NO: 549654 - DNA, 25 bp, Mus musculus
gccatttcgcccatatttgtgattg

SEQ ID NO: 549655 - DNA, 25 bp, Mus musculus
gccatttcgcccttatttgtgattg

SEQ ID NO: 549656 - DNA, 25 bp, Mus musculus
gccatttctcatacgcactgaaagc

SEQ ID NO: 549657 - DNA, 25 bp, Mus musculus
gccatttctcattcgcactgaaagc

SEQ ID NO: 549658 - DNA, 25 bp, Mus musculus
gccatttctcttccattaattaccc

SEQ ID NO: 549659 - DNA, 25 bp, Mus musculus
gccatttctcttgcattaattaccc

SEQ ID NO: 549660 - DNA, 25 bp, Mus musculus
gccatttctgcaccactggcaaaat

SEQ ID NO: 549661 - DNA, 25 bp, Mus musculus
gccatttctgcagcactggcaaaat

SEQ ID NO: 549662 - DNA, 25 bp, Mus musculus
gccatttctgtgcagcatgtcgtgt

SEQ ID NO: 549663 - DNA, 25 bp, Mus musculus
gccatttctgtggagcatgtcgtgt

SEQ ID NO: 549664 - DNA, 25 bp, Mus musculus
gccatttcttagcagttcccaggaa

SEQ ID NO: 549665 - DNA, 25 bp, Mus musculus
gccatttcttaggagttcccaggaa

SEQ ID NO: 549666 - DNA, 25 bp, Mus musculus
gccatttgaaaaaagcactagcgag

SEQ ID NO: 549667 - DNA, 25 bp, Mus musculus
gccatttgaaaacatgccacaccag

SEQ ID NO: 549668 - DNA, 25 bp, Mus musculus
gccatttgaaaagatgccacaccag

SEQ ID NO: 549669 - DNA, 25 bp, Mus musculus
gccatttgaaaatagcactagcgag

SEQ ID NO: 549670 - DNA, 25 bp, Mus musculus
gccatttgaattcatatgcgtctaa

SEQ ID NO: 549671 - DNA, 25 bp, Mus musculus
gccatttgaattgatatgcgtctaa

SEQ ID NO: 549672 - DNA, 25 bp, Mus musculus
gccatttgaggacccacagtgtgga

SEQ ID NO: 549673 - DNA, 25 bp, Mus musculus
gccatttgaggagccacagtgtgga

SEQ ID NO: 549674 - DNA, 25 bp, Mus musculus
gccatttgccagagcagcatgcatt

SEQ ID NO: 549675 - DNA, 25 bp, Mus musculus
gccatttgccagtgcagcatgcatt

SEQ ID NO: 549676 - DNA, 25 bp, Mus musculus
gccatttgctgcagcgtctaagaaa

SEQ ID NO: 549677 - DNA, 25 bp, Mus musculus
gccatttgctgcaggcaactttatt

SEQ ID NO: 549678 - DNA, 25 bp, Mus musculus
gccatttgctgctgcgtctaagaaa

SEQ ID NO: 549679 - DNA, 25 bp, Mus musculus
gccatttgctgctggcaactttatt

SEQ ID NO: 549680 - DNA, 25 bp, Mus musculus
gccatttggaaaagctcctgaaaaa

SEQ ID NO: 549681 - DNA, 25 bp, Mus musculus
gccatttggaaatgctcctgaaaaa

SEQ ID NO: 549682 - DNA, 25 bp, Mus musculus
gccatttggtagctttggcatcaaa

SEQ ID NO: 549683 - DNA, 25 bp, Mus musculus
gccatttggtaggtttggcatcaaa

SEQ ID NO: 549684 - DNA, 25 bp, Mus musculus
gccatttgtaaccttggacagtagt

SEQ ID NO: 549685 - DNA, 25 bp, Mus musculus
gccatttgtaacgttggacagtagt

SEQ ID NO: 549686 - DNA, 25 bp, Mus musculus
gccatttgtagtagctcgtgcctgt

SEQ ID NO: 549687 - DNA, 25 bp, Mus musculus
gccatttgtagttgctcgtgcctgt

SEQ ID NO: 549688 - DNA, 25 bp, Mus musculus
gccatttgtcttccctgagtcttga

SEQ ID NO: 549689 - DNA, 25 bp, Mus musculus
gccatttgtcttgcctgagtcttga

SEQ ID NO: 549690 - DNA, 25 bp, Mus musculus
gccatttgtgagagcttggagtgtt

SEQ ID NO: 549691 - DNA, 25 bp, Mus musculus
gccatttgtgagtgcttggagtgtt

SEQ ID NO: 549692 - DNA, 25 bp, Mus musculus
gccatttgtggcaagggtttcttcc

SEQ ID NO: 549693 - DNA, 25 bp, Mus musculus
gccatttgtggctagggtttcttcc

SEQ ID NO: 549694 - DNA, 25 bp, Mus musculus
gccatttgtgtaaatactagtcttt

SEQ ID NO: 549695 - DNA, 25 bp, Mus musculus
gccatttgtgtatatactagtcttt

SEQ ID NO: 549696 - DNA, 25 bp, Mus musculus
gccatttgttagatggtgccgtcca

SEQ ID NO: 549697 - DNA, 25 bp, Mus musculus
gccatttgttagttggtgccgtcca

SEQ ID NO: 549698 - DNA, 25 bp, Mus musculus
gccatttgttctagggctttgtaga

SEQ ID NO: 549699 - DNA, 25 bp, Mus musculus
gccatttgttcttgggctttgtaga

SEQ ID NO: 549700 - DNA, 25 bp, Mus musculus
gccatttgttttcccaagcaaacaa

SEQ ID NO: 549701 - DNA, 25 bp, Mus musculus
gccatttgttttgccaagcaaacaa

SEQ ID NO: 549702 - DNA, 25 bp, Mus musculus
gccattttagaaccagcggagaatt

SEQ ID NO: 549703 - DNA, 25 bp, Mus musculus
gccattttagaagcagcggagaatt

SEQ ID NO: 549704 - DNA, 25 bp, Mus musculus
gccattttagttcttgccatcctat

SEQ ID NO: 549705 - DNA, 25 bp, Mus musculus
gccattttagttgttgccatcctat

SEQ ID NO: 549706 - DNA, 25 bp, Mus musculus
gccattttatgacgcattgcacacc

SEQ ID NO: 549707 - DNA, 25 bp, Mus musculus
gccattttatgaggcattgcacacc

SEQ ID NO: 549708 - DNA, 25 bp, Mus musculus
gccattttcaaactagtctctgagt

SEQ ID NO: 549709 - DNA, 25 bp, Mus musculus
gccattttcaaagtagtctctgagt

SEQ ID NO: 549710 - DNA, 25 bp, Mus musculus
gccattttccctagcacagggttga

SEQ ID NO: 549711 - DNA, 25 bp, Mus musculus
gccattttcccttgcacagggttga

SEQ ID NO: 549712 - DNA, 25 bp, Mus musculus
gccattttcctcctgctgtttttaa

SEQ ID NO: 549713 - DNA, 25 bp, Mus musculus
gccattttcctcgtgctgtttttaa

SEQ ID NO: 549714 - DNA, 25 bp, Mus musculus
gccattttctctccttagatttctt

SEQ ID NO: 549715 - DNA, 25 bp, Mus musculus
gccattttctctgcttagatttctt

SEQ ID NO: 549716 - DNA, 25 bp, Mus musculus
gccattttctgaactgggccaatat

SEQ ID NO: 549717 - DNA, 25 bp, Mus musculus
gccattttctgatctgggccaatat

SEQ ID NO: 549718 - DNA, 25 bp, Mus musculus
gccattttctgtaagccaactgaac

SEQ ID NO: 549719 - DNA, 25 bp, Mus musculus
gccattttctgttagccaactgaac

SEQ ID NO: 549720 - DNA, 25 bp, Mus musculus
gccattttgaacagagtgttacctt

SEQ ID NO: 549721 - DNA, 25 bp, Mus musculus
gccattttgaactgagtgttacctt

SEQ ID NO: 549722 - DNA, 25 bp, Mus musculus
gccattttgactatggtttccagta

SEQ ID NO: 549723 - DNA, 25 bp, Mus musculus
gccattttgactttggtttccagta

SEQ ID NO: 549724 - DNA, 25 bp, Mus musculus
gccattttgattcctatgcccagta

SEQ ID NO: 549725 - DNA, 25 bp, Mus musculus
gccattttgattgctatgcccagta

SEQ ID NO: 549726 - DNA, 25 bp, Mus musculus
gccattttgcccaagccggtgaaaa

SEQ ID NO: 549727 - DNA, 25 bp, Mus musculus
gccattttgccctagccggtgaaaa

SEQ ID NO: 549728 - DNA, 25 bp, Mus musculus
gccattttgctaccatttttgacct

SEQ ID NO: 549729 - DNA, 25 bp, Mus musculus
gccattttgctagcatttttgacct

SEQ ID NO: 549730 - DNA, 25 bp, Mus musculus
gccattttggcccagcagtatgaac

SEQ ID NO: 549731 - DNA, 25 bp, Mus musculus
gccattttggccgagcagtatgaac

SEQ ID NO: 549732 - DNA, 25 bp, Mus musculus
gccattttgtagagttttcttcagc

SEQ ID NO: 549733 - DNA, 25 bp, Mus musculus
gccattttgtagtgttttcttcagc

SEQ ID NO: 549734 - DNA, 25 bp, Mus musculus
gccattttgtggcaataagacagat

SEQ ID NO: 549735 - DNA, 25 bp, Mus musculus
gccattttgtggcagtaatattagc

SEQ ID NO: 549736 - DNA, 25 bp, Mus musculus
gccattttgtgggaataagacagat

SEQ ID NO: 549737 - DNA, 25 bp, Mus musculus
gccattttgtgggagtaatattagc

SEQ ID NO: 549738 - DNA, 25 bp, Mus musculus
gccattttgttgctcctggaatact

SEQ ID NO: 549739 - DNA, 25 bp, Mus musculus
gccattttgttggtcctggaatact

SEQ ID NO: 549740 - DNA, 25 bp, Mus musculus
gccatttttccaccttcatataacc

SEQ ID NO: 549741 - DNA, 25 bp, Mus musculus
gccatttttccagcttcatataacc

SEQ ID NO: 549742 - DNA, 25 bp, Mus musculus
gccatttttggtccatgaggtcata

SEQ ID NO: 549743 - DNA, 25 bp, Mus musculus
gccatttttggtgcatgaggtcata

SEQ ID NO: 549744 - DNA, 25 bp, Mus musculus
gccattttttagctgttgaagccag

SEQ ID NO: 549745 - DNA, 25 bp, Mus musculus
gccattttttaggtgttgaagccag

SEQ ID NO: 549746 - DNA, 25 bp, Mus musculus
gccattttttggatgcatagcctat

SEQ ID NO: 549747 - DNA, 25 bp, Mus musculus
gccattttttggttgcatagcctat

SEQ ID NO: 549748 - DNA, 25 bp, Mus musculus
gcccaaaaatgtaccttatgttcct

SEQ ID NO: 549749 - DNA, 25 bp, Mus musculus
gcccaaaaatgttccttatgttcct

SEQ ID NO: 549750 - DNA, 25 bp, Mus musculus
gcccaaaatgttcccagtcaggttg

SEQ ID NO: 549751 - DNA, 25 bp, Mus musculus
gcccaaaatgttgccagtcaggttg

SEQ ID NO: 549752 - DNA, 25 bp, Mus musculus
gcccaaaattgcaaatctcacatgt

SEQ ID NO: 549753 - DNA, 25 bp, Mus musculus
gcccaaaattgcatctaaatcaata

SEQ ID NO: 549754 - DNA, 25 bp, Mus musculus
gcccaaaattgctaatctcacatgt

SEQ ID NO: 549755 - DNA, 25 bp, Mus musculus
gcccaaaattgcttctaaatcaata

SEQ ID NO: 549756 - DNA, 25 bp, Mus musculus
gcccaaacttttcacctcagggcgt

SEQ ID NO: 549757 - DNA, 25 bp, Mus musculus
gcccaaacttttgacctcagggcgt

SEQ ID NO: 549758 - DNA, 25 bp, Mus musculus
gcccaaagcccaactgaaaatgtaa

SEQ ID NO: 549759 - DNA, 25 bp, Mus musculus
gcccaaagcccatctgaaaatgtaa

SEQ ID NO: 549760 - DNA, 25 bp, Mus musculus
gcccaaaggcacaccactaatacat

SEQ ID NO: 549761 - DNA, 25 bp, Mus musculus
gcccaaaggcactccactaatacat

SEQ ID NO: 549762 - DNA, 25 bp, Mus musculus
gcccaaaggcttccctgattctgag

SEQ ID NO: 549763 - DNA, 25 bp, Mus musculus
gcccaaaggcttgcctgattctgag

SEQ ID NO: 549764 - DNA, 25 bp, Mus musculus
gcccaaatgggcagggtcactggaa

SEQ ID NO: 549765 - DNA, 25 bp, Mus musculus
gcccaaatgggctgggtcactggaa

SEQ ID NO: 549766 - DNA, 25 bp, Mus musculus
gcccaaattccaatctgtgtgcagt

SEQ ID NO: 549767 - DNA, 25 bp, Mus musculus
gcccaaattccattctgtgtgcagt

SEQ ID NO: 549768 - DNA, 25 bp, Mus musculus
gcccaaattgagacatgccccatgg

SEQ ID NO: 549769 - DNA, 25 bp, Mus musculus
gcccaaattgagtcatgccccatgg

SEQ ID NO: 549770 - DNA, 25 bp, Mus musculus
gcccaaattggcacacagtgacttg

SEQ ID NO: 549771 - DNA, 25 bp, Mus musculus
gcccaaattggctcacagtgacttg

SEQ ID NO: 549772 - DNA, 25 bp, Mus musculus
gcccaacaacagagccgcctatcgg

SEQ ID NO: 549773 - DNA, 25 bp, Mus musculus
gcccaacaacagtgccgcctatcgg

SEQ ID NO: 549774 - DNA, 25 bp, Mus musculus
gcccaacacagaacaacatattaaa

SEQ ID NO: 549775 - DNA, 25 bp, Mus musculus
gcccaacacagatcaacatattaaa

SEQ ID NO: 549776 - DNA, 25 bp, Mus musculus
gcccaacacaggagaggccctgggt

SEQ ID NO: 549777 - DNA, 25 bp, Mus musculus
gcccaacacaggtgaggccctgggt

SEQ ID NO: 549778 - DNA, 25 bp, Mus musculus
gcccaacacgacattgccgagagaa

SEQ ID NO: 549779 - DNA, 25 bp, Mus musculus
gcccaacacgactttgccgagagaa

SEQ ID NO: 549780 - DNA, 25 bp, Mus musculus
gcccaacagttgacccttggatgta

SEQ ID NO: 549781 - DNA, 25 bp, Mus musculus
gcccaacagttgtcccttggatgta

SEQ ID NO: 549782 - DNA, 25 bp, Mus musculus
gcccaacatgatcatcagcgtaaat

SEQ ID NO: 549783 - DNA, 25 bp, Mus musculus
gcccaacatgatgatcagcgtaaat

SEQ ID NO: 549784 - DNA, 25 bp, Mus musculus
gcccaacatggcagactattactat

SEQ ID NO: 549785 - DNA, 25 bp, Mus musculus
gcccaacatggctgactattactat

SEQ ID NO: 549786 - DNA, 25 bp, Mus musculus
gcccaacccatgaacttcctggaga

SEQ ID NO: 549787 - DNA, 25 bp, Mus musculus
gcccaacccatgtacttcctggaga

SEQ ID NO: 549788 - DNA, 25 bp, Mus musculus
gcccaacccgatacttaggacattt

SEQ ID NO: 549789 - DNA, 25 bp, Mus musculus
gcccaacccgattcttaggacattt

SEQ ID NO: 549790 - DNA, 25 bp, Mus musculus
gcccaactaccaactttctgaatga

SEQ ID NO: 549791 - DNA, 25 bp, Mus musculus
gcccaactaccatctttctgaatga

SEQ ID NO: 549792 - DNA, 25 bp, Mus musculus
gcccaactgtaaatcatttaaaccg

SEQ ID NO: 549793 - DNA, 25 bp, Mus musculus
gcccaactgtaattcatttaaaccg

SEQ ID NO: 549794 - DNA, 25 bp, Mus musculus
gcccaagaatgcagaccactttgct

SEQ ID NO: 549795 - DNA, 25 bp, Mus musculus
gcccaagaatgctgaccactttgct

SEQ ID NO: 549796 - DNA, 25 bp, Mus musculus
gcccaagactctcactacttgatat

SEQ ID NO: 549797 - DNA, 25 bp, Mus musculus
gcccaagactctgactacttgatat

SEQ ID NO: 549798 - DNA, 25 bp, Mus musculus
gcccaagattttaacacgcacctgt

SEQ ID NO: 549799 - DNA, 25 bp, Mus musculus
gcccaagatttttacacgcacctgt

SEQ ID NO: 549800 - DNA, 25 bp, Mus musculus
gcccaagccagaactttcactctgt

SEQ ID NO: 549801 - DNA, 25 bp, Mus musculus
gcccaagccagatctttcactctgt

SEQ ID NO: 549802 - DNA, 25 bp, Mus musculus
gcccaagctaaaaactttgactgtt

SEQ ID NO: 549803 - DNA, 25 bp, Mus musculus
gcccaagctaaatactttgactgtt

SEQ ID NO: 549804 - DNA, 25 bp, Mus musculus
gcccaagctctgctcactagtaaaa

SEQ ID NO: 549805 - DNA, 25 bp, Mus musculus
gcccaagctctggtcactagtaaaa

SEQ ID NO: 549806 - DNA, 25 bp, Mus musculus
gcccaagctggaaagcacatgtcta

SEQ ID NO: 549807 - DNA, 25 bp, Mus musculus
gcccaagctggatagcacatgtcta

SEQ ID NO: 549808 - DNA, 25 bp, Mus musculus
gcccaagctgggatcaaagtgtatc

SEQ ID NO: 549809 - DNA, 25 bp, Mus musculus
gcccaagctgggttcaaagtgtatc

SEQ ID NO: 549810 - DNA, 25 bp, Mus musculus
gcccaagcttcgagtctgacaagag

SEQ ID NO: 549811 - DNA, 25 bp, Mus musculus
gcccaagcttcgtgtctgacaagag

SEQ ID NO: 549812 - DNA, 25 bp, Mus musculus
gcccaagcttgacttacaggctgtt

SEQ ID NO: 549813 - DNA, 25 bp, Mus musculus
gcccaagcttgagttacaggctgtt

SEQ ID NO: 549814 - DNA, 25 bp, Mus musculus
gcccaaggaaggagagcgcaagatc

SEQ ID NO: 549815 - DNA, 25 bp, Mus musculus
gcccaaggaaggtgagcgcaagatc

SEQ ID NO: 549816 - DNA, 25 bp, Mus musculus
gcccaaggacttcgcttcatgtagt

SEQ ID NO: 549817 - DNA, 25 bp, Mus musculus
gcccaaggacttctgccaatggcta

SEQ ID NO: 549818 - DNA, 25 bp, Mus musculus
gcccaaggacttggcttcatgtagt

SEQ ID NO: 549819 - DNA, 25 bp, Mus musculus
gcccaaggacttgtgccaatggcta

SEQ ID NO: 549820 - DNA, 25 bp, Mus musculus
gcccaaggccatactactaacagta

SEQ ID NO: 549821 - DNA, 25 bp, Mus musculus
gcccaaggccatagatcaagacaag

SEQ ID NO: 549822 - DNA, 25 bp, Mus musculus
gcccaaggccattctactaacagta

SEQ ID NO: 549823 - DNA, 25 bp, Mus musculus
gcccaaggccattgatcaagacaag

SEQ ID NO: 549824 - DNA, 25 bp, Mus musculus
gcccaagggaggacactgggaaaat

SEQ ID NO: 549825 - DNA, 25 bp, Mus musculus
gcccaagggaggtcactgggaaaat

SEQ ID NO: 549826 - DNA, 25 bp, Mus musculus
gcccaagggatgatttagtagctct

SEQ ID NO: 549827 - DNA, 25 bp, Mus musculus
gcccaagggatgttttagtagctct

SEQ ID NO: 549828 - DNA, 25 bp, Mus musculus
gcccaagggccaatgtgcactatgt

SEQ ID NO: 549829 - DNA, 25 bp, Mus musculus
gcccaagggccattgtgcactatgt

SEQ ID NO: 549830 - DNA, 25 bp, Mus musculus
gcccaagggtttcctgatgctcgag

SEQ ID NO: 549831 - DNA, 25 bp, Mus musculus
gcccaagggtttgctgatgctcgag

SEQ ID NO: 549832 - DNA, 25 bp, Mus musculus
gcccaaggtgctaagtctcagtgag

SEQ ID NO: 549833 - DNA, 25 bp, Mus musculus
gcccaaggtgctactatttgcttaa

SEQ ID NO: 549834 - DNA, 25 bp, Mus musculus
gcccaaggtgcttagtctcagtgag

SEQ ID NO: 549835 - DNA, 25 bp, Mus musculus
gcccaaggtgcttctatttgcttaa

SEQ ID NO: 549836 - DNA, 25 bp, Mus musculus
gcccaaggtggaagttcgcatgatt

SEQ ID NO: 549837 - DNA, 25 bp, Mus musculus
gcccaaggtggatgttcgcatgatt

SEQ ID NO: 549838 - DNA, 25 bp, Mus musculus
gcccaaggtgttattgtccaggtca

SEQ ID NO: 549839 - DNA, 25 bp, Mus musculus
gcccaaggtgtttttgtccaggtca

SEQ ID NO: 549840 - DNA, 25 bp, Mus musculus
gcccaagtacttctctccagtgagt

SEQ ID NO: 549841 - DNA, 25 bp, Mus musculus
gcccaagtacttgtctccagtgagt

SEQ ID NO: 549842 - DNA, 25 bp, Mus musculus
gcccaagtcaatcccttgttttgta

SEQ ID NO: 549843 - DNA, 25 bp, Mus musculus
gcccaagtcaatgccttgttttgta

SEQ ID NO: 549844 - DNA, 25 bp, Mus musculus
gcccaagtcattatacgtttgcctt

SEQ ID NO: 549845 - DNA, 25 bp, Mus musculus
gcccaagtcattttacgtttgcctt

SEQ ID NO: 549846 - DNA, 25 bp, Mus musculus
gcccaagtctccatttactgaaata

SEQ ID NO: 549847 - DNA, 25 bp, Mus musculus
gcccaagtctccttttactgaaata

SEQ ID NO: 549848 - DNA, 25 bp, Mus musculus
gcccaagtgaagatgctcgcagctg

SEQ ID NO: 549849 - DNA, 25 bp, Mus musculus
gcccaagtgaagttgctcgcagctg

SEQ ID NO: 549850 - DNA, 25 bp, Mus musculus
gcccaagtgctacttcactttggtt

SEQ ID NO: 549851 - DNA, 25 bp, Mus musculus
gcccaagtgctagttcactttggtt

SEQ ID NO: 549852 - DNA, 25 bp, Mus musculus
gcccaagtgtctcgatgagttccca

SEQ ID NO: 549853 - DNA, 25 bp, Mus musculus
gcccaagtgtctggatgagttccca

SEQ ID NO: 549854 - DNA, 25 bp, Mus musculus
gcccaatactgcatcttgttaatct

SEQ ID NO: 549855 - DNA, 25 bp, Mus musculus
gcccaatactgcttcttgttaatct

SEQ ID NO: 549856 - DNA, 25 bp, Mus musculus
gcccaatcaatgatgcttctctttc

SEQ ID NO: 549857 - DNA, 25 bp, Mus musculus
gcccaatcaatgttgcttctctttc

SEQ ID NO: 549858 - DNA, 25 bp, Mus musculus
gcccaatccgctcccaatgtgagga

SEQ ID NO: 549859 - DNA, 25 bp, Mus musculus
gcccaatccgctgccaatgtgagga

SEQ ID NO: 549860 - DNA, 25 bp, Mus musculus
gcccaatctatgacgtgttttcaag

SEQ ID NO: 549861 - DNA, 25 bp, Mus musculus
gcccaatctatgtcgtgttttcaag

SEQ ID NO: 549862 - DNA, 25 bp, Mus musculus
gcccaatctccacagcaaatttcag

SEQ ID NO: 549863 - DNA, 25 bp, Mus musculus
gcccaatctccagagcaaatttcag

SEQ ID NO: 549864 - DNA, 25 bp, Mus musculus
gcccaatcttaccacttttattcaa

SEQ ID NO: 549865 - DNA, 25 bp, Mus musculus
gcccaatcttacgacttttattcaa

SEQ ID NO: 549866 - DNA, 25 bp, Mus musculus
gcccaatgacagcactatttctcag

SEQ ID NO: 549867 - DNA, 25 bp, Mus musculus
gcccaatgacaggactatttctcag

SEQ ID NO: 549868 - DNA, 25 bp, Mus musculus
gcccaatgactgaagacaacctgct

SEQ ID NO: 549869 - DNA, 25 bp, Mus musculus
gcccaatgactgtagacaacctgct

SEQ ID NO: 549870 - DNA, 25 bp, Mus musculus
gcccaatgaggccttatttctgcat

SEQ ID NO: 549871 - DNA, 25 bp, Mus musculus
gcccaatgaggcgttatttctgcat

SEQ ID NO: 549872 - DNA, 25 bp, Mus musculus
gcccaatgcctcaacctaaggtagg

SEQ ID NO: 549873 - DNA, 25 bp, Mus musculus
gcccaatgcctctacctaaggtagg

SEQ ID NO: 549874 - DNA, 25 bp, Mus musculus
gcccaatgctaaaatcagctagaag

SEQ ID NO: 549875 - DNA, 25 bp, Mus musculus
gcccaatgctaatatcagctagaag

SEQ ID NO: 549876 - DNA, 25 bp, Mus musculus
gcccaatggagccttacagaactaa

SEQ ID NO: 549877 - DNA, 25 bp, Mus musculus
gcccaatggagcgttacagaactaa

SEQ ID NO: 549878 - DNA, 25 bp, Mus musculus
gcccaatgtaagaccactgagctat

SEQ ID NO: 549879 - DNA, 25 bp, Mus musculus
gcccaatgtaagtccactgagctat

SEQ ID NO: 549880 - DNA, 25 bp, Mus musculus
gcccaatgtgctcccagtgttaagt

SEQ ID NO: 549881 - DNA, 25 bp, Mus musculus
gcccaatgtgctgccagtgttaagt

SEQ ID NO: 549882 - DNA, 25 bp, Mus musculus
gcccaatgttaaactgtgttcctgt

SEQ ID NO: 549883 - DNA, 25 bp, Mus musculus
gcccaatgttaatctgtgttcctgt

SEQ ID NO: 549884 - DNA, 25 bp, Mus musculus
gcccaattccaactgttctaacctt

SEQ ID NO: 549885 - DNA, 25 bp, Mus musculus
gcccaattccaagtgttctaacctt

SEQ ID NO: 549886 - DNA, 25 bp, Mus musculus
gcccaattctaacctcaacctagtt

SEQ ID NO: 549887 - DNA, 25 bp, Mus musculus
gcccaattctaagctcaacctagtt

SEQ ID NO: 549888 - DNA, 25 bp, Mus musculus
gcccaattctagaaattaggcctga

SEQ ID NO: 549889 - DNA, 25 bp, Mus musculus
gcccaattctagtaattaggcctga

SEQ ID NO: 549890 - DNA, 25 bp, Mus musculus
gcccacaaatggaattataatgctt

SEQ ID NO: 549891 - DNA, 25 bp, Mus musculus
gcccacaaatggtattataatgctt

SEQ ID NO: 549892 - DNA, 25 bp, Mus musculus
gcccacaaggataatgctgcatttc

SEQ ID NO: 549893 - DNA, 25 bp, Mus musculus
gcccacaaggattatgctgcatttc

SEQ ID NO: 549894 - DNA, 25 bp, Mus musculus
gcccacaatggcatcgattatgact

SEQ ID NO: 549895 - DNA, 25 bp, Mus musculus
gcccacaatggcttcgattatgact

SEQ ID NO: 549896 - DNA, 25 bp, Mus musculus
gcccacaatgggagccaagatcatt

SEQ ID NO: 549897 - DNA, 25 bp, Mus musculus
gcccacaatgggtgccaagatcatt

SEQ ID NO: 549898 - DNA, 25 bp, Mus musculus
gcccacacacagcttgtattatcag

SEQ ID NO: 549899 - DNA, 25 bp, Mus musculus
gcccacacacaggttgtattatcag

SEQ ID NO: 549900 - DNA, 25 bp, Mus musculus
gcccacacatggacatacgaacata

SEQ ID NO: 549901 - DNA, 25 bp, Mus musculus
gcccacacatggtcatacgaacata

SEQ ID NO: 549902 - DNA, 25 bp, Mus musculus
gcccacaccttaatcccattaagag

SEQ ID NO: 549903 - DNA, 25 bp, Mus musculus
gcccacaccttattcccattaagag

SEQ ID NO: 549904 - DNA, 25 bp, Mus musculus
gcccacacgtgtaatcataaatcat

SEQ ID NO: 549905 - DNA, 25 bp, Mus musculus
gcccacacgtgttatcataaatcat

SEQ ID NO: 549906 - DNA, 25 bp, Mus musculus
gcccacactgcaacatccaggagaa

SEQ ID NO: 549907 - DNA, 25 bp, Mus musculus
gcccacactgcatcatccaggagaa

SEQ ID NO: 549908 - DNA, 25 bp, Mus musculus
gcccacagacatcgcttcatttttt

SEQ ID NO: 549909 - DNA, 25 bp, Mus musculus
gcccacagacatggcttcatttttt

SEQ ID NO: 549910 - DNA, 25 bp, Mus musculus
gcccacagagacagcttcttttagg

SEQ ID NO: 549911 - DNA, 25 bp, Mus musculus
gcccacagagactgcttcttttagg

SEQ ID NO: 549912 - DNA, 25 bp, Mus musculus
gcccacagcatcctattatctatat

SEQ ID NO: 549913 - DNA, 25 bp, Mus musculus
gcccacagcatcgtattatctatat

SEQ ID NO: 549914 - DNA, 25 bp, Mus musculus
gcccacaggattcccattaggtttt

SEQ ID NO: 549915 - DNA, 25 bp, Mus musculus
gcccacaggattgccattaggtttt

SEQ ID NO: 549916 - DNA, 25 bp, Mus musculus
gcccacaggctaaagacagtagatt

SEQ ID NO: 549917 - DNA, 25 bp, Mus musculus
gcccacaggctatagacagtagatt

SEQ ID NO: 549918 - DNA, 25 bp, Mus musculus
gcccacagggttattaatactgtca

SEQ ID NO: 549919 - DNA, 25 bp, Mus musculus
gcccacagggtttttaatactgtca

SEQ ID NO: 549920 - DNA, 25 bp, Mus musculus
gcccacagtggcatttcattttata

SEQ ID NO: 549921 - DNA, 25 bp, Mus musculus
gcccacagtggcttttcattttata

SEQ ID NO: 549922 - DNA, 25 bp, Mus musculus
gcccacagttctaggttccagagtt

SEQ ID NO: 549923 - DNA, 25 bp, Mus musculus
gcccacagttcttggttccagagtt

SEQ ID NO: 549924 - DNA, 25 bp, Mus musculus
gcccacagtttcaatttttcatgtt

SEQ ID NO: 549925 - DNA, 25 bp, Mus musculus
gcccacagtttctatttttcatgtt

SEQ ID NO: 549926 - DNA, 25 bp, Mus musculus
gcccacatactcagtacctgaaatg

SEQ ID NO: 549927 - DNA, 25 bp, Mus musculus
gcccacatactctgtacctgaaatg

SEQ ID NO: 549928 - DNA, 25 bp, Mus musculus
gcccacatagataaacacagcaagt

SEQ ID NO: 549929 - DNA, 25 bp, Mus musculus
gcccacatagattaacacagcaagt

SEQ ID NO: 549930 - DNA, 25 bp, Mus musculus
gcccacatagcacaccatacataaa

SEQ ID NO: 549931 - DNA, 25 bp, Mus musculus
gcccacatagcagaccatacataaa

SEQ ID NO: 549932 - DNA, 25 bp, Mus musculus
gcccacatatagcttcagttacatt

SEQ ID NO: 549933 - DNA, 25 bp, Mus musculus
gcccacatataggttcagttacatt

SEQ ID NO: 549934 - DNA, 25 bp, Mus musculus
gcccacatcaagagacatgtcacat

SEQ ID NO: 549935 - DNA, 25 bp, Mus musculus
gcccacatcaagtgacatgtcacat

SEQ ID NO: 549936 - DNA, 25 bp, Mus musculus
gcccacatccctctttactgaaggt

SEQ ID NO: 549937 - DNA, 25 bp, Mus musculus
gcccacatccctgtttactgaaggt

SEQ ID NO: 549938 - DNA, 25 bp, Mus musculus
gcccacatccggctttctggaatat

SEQ ID NO: 549939 - DNA, 25 bp, Mus musculus
gcccacatccgggtttctggaatat

SEQ ID NO: 549940 - DNA, 25 bp, Mus musculus
gcccacatcttgagagctagccaaa

SEQ ID NO: 549941 - DNA, 25 bp, Mus musculus
gcccacatcttgtgagctagccaaa

SEQ ID NO: 549942 - DNA, 25 bp, Mus musculus
gcccacatctttaatgtctgagcca

SEQ ID NO: 549943 - DNA, 25 bp, Mus musculus
gcccacatcttttatgtctgagcca

SEQ ID NO: 549944 - DNA, 25 bp, Mus musculus
gcccacatgaagacaggagcctgtt

SEQ ID NO: 549945 - DNA, 25 bp, Mus musculus
gcccacatgaagtcaggagcctgtt

SEQ ID NO: 549946 - DNA, 25 bp, Mus musculus
gcccacatgtgcacagcaggactag

SEQ ID NO: 549947 - DNA, 25 bp, Mus musculus
gcccacatgtgctcagcaggactag

SEQ ID NO: 549948 - DNA, 25 bp, Mus musculus
gcccacatttatcctgaagaccctg

SEQ ID NO: 549949 - DNA, 25 bp, Mus musculus
gcccacatttatgctgaagaccctg

SEQ ID NO: 549950 - DNA, 25 bp, Mus musculus
gcccaccaagaaaggccgagaccga

SEQ ID NO: 549951 - DNA, 25 bp, Mus musculus
gcccaccaagaatggccgagaccga

SEQ ID NO: 549952 - DNA, 25 bp, Mus musculus
gcccaccaagccagtaaaaactaag

SEQ ID NO: 549953 - DNA, 25 bp, Mus musculus
gcccaccaagcctgtaaaaactaag

SEQ ID NO: 549954 - DNA, 25 bp, Mus musculus
gcccaccacgctagagcttaaggaa

SEQ ID NO: 549955 - DNA, 25 bp, Mus musculus
gcccaccacgcttgagcttaaggaa

SEQ ID NO: 549956 - DNA, 25 bp, Mus musculus
gcccaccagcctagtcctaataaaa

SEQ ID NO: 549957 - DNA, 25 bp, Mus musculus
gcccaccagccttgtcctaataaaa

SEQ ID NO: 549958 - DNA, 25 bp, Mus musculus
gcccaccagggtatgtaaatatctt

SEQ ID NO: 549959 - DNA, 25 bp, Mus musculus
gcccaccagggtttgtaaatatctt

SEQ ID NO: 549960 - DNA, 25 bp, Mus musculus
gcccaccaggttcttatggatgcaa

SEQ ID NO: 549961 - DNA, 25 bp, Mus musculus
gcccaccaggttgttatggatgcaa

SEQ ID NO: 549962 - DNA, 25 bp, Mus musculus
gcccaccagtggctttatacttctt

SEQ ID NO: 549963 - DNA, 25 bp, Mus musculus
gcccaccagtgggtttatacttctt

SEQ ID NO: 549964 - DNA, 25 bp, Mus musculus
gcccacccaagacatggcttacgta

SEQ ID NO: 549965 - DNA, 25 bp, Mus musculus
gcccacccaagagatggcttacgta

SEQ ID NO: 549966 - DNA, 25 bp, Mus musculus
gcccacccagagaattggtgcatct

SEQ ID NO: 549967 - DNA, 25 bp, Mus musculus
gcccacccagagtattggtgcatct

SEQ ID NO: 549968 - DNA, 25 bp, Mus musculus
gcccacccagtgaattttttttcat

SEQ ID NO: 549969 - DNA, 25 bp, Mus musculus
gcccacccagtgtattttttttcat

SEQ ID NO: 549970 - DNA, 25 bp, Mus musculus
gcccacccatggatgcatagtgaga

SEQ ID NO: 549971 - DNA, 25 bp, Mus musculus
gcccacccatggttgcatagtgaga

SEQ ID NO: 549972 - DNA, 25 bp, Mus musculus
gcccaccccaatatggaaacaatga

SEQ ID NO: 549973 - DNA, 25 bp, Mus musculus
gcccaccccaatttggaaacaatga

SEQ ID NO: 549974 - DNA, 25 bp, Mus musculus
gcccacccgcagagaagtggccaga

SEQ ID NO: 549975 - DNA, 25 bp, Mus musculus
gcccacccgcagtgaagtggccaga

SEQ ID NO: 549976 - DNA, 25 bp, Mus musculus
gcccaccctaggcaatggcatagaa

SEQ ID NO: 549977 - DNA, 25 bp, Mus musculus
gcccaccctagggaatggcatagaa

SEQ ID NO: 549978 - DNA, 25 bp, Mus musculus
gcccaccctcagcatgaatgataga

SEQ ID NO: 549979 - DNA, 25 bp, Mus musculus
gcccaccctcaggatgaatgataga

SEQ ID NO: 549980 - DNA, 25 bp, Mus musculus
gcccaccctgatctataacaggttt

SEQ ID NO: 549981 - DNA, 25 bp, Mus musculus
gcccaccctgatgtataacaggttt

SEQ ID NO: 549982 - DNA, 25 bp, Mus musculus
gcccacctccgtatcattattataa

SEQ ID NO: 549983 - DNA, 25 bp, Mus musculus
gcccacctccgtttcattattataa

SEQ ID NO: 549984 - DNA, 25 bp, Mus musculus
gcccacctcgtgagaagacggttct

SEQ ID NO: 549985 - DNA, 25 bp, Mus musculus
gcccacctcgtgtgaagacggttct

SEQ ID NO: 549986 - DNA, 25 bp, Mus musculus
gcccacctgatcatgttacttacaa

SEQ ID NO: 549987 - DNA, 25 bp, Mus musculus
gcccacctgatcttgttacttacaa

SEQ ID NO: 549988 - DNA, 25 bp, Mus musculus
gcccacctgcacagctaatactatt

SEQ ID NO: 549989 - DNA, 25 bp, Mus musculus
gcccacctgcactgctaatactatt

SEQ ID NO: 549990 - DNA, 25 bp, Mus musculus
gcccacctggagcacatttcaagga

SEQ ID NO: 549991 - DNA, 25 bp, Mus musculus
gcccacctggaggacatttcaagga

SEQ ID NO: 549992 - DNA, 25 bp, Mus musculus
gcccacctgggcacataggaaagct

SEQ ID NO: 549993 - DNA, 25 bp, Mus musculus
gcccacctgggctcataggaaagct

SEQ ID NO: 549994 - DNA, 25 bp, Mus musculus
gcccaccttgttacgatgtcttata

SEQ ID NO: 549995 - DNA, 25 bp, Mus musculus
gcccaccttgtttcgatgtcttata

SEQ ID NO: 549996 - DNA, 25 bp, Mus musculus
gcccaccttttcagatagcaaatct

SEQ ID NO: 549997 - DNA, 25 bp, Mus musculus
gcccaccttttctgatagcaaatct

SEQ ID NO: 549998 - DNA, 25 bp, Mus musculus
gcccacgactgtagctatgagaagc

SEQ ID NO: 549999 - DNA, 25 bp, Mus musculus
gcccacgactgttgctatgagaagc

SEQ ID NO: 550000 - DNA, 25 bp, Mus musculus
gcccacgaggttaccccagagaata

SEQ ID NO: 550001 - DNA, 25 bp, Mus musculus
gcccacgaggtttccccagagaata

SEQ ID NO: 550002 - DNA, 25 bp, Mus musculus
gcccacgcaggcaaagcataacaag

SEQ ID NO: 550003 - DNA, 25 bp, Mus musculus
gcccacgcaggctaagcataacaag

SEQ ID NO: 550004 - DNA, 25 bp, Mus musculus
gcccacgcctttagcaagatgccaa

SEQ ID NO: 550005 - DNA, 25 bp, Mus musculus
gcccacgccttttgcaagatgccaa

SEQ ID NO: 550006 - DNA, 25 bp, Mus musculus
gcccacggaatcagctgttgggatt

SEQ ID NO: 550007 - DNA, 25 bp, Mus musculus
gcccacggaatctgctgttgggatt

SEQ ID NO: 550008 - DNA, 25 bp, Mus musculus
gcccacggaatgatctgcaactgtt

SEQ ID NO: 550009 - DNA, 25 bp, Mus musculus
gcccacggaatgttctgcaactgtt

SEQ ID NO: 550010 - DNA, 25 bp, Mus musculus
gcccacggcgagcagggttcagctc

SEQ ID NO: 550011 - DNA, 25 bp, Mus musculus
gcccacggcgaggagggttcagctc

SEQ ID NO: 550012 - DNA, 25 bp, Mus musculus
gcccacgggtgcaggtatcagtgat

SEQ ID NO: 550013 - DNA, 25 bp, Mus musculus
gcccacgggtgctggtatcagtgat

SEQ ID NO: 550014 - DNA, 25 bp, Mus musculus
gcccacgggtggacttcatggtaga

SEQ ID NO: 550015 - DNA, 25 bp, Mus musculus
gcccacgggtggtcttcatggtaga

SEQ ID NO: 550016 - DNA, 25 bp, Mus musculus
gcccacggtgcaaaagcctaagaag

SEQ ID NO: 550017 - DNA, 25 bp, Mus musculus
gcccacggtgcataagcctaagaag

SEQ ID NO: 550018 - DNA, 25 bp, Mus musculus
gcccacggtgtgaagctagacgctg

SEQ ID NO: 550019 - DNA, 25 bp, Mus musculus
gcccacggtgtgtagctagacgctg

SEQ ID NO: 550020 - DNA, 25 bp, Mus musculus
gcccacgtggacagcagatgaagaa

SEQ ID NO: 550021 - DNA, 25 bp, Mus musculus
gcccacgtggactgcagatgaagaa

SEQ ID NO: 550022 - DNA, 25 bp, Mus musculus
gcccacgttggacttggttgtgtca

SEQ ID NO: 550023 - DNA, 25 bp, Mus musculus
gcccacgttggagttggttgtgtca

SEQ ID NO: 550024 - DNA, 25 bp, Mus musculus
gcccactaagggaacatgtgcgctt

SEQ ID NO: 550025 - DNA, 25 bp, Mus musculus
gcccactaagggtacatgtgcgctt

SEQ ID NO: 550026 - DNA, 25 bp, Mus musculus
gcccactactgcatttgtaactgga

SEQ ID NO: 550027 - DNA, 25 bp, Mus musculus
gcccactactgcttttgtaactgga

SEQ ID NO: 550028 - DNA, 25 bp, Mus musculus
gcccactatgccctgaagacaaatg

SEQ ID NO: 550029 - DNA, 25 bp, Mus musculus
gcccactatgccgtgaagacaaatg

SEQ ID NO: 550030 - DNA, 25 bp, Mus musculus
gcccactcagatatcttttgcttca

SEQ ID NO: 550031 - DNA, 25 bp, Mus musculus
gcccactcagatttcttttgcttca

SEQ ID NO: 550032 - DNA, 25 bp, Mus musculus
gcccactcgattcttactatgttgc

SEQ ID NO: 550033 - DNA, 25 bp, Mus musculus
gcccactcgattgttactatgttgc

SEQ ID NO: 550034 - DNA, 25 bp, Mus musculus
gcccactcttagcaggtgctgtata

SEQ ID NO: 550035 - DNA, 25 bp, Mus musculus
gcccactcttaggaggtgctgtata

SEQ ID NO: 550036 - DNA, 25 bp, Mus musculus
gcccactctttgcttttcttatttg

SEQ ID NO: 550037 - DNA, 25 bp, Mus musculus
gcccactctttggttttcttatttg

SEQ ID NO: 550038 - DNA, 25 bp, Mus musculus
gcccactgatcacctagacacttta

SEQ ID NO: 550039 - DNA, 25 bp, Mus musculus
gcccactgatcagctagacacttta

SEQ ID NO: 550040 - DNA, 25 bp, Mus musculus
gcccactgcaatactactcttgaaa

SEQ ID NO: 550041 - DNA, 25 bp, Mus musculus
gcccactgcaattctactcttgaaa

SEQ ID NO: 550042 - DNA, 25 bp, Mus musculus
gcccactgccaaatcatcaggttta

SEQ ID NO: 550043 - DNA, 25 bp, Mus musculus
gcccactgccaattcatcaggttta

SEQ ID NO: 550044 - DNA, 25 bp, Mus musculus
gcccactgccctcaagaaaggtgtg

SEQ ID NO: 550045 - DNA, 25 bp, Mus musculus
gcccactgccctgaagaaaggtgtg

SEQ ID NO: 550046 - DNA, 25 bp, Mus musculus
gcccactggagcactaggtgtggtc

SEQ ID NO: 550047 - DNA, 25 bp, Mus musculus
gcccactggagctctaggtgtggtc

SEQ ID NO: 550048 - DNA, 25 bp, Mus musculus
gcccactggcagaggcgactgtgaa

SEQ ID NO: 550049 - DNA, 25 bp, Mus musculus
gcccactggcagtggcgactgtgaa

SEQ ID NO: 550050 - DNA, 25 bp, Mus musculus
gcccactgtcatcacctagaaagat

SEQ ID NO: 550051 - DNA, 25 bp, Mus musculus
gcccactgtcatgacctagaaagat

SEQ ID NO: 550052 - DNA, 25 bp, Mus musculus
gcccactgtccgagagttctgagca

SEQ ID NO: 550053 - DNA, 25 bp, Mus musculus
gcccactgtccgtgagttctgagca

SEQ ID NO: 550054 - DNA, 25 bp, Mus musculus
gcccactgtgataattttctgctca

SEQ ID NO: 550055 - DNA, 25 bp, Mus musculus
gcccactgtgattattttctgctca

SEQ ID NO: 550056 - DNA, 25 bp, Mus musculus
gcccactgtgctctagaaggtacta

SEQ ID NO: 550057 - DNA, 25 bp, Mus musculus
gcccactgtgctgtagaaggtacta

SEQ ID NO: 550058 - DNA, 25 bp, Mus musculus
gcccacttcaaactcttgattgtgt

SEQ ID NO: 550059 - DNA, 25 bp, Mus musculus
gcccacttcaaagtcttgattgtgt

SEQ ID NO: 550060 - DNA, 25 bp, Mus musculus
gcccacttccccagaagtgtcaaga

SEQ ID NO: 550061 - DNA, 25 bp, Mus musculus
gcccacttcccctgaagtgtcaaga

SEQ ID NO: 550062 - DNA, 25 bp, Mus musculus
gcccacttgactcaggacgacagct

SEQ ID NO: 550063 - DNA, 25 bp, Mus musculus
gcccacttgactgaggacgacagct

SEQ ID NO: 550064 - DNA, 25 bp, Mus musculus
gcccacttgccccatgcagagaggg

SEQ ID NO: 550065 - DNA, 25 bp, Mus musculus
gcccacttgcccgatgcagagaggg

SEQ ID NO: 550066 - DNA, 25 bp, Mus musculus
gcccactttctgaacacagtcatgg

SEQ ID NO: 550067 - DNA, 25 bp, Mus musculus
gcccactttctgtacacagtcatgg

SEQ ID NO: 550068 - DNA, 25 bp, Mus musculus
gcccactttggcacatataattaac

SEQ ID NO: 550069 - DNA, 25 bp, Mus musculus
gcccactttggctcatataattaac

SEQ ID NO: 550070 - DNA, 25 bp, Mus musculus
gcccacttttgtaatgtccttttct

SEQ ID NO: 550071 - DNA, 25 bp, Mus musculus
gcccacttttgttatgtccttttct

SEQ ID NO: 550072 - DNA, 25 bp, Mus musculus
gcccagaaagctcttggcagtacct

SEQ ID NO: 550073 - DNA, 25 bp, Mus musculus
gcccagaaagctgttggcagtacct

SEQ ID NO: 550074 - DNA, 25 bp, Mus musculus
gcccagaacatcatccctgcatcca

SEQ ID NO: 550075 - DNA, 25 bp, Mus musculus
gcccagaacatcttccctgcatcca

SEQ ID NO: 550076 - DNA, 25 bp, Mus musculus
gcccagaaccccatatgtgactgtt

SEQ ID NO: 550077 - DNA, 25 bp, Mus musculus
gcccagaaccccttatgtgactgtt

SEQ ID NO: 550078 - DNA, 25 bp, Mus musculus
gcccagaacctcctgagtgacatca

SEQ ID NO: 550079 - DNA, 25 bp, Mus musculus
gcccagaacctcgtgagtgacatca

SEQ ID NO: 550080 - DNA, 25 bp, Mus musculus
gcccagaactcaactaagctcttgc

SEQ ID NO: 550081 - DNA, 25 bp, Mus musculus
gcccagaactcaagcaaaccaggtg

SEQ ID NO: 550082 - DNA, 25 bp, Mus musculus
gcccagaactcatctaagctcttgc

SEQ ID NO: 550083 - DNA, 25 bp, Mus musculus
gcccagaactcatgcaaaccaggtg

SEQ ID NO: 550084 - DNA, 25 bp, Mus musculus
gcccagaagattcgtgtgccggctt

SEQ ID NO: 550085 - DNA, 25 bp, Mus musculus
gcccagaagattggtgtgccggctt

SEQ ID NO: 550086 - DNA, 25 bp, Mus musculus
gcccagaagtctatgcgcgagttga

SEQ ID NO: 550087 - DNA, 25 bp, Mus musculus
gcccagaagtctttgcgcgagttga

SEQ ID NO: 550088 - DNA, 25 bp, Mus musculus
gcccagaatcgacgtggtgccttct

SEQ ID NO: 550089 - DNA, 25 bp, Mus musculus
gcccagaatcgaggtggtgccttct

SEQ ID NO: 550090 - DNA, 25 bp, Mus musculus
gcccagaatcttagtcatctttcac

SEQ ID NO: 550091 - DNA, 25 bp, Mus musculus
gcccagaatctttgtcatctttcac

SEQ ID NO: 550092 - DNA, 25 bp, Mus musculus
gcccagaatgacacttcccaagtag

SEQ ID NO: 550093 - DNA, 25 bp, Mus musculus
gcccagaatgactcttcccaagtag

SEQ ID NO: 550094 - DNA, 25 bp, Mus musculus
gcccagacaaagagaccaagacatt

SEQ ID NO: 550095 - DNA, 25 bp, Mus musculus
gcccagacaaagtgaccaagacatt

SEQ ID NO: 550096 - DNA, 25 bp, Mus musculus
gcccagacactaacttttttagctt

SEQ ID NO: 550097 - DNA, 25 bp, Mus musculus
gcccagacactatcttttttagctt

SEQ ID NO: 550098 - DNA, 25 bp, Mus musculus
gcccagacatgcagtcagggtagtg

SEQ ID NO: 550099 - DNA, 25 bp, Mus musculus
gcccagacatgctgtcagggtagtg

SEQ ID NO: 550100 - DNA, 25 bp, Mus musculus
gcccagacatttattgagctgtttc

SEQ ID NO: 550101 - DNA, 25 bp, Mus musculus
gcccagacattttttgagctgtttc

SEQ ID NO: 550102 - DNA, 25 bp, Mus musculus
gcccagacgcagacctagctggaaa

SEQ ID NO: 550103 - DNA, 25 bp, Mus musculus
gcccagacgcagtcctagctggaaa

SEQ ID NO: 550104 - DNA, 25 bp, Mus musculus
gcccagacgctaatatcatgccata

SEQ ID NO: 550105 - DNA, 25 bp, Mus musculus
gcccagacgctattatcatgccata

SEQ ID NO: 550106 - DNA, 25 bp, Mus musculus
gcccagagaaccctaaaccacaaag

SEQ ID NO: 550107 - DNA, 25 bp, Mus musculus
gcccagagaaccgtaaaccacaaag

SEQ ID NO: 550108 - DNA, 25 bp, Mus musculus
gcccagagaagcacggaacccagat

SEQ ID NO: 550109 - DNA, 25 bp, Mus musculus
gcccagagaagctcggaacccagat

SEQ ID NO: 550110 - DNA, 25 bp, Mus musculus
gcccagagacctacagagtaagagc

SEQ ID NO: 550111 - DNA, 25 bp, Mus musculus
gcccagagaccttcagagtaagagc

SEQ ID NO: 550112 - DNA, 25 bp, Mus musculus
gcccagagactgacagcctgatgct

SEQ ID NO: 550113 - DNA, 25 bp, Mus musculus
gcccagagactgtcagcctgatgct

SEQ ID NO: 550114 - DNA, 25 bp, Mus musculus
gcccagagacttcccctatgagaga

SEQ ID NO: 550115 - DNA, 25 bp, Mus musculus
gcccagagacttgccctatgagaga

SEQ ID NO: 550116 - DNA, 25 bp, Mus musculus
gcccagagagttcagccagtgtttt

SEQ ID NO: 550117 - DNA, 25 bp, Mus musculus
gcccagagagttgagccagtgtttt

SEQ ID NO: 550118 - DNA, 25 bp, Mus musculus
gcccagagcagccaattgttccggg

SEQ ID NO: 550119 - DNA, 25 bp, Mus musculus
gcccagagcagcgaattgttccggg

SEQ ID NO: 550120 - DNA, 25 bp, Mus musculus
gcccagagcctgattgacaagacaa

SEQ ID NO: 550121 - DNA, 25 bp, Mus musculus
gcccagagcctgtttgacaagacaa

SEQ ID NO: 550122 - DNA, 25 bp, Mus musculus
gcccagagctccatgcaagaagttt

SEQ ID NO: 550123 - DNA, 25 bp, Mus musculus
gcccagagctccttgcaagaagttt

SEQ ID NO: 550124 - DNA, 25 bp, Mus musculus
gcccagaggctcaatgttaagccat

SEQ ID NO: 550125 - DNA, 25 bp, Mus musculus
gcccagaggctctatgttaagccat

SEQ ID NO: 550126 - DNA, 25 bp, Mus musculus
gcccagagggataactaagcttacc

SEQ ID NO: 550127 - DNA, 25 bp, Mus musculus
gcccagagggattactaagcttacc

SEQ ID NO: 550128 - DNA, 25 bp, Mus musculus
gcccagagggtcagtggcagtggtc

SEQ ID NO: 550129 - DNA, 25 bp, Mus musculus
gcccagagggtctgtggcagtggtc

SEQ ID NO: 550130 - DNA, 25 bp, Mus musculus
gcccagaggtttccccggatggagt

SEQ ID NO: 550131 - DNA, 25 bp, Mus musculus
gcccagaggtttgcccggatggagt

SEQ ID NO: 550132 - DNA, 25 bp, Mus musculus
gcccagagtcttagaggctcagaga

SEQ ID NO: 550133 - DNA, 25 bp, Mus musculus
gcccagagtctttgaggctcagaga

SEQ ID NO: 550134 - DNA, 25 bp, Mus musculus
gcccagagttgtcagtgcccagcag

SEQ ID NO: 550135 - DNA, 25 bp, Mus musculus
gcccagagttgtgagtgcccagcag

SEQ ID NO: 550136 - DNA, 25 bp, Mus musculus
gcccagagtttgcatgagatttttc

SEQ ID NO: 550137 - DNA, 25 bp, Mus musculus
gcccagagtttggatgagatttttc

SEQ ID NO: 550138 - DNA, 25 bp, Mus musculus
gcccagatcaaaattgccaacccgg

SEQ ID NO: 550139 - DNA, 25 bp, Mus musculus
gcccagatcaaatttgccaacccgg

SEQ ID NO: 550140 - DNA, 25 bp, Mus musculus
gcccagatcatccttaggtgtttcc

SEQ ID NO: 550141 - DNA, 25 bp, Mus musculus
gcccagatcatcgttaggtgtttcc

SEQ ID NO: 550142 - DNA, 25 bp, Mus musculus
gcccagatctgcagcagcatacgga

SEQ ID NO: 550143 - DNA, 25 bp, Mus musculus
gcccagatctgctgcagcatacgga

SEQ ID NO: 550144 - DNA, 25 bp, Mus musculus
gcccagatctgtcccttacaaattg

SEQ ID NO: 550145 - DNA, 25 bp, Mus musculus
gcccagatctgtgccttacaaattg

SEQ ID NO: 550146 - DNA, 25 bp, Mus musculus
gcccagatgtttcgctagactgttt

SEQ ID NO: 550147 - DNA, 25 bp, Mus musculus
gcccagatgtttggctagactgttt

SEQ ID NO: 550148 - DNA, 25 bp, Mus musculus
gcccagatttctcctgagagtcttt

SEQ ID NO: 550149 - DNA, 25 bp, Mus musculus
gcccagatttctgctgagagtcttt

SEQ ID NO: 550150 - DNA, 25 bp, Mus musculus
gcccagcaatgacagagccctatga

SEQ ID NO: 550151 - DNA, 25 bp, Mus musculus
gcccagcaatgagagagccctatga

SEQ ID NO: 550152 - DNA, 25 bp, Mus musculus
gcccagcacagaccgcatggtgcta

SEQ ID NO: 550153 - DNA, 25 bp, Mus musculus
gcccagcacagagcgcatggtgcta

SEQ ID NO: 550154 - DNA, 25 bp, Mus musculus
gcccagcacgataaggctttgtaca

SEQ ID NO: 550155 - DNA, 25 bp, Mus musculus
gcccagcacgattaggctttgtaca

SEQ ID NO: 550156 - DNA, 25 bp, Mus musculus
gcccagcagattagacctgtctagt

SEQ ID NO: 550157 - DNA, 25 bp, Mus musculus
gcccagcagatttgacctgtctagt

SEQ ID NO: 550158 - DNA, 25 bp, Mus musculus
gcccagcagctcaagtcggatgaga

SEQ ID NO: 550159 - DNA, 25 bp, Mus musculus
gcccagcagctctagtcggatgaga

SEQ ID NO: 550160 - DNA, 25 bp, Mus musculus
gcccagcaggagcttcttggccagt

SEQ ID NO: 550161 - DNA, 25 bp, Mus musculus
gcccagcaggaggttcttggccagt

SEQ ID NO: 550162 - DNA, 25 bp, Mus musculus
gcccagcaggtgagtagaatacgtt

SEQ ID NO: 550163 - DNA, 25 bp, Mus musculus
gcccagcaggtgtgtagaatacgtt

SEQ ID NO: 550164 - DNA, 25 bp, Mus musculus
gcccagcagtggaggtgtatacctt

SEQ ID NO: 550165 - DNA, 25 bp, Mus musculus
gcccagcagtggtggtgtatacctt

SEQ ID NO: 550166 - DNA, 25 bp, Mus musculus
gcccagcagttgagccaaaggttaa

SEQ ID NO: 550167 - DNA, 25 bp, Mus musculus
gcccagcagttgtgccaaaggttaa

SEQ ID NO: 550168 - DNA, 25 bp, Mus musculus
gcccagcatccaaggtcaacgcaat

SEQ ID NO: 550169 - DNA, 25 bp, Mus musculus
gcccagcatccatggtcaacgcaat

SEQ ID NO: 550170 - DNA, 25 bp, Mus musculus
gcccagcatgacaggagctacagct

SEQ ID NO: 550171 - DNA, 25 bp, Mus musculus
gcccagcatgactggagctacagct

SEQ ID NO: 550172 - DNA, 25 bp, Mus musculus
gcccagcatggtacttttaatttta

SEQ ID NO: 550173 - DNA, 25 bp, Mus musculus
gcccagcatggttcttttaatttta

SEQ ID NO: 550174 - DNA, 25 bp, Mus musculus
gcccagcattgaactagaagcagaa

SEQ ID NO: 550175 - DNA, 25 bp, Mus musculus
gcccagcattgatctagaagcagaa

SEQ ID NO: 550176 - DNA, 25 bp, Mus musculus
gcccagcatttgataaggcattctg

SEQ ID NO: 550177 - DNA, 25 bp, Mus musculus
gcccagcatttgttaaggcattctg

SEQ ID NO: 550178 - DNA, 25 bp, Mus musculus
gcccagccagcaattcagagcagtt

SEQ ID NO: 550179 - DNA, 25 bp, Mus musculus
gcccagccagcatttcagagcagtt

SEQ ID NO: 550180 - DNA, 25 bp, Mus musculus
gcccagccatcacctgtttatcaaa

SEQ ID NO: 550181 - DNA, 25 bp, Mus musculus
gcccagccatcagctgtttatcaaa

SEQ ID NO: 550182 - DNA, 25 bp, Mus musculus
gcccagccccagagagataccagga

SEQ ID NO: 550183 - DNA, 25 bp, Mus musculus
gcccagccccagtgagataccagga

SEQ ID NO: 550184 - DNA, 25 bp, Mus musculus
gcccagcctgcgaagaagaagaagt

SEQ ID NO: 550185 - DNA, 25 bp, Mus musculus
gcccagcctgcgtagaagaagaagt

SEQ ID NO: 550186 - DNA, 25 bp, Mus musculus
gcccagcctggaaggtgtcagcgaa

SEQ ID NO: 550187 - DNA, 25 bp, Mus musculus
gcccagcctggatggtgtcagcgaa

SEQ ID NO: 550188 - DNA, 25 bp, Mus musculus
gcccagcgtgggattacattctcaa

SEQ ID NO: 550189 - DNA, 25 bp, Mus musculus
gcccagcgtgggtttacattctcaa

SEQ ID NO: 550190 - DNA, 25 bp, Mus musculus
gcccagctaaagagaagtgacctca

SEQ ID NO: 550191 - DNA, 25 bp, Mus musculus
gcccagctaaagtgaagtgacctca

SEQ ID NO: 550192 - DNA, 25 bp, Mus musculus
gcccagctacctatctgagttctag

SEQ ID NO: 550193 - DNA, 25 bp, Mus musculus
gcccagctacctttctgagttctag

SEQ ID NO: 550194 - DNA, 25 bp, Mus musculus
gcccagctacgtaaacggaaggctc

SEQ ID NO: 550195 - DNA, 25 bp, Mus musculus
gcccagctacgttaacggaaggctc

SEQ ID NO: 550196 - DNA, 25 bp, Mus musculus
gcccagctcactcttaatgttttga

SEQ ID NO: 550197 - DNA, 25 bp, Mus musculus
gcccagctcactgttaatgttttga

SEQ ID NO: 550198 - DNA, 25 bp, Mus musculus
gcccagctccagctgtttcgagtga

SEQ ID NO: 550199 - DNA, 25 bp, Mus musculus
gcccagctccaggtgtttcgagtga

SEQ ID NO: 550200 - DNA, 25 bp, Mus musculus
gcccagctcgtgaacataagacctt

SEQ ID NO: 550201 - DNA, 25 bp, Mus musculus
gcccagctcgtgtacataagacctt

SEQ ID NO: 550202 - DNA, 25 bp, Mus musculus
gcccagctgcctagtatcagttgat

SEQ ID NO: 550203 - DNA, 25 bp, Mus musculus
gcccagctgccttgtatcagttgat

SEQ ID NO: 550204 - DNA, 25 bp, Mus musculus
gcccagctgctcagtccagataaat

SEQ ID NO: 550205 - DNA, 25 bp, Mus musculus
gcccagctgctctgtccagataaat

SEQ ID NO: 550206 - DNA, 25 bp, Mus musculus
gcccagctgctgagacttagataat

SEQ ID NO: 550207 - DNA, 25 bp, Mus musculus
gcccagctgctgatggattgactca

SEQ ID NO: 550208 - DNA, 25 bp, Mus musculus
gcccagctgctgtgacttagataat

SEQ ID NO: 550209 - DNA, 25 bp, Mus musculus
gcccagctgctgttggattgactca

SEQ ID NO: 550210 - DNA, 25 bp, Mus musculus
gcccagcttcgactggagaagccag

SEQ ID NO: 550211 - DNA, 25 bp, Mus musculus
gcccagcttcgagtggagaagccag

SEQ ID NO: 550212 - DNA, 25 bp, Mus musculus
gcccagcttctacagatctctgtat

SEQ ID NO: 550213 - DNA, 25 bp, Mus musculus
gcccagcttctagagatctctgtat

SEQ ID NO: 550214 - DNA, 25 bp, Mus musculus
gcccagcttggacgagtgccagaaa

SEQ ID NO: 550215 - DNA, 25 bp, Mus musculus
gcccagcttggaggagtgccagaaa

SEQ ID NO: 550216 - DNA, 25 bp, Mus musculus
gcccagctttcacagcggttaagtt

SEQ ID NO: 550217 - DNA, 25 bp, Mus musculus
gcccagctttcagagcggttaagtt

SEQ ID NO: 550218 - DNA, 25 bp, Mus musculus
gcccagctttgaagttccctattat

SEQ ID NO: 550219 - DNA, 25 bp, Mus musculus
gcccagctttgatgttccctattat

SEQ ID NO: 550220 - DNA, 25 bp, Mus musculus
gcccaggaacctctaaaaggcacca

SEQ ID NO: 550221 - DNA, 25 bp, Mus musculus
gcccaggaacctgtaaaaggcacca

SEQ ID NO: 550222 - DNA, 25 bp, Mus musculus
gcccaggaaggcatgtaagctgcca

SEQ ID NO: 550223 - DNA, 25 bp, Mus musculus
gcccaggaaggcttgtaagctgcca

SEQ ID NO: 550224 - DNA, 25 bp, Mus musculus
gcccaggaagtcacaggtccatatc

SEQ ID NO: 550225 - DNA, 25 bp, Mus musculus
gcccaggaagtctcaggtccatatc

SEQ ID NO: 550226 - DNA, 25 bp, Mus musculus
gcccaggacaccaacttggtattgg

SEQ ID NO: 550227 - DNA, 25 bp, Mus musculus
gcccaggacacctacttggtattgg

SEQ ID NO: 550228 - DNA, 25 bp, Mus musculus
gcccaggacagaagtatgtgtgcgt

SEQ ID NO: 550229 - DNA, 25 bp, Mus musculus
gcccaggacagatgtatgtgtgcgt

SEQ ID NO: 550230 - DNA, 25 bp, Mus musculus
gcccaggaccaaacttgaaactcat

SEQ ID NO: 550231 - DNA, 25 bp, Mus musculus
gcccaggaccaatcttgaaactcat

SEQ ID NO: 550232 - DNA, 25 bp, Mus musculus
gcccaggaccccaatcagaaaggtg

SEQ ID NO: 550233 - DNA, 25 bp, Mus musculus
gcccaggacccctatcagaaaggtg

SEQ ID NO: 550234 - DNA, 25 bp, Mus musculus
gcccaggactgtcgttttctgttga

SEQ ID NO: 550235 - DNA, 25 bp, Mus musculus
gcccaggactgtggttttctgttga

SEQ ID NO: 550236 - DNA, 25 bp, Mus musculus
gcccaggagagactcacacagcaag

SEQ ID NO: 550237 - DNA, 25 bp, Mus musculus
gcccaggagagagtcacacagcaag

SEQ ID NO: 550238 - DNA, 25 bp, Mus musculus
gcccaggagctcaagtgcacatttt

SEQ ID NO: 550239 - DNA, 25 bp, Mus musculus
gcccaggagctctagtgcacatttt

SEQ ID NO: 550240 - DNA, 25 bp, Mus musculus
gcccaggagcttaggctgtcctgca

SEQ ID NO: 550241 - DNA, 25 bp, Mus musculus
gcccaggagctttggctgtcctgca

SEQ ID NO: 550242 - DNA, 25 bp, Mus musculus
gcccaggatgagaggctcaaagcgt

SEQ ID NO: 550243 - DNA, 25 bp, Mus musculus
gcccaggatgagtggctcaaagcgt

SEQ ID NO: 550244 - DNA, 25 bp, Mus musculus
gcccaggcaaggagaggctcgtgga

SEQ ID NO: 550245 - DNA, 25 bp, Mus musculus
gcccaggcaaggtgaggctcgtgga

SEQ ID NO: 550246 - DNA, 25 bp, Mus musculus
gcccaggcagtgcatccaagcagtg

SEQ ID NO: 550247 - DNA, 25 bp, Mus musculus
gcccaggcagtggatccaagcagtg

SEQ ID NO: 550248 - DNA, 25 bp, Mus musculus
gcccaggcccaaacactgagaagat

SEQ ID NO: 550249 - DNA, 25 bp, Mus musculus
gcccaggcccaatcactgagaagat

SEQ ID NO: 550250 - DNA, 25 bp, Mus musculus
gcccaggcctagaaaccttggtgtc

SEQ ID NO: 550251 - DNA, 25 bp, Mus musculus
gcccaggcctagtaaccttggtgtc

SEQ ID NO: 550252 - DNA, 25 bp, Mus musculus
gcccaggcctcaaatttgtgaagca

SEQ ID NO: 550253 - DNA, 25 bp, Mus musculus
gcccaggcctcatatttgtgaagca

SEQ ID NO: 550254 - DNA, 25 bp, Mus musculus
gcccagggagcccaacaatgacatt

SEQ ID NO: 550255 - DNA, 25 bp, Mus musculus
gcccagggagccgaacaatgacatt

SEQ ID NO: 550256 - DNA, 25 bp, Mus musculus
gcccagggaggaacagacacttcaa

SEQ ID NO: 550257 - DNA, 25 bp, Mus musculus
gcccagggaggatcagacacttcaa

SEQ ID NO: 550258 - DNA, 25 bp, Mus musculus
gcccagggatatctcttgtgccaag

SEQ ID NO: 550259 - DNA, 25 bp, Mus musculus
gcccagggatatgtcttgtgccaag

SEQ ID NO: 550260 - DNA, 25 bp, Mus musculus
gcccagggccaacacgtattacaga

SEQ ID NO: 550261 - DNA, 25 bp, Mus musculus
gcccagggccaactatctcagaaag

SEQ ID NO: 550262 - DNA, 25 bp, Mus musculus
gcccagggccaagacgtattacaga

SEQ ID NO: 550263 - DNA, 25 bp, Mus musculus
gcccagggccaagtatctcagaaag

SEQ ID NO: 550264 - DNA, 25 bp, Mus musculus
gcccagggctttctcgtgtggaaaa

SEQ ID NO: 550265 - DNA, 25 bp, Mus musculus
gcccagggctttgtcgtgtggaaaa

SEQ ID NO: 550266 - DNA, 25 bp, Mus musculus
gcccagggtcatagtcccaaagtaa

SEQ ID NO: 550267 - DNA, 25 bp, Mus musculus
gcccagggtcattgtcccaaagtaa

SEQ ID NO: 550268 - DNA, 25 bp, Mus musculus
gcccagggtcccagtgtagatgacg

SEQ ID NO: 550269 - DNA, 25 bp, Mus musculus
gcccagggtccctgtgtagatgacg

SEQ ID NO: 550270 - DNA, 25 bp, Mus musculus
gcccagggtggcactttgtgaaagt

SEQ ID NO: 550271 - DNA, 25 bp, Mus musculus
gcccagggtggctctttgtgaaagt

SEQ ID NO: 550272 - DNA, 25 bp, Mus musculus
gcccagggttcactgcttgctgtgg

SEQ ID NO: 550273 - DNA, 25 bp, Mus musculus
gcccagggttcagtgcttgctgtgg

SEQ ID NO: 550274 - DNA, 25 bp, Mus musculus
gcccagggttgtagccaatagaatt

SEQ ID NO: 550275 - DNA, 25 bp, Mus musculus
gcccagggttgttgccaatagaatt

SEQ ID NO: 550276 - DNA, 25 bp, Mus musculus
gcccaggtaaacagcagcgagtact

SEQ ID NO: 550277 - DNA, 25 bp, Mus musculus
gcccaggtaaactgcagcgagtact

SEQ ID NO: 550278 - DNA, 25 bp, Mus musculus
gcccaggtagctacgatgaggcacc

SEQ ID NO: 550279 - DNA, 25 bp, Mus musculus
gcccaggtagcttcgatgaggcacc

SEQ ID NO: 550280 - DNA, 25 bp, Mus musculus
gcccaggtgctgcatcagaagcgta

SEQ ID NO: 550281 - DNA, 25 bp, Mus musculus
gcccaggtgctggatcagaagcgta

SEQ ID NO: 550282 - DNA, 25 bp, Mus musculus
gcccaggtgtgcagtttattcaaag

SEQ ID NO: 550283 - DNA, 25 bp, Mus musculus
gcccaggtgtgctgtttattcaaag

SEQ ID NO: 550284 - DNA, 25 bp, Mus musculus
gcccaggttagccttcaactttaat

SEQ ID NO: 550285 - DNA, 25 bp, Mus musculus
gcccaggttagcgttcaactttaat

SEQ ID NO: 550286 - DNA, 25 bp, Mus musculus
gcccaggttattctttcctaatact

SEQ ID NO: 550287 - DNA, 25 bp, Mus musculus
gcccaggttattgtttcctaatact

SEQ ID NO: 550288 - DNA, 25 bp, Mus musculus
gcccaggttcgaagtgaggtctcac

SEQ ID NO: 550289 - DNA, 25 bp, Mus musculus
gcccaggttcgatgtgaggtctcac

SEQ ID NO: 550290 - DNA, 25 bp, Mus musculus
gcccaggtttgacttttgcttaatt

SEQ ID NO: 550291 - DNA, 25 bp, Mus musculus
gcccaggtttgagttttgcttaatt

SEQ ID NO: 550292 - DNA, 25 bp, Mus musculus
gcccaggttttcatcgatataccgg

SEQ ID NO: 550293 - DNA, 25 bp, Mus musculus
gcccaggttttcttcgatataccgg

SEQ ID NO: 550294 - DNA, 25 bp, Mus musculus
gcccagtaaataataggcacttcac

SEQ ID NO: 550295 - DNA, 25 bp, Mus musculus
gcccagtaaatattaggcacttcac

SEQ ID NO: 550296 - DNA, 25 bp, Mus musculus
gcccagtaaatgcacttgagtgtta

SEQ ID NO: 550297 - DNA, 25 bp, Mus musculus
gcccagtaaatggacttgagtgtta

SEQ ID NO: 550298 - DNA, 25 bp, Mus musculus
gcccagtacagtcctctgcacatag

SEQ ID NO: 550299 - DNA, 25 bp, Mus musculus
gcccagtacagtgctctgcacatag

SEQ ID NO: 550300 - DNA, 25 bp, Mus musculus
gcccagtaccctcatcagagttata

SEQ ID NO: 550301 - DNA, 25 bp, Mus musculus
gcccagtaccctgatcagagttata

SEQ ID NO: 550302 - DNA, 25 bp, Mus musculus
gcccagtactcaagtgcctatgtaa

SEQ ID NO: 550303 - DNA, 25 bp, Mus musculus
gcccagtactcatgtgcctatgtaa

SEQ ID NO: 550304 - DNA, 25 bp, Mus musculus
gcccagtagtgactagctgagtcta

SEQ ID NO: 550305 - DNA, 25 bp, Mus musculus
gcccagtagtgagtagctgagtcta

SEQ ID NO: 550306 - DNA, 25 bp, Mus musculus
gcccagtagtggacttgtgagctgc

SEQ ID NO: 550307 - DNA, 25 bp, Mus musculus
gcccagtagtggcagctctgctaca

SEQ ID NO: 550308 - DNA, 25 bp, Mus musculus
gcccagtagtgggagctctgctaca

SEQ ID NO: 550309 - DNA, 25 bp, Mus musculus
gcccagtagtggtcttgtgagctgc

SEQ ID NO: 550310 - DNA, 25 bp, Mus musculus
gcccagtatcatctctgtttgtctg

SEQ ID NO: 550311 - DNA, 25 bp, Mus musculus
gcccagtatcatgtctgtttgtctg

SEQ ID NO: 550312 - DNA, 25 bp, Mus musculus
gcccagtatgatcctgacgacgatg

SEQ ID NO: 550313 - DNA, 25 bp, Mus musculus
gcccagtatgatgctgacgacgatg

SEQ ID NO: 550314 - DNA, 25 bp, Mus musculus
gcccagtcagggacgattccagcag

SEQ ID NO: 550315 - DNA, 25 bp, Mus musculus
gcccagtcagggtcgattccagcag

SEQ ID NO: 550316 - DNA, 25 bp, Mus musculus
gcccagtcccagagtgattatctga

SEQ ID NO: 550317 - DNA, 25 bp, Mus musculus
gcccagtcccagtgtgattatctga

SEQ ID NO: 550318 - DNA, 25 bp, Mus musculus
gcccagtcctagattagcgtctttc

SEQ ID NO: 550319 - DNA, 25 bp, Mus musculus
gcccagtcctagtttagcgtctttc

SEQ ID NO: 550320 - DNA, 25 bp, Mus musculus
gcccagtcctgacgttctggcaaag

SEQ ID NO: 550321 - DNA, 25 bp, Mus musculus
gcccagtcctgaggttctggcaaag

SEQ ID NO: 550322 - DNA, 25 bp, Mus musculus
gcccagtctctgatattctgtacaa

SEQ ID NO: 550323 - DNA, 25 bp, Mus musculus
gcccagtctctgttattctgtacaa

SEQ ID NO: 550324 - DNA, 25 bp, Mus musculus
gcccagtcttcaaacactaagttat

SEQ ID NO: 550325 - DNA, 25 bp, Mus musculus
gcccagtcttcatacactaagttat

SEQ ID NO: 550326 - DNA, 25 bp, Mus musculus
gcccagtgaacacatgccttgtacg

SEQ ID NO: 550327 - DNA, 25 bp, Mus musculus
gcccagtgaacagatgccttgtacg

SEQ ID NO: 550328 - DNA, 25 bp, Mus musculus
gcccagtgaaccctcgggaattcaa

SEQ ID NO: 550329 - DNA, 25 bp, Mus musculus
gcccagtgaaccgtcgggaattcaa

SEQ ID NO: 550330 - DNA, 25 bp, Mus musculus
gcccagtgacataggccatgaatac

SEQ ID NO: 550331 - DNA, 25 bp, Mus musculus
gcccagtgacattggccatgaatac

SEQ ID NO: 550332 - DNA, 25 bp, Mus musculus
gcccagtgactgctactttgtaccc

SEQ ID NO: 550333 - DNA, 25 bp, Mus musculus
gcccagtgactggtactttgtaccc

SEQ ID NO: 550334 - DNA, 25 bp, Mus musculus
gcccagtgaggcatgcggatcctat

SEQ ID NO: 550335 - DNA, 25 bp, Mus musculus
gcccagtgaggcttgcggatcctat

SEQ ID NO: 550336 - DNA, 25 bp, Mus musculus
gcccagtgagtaatgtgttcccaga

SEQ ID NO: 550337 - DNA, 25 bp, Mus musculus
gcccagtgagtattgtgttcccaga

SEQ ID NO: 550338 - DNA, 25 bp, Mus musculus
gcccagtgattgctttctttattca

SEQ ID NO: 550339 - DNA, 25 bp, Mus musculus
gcccagtgattggtttctttattca

SEQ ID NO: 550340 - DNA, 25 bp, Mus musculus
gcccagtgcacacccaggagattga

SEQ ID NO: 550341 - DNA, 25 bp, Mus musculus
gcccagtgcacagccaggagattga

SEQ ID NO: 550342 - DNA, 25 bp, Mus musculus
gcccagtgggataagcaacgtctat

SEQ ID NO: 550343 - DNA, 25 bp, Mus musculus
gcccagtgggattagcaacgtctat

SEQ ID NO: 550344 - DNA, 25 bp, Mus musculus
gcccagtgggcacaggtgatacaaa

SEQ ID NO: 550345 - DNA, 25 bp, Mus musculus
gcccagtgggcagaggtgatacaaa

SEQ ID NO: 550346 - DNA, 25 bp, Mus musculus
gcccagtggtaacagcatgcgttct

SEQ ID NO: 550347 - DNA, 25 bp, Mus musculus
gcccagtggtaagagcatgcgttct

SEQ ID NO: 550348 - DNA, 25 bp, Mus musculus
gcccagtgtaccaactgcgtacaag

SEQ ID NO: 550349 - DNA, 25 bp, Mus musculus
gcccagtgtacctactgcgtacaag

SEQ ID NO: 550350 - DNA, 25 bp, Mus musculus
gcccagtgtccgaggaggccaaaga

SEQ ID NO: 550351 - DNA, 25 bp, Mus musculus
gcccagtgtccgtggaggccaaaga

SEQ ID NO: 550352 - DNA, 25 bp, Mus musculus
gcccagtgttaccaccaagaaggtc

SEQ ID NO: 550353 - DNA, 25 bp, Mus musculus
gcccagtgttacgaccaagaaggtc

SEQ ID NO: 550354 - DNA, 25 bp, Mus musculus
gcccagtgttgcctaaggcatgaga

SEQ ID NO: 550355 - DNA, 25 bp, Mus musculus
gcccagtgttgcgtaaggcatgaga

SEQ ID NO: 550356 - DNA, 25 bp, Mus musculus
gcccagtgtttaaggctgtcttcaa

SEQ ID NO: 550357 - DNA, 25 bp, Mus musculus
gcccagtgtttatggctgtcttcaa

SEQ ID NO: 550358 - DNA, 25 bp, Mus musculus
gcccagttattacctcatatgcaat

SEQ ID NO: 550359 - DNA, 25 bp, Mus musculus
gcccagttattagctcatatgcaat

SEQ ID NO: 550360 - DNA, 25 bp, Mus musculus
gcccagttcaacatttcactatttt

SEQ ID NO: 550361 - DNA, 25 bp, Mus musculus
gcccagttcaacttttcactatttt

SEQ ID NO: 550362 - DNA, 25 bp, Mus musculus
gcccagttcggaccaattaagatac

SEQ ID NO: 550363 - DNA, 25 bp, Mus musculus
gcccagttcggagcaattaagatac

SEQ ID NO: 550364 - DNA, 25 bp, Mus musculus
gcccagttggaacctatacccgatt

SEQ ID NO: 550365 - DNA, 25 bp, Mus musculus
gcccagttggaagctatacccgatt

SEQ ID NO: 550366 - DNA, 25 bp, Mus musculus
gcccagttgttactgtcggtgctac

SEQ ID NO: 550367 - DNA, 25 bp, Mus musculus
gcccagttgttagtgtcggtgctac

SEQ ID NO: 550368 - DNA, 25 bp, Mus musculus
gcccagtttcgtattcgttgctctt

SEQ ID NO: 550369 - DNA, 25 bp, Mus musculus
gcccagtttcgttttcgttgctctt

SEQ ID NO: 550370 - DNA, 25 bp, Mus musculus
gcccagtttgaaatgtggacctaaa

SEQ ID NO: 550371 - DNA, 25 bp, Mus musculus
gcccagtttgaattgtggacctaaa

SEQ ID NO: 550372 - DNA, 25 bp, Mus musculus
gcccagtttttgctgctgaagtact

SEQ ID NO: 550373 - DNA, 25 bp, Mus musculus
gcccagtttttggtgctgaagtact

SEQ ID NO: 550374 - DNA, 25 bp, Mus musculus
gcccataaacatattcgcagtacat

SEQ ID NO: 550375 - DNA, 25 bp, Mus musculus
gcccataaacattttcgcagtacat

SEQ ID NO: 550376 - DNA, 25 bp, Mus musculus
gcccataaaccccttctgatgaaag

SEQ ID NO: 550377 - DNA, 25 bp, Mus musculus
gcccataaacccgttctgatgaaag

SEQ ID NO: 550378 - DNA, 25 bp, Mus musculus
gcccataacagcctagatttaaaac

SEQ ID NO: 550379 - DNA, 25 bp, Mus musculus
gcccataacagcgtagatttaaaac

SEQ ID NO: 550380 - DNA, 25 bp, Mus musculus
gcccataatggtagctctcgaggta

SEQ ID NO: 550381 - DNA, 25 bp, Mus musculus
gcccataatggttgctctcgaggta

SEQ ID NO: 550382 - DNA, 25 bp, Mus musculus
gcccatacccatctctagaaagcaa

SEQ ID NO: 550383 - DNA, 25 bp, Mus musculus
gcccatacccatgtctagaaagcaa

SEQ ID NO: 550384 - DNA, 25 bp, Mus musculus
gcccatactcagaaaaggtccccag

SEQ ID NO: 550385 - DNA, 25 bp, Mus musculus
gcccatactcagtaaaggtccccag

SEQ ID NO: 550386 - DNA, 25 bp, Mus musculus
gcccatactcccaagaaagcttttg

SEQ ID NO: 550387 - DNA, 25 bp, Mus musculus
gcccatactccctagaaagcttttg

SEQ ID NO: 550388 - DNA, 25 bp, Mus musculus
gcccatacttaacgaggtttgcctt

SEQ ID NO: 550389 - DNA, 25 bp, Mus musculus
gcccatacttaaggaggtttgcctt

SEQ ID NO: 550390 - DNA, 25 bp, Mus musculus
gcccatagacatccttctgtttata

SEQ ID NO: 550391 - DNA, 25 bp, Mus musculus
gcccatagacatgcttctgtttata

SEQ ID NO: 550392 - DNA, 25 bp, Mus musculus
gcccatagagtgcatttttggctta

SEQ ID NO: 550393 - DNA, 25 bp, Mus musculus
gcccatagagtggatttttggctta

SEQ ID NO: 550394 - DNA, 25 bp, Mus musculus
gcccatagggtaattgtctttcctt

SEQ ID NO: 550395 - DNA, 25 bp, Mus musculus
gcccatagggtatttgtctttcctt

SEQ ID NO: 550396 - DNA, 25 bp, Mus musculus
gcccataggtgtccaatactcgagg

SEQ ID NO: 550397 - DNA, 25 bp, Mus musculus
gcccataggtgtgcaatactcgagg

SEQ ID NO: 550398 - DNA, 25 bp, Mus musculus
gcccatagttcaatggtgacatcta

SEQ ID NO: 550399 - DNA, 25 bp, Mus musculus
gcccatagttcattggtgacatcta

SEQ ID NO: 550400 - DNA, 25 bp, Mus musculus
gcccatagtttgcagtaagcctctc

SEQ ID NO: 550401 - DNA, 25 bp, Mus musculus
gcccatagtttggagtaagcctctc

SEQ ID NO: 550402 - DNA, 25 bp, Mus musculus
gcccatatcactatacaatgccttc

SEQ ID NO: 550403 - DNA, 25 bp, Mus musculus
gcccatatcactttacaatgccttc

SEQ ID NO: 550404 - DNA, 25 bp, Mus musculus
gcccatatcctgatgcaactttttg

SEQ ID NO: 550405 - DNA, 25 bp, Mus musculus
gcccatatcctgttgcaactttttg

SEQ ID NO: 550406 - DNA, 25 bp, Mus musculus
gcccatattccaatactcagtgttt

SEQ ID NO: 550407 - DNA, 25 bp, Mus musculus
gcccatattccattactcagtgttt

SEQ ID NO: 550408 - DNA, 25 bp, Mus musculus
gcccatattctgactgaaatctaga

SEQ ID NO: 550409 - DNA, 25 bp, Mus musculus
gcccatattctgtctgaaatctaga

SEQ ID NO: 550410 - DNA, 25 bp, Mus musculus
gcccatcaagaaaggtccggtgcag

SEQ ID NO: 550411 - DNA, 25 bp, Mus musculus
gcccatcaagaatggtccggtgcag

SEQ ID NO: 550412 - DNA, 25 bp, Mus musculus
gcccatcaccatagcagttttgcta

SEQ ID NO: 550413 - DNA, 25 bp, Mus musculus
gcccatcaccatcatgtgtatctta

SEQ ID NO: 550414 - DNA, 25 bp, Mus musculus
gcccatcaccatgatgtgtatctta

SEQ ID NO: 550415 - DNA, 25 bp, Mus musculus
gcccatcaccattgcagttttgcta

SEQ ID NO: 550416 - DNA, 25 bp, Mus musculus
gcccatcaggagagcccaacacaga

SEQ ID NO: 550417 - DNA, 25 bp, Mus musculus
gcccatcaggagtgcccaacacaga

SEQ ID NO: 550418 - DNA, 25 bp, Mus musculus
gcccatcatgctcgacctagtgctg

SEQ ID NO: 550419 - DNA, 25 bp, Mus musculus
gcccatcatgctggacctagtgctg

SEQ ID NO: 550420 - DNA, 25 bp, Mus musculus
gcccatccatgtacctgaaaatgtg

SEQ ID NO: 550421 - DNA, 25 bp, Mus musculus
gcccatccatgttcctgaaaatgtg

SEQ ID NO: 550422 - DNA, 25 bp, Mus musculus
gcccatccccagcattacttaagta

SEQ ID NO: 550423 - DNA, 25 bp, Mus musculus
gcccatccccaggattacttaagta

SEQ ID NO: 550424 - DNA, 25 bp, Mus musculus
gcccatccctataattaacattggt

SEQ ID NO: 550425 - DNA, 25 bp, Mus musculus
gcccatccctattattaacattggt

SEQ ID NO: 550426 - DNA, 25 bp, Mus musculus
gcccatcctcgaccctagaaaatgt

SEQ ID NO: 550427 - DNA, 25 bp, Mus musculus
gcccatcctcgagcctagaaaatgt

SEQ ID NO: 550428 - DNA, 25 bp, Mus musculus
gcccatccttggaggcacacatgaa

SEQ ID NO: 550429 - DNA, 25 bp, Mus musculus
gcccatccttggtggcacacatgaa

SEQ ID NO: 550430 - DNA, 25 bp, Mus musculus
gcccatcgcgcacatcaaggaagag

SEQ ID NO: 550431 - DNA, 25 bp, Mus musculus
gcccatcgcgcagatcaaggaagag

SEQ ID NO: 550432 - DNA, 25 bp, Mus musculus
gcccatcgcttcattaccgagaagg

SEQ ID NO: 550433 - DNA, 25 bp, Mus musculus
gcccatcgcttctttaccgagaagg

SEQ ID NO: 550434 - DNA, 25 bp, Mus musculus
gcccatcggctgctttttggatagt

SEQ ID NO: 550435 - DNA, 25 bp, Mus musculus
gcccatcggctggtttttggatagt

SEQ ID NO: 550436 - DNA, 25 bp, Mus musculus
gcccatcgtatgactcctgagaaga

SEQ ID NO: 550437 - DNA, 25 bp, Mus musculus
gcccatcgtatgtctcctgagaaga

SEQ ID NO: 550438 - DNA, 25 bp, Mus musculus
gcccatcgtgcgctctataataggt

SEQ ID NO: 550439 - DNA, 25 bp, Mus musculus
gcccatcgtgcggtctataataggt

SEQ ID NO: 550440 - DNA, 25 bp, Mus musculus
gcccatctaccaatgaatgctgaat

SEQ ID NO: 550441 - DNA, 25 bp, Mus musculus
gcccatctaccattgaatgctgaat

SEQ ID NO: 550442 - DNA, 25 bp, Mus musculus
gcccatctacctaaactctgatttg

SEQ ID NO: 550443 - DNA, 25 bp, Mus musculus
gcccatctaccttaactctgatttg

SEQ ID NO: 550444 - DNA, 25 bp, Mus musculus
gcccatctatcaattgtatgtagga

SEQ ID NO: 550445 - DNA, 25 bp, Mus musculus
gcccatctatcatttgtatgtagga

SEQ ID NO: 550446 - DNA, 25 bp, Mus musculus
gcccatctatccaattggtgagctt

SEQ ID NO: 550447 - DNA, 25 bp, Mus musculus
gcccatctatcctattggtgagctt

SEQ ID NO: 550448 - DNA, 25 bp, Mus musculus
gcccatctatgcaggctggatctgg

SEQ ID NO: 550449 - DNA, 25 bp, Mus musculus
gcccatctatgctggctggatctgg

SEQ ID NO: 550450 - DNA, 25 bp, Mus musculus
gcccatctccatatgtcatcatttt

SEQ ID NO: 550451 - DNA, 25 bp, Mus musculus
gcccatctccatttgtcatcatttt

SEQ ID NO: 550452 - DNA, 25 bp, Mus musculus
gcccatctgaaaaaggctccttttt

SEQ ID NO: 550453 - DNA, 25 bp, Mus musculus
gcccatctgaaataggctccttttt

SEQ ID NO: 550454 - DNA, 25 bp, Mus musculus
gcccatctgaaccatcaactgtata

SEQ ID NO: 550455 - DNA, 25 bp, Mus musculus
gcccatctgaacgatcaactgtata

SEQ ID NO: 550456 - DNA, 25 bp, Mus musculus
gcccatctgattattgtccagttct

SEQ ID NO: 550457 - DNA, 25 bp, Mus musculus
gcccatctgatttttgtccagttct

SEQ ID NO: 550458 - DNA, 25 bp, Mus musculus
gcccatctgggaatgaaacagagct

SEQ ID NO: 550459 - DNA, 25 bp, Mus musculus
gcccatctgggaccctgaggacctg

SEQ ID NO: 550460 - DNA, 25 bp, Mus musculus
gcccatctgggagcctgaggacctg

SEQ ID NO: 550461 - DNA, 25 bp, Mus musculus
gcccatctgggattgaaacagagct

SEQ ID NO: 550462 - DNA, 25 bp, Mus musculus
gcccatctggtaagtgagttctcca

SEQ ID NO: 550463 - DNA, 25 bp, Mus musculus
gcccatctggtatgtgagttctcca

SEQ ID NO: 550464 - DNA, 25 bp, Mus musculus
gcccatctggttatttacactgttt

SEQ ID NO: 550465 - DNA, 25 bp, Mus musculus
gcccatctggttttttacactgttt

SEQ ID NO: 550466 - DNA, 25 bp, Mus musculus
gcccatctgtagcttgcactttaaa

SEQ ID NO: 550467 - DNA, 25 bp, Mus musculus
gcccatctgtaggttgcactttaaa

SEQ ID NO: 550468 - DNA, 25 bp, Mus musculus
gcccatctgtgtacccaataaagaa

SEQ ID NO: 550469 - DNA, 25 bp, Mus musculus
gcccatctgtgttcccaataaagaa

SEQ ID NO: 550470 - DNA, 25 bp, Mus musculus
gcccatctgttacatactaggccct

SEQ ID NO: 550471 - DNA, 25 bp, Mus musculus
gcccatctgttagatactaggccct

SEQ ID NO: 550472 - DNA, 25 bp, Mus musculus
gcccatgaacctatcagaagaggcg

SEQ ID NO: 550473 - DNA, 25 bp, Mus musculus
gcccatgaacctttcagaagaggcg

SEQ ID NO: 550474 - DNA, 25 bp, Mus musculus
gcccatgaaggtactgattatttaa

SEQ ID NO: 550475 - DNA, 25 bp, Mus musculus
gcccatgaaggttctgattatttaa

SEQ ID NO: 550476 - DNA, 25 bp, Mus musculus
gcccatgacattatctctgttggta

SEQ ID NO: 550477 - DNA, 25 bp, Mus musculus
gcccatgacattttctctgttggta

SEQ ID NO: 550478 - DNA, 25 bp, Mus musculus
gcccatgacccacaaaatgccagag

SEQ ID NO: 550479 - DNA, 25 bp, Mus musculus
gcccatgacccagaaaatgccagag

SEQ ID NO: 550480 - DNA, 25 bp, Mus musculus
gcccatgaggctctgatatgttctt

SEQ ID NO: 550481 - DNA, 25 bp, Mus musculus
gcccatgaggctgtgatatgttctt

SEQ ID NO: 550482 - DNA, 25 bp, Mus musculus
gcccatgattcaagactgttctcat

SEQ ID NO: 550483 - DNA, 25 bp, Mus musculus
gcccatgattcatgactgttctcat

SEQ ID NO: 550484 - DNA, 25 bp, Mus musculus
gcccatgcatgcagcaacacagtga

SEQ ID NO: 550485 - DNA, 25 bp, Mus musculus
gcccatgcatgcatgaccacatgca

SEQ ID NO: 550486 - DNA, 25 bp, Mus musculus
gcccatgcatgctgcaacacagtga

SEQ ID NO: 550487 - DNA, 25 bp, Mus musculus
gcccatgcatgcttgaccacatgca

SEQ ID NO: 550488 - DNA, 25 bp, Mus musculus
gcccatgccaatatagaatgaaata

SEQ ID NO: 550489 - DNA, 25 bp, Mus musculus
gcccatgccaatttagaatgaaata

SEQ ID NO: 550490 - DNA, 25 bp, Mus musculus
gcccatgccagcctgtggtgagcac

SEQ ID NO: 550491 - DNA, 25 bp, Mus musculus
gcccatgccagcgtgtggtgagcac

SEQ ID NO: 550492 - DNA, 25 bp, Mus musculus
gcccatgcccaaagtgtgcagtaaa

SEQ ID NO: 550493 - DNA, 25 bp, Mus musculus
gcccatgcccaatgtgtgcagtaaa

SEQ ID NO: 550494 - DNA, 25 bp, Mus musculus
gcccatgcccagacagaagtagcaa

SEQ ID NO: 550495 - DNA, 25 bp, Mus musculus
gcccatgcccagagatcaaaatcta

SEQ ID NO: 550496 - DNA, 25 bp, Mus musculus
gcccatgcccagtcagaagtagcaa

SEQ ID NO: 550497 - DNA, 25 bp, Mus musculus
gcccatgcccagtgatcaaaatcta

SEQ ID NO: 550498 - DNA, 25 bp, Mus musculus
gcccatgcccggatcctggaaagga

SEQ ID NO: 550499 - DNA, 25 bp, Mus musculus
gcccatgcccggttcctggaaagga

SEQ ID NO: 550500 - DNA, 25 bp, Mus musculus
gcccatgccctaacaactggatatg

SEQ ID NO: 550501 - DNA, 25 bp, Mus musculus
gcccatgccctatcaactggatatg

SEQ ID NO: 550502 - DNA, 25 bp, Mus musculus
gcccatgcctagattttgctttctg

SEQ ID NO: 550503 - DNA, 25 bp, Mus musculus
gcccatgcctagtttttgctttctg

SEQ ID NO: 550504 - DNA, 25 bp, Mus musculus
gcccatgccttaaagctgtaaattc

SEQ ID NO: 550505 - DNA, 25 bp, Mus musculus
gcccatgccttatagctgtaaattc

SEQ ID NO: 550506 - DNA, 25 bp, Mus musculus
gcccatgcctttactgagagccttg

SEQ ID NO: 550507 - DNA, 25 bp, Mus musculus
gcccatgcctttcactagtgcttga

SEQ ID NO: 550508 - DNA, 25 bp, Mus musculus
gcccatgcctttgactagtgcttga

SEQ ID NO: 550509 - DNA, 25 bp, Mus musculus
gcccatgccttttctgagagccttg

SEQ ID NO: 550510 - DNA, 25 bp, Mus musculus
gcccatgctcacctctgtggtgaaa

SEQ ID NO: 550511 - DNA, 25 bp, Mus musculus
gcccatgctcacgtctgtggtgaaa

SEQ ID NO: 550512 - DNA, 25 bp, Mus musculus
gcccatgcttctcatcttatggcca

SEQ ID NO: 550513 - DNA, 25 bp, Mus musculus
gcccatgcttctgatcttatggcca

SEQ ID NO: 550514 - DNA, 25 bp, Mus musculus
gcccatggaggccactagcattatt

SEQ ID NO: 550515 - DNA, 25 bp, Mus musculus
gcccatggaggcgactagcattatt

SEQ ID NO: 550516 - DNA, 25 bp, Mus musculus
gcccatggcctcacagaatctgatg

SEQ ID NO: 550517 - DNA, 25 bp, Mus musculus
gcccatggcctctcagaatctgatg

SEQ ID NO: 550518 - DNA, 25 bp, Mus musculus
gcccatggctggatacctatattca

SEQ ID NO: 550519 - DNA, 25 bp, Mus musculus
gcccatggctggttacctatattca

SEQ ID NO: 550520 - DNA, 25 bp, Mus musculus
gcccatggcttcaataaacgttttt

SEQ ID NO: 550521 - DNA, 25 bp, Mus musculus
gcccatggcttctataaacgttttt

SEQ ID NO: 550522 - DNA, 25 bp, Mus musculus
gcccatgggccactggaggacactt

SEQ ID NO: 550523 - DNA, 25 bp, Mus musculus
gcccatgggccagtggaggacactt

SEQ ID NO: 550524 - DNA, 25 bp, Mus musculus
gcccatgggctcaataactagacaa

SEQ ID NO: 550525 - DNA, 25 bp, Mus musculus
gcccatgggctctataactagacaa

SEQ ID NO: 550526 - DNA, 25 bp, Mus musculus
gcccatgggtttcagaaccaggccc

SEQ ID NO: 550527 - DNA, 25 bp, Mus musculus
gcccatgggtttgagaaccaggccc

SEQ ID NO: 550528 - DNA, 25 bp, Mus musculus
gcccatggtaggcagcttctgtgaa

SEQ ID NO: 550529 - DNA, 25 bp, Mus musculus
gcccatggtagggagcttctgtgaa

SEQ ID NO: 550530 - DNA, 25 bp, Mus musculus
gcccatggttctccacttgtagtaa

SEQ ID NO: 550531 - DNA, 25 bp, Mus musculus
gcccatggttctgcacttgtagtaa

SEQ ID NO: 550532 - DNA, 25 bp, Mus musculus
gcccatgtctgccttatttttgata

SEQ ID NO: 550533 - DNA, 25 bp, Mus musculus
gcccatgtctgcgttatttttgata

SEQ ID NO: 550534 - DNA, 25 bp, Mus musculus
gcccatgtgctaaaggcccttggaa

SEQ ID NO: 550535 - DNA, 25 bp, Mus musculus
gcccatgtgctataggcccttggaa

SEQ ID NO: 550536 - DNA, 25 bp, Mus musculus
gcccatgtggcactagatgtgtctt

SEQ ID NO: 550537 - DNA, 25 bp, Mus musculus
gcccatgtggcagtagatgtgtctt

SEQ ID NO: 550538 - DNA, 25 bp, Mus musculus
gcccatgtgtaaaacattttcagag

SEQ ID NO: 550539 - DNA, 25 bp, Mus musculus
gcccatgtgtaatacattttcagag

SEQ ID NO: 550540 - DNA, 25 bp, Mus musculus
gcccatgtttttcacagtatcagga

SEQ ID NO: 550541 - DNA, 25 bp, Mus musculus
gcccatgtttttgacagtatcagga

SEQ ID NO: 550542 - DNA, 25 bp, Mus musculus
gcccattaataaatcgtttccttct

SEQ ID NO: 550543 - DNA, 25 bp, Mus musculus
gcccattaataattcgtttccttct

SEQ ID NO: 550544 - DNA, 25 bp, Mus musculus
gcccattatcctcatcctagaaata

SEQ ID NO: 550545 - DNA, 25 bp, Mus musculus
gcccattatcctgatcctagaaata

SEQ ID NO: 550546 - DNA, 25 bp, Mus musculus
gcccattattgaagctgtacttcta

SEQ ID NO: 550547 - DNA, 25 bp, Mus musculus
gcccattattgatgctgtacttcta

SEQ ID NO: 550548 - DNA, 25 bp, Mus musculus
gcccattcagagcacttatcaaact

SEQ ID NO: 550549 - DNA, 25 bp, Mus musculus
gcccattcagaggacttatcaaact

SEQ ID NO: 550550 - DNA, 25 bp, Mus musculus
gcccattcatcaactttctttagta

SEQ ID NO: 550551 - DNA, 25 bp, Mus musculus
gcccattcatcatctttctttagta

SEQ ID NO: 550552 - DNA, 25 bp, Mus musculus
gcccattcccagctatttatttatt

SEQ ID NO: 550553 - DNA, 25 bp, Mus musculus
gcccattcccaggtatttatttatt

SEQ ID NO: 550554 - DNA, 25 bp, Mus musculus
gcccattcgatgcactctaaacata

SEQ ID NO: 550555 - DNA, 25 bp, Mus musculus
gcccattcgatggactctaaacata

SEQ ID NO: 550556 - DNA, 25 bp, Mus musculus
gcccattctgggacgtccataagaa

SEQ ID NO: 550557 - DNA, 25 bp, Mus musculus
gcccattctgggtcgtccataagaa

SEQ ID NO: 550558 - DNA, 25 bp, Mus musculus
gcccattctgtgattctgtgcagag

SEQ ID NO: 550559 - DNA, 25 bp, Mus musculus
gcccattctgtgtttctgtgcagag

SEQ ID NO: 550560 - DNA, 25 bp, Mus musculus
gcccattctttcagaactagcatgt

SEQ ID NO: 550561 - DNA, 25 bp, Mus musculus
gcccattctttctgaactagcatgt

SEQ ID NO: 550562 - DNA, 25 bp, Mus musculus
gcccattgccggacaaggccgaaag

SEQ ID NO: 550563 - DNA, 25 bp, Mus musculus
gcccattgccggtcaaggccgaaag

SEQ ID NO: 550564 - DNA, 25 bp, Mus musculus
gcccattgctaactccatagcacat

SEQ ID NO: 550565 - DNA, 25 bp, Mus musculus
gcccattgctaagtccatagcacat

SEQ ID NO: 550566 - DNA, 25 bp, Mus musculus
gcccattggcacatgagtgagcttc

SEQ ID NO: 550567 - DNA, 25 bp, Mus musculus
gcccattggcacttgagtgagcttc

SEQ ID NO: 550568 - DNA, 25 bp, Mus musculus
gcccattgggaacccgagtagactt

SEQ ID NO: 550569 - DNA, 25 bp, Mus musculus
gcccattgggaagccgagtagactt

SEQ ID NO: 550570 - DNA, 25 bp, Mus musculus
gcccattgtaagaagcagttatagc

SEQ ID NO: 550571 - DNA, 25 bp, Mus musculus
gcccattgtaagtagcagttatagc

SEQ ID NO: 550572 - DNA, 25 bp, Mus musculus
gcccattgtcacaatcagtaatcag

SEQ ID NO: 550573 - DNA, 25 bp, Mus musculus
gcccattgtcactatcagtaatcag

SEQ ID NO: 550574 - DNA, 25 bp, Mus musculus
gcccattgtggccagaaagacagtg

SEQ ID NO: 550575 - DNA, 25 bp, Mus musculus
gcccattgtggcgagaaagacagtg

SEQ ID NO: 550576 - DNA, 25 bp, Mus musculus
gcccattgtgtaagcattctgcctt

SEQ ID NO: 550577 - DNA, 25 bp, Mus musculus
gcccattgtgtatgcattctgcctt

SEQ ID NO: 550578 - DNA, 25 bp, Mus musculus
gcccattgttttacttaccaggtat

SEQ ID NO: 550579 - DNA, 25 bp, Mus musculus
gcccattgtttttcttaccaggtat

SEQ ID NO: 550580 - DNA, 25 bp, Mus musculus
gcccatttagagagcttttaccaga

SEQ ID NO: 550581 - DNA, 25 bp, Mus musculus
gcccatttagagtgcttttaccaga

SEQ ID NO: 550582 - DNA, 25 bp, Mus musculus
gcccatttccagaaggatggcggtt

SEQ ID NO: 550583 - DNA, 25 bp, Mus musculus
gcccatttccagtaggatggcggtt

SEQ ID NO: 550584 - DNA, 25 bp, Mus musculus
gcccatttctgcagtgtgttgacat

SEQ ID NO: 550585 - DNA, 25 bp, Mus musculus
gcccatttctgctgtgtgttgacat

SEQ ID NO: 550586 - DNA, 25 bp, Mus musculus
gcccatttcttcactagcactagat

SEQ ID NO: 550587 - DNA, 25 bp, Mus musculus
gcccatttcttctctagcactagat

SEQ ID NO: 550588 - DNA, 25 bp, Mus musculus
gcccatttggttcgcatctgtttaa

SEQ ID NO: 550589 - DNA, 25 bp, Mus musculus
gcccatttggttggcatctgtttaa

SEQ ID NO: 550590 - DNA, 25 bp, Mus musculus
gcccattttactaccttggcatctg

SEQ ID NO: 550591 - DNA, 25 bp, Mus musculus
gcccattttacttccttggcatctg

SEQ ID NO: 550592 - DNA, 25 bp, Mus musculus
gcccattttgcgcaaaactgatcag

SEQ ID NO: 550593 - DNA, 25 bp, Mus musculus
gcccattttgcggaaaactgatcag

SEQ ID NO: 550594 - DNA, 25 bp, Mus musculus
gcccattttgtgagatttttatgta

SEQ ID NO: 550595 - DNA, 25 bp, Mus musculus
gcccattttgtgtgatttttatgta

SEQ ID NO: 550596 - DNA, 25 bp, Mus musculus
gccccaaactgcctttgtagtctgt

SEQ ID NO: 550597 - DNA, 25 bp, Mus musculus
gccccaaactgcgtttgtagtctgt

SEQ ID NO: 550598 - DNA, 25 bp, Mus musculus
gccccaaagagaagtgctacagtct

SEQ ID NO: 550599 - DNA, 25 bp, Mus musculus
gccccaaagagatgtgctacagtct

SEQ ID NO: 550600 - DNA, 25 bp, Mus musculus
gccccaaagatccccatcttcaatg

SEQ ID NO: 550601 - DNA, 25 bp, Mus musculus
gccccaaagatcgccatcttcaatg

SEQ ID NO: 550602 - DNA, 25 bp, Mus musculus
gccccaaagccacacagactgaagt

SEQ ID NO: 550603 - DNA, 25 bp, Mus musculus
gccccaaagccagacagactgaagt

SEQ ID NO: 550604 - DNA, 25 bp, Mus musculus
gccccaaaggcgatggcttattgtg

SEQ ID NO: 550605 - DNA, 25 bp, Mus musculus
gccccaaaggcgttggcttattgtg

SEQ ID NO: 550606 - DNA, 25 bp, Mus musculus
gccccaaagtcacgatcttagccta

SEQ ID NO: 550607 - DNA, 25 bp, Mus musculus
gccccaaagtcaggatcttagccta

SEQ ID NO: 550608 - DNA, 25 bp, Mus musculus
gccccaaattaactgccagagcagg

SEQ ID NO: 550609 - DNA, 25 bp, Mus musculus
gccccaaattaagtgccagagcagg

SEQ ID NO: 550610 - DNA, 25 bp, Mus musculus
gccccaaccggaaaagtgcattcaa

SEQ ID NO: 550611 - DNA, 25 bp, Mus musculus
gccccaaccggataagtgcattcaa

SEQ ID NO: 550612 - DNA, 25 bp, Mus musculus
gccccaacctatataagctttcatc

SEQ ID NO: 550613 - DNA, 25 bp, Mus musculus
gccccaacctatttaagctttcatc

SEQ ID NO: 550614 - DNA, 25 bp, Mus musculus
gccccaacctgtacaataaactcat

SEQ ID NO: 550615 - DNA, 25 bp, Mus musculus
gccccaacctgttcaataaactcat

SEQ ID NO: 550616 - DNA, 25 bp, Mus musculus
gccccaacttctataccatgaaatt

SEQ ID NO: 550617 - DNA, 25 bp, Mus musculus
gccccaacttctttaccatgaaatt

SEQ ID NO: 550618 - DNA, 25 bp, Mus musculus
gccccaagaagtcgttatggttgaa

SEQ ID NO: 550619 - DNA, 25 bp, Mus musculus
gccccaagaagtggttatggttgaa

SEQ ID NO: 550620 - DNA, 25 bp, Mus musculus
gccccaagatgtcgattcttctgag

SEQ ID NO: 550621 - DNA, 25 bp, Mus musculus
gccccaagatgtggattcttctgag

SEQ ID NO: 550622 - DNA, 25 bp, Mus musculus
gccccaagcccgagatgaattaatt

SEQ ID NO: 550623 - DNA, 25 bp, Mus musculus
gccccaagcccgtgatgaattaatt

SEQ ID NO: 550624 - DNA, 25 bp, Mus musculus
gccccaagccttaagtcatacatat

SEQ ID NO: 550625 - DNA, 25 bp, Mus musculus
gccccaagcctttagtcatacatat

SEQ ID NO: 550626 - DNA, 25 bp, Mus musculus
gccccaagtacaattgctccttttg

SEQ ID NO: 550627 - DNA, 25 bp, Mus musculus
gccccaagtacatttgctccttttg

SEQ ID NO: 550628 - DNA, 25 bp, Mus musculus
gccccaatacctcattcctgtatgt

SEQ ID NO: 550629 - DNA, 25 bp, Mus musculus
gccccaatacctgattcctgtatgt

SEQ ID NO: 550630 - DNA, 25 bp, Mus musculus
gccccaataggccacagatgtcatg

SEQ ID NO: 550631 - DNA, 25 bp, Mus musculus
gccccaataggcgacagatgtcatg

SEQ ID NO: 550632 - DNA, 25 bp, Mus musculus
gccccaatatgcctgacctttttaa

SEQ ID NO: 550633 - DNA, 25 bp, Mus musculus
gccccaatatgcgtgacctttttaa

SEQ ID NO: 550634 - DNA, 25 bp, Mus musculus
gccccaatccgaagtgcagccaatg

SEQ ID NO: 550635 - DNA, 25 bp, Mus musculus
gccccaatccgatgtgcagccaatg

SEQ ID NO: 550636 - DNA, 25 bp, Mus musculus
gccccaatgaggcttgcactgtgca

SEQ ID NO: 550637 - DNA, 25 bp, Mus musculus
gccccaatgagggttgcactgtgca

SEQ ID NO: 550638 - DNA, 25 bp, Mus musculus
gccccaatgcttagcctaatgtaaa

SEQ ID NO: 550639 - DNA, 25 bp, Mus musculus
gccccaatgctttgcctaatgtaaa

SEQ ID NO: 550640 - DNA, 25 bp, Mus musculus
gccccaatggcgagatctgtgtcaa

SEQ ID NO: 550641 - DNA, 25 bp, Mus musculus
gccccaatggcgtgatctgtgtcaa

SEQ ID NO: 550642 - DNA, 25 bp, Mus musculus
gccccaatgtcaccaggaagaaatc

SEQ ID NO: 550643 - DNA, 25 bp, Mus musculus
gccccaatgtcagcaggaagaaatc

SEQ ID NO: 550644 - DNA, 25 bp, Mus musculus
gccccacaaagtctctcttaacaag

SEQ ID NO: 550645 - DNA, 25 bp, Mus musculus
gccccacaaagtgtctcttaacaag

SEQ ID NO: 550646 - DNA, 25 bp, Mus musculus
gccccacacaccctaatatggtgga

SEQ ID NO: 550647 - DNA, 25 bp, Mus musculus
gccccacacaccgtaatatggtgga

SEQ ID NO: 550648 - DNA, 25 bp, Mus musculus
gccccacagagcacatgtttatagc

SEQ ID NO: 550649 - DNA, 25 bp, Mus musculus
gccccacagagctcatgtttatagc

SEQ ID NO: 550650 - DNA, 25 bp, Mus musculus
gccccacagaggatgcagttcttcg

SEQ ID NO: 550651 - DNA, 25 bp, Mus musculus
gccccacagaggttgcagttcttcg

SEQ ID NO: 550652 - DNA, 25 bp, Mus musculus
gccccacagcggcattgatgactgc

SEQ ID NO: 550653 - DNA, 25 bp, Mus musculus
gccccacagcgggattgatgactgc

SEQ ID NO: 550654 - DNA, 25 bp, Mus musculus
gccccacagctcatctgtatatata

SEQ ID NO: 550655 - DNA, 25 bp, Mus musculus
gccccacagctcttctgtatatata

SEQ ID NO: 550656 - DNA, 25 bp, Mus musculus
gccccacagtgcctgtttggataca

SEQ ID NO: 550657 - DNA, 25 bp, Mus musculus
gccccacagtgcgtgtttggataca

SEQ ID NO: 550658 - DNA, 25 bp, Mus musculus
gccccacataaaccgtccaatgaat

SEQ ID NO: 550659 - DNA, 25 bp, Mus musculus
gccccacataaagcgtccaatgaat

SEQ ID NO: 550660 - DNA, 25 bp, Mus musculus
gccccacatctcagcaaacataaat

SEQ ID NO: 550661 - DNA, 25 bp, Mus musculus
gccccacatctctgcaaacataaat

SEQ ID NO: 550662 - DNA, 25 bp, Mus musculus
gccccacattcaagcaggttatcta

SEQ ID NO: 550663 - DNA, 25 bp, Mus musculus
gccccacattcatgcaggttatcta

SEQ ID NO: 550664 - DNA, 25 bp, Mus musculus
gccccaccactaacggattatttgt

SEQ ID NO: 550665 - DNA, 25 bp, Mus musculus
gccccaccactatcggattatttgt

SEQ ID NO: 550666 - DNA, 25 bp, Mus musculus
gccccaccacttacgttttggatga

SEQ ID NO: 550667 - DNA, 25 bp, Mus musculus
gccccaccactttcgttttggatga

SEQ ID NO: 550668 - DNA, 25 bp, Mus musculus
gccccaccagctagttcagaagaaa

SEQ ID NO: 550669 - DNA, 25 bp, Mus musculus
gccccaccagcttgttcagaagaaa

SEQ ID NO: 550670 - DNA, 25 bp, Mus musculus
gccccaccagtgatattaaaggatc

SEQ ID NO: 550671 - DNA, 25 bp, Mus musculus
gccccaccagtgttattaaaggatc

SEQ ID NO: 550672 - DNA, 25 bp, Mus musculus
gccccaccgaggatcaggagctcat

SEQ ID NO: 550673 - DNA, 25 bp, Mus musculus
gccccaccgaggttcaggagctcat

SEQ ID NO: 550674 - DNA, 25 bp, Mus musculus
gccccaccgctgaagcaattcttaa

SEQ ID NO: 550675 - DNA, 25 bp, Mus musculus
gccccaccgctgtagcaattcttaa

SEQ ID NO: 550676 - DNA, 25 bp, Mus musculus
gccccacggcacagtaatctgagtt

SEQ ID NO: 550677 - DNA, 25 bp, Mus musculus
gccccacggcactgtaatctgagtt

SEQ ID NO: 550678 - DNA, 25 bp, Mus musculus
gccccacggctgcaacttcaatgga

SEQ ID NO: 550679 - DNA, 25 bp, Mus musculus
gccccacggctggaacttcaatgga

SEQ ID NO: 550680 - DNA, 25 bp, Mus musculus
gccccactaaaaatatcttgcacaa

SEQ ID NO: 550681 - DNA, 25 bp, Mus musculus
gccccactaaaattatcttgcacaa

SEQ ID NO: 550682 - DNA, 25 bp, Mus musculus
gccccactaaatcacattctttcaa

SEQ ID NO: 550683 - DNA, 25 bp, Mus musculus
gccccactaaatgacattctttcaa

SEQ ID NO: 550684 - DNA, 25 bp, Mus musculus
gccccactcaggatggtggagtcag

SEQ ID NO: 550685 - DNA, 25 bp, Mus musculus
gccccactcaggttggtggagtcag

SEQ ID NO: 550686 - DNA, 25 bp, Mus musculus
gccccactcccaaagaatgtttaat

SEQ ID NO: 550687 - DNA, 25 bp, Mus musculus
gccccactcccatagaatgtttaat

SEQ ID NO: 550688 - DNA, 25 bp, Mus musculus
gccccactgaagacactgctgcaaa

SEQ ID NO: 550689 - DNA, 25 bp, Mus musculus
gccccactgaagacattgcggaaga

SEQ ID NO: 550690 - DNA, 25 bp, Mus musculus
gccccactgaagtcactgctgcaaa

SEQ ID NO: 550691 - DNA, 25 bp, Mus musculus
gccccactgaagtcattgcggaaga

SEQ ID NO: 550692 - DNA, 25 bp, Mus musculus
gccccacttacaagttatccttata

SEQ ID NO: 550693 - DNA, 25 bp, Mus musculus
gccccacttacatgttatccttata

SEQ ID NO: 550694 - DNA, 25 bp, Mus musculus
gccccacttgaacctagctttctaa

SEQ ID NO: 550695 - DNA, 25 bp, Mus musculus
gccccacttgaagctagctttctaa

SEQ ID NO: 550696 - DNA, 25 bp, Mus musculus
gccccactttataaatgctgtctgc

SEQ ID NO: 550697 - DNA, 25 bp, Mus musculus
gccccactttattaatgctgtctgc

SEQ ID NO: 550698 - DNA, 25 bp, Mus musculus
gccccacttttgatgagaatggctc

SEQ ID NO: 550699 - DNA, 25 bp, Mus musculus
gccccacttttgttgagaatggctc

SEQ ID NO: 550700 - DNA, 25 bp, Mus musculus
gccccagaaatacctcgctgtatga

SEQ ID NO: 550701 - DNA, 25 bp, Mus musculus
gccccagaaatagctcgctgtatga

SEQ ID NO: 550702 - DNA, 25 bp, Mus musculus
gccccagaaccgcaaagtgagcaag

SEQ ID NO: 550703 - DNA, 25 bp, Mus musculus
gccccagaaccggaaagtgagcaag

SEQ ID NO: 550704 - DNA, 25 bp, Mus musculus
gccccagaactgcaggcgttgtgat

SEQ ID NO: 550705 - DNA, 25 bp, Mus musculus
gccccagaactggaggcgttgtgat

SEQ ID NO: 550706 - DNA, 25 bp, Mus musculus
gccccagacactcctgtgattttag

SEQ ID NO: 550707 - DNA, 25 bp, Mus musculus
gccccagacactgctgtgattttag

SEQ ID NO: 550708 - DNA, 25 bp, Mus musculus
gccccagacatacagtgttgagaga

SEQ ID NO: 550709 - DNA, 25 bp, Mus musculus
gccccagacatagagtgttgagaga

SEQ ID NO: 550710 - DNA, 25 bp, Mus musculus
gccccagacatcatgcacagaggat

SEQ ID NO: 550711 - DNA, 25 bp, Mus musculus
gccccagacatcttgcacagaggat

SEQ ID NO: 550712 - DNA, 25 bp, Mus musculus
gccccagacctaccagatgacattt

SEQ ID NO: 550713 - DNA, 25 bp, Mus musculus
gccccagacctagcagatgacattt

SEQ ID NO: 550714 - DNA, 25 bp, Mus musculus
gccccagagaccagtgccagaggga

SEQ ID NO: 550715 - DNA, 25 bp, Mus musculus
gccccagagacctgtgccagaggga

SEQ ID NO: 550716 - DNA, 25 bp, Mus musculus
gccccagagccccaagaaggatttc

SEQ ID NO: 550717 - DNA, 25 bp, Mus musculus
gccccagagcccgaagaaggatttc

SEQ ID NO: 550718 - DNA, 25 bp, Mus musculus
gccccagagtctcagggtagtttat

SEQ ID NO: 550719 - DNA, 25 bp, Mus musculus
gccccagagtctctaactagcagca

SEQ ID NO: 550720 - DNA, 25 bp, Mus musculus
gccccagagtctgagggtagtttat

SEQ ID NO: 550721 - DNA, 25 bp, Mus musculus
gccccagagtctgtaactagcagca

SEQ ID NO: 550722 - DNA, 25 bp, Mus musculus
gccccagatatgctcggctgtaatg

SEQ ID NO: 550723 - DNA, 25 bp, Mus musculus
gccccagatatggtcggctgtaatg

SEQ ID NO: 550724 - DNA, 25 bp, Mus musculus
gccccagcaaatccccagtccaggc

SEQ ID NO: 550725 - DNA, 25 bp, Mus musculus
gccccagcaaatgcccagtccaggc

SEQ ID NO: 550726 - DNA, 25 bp, Mus musculus
gccccagcacggcaattatttcctg

SEQ ID NO: 550727 - DNA, 25 bp, Mus musculus
gccccagcacgggaattatttcctg

SEQ ID NO: 550728 - DNA, 25 bp, Mus musculus
gccccagcactgaagataagaatcg

SEQ ID NO: 550729 - DNA, 25 bp, Mus musculus
gccccagcactgtagataagaatcg

SEQ ID NO: 550730 - DNA, 25 bp, Mus musculus
gccccagcagacacgtggaggtcag

SEQ ID NO: 550731 - DNA, 25 bp, Mus musculus
gccccagcagactcgtggaggtcag

SEQ ID NO: 550732 - DNA, 25 bp, Mus musculus
gccccagctaacattacagcacagt

SEQ ID NO: 550733 - DNA, 25 bp, Mus musculus
gccccagctaacattggacagtcag

SEQ ID NO: 550734 - DNA, 25 bp, Mus musculus
gccccagctaactttacagcacagt

SEQ ID NO: 550735 - DNA, 25 bp, Mus musculus
gccccagctaactttggacagtcag

SEQ ID NO: 550736 - DNA, 25 bp, Mus musculus
gccccagcttctagttgaatatgaa

SEQ ID NO: 550737 - DNA, 25 bp, Mus musculus
gccccagcttctctagtactaagga

SEQ ID NO: 550738 - DNA, 25 bp, Mus musculus
gccccagcttctgtagtactaagga

SEQ ID NO: 550739 - DNA, 25 bp, Mus musculus
gccccagcttcttgttgaatatgaa

SEQ ID NO: 550740 - DNA, 25 bp, Mus musculus
gccccaggaaccatgaagcttctct

SEQ ID NO: 550741 - DNA, 25 bp, Mus musculus
gccccaggaaccttgaagcttctct

SEQ ID NO: 550742 - DNA, 25 bp, Mus musculus
gccccaggcacactgtttactctgg

SEQ ID NO: 550743 - DNA, 25 bp, Mus musculus
gccccaggcacagtgtttactctgg

SEQ ID NO: 550744 - DNA, 25 bp, Mus musculus
gccccaggcctgagtgtacacctgt

SEQ ID NO: 550745 - DNA, 25 bp, Mus musculus
gccccaggcctgtgtgtacacctgt

SEQ ID NO: 550746 - DNA, 25 bp, Mus musculus
gccccagggacactgatttaagaca

SEQ ID NO: 550747 - DNA, 25 bp, Mus musculus
gccccagggacagtgatttaagaca

SEQ ID NO: 550748 - DNA, 25 bp, Mus musculus
gccccagggaccaatgtcctattac

SEQ ID NO: 550749 - DNA, 25 bp, Mus musculus
gccccagggacctatgtcctattac

SEQ ID NO: 550750 - DNA, 25 bp, Mus musculus
gccccaggggtcactgggcgagtat

SEQ ID NO: 550751 - DNA, 25 bp, Mus musculus
gccccaggggtctctgggcgagtat

SEQ ID NO: 550752 - DNA, 25 bp, Mus musculus
gccccagggttccaggacatagtct

SEQ ID NO: 550753 - DNA, 25 bp, Mus musculus
gccccagggttcgaggacatagtct

SEQ ID NO: 550754 - DNA, 25 bp, Mus musculus
gccccaggttccaggtttagcgaga

SEQ ID NO: 550755 - DNA, 25 bp, Mus musculus
gccccaggttcctggtttagcgaga

SEQ ID NO: 550756 - DNA, 25 bp, Mus musculus
gccccagtactgatgagaatgactc

SEQ ID NO: 550757 - DNA, 25 bp, Mus musculus
gccccagtactgttgagaatgactc

SEQ ID NO: 550758 - DNA, 25 bp, Mus musculus
gccccagtcccgcaatgcatttttt

SEQ ID NO: 550759 - DNA, 25 bp, Mus musculus
gccccagtcccggaatgcatttttt

SEQ ID NO: 550760 - DNA, 25 bp, Mus musculus
gccccagtcgttatttcacatttat

SEQ ID NO: 550761 - DNA, 25 bp, Mus musculus
gccccagtcgttttttcacatttat

SEQ ID NO: 550762 - DNA, 25 bp, Mus musculus
gccccagtctgtagtcccggaagaa

SEQ ID NO: 550763 - DNA, 25 bp, Mus musculus
gccccagtctgtatgcactgaaaaa

SEQ ID NO: 550764 - DNA, 25 bp, Mus musculus
gccccagtctgttgtcccggaagaa

SEQ ID NO: 550765 - DNA, 25 bp, Mus musculus
gccccagtctgtttgcactgaaaaa

SEQ ID NO: 550766 - DNA, 25 bp, Mus musculus
gccccagtgactcagggtcttggat

SEQ ID NO: 550767 - DNA, 25 bp, Mus musculus
gccccagtgactgagggtcttggat

SEQ ID NO: 550768 - DNA, 25 bp, Mus musculus
gccccagtgaggatccattggtgta

SEQ ID NO: 550769 - DNA, 25 bp, Mus musculus
gccccagtgaggttccattggtgta

SEQ ID NO: 550770 - DNA, 25 bp, Mus musculus
gccccagtggcaagtgtttgagtgt

SEQ ID NO: 550771 - DNA, 25 bp, Mus musculus
gccccagtggcatgtgtttgagtgt

SEQ ID NO: 550772 - DNA, 25 bp, Mus musculus
gccccagtgttgaagtctatactta

SEQ ID NO: 550773 - DNA, 25 bp, Mus musculus
gccccagtgttgtagtctatactta

SEQ ID NO: 550774 - DNA, 25 bp, Mus musculus
gccccagttagtaagtcagcaagtt

SEQ ID NO: 550775 - DNA, 25 bp, Mus musculus
gccccagttagttagtcagcaagtt

SEQ ID NO: 550776 - DNA, 25 bp, Mus musculus
gccccagttcctacaacagaaattc

SEQ ID NO: 550777 - DNA, 25 bp, Mus musculus
gccccagttccttcaacagaaattc

SEQ ID NO: 550778 - DNA, 25 bp, Mus musculus
gccccagttgccagaggctacacaa

SEQ ID NO: 550779 - DNA, 25 bp, Mus musculus
gccccagttgcctgaggctacacaa

SEQ ID NO: 550780 - DNA, 25 bp, Mus musculus
gccccagttgctagtctctttaggg

SEQ ID NO: 550781 - DNA, 25 bp, Mus musculus
gccccagttgcttgtctctttaggg

SEQ ID NO: 550782 - DNA, 25 bp, Mus musculus
gccccagttggccagacttaactct

SEQ ID NO: 550783 - DNA, 25 bp, Mus musculus
gccccagttggcgagacttaactct

SEQ ID NO: 550784 - DNA, 25 bp, Mus musculus
gccccagttgtcagtcaaagccgtt

SEQ ID NO: 550785 - DNA, 25 bp, Mus musculus
gccccagttgtctgtcaaagccgtt

SEQ ID NO: 550786 - DNA, 25 bp, Mus musculus
gccccataatggagtgcaatcttat

SEQ ID NO: 550787 - DNA, 25 bp, Mus musculus
gccccataatggtgtgcaatcttat

SEQ ID NO: 550788 - DNA, 25 bp, Mus musculus
gccccataccctcaggaacaggctg

SEQ ID NO: 550789 - DNA, 25 bp, Mus musculus
gccccataccctgaggaacaggctg

SEQ ID NO: 550790 - DNA, 25 bp, Mus musculus
gccccatcacgtccacattgagatt

SEQ ID NO: 550791 - DNA, 25 bp, Mus musculus
gccccatcacgtgcacattgagatt

SEQ ID NO: 550792 - DNA, 25 bp, Mus musculus
gccccatcattcacctgatacataa

SEQ ID NO: 550793 - DNA, 25 bp, Mus musculus
gccccatcattctcctgatacataa

SEQ ID NO: 550794 - DNA, 25 bp, Mus musculus
gccccatccaggcaacagttattta

SEQ ID NO: 550795 - DNA, 25 bp, Mus musculus
gccccatccagggaacagttattta

SEQ ID NO: 550796 - DNA, 25 bp, Mus musculus
gccccatccctgatatataacactt

SEQ ID NO: 550797 - DNA, 25 bp, Mus musculus
gccccatccctgttatataacactt

SEQ ID NO: 550798 - DNA, 25 bp, Mus musculus
gccccatctaccagtctttgtaagg

SEQ ID NO: 550799 - DNA, 25 bp, Mus musculus
gccccatctacctgtctttgtaagg

SEQ ID NO: 550800 - DNA, 25 bp, Mus musculus
gccccatctatgaactcttctgtat

SEQ ID NO: 550801 - DNA, 25 bp, Mus musculus
gccccatctatgtactcttctgtat

SEQ ID NO: 550802 - DNA, 25 bp, Mus musculus
gccccatctgggaggtggactcgct

SEQ ID NO: 550803 - DNA, 25 bp, Mus musculus
gccccatctgggtggtggactcgct

SEQ ID NO: 550804 - DNA, 25 bp, Mus musculus
gccccatgacagagatcctgtggtg

SEQ ID NO: 550805 - DNA, 25 bp, Mus musculus
gccccatgacagtgatcctgtggtg

SEQ ID NO: 550806 - DNA, 25 bp, Mus musculus
gccccatgacataccagtctgtgga

SEQ ID NO: 550807 - DNA, 25 bp, Mus musculus
gccccatgacattccagtctgtgga

SEQ ID NO: 550808 - DNA, 25 bp, Mus musculus
gccccatgaccgaggaccaatgacg

SEQ ID NO: 550809 - DNA, 25 bp, Mus musculus
gccccatgaccgtggaccaatgacg

SEQ ID NO: 550810 - DNA, 25 bp, Mus musculus
gccccatgcactctgtttaacatta

SEQ ID NO: 550811 - DNA, 25 bp, Mus musculus
gccccatgcactgtgtttaacatta

SEQ ID NO: 550812 - DNA, 25 bp, Mus musculus
gccccatggattagcttttgatatt

SEQ ID NO: 550813 - DNA, 25 bp, Mus musculus
gccccatggatttgcttttgatatt

SEQ ID NO: 550814 - DNA, 25 bp, Mus musculus
gccccatgtaaaaaagcctccttgt

SEQ ID NO: 550815 - DNA, 25 bp, Mus musculus
gccccatgtaaataagcctccttgt

SEQ ID NO: 550816 - DNA, 25 bp, Mus musculus
gccccatgtgaaatcagcttcaatt

SEQ ID NO: 550817 - DNA, 25 bp, Mus musculus
gccccatgtgaattcagcttcaatt

SEQ ID NO: 550818 - DNA, 25 bp, Mus musculus
gccccattatataggcccttccaag

SEQ ID NO: 550819 - DNA, 25 bp, Mus musculus
gccccattatattggcccttccaag

SEQ ID NO: 550820 - DNA, 25 bp, Mus musculus
gccccattcattactggactcagaa

SEQ ID NO: 550821 - DNA, 25 bp, Mus musculus
gccccattcatttctggactcagaa

SEQ ID NO: 550822 - DNA, 25 bp, Mus musculus
gccccattccttcaatttttgtgtc

SEQ ID NO: 550823 - DNA, 25 bp, Mus musculus
gccccattccttgaatttttgtgtc

SEQ ID NO: 550824 - DNA, 25 bp, Mus musculus
gccccattgaagactccattaaagt

SEQ ID NO: 550825 - DNA, 25 bp, Mus musculus
gccccattgaagtctccattaaagt

SEQ ID NO: 550826 - DNA, 25 bp, Mus musculus
gccccattgcacacaactgaataga

SEQ ID NO: 550827 - DNA, 25 bp, Mus musculus
gccccattgcactcaactgaataga

SEQ ID NO: 550828 - DNA, 25 bp, Mus musculus
gccccattgcagatgcccaactatt

SEQ ID NO: 550829 - DNA, 25 bp, Mus musculus
gccccattgcagttgcccaactatt

SEQ ID NO: 550830 - DNA, 25 bp, Mus musculus
gccccattgcggaaagactttgtca

SEQ ID NO: 550831 - DNA, 25 bp, Mus musculus
gccccattgcggtaagactttgtca

SEQ ID NO: 550832 - DNA, 25 bp, Mus musculus
gccccattgcttctcagcaggaaaa

SEQ ID NO: 550833 - DNA, 25 bp, Mus musculus
gccccattgcttgtcagcaggaaaa

SEQ ID NO: 550834 - DNA, 25 bp, Mus musculus
gccccattgggcactgtgacttgaa

SEQ ID NO: 550835 - DNA, 25 bp, Mus musculus
gccccattgggctctgtgacttgaa

SEQ ID NO: 550836 - DNA, 25 bp, Mus musculus
gccccattgtccaattcttcagaaa

SEQ ID NO: 550837 - DNA, 25 bp, Mus musculus
gccccattgtcctattcttcagaaa

SEQ ID NO: 550838 - DNA, 25 bp, Mus musculus
gccccattgtggagttattgtagat

SEQ ID NO: 550839 - DNA, 25 bp, Mus musculus
gccccattgtggtgttattgtagat

SEQ ID NO: 550840 - DNA, 25 bp, Mus musculus
gccccatttcttacagtctcagaaa

SEQ ID NO: 550841 - DNA, 25 bp, Mus musculus
gccccatttctttcagtctcagaaa

SEQ ID NO: 550842 - DNA, 25 bp, Mus musculus
gccccatttggacccgtggaatagg

SEQ ID NO: 550843 - DNA, 25 bp, Mus musculus
gccccatttggagccgtggaatagg

SEQ ID NO: 550844 - DNA, 25 bp, Mus musculus
gccccatttgtgaggttccaggaca

SEQ ID NO: 550845 - DNA, 25 bp, Mus musculus
gccccatttgtgtggttccaggaca

SEQ ID NO: 550846 - DNA, 25 bp, Mus musculus
gccccattttagaaggacaatcctg

SEQ ID NO: 550847 - DNA, 25 bp, Mus musculus
gccccattttagtaggacaatcctg

SEQ ID NO: 550848 - DNA, 25 bp, Mus musculus
gcccccagccaaagtctagctattg

SEQ ID NO: 550849 - DNA, 25 bp, Mus musculus
gcccccagccaatgtctagctattg

SEQ ID NO: 550850 - DNA, 25 bp, Mus musculus
gcccccataattcgtatactttgaa

SEQ ID NO: 550851 - DNA, 25 bp, Mus musculus
gcccccataattggtatactttgaa

SEQ ID NO: 550852 - DNA, 25 bp, Mus musculus
gccccccaagggactgataaaagct

SEQ ID NO: 550853 - DNA, 25 bp, Mus musculus
gccccccaagggtctgataaaagct

SEQ ID NO: 550854 - DNA, 25 bp, Mus musculus
gccccccctggcattagaatatagt

SEQ ID NO: 550855 - DNA, 25 bp, Mus musculus
gccccccctggctttagaatatagt

SEQ ID NO: 550856 - DNA, 25 bp, Mus musculus
gcccccgcatatccgtggtgtcttt

SEQ ID NO: 550857 - DNA, 25 bp, Mus musculus
gcccccgcatatgcgtggtgtcttt

SEQ ID NO: 550858 - DNA, 25 bp, Mus musculus
gccccctcgatgctcttagctgagt

SEQ ID NO: 550859 - DNA, 25 bp, Mus musculus
gccccctcgatggtcttagctgagt

SEQ ID NO: 550860 - DNA, 25 bp, Mus musculus
gccccctcggcaaagtgcatctgga

SEQ ID NO: 550861 - DNA, 25 bp, Mus musculus
gccccctcggcatagtgcatctgga

SEQ ID NO: 550862 - DNA, 25 bp, Mus musculus
gccccgaagaaaaggttgatgccat

SEQ ID NO: 550863 - DNA, 25 bp, Mus musculus
gccccgaagaaatggttgatgccat

SEQ ID NO: 550864 - DNA, 25 bp, Mus musculus
gccccgaagttcacagatggaccat

SEQ ID NO: 550865 - DNA, 25 bp, Mus musculus
gccccgaagttctcagatggaccat

SEQ ID NO: 550866 - DNA, 25 bp, Mus musculus
gccccgaattgtcttagtttgctct

SEQ ID NO: 550867 - DNA, 25 bp, Mus musculus
gccccgaattgtgttagtttgctct

SEQ ID NO: 550868 - DNA, 25 bp, Mus musculus
gccccgacagagattcgtgggagcc

SEQ ID NO: 550869 - DNA, 25 bp, Mus musculus
gccccgacagagtttcgtgggagcc

SEQ ID NO: 550870 - DNA, 25 bp, Mus musculus
gccccgacgtctccgatgagtataa

SEQ ID NO: 550871 - DNA, 25 bp, Mus musculus
gccccgacgtctgcgatgagtataa

SEQ ID NO: 550872 - DNA, 25 bp, Mus musculus
gccccgactctccaaatactgagat

SEQ ID NO: 550873 - DNA, 25 bp, Mus musculus
gccccgactctcgaaatactgagat

SEQ ID NO: 550874 - DNA, 25 bp, Mus musculus
gccccgagcactctagtaactttta

SEQ ID NO: 550875 - DNA, 25 bp, Mus musculus
gccccgagcactgtagtaactttta

SEQ ID NO: 550876 - DNA, 25 bp, Mus musculus
gccccgaggacgaggtactgcccag

SEQ ID NO: 550877 - DNA, 25 bp, Mus musculus
gccccgaggacgtggtactgcccag

SEQ ID NO: 550878 - DNA, 25 bp, Mus musculus
gccccgaggaggaccagaagaatta

SEQ ID NO: 550879 - DNA, 25 bp, Mus musculus
gccccgaggaggtccagaagaatta

SEQ ID NO: 550880 - DNA, 25 bp, Mus musculus
gccccgatgtgactgcttattctta

SEQ ID NO: 550881 - DNA, 25 bp, Mus musculus
gccccgatgtgagtgcttattctta

SEQ ID NO: 550882 - DNA, 25 bp, Mus musculus
gccccgcactgaatacattctttta

SEQ ID NO: 550883 - DNA, 25 bp, Mus musculus
gccccgcactgattacattctttta

SEQ ID NO: 550884 - DNA, 25 bp, Mus musculus
gccccgccagccagttatgaacgtt

SEQ ID NO: 550885 - DNA, 25 bp, Mus musculus
gccccgccagcctgttatgaacgtt

SEQ ID NO: 550886 - DNA, 25 bp, Mus musculus
gccccgccagcgaagtacgaggaaa

SEQ ID NO: 550887 - DNA, 25 bp, Mus musculus
gccccgccagcgtagtacgaggaaa

SEQ ID NO: 550888 - DNA, 25 bp, Mus musculus
gccccgccataccttaaagagaaat

SEQ ID NO: 550889 - DNA, 25 bp, Mus musculus
gccccgccatacgttaaagagaaat

SEQ ID NO: 550890 - DNA, 25 bp, Mus musculus
gccccgcccttacaatgttacttag

SEQ ID NO: 550891 - DNA, 25 bp, Mus musculus
gccccgcccttagaatgttacttag

SEQ ID NO: 550892 - DNA, 25 bp, Mus musculus
gccccgcctaagaagatcatgccgg

SEQ ID NO: 550893 - DNA, 25 bp, Mus musculus
gccccgcctaagtagatcatgccgg

SEQ ID NO: 550894 - DNA, 25 bp, Mus musculus
gccccgcggaaacattttggctttg

SEQ ID NO: 550895 - DNA, 25 bp, Mus musculus
gccccgcggaaagattttggctttg

SEQ ID NO: 550896 - DNA, 25 bp, Mus musculus
gccccgctaagacgatgtatgacat

SEQ ID NO: 550897 - DNA, 25 bp, Mus musculus
gccccgctaagaggatgtatgacat

SEQ ID NO: 550898 - DNA, 25 bp, Mus musculus
gccccgctaccaaatacaggaagat

SEQ ID NO: 550899 - DNA, 25 bp, Mus musculus
gccccgctaccatatacaggaagat

SEQ ID NO: 550900 - DNA, 25 bp, Mus musculus
gccccgctgattatctttctaagaa

SEQ ID NO: 550901 - DNA, 25 bp, Mus musculus
gccccgctgattttctttctaagaa

SEQ ID NO: 550902 - DNA, 25 bp, Mus musculus
gccccgcttctgagttgggaaggaa

SEQ ID NO: 550903 - DNA, 25 bp, Mus musculus
gccccgcttctgtgttgggaaggaa

SEQ ID NO: 550904 - DNA, 25 bp, Mus musculus
gccccgcttttcaggattgtaaacg

SEQ ID NO: 550905 - DNA, 25 bp, Mus musculus
gccccgcttttctggattgtaaacg

SEQ ID NO: 550906 - DNA, 25 bp, Mus musculus
gccccggaaaaaatctgctccagag

SEQ ID NO: 550907 - DNA, 25 bp, Mus musculus
gccccggaaaaattctgctccagag

SEQ ID NO: 550908 - DNA, 25 bp, Mus musculus
gccccggaacttcttatatggacca

SEQ ID NO: 550909 - DNA, 25 bp, Mus musculus
gccccggaacttgttatatggacca

SEQ ID NO: 550910 - DNA, 25 bp, Mus musculus
gccccggaagatcctcagctgagta

SEQ ID NO: 550911 - DNA, 25 bp, Mus musculus
gccccggaagatgctcagctgagta

SEQ ID NO: 550912 - DNA, 25 bp, Mus musculus
gccccggaggatctagatctggacc

SEQ ID NO: 550913 - DNA, 25 bp, Mus musculus
gccccggaggatgtagatctggacc

SEQ ID NO: 550914 - DNA, 25 bp, Mus musculus
gccccggcgtggagaatgcatgtaa

SEQ ID NO: 550915 - DNA, 25 bp, Mus musculus
gccccggcgtggtgaatgcatgtaa

SEQ ID NO: 550916 - DNA, 25 bp, Mus musculus
gccccggctgcaatgaaggcatgta

SEQ ID NO: 550917 - DNA, 25 bp, Mus musculus
gccccggctgcattgaaggcatgta

SEQ ID NO: 550918 - DNA, 25 bp, Mus musculus
gccccggctttgattcagtcggaat

SEQ ID NO: 550919 - DNA, 25 bp, Mus musculus
gccccggctttgtttcagtcggaat

SEQ ID NO: 550920 - DNA, 25 bp, Mus musculus
gccccgggacgcctaggagcctggg

SEQ ID NO: 550921 - DNA, 25 bp, Mus musculus
gccccgggacgcgtaggagcctggg

SEQ ID NO: 550922 - DNA, 25 bp, Mus musculus
gccccgggtcatatctcatgagaag

SEQ ID NO: 550923 - DNA, 25 bp, Mus musculus
gccccgggtcatttctcatgagaag

SEQ ID NO: 550924 - DNA, 25 bp, Mus musculus
gccccggtaaagatagctgtcattt

SEQ ID NO: 550925 - DNA, 25 bp, Mus musculus
gccccggtaaagttagctgtcattt

SEQ ID NO: 550926 - DNA, 25 bp, Mus musculus
gccccggtaatcattctgcatacaa

SEQ ID NO: 550927 - DNA, 25 bp, Mus musculus
gccccggtaatctttctgcatacaa

SEQ ID NO: 550928 - DNA, 25 bp, Mus musculus
gccccggtagctagttatttttcat

SEQ ID NO: 550929 - DNA, 25 bp, Mus musculus
gccccggtagcttgttatttttcat

SEQ ID NO: 550930 - DNA, 25 bp, Mus musculus
gccccggtcttaagatttccatttg

SEQ ID NO: 550931 - DNA, 25 bp, Mus musculus
gccccggtcttatgatttccatttg

SEQ ID NO: 550932 - DNA, 25 bp, Mus musculus
gccccgtattacaccgagatcttaa

SEQ ID NO: 550933 - DNA, 25 bp, Mus musculus
gccccgtattactccgagatcttaa

SEQ ID NO: 550934 - DNA, 25 bp, Mus musculus
gccccgtcacagctggagaattgca

SEQ ID NO: 550935 - DNA, 25 bp, Mus musculus
gccccgtcacaggtggagaattgca

SEQ ID NO: 550936 - DNA, 25 bp, Mus musculus
gccccgtgaatacatttggagacat

SEQ ID NO: 550937 - DNA, 25 bp, Mus musculus
gccccgtgaatagatttggagacat

SEQ ID NO: 550938 - DNA, 25 bp, Mus musculus
gccccgtgagagatcattctgccta

SEQ ID NO: 550939 - DNA, 25 bp, Mus musculus
gccccgtgagagttcattctgccta

SEQ ID NO: 550940 - DNA, 25 bp, Mus musculus
gccccgtgcatgaactcaaagccag

SEQ ID NO: 550941 - DNA, 25 bp, Mus musculus
gccccgtgcatgtactcaaagccag

SEQ ID NO: 550942 - DNA, 25 bp, Mus musculus
gccccgtgggaacagctttcacgga

SEQ ID NO: 550943 - DNA, 25 bp, Mus musculus
gccccgtgggaagagctttcacgga

SEQ ID NO: 550944 - DNA, 25 bp, Mus musculus
gccccgtgggatcttttgagacttc

SEQ ID NO: 550945 - DNA, 25 bp, Mus musculus
gccccgtgggatgttttgagacttc

SEQ ID NO: 550946 - DNA, 25 bp, Mus musculus
gccccgtgtgctccaggaactgaac

SEQ ID NO: 550947 - DNA, 25 bp, Mus musculus
gccccgtgtgctgcaggaactgaac

SEQ ID NO: 550948 - DNA, 25 bp, Mus musculus
gccccgtgttaaaaacttggtctga

SEQ ID NO: 550949 - DNA, 25 bp, Mus musculus
gccccgtgttaataacttggtctga

SEQ ID NO: 550950 - DNA, 25 bp, Mus musculus
gccccgtgttcaattgctggcataa

SEQ ID NO: 550951 - DNA, 25 bp, Mus musculus
gccccgtgttcatttgctggcataa

SEQ ID NO: 550952 - DNA, 25 bp, Mus musculus
gccccgttaagtcttgtacgcataa

SEQ ID NO: 550953 - DNA, 25 bp, Mus musculus
gccccgttaagtgttgtacgcataa

SEQ ID NO: 550954 - DNA, 25 bp, Mus musculus
gcccctaaatttcagactgaagcat

SEQ ID NO: 550955 - DNA, 25 bp, Mus musculus
gcccctaaatttgagactgaagcat

SEQ ID NO: 550956 - DNA, 25 bp, Mus musculus
gcccctacactgctttaagaattcg

SEQ ID NO: 550957 - DNA, 25 bp, Mus musculus
gcccctacactggtttaagaattcg

SEQ ID NO: 550958 - DNA, 25 bp, Mus musculus
gcccctaccttgacataagtgctga

SEQ ID NO: 550959 - DNA, 25 bp, Mus musculus
gcccctaccttgtcataagtgctga

SEQ ID NO: 550960 - DNA, 25 bp, Mus musculus
gcccctactggacaacagttgactg

SEQ ID NO: 550961 - DNA, 25 bp, Mus musculus
gcccctactggagaacagttgactg

SEQ ID NO: 550962 - DNA, 25 bp, Mus musculus
gcccctacttctctttgggaggtat

SEQ ID NO: 550963 - DNA, 25 bp, Mus musculus
gcccctacttctgtttgggaggtat

SEQ ID NO: 550964 - DNA, 25 bp, Mus musculus
gcccctagataaaccacttctgagt

SEQ ID NO: 550965 - DNA, 25 bp, Mus musculus
gcccctagataatccacttctgagt

SEQ ID NO: 550966 - DNA, 25 bp, Mus musculus
gcccctagtgataggcagcaggtct

SEQ ID NO: 550967 - DNA, 25 bp, Mus musculus
gcccctagtgattggcagcaggtct

SEQ ID NO: 550968 - DNA, 25 bp, Mus musculus
gcccctagttctctgtatatctgta

SEQ ID NO: 550969 - DNA, 25 bp, Mus musculus
gcccctagttctgtgtatatctgta

SEQ ID NO: 550970 - DNA, 25 bp, Mus musculus
gcccctatacttatggtggttggat

SEQ ID NO: 550971 - DNA, 25 bp, Mus musculus
gcccctatacttttggtggttggat

SEQ ID NO: 550972 - DNA, 25 bp, Mus musculus
gcccctatcaggctggagtattttt

SEQ ID NO: 550973 - DNA, 25 bp, Mus musculus
gcccctatcagggtggagtattttt

SEQ ID NO: 550974 - DNA, 25 bp, Mus musculus
gcccctatcctcagctaggaagaga

SEQ ID NO: 550975 - DNA, 25 bp, Mus musculus
gcccctatcctctgctaggaagaga

SEQ ID NO: 550976 - DNA, 25 bp, Mus musculus
gcccctattctgaggtagcctgtag

SEQ ID NO: 550977 - DNA, 25 bp, Mus musculus
gcccctattctgtggtagcctgtag

SEQ ID NO: 550978 - DNA, 25 bp, Mus musculus
gcccctatttccatagagaactctg

SEQ ID NO: 550979 - DNA, 25 bp, Mus musculus
gcccctatttccttagagaactctg

SEQ ID NO: 550980 - DNA, 25 bp, Mus musculus
gcccctcaaatacagacatctgctt

SEQ ID NO: 550981 - DNA, 25 bp, Mus musculus
gcccctcaaatagagacatctgctt

SEQ ID NO: 550982 - DNA, 25 bp, Mus musculus
gcccctcaactgaacgcttgggaaa

SEQ ID NO: 550983 - DNA, 25 bp, Mus musculus
gcccctcaactgtacgcttgggaaa

SEQ ID NO: 550984 - DNA, 25 bp, Mus musculus
gcccctcaccacagcaaataaatgg

SEQ ID NO: 550985 - DNA, 25 bp, Mus musculus
gcccctcaccactgcaaataaatgg

SEQ ID NO: 550986 - DNA, 25 bp, Mus musculus
gcccctcagaaaatacaaatacgat

SEQ ID NO: 550987 - DNA, 25 bp, Mus musculus
gcccctcagaaattacaaatacgat

SEQ ID NO: 550988 - DNA, 25 bp, Mus musculus
gcccctcagctgaagtctcgaaatt

SEQ ID NO: 550989 - DNA, 25 bp, Mus musculus
gcccctcagctgtagtctcgaaatt

SEQ ID NO: 550990 - DNA, 25 bp, Mus musculus
gcccctcagttgagggaccaactct

SEQ ID NO: 550991 - DNA, 25 bp, Mus musculus
gcccctcagttgtgggaccaactct

SEQ ID NO: 550992 - DNA, 25 bp, Mus musculus
gcccctcatgtccttattctgaaga

SEQ ID NO: 550993 - DNA, 25 bp, Mus musculus
gcccctcatgtcgttattctgaaga

SEQ ID NO: 550994 - DNA, 25 bp, Mus musculus
gcccctcatttgacacttgaattgg

SEQ ID NO: 550995 - DNA, 25 bp, Mus musculus
gcccctcatttgtcacttgaattgg

SEQ ID NO: 550996 - DNA, 25 bp, Mus musculus
gcccctccacatctgctaagtatga

SEQ ID NO: 550997 - DNA, 25 bp, Mus musculus
gcccctccacatgtgctaagtatga

SEQ ID NO: 550998 - DNA, 25 bp, Mus musculus
gcccctccaggtagcatttgtattt

SEQ ID NO: 550999 - DNA, 25 bp, Mus musculus
gcccctccaggttgcatttgtattt

SEQ ID NO: 551000 - DNA, 25 bp, Mus musculus
gcccctccatgcaaagaaagcgcca

SEQ ID NO: 551001 - DNA, 25 bp, Mus musculus
gcccctccatgctaagaaagcgcca

SEQ ID NO: 551002 - DNA, 25 bp, Mus musculus
gcccctcgaactctgagtgcctggg

SEQ ID NO: 551003 - DNA, 25 bp, Mus musculus
gcccctcgaactgtgagtgcctggg

SEQ ID NO: 551004 - DNA, 25 bp, Mus musculus
gcccctcggagcagtgcctgggaaa

SEQ ID NO: 551005 - DNA, 25 bp, Mus musculus
gcccctcggagctgtgcctgggaaa

SEQ ID NO: 551006 - DNA, 25 bp, Mus musculus
gcccctctcatgagtgcactgttga

SEQ ID NO: 551007 - DNA, 25 bp, Mus musculus
gcccctctcatgtgtgcactgttga

SEQ ID NO: 551008 - DNA, 25 bp, Mus musculus
gcccctctcattcaaccattgatga

SEQ ID NO: 551009 - DNA, 25 bp, Mus musculus
gcccctctcattgaaccattgatga

SEQ ID NO: 551010 - DNA, 25 bp, Mus musculus
gcccctctccttagacaaatcagaa

SEQ ID NO: 551011 - DNA, 25 bp, Mus musculus
gcccctctcctttgacaaatcagaa

SEQ ID NO: 551012 - DNA, 25 bp, Mus musculus
gcccctctctgaatgattacaaatc

SEQ ID NO: 551013 - DNA, 25 bp, Mus musculus
gcccctctctgattgattacaaatc

SEQ ID NO: 551014 - DNA, 25 bp, Mus musculus
gcccctctctggacttagaagttta

SEQ ID NO: 551015 - DNA, 25 bp, Mus musculus
gcccctctctggtcttagaagttta

SEQ ID NO: 551016 - DNA, 25 bp, Mus musculus
gcccctctgtgtcctatgatattga

SEQ ID NO: 551017 - DNA, 25 bp, Mus musculus
gcccctctgtgtgctatgatattga

SEQ ID NO: 551018 - DNA, 25 bp, Mus musculus
gcccctctgttactggacattttaa

SEQ ID NO: 551019 - DNA, 25 bp, Mus musculus
gcccctctgttagtggacattttaa

SEQ ID NO: 551020 - DNA, 25 bp, Mus musculus
gcccctcttaggcagttcagaattt

SEQ ID NO: 551021 - DNA, 25 bp, Mus musculus
gcccctcttagggagttcagaattt

SEQ ID NO: 551022 - DNA, 25 bp, Mus musculus
gcccctgaagatattgatacccaca

SEQ ID NO: 551023 - DNA, 25 bp, Mus musculus
gcccctgaagattttgatacccaca

SEQ ID NO: 551024 - DNA, 25 bp, Mus musculus
gcccctgaagccctgcagaagaagc

SEQ ID NO: 551025 - DNA, 25 bp, Mus musculus
gcccctgaagccgtgcagaagaagc

SEQ ID NO: 551026 - DNA, 25 bp, Mus musculus
gcccctgaaggcatcgttggagatc

SEQ ID NO: 551027 - DNA, 25 bp, Mus musculus
gcccctgaaggcttcgttggagatc

SEQ ID NO: 551028 - DNA, 25 bp, Mus musculus
gcccctgacaggcagctaacctgag

SEQ ID NO: 551029 - DNA, 25 bp, Mus musculus
gcccctgacagggagctaacctgag

SEQ ID NO: 551030 - DNA, 25 bp, Mus musculus
gcccctgacccaaacagtgtggtat

SEQ ID NO: 551031 - DNA, 25 bp, Mus musculus
gcccctgacccatacagtgtggtat

SEQ ID NO: 551032 - DNA, 25 bp, Mus musculus
gcccctgacgttcgaaacacctgta

SEQ ID NO: 551033 - DNA, 25 bp, Mus musculus
gcccctgacgttggaaacacctgta

SEQ ID NO: 551034 - DNA, 25 bp, Mus musculus
gcccctgagagtagatgtgcatcgc

SEQ ID NO: 551035 - DNA, 25 bp, Mus musculus
gcccctgagagttgatgtgcatcgc

SEQ ID NO: 551036 - DNA, 25 bp, Mus musculus
gcccctgagattaggaaggaccata

SEQ ID NO: 551037 - DNA, 25 bp, Mus musculus
gcccctgagatttggaaggaccata

SEQ ID NO: 551038 - DNA, 25 bp, Mus musculus
gcccctgagcacaggacatggagct

SEQ ID NO: 551039 - DNA, 25 bp, Mus musculus
gcccctgagcactggacatggagct

SEQ ID NO: 551040 - DNA, 25 bp, Mus musculus
gcccctgagcttaaatgatttgtac

SEQ ID NO: 551041 - DNA, 25 bp, Mus musculus
gcccctgagctttaatgatttgtac

SEQ ID NO: 551042 - DNA, 25 bp, Mus musculus
gcccctgagtatcatgcaagagaca

SEQ ID NO: 551043 - DNA, 25 bp, Mus musculus
gcccctgagtatgatgcaagagaca

SEQ ID NO: 551044 - DNA, 25 bp, Mus musculus
gcccctgatatgattgtcttctttg

SEQ ID NO: 551045 - DNA, 25 bp, Mus musculus
gcccctgatatgtttgtcttctttg

SEQ ID NO: 551046 - DNA, 25 bp, Mus musculus
gcccctgatcgaatttcctggagga

SEQ ID NO: 551047 - DNA, 25 bp, Mus musculus
gcccctgatcgaattttattggtcc

SEQ ID NO: 551048 - DNA, 25 bp, Mus musculus
gcccctgatcgattttcctggagga

SEQ ID NO: 551049 - DNA, 25 bp, Mus musculus
gcccctgatcgatttttattggtcc

SEQ ID NO: 551050 - DNA, 25 bp, Mus musculus
gcccctgcacatatgtagtagatga

SEQ ID NO: 551051 - DNA, 25 bp, Mus musculus
gcccctgcacatttgtagtagatga

SEQ ID NO: 551052 - DNA, 25 bp, Mus musculus
gcccctgcagggatctgaagactaa

SEQ ID NO: 551053 - DNA, 25 bp, Mus musculus
gcccctgcagggttctgaagactaa

SEQ ID NO: 551054 - DNA, 25 bp, Mus musculus
gcccctgccagtaacactaagattg

SEQ ID NO: 551055 - DNA, 25 bp, Mus musculus
gcccctgccagttacactaagattg

SEQ ID NO: 551056 - DNA, 25 bp, Mus musculus
gcccctgcccagaagtaggagctta

SEQ ID NO: 551057 - DNA, 25 bp, Mus musculus
gcccctgcccagtagtaggagctta

SEQ ID NO: 551058 - DNA, 25 bp, Mus musculus
gcccctgccgggagaatgctgcaga

SEQ ID NO: 551059 - DNA, 25 bp, Mus musculus
gcccctgccgggtgaatgctgcaga

SEQ ID NO: 551060 - DNA, 25 bp, Mus musculus
gcccctgcctaaagaaaattgtgcc

SEQ ID NO: 551061 - DNA, 25 bp, Mus musculus
gcccctgcctaatgaaaattgtgcc

SEQ ID NO: 551062 - DNA, 25 bp, Mus musculus
gcccctgctcaaatatcatgctgaa

SEQ ID NO: 551063 - DNA, 25 bp, Mus musculus
gcccctgctcaattatcatgctgaa

SEQ ID NO: 551064 - DNA, 25 bp, Mus musculus
gcccctgctgggaaagtgcccgact

SEQ ID NO: 551065 - DNA, 25 bp, Mus musculus
gcccctgctgggtaagtgcccgact

SEQ ID NO: 551066 - DNA, 25 bp, Mus musculus
gcccctgctgtaaccactttatagg

SEQ ID NO: 551067 - DNA, 25 bp, Mus musculus
gcccctgctgtatccactttatagg

SEQ ID NO: 551068 - DNA, 25 bp, Mus musculus
gcccctgcttcacaagtgtgcaaca

SEQ ID NO: 551069 - DNA, 25 bp, Mus musculus
gcccctgcttcagaagtgtgcaaca

SEQ ID NO: 551070 - DNA, 25 bp, Mus musculus
gcccctggcgtcagttggatagatg

SEQ ID NO: 551071 - DNA, 25 bp, Mus musculus
gcccctggcgtctgttggatagatg

SEQ ID NO: 551072 - DNA, 25 bp, Mus musculus
gcccctggctttcctaaggacatgg

SEQ ID NO: 551073 - DNA, 25 bp, Mus musculus
gcccctggctttgctaaggacatgg

SEQ ID NO: 551074 - DNA, 25 bp, Mus musculus
gcccctggtagtcattcatttatgg

SEQ ID NO: 551075 - DNA, 25 bp, Mus musculus
gcccctggtagtgattcatttatgg

SEQ ID NO: 551076 - DNA, 25 bp, Mus musculus
gcccctggtgagcttacatgtgcca

SEQ ID NO: 551077 - DNA, 25 bp, Mus musculus
gcccctggtgaggttacatgtgcca

SEQ ID NO: 551078 - DNA, 25 bp, Mus musculus
gcccctgtattccttgttaggctga

SEQ ID NO: 551079 - DNA, 25 bp, Mus musculus
gcccctgtattcgttgttaggctga

SEQ ID NO: 551080 - DNA, 25 bp, Mus musculus
gcccctgtggctcagtttgcagatt

SEQ ID NO: 551081 - DNA, 25 bp, Mus musculus
gcccctgtggctgagtttgcagatt

SEQ ID NO: 551082 - DNA, 25 bp, Mus musculus
gcccctgtgtacattggtgttttga

SEQ ID NO: 551083 - DNA, 25 bp, Mus musculus
gcccctgtgtactttggtgttttga

SEQ ID NO: 551084 - DNA, 25 bp, Mus musculus
gcccctgtgttaacttttcagaatg

SEQ ID NO: 551085 - DNA, 25 bp, Mus musculus
gcccctgtgttaatttttcagaatg

SEQ ID NO: 551086 - DNA, 25 bp, Mus musculus
gcccctgtgttatcttttcagaatg

SEQ ID NO: 551087 - DNA, 25 bp, Mus musculus
gcccctgtgttattttttcagaatg

SEQ ID NO: 551088 - DNA, 25 bp, Mus musculus
gcccctgttgacagcatgcctgaag

SEQ ID NO: 551089 - DNA, 25 bp, Mus musculus
gcccctgttgactgcatgcctgaag

SEQ ID NO: 551090 - DNA, 25 bp, Mus musculus
gcccctgttgctcagcatttttcaa

SEQ ID NO: 551091 - DNA, 25 bp, Mus musculus
gcccctgttgctgagcatttttcaa

SEQ ID NO: 551092 - DNA, 25 bp, Mus musculus
gcccctgtttggctgtgaactcaag

SEQ ID NO: 551093 - DNA, 25 bp, Mus musculus
gcccctgtttgggtgtgaactcaag

SEQ ID NO: 551094 - DNA, 25 bp, Mus musculus
gcccctgttttacgttgagaggcct

SEQ ID NO: 551095 - DNA, 25 bp, Mus musculus
gcccctgttttaggttgagaggcct

SEQ ID NO: 551096 - DNA, 25 bp, Mus musculus
gccccttacaagaagacttgcctaa

SEQ ID NO: 551097 - DNA, 25 bp, Mus musculus
gccccttacaagtagacttgcctaa

SEQ ID NO: 551098 - DNA, 25 bp, Mus musculus
gccccttacacaagctagctagcta

SEQ ID NO: 551099 - DNA, 25 bp, Mus musculus
gccccttacacatgctagctagcta

SEQ ID NO: 551100 - DNA, 25 bp, Mus musculus
gccccttacatgctgccagaggaga

SEQ ID NO: 551101 - DNA, 25 bp, Mus musculus
gccccttacatggtgccagaggaga

SEQ ID NO: 551102 - DNA, 25 bp, Mus musculus
gccccttacctgaactgcaaaatat

SEQ ID NO: 551103 - DNA, 25 bp, Mus musculus
gccccttacctgtactgcaaaatat

SEQ ID NO: 551104 - DNA, 25 bp, Mus musculus
gccccttagccccttgtatattatt

SEQ ID NO: 551105 - DNA, 25 bp, Mus musculus
gccccttagcccgttgtatattatt

SEQ ID NO: 551106 - DNA, 25 bp, Mus musculus
gccccttagcttcccattgagatag

SEQ ID NO: 551107 - DNA, 25 bp, Mus musculus
gccccttagcttgccattgagatag

SEQ ID NO: 551108 - DNA, 25 bp, Mus musculus
gccccttatacacgcctaacaatta

SEQ ID NO: 551109 - DNA, 25 bp, Mus musculus
gccccttatacaggcctaacaatta

SEQ ID NO: 551110 - DNA, 25 bp, Mus musculus
gccccttatctcaaacccttgataa

SEQ ID NO: 551111 - DNA, 25 bp, Mus musculus
gccccttatctcatttactaggtaa

SEQ ID NO: 551112 - DNA, 25 bp, Mus musculus
gccccttatctctaacccttgataa

SEQ ID NO: 551113 - DNA, 25 bp, Mus musculus
gccccttatctcttttactaggtaa

SEQ ID NO: 551114 - DNA, 25 bp, Mus musculus
gccccttatttgcttatcataggct

SEQ ID NO: 551115 - DNA, 25 bp, Mus musculus
gccccttatttggttatcataggct

SEQ ID NO: 551116 - DNA, 25 bp, Mus musculus
gccccttcaagtcgcttatttcttt

SEQ ID NO: 551117 - DNA, 25 bp, Mus musculus
gccccttcaagtggcttatttcttt

SEQ ID NO: 551118 - DNA, 25 bp, Mus musculus
gccccttcacttatttataagccct

SEQ ID NO: 551119 - DNA, 25 bp, Mus musculus
gccccttcacttttttataagccct

SEQ ID NO: 551120 - DNA, 25 bp, Mus musculus
gccccttcagctcgttcatggaaaa

SEQ ID NO: 551121 - DNA, 25 bp, Mus musculus
gccccttcagctggttcatggaaaa

SEQ ID NO: 551122 - DNA, 25 bp, Mus musculus
gccccttcctaaaccgatgtaataa

SEQ ID NO: 551123 - DNA, 25 bp, Mus musculus
gccccttcctaatccgatgtaataa

SEQ ID NO: 551124 - DNA, 25 bp, Mus musculus
gccccttcctcaaaaacggcaagag

SEQ ID NO: 551125 - DNA, 25 bp, Mus musculus
gccccttcctcataaacggcaagag

SEQ ID NO: 551126 - DNA, 25 bp, Mus musculus
gccccttccttcatgtataaacagt

SEQ ID NO: 551127 - DNA, 25 bp, Mus musculus
gccccttccttcttgtataaacagt

SEQ ID NO: 551128 - DNA, 25 bp, Mus musculus
gccccttctaatacggcttggaaat

SEQ ID NO: 551129 - DNA, 25 bp, Mus musculus
gccccttctaattcggcttggaaat

SEQ ID NO: 551130 - DNA, 25 bp, Mus musculus
gccccttctcaaagaccacgtattt

SEQ ID NO: 551131 - DNA, 25 bp, Mus musculus
gccccttctcaatgaccacgtattt

SEQ ID NO: 551132 - DNA, 25 bp, Mus musculus
gccccttctgatctttgtgtatgac

SEQ ID NO: 551133 - DNA, 25 bp, Mus musculus
gccccttctgatgtttgtgtatgac

SEQ ID NO: 551134 - DNA, 25 bp, Mus musculus
gccccttgacccatataagctggag

SEQ ID NO: 551135 - DNA, 25 bp, Mus musculus
gccccttgacccttataagctggag

SEQ ID NO: 551136 - DNA, 25 bp, Mus musculus
gccccttgaggcagattacagggat

SEQ ID NO: 551137 - DNA, 25 bp, Mus musculus
gccccttgaggctgattacagggat

SEQ ID NO: 551138 - DNA, 25 bp, Mus musculus
gccccttgctaacttttcaaatggt

SEQ ID NO: 551139 - DNA, 25 bp, Mus musculus
gccccttgctaagttttcaaatggt

SEQ ID NO: 551140 - DNA, 25 bp, Mus musculus
gccccttggcctctttacggagatg

SEQ ID NO: 551141 - DNA, 25 bp, Mus musculus
gccccttggcctgtttacggagatg

SEQ ID NO: 551142 - DNA, 25 bp, Mus musculus
gccccttggctgcatttttaacaga

SEQ ID NO: 551143 - DNA, 25 bp, Mus musculus
gccccttggctggatttttaacaga

SEQ ID NO: 551144 - DNA, 25 bp, Mus musculus
gccccttggttaatgctgttacatg

SEQ ID NO: 551145 - DNA, 25 bp, Mus musculus
gccccttggttattgctgttacatg

SEQ ID NO: 551146 - DNA, 25 bp, Mus musculus
gccccttgtataaattggacagctt

SEQ ID NO: 551147 - DNA, 25 bp, Mus musculus
gccccttgtatatattggacagctt

SEQ ID NO: 551148 - DNA, 25 bp, Mus musculus
gcccctttagaactcctctagagat

SEQ ID NO: 551149 - DNA, 25 bp, Mus musculus
gcccctttagaagtcctctagagat

SEQ ID NO: 551150 - DNA, 25 bp, Mus musculus
gcccctttagcacatggtgtttcaa

SEQ ID NO: 551151 - DNA, 25 bp, Mus musculus
gcccctttagcagatggtgtttcaa

SEQ ID NO: 551152 - DNA, 25 bp, Mus musculus
gcccctttagttaatcttcgtcaat

SEQ ID NO: 551153 - DNA, 25 bp, Mus musculus
gcccctttagtttatcttcgtcaat

SEQ ID NO: 551154 - DNA, 25 bp, Mus musculus
gcccctttataacacattacggcaa

SEQ ID NO: 551155 - DNA, 25 bp, Mus musculus
gcccctttataagacattacggcaa

SEQ ID NO: 551156 - DNA, 25 bp, Mus musculus
gcccctttatacctttatgaattag

SEQ ID NO: 551157 - DNA, 25 bp, Mus musculus
gcccctttatacgtttatgaattag

SEQ ID NO: 551158 - DNA, 25 bp, Mus musculus
gcccctttcaatcgtcagtgtctga

SEQ ID NO: 551159 - DNA, 25 bp, Mus musculus
gcccctttcaatggtcagtgtctga

SEQ ID NO: 551160 - DNA, 25 bp, Mus musculus
gcccctttcaggctacaggcagaga

SEQ ID NO: 551161 - DNA, 25 bp, Mus musculus
gcccctttcagggtacaggcagaga

SEQ ID NO: 551162 - DNA, 25 bp, Mus musculus
gcccctttcttcatagccatacttt

SEQ ID NO: 551163 - DNA, 25 bp, Mus musculus
gcccctttcttcttagccatacttt

SEQ ID NO: 551164 - DNA, 25 bp, Mus musculus
gcccctttgatgagtcacctagtga

SEQ ID NO: 551165 - DNA, 25 bp, Mus musculus
gcccctttgatgtgtcacctagtga

SEQ ID NO: 551166 - DNA, 25 bp, Mus musculus
gcccctttggtgatcatatgcattc

SEQ ID NO: 551167 - DNA, 25 bp, Mus musculus
gcccctttggtgttcatatgcattc

SEQ ID NO: 551168 - DNA, 25 bp, Mus musculus
gcccgaaatcggagttctgcaaagt

SEQ ID NO: 551169 - DNA, 25 bp, Mus musculus
gcccgaaatcggtgttctgcaaagt

SEQ ID NO: 551170 - DNA, 25 bp, Mus musculus
gcccgaagctgccattgtgcaaaga

SEQ ID NO: 551171 - DNA, 25 bp, Mus musculus
gcccgaagctgcgattgtgcaaaga

SEQ ID NO: 551172 - DNA, 25 bp, Mus musculus
gcccgaatgcgcacagaggatccca

SEQ ID NO: 551173 - DNA, 25 bp, Mus musculus
gcccgaatgcgctcagaggatccca

SEQ ID NO: 551174 - DNA, 25 bp, Mus musculus
gcccgacaacacagtgatcctggat

SEQ ID NO: 551175 - DNA, 25 bp, Mus musculus
gcccgacaacactgtgatcctggat

SEQ ID NO: 551176 - DNA, 25 bp, Mus musculus
gcccgacaatgtcaatgctctgaaa

SEQ ID NO: 551177 - DNA, 25 bp, Mus musculus
gcccgacaatgtgaatgctctgaaa

SEQ ID NO: 551178 - DNA, 25 bp, Mus musculus
gcccgacacagacgtgctctacatg

SEQ ID NO: 551179 - DNA, 25 bp, Mus musculus
gcccgacacagaggtgctctacatg

SEQ ID NO: 551180 - DNA, 25 bp, Mus musculus
gcccgacagagaccggctgctcaag

SEQ ID NO: 551181 - DNA, 25 bp, Mus musculus
gcccgacagagagcggctgctcaag

SEQ ID NO: 551182 - DNA, 25 bp, Mus musculus
gcccgacagctgctgcaagacagtg

SEQ ID NO: 551183 - DNA, 25 bp, Mus musculus
gcccgacagctggtgcaagacagtg

SEQ ID NO: 551184 - DNA, 25 bp, Mus musculus
gcccgacaggacatttgagctcaag

SEQ ID NO: 551185 - DNA, 25 bp, Mus musculus
gcccgacaggacttttgagctcaag

SEQ ID NO: 551186 - DNA, 25 bp, Mus musculus
gcccgacaggagcaaagtttttgat

SEQ ID NO: 551187 - DNA, 25 bp, Mus musculus
gcccgacaggaggaaagtttttgat

SEQ ID NO: 551188 - DNA, 25 bp, Mus musculus
gcccgacgagggaccagttgtgcaa

SEQ ID NO: 551189 - DNA, 25 bp, Mus musculus
gcccgacgagggtccagttgtgcaa

SEQ ID NO: 551190 - DNA, 25 bp, Mus musculus
gcccgactctacatatttagagaca

SEQ ID NO: 551191 - DNA, 25 bp, Mus musculus
gcccgactctacttatttagagaca

SEQ ID NO: 551192 - DNA, 25 bp, Mus musculus
gcccgactgaagcagagctgcatga

SEQ ID NO: 551193 - DNA, 25 bp, Mus musculus
gcccgactgaaggagagctgcatga

SEQ ID NO: 551194 - DNA, 25 bp, Mus musculus
gcccgactggagaactgagtgctga

SEQ ID NO: 551195 - DNA, 25 bp, Mus musculus
gcccgactggagtactgagtgctga

SEQ ID NO: 551196 - DNA, 25 bp, Mus musculus
gcccgacttatgacagccacaagtg

SEQ ID NO: 551197 - DNA, 25 bp, Mus musculus
gcccgacttatgtcagccacaagtg

SEQ ID NO: 551198 - DNA, 25 bp, Mus musculus
gcccgacttgaaagaggcctccaga

SEQ ID NO: 551199 - DNA, 25 bp, Mus musculus
gcccgacttgaatgaggcctccaga

SEQ ID NO: 551200 - DNA, 25 bp, Mus musculus
gcccgactttgtctttgcttgataa

SEQ ID NO: 551201 - DNA, 25 bp, Mus musculus
gcccgactttgtgtttgcttgataa

SEQ ID NO: 551202 - DNA, 25 bp, Mus musculus
gcccgagaaagcagtgtattgtttt

SEQ ID NO: 551203 - DNA, 25 bp, Mus musculus
gcccgagaaagctgtgtattgtttt

SEQ ID NO: 551204 - DNA, 25 bp, Mus musculus
gcccgagaacggaggaactttgact

SEQ ID NO: 551205 - DNA, 25 bp, Mus musculus
gcccgagaacggtggaactttgact

SEQ ID NO: 551206 - DNA, 25 bp, Mus musculus
gcccgagacccgcagtatgcagaaa

SEQ ID NO: 551207 - DNA, 25 bp, Mus musculus
gcccgagacccggagtatgcagaaa

SEQ ID NO: 551208 - DNA, 25 bp, Mus musculus
gcccgagatatgaccctgaagccaa

SEQ ID NO: 551209 - DNA, 25 bp, Mus musculus
gcccgagatatgtccctgaagccaa

SEQ ID NO: 551210 - DNA, 25 bp, Mus musculus
gcccgagatattcgcatccacactg

SEQ ID NO: 551211 - DNA, 25 bp, Mus musculus
gcccgagatattggcatccacactg

SEQ ID NO: 551212 - DNA, 25 bp, Mus musculus
gcccgagatgcacttggtgcccaag

SEQ ID NO: 551213 - DNA, 25 bp, Mus musculus
gcccgagatgcagttggtgcccaag

SEQ ID NO: 551214 - DNA, 25 bp, Mus musculus
gcccgagcacgtcttgtattgtttt

SEQ ID NO: 551215 - DNA, 25 bp, Mus musculus
gcccgagcacgtgttgtattgtttt

SEQ ID NO: 551216 - DNA, 25 bp, Mus musculus
gcccgagcacttctagaacatctgg

SEQ ID NO: 551217 - DNA, 25 bp, Mus musculus
gcccgagcacttgtagaacatctgg

SEQ ID NO: 551218 - DNA, 25 bp, Mus musculus
gcccgagcagggagatatggactat

SEQ ID NO: 551219 - DNA, 25 bp, Mus musculus
gcccgagcagggtgatatggactat

SEQ ID NO: 551220 - DNA, 25 bp, Mus musculus
gcccgagcccaacagagctgtggtc

SEQ ID NO: 551221 - DNA, 25 bp, Mus musculus
gcccgagcccaagagagctgtggtc

SEQ ID NO: 551222 - DNA, 25 bp, Mus musculus
gcccgagcccttaggccaacaaaga

SEQ ID NO: 551223 - DNA, 25 bp, Mus musculus
gcccgagccctttggccaacaaaga

SEQ ID NO: 551224 - DNA, 25 bp, Mus musculus
gcccgagccttaactttgtgactga

SEQ ID NO: 551225 - DNA, 25 bp, Mus musculus
gcccgagccttatctttgtgactga

SEQ ID NO: 551226 - DNA, 25 bp, Mus musculus
gcccgaggacctcatccagaaaggg

SEQ ID NO: 551227 - DNA, 25 bp, Mus musculus
gcccgaggacctgatccagaaaggg

SEQ ID NO: 551228 - DNA, 25 bp, Mus musculus
gcccgagtccagactgttgcttact

SEQ ID NO: 551229 - DNA, 25 bp, Mus musculus
gcccgagtccagtctgttgcttact

SEQ ID NO: 551230 - DNA, 25 bp, Mus musculus
gcccgagtccatacagtatatccga

SEQ ID NO: 551231 - DNA, 25 bp, Mus musculus
gcccgagtccattcagtatatccga

SEQ ID NO: 551232 - DNA, 25 bp, Mus musculus
gcccgagtctgcagttcatgtttaa

SEQ ID NO: 551233 - DNA, 25 bp, Mus musculus
gcccgagtctgctgttcatgtttaa

SEQ ID NO: 551234 - DNA, 25 bp, Mus musculus
gcccgataccagaaatcctaccgat

SEQ ID NO: 551235 - DNA, 25 bp, Mus musculus
gcccgataccagtaatcctaccgat

SEQ ID NO: 551236 - DNA, 25 bp, Mus musculus
gcccgatctcagagctcagacacag

SEQ ID NO: 551237 - DNA, 25 bp, Mus musculus
gcccgatctcagtgctcagacacag

SEQ ID NO: 551238 - DNA, 25 bp, Mus musculus
gcccgatgagttagagatttcttct

SEQ ID NO: 551239 - DNA, 25 bp, Mus musculus
gcccgatgagtttgagatttcttct

SEQ ID NO: 551240 - DNA, 25 bp, Mus musculus
gcccgatgccacagagttcatgatt

SEQ ID NO: 551241 - DNA, 25 bp, Mus musculus
gcccgatgccactgagttcatgatt

SEQ ID NO: 551242 - DNA, 25 bp, Mus musculus
gcccgatggacaccaagtattgaca

SEQ ID NO: 551243 - DNA, 25 bp, Mus musculus
gcccgatggacagcaagtattgaca

SEQ ID NO: 551244 - DNA, 25 bp, Mus musculus
gcccgattccagactgtcagtgtag

SEQ ID NO: 551245 - DNA, 25 bp, Mus musculus
gcccgattccagtctgtcagtgtag

SEQ ID NO: 551246 - DNA, 25 bp, Mus musculus
gcccgattccctcagattttgaaag

SEQ ID NO: 551247 - DNA, 25 bp, Mus musculus
gcccgattccctgagattttgaaag

SEQ ID NO: 551248 - DNA, 25 bp, Mus musculus
gcccgcaagcagaggtagccccagg

SEQ ID NO: 551249 - DNA, 25 bp, Mus musculus
gcccgcaagcagtggtagccccagg

SEQ ID NO: 551250 - DNA, 25 bp, Mus musculus
gcccgcactgcacggtacaagtaga

SEQ ID NO: 551251 - DNA, 25 bp, Mus musculus
gcccgcactgcagggtacaagtaga

SEQ ID NO: 551252 - DNA, 25 bp, Mus musculus
gcccgcaggaagcatcctaccgggt

SEQ ID NO: 551253 - DNA, 25 bp, Mus musculus
gcccgcaggaaggatcctaccgggt

SEQ ID NO: 551254 - DNA, 25 bp, Mus musculus
gcccgccacgatcctaggtaacaag

SEQ ID NO: 551255 - DNA, 25 bp, Mus musculus
gcccgccacgatgctaggtaacaag

SEQ ID NO: 551256 - DNA, 25 bp, Mus musculus
gcccgccactggagtgtcagaagta

SEQ ID NO: 551257 - DNA, 25 bp, Mus musculus
gcccgccactggtgtgtcagaagta

SEQ ID NO: 551258 - DNA, 25 bp, Mus musculus
gcccgccagaagaacatgaagaagc

SEQ ID NO: 551259 - DNA, 25 bp, Mus musculus
gcccgccagaagaatgtccgaaaag

SEQ ID NO: 551260 - DNA, 25 bp, Mus musculus
gcccgccagaagtacatgaagaagc

SEQ ID NO: 551261 - DNA, 25 bp, Mus musculus
gcccgccagaagtatgtccgaaaag

SEQ ID NO: 551262 - DNA, 25 bp, Mus musculus
gcccgccgaggacaaaggcttctat

SEQ ID NO: 551263 - DNA, 25 bp, Mus musculus
gcccgccgaggagaaaggcttctat

SEQ ID NO: 551264 - DNA, 25 bp, Mus musculus
gcccgcgagcaaaagctcccaatag

SEQ ID NO: 551265 - DNA, 25 bp, Mus musculus
gcccgcgagcaatagctcccaatag

SEQ ID NO: 551266 - DNA, 25 bp, Mus musculus
gcccgcgcaagtcgcagaacagcat

SEQ ID NO: 551267 - DNA, 25 bp, Mus musculus
gcccgcgcaagtggcagaacagcat

SEQ ID NO: 551268 - DNA, 25 bp, Mus musculus
gcccgcgcaggacaacttgaacaaa

SEQ ID NO: 551269 - DNA, 25 bp, Mus musculus
gcccgcgcaggagaacttgaacaaa

SEQ ID NO: 551270 - DNA, 25 bp, Mus musculus
gcccgcggagtaagttgtgttgcac

SEQ ID NO: 551271 - DNA, 25 bp, Mus musculus
gcccgcggagtatgttgtgttgcac

SEQ ID NO: 551272 - DNA, 25 bp, Mus musculus
gcccgctatgctattggccaagaga

SEQ ID NO: 551273 - DNA, 25 bp, Mus musculus
gcccgctatgcttttggccaagaga

SEQ ID NO: 551274 - DNA, 25 bp, Mus musculus
gcccgctccttcctaatgaatgaat

SEQ ID NO: 551275 - DNA, 25 bp, Mus musculus
gcccgctccttcgtaatgaatgaat

SEQ ID NO: 551276 - DNA, 25 bp, Mus musculus
gcccgctcgccgagtgagtatcgag

SEQ ID NO: 551277 - DNA, 25 bp, Mus musculus
gcccgctcgccgtgtgagtatcgag

SEQ ID NO: 551278 - DNA, 25 bp, Mus musculus
gcccgctctcggattttgaaacaga

SEQ ID NO: 551279 - DNA, 25 bp, Mus musculus
gcccgctctcggtttttgaaacaga

SEQ ID NO: 551280 - DNA, 25 bp, Mus musculus
gcccgctctgcgaggacggcgacaa

SEQ ID NO: 551281 - DNA, 25 bp, Mus musculus
gcccgctctgcgtggacggcgacaa

SEQ ID NO: 551282 - DNA, 25 bp, Mus musculus
gcccgctgcgcacatattttgagtc

SEQ ID NO: 551283 - DNA, 25 bp, Mus musculus
gcccgctgcgcagatattttgagtc

SEQ ID NO: 551284 - DNA, 25 bp, Mus musculus
gcccgctgtcttatgcaaacaatga

SEQ ID NO: 551285 - DNA, 25 bp, Mus musculus
gcccgctgtcttttgcaaacaatga

SEQ ID NO: 551286 - DNA, 25 bp, Mus musculus
gcccgcttatgaatgactctgccag

SEQ ID NO: 551287 - DNA, 25 bp, Mus musculus
gcccgcttatgattgactctgccag

SEQ ID NO: 551288 - DNA, 25 bp, Mus musculus
gcccgcttgggacagaacattgcat

SEQ ID NO: 551289 - DNA, 25 bp, Mus musculus
gcccgcttgggagagaacattgcat

SEQ ID NO: 551290 - DNA, 25 bp, Mus musculus
gcccggaaagtgatccaggacatca

SEQ ID NO: 551291 - DNA, 25 bp, Mus musculus
gcccggaaagtgttccaggacatca

SEQ ID NO: 551292 - DNA, 25 bp, Mus musculus
gcccggaacatcacagggccgaaaa

SEQ ID NO: 551293 - DNA, 25 bp, Mus musculus
gcccggaacatctcagggccgaaaa

SEQ ID NO: 551294 - DNA, 25 bp, Mus musculus
gcccggaagccacgagtgtacacca

SEQ ID NO: 551295 - DNA, 25 bp, Mus musculus
gcccggaagccaggagtgtacacca

SEQ ID NO: 551296 - DNA, 25 bp, Mus musculus
gcccggaatccccaggatgtagacc

SEQ ID NO: 551297 - DNA, 25 bp, Mus musculus
gcccggaatcccgaggatgtagacc

SEQ ID NO: 551298 - DNA, 25 bp, Mus musculus
gcccggaattttctccatttcttct

SEQ ID NO: 551299 - DNA, 25 bp, Mus musculus
gcccggaattttgtccatttcttct

SEQ ID NO: 551300 - DNA, 25 bp, Mus musculus
gcccggacacggacaggattgacag

SEQ ID NO: 551301 - DNA, 25 bp, Mus musculus
gcccggacacggtcaggattgacag

SEQ ID NO: 551302 - DNA, 25 bp, Mus musculus
gcccggactctgatctagaattttc

SEQ ID NO: 551303 - DNA, 25 bp, Mus musculus
gcccggactctgttctagaattttc

SEQ ID NO: 551304 - DNA, 25 bp, Mus musculus
gcccggagccctaaggcggctaatg

SEQ ID NO: 551305 - DNA, 25 bp, Mus musculus
gcccggagcccttaggcggctaatg

SEQ ID NO: 551306 - DNA, 25 bp, Mus musculus
gcccggagccgacgtggcactgtgt

SEQ ID NO: 551307 - DNA, 25 bp, Mus musculus
gcccggagccgaggtggcactgtgt

SEQ ID NO: 551308 - DNA, 25 bp, Mus musculus
gcccggagctttcattggctgtcct

SEQ ID NO: 551309 - DNA, 25 bp, Mus musculus
gcccggagctttgattggctgtcct

SEQ ID NO: 551310 - DNA, 25 bp, Mus musculus
gcccggaggaaccatggtgacctat

SEQ ID NO: 551311 - DNA, 25 bp, Mus musculus
gcccggaggaacgatggtgacctat

SEQ ID NO: 551312 - DNA, 25 bp, Mus musculus
gcccggagtaggatctgctgtcaag

SEQ ID NO: 551313 - DNA, 25 bp, Mus musculus
gcccggagtaggttctgctgtcaag

SEQ ID NO: 551314 - DNA, 25 bp, Mus musculus
gcccggatggcaccagtagttctag

SEQ ID NO: 551315 - DNA, 25 bp, Mus musculus
gcccggatggcagcagtagttctag

SEQ ID NO: 551316 - DNA, 25 bp, Mus musculus
gcccggcaggctacaaggaaaaaag

SEQ ID NO: 551317 - DNA, 25 bp, Mus musculus
gcccggcaggcttcaaggaaaaaag

SEQ ID NO: 551318 - DNA, 25 bp, Mus musculus
gcccggcatgtgctaagcgagatcc

SEQ ID NO: 551319 - DNA, 25 bp, Mus musculus
gcccggcatgtggtaagcgagatcc

SEQ ID NO: 551320 - DNA, 25 bp, Mus musculus
gcccggccaacaagtgcaagcacaa

SEQ ID NO: 551321 - DNA, 25 bp, Mus musculus
gcccggccaacatgtgcaagcacaa

SEQ ID NO: 551322 - DNA, 25 bp, Mus musculus
gcccggccatagatgcgccttttga

SEQ ID NO: 551323 - DNA, 25 bp, Mus musculus
gcccggccatagttgcgccttttga

SEQ ID NO: 551324 - DNA, 25 bp, Mus musculus
gcccggccggcaattgcagtgtaga

SEQ ID NO: 551325 - DNA, 25 bp, Mus musculus
gcccggccggcatttgcagtgtaga

SEQ ID NO: 551326 - DNA, 25 bp, Mus musculus
gcccggcctgggaagcaacgcatga

SEQ ID NO: 551327 - DNA, 25 bp, Mus musculus
gcccggcctgggtagcaacgcatga

SEQ ID NO: 551328 - DNA, 25 bp, Mus musculus
gcccggcgaacaactactacaaggt

SEQ ID NO: 551329 - DNA, 25 bp, Mus musculus
gcccggcgaacatctactacaaggt

SEQ ID NO: 551330 - DNA, 25 bp, Mus musculus
gcccggcgagtcagccatttaaaag

SEQ ID NO: 551331 - DNA, 25 bp, Mus musculus
gcccggcgagtctgccatttaaaag

SEQ ID NO: 551332 - DNA, 25 bp, Mus musculus
gcccggcgtgtcacattttttgtac

SEQ ID NO: 551333 - DNA, 25 bp, Mus musculus
gcccggcgtgtctcattttttgtac

SEQ ID NO: 551334 - DNA, 25 bp, Mus musculus
gcccggctaccaagctaacattttt

SEQ ID NO: 551335 - DNA, 25 bp, Mus musculus
gcccggctaccatgctaacattttt

SEQ ID NO: 551336 - DNA, 25 bp, Mus musculus
gcccggctacctcgatatgccagta

SEQ ID NO: 551337 - DNA, 25 bp, Mus musculus
gcccggctacctggatatgccagta

SEQ ID NO: 551338 - DNA, 25 bp, Mus musculus
gcccggctaggtaccatttcatttc

SEQ ID NO: 551339 - DNA, 25 bp, Mus musculus
gcccggctaggttccatttcatttc

SEQ ID NO: 551340 - DNA, 25 bp, Mus musculus
gcccggctctatattgtatcaggtc

SEQ ID NO: 551341 - DNA, 25 bp, Mus musculus
gcccggctctattttgtatcaggtc

SEQ ID NO: 551342 - DNA, 25 bp, Mus musculus
gcccggctggagacagagattgcca

SEQ ID NO: 551343 - DNA, 25 bp, Mus musculus
gcccggctggagtcagagattgcca

SEQ ID NO: 551344 - DNA, 25 bp, Mus musculus
gcccggcttagaaccttatttcatg

SEQ ID NO: 551345 - DNA, 25 bp, Mus musculus
gcccggcttagatccttatttcatg

SEQ ID NO: 551346 - DNA, 25 bp, Mus musculus
gcccggcttataactcattatgtag

SEQ ID NO: 551347 - DNA, 25 bp, Mus musculus
gcccggcttatatctcattatgtag

SEQ ID NO: 551348 - DNA, 25 bp, Mus musculus
gcccggcttcaaatgctttttaata

SEQ ID NO: 551349 - DNA, 25 bp, Mus musculus
gcccggcttcaacagttaccagaac

SEQ ID NO: 551350 - DNA, 25 bp, Mus musculus
gcccggcttcaagagttaccagaac

SEQ ID NO: 551351 - DNA, 25 bp, Mus musculus
gcccggcttcaattgctttttaata

SEQ ID NO: 551352 - DNA, 25 bp, Mus musculus
gcccggcttcggaatggattttgca

SEQ ID NO: 551353 - DNA, 25 bp, Mus musculus
gcccggcttcggtatggattttgca

SEQ ID NO: 551354 - DNA, 25 bp, Mus musculus
gcccggctttgtatcaggccaagag

SEQ ID NO: 551355 - DNA, 25 bp, Mus musculus
gcccggctttgtttcaggccaagag

SEQ ID NO: 551356 - DNA, 25 bp, Mus musculus
gcccgggaagtgctgcagttttctc

SEQ ID NO: 551357 - DNA, 25 bp, Mus musculus
gcccgggaagtggtgcagttttctc

SEQ ID NO: 551358 - DNA, 25 bp, Mus musculus
gcccgggatgccactggaatgcaga

SEQ ID NO: 551359 - DNA, 25 bp, Mus musculus
gcccgggatgcctctggaatgcaga

SEQ ID NO: 551360 - DNA, 25 bp, Mus musculus
gcccgggcaaacagacactgtttaa

SEQ ID NO: 551361 - DNA, 25 bp, Mus musculus
gcccgggcaaactgacactgtttaa

SEQ ID NO: 551362 - DNA, 25 bp, Mus musculus
gcccgggcgaggaccgaagcacaca

SEQ ID NO: 551363 - DNA, 25 bp, Mus musculus
gcccgggcgaggtccgaagcacaca

SEQ ID NO: 551364 - DNA, 25 bp, Mus musculus
gcccgggctgaaccgagaaaccgca

SEQ ID NO: 551365 - DNA, 25 bp, Mus musculus
gcccgggctgaagcgagaaaccgca

SEQ ID NO: 551366 - DNA, 25 bp, Mus musculus
gcccgggctgtcactctaggaatgc

SEQ ID NO: 551367 - DNA, 25 bp, Mus musculus
gcccgggctgtctctctaggaatgc

SEQ ID NO: 551368 - DNA, 25 bp, Mus musculus
gcccgggtgaagcaagtatctctga

SEQ ID NO: 551369 - DNA, 25 bp, Mus musculus
gcccgggtgaaggaagtatctctga

SEQ ID NO: 551370 - DNA, 25 bp, Mus musculus
gcccgggttttcagtttgagctata

SEQ ID NO: 551371 - DNA, 25 bp, Mus musculus
gcccgggttttctgtttgagctata

SEQ ID NO: 551372 - DNA, 25 bp, Mus musculus
gcccggtaaattataattggctcaa

SEQ ID NO: 551373 - DNA, 25 bp, Mus musculus
gcccggtaaattttaattggctcaa

SEQ ID NO: 551374 - DNA, 25 bp, Mus musculus
gcccggtaggccaagtgttatgtca

SEQ ID NO: 551375 - DNA, 25 bp, Mus musculus
gcccggtaggcctagtgttatgtca

SEQ ID NO: 551376 - DNA, 25 bp, Mus musculus
gcccggtagtccagcagacgtaaag

SEQ ID NO: 551377 - DNA, 25 bp, Mus musculus
gcccggtagtcctgcagacgtaaag

SEQ ID NO: 551378 - DNA, 25 bp, Mus musculus
gcccggtggaggctactaagctctt

SEQ ID NO: 551379 - DNA, 25 bp, Mus musculus
gcccggtggagggtactaagctctt

SEQ ID NO: 551380 - DNA, 25 bp, Mus musculus
gcccggttgagtactgatcttgttg

SEQ ID NO: 551381 - DNA, 25 bp, Mus musculus
gcccggttgagttctgatcttgttg

SEQ ID NO: 551382 - DNA, 25 bp, Mus musculus
gcccgtaacaatatgaggaggactt

SEQ ID NO: 551383 - DNA, 25 bp, Mus musculus
gcccgtaacaatttgaggaggactt

SEQ ID NO: 551384 - DNA, 25 bp, Mus musculus
gcccgtagatgtatttcctcatttt

SEQ ID NO: 551385 - DNA, 25 bp, Mus musculus
gcccgtagatgtttttcctcatttt

SEQ ID NO: 551386 - DNA, 25 bp, Mus musculus
gcccgtaggcttagtcagttttgac

SEQ ID NO: 551387 - DNA, 25 bp, Mus musculus
gcccgtaggctttgtcagttttgac

SEQ ID NO: 551388 - DNA, 25 bp, Mus musculus
gcccgtatgggcaactatgagacag

SEQ ID NO: 551389 - DNA, 25 bp, Mus musculus
gcccgtatgggctactatgagacag

SEQ ID NO: 551390 - DNA, 25 bp, Mus musculus
gcccgtcattctcaggacttctgaa

SEQ ID NO: 551391 - DNA, 25 bp, Mus musculus
gcccgtcattctgaggacttctgaa

SEQ ID NO: 551392 - DNA, 25 bp, Mus musculus
gcccgtcctcggcaaattatcaaca

SEQ ID NO: 551393 - DNA, 25 bp, Mus musculus
gcccgtcctcgggaaattatcaaca

SEQ ID NO: 551394 - DNA, 25 bp, Mus musculus
gcccgtccttgtacagggtggaaga

SEQ ID NO: 551395 - DNA, 25 bp, Mus musculus
gcccgtccttgttcagggtggaaga

SEQ ID NO: 551396 - DNA, 25 bp, Mus musculus
gcccgtcggcatactgggttaataa

SEQ ID NO: 551397 - DNA, 25 bp, Mus musculus
gcccgtcggcattctgggttaataa

SEQ ID NO: 551398 - DNA, 25 bp, Mus musculus
gcccgtctatagagttgaaatcgca

SEQ ID NO: 551399 - DNA, 25 bp, Mus musculus
gcccgtctatagtgttgaaatcgca

SEQ ID NO: 551400 - DNA, 25 bp, Mus musculus
gcccgtctgcacatctaaacttaga

SEQ ID NO: 551401 - DNA, 25 bp, Mus musculus
gcccgtctgcacttctaaacttaga

SEQ ID NO: 551402 - DNA, 25 bp, Mus musculus
gcccgtctgctcacagaaatccatg

SEQ ID NO: 551403 - DNA, 25 bp, Mus musculus
gcccgtctgctctcagaaatccatg

SEQ ID NO: 551404 - DNA, 25 bp, Mus musculus
gcccgtctggaccacaagtttgact

SEQ ID NO: 551405 - DNA, 25 bp, Mus musculus
gcccgtctggacgacaagtttgact

SEQ ID NO: 551406 - DNA, 25 bp, Mus musculus
gcccgtctgtacctctgctgaagta

SEQ ID NO: 551407 - DNA, 25 bp, Mus musculus
gcccgtctgtacgtctgctgaagta

SEQ ID NO: 551408 - DNA, 25 bp, Mus musculus
gcccgtgaaaatcccacatctattg

SEQ ID NO: 551409 - DNA, 25 bp, Mus musculus
gcccgtgaaaatgccacatctattg

SEQ ID NO: 551410 - DNA, 25 bp, Mus musculus
gcccgtgacttgctagaggtcccat

SEQ ID NO: 551411 - DNA, 25 bp, Mus musculus
gcccgtgacttggtagaggtcccat

SEQ ID NO: 551412 - DNA, 25 bp, Mus musculus
gcccgtgagtcacttcagaaaggaa

SEQ ID NO: 551413 - DNA, 25 bp, Mus musculus
gcccgtgagtcagttcagaaaggaa

SEQ ID NO: 551414 - DNA, 25 bp, Mus musculus
gcccgtgcacccacaatgaaaacag

SEQ ID NO: 551415 - DNA, 25 bp, Mus musculus
gcccgtgcaccctcaatgaaaacag

SEQ ID NO: 551416 - DNA, 25 bp, Mus musculus
gcccgtgcccctatattatacaaat

SEQ ID NO: 551417 - DNA, 25 bp, Mus musculus
gcccgtgcccctttattatacaaat

SEQ ID NO: 551418 - DNA, 25 bp, Mus musculus
gcccgtgcctttaacctgcaggcaa

SEQ ID NO: 551419 - DNA, 25 bp, Mus musculus
gcccgtgccttttacctgcaggcaa

SEQ ID NO: 551420 - DNA, 25 bp, Mus musculus
gcccgtgctccaagggaaggctgca

SEQ ID NO: 551421 - DNA, 25 bp, Mus musculus
gcccgtgctccatgggaaggctgca

SEQ ID NO: 551422 - DNA, 25 bp, Mus musculus
gcccgtgctgatagtcacgtatcac

SEQ ID NO: 551423 - DNA, 25 bp, Mus musculus
gcccgtgctgattgtcacgtatcac

SEQ ID NO: 551424 - DNA, 25 bp, Mus musculus
gcccgtgggctgattgatagagatt

SEQ ID NO: 551425 - DNA, 25 bp, Mus musculus
gcccgtgggctgtttgatagagatt

SEQ ID NO: 551426 - DNA, 25 bp, Mus musculus
gcccgtgggtgaatatcacactcgt

SEQ ID NO: 551427 - DNA, 25 bp, Mus musculus
gcccgtgggtgattatcacactcgt

SEQ ID NO: 551428 - DNA, 25 bp, Mus musculus
gcccgtgtagaaattgtatgctgaa

SEQ ID NO: 551429 - DNA, 25 bp, Mus musculus
gcccgtgtagaatttgtatgctgaa

SEQ ID NO: 551430 - DNA, 25 bp, Mus musculus
gcccgtgtagtgctggattccgtaa

SEQ ID NO: 551431 - DNA, 25 bp, Mus musculus
gcccgtgtagtggtggattccgtaa

SEQ ID NO: 551432 - DNA, 25 bp, Mus musculus
gcccgtgtcataaggctgtcattaa

SEQ ID NO: 551433 - DNA, 25 bp, Mus musculus
gcccgtgtcatatggctgtcattaa

SEQ ID NO: 551434 - DNA, 25 bp, Mus musculus
gcccgtgtcctacgagaacatttag

SEQ ID NO: 551435 - DNA, 25 bp, Mus musculus
gcccgtgtcctaggagaacatttag

SEQ ID NO: 551436 - DNA, 25 bp, Mus musculus
gcccgtgtgtttccactgtcaagaa

SEQ ID NO: 551437 - DNA, 25 bp, Mus musculus
gcccgtgtgtttgcactgtcaagaa

SEQ ID NO: 551438 - DNA, 25 bp, Mus musculus
gcccgttcagaaccacaatactttc

SEQ ID NO: 551439 - DNA, 25 bp, Mus musculus
gcccgttcagaagcacaatactttc

SEQ ID NO: 551440 - DNA, 25 bp, Mus musculus
gcccgttccagaaagaattcctaag

SEQ ID NO: 551441 - DNA, 25 bp, Mus musculus
gcccgttccagatagaattcctaag

SEQ ID NO: 551442 - DNA, 25 bp, Mus musculus
gcccgttctgatcatatgttctctt

SEQ ID NO: 551443 - DNA, 25 bp, Mus musculus
gcccgttctgatgatatgttctctt

SEQ ID NO: 551444 - DNA, 25 bp, Mus musculus
gcccgttggcaactaacttaatcat

SEQ ID NO: 551445 - DNA, 25 bp, Mus musculus
gcccgttggcaagtaacttaatcat

SEQ ID NO: 551446 - DNA, 25 bp, Mus musculus
gcccgtttgcatctccagtggtttt

SEQ ID NO: 551447 - DNA, 25 bp, Mus musculus
gcccgtttgcatgtccagtggtttt

SEQ ID NO: 551448 - DNA, 25 bp, Mus musculus
gcccgttttgtaccctgtaagctga

SEQ ID NO: 551449 - DNA, 25 bp, Mus musculus
gcccgttttgtagcctgtaagctga

SEQ ID NO: 551450 - DNA, 25 bp, Mus musculus
gccctaaaattcctgggcaggcaca

SEQ ID NO: 551451 - DNA, 25 bp, Mus musculus
gccctaaaattcgtgggcaggcaca

SEQ ID NO: 551452 - DNA, 25 bp, Mus musculus
gccctaaaccacaatcaagagaaaa

SEQ ID NO: 551453 - DNA, 25 bp, Mus musculus
gccctaaaccactatcaagagaaaa

SEQ ID NO: 551454 - DNA, 25 bp, Mus musculus
gccctaaacgtcaacagagatactt

SEQ ID NO: 551455 - DNA, 25 bp, Mus musculus
gccctaaacgtctacagagatactt

SEQ ID NO: 551456 - DNA, 25 bp, Mus musculus
gccctaaagccccatgtgtagtata

SEQ ID NO: 551457 - DNA, 25 bp, Mus musculus
gccctaaagcccgatgtgtagtata

SEQ ID NO: 551458 - DNA, 25 bp, Mus musculus
gccctaaaggccactccaaatagtt

SEQ ID NO: 551459 - DNA, 25 bp, Mus musculus
gccctaaaggcctctccaaatagtt

SEQ ID NO: 551460 - DNA, 25 bp, Mus musculus
gccctaaatgaacacctttctccaa

SEQ ID NO: 551461 - DNA, 25 bp, Mus musculus
gccctaaatgaagacctttctccaa

SEQ ID NO: 551462 - DNA, 25 bp, Mus musculus
gccctaacctagctatgaaatccag

SEQ ID NO: 551463 - DNA, 25 bp, Mus musculus
gccctaacctaggtatgaaatccag

SEQ ID NO: 551464 - DNA, 25 bp, Mus musculus
gccctaacgtgcattctataactaa

SEQ ID NO: 551465 - DNA, 25 bp, Mus musculus
gccctaacgtgctttctataactaa

SEQ ID NO: 551466 - DNA, 25 bp, Mus musculus
gccctaactagtctgggacttactg

SEQ ID NO: 551467 - DNA, 25 bp, Mus musculus
gccctaactagtgtgggacttactg

SEQ ID NO: 551468 - DNA, 25 bp, Mus musculus
gccctaagagcacaggagtcttcca

SEQ ID NO: 551469 - DNA, 25 bp, Mus musculus
gccctaagagcagaggagtcttcca

SEQ ID NO: 551470 - DNA, 25 bp, Mus musculus
gccctaagatgtacccatatgctgg

SEQ ID NO: 551471 - DNA, 25 bp, Mus musculus
gccctaagatgttcccatatgctgg

SEQ ID NO: 551472 - DNA, 25 bp, Mus musculus
gccctaagcaagaaagtgcctttca

SEQ ID NO: 551473 - DNA, 25 bp, Mus musculus
gccctaagcaagtaagtgcctttca

SEQ ID NO: 551474 - DNA, 25 bp, Mus musculus
gccctaatgataaaatccccttagc

SEQ ID NO: 551475 - DNA, 25 bp, Mus musculus
gccctaatgatataatccccttagc

SEQ ID NO: 551476 - DNA, 25 bp, Mus musculus
gccctacaatagatgcccatactgt

SEQ ID NO: 551477 - DNA, 25 bp, Mus musculus
gccctacaatagttgcccatactgt

SEQ ID NO: 551478 - DNA, 25 bp, Mus musculus
gccctacagaggcttcatgtgttta

SEQ ID NO: 551479 - DNA, 25 bp, Mus musculus
gccctacagagggttcatgtgttta

SEQ ID NO: 551480 - DNA, 25 bp, Mus musculus
gccctacatctgactggtggttgaa

SEQ ID NO: 551481 - DNA, 25 bp, Mus musculus
gccctacatctgtctggtggttgaa

SEQ ID NO: 551482 - DNA, 25 bp, Mus musculus
gccctacatggtctgatgctgcatt

SEQ ID NO: 551483 - DNA, 25 bp, Mus musculus
gccctacatggtgtgatgctgcatt

SEQ ID NO: 551484 - DNA, 25 bp, Mus musculus
gccctaccagcacgaggagatcatt

SEQ ID NO: 551485 - DNA, 25 bp, Mus musculus
gccctaccagcaggaggagatcatt

SEQ ID NO: 551486 - DNA, 25 bp, Mus musculus
gccctaccgggtctactttgtatga

SEQ ID NO: 551487 - DNA, 25 bp, Mus musculus
gccctaccgggtgtactttgtatga

SEQ ID NO: 551488 - DNA, 25 bp, Mus musculus
gccctacctttccagagcataaatg

SEQ ID NO: 551489 - DNA, 25 bp, Mus musculus
gccctacctttcgagagcataaatg

SEQ ID NO: 551490 - DNA, 25 bp, Mus musculus
gccctactgagtcttcctagaatgg

SEQ ID NO: 551491 - DNA, 25 bp, Mus musculus
gccctactgagtgttcctagaatgg

SEQ ID NO: 551492 - DNA, 25 bp, Mus musculus
gccctactggccaggacagtgtgca

SEQ ID NO: 551493 - DNA, 25 bp, Mus musculus
gccctactggcctggacagtgtgca

SEQ ID NO: 551494 - DNA, 25 bp, Mus musculus
gccctactggctcaggcccaaagat

SEQ ID NO: 551495 - DNA, 25 bp, Mus musculus
gccctactggctgaggcccaaagat

SEQ ID NO: 551496 - DNA, 25 bp, Mus musculus
gccctactgtcgcttgacatcatta

SEQ ID NO: 551497 - DNA, 25 bp, Mus musculus
gccctactgtcggttgacatcatta

SEQ ID NO: 551498 - DNA, 25 bp, Mus musculus
gccctactgtgtaggaatagaccgt

SEQ ID NO: 551499 - DNA, 25 bp, Mus musculus
gccctactgtgttggaatagaccgt

SEQ ID NO: 551500 - DNA, 25 bp, Mus musculus
gccctacttgctagtttataaaaat

SEQ ID NO: 551501 - DNA, 25 bp, Mus musculus
gccctacttgcttgtttataaaaat

SEQ ID NO: 551502 - DNA, 25 bp, Mus musculus
gccctacttggcatgacatctagac

SEQ ID NO: 551503 - DNA, 25 bp, Mus musculus
gccctacttggcttgacatctagac

SEQ ID NO: 551504 - DNA, 25 bp, Mus musculus
gccctacttgggacattcgagaatt

SEQ ID NO: 551505 - DNA, 25 bp, Mus musculus
gccctacttgggtcattcgagaatt

SEQ ID NO: 551506 - DNA, 25 bp, Mus musculus
gccctagaacctacagagccgaaag

SEQ ID NO: 551507 - DNA, 25 bp, Mus musculus
gccctagaaccttcagagccgaaag

SEQ ID NO: 551508 - DNA, 25 bp, Mus musculus
gccctagactcacaattgcaaatag

SEQ ID NO: 551509 - DNA, 25 bp, Mus musculus
gccctagactcagaattgcaaatag

SEQ ID NO: 551510 - DNA, 25 bp, Mus musculus
gccctagactttctctttcttttgg

SEQ ID NO: 551511 - DNA, 25 bp, Mus musculus
gccctagactttgtctttcttttgg

SEQ ID NO: 551512 - DNA, 25 bp, Mus musculus
gccctagagctaatcattcatggtt

SEQ ID NO: 551513 - DNA, 25 bp, Mus musculus
gccctagagctattcattcatggtt

SEQ ID NO: 551514 - DNA, 25 bp, Mus musculus
gccctagagggacgcttttgcttgt

SEQ ID NO: 551515 - DNA, 25 bp, Mus musculus
gccctagagggaggcttttgcttgt

SEQ ID NO: 551516 - DNA, 25 bp, Mus musculus
gccctagatcctcacttatttctaa

SEQ ID NO: 551517 - DNA, 25 bp, Mus musculus
gccctagatcctgacttatttctaa

SEQ ID NO: 551518 - DNA, 25 bp, Mus musculus
gccctagcaatgatttcttgttgta

SEQ ID NO: 551519 - DNA, 25 bp, Mus musculus
gccctagcaatgttttcttgttgta

SEQ ID NO: 551520 - DNA, 25 bp, Mus musculus
gccctagcaccaaccggaagttttt

SEQ ID NO: 551521 - DNA, 25 bp, Mus musculus
gccctagcaccatccggaagttttt

SEQ ID NO: 551522 - DNA, 25 bp, Mus musculus
gccctagcctacattttccaaatat

SEQ ID NO: 551523 - DNA, 25 bp, Mus musculus
gccctagcctactttttccaaatat

SEQ ID NO: 551524 - DNA, 25 bp, Mus musculus
gccctagctcatagattctttttca

SEQ ID NO: 551525 - DNA, 25 bp, Mus musculus
gccctagctcattgattctttttca

SEQ ID NO: 551526 - DNA, 25 bp, Mus musculus
gccctagctttgcacatgatggagt

SEQ ID NO: 551527 - DNA, 25 bp, Mus musculus
gccctagctttggacatgatggagt

SEQ ID NO: 551528 - DNA, 25 bp, Mus musculus
gccctaggaaagagtttctcaacct

SEQ ID NO: 551529 - DNA, 25 bp, Mus musculus
gccctaggaaagtgtttctcaacct

SEQ ID NO: 551530 - DNA, 25 bp, Mus musculus
gccctaggcaatcgttgttctcttt

SEQ ID NO: 551531 - DNA, 25 bp, Mus musculus
gccctaggcaatggttgttctcttt

SEQ ID NO: 551532 - DNA, 25 bp, Mus musculus
gccctaggcagcctgaaacagctgg

SEQ ID NO: 551533 - DNA, 25 bp, Mus musculus
gccctaggcagcgtgaaacagctgg

SEQ ID NO: 551534 - DNA, 25 bp, Mus musculus
gccctaggctaaactattggcatcc

SEQ ID NO: 551535 - DNA, 25 bp, Mus musculus
gccctaggctaatctattggcatcc

SEQ ID NO: 551536 - DNA, 25 bp, Mus musculus
gccctaggcttgagatttcatctgc

SEQ ID NO: 551537 - DNA, 25 bp, Mus musculus
gccctaggcttgagcgatgcaatca

SEQ ID NO: 551538 - DNA, 25 bp, Mus musculus
gccctaggcttgtgatttcatctgc

SEQ ID NO: 551539 - DNA, 25 bp, Mus musculus
gccctaggcttgtgcgatgcaatca

SEQ ID NO: 551540 - DNA, 25 bp, Mus musculus
gccctagtattcctaaagtcctttg

SEQ ID NO: 551541 - DNA, 25 bp, Mus musculus
gccctagtattcgtaaagtcctttg

SEQ ID NO: 551542 - DNA, 25 bp, Mus musculus
gccctagtcctgaggttttgtctgt

SEQ ID NO: 551543 - DNA, 25 bp, Mus musculus
gccctagtcctgtggttttgtctgt

SEQ ID NO: 551544 - DNA, 25 bp, Mus musculus
gccctagtcttaatcatctttgtct

SEQ ID NO: 551545 - DNA, 25 bp, Mus musculus
gccctagtcttattcatctttgtct

SEQ ID NO: 551546 - DNA, 25 bp, Mus musculus
gccctagttactagctgtatattaa

SEQ ID NO: 551547 - DNA, 25 bp, Mus musculus
gccctagttacttgctgtatattaa

SEQ ID NO: 551548 - DNA, 25 bp, Mus musculus
gccctagttcatagaccaaaggact

SEQ ID NO: 551549 - DNA, 25 bp, Mus musculus
gccctagttcattgaccaaaggact

SEQ ID NO: 551550 - DNA, 25 bp, Mus musculus
gccctagttgtacgtggcgacacta

SEQ ID NO: 551551 - DNA, 25 bp, Mus musculus
gccctagttgtaggtggcgacacta

SEQ ID NO: 551552 - DNA, 25 bp, Mus musculus
gccctataactaaccctctgaagag

SEQ ID NO: 551553 - DNA, 25 bp, Mus musculus
gccctataactatccctctgaagag

SEQ ID NO: 551554 - DNA, 25 bp, Mus musculus
gccctataagaacgccgctcggtgc

SEQ ID NO: 551555 - DNA, 25 bp, Mus musculus
gccctataagaaggccgctcggtgc

SEQ ID NO: 551556 - DNA, 25 bp, Mus musculus
gccctatacggacgctgtaatccat

SEQ ID NO: 551557 - DNA, 25 bp, Mus musculus
gccctatacggaggctgtaatccat

SEQ ID NO: 551558 - DNA, 25 bp, Mus musculus
gccctatacttgaaccttaaggctt

SEQ ID NO: 551559 - DNA, 25 bp, Mus musculus
gccctatacttgtaccttaaggctt

SEQ ID NO: 551560 - DNA, 25 bp, Mus musculus
gccctatatattaactgtaggcccc

SEQ ID NO: 551561 - DNA, 25 bp, Mus musculus
gccctatatatttactgtaggcccc

SEQ ID NO: 551562 - DNA, 25 bp, Mus musculus
gccctatccttacggcaggcgttat

SEQ ID NO: 551563 - DNA, 25 bp, Mus musculus
gccctatccttagggcaggcgttat

SEQ ID NO: 551564 - DNA, 25 bp, Mus musculus
gccctatccttgagaatttaccatt

SEQ ID NO: 551565 - DNA, 25 bp, Mus musculus
gccctatccttgtgaatttaccatt

SEQ ID NO: 551566 - DNA, 25 bp, Mus musculus
gccctatgagaacaaagctgccaag

SEQ ID NO: 551567 - DNA, 25 bp, Mus musculus
gccctatgagaagaaagctgccaag

SEQ ID NO: 551568 - DNA, 25 bp, Mus musculus
gccctatgatccaggcagaggttaa

SEQ ID NO: 551569 - DNA, 25 bp, Mus musculus
gccctatgatcctggcagaggttaa

SEQ ID NO: 551570 - DNA, 25 bp, Mus musculus
gccctatgccttctcacagttctgg

SEQ ID NO: 551571 - DNA, 25 bp, Mus musculus
gccctatgccttgtcacagttctgg

SEQ ID NO: 551572 - DNA, 25 bp, Mus musculus
gccctatgggcactcaagctggatg

SEQ ID NO: 551573 - DNA, 25 bp, Mus musculus
gccctatgggcagtcaagctggatg

SEQ ID NO: 551574 - DNA, 25 bp, Mus musculus
gccctatggttgactatcagcacag

SEQ ID NO: 551575 - DNA, 25 bp, Mus musculus
gccctatggttgtctatcagcacag

SEQ ID NO: 551576 - DNA, 25 bp, Mus musculus
gccctatgtggcagtctttgaccgt

SEQ ID NO: 551577 - DNA, 25 bp, Mus musculus
gccctatgtggctgtctttgaccgt

SEQ ID NO: 551578 - DNA, 25 bp, Mus musculus
gccctattacttagccgcagaactt

SEQ ID NO: 551579 - DNA, 25 bp, Mus musculus
gccctattactttgccgcagaactt

SEQ ID NO: 551580 - DNA, 25 bp, Mus musculus
gccctcaaagagctcagcatttcag

SEQ ID NO: 551581 - DNA, 25 bp, Mus musculus
gccctcaaagaggtcagcatttcag

SEQ ID NO: 551582 - DNA, 25 bp, Mus musculus
gccctcaagagccttcacaatagtt

SEQ ID NO: 551583 - DNA, 25 bp, Mus musculus
gccctcaagagcgttcacaatagtt

SEQ ID NO: 551584 - DNA, 25 bp, Mus musculus
gccctcaagatgagtgatctctcgg

SEQ ID NO: 551585 - DNA, 25 bp, Mus musculus
gccctcaagatgtgtgatctctcgg

SEQ ID NO: 551586 - DNA, 25 bp, Mus musculus
gccctcacagctaacatttcttata

SEQ ID NO: 551587 - DNA, 25 bp, Mus musculus
gccctcacagcttacatttcttata

SEQ ID NO: 551588 - DNA, 25 bp, Mus musculus
gccctcaccgaacagatgctgctga

SEQ ID NO: 551589 - DNA, 25 bp, Mus musculus
gccctcaccgaagagatgctgctga

SEQ ID NO: 551590 - DNA, 25 bp, Mus musculus
gccctcacctctaagaccaataaaa

SEQ ID NO: 551591 - DNA, 25 bp, Mus musculus
gccctcacctcttagaccaataaaa

SEQ ID NO: 551592 - DNA, 25 bp, Mus musculus
gccctcacctgacttgtacattttt

SEQ ID NO: 551593 - DNA, 25 bp, Mus musculus
gccctcacctgagttgtacattttt

SEQ ID NO: 551594 - DNA, 25 bp, Mus musculus
gccctcactgagctgtagtctggtt

SEQ ID NO: 551595 - DNA, 25 bp, Mus musculus
gccctcactgaggtgtagtctggtt

SEQ ID NO: 551596 - DNA, 25 bp, Mus musculus
gccctcactggcactacagagttaa

SEQ ID NO: 551597 - DNA, 25 bp, Mus musculus
gccctcactggctctacagagttaa

SEQ ID NO: 551598 - DNA, 25 bp, Mus musculus
gccctcagacatagcagacatcgac

SEQ ID NO: 551599 - DNA, 25 bp, Mus musculus
gccctcagacattgcagacatcgac

SEQ ID NO: 551600 - DNA, 25 bp, Mus musculus
gccctcagaggtcctcttaattcat

SEQ ID NO: 551601 - DNA, 25 bp, Mus musculus
gccctcagaggtgctcttaattcat

SEQ ID NO: 551602 - DNA, 25 bp, Mus musculus
gccctcagattcaatagactagttt

SEQ ID NO: 551603 - DNA, 25 bp, Mus musculus
gccctcagattctatagactagttt

SEQ ID NO: 551604 - DNA, 25 bp, Mus musculus
gccctcagcagtatctagagaacca

SEQ ID NO: 551605 - DNA, 25 bp, Mus musculus
gccctcagcagtttctagagaacca

SEQ ID NO: 551606 - DNA, 25 bp, Mus musculus
gccctcagcatcactttgaacagaa

SEQ ID NO: 551607 - DNA, 25 bp, Mus musculus
gccctcagcatctctttgaacagaa

SEQ ID NO: 551608 - DNA, 25 bp, Mus musculus
gccctcagccagattgtttatgttg

SEQ ID NO: 551609 - DNA, 25 bp, Mus musculus
gccctcagccagtttgtttatgttg

SEQ ID NO: 551610 - DNA, 25 bp, Mus musculus
gccctcagcccaaaaccaaatgtga

SEQ ID NO: 551611 - DNA, 25 bp, Mus musculus
gccctcagcccataaccaaatgtga

SEQ ID NO: 551612 - DNA, 25 bp, Mus musculus
gccctcaggcttcgctatgaaaagt

SEQ ID NO: 551613 - DNA, 25 bp, Mus musculus
gccctcaggcttggctatgaaaagt

SEQ ID NO: 551614 - DNA, 25 bp, Mus musculus
gccctcaggtggcattacttacaca

SEQ ID NO: 551615 - DNA, 25 bp, Mus musculus
gccctcaggtgggattacttacaca

SEQ ID NO: 551616 - DNA, 25 bp, Mus musculus
gccctcagtcctagtatttctcttt

SEQ ID NO: 551617 - DNA, 25 bp, Mus musculus
gccctcagtccttgtatttctcttt

SEQ ID NO: 551618 - DNA, 25 bp, Mus musculus
gccctcagtgcaaggatcattcaat

SEQ ID NO: 551619 - DNA, 25 bp, Mus musculus
gccctcagtgcatggatcattcaat

SEQ ID NO: 551620 - DNA, 25 bp, Mus musculus
gccctcataagtcagtcatgggtat

SEQ ID NO: 551621 - DNA, 25 bp, Mus musculus
gccctcataagtgagtcatgggtat

SEQ ID NO: 551622 - DNA, 25 bp, Mus musculus
gccctcatcgccatgatggcatgga

SEQ ID NO: 551623 - DNA, 25 bp, Mus musculus
gccctcatcgccttgatggcatgga

SEQ ID NO: 551624 - DNA, 25 bp, Mus musculus
gccctcatctcaatttgtaccaaaa

SEQ ID NO: 551625 - DNA, 25 bp, Mus musculus
gccctcatctcattttgtaccaaaa

SEQ ID NO: 551626 - DNA, 25 bp, Mus musculus
gccctcatgctgcagtattacgtgc

SEQ ID NO: 551627 - DNA, 25 bp, Mus musculus
gccctcatgctggagtattacgtgc

SEQ ID NO: 551628 - DNA, 25 bp, Mus musculus
gccctcatggctactttgtatgtga

SEQ ID NO: 551629 - DNA, 25 bp, Mus musculus
gccctcatggcttctttgtatgtga

SEQ ID NO: 551630 - DNA, 25 bp, Mus musculus
gccctcatgtcgctagcagacactt

SEQ ID NO: 551631 - DNA, 25 bp, Mus musculus
gccctcatgtcggtagcagacactt

SEQ ID NO: 551632 - DNA, 25 bp, Mus musculus
gccctcattagtctctggcagaagt

SEQ ID NO: 551633 - DNA, 25 bp, Mus musculus
gccctcattagtgtctggcagaagt

SEQ ID NO: 551634 - DNA, 25 bp, Mus musculus
gccctcattcccacttaaatcaaag

SEQ ID NO: 551635 - DNA, 25 bp, Mus musculus
gccctcattccctcttaaatcaaag

SEQ ID NO: 551636 - DNA, 25 bp, Mus musculus
gccctcattgatacagcgtgaatta

SEQ ID NO: 551637 - DNA, 25 bp, Mus musculus
gccctcattgattcagcgtgaatta

SEQ ID NO: 551638 - DNA, 25 bp, Mus musculus
gccctccaaataccatagccagagt

SEQ ID NO: 551639 - DNA, 25 bp, Mus musculus
gccctccaaatagcatagccagagt

SEQ ID NO: 551640 - DNA, 25 bp, Mus musculus
gccctccaaatccaacggagatgaa

SEQ ID NO: 551641 - DNA, 25 bp, Mus musculus
gccctccaaatcgaacggagatgaa

SEQ ID NO: 551642 - DNA, 25 bp, Mus musculus
gccctccaagctagaaggctctgaa

SEQ ID NO: 551643 - DNA, 25 bp, Mus musculus
gccctccaagcttgaaggctctgaa

SEQ ID NO: 551644 - DNA, 25 bp, Mus musculus
gccctccacagaagatttctatgac

SEQ ID NO: 551645 - DNA, 25 bp, Mus musculus
gccctccacagatgatttctatgac

SEQ ID NO: 551646 - DNA, 25 bp, Mus musculus
gccctccagctactcttgaaactaa

SEQ ID NO: 551647 - DNA, 25 bp, Mus musculus
gccctccagctagtcttgaaactaa

SEQ ID NO: 551648 - DNA, 25 bp, Mus musculus
gccctccagctcagtaggtattagc

SEQ ID NO: 551649 - DNA, 25 bp, Mus musculus
gccctccagctctgtaggtattagc

SEQ ID NO: 551650 - DNA, 25 bp, Mus musculus
gccctccatcagatcagttgcgaga

SEQ ID NO: 551651 - DNA, 25 bp, Mus musculus
gccctccatcagttcagttgcgaga

SEQ ID NO: 551652 - DNA, 25 bp, Mus musculus
gccctccatggcctcgctcctgtgc

SEQ ID NO: 551653 - DNA, 25 bp, Mus musculus
gccctccatggcgtcgctcctgtgc

SEQ ID NO: 551654 - DNA, 25 bp, Mus musculus
gccctccattacacatttctttttt

SEQ ID NO: 551655 - DNA, 25 bp, Mus musculus
gccctccattactcatttctttttt

SEQ ID NO: 551656 - DNA, 25 bp, Mus musculus
gccctccccataattagcttttgta

SEQ ID NO: 551657 - DNA, 25 bp, Mus musculus
gccctccccatatttagcttttgta

SEQ ID NO: 551658 - DNA, 25 bp, Mus musculus
gccctcccctagagatttttggaag

SEQ ID NO: 551659 - DNA, 25 bp, Mus musculus
gccctcccctagtgatttttggaag

SEQ ID NO: 551660 - DNA, 25 bp, Mus musculus
gccctccgagctctgagtgtgacaa

SEQ ID NO: 551661 - DNA, 25 bp, Mus musculus
gccctccgagctgtgagtgtgacaa

SEQ ID NO: 551662 - DNA, 25 bp, Mus musculus
gccctccgtctgatgaattgctaat

SEQ ID NO: 551663 - DNA, 25 bp, Mus musculus
gccctccgtctgttgaattgctaat

SEQ ID NO: 551664 - DNA, 25 bp, Mus musculus
gccctccgtgacctaggcaggaaag

SEQ ID NO: 551665 - DNA, 25 bp, Mus musculus
gccctccgtgacgtaggcaggaaag

SEQ ID NO: 551666 - DNA, 25 bp, Mus musculus
gccctcctagcaagttatattttgt

SEQ ID NO: 551667 - DNA, 25 bp, Mus musculus
gccctcctagcatgttatattttgt

SEQ ID NO: 551668 - DNA, 25 bp, Mus musculus
gccctcctagttccaggcattaaag

SEQ ID NO: 551669 - DNA, 25 bp, Mus musculus
gccctcctagttgcaggcattaaag

SEQ ID NO: 551670 - DNA, 25 bp, Mus musculus
gccctcctccagaaaatcattatta

SEQ ID NO: 551671 - DNA, 25 bp, Mus musculus
gccctcctccagtaaatcattatta

SEQ ID NO: 551672 - DNA, 25 bp, Mus musculus
gccctcctcccaagaatgtagtatt

SEQ ID NO: 551673 - DNA, 25 bp, Mus musculus
gccctcctcccatgaatgtagtatt

SEQ ID NO: 551674 - DNA, 25 bp, Mus musculus
gccctcctcctaagatgcagatttg

SEQ ID NO: 551675 - DNA, 25 bp, Mus musculus
gccctcctcctatgatgcagatttg

SEQ ID NO: 551676 - DNA, 25 bp, Mus musculus
gccctcctgaggacatggttatttt

SEQ ID NO: 551677 - DNA, 25 bp, Mus musculus
gccctcctgaggtcatggttatttt

SEQ ID NO: 551678 - DNA, 25 bp, Mus musculus
gccctcctgcatcaagacatatgtg

SEQ ID NO: 551679 - DNA, 25 bp, Mus musculus
gccctcctgcatgaagacatatgtg

SEQ ID NO: 551680 - DNA, 25 bp, Mus musculus
gccctcctgctacgtttagtctaag

SEQ ID NO: 551681 - DNA, 25 bp, Mus musculus
gccctcctgctaggtttagtctaag

SEQ ID NO: 551682 - DNA, 25 bp, Mus musculus
gccctcctggaaagcaatcagcaaa

SEQ ID NO: 551683 - DNA, 25 bp, Mus musculus
gccctcctggaatgcaatcagcaaa

SEQ ID NO: 551684 - DNA, 25 bp, Mus musculus
gccctcctggcaagtgattgattat

SEQ ID NO: 551685 - DNA, 25 bp, Mus musculus
gccctcctggcatgtgattgattat

SEQ ID NO: 551686 - DNA, 25 bp, Mus musculus
gccctcctgggtcatgctgtggtta

SEQ ID NO: 551687 - DNA, 25 bp, Mus musculus
gccctcctgggtgatgctgtggtta

SEQ ID NO: 551688 - DNA, 25 bp, Mus musculus
gccctcctgtttcatttagcaatca

SEQ ID NO: 551689 - DNA, 25 bp, Mus musculus
gccctcctgtttgatttagcaatca

SEQ ID NO: 551690 - DNA, 25 bp, Mus musculus
gccctccttgctctatttatcataa

SEQ ID NO: 551691 - DNA, 25 bp, Mus musculus
gccctccttgctgtatttatcataa

SEQ ID NO: 551692 - DNA, 25 bp, Mus musculus
gccctcgaatagagagcttcctgga

SEQ ID NO: 551693 - DNA, 25 bp, Mus musculus
gccctcgaatagtgagcttcctgga

SEQ ID NO: 551694 - DNA, 25 bp, Mus musculus
gccctcgacccaagcagaagtaagt

SEQ ID NO: 551695 - DNA, 25 bp, Mus musculus
gccctcgacccatgcagaagtaagt

SEQ ID NO: 551696 - DNA, 25 bp, Mus musculus
gccctcgagaggcacgacttcgaga

SEQ ID NO: 551697 - DNA, 25 bp, Mus musculus
gccctcgagagggacgacttcgaga

SEQ ID NO: 551698 - DNA, 25 bp, Mus musculus
gccctcgagttgattggattgttcc

SEQ ID NO: 551699 - DNA, 25 bp, Mus musculus
gccctcgagttgtttggattgttcc

SEQ ID NO: 551700 - DNA, 25 bp, Mus musculus
gccctcgccatgcttgatatcaagg

SEQ ID NO: 551701 - DNA, 25 bp, Mus musculus
gccctcgccatggttgatatcaagg

SEQ ID NO: 551702 - DNA, 25 bp, Mus musculus
gccctcgctcaaagtgcactacagc

SEQ ID NO: 551703 - DNA, 25 bp, Mus musculus
gccctcgctcaatgtgcactacagc

SEQ ID NO: 551704 - DNA, 25 bp, Mus musculus
gccctcgggaaacttaagctcagta

SEQ ID NO: 551705 - DNA, 25 bp, Mus musculus
gccctcgggaaagttaagctcagta

SEQ ID NO: 551706 - DNA, 25 bp, Mus musculus
gccctcgtagtgattgtatcgtatt

SEQ ID NO: 551707 - DNA, 25 bp, Mus musculus
gccctcgtagtgtttgtatcgtatt

SEQ ID NO: 551708 - DNA, 25 bp, Mus musculus
gccctcgtccggcagatccgtaaga

SEQ ID NO: 551709 - DNA, 25 bp, Mus musculus
gccctcgtccgggagatccgtaaga

SEQ ID NO: 551710 - DNA, 25 bp, Mus musculus
gccctcgtgcctcgatttcaaatgt

SEQ ID NO: 551711 - DNA, 25 bp, Mus musculus
gccctcgtgcctggatttcaaatgt

SEQ ID NO: 551712 - DNA, 25 bp, Mus musculus
gccctcgtggctcgtttgtataaac

SEQ ID NO: 551713 - DNA, 25 bp, Mus musculus
gccctcgtggctggtttgtataaac

SEQ ID NO: 551714 - DNA, 25 bp, Mus musculus
gccctcgttagaaagcggccgtgag

SEQ ID NO: 551715 - DNA, 25 bp, Mus musculus
gccctcgttagatagcggccgtgag

SEQ ID NO: 551716 - DNA, 25 bp, Mus musculus
gccctctaacttaagcacatgcatg

SEQ ID NO: 551717 - DNA, 25 bp, Mus musculus
gccctctaactttagcacatgcatg

SEQ ID NO: 551718 - DNA, 25 bp, Mus musculus
gccctctacaccatgaactgattaa

SEQ ID NO: 551719 - DNA, 25 bp, Mus musculus
gccctctacaccttgaactgattaa

SEQ ID NO: 551720 - DNA, 25 bp, Mus musculus
gccctctaccacaatatgccaaaaa

SEQ ID NO: 551721 - DNA, 25 bp, Mus musculus
gccctctaccactatatgccaaaaa

SEQ ID NO: 551722 - DNA, 25 bp, Mus musculus
gccctctatgacatcactgaaggat

SEQ ID NO: 551723 - DNA, 25 bp, Mus musculus
gccctctatgacttcactgaaggat

SEQ ID NO: 551724 - DNA, 25 bp, Mus musculus
gccctctatttccttgtggtaccga

SEQ ID NO: 551725 - DNA, 25 bp, Mus musculus
gccctctatttcgttgtggtaccga

SEQ ID NO: 551726 - DNA, 25 bp, Mus musculus
gccctctcacgtagctgcaatgata

SEQ ID NO: 551727 - DNA, 25 bp, Mus musculus
gccctctcacgttgctgcaatgata

SEQ ID NO: 551728 - DNA, 25 bp, Mus musculus
gccctctcaggcattgtatcttttg

SEQ ID NO: 551729 - DNA, 25 bp, Mus musculus
gccctctcaggctttgtatcttttg

SEQ ID NO: 551730 - DNA, 25 bp, Mus musculus
gccctctccaccagaatggtatgga

SEQ ID NO: 551731 - DNA, 25 bp, Mus musculus
gccctctccacctgaatggtatgga

SEQ ID NO: 551732 - DNA, 25 bp, Mus musculus
gccctctccattcgctcttagagaa

SEQ ID NO: 551733 - DNA, 25 bp, Mus musculus
gccctctccattggctcttagagaa

SEQ ID NO: 551734 - DNA, 25 bp, Mus musculus
gccctctcctcaatggcattgggaa

SEQ ID NO: 551735 - DNA, 25 bp, Mus musculus
gccctctcctcattggcattgggaa

SEQ ID NO: 551736 - DNA, 25 bp, Mus musculus
gccctctcgattagccgaggtgagt

SEQ ID NO: 551737 - DNA, 25 bp, Mus musculus
gccctctcgatttgccgaggtgagt

SEQ ID NO: 551738 - DNA, 25 bp, Mus musculus
gccctctctcttaaatcactttatt

SEQ ID NO: 551739 - DNA, 25 bp, Mus musculus
gccctctctctttaatcactttatt

SEQ ID NO: 551740 - DNA, 25 bp, Mus musculus
gccctctgctgtagattctgtttcc

SEQ ID NO: 551741 - DNA, 25 bp, Mus musculus
gccctctgctgttgattctgtttcc

SEQ ID NO: 551742 - DNA, 25 bp, Mus musculus
gccctctggctcaggaggaagcagc

SEQ ID NO: 551743 - DNA, 25 bp, Mus musculus
gccctctggctctggaggaagcagc

SEQ ID NO: 551744 - DNA, 25 bp, Mus musculus
gccctctgggatagtgccaaggctt

SEQ ID NO: 551745 - DNA, 25 bp, Mus musculus
gccctctgggattgtgccaaggctt

SEQ ID NO: 551746 - DNA, 25 bp, Mus musculus
gccctctggtccaacaggactctga

SEQ ID NO: 551747 - DNA, 25 bp, Mus musculus
gccctctggtcctacaggactctga

SEQ ID NO: 551748 - DNA, 25 bp, Mus musculus
gccctctgtatcaagtaaactcacc

SEQ ID NO: 551749 - DNA, 25 bp, Mus musculus
gccctctgtatctagtaaactcacc

SEQ ID NO: 551750 - DNA, 25 bp, Mus musculus
gccctcttatctatgttgcatctat

SEQ ID NO: 551751 - DNA, 25 bp, Mus musculus
gccctcttatctttgttgcatctat

SEQ ID NO: 551752 - DNA, 25 bp, Mus musculus
gccctcttcaggagtcttctaaaga

SEQ ID NO: 551753 - DNA, 25 bp, Mus musculus
gccctcttcaggtgtcttctaaaga

SEQ ID NO: 551754 - DNA, 25 bp, Mus musculus
gccctcttcattatttgagactgga

SEQ ID NO: 551755 - DNA, 25 bp, Mus musculus
gccctcttcattttttgagactgga

SEQ ID NO: 551756 - DNA, 25 bp, Mus musculus
gccctcttgaatactgttctatcct

SEQ ID NO: 551757 - DNA, 25 bp, Mus musculus
gccctcttgaatacttgcttttaag

SEQ ID NO: 551758 - DNA, 25 bp, Mus musculus
gccctcttgaattctgttctatcct

SEQ ID NO: 551759 - DNA, 25 bp, Mus musculus
gccctcttgaattcttgcttttaag

SEQ ID NO: 551760 - DNA, 25 bp, Mus musculus
gccctcttgtctcccagaagggaaa

SEQ ID NO: 551761 - DNA, 25 bp, Mus musculus
gccctcttgtctgccagaagggaaa

SEQ ID NO: 551762 - DNA, 25 bp, Mus musculus
gccctctttagcaggactattctga

SEQ ID NO: 551763 - DNA, 25 bp, Mus musculus
gccctctttagctggactattctga

SEQ ID NO: 551764 - DNA, 25 bp, Mus musculus
gccctctttctgatgcctgtagaag

SEQ ID NO: 551765 - DNA, 25 bp, Mus musculus
gccctctttctgttgcctgtagaag

SEQ ID NO: 551766 - DNA, 25 bp, Mus musculus
gccctctttggcctgtgggatatga

SEQ ID NO: 551767 - DNA, 25 bp, Mus musculus
gccctctttggcgtgtgggatatga

SEQ ID NO: 551768 - DNA, 25 bp, Mus musculus
gccctgaactgtatgcactaagtca

SEQ ID NO: 551769 - DNA, 25 bp, Mus musculus
gccctgaactgtttgcactaagtca

SEQ ID NO: 551770 - DNA, 25 bp, Mus musculus
gccctgaagaatcctccctgtgtga

SEQ ID NO: 551771 - DNA, 25 bp, Mus musculus
gccctgaagaatgctccctgtgtga

SEQ ID NO: 551772 - DNA, 25 bp, Mus musculus
gccctgaatgctcgattcttaagca

SEQ ID NO: 551773 - DNA, 25 bp, Mus musculus
gccctgaatgctggattcttaagca

SEQ ID NO: 551774 - DNA, 25 bp, Mus musculus
gccctgaccaagaaattgcttcctg

SEQ ID NO: 551775 - DNA, 25 bp, Mus musculus
gccctgaccaagtaattgcttcctg

SEQ ID NO: 551776 - DNA, 25 bp, Mus musculus
gccctgaccattcgtcttcgaaaga

SEQ ID NO: 551777 - DNA, 25 bp, Mus musculus
gccctgaccattggtcttcgaaaga

SEQ ID NO: 551778 - DNA, 25 bp, Mus musculus
gccctgacccctcatacaaggataa

SEQ ID NO: 551779 - DNA, 25 bp, Mus musculus
gccctgacccctgatacaaggataa

SEQ ID NO: 551780 - DNA, 25 bp, Mus musculus
gccctgacctccaccaggttttaga

SEQ ID NO: 551781 - DNA, 25 bp, Mus musculus
gccctgacctcctccaggttttaga

SEQ ID NO: 551782 - DNA, 25 bp, Mus musculus
gccctgacgctgaagcagttcatga

SEQ ID NO: 551783 - DNA, 25 bp, Mus musculus
gccctgacgctgtagcagttcatga

SEQ ID NO: 551784 - DNA, 25 bp, Mus musculus
gccctgactgataggcagccgattg

SEQ ID NO: 551785 - DNA, 25 bp, Mus musculus
gccctgactgattggcagccgattg

SEQ ID NO: 551786 - DNA, 25 bp, Mus musculus
gccctgacttccctgtattacatat

SEQ ID NO: 551787 - DNA, 25 bp, Mus musculus
gccctgacttccgtgtattacatat

SEQ ID NO: 551788 - DNA, 25 bp, Mus musculus
gccctgacttgcctttagttcactt

SEQ ID NO: 551789 - DNA, 25 bp, Mus musculus
gccctgacttgcgtttagttcactt

SEQ ID NO: 551790 - DNA, 25 bp, Mus musculus
gccctgagacttctgttctgattca

SEQ ID NO: 551791 - DNA, 25 bp, Mus musculus
gccctgagacttgtgttctgattca

SEQ ID NO: 551792 - DNA, 25 bp, Mus musculus
gccctgaggaccaaggtgagcctgt

SEQ ID NO: 551793 - DNA, 25 bp, Mus musculus
gccctgaggacctaggtgagcctgt

SEQ ID NO: 551794 - DNA, 25 bp, Mus musculus
gccctgaggataccaaagcagtctc

SEQ ID NO: 551795 - DNA, 25 bp, Mus musculus
gccctgaggatagcaaagcagtctc

SEQ ID NO: 551796 - DNA, 25 bp, Mus musculus
gccctgaggcggcactctatgagaa

SEQ ID NO: 551797 - DNA, 25 bp, Mus musculus
gccctgaggcgggactctatgagaa

SEQ ID NO: 551798 - DNA, 25 bp, Mus musculus
gccctgaggctccatgatgttaaat

SEQ ID NO: 551799 - DNA, 25 bp, Mus musculus
gccctgaggctcgatgatgttaaat

SEQ ID NO: 551800 - DNA, 25 bp, Mus musculus
gccctgaggctgatcaatagctttt

SEQ ID NO: 551801 - DNA, 25 bp, Mus musculus
gccctgaggctgttcaatagctttt

SEQ ID NO: 551802 - DNA, 25 bp, Mus musculus
gccctgagtcctaggaggtatgagt

SEQ ID NO: 551803 - DNA, 25 bp, Mus musculus
gccctgagtccttggaggtatgagt

SEQ ID NO: 551804 - DNA, 25 bp, Mus musculus
gccctgagtggcctgtagcactgaa

SEQ ID NO: 551805 - DNA, 25 bp, Mus musculus
gccctgagtggcgtgtagcactgaa

SEQ ID NO: 551806 - DNA, 25 bp, Mus musculus
gccctgagtgtgacccaaggctgag

SEQ ID NO: 551807 - DNA, 25 bp, Mus musculus
gccctgagtgtgtcccaaggctgag

SEQ ID NO: 551808 - DNA, 25 bp, Mus musculus
gccctgatccttactttgtgcaaaa

SEQ ID NO: 551809 - DNA, 25 bp, Mus musculus
gccctgatcctttctttgtgcaaaa

SEQ ID NO: 551810 - DNA, 25 bp, Mus musculus
gccctgatgaggaaaatccaaacag

SEQ ID NO: 551811 - DNA, 25 bp, Mus musculus
gccctgatgaggtaaatccaaacag

SEQ ID NO: 551812 - DNA, 25 bp, Mus musculus
gccctgatgatcaaggtttgatccc

SEQ ID NO: 551813 - DNA, 25 bp, Mus musculus
gccctgatgatctaggtttgatccc

SEQ ID NO: 551814 - DNA, 25 bp, Mus musculus
gccctgatgtagagaccagcccagc

SEQ ID NO: 551815 - DNA, 25 bp, Mus musculus
gccctgatgtagtgaccagcccagc

SEQ ID NO: 551816 - DNA, 25 bp, Mus musculus
gccctgatgtctcttcttctaaatg

SEQ ID NO: 551817 - DNA, 25 bp, Mus musculus
gccctgatgtctgttcttctaaatg

SEQ ID NO: 551818 - DNA, 25 bp, Mus musculus
gccctgattggacgtggatgtcaca

SEQ ID NO: 551819 - DNA, 25 bp, Mus musculus
gccctgattggaggtggatgtcaca

SEQ ID NO: 551820 - DNA, 25 bp, Mus musculus
gccctgcacaggcactgctaaggag

SEQ ID NO: 551821 - DNA, 25 bp, Mus musculus
gccctgcacagggactgctaaggag

SEQ ID NO: 551822 - DNA, 25 bp, Mus musculus
gccctgcaccagagaaatcataaac

SEQ ID NO: 551823 - DNA, 25 bp, Mus musculus
gccctgcaccagtgaaatcataaac

SEQ ID NO: 551824 - DNA, 25 bp, Mus musculus
gccctgcacgccctggaacattgtg

SEQ ID NO: 551825 - DNA, 25 bp, Mus musculus
gccctgcacgccgtggaacattgtg

SEQ ID NO: 551826 - DNA, 25 bp, Mus musculus
gccctgcacttcactgaaaacatag

SEQ ID NO: 551827 - DNA, 25 bp, Mus musculus
gccctgcacttctctgaaaacatag

SEQ ID NO: 551828 - DNA, 25 bp, Mus musculus
gccctgcaggccaatattgatgatt

SEQ ID NO: 551829 - DNA, 25 bp, Mus musculus
gccctgcaggcctatattgatgatt

SEQ ID NO: 551830 - DNA, 25 bp, Mus musculus
gccctgcatattacctgagttgttt

SEQ ID NO: 551831 - DNA, 25 bp, Mus musculus
gccctgcatatttcctgagttgttt

SEQ ID NO: 551832 - DNA, 25 bp, Mus musculus
gccctgcatttgcatctagacttgg

SEQ ID NO: 551833 - DNA, 25 bp, Mus musculus
gccctgcatttggatctagacttgg

SEQ ID NO: 551834 - DNA, 25 bp, Mus musculus
gccctgccaaggatctagcaatcta

SEQ ID NO: 551835 - DNA, 25 bp, Mus musculus
gccctgccaaggttctagcaatcta

SEQ ID NO: 551836 - DNA, 25 bp, Mus musculus
gccctgccaggcaattctgggaggt

SEQ ID NO: 551837 - DNA, 25 bp, Mus musculus
gccctgccaggcatattacagcaat

SEQ ID NO: 551838 - DNA, 25 bp, Mus musculus
gccctgccaggctattctgggaggt

SEQ ID NO: 551839 - DNA, 25 bp, Mus musculus
gccctgccaggcttattacagcaat

SEQ ID NO: 551840 - DNA, 25 bp, Mus musculus
gccctgcccaatacaaactaaggca

SEQ ID NO: 551841 - DNA, 25 bp, Mus musculus
gccctgcccaatctgcatttaataa

SEQ ID NO: 551842 - DNA, 25 bp, Mus musculus
gccctgcccaatgtgcatttaataa

SEQ ID NO: 551843 - DNA, 25 bp, Mus musculus
gccctgcccaattcaaactaaggca

SEQ ID NO: 551844 - DNA, 25 bp, Mus musculus
gccctgcccagcatcgtgtttgctt

SEQ ID NO: 551845 - DNA, 25 bp, Mus musculus
gccctgcccagcttcgtgtttgctt

SEQ ID NO: 551846 - DNA, 25 bp, Mus musculus
gccctgcccaggactcattatgtaa

SEQ ID NO: 551847 - DNA, 25 bp, Mus musculus
gccctgcccaggtctcattatgtaa

SEQ ID NO: 551848 - DNA, 25 bp, Mus musculus
gccctgccctaaatgcacttcgata

SEQ ID NO: 551849 - DNA, 25 bp, Mus musculus
gccctgccctaattgcacttcgata

SEQ ID NO: 551850 - DNA, 25 bp, Mus musculus
gccctgccctttcaggagaagtgct

SEQ ID NO: 551851 - DNA, 25 bp, Mus musculus
gccctgccctttgaggagaagtgct

SEQ ID NO: 551852 - DNA, 25 bp, Mus musculus
gccctgcctaaactctggtacataa

SEQ ID NO: 551853 - DNA, 25 bp, Mus musculus
gccctgcctaaagtctggtacataa

SEQ ID NO: 551854 - DNA, 25 bp, Mus musculus
gccctgcctagtctactagatcaga

SEQ ID NO: 551855 - DNA, 25 bp, Mus musculus
gccctgcctagtgtactagatcaga

SEQ ID NO: 551856 - DNA, 25 bp, Mus musculus
gccctgcctatactatgctgtcttc

SEQ ID NO: 551857 - DNA, 25 bp, Mus musculus
gccctgcctatagtatgctgtcttc

SEQ ID NO: 551858 - DNA, 25 bp, Mus musculus
gccctgcctcatctgagagggtatt

SEQ ID NO: 551859 - DNA, 25 bp, Mus musculus
gccctgcctcatgtgagagggtatt

SEQ ID NO: 551860 - DNA, 25 bp, Mus musculus
gccctgcctccactggtaggattaa

SEQ ID NO: 551861 - DNA, 25 bp, Mus musculus
gccctgcctccagtggtaggattaa

SEQ ID NO: 551862 - DNA, 25 bp, Mus musculus
gccctgccttacaccaaagactagg

SEQ ID NO: 551863 - DNA, 25 bp, Mus musculus
gccctgccttactccaaagactagg

SEQ ID NO: 551864 - DNA, 25 bp, Mus musculus
gccctgccttcaaactatggatgtg

SEQ ID NO: 551865 - DNA, 25 bp, Mus musculus
gccctgccttcatactatggatgtg

SEQ ID NO: 551866 - DNA, 25 bp, Mus musculus
gccctgcgaaggcatgagccagtat

SEQ ID NO: 551867 - DNA, 25 bp, Mus musculus
gccctgcgaagggatgagccagtat

SEQ ID NO: 551868 - DNA, 25 bp, Mus musculus
gccctgcgacagctagatggcatct

SEQ ID NO: 551869 - DNA, 25 bp, Mus musculus
gccctgcgacaggtagatggcatct

SEQ ID NO: 551870 - DNA, 25 bp, Mus musculus
gccctgcgagaaagctggataaatg

SEQ ID NO: 551871 - DNA, 25 bp, Mus musculus
gccctgcgagaatgctggataaatg

SEQ ID NO: 551872 - DNA, 25 bp, Mus musculus
gccctgcgatggagctgagacttta

SEQ ID NO: 551873 - DNA, 25 bp, Mus musculus
gccctgcgatggtgctgagacttta

SEQ ID NO: 551874 - DNA, 25 bp, Mus musculus
gccctgctagtgataaggacccaca

SEQ ID NO: 551875 - DNA, 25 bp, Mus musculus
gccctgctagtgttaaggacccaca

SEQ ID NO: 551876 - DNA, 25 bp, Mus musculus
gccctgctcaatacagacctggtgg

SEQ ID NO: 551877 - DNA, 25 bp, Mus musculus
gccctgctcaattcagacctggtgg

SEQ ID NO: 551878 - DNA, 25 bp, Mus musculus
gccctgctcagtcttcctggacttg

SEQ ID NO: 551879 - DNA, 25 bp, Mus musculus
gccctgctcagtgttcctggacttg

SEQ ID NO: 551880 - DNA, 25 bp, Mus musculus
gccctgctccatcagtcaggaaaag

SEQ ID NO: 551881 - DNA, 25 bp, Mus musculus
gccctgctccatgagtcaggaaaag

SEQ ID NO: 551882 - DNA, 25 bp, Mus musculus
gccctgctccttaaaaactgctaac

SEQ ID NO: 551883 - DNA, 25 bp, Mus musculus
gccctgctcctttaaaactgctaac

SEQ ID NO: 551884 - DNA, 25 bp, Mus musculus
gccctgctctttcgatactttcaat

SEQ ID NO: 551885 - DNA, 25 bp, Mus musculus
gccctgctctttggatactttcaat

SEQ ID NO: 551886 - DNA, 25 bp, Mus musculus
gccctgctgacaatttcttggtaaa

SEQ ID NO: 551887 - DNA, 25 bp, Mus musculus
gccctgctgacattttcttggtaaa

SEQ ID NO: 551888 - DNA, 25 bp, Mus musculus
gccctgctgctacctcactaaataa

SEQ ID NO: 551889 - DNA, 25 bp, Mus musculus
gccctgctgctagctcactaaataa

SEQ ID NO: 551890 - DNA, 25 bp, Mus musculus
gccctgctggaactatttcctgtat

SEQ ID NO: 551891 - DNA, 25 bp, Mus musculus
gccctgctggaagtatttcctgtat

SEQ ID NO: 551892 - DNA, 25 bp, Mus musculus
gccctgctgttgctttaagtgtgta

SEQ ID NO: 551893 - DNA, 25 bp, Mus musculus
gccctgctgttggtttaagtgtgta

SEQ ID NO: 551894 - DNA, 25 bp, Mus musculus
gccctgcttcacatccaaaaggatg

SEQ ID NO: 551895 - DNA, 25 bp, Mus musculus
gccctgcttcacttccaaaaggatg

SEQ ID NO: 551896 - DNA, 25 bp, Mus musculus
gccctgcttcgtctctttgtatata

SEQ ID NO: 551897 - DNA, 25 bp, Mus musculus
gccctgcttcgtgtctttgtatata

SEQ ID NO: 551898 - DNA, 25 bp, Mus musculus
gccctgcttggcaattttataatac

SEQ ID NO: 551899 - DNA, 25 bp, Mus musculus
gccctgcttggctattttataatac

SEQ ID NO: 551900 - DNA, 25 bp, Mus musculus
gccctgcttgtcctttgacagaagt

SEQ ID NO: 551901 - DNA, 25 bp, Mus musculus
gccctgcttgtcgtttgacagaagt

SEQ ID NO: 551902 - DNA, 25 bp, Mus musculus
gccctgcttttgagctcatggtaaa

SEQ ID NO: 551903 - DNA, 25 bp, Mus musculus
gccctgcttttgtgctcatggtaaa

SEQ ID NO: 551904 - DNA, 25 bp, Mus musculus
gccctggaaatgaaagtgcctcctt

SEQ ID NO: 551905 - DNA, 25 bp, Mus musculus
gccctggaaatgtaagtgcctcctt

SEQ ID NO: 551906 - DNA, 25 bp, Mus musculus
gccctggaacagatgcctggatgtt

SEQ ID NO: 551907 - DNA, 25 bp, Mus musculus
gccctggaacagttgcctggatgtt

SEQ ID NO: 551908 - DNA, 25 bp, Mus musculus
gccctggaagacatctgttgagcaa

SEQ ID NO: 551909 - DNA, 25 bp, Mus musculus
gccctggaagacttctgttgagcaa

SEQ ID NO: 551910 - DNA, 25 bp, Mus musculus
gccctggaattcacaagtttcctga

SEQ ID NO: 551911 - DNA, 25 bp, Mus musculus
gccctggaattctcaagtttcctga

SEQ ID NO: 551912 - DNA, 25 bp, Mus musculus
gccctggacattcacactgctgaca

SEQ ID NO: 551913 - DNA, 25 bp, Mus musculus
gccctggacattgacactgctgaca

SEQ ID NO: 551914 - DNA, 25 bp, Mus musculus
gccctggaccaactggacttcgtga

SEQ ID NO: 551915 - DNA, 25 bp, Mus musculus
gccctggaccaagtggacttcgtga

SEQ ID NO: 551916 - DNA, 25 bp, Mus musculus
gccctggacgcaagtgtagcagagt

SEQ ID NO: 551917 - DNA, 25 bp, Mus musculus
gccctggacgcatgtgtagcagagt

SEQ ID NO: 551918 - DNA, 25 bp, Mus musculus
gccctggagctaactcagtattttt

SEQ ID NO: 551919 - DNA, 25 bp, Mus musculus
gccctggagctatctcagtattttt

SEQ ID NO: 551920 - DNA, 25 bp, Mus musculus
gccctggagctcagcttttatcatc

SEQ ID NO: 551921 - DNA, 25 bp, Mus musculus
gccctggagctctgcttttatcatc

SEQ ID NO: 551922 - DNA, 25 bp, Mus musculus
gccctggataatctgctaccctctg

SEQ ID NO: 551923 - DNA, 25 bp, Mus musculus
gccctggataatgtgctaccctctg

SEQ ID NO: 551924 - DNA, 25 bp, Mus musculus
gccctggattctattcctgaaaata

SEQ ID NO: 551925 - DNA, 25 bp, Mus musculus
gccctggattcttttcctgaaaata

SEQ ID NO: 551926 - DNA, 25 bp, Mus musculus
gccctggatttgctacagagtgaga

SEQ ID NO: 551927 - DNA, 25 bp, Mus musculus
gccctggatttggtacagagtgaga

SEQ ID NO: 551928 - DNA, 25 bp, Mus musculus
gccctggcaaatatggatggtcatc

SEQ ID NO: 551929 - DNA, 25 bp, Mus musculus
gccctggcaaatttggatggtcatc

SEQ ID NO: 551930 - DNA, 25 bp, Mus musculus
gccctggcacacacatgcgctgtgg

SEQ ID NO: 551931 - DNA, 25 bp, Mus musculus
gccctggcacactcatgcgctgtgg

SEQ ID NO: 551932 - DNA, 25 bp, Mus musculus
gccctggcacttcttaggttttcaa

SEQ ID NO: 551933 - DNA, 25 bp, Mus musculus
gccctggcacttgttaggttttcaa

SEQ ID NO: 551934 - DNA, 25 bp, Mus musculus
gccctggcagccacatctggtttat

SEQ ID NO: 551935 - DNA, 25 bp, Mus musculus
gccctggcagcctcatctggtttat

SEQ ID NO: 551936 - DNA, 25 bp, Mus musculus
gccctggccaacagcagtgtgagtt

SEQ ID NO: 551937 - DNA, 25 bp, Mus musculus
gccctggccaactgcagtgtgagtt

SEQ ID NO: 551938 - DNA, 25 bp, Mus musculus
gccctggcctcaacatagatactgg

SEQ ID NO: 551939 - DNA, 25 bp, Mus musculus
gccctggcctcatcatagatactgg

SEQ ID NO: 551940 - DNA, 25 bp, Mus musculus
gccctggccttgaaagctctgtgat

SEQ ID NO: 551941 - DNA, 25 bp, Mus musculus
gccctggccttgtaagctctgtgat

SEQ ID NO: 551942 - DNA, 25 bp, Mus musculus
gccctggcctttaccacgtagggat

SEQ ID NO: 551943 - DNA, 25 bp, Mus musculus
gccctggccttttccacgtagggat

SEQ ID NO: 551944 - DNA, 25 bp, Mus musculus
gccctggctgttcacggagatcaaa

SEQ ID NO: 551945 - DNA, 25 bp, Mus musculus
gccctggctgttgacggagatcaaa

SEQ ID NO: 551946 - DNA, 25 bp, Mus musculus
gccctggctttcacctgaaatcgtg

SEQ ID NO: 551947 - DNA, 25 bp, Mus musculus
gccctggctttctcctgaaatcgtg

SEQ ID NO: 551948 - DNA, 25 bp, Mus musculus
gccctgggaaggacctcggtgccca

SEQ ID NO: 551949 - DNA, 25 bp, Mus musculus
gccctgggaaggtcctcggtgccca

SEQ ID NO: 551950 - DNA, 25 bp, Mus musculus
gccctgggacaaaggcagctctgga

SEQ ID NO: 551951 - DNA, 25 bp, Mus musculus
gccctgggacaatggcagctctgga

SEQ ID NO: 551952 - DNA, 25 bp, Mus musculus
gccctgggaggacccctatggcctt

SEQ ID NO: 551953 - DNA, 25 bp, Mus musculus
gccctgggaggagccctatggcctt

SEQ ID NO: 551954 - DNA, 25 bp, Mus musculus
gccctgggaggcctcaaagcaaatg

SEQ ID NO: 551955 - DNA, 25 bp, Mus musculus
gccctgggaggcgtcaaagcaaatg

SEQ ID NO: 551956 - DNA, 25 bp, Mus musculus
gccctgggcattcctgtttcttagg

SEQ ID NO: 551957 - DNA, 25 bp, Mus musculus
gccctgggcattgctgtttcttagg

SEQ ID NO: 551958 - DNA, 25 bp, Mus musculus
gccctgggtattaccagtccagtaa

SEQ ID NO: 551959 - DNA, 25 bp, Mus musculus
gccctgggtatttccagtccagtaa

SEQ ID NO: 551960 - DNA, 25 bp, Mus musculus
gccctgggtcctcaggtcatgacag

SEQ ID NO: 551961 - DNA, 25 bp, Mus musculus
gccctgggtcctgaggtcatgacag

SEQ ID NO: 551962 - DNA, 25 bp, Mus musculus
gccctgggtgctataatgtgaatat

SEQ ID NO: 551963 - DNA, 25 bp, Mus musculus
gccctgggtgctttaatgtgaatat

SEQ ID NO: 551964 - DNA, 25 bp, Mus musculus
gccctgggtgggacagaaccgacat

SEQ ID NO: 551965 - DNA, 25 bp, Mus musculus
gccctgggtgggtcagaaccgacat

SEQ ID NO: 551966 - DNA, 25 bp, Mus musculus
gccctgggtgtcacgcaagcctcag

SEQ ID NO: 551967 - DNA, 25 bp, Mus musculus
gccctgggtgtctcgcaagcctcag

SEQ ID NO: 551968 - DNA, 25 bp, Mus musculus
gccctgggttagagtcaccttggaa

SEQ ID NO: 551969 - DNA, 25 bp, Mus musculus
gccctgggttagtgtcaccttggaa

SEQ ID NO: 551970 - DNA, 25 bp, Mus musculus
gccctgggttcgctcctcagctctg

SEQ ID NO: 551971 - DNA, 25 bp, Mus musculus
gccctgggttcggtcctcagctctg

SEQ ID NO: 551972 - DNA, 25 bp, Mus musculus
gccctggtaacaaggtgctacagta

SEQ ID NO: 551973 - DNA, 25 bp, Mus musculus
gccctggtaacatggtgctacagta

SEQ ID NO: 551974 - DNA, 25 bp, Mus musculus
gccctggtacctctgaacttgttca

SEQ ID NO: 551975 - DNA, 25 bp, Mus musculus
gccctggtacctgtgaacttgttca

SEQ ID NO: 551976 - DNA, 25 bp, Mus musculus
gccctggtactgatgtctttttata

SEQ ID NO: 551977 - DNA, 25 bp, Mus musculus
gccctggtactgttgtctttttata

SEQ ID NO: 551978 - DNA, 25 bp, Mus musculus
gccctggtacttcattgtttcacaa

SEQ ID NO: 551979 - DNA, 25 bp, Mus musculus
gccctggtacttgattgtttcacaa

SEQ ID NO: 551980 - DNA, 25 bp, Mus musculus
gccctggtagtgattctgtgagttt

SEQ ID NO: 551981 - DNA, 25 bp, Mus musculus
gccctggtagtgtttctgtgagttt

SEQ ID NO: 551982 - DNA, 25 bp, Mus musculus
gccctggtccagatgaagtcctaca

SEQ ID NO: 551983 - DNA, 25 bp, Mus musculus
gccctggtccagttgaagtcctaca

SEQ ID NO: 551984 - DNA, 25 bp, Mus musculus
gccctggtcccactggtttgaaaga

SEQ ID NO: 551985 - DNA, 25 bp, Mus musculus
gccctggtcccagtggtttgaaaga

SEQ ID NO: 551986 - DNA, 25 bp, Mus musculus
gccctggtgcctaatagtgttctta

SEQ ID NO: 551987 - DNA, 25 bp, Mus musculus
gccctggtgcctcacaaggttgaaa

SEQ ID NO: 551988 - DNA, 25 bp, Mus musculus
gccctggtgcctgacaaggttgaaa

SEQ ID NO: 551989 - DNA, 25 bp, Mus musculus
gccctggtgccttatagtgttctta

SEQ ID NO: 551990 - DNA, 25 bp, Mus musculus
gccctggtgtggactttaactctag

SEQ ID NO: 551991 - DNA, 25 bp, Mus musculus
gccctggtgtggtctttaactctag

SEQ ID NO: 551992 - DNA, 25 bp, Mus musculus
gccctggttgccctgacaatacaac

SEQ ID NO: 551993 - DNA, 25 bp, Mus musculus
gccctggttgccgtgacaatacaac

SEQ ID NO: 551994 - DNA, 25 bp, Mus musculus
gccctggttggtaggaacttgttat

SEQ ID NO: 551995 - DNA, 25 bp, Mus musculus
gccctggttggttggaacttgttat

SEQ ID NO: 551996 - DNA, 25 bp, Mus musculus
gccctggtttgaagaggttaccctt

SEQ ID NO: 551997 - DNA, 25 bp, Mus musculus
gccctggtttgatgaggttaccctt

SEQ ID NO: 551998 - DNA, 25 bp, Mus musculus
gccctggtttgtcgatgctgtcctt

SEQ ID NO: 551999 - DNA, 25 bp, Mus musculus
gccctggtttgtggatgctgtcctt

SEQ ID NO: 552000 - DNA, 25 bp, Mus musculus
gccctggttttgacccaacagtatc

SEQ ID NO: 552001 - DNA, 25 bp, Mus musculus
gccctggttttgtcccaacagtatc

SEQ ID NO: 552002 - DNA, 25 bp, Mus musculus
gccctgtcacttactgcatggaaga

SEQ ID NO: 552003 - DNA, 25 bp, Mus musculus
gccctgtcactttctgcatggaaga

SEQ ID NO: 552004 - DNA, 25 bp, Mus musculus
gccctgtcaggaatggtatttctat

SEQ ID NO: 552005 - DNA, 25 bp, Mus musculus
gccctgtcaggattggtatttctat

SEQ ID NO: 552006 - DNA, 25 bp, Mus musculus
gccctgtcagtaactcttggtacat

SEQ ID NO: 552007 - DNA, 25 bp, Mus musculus
gccctgtcagtatctcttggtacat

SEQ ID NO: 552008 - DNA, 25 bp, Mus musculus
gccctgtcagtgcaggctggcttta

SEQ ID NO: 552009 - DNA, 25 bp, Mus musculus
gccctgtcagtggaggctggcttta

SEQ ID NO: 552010 - DNA, 25 bp, Mus musculus
gccctgtccagaatacctgtgcttc

SEQ ID NO: 552011 - DNA, 25 bp, Mus musculus
gccctgtccagattacctgtgcttc

SEQ ID NO: 552012 - DNA, 25 bp, Mus musculus
gccctgtccaggctatgagagctac

SEQ ID NO: 552013 - DNA, 25 bp, Mus musculus
gccctgtccagggtatgagagctac

SEQ ID NO: 552014 - DNA, 25 bp, Mus musculus
gccctgtccatacacaaacaagcta

SEQ ID NO: 552015 - DNA, 25 bp, Mus musculus
gccctgtccatagacaaacaagcta

SEQ ID NO: 552016 - DNA, 25 bp, Mus musculus
gccctgtctgtgcactttcatctgg

SEQ ID NO: 552017 - DNA, 25 bp, Mus musculus
gccctgtctgtggactttcatctgg

SEQ ID NO: 552018 - DNA, 25 bp, Mus musculus
gccctgtcttccaagttcctaagga

SEQ ID NO: 552019 - DNA, 25 bp, Mus musculus
gccctgtcttcctagttcctaagga

SEQ ID NO: 552020 - DNA, 25 bp, Mus musculus
gccctgtgaagacctgaagttccca

SEQ ID NO: 552021 - DNA, 25 bp, Mus musculus
gccctgtgaagagctgaagttccca

SEQ ID NO: 552022 - DNA, 25 bp, Mus musculus
gccctgtgcactatgctgtgacata

SEQ ID NO: 552023 - DNA, 25 bp, Mus musculus
gccctgtgcactttgctgtgacata

SEQ ID NO: 552024 - DNA, 25 bp, Mus musculus
gccctgtgcagcagaggttctcaga

SEQ ID NO: 552025 - DNA, 25 bp, Mus musculus
gccctgtgcagctgaggttctcaga

SEQ ID NO: 552026 - DNA, 25 bp, Mus musculus
gccctgtgcaggcatctgtattgta

SEQ ID NO: 552027 - DNA, 25 bp, Mus musculus
gccctgtgcagggatctgtattgta

SEQ ID NO: 552028 - DNA, 25 bp, Mus musculus
gccctgtgctaaatagagcctctct

SEQ ID NO: 552029 - DNA, 25 bp, Mus musculus
gccctgtgctaattagagcctctct

SEQ ID NO: 552030 - DNA, 25 bp, Mus musculus
gccctgtgttcaatcattagcatta

SEQ ID NO: 552031 - DNA, 25 bp, Mus musculus
gccctgtgttcattcattagcatta

SEQ ID NO: 552032 - DNA, 25 bp, Mus musculus
gccctgttacaaatggctttggcag

SEQ ID NO: 552033 - DNA, 25 bp, Mus musculus
gccctgttacaattggctttggcag

SEQ ID NO: 552034 - DNA, 25 bp, Mus musculus
gccctgttcaaaacagaggcactta

SEQ ID NO: 552035 - DNA, 25 bp, Mus musculus
gccctgttcaaaacatttcaagtca

SEQ ID NO: 552036 - DNA, 25 bp, Mus musculus
gccctgttcaaatcagaggcactta

SEQ ID NO: 552037 - DNA, 25 bp, Mus musculus
gccctgttcaaatcatttcaagtca

SEQ ID NO: 552038 - DNA, 25 bp, Mus musculus
gccctgttcatcaatcaccaaagtg

SEQ ID NO: 552039 - DNA, 25 bp, Mus musculus
gccctgttcatctatcaccaaagtg

SEQ ID NO: 552040 - DNA, 25 bp, Mus musculus
gccctgttcgtccattctgtaaata

SEQ ID NO: 552041 - DNA, 25 bp, Mus musculus
gccctgttcgtcgattctgtaaata

SEQ ID NO: 552042 - DNA, 25 bp, Mus musculus
gccctgttctgtctgacctgtcaag

SEQ ID NO: 552043 - DNA, 25 bp, Mus musculus
gccctgttctgtgtgacctgtcaag

SEQ ID NO: 552044 - DNA, 25 bp, Mus musculus
gccctgttgagcaaataatttctgg

SEQ ID NO: 552045 - DNA, 25 bp, Mus musculus
gccctgttgagccttttcatatgaa

SEQ ID NO: 552046 - DNA, 25 bp, Mus musculus
gccctgttgagcgttttcatatgaa

SEQ ID NO: 552047 - DNA, 25 bp, Mus musculus
gccctgttgagctaataatttctgg

SEQ ID NO: 552048 - DNA, 25 bp, Mus musculus
gccctgtttataatagaaacctcag

SEQ ID NO: 552049 - DNA, 25 bp, Mus musculus
gccctgtttatattagaaacctcag

SEQ ID NO: 552050 - DNA, 25 bp, Mus musculus
gccctgtttcatccacagactattt

SEQ ID NO: 552051 - DNA, 25 bp, Mus musculus
gccctgtttcatgcacagactattt

SEQ ID NO: 552052 - DNA, 25 bp, Mus musculus
gccctgtttgaccttcgtgaaatta

SEQ ID NO: 552053 - DNA, 25 bp, Mus musculus
gccctgtttgacgttcgtgaaatta

SEQ ID NO: 552054 - DNA, 25 bp, Mus musculus
gccctgtttgctaccaggtgcagaa

SEQ ID NO: 552055 - DNA, 25 bp, Mus musculus
gccctgtttgcttccaggtgcagaa

SEQ ID NO: 552056 - DNA, 25 bp, Mus musculus
gccctgtttggtcatacaagtctgt

SEQ ID NO: 552057 - DNA, 25 bp, Mus musculus
gccctgtttggtgatacaagtctgt

SEQ ID NO: 552058 - DNA, 25 bp, Mus musculus
gccctgtttgttcatgctgatgtgg

SEQ ID NO: 552059 - DNA, 25 bp, Mus musculus
gccctgtttgttgatgctgatgtgg

SEQ ID NO: 552060 - DNA, 25 bp, Mus musculus
gccctgttttctatggtagccggag

SEQ ID NO: 552061 - DNA, 25 bp, Mus musculus
gccctgttttctcttagatcctaaa

SEQ ID NO: 552062 - DNA, 25 bp, Mus musculus
gccctgttttctgttagatcctaaa

SEQ ID NO: 552063 - DNA, 25 bp, Mus musculus
gccctgttttctttggtagccggag

SEQ ID NO: 552064 - DNA, 25 bp, Mus musculus
gcccttaaaaggctggtgacaccag

SEQ ID NO: 552065 - DNA, 25 bp, Mus musculus
gcccttaaaagggtggtgacaccag

SEQ ID NO: 552066 - DNA, 25 bp, Mus musculus
gcccttaaaatcactgacgctggaa

SEQ ID NO: 552067 - DNA, 25 bp, Mus musculus
gcccttaaaatctctgacgctggaa

SEQ ID NO: 552068 - DNA, 25 bp, Mus musculus
gcccttaaaattcttgccggacgag

SEQ ID NO: 552069 - DNA, 25 bp, Mus musculus
gcccttaaaattgttgccggacgag

SEQ ID NO: 552070 - DNA, 25 bp, Mus musculus
gcccttaaccatctgacttggagga

SEQ ID NO: 552071 - DNA, 25 bp, Mus musculus
gcccttaaccatgtgacttggagga

SEQ ID NO: 552072 - DNA, 25 bp, Mus musculus
gcccttacagaaagtctactctttt

SEQ ID NO: 552073 - DNA, 25 bp, Mus musculus
gcccttacagaatgtctactctttt

SEQ ID NO: 552074 - DNA, 25 bp, Mus musculus
gcccttacatacattcaacacattt

SEQ ID NO: 552075 - DNA, 25 bp, Mus musculus
gcccttacatactttcaacacattt

SEQ ID NO: 552076 - DNA, 25 bp, Mus musculus
gcccttacgtctacatctataacag

SEQ ID NO: 552077 - DNA, 25 bp, Mus musculus
gcccttacgtcttcatctataacag

SEQ ID NO: 552078 - DNA, 25 bp, Mus musculus
gcccttactagcctggaacttatgc

SEQ ID NO: 552079 - DNA, 25 bp, Mus musculus
gcccttactagcgtggaacttatgc

SEQ ID NO: 552080 - DNA, 25 bp, Mus musculus
gcccttactgcccaaggcgtatcga

SEQ ID NO: 552081 - DNA, 25 bp, Mus musculus
gcccttactgccgaaggcgtatcga

SEQ ID NO: 552082 - DNA, 25 bp, Mus musculus
gcccttagaactatggaatcctgcc

SEQ ID NO: 552083 - DNA, 25 bp, Mus musculus
gcccttagaactttggaatcctgcc

SEQ ID NO: 552084 - DNA, 25 bp, Mus musculus
gcccttagacttaatttccagctct

SEQ ID NO: 552085 - DNA, 25 bp, Mus musculus
gcccttagactttatttccagctct

SEQ ID NO: 552086 - DNA, 25 bp, Mus musculus
gcccttagcagcacttagactagaa

SEQ ID NO: 552087 - DNA, 25 bp, Mus musculus
gcccttagcagctcttagactagaa

SEQ ID NO: 552088 - DNA, 25 bp, Mus musculus
gcccttagctaccaggatgctgagg

SEQ ID NO: 552089 - DNA, 25 bp, Mus musculus
gcccttagctacgaggatgctgagg

SEQ ID NO: 552090 - DNA, 25 bp, Mus musculus
gcccttaggattatcttttggatgc

SEQ ID NO: 552091 - DNA, 25 bp, Mus musculus
gcccttaggattttcttttggatgc

SEQ ID NO: 552092 - DNA, 25 bp, Mus musculus
gcccttagggatatgctgaatttca

SEQ ID NO: 552093 - DNA, 25 bp, Mus musculus
gcccttagggatttgctgaatttca

SEQ ID NO: 552094 - DNA, 25 bp, Mus musculus
gcccttagggttaccacctgatgaa

SEQ ID NO: 552095 - DNA, 25 bp, Mus musculus
gcccttagggtttccacctgatgaa

SEQ ID NO: 552096 - DNA, 25 bp, Mus musculus
gcccttagtgagcaccagagattca

SEQ ID NO: 552097 - DNA, 25 bp, Mus musculus
gcccttagtgaggaccagagattca

SEQ ID NO: 552098 - DNA, 25 bp, Mus musculus
gcccttatatttccagattcgactg

SEQ ID NO: 552099 - DNA, 25 bp, Mus musculus
gcccttatatttgcagattcgactg

SEQ ID NO: 552100 - DNA, 25 bp, Mus musculus
gcccttatggaccaaatttaagaat

SEQ ID NO: 552101 - DNA, 25 bp, Mus musculus
gcccttatggacgaaatttaagaat

SEQ ID NO: 552102 - DNA, 25 bp, Mus musculus
gcccttatgtgccagaaacttcggt

SEQ ID NO: 552103 - DNA, 25 bp, Mus musculus
gcccttatgtgcgagaaacttcggt

SEQ ID NO: 552104 - DNA, 25 bp, Mus musculus
gcccttatgtttctgtgctgactta

SEQ ID NO: 552105 - DNA, 25 bp, Mus musculus
gcccttatgtttgtgtgctgactta

SEQ ID NO: 552106 - DNA, 25 bp, Mus musculus
gcccttattgacacctatgctgaag

SEQ ID NO: 552107 - DNA, 25 bp, Mus musculus
gcccttattgactcctatgctgaag

SEQ ID NO: 552108 - DNA, 25 bp, Mus musculus
gcccttcaaagccatcatctgagag

SEQ ID NO: 552109 - DNA, 25 bp, Mus musculus
gcccttcaaagcgatcatctgagag

SEQ ID NO: 552110 - DNA, 25 bp, Mus musculus
gcccttcaagaacttcctgtgagta

SEQ ID NO: 552111 - DNA, 25 bp, Mus musculus
gcccttcaagaagttcctgtgagta

SEQ ID NO: 552112 - DNA, 25 bp, Mus musculus
gcccttcaatgtctactttgaataa

SEQ ID NO: 552113 - DNA, 25 bp, Mus musculus
gcccttcaatgtgtactttgaataa

SEQ ID NO: 552114 - DNA, 25 bp, Mus musculus
gcccttcaattcatgttcacagtag

SEQ ID NO: 552115 - DNA, 25 bp, Mus musculus
gcccttcaattcttgttcacagtag

SEQ ID NO: 552116 - DNA, 25 bp, Mus musculus
gcccttcacatgaggtcagacttgg

SEQ ID NO: 552117 - DNA, 25 bp, Mus musculus
gcccttcacatgtggtcagacttgg

SEQ ID NO: 552118 - DNA, 25 bp, Mus musculus
gcccttcaccaacctttgatggcat

SEQ ID NO: 552119 - DNA, 25 bp, Mus musculus
gcccttcaccaagctttgatggcat

SEQ ID NO: 552120 - DNA, 25 bp, Mus musculus
gcccttcacctgaagagggtaggga

SEQ ID NO: 552121 - DNA, 25 bp, Mus musculus
gcccttcacctgtagagggtaggga

SEQ ID NO: 552122 - DNA, 25 bp, Mus musculus
gcccttcacgggcaccaggcatgaa

SEQ ID NO: 552123 - DNA, 25 bp, Mus musculus
gcccttcacggggaccaggcatgaa

SEQ ID NO: 552124 - DNA, 25 bp, Mus musculus
gcccttcagctgaccaatgtgagaa

SEQ ID NO: 552125 - DNA, 25 bp, Mus musculus
gcccttcagctgtccaatgtgagaa

SEQ ID NO: 552126 - DNA, 25 bp, Mus musculus
gcccttcagtacagtgaatgtacat

SEQ ID NO: 552127 - DNA, 25 bp, Mus musculus
gcccttcagtactgtgaatgtacat

SEQ ID NO: 552128 - DNA, 25 bp, Mus musculus
gcccttcatggcagagacagctaag

SEQ ID NO: 552129 - DNA, 25 bp, Mus musculus
gcccttcatggctgagacagctaag

SEQ ID NO: 552130 - DNA, 25 bp, Mus musculus
gcccttccacagcatgcgaagaagt

SEQ ID NO: 552131 - DNA, 25 bp, Mus musculus
gcccttccacaggatgcgaagaagt

SEQ ID NO: 552132 - DNA, 25 bp, Mus musculus
gcccttccatcacgattaaatctgc

SEQ ID NO: 552133 - DNA, 25 bp, Mus musculus
gcccttccatcaggattaaatctgc

SEQ ID NO: 552134 - DNA, 25 bp, Mus musculus
gcccttcccaaactattaatgttgt

SEQ ID NO: 552135 - DNA, 25 bp, Mus musculus
gcccttcccaaagtattaatgttgt

SEQ ID NO: 552136 - DNA, 25 bp, Mus musculus
gcccttcccagcatagattcaaatg

SEQ ID NO: 552137 - DNA, 25 bp, Mus musculus
gcccttcccagcttagattcaaatg

SEQ ID NO: 552138 - DNA, 25 bp, Mus musculus
gcccttcccattagtttgagactgt

SEQ ID NO: 552139 - DNA, 25 bp, Mus musculus
gcccttcccatttgtttgagactgt

SEQ ID NO: 552140 - DNA, 25 bp, Mus musculus
gcccttccctagctcaggagctggg

SEQ ID NO: 552141 - DNA, 25 bp, Mus musculus
gcccttccctaggtcaggagctggg

SEQ ID NO: 552142 - DNA, 25 bp, Mus musculus
gcccttccctatctgagtcttaaaa

SEQ ID NO: 552143 - DNA, 25 bp, Mus musculus
gcccttccctatgtgagtcttaaaa

SEQ ID NO: 552144 - DNA, 25 bp, Mus musculus
gcccttccctgactttgtgtacaaa

SEQ ID NO: 552145 - DNA, 25 bp, Mus musculus
gcccttccctgagtttgtgtacaaa

SEQ ID NO: 552146 - DNA, 25 bp, Mus musculus
gcccttcccttgattttgcttgtaa

SEQ ID NO: 552147 - DNA, 25 bp, Mus musculus
gcccttcccttgtttttgcttgtaa

SEQ ID NO: 552148 - DNA, 25 bp, Mus musculus
gcccttccgcggattcctggagtca

SEQ ID NO: 552149 - DNA, 25 bp, Mus musculus
gcccttccgcggtttcctggagtca

SEQ ID NO: 552150 - DNA, 25 bp, Mus musculus
gcccttccgcttagtggatctgtat

SEQ ID NO: 552151 - DNA, 25 bp, Mus musculus
gcccttccgctttgtggatctgtat

SEQ ID NO: 552152 - DNA, 25 bp, Mus musculus
gcccttccggtgagatcgagagcgt

SEQ ID NO: 552153 - DNA, 25 bp, Mus musculus
gcccttccggtgtgatcgagagcgt

SEQ ID NO: 552154 - DNA, 25 bp, Mus musculus
gcccttcctagcctttacagaacag

SEQ ID NO: 552155 - DNA, 25 bp, Mus musculus
gcccttcctagcgtttacagaacag

SEQ ID NO: 552156 - DNA, 25 bp, Mus musculus
gcccttcctcaacttagtggcaaag

SEQ ID NO: 552157 - DNA, 25 bp, Mus musculus
gcccttcctcaagttagtggcaaag

SEQ ID NO: 552158 - DNA, 25 bp, Mus musculus
gcccttcgaaaccttgtgtttggca

SEQ ID NO: 552159 - DNA, 25 bp, Mus musculus
gcccttcgaaacgttgtgtttggca

SEQ ID NO: 552160 - DNA, 25 bp, Mus musculus
gcccttcgagaaccattccacattg

SEQ ID NO: 552161 - DNA, 25 bp, Mus musculus
gcccttcgagaagcattccacattg

SEQ ID NO: 552162 - DNA, 25 bp, Mus musculus
gcccttctagcccagcagtaggagg

SEQ ID NO: 552163 - DNA, 25 bp, Mus musculus
gcccttctagccgagcagtaggagg

SEQ ID NO: 552164 - DNA, 25 bp, Mus musculus
gcccttctgctcaatgttggttaca

SEQ ID NO: 552165 - DNA, 25 bp, Mus musculus
gcccttctgctctatgttggttaca

SEQ ID NO: 552166 - DNA, 25 bp, Mus musculus
gcccttcttatgagtcccacagtaa

SEQ ID NO: 552167 - DNA, 25 bp, Mus musculus
gcccttcttatgagttaccatagat

SEQ ID NO: 552168 - DNA, 25 bp, Mus musculus
gcccttcttatgtgtcccacagtaa

SEQ ID NO: 552169 - DNA, 25 bp, Mus musculus
gcccttcttatgtgttaccatagat

SEQ ID NO: 552170 - DNA, 25 bp, Mus musculus
gcccttcttcaaactctctgaggaa

SEQ ID NO: 552171 - DNA, 25 bp, Mus musculus
gcccttcttcaatctctctgaggaa

SEQ ID NO: 552172 - DNA, 25 bp, Mus musculus
gcccttcttggcacaaacaattttt

SEQ ID NO: 552173 - DNA, 25 bp, Mus musculus
gcccttcttggctcaaacaattttt

SEQ ID NO: 552174 - DNA, 25 bp, Mus musculus
gcccttctttcaattgctttgtttg

SEQ ID NO: 552175 - DNA, 25 bp, Mus musculus
gcccttctttcatttgctttgtttg

SEQ ID NO: 552176 - DNA, 25 bp, Mus musculus
gcccttgaaaacactttgcattata

SEQ ID NO: 552177 - DNA, 25 bp, Mus musculus
gcccttgaaaactctttgcattata

SEQ ID NO: 552178 - DNA, 25 bp, Mus musculus
gcccttgaaaatccgacatttgcat

SEQ ID NO: 552179 - DNA, 25 bp, Mus musculus
gcccttgaaaatgcgacatttgcat

SEQ ID NO: 552180 - DNA, 25 bp, Mus musculus
gcccttgaacttactgagccagagc

SEQ ID NO: 552181 - DNA, 25 bp, Mus musculus
gcccttgaactttctgagccagagc

SEQ ID NO: 552182 - DNA, 25 bp, Mus musculus
gcccttgaaggcaagtacttagttt

SEQ ID NO: 552183 - DNA, 25 bp, Mus musculus
gcccttgaaggctagtacttagttt

SEQ ID NO: 552184 - DNA, 25 bp, Mus musculus
gcccttgacctcatagctggaggaa

SEQ ID NO: 552185 - DNA, 25 bp, Mus musculus
gcccttgacctcttagctggaggaa

SEQ ID NO: 552186 - DNA, 25 bp, Mus musculus
gcccttgacttaaagctttctttgt

SEQ ID NO: 552187 - DNA, 25 bp, Mus musculus
gcccttgacttatagctttctttgt

SEQ ID NO: 552188 - DNA, 25 bp, Mus musculus
gcccttgagcctagtcgtgataaca

SEQ ID NO: 552189 - DNA, 25 bp, Mus musculus
gcccttgagccttgtcgtgataaca

SEQ ID NO: 552190 - DNA, 25 bp, Mus musculus
gcccttgagctgcatggacacttga

SEQ ID NO: 552191 - DNA, 25 bp, Mus musculus
gcccttgagctggatggacacttga

SEQ ID NO: 552192 - DNA, 25 bp, Mus musculus
gcccttgagtaaatgccagcttatt

SEQ ID NO: 552193 - DNA, 25 bp, Mus musculus
gcccttgagtaattgccagcttatt

SEQ ID NO: 552194 - DNA, 25 bp, Mus musculus
gcccttgatggtatataatttttat

SEQ ID NO: 552195 - DNA, 25 bp, Mus musculus
gcccttgatggtttataatttttat

SEQ ID NO: 552196 - DNA, 25 bp, Mus musculus
gcccttgatttaattgtcgttattt

SEQ ID NO: 552197 - DNA, 25 bp, Mus musculus
gcccttgatttatttgtcgttattt

SEQ ID NO: 552198 - DNA, 25 bp, Mus musculus
gcccttgcattgctgcttcctgtga

SEQ ID NO: 552199 - DNA, 25 bp, Mus musculus
gcccttgcattggtgcttcctgtga

SEQ ID NO: 552200 - DNA, 25 bp, Mus musculus
gcccttgccacgagttctattagaa

SEQ ID NO: 552201 - DNA, 25 bp, Mus musculus
gcccttgccacgtgttctattagaa

SEQ ID NO: 552202 - DNA, 25 bp, Mus musculus
gcccttgccctgcaggagagaccga

SEQ ID NO: 552203 - DNA, 25 bp, Mus musculus
gcccttgccctggaggagagaccga

SEQ ID NO: 552204 - DNA, 25 bp, Mus musculus
gcccttgcctttccagagatgctga

SEQ ID NO: 552205 - DNA, 25 bp, Mus musculus
gcccttgcctttgcagagatgctga

SEQ ID NO: 552206 - DNA, 25 bp, Mus musculus
gcccttgctatgctctacagaagtg

SEQ ID NO: 552207 - DNA, 25 bp, Mus musculus
gcccttgctatggtctacagaagtg

SEQ ID NO: 552208 - DNA, 25 bp, Mus musculus
gcccttgctgcaaggcggatacact

SEQ ID NO: 552209 - DNA, 25 bp, Mus musculus
gcccttgctgcatggcggatacact

SEQ ID NO: 552210 - DNA, 25 bp, Mus musculus
gcccttgctggtcagtttcttatga

SEQ ID NO: 552211 - DNA, 25 bp, Mus musculus
gcccttgctggtgagtttcttatga

SEQ ID NO: 552212 - DNA, 25 bp, Mus musculus
gcccttggacctattcatctgatga

SEQ ID NO: 552213 - DNA, 25 bp, Mus musculus
gcccttggaccttttcatctgatga

SEQ ID NO: 552214 - DNA, 25 bp, Mus musculus
gcccttggcattctctacttttaaa

SEQ ID NO: 552215 - DNA, 25 bp, Mus musculus
gcccttggcattgtctacttttaaa

SEQ ID NO: 552216 - DNA, 25 bp, Mus musculus
gcccttgggactaaacttctaacat

SEQ ID NO: 552217 - DNA, 25 bp, Mus musculus
gcccttgggacttaacttctaacat

SEQ ID NO: 552218 - DNA, 25 bp, Mus musculus
gcccttgggcttctttgaatttcac

SEQ ID NO: 552219 - DNA, 25 bp, Mus musculus
gcccttgggcttgtttgaatttcac

SEQ ID NO: 552220 - DNA, 25 bp, Mus musculus
gcccttgggtacaccagggtcagta

SEQ ID NO: 552221 - DNA, 25 bp, Mus musculus
gcccttgggtactccagggtcagta

SEQ ID NO: 552222 - DNA, 25 bp, Mus musculus
gcccttggtaagcatgcaggcctgt

SEQ ID NO: 552223 - DNA, 25 bp, Mus musculus
gcccttggtaaggatgcaggcctgt

SEQ ID NO: 552224 - DNA, 25 bp, Mus musculus
gcccttggtccaatgaaaattctat

SEQ ID NO: 552225 - DNA, 25 bp, Mus musculus
gcccttggtccattgaaaattctat

SEQ ID NO: 552226 - DNA, 25 bp, Mus musculus
gcccttggtcctcttaatgtattaa

SEQ ID NO: 552227 - DNA, 25 bp, Mus musculus
gcccttggtcctgttaatgtattaa

SEQ ID NO: 552228 - DNA, 25 bp, Mus musculus
gcccttggtctaaatcacccagtgg

SEQ ID NO: 552229 - DNA, 25 bp, Mus musculus
gcccttggtctatatcacccagtgg

SEQ ID NO: 552230 - DNA, 25 bp, Mus musculus
gcccttggtttcactctttgtggaa

SEQ ID NO: 552231 - DNA, 25 bp, Mus musculus
gcccttggtttctctctttgtggaa

SEQ ID NO: 552232 - DNA, 25 bp, Mus musculus
gcccttgtaggtctgaaagactcat

SEQ ID NO: 552233 - DNA, 25 bp, Mus musculus
gcccttgtaggtgtgaaagactcat

SEQ ID NO: 552234 - DNA, 25 bp, Mus musculus
gcccttgtcactataggctgcggga

SEQ ID NO: 552235 - DNA, 25 bp, Mus musculus
gcccttgtcactttaggctgcggga

SEQ ID NO: 552236 - DNA, 25 bp, Mus musculus
gcccttgtcctactattattcagcc

SEQ ID NO: 552237 - DNA, 25 bp, Mus musculus
gcccttgtcctagtattattcagcc

SEQ ID NO: 552238 - DNA, 25 bp, Mus musculus
gcccttgtctggatattccaagtga

SEQ ID NO: 552239 - DNA, 25 bp, Mus musculus
gcccttgtctggttattccaagtga

SEQ ID NO: 552240 - DNA, 25 bp, Mus musculus
gcccttgtctttctacatcgtatgt

SEQ ID NO: 552241 - DNA, 25 bp, Mus musculus
gcccttgtctttgtacatcgtatgt

SEQ ID NO: 552242 - DNA, 25 bp, Mus musculus
gcccttgtgggcattatgtagactt

SEQ ID NO: 552243 - DNA, 25 bp, Mus musculus
gcccttgtgggctttatgtagactt

SEQ ID NO: 552244 - DNA, 25 bp, Mus musculus
gcccttgtggtgacagaagcccgga

SEQ ID NO: 552245 - DNA, 25 bp, Mus musculus
gcccttgtggtgtcagaagcccgga

SEQ ID NO: 552246 - DNA, 25 bp, Mus musculus
gcccttgttaggaggaaggtgccca

SEQ ID NO: 552247 - DNA, 25 bp, Mus musculus
gcccttgttaggtggaaggtgccca

SEQ ID NO: 552248 - DNA, 25 bp, Mus musculus
gcccttgttcttcgttctaacctag

SEQ ID NO: 552249 - DNA, 25 bp, Mus musculus
gcccttgttcttggttctaacctag

SEQ ID NO: 552250 - DNA, 25 bp, Mus musculus
gcccttgttggccttgtcagtaaaa

SEQ ID NO: 552251 - DNA, 25 bp, Mus musculus
gcccttgttggcgttgtcagtaaaa

SEQ ID NO: 552252 - DNA, 25 bp, Mus musculus
gcccttgtttaaattcctagcactg

SEQ ID NO: 552253 - DNA, 25 bp, Mus musculus
gcccttgtttaatttcctagcactg

SEQ ID NO: 552254 - DNA, 25 bp, Mus musculus
gcccttgtttatcccagttgttatc

SEQ ID NO: 552255 - DNA, 25 bp, Mus musculus
gcccttgtttatgccagttgttatc

SEQ ID NO: 552256 - DNA, 25 bp, Mus musculus
gccctttaaaaacttccgcatgttg

SEQ ID NO: 552257 - DNA, 25 bp, Mus musculus
gccctttaaaaagttccgcatgttg

SEQ ID NO: 552258 - DNA, 25 bp, Mus musculus
gccctttaatgaagcatggttgact

SEQ ID NO: 552259 - DNA, 25 bp, Mus musculus
gccctttaatgatgcatggttgact

SEQ ID NO: 552260 - DNA, 25 bp, Mus musculus
gccctttaattcagatctttgtgag

SEQ ID NO: 552261 - DNA, 25 bp, Mus musculus
gccctttaattctgatctttgtgag

SEQ ID NO: 552262 - DNA, 25 bp, Mus musculus
gccctttacctaaacttgaggcaga

SEQ ID NO: 552263 - DNA, 25 bp, Mus musculus
gccctttacctatacttgaggcaga

SEQ ID NO: 552264 - DNA, 25 bp, Mus musculus
gccctttactgccatgtcggaggag

SEQ ID NO: 552265 - DNA, 25 bp, Mus musculus
gccctttactgcgatgtcggaggag

SEQ ID NO: 552266 - DNA, 25 bp, Mus musculus
gccctttagaagattgtagtgtgta

SEQ ID NO: 552267 - DNA, 25 bp, Mus musculus
gccctttagaagtttgtagtgtgta

SEQ ID NO: 552268 - DNA, 25 bp, Mus musculus
gccctttatgagatgttgcggttat

SEQ ID NO: 552269 - DNA, 25 bp, Mus musculus
gccctttatgagttgttgcggttat

SEQ ID NO: 552270 - DNA, 25 bp, Mus musculus
gccctttattgacttcccagttgag

SEQ ID NO: 552271 - DNA, 25 bp, Mus musculus
gccctttattgagttcccagttgag

SEQ ID NO: 552272 - DNA, 25 bp, Mus musculus
gccctttcaaagcaattctctctga

SEQ ID NO: 552273 - DNA, 25 bp, Mus musculus
gccctttcaaaggaattctctctga

SEQ ID NO: 552274 - DNA, 25 bp, Mus musculus
gccctttcagaaaacgaatgctagt

SEQ ID NO: 552275 - DNA, 25 bp, Mus musculus
gccctttcagaatacgaatgctagt

SEQ ID NO: 552276 - DNA, 25 bp, Mus musculus
gccctttcatgactttacaataaat

SEQ ID NO: 552277 - DNA, 25 bp, Mus musculus
gccctttcatgagtttacaataaat

SEQ ID NO: 552278 - DNA, 25 bp, Mus musculus
gccctttcttttaggctggaggtag

SEQ ID NO: 552279 - DNA, 25 bp, Mus musculus
gccctttctttttggctggaggtag

SEQ ID NO: 552280 - DNA, 25 bp, Mus musculus
gccctttgaaaaatgttgacgtata

SEQ ID NO: 552281 - DNA, 25 bp, Mus musculus
gccctttgaaaattgttgacgtata

SEQ ID NO: 552282 - DNA, 25 bp, Mus musculus
gccctttgaaataatccatagtttt

SEQ ID NO: 552283 - DNA, 25 bp, Mus musculus
gccctttgaaattatccatagtttt

SEQ ID NO: 552284 - DNA, 25 bp, Mus musculus
gccctttgaagactgtagctccatg

SEQ ID NO: 552285 - DNA, 25 bp, Mus musculus
gccctttgaagagtgtagctccatg

SEQ ID NO: 552286 - DNA, 25 bp, Mus musculus
gccctttgcagtaccatgagtttat

SEQ ID NO: 552287 - DNA, 25 bp, Mus musculus
gccctttgcagttccatgagtttat

SEQ ID NO: 552288 - DNA, 25 bp, Mus musculus
gccctttgcggaacttctcttgaat

SEQ ID NO: 552289 - DNA, 25 bp, Mus musculus
gccctttgcggatcttctcttgaat

SEQ ID NO: 552290 - DNA, 25 bp, Mus musculus
gccctttgctatccttgcaagagtc

SEQ ID NO: 552291 - DNA, 25 bp, Mus musculus
gccctttgctatgcttgcaagagtc

SEQ ID NO: 552292 - DNA, 25 bp, Mus musculus
gccctttgctcgcatttctgtctag

SEQ ID NO: 552293 - DNA, 25 bp, Mus musculus
gccctttgctcggatttctgtctag

SEQ ID NO: 552294 - DNA, 25 bp, Mus musculus
gccctttgctggagcgagatgtatt

SEQ ID NO: 552295 - DNA, 25 bp, Mus musculus
gccctttgctggtgcgagatgtatt

SEQ ID NO: 552296 - DNA, 25 bp, Mus musculus
gccctttgctgtagatttggctgca

SEQ ID NO: 552297 - DNA, 25 bp, Mus musculus
gccctttgctgttgatttggctgca

SEQ ID NO: 552298 - DNA, 25 bp, Mus musculus
gccctttgctttcctgatactgaaa

SEQ ID NO: 552299 - DNA, 25 bp, Mus musculus
gccctttgctttgctgatactgaaa

SEQ ID NO: 552300 - DNA, 25 bp, Mus musculus
gccctttggaagctcacacacttaa

SEQ ID NO: 552301 - DNA, 25 bp, Mus musculus
gccctttggaaggtcacacacttaa

SEQ ID NO: 552302 - DNA, 25 bp, Mus musculus
gccctttgggcaagtgttaataaca

SEQ ID NO: 552303 - DNA, 25 bp, Mus musculus
gccctttgggcatgtgttaataaca

SEQ ID NO: 552304 - DNA, 25 bp, Mus musculus
gccctttggtacatctatcactttg

SEQ ID NO: 552305 - DNA, 25 bp, Mus musculus
gccctttggtacttctatcactttg

SEQ ID NO: 552306 - DNA, 25 bp, Mus musculus
gccctttggtcacatgctttgtgga

SEQ ID NO: 552307 - DNA, 25 bp, Mus musculus
gccctttggtcagatgctttgtgga

SEQ ID NO: 552308 - DNA, 25 bp, Mus musculus
gccctttgtatgatctcgtattgca

SEQ ID NO: 552309 - DNA, 25 bp, Mus musculus
gccctttgtatgttctcgtattgca

SEQ ID NO: 552310 - DNA, 25 bp, Mus musculus
gccctttgtcgtcttgtttactgaa

SEQ ID NO: 552311 - DNA, 25 bp, Mus musculus
gccctttgtcgtgttgtttactgaa

SEQ ID NO: 552312 - DNA, 25 bp, Mus musculus
gccctttgttagatcctgcaggaga

SEQ ID NO: 552313 - DNA, 25 bp, Mus musculus
gccctttgttagttcctgcaggaga

SEQ ID NO: 552314 - DNA, 25 bp, Mus musculus
gccctttgttcaagtcttagttagg

SEQ ID NO: 552315 - DNA, 25 bp, Mus musculus
gccctttgttcatgtcttagttagg

SEQ ID NO: 552316 - DNA, 25 bp, Mus musculus
gcccttttacaacccagtggacgcg

SEQ ID NO: 552317 - DNA, 25 bp, Mus musculus
gcccttttacaagccagtggacgcg

SEQ ID NO: 552318 - DNA, 25 bp, Mus musculus
gcccttttacttcttggcaagcaga

SEQ ID NO: 552319 - DNA, 25 bp, Mus musculus
gcccttttacttgttggcaagcaga

SEQ ID NO: 552320 - DNA, 25 bp, Mus musculus
gcccttttagtaagtgagcaaccaa

SEQ ID NO: 552321 - DNA, 25 bp, Mus musculus
gcccttttagtatgtgagcaaccaa

SEQ ID NO: 552322 - DNA, 25 bp, Mus musculus
gcccttttatatccatatctacggg

SEQ ID NO: 552323 - DNA, 25 bp, Mus musculus
gcccttttatatgcatatctacggg

SEQ ID NO: 552324 - DNA, 25 bp, Mus musculus
gcccttttcctcagagatttgtgca

SEQ ID NO: 552325 - DNA, 25 bp, Mus musculus
gcccttttcctctgagatttgtgca

SEQ ID NO: 552326 - DNA, 25 bp, Mus musculus
gcccttttctgcaatctgaggtctg

SEQ ID NO: 552327 - DNA, 25 bp, Mus musculus
gcccttttctgctatctgaggtctg

SEQ ID NO: 552328 - DNA, 25 bp, Mus musculus
gcccttttctttcacaacgttaatg

SEQ ID NO: 552329 - DNA, 25 bp, Mus musculus
gcccttttctttgacaacgttaatg

SEQ ID NO: 552330 - DNA, 25 bp, Mus musculus
gcccttttgagtatcctactagaca

SEQ ID NO: 552331 - DNA, 25 bp, Mus musculus
gcccttttgagtttcctactagaca

SEQ ID NO: 552332 - DNA, 25 bp, Mus musculus
gcccttttgctcatctgcagagcaa

SEQ ID NO: 552333 - DNA, 25 bp, Mus musculus
gcccttttgctcttctgcagagcaa

SEQ ID NO: 552334 - DNA, 25 bp, Mus musculus
gccctttttctcacaactgagctaa

SEQ ID NO: 552335 - DNA, 25 bp, Mus musculus
gccctttttctctcaactgagctaa

SEQ ID NO: 552336 - DNA, 25 bp, Mus musculus
gccctttttggcagtgttctgaaat

SEQ ID NO: 552337 - DNA, 25 bp, Mus musculus
gccctttttggctgtgttctgaaat

SEQ ID NO: 552338 - DNA, 25 bp, Mus musculus
gcccttttttgtatccccatgtttg

SEQ ID NO: 552339 - DNA, 25 bp, Mus musculus
gcccttttttgtttccccatgtttg

SEQ ID NO: 552340 - DNA, 25 bp, Mus musculus
gccgaaacacatcaaatagcatttt

SEQ ID NO: 552341 - DNA, 25 bp, Mus musculus
gccgaaacacatgaaatagcatttt

SEQ ID NO: 552342 - DNA, 25 bp, Mus musculus
gccgaaagacagctcatctatgact

SEQ ID NO: 552343 - DNA, 25 bp, Mus musculus
gccgaaagacaggtcatctatgact

SEQ ID NO: 552344 - DNA, 25 bp, Mus musculus
gccgaaatgaacaagacactcctgg

SEQ ID NO: 552345 - DNA, 25 bp, Mus musculus
gccgaaatgaactagacactcctgg

SEQ ID NO: 552346 - DNA, 25 bp, Mus musculus
gccgaaattgctctggactggacca

SEQ ID NO: 552347 - DNA, 25 bp, Mus musculus
gccgaaattgctgtggactggacca

SEQ ID NO: 552348 - DNA, 25 bp, Mus musculus
gccgaacagcagaaggcgcaattca

SEQ ID NO: 552349 - DNA, 25 bp, Mus musculus
gccgaacagcagtaggcgcaattca

SEQ ID NO: 552350 - DNA, 25 bp, Mus musculus
gccgaacatactcaactgctacgta

SEQ ID NO: 552351 - DNA, 25 bp, Mus musculus
gccgaacatactgaactgctacgta

SEQ ID NO: 552352 - DNA, 25 bp, Mus musculus
gccgaacattgtccatgacctgtct

SEQ ID NO: 552353 - DNA, 25 bp, Mus musculus
gccgaacattgtgcatgacctgtct

SEQ ID NO: 552354 - DNA, 25 bp, Mus musculus
gccgaaccaggaccatcaccaagga

SEQ ID NO: 552355 - DNA, 25 bp, Mus musculus
gccgaaccaggagcatcaccaagga

SEQ ID NO: 552356 - DNA, 25 bp, Mus musculus
gccgaacgacaacgacactcaaact

SEQ ID NO: 552357 - DNA, 25 bp, Mus musculus
gccgaacgacaaggacactcaaact

SEQ ID NO: 552358 - DNA, 25 bp, Mus musculus
gccgaacttgctcccccagttggga

SEQ ID NO: 552359 - DNA, 25 bp, Mus musculus
gccgaacttgctgccccagttggga

SEQ ID NO: 552360 - DNA, 25 bp, Mus musculus
gccgaagacaatccattatgggaaa

SEQ ID NO: 552361 - DNA, 25 bp, Mus musculus
gccgaagacaatgcattatgggaaa

SEQ ID NO: 552362 - DNA, 25 bp, Mus musculus
gccgaagactggcttactgatgatt

SEQ ID NO: 552363 - DNA, 25 bp, Mus musculus
gccgaagactgggttactgatgatt

SEQ ID NO: 552364 - DNA, 25 bp, Mus musculus
gccgaagagtcccatgacagcgatg

SEQ ID NO: 552365 - DNA, 25 bp, Mus musculus
gccgaagagtccgatgacagcgatg

SEQ ID NO: 552366 - DNA, 25 bp, Mus musculus
gccgaagagtctcccagagtcatgt

SEQ ID NO: 552367 - DNA, 25 bp, Mus musculus
gccgaagagtctgccagagtcatgt

SEQ ID NO: 552368 - DNA, 25 bp, Mus musculus
gccgaagcacgcactgagtgtattt

SEQ ID NO: 552369 - DNA, 25 bp, Mus musculus
gccgaagcacgctctgagtgtattt

SEQ ID NO: 552370 - DNA, 25 bp, Mus musculus
gccgaagcctggactggacttactc

SEQ ID NO: 552371 - DNA, 25 bp, Mus musculus
gccgaagcctggtctggacttactc

SEQ ID NO: 552372 - DNA, 25 bp, Mus musculus
gccgaagggttacctcttagcttct

SEQ ID NO: 552373 - DNA, 25 bp, Mus musculus
gccgaagggttagctcttagcttct

SEQ ID NO: 552374 - DNA, 25 bp, Mus musculus
gccgaaggtggtcgtaaagtcccat

SEQ ID NO: 552375 - DNA, 25 bp, Mus musculus
gccgaaggtggtggtaaagtcccat

SEQ ID NO: 552376 - DNA, 25 bp, Mus musculus
gccgaagtgccccaagtgcgacaag

SEQ ID NO: 552377 - DNA, 25 bp, Mus musculus
gccgaagtgcccgaagtgcgacaag

SEQ ID NO: 552378 - DNA, 25 bp, Mus musculus
gccgaagtgtggctgaacctgtact

SEQ ID NO: 552379 - DNA, 25 bp, Mus musculus
gccgaagtgtgggtgaacctgtact

SEQ ID NO: 552380 - DNA, 25 bp, Mus musculus
gccgaatacaaacgcacacacagta

SEQ ID NO: 552381 - DNA, 25 bp, Mus musculus
gccgaatacaaaggcacacacagta

SEQ ID NO: 552382 - DNA, 25 bp, Mus musculus
gccgaatatacgcaacttcgcagtg

SEQ ID NO: 552383 - DNA, 25 bp, Mus musculus
gccgaatatacggaacttcgcagtg

SEQ ID NO: 552384 - DNA, 25 bp, Mus musculus
gccgaatggttcctttgctgctact

SEQ ID NO: 552385 - DNA, 25 bp, Mus musculus
gccgaatggttcgtttgctgctact

SEQ ID NO: 552386 - DNA, 25 bp, Mus musculus
gccgaatgtcgcagaaccttagata

SEQ ID NO: 552387 - DNA, 25 bp, Mus musculus
gccgaatgtcgctgaaccttagata

SEQ ID NO: 552388 - DNA, 25 bp, Mus musculus
gccgaatgtgatactcaggctacac

SEQ ID NO: 552389 - DNA, 25 bp, Mus musculus
gccgaatgtgattctcaggctacac

SEQ ID NO: 552390 - DNA, 25 bp, Mus musculus
gccgaattcttgaccttgtacgaga

SEQ ID NO: 552391 - DNA, 25 bp, Mus musculus
gccgaattcttgtccttgtacgaga

SEQ ID NO: 552392 - DNA, 25 bp, Mus musculus
gccgacaacgtcaagggcaggtcac

SEQ ID NO: 552393 - DNA, 25 bp, Mus musculus
gccgacaacgtctagggcaggtcac

SEQ ID NO: 552394 - DNA, 25 bp, Mus musculus
gccgacaacttccaggcatttgtgt

SEQ ID NO: 552395 - DNA, 25 bp, Mus musculus
gccgacaacttcgaggcatttgtgt

SEQ ID NO: 552396 - DNA, 25 bp, Mus musculus
gccgacaagtacatggacaccgccg

SEQ ID NO: 552397 - DNA, 25 bp, Mus musculus
gccgacaagtacttggacaccgccg

SEQ ID NO: 552398 - DNA, 25 bp, Mus musculus
gccgacatcattctgatcaaataca

SEQ ID NO: 552399 - DNA, 25 bp, Mus musculus
gccgacatcattgtgatcaaataca

SEQ ID NO: 552400 - DNA, 25 bp, Mus musculus
gccgacatgcgtctggccgacatgc

SEQ ID NO: 552401 - DNA, 25 bp, Mus musculus
gccgacatgcgtgtggccgacatgc

SEQ ID NO: 552402 - DNA, 25 bp, Mus musculus
gccgacatggccatccttgtaggaa

SEQ ID NO: 552403 - DNA, 25 bp, Mus musculus
gccgacatggccttccttgtaggaa

SEQ ID NO: 552404 - DNA, 25 bp, Mus musculus
gccgacatgtctagaccttttcttc

SEQ ID NO: 552405 - DNA, 25 bp, Mus musculus
gccgacatgtcttgaccttttcttc

SEQ ID NO: 552406 - DNA, 25 bp, Mus musculus
gccgaccccacaagcaataacagat

SEQ ID NO: 552407 - DNA, 25 bp, Mus musculus
gccgaccccacatgcaataacagat

SEQ ID NO: 552408 - DNA, 25 bp, Mus musculus
gccgacccgggcaagcaaaaatggg

SEQ ID NO: 552409 - DNA, 25 bp, Mus musculus
gccgacccgggctagcaaaaatggg

SEQ ID NO: 552410 - DNA, 25 bp, Mus musculus
gccgacctggtcctcatcgagggaa

SEQ ID NO: 552411 - DNA, 25 bp, Mus musculus
gccgacctggtcgtcatcgagggaa

SEQ ID NO: 552412 - DNA, 25 bp, Mus musculus
gccgacctttacctcacaggtgaaa

SEQ ID NO: 552413 - DNA, 25 bp, Mus musculus
gccgacctttacgtcacaggtgaaa

SEQ ID NO: 552414 - DNA, 25 bp, Mus musculus
gccgacgcacgtcttttgcaaacat

SEQ ID NO: 552415 - DNA, 25 bp, Mus musculus
gccgacgcacgtgttttgcaaacat

SEQ ID NO: 552416 - DNA, 25 bp, Mus musculus
gccgacggccccatgaacctggaga

SEQ ID NO: 552417 - DNA, 25 bp, Mus musculus
gccgacggccccttgaacctggaga

SEQ ID NO: 552418 - DNA, 25 bp, Mus musculus
gccgacggttagattgcacaggaag

SEQ ID NO: 552419 - DNA, 25 bp, Mus musculus
gccgacggttagtttgcacaggaag

SEQ ID NO: 552420 - DNA, 25 bp, Mus musculus
gccgacgtcgcgaccacagtgcatg

SEQ ID NO: 552421 - DNA, 25 bp, Mus musculus
gccgacgtcgcgtccacagtgcatg

SEQ ID NO: 552422 - DNA, 25 bp, Mus musculus
gccgacgtggatcccgaaaaccaga

SEQ ID NO: 552423 - DNA, 25 bp, Mus musculus
gccgacgtggatgccgaaaaccaga

SEQ ID NO: 552424 - DNA, 25 bp, Mus musculus
gccgacgtggcgcagcgcacaggtc

SEQ ID NO: 552425 - DNA, 25 bp, Mus musculus
gccgacgtggcggagcgcacaggtc

SEQ ID NO: 552426 - DNA, 25 bp, Mus musculus
gccgactagttacggtctgtatcct

SEQ ID NO: 552427 - DNA, 25 bp, Mus musculus
gccgactagttagggtctgtatcct

SEQ ID NO: 552428 - DNA, 25 bp, Mus musculus
gccgactcacccaggcacagaggat

SEQ ID NO: 552429 - DNA, 25 bp, Mus musculus
gccgactcaccctggcacagaggat

SEQ ID NO: 552430 - DNA, 25 bp, Mus musculus
gccgactcacctcatgtgtgcatca

SEQ ID NO: 552431 - DNA, 25 bp, Mus musculus
gccgactcacctgatgtgtgcatca

SEQ ID NO: 552432 - DNA, 25 bp, Mus musculus
gccgactcagccactaagtatacat

SEQ ID NO: 552433 - DNA, 25 bp, Mus musculus
gccgactcagcctctaagtatacat

SEQ ID NO: 552434 - DNA, 25 bp, Mus musculus
gccgactgatccaaagcaactgcta

SEQ ID NO: 552435 - DNA, 25 bp, Mus musculus
gccgactgatcctaagcaactgcta

SEQ ID NO: 552436 - DNA, 25 bp, Mus musculus
gccgactggcatatttaaggagcac

SEQ ID NO: 552437 - DNA, 25 bp, Mus musculus
gccgactggcatttttaaggagcac

SEQ ID NO: 552438 - DNA, 25 bp, Mus musculus
gccgactgtgaacctgggccatcag

SEQ ID NO: 552439 - DNA, 25 bp, Mus musculus
gccgactgtgaagctgggccatcag

SEQ ID NO: 552440 - DNA, 25 bp, Mus musculus
gccgactgtgtgagtaatgctctag

SEQ ID NO: 552441 - DNA, 25 bp, Mus musculus
gccgactgtgtgtgtaatgctctag

SEQ ID NO: 552442 - DNA, 25 bp, Mus musculus
gccgacttcacgctcgcggtcgcct

SEQ ID NO: 552443 - DNA, 25 bp, Mus musculus
gccgacttcacggtcgcggtcgcct

SEQ ID NO: 552444 - DNA, 25 bp, Mus musculus
gccgagaaagttaggcatcattttt

SEQ ID NO: 552445 - DNA, 25 bp, Mus musculus
gccgagaaagtttggcatcattttt

SEQ ID NO: 552446 - DNA, 25 bp, Mus musculus
gccgagaccttacccacattggaga

SEQ ID NO: 552447 - DNA, 25 bp, Mus musculus
gccgagaccttagccacattggaga

SEQ ID NO: 552448 - DNA, 25 bp, Mus musculus
gccgagagaagaccctatatcacag

SEQ ID NO: 552449 - DNA, 25 bp, Mus musculus
gccgagagaagagcctatatcacag

SEQ ID NO: 552450 - DNA, 25 bp, Mus musculus
gccgagaggaagcttgtgaactcaa

SEQ ID NO: 552451 - DNA, 25 bp, Mus musculus
gccgagaggaaggttgtgaactcaa

SEQ ID NO: 552452 - DNA, 25 bp, Mus musculus
gccgagagtattcgtgcaagcctat

SEQ ID NO: 552453 - DNA, 25 bp, Mus musculus
gccgagagtattggtgcaagcctat

SEQ ID NO: 552454 - DNA, 25 bp, Mus musculus
gccgagagtgctccctggattactt

SEQ ID NO: 552455 - DNA, 25 bp, Mus musculus
gccgagagtgctgcctggattactt

SEQ ID NO: 552456 - DNA, 25 bp, Mus musculus
gccgagatctcgatcagtggcaatc

SEQ ID NO: 552457 - DNA, 25 bp, Mus musculus
gccgagatctcgttcagtggcaatc

SEQ ID NO: 552458 - DNA, 25 bp, Mus musculus
gccgagatgcataagatgaaatcta

SEQ ID NO: 552459 - DNA, 25 bp, Mus musculus
gccgagatgcattagatgaaatcta

SEQ ID NO: 552460 - DNA, 25 bp, Mus musculus
gccgagatggccacggccaagaaga

SEQ ID NO: 552461 - DNA, 25 bp, Mus musculus
gccgagatggccattagtggaagta

SEQ ID NO: 552462 - DNA, 25 bp, Mus musculus
gccgagatggcctcggccaagaaga

SEQ ID NO: 552463 - DNA, 25 bp, Mus musculus
gccgagatggcctttagtggaagta

SEQ ID NO: 552464 - DNA, 25 bp, Mus musculus
gccgagatgtgcatggcacatgaat

SEQ ID NO: 552465 - DNA, 25 bp, Mus musculus
gccgagatgtgcttggcacatgaat

SEQ ID NO: 552466 - DNA, 25 bp, Mus musculus
gccgagcactcacctggagcagaga

SEQ ID NO: 552467 - DNA, 25 bp, Mus musculus
gccgagcactcagctggagcagaga

SEQ ID NO: 552468 - DNA, 25 bp, Mus musculus
gccgagcgaacgagtgcgtccagta

SEQ ID NO: 552469 - DNA, 25 bp, Mus musculus
gccgagcgaacgtgtgcgtccagta

SEQ ID NO: 552470 - DNA, 25 bp, Mus musculus
gccgagcggcagacgccaacatgca

SEQ ID NO: 552471 - DNA, 25 bp, Mus musculus
gccgagcggcagtcgccaacatgca

SEQ ID NO: 552472 - DNA, 25 bp, Mus musculus
gccgagctacctaccggatagagga

SEQ ID NO: 552473 - DNA, 25 bp, Mus musculus
gccgagctaccttccggatagagga

SEQ ID NO: 552474 - DNA, 25 bp, Mus musculus
gccgagctagacaacaaggtctgct

SEQ ID NO: 552475 - DNA, 25 bp, Mus musculus
gccgagctagactacaaggtctgct

SEQ ID NO: 552476 - DNA, 25 bp, Mus musculus
gccgagctgagcagtaccttatgga

SEQ ID NO: 552477 - DNA, 25 bp, Mus musculus
gccgagctgagctgtaccttatgga

SEQ ID NO: 552478 - DNA, 25 bp, Mus musculus
gccgagctgtcaacgtagtgttcga

SEQ ID NO: 552479 - DNA, 25 bp, Mus musculus
gccgagctgtcatcgtagtgttcga

SEQ ID NO: 552480 - DNA, 25 bp, Mus musculus
gccgaggccaataaagactggtttt

SEQ ID NO: 552481 - DNA, 25 bp, Mus musculus
gccgaggccaattaagactggtttt

SEQ ID NO: 552482 - DNA, 25 bp, Mus musculus
gccgaggcttcacccgatgagatga

SEQ ID NO: 552483 - DNA, 25 bp, Mus musculus
gccgaggcttcagccgatgagatga

SEQ ID NO: 552484 - DNA, 25 bp, Mus musculus
gccgagggcggacatttatgacttt

SEQ ID NO: 552485 - DNA, 25 bp, Mus musculus
gccgagggcggagatttatgacttt

SEQ ID NO: 552486 - DNA, 25 bp, Mus musculus
gccgaggtagccatttctcactgag

SEQ ID NO: 552487 - DNA, 25 bp, Mus musculus
gccgaggtagccttttctcactgag

SEQ ID NO: 552488 - DNA, 25 bp, Mus musculus
gccgaggttgataggaccacaggcc

SEQ ID NO: 552489 - DNA, 25 bp, Mus musculus
gccgaggttgattggaccacaggcc

SEQ ID NO: 552490 - DNA, 25 bp, Mus musculus
gccgaggttggcattaaactgatcc

SEQ ID NO: 552491 - DNA, 25 bp, Mus musculus
gccgaggttggctttaaactgatcc

SEQ ID NO: 552492 - DNA, 25 bp, Mus musculus
gccgagtatgatatgattcagccta

SEQ ID NO: 552493 - DNA, 25 bp, Mus musculus
gccgagtatgatttgattcagccta

SEQ ID NO: 552494 - DNA, 25 bp, Mus musculus
gccgagtcactgcaacaagttcaaa

SEQ ID NO: 552495 - DNA, 25 bp, Mus musculus
gccgagtcactggaacaagttcaaa

SEQ ID NO: 552496 - DNA, 25 bp, Mus musculus
gccgagtcctgaacgctgtgaaact

SEQ ID NO: 552497 - DNA, 25 bp, Mus musculus
gccgagtcctgatcgctgtgaaact

SEQ ID NO: 552498 - DNA, 25 bp, Mus musculus
gccgagtcctgccatcataagtatg

SEQ ID NO: 552499 - DNA, 25 bp, Mus musculus
gccgagtcctgcgatcataagtatg

SEQ ID NO: 552500 - DNA, 25 bp, Mus musculus
gccgagtgaagacgaagaatgccaa

SEQ ID NO: 552501 - DNA, 25 bp, Mus musculus
gccgagtgaagaggaagaatgccaa

SEQ ID NO: 552502 - DNA, 25 bp, Mus musculus
gccgagtgacaaaccatctggtatt

SEQ ID NO: 552503 - DNA, 25 bp, Mus musculus
gccgagtgacaatccatctggtatt

SEQ ID NO: 552504 - DNA, 25 bp, Mus musculus
gccgagttcaacagcacgagggctc

SEQ ID NO: 552505 - DNA, 25 bp, Mus musculus
gccgagttcaactgcacgagggctc

SEQ ID NO: 552506 - DNA, 25 bp, Mus musculus
gccgagttccgtctccgaggtgtaa

SEQ ID NO: 552507 - DNA, 25 bp, Mus musculus
gccgagttccgtgtccgaggtgtaa

SEQ ID NO: 552508 - DNA, 25 bp, Mus musculus
gccgagttcttgagtaagtaatact

SEQ ID NO: 552509 - DNA, 25 bp, Mus musculus
gccgagttcttgtgtaagtaatact

SEQ ID NO: 552510 - DNA, 25 bp, Mus musculus
gccgagttttaactgaacccaggtg

SEQ ID NO: 552511 - DNA, 25 bp, Mus musculus
gccgagttttaagtgaacccaggtg

SEQ ID NO: 552512 - DNA, 25 bp, Mus musculus
gccgataagcatcggtttccttggt

SEQ ID NO: 552513 - DNA, 25 bp, Mus musculus
gccgataagcatgggtttccttggt

SEQ ID NO: 552514 - DNA, 25 bp, Mus musculus
gccgataatgtgctttttgagtgat

SEQ ID NO: 552515 - DNA, 25 bp, Mus musculus
gccgataatgtggtttttgagtgat

SEQ ID NO: 552516 - DNA, 25 bp, Mus musculus
gccgatacccagatcctaatcttaa

SEQ ID NO: 552517 - DNA, 25 bp, Mus musculus
gccgatacccagttcctaatcttaa

SEQ ID NO: 552518 - DNA, 25 bp, Mus musculus
gccgatacctgcctttgtccaagaa

SEQ ID NO: 552519 - DNA, 25 bp, Mus musculus
gccgatacctgcgtttgtccaagaa

SEQ ID NO: 552520 - DNA, 25 bp, Mus musculus
gccgatatcggcaacaagaccttct

SEQ ID NO: 552521 - DNA, 25 bp, Mus musculus
gccgatatcggctacaagaccttct

SEQ ID NO: 552522 - DNA, 25 bp, Mus musculus
gccgatatcttaaacgacctgtgtt

SEQ ID NO: 552523 - DNA, 25 bp, Mus musculus
gccgatatcttatacgacctgtgtt

SEQ ID NO: 552524 - DNA, 25 bp, Mus musculus
gccgatatgtttcccctaaagccca

SEQ ID NO: 552525 - DNA, 25 bp, Mus musculus
gccgatatgtttgccctaaagccca

SEQ ID NO: 552526 - DNA, 25 bp, Mus musculus
gccgatcaatggcatgaactggacc

SEQ ID NO: 552527 - DNA, 25 bp, Mus musculus
gccgatcaatgggatgaactggacc

SEQ ID NO: 552528 - DNA, 25 bp, Mus musculus
gccgatcctaaaccaattaatttat

SEQ ID NO: 552529 - DNA, 25 bp, Mus musculus
gccgatcctaaagcaattaatttat

SEQ ID NO: 552530 - DNA, 25 bp, Mus musculus
gccgatcgggtcaggcaagtccgtc

SEQ ID NO: 552531 - DNA, 25 bp, Mus musculus
gccgatcgggtctggcaagtccgtc

SEQ ID NO: 552532 - DNA, 25 bp, Mus musculus
gccgatctacggaggtaccaacgaa

SEQ ID NO: 552533 - DNA, 25 bp, Mus musculus
gccgatctacggtggtaccaacgaa

SEQ ID NO: 552534 - DNA, 25 bp, Mus musculus
gccgatgatcacagctagttaagag

SEQ ID NO: 552535 - DNA, 25 bp, Mus musculus
gccgatgatcactgctagttaagag

SEQ ID NO: 552536 - DNA, 25 bp, Mus musculus
gccgatgattctccatcagggacaa

SEQ ID NO: 552537 - DNA, 25 bp, Mus musculus
gccgatgattctgcatcagggacaa

SEQ ID NO: 552538 - DNA, 25 bp, Mus musculus
gccgatgcccatatgctgagcatga

SEQ ID NO: 552539 - DNA, 25 bp, Mus musculus
gccgatgcccatttgctgagcatga

SEQ ID NO: 552540 - DNA, 25 bp, Mus musculus
gccgatgcggtccatcaatggcact

SEQ ID NO: 552541 - DNA, 25 bp, Mus musculus
gccgatgcggtcgatcaatggcact

SEQ ID NO: 552542 - DNA, 25 bp, Mus musculus
gccgatggcctaagcaaatcctttt

SEQ ID NO: 552543 - DNA, 25 bp, Mus musculus
gccgatggcctatgcaaatcctttt

SEQ ID NO: 552544 - DNA, 25 bp, Mus musculus
gccgatgggattacctagctgctag

SEQ ID NO: 552545 - DNA, 25 bp, Mus musculus
gccgatgggatttcctagctgctag

SEQ ID NO: 552546 - DNA, 25 bp, Mus musculus
gccgatgggcctagctgagtaagaa

SEQ ID NO: 552547 - DNA, 25 bp, Mus musculus
gccgatgggccttgctgagtaagaa

SEQ ID NO: 552548 - DNA, 25 bp, Mus musculus
gccgatggtcagagtctcaaggtga

SEQ ID NO: 552549 - DNA, 25 bp, Mus musculus
gccgatggtcagtgtctcaaggtga

SEQ ID NO: 552550 - DNA, 25 bp, Mus musculus
gccgatgtcagtactaaggattctc

SEQ ID NO: 552551 - DNA, 25 bp, Mus musculus
gccgatgtcagttctaaggattctc

SEQ ID NO: 552552 - DNA, 25 bp, Mus musculus
gccgatgtctttcttcgtatggaaa

SEQ ID NO: 552553 - DNA, 25 bp, Mus musculus
gccgatgtctttgttcgtatggaaa

SEQ ID NO: 552554 - DNA, 25 bp, Mus musculus
gccgattcatggatgggagccccta

SEQ ID NO: 552555 - DNA, 25 bp, Mus musculus
gccgattcatggttgggagccccta

SEQ ID NO: 552556 - DNA, 25 bp, Mus musculus
gccgattctgttaaacgaacgtctt

SEQ ID NO: 552557 - DNA, 25 bp, Mus musculus
gccgattctgtttaacgaacgtctt

SEQ ID NO: 552558 - DNA, 25 bp, Mus musculus
gccgatttgccaccaaagcttcaaa

SEQ ID NO: 552559 - DNA, 25 bp, Mus musculus
gccgatttgccagcaaagcttcaaa

SEQ ID NO: 552560 - DNA, 25 bp, Mus musculus
gccgattttcctctaggaagatgat

SEQ ID NO: 552561 - DNA, 25 bp, Mus musculus
gccgattttcctgtaggaagatgat

SEQ ID NO: 552562 - DNA, 25 bp, Mus musculus
gccgatttttagcatgcctgctgct

SEQ ID NO: 552563 - DNA, 25 bp, Mus musculus
gccgatttttaggatgcctgctgct

SEQ ID NO: 552564 - DNA, 25 bp, Mus musculus
gccgcaaacacaagtctaagtcccg

SEQ ID NO: 552565 - DNA, 25 bp, Mus musculus
gccgcaaacacatgtctaagtcccg

SEQ ID NO: 552566 - DNA, 25 bp, Mus musculus
gccgcaaagactcttcttggcataa

SEQ ID NO: 552567 - DNA, 25 bp, Mus musculus
gccgcaaagactgttcttggcataa

SEQ ID NO: 552568 - DNA, 25 bp, Mus musculus
gccgcaagagagaggctttccacgc

SEQ ID NO: 552569 - DNA, 25 bp, Mus musculus
gccgcaagagagtggctttccacgc

SEQ ID NO: 552570 - DNA, 25 bp, Mus musculus
gccgcaagctggctgtaagataata

SEQ ID NO: 552571 - DNA, 25 bp, Mus musculus
gccgcaagctgggtgtaagataata

SEQ ID NO: 552572 - DNA, 25 bp, Mus musculus
gccgcaatgtggacaagcctcctgg

SEQ ID NO: 552573 - DNA, 25 bp, Mus musculus
gccgcaatgtggtcaagcctcctgg

SEQ ID NO: 552574 - DNA, 25 bp, Mus musculus
gccgcacacaacactgtcgtaatag

SEQ ID NO: 552575 - DNA, 25 bp, Mus musculus
gccgcacacaactctgtcgtaatag

SEQ ID NO: 552576 - DNA, 25 bp, Mus musculus
gccgcacagtcacggcaaggcctag

SEQ ID NO: 552577 - DNA, 25 bp, Mus musculus
gccgcacagtcagggcaaggcctag

SEQ ID NO: 552578 - DNA, 25 bp, Mus musculus
gccgcacctccacgaggagaataaa

SEQ ID NO: 552579 - DNA, 25 bp, Mus musculus
gccgcacctccaggaggagaataaa

SEQ ID NO: 552580 - DNA, 25 bp, Mus musculus
gccgcacgcgagatcattctgaaga

SEQ ID NO: 552581 - DNA, 25 bp, Mus musculus
gccgcacgcgagttcattctgaaga

SEQ ID NO: 552582 - DNA, 25 bp, Mus musculus
gccgcacgtgcaacaagacatctaa

SEQ ID NO: 552583 - DNA, 25 bp, Mus musculus
gccgcacgtgcatcaagacatctaa

SEQ ID NO: 552584 - DNA, 25 bp, Mus musculus
gccgcactcccacgtagtcagagtg

SEQ ID NO: 552585 - DNA, 25 bp, Mus musculus
gccgcactcccaggtagtcagagtg

SEQ ID NO: 552586 - DNA, 25 bp, Mus musculus
gccgcactgggtacattttaagctt

SEQ ID NO: 552587 - DNA, 25 bp, Mus musculus
gccgcactgggttcattttaagctt

SEQ ID NO: 552588 - DNA, 25 bp, Mus musculus
gccgcagaaggccatgattctttaa

SEQ ID NO: 552589 - DNA, 25 bp, Mus musculus
gccgcagaaggcgatgattctttaa

SEQ ID NO: 552590 - DNA, 25 bp, Mus musculus
gccgcagaatcgagggacccatcgt

SEQ ID NO: 552591 - DNA, 25 bp, Mus musculus
gccgcagaatcgtgggacccatcgt

SEQ ID NO: 552592 - DNA, 25 bp, Mus musculus
gccgcagaccataatctggcgggag

SEQ ID NO: 552593 - DNA, 25 bp, Mus musculus
gccgcagaccattatctggcgggag

SEQ ID NO: 552594 - DNA, 25 bp, Mus musculus
gccgcagcatttaccacttacaaaa

SEQ ID NO: 552595 - DNA, 25 bp, Mus musculus
gccgcagcattttccacttacaaaa

SEQ ID NO: 552596 - DNA, 25 bp, Mus musculus
gccgcagcctagcagggtctcgggc

SEQ ID NO: 552597 - DNA, 25 bp, Mus musculus
gccgcagcctaggagggtctcgggc

SEQ ID NO: 552598 - DNA, 25 bp, Mus musculus
gccgcagcgggtaattacagctcat

SEQ ID NO: 552599 - DNA, 25 bp, Mus musculus
gccgcagcgggttattacagctcat

SEQ ID NO: 552600 - DNA, 25 bp, Mus musculus
gccgcagctctgctacagtggaaga

SEQ ID NO: 552601 - DNA, 25 bp, Mus musculus
gccgcagctctggtacagtggaaga

SEQ ID NO: 552602 - DNA, 25 bp, Mus musculus
gccgcagggaacaaagaccgcctgt

SEQ ID NO: 552603 - DNA, 25 bp, Mus musculus
gccgcagggaactaagaccgcctgt

SEQ ID NO: 552604 - DNA, 25 bp, Mus musculus
gccgcagggttgatatccgcgtcca

SEQ ID NO: 552605 - DNA, 25 bp, Mus musculus
gccgcagggttgttatccgcgtcca

SEQ ID NO: 552606 - DNA, 25 bp, Mus musculus
gccgcaggtttcacctagggaatgc

SEQ ID NO: 552607 - DNA, 25 bp, Mus musculus
gccgcaggtttctcctagggaatgc

SEQ ID NO: 552608 - DNA, 25 bp, Mus musculus
gccgcagtaagccagggactagttt

SEQ ID NO: 552609 - DNA, 25 bp, Mus musculus
gccgcagtaagcgagggactagttt

SEQ ID NO: 552610 - DNA, 25 bp, Mus musculus
gccgcagtcatgaccatctggcaag

SEQ ID NO: 552611 - DNA, 25 bp, Mus musculus
gccgcagtcatgtccatctggcaag

SEQ ID NO: 552612 - DNA, 25 bp, Mus musculus
gccgcagtccggatgattcttgggt

SEQ ID NO: 552613 - DNA, 25 bp, Mus musculus
gccgcagtccggttgattcttgggt

SEQ ID NO: 552614 - DNA, 25 bp, Mus musculus
gccgcagtgaacaccattttgacat

SEQ ID NO: 552615 - DNA, 25 bp, Mus musculus
gccgcagtgaactccattttgacat

SEQ ID NO: 552616 - DNA, 25 bp, Mus musculus
gccgcatacgcgcagaacgtgctta

SEQ ID NO: 552617 - DNA, 25 bp, Mus musculus
gccgcatacgcggagaacgtgctta

SEQ ID NO: 552618 - DNA, 25 bp, Mus musculus
gccgcataggccagcttcactggag

SEQ ID NO: 552619 - DNA, 25 bp, Mus musculus
gccgcataggcctgcttcactggag

SEQ ID NO: 552620 - DNA, 25 bp, Mus musculus
gccgcatctagtactgataatgatt

SEQ ID NO: 552621 - DNA, 25 bp, Mus musculus
gccgcatctagttctgataatgatt

SEQ ID NO: 552622 - DNA, 25 bp, Mus musculus
gccgcatgctgcaagcacacgtgga

SEQ ID NO: 552623 - DNA, 25 bp, Mus musculus
gccgcatgctgctagcacacgtgga

SEQ ID NO: 552624 - DNA, 25 bp, Mus musculus
gccgcatggacgaccagcgtgtaac

SEQ ID NO: 552625 - DNA, 25 bp, Mus musculus
gccgcatggacgtccagcgtgtaac

SEQ ID NO: 552626 - DNA, 25 bp, Mus musculus
gccgcatgggccaagatggtgccct

SEQ ID NO: 552627 - DNA, 25 bp, Mus musculus
gccgcatgggcctagatggtgccct

SEQ ID NO: 552628 - DNA, 25 bp, Mus musculus
gccgcatgtacaaaccgagtctact

SEQ ID NO: 552629 - DNA, 25 bp, Mus musculus
gccgcatgtacacagctagcacttt

SEQ ID NO: 552630 - DNA, 25 bp, Mus musculus
gccgcatgtacagagctagcacttt

SEQ ID NO: 552631 - DNA, 25 bp, Mus musculus
gccgcatgtacataccgagtctact

SEQ ID NO: 552632 - DNA, 25 bp, Mus musculus
gccgccaagtttcctaatgtgcttt

SEQ ID NO: 552633 - DNA, 25 bp, Mus musculus
gccgccaagtttgctaatgtgcttt

SEQ ID NO: 552634 - DNA, 25 bp, Mus musculus
gccgccaatgctagttcaggcacgc

SEQ ID NO: 552635 - DNA, 25 bp, Mus musculus
gccgccaatgcttgttcaggcacgc

SEQ ID NO: 552636 - DNA, 25 bp, Mus musculus
gccgccaattgcacagatctttttt

SEQ ID NO: 552637 - DNA, 25 bp, Mus musculus
gccgccaattgctcagatctttttt

SEQ ID NO: 552638 - DNA, 25 bp, Mus musculus
gccgccacaagaaggcaccagattc

SEQ ID NO: 552639 - DNA, 25 bp, Mus musculus
gccgccacaagatggcaccagattc

SEQ ID NO: 552640 - DNA, 25 bp, Mus musculus
gccgccacacagaattgctggcttt

SEQ ID NO: 552641 - DNA, 25 bp, Mus musculus
gccgccacacagtattgctggcttt

SEQ ID NO: 552642 - DNA, 25 bp, Mus musculus
gccgccaccattacctttgaaggag

SEQ ID NO: 552643 - DNA, 25 bp, Mus musculus
gccgccaccatttcctttgaaggag

SEQ ID NO: 552644 - DNA, 25 bp, Mus musculus
gccgccaccgaaagcacgaagcaat

SEQ ID NO: 552645 - DNA, 25 bp, Mus musculus
gccgccaccgaatgcacgaagcaat

SEQ ID NO: 552646 - DNA, 25 bp, Mus musculus
gccgccacctgacaacggaagtgac

SEQ ID NO: 552647 - DNA, 25 bp, Mus musculus
gccgccacctgagaacggaagtgac

SEQ ID NO: 552648 - DNA, 25 bp, Mus musculus
gccgccacggtcagaggtgactatt

SEQ ID NO: 552649 - DNA, 25 bp, Mus musculus
gccgccacggtctgaggtgactatt

SEQ ID NO: 552650 - DNA, 25 bp, Mus musculus
gccgccagcaccagcgaaatgtcaa

SEQ ID NO: 552651 - DNA, 25 bp, Mus musculus
gccgccagcacctgcgaaatgtcaa

SEQ ID NO: 552652 - DNA, 25 bp, Mus musculus
gccgccagcccactagactgttgta

SEQ ID NO: 552653 - DNA, 25 bp, Mus musculus
gccgccagcccagtagactgttgta

SEQ ID NO: 552654 - DNA, 25 bp, Mus musculus
gccgccagtcgaacatcctgaagat

SEQ ID NO: 552655 - DNA, 25 bp, Mus musculus
gccgccagtcgatcatcctgaagat

SEQ ID NO: 552656 - DNA, 25 bp, Mus musculus
gccgccagtgtcatcaaccaggtgc

SEQ ID NO: 552657 - DNA, 25 bp, Mus musculus
gccgccagtgtcttcaaccaggtgc

SEQ ID NO: 552658 - DNA, 25 bp, Mus musculus
gccgccatatctctcttatctatta

SEQ ID NO: 552659 - DNA, 25 bp, Mus musculus
gccgccatatctgtcttatctatta

SEQ ID NO: 552660 - DNA, 25 bp, Mus musculus
gccgccatcgaactgaatgcaggca

SEQ ID NO: 552661 - DNA, 25 bp, Mus musculus
gccgccatcgaagtgaatgcaggca

SEQ ID NO: 552662 - DNA, 25 bp, Mus musculus
gccgccatggcgagtggtggctggg

SEQ ID NO: 552663 - DNA, 25 bp, Mus musculus
gccgccatggcgtgtggtggctggg

SEQ ID NO: 552664 - DNA, 25 bp, Mus musculus
gccgcccaacggacgtgcaaaaaag

SEQ ID NO: 552665 - DNA, 25 bp, Mus musculus
gccgcccaacggtcgtgcaaaaaag

SEQ ID NO: 552666 - DNA, 25 bp, Mus musculus
gccgcccatacaaaccagagaacaa

SEQ ID NO: 552667 - DNA, 25 bp, Mus musculus
gccgcccatacataccagagaacaa

SEQ ID NO: 552668 - DNA, 25 bp, Mus musculus
gccgcccatccccaccctgaatttg

SEQ ID NO: 552669 - DNA, 25 bp, Mus musculus
gccgcccatcccgaccctgaatttg

SEQ ID NO: 552670 - DNA, 25 bp, Mus musculus
gccgcccatggcactgataatggaa

SEQ ID NO: 552671 - DNA, 25 bp, Mus musculus
gccgcccatggctctgataatggaa

SEQ ID NO: 552672 - DNA, 25 bp, Mus musculus
gccgccctacagctatagattccga

SEQ ID NO: 552673 - DNA, 25 bp, Mus musculus
gccgccctacaggtatagattccga

SEQ ID NO: 552674 - DNA, 25 bp, Mus musculus
gccgccctctgtatttgtatttgga

SEQ ID NO: 552675 - DNA, 25 bp, Mus musculus
gccgccctctgtttttgtatttgga

SEQ ID NO: 552676 - DNA, 25 bp, Mus musculus
gccgccgcagcgacacatgtgagta

SEQ ID NO: 552677 - DNA, 25 bp, Mus musculus
gccgccgcagcgtcacatgtgagta

SEQ ID NO: 552678 - DNA, 25 bp, Mus musculus
gccgccgtggctacatgagttaatg

SEQ ID NO: 552679 - DNA, 25 bp, Mus musculus
gccgccgtggcttcatgagttaatg

SEQ ID NO: 552680 - DNA, 25 bp, Mus musculus
gccgcctatttcagcaggacaggta

SEQ ID NO: 552681 - DNA, 25 bp, Mus musculus
gccgcctatttctgcaggacaggta

SEQ ID NO: 552682 - DNA, 25 bp, Mus musculus
gccgcctcaagactgttggccgtga

SEQ ID NO: 552683 - DNA, 25 bp, Mus musculus
gccgcctcaagagtgttggccgtga

SEQ ID NO: 552684 - DNA, 25 bp, Mus musculus
gccgcctccagaatctgcaatggca

SEQ ID NO: 552685 - DNA, 25 bp, Mus musculus
gccgcctccagattctgcaatggca

SEQ ID NO: 552686 - DNA, 25 bp, Mus musculus
gccgcctcctagagtgaatatttca

SEQ ID NO: 552687 - DNA, 25 bp, Mus musculus
gccgcctcctagtgtgaatatttca

SEQ ID NO: 552688 - DNA, 25 bp, Mus musculus
gccgcctgtttgatacgatgcagat

SEQ ID NO: 552689 - DNA, 25 bp, Mus musculus
gccgcctgtttgttacgatgcagat

SEQ ID NO: 552690 - DNA, 25 bp, Mus musculus
gccgccttacagctgagttagagat

SEQ ID NO: 552691 - DNA, 25 bp, Mus musculus
gccgccttacaggtgagttagagat

SEQ ID NO: 552692 - DNA, 25 bp, Mus musculus
gccgccttcgaaaactgggtgatca

SEQ ID NO: 552693 - DNA, 25 bp, Mus musculus
gccgccttcgaatactgggtgatca

SEQ ID NO: 552694 - DNA, 25 bp, Mus musculus
gccgccttcgttaggagcctaacaa

SEQ ID NO: 552695 - DNA, 25 bp, Mus musculus
gccgccttcgtttggagcctaacaa

SEQ ID NO: 552696 - DNA, 25 bp, Mus musculus
gccgccttgccacagtgtgcatcaa

SEQ ID NO: 552697 - DNA, 25 bp, Mus musculus
gccgccttgccagagtgtgcatcaa

SEQ ID NO: 552698 - DNA, 25 bp, Mus musculus
gccgccttttatatgtatcgtcagt

SEQ ID NO: 552699 - DNA, 25 bp, Mus musculus
gccgccttttatttgtatcgtcagt

SEQ ID NO: 552700 - DNA, 25 bp, Mus musculus
gccgcgacatcgagctcaagagtgg

SEQ ID NO: 552701 - DNA, 25 bp, Mus musculus
gccgcgacatcgtgctcaagagtgg

SEQ ID NO: 552702 - DNA, 25 bp, Mus musculus
gccgcgagctggaggaataccgctt

SEQ ID NO: 552703 - DNA, 25 bp, Mus musculus
gccgcgagctggtggaataccgctt

SEQ ID NO: 552704 - DNA, 25 bp, Mus musculus
gccgcgcagtttagctcagagggtc

SEQ ID NO: 552705 - DNA, 25 bp, Mus musculus
gccgcgcagttttgctcagagggtc

SEQ ID NO: 552706 - DNA, 25 bp, Mus musculus
gccgcgctgacaaggctcattccta

SEQ ID NO: 552707 - DNA, 25 bp, Mus musculus
gccgcgctgacatggctcattccta

SEQ ID NO: 552708 - DNA, 25 bp, Mus musculus
gccgcggagaggagcacatttgcat

SEQ ID NO: 552709 - DNA, 25 bp, Mus musculus
gccgcggagaggtgcacatttgcat

SEQ ID NO: 552710 - DNA, 25 bp, Mus musculus
gccgcggatgtgcagatcagccaaa

SEQ ID NO: 552711 - DNA, 25 bp, Mus musculus
gccgcggatgtggagatcagccaaa

SEQ ID NO: 552712 - DNA, 25 bp, Mus musculus
gccgcggtagctatggcttttatag

SEQ ID NO: 552713 - DNA, 25 bp, Mus musculus
gccgcggtagctttggcttttatag

SEQ ID NO: 552714 - DNA, 25 bp, Mus musculus
gccgcggtccccagaagaatggaga

SEQ ID NO: 552715 - DNA, 25 bp, Mus musculus
gccgcggtcccctgaagaatggaga

SEQ ID NO: 552716 - DNA, 25 bp, Mus musculus
gccgcgtccgcacggagtaaagata

SEQ ID NO: 552717 - DNA, 25 bp, Mus musculus
gccgcgtccgcagggagtaaagata

SEQ ID NO: 552718 - DNA, 25 bp, Mus musculus
gccgcgtctgcaccaagacttctaa

SEQ ID NO: 552719 - DNA, 25 bp, Mus musculus
gccgcgtctgcagcaagacttctaa

SEQ ID NO: 552720 - DNA, 25 bp, Mus musculus
gccgcgtgatgcatggagagaccaa

SEQ ID NO: 552721 - DNA, 25 bp, Mus musculus
gccgcgtgatgcttggagagaccaa

SEQ ID NO: 552722 - DNA, 25 bp, Mus musculus
gccgcgtgcagaatcctacataaaa

SEQ ID NO: 552723 - DNA, 25 bp, Mus musculus
gccgcgtgcagattcctacataaaa

SEQ ID NO: 552724 - DNA, 25 bp, Mus musculus
gccgcgtgcctcagaaatgtgacat

SEQ ID NO: 552725 - DNA, 25 bp, Mus musculus
gccgcgtgcctctgaaatgtgacat

SEQ ID NO: 552726 - DNA, 25 bp, Mus musculus
gccgcgtggaaacccagcatgacca

SEQ ID NO: 552727 - DNA, 25 bp, Mus musculus
gccgcgtggaaagccagcatgacca

SEQ ID NO: 552728 - DNA, 25 bp, Mus musculus
gccgcgtggcagagccggtgctcgt

SEQ ID NO: 552729 - DNA, 25 bp, Mus musculus
gccgcgtggcagtgccggtgctcgt

SEQ ID NO: 552730 - DNA, 25 bp, Mus musculus
gccgcgttgagcaggcctctaatga

SEQ ID NO: 552731 - DNA, 25 bp, Mus musculus
gccgcgttgagctggcctctaatga

SEQ ID NO: 552732 - DNA, 25 bp, Mus musculus
gccgctaagggcattcaggagatcg

SEQ ID NO: 552733 - DNA, 25 bp, Mus musculus
gccgctaagggctttcaggagatcg

SEQ ID NO: 552734 - DNA, 25 bp, Mus musculus
gccgctacaaggagttacttactaa

SEQ ID NO: 552735 - DNA, 25 bp, Mus musculus
gccgctacaaggtgttacttactaa

SEQ ID NO: 552736 - DNA, 25 bp, Mus musculus
gccgctaccagcacaaccagatgta

SEQ ID NO: 552737 - DNA, 25 bp, Mus musculus
gccgctaccagctcaaccagatgta

SEQ ID NO: 552738 - DNA, 25 bp, Mus musculus
gccgctaggaacagtcattccctat

SEQ ID NO: 552739 - DNA, 25 bp, Mus musculus
gccgctaggaactgtcattccctat

SEQ ID NO: 552740 - DNA, 25 bp, Mus musculus
gccgctaggttacttggtctgtcta

SEQ ID NO: 552741 - DNA, 25 bp, Mus musculus
gccgctaggttagttggtctgtcta

SEQ ID NO: 552742 - DNA, 25 bp, Mus musculus
gccgctatatggctcgggacactaa

SEQ ID NO: 552743 - DNA, 25 bp, Mus musculus
gccgctatatgggtcgggacactaa

SEQ ID NO: 552744 - DNA, 25 bp, Mus musculus
gccgctatgccgcagtgttccagga

SEQ ID NO: 552745 - DNA, 25 bp, Mus musculus
gccgctatgccggagtgttccagga

SEQ ID NO: 552746 - DNA, 25 bp, Mus musculus
gccgctcactctatcaggactggag

SEQ ID NO: 552747 - DNA, 25 bp, Mus musculus
gccgctcactctttcaggactggag

SEQ ID NO: 552748 - DNA, 25 bp, Mus musculus
gccgctccattcactggataggtga

SEQ ID NO: 552749 - DNA, 25 bp, Mus musculus
gccgctccattctctggataggtga

SEQ ID NO: 552750 - DNA, 25 bp, Mus musculus
gccgctcccactcgttatgagataa

SEQ ID NO: 552751 - DNA, 25 bp, Mus musculus
gccgctcccactggttatgagataa

SEQ ID NO: 552752 - DNA, 25 bp, Mus musculus
gccgctccctttaatggaggctcat

SEQ ID NO: 552753 - DNA, 25 bp, Mus musculus
gccgctcccttttatggaggctcat

SEQ ID NO: 552754 - DNA, 25 bp, Mus musculus
gccgctctatcaaccgaaatgtcaa

SEQ ID NO: 552755 - DNA, 25 bp, Mus musculus
gccgctctatcatccgaaatgtcaa

SEQ ID NO: 552756 - DNA, 25 bp, Mus musculus
gccgctctgattccctagtgaggag

SEQ ID NO: 552757 - DNA, 25 bp, Mus musculus
gccgctctgattgcctagtgaggag

SEQ ID NO: 552758 - DNA, 25 bp, Mus musculus
gccgctctgcagacttctgttaaga

SEQ ID NO: 552759 - DNA, 25 bp, Mus musculus
gccgctctgcagtcttctgttaaga

SEQ ID NO: 552760 - DNA, 25 bp, Mus musculus
gccgctgaacaaattatcctgcaat

SEQ ID NO: 552761 - DNA, 25 bp, Mus musculus
gccgctgaacaatttatcctgcaat

SEQ ID NO: 552762 - DNA, 25 bp, Mus musculus
gccgctgaacggagtgtcccagaat

SEQ ID NO: 552763 - DNA, 25 bp, Mus musculus
gccgctgaacggtgtgtcccagaat

SEQ ID NO: 552764 - DNA, 25 bp, Mus musculus
gccgctgattggacctgctgagaaa

SEQ ID NO: 552765 - DNA, 25 bp, Mus musculus
gccgctgattggtcctgctgagaaa

SEQ ID NO: 552766 - DNA, 25 bp, Mus musculus
gccgctgcaggtattatagttccca

SEQ ID NO: 552767 - DNA, 25 bp, Mus musculus
gccgctgcaggttttatagttccca

SEQ ID NO: 552768 - DNA, 25 bp, Mus musculus
gccgctgcatgaaccgctgggctga

SEQ ID NO: 552769 - DNA, 25 bp, Mus musculus
gccgctgcatgatccgctgggctga

SEQ ID NO: 552770 - DNA, 25 bp, Mus musculus
gccgctgccgtcaattgtggccgag

SEQ ID NO: 552771 - DNA, 25 bp, Mus musculus
gccgctgccgtctattgtggccgag

SEQ ID NO: 552772 - DNA, 25 bp, Mus musculus
gccgctgcgagcaatcaggctaata

SEQ ID NO: 552773 - DNA, 25 bp, Mus musculus
gccgctgcgagctatcaggctaata

SEQ ID NO: 552774 - DNA, 25 bp, Mus musculus
gccgctgctgttacttcaggatgaa

SEQ ID NO: 552775 - DNA, 25 bp, Mus musculus
gccgctgctgtttcttcaggatgaa

SEQ ID NO: 552776 - DNA, 25 bp, Mus musculus
gccgctgcttctcggacaagtgaga

SEQ ID NO: 552777 - DNA, 25 bp, Mus musculus
gccgctgcttctgggacaagtgaga

SEQ ID NO: 552778 - DNA, 25 bp, Mus musculus
gccgctggaggaagaggccacccta

SEQ ID NO: 552779 - DNA, 25 bp, Mus musculus
gccgctggaggatgaggccacccta

SEQ ID NO: 552780 - DNA, 25 bp, Mus musculus
gccgctggcctcaagctgaaatgat

SEQ ID NO: 552781 - DNA, 25 bp, Mus musculus
gccgctggcctctagctgaaatgat

SEQ ID NO: 552782 - DNA, 25 bp, Mus musculus
gccgctgtacacacttctggagaaa

SEQ ID NO: 552783 - DNA, 25 bp, Mus musculus
gccgctgtacactcttctggagaaa

SEQ ID NO: 552784 - DNA, 25 bp, Mus musculus
gccgctgtattccattggccattgg

SEQ ID NO: 552785 - DNA, 25 bp, Mus musculus
gccgctgtattcgattggccattgg

SEQ ID NO: 552786 - DNA, 25 bp, Mus musculus
gccgctgtatttactaaggctacaa

SEQ ID NO: 552787 - DNA, 25 bp, Mus musculus
gccgctgtattttctaaggctacaa

SEQ ID NO: 552788 - DNA, 25 bp, Mus musculus
gccgctgtcaccctttacataagac

SEQ ID NO: 552789 - DNA, 25 bp, Mus musculus
gccgctgtcaccgtttacataagac

SEQ ID NO: 552790 - DNA, 25 bp, Mus musculus
gccgctgtctacacgcagaaacaca

SEQ ID NO: 552791 - DNA, 25 bp, Mus musculus
gccgctgtctactcgcagaaacaca

SEQ ID NO: 552792 - DNA, 25 bp, Mus musculus
gccgctgtctggacagttcctgcag

SEQ ID NO: 552793 - DNA, 25 bp, Mus musculus
gccgctgtctggtcagttcctgcag

SEQ ID NO: 552794 - DNA, 25 bp, Mus musculus
gccgctgtgccaatgaagcagatat

SEQ ID NO: 552795 - DNA, 25 bp, Mus musculus
gccgctgtgccattgaagcagatat

SEQ ID NO: 552796 - DNA, 25 bp, Mus musculus
gccgcttcatccctgaaaactgtgg

SEQ ID NO: 552797 - DNA, 25 bp, Mus musculus
gccgcttcatccgtgaaaactgtgg

SEQ ID NO: 552798 - DNA, 25 bp, Mus musculus
gccgcttccatgacagcttgtagag

SEQ ID NO: 552799 - DNA, 25 bp, Mus musculus
gccgcttccatgtcagcttgtagag

SEQ ID NO: 552800 - DNA, 25 bp, Mus musculus
gccgcttcccggatatgtaaaccag

SEQ ID NO: 552801 - DNA, 25 bp, Mus musculus
gccgcttcccggttatgtaaaccag

SEQ ID NO: 552802 - DNA, 25 bp, Mus musculus
gccgcttctttccagagcatggaag

SEQ ID NO: 552803 - DNA, 25 bp, Mus musculus
gccgcttctttcgagagcatggaag

SEQ ID NO: 552804 - DNA, 25 bp, Mus musculus
gccgcttgaataagactgttcgact

SEQ ID NO: 552805 - DNA, 25 bp, Mus musculus
gccgcttgaatatgactgttcgact

SEQ ID NO: 552806 - DNA, 25 bp, Mus musculus
gccgcttgagcgcagtcagtaactt

SEQ ID NO: 552807 - DNA, 25 bp, Mus musculus
gccgcttgagcggagtcagtaactt

SEQ ID NO: 552808 - DNA, 25 bp, Mus musculus
gccgcttggcacaaacgtgggagaa

SEQ ID NO: 552809 - DNA, 25 bp, Mus musculus
gccgcttggcactaacgtgggagaa

SEQ ID NO: 552810 - DNA, 25 bp, Mus musculus
gccgctttggtgacatcaacgtgca

SEQ ID NO: 552811 - DNA, 25 bp, Mus musculus
gccgctttggtgtcatcaacgtgca

SEQ ID NO: 552812 - DNA, 25 bp, Mus musculus
gccgctttttccataattgttgttg

SEQ ID NO: 552813 - DNA, 25 bp, Mus musculus
gccgctttttccttaattgttgttg

SEQ ID NO: 552814 - DNA, 25 bp, Mus musculus
gccggaaagcccagtgcaagggtcc

SEQ ID NO: 552815 - DNA, 25 bp, Mus musculus
gccggaaagccctgtgcaagggtcc

SEQ ID NO: 552816 - DNA, 25 bp, Mus musculus
gccggaaattcccttatgaacgcag

SEQ ID NO: 552817 - DNA, 25 bp, Mus musculus
gccggaaattccgttatgaacgcag

SEQ ID NO: 552818 - DNA, 25 bp, Mus musculus
gccggaaccagaatctcttgcaaca

SEQ ID NO: 552819 - DNA, 25 bp, Mus musculus
gccggaaccagattctcttgcaaca

SEQ ID NO: 552820 - DNA, 25 bp, Mus musculus
gccggaacgtatcaggagagaaaca

SEQ ID NO: 552821 - DNA, 25 bp, Mus musculus
gccggaacgtatgaggagagaaaca

SEQ ID NO: 552822 - DNA, 25 bp, Mus musculus
gccggaagatctctatggcttcatg

SEQ ID NO: 552823 - DNA, 25 bp, Mus musculus
gccggaagatctgtatggcttcatg

SEQ ID NO: 552824 - DNA, 25 bp, Mus musculus
gccggaatctagatttccaggcact

SEQ ID NO: 552825 - DNA, 25 bp, Mus musculus
gccggaatctagttttccaggcact

SEQ ID NO: 552826 - DNA, 25 bp, Mus musculus
gccggaatggacctcaggagctttt

SEQ ID NO: 552827 - DNA, 25 bp, Mus musculus
gccggaatggacgtcaggagctttt

SEQ ID NO: 552828 - DNA, 25 bp, Mus musculus
gccggaattacacccatccctgtat

SEQ ID NO: 552829 - DNA, 25 bp, Mus musculus
gccggaattacagccatccctgtat

SEQ ID NO: 552830 - DNA, 25 bp, Mus musculus
gccggaattttccagcagttgcttt

SEQ ID NO: 552831 - DNA, 25 bp, Mus musculus
gccggaattttcgagcagttgcttt

SEQ ID NO: 552832 - DNA, 25 bp, Mus musculus
gccggacatatgctgagttggttca

SEQ ID NO: 552833 - DNA, 25 bp, Mus musculus
gccggacatatggtgagttggttca

SEQ ID NO: 552834 - DNA, 25 bp, Mus musculus
gccggacccagcagtttggcgtatc

SEQ ID NO: 552835 - DNA, 25 bp, Mus musculus
gccggacccagctgtttggcgtatc

SEQ ID NO: 552836 - DNA, 25 bp, Mus musculus
gccggacgcgagcagatgaacgaac

SEQ ID NO: 552837 - DNA, 25 bp, Mus musculus
gccggacgcgaggagatgaacgaac

SEQ ID NO: 552838 - DNA, 25 bp, Mus musculus
gccggacgctacctgtttaagtgtt

SEQ ID NO: 552839 - DNA, 25 bp, Mus musculus
gccggacgctacgtgtttaagtgtt

SEQ ID NO: 552840 - DNA, 25 bp, Mus musculus
gccggactactccagcattgacata

SEQ ID NO: 552841 - DNA, 25 bp, Mus musculus
gccggactactcgagcattgacata

SEQ ID NO: 552842 - DNA, 25 bp, Mus musculus
gccggactgttaaggagttctgcca

SEQ ID NO: 552843 - DNA, 25 bp, Mus musculus
gccggactgttatggagttctgcca

SEQ ID NO: 552844 - DNA, 25 bp, Mus musculus
gccggactttctcctggcatagaga

SEQ ID NO: 552845 - DNA, 25 bp, Mus musculus
gccggactttctgctggcatagaga

SEQ ID NO: 552846 - DNA, 25 bp, Mus musculus
gccggagacctgactggtctgcaga

SEQ ID NO: 552847 - DNA, 25 bp, Mus musculus
gccggagacctgtctggtctgcaga

SEQ ID NO: 552848 - DNA, 25 bp, Mus musculus
gccggagactttctggttgatgcac

SEQ ID NO: 552849 - DNA, 25 bp, Mus musculus
gccggagactttgtggttgatgcac

SEQ ID NO: 552850 - DNA, 25 bp, Mus musculus
gccggagagtcaatttttccagtta

SEQ ID NO: 552851 - DNA, 25 bp, Mus musculus
gccggagagtcattttttccagtta

SEQ ID NO: 552852 - DNA, 25 bp, Mus musculus
gccggagatgccagacgcttggttc

SEQ ID NO: 552853 - DNA, 25 bp, Mus musculus
gccggagatgcctgacgcttggttc

SEQ ID NO: 552854 - DNA, 25 bp, Mus musculus
gccggagcaagtcaggactaagcaa

SEQ ID NO: 552855 - DNA, 25 bp, Mus musculus
gccggagcaagtgaggactaagcaa

SEQ ID NO: 552856 - DNA, 25 bp, Mus musculus
gccggagcagagatgaccagagcaa

SEQ ID NO: 552857 - DNA, 25 bp, Mus musculus
gccggagcagagttgaccagagcaa

SEQ ID NO: 552858 - DNA, 25 bp, Mus musculus
gccggagccgccatgaggactgaat

SEQ ID NO: 552859 - DNA, 25 bp, Mus musculus
gccggagccgccttgaggactgaat

SEQ ID NO: 552860 - DNA, 25 bp, Mus musculus
gccggagctggcatgtgctagcaca

SEQ ID NO: 552861 - DNA, 25 bp, Mus musculus
gccggagctggcttgtgctagcaca

SEQ ID NO: 552862 - DNA, 25 bp, Mus musculus
gccggaggccccaagcaaacaggat

SEQ ID NO: 552863 - DNA, 25 bp, Mus musculus
gccggaggcccctagcaaacaggat

SEQ ID NO: 552864 - DNA, 25 bp, Mus musculus
gccggagtcaacaatcttttcttta

SEQ ID NO: 552865 - DNA, 25 bp, Mus musculus
gccggagtcaactatcttttcttta

SEQ ID NO: 552866 - DNA, 25 bp, Mus musculus
gccggagtcacgaaagcctgcaaag

SEQ ID NO: 552867 - DNA, 25 bp, Mus musculus
gccggagtcacgtaagcctgcaaag

SEQ ID NO: 552868 - DNA, 25 bp, Mus musculus
gccggagtcagacctctctcagaga

SEQ ID NO: 552869 - DNA, 25 bp, Mus musculus
gccggagtcagagctctctcagaga

SEQ ID NO: 552870 - DNA, 25 bp, Mus musculus
gccggagtctagaaggttacattcg

SEQ ID NO: 552871 - DNA, 25 bp, Mus musculus
gccggagtctagtaggttacattcg

SEQ ID NO: 552872 - DNA, 25 bp, Mus musculus
gccggagttacgcagcactttcagt

SEQ ID NO: 552873 - DNA, 25 bp, Mus musculus
gccggagttacggagcactttcagt

SEQ ID NO: 552874 - DNA, 25 bp, Mus musculus
gccggagttatcaacagagctgttc

SEQ ID NO: 552875 - DNA, 25 bp, Mus musculus
gccggagttatctacagagctgttc

SEQ ID NO: 552876 - DNA, 25 bp, Mus musculus
gccggagttggcaccacggcaactt

SEQ ID NO: 552877 - DNA, 25 bp, Mus musculus
gccggagttggctccacggcaactt

SEQ ID NO: 552878 - DNA, 25 bp, Mus musculus
gccggagttttacggcaatatcatc

SEQ ID NO: 552879 - DNA, 25 bp, Mus musculus
gccggagttttagggcaatatcatc

SEQ ID NO: 552880 - DNA, 25 bp, Mus musculus
gccggatagcgcacagaaggacttc

SEQ ID NO: 552881 - DNA, 25 bp, Mus musculus
gccggatagcgctcagaaggacttc

SEQ ID NO: 552882 - DNA, 25 bp, Mus musculus
gccggatccaaacacgctagatgtt

SEQ ID NO: 552883 - DNA, 25 bp, Mus musculus
gccggatccaaagacgctagatgtt

SEQ ID NO: 552884 - DNA, 25 bp, Mus musculus
gccggatctacaacagcttcagaga

SEQ ID NO: 552885 - DNA, 25 bp, Mus musculus
gccggatctacatcagcttcagaga

SEQ ID NO: 552886 - DNA, 25 bp, Mus musculus
gccggatgatgcacttgactttatt

SEQ ID NO: 552887 - DNA, 25 bp, Mus musculus
gccggatgatgctcttgactttatt

SEQ ID NO: 552888 - DNA, 25 bp, Mus musculus
gccggatgctctctagttgtagtta

SEQ ID NO: 552889 - DNA, 25 bp, Mus musculus
gccggatgctctgtagttgtagtta

SEQ ID NO: 552890 - DNA, 25 bp, Mus musculus
gccggatgctgcaactatagactgt

SEQ ID NO: 552891 - DNA, 25 bp, Mus musculus
gccggatgctgctactatagactgt

SEQ ID NO: 552892 - DNA, 25 bp, Mus musculus
gccggattattgctgcaactggcaa

SEQ ID NO: 552893 - DNA, 25 bp, Mus musculus
gccggattattggtgcaactggcaa

SEQ ID NO: 552894 - DNA, 25 bp, Mus musculus
gccggcaaattccaggacaagctta

SEQ ID NO: 552895 - DNA, 25 bp, Mus musculus
gccggcaaattcgaggacaagctta

SEQ ID NO: 552896 - DNA, 25 bp, Mus musculus
gccggcaaggccataacgaaggatg

SEQ ID NO: 552897 - DNA, 25 bp, Mus musculus
gccggcaaggccttaacgaaggatg

SEQ ID NO: 552898 - DNA, 25 bp, Mus musculus
gccggcaccctaactgaggtgtttt

SEQ ID NO: 552899 - DNA, 25 bp, Mus musculus
gccggcaccctatctgaggtgtttt

SEQ ID NO: 552900 - DNA, 25 bp, Mus musculus
gccggcactccgagataagctgcaa

SEQ ID NO: 552901 - DNA, 25 bp, Mus musculus
gccggcactccgtgataagctgcaa

SEQ ID NO: 552902 - DNA, 25 bp, Mus musculus
gccggcacttcacctacaagagtat

SEQ ID NO: 552903 - DNA, 25 bp, Mus musculus
gccggcacttcagctacaagagtat

SEQ ID NO: 552904 - DNA, 25 bp, Mus musculus
gccggcagacccaagccaaatatgg

SEQ ID NO: 552905 - DNA, 25 bp, Mus musculus
gccggcagaccctagccaaatatgg

SEQ ID NO: 552906 - DNA, 25 bp, Mus musculus
gccggcagagcaaaggcctgaccca

SEQ ID NO: 552907 - DNA, 25 bp, Mus musculus
gccggcagagcataggcctgaccca

SEQ ID NO: 552908 - DNA, 25 bp, Mus musculus
gccggcagaggaacgattgcacagt

SEQ ID NO: 552909 - DNA, 25 bp, Mus musculus
gccggcagaggatcgattgcacagt

SEQ ID NO: 552910 - DNA, 25 bp, Mus musculus
gccggcagcataaaggccctttttg

SEQ ID NO: 552911 - DNA, 25 bp, Mus musculus
gccggcagcatataggccctttttg

SEQ ID NO: 552912 - DNA, 25 bp, Mus musculus
gccggcagtttgactcataatatca

SEQ ID NO: 552913 - DNA, 25 bp, Mus musculus
gccggcagtttgtctcataatatca

SEQ ID NO: 552914 - DNA, 25 bp, Mus musculus
gccggcatgcacatacaatacctac

SEQ ID NO: 552915 - DNA, 25 bp, Mus musculus
gccggcatgcacttacaatacctac

SEQ ID NO: 552916 - DNA, 25 bp, Mus musculus
gccggcatgccacggatgcagatct

SEQ ID NO: 552917 - DNA, 25 bp, Mus musculus
gccggcatgccagggatgcagatct

SEQ ID NO: 552918 - DNA, 25 bp, Mus musculus
gccggccaattgcaacctcattgta

SEQ ID NO: 552919 - DNA, 25 bp, Mus musculus
gccggccaattggaacctcattgta

SEQ ID NO: 552920 - DNA, 25 bp, Mus musculus
gccggccacactattaaacctgtgt

SEQ ID NO: 552921 - DNA, 25 bp, Mus musculus
gccggccacacttttaaacctgtgt

SEQ ID NO: 552922 - DNA, 25 bp, Mus musculus
gccggccagaggaggacccttttct

SEQ ID NO: 552923 - DNA, 25 bp, Mus musculus
gccggccagaggtggacccttttct

SEQ ID NO: 552924 - DNA, 25 bp, Mus musculus
gccggccagctgacaagcagttcca

SEQ ID NO: 552925 - DNA, 25 bp, Mus musculus
gccggccagctgtcaagcagttcca

SEQ ID NO: 552926 - DNA, 25 bp, Mus musculus
gccggccagggcacagggctctact

SEQ ID NO: 552927 - DNA, 25 bp, Mus musculus
gccggccagggctcagggctctact

SEQ ID NO: 552928 - DNA, 25 bp, Mus musculus
gccggccccagtcttcagagtatat

SEQ ID NO: 552929 - DNA, 25 bp, Mus musculus
gccggccccagtgttcagagtatat

SEQ ID NO: 552930 - DNA, 25 bp, Mus musculus
gccggccgtttcatccagagagaga

SEQ ID NO: 552931 - DNA, 25 bp, Mus musculus
gccggccgtttcttccagagagaga

SEQ ID NO: 552932 - DNA, 25 bp, Mus musculus
gccggcgacctcaatgtgcttgaag

SEQ ID NO: 552933 - DNA, 25 bp, Mus musculus
gccggcgacctctatgtgcttgaag

SEQ ID NO: 552934 - DNA, 25 bp, Mus musculus
gccggcgagagccaagtacatcttg

SEQ ID NO: 552935 - DNA, 25 bp, Mus musculus
gccggcgagagcgaagtacatcttg

SEQ ID NO: 552936 - DNA, 25 bp, Mus musculus
gccggcggttgaatctcgagtctcg

SEQ ID NO: 552937 - DNA, 25 bp, Mus musculus
gccggcggttgattctcgagtctcg

SEQ ID NO: 552938 - DNA, 25 bp, Mus musculus
gccggctcctttcctctgtctagtg

SEQ ID NO: 552939 - DNA, 25 bp, Mus musculus
gccggctcctttgctctgtctagtg

SEQ ID NO: 552940 - DNA, 25 bp, Mus musculus
gccggctctcagctgacaatgttaa

SEQ ID NO: 552941 - DNA, 25 bp, Mus musculus
gccggctctcaggtgacaatgttaa

SEQ ID NO: 552942 - DNA, 25 bp, Mus musculus
gccggctctgaaacatgtgtctgga

SEQ ID NO: 552943 - DNA, 25 bp, Mus musculus
gccggctctgaatcatgtgtctgga

SEQ ID NO: 552944 - DNA, 25 bp, Mus musculus
gccggctctttaagaccagggttct

SEQ ID NO: 552945 - DNA, 25 bp, Mus musculus
gccggctctttatgaccagggttct

SEQ ID NO: 552946 - DNA, 25 bp, Mus musculus
gccggctgagcaaagctgagatctt

SEQ ID NO: 552947 - DNA, 25 bp, Mus musculus
gccggctgagcatagctgagatctt

SEQ ID NO: 552948 - DNA, 25 bp, Mus musculus
gccggctgccatcctggtgaaacat

SEQ ID NO: 552949 - DNA, 25 bp, Mus musculus
gccggctgccatgctggtgaaacat

SEQ ID NO: 552950 - DNA, 25 bp, Mus musculus
gccggctgctgtccggttaccgaaa

SEQ ID NO: 552951 - DNA, 25 bp, Mus musculus
gccggctgctgtgcggttaccgaaa

SEQ ID NO: 552952 - DNA, 25 bp, Mus musculus
gccggcttggtcaacaagactacac

SEQ ID NO: 552953 - DNA, 25 bp, Mus musculus
gccggcttggtctacaagactacac

SEQ ID NO: 552954 - DNA, 25 bp, Mus musculus
gccggcttttgtcacagcttctgta

SEQ ID NO: 552955 - DNA, 25 bp, Mus musculus
gccggcttttgtgacagcttctgta

SEQ ID NO: 552956 - DNA, 25 bp, Mus musculus
gccgggaaacaacccaggaacgcag

SEQ ID NO: 552957 - DNA, 25 bp, Mus musculus
gccgggaaacaagccaggaacgcag

SEQ ID NO: 552958 - DNA, 25 bp, Mus musculus
gccgggaacaagctcagaagtctct

SEQ ID NO: 552959 - DNA, 25 bp, Mus musculus
gccgggaacaaggtcagaagtctct

SEQ ID NO: 552960 - DNA, 25 bp, Mus musculus
gccgggaaggccacatgcttaaagt

SEQ ID NO: 552961 - DNA, 25 bp, Mus musculus
gccgggaaggcctcatgcttaaagt

SEQ ID NO: 552962 - DNA, 25 bp, Mus musculus
gccgggaaggctatcgaaatccgcg

SEQ ID NO: 552963 - DNA, 25 bp, Mus musculus
gccgggaaggctttcgaaatccgcg

SEQ ID NO: 552964 - DNA, 25 bp, Mus musculus
gccgggacctctaccaagataccta

SEQ ID NO: 552965 - DNA, 25 bp, Mus musculus
gccgggacctcttccaagataccta

SEQ ID NO: 552966 - DNA, 25 bp, Mus musculus
gccgggactctcaacaacagatgtg

SEQ ID NO: 552967 - DNA, 25 bp, Mus musculus
gccgggactctctacaacagatgtg

SEQ ID NO: 552968 - DNA, 25 bp, Mus musculus
gccgggagactcctgtgtggacatg

SEQ ID NO: 552969 - DNA, 25 bp, Mus musculus
gccgggagactcgtgtgtggacatg

SEQ ID NO: 552970 - DNA, 25 bp, Mus musculus
gccgggagcactactcggactcgga

SEQ ID NO: 552971 - DNA, 25 bp, Mus musculus
gccgggagcacttctcggactcgga

SEQ ID NO: 552972 - DNA, 25 bp, Mus musculus
gccgggagctatatgtgtcttggtc

SEQ ID NO: 552973 - DNA, 25 bp, Mus musculus
gccgggagctatttgtgtcttggtc

SEQ ID NO: 552974 - DNA, 25 bp, Mus musculus
gccgggaggttcacaccaaaatcat

SEQ ID NO: 552975 - DNA, 25 bp, Mus musculus
gccgggaggttctcaccaaaatcat

SEQ ID NO: 552976 - DNA, 25 bp, Mus musculus
gccgggatcaaactctgttctggcg

SEQ ID NO: 552977 - DNA, 25 bp, Mus musculus
gccgggatcaaagtctgttctggcg

SEQ ID NO: 552978 - DNA, 25 bp, Mus musculus
gccgggatgctgagaagaccccata

SEQ ID NO: 552979 - DNA, 25 bp, Mus musculus
gccgggatgctgtgaagaccccata

SEQ ID NO: 552980 - DNA, 25 bp, Mus musculus
gccgggatggttcatctgtttgttt

SEQ ID NO: 552981 - DNA, 25 bp, Mus musculus
gccgggatggttgatctgtttgttt

SEQ ID NO: 552982 - DNA, 25 bp, Mus musculus
gccgggcactggaagtatacatttt

SEQ ID NO: 552983 - DNA, 25 bp, Mus musculus
gccgggcactggtagtatacatttt

SEQ ID NO: 552984 - DNA, 25 bp, Mus musculus
gccgggcagggcacaatgcattgat

SEQ ID NO: 552985 - DNA, 25 bp, Mus musculus
gccgggcagggctcaatgcattgat

SEQ ID NO: 552986 - DNA, 25 bp, Mus musculus
gccgggcatcttacttacttcagtg

SEQ ID NO: 552987 - DNA, 25 bp, Mus musculus
gccgggcatctttcttacttcagtg

SEQ ID NO: 552988 - DNA, 25 bp, Mus musculus
gccgggcatgttcatacccatcttt

SEQ ID NO: 552989 - DNA, 25 bp, Mus musculus
gccgggcatgttgatacccatcttt

SEQ ID NO: 552990 - DNA, 25 bp, Mus musculus
gccgggccagggagcatatccagaa

SEQ ID NO: 552991 - DNA, 25 bp, Mus musculus
gccgggccagggtgcatatccagaa

SEQ ID NO: 552992 - DNA, 25 bp, Mus musculus
gccgggccatgcactgcatagggtt

SEQ ID NO: 552993 - DNA, 25 bp, Mus musculus
gccgggccatgctctgcatagggtt

SEQ ID NO: 552994 - DNA, 25 bp, Mus musculus
gccgggcccgtaacatgttccctgt

SEQ ID NO: 552995 - DNA, 25 bp, Mus musculus
gccgggcccgtatcatgttccctgt

SEQ ID NO: 552996 - DNA, 25 bp, Mus musculus
gccgggcctaggaactacagcttag

SEQ ID NO: 552997 - DNA, 25 bp, Mus musculus
gccgggcctaggtactacagcttag

SEQ ID NO: 552998 - DNA, 25 bp, Mus musculus
gccgggcctggtccctgtaattcta

SEQ ID NO: 552999 - DNA, 25 bp, Mus musculus
gccgggcctggtgcctgtaattcta

SEQ ID NO: 553000 - DNA, 25 bp, Mus musculus
gccgggctacagacccaaggagtga

SEQ ID NO: 553001 - DNA, 25 bp, Mus musculus
gccgggctacagtcccaaggagtga

SEQ ID NO: 553002 - DNA, 25 bp, Mus musculus
gccgggctatccagggcaaagcaac

SEQ ID NO: 553003 - DNA, 25 bp, Mus musculus
gccgggctatcctgggcaaagcaac

SEQ ID NO: 553004 - DNA, 25 bp, Mus musculus
gccgggctatgacatattactacaa

SEQ ID NO: 553005 - DNA, 25 bp, Mus musculus
gccgggctatgagatattactacaa

SEQ ID NO: 553006 - DNA, 25 bp, Mus musculus
gccgggctccgactgtggaattcaa

SEQ ID NO: 553007 - DNA, 25 bp, Mus musculus
gccgggctccgagtgtggaattcaa

SEQ ID NO: 553008 - DNA, 25 bp, Mus musculus
gccgggctggaacacccagagctca

SEQ ID NO: 553009 - DNA, 25 bp, Mus musculus
gccgggctggaagacccagagctca

SEQ ID NO: 553010 - DNA, 25 bp, Mus musculus
gccgggctgtgtcgctacgcttctc

SEQ ID NO: 553011 - DNA, 25 bp, Mus musculus
gccgggctgtgtggctacgcttctc

SEQ ID NO: 553012 - DNA, 25 bp, Mus musculus
gccgggcttaagacgcatctgcgta

SEQ ID NO: 553013 - DNA, 25 bp, Mus musculus
gccgggcttaagtcgcatctgcgta

SEQ ID NO: 553014 - DNA, 25 bp, Mus musculus
gccgggcttgcaagattagaccagt

SEQ ID NO: 553015 - DNA, 25 bp, Mus musculus
gccgggcttgcatgattagaccagt

SEQ ID NO: 553016 - DNA, 25 bp, Mus musculus
gccggggccaaaattatacttatat

SEQ ID NO: 553017 - DNA, 25 bp, Mus musculus
gccggggccaaatttatacttatat

SEQ ID NO: 553018 - DNA, 25 bp, Mus musculus
gccgggttcaccagtctctagtaag

SEQ ID NO: 553019 - DNA, 25 bp, Mus musculus
gccgggttcacctgtctctagtaag

SEQ ID NO: 553020 - DNA, 25 bp, Mus musculus
gccgggttctttcagcaggacacgc

SEQ ID NO: 553021 - DNA, 25 bp, Mus musculus
gccgggttctttgagcaggacacgc

SEQ ID NO: 553022 - DNA, 25 bp, Mus musculus
gccgggttgagcaagtctctgattt

SEQ ID NO: 553023 - DNA, 25 bp, Mus musculus
gccgggttgagctagtctctgattt

SEQ ID NO: 553024 - DNA, 25 bp, Mus musculus
gccgggtttctcatgggagtcacag

SEQ ID NO: 553025 - DNA, 25 bp, Mus musculus
gccgggtttctcttgggagtcacag

SEQ ID NO: 553026 - DNA, 25 bp, Mus musculus
gccggtaaacctacacatctcaaaa

SEQ ID NO: 553027 - DNA, 25 bp, Mus musculus
gccggtaaaccttcacatctcaaaa

SEQ ID NO: 553028 - DNA, 25 bp, Mus musculus
gccggtaatattagctatgcctgaa

SEQ ID NO: 553029 - DNA, 25 bp, Mus musculus
gccggtaatatttgctatgcctgaa

SEQ ID NO: 553030 - DNA, 25 bp, Mus musculus
gccggtacaaccataagcagtgcaa

SEQ ID NO: 553031 - DNA, 25 bp, Mus musculus
gccggtacaaccttaagcagtgcaa

SEQ ID NO: 553032 - DNA, 25 bp, Mus musculus
gccggtagtccaccttagtaggcaa

SEQ ID NO: 553033 - DNA, 25 bp, Mus musculus
gccggtagtccagcttagtaggcaa

SEQ ID NO: 553034 - DNA, 25 bp, Mus musculus
gccggtatacatcgcggcggtgctg

SEQ ID NO: 553035 - DNA, 25 bp, Mus musculus
gccggtatacatggcggcggtgctg

SEQ ID NO: 553036 - DNA, 25 bp, Mus musculus
gccggtatggaccacatccacagaa

SEQ ID NO: 553037 - DNA, 25 bp, Mus musculus
gccggtatggacgacatccacagaa

SEQ ID NO: 553038 - DNA, 25 bp, Mus musculus
gccggtcagactatacatatgatat

SEQ ID NO: 553039 - DNA, 25 bp, Mus musculus
gccggtcagactttacatatgatat

SEQ ID NO: 553040 - DNA, 25 bp, Mus musculus
gccggtcattttcaccttggtgtaa

SEQ ID NO: 553041 - DNA, 25 bp, Mus musculus
gccggtcattttgaccttggtgtaa

SEQ ID NO: 553042 - DNA, 25 bp, Mus musculus
gccggtccaggaccgtgtccagtaa

SEQ ID NO: 553043 - DNA, 25 bp, Mus musculus
gccggtccaggagcgtgtccagtaa

SEQ ID NO: 553044 - DNA, 25 bp, Mus musculus
gccggtccctgtcattggcggaggc

SEQ ID NO: 553045 - DNA, 25 bp, Mus musculus
gccggtccctgtgattggcggaggc

SEQ ID NO: 553046 - DNA, 25 bp, Mus musculus
gccggtccttgacactggatcttca

SEQ ID NO: 553047 - DNA, 25 bp, Mus musculus
gccggtccttgagactggatcttca

SEQ ID NO: 553048 - DNA, 25 bp, Mus musculus
gccggtcgcgctagtgggatccttc

SEQ ID NO: 553049 - DNA, 25 bp, Mus musculus
gccggtcgcgcttgtgggatccttc

SEQ ID NO: 553050 - DNA, 25 bp, Mus musculus
gccggtctcacactaaattctcaca

SEQ ID NO: 553051 - DNA, 25 bp, Mus musculus
gccggtctcacagtaaattctcaca

SEQ ID NO: 553052 - DNA, 25 bp, Mus musculus
gccggtctgtgccaaatcgaggaca

SEQ ID NO: 553053 - DNA, 25 bp, Mus musculus
gccggtctgtgcgaaatcgaggaca

SEQ ID NO: 553054 - DNA, 25 bp, Mus musculus
gccggtgaacgtccaaaacaggctc

SEQ ID NO: 553055 - DNA, 25 bp, Mus musculus
gccggtgaacgtgcaaaacaggctc

SEQ ID NO: 553056 - DNA, 25 bp, Mus musculus
gccggtgatactcgtagttggtgtg

SEQ ID NO: 553057 - DNA, 25 bp, Mus musculus
gccggtgatactggtagttggtgtg

SEQ ID NO: 553058 - DNA, 25 bp, Mus musculus
gccggtgatgaccaggccatgttca

SEQ ID NO: 553059 - DNA, 25 bp, Mus musculus
gccggtgatgacgaggccatgttca

SEQ ID NO: 553060 - DNA, 25 bp, Mus musculus
gccggtgatgtcatcaggattcaag

SEQ ID NO: 553061 - DNA, 25 bp, Mus musculus
gccggtgatgtcttcaggattcaag

SEQ ID NO: 553062 - DNA, 25 bp, Mus musculus
gccggtgatttaagtgattagcaaa

SEQ ID NO: 553063 - DNA, 25 bp, Mus musculus
gccggtgatttatgtgattagcaaa

SEQ ID NO: 553064 - DNA, 25 bp, Mus musculus
gccggtgcgcacagtgagtaatttg

SEQ ID NO: 553065 - DNA, 25 bp, Mus musculus
gccggtgcgcactgtgagtaatttg

SEQ ID NO: 553066 - DNA, 25 bp, Mus musculus
gccggtggacgccaaggagttggaa

SEQ ID NO: 553067 - DNA, 25 bp, Mus musculus
gccggtggacgcgaaggagttggaa

SEQ ID NO: 553068 - DNA, 25 bp, Mus musculus
gccggtggatttctctagttgtgat

SEQ ID NO: 553069 - DNA, 25 bp, Mus musculus
gccggtggatttgtctagttgtgat

SEQ ID NO: 553070 - DNA, 25 bp, Mus musculus
gccggtggtcgccatgagtctaccc

SEQ ID NO: 553071 - DNA, 25 bp, Mus musculus
gccggtggtcgcgatgagtctaccc

SEQ ID NO: 553072 - DNA, 25 bp, Mus musculus
gccggtgtatgtagcagatgtttcc

SEQ ID NO: 553073 - DNA, 25 bp, Mus musculus
gccggtgtatgttgcagatgtttcc

SEQ ID NO: 553074 - DNA, 25 bp, Mus musculus
gccggtgtccctaatctttattgta

SEQ ID NO: 553075 - DNA, 25 bp, Mus musculus
gccggtgtcccttatctttattgta

SEQ ID NO: 553076 - DNA, 25 bp, Mus musculus
gccggtgtgctgcaacaggctatcc

SEQ ID NO: 553077 - DNA, 25 bp, Mus musculus
gccggtgtgctggaacaggctatcc

SEQ ID NO: 553078 - DNA, 25 bp, Mus musculus
gccggttccactctttctaaaggat

SEQ ID NO: 553079 - DNA, 25 bp, Mus musculus
gccggttccactgtttctaaaggat

SEQ ID NO: 553080 - DNA, 25 bp, Mus musculus
gccggttctctcatttgatgtttac

SEQ ID NO: 553081 - DNA, 25 bp, Mus musculus
gccggttctctcttttgatgtttac

SEQ ID NO: 553082 - DNA, 25 bp, Mus musculus
gccggttctgagagtaacgcatcca

SEQ ID NO: 553083 - DNA, 25 bp, Mus musculus
gccggttctgagtgtaacgcatcca

SEQ ID NO: 553084 - DNA, 25 bp, Mus musculus
gccggttgatgcattggcagtcatt

SEQ ID NO: 553085 - DNA, 25 bp, Mus musculus
gccggttgatgctttggcagtcatt

SEQ ID NO: 553086 - DNA, 25 bp, Mus musculus
gccggtttcattacgctcagaatat

SEQ ID NO: 553087 - DNA, 25 bp, Mus musculus
gccggtttcatttcgctcagaatat

SEQ ID NO: 553088 - DNA, 25 bp, Mus musculus
gccggtttcctcctatatgcagatg

SEQ ID NO: 553089 - DNA, 25 bp, Mus musculus
gccggtttcctcgtatatgcagatg

SEQ ID NO: 553090 - DNA, 25 bp, Mus musculus
gccggtttgcatcagtggaaggtct

SEQ ID NO: 553091 - DNA, 25 bp, Mus musculus
gccggtttgcatgagtggaaggtct

SEQ ID NO: 553092 - DNA, 25 bp, Mus musculus
gccggtttgtgccaccacagacaag

SEQ ID NO: 553093 - DNA, 25 bp, Mus musculus
gccggtttgtgcgaccacagacaag

SEQ ID NO: 553094 - DNA, 25 bp, Mus musculus
gccgtaaagcaaatgccattcctga

SEQ ID NO: 553095 - DNA, 25 bp, Mus musculus
gccgtaaagcaattgccattcctga

SEQ ID NO: 553096 - DNA, 25 bp, Mus musculus
gccgtagaaggaatcttcttttccg

SEQ ID NO: 553097 - DNA, 25 bp, Mus musculus
gccgtagaaggattcttcttttccg

SEQ ID NO: 553098 - DNA, 25 bp, Mus musculus
gccgtagacatactccatctgtttg

SEQ ID NO: 553099 - DNA, 25 bp, Mus musculus
gccgtagacatagtccatctgtttg

SEQ ID NO: 553100 - DNA, 25 bp, Mus musculus
gccgtagctttcagtaaggtggcca

SEQ ID NO: 553101 - DNA, 25 bp, Mus musculus
gccgtagctttctgtaaggtggcca

SEQ ID NO: 553102 - DNA, 25 bp, Mus musculus
gccgtaggctttcgccaaacgcaaa

SEQ ID NO: 553103 - DNA, 25 bp, Mus musculus
gccgtaggctttggccaaacgcaaa

SEQ ID NO: 553104 - DNA, 25 bp, Mus musculus
gccgtaggtggactgtttgtcattc

SEQ ID NO: 553105 - DNA, 25 bp, Mus musculus
gccgtaggtggagtgtttgtcattc

SEQ ID NO: 553106 - DNA, 25 bp, Mus musculus
gccgtatccggtctatgcagtgtta

SEQ ID NO: 553107 - DNA, 25 bp, Mus musculus
gccgtatccggtgtatgcagtgtta

SEQ ID NO: 553108 - DNA, 25 bp, Mus musculus
gccgtatgatctctctggtaacaca

SEQ ID NO: 553109 - DNA, 25 bp, Mus musculus
gccgtatgatctgtctggtaacaca

SEQ ID NO: 553110 - DNA, 25 bp, Mus musculus
gccgtattaactccattgtttaatt

SEQ ID NO: 553111 - DNA, 25 bp, Mus musculus
gccgtattaactgcattgtttaatt

SEQ ID NO: 553112 - DNA, 25 bp, Mus musculus
gccgtcactttaagttctggacttg

SEQ ID NO: 553113 - DNA, 25 bp, Mus musculus
gccgtcactttatgttctggacttg

SEQ ID NO: 553114 - DNA, 25 bp, Mus musculus
gccgtcagcacgagttggttatatc

SEQ ID NO: 553115 - DNA, 25 bp, Mus musculus
gccgtcagcacgtgttggttatatc

SEQ ID NO: 553116 - DNA, 25 bp, Mus musculus
gccgtcagcgttctttctcttccaa

SEQ ID NO: 553117 - DNA, 25 bp, Mus musculus
gccgtcagcgttgtttctcttccaa

SEQ ID NO: 553118 - DNA, 25 bp, Mus musculus
gccgtcagggttaataaagcacttt

SEQ ID NO: 553119 - DNA, 25 bp, Mus musculus
gccgtcagggtttataaagcacttt

SEQ ID NO: 553120 - DNA, 25 bp, Mus musculus
gccgtcatgaaaccccgcaaagaca

SEQ ID NO: 553121 - DNA, 25 bp, Mus musculus
gccgtcatgaaagcccgcaaagaca

SEQ ID NO: 553122 - DNA, 25 bp, Mus musculus
gccgtccaccggattatacagaact

SEQ ID NO: 553123 - DNA, 25 bp, Mus musculus
gccgtccaccggtttatacagaact

SEQ ID NO: 553124 - DNA, 25 bp, Mus musculus
gccgtccacctgatgtttctgtgat

SEQ ID NO: 553125 - DNA, 25 bp, Mus musculus
gccgtccacctgttgtttctgtgat

SEQ ID NO: 553126 - DNA, 25 bp, Mus musculus
gccgtccaggcgctccgtaaataaa

SEQ ID NO: 553127 - DNA, 25 bp, Mus musculus
gccgtccaggcggtccgtaaataaa

SEQ ID NO: 553128 - DNA, 25 bp, Mus musculus
gccgtccccgttcagagtgggatca

SEQ ID NO: 553129 - DNA, 25 bp, Mus musculus
gccgtccccgttgagagtgggatca

SEQ ID NO: 553130 - DNA, 25 bp, Mus musculus
gccgtcccctggagacaaagaaagc

SEQ ID NO: 553131 - DNA, 25 bp, Mus musculus
gccgtcccctggtgacaaagaaagc

SEQ ID NO: 553132 - DNA, 25 bp, Mus musculus
gccgtccgagctcagatactttgtg

SEQ ID NO: 553133 - DNA, 25 bp, Mus musculus
gccgtccgagctgagatactttgtg

SEQ ID NO: 553134 - DNA, 25 bp, Mus musculus
gccgtccgtactcgacacgtggaga

SEQ ID NO: 553135 - DNA, 25 bp, Mus musculus
gccgtccgtactggacacgtggaga

SEQ ID NO: 553136 - DNA, 25 bp, Mus musculus
gccgtcctatgaccagagctgtggt

SEQ ID NO: 553137 - DNA, 25 bp, Mus musculus
gccgtcctatgagcagagctgtggt

SEQ ID NO: 553138 - DNA, 25 bp, Mus musculus
gccgtcgagattataggatgcgctt

SEQ ID NO: 553139 - DNA, 25 bp, Mus musculus
gccgtcgagattttaggatgcgctt

SEQ ID NO: 553140 - DNA, 25 bp, Mus musculus
gccgtcgggcatacagctatgatga

SEQ ID NO: 553141 - DNA, 25 bp, Mus musculus
gccgtcgggcattcagctatgatga

SEQ ID NO: 553142 - DNA, 25 bp, Mus musculus
gccgtctaaattacatgttccacaa

SEQ ID NO: 553143 - DNA, 25 bp, Mus musculus
gccgtctaaatttcatgttccacaa

SEQ ID NO: 553144 - DNA, 25 bp, Mus musculus
gccgtctaccgcagggacaagaaga

SEQ ID NO: 553145 - DNA, 25 bp, Mus musculus
gccgtctaccgctgggacaagaaga

SEQ ID NO: 553146 - DNA, 25 bp, Mus musculus
gccgtctagaccactctggagtgag

SEQ ID NO: 553147 - DNA, 25 bp, Mus musculus
gccgtctagacctctctggagtgag

SEQ ID NO: 553148 - DNA, 25 bp, Mus musculus
gccgtctagttaatgctgcattgtt

SEQ ID NO: 553149 - DNA, 25 bp, Mus musculus
gccgtctagttattgctgcattgtt

SEQ ID NO: 553150 - DNA, 25 bp, Mus musculus
gccgtctccaggacatgcagcagat

SEQ ID NO: 553151 - DNA, 25 bp, Mus musculus
gccgtctccaggtcatgcagcagat

SEQ ID NO: 553152 - DNA, 25 bp, Mus musculus
gccgtctctccaccacaaagtttta

SEQ ID NO: 553153 - DNA, 25 bp, Mus musculus
gccgtctctccagcacaaagtttta

SEQ ID NO: 553154 - DNA, 25 bp, Mus musculus
gccgtctgaaacacaatgctgtaga

SEQ ID NO: 553155 - DNA, 25 bp, Mus musculus
gccgtctgaaactcaatgctgtaga

SEQ ID NO: 553156 - DNA, 25 bp, Mus musculus
gccgtctgcgcgatggaaagccaaa

SEQ ID NO: 553157 - DNA, 25 bp, Mus musculus
gccgtctgcgcgttggaaagccaaa

SEQ ID NO: 553158 - DNA, 25 bp, Mus musculus
gccgtctggttcaaggacacctaaa

SEQ ID NO: 553159 - DNA, 25 bp, Mus musculus
gccgtctggttctaggacacctaaa

SEQ ID NO: 553160 - DNA, 25 bp, Mus musculus
gccgtcttaactagaaggttccatt

SEQ ID NO: 553161 - DNA, 25 bp, Mus musculus
gccgtcttaacttgaaggttccatt

SEQ ID NO: 553162 - DNA, 25 bp, Mus musculus
gccgtcttgcacagggccatgctaa

SEQ ID NO: 553163 - DNA, 25 bp, Mus musculus
gccgtcttgcactgggccatgctaa

SEQ ID NO: 553164 - DNA, 25 bp, Mus musculus
gccgtgaaaaccatgctggagctgg

SEQ ID NO: 553165 - DNA, 25 bp, Mus musculus
gccgtgaaaaccttgctggagctgg

SEQ ID NO: 553166 - DNA, 25 bp, Mus musculus
gccgtgaaatcaccgcatgcaccgc

SEQ ID NO: 553167 - DNA, 25 bp, Mus musculus
gccgtgaaatcagcgcatgcaccgc

SEQ ID NO: 553168 - DNA, 25 bp, Mus musculus
gccgtgaaggttagcgcgacgacca

SEQ ID NO: 553169 - DNA, 25 bp, Mus musculus
gccgtgaaggtttgcgcgacgacca

SEQ ID NO: 553170 - DNA, 25 bp, Mus musculus
gccgtgacagcgacctagtgttaac

SEQ ID NO: 553171 - DNA, 25 bp, Mus musculus
gccgtgacagcgtcctagtgttaac

SEQ ID NO: 553172 - DNA, 25 bp, Mus musculus
gccgtgagagttaagagcatgtgct

SEQ ID NO: 553173 - DNA, 25 bp, Mus musculus
gccgtgagagtttagagcatgtgct

SEQ ID NO: 553174 - DNA, 25 bp, Mus musculus
gccgtgagcgctcgtagacagaact

SEQ ID NO: 553175 - DNA, 25 bp, Mus musculus
gccgtgagcgctggtagacagaact

SEQ ID NO: 553176 - DNA, 25 bp, Mus musculus
gccgtgaggtttctgtttaggcctt

SEQ ID NO: 553177 - DNA, 25 bp, Mus musculus
gccgtgaggtttgtgtttaggcctt

SEQ ID NO: 553178 - DNA, 25 bp, Mus musculus
gccgtgataatgatactagttctaa

SEQ ID NO: 553179 - DNA, 25 bp, Mus musculus
gccgtgataatgttactagttctaa

SEQ ID NO: 553180 - DNA, 25 bp, Mus musculus
gccgtgatgctaagatgtcacaaaa

SEQ ID NO: 553181 - DNA, 25 bp, Mus musculus
gccgtgatgctatgatgtcacaaaa

SEQ ID NO: 553182 - DNA, 25 bp, Mus musculus
gccgtgcaagtaaggtcaccgggtt

SEQ ID NO: 553183 - DNA, 25 bp, Mus musculus
gccgtgcaagtatggtcaccgggtt

SEQ ID NO: 553184 - DNA, 25 bp, Mus musculus
gccgtgcacgaaaagcccgcaaatt

SEQ ID NO: 553185 - DNA, 25 bp, Mus musculus
gccgtgcacgaatagcccgcaaatt

SEQ ID NO: 553186 - DNA, 25 bp, Mus musculus
gccgtgcacgctaagttccaggttg

SEQ ID NO: 553187 - DNA, 25 bp, Mus musculus
gccgtgcacgcttagttccaggttg

SEQ ID NO: 553188 - DNA, 25 bp, Mus musculus
gccgtgcaggctaccacttgtgtca

SEQ ID NO: 553189 - DNA, 25 bp, Mus musculus
gccgtgcaggcttccacttgtgtca

SEQ ID NO: 553190 - DNA, 25 bp, Mus musculus
gccgtgcatggtatctaggactcaa

SEQ ID NO: 553191 - DNA, 25 bp, Mus musculus
gccgtgcatggtttctaggactcaa

SEQ ID NO: 553192 - DNA, 25 bp, Mus musculus
gccgtgcctttccaaggatcctttg

SEQ ID NO: 553193 - DNA, 25 bp, Mus musculus
gccgtgcctttcgaaggatcctttg

SEQ ID NO: 553194 - DNA, 25 bp, Mus musculus
gccgtgcggcatcctggaagatcat

SEQ ID NO: 553195 - DNA, 25 bp, Mus musculus
gccgtgcggcatgctggaagatcat

SEQ ID NO: 553196 - DNA, 25 bp, Mus musculus
gccgtgcgttctaatcagctagtat

SEQ ID NO: 553197 - DNA, 25 bp, Mus musculus
gccgtgcgttcttatcagctagtat

SEQ ID NO: 553198 - DNA, 25 bp, Mus musculus
gccgtgctgattcctttggaatgtt

SEQ ID NO: 553199 - DNA, 25 bp, Mus musculus
gccgtgctgattgctttggaatgtt

SEQ ID NO: 553200 - DNA, 25 bp, Mus musculus
gccgtgctgcagacacagtactgga

SEQ ID NO: 553201 - DNA, 25 bp, Mus musculus
gccgtgctgcagtcacagtactgga

SEQ ID NO: 553202 - DNA, 25 bp, Mus musculus
gccgtgcttgctatttctatatttt

SEQ ID NO: 553203 - DNA, 25 bp, Mus musculus
gccgtgcttgctttttctatatttt

SEQ ID NO: 553204 - DNA, 25 bp, Mus musculus
gccgtggaaacaagttcgcccagat

SEQ ID NO: 553205 - DNA, 25 bp, Mus musculus
gccgtggaaacatgttcgcccagat

SEQ ID NO: 553206 - DNA, 25 bp, Mus musculus
gccgtggacttcagctttaacctat

SEQ ID NO: 553207 - DNA, 25 bp, Mus musculus
gccgtggacttctgctttaacctat

SEQ ID NO: 553208 - DNA, 25 bp, Mus musculus
gccgtggattaaagccgacctcaat

SEQ ID NO: 553209 - DNA, 25 bp, Mus musculus
gccgtggattaatgccgacctcaat

SEQ ID NO: 553210 - DNA, 25 bp, Mus musculus
gccgtggattggcaaacgtcctatg

SEQ ID NO: 553211 - DNA, 25 bp, Mus musculus
gccgtggattgggaaacgtcctatg

SEQ ID NO: 553212 - DNA, 25 bp, Mus musculus
gccgtggcccacattactgaggaat

SEQ ID NO: 553213 - DNA, 25 bp, Mus musculus
gccgtggcccactttactgaggaat

SEQ ID NO: 553214 - DNA, 25 bp, Mus musculus
gccgtggctcatctcaacagtttca

SEQ ID NO: 553215 - DNA, 25 bp, Mus musculus
gccgtggctcatgtcaacagtttca

SEQ ID NO: 553216 - DNA, 25 bp, Mus musculus
gccgtggctgggaagaaactctcta

SEQ ID NO: 553217 - DNA, 25 bp, Mus musculus
gccgtggctgggtagaaactctcta

SEQ ID NO: 553218 - DNA, 25 bp, Mus musculus
gccgtggctttcacagagaggactc

SEQ ID NO: 553219 - DNA, 25 bp, Mus musculus
gccgtggctttctcagagaggactc

SEQ ID NO: 553220 - DNA, 25 bp, Mus musculus
gccgtgggtcgcaacggcatcctgc

SEQ ID NO: 553221 - DNA, 25 bp, Mus musculus
gccgtgggtcgctacggcatcctgc

SEQ ID NO: 553222 - DNA, 25 bp, Mus musculus
gccgtggtctgtcttcatggtcctg

SEQ ID NO: 553223 - DNA, 25 bp, Mus musculus
gccgtggtctgtgttcatggtcctg

SEQ ID NO: 553224 - DNA, 25 bp, Mus musculus
gccgtggtgcgaatgcagcaacagt

SEQ ID NO: 553225 - DNA, 25 bp, Mus musculus
gccgtggtgcgattgcagcaacagt

SEQ ID NO: 553226 - DNA, 25 bp, Mus musculus
gccgtggtggctaccgccagcagca

SEQ ID NO: 553227 - DNA, 25 bp, Mus musculus
gccgtggtggcttccgccagcagca

SEQ ID NO: 553228 - DNA, 25 bp, Mus musculus
gccgtggttcacagacagatattcc

SEQ ID NO: 553229 - DNA, 25 bp, Mus musculus
gccgtggttcactgacagatattcc

SEQ ID NO: 553230 - DNA, 25 bp, Mus musculus
gccgtgtacccaatggctatcactg

SEQ ID NO: 553231 - DNA, 25 bp, Mus musculus
gccgtgtacccattggctatcactg

SEQ ID NO: 553232 - DNA, 25 bp, Mus musculus
gccgtgtccaccaggaaatcgacga

SEQ ID NO: 553233 - DNA, 25 bp, Mus musculus
gccgtgtccacctggaaatcgacga

SEQ ID NO: 553234 - DNA, 25 bp, Mus musculus
gccgtgtctgtcaacaagcgtggag

SEQ ID NO: 553235 - DNA, 25 bp, Mus musculus
gccgtgtctgtctacaagcgtggag

SEQ ID NO: 553236 - DNA, 25 bp, Mus musculus
gccgtgtctgtgaacctttactagg

SEQ ID NO: 553237 - DNA, 25 bp, Mus musculus
gccgtgtctgtgtacctttactagg

SEQ ID NO: 553238 - DNA, 25 bp, Mus musculus
gccgtgtgaagcagcctcagatgac

SEQ ID NO: 553239 - DNA, 25 bp, Mus musculus
gccgtgtgaagctgcctcagatgac

SEQ ID NO: 553240 - DNA, 25 bp, Mus musculus
gccgtgtgccttacaggtgtgactt

SEQ ID NO: 553241 - DNA, 25 bp, Mus musculus
gccgtgtgcctttcaggtgtgactt

SEQ ID NO: 553242 - DNA, 25 bp, Mus musculus
gccgtgtgggagaaggcattccaaa

SEQ ID NO: 553243 - DNA, 25 bp, Mus musculus
gccgtgtgggagtaggcattccaaa

SEQ ID NO: 553244 - DNA, 25 bp, Mus musculus
gccgtgtggtgaaatcctcccgtgg

SEQ ID NO: 553245 - DNA, 25 bp, Mus musculus
gccgtgtggtgatatcctcccgtgg

SEQ ID NO: 553246 - DNA, 25 bp, Mus musculus
gccgtgtgtcaaaaattttgagaga

SEQ ID NO: 553247 - DNA, 25 bp, Mus musculus
gccgtgtgtcaataattttgagaga

SEQ ID NO: 553248 - DNA, 25 bp, Mus musculus
gccgtgtgtgccagactagactaac

SEQ ID NO: 553249 - DNA, 25 bp, Mus musculus
gccgtgtgtgcctgactagactaac

SEQ ID NO: 553250 - DNA, 25 bp, Mus musculus
gccgtgttcgatatgagtggtcttc

SEQ ID NO: 553251 - DNA, 25 bp, Mus musculus
gccgtgttcgatttgagtggtcttc

SEQ ID NO: 553252 - DNA, 25 bp, Mus musculus
gccgtgttgaacactggactggtat

SEQ ID NO: 553253 - DNA, 25 bp, Mus musculus
gccgtgttgaactctggactggtat

SEQ ID NO: 553254 - DNA, 25 bp, Mus musculus
gccgtgtttgctcaaggactcttaa

SEQ ID NO: 553255 - DNA, 25 bp, Mus musculus
gccgtgtttgctgaaggactcttaa

SEQ ID NO: 553256 - DNA, 25 bp, Mus musculus
gccgtgtttgtacggtgtctttgat

SEQ ID NO: 553257 - DNA, 25 bp, Mus musculus
gccgtgtttgtagggtgtctttgat

SEQ ID NO: 553258 - DNA, 25 bp, Mus musculus
gccgttaaccgtccacatactaatg

SEQ ID NO: 553259 - DNA, 25 bp, Mus musculus
gccgttaaccgtgcacatactaatg

SEQ ID NO: 553260 - DNA, 25 bp, Mus musculus
gccgttacactcatctgttctgtaa

SEQ ID NO: 553261 - DNA, 25 bp, Mus musculus
gccgttacactcttctgttctgtaa

SEQ ID NO: 553262 - DNA, 25 bp, Mus musculus
gccgttacagctcttcgtgcgaaac

SEQ ID NO: 553263 - DNA, 25 bp, Mus musculus
gccgttacagctgttcgtgcgaaac

SEQ ID NO: 553264 - DNA, 25 bp, Mus musculus
gccgttaccgccctggcaagtgaag

SEQ ID NO: 553265 - DNA, 25 bp, Mus musculus
gccgttaccgccgtggcaagtgaag

SEQ ID NO: 553266 - DNA, 25 bp, Mus musculus
gccgttagcattagctgtactggaa

SEQ ID NO: 553267 - DNA, 25 bp, Mus musculus
gccgttagcatttgctgtactggaa

SEQ ID NO: 553268 - DNA, 25 bp, Mus musculus
gccgttagtacgaggctcaacttgt

SEQ ID NO: 553269 - DNA, 25 bp, Mus musculus
gccgttagtacgtggctcaacttgt

SEQ ID NO: 553270 - DNA, 25 bp, Mus musculus
gccgttatctcacggcgaactttct

SEQ ID NO: 553271 - DNA, 25 bp, Mus musculus
gccgttatctcagggcgaactttct

SEQ ID NO: 553272 - DNA, 25 bp, Mus musculus
gccgttattgctaccaggatgctga

SEQ ID NO: 553273 - DNA, 25 bp, Mus musculus
gccgttattgcttccaggatgctga

SEQ ID NO: 553274 - DNA, 25 bp, Mus musculus
gccgttcaaaagcagacagttcaaa

SEQ ID NO: 553275 - DNA, 25 bp, Mus musculus
gccgttcaaaaggagacagttcaaa

SEQ ID NO: 553276 - DNA, 25 bp, Mus musculus
gccgttcaaggcacagttctgggaa

SEQ ID NO: 553277 - DNA, 25 bp, Mus musculus
gccgttcaaggctcagttctgggaa

SEQ ID NO: 553278 - DNA, 25 bp, Mus musculus
gccgttcacatcagttccttatggg

SEQ ID NO: 553279 - DNA, 25 bp, Mus musculus
gccgttcacatctgttccttatggg

SEQ ID NO: 553280 - DNA, 25 bp, Mus musculus
gccgttcagactcgcagatcttctc

SEQ ID NO: 553281 - DNA, 25 bp, Mus musculus
gccgttcagactggcagatcttctc

SEQ ID NO: 553282 - DNA, 25 bp, Mus musculus
gccgttcatctccacagactgggaa

SEQ ID NO: 553283 - DNA, 25 bp, Mus musculus
gccgttcatctcgacagactgggaa

SEQ ID NO: 553284 - DNA, 25 bp, Mus musculus
gccgttccagcaaccataggctaaa

SEQ ID NO: 553285 - DNA, 25 bp, Mus musculus
gccgttccagcatccataggctaaa

SEQ ID NO: 553286 - DNA, 25 bp, Mus musculus
gccgttccatttcttcattaaaaca

SEQ ID NO: 553287 - DNA, 25 bp, Mus musculus
gccgttccatttgttcattaaaaca

SEQ ID NO: 553288 - DNA, 25 bp, Mus musculus
gccgttccttgcagtgtgtatatat

SEQ ID NO: 553289 - DNA, 25 bp, Mus musculus
gccgttccttgctgtgtgtatatat

SEQ ID NO: 553290 - DNA, 25 bp, Mus musculus
gccgttctcctaaatttctatgcat

SEQ ID NO: 553291 - DNA, 25 bp, Mus musculus
gccgttctcctatatttctatgcat

SEQ ID NO: 553292 - DNA, 25 bp, Mus musculus
gccgttgaacctagatctctatcca

SEQ ID NO: 553293 - DNA, 25 bp, Mus musculus
gccgttgaaccttgatctctatcca

SEQ ID NO: 553294 - DNA, 25 bp, Mus musculus
gccgttgacagtctttgatttctca

SEQ ID NO: 553295 - DNA, 25 bp, Mus musculus
gccgttgacagtgtttgatttctca

SEQ ID NO: 553296 - DNA, 25 bp, Mus musculus
gccgttgacctcctcctttacgaag

SEQ ID NO: 553297 - DNA, 25 bp, Mus musculus
gccgttgacctcgtcctttacgaag

SEQ ID NO: 553298 - DNA, 25 bp, Mus musculus
gccgttgacctgaattgcatcttag

SEQ ID NO: 553299 - DNA, 25 bp, Mus musculus
gccgttgacctgtattgcatcttag

SEQ ID NO: 553300 - DNA, 25 bp, Mus musculus
gccgttgcaacactctgggttatga

SEQ ID NO: 553301 - DNA, 25 bp, Mus musculus
gccgttgcaacagtctgggttatga

SEQ ID NO: 553302 - DNA, 25 bp, Mus musculus
gccgttggagccacagttaccagct

SEQ ID NO: 553303 - DNA, 25 bp, Mus musculus
gccgttggagcctcagttaccagct

SEQ ID NO: 553304 - DNA, 25 bp, Mus musculus
gccgttgtggatccaacctgcaaga

SEQ ID NO: 553305 - DNA, 25 bp, Mus musculus
gccgttgtggatgcaacctgcaaga

SEQ ID NO: 553306 - DNA, 25 bp, Mus musculus
gccgttgtggccagtgtcatgaaca

SEQ ID NO: 553307 - DNA, 25 bp, Mus musculus
gccgttgtggcctgtgtcatgaaca

SEQ ID NO: 553308 - DNA, 25 bp, Mus musculus
gccgttgtgttcaccgagttgtgag

SEQ ID NO: 553309 - DNA, 25 bp, Mus musculus
gccgttgtgttctccgagttgtgag

SEQ ID NO: 553310 - DNA, 25 bp, Mus musculus
gccgttgttttgatgaagcatactc

SEQ ID NO: 553311 - DNA, 25 bp, Mus musculus
gccgttgttttgttgaagcatactc

SEQ ID NO: 553312 - DNA, 25 bp, Mus musculus
gccgtttaaagcacagttctgatga

SEQ ID NO: 553313 - DNA, 25 bp, Mus musculus
gccgtttaaagctcagttctgatga

SEQ ID NO: 553314 - DNA, 25 bp, Mus musculus
gccgtttacgttaattgttgtatca

SEQ ID NO: 553315 - DNA, 25 bp, Mus musculus
gccgtttacgtttattgttgtatca

SEQ ID NO: 553316 - DNA, 25 bp, Mus musculus
gccgtttcaacgatacaatcatttt

SEQ ID NO: 553317 - DNA, 25 bp, Mus musculus
gccgtttcaacgttacaatcatttt

SEQ ID NO: 553318 - DNA, 25 bp, Mus musculus
gccgtttctgaacccaggcagggat

SEQ ID NO: 553319 - DNA, 25 bp, Mus musculus
gccgtttctgaagccaggcagggat

SEQ ID NO: 553320 - DNA, 25 bp, Mus musculus
gccgtttcttgcagttttgtacagt

SEQ ID NO: 553321 - DNA, 25 bp, Mus musculus
gccgtttcttgctgttttgtacagt

SEQ ID NO: 553322 - DNA, 25 bp, Mus musculus
gccgtttgcttccatacagctccgg

SEQ ID NO: 553323 - DNA, 25 bp, Mus musculus
gccgtttgcttcgatacagctccgg

SEQ ID NO: 553324 - DNA, 25 bp, Mus musculus
gccgtttgctttctaatcatttcat

SEQ ID NO: 553325 - DNA, 25 bp, Mus musculus
gccgtttgctttgtaatcatttcat

SEQ ID NO: 553326 - DNA, 25 bp, Mus musculus
gccgtttgtcagatttgtgttacca

SEQ ID NO: 553327 - DNA, 25 bp, Mus musculus
gccgtttgtcagttttgtgttacca

SEQ ID NO: 553328 - DNA, 25 bp, Mus musculus
gccgttttccaactcttgaactaca

SEQ ID NO: 553329 - DNA, 25 bp, Mus musculus
gccgttttccaagtcttgaactaca

SEQ ID NO: 553330 - DNA, 25 bp, Mus musculus
gccgttttcgtgcaattaggactca

SEQ ID NO: 553331 - DNA, 25 bp, Mus musculus
gccgttttcgtggaattaggactca

SEQ ID NO: 553332 - DNA, 25 bp, Mus musculus
gccgttttctatagggtgagtgcga

SEQ ID NO: 553333 - DNA, 25 bp, Mus musculus
gccgttttctattgggtgagtgcga

SEQ ID NO: 553334 - DNA, 25 bp, Mus musculus
gccgttttgtatataatgccctctg

SEQ ID NO: 553335 - DNA, 25 bp, Mus musculus
gccgttttgtatttaatgccctctg

SEQ ID NO: 553336 - DNA, 25 bp, Mus musculus
gccgttttgtgaatccttttgattt

SEQ ID NO: 553337 - DNA, 25 bp, Mus musculus
gccgttttgtgattccttttgattt

SEQ ID NO: 553338 - DNA, 25 bp, Mus musculus
gccgttttgtttcattccacttaga

SEQ ID NO: 553339 - DNA, 25 bp, Mus musculus
gccgttttgtttgattccacttaga

SEQ ID NO: 553340 - DNA, 25 bp, Mus musculus
gcctaaaacactatgggtggtattg

SEQ ID NO: 553341 - DNA, 25 bp, Mus musculus
gcctaaaacactccccgatgatgat

SEQ ID NO: 553342 - DNA, 25 bp, Mus musculus
gcctaaaacactgcccgatgatgat

SEQ ID NO: 553343 - DNA, 25 bp, Mus musculus
gcctaaaacactttgggtggtattg

SEQ ID NO: 553344 - DNA, 25 bp, Mus musculus
gcctaaaacagcattcatttggtac

SEQ ID NO: 553345 - DNA, 25 bp, Mus musculus
gcctaaaacagctttcatttggtac

SEQ ID NO: 553346 - DNA, 25 bp, Mus musculus
gcctaaaatcacagcatgctagttt

SEQ ID NO: 553347 - DNA, 25 bp, Mus musculus
gcctaaaatcactgcatgctagttt

SEQ ID NO: 553348 - DNA, 25 bp, Mus musculus
gcctaaaattttagcactctctgcc

SEQ ID NO: 553349 - DNA, 25 bp, Mus musculus
gcctaaaatttttgcactctctgcc

SEQ ID NO: 553350 - DNA, 25 bp, Mus musculus
gcctaaactcagcagcacagccata

SEQ ID NO: 553351 - DNA, 25 bp, Mus musculus
gcctaaactcaggagcacagccata

SEQ ID NO: 553352 - DNA, 25 bp, Mus musculus
gcctaaagccttcttgatttatttt

SEQ ID NO: 553353 - DNA, 25 bp, Mus musculus
gcctaaagccttgttgatttatttt

SEQ ID NO: 553354 - DNA, 25 bp, Mus musculus
gcctaaaggaagactgactccctcc

SEQ ID NO: 553355 - DNA, 25 bp, Mus musculus
gcctaaaggaagtctgactccctcc

SEQ ID NO: 553356 - DNA, 25 bp, Mus musculus
gcctaaagggctcccagggcaaact

SEQ ID NO: 553357 - DNA, 25 bp, Mus musculus
gcctaaagggctgccagggcaaact

SEQ ID NO: 553358 - DNA, 25 bp, Mus musculus
gcctaaatgatgctgcttggtgagt

SEQ ID NO: 553359 - DNA, 25 bp, Mus musculus
gcctaaatgatggtgcttggtgagt

SEQ ID NO: 553360 - DNA, 25 bp, Mus musculus
gcctaacagtgcagtcatttctcaa

SEQ ID NO: 553361 - DNA, 25 bp, Mus musculus
gcctaacagtgctgtcatttctcaa

SEQ ID NO: 553362 - DNA, 25 bp, Mus musculus
gcctaacatctgaccctatggctgg

SEQ ID NO: 553363 - DNA, 25 bp, Mus musculus
gcctaacatctgtccctatggctgg

SEQ ID NO: 553364 - DNA, 25 bp, Mus musculus
gcctaacatgacacctttatacatt

SEQ ID NO: 553365 - DNA, 25 bp, Mus musculus
gcctaacatgactcctttatacatt

SEQ ID NO: 553366 - DNA, 25 bp, Mus musculus
gcctaacattgtcttcggtagctct

SEQ ID NO: 553367 - DNA, 25 bp, Mus musculus
gcctaacattgtgttcggtagctct

SEQ ID NO: 553368 - DNA, 25 bp, Mus musculus
gcctaaccaagaccaagtgggtccc

SEQ ID NO: 553369 - DNA, 25 bp, Mus musculus
gcctaaccaagagcaagtgggtccc

SEQ ID NO: 553370 - DNA, 25 bp, Mus musculus
gcctaaccctgccataaaacattca

SEQ ID NO: 553371 - DNA, 25 bp, Mus musculus
gcctaaccctgcgataaaacattca

SEQ ID NO: 553372 - DNA, 25 bp, Mus musculus
gcctaacctattaggtgagccctaa

SEQ ID NO: 553373 - DNA, 25 bp, Mus musculus
gcctaacctatttggtgagccctaa

SEQ ID NO: 553374 - DNA, 25 bp, Mus musculus
gcctaacctcgacatatggtctcaa

SEQ ID NO: 553375 - DNA, 25 bp, Mus musculus
gcctaacctcgagatatggtctcaa

SEQ ID NO: 553376 - DNA, 25 bp, Mus musculus
gcctaacctgtcctcagcgagataa

SEQ ID NO: 553377 - DNA, 25 bp, Mus musculus
gcctaacctgtcgtcagcgagataa

SEQ ID NO: 553378 - DNA, 25 bp, Mus musculus
gcctaacgtgttacattccttcaaa

SEQ ID NO: 553379 - DNA, 25 bp, Mus musculus
gcctaacgtgtttcattccttcaaa

SEQ ID NO: 553380 - DNA, 25 bp, Mus musculus
gcctaactacacacctgttatcagt

SEQ ID NO: 553381 - DNA, 25 bp, Mus musculus
gcctaactacactcctgttatcagt

SEQ ID NO: 553382 - DNA, 25 bp, Mus musculus
gcctaactgactaggttcttcttga

SEQ ID NO: 553383 - DNA, 25 bp, Mus musculus
gcctaactgacttggttcttcttga

SEQ ID NO: 553384 - DNA, 25 bp, Mus musculus
gcctaactgcacacctgaattcttt

SEQ ID NO: 553385 - DNA, 25 bp, Mus musculus
gcctaactgcactcctgaattcttt

SEQ ID NO: 553386 - DNA, 25 bp, Mus musculus
gcctaacttgtgaaactgcttttgc

SEQ ID NO: 553387 - DNA, 25 bp, Mus musculus
gcctaacttgtgtaactgcttttgc

SEQ ID NO: 553388 - DNA, 25 bp, Mus musculus
gcctaagacttcaggagcagccaat

SEQ ID NO: 553389 - DNA, 25 bp, Mus musculus
gcctaagacttctggagcagccaat

SEQ ID NO: 553390 - DNA, 25 bp, Mus musculus
gcctaagagatcctgggtgagaacc

SEQ ID NO: 553391 - DNA, 25 bp, Mus musculus
gcctaagagatcgtgggtgagaacc

SEQ ID NO: 553392 - DNA, 25 bp, Mus musculus
gcctaagagctcctttttggtatta

SEQ ID NO: 553393 - DNA, 25 bp, Mus musculus
gcctaagagctcgtttttggtatta

SEQ ID NO: 553394 - DNA, 25 bp, Mus musculus
gcctaagaggcactactacaagcag

SEQ ID NO: 553395 - DNA, 25 bp, Mus musculus
gcctaagaggcagtactacaagcag

SEQ ID NO: 553396 - DNA, 25 bp, Mus musculus
gcctaagaggccagcatatgattga

SEQ ID NO: 553397 - DNA, 25 bp, Mus musculus
gcctaagaggcctgcatatgattga

SEQ ID NO: 553398 - DNA, 25 bp, Mus musculus
gcctaagatgaaacaaccctttcct

SEQ ID NO: 553399 - DNA, 25 bp, Mus musculus
gcctaagatgaatcaaccctttcct

SEQ ID NO: 553400 - DNA, 25 bp, Mus musculus
gcctaagcatatcagtttgtggaca

SEQ ID NO: 553401 - DNA, 25 bp, Mus musculus
gcctaagcatatgagtttgtggaca

SEQ ID NO: 553402 - DNA, 25 bp, Mus musculus
gcctaagccgagcagggttcatcga

SEQ ID NO: 553403 - DNA, 25 bp, Mus musculus
gcctaagccgaggagggttcatcga

SEQ ID NO: 553404 - DNA, 25 bp, Mus musculus
gcctaagcgctcagatgctcagtta

SEQ ID NO: 553405 - DNA, 25 bp, Mus musculus
gcctaagcgctctgatgctcagtta

SEQ ID NO: 553406 - DNA, 25 bp, Mus musculus
gcctaagctctcatggattcagtac

SEQ ID NO: 553407 - DNA, 25 bp, Mus musculus
gcctaagctctcttggattcagtac

SEQ ID NO: 553408 - DNA, 25 bp, Mus musculus
gcctaagctgatatggatctgggtt

SEQ ID NO: 553409 - DNA, 25 bp, Mus musculus
gcctaagctgatttggatctgggtt

SEQ ID NO: 553410 - DNA, 25 bp, Mus musculus
gcctaaggaaaacccgactgtaagc

SEQ ID NO: 553411 - DNA, 25 bp, Mus musculus
gcctaaggaaaagccgactgtaagc

SEQ ID NO: 553412 - DNA, 25 bp, Mus musculus
gcctaaggacttcttgactagactc

SEQ ID NO: 553413 - DNA, 25 bp, Mus musculus
gcctaaggacttgttgactagactc

SEQ ID NO: 553414 - DNA, 25 bp, Mus musculus
gcctaaggagctcaggtcaatcccc

SEQ ID NO: 553415 - DNA, 25 bp, Mus musculus
gcctaaggagctgaggtcaatcccc

SEQ ID NO: 553416 - DNA, 25 bp, Mus musculus
gcctaaggaggcctctctgagcaga

SEQ ID NO: 553417 - DNA, 25 bp, Mus musculus
gcctaaggaggcgtctctgagcaga

SEQ ID NO: 553418 - DNA, 25 bp, Mus musculus
gcctaaggcacaacagtgcttcatt

SEQ ID NO: 553419 - DNA, 25 bp, Mus musculus
gcctaaggcacatcagtgcttcatt

SEQ ID NO: 553420 - DNA, 25 bp, Mus musculus
gcctaaggcagtacgctactgttat

SEQ ID NO: 553421 - DNA, 25 bp, Mus musculus
gcctaaggcagttcgctactgttat

SEQ ID NO: 553422 - DNA, 25 bp, Mus musculus
gcctaaggctgcaggtagaatcccc

SEQ ID NO: 553423 - DNA, 25 bp, Mus musculus
gcctaaggctgctggtagaatcccc

SEQ ID NO: 553424 - DNA, 25 bp, Mus musculus
gcctaaggtcatagttgtctgggta

SEQ ID NO: 553425 - DNA, 25 bp, Mus musculus
gcctaaggtcattgttgtctgggta

SEQ ID NO: 553426 - DNA, 25 bp, Mus musculus
gcctaaggtggtcataacgcaactg

SEQ ID NO: 553427 - DNA, 25 bp, Mus musculus
gcctaaggtggtgataacgcaactg

SEQ ID NO: 553428 - DNA, 25 bp, Mus musculus
gcctaagtagacaggcacatctctg

SEQ ID NO: 553429 - DNA, 25 bp, Mus musculus
gcctaagtagactggcacatctctg

SEQ ID NO: 553430 - DNA, 25 bp, Mus musculus
gcctaagtatgtccttgctttctac

SEQ ID NO: 553431 - DNA, 25 bp, Mus musculus
gcctaagtatgtgcttgctttctac

SEQ ID NO: 553432 - DNA, 25 bp, Mus musculus
gcctaagtctgcatttgcactggca

SEQ ID NO: 553433 - DNA, 25 bp, Mus musculus
gcctaagtctgcttttgcactggca

SEQ ID NO: 553434 - DNA, 25 bp, Mus musculus
gcctaagtcttaagttgcaaaatat

SEQ ID NO: 553435 - DNA, 25 bp, Mus musculus
gcctaagtcttatgttgcaaaatat

SEQ ID NO: 553436 - DNA, 25 bp, Mus musculus
gcctaagtggatcaatgctactgac

SEQ ID NO: 553437 - DNA, 25 bp, Mus musculus
gcctaagtggatgaatgctactgac

SEQ ID NO: 553438 - DNA, 25 bp, Mus musculus
gcctaagtgtctcagctcatcaaaa

SEQ ID NO: 553439 - DNA, 25 bp, Mus musculus
gcctaagtgtctgagctcatcaaaa

SEQ ID NO: 553440 - DNA, 25 bp, Mus musculus
gcctaagttttacctgtttcaccag

SEQ ID NO: 553441 - DNA, 25 bp, Mus musculus
gcctaagttttagctgtttcaccag

SEQ ID NO: 553442 - DNA, 25 bp, Mus musculus
gcctaataaaccatgtgcgagcgaa

SEQ ID NO: 553443 - DNA, 25 bp, Mus musculus
gcctaataaaccttgtgcgagcgaa

SEQ ID NO: 553444 - DNA, 25 bp, Mus musculus
gcctaatccagtaatgcctgtgtct

SEQ ID NO: 553445 - DNA, 25 bp, Mus musculus
gcctaatccagttatgcctgtgtct

SEQ ID NO: 553446 - DNA, 25 bp, Mus musculus
gcctaatccattactgtctttttga

SEQ ID NO: 553447 - DNA, 25 bp, Mus musculus
gcctaatccatttctgtctttttga

SEQ ID NO: 553448 - DNA, 25 bp, Mus musculus
gcctaatctagaatttatcccgtgg

SEQ ID NO: 553449 - DNA, 25 bp, Mus musculus
gcctaatctagattttatcccgtgg

SEQ ID NO: 553450 - DNA, 25 bp, Mus musculus
gcctaatcttgtatatctgctccaa

SEQ ID NO: 553451 - DNA, 25 bp, Mus musculus
gcctaatcttgtttatctgctccaa

SEQ ID NO: 553452 - DNA, 25 bp, Mus musculus
gcctaatgctaccaagaacggtcaa

SEQ ID NO: 553453 - DNA, 25 bp, Mus musculus
gcctaatgctacgaagaacggtcaa

SEQ ID NO: 553454 - DNA, 25 bp, Mus musculus
gcctaatgctgaccctttgctgaga

SEQ ID NO: 553455 - DNA, 25 bp, Mus musculus
gcctaatgctgagcctttgctgaga

SEQ ID NO: 553456 - DNA, 25 bp, Mus musculus
gcctaattctagcaggttgcccaat

SEQ ID NO: 553457 - DNA, 25 bp, Mus musculus
gcctaattctaggaggttgcccaat

SEQ ID NO: 553458 - DNA, 25 bp, Mus musculus
gcctaattttgaaggtctccaattt

SEQ ID NO: 553459 - DNA, 25 bp, Mus musculus
gcctaattttgatggtctccaattt

SEQ ID NO: 553460 - DNA, 25 bp, Mus musculus
gcctaattttttcctagaacctggt

SEQ ID NO: 553461 - DNA, 25 bp, Mus musculus
gcctaattttttgctagaacctggt

SEQ ID NO: 553462 - DNA, 25 bp, Mus musculus
gcctacaaactcacgcaagcagttt

SEQ ID NO: 553463 - DNA, 25 bp, Mus musculus
gcctacaaactctcgcaagcagttt

SEQ ID NO: 553464 - DNA, 25 bp, Mus musculus
gcctacaaatggacctgcgctgaga

SEQ ID NO: 553465 - DNA, 25 bp, Mus musculus
gcctacaaatggtcctgcgctgaga

SEQ ID NO: 553466 - DNA, 25 bp, Mus musculus
gcctacaagctcaaaggtgcatgaa

SEQ ID NO: 553467 - DNA, 25 bp, Mus musculus
gcctacaagctctaaggtgcatgaa

SEQ ID NO: 553468 - DNA, 25 bp, Mus musculus
gcctacaaggttctgcaagctctgc

SEQ ID NO: 553469 - DNA, 25 bp, Mus musculus
gcctacaaggttgtgcaagctctgc

SEQ ID NO: 553470 - DNA, 25 bp, Mus musculus
gcctacaagtctaagcaacctgagt

SEQ ID NO: 553471 - DNA, 25 bp, Mus musculus
gcctacaagtcttagcaacctgagt

SEQ ID NO: 553472 - DNA, 25 bp, Mus musculus
gcctacaatcctctggtctagatga

SEQ ID NO: 553473 - DNA, 25 bp, Mus musculus
gcctacaatcctgtggtctagatga

SEQ ID NO: 553474 - DNA, 25 bp, Mus musculus
gcctacacacagcaactcaatgagt

SEQ ID NO: 553475 - DNA, 25 bp, Mus musculus
gcctacacacaggaactcaatgagt

SEQ ID NO: 553476 - DNA, 25 bp, Mus musculus
gcctacacctgccaagcaacaaatg

SEQ ID NO: 553477 - DNA, 25 bp, Mus musculus
gcctacacctgcgaagcaacaaatg

SEQ ID NO: 553478 - DNA, 25 bp, Mus musculus
gcctacacgaggacagggccctgtg

SEQ ID NO: 553479 - DNA, 25 bp, Mus musculus
gcctacacgaggtcagggccctgtg

SEQ ID NO: 553480 - DNA, 25 bp, Mus musculus
gcctacactgttctagattgctcat

SEQ ID NO: 553481 - DNA, 25 bp, Mus musculus
gcctacactgttgtagattgctcat

SEQ ID NO: 553482 - DNA, 25 bp, Mus musculus
gcctacatcaaaatgggcatttcac

SEQ ID NO: 553483 - DNA, 25 bp, Mus musculus
gcctacatcaaattgggcatttcac

SEQ ID NO: 553484 - DNA, 25 bp, Mus musculus
gcctacatcgagcagtgccaggata

SEQ ID NO: 553485 - DNA, 25 bp, Mus musculus
gcctacatcgaggagtgccaggata

SEQ ID NO: 553486 - DNA, 25 bp, Mus musculus
gcctacatgttcagcatcattgaca

SEQ ID NO: 553487 - DNA, 25 bp, Mus musculus
gcctacatgttctgcatcattgaca

SEQ ID NO: 553488 - DNA, 25 bp, Mus musculus
gcctacattattacatgcctctgag

SEQ ID NO: 553489 - DNA, 25 bp, Mus musculus
gcctacattatttcatgcctctgag

SEQ ID NO: 553490 - DNA, 25 bp, Mus musculus
gcctacattcctaactgacaggaac

SEQ ID NO: 553491 - DNA, 25 bp, Mus musculus
gcctacattccttactgacaggaac

SEQ ID NO: 553492 - DNA, 25 bp, Mus musculus
gcctaccaatatatagtcttttatg

SEQ ID NO: 553493 - DNA, 25 bp, Mus musculus
gcctaccaatatttagtcttttatg

SEQ ID NO: 553494 - DNA, 25 bp, Mus musculus
gcctaccactttcagaagttgaatt

SEQ ID NO: 553495 - DNA, 25 bp, Mus musculus
gcctaccactttgagaagttgaatt

SEQ ID NO: 553496 - DNA, 25 bp, Mus musculus
gcctaccagaaactttgcttacctg

SEQ ID NO: 553497 - DNA, 25 bp, Mus musculus
gcctaccagaaagtttgcttacctg

SEQ ID NO: 553498 - DNA, 25 bp, Mus musculus
gcctaccagcgcatcatgacagaaa

SEQ ID NO: 553499 - DNA, 25 bp, Mus musculus
gcctaccagcgcttcatgacagaaa

SEQ ID NO: 553500 - DNA, 25 bp, Mus musculus
gcctacccacatactgtatgctgtg

SEQ ID NO: 553501 - DNA, 25 bp, Mus musculus
gcctacccacattctgtatgctgtg

SEQ ID NO: 553502 - DNA, 25 bp, Mus musculus
gcctaccccgcaattttaacaagtg

SEQ ID NO: 553503 - DNA, 25 bp, Mus musculus
gcctaccccgcatttttaacaagtg

SEQ ID NO: 553504 - DNA, 25 bp, Mus musculus
gcctaccccggaaactcaagatgtc

SEQ ID NO: 553505 - DNA, 25 bp, Mus musculus
gcctaccccggatactcaagatgtc

SEQ ID NO: 553506 - DNA, 25 bp, Mus musculus
gcctacccttcacctcagagagtgg

SEQ ID NO: 553507 - DNA, 25 bp, Mus musculus
gcctacccttcagctcagagagtgg

SEQ ID NO: 553508 - DNA, 25 bp, Mus musculus
gcctacccttggagctgtcataaaa

SEQ ID NO: 553509 - DNA, 25 bp, Mus musculus
gcctacccttggtgctgtcataaaa

SEQ ID NO: 553510 - DNA, 25 bp, Mus musculus
gcctaccctttaatgctgcagttta

SEQ ID NO: 553511 - DNA, 25 bp, Mus musculus
gcctaccctttattgctgcagttta

SEQ ID NO: 553512 - DNA, 25 bp, Mus musculus
gcctaccgatacagcaaccgatatt

SEQ ID NO: 553513 - DNA, 25 bp, Mus musculus
gcctaccgatactgcaaccgatatt

SEQ ID NO: 553514 - DNA, 25 bp, Mus musculus
gcctacctaggacgcccatgtggga

SEQ ID NO: 553515 - DNA, 25 bp, Mus musculus
gcctacctaggaggcccatgtggga

SEQ ID NO: 553516 - DNA, 25 bp, Mus musculus
gcctacctctggactgaagtacaag

SEQ ID NO: 553517 - DNA, 25 bp, Mus musculus
gcctacctctggtctgaagtacaag

SEQ ID NO: 553518 - DNA, 25 bp, Mus musculus
gcctacctcttgaagttgttgcaga

SEQ ID NO: 553519 - DNA, 25 bp, Mus musculus
gcctacctcttgtagttgttgcaga

SEQ ID NO: 553520 - DNA, 25 bp, Mus musculus
gcctacctgaatacttttggcagca

SEQ ID NO: 553521 - DNA, 25 bp, Mus musculus
gcctacctgaattcttttggcagca

SEQ ID NO: 553522 - DNA, 25 bp, Mus musculus
gcctacctgagaacattctctctct

SEQ ID NO: 553523 - DNA, 25 bp, Mus musculus
gcctacctgagacagccgggcttcg

SEQ ID NO: 553524 - DNA, 25 bp, Mus musculus
gcctacctgagagagccgggcttcg

SEQ ID NO: 553525 - DNA, 25 bp, Mus musculus
gcctacctgagatcattctctctct

SEQ ID NO: 553526 - DNA, 25 bp, Mus musculus
gcctacctggccctgcaagtaaggt

SEQ ID NO: 553527 - DNA, 25 bp, Mus musculus
gcctacctggccgtgcaagtaaggt

SEQ ID NO: 553528 - DNA, 25 bp, Mus musculus
gcctacctgggcctctagagtgaag

SEQ ID NO: 553529 - DNA, 25 bp, Mus musculus
gcctacctgggcgtctagagtgaag

SEQ ID NO: 553530 - DNA, 25 bp, Mus musculus
gcctaccttgaacagcagcatactt

SEQ ID NO: 553531 - DNA, 25 bp, Mus musculus
gcctaccttgaagagcagcatactt

SEQ ID NO: 553532 - DNA, 25 bp, Mus musculus
gcctaccttgttccatttatccaat

SEQ ID NO: 553533 - DNA, 25 bp, Mus musculus
gcctaccttgttgcatttatccaat

SEQ ID NO: 553534 - DNA, 25 bp, Mus musculus
gcctacgaacctctagcgttcatca

SEQ ID NO: 553535 - DNA, 25 bp, Mus musculus
gcctacgaacctgtagcgttcatca

SEQ ID NO: 553536 - DNA, 25 bp, Mus musculus
gcctacgctcttactatgagaccag

SEQ ID NO: 553537 - DNA, 25 bp, Mus musculus
gcctacgctctttctatgagaccag

SEQ ID NO: 553538 - DNA, 25 bp, Mus musculus
gcctacgctgcaatcagactcggga

SEQ ID NO: 553539 - DNA, 25 bp, Mus musculus
gcctacgctgcattcagactcggga

SEQ ID NO: 553540 - DNA, 25 bp, Mus musculus
gcctacgggctcaatgtgaggaact

SEQ ID NO: 553541 - DNA, 25 bp, Mus musculus
gcctacgggctctatgtgaggaact

SEQ ID NO: 553542 - DNA, 25 bp, Mus musculus
gcctacggtacaattttcatcccag

SEQ ID NO: 553543 - DNA, 25 bp, Mus musculus
gcctacggtacatttttcatcccag

SEQ ID NO: 553544 - DNA, 25 bp, Mus musculus
gcctacgtcgctatagcagcagtga

SEQ ID NO: 553545 - DNA, 25 bp, Mus musculus
gcctacgtcgctttagcagcagtga

SEQ ID NO: 553546 - DNA, 25 bp, Mus musculus
gcctactaagaacgtaccttgcata

SEQ ID NO: 553547 - DNA, 25 bp, Mus musculus
gcctactaagaaggtaccttgcata

SEQ ID NO: 553548 - DNA, 25 bp, Mus musculus
gcctactaaggcagctgagatcatt

SEQ ID NO: 553549 - DNA, 25 bp, Mus musculus
gcctactaaggctgctgagatcatt

SEQ ID NO: 553550 - DNA, 25 bp, Mus musculus
gcctactacaagagtttcttttttg

SEQ ID NO: 553551 - DNA, 25 bp, Mus musculus
gcctactacaagtgtttcttttttg

SEQ ID NO: 553552 - DNA, 25 bp, Mus musculus
gcctactatccccttggaagtggca

SEQ ID NO: 553553 - DNA, 25 bp, Mus musculus
gcctactatcccgttggaagtggca

SEQ ID NO: 553554 - DNA, 25 bp, Mus musculus
gcctactcaacactggatcaagcgt

SEQ ID NO: 553555 - DNA, 25 bp, Mus musculus
gcctactcaacagtggatcaagcgt

SEQ ID NO: 553556 - DNA, 25 bp, Mus musculus
gcctactcagagaagttgttccagt

SEQ ID NO: 553557 - DNA, 25 bp, Mus musculus
gcctactcagagtagttgttccagt

SEQ ID NO: 553558 - DNA, 25 bp, Mus musculus
gcctactcagttattatggttctct

SEQ ID NO: 553559 - DNA, 25 bp, Mus musculus
gcctactcagtttttatggttctct

SEQ ID NO: 553560 - DNA, 25 bp, Mus musculus
gcctactcatttactagttcagaga

SEQ ID NO: 553561 - DNA, 25 bp, Mus musculus
gcctactcattttctagttcagaga

SEQ ID NO: 553562 - DNA, 25 bp, Mus musculus
gcctactccaaacccgcatttgaga

SEQ ID NO: 553563 - DNA, 25 bp, Mus musculus
gcctactccaaagccgcatttgaga

SEQ ID NO: 553564 - DNA, 25 bp, Mus musculus
gcctactccatacaatcggtcatct

SEQ ID NO: 553565 - DNA, 25 bp, Mus musculus
gcctactccatagaatcggtcatct

SEQ ID NO: 553566 - DNA, 25 bp, Mus musculus
gcctactccctcagtacataaaaat

SEQ ID NO: 553567 - DNA, 25 bp, Mus musculus
gcctactccctctgtacataaaaat

SEQ ID NO: 553568 - DNA, 25 bp, Mus musculus
gcctactccttgactgcagatgcaa

SEQ ID NO: 553569 - DNA, 25 bp, Mus musculus
gcctactccttgtctgcagatgcaa

SEQ ID NO: 553570 - DNA, 25 bp, Mus musculus
gcctactctaacacaattagtcctc

SEQ ID NO: 553571 - DNA, 25 bp, Mus musculus
gcctactctaactcaattagtcctc

SEQ ID NO: 553572 - DNA, 25 bp, Mus musculus
gcctactctccacggctgattgata

SEQ ID NO: 553573 - DNA, 25 bp, Mus musculus
gcctactctccagggctgattgata

SEQ ID NO: 553574 - DNA, 25 bp, Mus musculus
gcctactctgaaaccggtcacacgg

SEQ ID NO: 553575 - DNA, 25 bp, Mus musculus
gcctactctgaatccggtcacacgg

SEQ ID NO: 553576 - DNA, 25 bp, Mus musculus
gcctactctgcaaggatcactgaaa

SEQ ID NO: 553577 - DNA, 25 bp, Mus musculus
gcctactctgcatggatcactgaaa

SEQ ID NO: 553578 - DNA, 25 bp, Mus musculus
gcctactgaatgctgtgtatatatt

SEQ ID NO: 553579 - DNA, 25 bp, Mus musculus
gcctactgaatggtgtgtatatatt

SEQ ID NO: 553580 - DNA, 25 bp, Mus musculus
gcctactgactcatggaactacaag

SEQ ID NO: 553581 - DNA, 25 bp, Mus musculus
gcctactgactcttggaactacaag

SEQ ID NO: 553582 - DNA, 25 bp, Mus musculus
gcctactgagatcaggccctggatt

SEQ ID NO: 553583 - DNA, 25 bp, Mus musculus
gcctactgagatgaggccctggatt

SEQ ID NO: 553584 - DNA, 25 bp, Mus musculus
gcctactgcgcgaaagaagtctgtt

SEQ ID NO: 553585 - DNA, 25 bp, Mus musculus
gcctactgcgcgtaagaagtctgtt

SEQ ID NO: 553586 - DNA, 25 bp, Mus musculus
gcctactgctagaagctgaagggat

SEQ ID NO: 553587 - DNA, 25 bp, Mus musculus
gcctactgctagtagctgaagggat

SEQ ID NO: 553588 - DNA, 25 bp, Mus musculus
gcctactggccgatgggaagcaatt

SEQ ID NO: 553589 - DNA, 25 bp, Mus musculus
gcctactggccgttgggaagcaatt

SEQ ID NO: 553590 - DNA, 25 bp, Mus musculus
gcctactgtccaatgtcaaccggaa

SEQ ID NO: 553591 - DNA, 25 bp, Mus musculus
gcctactgtccattgtcaaccggaa

SEQ ID NO: 553592 - DNA, 25 bp, Mus musculus
gcctacttaggcctgtaaggacaat

SEQ ID NO: 553593 - DNA, 25 bp, Mus musculus
gcctacttaggcgtgtaaggacaat

SEQ ID NO: 553594 - DNA, 25 bp, Mus musculus
gcctacttatataccctcttgaaga

SEQ ID NO: 553595 - DNA, 25 bp, Mus musculus
gcctacttatattccctcttgaaga

SEQ ID NO: 553596 - DNA, 25 bp, Mus musculus
gcctacttcatgacacagcttgtga

SEQ ID NO: 553597 - DNA, 25 bp, Mus musculus
gcctacttcatgtcacagcttgtga

SEQ ID NO: 553598 - DNA, 25 bp, Mus musculus
gcctacttccttacacagttggtgt

SEQ ID NO: 553599 - DNA, 25 bp, Mus musculus
gcctacttcctttcacagttggtgt

SEQ ID NO: 553600 - DNA, 25 bp, Mus musculus
gcctactttattcaaatgctacttt

SEQ ID NO: 553601 - DNA, 25 bp, Mus musculus
gcctactttattgaaatgctacttt

SEQ ID NO: 553602 - DNA, 25 bp, Mus musculus
gcctactttggaagatgctgcagcc

SEQ ID NO: 553603 - DNA, 25 bp, Mus musculus
gcctactttggatgatgctgcagcc

SEQ ID NO: 553604 - DNA, 25 bp, Mus musculus
gcctactttgtgaatgaataatcct

SEQ ID NO: 553605 - DNA, 25 bp, Mus musculus
gcctactttgtgtatgaataatcct

SEQ ID NO: 553606 - DNA, 25 bp, Mus musculus
gcctacttttaaccagctggtggaa

SEQ ID NO: 553607 - DNA, 25 bp, Mus musculus
gcctacttttaagcagctggtggaa

SEQ ID NO: 553608 - DNA, 25 bp, Mus musculus
gcctacttttgtcagtcagatgcca

SEQ ID NO: 553609 - DNA, 25 bp, Mus musculus
gcctacttttgtgagtcagatgcca

SEQ ID NO: 553610 - DNA, 25 bp, Mus musculus
gcctagaaaacaaggttggcattca

SEQ ID NO: 553611 - DNA, 25 bp, Mus musculus
gcctagaaaacatggttggcattca

SEQ ID NO: 553612 - DNA, 25 bp, Mus musculus
gcctagaaacctaggtgtctttcct

SEQ ID NO: 553613 - DNA, 25 bp, Mus musculus
gcctagaaaccttggtgtctttcct

SEQ ID NO: 553614 - DNA, 25 bp, Mus musculus
gcctagaatctgattggtggttgta

SEQ ID NO: 553615 - DNA, 25 bp, Mus musculus
gcctagaatctgtttggtggttgta

SEQ ID NO: 553616 - DNA, 25 bp, Mus musculus
gcctagaattaacctcctggatctt

SEQ ID NO: 553617 - DNA, 25 bp, Mus musculus
gcctagaattaagctcctggatctt

SEQ ID NO: 553618 - DNA, 25 bp, Mus musculus
gcctagaattgaaccagtgctgctg

SEQ ID NO: 553619 - DNA, 25 bp, Mus musculus
gcctagaattgatccagtgctgctg

SEQ ID NO: 553620 - DNA, 25 bp, Mus musculus
gcctagaccgtaagtttgacctgat

SEQ ID NO: 553621 - DNA, 25 bp, Mus musculus
gcctagaccgtatgtttgacctgat

SEQ ID NO: 553622 - DNA, 25 bp, Mus musculus
gcctagacctttcctttgcatggaa

SEQ ID NO: 553623 - DNA, 25 bp, Mus musculus
gcctagacctttgctttgcatggaa

SEQ ID NO: 553624 - DNA, 25 bp, Mus musculus
gcctagactactaagtgagctctaa

SEQ ID NO: 553625 - DNA, 25 bp, Mus musculus
gcctagactacttagtgagctctaa

SEQ ID NO: 553626 - DNA, 25 bp, Mus musculus
gcctagactagtaacaagactatgt

SEQ ID NO: 553627 - DNA, 25 bp, Mus musculus
gcctagactagttacaagactatgt

SEQ ID NO: 553628 - DNA, 25 bp, Mus musculus
gcctagactataacaacttttcttt

SEQ ID NO: 553629 - DNA, 25 bp, Mus musculus
gcctagactatatcaacttttcttt

SEQ ID NO: 553630 - DNA, 25 bp, Mus musculus
gcctagacttccagtggcattggat

SEQ ID NO: 553631 - DNA, 25 bp, Mus musculus
gcctagacttcctgtggcattggat

SEQ ID NO: 553632 - DNA, 25 bp, Mus musculus
gcctagacttttacagtcccaacaa

SEQ ID NO: 553633 - DNA, 25 bp, Mus musculus
gcctagactttttcagtcccaacaa

SEQ ID NO: 553634 - DNA, 25 bp, Mus musculus
gcctagagacatatctacctgcatg

SEQ ID NO: 553635 - DNA, 25 bp, Mus musculus
gcctagagacatttctacctgcatg

SEQ ID NO: 553636 - DNA, 25 bp, Mus musculus
gcctagagatttagtttactaccca

SEQ ID NO: 553637 - DNA, 25 bp, Mus musculus
gcctagagattttgtttactaccca

SEQ ID NO: 553638 - DNA, 25 bp, Mus musculus
gcctagaggctacttaaatatcaca

SEQ ID NO: 553639 - DNA, 25 bp, Mus musculus
gcctagaggctagttaaatatcaca

SEQ ID NO: 553640 - DNA, 25 bp, Mus musculus
gcctagagggttcgctcagcactta

SEQ ID NO: 553641 - DNA, 25 bp, Mus musculus
gcctagagggttggctcagcactta

SEQ ID NO: 553642 - DNA, 25 bp, Mus musculus
gcctagatagtgcttctttaaagaa

SEQ ID NO: 553643 - DNA, 25 bp, Mus musculus
gcctagatagtggttctttaaagaa

SEQ ID NO: 553644 - DNA, 25 bp, Mus musculus
gcctagatcagcacattgccaagtt

SEQ ID NO: 553645 - DNA, 25 bp, Mus musculus
gcctagatcagcaggtcgacatttt

SEQ ID NO: 553646 - DNA, 25 bp, Mus musculus
gcctagatcagctcattgccaagtt

SEQ ID NO: 553647 - DNA, 25 bp, Mus musculus
gcctagatcagctggtcgacatttt

SEQ ID NO: 553648 - DNA, 25 bp, Mus musculus
gcctagatccagcaggtatagccaa

SEQ ID NO: 553649 - DNA, 25 bp, Mus musculus
gcctagatccaggaggtatagccaa

SEQ ID NO: 553650 - DNA, 25 bp, Mus musculus
gcctagatccctacccatgggaatg

SEQ ID NO: 553651 - DNA, 25 bp, Mus musculus
gcctagatcccttcccatgggaatg

SEQ ID NO: 553652 - DNA, 25 bp, Mus musculus
gcctagattagcaggatattttgac

SEQ ID NO: 553653 - DNA, 25 bp, Mus musculus
gcctagattagctggatattttgac

SEQ ID NO: 553654 - DNA, 25 bp, Mus musculus
gcctagattggcctcttgtgtttag

SEQ ID NO: 553655 - DNA, 25 bp, Mus musculus
gcctagattggcgtcttgtgtttag

SEQ ID NO: 553656 - DNA, 25 bp, Mus musculus
gcctagatttcaaccctgcatagga

SEQ ID NO: 553657 - DNA, 25 bp, Mus musculus
gcctagatttcatccctgcatagga

SEQ ID NO: 553658 - DNA, 25 bp, Mus musculus
gcctagattttgctttctggcagag

SEQ ID NO: 553659 - DNA, 25 bp, Mus musculus
gcctagattttggtttctggcagag

SEQ ID NO: 553660 - DNA, 25 bp, Mus musculus
gcctagcaacctcattgtttccatg

SEQ ID NO: 553661 - DNA, 25 bp, Mus musculus
gcctagcaacctgattgtttccatg

SEQ ID NO: 553662 - DNA, 25 bp, Mus musculus
gcctagcaatatatccacttgacca

SEQ ID NO: 553663 - DNA, 25 bp, Mus musculus
gcctagcaatatttccacttgacca

SEQ ID NO: 553664 - DNA, 25 bp, Mus musculus
gcctagcagcagaactcaggatcta

SEQ ID NO: 553665 - DNA, 25 bp, Mus musculus
gcctagcagcagtactcaggatcta

SEQ ID NO: 553666 - DNA, 25 bp, Mus musculus
gcctagcatatcagatgtcctggat

SEQ ID NO: 553667 - DNA, 25 bp, Mus musculus
gcctagcatatctgatgtcctggat

SEQ ID NO: 553668 - DNA, 25 bp, Mus musculus
gcctagcatgtgcataccacttggg

SEQ ID NO: 553669 - DNA, 25 bp, Mus musculus
gcctagcatgtggataccacttggg

SEQ ID NO: 553670 - DNA, 25 bp, Mus musculus
gcctagccacaaactgcagagagtt

SEQ ID NO: 553671 - DNA, 25 bp, Mus musculus
gcctagccacaatctgcagagagtt

SEQ ID NO: 553672 - DNA, 25 bp, Mus musculus
gcctagccactaatctgacagttgt

SEQ ID NO: 553673 - DNA, 25 bp, Mus musculus
gcctagccactattctgacagttgt

SEQ ID NO: 553674 - DNA, 25 bp, Mus musculus
gcctagccaggacctttgtatttca

SEQ ID NO: 553675 - DNA, 25 bp, Mus musculus
gcctagccaggagctttgtatttca

SEQ ID NO: 553676 - DNA, 25 bp, Mus musculus
gcctagccatggctatggtgaagaa

SEQ ID NO: 553677 - DNA, 25 bp, Mus musculus
gcctagccatgggtatggtgaagaa

SEQ ID NO: 553678 - DNA, 25 bp, Mus musculus
gcctagccctgtagtatttgtatta

SEQ ID NO: 553679 - DNA, 25 bp, Mus musculus
gcctagccctgttgtatttgtatta

SEQ ID NO: 553680 - DNA, 25 bp, Mus musculus
gcctagccggctaaatggtcgatag

SEQ ID NO: 553681 - DNA, 25 bp, Mus musculus
gcctagccggcttaatggtcgatag

SEQ ID NO: 553682 - DNA, 25 bp, Mus musculus
gcctagcctgtgacccatagaaatg

SEQ ID NO: 553683 - DNA, 25 bp, Mus musculus
gcctagcctgtgtcccatagaaatg

SEQ ID NO: 553684 - DNA, 25 bp, Mus musculus
gcctagcggaggatggagatacaca

SEQ ID NO: 553685 - DNA, 25 bp, Mus musculus
gcctagcggaggttggagatacaca

SEQ ID NO: 553686 - DNA, 25 bp, Mus musculus
gcctagcgtttaccactgttgttaa

SEQ ID NO: 553687 - DNA, 25 bp, Mus musculus
gcctagcgtttagcactgttgttaa

SEQ ID NO: 553688 - DNA, 25 bp, Mus musculus
gcctagctaaggatatggatatttg

SEQ ID NO: 553689 - DNA, 25 bp, Mus musculus
gcctagctaaggttatggatatttg

SEQ ID NO: 553690 - DNA, 25 bp, Mus musculus
gcctagctccacatcagatatgtac

SEQ ID NO: 553691 - DNA, 25 bp, Mus musculus
gcctagctccacttcagatatgtac

SEQ ID NO: 553692 - DNA, 25 bp, Mus musculus
gcctagctgcttaggctgtgcttaa

SEQ ID NO: 553693 - DNA, 25 bp, Mus musculus
gcctagctgctttggctgtgcttaa

SEQ ID NO: 553694 - DNA, 25 bp, Mus musculus
gcctagcttgacaattgcatggtct

SEQ ID NO: 553695 - DNA, 25 bp, Mus musculus
gcctagcttgactattgcatggtct

SEQ ID NO: 553696 - DNA, 25 bp, Mus musculus
gcctagcttggacagtgaccttata

SEQ ID NO: 553697 - DNA, 25 bp, Mus musculus
gcctagcttggagagtgaccttata

SEQ ID NO: 553698 - DNA, 25 bp, Mus musculus
gcctagcttggtctcaaacttctaa

SEQ ID NO: 553699 - DNA, 25 bp, Mus musculus
gcctagcttggtgtcaaacttctaa

SEQ ID NO: 553700 - DNA, 25 bp, Mus musculus
gcctagctttgcactcagaatctga

SEQ ID NO: 553701 - DNA, 25 bp, Mus musculus
gcctagctttgctctcagaatctga

SEQ ID NO: 553702 - DNA, 25 bp, Mus musculus
gcctagcttttccaacctggaaggg

SEQ ID NO: 553703 - DNA, 25 bp, Mus musculus
gcctagcttttcgaacctggaaggg

SEQ ID NO: 553704 - DNA, 25 bp, Mus musculus
gcctaggactttctaggttcacctt

SEQ ID NO: 553705 - DNA, 25 bp, Mus musculus
gcctaggactttgtaggttcacctt

SEQ ID NO: 553706 - DNA, 25 bp, Mus musculus
gcctaggcacacagctgttaacatc

SEQ ID NO: 553707 - DNA, 25 bp, Mus musculus
gcctaggcacactgctgttaacatc

SEQ ID NO: 553708 - DNA, 25 bp, Mus musculus
gcctaggcagagagagatctgtctc

SEQ ID NO: 553709 - DNA, 25 bp, Mus musculus
gcctaggcagagtgagatctgtctc

SEQ ID NO: 553710 - DNA, 25 bp, Mus musculus
gcctaggcagctatctgaagtgcaa

SEQ ID NO: 553711 - DNA, 25 bp, Mus musculus
gcctaggcagctttctgaagtgcaa

SEQ ID NO: 553712 - DNA, 25 bp, Mus musculus
gcctaggccaagcttctctgttcct

SEQ ID NO: 553713 - DNA, 25 bp, Mus musculus
gcctaggccaaggttctctgttcct

SEQ ID NO: 553714 - DNA, 25 bp, Mus musculus
gcctaggcccagagagactcctgag

SEQ ID NO: 553715 - DNA, 25 bp, Mus musculus
gcctaggcccagtgagactcctgag

SEQ ID NO: 553716 - DNA, 25 bp, Mus musculus
gcctaggccctactacaaagcaaat

SEQ ID NO: 553717 - DNA, 25 bp, Mus musculus
gcctaggccctagtacaaagcaaat

SEQ ID NO: 553718 - DNA, 25 bp, Mus musculus
gcctaggctattccagaagtctcac

SEQ ID NO: 553719 - DNA, 25 bp, Mus musculus
gcctaggctattgcagaagtctcac

SEQ ID NO: 553720 - DNA, 25 bp, Mus musculus
gcctaggctgaaatggtttgcttta

SEQ ID NO: 553721 - DNA, 25 bp, Mus musculus
gcctaggctgaattggtttgcttta

SEQ ID NO: 553722 - DNA, 25 bp, Mus musculus
gcctagggaaaaatgagctcggaaa

SEQ ID NO: 553723 - DNA, 25 bp, Mus musculus
gcctagggaaaattgagctcggaaa

SEQ ID NO: 553724 - DNA, 25 bp, Mus musculus
gcctagggagccaaggcctagctgc

SEQ ID NO: 553725 - DNA, 25 bp, Mus musculus
gcctagggagcctaggcctagctgc

SEQ ID NO: 553726 - DNA, 25 bp, Mus musculus
gcctagggcaatcttccttttgaac

SEQ ID NO: 553727 - DNA, 25 bp, Mus musculus
gcctagggcaatgttccttttgaac

SEQ ID NO: 553728 - DNA, 25 bp, Mus musculus
gcctagggccttcatgtcattttac

SEQ ID NO: 553729 - DNA, 25 bp, Mus musculus
gcctagggccttgatgtcattttac

SEQ ID NO: 553730 - DNA, 25 bp, Mus musculus
gcctagggctttaaagtgagtctga

SEQ ID NO: 553731 - DNA, 25 bp, Mus musculus
gcctagggcttttaagtgagtctga

SEQ ID NO: 553732 - DNA, 25 bp, Mus musculus
gcctagggtctcagtcagttgtata

SEQ ID NO: 553733 - DNA, 25 bp, Mus musculus
gcctagggtctctgtcagttgtata

SEQ ID NO: 553734 - DNA, 25 bp, Mus musculus
gcctagggttgaactggagcccagt

SEQ ID NO: 553735 - DNA, 25 bp, Mus musculus
gcctagggttgatctggagcccagt

SEQ ID NO: 553736 - DNA, 25 bp, Mus musculus
gcctaggtggcaaatgaagtggttt

SEQ ID NO: 553737 - DNA, 25 bp, Mus musculus
gcctaggtggcatatgaagtggttt

SEQ ID NO: 553738 - DNA, 25 bp, Mus musculus
gcctaggtggctcgaacaagaatct

SEQ ID NO: 553739 - DNA, 25 bp, Mus musculus
gcctaggtggctggaacaagaatct

SEQ ID NO: 553740 - DNA, 25 bp, Mus musculus
gcctaggtggtcaggttgaaactga

SEQ ID NO: 553741 - DNA, 25 bp, Mus musculus
gcctaggtggtctggttgaaactga

SEQ ID NO: 553742 - DNA, 25 bp, Mus musculus
gcctaggtgtgtatccttcctccta

SEQ ID NO: 553743 - DNA, 25 bp, Mus musculus
gcctaggtgtgtttccttcctccta

SEQ ID NO: 553744 - DNA, 25 bp, Mus musculus
gcctaggttacaaaagacactgtct

SEQ ID NO: 553745 - DNA, 25 bp, Mus musculus
gcctaggttacataagacactgtct

SEQ ID NO: 553746 - DNA, 25 bp, Mus musculus
gcctaggttctgctattagtttcat

SEQ ID NO: 553747 - DNA, 25 bp, Mus musculus
gcctaggttctggtattagtttcat

SEQ ID NO: 553748 - DNA, 25 bp, Mus musculus
gcctaggttggtcatctgttttcat

SEQ ID NO: 553749 - DNA, 25 bp, Mus musculus
gcctaggttggtgatctgttttcat

SEQ ID NO: 553750 - DNA, 25 bp, Mus musculus
gcctagtacactctaaatgctcaat

SEQ ID NO: 553751 - DNA, 25 bp, Mus musculus
gcctagtacactgtaaatgctcaat

SEQ ID NO: 553752 - DNA, 25 bp, Mus musculus
gcctagtatcaactacacatcccgt

SEQ ID NO: 553753 - DNA, 25 bp, Mus musculus
gcctagtatcaagtacacatcccgt

SEQ ID NO: 553754 - DNA, 25 bp, Mus musculus
gcctagtatgcacaggacccttagt

SEQ ID NO: 553755 - DNA, 25 bp, Mus musculus
gcctagtatgcagaggacccttagt

SEQ ID NO: 553756 - DNA, 25 bp, Mus musculus
gcctagtggccgcatgtgaactccc

SEQ ID NO: 553757 - DNA, 25 bp, Mus musculus
gcctagtggccggatgtgaactccc

SEQ ID NO: 553758 - DNA, 25 bp, Mus musculus
gcctagtggctaagcttttaatttc

SEQ ID NO: 553759 - DNA, 25 bp, Mus musculus
gcctagtggctatgcttttaatttc

SEQ ID NO: 553760 - DNA, 25 bp, Mus musculus
gcctagtgggctaggtatccactgt

SEQ ID NO: 553761 - DNA, 25 bp, Mus musculus
gcctagtgggcttggtatccactgt

SEQ ID NO: 553762 - DNA, 25 bp, Mus musculus
gcctagttccttcgcataagcatag

SEQ ID NO: 553763 - DNA, 25 bp, Mus musculus
gcctagttccttggcataagcatag

SEQ ID NO: 553764 - DNA, 25 bp, Mus musculus
gcctagtttagaacttgaggtaaaa

SEQ ID NO: 553765 - DNA, 25 bp, Mus musculus
gcctagtttagatcttgaggtaaaa

SEQ ID NO: 553766 - DNA, 25 bp, Mus musculus
gcctagtttgacctttgtgaagtct

SEQ ID NO: 553767 - DNA, 25 bp, Mus musculus
gcctagtttgacgtttgtgaagtct

SEQ ID NO: 553768 - DNA, 25 bp, Mus musculus
gcctagttttcaaagcaagttccag

SEQ ID NO: 553769 - DNA, 25 bp, Mus musculus
gcctagttttcatagcaagttccag

SEQ ID NO: 553770 - DNA, 25 bp, Mus musculus
gcctataaatctccacttcttacat

SEQ ID NO: 553771 - DNA, 25 bp, Mus musculus
gcctataaatctgcacttcttacat

SEQ ID NO: 553772 - DNA, 25 bp, Mus musculus
gcctataagttgaccttgttcctat

SEQ ID NO: 553773 - DNA, 25 bp, Mus musculus
gcctataagttgtccttgttcctat

SEQ ID NO: 553774 - DNA, 25 bp, Mus musculus
gcctataatgccatggaaacaaaca

SEQ ID NO: 553775 - DNA, 25 bp, Mus musculus
gcctataatgccttggaaacaaaca

SEQ ID NO: 553776 - DNA, 25 bp, Mus musculus
gcctatacctgcagttgagctgaat

SEQ ID NO: 553777 - DNA, 25 bp, Mus musculus
gcctatacctgctgttgagctgaat

SEQ ID NO: 553778 - DNA, 25 bp, Mus musculus
gcctatactatgctgtcttcctagc

SEQ ID NO: 553779 - DNA, 25 bp, Mus musculus
gcctatactatggtgtcttcctagc

SEQ ID NO: 553780 - DNA, 25 bp, Mus musculus
gcctatatactgagatagcttgtat

SEQ ID NO: 553781 - DNA, 25 bp, Mus musculus
gcctatatactgtgatagcttgtat

SEQ ID NO: 553782 - DNA, 25 bp, Mus musculus
gcctatatatctatactggctttct

SEQ ID NO: 553783 - DNA, 25 bp, Mus musculus
gcctatatatctttactggctttct

SEQ ID NO: 553784 - DNA, 25 bp, Mus musculus
gcctatatctagaccttatttttaa

SEQ ID NO: 553785 - DNA, 25 bp, Mus musculus
gcctatatctagtccttatttttaa

SEQ ID NO: 553786 - DNA, 25 bp, Mus musculus
gcctatatgcttcagtggaggacat

SEQ ID NO: 553787 - DNA, 25 bp, Mus musculus
gcctatatgcttgagtggaggacat

SEQ ID NO: 553788 - DNA, 25 bp, Mus musculus
gcctatcaagaaagtccagctgcaa

SEQ ID NO: 553789 - DNA, 25 bp, Mus musculus
gcctatcaagaatgtccagctgcaa

SEQ ID NO: 553790 - DNA, 25 bp, Mus musculus
gcctatcaattcagcgtagctcgga

SEQ ID NO: 553791 - DNA, 25 bp, Mus musculus
gcctatcaattctgcgtagctcgga

SEQ ID NO: 553792 - DNA, 25 bp, Mus musculus
gcctatccaaagaaagccaacgcat

SEQ ID NO: 553793 - DNA, 25 bp, Mus musculus
gcctatccaaagtaagccaacgcat

SEQ ID NO: 553794 - DNA, 25 bp, Mus musculus
gcctatccagtgatcagccggaaga

SEQ ID NO: 553795 - DNA, 25 bp, Mus musculus
gcctatccagtgttcagccggaaga

SEQ ID NO: 553796 - DNA, 25 bp, Mus musculus
gcctatccccgaagtgatgatgcaa

SEQ ID NO: 553797 - DNA, 25 bp, Mus musculus
gcctatccccgatgtgatgatgcaa

SEQ ID NO: 553798 - DNA, 25 bp, Mus musculus
gcctatcctggtcaagctctaaaga

SEQ ID NO: 553799 - DNA, 25 bp, Mus musculus
gcctatcctggtgaagctctaaaga

SEQ ID NO: 553800 - DNA, 25 bp, Mus musculus
gcctatctaggcacttggtaacagt

SEQ ID NO: 553801 - DNA, 25 bp, Mus musculus
gcctatctaggctcttggtaacagt

SEQ ID NO: 553802 - DNA, 25 bp, Mus musculus
gcctatctccctaaagttactttgt

SEQ ID NO: 553803 - DNA, 25 bp, Mus musculus
gcctatctcccttaagttactttgt

SEQ ID NO: 553804 - DNA, 25 bp, Mus musculus
gcctatctctttccaaattgtcaac

SEQ ID NO: 553805 - DNA, 25 bp, Mus musculus
gcctatctctttgcaaattgtcaac

SEQ ID NO: 553806 - DNA, 25 bp, Mus musculus
gcctatctggttcgcctttttgaag

SEQ ID NO: 553807 - DNA, 25 bp, Mus musculus
gcctatctggttggcctttttgaag

SEQ ID NO: 553808 - DNA, 25 bp, Mus musculus
gcctatcttggtctctaaaagttac

SEQ ID NO: 553809 - DNA, 25 bp, Mus musculus
gcctatcttggtgtctaaaagttac

SEQ ID NO: 553810 - DNA, 25 bp, Mus musculus
gcctatgaaagtcccagagtatttt

SEQ ID NO: 553811 - DNA, 25 bp, Mus musculus
gcctatgaaagtgccagagtatttt

SEQ ID NO: 553812 - DNA, 25 bp, Mus musculus
gcctatgaagctatagtgcctgagc

SEQ ID NO: 553813 - DNA, 25 bp, Mus musculus
gcctatgaagctttagtgcctgagc

SEQ ID NO: 553814 - DNA, 25 bp, Mus musculus
gcctatgagcgactccgcagggaaa

SEQ ID NO: 553815 - DNA, 25 bp, Mus musculus
gcctatgagcgagtccgcagggaaa

SEQ ID NO: 553816 - DNA, 25 bp, Mus musculus
gcctatgagtacatgggcttcatca

SEQ ID NO: 553817 - DNA, 25 bp, Mus musculus
gcctatgagtacatgtgggctcaaa

SEQ ID NO: 553818 - DNA, 25 bp, Mus musculus
gcctatgagtacttgggcttcatca

SEQ ID NO: 553819 - DNA, 25 bp, Mus musculus
gcctatgagtacttgtgggctcaaa

SEQ ID NO: 553820 - DNA, 25 bp, Mus musculus
gcctatgatgatctgagtccccttc

SEQ ID NO: 553821 - DNA, 25 bp, Mus musculus
gcctatgatgatgtgagtccccttc

SEQ ID NO: 553822 - DNA, 25 bp, Mus musculus
gcctatgatttgcaaaagctgcctc

SEQ ID NO: 553823 - DNA, 25 bp, Mus musculus
gcctatgatttggaaaagctgcctc

SEQ ID NO: 553824 - DNA, 25 bp, Mus musculus
gcctatgcacctaacctttaatggt

SEQ ID NO: 553825 - DNA, 25 bp, Mus musculus
gcctatgcaccttacctttaatggt

SEQ ID NO: 553826 - DNA, 25 bp, Mus musculus
gcctatgccattcagttaaatccac

SEQ ID NO: 553827 - DNA, 25 bp, Mus musculus
gcctatgccattgagttaaatccac

SEQ ID NO: 553828 - DNA, 25 bp, Mus musculus
gcctatgccctccatcacaataaga

SEQ ID NO: 553829 - DNA, 25 bp, Mus musculus
gcctatgccctcgatcacaataaga

SEQ ID NO: 553830 - DNA, 25 bp, Mus musculus
gcctatgctacacaatctgaatgtt

SEQ ID NO: 553831 - DNA, 25 bp, Mus musculus
gcctatgctacagaatctgaatgtt

SEQ ID NO: 553832 - DNA, 25 bp, Mus musculus
gcctatgctcatattcaacctttac

SEQ ID NO: 553833 - DNA, 25 bp, Mus musculus
gcctatgctcattttcaacctttac

SEQ ID NO: 553834 - DNA, 25 bp, Mus musculus
gcctatgctttgaaccttaggctac

SEQ ID NO: 553835 - DNA, 25 bp, Mus musculus
gcctatgctttgtaccttaggctac

SEQ ID NO: 553836 - DNA, 25 bp, Mus musculus
gcctatggacaaatggacacttact

SEQ ID NO: 553837 - DNA, 25 bp, Mus musculus
gcctatggacaattggacacttact

SEQ ID NO: 553838 - DNA, 25 bp, Mus musculus
gcctatggagcacttgactactata

SEQ ID NO: 553839 - DNA, 25 bp, Mus musculus
gcctatggagcagttgactactata

SEQ ID NO: 553840 - DNA, 25 bp, Mus musculus
gcctatggatctagaagctgctact

SEQ ID NO: 553841 - DNA, 25 bp, Mus musculus
gcctatggatcttgaagctgctact

SEQ ID NO: 553842 - DNA, 25 bp, Mus musculus
gcctatggattactgagttgctgat

SEQ ID NO: 553843 - DNA, 25 bp, Mus musculus
gcctatggattagtgagttgctgat

SEQ ID NO: 553844 - DNA, 25 bp, Mus musculus
gcctatggcttacagttcgacattt

SEQ ID NO: 553845 - DNA, 25 bp, Mus musculus
gcctatggcttagagttcgacattt

SEQ ID NO: 553846 - DNA, 25 bp, Mus musculus
gcctatgggactcaaatgtgaagaa

SEQ ID NO: 553847 - DNA, 25 bp, Mus musculus
gcctatgggactgaaatgtgaagaa

SEQ ID NO: 553848 - DNA, 25 bp, Mus musculus
gcctatgggaggaggttagtcctat

SEQ ID NO: 553849 - DNA, 25 bp, Mus musculus
gcctatgggaggtggttagtcctat

SEQ ID NO: 553850 - DNA, 25 bp, Mus musculus
gcctatgggttgaacaagctgaaga

SEQ ID NO: 553851 - DNA, 25 bp, Mus musculus
gcctatgggttgtacaagctgaaga

SEQ ID NO: 553852 - DNA, 25 bp, Mus musculus
gcctatggtcaaagaggccactggg

SEQ ID NO: 553853 - DNA, 25 bp, Mus musculus
gcctatggtcaatgaggccactggg

SEQ ID NO: 553854 - DNA, 25 bp, Mus musculus
gcctatggtgacatcgacgcctaca

SEQ ID NO: 553855 - DNA, 25 bp, Mus musculus
gcctatggtgacttcgacgcctaca

SEQ ID NO: 553856 - DNA, 25 bp, Mus musculus
gcctatgtaggccattctcattgga

SEQ ID NO: 553857 - DNA, 25 bp, Mus musculus
gcctatgtaggcgattctcattgga

SEQ ID NO: 553858 - DNA, 25 bp, Mus musculus
gcctatgtaggtcttgcgtgtcaga

SEQ ID NO: 553859 - DNA, 25 bp, Mus musculus
gcctatgtaggtgttgcgtgtcaga

SEQ ID NO: 553860 - DNA, 25 bp, Mus musculus
gcctatgtgatcacaacagacacaa

SEQ ID NO: 553861 - DNA, 25 bp, Mus musculus
gcctatgtgatctcaacagacacaa

SEQ ID NO: 553862 - DNA, 25 bp, Mus musculus
gcctatgtggccaactgggtggtaa

SEQ ID NO: 553863 - DNA, 25 bp, Mus musculus
gcctatgtggcctactgggtggtaa

SEQ ID NO: 553864 - DNA, 25 bp, Mus musculus
gcctatgtggctatactctttcaaa

SEQ ID NO: 553865 - DNA, 25 bp, Mus musculus
gcctatgtggctttactctttcaaa

SEQ ID NO: 553866 - DNA, 25 bp, Mus musculus
gcctatgtgtgtacgtgtatgtgta

SEQ ID NO: 553867 - DNA, 25 bp, Mus musculus
gcctatgtgtgttcgtgtatgtgta

SEQ ID NO: 553868 - DNA, 25 bp, Mus musculus
gcctatgttgaccaagtactgagat

SEQ ID NO: 553869 - DNA, 25 bp, Mus musculus
gcctatgttgacgaagtactgagat

SEQ ID NO: 553870 - DNA, 25 bp, Mus musculus
gcctattaaactcaacactggtgca

SEQ ID NO: 553871 - DNA, 25 bp, Mus musculus
gcctattaaactgaacactggtgca

SEQ ID NO: 553872 - DNA, 25 bp, Mus musculus
gcctattatgaccttctggccaatg

SEQ ID NO: 553873 - DNA, 25 bp, Mus musculus
gcctattatgacgttctggccaatg

SEQ ID NO: 553874 - DNA, 25 bp, Mus musculus
gcctattcccctattattgctgatt

SEQ ID NO: 553875 - DNA, 25 bp, Mus musculus
gcctattccccttttattgctgatt

SEQ ID NO: 553876 - DNA, 25 bp, Mus musculus
gcctattcggaaatgagcagagcat

SEQ ID NO: 553877 - DNA, 25 bp, Mus musculus
gcctattcggaattgagcagagcat

SEQ ID NO: 553878 - DNA, 25 bp, Mus musculus
gcctattctggccagtaccctaagc

SEQ ID NO: 553879 - DNA, 25 bp, Mus musculus
gcctattctggcgagtaccctaagc

SEQ ID NO: 553880 - DNA, 25 bp, Mus musculus
gcctattgcaagctaaaatctgctg

SEQ ID NO: 553881 - DNA, 25 bp, Mus musculus
gcctattgcaaggtaaaatctgctg

SEQ ID NO: 553882 - DNA, 25 bp, Mus musculus
gcctattgtaagcattcccgaagac

SEQ ID NO: 553883 - DNA, 25 bp, Mus musculus
gcctattgtaaggattcccgaagac

SEQ ID NO: 553884 - DNA, 25 bp, Mus musculus
gcctattgtgcaacgtgttgtatgt

SEQ ID NO: 553885 - DNA, 25 bp, Mus musculus
gcctattgtgcatcgtgttgtatgt

SEQ ID NO: 553886 - DNA, 25 bp, Mus musculus
gcctattgttgtaggagcttaaacc

SEQ ID NO: 553887 - DNA, 25 bp, Mus musculus
gcctattgttgttggagcttaaacc

SEQ ID NO: 553888 - DNA, 25 bp, Mus musculus
gcctatttacaaacctgcacactaa

SEQ ID NO: 553889 - DNA, 25 bp, Mus musculus
gcctatttacaatcctgcacactaa

SEQ ID NO: 553890 - DNA, 25 bp, Mus musculus
gcctatttcctacaatgttaacagt

SEQ ID NO: 553891 - DNA, 25 bp, Mus musculus
gcctatttcctagaatgttaacagt

SEQ ID NO: 553892 - DNA, 25 bp, Mus musculus
gcctatttgaatagcccgagcctta

SEQ ID NO: 553893 - DNA, 25 bp, Mus musculus
gcctatttgaattgcccgagcctta

SEQ ID NO: 553894 - DNA, 25 bp, Mus musculus
gcctatttgcccatctctggagaga

SEQ ID NO: 553895 - DNA, 25 bp, Mus musculus
gcctatttgcccttctctggagaga

SEQ ID NO: 553896 - DNA, 25 bp, Mus musculus
gcctatttggccaaatgagcactgg

SEQ ID NO: 553897 - DNA, 25 bp, Mus musculus
gcctatttggcctaatgagcactgg

SEQ ID NO: 553898 - DNA, 25 bp, Mus musculus
gcctattttcatcaccggcagatat

SEQ ID NO: 553899 - DNA, 25 bp, Mus musculus
gcctattttcatgaccggcagatat

SEQ ID NO: 553900 - DNA, 25 bp, Mus musculus
gcctattttgccagatgctgccacc

SEQ ID NO: 553901 - DNA, 25 bp, Mus musculus
gcctattttgcctgatgctgccacc

SEQ ID NO: 553902 - DNA, 25 bp, Mus musculus
gcctcaaactcacagtagtcgtcta

SEQ ID NO: 553903 - DNA, 25 bp, Mus musculus
gcctcaaactcagagtagtcgtcta

SEQ ID NO: 553904 - DNA, 25 bp, Mus musculus
gcctcaaagagtagctgagagctaa

SEQ ID NO: 553905 - DNA, 25 bp, Mus musculus
gcctcaaagagttgctgagagctaa

SEQ ID NO: 553906 - DNA, 25 bp, Mus musculus
gcctcaaagtcccttaacactgaaa

SEQ ID NO: 553907 - DNA, 25 bp, Mus musculus
gcctcaaagtccgttaacactgaaa

SEQ ID NO: 553908 - DNA, 25 bp, Mus musculus
gcctcaaatgaacagcactaaacgc

SEQ ID NO: 553909 - DNA, 25 bp, Mus musculus
gcctcaaatgaagagcactaaacgc

SEQ ID NO: 553910 - DNA, 25 bp, Mus musculus
gcctcaaattccctagtgattcgtt

SEQ ID NO: 553911 - DNA, 25 bp, Mus musculus
gcctcaaattccgtagtgattcgtt

SEQ ID NO: 553912 - DNA, 25 bp, Mus musculus
gcctcaaattctccatgtcgatgag

SEQ ID NO: 553913 - DNA, 25 bp, Mus musculus
gcctcaaattctgcatgtcgatgag

SEQ ID NO: 553914 - DNA, 25 bp, Mus musculus
gcctcaaattgcatttttgccttcc

SEQ ID NO: 553915 - DNA, 25 bp, Mus musculus
gcctcaaattgcttttttgccttcc

SEQ ID NO: 553916 - DNA, 25 bp, Mus musculus
gcctcaacagcacatgaccttgaag

SEQ ID NO: 553917 - DNA, 25 bp, Mus musculus
gcctcaacagcagatgaccttgaag

SEQ ID NO: 553918 - DNA, 25 bp, Mus musculus
gcctcaacagggaattcttgtcagt

SEQ ID NO: 553919 - DNA, 25 bp, Mus musculus
gcctcaacagggtattcttgtcagt

SEQ ID NO: 553920 - DNA, 25 bp, Mus musculus
gcctcaacagtcaatcagtgttcat

SEQ ID NO: 553921 - DNA, 25 bp, Mus musculus
gcctcaacagtctatcagtgttcat

SEQ ID NO: 553922 - DNA, 25 bp, Mus musculus
gcctcaacgacaaggccgcggaagg

SEQ ID NO: 553923 - DNA, 25 bp, Mus musculus
gcctcaacgacatggccgcggaagg

SEQ ID NO: 553924 - DNA, 25 bp, Mus musculus
gcctcaactacgaaagcctggtgaa

SEQ ID NO: 553925 - DNA, 25 bp, Mus musculus
gcctcaactacgtaagcctggtgaa

SEQ ID NO: 553926 - DNA, 25 bp, Mus musculus
gcctcaactataacgccatcgatgt

SEQ ID NO: 553927 - DNA, 25 bp, Mus musculus
gcctcaactatatcgccatcgatgt

SEQ ID NO: 553928 - DNA, 25 bp, Mus musculus
gcctcaactcttcgcaggttttcta

SEQ ID NO: 553929 - DNA, 25 bp, Mus musculus
gcctcaactcttggcaggttttcta

SEQ ID NO: 553930 - DNA, 25 bp, Mus musculus
gcctcaactgaaagcctcctgtggg

SEQ ID NO: 553931 - DNA, 25 bp, Mus musculus
gcctcaactgaatgcctcctgtggg

SEQ ID NO: 553932 - DNA, 25 bp, Mus musculus
gcctcaagaccacaattcgatctct

SEQ ID NO: 553933 - DNA, 25 bp, Mus musculus
gcctcaagaccagaattcgatctct

SEQ ID NO: 553934 - DNA, 25 bp, Mus musculus
gcctcaagactcagccaactgatga

SEQ ID NO: 553935 - DNA, 25 bp, Mus musculus
gcctcaagactctgccaactgatga

SEQ ID NO: 553936 - DNA, 25 bp, Mus musculus
gcctcaagccctcagtaagaacata

SEQ ID NO: 553937 - DNA, 25 bp, Mus musculus
gcctcaagccctgagtaagaacata

SEQ ID NO: 553938 - DNA, 25 bp, Mus musculus
gcctcaaggattcctttcttgctta

SEQ ID NO: 553939 - DNA, 25 bp, Mus musculus
gcctcaaggattgctttcttgctta

SEQ ID NO: 553940 - DNA, 25 bp, Mus musculus
gcctcaagtcatacagacagcctgc

SEQ ID NO: 553941 - DNA, 25 bp, Mus musculus
gcctcaagtcattcagacagcctgc

SEQ ID NO: 553942 - DNA, 25 bp, Mus musculus
gcctcaagttcaaatccagtgtgct

SEQ ID NO: 553943 - DNA, 25 bp, Mus musculus
gcctcaagttcatatccagtgtgct

SEQ ID NO: 553944 - DNA, 25 bp, Mus musculus
gcctcaataaggactctggatattt

SEQ ID NO: 553945 - DNA, 25 bp, Mus musculus
gcctcaataaggtctctggatattt

SEQ ID NO: 553946 - DNA, 25 bp, Mus musculus
gcctcaatgctgagctagtttgggt

SEQ ID NO: 553947 - DNA, 25 bp, Mus musculus
gcctcaatgctgtgctagtttgggt

SEQ ID NO: 553948 - DNA, 25 bp, Mus musculus
gcctcaatgtctccacagggaaatt

SEQ ID NO: 553949 - DNA, 25 bp, Mus musculus
gcctcaatgtctgcacagggaaatt

SEQ ID NO: 553950 - DNA, 25 bp, Mus musculus
gcctcaattcagaaccggatccaga

SEQ ID NO: 553951 - DNA, 25 bp, Mus musculus
gcctcaattcagtaccggatccaga

SEQ ID NO: 553952 - DNA, 25 bp, Mus musculus
gcctcaattcctccatttgtgaaat

SEQ ID NO: 553953 - DNA, 25 bp, Mus musculus
gcctcaattcctgcatttgtgaaat

SEQ ID NO: 553954 - DNA, 25 bp, Mus musculus
gcctcaattgctcgtggtgtctatg

SEQ ID NO: 553955 - DNA, 25 bp, Mus musculus
gcctcaattgctggtggtgtctatg

SEQ ID NO: 553956 - DNA, 25 bp, Mus musculus
gcctcacaaatcctctgtgtgcaga

SEQ ID NO: 553957 - DNA, 25 bp, Mus musculus
gcctcacaaatcgtctgtgtgcaga

SEQ ID NO: 553958 - DNA, 25 bp, Mus musculus
gcctcacaacgtctttgatgtcctt

SEQ ID NO: 553959 - DNA, 25 bp, Mus musculus
gcctcacaacgtgtttgatgtcctt

SEQ ID NO: 553960 - DNA, 25 bp, Mus musculus
gcctcacaaggcagcttgggcatta

SEQ ID NO: 553961 - DNA, 25 bp, Mus musculus
gcctcacaaggctgcttgggcatta

SEQ ID NO: 553962 - DNA, 25 bp, Mus musculus
gcctcacacagcaggtgttctggga

SEQ ID NO: 553963 - DNA, 25 bp, Mus musculus
gcctcacacagctggtgttctggga

SEQ ID NO: 553964 - DNA, 25 bp, Mus musculus
gcctcacacgccagatccaaaatgt

SEQ ID NO: 553965 - DNA, 25 bp, Mus musculus
gcctcacacgcctgatccaaaatgt

SEQ ID NO: 553966 - DNA, 25 bp, Mus musculus
gcctcacacgggaagcatagactct

SEQ ID NO: 553967 - DNA, 25 bp, Mus musculus
gcctcacacgggtagcatagactct

SEQ ID NO: 553968 - DNA, 25 bp, Mus musculus
gcctcacactaacttactaccagaa

SEQ ID NO: 553969 - DNA, 25 bp, Mus musculus
gcctcacactaagttactaccagaa

SEQ ID NO: 553970 - DNA, 25 bp, Mus musculus
gcctcacagactattctcacatgtt

SEQ ID NO: 553971 - DNA, 25 bp, Mus musculus
gcctcacagacttttctcacatgtt

SEQ ID NO: 553972 - DNA, 25 bp, Mus musculus
gcctcacagagaagttcagtgcttg

SEQ ID NO: 553973 - DNA, 25 bp, Mus musculus
gcctcacagagatgttcagtgcttg

SEQ ID NO: 553974 - DNA, 25 bp, Mus musculus
gcctcacagattcacctggttcata

SEQ ID NO: 553975 - DNA, 25 bp, Mus musculus
gcctcacagattgacctggttcata

SEQ ID NO: 553976 - DNA, 25 bp, Mus musculus
gcctcacaggagactgacatctgga

SEQ ID NO: 553977 - DNA, 25 bp, Mus musculus
gcctcacaggagtctgacatctgga

SEQ ID NO: 553978 - DNA, 25 bp, Mus musculus
gcctcaccaaccacagggaaaacat

SEQ ID NO: 553979 - DNA, 25 bp, Mus musculus
gcctcaccaacctcagggaaaacat

SEQ ID NO: 553980 - DNA, 25 bp, Mus musculus
gcctcaccctctctgatgatactga

SEQ ID NO: 553981 - DNA, 25 bp, Mus musculus
gcctcaccctctgtgatgatactga

SEQ ID NO: 553982 - DNA, 25 bp, Mus musculus
gcctcaccctgaaaacaagtcatac

SEQ ID NO: 553983 - DNA, 25 bp, Mus musculus
gcctcaccctgataacaagtcatac

SEQ ID NO: 553984 - DNA, 25 bp, Mus musculus
gcctcaccgaggctgagcagagaat

SEQ ID NO: 553985 - DNA, 25 bp, Mus musculus
gcctcaccgagggtgagcagagaat

SEQ ID NO: 553986 - DNA, 25 bp, Mus musculus
gcctcaccgtgtatgaatcccaaga

SEQ ID NO: 553987 - DNA, 25 bp, Mus musculus
gcctcaccgtgtttgaatcccaaga

SEQ ID NO: 553988 - DNA, 25 bp, Mus musculus
gcctcacctcagattccaggatgtt

SEQ ID NO: 553989 - DNA, 25 bp, Mus musculus
gcctcacctcagtttccaggatgtt

SEQ ID NO: 553990 - DNA, 25 bp, Mus musculus
gcctcacctgacactattctaaaat

SEQ ID NO: 553991 - DNA, 25 bp, Mus musculus
gcctcacctgactctattctaaaat

SEQ ID NO: 553992 - DNA, 25 bp, Mus musculus
gcctcacctgtcatttaacttacaa

SEQ ID NO: 553993 - DNA, 25 bp, Mus musculus
gcctcacctgtcttttaacttacaa

SEQ ID NO: 553994 - DNA, 25 bp, Mus musculus
gcctcacgccctcactgagaaatta

SEQ ID NO: 553995 - DNA, 25 bp, Mus musculus
gcctcacgccctgactgagaaatta

SEQ ID NO: 553996 - DNA, 25 bp, Mus musculus
gcctcacggtagatagctgctcaga

SEQ ID NO: 553997 - DNA, 25 bp, Mus musculus
gcctcacggtagttagctgctcaga

SEQ ID NO: 553998 - DNA, 25 bp, Mus musculus
gcctcacgtcaaactgaactaagtt

SEQ ID NO: 553999 - DNA, 25 bp, Mus musculus
gcctcacgtcaatctgaactaagtt

SEQ ID NO: 554000 - DNA, 25 bp, Mus musculus
gcctcactacagctaacattttcaa

SEQ ID NO: 554001 - DNA, 25 bp, Mus musculus
gcctcactacaggtaacattttcaa

SEQ ID NO: 554002 - DNA, 25 bp, Mus musculus
gcctcactcctaattcttcaggaat

SEQ ID NO: 554003 - DNA, 25 bp, Mus musculus
gcctcactcctatttcttcaggaat

SEQ ID NO: 554004 - DNA, 25 bp, Mus musculus
gcctcactgaggatggccatgtggt

SEQ ID NO: 554005 - DNA, 25 bp, Mus musculus
gcctcactgaggttggccatgtggt

SEQ ID NO: 554006 - DNA, 25 bp, Mus musculus
gcctcactgagtagttttgctactc

SEQ ID NO: 554007 - DNA, 25 bp, Mus musculus
gcctcactgagttgttttgctactc

SEQ ID NO: 554008 - DNA, 25 bp, Mus musculus
gcctcactggccaaatcaatgttgc

SEQ ID NO: 554009 - DNA, 25 bp, Mus musculus
gcctcactggcctaatcaatgttgc

SEQ ID NO: 554010 - DNA, 25 bp, Mus musculus
gcctcactggtacttcatcaaccaa

SEQ ID NO: 554011 - DNA, 25 bp, Mus musculus
gcctcactggtagttcatcaaccaa

SEQ ID NO: 554012 - DNA, 25 bp, Mus musculus
gcctcactgtgacgttagcagggca

SEQ ID NO: 554013 - DNA, 25 bp, Mus musculus
gcctcactgtgaggttagcagggca

SEQ ID NO: 554014 - DNA, 25 bp, Mus musculus
gcctcacttagtcaacatccaattc

SEQ ID NO: 554015 - DNA, 25 bp, Mus musculus
gcctcacttagtgaacatccaattc

SEQ ID NO: 554016 - DNA, 25 bp, Mus musculus
gcctcagaagcccaagaagctcaag

SEQ ID NO: 554017 - DNA, 25 bp, Mus musculus
gcctcagaagccgaagaagctcaag

SEQ ID NO: 554018 - DNA, 25 bp, Mus musculus
gcctcagaagttcatgtgctcgata

SEQ ID NO: 554019 - DNA, 25 bp, Mus musculus
gcctcagaagttgatgtgctcgata

SEQ ID NO: 554020 - DNA, 25 bp, Mus musculus
gcctcagaattcattgtgattcctt

SEQ ID NO: 554021 - DNA, 25 bp, Mus musculus
gcctcagaattctttgtgattcctt

SEQ ID NO: 554022 - DNA, 25 bp, Mus musculus
gcctcagaatttaccccttcaaatt

SEQ ID NO: 554023 - DNA, 25 bp, Mus musculus
gcctcagaattttccccttcaaatt

SEQ ID NO: 554024 - DNA, 25 bp, Mus musculus
gcctcagacatacatatgccacatt

SEQ ID NO: 554025 - DNA, 25 bp, Mus musculus
gcctcagacatagatatgccacatt

SEQ ID NO: 554026 - DNA, 25 bp, Mus musculus
gcctcagacccgcaatacggatttt

SEQ ID NO: 554027 - DNA, 25 bp, Mus musculus
gcctcagacccggaatacggatttt

SEQ ID NO: 554028 - DNA, 25 bp, Mus musculus
gcctcagacctcagtcagagtccag

SEQ ID NO: 554029 - DNA, 25 bp, Mus musculus
gcctcagacctctgtcagagtccag

SEQ ID NO: 554030 - DNA, 25 bp, Mus musculus
gcctcagactgacatttgctcacct

SEQ ID NO: 554031 - DNA, 25 bp, Mus musculus
gcctcagactgagatttgctcacct

SEQ ID NO: 554032 - DNA, 25 bp, Mus musculus
gcctcagacttaccatgaagcctgg

SEQ ID NO: 554033 - DNA, 25 bp, Mus musculus
gcctcagacttagcatgaagcctgg

SEQ ID NO: 554034 - DNA, 25 bp, Mus musculus
gcctcagagaaactctccatggctt

SEQ ID NO: 554035 - DNA, 25 bp, Mus musculus
gcctcagagaaagtctccatggctt

SEQ ID NO: 554036 - DNA, 25 bp, Mus musculus
gcctcagagatgatgcctcactttg

SEQ ID NO: 554037 - DNA, 25 bp, Mus musculus
gcctcagagatgcagttctgccctt

SEQ ID NO: 554038 - DNA, 25 bp, Mus musculus
gcctcagagatggagttctgccctt

SEQ ID NO: 554039 - DNA, 25 bp, Mus musculus
gcctcagagatgttgcctcactttg

SEQ ID NO: 554040 - DNA, 25 bp, Mus musculus
gcctcagagcatcttctgccccact

SEQ ID NO: 554041 - DNA, 25 bp, Mus musculus
gcctcagagcatgttctgccccact

SEQ ID NO: 554042 - DNA, 25 bp, Mus musculus
gcctcagagtggctcgccagatgat

SEQ ID NO: 554043 - DNA, 25 bp, Mus musculus
gcctcagagtgggtcgccagatgat

SEQ ID NO: 554044 - DNA, 25 bp, Mus musculus
gcctcagatattaaacccgtaagcc

SEQ ID NO: 554045 - DNA, 25 bp, Mus musculus
gcctcagatatttaacccgtaagcc

SEQ ID NO: 554046 - DNA, 25 bp, Mus musculus
gcctcagatccgagactcgcggtca

SEQ ID NO: 554047 - DNA, 25 bp, Mus musculus
gcctcagatccgtgactcgcggtca

SEQ ID NO: 554048 - DNA, 25 bp, Mus musculus
gcctcagattctcgtgtaccttgga

SEQ ID NO: 554049 - DNA, 25 bp, Mus musculus
gcctcagattctggtgtaccttgga

SEQ ID NO: 554050 - DNA, 25 bp, Mus musculus
gcctcagcaagtacgatctccaaag

SEQ ID NO: 554051 - DNA, 25 bp, Mus musculus
gcctcagcaagttcgatctccaaag

SEQ ID NO: 554052 - DNA, 25 bp, Mus musculus
gcctcagcacccacttgatataaat

SEQ ID NO: 554053 - DNA, 25 bp, Mus musculus
gcctcagcaccctcttgatataaat

SEQ ID NO: 554054 - DNA, 25 bp, Mus musculus
gcctcagcactcatgggtttgttca

SEQ ID NO: 554055 - DNA, 25 bp, Mus musculus
gcctcagcactcttgggtttgttca

SEQ ID NO: 554056 - DNA, 25 bp, Mus musculus
gcctcagcagttagccgggactaaa

SEQ ID NO: 554057 - DNA, 25 bp, Mus musculus
gcctcagcagtttgccgggactaaa

SEQ ID NO: 554058 - DNA, 25 bp, Mus musculus
gcctcagcatgtctaactccaggct

SEQ ID NO: 554059 - DNA, 25 bp, Mus musculus
gcctcagcatgtgtaactccaggct

SEQ ID NO: 554060 - DNA, 25 bp, Mus musculus
gcctcagcattgcaggagcacgtca

SEQ ID NO: 554061 - DNA, 25 bp, Mus musculus
gcctcagcattggaggagcacgtca

SEQ ID NO: 554062 - DNA, 25 bp, Mus musculus
gcctcagccacaaagttatcatgga

SEQ ID NO: 554063 - DNA, 25 bp, Mus musculus
gcctcagccacatagttatcatgga

SEQ ID NO: 554064 - DNA, 25 bp, Mus musculus
gcctcagccattagtatgcagttct

SEQ ID NO: 554065 - DNA, 25 bp, Mus musculus
gcctcagccatttgtatgcagttct

SEQ ID NO: 554066 - DNA, 25 bp, Mus musculus
gcctcagcctttagtggtgctatag

SEQ ID NO: 554067 - DNA, 25 bp, Mus musculus
gcctcagccttttgtggtgctatag

SEQ ID NO: 554068 - DNA, 25 bp, Mus musculus
gcctcagcgtccaccagagggttca

SEQ ID NO: 554069 - DNA, 25 bp, Mus musculus
gcctcagcgtcctccagagggttca

SEQ ID NO: 554070 - DNA, 25 bp, Mus musculus
gcctcagctacaaaaccagttccag

SEQ ID NO: 554071 - DNA, 25 bp, Mus musculus
gcctcagctacataaccagttccag

SEQ ID NO: 554072 - DNA, 25 bp, Mus musculus
gcctcagctatcatagctctgacta

SEQ ID NO: 554073 - DNA, 25 bp, Mus musculus
gcctcagctatcttagctctgacta

SEQ ID NO: 554074 - DNA, 25 bp, Mus musculus
gcctcagctgatatttccagttgat

SEQ ID NO: 554075 - DNA, 25 bp, Mus musculus
gcctcagctgatttttccagttgat

SEQ ID NO: 554076 - DNA, 25 bp, Mus musculus
gcctcagctgctatagtaagataca

SEQ ID NO: 554077 - DNA, 25 bp, Mus musculus
gcctcagctgctttagtaagataca

SEQ ID NO: 554078 - DNA, 25 bp, Mus musculus
gcctcaggaggcaaggtcaccgcaa

SEQ ID NO: 554079 - DNA, 25 bp, Mus musculus
gcctcaggaggctaggtcaccgcaa

SEQ ID NO: 554080 - DNA, 25 bp, Mus musculus
gcctcaggatagctttcagcacatt

SEQ ID NO: 554081 - DNA, 25 bp, Mus musculus
gcctcaggataggtttcagcacatt

SEQ ID NO: 554082 - DNA, 25 bp, Mus musculus
gcctcaggatcactcctctagcatt

SEQ ID NO: 554083 - DNA, 25 bp, Mus musculus
gcctcaggatcagtcctctagcatt

SEQ ID NO: 554084 - DNA, 25 bp, Mus musculus
gcctcaggcaatataaatccatcat

SEQ ID NO: 554085 - DNA, 25 bp, Mus musculus
gcctcaggcaatttaaatccatcat

SEQ ID NO: 554086 - DNA, 25 bp, Mus musculus
gcctcaggcctcagtgtgtctagga

SEQ ID NO: 554087 - DNA, 25 bp, Mus musculus
gcctcaggcctctgtgtgtctagga

SEQ ID NO: 554088 - DNA, 25 bp, Mus musculus
gcctcaggtcaaagatgcccgttat

SEQ ID NO: 554089 - DNA, 25 bp, Mus musculus
gcctcaggtcaatgatgcccgttat

SEQ ID NO: 554090 - DNA, 25 bp, Mus musculus
gcctcaggtctccttagcagtaaga

SEQ ID NO: 554091 - DNA, 25 bp, Mus musculus
gcctcaggtctcgttagcagtaaga

SEQ ID NO: 554092 - DNA, 25 bp, Mus musculus
gcctcaggttccagagtaccagcat

SEQ ID NO: 554093 - DNA, 25 bp, Mus musculus
gcctcaggttcctgagtaccagcat

SEQ ID NO: 554094 - DNA, 25 bp, Mus musculus
gcctcaggttctcttttgagcatgt

SEQ ID NO: 554095 - DNA, 25 bp, Mus musculus
gcctcaggttctgttttgagcatgt

SEQ ID NO: 554096 - DNA, 25 bp, Mus musculus
gcctcaggttgcactgtcttttggt

SEQ ID NO: 554097 - DNA, 25 bp, Mus musculus
gcctcaggttgctctgtcttttggt

SEQ ID NO: 554098 - DNA, 25 bp, Mus musculus
gcctcagtaacgctaatggcacaga

SEQ ID NO: 554099 - DNA, 25 bp, Mus musculus
gcctcagtaacggtaatggcacaga

SEQ ID NO: 554100 - DNA, 25 bp, Mus musculus
gcctcagtacctatgattacctgtg

SEQ ID NO: 554101 - DNA, 25 bp, Mus musculus
gcctcagtacctttgattacctgtg

SEQ ID NO: 554102 - DNA, 25 bp, Mus musculus
gcctcagtacttccacacaagggtt

SEQ ID NO: 554103 - DNA, 25 bp, Mus musculus
gcctcagtacttgcacacaagggtt

SEQ ID NO: 554104 - DNA, 25 bp, Mus musculus
gcctcagtaggcagccacacatgtg

SEQ ID NO: 554105 - DNA, 25 bp, Mus musculus
gcctcagtaggctgccacacatgtg

SEQ ID NO: 554106 - DNA, 25 bp, Mus musculus
gcctcagtcaaaacagccattcatg

SEQ ID NO: 554107 - DNA, 25 bp, Mus musculus
gcctcagtcaaatcagccattcatg

SEQ ID NO: 554108 - DNA, 25 bp, Mus musculus
gcctcagtcaagatgtcctgcacag

SEQ ID NO: 554109 - DNA, 25 bp, Mus musculus
gcctcagtcaagttgtcctgcacag

SEQ ID NO: 554110 - DNA, 25 bp, Mus musculus
gcctcagtcatgatgtcttatcaca

SEQ ID NO: 554111 - DNA, 25 bp, Mus musculus
gcctcagtcatgttgtcttatcaca

SEQ ID NO: 554112 - DNA, 25 bp, Mus musculus
gcctcagtctccaaatctatcagat

SEQ ID NO: 554113 - DNA, 25 bp, Mus musculus
gcctcagtctcctaatctatcagat

SEQ ID NO: 554114 - DNA, 25 bp, Mus musculus
gcctcagtctctagctgactggtag

SEQ ID NO: 554115 - DNA, 25 bp, Mus musculus
gcctcagtctcttgctgactggtag

SEQ ID NO: 554116 - DNA, 25 bp, Mus musculus
gcctcagtctgaaaacatcccaaat

SEQ ID NO: 554117 - DNA, 25 bp, Mus musculus
gcctcagtctgataacatcccaaat

SEQ ID NO: 554118 - DNA, 25 bp, Mus musculus
gcctcagtctttagttcaccaaaga

SEQ ID NO: 554119 - DNA, 25 bp, Mus musculus
gcctcagtcttttgttcaccaaaga

SEQ ID NO: 554120 - DNA, 25 bp, Mus musculus
gcctcagtgctacggacgaggacac

SEQ ID NO: 554121 - DNA, 25 bp, Mus musculus
gcctcagtgctagggacgaggacac

SEQ ID NO: 554122 - DNA, 25 bp, Mus musculus
gcctcagtggccacggttgtgctga

SEQ ID NO: 554123 - DNA, 25 bp, Mus musculus
gcctcagtggcctcggttgtgctga

SEQ ID NO: 554124 - DNA, 25 bp, Mus musculus
gcctcagttagcagagaagctgttc

SEQ ID NO: 554125 - DNA, 25 bp, Mus musculus
gcctcagttagctgagaagctgttc

SEQ ID NO: 554126 - DNA, 25 bp, Mus musculus
gcctcagttcaaacaacggtgcatt

SEQ ID NO: 554127 - DNA, 25 bp, Mus musculus
gcctcagttcaatcaacggtgcatt

SEQ ID NO: 554128 - DNA, 25 bp, Mus musculus
gcctcagttgagaatcggttagtat

SEQ ID NO: 554129 - DNA, 25 bp, Mus musculus
gcctcagttgagtatcggttagtat

SEQ ID NO: 554130 - DNA, 25 bp, Mus musculus
gcctcagttgtcatcgtgatactca

SEQ ID NO: 554131 - DNA, 25 bp, Mus musculus
gcctcagttgtcttcgtgatactca

SEQ ID NO: 554132 - DNA, 25 bp, Mus musculus
gcctcagtttacagtatctcaggtt

SEQ ID NO: 554133 - DNA, 25 bp, Mus musculus
gcctcagtttactgtatctcaggtt

SEQ ID NO: 554134 - DNA, 25 bp, Mus musculus
gcctcagtttccacacttataaaat

SEQ ID NO: 554135 - DNA, 25 bp, Mus musculus
gcctcagtttcctcacttataaaat

SEQ ID NO: 554136 - DNA, 25 bp, Mus musculus
gcctcagtttggctacatgacttac

SEQ ID NO: 554137 - DNA, 25 bp, Mus musculus
gcctcagtttgggtacatgacttac

SEQ ID NO: 554138 - DNA, 25 bp, Mus musculus
gcctcagttttcacctcttgaaata

SEQ ID NO: 554139 - DNA, 25 bp, Mus musculus
gcctcagttttcagcatctgtggaa

SEQ ID NO: 554140 - DNA, 25 bp, Mus musculus
gcctcagttttctcctcttgaaata

SEQ ID NO: 554141 - DNA, 25 bp, Mus musculus
gcctcagttttctgcatctgtggaa

SEQ ID NO: 554142 - DNA, 25 bp, Mus musculus
gcctcataaactcttgcacctggca

SEQ ID NO: 554143 - DNA, 25 bp, Mus musculus
gcctcataaactgttgcacctggca

SEQ ID NO: 554144 - DNA, 25 bp, Mus musculus
gcctcataatttatagcctagtaat

SEQ ID NO: 554145 - DNA, 25 bp, Mus musculus
gcctcataatttttagcctagtaat

SEQ ID NO: 554146 - DNA, 25 bp, Mus musculus
gcctcatagacgcagacgagaattc

SEQ ID NO: 554147 - DNA, 25 bp, Mus musculus
gcctcatagacggagacgagaattc

SEQ ID NO: 554148 - DNA, 25 bp, Mus musculus
gcctcataggctcaaaccctcaata

SEQ ID NO: 554149 - DNA, 25 bp, Mus musculus
gcctcataggctgaaaccctcaata

SEQ ID NO: 554150 - DNA, 25 bp, Mus musculus
gcctcatataaacatagcctgtgtt

SEQ ID NO: 554151 - DNA, 25 bp, Mus musculus
gcctcatataaagatagcctgtgtt

SEQ ID NO: 554152 - DNA, 25 bp, Mus musculus
gcctcatcagcaaggcaaggtgttc

SEQ ID NO: 554153 - DNA, 25 bp, Mus musculus
gcctcatcagcatggcaaggtgttc

SEQ ID NO: 554154 - DNA, 25 bp, Mus musculus
gcctcatccagaaaatcgttcatcg

SEQ ID NO: 554155 - DNA, 25 bp, Mus musculus
gcctcatccagataatcgttcatcg

SEQ ID NO: 554156 - DNA, 25 bp, Mus musculus
gcctcatcccatcctattgaatagg

SEQ ID NO: 554157 - DNA, 25 bp, Mus musculus
gcctcatcccatgctattgaatagg

SEQ ID NO: 554158 - DNA, 25 bp, Mus musculus
gcctcatccggaatctggagcagct

SEQ ID NO: 554159 - DNA, 25 bp, Mus musculus
gcctcatccggattctggagcagct

SEQ ID NO: 554160 - DNA, 25 bp, Mus musculus
gcctcatccgtgaggttcgcagaaa

SEQ ID NO: 554161 - DNA, 25 bp, Mus musculus
gcctcatccgtgtggttcgcagaaa

SEQ ID NO: 554162 - DNA, 25 bp, Mus musculus
gcctcatcctcaaactgttcataat

SEQ ID NO: 554163 - DNA, 25 bp, Mus musculus
gcctcatcctcatactgttcataat

SEQ ID NO: 554164 - DNA, 25 bp, Mus musculus
gcctcatcggcaacaaggacatgta

SEQ ID NO: 554165 - DNA, 25 bp, Mus musculus
gcctcatcggcatcaaggacatgta

SEQ ID NO: 554166 - DNA, 25 bp, Mus musculus
gcctcatctcaaagctgggtaccag

SEQ ID NO: 554167 - DNA, 25 bp, Mus musculus
gcctcatctcaatgctgggtaccag

SEQ ID NO: 554168 - DNA, 25 bp, Mus musculus
gcctcatctgctcatttttggtttg

SEQ ID NO: 554169 - DNA, 25 bp, Mus musculus
gcctcatctgctgatttttggtttg

SEQ ID NO: 554170 - DNA, 25 bp, Mus musculus
gcctcatgagagcttgtttggttac

SEQ ID NO: 554171 - DNA, 25 bp, Mus musculus
gcctcatgagaggttgtttggttac

SEQ ID NO: 554172 - DNA, 25 bp, Mus musculus
gcctcatgagcacccttatttcaga

SEQ ID NO: 554173 - DNA, 25 bp, Mus musculus
gcctcatgagcagccttatttcaga

SEQ ID NO: 554174 - DNA, 25 bp, Mus musculus
gcctcatgatgcagattgccacagg

SEQ ID NO: 554175 - DNA, 25 bp, Mus musculus
gcctcatgatgcctgactttaatat

SEQ ID NO: 554176 - DNA, 25 bp, Mus musculus
gcctcatgatgcgtgactttaatat

SEQ ID NO: 554177 - DNA, 25 bp, Mus musculus
gcctcatgatgctgattgccacagg

SEQ ID NO: 554178 - DNA, 25 bp, Mus musculus
gcctcatgcagaccctgttgagagc

SEQ ID NO: 554179 - DNA, 25 bp, Mus musculus
gcctcatgcagagcctgttgagagc

SEQ ID NO: 554180 - DNA, 25 bp, Mus musculus
gcctcatgcagtacacagctgggat

SEQ ID NO: 554181 - DNA, 25 bp, Mus musculus
gcctcatgcagttcacagctgggat

SEQ ID NO: 554182 - DNA, 25 bp, Mus musculus
gcctcatgccatatactcattggag

SEQ ID NO: 554183 - DNA, 25 bp, Mus musculus
gcctcatgccatttactcattggag

SEQ ID NO: 554184 - DNA, 25 bp, Mus musculus
gcctcatgctgaaagctgagctacc

SEQ ID NO: 554185 - DNA, 25 bp, Mus musculus
gcctcatgctgatagctgagctacc

SEQ ID NO: 554186 - DNA, 25 bp, Mus musculus
gcctcatgcttgctcatttccagaa

SEQ ID NO: 554187 - DNA, 25 bp, Mus musculus
gcctcatgcttggtcatttccagaa

SEQ ID NO: 554188 - DNA, 25 bp, Mus musculus
gcctcatggatgctggacaagcact

SEQ ID NO: 554189 - DNA, 25 bp, Mus musculus
gcctcatggatggtggacaagcact

SEQ ID NO: 554190 - DNA, 25 bp, Mus musculus
gcctcatgggctcctcagtatcaag

SEQ ID NO: 554191 - DNA, 25 bp, Mus musculus
gcctcatgggctgctcagtatcaag

SEQ ID NO: 554192 - DNA, 25 bp, Mus musculus
gcctcatggtgaagggtctttaatc

SEQ ID NO: 554193 - DNA, 25 bp, Mus musculus
gcctcatggtgatgggtctttaatc

SEQ ID NO: 554194 - DNA, 25 bp, Mus musculus
gcctcatggttcagcttttacacaa

SEQ ID NO: 554195 - DNA, 25 bp, Mus musculus
gcctcatggttctgcttttacacaa

SEQ ID NO: 554196 - DNA, 25 bp, Mus musculus
gcctcatgtcttataattctcagtg

SEQ ID NO: 554197 - DNA, 25 bp, Mus musculus
gcctcatgtcttttaattctcagtg

SEQ ID NO: 554198 - DNA, 25 bp, Mus musculus
gcctcatgtgtcagggagcatccca

SEQ ID NO: 554199 - DNA, 25 bp, Mus musculus
gcctcatgtgtctgggagcatccca

SEQ ID NO: 554200 - DNA, 25 bp, Mus musculus
gcctcattaaagacactgccatact

SEQ ID NO: 554201 - DNA, 25 bp, Mus musculus
gcctcattaaagtcactgccatact

SEQ ID NO: 554202 - DNA, 25 bp, Mus musculus
gcctcattacacagcagcacgatcg

SEQ ID NO: 554203 - DNA, 25 bp, Mus musculus
gcctcattacactgcagcacgatcg

SEQ ID NO: 554204 - DNA, 25 bp, Mus musculus
gcctcattagttaatagtcgcacag

SEQ ID NO: 554205 - DNA, 25 bp, Mus musculus
gcctcattagtttatagtcgcacag

SEQ ID NO: 554206 - DNA, 25 bp, Mus musculus
gcctcattatttctcttgcagtcta

SEQ ID NO: 554207 - DNA, 25 bp, Mus musculus
gcctcattatttgtcttgcagtcta

SEQ ID NO: 554208 - DNA, 25 bp, Mus musculus
gcctcattccaaccaattcaacaaa

SEQ ID NO: 554209 - DNA, 25 bp, Mus musculus
gcctcattccaagcaattcaacaaa

SEQ ID NO: 554210 - DNA, 25 bp, Mus musculus
gcctcattcctgaagtaatctctgg

SEQ ID NO: 554211 - DNA, 25 bp, Mus musculus
gcctcattcctgctgctaagctgga

SEQ ID NO: 554212 - DNA, 25 bp, Mus musculus
gcctcattcctggtgctaagctgga

SEQ ID NO: 554213 - DNA, 25 bp, Mus musculus
gcctcattcctgtagtaatctctgg

SEQ ID NO: 554214 - DNA, 25 bp, Mus musculus
gcctcattctgccatcatcagataa

SEQ ID NO: 554215 - DNA, 25 bp, Mus musculus
gcctcattctgcgatcatcagataa

SEQ ID NO: 554216 - DNA, 25 bp, Mus musculus
gcctcattgagtatgacacgttcgt

SEQ ID NO: 554217 - DNA, 25 bp, Mus musculus
gcctcattgagtttgacacgttcgt

SEQ ID NO: 554218 - DNA, 25 bp, Mus musculus
gcctcattgatcaatggcctggcaa

SEQ ID NO: 554219 - DNA, 25 bp, Mus musculus
gcctcattgatctatggcctggcaa

SEQ ID NO: 554220 - DNA, 25 bp, Mus musculus
gcctcattgatgaagtccaccagtt

SEQ ID NO: 554221 - DNA, 25 bp, Mus musculus
gcctcattgatgtagtccaccagtt

SEQ ID NO: 554222 - DNA, 25 bp, Mus musculus
gcctcattgcagaggtttccctttg

SEQ ID NO: 554223 - DNA, 25 bp, Mus musculus
gcctcattgcagtggtttccctttg

SEQ ID NO: 554224 - DNA, 25 bp, Mus musculus
gcctcatttcatctcccagttttaa

SEQ ID NO: 554225 - DNA, 25 bp, Mus musculus
gcctcatttcatgtcccagttttaa

SEQ ID NO: 554226 - DNA, 25 bp, Mus musculus
gcctcatttctaatactacaaggac

SEQ ID NO: 554227 - DNA, 25 bp, Mus musculus
gcctcatttctattactacaaggac

SEQ ID NO: 554228 - DNA, 25 bp, Mus musculus
gcctcatttctgatctccgtggaaa

SEQ ID NO: 554229 - DNA, 25 bp, Mus musculus
gcctcatttctgttctccgtggaaa

SEQ ID NO: 554230 - DNA, 25 bp, Mus musculus
gcctcattttaactgactgtgggaa

SEQ ID NO: 554231 - DNA, 25 bp, Mus musculus
gcctcattttaagtgactgtgggaa

SEQ ID NO: 554232 - DNA, 25 bp, Mus musculus
gcctcattttatcatagcttattgt

SEQ ID NO: 554233 - DNA, 25 bp, Mus musculus
gcctcattttatgatagcttattgt

SEQ ID NO: 554234 - DNA, 25 bp, Mus musculus
gcctcattttccctagtagctgaga

SEQ ID NO: 554235 - DNA, 25 bp, Mus musculus
gcctcattttccgtagtagctgaga

SEQ ID NO: 554236 - DNA, 25 bp, Mus musculus
gcctccaaattacaatgtgtcttcc

SEQ ID NO: 554237 - DNA, 25 bp, Mus musculus
gcctccaaattagaatgtgtcttcc

SEQ ID NO: 554238 - DNA, 25 bp, Mus musculus
gcctccaaattgaaggtttctcatg

SEQ ID NO: 554239 - DNA, 25 bp, Mus musculus
gcctccaaattgtaggtttctcatg

SEQ ID NO: 554240 - DNA, 25 bp, Mus musculus
gcctccaacccacggcaagctgagg

SEQ ID NO: 554241 - DNA, 25 bp, Mus musculus
gcctccaacccagggcaagctgagg

SEQ ID NO: 554242 - DNA, 25 bp, Mus musculus
gcctccaacttcaggtggttaacag

SEQ ID NO: 554243 - DNA, 25 bp, Mus musculus
gcctccaacttctggtggttaacag

SEQ ID NO: 554244 - DNA, 25 bp, Mus musculus
gcctccaatttaactcctttgtaag

SEQ ID NO: 554245 - DNA, 25 bp, Mus musculus
gcctccaatttatctcctttgtaag

SEQ ID NO: 554246 - DNA, 25 bp, Mus musculus
gcctccacacacaactgtacagatg

SEQ ID NO: 554247 - DNA, 25 bp, Mus musculus
gcctccacacactactgtacagatg

SEQ ID NO: 554248 - DNA, 25 bp, Mus musculus
gcctccacacgcctagggaagtaga

SEQ ID NO: 554249 - DNA, 25 bp, Mus musculus
gcctccacacgcgtagggaagtaga

SEQ ID NO: 554250 - DNA, 25 bp, Mus musculus
gcctccacagagaccaagaagctaa

SEQ ID NO: 554251 - DNA, 25 bp, Mus musculus
gcctccacagagtccaagaagctaa

SEQ ID NO: 554252 - DNA, 25 bp, Mus musculus
gcctccacagggacaggaacctgtg

SEQ ID NO: 554253 - DNA, 25 bp, Mus musculus
gcctccacagggtcaggaacctgtg

SEQ ID NO: 554254 - DNA, 25 bp, Mus musculus
gcctccacatagcttcaactcagaa

SEQ ID NO: 554255 - DNA, 25 bp, Mus musculus
gcctccacataggttcaactcagaa

SEQ ID NO: 554256 - DNA, 25 bp, Mus musculus
gcctccaccgtaacaaaccaagatt

SEQ ID NO: 554257 - DNA, 25 bp, Mus musculus
gcctccaccgtatcaaaccaagatt

SEQ ID NO: 554258 - DNA, 25 bp, Mus musculus
gcctccacctatatgtatgagtttg

SEQ ID NO: 554259 - DNA, 25 bp, Mus musculus
gcctccacctatttgtatgagtttg

SEQ ID NO: 554260 - DNA, 25 bp, Mus musculus
gcctccacgcctatgaaatttgtaa

SEQ ID NO: 554261 - DNA, 25 bp, Mus musculus
gcctccacgcctttgaaatttgtaa

SEQ ID NO: 554262 - DNA, 25 bp, Mus musculus
gcctccacgggacaaagcttcaaga

SEQ ID NO: 554263 - DNA, 25 bp, Mus musculus
gcctccacgggagaaagcttcaaga

SEQ ID NO: 554264 - DNA, 25 bp, Mus musculus
gcctccactgagctgtgctgtgtat

SEQ ID NO: 554265 - DNA, 25 bp, Mus musculus
gcctccactgaggtgtgctgtgtat

SEQ ID NO: 554266 - DNA, 25 bp, Mus musculus
gcctccagacctatgttatcggtag

SEQ ID NO: 554267 - DNA, 25 bp, Mus musculus
gcctccagacctttgttatcggtag

SEQ ID NO: 554268 - DNA, 25 bp, Mus musculus
gcctccagatcccaaagttcgaggt

SEQ ID NO: 554269 - DNA, 25 bp, Mus musculus
gcctccagatccgaaagttcgaggt

SEQ ID NO: 554270 - DNA, 25 bp, Mus musculus
gcctccagcaaaacgacttctagtg

SEQ ID NO: 554271 - DNA, 25 bp, Mus musculus
gcctccagcaaatcgacttctagtg

SEQ ID NO: 554272 - DNA, 25 bp, Mus musculus
gcctccagcatccagtatcgaaaag

SEQ ID NO: 554273 - DNA, 25 bp, Mus musculus
gcctccagcatcgagtatcgaaaag

SEQ ID NO: 554274 - DNA, 25 bp, Mus musculus
gcctccagcctgaattgaagtttga

SEQ ID NO: 554275 - DNA, 25 bp, Mus musculus
gcctccagcctgtattgaagtttga

SEQ ID NO: 554276 - DNA, 25 bp, Mus musculus
gcctccaggcccagtattgtcctgg

SEQ ID NO: 554277 - DNA, 25 bp, Mus musculus
gcctccaggccctgtattgtcctgg

SEQ ID NO: 554278 - DNA, 25 bp, Mus musculus
gcctccagggtgagtacagtcagtg

SEQ ID NO: 554279 - DNA, 25 bp, Mus musculus
gcctccagggtgtgtacagtcagtg

SEQ ID NO: 554280 - DNA, 25 bp, Mus musculus
gcctccaggttgcacatttatttat

SEQ ID NO: 554281 - DNA, 25 bp, Mus musculus
gcctccaggttggacatttatttat

SEQ ID NO: 554282 - DNA, 25 bp, Mus musculus
gcctccagttctagtaagcttacag

SEQ ID NO: 554283 - DNA, 25 bp, Mus musculus
gcctccagttcttgtaagcttacag

SEQ ID NO: 554284 - DNA, 25 bp, Mus musculus
gcctccataagaacttggtgattaa

SEQ ID NO: 554285 - DNA, 25 bp, Mus musculus
gcctccataagatcttggtgattaa

SEQ ID NO: 554286 - DNA, 25 bp, Mus musculus
gcctccatagctagagtcatatcca

SEQ ID NO: 554287 - DNA, 25 bp, Mus musculus
gcctccatagcttgagtcatatcca

SEQ ID NO: 554288 - DNA, 25 bp, Mus musculus
gcctccatagtgatagcctccaaga

SEQ ID NO: 554289 - DNA, 25 bp, Mus musculus
gcctccatagtgttagcctccaaga

SEQ ID NO: 554290 - DNA, 25 bp, Mus musculus
gcctccatgcagagtttgcagctga

SEQ ID NO: 554291 - DNA, 25 bp, Mus musculus
gcctccatgcagtgtttgcagctga

SEQ ID NO: 554292 - DNA, 25 bp, Mus musculus
gcctccatgggaattcagggacttt

SEQ ID NO: 554293 - DNA, 25 bp, Mus musculus
gcctccatgggatttcagggacttt

SEQ ID NO: 554294 - DNA, 25 bp, Mus musculus
gcctccatggttcgctggtatgatc

SEQ ID NO: 554295 - DNA, 25 bp, Mus musculus
gcctccatggttggctggtatgatc

SEQ ID NO: 554296 - DNA, 25 bp, Mus musculus
gcctccatgtccagcaaattattaa

SEQ ID NO: 554297 - DNA, 25 bp, Mus musculus
gcctccatgtcctgcaaattattaa

SEQ ID NO: 554298 - DNA, 25 bp, Mus musculus
gcctccattcgtacgagaaacggct

SEQ ID NO: 554299 - DNA, 25 bp, Mus musculus
gcctccattcgttcgagaaacggct

SEQ ID NO: 554300 - DNA, 25 bp, Mus musculus
gcctcccaactcatggatcaaaagc

SEQ ID NO: 554301 - DNA, 25 bp, Mus musculus
gcctcccaactcttggatcaaaagc

SEQ ID NO: 554302 - DNA, 25 bp, Mus musculus
gcctcccaagtaatagttgtgcctg

SEQ ID NO: 554303 - DNA, 25 bp, Mus musculus
gcctcccaagtattagttgtgcctg

SEQ ID NO: 554304 - DNA, 25 bp, Mus musculus
gcctcccaattgctgaaattagaaa

SEQ ID NO: 554305 - DNA, 25 bp, Mus musculus
gcctcccaattggtgaaattagaaa

SEQ ID NO: 554306 - DNA, 25 bp, Mus musculus
gcctcccacctgaagtaaatcggat

SEQ ID NO: 554307 - DNA, 25 bp, Mus musculus
gcctcccacctgtagtaaatcggat

SEQ ID NO: 554308 - DNA, 25 bp, Mus musculus
gcctcccaggaaaacaatacgctca

SEQ ID NO: 554309 - DNA, 25 bp, Mus musculus
gcctcccaggaatacaatacgctca

SEQ ID NO: 554310 - DNA, 25 bp, Mus musculus
gcctcccaggagaaacttaacatcc

SEQ ID NO: 554311 - DNA, 25 bp, Mus musculus
gcctcccaggagtaacttaacatcc

SEQ ID NO: 554312 - DNA, 25 bp, Mus musculus
gcctcccaggtcagctgcttctgag

SEQ ID NO: 554313 - DNA, 25 bp, Mus musculus
gcctcccaggtctgctgcttctgag

SEQ ID NO: 554314 - DNA, 25 bp, Mus musculus
gcctcccataccatagtggactgga

SEQ ID NO: 554315 - DNA, 25 bp, Mus musculus
gcctcccataccttagtggactgga

SEQ ID NO: 554316 - DNA, 25 bp, Mus musculus
gcctcccatgacaacatcttgaaga

SEQ ID NO: 554317 - DNA, 25 bp, Mus musculus
gcctcccatgactacatcttgaaga

SEQ ID NO: 554318 - DNA, 25 bp, Mus musculus
gcctccccagtacttagattacaag

SEQ ID NO: 554319 - DNA, 25 bp, Mus musculus
gcctccccagtagttagattacaag

SEQ ID NO: 554320 - DNA, 25 bp, Mus musculus
gcctccccagtgattagtgtgttac

SEQ ID NO: 554321 - DNA, 25 bp, Mus musculus
gcctccccagtgtttagtgtgttac

SEQ ID NO: 554322 - DNA, 25 bp, Mus musculus
gcctccccggtgcatgtggtaaaga

SEQ ID NO: 554323 - DNA, 25 bp, Mus musculus
gcctccccggtggatgtggtaaaga

SEQ ID NO: 554324 - DNA, 25 bp, Mus musculus
gcctccccggttctagatgtggttg

SEQ ID NO: 554325 - DNA, 25 bp, Mus musculus
gcctccccggttgtagatgtggttg

SEQ ID NO: 554326 - DNA, 25 bp, Mus musculus
gcctcccctgttcatgtggtcaaga

SEQ ID NO: 554327 - DNA, 25 bp, Mus musculus
gcctcccctgttgatgtggtcaaga

SEQ ID NO: 554328 - DNA, 25 bp, Mus musculus
gcctcccctttactagtgtctgttt

SEQ ID NO: 554329 - DNA, 25 bp, Mus musculus
gcctcccctttagtagtgtctgttt

SEQ ID NO: 554330 - DNA, 25 bp, Mus musculus
gcctcccgcggacagctaggaaaca

SEQ ID NO: 554331 - DNA, 25 bp, Mus musculus
gcctcccgcggagagctaggaaaca

SEQ ID NO: 554332 - DNA, 25 bp, Mus musculus
gcctcccgtcctagaatgtctaatg

SEQ ID NO: 554333 - DNA, 25 bp, Mus musculus
gcctcccgtccttgaatgtctaatg

SEQ ID NO: 554334 - DNA, 25 bp, Mus musculus
gcctccctaatgctataatccttta

SEQ ID NO: 554335 - DNA, 25 bp, Mus musculus
gcctccctaatggtataatccttta

SEQ ID NO: 554336 - DNA, 25 bp, Mus musculus
gcctccctacatactttattttgac

SEQ ID NO: 554337 - DNA, 25 bp, Mus musculus
gcctccctacattctttattttgac

SEQ ID NO: 554338 - DNA, 25 bp, Mus musculus
gcctccctccagagcatcagaaata

SEQ ID NO: 554339 - DNA, 25 bp, Mus musculus
gcctccctccagtgcatcagaaata

SEQ ID NO: 554340 - DNA, 25 bp, Mus musculus
gcctccctgaatcggatgctgtgtt

SEQ ID NO: 554341 - DNA, 25 bp, Mus musculus
gcctccctgaatgggatgctgtgtt

SEQ ID NO: 554342 - DNA, 25 bp, Mus musculus
gcctccctggatcattgacgtacaa

SEQ ID NO: 554343 - DNA, 25 bp, Mus musculus
gcctccctggatgattgacgtacaa

SEQ ID NO: 554344 - DNA, 25 bp, Mus musculus
gcctccctggtaacgagcacagaaa

SEQ ID NO: 554345 - DNA, 25 bp, Mus musculus
gcctccctggtatcgagcacagaaa

SEQ ID NO: 554346 - DNA, 25 bp, Mus musculus
gcctccctttctaaggagtagttct

SEQ ID NO: 554347 - DNA, 25 bp, Mus musculus
gcctccctttcttaggagtagttct

SEQ ID NO: 554348 - DNA, 25 bp, Mus musculus
gcctccctttgacgtggtacagcca

SEQ ID NO: 554349 - DNA, 25 bp, Mus musculus
gcctccctttgaggtggtacagcca

SEQ ID NO: 554350 - DNA, 25 bp, Mus musculus
gcctccgaaactctgctcaacttgg

SEQ ID NO: 554351 - DNA, 25 bp, Mus musculus
gcctccgaaactgtgctcaacttgg

SEQ ID NO: 554352 - DNA, 25 bp, Mus musculus
gcctccgaagacaaggttcacggtg

SEQ ID NO: 554353 - DNA, 25 bp, Mus musculus
gcctccgaagactaggttcacggtg

SEQ ID NO: 554354 - DNA, 25 bp, Mus musculus
gcctccgactttaatgatagctgtt

SEQ ID NO: 554355 - DNA, 25 bp, Mus musculus
gcctccgacttttatgatagctgtt

SEQ ID NO: 554356 - DNA, 25 bp, Mus musculus
gcctccgaggatcatgtaagcttgc

SEQ ID NO: 554357 - DNA, 25 bp, Mus musculus
gcctccgaggatgatgtaagcttgc

SEQ ID NO: 554358 - DNA, 25 bp, Mus musculus
gcctccgagggaatatgtgtacata

SEQ ID NO: 554359 - DNA, 25 bp, Mus musculus
gcctccgagggattatgtgtacata

SEQ ID NO: 554360 - DNA, 25 bp, Mus musculus
gcctccgaggtcagggttatctgcc

SEQ ID NO: 554361 - DNA, 25 bp, Mus musculus
gcctccgaggtctgggttatctgcc

SEQ ID NO: 554362 - DNA, 25 bp, Mus musculus
gcctccgcacggcttaacagaaaca

SEQ ID NO: 554363 - DNA, 25 bp, Mus musculus
gcctccgcacgggttaacagaaaca

SEQ ID NO: 554364 - DNA, 25 bp, Mus musculus
gcctccgcctgtcgctgaagactga

SEQ ID NO: 554365 - DNA, 25 bp, Mus musculus
gcctccgcctgtggctgaagactga

SEQ ID NO: 554366 - DNA, 25 bp, Mus musculus
gcctccgctcgcagcaggatggatg

SEQ ID NO: 554367 - DNA, 25 bp, Mus musculus
gcctccgctcgctgcaggatggatg

SEQ ID NO: 554368 - DNA, 25 bp, Mus musculus
gcctccggaggaagacgtctgcaag

SEQ ID NO: 554369 - DNA, 25 bp, Mus musculus
gcctccggaggatgacgtctgcaag

SEQ ID NO: 554370 - DNA, 25 bp, Mus musculus
gcctccgggagacacctgcttggaa

SEQ ID NO: 554371 - DNA, 25 bp, Mus musculus
gcctccgggagagacctgcttggaa

SEQ ID NO: 554372 - DNA, 25 bp, Mus musculus
gcctccggtgtgaggtacttgtcga

SEQ ID NO: 554373 - DNA, 25 bp, Mus musculus
gcctccggtgtgtggtacttgtcga

SEQ ID NO: 554374 - DNA, 25 bp, Mus musculus
gcctccgtatcacggcagagagtag

SEQ ID NO: 554375 - DNA, 25 bp, Mus musculus
gcctccgtatcagggcagagagtag

SEQ ID NO: 554376 - DNA, 25 bp, Mus musculus
gcctccgtctgaattaccgaaaagt

SEQ ID NO: 554377 - DNA, 25 bp, Mus musculus
gcctccgtctgatttaccgaaaagt

SEQ ID NO: 554378 - DNA, 25 bp, Mus musculus
gcctccgtggtcacctgtgttaaaa

SEQ ID NO: 554379 - DNA, 25 bp, Mus musculus
gcctccgtggtctcctgtgttaaaa

SEQ ID NO: 554380 - DNA, 25 bp, Mus musculus
gcctccgtgtgtcttgttaatgcaa

SEQ ID NO: 554381 - DNA, 25 bp, Mus musculus
gcctccgtgtgtgttgttaatgcaa

SEQ ID NO: 554382 - DNA, 25 bp, Mus musculus
gcctcctaaataatcggtgctacaa

SEQ ID NO: 554383 - DNA, 25 bp, Mus musculus
gcctcctaaatattcggtgctacaa

SEQ ID NO: 554384 - DNA, 25 bp, Mus musculus
gcctcctaaggaaggtgagtatcat

SEQ ID NO: 554385 - DNA, 25 bp, Mus musculus
gcctcctaaggatggtgagtatcat

SEQ ID NO: 554386 - DNA, 25 bp, Mus musculus
gcctcctaagttatggattacagtt

SEQ ID NO: 554387 - DNA, 25 bp, Mus musculus
gcctcctaagttttggattacagtt

SEQ ID NO: 554388 - DNA, 25 bp, Mus musculus
gcctcctaatctctaagatgcaggc

SEQ ID NO: 554389 - DNA, 25 bp, Mus musculus
gcctcctaatctgtaagatgcaggc

SEQ ID NO: 554390 - DNA, 25 bp, Mus musculus
gcctcctacgtgctggaatcaaaga

SEQ ID NO: 554391 - DNA, 25 bp, Mus musculus
gcctcctacgtggtggaatcaaaga

SEQ ID NO: 554392 - DNA, 25 bp, Mus musculus
gcctcctacttccatatgtactgta

SEQ ID NO: 554393 - DNA, 25 bp, Mus musculus
gcctcctacttcgatatgtactgta

SEQ ID NO: 554394 - DNA, 25 bp, Mus musculus
gcctcctagagccatctagtaacag

SEQ ID NO: 554395 - DNA, 25 bp, Mus musculus
gcctcctagagcgatctagtaacag

SEQ ID NO: 554396 - DNA, 25 bp, Mus musculus
gcctcctagaggatacctggcttta

SEQ ID NO: 554397 - DNA, 25 bp, Mus musculus
gcctcctagaggttacctggcttta

SEQ ID NO: 554398 - DNA, 25 bp, Mus musculus
gcctcctagctcagattgagcttta

SEQ ID NO: 554399 - DNA, 25 bp, Mus musculus
gcctcctagctctgattgagcttta

SEQ ID NO: 554400 - DNA, 25 bp, Mus musculus
gcctcctaggcaagagaccaggtat

SEQ ID NO: 554401 - DNA, 25 bp, Mus musculus
gcctcctaggcatgagaccaggtat

SEQ ID NO: 554402 - DNA, 25 bp, Mus musculus
gcctcctagggaaggcttcttgaag

SEQ ID NO: 554403 - DNA, 25 bp, Mus musculus
gcctcctagggatggcttcttgaag

SEQ ID NO: 554404 - DNA, 25 bp, Mus musculus
gcctcctcaacaccaaacagttgga

SEQ ID NO: 554405 - DNA, 25 bp, Mus musculus
gcctcctcaacagcaaacagttgga

SEQ ID NO: 554406 - DNA, 25 bp, Mus musculus
gcctcctcaaggaatgagaccccat

SEQ ID NO: 554407 - DNA, 25 bp, Mus musculus
gcctcctcaaggtatgagaccccat

SEQ ID NO: 554408 - DNA, 25 bp, Mus musculus
gcctcctcagagcaagacatcattg

SEQ ID NO: 554409 - DNA, 25 bp, Mus musculus
gcctcctcagaggaagacatcattg

SEQ ID NO: 554410 - DNA, 25 bp, Mus musculus
gcctcctcagttccactgattgaaa

SEQ ID NO: 554411 - DNA, 25 bp, Mus musculus
gcctcctcagttgcactgattgaaa

SEQ ID NO: 554412 - DNA, 25 bp, Mus musculus
gcctcctcctcaagtatattcttga

SEQ ID NO: 554413 - DNA, 25 bp, Mus musculus
gcctcctcctcatgtatattcttga

SEQ ID NO: 554414 - DNA, 25 bp, Mus musculus
gcctcctccttgaagggacagggtg

SEQ ID NO: 554415 - DNA, 25 bp, Mus musculus
gcctcctccttgaggaccgaaggaa

SEQ ID NO: 554416 - DNA, 25 bp, Mus musculus
gcctcctccttgtagggacagggtg

SEQ ID NO: 554417 - DNA, 25 bp, Mus musculus
gcctcctccttgtggaccgaaggaa

SEQ ID NO: 554418 - DNA, 25 bp, Mus musculus
gcctcctcggaacctgactttagaa

SEQ ID NO: 554419 - DNA, 25 bp, Mus musculus
gcctcctcggaagctgactttagaa

SEQ ID NO: 554420 - DNA, 25 bp, Mus musculus
gcctcctcgggccaataaactgatg

SEQ ID NO: 554421 - DNA, 25 bp, Mus musculus
gcctcctcgggcgaataaactgatg

SEQ ID NO: 554422 - DNA, 25 bp, Mus musculus
gcctcctctacccaactggaataaa

SEQ ID NO: 554423 - DNA, 25 bp, Mus musculus
gcctcctctaccgaactggaataaa

SEQ ID NO: 554424 - DNA, 25 bp, Mus musculus
gcctcctctagcctaaacaggaaag

SEQ ID NO: 554425 - DNA, 25 bp, Mus musculus
gcctcctctagcgtaaacaggaaag

SEQ ID NO: 554426 - DNA, 25 bp, Mus musculus
gcctcctctattaccttgggtagaa

SEQ ID NO: 554427 - DNA, 25 bp, Mus musculus
gcctcctctatttccttgggtagaa

SEQ ID NO: 554428 - DNA, 25 bp, Mus musculus
gcctcctctcgaaccatgtgtagaa

SEQ ID NO: 554429 - DNA, 25 bp, Mus musculus
gcctcctctcgatccatgtgtagaa

SEQ ID NO: 554430 - DNA, 25 bp, Mus musculus
gcctcctctctgagcttgcatgaag

SEQ ID NO: 554431 - DNA, 25 bp, Mus musculus
gcctcctctctgtgcttgcatgaag

SEQ ID NO: 554432 - DNA, 25 bp, Mus musculus
gcctcctctgctcgtgtgatgataa

SEQ ID NO: 554433 - DNA, 25 bp, Mus musculus
gcctcctctgctggtgtgatgataa

SEQ ID NO: 554434 - DNA, 25 bp, Mus musculus
gcctcctctgtcctaaggtagaagg

SEQ ID NO: 554435 - DNA, 25 bp, Mus musculus
gcctcctctgtcgtaaggtagaagg

SEQ ID NO: 554436 - DNA, 25 bp, Mus musculus
gcctcctgacccagaatcattgtga

SEQ ID NO: 554437 - DNA, 25 bp, Mus musculus
gcctcctgaccctgaatcattgtga

SEQ ID NO: 554438 - DNA, 25 bp, Mus musculus
gcctcctgagctacaaacacacaga

SEQ ID NO: 554439 - DNA, 25 bp, Mus musculus
gcctcctgagcttcaaacacacaga

SEQ ID NO: 554440 - DNA, 25 bp, Mus musculus
gcctcctgagtaccttcaactacag

SEQ ID NO: 554441 - DNA, 25 bp, Mus musculus
gcctcctgagtagcttcaactacag

SEQ ID NO: 554442 - DNA, 25 bp, Mus musculus
gcctcctgagttacctggcacagaa

SEQ ID NO: 554443 - DNA, 25 bp, Mus musculus
gcctcctgagtttcctggcacagaa

SEQ ID NO: 554444 - DNA, 25 bp, Mus musculus
gcctcctgatatatttgatggtgca

SEQ ID NO: 554445 - DNA, 25 bp, Mus musculus
gcctcctgatatttttgatggtgca

SEQ ID NO: 554446 - DNA, 25 bp, Mus musculus
gcctcctgatgcatcaaacaatacc

SEQ ID NO: 554447 - DNA, 25 bp, Mus musculus
gcctcctgatgcttcaaacaatacc

SEQ ID NO: 554448 - DNA, 25 bp, Mus musculus
gcctcctgatgtatgagcctcatta

SEQ ID NO: 554449 - DNA, 25 bp, Mus musculus
gcctcctgatgtttgagcctcatta

SEQ ID NO: 554450 - DNA, 25 bp, Mus musculus
gcctcctgatttaatctttacgatg

SEQ ID NO: 554451 - DNA, 25 bp, Mus musculus
gcctcctgattttatctttacgatg

SEQ ID NO: 554452 - DNA, 25 bp, Mus musculus
gcctcctgcacccagagagatggaa

SEQ ID NO: 554453 - DNA, 25 bp, Mus musculus
gcctcctgcaccgagagagatggaa

SEQ ID NO: 554454 - DNA, 25 bp, Mus musculus
gcctcctgcagaacggtttaatttg

SEQ ID NO: 554455 - DNA, 25 bp, Mus musculus
gcctcctgcagatcggtttaatttg

SEQ ID NO: 554456 - DNA, 25 bp, Mus musculus
gcctcctgccagcttgaagggacag

SEQ ID NO: 554457 - DNA, 25 bp, Mus musculus
gcctcctgccaggttgaagggacag

SEQ ID NO: 554458 - DNA, 25 bp, Mus musculus
gcctcctgctatcggagccatgctg

SEQ ID NO: 554459 - DNA, 25 bp, Mus musculus
gcctcctgctatgggagccatgctg

SEQ ID NO: 554460 - DNA, 25 bp, Mus musculus
gcctcctgcttcagtaatatttaaa

SEQ ID NO: 554461 - DNA, 25 bp, Mus musculus
gcctcctgcttctgtaatatttaaa

SEQ ID NO: 554462 - DNA, 25 bp, Mus musculus
gcctcctgctttcttatttggtgta

SEQ ID NO: 554463 - DNA, 25 bp, Mus musculus
gcctcctgctttgttatttggtgta

SEQ ID NO: 554464 - DNA, 25 bp, Mus musculus
gcctcctggaagaccaatcattggg

SEQ ID NO: 554465 - DNA, 25 bp, Mus musculus
gcctcctggaagtccaatcattggg

SEQ ID NO: 554466 - DNA, 25 bp, Mus musculus
gcctcctggagcatatgatgcgtta

SEQ ID NO: 554467 - DNA, 25 bp, Mus musculus
gcctcctggagcttatgatgcgtta

SEQ ID NO: 554468 - DNA, 25 bp, Mus musculus
gcctcctggcctacaagaactggga

SEQ ID NO: 554469 - DNA, 25 bp, Mus musculus
gcctcctggccttcaagaactggga

SEQ ID NO: 554470 - DNA, 25 bp, Mus musculus
gcctcctgtcagacattgttgactg

SEQ ID NO: 554471 - DNA, 25 bp, Mus musculus
gcctcctgtcagtcattgttgactg

SEQ ID NO: 554472 - DNA, 25 bp, Mus musculus
gcctcctgtgggaacctggacattg

SEQ ID NO: 554473 - DNA, 25 bp, Mus musculus
gcctcctgtgggtacctggacattg

SEQ ID NO: 554474 - DNA, 25 bp, Mus musculus
gcctccttaaagatgcagtgccgca

SEQ ID NO: 554475 - DNA, 25 bp, Mus musculus
gcctccttaaagttgcagtgccgca

SEQ ID NO: 554476 - DNA, 25 bp, Mus musculus
gcctccttaggtcttagtgcttaga

SEQ ID NO: 554477 - DNA, 25 bp, Mus musculus
gcctccttaggtgttagtgcttaga

SEQ ID NO: 554478 - DNA, 25 bp, Mus musculus
gcctccttcagaaatatgtctggct

SEQ ID NO: 554479 - DNA, 25 bp, Mus musculus
gcctccttcagatatatgtctggct

SEQ ID NO: 554480 - DNA, 25 bp, Mus musculus
gcctccttcaggacacttgcagaag

SEQ ID NO: 554481 - DNA, 25 bp, Mus musculus
gcctccttcaggtcacttgcagaag

SEQ ID NO: 554482 - DNA, 25 bp, Mus musculus
gcctccttccaaagaatatttggaa

SEQ ID NO: 554483 - DNA, 25 bp, Mus musculus
gcctccttccaatgaatatttggaa

SEQ ID NO: 554484 - DNA, 25 bp, Mus musculus
gcctccttctggaatgtgacaaaaa

SEQ ID NO: 554485 - DNA, 25 bp, Mus musculus
gcctccttctggtatgtgacaaaaa

SEQ ID NO: 554486 - DNA, 25 bp, Mus musculus
gcctccttgcacaaagtcttgttat

SEQ ID NO: 554487 - DNA, 25 bp, Mus musculus
gcctccttgcactaagtcttgttat

SEQ ID NO: 554488 - DNA, 25 bp, Mus musculus
gcctccttgctcctgtccagtggtg

SEQ ID NO: 554489 - DNA, 25 bp, Mus musculus
gcctccttgctcgtgtccagtggtg

SEQ ID NO: 554490 - DNA, 25 bp, Mus musculus
gcctccttggacattatgggaactg

SEQ ID NO: 554491 - DNA, 25 bp, Mus musculus
gcctccttggaccagtttcgaagtg

SEQ ID NO: 554492 - DNA, 25 bp, Mus musculus
gcctccttggacgagtttcgaagtg

SEQ ID NO: 554493 - DNA, 25 bp, Mus musculus
gcctccttggactttatgggaactg

SEQ ID NO: 554494 - DNA, 25 bp, Mus musculus
gcctccttggtaagccaggtgtcaa

SEQ ID NO: 554495 - DNA, 25 bp, Mus musculus
gcctccttggtatgccaggtgtcaa

SEQ ID NO: 554496 - DNA, 25 bp, Mus musculus
gcctccttggtgagtcactggtaca

SEQ ID NO: 554497 - DNA, 25 bp, Mus musculus
gcctccttggtgtgtcactggtaca

SEQ ID NO: 554498 - DNA, 25 bp, Mus musculus
gcctccttgtacatagtgtcacaga

SEQ ID NO: 554499 - DNA, 25 bp, Mus musculus
gcctccttgtaccataagtagctgt

SEQ ID NO: 554500 - DNA, 25 bp, Mus musculus
gcctccttgtacgataagtagctgt

SEQ ID NO: 554501 - DNA, 25 bp, Mus musculus
gcctccttgtacttagtgtcacaga

SEQ ID NO: 554502 - DNA, 25 bp, Mus musculus
gcctccttgtataggtttacactgt

SEQ ID NO: 554503 - DNA, 25 bp, Mus musculus
gcctccttgtattggtttacactgt

SEQ ID NO: 554504 - DNA, 25 bp, Mus musculus
gcctcctttgccagaaatcccgaaa

SEQ ID NO: 554505 - DNA, 25 bp, Mus musculus
gcctcctttgcctgaaatcccgaaa

SEQ ID NO: 554506 - DNA, 25 bp, Mus musculus
gcctcctttggaactcccagggttc

SEQ ID NO: 554507 - DNA, 25 bp, Mus musculus
gcctcctttggatctcccagggttc

SEQ ID NO: 554508 - DNA, 25 bp, Mus musculus
gcctcctttgtacccacggtaaata

SEQ ID NO: 554509 - DNA, 25 bp, Mus musculus
gcctcctttgtagccacggtaaata

SEQ ID NO: 554510 - DNA, 25 bp, Mus musculus
gcctccttttacactgagctgtgaa

SEQ ID NO: 554511 - DNA, 25 bp, Mus musculus
gcctccttttactctgagctgtgaa

SEQ ID NO: 554512 - DNA, 25 bp, Mus musculus
gcctcgaactcacacatcagggatt

SEQ ID NO: 554513 - DNA, 25 bp, Mus musculus
gcctcgaactcacgagtagatcagg

SEQ ID NO: 554514 - DNA, 25 bp, Mus musculus
gcctcgaactcagacatcagggatt

SEQ ID NO: 554515 - DNA, 25 bp, Mus musculus
gcctcgaactcaggagtagatcagg

SEQ ID NO: 554516 - DNA, 25 bp, Mus musculus
gcctcgaaggtgaccgaacaggagt

SEQ ID NO: 554517 - DNA, 25 bp, Mus musculus
gcctcgaaggtgtccgaacaggagt

SEQ ID NO: 554518 - DNA, 25 bp, Mus musculus
gcctcgaccacaaatttaacttcat

SEQ ID NO: 554519 - DNA, 25 bp, Mus musculus
gcctcgaccacatatttaacttcat

SEQ ID NO: 554520 - DNA, 25 bp, Mus musculus
gcctcgaccgcccatgagttaggat

SEQ ID NO: 554521 - DNA, 25 bp, Mus musculus
gcctcgaccgccgatgagttaggat

SEQ ID NO: 554522 - DNA, 25 bp, Mus musculus
gcctcgacttctccacaataaggga

SEQ ID NO: 554523 - DNA, 25 bp, Mus musculus
gcctcgacttctgcacaataaggga

SEQ ID NO: 554524 - DNA, 25 bp, Mus musculus
gcctcgagaggtatctctacctcga

SEQ ID NO: 554525 - DNA, 25 bp, Mus musculus
gcctcgagaggtttctctacctcga

SEQ ID NO: 554526 - DNA, 25 bp, Mus musculus
gcctcgagcaagatggctgtggaca

SEQ ID NO: 554527 - DNA, 25 bp, Mus musculus
gcctcgagcaagttggctgtggaca

SEQ ID NO: 554528 - DNA, 25 bp, Mus musculus
gcctcgatgcccacaacggtgaata

SEQ ID NO: 554529 - DNA, 25 bp, Mus musculus
gcctcgatgccctcaacggtgaata

SEQ ID NO: 554530 - DNA, 25 bp, Mus musculus
gcctcgatgtccctctgaagggaat

SEQ ID NO: 554531 - DNA, 25 bp, Mus musculus
gcctcgatgtccgtctgaagggaat

SEQ ID NO: 554532 - DNA, 25 bp, Mus musculus
gcctcgatttcaaccagcagcagaa

SEQ ID NO: 554533 - DNA, 25 bp, Mus musculus
gcctcgatttcatccagcagcagaa

SEQ ID NO: 554534 - DNA, 25 bp, Mus musculus
gcctcgccagccctgaagtggaaaa

SEQ ID NO: 554535 - DNA, 25 bp, Mus musculus
gcctcgccagccgtgaagtggaaaa

SEQ ID NO: 554536 - DNA, 25 bp, Mus musculus
gcctcgccctggaaagaccctgtaa

SEQ ID NO: 554537 - DNA, 25 bp, Mus musculus
gcctcgccctggtaagaccctgtaa

SEQ ID NO: 554538 - DNA, 25 bp, Mus musculus
gcctcgccgctaaccatcagtgtgt

SEQ ID NO: 554539 - DNA, 25 bp, Mus musculus
gcctcgccgctatccatcagtgtgt

SEQ ID NO: 554540 - DNA, 25 bp, Mus musculus
gcctcgcgaggaaatgaccaagaaa

SEQ ID NO: 554541 - DNA, 25 bp, Mus musculus
gcctcgcgaggatatgaccaagaaa

SEQ ID NO: 554542 - DNA, 25 bp, Mus musculus
gcctcgctataaatatgcccatgat

SEQ ID NO: 554543 - DNA, 25 bp, Mus musculus
gcctcgctataattatgcccatgat

SEQ ID NO: 554544 - DNA, 25 bp, Mus musculus
gcctcgctccaaaaaaggattcaca

SEQ ID NO: 554545 - DNA, 25 bp, Mus musculus
gcctcgctccaataaaggattcaca

SEQ ID NO: 554546 - DNA, 25 bp, Mus musculus
gcctcgctcctgctaaacggtagaa

SEQ ID NO: 554547 - DNA, 25 bp, Mus musculus
gcctcgctcctggtaaacggtagaa

SEQ ID NO: 554548 - DNA, 25 bp, Mus musculus
gcctcgctgcgtattaccattgaat

SEQ ID NO: 554549 - DNA, 25 bp, Mus musculus
gcctcgctgcgttttaccattgaat

SEQ ID NO: 554550 - DNA, 25 bp, Mus musculus
gcctcgctgggcaactgtcagtcaa

SEQ ID NO: 554551 - DNA, 25 bp, Mus musculus
gcctcgctgggctactgtcagtcaa

SEQ ID NO: 554552 - DNA, 25 bp, Mus musculus
gcctcgctttctattattacctatt

SEQ ID NO: 554553 - DNA, 25 bp, Mus musculus
gcctcgctttcttttattacctatt

SEQ ID NO: 554554 - DNA, 25 bp, Mus musculus
gcctcggacacaagcgcaggttgaa

SEQ ID NO: 554555 - DNA, 25 bp, Mus musculus
gcctcggacacatgcgcaggttgaa

SEQ ID NO: 554556 - DNA, 25 bp, Mus musculus
gcctcggatccaaaaagtacagtta

SEQ ID NO: 554557 - DNA, 25 bp, Mus musculus
gcctcggatccataaagtacagtta

SEQ ID NO: 554558 - DNA, 25 bp, Mus musculus
gcctcggatgctcgttacatttgat

SEQ ID NO: 554559 - DNA, 25 bp, Mus musculus
gcctcggatgctggttacatttgat

SEQ ID NO: 554560 - DNA, 25 bp, Mus musculus
gcctcggcacagattcaagtcccta

SEQ ID NO: 554561 - DNA, 25 bp, Mus musculus
gcctcggcacagtttcaagtcccta

SEQ ID NO: 554562 - DNA, 25 bp, Mus musculus
gcctcggcagagagtcccagtgacg

SEQ ID NO: 554563 - DNA, 25 bp, Mus musculus
gcctcggcagagtgtcccagtgacg

SEQ ID NO: 554564 - DNA, 25 bp, Mus musculus
gcctcggcgcttcctgaagaaatca

SEQ ID NO: 554565 - DNA, 25 bp, Mus musculus
gcctcggcgcttgctgaagaaatca

SEQ ID NO: 554566 - DNA, 25 bp, Mus musculus
gcctcggcgggcagagaccttcggg

SEQ ID NO: 554567 - DNA, 25 bp, Mus musculus
gcctcggcgggctgagaccttcggg

SEQ ID NO: 554568 - DNA, 25 bp, Mus musculus
gcctcggcttataggcagagactga

SEQ ID NO: 554569 - DNA, 25 bp, Mus musculus
gcctcggcttattggcagagactga

SEQ ID NO: 554570 - DNA, 25 bp, Mus musculus
gcctcgggaaatctacacagccaaa

SEQ ID NO: 554571 - DNA, 25 bp, Mus musculus
gcctcgggaaatgtacacagccaaa

SEQ ID NO: 554572 - DNA, 25 bp, Mus musculus
gcctcgggacgcaatttattattca

SEQ ID NO: 554573 - DNA, 25 bp, Mus musculus
gcctcgggacgctatttattattca

SEQ ID NO: 554574 - DNA, 25 bp, Mus musculus
gcctcggtattgactctttgggaat

SEQ ID NO: 554575 - DNA, 25 bp, Mus musculus
gcctcggtattgtctctttgggaat

SEQ ID NO: 554576 - DNA, 25 bp, Mus musculus
gcctcggtcaacaagccatttatca

SEQ ID NO: 554577 - DNA, 25 bp, Mus musculus
gcctcggtcaactagccatttatca

SEQ ID NO: 554578 - DNA, 25 bp, Mus musculus
gcctcggtgaatcttagcgtttact

SEQ ID NO: 554579 - DNA, 25 bp, Mus musculus
gcctcggtgaatgttagcgtttact

SEQ ID NO: 554580 - DNA, 25 bp, Mus musculus
gcctcggtggctcgttaacgtctca

SEQ ID NO: 554581 - DNA, 25 bp, Mus musculus
gcctcggtggctggttaacgtctca

SEQ ID NO: 554582 - DNA, 25 bp, Mus musculus
gcctcggttagactactgaacaatc

SEQ ID NO: 554583 - DNA, 25 bp, Mus musculus
gcctcggttagagtactgaacaatc

SEQ ID NO: 554584 - DNA, 25 bp, Mus musculus
gcctcggttctcatttctataacat

SEQ ID NO: 554585 - DNA, 25 bp, Mus musculus
gcctcggttctcttttctataacat

SEQ ID NO: 554586 - DNA, 25 bp, Mus musculus
gcctcggtttgccatctgtgggaac

SEQ ID NO: 554587 - DNA, 25 bp, Mus musculus
gcctcggtttgcgatctgtgggaac

SEQ ID NO: 554588 - DNA, 25 bp, Mus musculus
gcctcggttttcatgtggatttatc

SEQ ID NO: 554589 - DNA, 25 bp, Mus musculus
gcctcggttttcttgtggatttatc

SEQ ID NO: 554590 - DNA, 25 bp, Mus musculus
gcctcgtaaacccaaggatattctg

SEQ ID NO: 554591 - DNA, 25 bp, Mus musculus
gcctcgtaaaccgaaggatattctg

SEQ ID NO: 554592 - DNA, 25 bp, Mus musculus
gcctcgtattttactcacgtatatt

SEQ ID NO: 554593 - DNA, 25 bp, Mus musculus
gcctcgtatttttctcacgtatatt

SEQ ID NO: 554594 - DNA, 25 bp, Mus musculus
gcctcgtccttcagactttatcaag

SEQ ID NO: 554595 - DNA, 25 bp, Mus musculus
gcctcgtccttctgactttatcaag

SEQ ID NO: 554596 - DNA, 25 bp, Mus musculus
gcctcgtgaaaaactctgggtgctt

SEQ ID NO: 554597 - DNA, 25 bp, Mus musculus
gcctcgtgaaaatctctgggtgctt

SEQ ID NO: 554598 - DNA, 25 bp, Mus musculus
gcctcgtgactacacctgtttttaa

SEQ ID NO: 554599 - DNA, 25 bp, Mus musculus
gcctcgtgactagacctgtttttaa

SEQ ID NO: 554600 - DNA, 25 bp, Mus musculus
gcctcgtgcataagttaaagcttat

SEQ ID NO: 554601 - DNA, 25 bp, Mus musculus
gcctcgtgcatatgttaaagcttat

SEQ ID NO: 554602 - DNA, 25 bp, Mus musculus
gcctcgtggaaaagttatgccctat

SEQ ID NO: 554603 - DNA, 25 bp, Mus musculus
gcctcgtggaaatgttatgccctat

SEQ ID NO: 554604 - DNA, 25 bp, Mus musculus
gcctcgtggagtctgtcttgcttct

SEQ ID NO: 554605 - DNA, 25 bp, Mus musculus
gcctcgtggagtgtgtcttgcttct

SEQ ID NO: 554606 - DNA, 25 bp, Mus musculus
gcctcgtggtgaacctctttaggaa

SEQ ID NO: 554607 - DNA, 25 bp, Mus musculus
gcctcgtggtgatcctctttaggaa

SEQ ID NO: 554608 - DNA, 25 bp, Mus musculus
gcctcgtggttgaagcttttagtac

SEQ ID NO: 554609 - DNA, 25 bp, Mus musculus
gcctcgtggttgtagcttttagtac

SEQ ID NO: 554610 - DNA, 25 bp, Mus musculus
gcctcgtgtggtcatatgtatctat

SEQ ID NO: 554611 - DNA, 25 bp, Mus musculus
gcctcgtgtggtgatatgtatctat

SEQ ID NO: 554612 - DNA, 25 bp, Mus musculus
gcctcgtgtgtaaaaactctcattt

SEQ ID NO: 554613 - DNA, 25 bp, Mus musculus
gcctcgtgtgtataaactctcattt

SEQ ID NO: 554614 - DNA, 25 bp, Mus musculus
gcctcgttcaaccacatgggcagga

SEQ ID NO: 554615 - DNA, 25 bp, Mus musculus
gcctcgttcaacgacatgggcagga

SEQ ID NO: 554616 - DNA, 25 bp, Mus musculus
gcctcgttctttatcacagctgtga

SEQ ID NO: 554617 - DNA, 25 bp, Mus musculus
gcctcgttctttttcacagctgtga

SEQ ID NO: 554618 - DNA, 25 bp, Mus musculus
gcctcgttggttacacagtgtcata

SEQ ID NO: 554619 - DNA, 25 bp, Mus musculus
gcctcgttggtttcacagtgtcata

SEQ ID NO: 554620 - DNA, 25 bp, Mus musculus
gcctcgttttacaatacacttagag

SEQ ID NO: 554621 - DNA, 25 bp, Mus musculus
gcctcgttttactatacacttagag

SEQ ID NO: 554622 - DNA, 25 bp, Mus musculus
gcctcgtttttcagaagttacctct

SEQ ID NO: 554623 - DNA, 25 bp, Mus musculus
gcctcgtttttctgaagttacctct

SEQ ID NO: 554624 - DNA, 25 bp, Mus musculus
gcctctaaagcacacggctctagtt

SEQ ID NO: 554625 - DNA, 25 bp, Mus musculus
gcctctaaagcagacggctctagtt

SEQ ID NO: 554626 - DNA, 25 bp, Mus musculus
gcctctaaagggatcagatatatta

SEQ ID NO: 554627 - DNA, 25 bp, Mus musculus
gcctctaaagggttcagatatatta

SEQ ID NO: 554628 - DNA, 25 bp, Mus musculus
gcctctaaagtgagtgtttcccgaa

SEQ ID NO: 554629 - DNA, 25 bp, Mus musculus
gcctctaaagtgtgtgtttcccgaa

SEQ ID NO: 554630 - DNA, 25 bp, Mus musculus
gcctctaacgagctttctgtgatga

SEQ ID NO: 554631 - DNA, 25 bp, Mus musculus
gcctctaacgaggtttctgtgatga

SEQ ID NO: 554632 - DNA, 25 bp, Mus musculus
gcctctaaggttaggaagtcctcct

SEQ ID NO: 554633 - DNA, 25 bp, Mus musculus
gcctctaaggtttggaagtcctcct

SEQ ID NO: 554634 - DNA, 25 bp, Mus musculus
gcctctacaatcattctgaccttaa

SEQ ID NO: 554635 - DNA, 25 bp, Mus musculus
gcctctacaatctttctgaccttaa

SEQ ID NO: 554636 - DNA, 25 bp, Mus musculus
gcctctacagtaccttttctgattg

SEQ ID NO: 554637 - DNA, 25 bp, Mus musculus
gcctctacagtagcttttctgattg

SEQ ID NO: 554638 - DNA, 25 bp, Mus musculus
gcctctacagtcataggaccctgtg

SEQ ID NO: 554639 - DNA, 25 bp, Mus musculus
gcctctacagtcttaggaccctgtg

SEQ ID NO: 554640 - DNA, 25 bp, Mus musculus
gcctctaccaacattgctctggaat

SEQ ID NO: 554641 - DNA, 25 bp, Mus musculus
gcctctaccaactttgctctggaat

SEQ ID NO: 554642 - DNA, 25 bp, Mus musculus
gcctctacccacaatgtactaggat

SEQ ID NO: 554643 - DNA, 25 bp, Mus musculus
gcctctacccactatgtactaggat

SEQ ID NO: 554644 - DNA, 25 bp, Mus musculus
gcctctacccatccagaacagttag

SEQ ID NO: 554645 - DNA, 25 bp, Mus musculus
gcctctacccatgcagaacagttag

SEQ ID NO: 554646 - DNA, 25 bp, Mus musculus
gcctctaccctgatgtcaatgctga

SEQ ID NO: 554647 - DNA, 25 bp, Mus musculus
gcctctaccctgttgtcaatgctga

SEQ ID NO: 554648 - DNA, 25 bp, Mus musculus
gcctctacctccaactgtgaaaaag

SEQ ID NO: 554649 - DNA, 25 bp, Mus musculus
gcctctacctcctactgtgaaaaag

SEQ ID NO: 554650 - DNA, 25 bp, Mus musculus
gcctctacctgtcaaaaggtggcct

SEQ ID NO: 554651 - DNA, 25 bp, Mus musculus
gcctctacctgtgaaaaggtggcct

SEQ ID NO: 554652 - DNA, 25 bp, Mus musculus
gcctctacgaagactgaagctctag

SEQ ID NO: 554653 - DNA, 25 bp, Mus musculus
gcctctacgaagtctgaagctctag

SEQ ID NO: 554654 - DNA, 25 bp, Mus musculus
gcctctacggttacacagtgtccaa

SEQ ID NO: 554655 - DNA, 25 bp, Mus musculus
gcctctacggtttcacagtgtccaa

SEQ ID NO: 554656 - DNA, 25 bp, Mus musculus
gcctctagaatgctttaaagcctaa

SEQ ID NO: 554657 - DNA, 25 bp, Mus musculus
gcctctagaatggtttaaagcctaa

SEQ ID NO: 554658 - DNA, 25 bp, Mus musculus
gcctctagaattataccacacacct

SEQ ID NO: 554659 - DNA, 25 bp, Mus musculus
gcctctagaattttaccacacacct

SEQ ID NO: 554660 - DNA, 25 bp, Mus musculus
gcctctagactaaattccctttgga

SEQ ID NO: 554661 - DNA, 25 bp, Mus musculus
gcctctagactatattccctttgga

SEQ ID NO: 554662 - DNA, 25 bp, Mus musculus
gcctctaggactctttgtatgaaaa

SEQ ID NO: 554663 - DNA, 25 bp, Mus musculus
gcctctaggactgtttgtatgaaaa

SEQ ID NO: 554664 - DNA, 25 bp, Mus musculus
gcctctaggaggatttgctgagctc

SEQ ID NO: 554665 - DNA, 25 bp, Mus musculus
gcctctaggaggttttgctgagctc

SEQ ID NO: 554666 - DNA, 25 bp, Mus musculus
gcctctagggtaccagcatgcacat

SEQ ID NO: 554667 - DNA, 25 bp, Mus musculus
gcctctagggtagcagcatgcacat

SEQ ID NO: 554668 - DNA, 25 bp, Mus musculus
gcctctagtctaaatatgtctgtca

SEQ ID NO: 554669 - DNA, 25 bp, Mus musculus
gcctctagtctatatatgtctgtca

SEQ ID NO: 554670 - DNA, 25 bp, Mus musculus
gcctctagtgcaaaaccttcttaat

SEQ ID NO: 554671 - DNA, 25 bp, Mus musculus
gcctctagtgcataaccttcttaat

SEQ ID NO: 554672 - DNA, 25 bp, Mus musculus
gcctctagtgtgatctgcctaaagt

SEQ ID NO: 554673 - DNA, 25 bp, Mus musculus
gcctctagtgtgttctgcctaaagt

SEQ ID NO: 554674 - DNA, 25 bp, Mus musculus
gcctctatacccactgaatggtcaa

SEQ ID NO: 554675 - DNA, 25 bp, Mus musculus
gcctctataccctctgaatggtcaa

SEQ ID NO: 554676 - DNA, 25 bp, Mus musculus
gcctctatataacgccggcgcaggg

SEQ ID NO: 554677 - DNA, 25 bp, Mus musculus
gcctctatataaggccggcgcaggg

SEQ ID NO: 554678 - DNA, 25 bp, Mus musculus
gcctctatcagcctccagattgaag

SEQ ID NO: 554679 - DNA, 25 bp, Mus musculus
gcctctatcagcgtccagattgaag

SEQ ID NO: 554680 - DNA, 25 bp, Mus musculus
gcctctatctctcagttgtcattaa

SEQ ID NO: 554681 - DNA, 25 bp, Mus musculus
gcctctatctctgagttgtcattaa

SEQ ID NO: 554682 - DNA, 25 bp, Mus musculus
gcctctatgttaattctcacgcatc

SEQ ID NO: 554683 - DNA, 25 bp, Mus musculus
gcctctatgttatttctcacgcatc

SEQ ID NO: 554684 - DNA, 25 bp, Mus musculus
gcctctattccaacacttgagaatt

SEQ ID NO: 554685 - DNA, 25 bp, Mus musculus
gcctctattccatcacttgagaatt

SEQ ID NO: 554686 - DNA, 25 bp, Mus musculus
gcctctatttgtcggcagttggttt

SEQ ID NO: 554687 - DNA, 25 bp, Mus musculus
gcctctatttgtgggcagttggttt

SEQ ID NO: 554688 - DNA, 25 bp, Mus musculus
gcctctcaaacgcttgggatttcag

SEQ ID NO: 554689 - DNA, 25 bp, Mus musculus
gcctctcaaacggttgggatttcag

SEQ ID NO: 554690 - DNA, 25 bp, Mus musculus
gcctctcaaactccaggtgctgtga

SEQ ID NO: 554691 - DNA, 25 bp, Mus musculus
gcctctcaaactgcaggtgctgtga

SEQ ID NO: 554692 - DNA, 25 bp, Mus musculus
gcctctcaagcgcttcagcatggaa

SEQ ID NO: 554693 - DNA, 25 bp, Mus musculus
gcctctcaagcggttcagcatggaa

SEQ ID NO: 554694 - DNA, 25 bp, Mus musculus
gcctctcactctataatgactgggt

SEQ ID NO: 554695 - DNA, 25 bp, Mus musculus
gcctctcactctttaatgactgggt

SEQ ID NO: 554696 - DNA, 25 bp, Mus musculus
gcctctcactgtagtgtcagagcta

SEQ ID NO: 554697 - DNA, 25 bp, Mus musculus
gcctctcactgttgtgtcagagcta

SEQ ID NO: 554698 - DNA, 25 bp, Mus musculus
gcctctcagagtagaatctcaggga

SEQ ID NO: 554699 - DNA, 25 bp, Mus musculus
gcctctcagagttgaatctcaggga

SEQ ID NO: 554700 - DNA, 25 bp, Mus musculus
gcctctcagatgattgcattttgcg

SEQ ID NO: 554701 - DNA, 25 bp, Mus musculus
gcctctcagatgtttgcattttgcg

SEQ ID NO: 554702 - DNA, 25 bp, Mus musculus
gcctctcaggaaaatgctttgtcta

SEQ ID NO: 554703 - DNA, 25 bp, Mus musculus
gcctctcaggaatatgctttgtcta

SEQ ID NO: 554704 - DNA, 25 bp, Mus musculus
gcctctcagttacattttcactttc

SEQ ID NO: 554705 - DNA, 25 bp, Mus musculus
gcctctcagttagattttcactttc

SEQ ID NO: 554706 - DNA, 25 bp, Mus musculus
gcctctcatcacctacagcaatgaa

SEQ ID NO: 554707 - DNA, 25 bp, Mus musculus
gcctctcatcacgtacagcaatgaa

SEQ ID NO: 554708 - DNA, 25 bp, Mus musculus
gcctctcatggtcagcgtggataga

SEQ ID NO: 554709 - DNA, 25 bp, Mus musculus
gcctctcatggtgagcgtggataga

SEQ ID NO: 554710 - DNA, 25 bp, Mus musculus
gcctctccacacaaatggcttttaa

SEQ ID NO: 554711 - DNA, 25 bp, Mus musculus
gcctctccacactaatggcttttaa

SEQ ID NO: 554712 - DNA, 25 bp, Mus musculus
gcctctcccgggactttgcagcttc

SEQ ID NO: 554713 - DNA, 25 bp, Mus musculus
gcctctcccgggtctttgcagcttc

SEQ ID NO: 554714 - DNA, 25 bp, Mus musculus
gcctctcctggaagaagcatagcca

SEQ ID NO: 554715 - DNA, 25 bp, Mus musculus
gcctctcctggatgaagcatagcca

SEQ ID NO: 554716 - DNA, 25 bp, Mus musculus
gcctctcctttacatacatttcttc

SEQ ID NO: 554717 - DNA, 25 bp, Mus musculus
gcctctcctttagatacatttcttc

SEQ ID NO: 554718 - DNA, 25 bp, Mus musculus
gcctctcgactcaacattcaattag

SEQ ID NO: 554719 - DNA, 25 bp, Mus musculus
gcctctcgactctacattcaattag

SEQ ID NO: 554720 - DNA, 25 bp, Mus musculus
gcctctcgccacatagtgatatctg

SEQ ID NO: 554721 - DNA, 25 bp, Mus musculus
gcctctcgccacttagtgatatctg

SEQ ID NO: 554722 - DNA, 25 bp, Mus musculus
gcctctctaagaatgcagctactgt

SEQ ID NO: 554723 - DNA, 25 bp, Mus musculus
gcctctctaagattgcagctactgt

SEQ ID NO: 554724 - DNA, 25 bp, Mus musculus
gcctctctactcaggaacttgcaga

SEQ ID NO: 554725 - DNA, 25 bp, Mus musculus
gcctctctactctggaacttgcaga

SEQ ID NO: 554726 - DNA, 25 bp, Mus musculus
gcctctctaggcaccgggaaagcag

SEQ ID NO: 554727 - DNA, 25 bp, Mus musculus
gcctctctaggctccgggaaagcag

SEQ ID NO: 554728 - DNA, 25 bp, Mus musculus
gcctctctatagcaaattttggtta

SEQ ID NO: 554729 - DNA, 25 bp, Mus musculus
gcctctctataggaaattttggtta

SEQ ID NO: 554730 - DNA, 25 bp, Mus musculus
gcctctctcagaccctacaggagtt

SEQ ID NO: 554731 - DNA, 25 bp, Mus musculus
gcctctctcagagcctacaggagtt

SEQ ID NO: 554732 - DNA, 25 bp, Mus musculus
gcctctctcaggaaagccattttat

SEQ ID NO: 554733 - DNA, 25 bp, Mus musculus
gcctctctcaggtaagccattttat

SEQ ID NO: 554734 - DNA, 25 bp, Mus musculus
gcctctctccatcagtactgtattg

SEQ ID NO: 554735 - DNA, 25 bp, Mus musculus
gcctctctccatgagtactgtattg

SEQ ID NO: 554736 - DNA, 25 bp, Mus musculus
gcctctctctgaactgtgatctttg

SEQ ID NO: 554737 - DNA, 25 bp, Mus musculus
gcctctctctgatctgtgatctttg

SEQ ID NO: 554738 - DNA, 25 bp, Mus musculus
gcctctctcttaccatacaaagcat

SEQ ID NO: 554739 - DNA, 25 bp, Mus musculus
gcctctctcttagcatacaaagcat

SEQ ID NO: 554740 - DNA, 25 bp, Mus musculus
gcctctctctttcgactttgcagga

SEQ ID NO: 554741 - DNA, 25 bp, Mus musculus
gcctctctctttggactttgcagga

SEQ ID NO: 554742 - DNA, 25 bp, Mus musculus
gcctctctgagtcgaaatcttattt

SEQ ID NO: 554743 - DNA, 25 bp, Mus musculus
gcctctctgagtggaaatcttattt

SEQ ID NO: 554744 - DNA, 25 bp, Mus musculus
gcctctctgattacagctcactaga

SEQ ID NO: 554745 - DNA, 25 bp, Mus musculus
gcctctctgatttcagctcactaga

SEQ ID NO: 554746 - DNA, 25 bp, Mus musculus
gcctctctggaactgtgcctacgaa

SEQ ID NO: 554747 - DNA, 25 bp, Mus musculus
gcctctctggaagtgtgcctacgaa

SEQ ID NO: 554748 - DNA, 25 bp, Mus musculus
gcctctctggacaggtctcattgaa

SEQ ID NO: 554749 - DNA, 25 bp, Mus musculus
gcctctctggactggtctcattgaa

SEQ ID NO: 554750 - DNA, 25 bp, Mus musculus
gcctctctgggcactatactcaagt

SEQ ID NO: 554751 - DNA, 25 bp, Mus musculus
gcctctctgggctctatactcaagt

SEQ ID NO: 554752 - DNA, 25 bp, Mus musculus
gcctctctgggtcgttcctaaagag

SEQ ID NO: 554753 - DNA, 25 bp, Mus musculus
gcctctctgggtggttcctaaagag

SEQ ID NO: 554754 - DNA, 25 bp, Mus musculus
gcctctctgtgccatgaaatgctag

SEQ ID NO: 554755 - DNA, 25 bp, Mus musculus
gcctctctgtgcgatgaaatgctag

SEQ ID NO: 554756 - DNA, 25 bp, Mus musculus
gcctctcttggaccaaatgatgaag

SEQ ID NO: 554757 - DNA, 25 bp, Mus musculus
gcctctcttggagcaaatgatgaag

SEQ ID NO: 554758 - DNA, 25 bp, Mus musculus
gcctctctttgcagcatttgttatg

SEQ ID NO: 554759 - DNA, 25 bp, Mus musculus
gcctctctttgctgcatttgttatg

SEQ ID NO: 554760 - DNA, 25 bp, Mus musculus
gcctctgaaaaacaggttccctttg

SEQ ID NO: 554761 - DNA, 25 bp, Mus musculus
gcctctgaaaaagaggttccctttg

SEQ ID NO: 554762 - DNA, 25 bp, Mus musculus
gcctctgaaacaacacagctctgtg

SEQ ID NO: 554763 - DNA, 25 bp, Mus musculus
gcctctgaaacatcacagctctgtg

SEQ ID NO: 554764 - DNA, 25 bp, Mus musculus
gcctctgaagtgatatatgcaccat

SEQ ID NO: 554765 - DNA, 25 bp, Mus musculus
gcctctgaagtgttatatgcaccat

SEQ ID NO: 554766 - DNA, 25 bp, Mus musculus
gcctctgaatttcctggcattgtga

SEQ ID NO: 554767 - DNA, 25 bp, Mus musculus
gcctctgaatttgctggcattgtga

SEQ ID NO: 554768 - DNA, 25 bp, Mus musculus
gcctctgacatgcttagcaagcatt

SEQ ID NO: 554769 - DNA, 25 bp, Mus musculus
gcctctgacatggttagcaagcatt

SEQ ID NO: 554770 - DNA, 25 bp, Mus musculus
gcctctgacccaaaagtactggaat

SEQ ID NO: 554771 - DNA, 25 bp, Mus musculus
gcctctgacccataagtactggaat

SEQ ID NO: 554772 - DNA, 25 bp, Mus musculus
gcctctgacccgcatggaaatggga

SEQ ID NO: 554773 - DNA, 25 bp, Mus musculus
gcctctgacccggatggaaatggga

SEQ ID NO: 554774 - DNA, 25 bp, Mus musculus
gcctctgacgtaaatcaggcgtgat

SEQ ID NO: 554775 - DNA, 25 bp, Mus musculus
gcctctgacgtatatcaggcgtgat

SEQ ID NO: 554776 - DNA, 25 bp, Mus musculus
gcctctgactcactggtcatttttt

SEQ ID NO: 554777 - DNA, 25 bp, Mus musculus
gcctctgactcagtggtcatttttt

SEQ ID NO: 554778 - DNA, 25 bp, Mus musculus
gcctctgactttcctgactcagaaa

SEQ ID NO: 554779 - DNA, 25 bp, Mus musculus
gcctctgactttgctgactcagaaa

SEQ ID NO: 554780 - DNA, 25 bp, Mus musculus
gcctctgagaaccatatttcctttg

SEQ ID NO: 554781 - DNA, 25 bp, Mus musculus
gcctctgagaacgatatttcctttg

SEQ ID NO: 554782 - DNA, 25 bp, Mus musculus
gcctctgagcaactttctttccagt

SEQ ID NO: 554783 - DNA, 25 bp, Mus musculus
gcctctgagcaagtttctttccagt

SEQ ID NO: 554784 - DNA, 25 bp, Mus musculus
gcctctgagggcagcagtacatcat

SEQ ID NO: 554785 - DNA, 25 bp, Mus musculus
gcctctgagggctgcagtacatcat

SEQ ID NO: 554786 - DNA, 25 bp, Mus musculus
gcctctgaggtaaagtagctacgct

SEQ ID NO: 554787 - DNA, 25 bp, Mus musculus
gcctctgaggtatagtagctacgct

SEQ ID NO: 554788 - DNA, 25 bp, Mus musculus
gcctctgaggtcactgtccagtaaa

SEQ ID NO: 554789 - DNA, 25 bp, Mus musculus
gcctctgaggtctctgtccagtaaa

SEQ ID NO: 554790 - DNA, 25 bp, Mus musculus
gcctctgagtaactgatgatcctat

SEQ ID NO: 554791 - DNA, 25 bp, Mus musculus
gcctctgagtaagtgatgatcctat

SEQ ID NO: 554792 - DNA, 25 bp, Mus musculus
gcctctgagtagcagtagaagacca

SEQ ID NO: 554793 - DNA, 25 bp, Mus musculus
gcctctgagtaggagtagaagacca

SEQ ID NO: 554794 - DNA, 25 bp, Mus musculus
gcctctgagtctctgattaagcaga

SEQ ID NO: 554795 - DNA, 25 bp, Mus musculus
gcctctgagtctgtgattaagcaga

SEQ ID NO: 554796 - DNA, 25 bp, Mus musculus
gcctctgcaaatcgagctgaagtcc

SEQ ID NO: 554797 - DNA, 25 bp, Mus musculus
gcctctgcaaatggagctgaagtcc

SEQ ID NO: 554798 - DNA, 25 bp, Mus musculus
gcctctgcaaccatgtatgctggag

SEQ ID NO: 554799 - DNA, 25 bp, Mus musculus
gcctctgcaaccttgtatgctggag

SEQ ID NO: 554800 - DNA, 25 bp, Mus musculus
gcctctgcaggaaacctcaagtctg

SEQ ID NO: 554801 - DNA, 25 bp, Mus musculus
gcctctgcaggatacctcaagtctg

SEQ ID NO: 554802 - DNA, 25 bp, Mus musculus
gcctctgcaggtatcgtttgatttt

SEQ ID NO: 554803 - DNA, 25 bp, Mus musculus
gcctctgcaggtattgttttgtgta

SEQ ID NO: 554804 - DNA, 25 bp, Mus musculus
gcctctgcaggtttcgtttgatttt

SEQ ID NO: 554805 - DNA, 25 bp, Mus musculus
gcctctgcaggttttgttttgtgta

SEQ ID NO: 554806 - DNA, 25 bp, Mus musculus
gcctctgcatcaagactgtctaatc

SEQ ID NO: 554807 - DNA, 25 bp, Mus musculus
gcctctgcatcatgactgtctaatc

SEQ ID NO: 554808 - DNA, 25 bp, Mus musculus
gcctctgcccacagaagcatagggt

SEQ ID NO: 554809 - DNA, 25 bp, Mus musculus
gcctctgcccactgaagcatagggt

SEQ ID NO: 554810 - DNA, 25 bp, Mus musculus
gcctctgcccgtcacctcgaagcca

SEQ ID NO: 554811 - DNA, 25 bp, Mus musculus
gcctctgcccgtgacctcgaagcca

SEQ ID NO: 554812 - DNA, 25 bp, Mus musculus
gcctctgcctctagattgtgggtat

SEQ ID NO: 554813 - DNA, 25 bp, Mus musculus
gcctctgcctcttgattgtgggtat

SEQ ID NO: 554814 - DNA, 25 bp, Mus musculus
gcctctgcgcgcctagaaaaagaat

SEQ ID NO: 554815 - DNA, 25 bp, Mus musculus
gcctctgcgcgcgtagaaaaagaat

SEQ ID NO: 554816 - DNA, 25 bp, Mus musculus
gcctctgcgtctaggttgttaatta

SEQ ID NO: 554817 - DNA, 25 bp, Mus musculus
gcctctgcgtcttggttgttaatta

SEQ ID NO: 554818 - DNA, 25 bp, Mus musculus
gcctctgctcacacagtgtcggaag

SEQ ID NO: 554819 - DNA, 25 bp, Mus musculus
gcctctgctcactcagtgtcggaag

SEQ ID NO: 554820 - DNA, 25 bp, Mus musculus
gcctctgctctacagaactgagatt

SEQ ID NO: 554821 - DNA, 25 bp, Mus musculus
gcctctgctctagagaactgagatt

SEQ ID NO: 554822 - DNA, 25 bp, Mus musculus
gcctctgcttccaagagctagaatc

SEQ ID NO: 554823 - DNA, 25 bp, Mus musculus
gcctctgcttcctagagctagaatc

SEQ ID NO: 554824 - DNA, 25 bp, Mus musculus
gcctctgcttctaaaacactatgtc

SEQ ID NO: 554825 - DNA, 25 bp, Mus musculus
gcctctgcttctccttgaagattaa

SEQ ID NO: 554826 - DNA, 25 bp, Mus musculus
gcctctgcttctgcttgaagattaa

SEQ ID NO: 554827 - DNA, 25 bp, Mus musculus
gcctctgcttcttaaacactatgtc

SEQ ID NO: 554828 - DNA, 25 bp, Mus musculus
gcctctgcttgcaatacgttgaaca

SEQ ID NO: 554829 - DNA, 25 bp, Mus musculus
gcctctgcttgctatacgttgaaca

SEQ ID NO: 554830 - DNA, 25 bp, Mus musculus
gcctctggacgtctttttctgttta

SEQ ID NO: 554831 - DNA, 25 bp, Mus musculus
gcctctggacgtgtttttctgttta

SEQ ID NO: 554832 - DNA, 25 bp, Mus musculus
gcctctggatcaagctggcgctttc

SEQ ID NO: 554833 - DNA, 25 bp, Mus musculus
gcctctggatcatgctggcgctttc

SEQ ID NO: 554834 - DNA, 25 bp, Mus musculus
gcctctggatgaccaacactggaga

SEQ ID NO: 554835 - DNA, 25 bp, Mus musculus
gcctctggatgagcaacactggaga

SEQ ID NO: 554836 - DNA, 25 bp, Mus musculus
gcctctggatgcactatatatgtga

SEQ ID NO: 554837 - DNA, 25 bp, Mus musculus
gcctctggatgctctatatatgtga

SEQ ID NO: 554838 - DNA, 25 bp, Mus musculus
gcctctggcagtcttgccactgttg

SEQ ID NO: 554839 - DNA, 25 bp, Mus musculus
gcctctggcagtgttgccactgttg

SEQ ID NO: 554840 - DNA, 25 bp, Mus musculus
gcctctggcgggaacctcaccaagg

SEQ ID NO: 554841 - DNA, 25 bp, Mus musculus
gcctctggcgggtacctcaccaagg

SEQ ID NO: 554842 - DNA, 25 bp, Mus musculus
gcctctggctgcatattttgcatca

SEQ ID NO: 554843 - DNA, 25 bp, Mus musculus
gcctctggctgcttattttgcatca

SEQ ID NO: 554844 - DNA, 25 bp, Mus musculus
gcctctgggatcaagctctttgcaa

SEQ ID NO: 554845 - DNA, 25 bp, Mus musculus
gcctctgggatctagctctttgcaa

SEQ ID NO: 554846 - DNA, 25 bp, Mus musculus
gcctctggtagacattgcccggaat

SEQ ID NO: 554847 - DNA, 25 bp, Mus musculus
gcctctggtagagattgcccggaat

SEQ ID NO: 554848 - DNA, 25 bp, Mus musculus
gcctctggtcccatctgaactgaga

SEQ ID NO: 554849 - DNA, 25 bp, Mus musculus
gcctctggtcccttctgaactgaga

SEQ ID NO: 554850 - DNA, 25 bp, Mus musculus
gcctctggtgaaagttctgtcttaa

SEQ ID NO: 554851 - DNA, 25 bp, Mus musculus
gcctctggtgaatgttctgtcttaa

SEQ ID NO: 554852 - DNA, 25 bp, Mus musculus
gcctctggtttactatgctgtggga

SEQ ID NO: 554853 - DNA, 25 bp, Mus musculus
gcctctggtttagtatgctgtggga

SEQ ID NO: 554854 - DNA, 25 bp, Mus musculus
gcctctgtaccacaatttccttggt

SEQ ID NO: 554855 - DNA, 25 bp, Mus musculus
gcctctgtaccagaatttccttggt

SEQ ID NO: 554856 - DNA, 25 bp, Mus musculus
gcctctgtactcagtgttgatattg

SEQ ID NO: 554857 - DNA, 25 bp, Mus musculus
gcctctgtactctgtgttgatattg

SEQ ID NO: 554858 - DNA, 25 bp, Mus musculus
gcctctgtcagaaaaaccctcagat

SEQ ID NO: 554859 - DNA, 25 bp, Mus musculus
gcctctgtcagataaaccctcagat

SEQ ID NO: 554860 - DNA, 25 bp, Mus musculus
gcctctgtccatatgtttctctcat

SEQ ID NO: 554861 - DNA, 25 bp, Mus musculus
gcctctgtccatttgtttctctcat

SEQ ID NO: 554862 - DNA, 25 bp, Mus musculus
gcctctgtcgaactgccccggaaga

SEQ ID NO: 554863 - DNA, 25 bp, Mus musculus
gcctctgtcgaagtgccccggaaga

SEQ ID NO: 554864 - DNA, 25 bp, Mus musculus
gcctctgtctcgcagctactgcaat

SEQ ID NO: 554865 - DNA, 25 bp, Mus musculus
gcctctgtctcggagctactgcaat

SEQ ID NO: 554866 - DNA, 25 bp, Mus musculus
gcctctgtctttccaaatggtggga

SEQ ID NO: 554867 - DNA, 25 bp, Mus musculus
gcctctgtctttgcaaatggtggga

SEQ ID NO: 554868 - DNA, 25 bp, Mus musculus
gcctctgtgaggacaaagcaggata

SEQ ID NO: 554869 - DNA, 25 bp, Mus musculus
gcctctgtgaggtcaaagcaggata

SEQ ID NO: 554870 - DNA, 25 bp, Mus musculus
gcctctgtgctgcaaggcagcagat

SEQ ID NO: 554871 - DNA, 25 bp, Mus musculus
gcctctgtgctggaaggcagcagat

SEQ ID NO: 554872 - DNA, 25 bp, Mus musculus
gcctctgtggctatggtctggatga

SEQ ID NO: 554873 - DNA, 25 bp, Mus musculus
gcctctgtggctttggtctggatga

SEQ ID NO: 554874 - DNA, 25 bp, Mus musculus
gcctctgtgggaacacctgcaacag

SEQ ID NO: 554875 - DNA, 25 bp, Mus musculus
gcctctgtgggatcacctgcaacag

SEQ ID NO: 554876 - DNA, 25 bp, Mus musculus
gcctctgtgggcactacatgcatgt

SEQ ID NO: 554877 - DNA, 25 bp, Mus musculus
gcctctgtgggctctacatgcatgt

SEQ ID NO: 554878 - DNA, 25 bp, Mus musculus
gcctctgtgggtagtagtaggtaac

SEQ ID NO: 554879 - DNA, 25 bp, Mus musculus
gcctctgtgggttgtagtaggtaac

SEQ ID NO: 554880 - DNA, 25 bp, Mus musculus
gcctctgtgtacatgactctgctgt

SEQ ID NO: 554881 - DNA, 25 bp, Mus musculus
gcctctgtgtacttgactctgctgt

SEQ ID NO: 554882 - DNA, 25 bp, Mus musculus
gcctctgtgtgtccgtaataaaaga

SEQ ID NO: 554883 - DNA, 25 bp, Mus musculus
gcctctgtgtgtgcgtaataaaaga

SEQ ID NO: 554884 - DNA, 25 bp, Mus musculus
gcctctgttactccaatatattaca

SEQ ID NO: 554885 - DNA, 25 bp, Mus musculus
gcctctgttactgcaatatattaca

SEQ ID NO: 554886 - DNA, 25 bp, Mus musculus
gcctctgttagaaaagtgcttgctg

SEQ ID NO: 554887 - DNA, 25 bp, Mus musculus
gcctctgttagataagtgcttgctg

SEQ ID NO: 554888 - DNA, 25 bp, Mus musculus
gcctctgttccacgaagtctcgctg

SEQ ID NO: 554889 - DNA, 25 bp, Mus musculus
gcctctgttccaggaagtctcgctg

SEQ ID NO: 554890 - DNA, 25 bp, Mus musculus
gcctctgttgaccaggttcttgaga

SEQ ID NO: 554891 - DNA, 25 bp, Mus musculus
gcctctgttgacgaggttcttgaga

SEQ ID NO: 554892 - DNA, 25 bp, Mus musculus
gcctctgtttacaaaagattagctt

SEQ ID NO: 554893 - DNA, 25 bp, Mus musculus
gcctctgtttactaaagattagctt

SEQ ID NO: 554894 - DNA, 25 bp, Mus musculus
gcctctgtttcaatcacttttgata

SEQ ID NO: 554895 - DNA, 25 bp, Mus musculus
gcctctgtttcattcacttttgata

SEQ ID NO: 554896 - DNA, 25 bp, Mus musculus
gcctcttaaccccttacctgagaat

SEQ ID NO: 554897 - DNA, 25 bp, Mus musculus
gcctcttaacccgttacctgagaat

SEQ ID NO: 554898 - DNA, 25 bp, Mus musculus
gcctcttaatacagttgacccttgg

SEQ ID NO: 554899 - DNA, 25 bp, Mus musculus
gcctcttaatactgttgacccttgg

SEQ ID NO: 554900 - DNA, 25 bp, Mus musculus
gcctcttaatgtcgtaggtttcaga

SEQ ID NO: 554901 - DNA, 25 bp, Mus musculus
gcctcttaatgtggtaggtttcaga

SEQ ID NO: 554902 - DNA, 25 bp, Mus musculus
gcctcttaattccagttcatgctag

SEQ ID NO: 554903 - DNA, 25 bp, Mus musculus
gcctcttaattcgagttcatgctag

SEQ ID NO: 554904 - DNA, 25 bp, Mus musculus
gcctcttactggagtttctttgcta

SEQ ID NO: 554905 - DNA, 25 bp, Mus musculus
gcctcttactggtgtttctttgcta

SEQ ID NO: 554906 - DNA, 25 bp, Mus musculus
gcctcttagaatatgagctgagcct

SEQ ID NO: 554907 - DNA, 25 bp, Mus musculus
gcctcttagaatttgagctgagcct

SEQ ID NO: 554908 - DNA, 25 bp, Mus musculus
gcctcttagggcagagacatttctg

SEQ ID NO: 554909 - DNA, 25 bp, Mus musculus
gcctcttagggctgagacatttctg

SEQ ID NO: 554910 - DNA, 25 bp, Mus musculus
gcctcttagtgtatgggttacttca

SEQ ID NO: 554911 - DNA, 25 bp, Mus musculus
gcctcttagtgtttgggttacttca

SEQ ID NO: 554912 - DNA, 25 bp, Mus musculus
gcctcttatgtaaacagtctgggtt

SEQ ID NO: 554913 - DNA, 25 bp, Mus musculus
gcctcttatgtatacagtctgggtt

SEQ ID NO: 554914 - DNA, 25 bp, Mus musculus
gcctcttcaaagctgccgacttaaa

SEQ ID NO: 554915 - DNA, 25 bp, Mus musculus
gcctcttcaaaggtgccgacttaaa

SEQ ID NO: 554916 - DNA, 25 bp, Mus musculus
gcctcttcaataaattcccatggac

SEQ ID NO: 554917 - DNA, 25 bp, Mus musculus
gcctcttcaatatattcccatggac

SEQ ID NO: 554918 - DNA, 25 bp, Mus musculus
gcctcttcatacagtcttcatacag

SEQ ID NO: 554919 - DNA, 25 bp, Mus musculus
gcctcttcatactgtcttcatacag

SEQ ID NO: 554920 - DNA, 25 bp, Mus musculus
gcctcttccaaaacacatgtttttt

SEQ ID NO: 554921 - DNA, 25 bp, Mus musculus
gcctcttccaaatcacatgtttttt

SEQ ID NO: 554922 - DNA, 25 bp, Mus musculus
gcctcttccaagagaatgaactttg

SEQ ID NO: 554923 - DNA, 25 bp, Mus musculus
gcctcttccaagtgaatgaactttg

SEQ ID NO: 554924 - DNA, 25 bp, Mus musculus
gcctcttcccatagcatgtgattgc

SEQ ID NO: 554925 - DNA, 25 bp, Mus musculus
gcctcttcccattgcatgtgattgc

SEQ ID NO: 554926 - DNA, 25 bp, Mus musculus
gcctcttccgggacacttaaatatg

SEQ ID NO: 554927 - DNA, 25 bp, Mus musculus
gcctcttccgggtcacttaaatatg

SEQ ID NO: 554928 - DNA, 25 bp, Mus musculus
gcctcttcgaggagcgatggactca

SEQ ID NO: 554929 - DNA, 25 bp, Mus musculus
gcctcttcgaggtgcgatggactca

SEQ ID NO: 554930 - DNA, 25 bp, Mus musculus
gcctcttctagcaagtagttcccag

SEQ ID NO: 554931 - DNA, 25 bp, Mus musculus
gcctcttctagctagtagttcccag

SEQ ID NO: 554932 - DNA, 25 bp, Mus musculus
gcctcttctccgatactgaaacaga

SEQ ID NO: 554933 - DNA, 25 bp, Mus musculus
gcctcttctccgttactgaaacaga

SEQ ID NO: 554934 - DNA, 25 bp, Mus musculus
gcctcttctcggctgggaagtgcca

SEQ ID NO: 554935 - DNA, 25 bp, Mus musculus
gcctcttctcgggtgggaagtgcca

SEQ ID NO: 554936 - DNA, 25 bp, Mus musculus
gcctcttctgtgaatgtcatggact

SEQ ID NO: 554937 - DNA, 25 bp, Mus musculus
gcctcttctgtgtatgtcatggact

SEQ ID NO: 554938 - DNA, 25 bp, Mus musculus
gcctcttcttctcttcggaaaaagg

SEQ ID NO: 554939 - DNA, 25 bp, Mus musculus
gcctcttcttctgttcggaaaaagg

SEQ ID NO: 554940 - DNA, 25 bp, Mus musculus
gcctcttgacctctaagctcagaaa

SEQ ID NO: 554941 - DNA, 25 bp, Mus musculus
gcctcttgacctgtaagctcagaaa

SEQ ID NO: 554942 - DNA, 25 bp, Mus musculus
gcctcttgagtcagggtttttagct

SEQ ID NO: 554943 - DNA, 25 bp, Mus musculus
gcctcttgagtctgggtttttagct

SEQ ID NO: 554944 - DNA, 25 bp, Mus musculus
gcctcttgcaaaagttgtacctgga

SEQ ID NO: 554945 - DNA, 25 bp, Mus musculus
gcctcttgcaaatgttgtacctgga

SEQ ID NO: 554946 - DNA, 25 bp, Mus musculus
gcctcttgcatgctgggtaaacacc

SEQ ID NO: 554947 - DNA, 25 bp, Mus musculus
gcctcttgcatggtgggtaaacacc

SEQ ID NO: 554948 - DNA, 25 bp, Mus musculus
gcctcttgccaaactcgcattatga

SEQ ID NO: 554949 - DNA, 25 bp, Mus musculus
gcctcttgccaacgtctagacataa

SEQ ID NO: 554950 - DNA, 25 bp, Mus musculus
gcctcttgccaaggtctagacataa

SEQ ID NO: 554951 - DNA, 25 bp, Mus musculus
gcctcttgccaatctcgcattatga

SEQ ID NO: 554952 - DNA, 25 bp, Mus musculus
gcctcttgcccacaaaggtgagaag

SEQ ID NO: 554953 - DNA, 25 bp, Mus musculus
gcctcttgcccagaaaggtgagaag

SEQ ID NO: 554954 - DNA, 25 bp, Mus musculus
gcctcttgcgttagcttgctcactt

SEQ ID NO: 554955 - DNA, 25 bp, Mus musculus
gcctcttgcgtttgcttgctcactt

SEQ ID NO: 554956 - DNA, 25 bp, Mus musculus
gcctcttgtcgtatgctgtactcaa

SEQ ID NO: 554957 - DNA, 25 bp, Mus musculus
gcctcttgtcgtttgctgtactcaa

SEQ ID NO: 554958 - DNA, 25 bp, Mus musculus
gcctcttgtcttcgagacagacctg

SEQ ID NO: 554959 - DNA, 25 bp, Mus musculus
gcctcttgtcttggagacagacctg

SEQ ID NO: 554960 - DNA, 25 bp, Mus musculus
gcctcttgtttcattgggctttaag

SEQ ID NO: 554961 - DNA, 25 bp, Mus musculus
gcctcttgtttctttgggctttaag

SEQ ID NO: 554962 - DNA, 25 bp, Mus musculus
gcctctttaatccttaaatcagaaa

SEQ ID NO: 554963 - DNA, 25 bp, Mus musculus
gcctctttaatcgttaaatcagaaa

SEQ ID NO: 554964 - DNA, 25 bp, Mus musculus
gcctctttaggtctccaaattgcaa

SEQ ID NO: 554965 - DNA, 25 bp, Mus musculus
gcctctttaggtgtccaaattgcaa

SEQ ID NO: 554966 - DNA, 25 bp, Mus musculus
gcctctttatatcagctttgccata

SEQ ID NO: 554967 - DNA, 25 bp, Mus musculus
gcctctttatatgagctttgccata

SEQ ID NO: 554968 - DNA, 25 bp, Mus musculus
gcctctttatctatgcaactctagg

SEQ ID NO: 554969 - DNA, 25 bp, Mus musculus
gcctctttatctttgcaactctagg

SEQ ID NO: 554970 - DNA, 25 bp, Mus musculus
gcctctttattgctcctctttttat

SEQ ID NO: 554971 - DNA, 25 bp, Mus musculus
gcctctttattggtcctctttttat

SEQ ID NO: 554972 - DNA, 25 bp, Mus musculus
gcctctttcatgatgaggatgttgg

SEQ ID NO: 554973 - DNA, 25 bp, Mus musculus
gcctctttcatgttgaggatgttgg

SEQ ID NO: 554974 - DNA, 25 bp, Mus musculus
gcctctttcgtgactgatccggatg

SEQ ID NO: 554975 - DNA, 25 bp, Mus musculus
gcctctttcgtgtctgatccggatg

SEQ ID NO: 554976 - DNA, 25 bp, Mus musculus
gcctctttctaacccaacaggaagt

SEQ ID NO: 554977 - DNA, 25 bp, Mus musculus
gcctctttctaagccaacaggaagt

SEQ ID NO: 554978 - DNA, 25 bp, Mus musculus
gcctctttctagaactatatgccac

SEQ ID NO: 554979 - DNA, 25 bp, Mus musculus
gcctctttctagtactatatgccac

SEQ ID NO: 554980 - DNA, 25 bp, Mus musculus
gcctctttctgtcatcaatatctca

SEQ ID NO: 554981 - DNA, 25 bp, Mus musculus
gcctctttctgtgatcaatatctca

SEQ ID NO: 554982 - DNA, 25 bp, Mus musculus
gcctctttgtggcttatgctaagat

SEQ ID NO: 554983 - DNA, 25 bp, Mus musculus
gcctctttgtgggttatgctaagat

SEQ ID NO: 554984 - DNA, 25 bp, Mus musculus
gcctctttgttgattaacataggac

SEQ ID NO: 554985 - DNA, 25 bp, Mus musculus
gcctctttgttgtttaacataggac

SEQ ID NO: 554986 - DNA, 25 bp, Mus musculus
gcctcttttaacctaatgggtgaca

SEQ ID NO: 554987 - DNA, 25 bp, Mus musculus
gcctcttttaacgtaatgggtgaca

SEQ ID NO: 554988 - DNA, 25 bp, Mus musculus
gcctcttttcagctggattccaagg

SEQ ID NO: 554989 - DNA, 25 bp, Mus musculus
gcctcttttcaggtggattccaagg

SEQ ID NO: 554990 - DNA, 25 bp, Mus musculus
gcctcttttctcatgttcctaaaag

SEQ ID NO: 554991 - DNA, 25 bp, Mus musculus
gcctcttttctcttgttcctaaaag

SEQ ID NO: 554992 - DNA, 25 bp, Mus musculus
gcctcttttgacaccacaaaaggga

SEQ ID NO: 554993 - DNA, 25 bp, Mus musculus
gcctcttttgactccacaaaaggga

SEQ ID NO: 554994 - DNA, 25 bp, Mus musculus
gcctcttttggaatctggagagtta

SEQ ID NO: 554995 - DNA, 25 bp, Mus musculus
gcctcttttggattctggagagtta

SEQ ID NO: 554996 - DNA, 25 bp, Mus musculus
gcctgaaaaccaccctgctggtggg

SEQ ID NO: 554997 - DNA, 25 bp, Mus musculus
gcctgaaaaccagcctgctggtggg

SEQ ID NO: 554998 - DNA, 25 bp, Mus musculus
gcctgaaaagagaccccgtgacagc

SEQ ID NO: 554999 - DNA, 25 bp, Mus musculus
gcctgaaaagagtccccgtgacagc

SEQ ID NO: 555000 - DNA, 25 bp, Mus musculus
gcctgaaacagccaagtagccctta

SEQ ID NO: 555001 - DNA, 25 bp, Mus musculus
gcctgaaacagcgaagtagccctta

SEQ ID NO: 555002 - DNA, 25 bp, Mus musculus
gcctgaaaccagctggttgacccca

SEQ ID NO: 555003 - DNA, 25 bp, Mus musculus
gcctgaaaccaggtggttgacccca

SEQ ID NO: 555004 - DNA, 25 bp, Mus musculus
gcctgaaacccaagttactggcagt

SEQ ID NO: 555005 - DNA, 25 bp, Mus musculus
gcctgaaacccatgttactggcagt

SEQ ID NO: 555006 - DNA, 25 bp, Mus musculus
gcctgaaagaaaccctatctgcctt

SEQ ID NO: 555007 - DNA, 25 bp, Mus musculus
gcctgaaagaaagcctatctgcctt

SEQ ID NO: 555008 - DNA, 25 bp, Mus musculus
gcctgaaataacacagctgtccttt

SEQ ID NO: 555009 - DNA, 25 bp, Mus musculus
gcctgaaataactcagctgtccttt

SEQ ID NO: 555010 - DNA, 25 bp, Mus musculus
gcctgaaattccatatctctgcatc

SEQ ID NO: 555011 - DNA, 25 bp, Mus musculus
gcctgaaattccttatctctgcatc

SEQ ID NO: 555012 - DNA, 25 bp, Mus musculus
gcctgaacaaccagtgccaggagct

SEQ ID NO: 555013 - DNA, 25 bp, Mus musculus
gcctgaacaacctgtgccaggagct

SEQ ID NO: 555014 - DNA, 25 bp, Mus musculus
gcctgaacacagcttccgaagacaa

SEQ ID NO: 555015 - DNA, 25 bp, Mus musculus
gcctgaacacaggttccgaagacaa

SEQ ID NO: 555016 - DNA, 25 bp, Mus musculus
gcctgaacacggacatgataaactg

SEQ ID NO: 555017 - DNA, 25 bp, Mus musculus
gcctgaacacggtcatgataaactg

SEQ ID NO: 555018 - DNA, 25 bp, Mus musculus
gcctgaacatcaagaccttgggttg

SEQ ID NO: 555019 - DNA, 25 bp, Mus musculus
gcctgaacatcatgaccttgggttg

SEQ ID NO: 555020 - DNA, 25 bp, Mus musculus
gcctgaacattcatctgggagggtt

SEQ ID NO: 555021 - DNA, 25 bp, Mus musculus
gcctgaacattcttctgggagggtt

SEQ ID NO: 555022 - DNA, 25 bp, Mus musculus
gcctgaacccacagatttatgtctt

SEQ ID NO: 555023 - DNA, 25 bp, Mus musculus
gcctgaacccactgatttatgtctt

SEQ ID NO: 555024 - DNA, 25 bp, Mus musculus
gcctgaacccagcaacagtaagaaa

SEQ ID NO: 555025 - DNA, 25 bp, Mus musculus
gcctgaacccaggaacagtaagaaa

SEQ ID NO: 555026 - DNA, 25 bp, Mus musculus
gcctgaacctgcctcttaggactga

SEQ ID NO: 555027 - DNA, 25 bp, Mus musculus
gcctgaacctgcgtcttaggactga

SEQ ID NO: 555028 - DNA, 25 bp, Mus musculus
gcctgaaccttaatggtattactat

SEQ ID NO: 555029 - DNA, 25 bp, Mus musculus
gcctgaaccttattggtattactat

SEQ ID NO: 555030 - DNA, 25 bp, Mus musculus
gcctgaaccttcattacccagagaa

SEQ ID NO: 555031 - DNA, 25 bp, Mus musculus
gcctgaaccttctttacccagagaa

SEQ ID NO: 555032 - DNA, 25 bp, Mus musculus
gcctgaacgaccatttggtcaaggt

SEQ ID NO: 555033 - DNA, 25 bp, Mus musculus
gcctgaacgaccttttggtcaaggt

SEQ ID NO: 555034 - DNA, 25 bp, Mus musculus
gcctgaactgctatgctcacacagt

SEQ ID NO: 555035 - DNA, 25 bp, Mus musculus
gcctgaactgctttgctcacacagt

SEQ ID NO: 555036 - DNA, 25 bp, Mus musculus
gcctgaactgtcataacactttatg

SEQ ID NO: 555037 - DNA, 25 bp, Mus musculus
gcctgaactgtcttaacactttatg

SEQ ID NO: 555038 - DNA, 25 bp, Mus musculus
gcctgaagaagcagtggtccacctc

SEQ ID NO: 555039 - DNA, 25 bp, Mus musculus
gcctgaagaagctgtggtccacctc

SEQ ID NO: 555040 - DNA, 25 bp, Mus musculus
gcctgaagacacaaacagacgctca

SEQ ID NO: 555041 - DNA, 25 bp, Mus musculus
gcctgaagacactaacagacgctca

SEQ ID NO: 555042 - DNA, 25 bp, Mus musculus
gcctgaagacttagtagctgatttt

SEQ ID NO: 555043 - DNA, 25 bp, Mus musculus
gcctgaagactttgtagctgatttt

SEQ ID NO: 555044 - DNA, 25 bp, Mus musculus
gcctgaagcctaaggtatttgttct

SEQ ID NO: 555045 - DNA, 25 bp, Mus musculus
gcctgaagcctatggtatttgttct

SEQ ID NO: 555046 - DNA, 25 bp, Mus musculus
gcctgaaggactatgcccctggaaa

SEQ ID NO: 555047 - DNA, 25 bp, Mus musculus
gcctgaaggactttgcccctggaaa

SEQ ID NO: 555048 - DNA, 25 bp, Mus musculus
gcctgaaggcatcacaagcacactg

SEQ ID NO: 555049 - DNA, 25 bp, Mus musculus
gcctgaaggcatgacaagcacactg

SEQ ID NO: 555050 - DNA, 25 bp, Mus musculus
gcctgaaggcctcttggtgagttct

SEQ ID NO: 555051 - DNA, 25 bp, Mus musculus
gcctgaaggcctgttggtgagttct

SEQ ID NO: 555052 - DNA, 25 bp, Mus musculus
gcctgaaggtataagtagatttgtt

SEQ ID NO: 555053 - DNA, 25 bp, Mus musculus
gcctgaaggtattagtagatttgtt

SEQ ID NO: 555054 - DNA, 25 bp, Mus musculus
gcctgaagtacaccgagtagtctct

SEQ ID NO: 555055 - DNA, 25 bp, Mus musculus
gcctgaagtacagcgagtagtctct

SEQ ID NO: 555056 - DNA, 25 bp, Mus musculus
gcctgaagtagacctctgacattag

SEQ ID NO: 555057 - DNA, 25 bp, Mus musculus
gcctgaagtagagctctgacattag

SEQ ID NO: 555058 - DNA, 25 bp, Mus musculus
gcctgaagtctcaatcatgtggtta

SEQ ID NO: 555059 - DNA, 25 bp, Mus musculus
gcctgaagtctctatcatgtggtta

SEQ ID NO: 555060 - DNA, 25 bp, Mus musculus
gcctgaagttcgatgctctggattc

SEQ ID NO: 555061 - DNA, 25 bp, Mus musculus
gcctgaagttcgttgctctggattc

SEQ ID NO: 555062 - DNA, 25 bp, Mus musculus
gcctgaataaagagaataaagctct

SEQ ID NO: 555063 - DNA, 25 bp, Mus musculus
gcctgaataaagtgaataaagctct

SEQ ID NO: 555064 - DNA, 25 bp, Mus musculus
gcctgaataggcaccgaatggaaat

SEQ ID NO: 555065 - DNA, 25 bp, Mus musculus
gcctgaataggctccgaatggaaat

SEQ ID NO: 555066 - DNA, 25 bp, Mus musculus
gcctgaatagtaacaacccgggaag

SEQ ID NO: 555067 - DNA, 25 bp, Mus musculus
gcctgaatagtatcaacccgggaag

SEQ ID NO: 555068 - DNA, 25 bp, Mus musculus
gcctgaatcggaaccagacacagat

SEQ ID NO: 555069 - DNA, 25 bp, Mus musculus
gcctgaatcggatccagacacagat

SEQ ID NO: 555070 - DNA, 25 bp, Mus musculus
gcctgaattaggactctacccaaca

SEQ ID NO: 555071 - DNA, 25 bp, Mus musculus
gcctgaattaggtctctacccaaca

SEQ ID NO: 555072 - DNA, 25 bp, Mus musculus
gcctgaattcagacctgaattccag

SEQ ID NO: 555073 - DNA, 25 bp, Mus musculus
gcctgaattcagtcctgaattccag

SEQ ID NO: 555074 - DNA, 25 bp, Mus musculus
gcctgaatttgcagagtagccaaga

SEQ ID NO: 555075 - DNA, 25 bp, Mus musculus
gcctgaatttgctgagtagccaaga

SEQ ID NO: 555076 - DNA, 25 bp, Mus musculus
gcctgacaaaagaatggccttctgg

SEQ ID NO: 555077 - DNA, 25 bp, Mus musculus
gcctgacaaaagtatggccttctgg

SEQ ID NO: 555078 - DNA, 25 bp, Mus musculus
gcctgacaaggacgagccagagctc

SEQ ID NO: 555079 - DNA, 25 bp, Mus musculus
gcctgacaaggaggagccagagctc

SEQ ID NO: 555080 - DNA, 25 bp, Mus musculus
gcctgacaccaacaaagtggccttt

SEQ ID NO: 555081 - DNA, 25 bp, Mus musculus
gcctgacaccaagaaagtggccttt

SEQ ID NO: 555082 - DNA, 25 bp, Mus musculus
gcctgacaccatatttgacactcat

SEQ ID NO: 555083 - DNA, 25 bp, Mus musculus
gcctgacaccatttttgacactcat

SEQ ID NO: 555084 - DNA, 25 bp, Mus musculus
gcctgacacccaagggcatgatgca

SEQ ID NO: 555085 - DNA, 25 bp, Mus musculus
gcctgacacccatgggcatgatgca

SEQ ID NO: 555086 - DNA, 25 bp, Mus musculus
gcctgacacggtaagagccatctgg

SEQ ID NO: 555087 - DNA, 25 bp, Mus musculus
gcctgacacggttagagccatctgg

SEQ ID NO: 555088 - DNA, 25 bp, Mus musculus
gcctgacactgtacctagctggtta

SEQ ID NO: 555089 - DNA, 25 bp, Mus musculus
gcctgacactgttcctagctggtta

SEQ ID NO: 555090 - DNA, 25 bp, Mus musculus
gcctgacagaaaccactatgacaaa

SEQ ID NO: 555091 - DNA, 25 bp, Mus musculus
gcctgacagaaagcactatgacaaa

SEQ ID NO: 555092 - DNA, 25 bp, Mus musculus
gcctgacagcataagtttactccct

SEQ ID NO: 555093 - DNA, 25 bp, Mus musculus
gcctgacagcatattttctgtgaga

SEQ ID NO: 555094 - DNA, 25 bp, Mus musculus
gcctgacagcatctttgtgatcgaa

SEQ ID NO: 555095 - DNA, 25 bp, Mus musculus
gcctgacagcatgtttgtgatcgaa

SEQ ID NO: 555096 - DNA, 25 bp, Mus musculus
gcctgacagcattagtttactccct

SEQ ID NO: 555097 - DNA, 25 bp, Mus musculus
gcctgacagcattttttctgtgaga

SEQ ID NO: 555098 - DNA, 25 bp, Mus musculus
gcctgacaggtgagctgagaaccgt

SEQ ID NO: 555099 - DNA, 25 bp, Mus musculus
gcctgacaggtgtgctgagaaccgt

SEQ ID NO: 555100 - DNA, 25 bp, Mus musculus
gcctgacatcaaccagattatgact

SEQ ID NO: 555101 - DNA, 25 bp, Mus musculus
gcctgacatcaagcagattatgact

SEQ ID NO: 555102 - DNA, 25 bp, Mus musculus
gcctgacattgtagatttggtgaaa

SEQ ID NO: 555103 - DNA, 25 bp, Mus musculus
gcctgacattgttgatttggtgaaa

SEQ ID NO: 555104 - DNA, 25 bp, Mus musculus
gcctgaccaaatcccaagtgctgac

SEQ ID NO: 555105 - DNA, 25 bp, Mus musculus
gcctgaccaaatgccaagtgctgac

SEQ ID NO: 555106 - DNA, 25 bp, Mus musculus
gcctgaccacctacggcaagatgtg

SEQ ID NO: 555107 - DNA, 25 bp, Mus musculus
gcctgaccaccttcggcaagatgtg

SEQ ID NO: 555108 - DNA, 25 bp, Mus musculus
gcctgaccacttctaattttttctc

SEQ ID NO: 555109 - DNA, 25 bp, Mus musculus
gcctgaccacttgtaattttttctc

SEQ ID NO: 555110 - DNA, 25 bp, Mus musculus
gcctgaccagtgcatgctttagtga

SEQ ID NO: 555111 - DNA, 25 bp, Mus musculus
gcctgaccagtggatgctttagtga

SEQ ID NO: 555112 - DNA, 25 bp, Mus musculus
gcctgaccatgaaggcccaatggag

SEQ ID NO: 555113 - DNA, 25 bp, Mus musculus
gcctgaccatgatggcccaatggag

SEQ ID NO: 555114 - DNA, 25 bp, Mus musculus
gcctgacccagaactattgcagttt

SEQ ID NO: 555115 - DNA, 25 bp, Mus musculus
gcctgacccagatctattgcagttt

SEQ ID NO: 555116 - DNA, 25 bp, Mus musculus
gcctgacccggaatcgggacaggaa

SEQ ID NO: 555117 - DNA, 25 bp, Mus musculus
gcctgacccggattcgggacaggaa

SEQ ID NO: 555118 - DNA, 25 bp, Mus musculus
gcctgacctaatcaaatgttgtcca

SEQ ID NO: 555119 - DNA, 25 bp, Mus musculus
gcctgacctaatgaaatgttgtcca

SEQ ID NO: 555120 - DNA, 25 bp, Mus musculus
gcctgacctggacttcgctgtatgg

SEQ ID NO: 555121 - DNA, 25 bp, Mus musculus
gcctgacctggagttcgctgtatgg

SEQ ID NO: 555122 - DNA, 25 bp, Mus musculus
gcctgacctgtgactccattagaaa

SEQ ID NO: 555123 - DNA, 25 bp, Mus musculus
gcctgacctgtgtctccattagaaa

SEQ ID NO: 555124 - DNA, 25 bp, Mus musculus
gcctgaccttcaatcacaggtttgg

SEQ ID NO: 555125 - DNA, 25 bp, Mus musculus
gcctgaccttcattcacaggtttgg

SEQ ID NO: 555126 - DNA, 25 bp, Mus musculus
gcctgaccttggatttgacacgtta

SEQ ID NO: 555127 - DNA, 25 bp, Mus musculus
gcctgaccttggttttgacacgtta

SEQ ID NO: 555128 - DNA, 25 bp, Mus musculus
gcctgacgccgtacgcgggaaatta

SEQ ID NO: 555129 - DNA, 25 bp, Mus musculus
gcctgacgccgttcgcgggaaatta

SEQ ID NO: 555130 - DNA, 25 bp, Mus musculus
gcctgacgcgcaagctctacaagtg

SEQ ID NO: 555131 - DNA, 25 bp, Mus musculus
gcctgacgcgcatgctctacaagtg

SEQ ID NO: 555132 - DNA, 25 bp, Mus musculus
gcctgacgctctcattaaaatccat

SEQ ID NO: 555133 - DNA, 25 bp, Mus musculus
gcctgacgctctgattaaaatccat

SEQ ID NO: 555134 - DNA, 25 bp, Mus musculus
gcctgacggtcactttgatgggatt

SEQ ID NO: 555135 - DNA, 25 bp, Mus musculus
gcctgacggtcagtttgatgggatt

SEQ ID NO: 555136 - DNA, 25 bp, Mus musculus
gcctgactcagtctgggctgaacga

SEQ ID NO: 555137 - DNA, 25 bp, Mus musculus
gcctgactcagtgtgggctgaacga

SEQ ID NO: 555138 - DNA, 25 bp, Mus musculus
gcctgactccttagtttgctttgaa

SEQ ID NO: 555139 - DNA, 25 bp, Mus musculus
gcctgactcctttgtttgctttgaa

SEQ ID NO: 555140 - DNA, 25 bp, Mus musculus
gcctgactcggcactgagatgtcta

SEQ ID NO: 555141 - DNA, 25 bp, Mus musculus
gcctgactcggctctgagatgtcta

SEQ ID NO: 555142 - DNA, 25 bp, Mus musculus
gcctgactctacctggcttgtctgg

SEQ ID NO: 555143 - DNA, 25 bp, Mus musculus
gcctgactctacgtggcttgtctgg

SEQ ID NO: 555144 - DNA, 25 bp, Mus musculus
gcctgactgctgattacaagactag

SEQ ID NO: 555145 - DNA, 25 bp, Mus musculus
gcctgactgctgtttacaagactag

SEQ ID NO: 555146 - DNA, 25 bp, Mus musculus
gcctgactggagatactgggacccc

SEQ ID NO: 555147 - DNA, 25 bp, Mus musculus
gcctgactggagttactgggacccc

SEQ ID NO: 555148 - DNA, 25 bp, Mus musculus
gcctgactggcgagaactggatgac

SEQ ID NO: 555149 - DNA, 25 bp, Mus musculus
gcctgactggcgtgaactggatgac

SEQ ID NO: 555150 - DNA, 25 bp, Mus musculus
gcctgactgtctctaggtctgttat

SEQ ID NO: 555151 - DNA, 25 bp, Mus musculus
gcctgactgtctgtaggtctgttat

SEQ ID NO: 555152 - DNA, 25 bp, Mus musculus
gcctgactgtggcttcagcacaatt

SEQ ID NO: 555153 - DNA, 25 bp, Mus musculus
gcctgactgtgggttcagcacaatt

SEQ ID NO: 555154 - DNA, 25 bp, Mus musculus
gcctgactgttcactagacctgaat

SEQ ID NO: 555155 - DNA, 25 bp, Mus musculus
gcctgactgttctctagacctgaat

SEQ ID NO: 555156 - DNA, 25 bp, Mus musculus
gcctgacttagtagtttagctctgg

SEQ ID NO: 555157 - DNA, 25 bp, Mus musculus
gcctgacttagttgtttagctctgg

SEQ ID NO: 555158 - DNA, 25 bp, Mus musculus
gcctgacttccaagctggttattaa

SEQ ID NO: 555159 - DNA, 25 bp, Mus musculus
gcctgacttccacaaagttagctgc

SEQ ID NO: 555160 - DNA, 25 bp, Mus musculus
gcctgacttccagaaagttagctgc

SEQ ID NO: 555161 - DNA, 25 bp, Mus musculus
gcctgacttccatgctggttattaa

SEQ ID NO: 555162 - DNA, 25 bp, Mus musculus
gcctgactttcgagatgcccttgaa

SEQ ID NO: 555163 - DNA, 25 bp, Mus musculus
gcctgactttcgtgatgcccttgaa

SEQ ID NO: 555164 - DNA, 25 bp, Mus musculus
gcctgagaacaaagacccaagtgag

SEQ ID NO: 555165 - DNA, 25 bp, Mus musculus
gcctgagaacaacatgtatgcttaa

SEQ ID NO: 555166 - DNA, 25 bp, Mus musculus
gcctgagaacaagatgtatgcttaa

SEQ ID NO: 555167 - DNA, 25 bp, Mus musculus
gcctgagaacaatgacccaagtgag

SEQ ID NO: 555168 - DNA, 25 bp, Mus musculus
gcctgagaacagctatttttgagat

SEQ ID NO: 555169 - DNA, 25 bp, Mus musculus
gcctgagaacaggtatttttgagat

SEQ ID NO: 555170 - DNA, 25 bp, Mus musculus
gcctgagaacttaaattcatcgctg

SEQ ID NO: 555171 - DNA, 25 bp, Mus musculus
gcctgagaactttaattcatcgctg

SEQ ID NO: 555172 - DNA, 25 bp, Mus musculus
gcctgagaagtcataacctctgtgc

SEQ ID NO: 555173 - DNA, 25 bp, Mus musculus
gcctgagaagtcttaacctctgtgc

SEQ ID NO: 555174 - DNA, 25 bp, Mus musculus
gcctgagaatttcggcctggaacca

SEQ ID NO: 555175 - DNA, 25 bp, Mus musculus
gcctgagaatttgggcctggaacca

SEQ ID NO: 555176 - DNA, 25 bp, Mus musculus
gcctgagaccctctggttactatta

SEQ ID NO: 555177 - DNA, 25 bp, Mus musculus
gcctgagaccctgtggttactatta

SEQ ID NO: 555178 - DNA, 25 bp, Mus musculus
gcctgagactgaagcctgcggagtt

SEQ ID NO: 555179 - DNA, 25 bp, Mus musculus
gcctgagactgatgcctgcggagtt

SEQ ID NO: 555180 - DNA, 25 bp, Mus musculus
gcctgagacttcatttggccaagtt

SEQ ID NO: 555181 - DNA, 25 bp, Mus musculus
gcctgagacttcttttggccaagtt

SEQ ID NO: 555182 - DNA, 25 bp, Mus musculus
gcctgagagagcactgtccttacaa

SEQ ID NO: 555183 - DNA, 25 bp, Mus musculus
gcctgagagagctctgtccttacaa

SEQ ID NO: 555184 - DNA, 25 bp, Mus musculus
gcctgagagggccaaagcggtccat

SEQ ID NO: 555185 - DNA, 25 bp, Mus musculus
gcctgagagggcgaaagcggtccat

SEQ ID NO: 555186 - DNA, 25 bp, Mus musculus
gcctgagataagcagctccttccta

SEQ ID NO: 555187 - DNA, 25 bp, Mus musculus
gcctgagataaggagctccttccta

SEQ ID NO: 555188 - DNA, 25 bp, Mus musculus
gcctgagatggcacttttgatgctg

SEQ ID NO: 555189 - DNA, 25 bp, Mus musculus
gcctgagatggctcttttgatgctg

SEQ ID NO: 555190 - DNA, 25 bp, Mus musculus
gcctgagcaagcctgagacctagtt

SEQ ID NO: 555191 - DNA, 25 bp, Mus musculus
gcctgagcaagcgtgagacctagtt

SEQ ID NO: 555192 - DNA, 25 bp, Mus musculus
gcctgagcaggtatcttaccctaag

SEQ ID NO: 555193 - DNA, 25 bp, Mus musculus
gcctgagcaggtttcttaccctaag

SEQ ID NO: 555194 - DNA, 25 bp, Mus musculus
gcctgagcatggacattggtctgga

SEQ ID NO: 555195 - DNA, 25 bp, Mus musculus
gcctgagcatggtcattggtctgga

SEQ ID NO: 555196 - DNA, 25 bp, Mus musculus
gcctgagccaagaatctcgtaccag

SEQ ID NO: 555197 - DNA, 25 bp, Mus musculus
gcctgagccaagtatctcgtaccag

SEQ ID NO: 555198 - DNA, 25 bp, Mus musculus
gcctgagccacgaagaaaacctcgt

SEQ ID NO: 555199 - DNA, 25 bp, Mus musculus
gcctgagccacgtagaaaacctcgt

SEQ ID NO: 555200 - DNA, 25 bp, Mus musculus
gcctgagccaggcaacactgttgtt

SEQ ID NO: 555201 - DNA, 25 bp, Mus musculus
gcctgagccagggaacactgttgtt

SEQ ID NO: 555202 - DNA, 25 bp, Mus musculus
gcctgagccattattgggctcccca

SEQ ID NO: 555203 - DNA, 25 bp, Mus musculus
gcctgagccatttttgggctcccca

SEQ ID NO: 555204 - DNA, 25 bp, Mus musculus
gcctgagcccttcatatcgggaagt

SEQ ID NO: 555205 - DNA, 25 bp, Mus musculus
gcctgagcccttgatatcgggaagt

SEQ ID NO: 555206 - DNA, 25 bp, Mus musculus
gcctgagccgtgatgctaggaaaca

SEQ ID NO: 555207 - DNA, 25 bp, Mus musculus
gcctgagccgtgttgctaggaaaca

SEQ ID NO: 555208 - DNA, 25 bp, Mus musculus
gcctgagcctccaggtgggcaatat

SEQ ID NO: 555209 - DNA, 25 bp, Mus musculus
gcctgagcctcctggtgggcaatat

SEQ ID NO: 555210 - DNA, 25 bp, Mus musculus
gcctgagcggccatcagcagagaaa

SEQ ID NO: 555211 - DNA, 25 bp, Mus musculus
gcctgagcggccttcagcagagaaa

SEQ ID NO: 555212 - DNA, 25 bp, Mus musculus
gcctgagctaccctactttaacatt

SEQ ID NO: 555213 - DNA, 25 bp, Mus musculus
gcctgagctaccgtactttaacatt

SEQ ID NO: 555214 - DNA, 25 bp, Mus musculus
gcctgagctagcaaatgaccacttt

SEQ ID NO: 555215 - DNA, 25 bp, Mus musculus
gcctgagctagctaatgaccacttt

SEQ ID NO: 555216 - DNA, 25 bp, Mus musculus
gcctgagctcagactttgccaaagt

SEQ ID NO: 555217 - DNA, 25 bp, Mus musculus
gcctgagctcagtctttgccaaagt

SEQ ID NO: 555218 - DNA, 25 bp, Mus musculus
gcctgagctgcaagcgatcctataa

SEQ ID NO: 555219 - DNA, 25 bp, Mus musculus
gcctgagctgcatgcgatcctataa

SEQ ID NO: 555220 - DNA, 25 bp, Mus musculus
gcctgagctgtcagagtggtgatat

SEQ ID NO: 555221 - DNA, 25 bp, Mus musculus
gcctgagctgtctgagtggtgatat

SEQ ID NO: 555222 - DNA, 25 bp, Mus musculus
gcctgagcttagctgctccaaagat

SEQ ID NO: 555223 - DNA, 25 bp, Mus musculus
gcctgagcttaggtgctccaaagat

SEQ ID NO: 555224 - DNA, 25 bp, Mus musculus
gcctgagcttgcagccctctgagag

SEQ ID NO: 555225 - DNA, 25 bp, Mus musculus
gcctgagcttgctgccctctgagag

SEQ ID NO: 555226 - DNA, 25 bp, Mus musculus
gcctgaggaacacggccacccaggt

SEQ ID NO: 555227 - DNA, 25 bp, Mus musculus
gcctgaggaacagggccacccaggt

SEQ ID NO: 555228 - DNA, 25 bp, Mus musculus
gcctgaggacatactgccttgtcaa

SEQ ID NO: 555229 - DNA, 25 bp, Mus musculus
gcctgaggacattctgccttgtcaa

SEQ ID NO: 555230 - DNA, 25 bp, Mus musculus
gcctgaggaccgcacagagatacta

SEQ ID NO: 555231 - DNA, 25 bp, Mus musculus
gcctgaggaccggacagagatacta

SEQ ID NO: 555232 - DNA, 25 bp, Mus musculus
gcctgaggacctccgactagactga

SEQ ID NO: 555233 - DNA, 25 bp, Mus musculus
gcctgaggacctgcgactagactga

SEQ ID NO: 555234 - DNA, 25 bp, Mus musculus
gcctgaggacgacgctgtgtattac

SEQ ID NO: 555235 - DNA, 25 bp, Mus musculus
gcctgaggacgaggctgtgtattac

SEQ ID NO: 555236 - DNA, 25 bp, Mus musculus
gcctgaggacgccaggttttttcct

SEQ ID NO: 555237 - DNA, 25 bp, Mus musculus
gcctgaggacgcgaggttttttcct

SEQ ID NO: 555238 - DNA, 25 bp, Mus musculus
gcctgaggactactccatgtgtgga

SEQ ID NO: 555239 - DNA, 25 bp, Mus musculus
gcctgaggactagtccatgtgtgga

SEQ ID NO: 555240 - DNA, 25 bp, Mus musculus
gcctgaggactgaatgctagcccaa

SEQ ID NO: 555241 - DNA, 25 bp, Mus musculus
gcctgaggactgtatgctagcccaa

SEQ ID NO: 555242 - DNA, 25 bp, Mus musculus
gcctgaggagctcatgggtcaccca

SEQ ID NO: 555243 - DNA, 25 bp, Mus musculus
gcctgaggagctgatgggtcaccca

SEQ ID NO: 555244 - DNA, 25 bp, Mus musculus
gcctgaggagttcgctttctgagcc

SEQ ID NO: 555245 - DNA, 25 bp, Mus musculus
gcctgaggagttggctttctgagcc

SEQ ID NO: 555246 - DNA, 25 bp, Mus musculus
gcctgaggatacactcacctttgaa

SEQ ID NO: 555247 - DNA, 25 bp, Mus musculus
gcctgaggatactctcacctttgaa

SEQ ID NO: 555248 - DNA, 25 bp, Mus musculus
gcctgaggccagctgacccgtttgt

SEQ ID NO: 555249 - DNA, 25 bp, Mus musculus
gcctgaggccaggtgacccgtttgt

SEQ ID NO: 555250 - DNA, 25 bp, Mus musculus
gcctgaggccgaacctgcctgaggc

SEQ ID NO: 555251 - DNA, 25 bp, Mus musculus
gcctgaggccgatcctgcctgaggc

SEQ ID NO: 555252 - DNA, 25 bp, Mus musculus
gcctgagggagcacaaataatcctt

SEQ ID NO: 555253 - DNA, 25 bp, Mus musculus
gcctgagggagctcaaataatcctt

SEQ ID NO: 555254 - DNA, 25 bp, Mus musculus
gcctgagggcatctcctctgacaaa

SEQ ID NO: 555255 - DNA, 25 bp, Mus musculus
gcctgagggcatgtcctctgacaaa

SEQ ID NO: 555256 - DNA, 25 bp, Mus musculus
gcctgagggtgtcttcttcagttca

SEQ ID NO: 555257 - DNA, 25 bp, Mus musculus
gcctgagggtgtgttcttcagttca

SEQ ID NO: 555258 - DNA, 25 bp, Mus musculus
gcctgaggtcagagctcactgatgt

SEQ ID NO: 555259 - DNA, 25 bp, Mus musculus
gcctgaggtcagtgctcactgatgt

SEQ ID NO: 555260 - DNA, 25 bp, Mus musculus
gcctgaggtctacaagcctgtaatt

SEQ ID NO: 555261 - DNA, 25 bp, Mus musculus
gcctgaggtctagaagcctgtaatt

SEQ ID NO: 555262 - DNA, 25 bp, Mus musculus
gcctgaggtggtcaacatccttcaa

SEQ ID NO: 555263 - DNA, 25 bp, Mus musculus
gcctgaggtggtgaacatccttcaa

SEQ ID NO: 555264 - DNA, 25 bp, Mus musculus
gcctgaggtgtcatctgagaggaac

SEQ ID NO: 555265 - DNA, 25 bp, Mus musculus
gcctgaggtgtcttctgagaggaac

SEQ ID NO: 555266 - DNA, 25 bp, Mus musculus
gcctgagtcaggagaattgctctta

SEQ ID NO: 555267 - DNA, 25 bp, Mus musculus
gcctgagtcaggtgaattgctctta

SEQ ID NO: 555268 - DNA, 25 bp, Mus musculus
gcctgagtccctagcaattttgaag

SEQ ID NO: 555269 - DNA, 25 bp, Mus musculus
gcctgagtcccttgcaattttgaag

SEQ ID NO: 555270 - DNA, 25 bp, Mus musculus
gcctgagtctcacttgctgaactaa

SEQ ID NO: 555271 - DNA, 25 bp, Mus musculus
gcctgagtctcagttgctgaactaa

SEQ ID NO: 555272 - DNA, 25 bp, Mus musculus
gcctgagtctccaaaccgaagaaaa

SEQ ID NO: 555273 - DNA, 25 bp, Mus musculus
gcctgagtctcctaaccgaagaaaa

SEQ ID NO: 555274 - DNA, 25 bp, Mus musculus
gcctgagtgaacagctgctgggctc

SEQ ID NO: 555275 - DNA, 25 bp, Mus musculus
gcctgagtgaactgctgctgggctc

SEQ ID NO: 555276 - DNA, 25 bp, Mus musculus
gcctgagtggcaacatgaatttgat

SEQ ID NO: 555277 - DNA, 25 bp, Mus musculus
gcctgagtggcatcatgaatttgat

SEQ ID NO: 555278 - DNA, 25 bp, Mus musculus
gcctgagttcctacatcttgtaatc

SEQ ID NO: 555279 - DNA, 25 bp, Mus musculus
gcctgagttccttcatcttgtaatc

SEQ ID NO: 555280 - DNA, 25 bp, Mus musculus
gcctgagttgatatccgcagctgca

SEQ ID NO: 555281 - DNA, 25 bp, Mus musculus
gcctgagttgatttccgcagctgca

SEQ ID NO: 555282 - DNA, 25 bp, Mus musculus
gcctgagttgcaaagctggtgtctg

SEQ ID NO: 555283 - DNA, 25 bp, Mus musculus
gcctgagttgcatagctggtgtctg

SEQ ID NO: 555284 - DNA, 25 bp, Mus musculus
gcctgagtttacaggcagcacttgg

SEQ ID NO: 555285 - DNA, 25 bp, Mus musculus
gcctgagtttactggcagcacttgg

SEQ ID NO: 555286 - DNA, 25 bp, Mus musculus
gcctgataacccaggttgtttgcat

SEQ ID NO: 555287 - DNA, 25 bp, Mus musculus
gcctgataaccctggttgtttgcat

SEQ ID NO: 555288 - DNA, 25 bp, Mus musculus
gcctgatacatcactacacttttat

SEQ ID NO: 555289 - DNA, 25 bp, Mus musculus
gcctgatacatctctacacttttat

SEQ ID NO: 555290 - DNA, 25 bp, Mus musculus
gcctgatagaataaatctgccaaca

SEQ ID NO: 555291 - DNA, 25 bp, Mus musculus
gcctgatagaattaatctgccaaca

SEQ ID NO: 555292 - DNA, 25 bp, Mus musculus
gcctgatagacacttgtgcctgcgt

SEQ ID NO: 555293 - DNA, 25 bp, Mus musculus
gcctgatagacagttgtgcctgcgt

SEQ ID NO: 555294 - DNA, 25 bp, Mus musculus
gcctgatagagccatagaagttcta

SEQ ID NO: 555295 - DNA, 25 bp, Mus musculus
gcctgatagagcgatagaagttcta

SEQ ID NO: 555296 - DNA, 25 bp, Mus musculus
gcctgatagggaatattactccatc

SEQ ID NO: 555297 - DNA, 25 bp, Mus musculus
gcctgatagggattattactccatc

SEQ ID NO: 555298 - DNA, 25 bp, Mus musculus
gcctgatatgccacactgtggaaga

SEQ ID NO: 555299 - DNA, 25 bp, Mus musculus
gcctgatatgcctcactgtggaaga

SEQ ID NO: 555300 - DNA, 25 bp, Mus musculus
gcctgatcaagtatctgctttctgc

SEQ ID NO: 555301 - DNA, 25 bp, Mus musculus
gcctgatcaagtttctgctttctgc

SEQ ID NO: 555302 - DNA, 25 bp, Mus musculus
gcctgatcacatcactgatcacggc

SEQ ID NO: 555303 - DNA, 25 bp, Mus musculus
gcctgatcacatgactgatcacggc

SEQ ID NO: 555304 - DNA, 25 bp, Mus musculus
gcctgatcacgtcgaggacatgaaa

SEQ ID NO: 555305 - DNA, 25 bp, Mus musculus
gcctgatcacgtggaggacatgaaa

SEQ ID NO: 555306 - DNA, 25 bp, Mus musculus
gcctgatgaaggactattattccaa

SEQ ID NO: 555307 - DNA, 25 bp, Mus musculus
gcctgatgaaggtctattattccaa

SEQ ID NO: 555308 - DNA, 25 bp, Mus musculus
gcctgatgacataagcactgtggta

SEQ ID NO: 555309 - DNA, 25 bp, Mus musculus
gcctgatgacatcggctgtggcaca

SEQ ID NO: 555310 - DNA, 25 bp, Mus musculus
gcctgatgacatgggctgtggcaca

SEQ ID NO: 555311 - DNA, 25 bp, Mus musculus
gcctgatgacattagcactgtggta

SEQ ID NO: 555312 - DNA, 25 bp, Mus musculus
gcctgatgactgatgcccatttgat

SEQ ID NO: 555313 - DNA, 25 bp, Mus musculus
gcctgatgactgttgcccatttgat

SEQ ID NO: 555314 - DNA, 25 bp, Mus musculus
gcctgatgacttcactttaagcccc

SEQ ID NO: 555315 - DNA, 25 bp, Mus musculus
gcctgatgacttgactttaagcccc

SEQ ID NO: 555316 - DNA, 25 bp, Mus musculus
gcctgatgatagcttttcacacatg

SEQ ID NO: 555317 - DNA, 25 bp, Mus musculus
gcctgatgataggttttcacacatg

SEQ ID NO: 555318 - DNA, 25 bp, Mus musculus
gcctgatgcaaaaaaccctgatggt

SEQ ID NO: 555319 - DNA, 25 bp, Mus musculus
gcctgatgcaaataaccctgatggt

SEQ ID NO: 555320 - DNA, 25 bp, Mus musculus
gcctgatgctgacttaccttggaat

SEQ ID NO: 555321 - DNA, 25 bp, Mus musculus
gcctgatgctgagttaccttggaat

SEQ ID NO: 555322 - DNA, 25 bp, Mus musculus
gcctgatggattcccggagcttaga

SEQ ID NO: 555323 - DNA, 25 bp, Mus musculus
gcctgatggattgccggagcttaga

SEQ ID NO: 555324 - DNA, 25 bp, Mus musculus
gcctgatggcgtaaatgactcctga

SEQ ID NO: 555325 - DNA, 25 bp, Mus musculus
gcctgatggcgttaatgactcctga

SEQ ID NO: 555326 - DNA, 25 bp, Mus musculus
gcctgatggcttcccttcagaatga

SEQ ID NO: 555327 - DNA, 25 bp, Mus musculus
gcctgatggcttgccttcagaatga

SEQ ID NO: 555328 - DNA, 25 bp, Mus musculus
gcctgatgggcaatgagctttatta

SEQ ID NO: 555329 - DNA, 25 bp, Mus musculus
gcctgatgggcactacagactctta

SEQ ID NO: 555330 - DNA, 25 bp, Mus musculus
gcctgatgggcagtacagactctta

SEQ ID NO: 555331 - DNA, 25 bp, Mus musculus
gcctgatgggcattgagctttatta

SEQ ID NO: 555332 - DNA, 25 bp, Mus musculus
gcctgatggttaatctccgttctcc

SEQ ID NO: 555333 - DNA, 25 bp, Mus musculus
gcctgatggttattctccgttctcc

SEQ ID NO: 555334 - DNA, 25 bp, Mus musculus
gcctgatggtttattggcgtcagat

SEQ ID NO: 555335 - DNA, 25 bp, Mus musculus
gcctgatggttttttggcgtcagat

SEQ ID NO: 555336 - DNA, 25 bp, Mus musculus
gcctgatgtaacaggcctgtaacaa

SEQ ID NO: 555337 - DNA, 25 bp, Mus musculus
gcctgatgtaactggcctgtaacaa

SEQ ID NO: 555338 - DNA, 25 bp, Mus musculus
gcctgatgtcacacagcgtttgcag

SEQ ID NO: 555339 - DNA, 25 bp, Mus musculus
gcctgatgtcactcagcgtttgcag

SEQ ID NO: 555340 - DNA, 25 bp, Mus musculus
gcctgatgtcagagtcaattgtgtg

SEQ ID NO: 555341 - DNA, 25 bp, Mus musculus
gcctgatgtcagtgtcaattgtgtg

SEQ ID NO: 555342 - DNA, 25 bp, Mus musculus
gcctgatgtcctcatcttggatgaa

SEQ ID NO: 555343 - DNA, 25 bp, Mus musculus
gcctgatgtcctgatcttggatgaa

SEQ ID NO: 555344 - DNA, 25 bp, Mus musculus
gcctgatgtgctctttcctggtgac

SEQ ID NO: 555345 - DNA, 25 bp, Mus musculus
gcctgatgtgctgtttcctggtgac

SEQ ID NO: 555346 - DNA, 25 bp, Mus musculus
gcctgatgttaacaatgtttagaat

SEQ ID NO: 555347 - DNA, 25 bp, Mus musculus
gcctgatgttaagaatgtttagaat

SEQ ID NO: 555348 - DNA, 25 bp, Mus musculus
gcctgattaactctgggtggtaccc

SEQ ID NO: 555349 - DNA, 25 bp, Mus musculus
gcctgattaactgtgggtggtaccc

SEQ ID NO: 555350 - DNA, 25 bp, Mus musculus
gcctgattaatcaacatgctggaag

SEQ ID NO: 555351 - DNA, 25 bp, Mus musculus
gcctgattaatctacatgctggaag

SEQ ID NO: 555352 - DNA, 25 bp, Mus musculus
gcctgattacctacatagatgcaac

SEQ ID NO: 555353 - DNA, 25 bp, Mus musculus
gcctgattaccttcatagatgcaac

SEQ ID NO: 555354 - DNA, 25 bp, Mus musculus
gcctgattcacccttattggcatgt

SEQ ID NO: 555355 - DNA, 25 bp, Mus musculus
gcctgattcaccgttattggcatgt

SEQ ID NO: 555356 - DNA, 25 bp, Mus musculus
gcctgattcaggaaacccggattct

SEQ ID NO: 555357 - DNA, 25 bp, Mus musculus
gcctgattcaggtaacccggattct

SEQ ID NO: 555358 - DNA, 25 bp, Mus musculus
gcctgattcatgatgctatctgctg

SEQ ID NO: 555359 - DNA, 25 bp, Mus musculus
gcctgattcatgttgctatctgctg

SEQ ID NO: 555360 - DNA, 25 bp, Mus musculus
gcctgattctcacccaagtcatgat

SEQ ID NO: 555361 - DNA, 25 bp, Mus musculus
gcctgattctcagccaagtcatgat

SEQ ID NO: 555362 - DNA, 25 bp, Mus musculus
gcctgattcttgcatctgtagttac

SEQ ID NO: 555363 - DNA, 25 bp, Mus musculus
gcctgattcttggatctgtagttac

SEQ ID NO: 555364 - DNA, 25 bp, Mus musculus
gcctgattggtgaaagctgtcatct

SEQ ID NO: 555365 - DNA, 25 bp, Mus musculus
gcctgattggtgctggtatcctgat

SEQ ID NO: 555366 - DNA, 25 bp, Mus musculus
gcctgattggtggtggtatcctgat

SEQ ID NO: 555367 - DNA, 25 bp, Mus musculus
gcctgattggtgtaagctgtcatct

SEQ ID NO: 555368 - DNA, 25 bp, Mus musculus
gcctgattgtagattgctccttaaa

SEQ ID NO: 555369 - DNA, 25 bp, Mus musculus
gcctgattgtagtttgctccttaaa

SEQ ID NO: 555370 - DNA, 25 bp, Mus musculus
gcctgattgtgtcttgcgccttcta

SEQ ID NO: 555371 - DNA, 25 bp, Mus musculus
gcctgattgtgtgttgcgccttcta

SEQ ID NO: 555372 - DNA, 25 bp, Mus musculus
gcctgatttaggcagagatctttat

SEQ ID NO: 555373 - DNA, 25 bp, Mus musculus
gcctgatttagggagagatctttat

SEQ ID NO: 555374 - DNA, 25 bp, Mus musculus
gcctgatttggcattcgaaactgga

SEQ ID NO: 555375 - DNA, 25 bp, Mus musculus
gcctgatttggctttcgaaactgga

SEQ ID NO: 555376 - DNA, 25 bp, Mus musculus
gcctgatttgggagctaggagctta

SEQ ID NO: 555377 - DNA, 25 bp, Mus musculus
gcctgatttgggtgctaggagctta

SEQ ID NO: 555378 - DNA, 25 bp, Mus musculus
gcctgattttcgcctgtggatgaag

SEQ ID NO: 555379 - DNA, 25 bp, Mus musculus
gcctgattttcggctgtggatgaag

SEQ ID NO: 555380 - DNA, 25 bp, Mus musculus
gcctgattttgaatttaaccctgaa

SEQ ID NO: 555381 - DNA, 25 bp, Mus musculus
gcctgattttgattttaaccctgaa

SEQ ID NO: 555382 - DNA, 25 bp, Mus musculus
gcctgcaaagacagaaagttaatta

SEQ ID NO: 555383 - DNA, 25 bp, Mus musculus
gcctgcaaagactgaaagttaatta

SEQ ID NO: 555384 - DNA, 25 bp, Mus musculus
gcctgcaaagagctgttgcttgcct

SEQ ID NO: 555385 - DNA, 25 bp, Mus musculus
gcctgcaaagaggtgttgcttgcct

SEQ ID NO: 555386 - DNA, 25 bp, Mus musculus
gcctgcaacccacctcatataaatg

SEQ ID NO: 555387 - DNA, 25 bp, Mus musculus
gcctgcaacccagctcatataaatg

SEQ ID NO: 555388 - DNA, 25 bp, Mus musculus
gcctgcaaccccaacctgggaagaa

SEQ ID NO: 555389 - DNA, 25 bp, Mus musculus
gcctgcaacccctacctgggaagaa

SEQ ID NO: 555390 - DNA, 25 bp, Mus musculus
gcctgcaacgtcatcgtgaacggca

SEQ ID NO: 555391 - DNA, 25 bp, Mus musculus
gcctgcaacgtcttcgtgaacggca

SEQ ID NO: 555392 - DNA, 25 bp, Mus musculus
gcctgcaagcaacagctttctttgt

SEQ ID NO: 555393 - DNA, 25 bp, Mus musculus
gcctgcaagcaagagctttctttgt

SEQ ID NO: 555394 - DNA, 25 bp, Mus musculus
gcctgcaagcgaaatctggcatgat

SEQ ID NO: 555395 - DNA, 25 bp, Mus musculus
gcctgcaagcgatatctggcatgat

SEQ ID NO: 555396 - DNA, 25 bp, Mus musculus
gcctgcaatcctatctcttggaagg

SEQ ID NO: 555397 - DNA, 25 bp, Mus musculus
gcctgcaatcctttctcttggaagg

SEQ ID NO: 555398 - DNA, 25 bp, Mus musculus
gcctgcacaaacagtccagcatgac

SEQ ID NO: 555399 - DNA, 25 bp, Mus musculus
gcctgcacaaactgtccagcatgac

SEQ ID NO: 555400 - DNA, 25 bp, Mus musculus
gcctgcacaaataatgtcttctgtt

SEQ ID NO: 555401 - DNA, 25 bp, Mus musculus
gcctgcacaaattatgtcttctgtt

SEQ ID NO: 555402 - DNA, 25 bp, Mus musculus
gcctgcacagcaccttgtcagagtg

SEQ ID NO: 555403 - DNA, 25 bp, Mus musculus
gcctgcacagcagcttgtcagagtg

SEQ ID NO: 555404 - DNA, 25 bp, Mus musculus
gcctgcacagggcaagccctttagg

SEQ ID NO: 555405 - DNA, 25 bp, Mus musculus
gcctgcacaggggaagccctttagg

SEQ ID NO: 555406 - DNA, 25 bp, Mus musculus
gcctgcacaggtatttctgaggttt

SEQ ID NO: 555407 - DNA, 25 bp, Mus musculus
gcctgcacaggtttttctgaggttt

SEQ ID NO: 555408 - DNA, 25 bp, Mus musculus
gcctgcaccgctcagactggagact

SEQ ID NO: 555409 - DNA, 25 bp, Mus musculus
gcctgcaccgctgagactggagact

SEQ ID NO: 555410 - DNA, 25 bp, Mus musculus
gcctgcacggaaatactgtctgttg

SEQ ID NO: 555411 - DNA, 25 bp, Mus musculus
gcctgcacggaattactgtctgttg

SEQ ID NO: 555412 - DNA, 25 bp, Mus musculus
gcctgcactcagaccaacttggaga

SEQ ID NO: 555413 - DNA, 25 bp, Mus musculus
gcctgcactcagtccaacttggaga

SEQ ID NO: 555414 - DNA, 25 bp, Mus musculus
gcctgcactcttcacgtgtgtagac

SEQ ID NO: 555415 - DNA, 25 bp, Mus musculus
gcctgcactcttgacgtgtgtagac

SEQ ID NO: 555416 - DNA, 25 bp, Mus musculus
gcctgcactgccaacatacataaat

SEQ ID NO: 555417 - DNA, 25 bp, Mus musculus
gcctgcactgcctacatacataaat

SEQ ID NO: 555418 - DNA, 25 bp, Mus musculus
gcctgcactgtaacattggacaaat

SEQ ID NO: 555419 - DNA, 25 bp, Mus musculus
gcctgcactgtatcattggacaaat

SEQ ID NO: 555420 - DNA, 25 bp, Mus musculus
gcctgcactgtgcttcttcagtcaa

SEQ ID NO: 555421 - DNA, 25 bp, Mus musculus
gcctgcactgtggttcttcagtcaa

SEQ ID NO: 555422 - DNA, 25 bp, Mus musculus
gcctgcagaaagcttagtgaccatc

SEQ ID NO: 555423 - DNA, 25 bp, Mus musculus
gcctgcagaaaggttagtgaccatc

SEQ ID NO: 555424 - DNA, 25 bp, Mus musculus
gcctgcagagcccttaaagagttat

SEQ ID NO: 555425 - DNA, 25 bp, Mus musculus
gcctgcagagccgttaaagagttat

SEQ ID NO: 555426 - DNA, 25 bp, Mus musculus
gcctgcagcagtaataattttctat

SEQ ID NO: 555427 - DNA, 25 bp, Mus musculus
gcctgcagcagttataattttctat

SEQ ID NO: 555428 - DNA, 25 bp, Mus musculus
gcctgcagcccaccgtcatggagga

SEQ ID NO: 555429 - DNA, 25 bp, Mus musculus
gcctgcagcccagcgtcatggagga

SEQ ID NO: 555430 - DNA, 25 bp, Mus musculus
gcctgcagcctgaggaattactgct

SEQ ID NO: 555431 - DNA, 25 bp, Mus musculus
gcctgcagcctgtggaattactgct

SEQ ID NO: 555432 - DNA, 25 bp, Mus musculus
gcctgcaggaacatagagacacact

SEQ ID NO: 555433 - DNA, 25 bp, Mus musculus
gcctgcaggaacttagagacacact

SEQ ID NO: 555434 - DNA, 25 bp, Mus musculus
gcctgcaggacaccgtttaggaact

SEQ ID NO: 555435 - DNA, 25 bp, Mus musculus
gcctgcaggacagcgtttaggaact

SEQ ID NO: 555436 - DNA, 25 bp, Mus musculus
gcctgcagggacacttgcttcctgg

SEQ ID NO: 555437 - DNA, 25 bp, Mus musculus
gcctgcagggactcttgcttcctgg

SEQ ID NO: 555438 - DNA, 25 bp, Mus musculus
gcctgcagttgaccaaggaagctga

SEQ ID NO: 555439 - DNA, 25 bp, Mus musculus
gcctgcagttgagcaaggaagctga

SEQ ID NO: 555440 - DNA, 25 bp, Mus musculus
gcctgcagtttgaacccctttttat

SEQ ID NO: 555441 - DNA, 25 bp, Mus musculus
gcctgcagtttgtacccctttttat

SEQ ID NO: 555442 - DNA, 25 bp, Mus musculus
gcctgcatcagacaatggctggcca

SEQ ID NO: 555443 - DNA, 25 bp, Mus musculus
gcctgcatcagacgatttagctcag

SEQ ID NO: 555444 - DNA, 25 bp, Mus musculus
gcctgcatcagagaatggctggcca

SEQ ID NO: 555445 - DNA, 25 bp, Mus musculus
gcctgcatcagaggatttagctcag

SEQ ID NO: 555446 - DNA, 25 bp, Mus musculus
gcctgcatccagaagcacaaaggga

SEQ ID NO: 555447 - DNA, 25 bp, Mus musculus
gcctgcatccagtagcacaaaggga

SEQ ID NO: 555448 - DNA, 25 bp, Mus musculus
gcctgcatccgtatagctatgagtg

SEQ ID NO: 555449 - DNA, 25 bp, Mus musculus
gcctgcatccgtttagctatgagtg

SEQ ID NO: 555450 - DNA, 25 bp, Mus musculus
gcctgcatctgcctgatcatattta

SEQ ID NO: 555451 - DNA, 25 bp, Mus musculus
gcctgcatctgcgtgatcatattta

SEQ ID NO: 555452 - DNA, 25 bp, Mus musculus
gcctgcatgccgctttaaattgttt

SEQ ID NO: 555453 - DNA, 25 bp, Mus musculus
gcctgcatgccggtttaaattgttt

SEQ ID NO: 555454 - DNA, 25 bp, Mus musculus
gcctgcatggcgactacataattat

SEQ ID NO: 555455 - DNA, 25 bp, Mus musculus
gcctgcatggcgtctacataattat

SEQ ID NO: 555456 - DNA, 25 bp, Mus musculus
gcctgcatggttcagtaccagaagt

SEQ ID NO: 555457 - DNA, 25 bp, Mus musculus
gcctgcatggttgagtaccagaagt

SEQ ID NO: 555458 - DNA, 25 bp, Mus musculus
gcctgcatgtagctctgtatcgcat

SEQ ID NO: 555459 - DNA, 25 bp, Mus musculus
gcctgcatgtaggtctgtatcgcat

SEQ ID NO: 555460 - DNA, 25 bp, Mus musculus
gcctgcatgtctcccctatatgaat

SEQ ID NO: 555461 - DNA, 25 bp, Mus musculus
gcctgcatgtctgccctatatgaat

SEQ ID NO: 555462 - DNA, 25 bp, Mus musculus
gcctgcattaaaatggaccccaagg

SEQ ID NO: 555463 - DNA, 25 bp, Mus musculus
gcctgcattaaattggaccccaagg

SEQ ID NO: 555464 - DNA, 25 bp, Mus musculus
gcctgcattctaatctgttcaaaac

SEQ ID NO: 555465 - DNA, 25 bp, Mus musculus
gcctgcattctattctgttcaaaac

SEQ ID NO: 555466 - DNA, 25 bp, Mus musculus
gcctgcattgagcttgggaaatccc

SEQ ID NO: 555467 - DNA, 25 bp, Mus musculus
gcctgcattgaggttgggaaatccc

SEQ ID NO: 555468 - DNA, 25 bp, Mus musculus
gcctgcattgtcatggtatttttgt

SEQ ID NO: 555469 - DNA, 25 bp, Mus musculus
gcctgcattgtcttggtatttttgt

SEQ ID NO: 555470 - DNA, 25 bp, Mus musculus
gcctgcattgtgattggtgccagac

SEQ ID NO: 555471 - DNA, 25 bp, Mus musculus
gcctgcattgtgtttggtgccagac

SEQ ID NO: 555472 - DNA, 25 bp, Mus musculus
gcctgcatttctatacagccgttag

SEQ ID NO: 555473 - DNA, 25 bp, Mus musculus
gcctgcatttctttacagccgttag

SEQ ID NO: 555474 - DNA, 25 bp, Mus musculus
gcctgccaaattcaagactgccttt

SEQ ID NO: 555475 - DNA, 25 bp, Mus musculus
gcctgccaaattgaagactgccttt

SEQ ID NO: 555476 - DNA, 25 bp, Mus musculus
gcctgccactgtaaagaccagcatc

SEQ ID NO: 555477 - DNA, 25 bp, Mus musculus
gcctgccactgttaagaccagcatc

SEQ ID NO: 555478 - DNA, 25 bp, Mus musculus
gcctgccagagtatctgtgcatcat

SEQ ID NO: 555479 - DNA, 25 bp, Mus musculus
gcctgccagagtttctgtgcatcat

SEQ ID NO: 555480 - DNA, 25 bp, Mus musculus
gcctgccagccccagatgagaagat

SEQ ID NO: 555481 - DNA, 25 bp, Mus musculus
gcctgccagcccgagatgagaagat

SEQ ID NO: 555482 - DNA, 25 bp, Mus musculus
gcctgccagctcagcaatcagagat

SEQ ID NO: 555483 - DNA, 25 bp, Mus musculus
gcctgccagctctgcaatcagagat

SEQ ID NO: 555484 - DNA, 25 bp, Mus musculus
gcctgccagtaaccccaggaagagt

SEQ ID NO: 555485 - DNA, 25 bp, Mus musculus
gcctgccagtaagcccaggaagagt

SEQ ID NO: 555486 - DNA, 25 bp, Mus musculus
gcctgccatcctaatacttggaaat

SEQ ID NO: 555487 - DNA, 25 bp, Mus musculus
gcctgccatccttatacttggaaat

SEQ ID NO: 555488 - DNA, 25 bp, Mus musculus
gcctgccatcttctgcaatgtgcaa

SEQ ID NO: 555489 - DNA, 25 bp, Mus musculus
gcctgccatcttgtgcaatgtgcaa

SEQ ID NO: 555490 - DNA, 25 bp, Mus musculus
gcctgcccagcaaatgtagacacac

SEQ ID NO: 555491 - DNA, 25 bp, Mus musculus
gcctgcccagcatatgtagacacac

SEQ ID NO: 555492 - DNA, 25 bp, Mus musculus
gcctgcccgatcatcaaactttttt

SEQ ID NO: 555493 - DNA, 25 bp, Mus musculus
gcctgcccgatcttcaaactttttt

SEQ ID NO: 555494 - DNA, 25 bp, Mus musculus
gcctgccctaagaggtataatccta

SEQ ID NO: 555495 - DNA, 25 bp, Mus musculus
gcctgccctaagtggtataatccta

SEQ ID NO: 555496 - DNA, 25 bp, Mus musculus
gcctgccctgtaacaaagcatactt

SEQ ID NO: 555497 - DNA, 25 bp, Mus musculus
gcctgccctgtatcaaagcatactt

SEQ ID NO: 555498 - DNA, 25 bp, Mus musculus
gcctgcccttacaagtggagccaga

SEQ ID NO: 555499 - DNA, 25 bp, Mus musculus
gcctgcccttactagtggagccaga

SEQ ID NO: 555500 - DNA, 25 bp, Mus musculus
gcctgccctttacagcttctaagag

SEQ ID NO: 555501 - DNA, 25 bp, Mus musculus
gcctgccctttagagcttctaagag

SEQ ID NO: 555502 - DNA, 25 bp, Mus musculus
gcctgcctaaccagctcaaataagg

SEQ ID NO: 555503 - DNA, 25 bp, Mus musculus
gcctgcctaacctgctcaaataagg

SEQ ID NO: 555504 - DNA, 25 bp, Mus musculus
gcctgcctaaggatgataccacctg

SEQ ID NO: 555505 - DNA, 25 bp, Mus musculus
gcctgcctaaggttgataccacctg

SEQ ID NO: 555506 - DNA, 25 bp, Mus musculus
gcctgcctactgagcccgctgatgg

SEQ ID NO: 555507 - DNA, 25 bp, Mus musculus
gcctgcctactgtgcccgctgatgg

SEQ ID NO: 555508 - DNA, 25 bp, Mus musculus
gcctgcctagcaagttaaagccctt

SEQ ID NO: 555509 - DNA, 25 bp, Mus musculus
gcctgcctagcacttggctgattat

SEQ ID NO: 555510 - DNA, 25 bp, Mus musculus
gcctgcctagcagttggctgattat

SEQ ID NO: 555511 - DNA, 25 bp, Mus musculus
gcctgcctagcatgttaaagccctt

SEQ ID NO: 555512 - DNA, 25 bp, Mus musculus
gcctgcctatatatctagcaatgat

SEQ ID NO: 555513 - DNA, 25 bp, Mus musculus
gcctgcctatatttctagcaatgat

SEQ ID NO: 555514 - DNA, 25 bp, Mus musculus
gcctgcctatgaattaagccatctc

SEQ ID NO: 555515 - DNA, 25 bp, Mus musculus
gcctgcctatgatttaagccatctc

SEQ ID NO: 555516 - DNA, 25 bp, Mus musculus
gcctgcctattacctgatcttatgg

SEQ ID NO: 555517 - DNA, 25 bp, Mus musculus
gcctgcctattagctgatcttatgg

SEQ ID NO: 555518 - DNA, 25 bp, Mus musculus
gcctgcctcagtcgttcagaagaga

SEQ ID NO: 555519 - DNA, 25 bp, Mus musculus
gcctgcctcagtggttcagaagaga

SEQ ID NO: 555520 - DNA, 25 bp, Mus musculus
gcctgcctcattagcaaaggctgga

SEQ ID NO: 555521 - DNA, 25 bp, Mus musculus
gcctgcctcatttgcaaaggctgga

SEQ ID NO: 555522 - DNA, 25 bp, Mus musculus
gcctgcctccacagcagattgagaa

SEQ ID NO: 555523 - DNA, 25 bp, Mus musculus
gcctgcctccactgcagattgagaa

SEQ ID NO: 555524 - DNA, 25 bp, Mus musculus
gcctgcctcgtcagcttgttttgat

SEQ ID NO: 555525 - DNA, 25 bp, Mus musculus
gcctgcctcgtctgcttgttttgat

SEQ ID NO: 555526 - DNA, 25 bp, Mus musculus
gcctgcctctcacttttatttcagt

SEQ ID NO: 555527 - DNA, 25 bp, Mus musculus
gcctgcctctcagttttatttcagt

SEQ ID NO: 555528 - DNA, 25 bp, Mus musculus
gcctgcctgagaaggagacggttta

SEQ ID NO: 555529 - DNA, 25 bp, Mus musculus
gcctgcctgagatggagacggttta

SEQ ID NO: 555530 - DNA, 25 bp, Mus musculus
gcctgcctgatcagacacctaatag

SEQ ID NO: 555531 - DNA, 25 bp, Mus musculus
gcctgcctgatctgacacctaatag

SEQ ID NO: 555532 - DNA, 25 bp, Mus musculus
gcctgcctgcagctatgattgtctg

SEQ ID NO: 555533 - DNA, 25 bp, Mus musculus
gcctgcctgcaggtatgattgtctg

SEQ ID NO: 555534 - DNA, 25 bp, Mus musculus
gcctgcctgcggcttagagtttttt

SEQ ID NO: 555535 - DNA, 25 bp, Mus musculus
gcctgcctgcgggttagagtttttt

SEQ ID NO: 555536 - DNA, 25 bp, Mus musculus
gcctgcctggaaactttatgcgaac

SEQ ID NO: 555537 - DNA, 25 bp, Mus musculus
gcctgcctggaatctttatgcgaac

SEQ ID NO: 555538 - DNA, 25 bp, Mus musculus
gcctgcctggcaaagcatacataga

SEQ ID NO: 555539 - DNA, 25 bp, Mus musculus
gcctgcctggcatagcatacataga

SEQ ID NO: 555540 - DNA, 25 bp, Mus musculus
gcctgcctggctcggtatcatactg

SEQ ID NO: 555541 - DNA, 25 bp, Mus musculus
gcctgcctggctgggtatcatactg

SEQ ID NO: 555542 - DNA, 25 bp, Mus musculus
gcctgcctgggacacttacatttta

SEQ ID NO: 555543 - DNA, 25 bp, Mus musculus
gcctgcctgggagacttacatttta

SEQ ID NO: 555544 - DNA, 25 bp, Mus musculus
gcctgcctgggtaattatcacacac

SEQ ID NO: 555545 - DNA, 25 bp, Mus musculus
gcctgcctgggttattatcacacac

SEQ ID NO: 555546 - DNA, 25 bp, Mus musculus
gcctgcctgtgtccttgaaccttgg

SEQ ID NO: 555547 - DNA, 25 bp, Mus musculus
gcctgcctgtgtgcttgaaccttgg

SEQ ID NO: 555548 - DNA, 25 bp, Mus musculus
gcctgccttagtacaatctgtttaa

SEQ ID NO: 555549 - DNA, 25 bp, Mus musculus
gcctgccttagttcaatctgtttaa

SEQ ID NO: 555550 - DNA, 25 bp, Mus musculus
gcctgccttattccagtggcctgtg

SEQ ID NO: 555551 - DNA, 25 bp, Mus musculus
gcctgccttattgcagtggcctgtg

SEQ ID NO: 555552 - DNA, 25 bp, Mus musculus
gcctgccttcgaagtcaagctgaaa

SEQ ID NO: 555553 - DNA, 25 bp, Mus musculus
gcctgccttcgatgtcaagctgaaa

SEQ ID NO: 555554 - DNA, 25 bp, Mus musculus
gcctgccttgcacagctaaaaccag

SEQ ID NO: 555555 - DNA, 25 bp, Mus musculus
gcctgccttgcagagctaaaaccag

SEQ ID NO: 555556 - DNA, 25 bp, Mus musculus
gcctgcgaaccaacttcaacaggtt

SEQ ID NO: 555557 - DNA, 25 bp, Mus musculus
gcctgcgaaccatcttcaacaggtt

SEQ ID NO: 555558 - DNA, 25 bp, Mus musculus
gcctgcgagagccattcctagtcga

SEQ ID NO: 555559 - DNA, 25 bp, Mus musculus
gcctgcgagagcgattcctagtcga

SEQ ID NO: 555560 - DNA, 25 bp, Mus musculus
gcctgcgcagaaagagctgttgcac

SEQ ID NO: 555561 - DNA, 25 bp, Mus musculus
gcctgcgcagaatgagctgttgcac

SEQ ID NO: 555562 - DNA, 25 bp, Mus musculus
gcctgcgccaccagtatgaagcagg

SEQ ID NO: 555563 - DNA, 25 bp, Mus musculus
gcctgcgccacctgtatgaagcagg

SEQ ID NO: 555564 - DNA, 25 bp, Mus musculus
gcctgcgttcccatttggcagaaaa

SEQ ID NO: 555565 - DNA, 25 bp, Mus musculus
gcctgcgttcccttttggcagaaaa

SEQ ID NO: 555566 - DNA, 25 bp, Mus musculus
gcctgctaaggaatcttcccgaact

SEQ ID NO: 555567 - DNA, 25 bp, Mus musculus
gcctgctaaggattcttcccgaact

SEQ ID NO: 555568 - DNA, 25 bp, Mus musculus
gcctgctacaggacaatctgcttgt

SEQ ID NO: 555569 - DNA, 25 bp, Mus musculus
gcctgctacaggtcaatctgcttgt

SEQ ID NO: 555570 - DNA, 25 bp, Mus musculus
gcctgctactgaaccattattgcat

SEQ ID NO: 555571 - DNA, 25 bp, Mus musculus
gcctgctactgaccgagctgtcatg

SEQ ID NO: 555572 - DNA, 25 bp, Mus musculus
gcctgctactgagcgagctgtcatg

SEQ ID NO: 555573 - DNA, 25 bp, Mus musculus
gcctgctactgatccattattgcat

SEQ ID NO: 555574 - DNA, 25 bp, Mus musculus
gcctgctaggccctgttgataacct

SEQ ID NO: 555575 - DNA, 25 bp, Mus musculus
gcctgctaggccgtgttgataacct

SEQ ID NO: 555576 - DNA, 25 bp, Mus musculus
gcctgctatgctatttgatggagtc

SEQ ID NO: 555577 - DNA, 25 bp, Mus musculus
gcctgctatgctttttgatggagtc

SEQ ID NO: 555578 - DNA, 25 bp, Mus musculus
gcctgctattatccccgaagtggag

SEQ ID NO: 555579 - DNA, 25 bp, Mus musculus
gcctgctattatgcccgaagtggag

SEQ ID NO: 555580 - DNA, 25 bp, Mus musculus
gcctgctcacaaccaattctaaata

SEQ ID NO: 555581 - DNA, 25 bp, Mus musculus
gcctgctcacaagcaattctaaata

SEQ ID NO: 555582 - DNA, 25 bp, Mus musculus
gcctgctcacggaactgcagtgtga

SEQ ID NO: 555583 - DNA, 25 bp, Mus musculus
gcctgctcacggtactgcagtgtga

SEQ ID NO: 555584 - DNA, 25 bp, Mus musculus
gcctgctcagacatcaggtttgcaa

SEQ ID NO: 555585 - DNA, 25 bp, Mus musculus
gcctgctcagacttcaggtttgcaa

SEQ ID NO: 555586 - DNA, 25 bp, Mus musculus
gcctgctcatagctactgcagccat

SEQ ID NO: 555587 - DNA, 25 bp, Mus musculus
gcctgctcataggtactgcagccat

SEQ ID NO: 555588 - DNA, 25 bp, Mus musculus
gcctgctcatatacttgaccagtgg

SEQ ID NO: 555589 - DNA, 25 bp, Mus musculus
gcctgctcatattcttgaccagtgg

SEQ ID NO: 555590 - DNA, 25 bp, Mus musculus
gcctgctcatgacgcttcagggtga

SEQ ID NO: 555591 - DNA, 25 bp, Mus musculus
gcctgctcatgaggcttcagggtga

SEQ ID NO: 555592 - DNA, 25 bp, Mus musculus
gcctgctccccaaatgaacagtgag

SEQ ID NO: 555593 - DNA, 25 bp, Mus musculus
gcctgctccccatatgaacagtgag

SEQ ID NO: 555594 - DNA, 25 bp, Mus musculus
gcctgctccgtgcacagtgggattt

SEQ ID NO: 555595 - DNA, 25 bp, Mus musculus
gcctgctccgtggacagtgggattt

SEQ ID NO: 555596 - DNA, 25 bp, Mus musculus
gcctgctcctcccaagtaaagaagc

SEQ ID NO: 555597 - DNA, 25 bp, Mus musculus
gcctgctcctccgaagtaaagaagc

SEQ ID NO: 555598 - DNA, 25 bp, Mus musculus
gcctgctccttactactacagtttt

SEQ ID NO: 555599 - DNA, 25 bp, Mus musculus
gcctgctccttagtactacagtttt

SEQ ID NO: 555600 - DNA, 25 bp, Mus musculus
gcctgctctaagagccgagaagatt

SEQ ID NO: 555601 - DNA, 25 bp, Mus musculus
gcctgctctaagtgccgagaagatt

SEQ ID NO: 555602 - DNA, 25 bp, Mus musculus
gcctgctctcctcaaagggaagaag

SEQ ID NO: 555603 - DNA, 25 bp, Mus musculus
gcctgctctcctgaaagggaagaag

SEQ ID NO: 555604 - DNA, 25 bp, Mus musculus
gcctgctctcggctaccgtgagcaa

SEQ ID NO: 555605 - DNA, 25 bp, Mus musculus
gcctgctctcgggtaccgtgagcaa

SEQ ID NO: 555606 - DNA, 25 bp, Mus musculus
gcctgctctgaacgtgttcaaaagc

SEQ ID NO: 555607 - DNA, 25 bp, Mus musculus
gcctgctctgaaggtgttcaaaagc

SEQ ID NO: 555608 - DNA, 25 bp, Mus musculus
gcctgctctgccaagacaaggattt

SEQ ID NO: 555609 - DNA, 25 bp, Mus musculus
gcctgctctgcctagacaaggattt

SEQ ID NO: 555610 - DNA, 25 bp, Mus musculus
gcctgctctgctctaagatgctaaa

SEQ ID NO: 555611 - DNA, 25 bp, Mus musculus
gcctgctctgctgtaagatgctaaa

SEQ ID NO: 555612 - DNA, 25 bp, Mus musculus
gcctgctctggacctgtgacctgca

SEQ ID NO: 555613 - DNA, 25 bp, Mus musculus
gcctgctctggagctgtgacctgca

SEQ ID NO: 555614 - DNA, 25 bp, Mus musculus
gcctgctctgtcacttgtaggtgag

SEQ ID NO: 555615 - DNA, 25 bp, Mus musculus
gcctgctctgtctcttgtaggtgag

SEQ ID NO: 555616 - DNA, 25 bp, Mus musculus
gcctgctcttcactagtttaactgg

SEQ ID NO: 555617 - DNA, 25 bp, Mus musculus
gcctgctcttcagtagtttaactgg

SEQ ID NO: 555618 - DNA, 25 bp, Mus musculus
gcctgctgaagtcctgcactcagaa

SEQ ID NO: 555619 - DNA, 25 bp, Mus musculus
gcctgctgaagtgctgcactcagaa

SEQ ID NO: 555620 - DNA, 25 bp, Mus musculus
gcctgctgagctcacgtaatgtgtg

SEQ ID NO: 555621 - DNA, 25 bp, Mus musculus
gcctgctgagctgacgtaatgtgtg

SEQ ID NO: 555622 - DNA, 25 bp, Mus musculus
gcctgctgcagaagcacagttcaag

SEQ ID NO: 555623 - DNA, 25 bp, Mus musculus
gcctgctgcagatgcacagttcaag

SEQ ID NO: 555624 - DNA, 25 bp, Mus musculus
gcctgctgcatgctacgcattggga

SEQ ID NO: 555625 - DNA, 25 bp, Mus musculus
gcctgctgcatggtacgcattggga

SEQ ID NO: 555626 - DNA, 25 bp, Mus musculus
gcctgctgccagaactcaagaagta

SEQ ID NO: 555627 - DNA, 25 bp, Mus musculus
gcctgctgccagtactcaagaagta

SEQ ID NO: 555628 - DNA, 25 bp, Mus musculus
gcctgctgccgccagtatgaaatgg

SEQ ID NO: 555629 - DNA, 25 bp, Mus musculus
gcctgctgccgcgagtatgaaatgg

SEQ ID NO: 555630 - DNA, 25 bp, Mus musculus
gcctgctgctcacatgtgcagtatt

SEQ ID NO: 555631 - DNA, 25 bp, Mus musculus
gcctgctgctcagatgtgcagtatt

SEQ ID NO: 555632 - DNA, 25 bp, Mus musculus
gcctgctgctctattccaaaggtag

SEQ ID NO: 555633 - DNA, 25 bp, Mus musculus
gcctgctgctcttttccaaaggtag

SEQ ID NO: 555634 - DNA, 25 bp, Mus musculus
gcctgctggaacctacactttgata

SEQ ID NO: 555635 - DNA, 25 bp, Mus musculus
gcctgctggaacgtacactttgata

SEQ ID NO: 555636 - DNA, 25 bp, Mus musculus
gcctgctggaatcgacctagggtat

SEQ ID NO: 555637 - DNA, 25 bp, Mus musculus
gcctgctggaatggacctagggtat

SEQ ID NO: 555638 - DNA, 25 bp, Mus musculus
gcctgctggctactagaatcttaca

SEQ ID NO: 555639 - DNA, 25 bp, Mus musculus
gcctgctggctagtagaatcttaca

SEQ ID NO: 555640 - DNA, 25 bp, Mus musculus
gcctgctgggacataagctatggac

SEQ ID NO: 555641 - DNA, 25 bp, Mus musculus
gcctgctgggacttaagctatggac

SEQ ID NO: 555642 - DNA, 25 bp, Mus musculus
gcctgctggtacattacatttccgg

SEQ ID NO: 555643 - DNA, 25 bp, Mus musculus
gcctgctggtactttacatttccgg

SEQ ID NO: 555644 - DNA, 25 bp, Mus musculus
gcctgctggtggacaagctgacaat

SEQ ID NO: 555645 - DNA, 25 bp, Mus musculus
gcctgctggtggtcaagctgacaat

SEQ ID NO: 555646 - DNA, 25 bp, Mus musculus
gcctgctgtaatagttgtctgagga

SEQ ID NO: 555647 - DNA, 25 bp, Mus musculus
gcctgctgtaattgttgtctgagga

SEQ ID NO: 555648 - DNA, 25 bp, Mus musculus
gcctgctgtcgacatgggcaagttc

SEQ ID NO: 555649 - DNA, 25 bp, Mus musculus
gcctgctgtcgagatgggcaagttc

SEQ ID NO: 555650 - DNA, 25 bp, Mus musculus
gcctgctgtctacctgctgggaaag

SEQ ID NO: 555651 - DNA, 25 bp, Mus musculus
gcctgctgtctagctgctgggaaag

SEQ ID NO: 555652 - DNA, 25 bp, Mus musculus
gcctgctgtcttaaaatacaccgct

SEQ ID NO: 555653 - DNA, 25 bp, Mus musculus
gcctgctgtctttaaatacaccgct

SEQ ID NO: 555654 - DNA, 25 bp, Mus musculus
gcctgctgtgctaccaaggcagctg

SEQ ID NO: 555655 - DNA, 25 bp, Mus musculus
gcctgctgtgcttccaaggcagctg

SEQ ID NO: 555656 - DNA, 25 bp, Mus musculus
gcctgctgtggacagaagtccagct

SEQ ID NO: 555657 - DNA, 25 bp, Mus musculus
gcctgctgtggagagaagtccagct

SEQ ID NO: 555658 - DNA, 25 bp, Mus musculus
gcctgctgtggtattgacctgcaca

SEQ ID NO: 555659 - DNA, 25 bp, Mus musculus
gcctgctgtggttttgacctgcaca

SEQ ID NO: 555660 - DNA, 25 bp, Mus musculus
gcctgctgtgttcgtcaatggactc

SEQ ID NO: 555661 - DNA, 25 bp, Mus musculus
gcctgctgtgttggtcaatggactc

SEQ ID NO: 555662 - DNA, 25 bp, Mus musculus
gcctgctgtttaaaatgttgaattt

SEQ ID NO: 555663 - DNA, 25 bp, Mus musculus
gcctgctgtttataatgttgaattt

SEQ ID NO: 555664 - DNA, 25 bp, Mus musculus
gcctgcttacataaatgtcctctga

SEQ ID NO: 555665 - DNA, 25 bp, Mus musculus
gcctgcttacatcgacgccttaaaa

SEQ ID NO: 555666 - DNA, 25 bp, Mus musculus
gcctgcttacatggacgccttaaaa

SEQ ID NO: 555667 - DNA, 25 bp, Mus musculus
gcctgcttacattaatgtcctctga

SEQ ID NO: 555668 - DNA, 25 bp, Mus musculus
gcctgcttacctctgaggactgtaa

SEQ ID NO: 555669 - DNA, 25 bp, Mus musculus
gcctgcttacctctgctagaaataa

SEQ ID NO: 555670 - DNA, 25 bp, Mus musculus
gcctgcttacctgtgaggactgtaa

SEQ ID NO: 555671 - DNA, 25 bp, Mus musculus
gcctgcttacctgtgctagaaataa

SEQ ID NO: 555672 - DNA, 25 bp, Mus musculus
gcctgcttccttataaaacccgaga

SEQ ID NO: 555673 - DNA, 25 bp, Mus musculus
gcctgcttccttttaaaacccgaga

SEQ ID NO: 555674 - DNA, 25 bp, Mus musculus
gcctgcttctctaagctggctggtg

SEQ ID NO: 555675 - DNA, 25 bp, Mus musculus
gcctgcttctcttagctggctggtg

SEQ ID NO: 555676 - DNA, 25 bp, Mus musculus
gcctgcttctgacaaagttatgtgt

SEQ ID NO: 555677 - DNA, 25 bp, Mus musculus
gcctgcttctgactttctgaaatgc

SEQ ID NO: 555678 - DNA, 25 bp, Mus musculus
gcctgcttctgagaaagttatgtgt

SEQ ID NO: 555679 - DNA, 25 bp, Mus musculus
gcctgcttctgagtttctgaaatgc

SEQ ID NO: 555680 - DNA, 25 bp, Mus musculus
gcctgcttgaggatactgtagtgat

SEQ ID NO: 555681 - DNA, 25 bp, Mus musculus
gcctgcttgaggttactgtagtgat

SEQ ID NO: 555682 - DNA, 25 bp, Mus musculus
gcctgcttggcaaaaatcatatctt

SEQ ID NO: 555683 - DNA, 25 bp, Mus musculus
gcctgcttggcataaatcatatctt

SEQ ID NO: 555684 - DNA, 25 bp, Mus musculus
gcctgcttgttcacaatttatcttc

SEQ ID NO: 555685 - DNA, 25 bp, Mus musculus
gcctgcttgttcaccatcaacaaag

SEQ ID NO: 555686 - DNA, 25 bp, Mus musculus
gcctgcttgttctcaatttatcttc

SEQ ID NO: 555687 - DNA, 25 bp, Mus musculus
gcctgcttgttctccatcaacaaag

SEQ ID NO: 555688 - DNA, 25 bp, Mus musculus
gcctgctttagtctgtctcgctgaa

SEQ ID NO: 555689 - DNA, 25 bp, Mus musculus
gcctgctttagtgtgtctcgctgaa

SEQ ID NO: 555690 - DNA, 25 bp, Mus musculus
gcctgctttcagctacagattttgt

SEQ ID NO: 555691 - DNA, 25 bp, Mus musculus
gcctgctttcaggtacagattttgt

SEQ ID NO: 555692 - DNA, 25 bp, Mus musculus
gcctgctttccaaggtgcggttgta

SEQ ID NO: 555693 - DNA, 25 bp, Mus musculus
gcctgctttccatggtgcggttgta

SEQ ID NO: 555694 - DNA, 25 bp, Mus musculus
gcctgctttgtaaccatctatgctg

SEQ ID NO: 555695 - DNA, 25 bp, Mus musculus
gcctgctttgtatccatctatgctg

SEQ ID NO: 555696 - DNA, 25 bp, Mus musculus
gcctgcttttcacctcagaggatga

SEQ ID NO: 555697 - DNA, 25 bp, Mus musculus
gcctgcttttcagctcagaggatga

SEQ ID NO: 555698 - DNA, 25 bp, Mus musculus
gcctgcttttgtagagttgacgaac

SEQ ID NO: 555699 - DNA, 25 bp, Mus musculus
gcctgcttttgtcactttaaagttt

SEQ ID NO: 555700 - DNA, 25 bp, Mus musculus
gcctgcttttgtgactttaaagttt

SEQ ID NO: 555701 - DNA, 25 bp, Mus musculus
gcctgcttttgttgagttgacgaac

SEQ ID NO: 555702 - DNA, 25 bp, Mus musculus
gcctggaaacagaacttgaacaaag

SEQ ID NO: 555703 - DNA, 25 bp, Mus musculus
gcctggaaacagtacttgaacaaag

SEQ ID NO: 555704 - DNA, 25 bp, Mus musculus
gcctggaaacatctttctcttcctg

SEQ ID NO: 555705 - DNA, 25 bp, Mus musculus
gcctggaaacatgtttctcttcctg

SEQ ID NO: 555706 - DNA, 25 bp, Mus musculus
gcctggaaaccaagactctaaaaga

SEQ ID NO: 555707 - DNA, 25 bp, Mus musculus
gcctggaaaccatgactctaaaaga

SEQ ID NO: 555708 - DNA, 25 bp, Mus musculus
gcctggaaagatatggaggttccct

SEQ ID NO: 555709 - DNA, 25 bp, Mus musculus
gcctggaaagatttggaggttccct

SEQ ID NO: 555710 - DNA, 25 bp, Mus musculus
gcctggaaaggcagttgcatttcat

SEQ ID NO: 555711 - DNA, 25 bp, Mus musculus
gcctggaaaggctgttgcatttcat

SEQ ID NO: 555712 - DNA, 25 bp, Mus musculus
gcctggaacattctgcacatggaac

SEQ ID NO: 555713 - DNA, 25 bp, Mus musculus
gcctggaacattgtgcacatggaac

SEQ ID NO: 555714 - DNA, 25 bp, Mus musculus
gcctggaactaccaacatggtgcat

SEQ ID NO: 555715 - DNA, 25 bp, Mus musculus
gcctggaactacgaacatggtgcat

SEQ ID NO: 555716 - DNA, 25 bp, Mus musculus
gcctggaactcaatgcgtagcctaa

SEQ ID NO: 555717 - DNA, 25 bp, Mus musculus
gcctggaactcattgcgtagcctaa

SEQ ID NO: 555718 - DNA, 25 bp, Mus musculus
gcctggaactcgaacccagttgttt

SEQ ID NO: 555719 - DNA, 25 bp, Mus musculus
gcctggaactcgctatgtagctgag

SEQ ID NO: 555720 - DNA, 25 bp, Mus musculus
gcctggaactcggtatgtagctgag

SEQ ID NO: 555721 - DNA, 25 bp, Mus musculus
gcctggaactcgtacccagttgttt

SEQ ID NO: 555722 - DNA, 25 bp, Mus musculus
gcctggaactctcaaatctgtctgt

SEQ ID NO: 555723 - DNA, 25 bp, Mus musculus
gcctggaactctgaaatctgtctgt

SEQ ID NO: 555724 - DNA, 25 bp, Mus musculus
gcctggaacttaagcaggtcagact

SEQ ID NO: 555725 - DNA, 25 bp, Mus musculus
gcctggaacttatgcaggtcagact

SEQ ID NO: 555726 - DNA, 25 bp, Mus musculus
gcctggaagattaccctagactttg

SEQ ID NO: 555727 - DNA, 25 bp, Mus musculus
gcctggaagatttccctagactttg

SEQ ID NO: 555728 - DNA, 25 bp, Mus musculus
gcctggaagctgacaaattctaaat

SEQ ID NO: 555729 - DNA, 25 bp, Mus musculus
gcctggaagctgtcaaattctaaat

SEQ ID NO: 555730 - DNA, 25 bp, Mus musculus
gcctggaagtctccagcttaggata

SEQ ID NO: 555731 - DNA, 25 bp, Mus musculus
gcctggaagtctgcagcttaggata

SEQ ID NO: 555732 - DNA, 25 bp, Mus musculus
gcctggaatgagctggcaattgatt

SEQ ID NO: 555733 - DNA, 25 bp, Mus musculus
gcctggaatgaggtggcaattgatt

SEQ ID NO: 555734 - DNA, 25 bp, Mus musculus
gcctggaattgtacaatgactgctt

SEQ ID NO: 555735 - DNA, 25 bp, Mus musculus
gcctggaattgttcaatgactgctt

SEQ ID NO: 555736 - DNA, 25 bp, Mus musculus
gcctggaatttcattgcctcttata

SEQ ID NO: 555737 - DNA, 25 bp, Mus musculus
gcctggaatttctttgcctcttata

SEQ ID NO: 555738 - DNA, 25 bp, Mus musculus
gcctggacaactcaacttggaaact

SEQ ID NO: 555739 - DNA, 25 bp, Mus musculus
gcctggacaactgaacttggaaact

SEQ ID NO: 555740 - DNA, 25 bp, Mus musculus
gcctggacacgtcggtttcttagcc

SEQ ID NO: 555741 - DNA, 25 bp, Mus musculus
gcctggacacgtgggtttcttagcc

SEQ ID NO: 555742 - DNA, 25 bp, Mus musculus
gcctggacagagaatgctcggcctt

SEQ ID NO: 555743 - DNA, 25 bp, Mus musculus
gcctggacagagtatgctcggcctt

SEQ ID NO: 555744 - DNA, 25 bp, Mus musculus
gcctggacaggcctcagtcttaaat

SEQ ID NO: 555745 - DNA, 25 bp, Mus musculus
gcctggacaggcgtcagtcttaaat

SEQ ID NO: 555746 - DNA, 25 bp, Mus musculus
gcctggacataaaaattgcttagta

SEQ ID NO: 555747 - DNA, 25 bp, Mus musculus
gcctggacataataattgcttagta

SEQ ID NO: 555748 - DNA, 25 bp, Mus musculus
gcctggacattacgcttcctaagct

SEQ ID NO: 555749 - DNA, 25 bp, Mus musculus
gcctggacattaggcttcctaagct

SEQ ID NO: 555750 - DNA, 25 bp, Mus musculus
gcctggaccaatagagacctcttta

SEQ ID NO: 555751 - DNA, 25 bp, Mus musculus
gcctggaccaatcaaaaccactttt

SEQ ID NO: 555752 - DNA, 25 bp, Mus musculus
gcctggaccaatgaaaaccactttt

SEQ ID NO: 555753 - DNA, 25 bp, Mus musculus
gcctggaccaattgagacctcttta

SEQ ID NO: 555754 - DNA, 25 bp, Mus musculus
gcctggaccattagcaaccatgttt

SEQ ID NO: 555755 - DNA, 25 bp, Mus musculus
gcctggaccatttgcaaccatgttt

SEQ ID NO: 555756 - DNA, 25 bp, Mus musculus
gcctggacccagagagtttaacatg

SEQ ID NO: 555757 - DNA, 25 bp, Mus musculus
gcctggacccagtgagtttaacatg

SEQ ID NO: 555758 - DNA, 25 bp, Mus musculus
gcctggaccggaattttgtgtgtgc

SEQ ID NO: 555759 - DNA, 25 bp, Mus musculus
gcctggaccggatttttgtgtgtgc

SEQ ID NO: 555760 - DNA, 25 bp, Mus musculus
gcctggacctcaatagctaccagag

SEQ ID NO: 555761 - DNA, 25 bp, Mus musculus
gcctggacctcattagctaccagag

SEQ ID NO: 555762 - DNA, 25 bp, Mus musculus
gcctggacctcgcaaatcagtctct

SEQ ID NO: 555763 - DNA, 25 bp, Mus musculus
gcctggacctcggaaatcagtctct

SEQ ID NO: 555764 - DNA, 25 bp, Mus musculus
gcctggacgttaactttgaggaagt

SEQ ID NO: 555765 - DNA, 25 bp, Mus musculus
gcctggacgttatctttgaggaagt

SEQ ID NO: 555766 - DNA, 25 bp, Mus musculus
gcctggactacaaaatgagcctgag

SEQ ID NO: 555767 - DNA, 25 bp, Mus musculus
gcctggactacataatgagcctgag

SEQ ID NO: 555768 - DNA, 25 bp, Mus musculus
gcctggactataaaggtgagacctt

SEQ ID NO: 555769 - DNA, 25 bp, Mus musculus
gcctggactatataggtgagacctt

SEQ ID NO: 555770 - DNA, 25 bp, Mus musculus
gcctggactattaaggtcatggaat

SEQ ID NO: 555771 - DNA, 25 bp, Mus musculus
gcctggactatttaggtcatggaat

SEQ ID NO: 555772 - DNA, 25 bp, Mus musculus
gcctggactgcactgagtgacagac

SEQ ID NO: 555773 - DNA, 25 bp, Mus musculus
gcctggactgcagtgagtgacagac

SEQ ID NO: 555774 - DNA, 25 bp, Mus musculus
gcctggactgccctaatgctaagtg

SEQ ID NO: 555775 - DNA, 25 bp, Mus musculus
gcctggactgccgtaatgctaagtg

SEQ ID NO: 555776 - DNA, 25 bp, Mus musculus
gcctggactgctcctgattgatttc

SEQ ID NO: 555777 - DNA, 25 bp, Mus musculus
gcctggactgctgctgattgatttc

SEQ ID NO: 555778 - DNA, 25 bp, Mus musculus
gcctggactggcaagatgctggttt

SEQ ID NO: 555779 - DNA, 25 bp, Mus musculus
gcctggactggctagatgctggttt

SEQ ID NO: 555780 - DNA, 25 bp, Mus musculus
gcctggactgggagctcagacgtaa

SEQ ID NO: 555781 - DNA, 25 bp, Mus musculus
gcctggactgggatgatcggactac

SEQ ID NO: 555782 - DNA, 25 bp, Mus musculus
gcctggactgggtgctcagacgtaa

SEQ ID NO: 555783 - DNA, 25 bp, Mus musculus
gcctggactgggttgatcggactac

SEQ ID NO: 555784 - DNA, 25 bp, Mus musculus
gcctggactggtctgtaacaagttt

SEQ ID NO: 555785 - DNA, 25 bp, Mus musculus
gcctggactggtgtgtaacaagttt

SEQ ID NO: 555786 - DNA, 25 bp, Mus musculus
gcctggacttgtacatgtaatttca

SEQ ID NO: 555787 - DNA, 25 bp, Mus musculus
gcctggacttgttcatgtaatttca

SEQ ID NO: 555788 - DNA, 25 bp, Mus musculus
gcctggagaaatattcaccggttaa

SEQ ID NO: 555789 - DNA, 25 bp, Mus musculus
gcctggagaaattttcaccggttaa

SEQ ID NO: 555790 - DNA, 25 bp, Mus musculus
gcctggagacgacacattcttcgga

SEQ ID NO: 555791 - DNA, 25 bp, Mus musculus
gcctggagacgagacattcttcgga

SEQ ID NO: 555792 - DNA, 25 bp, Mus musculus
gcctggagagtgagcacctaataat

SEQ ID NO: 555793 - DNA, 25 bp, Mus musculus
gcctggagagtgtgcacctaataat

SEQ ID NO: 555794 - DNA, 25 bp, Mus musculus
gcctggagagttaagggcattcttc

SEQ ID NO: 555795 - DNA, 25 bp, Mus musculus
gcctggagagtttagggcattcttc

SEQ ID NO: 555796 - DNA, 25 bp, Mus musculus
gcctggagataacacccagctttat

SEQ ID NO: 555797 - DNA, 25 bp, Mus musculus
gcctggagataactcattactgcct

SEQ ID NO: 555798 - DNA, 25 bp, Mus musculus
gcctggagataagacccagctttat

SEQ ID NO: 555799 - DNA, 25 bp, Mus musculus
gcctggagataagtcattactgcct

SEQ ID NO: 555800 - DNA, 25 bp, Mus musculus
gcctggagcatgaatcaagatctgt

SEQ ID NO: 555801 - DNA, 25 bp, Mus musculus
gcctggagcatgtatcaagatctgt

SEQ ID NO: 555802 - DNA, 25 bp, Mus musculus
gcctggagccctcttttaaggaact

SEQ ID NO: 555803 - DNA, 25 bp, Mus musculus
gcctggagccctgttttaaggaact

SEQ ID NO: 555804 - DNA, 25 bp, Mus musculus
gcctggagcggtaagaatattccat

SEQ ID NO: 555805 - DNA, 25 bp, Mus musculus
gcctggagcggttagaatattccat

SEQ ID NO: 555806 - DNA, 25 bp, Mus musculus
gcctggagcgtgcagaaccgttaat

SEQ ID NO: 555807 - DNA, 25 bp, Mus musculus
gcctggagcgtggagaaccgttaat

SEQ ID NO: 555808 - DNA, 25 bp, Mus musculus
gcctggaggagcagaattttctgaa

SEQ ID NO: 555809 - DNA, 25 bp, Mus musculus
gcctggaggagctgaattttctgaa

SEQ ID NO: 555810 - DNA, 25 bp, Mus musculus
gcctggaggccaagtttatgctaga

SEQ ID NO: 555811 - DNA, 25 bp, Mus musculus
gcctggaggccatgtttatgctaga

SEQ ID NO: 555812 - DNA, 25 bp, Mus musculus
gcctggaggctcatcgagaacttta

SEQ ID NO: 555813 - DNA, 25 bp, Mus musculus
gcctggaggctcttcgagaacttta

SEQ ID NO: 555814 - DNA, 25 bp, Mus musculus
gcctggagtcaacctccgggacaaa

SEQ ID NO: 555815 - DNA, 25 bp, Mus musculus
gcctggagtcaagctccgggacaaa

SEQ ID NO: 555816 - DNA, 25 bp, Mus musculus
gcctggagtctacaaatgtcactga

SEQ ID NO: 555817 - DNA, 25 bp, Mus musculus
gcctggagtctagaaatgtcactga

SEQ ID NO: 555818 - DNA, 25 bp, Mus musculus
gcctggagtggtcctttaattttgt

SEQ ID NO: 555819 - DNA, 25 bp, Mus musculus
gcctggagtggtgctttaattttgt

SEQ ID NO: 555820 - DNA, 25 bp, Mus musculus
gcctggagtttacttttgacacgaa

SEQ ID NO: 555821 - DNA, 25 bp, Mus musculus
gcctggagtttagttttgacacgaa

SEQ ID NO: 555822 - DNA, 25 bp, Mus musculus
gcctggatacgactcacttgcccta

SEQ ID NO: 555823 - DNA, 25 bp, Mus musculus
gcctggatacgagtcacttgcccta

SEQ ID NO: 555824 - DNA, 25 bp, Mus musculus
gcctggatacgcacaccaaggagtt

SEQ ID NO: 555825 - DNA, 25 bp, Mus musculus
gcctggatacgctcaccaaggagtt

SEQ ID NO: 555826 - DNA, 25 bp, Mus musculus
gcctggatccacctcttattcaaaa

SEQ ID NO: 555827 - DNA, 25 bp, Mus musculus
gcctggatccacgtcttattcaaaa

SEQ ID NO: 555828 - DNA, 25 bp, Mus musculus
gcctggatcccgacgtagccgcatt

SEQ ID NO: 555829 - DNA, 25 bp, Mus musculus
gcctggatcccgtcgtagccgcatt

SEQ ID NO: 555830 - DNA, 25 bp, Mus musculus
gcctggatctttaacaatatcagca

SEQ ID NO: 555831 - DNA, 25 bp, Mus musculus
gcctggatcttttacaatatcagca

SEQ ID NO: 555832 - DNA, 25 bp, Mus musculus
gcctggatgattagcttacctgatg

SEQ ID NO: 555833 - DNA, 25 bp, Mus musculus
gcctggatgatttgcttacctgatg

SEQ ID NO: 555834 - DNA, 25 bp, Mus musculus
gcctggatgcgaaacttctcctcca

SEQ ID NO: 555835 - DNA, 25 bp, Mus musculus
gcctggatgcgatacttctcctcca

SEQ ID NO: 555836 - DNA, 25 bp, Mus musculus
gcctggatggcaagaacttgatctt

SEQ ID NO: 555837 - DNA, 25 bp, Mus musculus
gcctggatggcacatcgagtgctct

SEQ ID NO: 555838 - DNA, 25 bp, Mus musculus
gcctggatggcagatcgagtgctct

SEQ ID NO: 555839 - DNA, 25 bp, Mus musculus
gcctggatggcatgaacttgatctt

SEQ ID NO: 555840 - DNA, 25 bp, Mus musculus
gcctggattgctcactaagactttt

SEQ ID NO: 555841 - DNA, 25 bp, Mus musculus
gcctggattgctgactaagactttt

SEQ ID NO: 555842 - DNA, 25 bp, Mus musculus
gcctggattgtgcacataactgtgg

SEQ ID NO: 555843 - DNA, 25 bp, Mus musculus
gcctggattgtggacataactgtgg

SEQ ID NO: 555844 - DNA, 25 bp, Mus musculus
gcctggcaaaggatacactgtaaat

SEQ ID NO: 555845 - DNA, 25 bp, Mus musculus
gcctggcaaaggttacactgtaaat

SEQ ID NO: 555846 - DNA, 25 bp, Mus musculus
gcctggcacggcacaaaacatggaa

SEQ ID NO: 555847 - DNA, 25 bp, Mus musculus
gcctggcacggctcaaaacatggaa

SEQ ID NO: 555848 - DNA, 25 bp, Mus musculus
gcctggcactgccaagctggagata

SEQ ID NO: 555849 - DNA, 25 bp, Mus musculus
gcctggcactgcgaagctggagata

SEQ ID NO: 555850 - DNA, 25 bp, Mus musculus
gcctggcagaccctagtgcttgtaa

SEQ ID NO: 555851 - DNA, 25 bp, Mus musculus
gcctggcagaccgtagtgcttgtaa

SEQ ID NO: 555852 - DNA, 25 bp, Mus musculus
gcctggcagacgcttgctgacgctc

SEQ ID NO: 555853 - DNA, 25 bp, Mus musculus
gcctggcagacggttgctgacgctc

SEQ ID NO: 555854 - DNA, 25 bp, Mus musculus
gcctggcagcggagcgacagtctct

SEQ ID NO: 555855 - DNA, 25 bp, Mus musculus
gcctggcagcggtgcgacagtctct

SEQ ID NO: 555856 - DNA, 25 bp, Mus musculus
gcctggcagctgctatgaagtacat

SEQ ID NO: 555857 - DNA, 25 bp, Mus musculus
gcctggcagctggtatgaagtacat

SEQ ID NO: 555858 - DNA, 25 bp, Mus musculus
gcctggcagcttcaccaagaaagat

SEQ ID NO: 555859 - DNA, 25 bp, Mus musculus
gcctggcagcttgaccaagaaagat

SEQ ID NO: 555860 - DNA, 25 bp, Mus musculus
gcctggcagggtatgcgtttattgc

SEQ ID NO: 555861 - DNA, 25 bp, Mus musculus
gcctggcagggtttgcgtttattgc

SEQ ID NO: 555862 - DNA, 25 bp, Mus musculus
gcctggcagtatcggccttgtacag

SEQ ID NO: 555863 - DNA, 25 bp, Mus musculus
gcctggcagtatgggccttgtacag

SEQ ID NO: 555864 - DNA, 25 bp, Mus musculus
gcctggcagtccagtggttgtatct

SEQ ID NO: 555865 - DNA, 25 bp, Mus musculus
gcctggcagtcctgtggttgtatct

SEQ ID NO: 555866 - DNA, 25 bp, Mus musculus
gcctggcatagactaggttctccat

SEQ ID NO: 555867 - DNA, 25 bp, Mus musculus
gcctggcatagagtaggttctccat

SEQ ID NO: 555868 - DNA, 25 bp, Mus musculus
gcctggcatatgaaagatcctgggt

SEQ ID NO: 555869 - DNA, 25 bp, Mus musculus
gcctggcatatgtaagatcctgggt

SEQ ID NO: 555870 - DNA, 25 bp, Mus musculus
gcctggcatcacaggtaatgaggat

SEQ ID NO: 555871 - DNA, 25 bp, Mus musculus
gcctggcatcactggtaatgaggat

SEQ ID NO: 555872 - DNA, 25 bp, Mus musculus
gcctggcatctgaggtaaaataatt

SEQ ID NO: 555873 - DNA, 25 bp, Mus musculus
gcctggcatctgtggtaaaataatt

SEQ ID NO: 555874 - DNA, 25 bp, Mus musculus
gcctggcatgagctcacatctgctt

SEQ ID NO: 555875 - DNA, 25 bp, Mus musculus
gcctggcatgaggtcacatctgctt

SEQ ID NO: 555876 - DNA, 25 bp, Mus musculus
gcctggcatggaatctcatggagta

SEQ ID NO: 555877 - DNA, 25 bp, Mus musculus
gcctggcatggattctcatggagta

SEQ ID NO: 555878 - DNA, 25 bp, Mus musculus
gcctggcatggtcctacatacattt

SEQ ID NO: 555879 - DNA, 25 bp, Mus musculus
gcctggcatggtgctacatacattt

SEQ ID NO: 555880 - DNA, 25 bp, Mus musculus
gcctggcattccctgggaaccataa

SEQ ID NO: 555881 - DNA, 25 bp, Mus musculus
gcctggcattccgtgggaaccataa

SEQ ID NO: 555882 - DNA, 25 bp, Mus musculus
gcctggccaacactgagatttgcat

SEQ ID NO: 555883 - DNA, 25 bp, Mus musculus
gcctggccaacagtgagatttgcat

SEQ ID NO: 555884 - DNA, 25 bp, Mus musculus
gcctggccactgagcaacttttaag

SEQ ID NO: 555885 - DNA, 25 bp, Mus musculus
gcctggccactgtgcaacttttaag

SEQ ID NO: 555886 - DNA, 25 bp, Mus musculus
gcctggccagcaactcaatatttag

SEQ ID NO: 555887 - DNA, 25 bp, Mus musculus
gcctggccagcaaggcttgggacat

SEQ ID NO: 555888 - DNA, 25 bp, Mus musculus
gcctggccagcatctcaatatttag

SEQ ID NO: 555889 - DNA, 25 bp, Mus musculus
gcctggccagcatggcttgggacat

SEQ ID NO: 555890 - DNA, 25 bp, Mus musculus
gcctggcccagaactcaaaggacat

SEQ ID NO: 555891 - DNA, 25 bp, Mus musculus
gcctggcccagatctcaaaggacat

SEQ ID NO: 555892 - DNA, 25 bp, Mus musculus
gcctggccccagaaaacaatgttca

SEQ ID NO: 555893 - DNA, 25 bp, Mus musculus
gcctggccccagtaaacaatgttca

SEQ ID NO: 555894 - DNA, 25 bp, Mus musculus
gcctggccctaacaagttgtcacta

SEQ ID NO: 555895 - DNA, 25 bp, Mus musculus
gcctggccctaagaagttgtcacta

SEQ ID NO: 555896 - DNA, 25 bp, Mus musculus
gcctggccctcaaatttgtaagatt

SEQ ID NO: 555897 - DNA, 25 bp, Mus musculus
gcctggccctcatatttgtaagatt

SEQ ID NO: 555898 - DNA, 25 bp, Mus musculus
gcctggccctgcagatatgcaagga

SEQ ID NO: 555899 - DNA, 25 bp, Mus musculus
gcctggccctgctgatatgcaagga

SEQ ID NO: 555900 - DNA, 25 bp, Mus musculus
gcctggccgggaagcttccaaagat

SEQ ID NO: 555901 - DNA, 25 bp, Mus musculus
gcctggccgggatgcttccaaagat

SEQ ID NO: 555902 - DNA, 25 bp, Mus musculus
gcctggcctagcatgtttagccaag

SEQ ID NO: 555903 - DNA, 25 bp, Mus musculus
gcctggcctagcttgtttagccaag

SEQ ID NO: 555904 - DNA, 25 bp, Mus musculus
gcctggcctcctcagagtggtaata

SEQ ID NO: 555905 - DNA, 25 bp, Mus musculus
gcctggcctcctgagagtggtaata

SEQ ID NO: 555906 - DNA, 25 bp, Mus musculus
gcctggcctgagctatctgggactt

SEQ ID NO: 555907 - DNA, 25 bp, Mus musculus
gcctggcctgaggtatctgggactt

SEQ ID NO: 555908 - DNA, 25 bp, Mus musculus
gcctggcctggtcactgccttaagg

SEQ ID NO: 555909 - DNA, 25 bp, Mus musculus
gcctggcctggtgactgccttaagg

SEQ ID NO: 555910 - DNA, 25 bp, Mus musculus
gcctggccttggcaattgctgtagc

SEQ ID NO: 555911 - DNA, 25 bp, Mus musculus
gcctggccttgggaattgctgtagc

SEQ ID NO: 555912 - DNA, 25 bp, Mus musculus
gcctggcgaaccagattgttcagtt

SEQ ID NO: 555913 - DNA, 25 bp, Mus musculus
gcctggcgaacctgattgttcagtt

SEQ ID NO: 555914 - DNA, 25 bp, Mus musculus
gcctggcggcgcaaaacccaaggaa

SEQ ID NO: 555915 - DNA, 25 bp, Mus musculus
gcctggcggcgctaaacccaaggaa

SEQ ID NO: 555916 - DNA, 25 bp, Mus musculus
gcctggcgggttccttgtcattgta

SEQ ID NO: 555917 - DNA, 25 bp, Mus musculus
gcctggcgggttgcttgtcattgta

SEQ ID NO: 555918 - DNA, 25 bp, Mus musculus
gcctggcgttctcgatttctaatga

SEQ ID NO: 555919 - DNA, 25 bp, Mus musculus
gcctggcgttctggatttctaatga

SEQ ID NO: 555920 - DNA, 25 bp, Mus musculus
gcctggcgttggattttcgtaggat

SEQ ID NO: 555921 - DNA, 25 bp, Mus musculus
gcctggcgttggtttttcgtaggat

SEQ ID NO: 555922 - DNA, 25 bp, Mus musculus
gcctggctaatacagaagtagatga

SEQ ID NO: 555923 - DNA, 25 bp, Mus musculus
gcctggctaatagagaagtagatga

SEQ ID NO: 555924 - DNA, 25 bp, Mus musculus
gcctggctacagcacatgctgagat

SEQ ID NO: 555925 - DNA, 25 bp, Mus musculus
gcctggctacaggacatgctgagat

SEQ ID NO: 555926 - DNA, 25 bp, Mus musculus
gcctggctactacagagacttcttc

SEQ ID NO: 555927 - DNA, 25 bp, Mus musculus
gcctggctactagagagacttcttc

SEQ ID NO: 555928 - DNA, 25 bp, Mus musculus
gcctggctagctctgtccagatagg

SEQ ID NO: 555929 - DNA, 25 bp, Mus musculus
gcctggctagctgtgtccagatagg

SEQ ID NO: 555930 - DNA, 25 bp, Mus musculus
gcctggctctctacaactgggtgtt

SEQ ID NO: 555931 - DNA, 25 bp, Mus musculus
gcctggctctcttcaactgggtgtt

SEQ ID NO: 555932 - DNA, 25 bp, Mus musculus
gcctggctctgcatacctaggaaaa

SEQ ID NO: 555933 - DNA, 25 bp, Mus musculus
gcctggctctgcttacctaggaaaa

SEQ ID NO: 555934 - DNA, 25 bp, Mus musculus
gcctggctgaccagattgttctgaa

SEQ ID NO: 555935 - DNA, 25 bp, Mus musculus
gcctggctgacctgattgttctgaa

SEQ ID NO: 555936 - DNA, 25 bp, Mus musculus
gcctggctgagtacattgacatgat

SEQ ID NO: 555937 - DNA, 25 bp, Mus musculus
gcctggctgagttcattgacatgat

SEQ ID NO: 555938 - DNA, 25 bp, Mus musculus
gcctggctgccacaaatattgttca

SEQ ID NO: 555939 - DNA, 25 bp, Mus musculus
gcctggctgccagaaatattgttca

SEQ ID NO: 555940 - DNA, 25 bp, Mus musculus
gcctggctggctatggtaggcaaaa

SEQ ID NO: 555941 - DNA, 25 bp, Mus musculus
gcctggctggctttggtaggcaaaa

SEQ ID NO: 555942 - DNA, 25 bp, Mus musculus
gcctggctgtgaaggaaactgcagt

SEQ ID NO: 555943 - DNA, 25 bp, Mus musculus
gcctggctgtgatggaaactgcagt

SEQ ID NO: 555944 - DNA, 25 bp, Mus musculus
gcctggctgtgtatttaacgacaat

SEQ ID NO: 555945 - DNA, 25 bp, Mus musculus
gcctggctgtgtccattagtcaatg

SEQ ID NO: 555946 - DNA, 25 bp, Mus musculus
gcctggctgtgtgcattagtcaatg

SEQ ID NO: 555947 - DNA, 25 bp, Mus musculus
gcctggctgtgtttttaacgacaat

SEQ ID NO: 555948 - DNA, 25 bp, Mus musculus
gcctggctgttgagacgcttcttaa

SEQ ID NO: 555949 - DNA, 25 bp, Mus musculus
gcctggctgttgtgacgcttcttaa

SEQ ID NO: 555950 - DNA, 25 bp, Mus musculus
gcctggcttaccagaccttttgctt

SEQ ID NO: 555951 - DNA, 25 bp, Mus musculus
gcctggcttacctgaccttttgctt

SEQ ID NO: 555952 - DNA, 25 bp, Mus musculus
gcctggcttaggcaacagctgtttt

SEQ ID NO: 555953 - DNA, 25 bp, Mus musculus
gcctggcttagggaacagctgtttt

SEQ ID NO: 555954 - DNA, 25 bp, Mus musculus
gcctggcttcataacctcaggatat

SEQ ID NO: 555955 - DNA, 25 bp, Mus musculus
gcctggcttcattacctcaggatat

SEQ ID NO: 555956 - DNA, 25 bp, Mus musculus
gcctggcttctaatgaaaagataac

SEQ ID NO: 555957 - DNA, 25 bp, Mus musculus
gcctggcttctattgaaaagataac

SEQ ID NO: 555958 - DNA, 25 bp, Mus musculus
gcctggcttggtcgatgattttgaa

SEQ ID NO: 555959 - DNA, 25 bp, Mus musculus
gcctggcttggtggatgattttgaa

SEQ ID NO: 555960 - DNA, 25 bp, Mus musculus
gcctggcttttcattgacagcatgg

SEQ ID NO: 555961 - DNA, 25 bp, Mus musculus
gcctggcttttctttgacagcatgg

SEQ ID NO: 555962 - DNA, 25 bp, Mus musculus
gcctgggaaatcagacgtccattct

SEQ ID NO: 555963 - DNA, 25 bp, Mus musculus
gcctgggaaatctgacgtccattct

SEQ ID NO: 555964 - DNA, 25 bp, Mus musculus
gcctgggaagatagttcagtctgta

SEQ ID NO: 555965 - DNA, 25 bp, Mus musculus
gcctgggaagattgttcagtctgta

SEQ ID NO: 555966 - DNA, 25 bp, Mus musculus
gcctgggaaggtactatgcctggaa

SEQ ID NO: 555967 - DNA, 25 bp, Mus musculus
gcctgggaaggttctatgcctggaa

SEQ ID NO: 555968 - DNA, 25 bp, Mus musculus
gcctgggaatccagctgaatcatac

SEQ ID NO: 555969 - DNA, 25 bp, Mus musculus
gcctgggaatcctgctgaatcatac

SEQ ID NO: 555970 - DNA, 25 bp, Mus musculus
gcctgggacagtatatggcactcca

SEQ ID NO: 555971 - DNA, 25 bp, Mus musculus
gcctgggacagtttatggcactcca

SEQ ID NO: 555972 - DNA, 25 bp, Mus musculus
gcctgggaccaaagtgaatgccgag

SEQ ID NO: 555973 - DNA, 25 bp, Mus musculus
gcctgggaccaatgtgaatgccgag

SEQ ID NO: 555974 - DNA, 25 bp, Mus musculus
gcctgggaccttcaacctaatttct

SEQ ID NO: 555975 - DNA, 25 bp, Mus musculus
gcctgggaccttgaacctaatttct

SEQ ID NO: 555976 - DNA, 25 bp, Mus musculus
gcctgggacgataaaactgaatttt

SEQ ID NO: 555977 - DNA, 25 bp, Mus musculus
gcctgggacgattaaactgaatttt

SEQ ID NO: 555978 - DNA, 25 bp, Mus musculus
gcctgggagcctcaaagcggcattt

SEQ ID NO: 555979 - DNA, 25 bp, Mus musculus
gcctgggagcctgaaagcggcattt

SEQ ID NO: 555980 - DNA, 25 bp, Mus musculus
gcctgggagcgacatctaagactgt

SEQ ID NO: 555981 - DNA, 25 bp, Mus musculus
gcctgggagcgagatctaagactgt

SEQ ID NO: 555982 - DNA, 25 bp, Mus musculus
gcctgggatccgagctcatcaaaga

SEQ ID NO: 555983 - DNA, 25 bp, Mus musculus
gcctgggatccgtgctcatcaaaga

SEQ ID NO: 555984 - DNA, 25 bp, Mus musculus
gcctgggatgacagtttagtttcta

SEQ ID NO: 555985 - DNA, 25 bp, Mus musculus
gcctgggatgactgtttagtttcta

SEQ ID NO: 555986 - DNA, 25 bp, Mus musculus
gcctgggatgcgcactttgtagaca

SEQ ID NO: 555987 - DNA, 25 bp, Mus musculus
gcctgggatgcggactttgtagaca

SEQ ID NO: 555988 - DNA, 25 bp, Mus musculus
gcctgggatggaagcccaccctcag

SEQ ID NO: 555989 - DNA, 25 bp, Mus musculus
gcctgggatggatgcccaccctcag

SEQ ID NO: 555990 - DNA, 25 bp, Mus musculus
gcctgggcacttcggagcctcctga

SEQ ID NO: 555991 - DNA, 25 bp, Mus musculus
gcctgggcacttgggagcctcctga

SEQ ID NO: 555992 - DNA, 25 bp, Mus musculus
gcctgggcagaccttaatgggtaca

SEQ ID NO: 555993 - DNA, 25 bp, Mus musculus
gcctgggcagacgttaatgggtaca

SEQ ID NO: 555994 - DNA, 25 bp, Mus musculus
gcctgggccatcagcactggaagaa

SEQ ID NO: 555995 - DNA, 25 bp, Mus musculus
gcctgggccatctgcactggaagaa

SEQ ID NO: 555996 - DNA, 25 bp, Mus musculus
gcctgggccccgaataacagaagtg

SEQ ID NO: 555997 - DNA, 25 bp, Mus musculus
gcctgggccccgtataacagaagtg

SEQ ID NO: 555998 - DNA, 25 bp, Mus musculus
gcctgggccgagagatcatgaccat

SEQ ID NO: 555999 - DNA, 25 bp, Mus musculus
gcctgggccgagtgatcatgaccat

SEQ ID NO: 556000 - DNA, 25 bp, Mus musculus
gcctgggcgcagaccatgagttgat

SEQ ID NO: 556001 - DNA, 25 bp, Mus musculus
gcctgggcgcagtccatgagttgat

SEQ ID NO: 556002 - DNA, 25 bp, Mus musculus
gcctgggcgtgtacctgctcaagag

SEQ ID NO: 556003 - DNA, 25 bp, Mus musculus
gcctgggcgtgttcctgctcaagag

SEQ ID NO: 556004 - DNA, 25 bp, Mus musculus
gcctgggctacaaacgtactgaatt

SEQ ID NO: 556005 - DNA, 25 bp, Mus musculus
gcctgggctacatacgtactgaatt

SEQ ID NO: 556006 - DNA, 25 bp, Mus musculus
gcctgggctagtcctggaagtactt

SEQ ID NO: 556007 - DNA, 25 bp, Mus musculus
gcctgggctagtgctggaagtactt

SEQ ID NO: 556008 - DNA, 25 bp, Mus musculus
gcctgggctattaactaagactgtg

SEQ ID NO: 556009 - DNA, 25 bp, Mus musculus
gcctgggctatttactaagactgtg

SEQ ID NO: 556010 - DNA, 25 bp, Mus musculus
gcctgggctctgaaactattaacct

SEQ ID NO: 556011 - DNA, 25 bp, Mus musculus
gcctgggctctgtaactattaacct

SEQ ID NO: 556012 - DNA, 25 bp, Mus musculus
gcctgggctgagattgactacgtgt

SEQ ID NO: 556013 - DNA, 25 bp, Mus musculus
gcctgggctgagtttgactacgtgt

SEQ ID NO: 556014 - DNA, 25 bp, Mus musculus
gcctgggctgctagagactatgtct

SEQ ID NO: 556015 - DNA, 25 bp, Mus musculus
gcctgggctgcttgagactatgtct

SEQ ID NO: 556016 - DNA, 25 bp, Mus musculus
gcctgggctggcatataacttttat

SEQ ID NO: 556017 - DNA, 25 bp, Mus musculus
gcctgggctggcttataacttttat

SEQ ID NO: 556018 - DNA, 25 bp, Mus musculus
gcctgggcttcaaaatttgaccttt

SEQ ID NO: 556019 - DNA, 25 bp, Mus musculus
gcctgggcttcataatttgaccttt

SEQ ID NO: 556020 - DNA, 25 bp, Mus musculus
gcctgggcttccagtggaacttgaa

SEQ ID NO: 556021 - DNA, 25 bp, Mus musculus
gcctgggcttcctgtggaacttgaa

SEQ ID NO: 556022 - DNA, 25 bp, Mus musculus
gcctgggtaatcatcacacaagact

SEQ ID NO: 556023 - DNA, 25 bp, Mus musculus
gcctgggtaatcttcacacaagact

SEQ ID NO: 556024 - DNA, 25 bp, Mus musculus
gcctgggtcagaaactctgttataa

SEQ ID NO: 556025 - DNA, 25 bp, Mus musculus
gcctgggtcagatactctgttataa

SEQ ID NO: 556026 - DNA, 25 bp, Mus musculus
gcctgggtcatgactgatctcatca

SEQ ID NO: 556027 - DNA, 25 bp, Mus musculus
gcctgggtcatgtctgatctcatca

SEQ ID NO: 556028 - DNA, 25 bp, Mus musculus
gcctgggtccgaagactctgatgaa

SEQ ID NO: 556029 - DNA, 25 bp, Mus musculus
gcctgggtccgatgactctgatgaa

SEQ ID NO: 556030 - DNA, 25 bp, Mus musculus
gcctgggtcctcacctgggcctgag

SEQ ID NO: 556031 - DNA, 25 bp, Mus musculus
gcctgggtcctctcctgggcctgag

SEQ ID NO: 556032 - DNA, 25 bp, Mus musculus
gcctgggtcctgacgcagggatgat

SEQ ID NO: 556033 - DNA, 25 bp, Mus musculus
gcctgggtcctgtcgcagggatgat

SEQ ID NO: 556034 - DNA, 25 bp, Mus musculus
gcctgggtcgccagcggttatgtaa

SEQ ID NO: 556035 - DNA, 25 bp, Mus musculus
gcctgggtcgcctgcggttatgtaa

SEQ ID NO: 556036 - DNA, 25 bp, Mus musculus
gcctgggtcggcatattgagctcaa

SEQ ID NO: 556037 - DNA, 25 bp, Mus musculus
gcctgggtcggcttattgagctcaa

SEQ ID NO: 556038 - DNA, 25 bp, Mus musculus
gcctgggtctacatgagttagcaaa

SEQ ID NO: 556039 - DNA, 25 bp, Mus musculus
gcctgggtctacttgagttagcaaa

SEQ ID NO: 556040 - DNA, 25 bp, Mus musculus
gcctgggtgtagagtccatgcagca

SEQ ID NO: 556041 - DNA, 25 bp, Mus musculus
gcctgggtgtagtgtccatgcagca

SEQ ID NO: 556042 - DNA, 25 bp, Mus musculus
gcctgggtgtgcatggatgacttca

SEQ ID NO: 556043 - DNA, 25 bp, Mus musculus
gcctgggtgtgcttggatgacttca

SEQ ID NO: 556044 - DNA, 25 bp, Mus musculus
gcctgggttctcaaatttctgggaa

SEQ ID NO: 556045 - DNA, 25 bp, Mus musculus
gcctgggttctctaatttctgggaa

SEQ ID NO: 556046 - DNA, 25 bp, Mus musculus
gcctgggtttctaataccccacaag

SEQ ID NO: 556047 - DNA, 25 bp, Mus musculus
gcctgggtttcttataccccacaag

SEQ ID NO: 556048 - DNA, 25 bp, Mus musculus
gcctggtaagaccacagcgctgtga

SEQ ID NO: 556049 - DNA, 25 bp, Mus musculus
gcctggtaagacgacagcgctgtga

SEQ ID NO: 556050 - DNA, 25 bp, Mus musculus
gcctggtaagttagtccaatgttac

SEQ ID NO: 556051 - DNA, 25 bp, Mus musculus
gcctggtaagtttgtccaatgttac

SEQ ID NO: 556052 - DNA, 25 bp, Mus musculus
gcctggtaatagaactgctttgtat

SEQ ID NO: 556053 - DNA, 25 bp, Mus musculus
gcctggtaatagtactgctttgtat

SEQ ID NO: 556054 - DNA, 25 bp, Mus musculus
gcctggtaatgacccacagagactg

SEQ ID NO: 556055 - DNA, 25 bp, Mus musculus
gcctggtaatgagccacagagactg

SEQ ID NO: 556056 - DNA, 25 bp, Mus musculus
gcctggtacagcctgagtcacaatc

SEQ ID NO: 556057 - DNA, 25 bp, Mus musculus
gcctggtacagcgtgagtcacaatc

SEQ ID NO: 556058 - DNA, 25 bp, Mus musculus
gcctggtactggcagcactagcaag

SEQ ID NO: 556059 - DNA, 25 bp, Mus musculus
gcctggtactgggagcactagcaag

SEQ ID NO: 556060 - DNA, 25 bp, Mus musculus
gcctggtagggaagcttattgtatt

SEQ ID NO: 556061 - DNA, 25 bp, Mus musculus
gcctggtagggatgcttattgtatt

SEQ ID NO: 556062 - DNA, 25 bp, Mus musculus
gcctggtatattacccaagacagtg

SEQ ID NO: 556063 - DNA, 25 bp, Mus musculus
gcctggtatatttcccaagacagtg

SEQ ID NO: 556064 - DNA, 25 bp, Mus musculus
gcctggtattctctgatgcttgctt

SEQ ID NO: 556065 - DNA, 25 bp, Mus musculus
gcctggtattctgtgatgcttgctt

SEQ ID NO: 556066 - DNA, 25 bp, Mus musculus
gcctggtcaaatacaaagctttctg

SEQ ID NO: 556067 - DNA, 25 bp, Mus musculus
gcctggtcaaattcaaagctttctg

SEQ ID NO: 556068 - DNA, 25 bp, Mus musculus
gcctggtcagcaccttgcaacttag

SEQ ID NO: 556069 - DNA, 25 bp, Mus musculus
gcctggtcagcagcttgcaacttag

SEQ ID NO: 556070 - DNA, 25 bp, Mus musculus
gcctggtcatatatgtgctctgtat

SEQ ID NO: 556071 - DNA, 25 bp, Mus musculus
gcctggtcatatttgtgctctgtat

SEQ ID NO: 556072 - DNA, 25 bp, Mus musculus
gcctggtcattgagtgactggcgat

SEQ ID NO: 556073 - DNA, 25 bp, Mus musculus
gcctggtcattgtgtgactggcgat

SEQ ID NO: 556074 - DNA, 25 bp, Mus musculus
gcctggtccacactgactgggaaaa

SEQ ID NO: 556075 - DNA, 25 bp, Mus musculus
gcctggtccacagtgactgggaaaa

SEQ ID NO: 556076 - DNA, 25 bp, Mus musculus
gcctggtccagtatatcaaagacag

SEQ ID NO: 556077 - DNA, 25 bp, Mus musculus
gcctggtccagtttatcaaagacag

SEQ ID NO: 556078 - DNA, 25 bp, Mus musculus
gcctggtccatcaacacaagaactg

SEQ ID NO: 556079 - DNA, 25 bp, Mus musculus
gcctggtccatctacacaagaactg

SEQ ID NO: 556080 - DNA, 25 bp, Mus musculus
gcctggtccctaatttctaagacgc

SEQ ID NO: 556081 - DNA, 25 bp, Mus musculus
gcctggtccctattttctaagacgc

SEQ ID NO: 556082 - DNA, 25 bp, Mus musculus
gcctggtcctgactaatgatggtca

SEQ ID NO: 556083 - DNA, 25 bp, Mus musculus
gcctggtcctgagtaatgatggtca

SEQ ID NO: 556084 - DNA, 25 bp, Mus musculus
gcctggtcctttataatttgagata

SEQ ID NO: 556085 - DNA, 25 bp, Mus musculus
gcctggtcctttttaatttgagata

SEQ ID NO: 556086 - DNA, 25 bp, Mus musculus
gcctggtcgcagattgtagtttcat

SEQ ID NO: 556087 - DNA, 25 bp, Mus musculus
gcctggtcgcagtttgtagtttcat

SEQ ID NO: 556088 - DNA, 25 bp, Mus musculus
gcctggtctagcaactcttggaaca

SEQ ID NO: 556089 - DNA, 25 bp, Mus musculus
gcctggtctagctactcttggaaca

SEQ ID NO: 556090 - DNA, 25 bp, Mus musculus
gcctggtctataaaacgaattctcg

SEQ ID NO: 556091 - DNA, 25 bp, Mus musculus
gcctggtctataaggaggaccccta

SEQ ID NO: 556092 - DNA, 25 bp, Mus musculus
gcctggtctatataacgaattctcg

SEQ ID NO: 556093 - DNA, 25 bp, Mus musculus
gcctggtctatatggaggaccccta

SEQ ID NO: 556094 - DNA, 25 bp, Mus musculus
gcctggtctatcaagatcggtaacc

SEQ ID NO: 556095 - DNA, 25 bp, Mus musculus
gcctggtctatctagatcggtaacc

SEQ ID NO: 556096 - DNA, 25 bp, Mus musculus
gcctggtctatgaaaacttgtcaca

SEQ ID NO: 556097 - DNA, 25 bp, Mus musculus
gcctggtctatgtaaacttgtcaca

SEQ ID NO: 556098 - DNA, 25 bp, Mus musculus
gcctggtctcagaattcatttatta

SEQ ID NO: 556099 - DNA, 25 bp, Mus musculus
gcctggtctcagcatatggatcaga

SEQ ID NO: 556100 - DNA, 25 bp, Mus musculus
gcctggtctcaggatatggatcaga

SEQ ID NO: 556101 - DNA, 25 bp, Mus musculus
gcctggtctcagtattcatttatta

SEQ ID NO: 556102 - DNA, 25 bp, Mus musculus
gcctggtctcctaactaagtgctgg

SEQ ID NO: 556103 - DNA, 25 bp, Mus musculus
gcctggtctccttactaagtgctgg

SEQ ID NO: 556104 - DNA, 25 bp, Mus musculus
gcctggtctgcacattagactctaa

SEQ ID NO: 556105 - DNA, 25 bp, Mus musculus
gcctggtctgcagattagactctaa

SEQ ID NO: 556106 - DNA, 25 bp, Mus musculus
gcctggtctgccaagtttaagtggt

SEQ ID NO: 556107 - DNA, 25 bp, Mus musculus
gcctggtctgcctagtttaagtggt

SEQ ID NO: 556108 - DNA, 25 bp, Mus musculus
gcctggtctgctaatatcatggtta

SEQ ID NO: 556109 - DNA, 25 bp, Mus musculus
gcctggtctgcttatatcatggtta

SEQ ID NO: 556110 - DNA, 25 bp, Mus musculus
gcctggtctggcaataagacaggac

SEQ ID NO: 556111 - DNA, 25 bp, Mus musculus
gcctggtctggctataagacaggac

SEQ ID NO: 556112 - DNA, 25 bp, Mus musculus
gcctggtctgtaaagcaggttctaa

SEQ ID NO: 556113 - DNA, 25 bp, Mus musculus
gcctggtctgtatagcaggttctaa

SEQ ID NO: 556114 - DNA, 25 bp, Mus musculus
gcctggtgacctcacacgggacaag

SEQ ID NO: 556115 - DNA, 25 bp, Mus musculus
gcctggtgacctgacacgggacaag

SEQ ID NO: 556116 - DNA, 25 bp, Mus musculus
gcctggtgactgagatcccaagcaa

SEQ ID NO: 556117 - DNA, 25 bp, Mus musculus
gcctggtgactgtgatcccaagcaa

SEQ ID NO: 556118 - DNA, 25 bp, Mus musculus
gcctggtgccaaaggttggaaacaa

SEQ ID NO: 556119 - DNA, 25 bp, Mus musculus
gcctggtgccaatggttggaaacaa

SEQ ID NO: 556120 - DNA, 25 bp, Mus musculus
gcctggtgccatagtgttacagact

SEQ ID NO: 556121 - DNA, 25 bp, Mus musculus
gcctggtgccattgtgttacagact

SEQ ID NO: 556122 - DNA, 25 bp, Mus musculus
gcctggtgccggcagaacatcaaca

SEQ ID NO: 556123 - DNA, 25 bp, Mus musculus
gcctggtgccgggagaacatcaaca

SEQ ID NO: 556124 - DNA, 25 bp, Mus musculus
gcctggtgctacattcatatgtcta

SEQ ID NO: 556125 - DNA, 25 bp, Mus musculus
gcctggtgctactttcatatgtcta

SEQ ID NO: 556126 - DNA, 25 bp, Mus musculus
gcctggtgggcaagacacccatcga

SEQ ID NO: 556127 - DNA, 25 bp, Mus musculus
gcctggtgggcatgacacccatcga

SEQ ID NO: 556128 - DNA, 25 bp, Mus musculus
gcctggtgtctgcagcatttatgtt

SEQ ID NO: 556129 - DNA, 25 bp, Mus musculus
gcctggtgtctggagcatttatgtt

SEQ ID NO: 556130 - DNA, 25 bp, Mus musculus
gcctggtgtgccagggtagaattac

SEQ ID NO: 556131 - DNA, 25 bp, Mus musculus
gcctggtgtgcctgggtagaattac

SEQ ID NO: 556132 - DNA, 25 bp, Mus musculus
gcctggtgtggccaaggactacaaa

SEQ ID NO: 556133 - DNA, 25 bp, Mus musculus
gcctggtgtggcgaaggactacaaa

SEQ ID NO: 556134 - DNA, 25 bp, Mus musculus
gcctggtgttaaatcagtgttcaca

SEQ ID NO: 556135 - DNA, 25 bp, Mus musculus
gcctggtgttaattcagtgttcaca

SEQ ID NO: 556136 - DNA, 25 bp, Mus musculus
gcctggtgttctcgcccgtcgagct

SEQ ID NO: 556137 - DNA, 25 bp, Mus musculus
gcctggtgttctggcccgtcgagct

SEQ ID NO: 556138 - DNA, 25 bp, Mus musculus
gcctggtgtttacagcctcttgcaa

SEQ ID NO: 556139 - DNA, 25 bp, Mus musculus
gcctggtgtttagagcctcttgcaa

SEQ ID NO: 556140 - DNA, 25 bp, Mus musculus
gcctggttatatcgaaaagctgctt

SEQ ID NO: 556141 - DNA, 25 bp, Mus musculus
gcctggttatatggaaaagctgctt

SEQ ID NO: 556142 - DNA, 25 bp, Mus musculus
gcctggttatgcacagctttgtaat

SEQ ID NO: 556143 - DNA, 25 bp, Mus musculus
gcctggttatgctcagctttgtaat

SEQ ID NO: 556144 - DNA, 25 bp, Mus musculus
gcctggttatttcctgtttctctat

SEQ ID NO: 556145 - DNA, 25 bp, Mus musculus
gcctggttatttgctgtttctctat

SEQ ID NO: 556146 - DNA, 25 bp, Mus musculus
gcctggttcgataatgaagctgctt

SEQ ID NO: 556147 - DNA, 25 bp, Mus musculus
gcctggttcgattatgaagctgctt

SEQ ID NO: 556148 - DNA, 25 bp, Mus musculus
gcctggttctctaaacttgttttct

SEQ ID NO: 556149 - DNA, 25 bp, Mus musculus
gcctggttctcttaacttgttttct

SEQ ID NO: 556150 - DNA, 25 bp, Mus musculus
gcctggttcttcctttacgaggtca

SEQ ID NO: 556151 - DNA, 25 bp, Mus musculus
gcctggttcttcgtttacgaggtca

SEQ ID NO: 556152 - DNA, 25 bp, Mus musculus
gcctggttcttgcaatctgacaatg

SEQ ID NO: 556153 - DNA, 25 bp, Mus musculus
gcctggttcttggaatctgacaatg

SEQ ID NO: 556154 - DNA, 25 bp, Mus musculus
gcctggttggcacatctgaactgca

SEQ ID NO: 556155 - DNA, 25 bp, Mus musculus
gcctggttggcagatctgaactgca

SEQ ID NO: 556156 - DNA, 25 bp, Mus musculus
gcctggttgtctccaggagcagcca

SEQ ID NO: 556157 - DNA, 25 bp, Mus musculus
gcctggttgtctgcaggagcagcca

SEQ ID NO: 556158 - DNA, 25 bp, Mus musculus
gcctggtttacaaactgtattttta

SEQ ID NO: 556159 - DNA, 25 bp, Mus musculus
gcctggtttacatactgtattttta

SEQ ID NO: 556160 - DNA, 25 bp, Mus musculus
gcctggtttgggacctgaccgttct

SEQ ID NO: 556161 - DNA, 25 bp, Mus musculus
gcctggtttgggtcctgaccgttct

SEQ ID NO: 556162 - DNA, 25 bp, Mus musculus
gcctggttttagagtgtagctgtaa

SEQ ID NO: 556163 - DNA, 25 bp, Mus musculus
gcctggttttagtgtgtagctgtaa

SEQ ID NO: 556164 - DNA, 25 bp, Mus musculus
gcctggtttttgctggaggcgcgtt

SEQ ID NO: 556165 - DNA, 25 bp, Mus musculus
gcctggtttttggtggaggcgcgtt

SEQ ID NO: 556166 - DNA, 25 bp, Mus musculus
gcctgtaacattatcacccagctga

SEQ ID NO: 556167 - DNA, 25 bp, Mus musculus
gcctgtaacattttcacccagctga

SEQ ID NO: 556168 - DNA, 25 bp, Mus musculus
gcctgtaaccctccaactcaggaag

SEQ ID NO: 556169 - DNA, 25 bp, Mus musculus
gcctgtaaccctgcaactcaggaag

SEQ ID NO: 556170 - DNA, 25 bp, Mus musculus
gcctgtaactacacatgtgcttgca

SEQ ID NO: 556171 - DNA, 25 bp, Mus musculus
gcctgtaactactcatgtgcttgca

SEQ ID NO: 556172 - DNA, 25 bp, Mus musculus
gcctgtaagatcactaaaatgcctg

SEQ ID NO: 556173 - DNA, 25 bp, Mus musculus
gcctgtaagatctctaaaatgcctg

SEQ ID NO: 556174 - DNA, 25 bp, Mus musculus
gcctgtaagcctcaagagctaatcc

SEQ ID NO: 556175 - DNA, 25 bp, Mus musculus
gcctgtaagcctgaagagctaatcc

SEQ ID NO: 556176 - DNA, 25 bp, Mus musculus
gcctgtaagtccagagtccaagtct

SEQ ID NO: 556177 - DNA, 25 bp, Mus musculus
gcctgtaagtcctgagtccaagtct

SEQ ID NO: 556178 - DNA, 25 bp, Mus musculus
gcctgtaagtctatgtccacaagtt

SEQ ID NO: 556179 - DNA, 25 bp, Mus musculus
gcctgtaagtctttgtccacaagtt

SEQ ID NO: 556180 - DNA, 25 bp, Mus musculus
gcctgtacagccatcactaaaacat

SEQ ID NO: 556181 - DNA, 25 bp, Mus musculus
gcctgtacagccttcactaaaacat

SEQ ID NO: 556182 - DNA, 25 bp, Mus musculus
gcctgtacccatatctgttgtgata

SEQ ID NO: 556183 - DNA, 25 bp, Mus musculus
gcctgtacccatttctgttgtgata

SEQ ID NO: 556184 - DNA, 25 bp, Mus musculus
gcctgtacctagcttgtcaatccag

SEQ ID NO: 556185 - DNA, 25 bp, Mus musculus
gcctgtacctaggttgtcaatccag

SEQ ID NO: 556186 - DNA, 25 bp, Mus musculus
gcctgtacctcacttgactgggaga

SEQ ID NO: 556187 - DNA, 25 bp, Mus musculus
gcctgtacctcagttgactgggaga

SEQ ID NO: 556188 - DNA, 25 bp, Mus musculus
gcctgtagacttctatatgactcct

SEQ ID NO: 556189 - DNA, 25 bp, Mus musculus
gcctgtagacttgtatatgactcct

SEQ ID NO: 556190 - DNA, 25 bp, Mus musculus
gcctgtagaggcatacgtattgatg

SEQ ID NO: 556191 - DNA, 25 bp, Mus musculus
gcctgtagaggcttacgtattgatg

SEQ ID NO: 556192 - DNA, 25 bp, Mus musculus
gcctgtagattaatgtttcggtcat

SEQ ID NO: 556193 - DNA, 25 bp, Mus musculus
gcctgtagattattgtttcggtcat

SEQ ID NO: 556194 - DNA, 25 bp, Mus musculus
gcctgtagctctccattttgattaa

SEQ ID NO: 556195 - DNA, 25 bp, Mus musculus
gcctgtagctctgcattttgattaa

SEQ ID NO: 556196 - DNA, 25 bp, Mus musculus
gcctgtaggcatatcttgagcattt

SEQ ID NO: 556197 - DNA, 25 bp, Mus musculus
gcctgtaggcatttcttgagcattt

SEQ ID NO: 556198 - DNA, 25 bp, Mus musculus
gcctgtaggtggctaactcacttca

SEQ ID NO: 556199 - DNA, 25 bp, Mus musculus
gcctgtaggtgggtaactcacttca

SEQ ID NO: 556200 - DNA, 25 bp, Mus musculus
gcctgtagtcctaactactctggaa

SEQ ID NO: 556201 - DNA, 25 bp, Mus musculus
gcctgtagtccttactactctggaa

SEQ ID NO: 556202 - DNA, 25 bp, Mus musculus
gcctgtagtctactccttgtgttta

SEQ ID NO: 556203 - DNA, 25 bp, Mus musculus
gcctgtagtctagtccttgtgttta

SEQ ID NO: 556204 - DNA, 25 bp, Mus musculus
gcctgtagtggcctgaacactctgt

SEQ ID NO: 556205 - DNA, 25 bp, Mus musculus
gcctgtagtggcgtgaacactctgt

SEQ ID NO: 556206 - DNA, 25 bp, Mus musculus
gcctgtataaccctcattccagtga

SEQ ID NO: 556207 - DNA, 25 bp, Mus musculus
gcctgtataaccgtcattccagtga

SEQ ID NO: 556208 - DNA, 25 bp, Mus musculus
gcctgtataagaacggcacgcctac

SEQ ID NO: 556209 - DNA, 25 bp, Mus musculus
gcctgtataagatcggcacgcctac

SEQ ID NO: 556210 - DNA, 25 bp, Mus musculus
gcctgtatacccctattttctataa

SEQ ID NO: 556211 - DNA, 25 bp, Mus musculus
gcctgtatacccgtattttctataa

SEQ ID NO: 556212 - DNA, 25 bp, Mus musculus
gcctgtatatatctacatgcagatg

SEQ ID NO: 556213 - DNA, 25 bp, Mus musculus
gcctgtatatatgtacatgcagatg

SEQ ID NO: 556214 - DNA, 25 bp, Mus musculus
gcctgtatcctgacatgttctgtat

SEQ ID NO: 556215 - DNA, 25 bp, Mus musculus
gcctgtatcctgtcatgttctgtat

SEQ ID NO: 556216 - DNA, 25 bp, Mus musculus
gcctgtatgattcggtaccgacctt

SEQ ID NO: 556217 - DNA, 25 bp, Mus musculus
gcctgtatgattgggtaccgacctt

SEQ ID NO: 556218 - DNA, 25 bp, Mus musculus
gcctgtatgcagcttgtcatctgga

SEQ ID NO: 556219 - DNA, 25 bp, Mus musculus
gcctgtatgcaggttgtcatctgga

SEQ ID NO: 556220 - DNA, 25 bp, Mus musculus
gcctgtattcatacttgcttgcgaa

SEQ ID NO: 556221 - DNA, 25 bp, Mus musculus
gcctgtattcattcttgcttgcgaa

SEQ ID NO: 556222 - DNA, 25 bp, Mus musculus
gcctgtattccaagtgctgtagcaa

SEQ ID NO: 556223 - DNA, 25 bp, Mus musculus
gcctgtattccactttaggattagt

SEQ ID NO: 556224 - DNA, 25 bp, Mus musculus
gcctgtattccagtttaggattagt

SEQ ID NO: 556225 - DNA, 25 bp, Mus musculus
gcctgtattccatgtgctgtagcaa

SEQ ID NO: 556226 - DNA, 25 bp, Mus musculus
gcctgtatttagacagtgcctgtat

SEQ ID NO: 556227 - DNA, 25 bp, Mus musculus
gcctgtatttagtcagtgcctgtat

SEQ ID NO: 556228 - DNA, 25 bp, Mus musculus
gcctgtatttctcgccttaggagaa

SEQ ID NO: 556229 - DNA, 25 bp, Mus musculus
gcctgtatttctggccttaggagaa

SEQ ID NO: 556230 - DNA, 25 bp, Mus musculus
gcctgtcacaaaccagcacgctgga

SEQ ID NO: 556231 - DNA, 25 bp, Mus musculus
gcctgtcacaaagcagcacgctgga

SEQ ID NO: 556232 - DNA, 25 bp, Mus musculus
gcctgtcacctgagggaaccaagat

SEQ ID NO: 556233 - DNA, 25 bp, Mus musculus
gcctgtcacctgtgggaaccaagat

SEQ ID NO: 556234 - DNA, 25 bp, Mus musculus
gcctgtcactagatgtttcctgttt

SEQ ID NO: 556235 - DNA, 25 bp, Mus musculus
gcctgtcactagttgtttcctgttt

SEQ ID NO: 556236 - DNA, 25 bp, Mus musculus
gcctgtcactgacaagtttgcaaat

SEQ ID NO: 556237 - DNA, 25 bp, Mus musculus
gcctgtcactgagaagtttgcaaat

SEQ ID NO: 556238 - DNA, 25 bp, Mus musculus
gcctgtcagcaaagttatttcgctt

SEQ ID NO: 556239 - DNA, 25 bp, Mus musculus
gcctgtcagcaatgttatttcgctt

SEQ ID NO: 556240 - DNA, 25 bp, Mus musculus
gcctgtcagtacatatttgggtcca

SEQ ID NO: 556241 - DNA, 25 bp, Mus musculus
gcctgtcagtacttatttgggtcca

SEQ ID NO: 556242 - DNA, 25 bp, Mus musculus
gcctgtcagtcaaggatggccttca

SEQ ID NO: 556243 - DNA, 25 bp, Mus musculus
gcctgtcagtcatggatggccttca

SEQ ID NO: 556244 - DNA, 25 bp, Mus musculus
gcctgtcatactatggtcttgacaa

SEQ ID NO: 556245 - DNA, 25 bp, Mus musculus
gcctgtcatactttggtcttgacaa

SEQ ID NO: 556246 - DNA, 25 bp, Mus musculus
gcctgtcatcccagctactgaggat

SEQ ID NO: 556247 - DNA, 25 bp, Mus musculus
gcctgtcatccctgctactgaggat

SEQ ID NO: 556248 - DNA, 25 bp, Mus musculus
gcctgtcatctgactctcaataaat

SEQ ID NO: 556249 - DNA, 25 bp, Mus musculus
gcctgtcatctgtctctcaataaat

SEQ ID NO: 556250 - DNA, 25 bp, Mus musculus
gcctgtcatgtcatcaggcctcaga

SEQ ID NO: 556251 - DNA, 25 bp, Mus musculus
gcctgtcatgtcttcaggcctcaga

SEQ ID NO: 556252 - DNA, 25 bp, Mus musculus
gcctgtcattgcagaccattggtgt

SEQ ID NO: 556253 - DNA, 25 bp, Mus musculus
gcctgtcattgctgaccattggtgt

SEQ ID NO: 556254 - DNA, 25 bp, Mus musculus
gcctgtccaaagacatgccggaact

SEQ ID NO: 556255 - DNA, 25 bp, Mus musculus
gcctgtccaaagtcatgccggaact

SEQ ID NO: 556256 - DNA, 25 bp, Mus musculus
gcctgtccacgcagagtatctggaa

SEQ ID NO: 556257 - DNA, 25 bp, Mus musculus
gcctgtccacgctgagtatctggaa

SEQ ID NO: 556258 - DNA, 25 bp, Mus musculus
gcctgtccagaactacacgtgcaat

SEQ ID NO: 556259 - DNA, 25 bp, Mus musculus
gcctgtccagaagtacacgtgcaat

SEQ ID NO: 556260 - DNA, 25 bp, Mus musculus
gcctgtccatgtactgcttggagaa

SEQ ID NO: 556261 - DNA, 25 bp, Mus musculus
gcctgtccatgtcggtcacggagca

SEQ ID NO: 556262 - DNA, 25 bp, Mus musculus
gcctgtccatgtgggtcacggagca

SEQ ID NO: 556263 - DNA, 25 bp, Mus musculus
gcctgtccatgttctgcttggagaa

SEQ ID NO: 556264 - DNA, 25 bp, Mus musculus
gcctgtccatttacctctggaggat

SEQ ID NO: 556265 - DNA, 25 bp, Mus musculus
gcctgtccattttcctctggaggat

SEQ ID NO: 556266 - DNA, 25 bp, Mus musculus
gcctgtcccatcaccatgtataata

SEQ ID NO: 556267 - DNA, 25 bp, Mus musculus
gcctgtcccatctccatgtataata

SEQ ID NO: 556268 - DNA, 25 bp, Mus musculus
gcctgtcccgcaaggtgatagtgat

SEQ ID NO: 556269 - DNA, 25 bp, Mus musculus
gcctgtcccgcatggtgatagtgat

SEQ ID NO: 556270 - DNA, 25 bp, Mus musculus
gcctgtccctgtaatctgctgagaa

SEQ ID NO: 556271 - DNA, 25 bp, Mus musculus
gcctgtccctgttatctgctgagaa

SEQ ID NO: 556272 - DNA, 25 bp, Mus musculus
gcctgtcctacacagctaactaact

SEQ ID NO: 556273 - DNA, 25 bp, Mus musculus
gcctgtcctacagagctaactaact

SEQ ID NO: 556274 - DNA, 25 bp, Mus musculus
gcctgtcctgcaagcttctttgaga

SEQ ID NO: 556275 - DNA, 25 bp, Mus musculus
gcctgtcctgcatgcttctttgaga

SEQ ID NO: 556276 - DNA, 25 bp, Mus musculus
gcctgtcgcactacaattggccggt

SEQ ID NO: 556277 - DNA, 25 bp, Mus musculus
gcctgtcgcacttcaattggccggt

SEQ ID NO: 556278 - DNA, 25 bp, Mus musculus
gcctgtcgcagtaaacaacaccact

SEQ ID NO: 556279 - DNA, 25 bp, Mus musculus
gcctgtcgcagttaacaacaccact

SEQ ID NO: 556280 - DNA, 25 bp, Mus musculus
gcctgtcgcatgacggatttattcc

SEQ ID NO: 556281 - DNA, 25 bp, Mus musculus
gcctgtcgcatgtcggatttattcc

SEQ ID NO: 556282 - DNA, 25 bp, Mus musculus
gcctgtcgggagagtgtttcccctt

SEQ ID NO: 556283 - DNA, 25 bp, Mus musculus
gcctgtcgggagtgtgtttcccctt

SEQ ID NO: 556284 - DNA, 25 bp, Mus musculus
gcctgtctaaagaagccgggttcca

SEQ ID NO: 556285 - DNA, 25 bp, Mus musculus
gcctgtctaaagtagccgggttcca

SEQ ID NO: 556286 - DNA, 25 bp, Mus musculus
gcctgtctaaccaggcaaagggtag

SEQ ID NO: 556287 - DNA, 25 bp, Mus musculus
gcctgtctaacctggcaaagggtag

SEQ ID NO: 556288 - DNA, 25 bp, Mus musculus
gcctgtctacaaagcacgaagccct

SEQ ID NO: 556289 - DNA, 25 bp, Mus musculus
gcctgtctacaatgcacgaagccct

SEQ ID NO: 556290 - DNA, 25 bp, Mus musculus
gcctgtctacacatgctgtgcagaa

SEQ ID NO: 556291 - DNA, 25 bp, Mus musculus
gcctgtctacacttgctgtgcagaa

SEQ ID NO: 556292 - DNA, 25 bp, Mus musculus
gcctgtctatcaagggcttgttaat

SEQ ID NO: 556293 - DNA, 25 bp, Mus musculus
gcctgtctatcatgggcttgttaat

SEQ ID NO: 556294 - DNA, 25 bp, Mus musculus
gcctgtctatttagctttctttgta

SEQ ID NO: 556295 - DNA, 25 bp, Mus musculus
gcctgtctattttgctttctttgta

SEQ ID NO: 556296 - DNA, 25 bp, Mus musculus
gcctgtctcaggacgttgtcatttg

SEQ ID NO: 556297 - DNA, 25 bp, Mus musculus
gcctgtctcaggtcgttgtcatttg

SEQ ID NO: 556298 - DNA, 25 bp, Mus musculus
gcctgtctcatcataaattgtgtct

SEQ ID NO: 556299 - DNA, 25 bp, Mus musculus
gcctgtctcatcttaaattgtgtct

SEQ ID NO: 556300 - DNA, 25 bp, Mus musculus
gcctgtctctctagctatgtttata

SEQ ID NO: 556301 - DNA, 25 bp, Mus musculus
gcctgtctctcttgctatgtttata

SEQ ID NO: 556302 - DNA, 25 bp, Mus musculus
gcctgtctctttcgttaaaagccaa

SEQ ID NO: 556303 - DNA, 25 bp, Mus musculus
gcctgtctctttggttaaaagccaa

SEQ ID NO: 556304 - DNA, 25 bp, Mus musculus
gcctgtctgacgactggagatgtga

SEQ ID NO: 556305 - DNA, 25 bp, Mus musculus
gcctgtctgacgtctggagatgtga

SEQ ID NO: 556306 - DNA, 25 bp, Mus musculus
gcctgtctgccaaggttgaggctta

SEQ ID NO: 556307 - DNA, 25 bp, Mus musculus
gcctgtctgccatggttgaggctta

SEQ ID NO: 556308 - DNA, 25 bp, Mus musculus
gcctgtctggatccatcaggactaa

SEQ ID NO: 556309 - DNA, 25 bp, Mus musculus
gcctgtctggatgcatcaggactaa

SEQ ID NO: 556310 - DNA, 25 bp, Mus musculus
gcctgtctggttcgcaatgtctaag

SEQ ID NO: 556311 - DNA, 25 bp, Mus musculus
gcctgtctggttggcaatgtctaag

SEQ ID NO: 556312 - DNA, 25 bp, Mus musculus
gcctgtctgtacataatggcataag

SEQ ID NO: 556313 - DNA, 25 bp, Mus musculus
gcctgtctgtacttaatggcataag

SEQ ID NO: 556314 - DNA, 25 bp, Mus musculus
gcctgtctgtcacgaagatcttcct

SEQ ID NO: 556315 - DNA, 25 bp, Mus musculus
gcctgtctgtcaggaagatcttcct

SEQ ID NO: 556316 - DNA, 25 bp, Mus musculus
gcctgtctgtgcagtcattcacaga

SEQ ID NO: 556317 - DNA, 25 bp, Mus musculus
gcctgtctgtgctgtcattcacaga

SEQ ID NO: 556318 - DNA, 25 bp, Mus musculus
gcctgtctgttcctagtgtgtaata

SEQ ID NO: 556319 - DNA, 25 bp, Mus musculus
gcctgtctgttcgtagtgtgtaata

SEQ ID NO: 556320 - DNA, 25 bp, Mus musculus
gcctgtcttcagatagttgtagcat

SEQ ID NO: 556321 - DNA, 25 bp, Mus musculus
gcctgtcttcagttagttgtagcat

SEQ ID NO: 556322 - DNA, 25 bp, Mus musculus
gcctgtcttctcatgggcaccaagg

SEQ ID NO: 556323 - DNA, 25 bp, Mus musculus
gcctgtcttctcttgggcaccaagg

SEQ ID NO: 556324 - DNA, 25 bp, Mus musculus
gcctgtcttctgcacttagcaaatg

SEQ ID NO: 556325 - DNA, 25 bp, Mus musculus
gcctgtcttctggacttagcaaatg

SEQ ID NO: 556326 - DNA, 25 bp, Mus musculus
gcctgtcttgcactggtaccttaaa

SEQ ID NO: 556327 - DNA, 25 bp, Mus musculus
gcctgtcttgcagtggtaccttaaa

SEQ ID NO: 556328 - DNA, 25 bp, Mus musculus
gcctgtctttttcttacaggagcct

SEQ ID NO: 556329 - DNA, 25 bp, Mus musculus
gcctgtctttttgttacaggagcct

SEQ ID NO: 556330 - DNA, 25 bp, Mus musculus
gcctgtgaacacatctaccttctga

SEQ ID NO: 556331 - DNA, 25 bp, Mus musculus
gcctgtgaacacttctaccttctga

SEQ ID NO: 556332 - DNA, 25 bp, Mus musculus
gcctgtgacagacgcctgagaactg

SEQ ID NO: 556333 - DNA, 25 bp, Mus musculus
gcctgtgacagaggcctgagaactg

SEQ ID NO: 556334 - DNA, 25 bp, Mus musculus
gcctgtgacagcctactgtggagat

SEQ ID NO: 556335 - DNA, 25 bp, Mus musculus
gcctgtgacagcgtactgtggagat

SEQ ID NO: 556336 - DNA, 25 bp, Mus musculus
gcctgtgacaggctcctattatgtt

SEQ ID NO: 556337 - DNA, 25 bp, Mus musculus
gcctgtgacaggctgtttccgacac

SEQ ID NO: 556338 - DNA, 25 bp, Mus musculus
gcctgtgacagggtcctattatgtt

SEQ ID NO: 556339 - DNA, 25 bp, Mus musculus
gcctgtgacagggtgtttccgacac

SEQ ID NO: 556340 - DNA, 25 bp, Mus musculus
gcctgtgaccatagtcctagtgtct

SEQ ID NO: 556341 - DNA, 25 bp, Mus musculus
gcctgtgaccattgtcctagtgtct

SEQ ID NO: 556342 - DNA, 25 bp, Mus musculus
gcctgtgactagaagaccaacccct

SEQ ID NO: 556343 - DNA, 25 bp, Mus musculus
gcctgtgactagtagaccaacccct

SEQ ID NO: 556344 - DNA, 25 bp, Mus musculus
gcctgtgactataacgttgacttct

SEQ ID NO: 556345 - DNA, 25 bp, Mus musculus
gcctgtgactattacgttgacttct

SEQ ID NO: 556346 - DNA, 25 bp, Mus musculus
gcctgtgactcgacattgatgcttt

SEQ ID NO: 556347 - DNA, 25 bp, Mus musculus
gcctgtgactcgtcattgatgcttt

SEQ ID NO: 556348 - DNA, 25 bp, Mus musculus
gcctgtgacttactctgtagccaga

SEQ ID NO: 556349 - DNA, 25 bp, Mus musculus
gcctgtgacttagtctgtagccaga

SEQ ID NO: 556350 - DNA, 25 bp, Mus musculus
gcctgtgagcctagtgggagcccat

SEQ ID NO: 556351 - DNA, 25 bp, Mus musculus
gcctgtgagccttgtgggagcccat

SEQ ID NO: 556352 - DNA, 25 bp, Mus musculus
gcctgtgagtatcgctttggcaaaa

SEQ ID NO: 556353 - DNA, 25 bp, Mus musculus
gcctgtgagtatggctttggcaaaa

SEQ ID NO: 556354 - DNA, 25 bp, Mus musculus
gcctgtgattaccattgctgagatg

SEQ ID NO: 556355 - DNA, 25 bp, Mus musculus
gcctgtgattacgattgctgagatg

SEQ ID NO: 556356 - DNA, 25 bp, Mus musculus
gcctgtgattatcatgccaagctat

SEQ ID NO: 556357 - DNA, 25 bp, Mus musculus
gcctgtgattatgatgccaagctat

SEQ ID NO: 556358 - DNA, 25 bp, Mus musculus
gcctgtgcaaaactcctgtgacagg

SEQ ID NO: 556359 - DNA, 25 bp, Mus musculus
gcctgtgcaaaagtcctgtgacagg

SEQ ID NO: 556360 - DNA, 25 bp, Mus musculus
gcctgtgcaattaaatgttcacgct

SEQ ID NO: 556361 - DNA, 25 bp, Mus musculus
gcctgtgcaatttaatgttcacgct

SEQ ID NO: 556362 - DNA, 25 bp, Mus musculus
gcctgtgcacacaaccttttattga

SEQ ID NO: 556363 - DNA, 25 bp, Mus musculus
gcctgtgcacactaccttttattga

SEQ ID NO: 556364 - DNA, 25 bp, Mus musculus
gcctgtgcagaacaggatgcctcct

SEQ ID NO: 556365 - DNA, 25 bp, Mus musculus
gcctgtgcagaagaggatgcctcct

SEQ ID NO: 556366 - DNA, 25 bp, Mus musculus
gcctgtgcagacaagctagccatta

SEQ ID NO: 556367 - DNA, 25 bp, Mus musculus
gcctgtgcagactagctagccatta

SEQ ID NO: 556368 - DNA, 25 bp, Mus musculus
gcctgtgccaagaaacttagagcct

SEQ ID NO: 556369 - DNA, 25 bp, Mus musculus
gcctgtgccaagaagctcctagaat

SEQ ID NO: 556370 - DNA, 25 bp, Mus musculus
gcctgtgccaagtaacttagagcct

SEQ ID NO: 556371 - DNA, 25 bp, Mus musculus
gcctgtgccaagtagctcctagaat

SEQ ID NO: 556372 - DNA, 25 bp, Mus musculus
gcctgtgccaatagctgttttctaa

SEQ ID NO: 556373 - DNA, 25 bp, Mus musculus
gcctgtgccaattgctgttttctaa

SEQ ID NO: 556374 - DNA, 25 bp, Mus musculus
gcctgtgccactagaatgtttgcta

SEQ ID NO: 556375 - DNA, 25 bp, Mus musculus
gcctgtgccacttgaatgtttgcta

SEQ ID NO: 556376 - DNA, 25 bp, Mus musculus
gcctgtgcccctcgagaactaataa

SEQ ID NO: 556377 - DNA, 25 bp, Mus musculus
gcctgtgcccctggagaactaataa

SEQ ID NO: 556378 - DNA, 25 bp, Mus musculus
gcctgtgccctcagttatcaagtgt

SEQ ID NO: 556379 - DNA, 25 bp, Mus musculus
gcctgtgccctctgttatcaagtgt

SEQ ID NO: 556380 - DNA, 25 bp, Mus musculus
gcctgtgccgctcttacgaagagaa

SEQ ID NO: 556381 - DNA, 25 bp, Mus musculus
gcctgtgccgctgttacgaagagaa

SEQ ID NO: 556382 - DNA, 25 bp, Mus musculus
gcctgtgccggtcattgtgtctaac

SEQ ID NO: 556383 - DNA, 25 bp, Mus musculus
gcctgtgccggtgattgtgtctaac

SEQ ID NO: 556384 - DNA, 25 bp, Mus musculus
gcctgtgccgtcagataccactgtg

SEQ ID NO: 556385 - DNA, 25 bp, Mus musculus
gcctgtgccgtctgataccactgtg

SEQ ID NO: 556386 - DNA, 25 bp, Mus musculus
gcctgtgcgtgtctttacactcgaa

SEQ ID NO: 556387 - DNA, 25 bp, Mus musculus
gcctgtgcgtgtgtttacactcgaa

SEQ ID NO: 556388 - DNA, 25 bp, Mus musculus
gcctgtgctaagagatcctgaggta

SEQ ID NO: 556389 - DNA, 25 bp, Mus musculus
gcctgtgctaagtgatcctgaggta

SEQ ID NO: 556390 - DNA, 25 bp, Mus musculus
gcctgtgctaccagagacaatctca

SEQ ID NO: 556391 - DNA, 25 bp, Mus musculus
gcctgtgctaccatggcaagctctc

SEQ ID NO: 556392 - DNA, 25 bp, Mus musculus
gcctgtgctacctgagacaatctca

SEQ ID NO: 556393 - DNA, 25 bp, Mus musculus
gcctgtgctaccttggcaagctctc

SEQ ID NO: 556394 - DNA, 25 bp, Mus musculus
gcctgtgctatgagcagaaccactt

SEQ ID NO: 556395 - DNA, 25 bp, Mus musculus
gcctgtgctatgtgcagaaccactt

SEQ ID NO: 556396 - DNA, 25 bp, Mus musculus
gcctgtgctgagagctaagtgcctg

SEQ ID NO: 556397 - DNA, 25 bp, Mus musculus
gcctgtgctgagtgctaagtgcctg

SEQ ID NO: 556398 - DNA, 25 bp, Mus musculus
gcctgtgcttgcactgatgcattga

SEQ ID NO: 556399 - DNA, 25 bp, Mus musculus
gcctgtgcttgctctgatgcattga

SEQ ID NO: 556400 - DNA, 25 bp, Mus musculus
gcctgtggaccaactgctgcgaaaa

SEQ ID NO: 556401 - DNA, 25 bp, Mus musculus
gcctgtggaccatctgctgcgaaaa

SEQ ID NO: 556402 - DNA, 25 bp, Mus musculus
gcctgtggacccctactgtgtacat

SEQ ID NO: 556403 - DNA, 25 bp, Mus musculus
gcctgtggacccgtactgtgtacat

SEQ ID NO: 556404 - DNA, 25 bp, Mus musculus
gcctgtggacctatcagtgaaataa

SEQ ID NO: 556405 - DNA, 25 bp, Mus musculus
gcctgtggacctttcagtgaaataa

SEQ ID NO: 556406 - DNA, 25 bp, Mus musculus
gcctgtggagcgcaacatgccattc

SEQ ID NO: 556407 - DNA, 25 bp, Mus musculus
gcctgtggagcggaacatgccattc

SEQ ID NO: 556408 - DNA, 25 bp, Mus musculus
gcctgtggatgtaatcttggcttct

SEQ ID NO: 556409 - DNA, 25 bp, Mus musculus
gcctgtggatgttatcttggcttct

SEQ ID NO: 556410 - DNA, 25 bp, Mus musculus
gcctgtggattgatttgagcttggt

SEQ ID NO: 556411 - DNA, 25 bp, Mus musculus
gcctgtggattgttttgagcttggt

SEQ ID NO: 556412 - DNA, 25 bp, Mus musculus
gcctgtggcagccagtggcatcaaa

SEQ ID NO: 556413 - DNA, 25 bp, Mus musculus
gcctgtggcagcgagtggcatcaaa

SEQ ID NO: 556414 - DNA, 25 bp, Mus musculus
gcctgtgggccaatcttataaagac

SEQ ID NO: 556415 - DNA, 25 bp, Mus musculus
gcctgtgggccattcttataaagac

SEQ ID NO: 556416 - DNA, 25 bp, Mus musculus
gcctgtgggcccatggtttccagga

SEQ ID NO: 556417 - DNA, 25 bp, Mus musculus
gcctgtgggcccttggtttccagga

SEQ ID NO: 556418 - DNA, 25 bp, Mus musculus
gcctgtgggccgaagccagggacat

SEQ ID NO: 556419 - DNA, 25 bp, Mus musculus
gcctgtgggccgtagccagggacat

SEQ ID NO: 556420 - DNA, 25 bp, Mus musculus
gcctgtggtaagatagcttctcctt

SEQ ID NO: 556421 - DNA, 25 bp, Mus musculus
gcctgtggtaagttagcttctcctt

SEQ ID NO: 556422 - DNA, 25 bp, Mus musculus
gcctgtggtaatctcatctgcttat

SEQ ID NO: 556423 - DNA, 25 bp, Mus musculus
gcctgtggtaatgtcatctgcttat

SEQ ID NO: 556424 - DNA, 25 bp, Mus musculus
gcctgtggtgacattttgtactgct

SEQ ID NO: 556425 - DNA, 25 bp, Mus musculus
gcctgtggtgactttttgtactgct

SEQ ID NO: 556426 - DNA, 25 bp, Mus musculus
gcctgtggtgtgaataccatggcca

SEQ ID NO: 556427 - DNA, 25 bp, Mus musculus
gcctgtggtgtgtataccatggcca

SEQ ID NO: 556428 - DNA, 25 bp, Mus musculus
gcctgtggtgttaatcttctactga

SEQ ID NO: 556429 - DNA, 25 bp, Mus musculus
gcctgtggtgtttatcttctactga

SEQ ID NO: 556430 - DNA, 25 bp, Mus musculus
gcctgtggttaacttgccatgctgc

SEQ ID NO: 556431 - DNA, 25 bp, Mus musculus
gcctgtggttaagttgccatgctgc

SEQ ID NO: 556432 - DNA, 25 bp, Mus musculus
gcctgtggttagatgttgttagcct

SEQ ID NO: 556433 - DNA, 25 bp, Mus musculus
gcctgtggttagttgttgttagcct

SEQ ID NO: 556434 - DNA, 25 bp, Mus musculus
gcctgtggttctcttgaaatacttc

SEQ ID NO: 556435 - DNA, 25 bp, Mus musculus
gcctgtggttctgttgaaatacttc

SEQ ID NO: 556436 - DNA, 25 bp, Mus musculus
gcctgtgtaagcacgcgctgtactg

SEQ ID NO: 556437 - DNA, 25 bp, Mus musculus
gcctgtgtaagctcgcgctgtactg

SEQ ID NO: 556438 - DNA, 25 bp, Mus musculus
gcctgtgtagagacacacctcccag

SEQ ID NO: 556439 - DNA, 25 bp, Mus musculus
gcctgtgtagagtcacacctcccag

SEQ ID NO: 556440 - DNA, 25 bp, Mus musculus
gcctgtgtattgaccagtgcatgat

SEQ ID NO: 556441 - DNA, 25 bp, Mus musculus
gcctgtgtattgtccagtgcatgat

SEQ ID NO: 556442 - DNA, 25 bp, Mus musculus
gcctgtgtcattcaaggaactactt

SEQ ID NO: 556443 - DNA, 25 bp, Mus musculus
gcctgtgtcattgaaggaactactt

SEQ ID NO: 556444 - DNA, 25 bp, Mus musculus
gcctgtgtcccgactttcaaataag

SEQ ID NO: 556445 - DNA, 25 bp, Mus musculus
gcctgtgtcccgtctttcaaataag

SEQ ID NO: 556446 - DNA, 25 bp, Mus musculus
gcctgtgtcctcagaggagaaccca

SEQ ID NO: 556447 - DNA, 25 bp, Mus musculus
gcctgtgtcctctgaggagaaccca

SEQ ID NO: 556448 - DNA, 25 bp, Mus musculus
gcctgtgtctcacaatcaccatatt

SEQ ID NO: 556449 - DNA, 25 bp, Mus musculus
gcctgtgtctcagaatcaccatatt

SEQ ID NO: 556450 - DNA, 25 bp, Mus musculus
gcctgtgtctgaaaaccatgacttt

SEQ ID NO: 556451 - DNA, 25 bp, Mus musculus
gcctgtgtctgataaccatgacttt

SEQ ID NO: 556452 - DNA, 25 bp, Mus musculus
gcctgtgtctggaaattgcattctt

SEQ ID NO: 556453 - DNA, 25 bp, Mus musculus
gcctgtgtctggtaattgcattctt

SEQ ID NO: 556454 - DNA, 25 bp, Mus musculus
gcctgtgtgagtcactcccgtgtgt

SEQ ID NO: 556455 - DNA, 25 bp, Mus musculus
gcctgtgtgagtgactcccgtgtgt

SEQ ID NO: 556456 - DNA, 25 bp, Mus musculus
gcctgtgtgatccttctgtgaagag

SEQ ID NO: 556457 - DNA, 25 bp, Mus musculus
gcctgtgtgatcgttctgtgaagag

SEQ ID NO: 556458 - DNA, 25 bp, Mus musculus
gcctgtgtgggcatatcattaatat

SEQ ID NO: 556459 - DNA, 25 bp, Mus musculus
gcctgtgtgggcttatcattaatat

SEQ ID NO: 556460 - DNA, 25 bp, Mus musculus
gcctgtgtgtccatcattggcactg

SEQ ID NO: 556461 - DNA, 25 bp, Mus musculus
gcctgtgtgtccttcattggcactg

SEQ ID NO: 556462 - DNA, 25 bp, Mus musculus
gcctgtgttcagattagttccgtga

SEQ ID NO: 556463 - DNA, 25 bp, Mus musculus
gcctgtgttcagtttagttccgtga

SEQ ID NO: 556464 - DNA, 25 bp, Mus musculus
gcctgtgttcctccaaatctacaat

SEQ ID NO: 556465 - DNA, 25 bp, Mus musculus
gcctgtgttcctgcaaatctacaat

SEQ ID NO: 556466 - DNA, 25 bp, Mus musculus
gcctgtgttcttaaagctgtttaca

SEQ ID NO: 556467 - DNA, 25 bp, Mus musculus
gcctgtgttctttaagctgtttaca

SEQ ID NO: 556468 - DNA, 25 bp, Mus musculus
gcctgtgtttcgaacgttgggatca

SEQ ID NO: 556469 - DNA, 25 bp, Mus musculus
gcctgtgtttcgtacgttgggatca

SEQ ID NO: 556470 - DNA, 25 bp, Mus musculus
gcctgtgtttctacatctgtctctt

SEQ ID NO: 556471 - DNA, 25 bp, Mus musculus
gcctgtgtttcttcatctgtctctt

SEQ ID NO: 556472 - DNA, 25 bp, Mus musculus
gcctgttaacagattgggagcacat

SEQ ID NO: 556473 - DNA, 25 bp, Mus musculus
gcctgttaacagtttgggagcacat

SEQ ID NO: 556474 - DNA, 25 bp, Mus musculus
gcctgttaagctatattccatgaag

SEQ ID NO: 556475 - DNA, 25 bp, Mus musculus
gcctgttaagctttattccatgaag

SEQ ID NO: 556476 - DNA, 25 bp, Mus musculus
gcctgttaaggcactactaatggaa

SEQ ID NO: 556477 - DNA, 25 bp, Mus musculus
gcctgttaaggctctactaatggaa

SEQ ID NO: 556478 - DNA, 25 bp, Mus musculus
gcctgttacaaacagggtggtcatt

SEQ ID NO: 556479 - DNA, 25 bp, Mus musculus
gcctgttacaaagagggtggtcatt

SEQ ID NO: 556480 - DNA, 25 bp, Mus musculus
gcctgttacaggactgcagcatagt

SEQ ID NO: 556481 - DNA, 25 bp, Mus musculus
gcctgttacaggtctgcagcatagt

SEQ ID NO: 556482 - DNA, 25 bp, Mus musculus
gcctgttaccaaccttgatgacttg

SEQ ID NO: 556483 - DNA, 25 bp, Mus musculus
gcctgttaccaagcttgatgacttg

SEQ ID NO: 556484 - DNA, 25 bp, Mus musculus
gcctgttactaactttattgctgta

SEQ ID NO: 556485 - DNA, 25 bp, Mus musculus
gcctgttactaagtttattgctgta

SEQ ID NO: 556486 - DNA, 25 bp, Mus musculus
gcctgttactatcgccttgtagaca

SEQ ID NO: 556487 - DNA, 25 bp, Mus musculus
gcctgttactatggccttgtagaca

SEQ ID NO: 556488 - DNA, 25 bp, Mus musculus
gcctgttagcacactgttacttgta

SEQ ID NO: 556489 - DNA, 25 bp, Mus musculus
gcctgttagcactctgttacttgta

SEQ ID NO: 556490 - DNA, 25 bp, Mus musculus
gcctgttagcctctgcctacagaga

SEQ ID NO: 556491 - DNA, 25 bp, Mus musculus
gcctgttagcctgtgcctacagaga

SEQ ID NO: 556492 - DNA, 25 bp, Mus musculus
gcctgttaggtgcgcaccctgcaga

SEQ ID NO: 556493 - DNA, 25 bp, Mus musculus
gcctgttaggtgggcaccctgcaga

SEQ ID NO: 556494 - DNA, 25 bp, Mus musculus
gcctgttagttaccctggttcaaag

SEQ ID NO: 556495 - DNA, 25 bp, Mus musculus
gcctgttagttagcctggttcaaag

SEQ ID NO: 556496 - DNA, 25 bp, Mus musculus
gcctgttatactatactattcctgg

SEQ ID NO: 556497 - DNA, 25 bp, Mus musculus
gcctgttatactttactattcctgg

SEQ ID NO: 556498 - DNA, 25 bp, Mus musculus
gcctgttatttcctatctcaggaga

SEQ ID NO: 556499 - DNA, 25 bp, Mus musculus
gcctgttatttcgtatctcaggaga

SEQ ID NO: 556500 - DNA, 25 bp, Mus musculus
gcctgttcaaagagcagagcctcca

SEQ ID NO: 556501 - DNA, 25 bp, Mus musculus
gcctgttcaaagtgcagagcctcca

SEQ ID NO: 556502 - DNA, 25 bp, Mus musculus
gcctgttcaagcagctttgtttaca

SEQ ID NO: 556503 - DNA, 25 bp, Mus musculus
gcctgttcaagctgctttgtttaca

SEQ ID NO: 556504 - DNA, 25 bp, Mus musculus
gcctgttcacctaatcatgggtgta

SEQ ID NO: 556505 - DNA, 25 bp, Mus musculus
gcctgttcaccttatcatgggtgta

SEQ ID NO: 556506 - DNA, 25 bp, Mus musculus
gcctgttcactgagtttattgcaaa

SEQ ID NO: 556507 - DNA, 25 bp, Mus musculus
gcctgttcactgtgtttattgcaaa

SEQ ID NO: 556508 - DNA, 25 bp, Mus musculus
gcctgttcaggcagctcagagcaca

SEQ ID NO: 556509 - DNA, 25 bp, Mus musculus
gcctgttcaggctgctcagagcaca

SEQ ID NO: 556510 - DNA, 25 bp, Mus musculus
gcctgttcagtgcactggcaagaga

SEQ ID NO: 556511 - DNA, 25 bp, Mus musculus
gcctgttcagtggactggcaagaga

SEQ ID NO: 556512 - DNA, 25 bp, Mus musculus
gcctgttccactctgttctacaaag

SEQ ID NO: 556513 - DNA, 25 bp, Mus musculus
gcctgttccactgtgttctacaaag

SEQ ID NO: 556514 - DNA, 25 bp, Mus musculus
gcctgttccagaagtctaaccctaa

SEQ ID NO: 556515 - DNA, 25 bp, Mus musculus
gcctgttccagatgtctaaccctaa

SEQ ID NO: 556516 - DNA, 25 bp, Mus musculus
gcctgttcctgccataaagtgattt

SEQ ID NO: 556517 - DNA, 25 bp, Mus musculus
gcctgttcctgcgataaagtgattt

SEQ ID NO: 556518 - DNA, 25 bp, Mus musculus
gcctgttcctgtcggtgttcgtgat

SEQ ID NO: 556519 - DNA, 25 bp, Mus musculus
gcctgttcctgtgggtgttcgtgat

SEQ ID NO: 556520 - DNA, 25 bp, Mus musculus
gcctgttcttgtctctgggcaaact

SEQ ID NO: 556521 - DNA, 25 bp, Mus musculus
gcctgttcttgtgtctgggcaaact

SEQ ID NO: 556522 - DNA, 25 bp, Mus musculus
gcctgttgaatcatcacactccaaa

SEQ ID NO: 556523 - DNA, 25 bp, Mus musculus
gcctgttgaatcttcacactccaaa

SEQ ID NO: 556524 - DNA, 25 bp, Mus musculus
gcctgttgacttacatgttcattaa

SEQ ID NO: 556525 - DNA, 25 bp, Mus musculus
gcctgttgacttccacttgtaccgg

SEQ ID NO: 556526 - DNA, 25 bp, Mus musculus
gcctgttgacttgcacttgtaccgg

SEQ ID NO: 556527 - DNA, 25 bp, Mus musculus
gcctgttgactttcatgttcattaa

SEQ ID NO: 556528 - DNA, 25 bp, Mus musculus
gcctgttgctcaaggtgtgggatca

SEQ ID NO: 556529 - DNA, 25 bp, Mus musculus
gcctgttgctcatggtgtgggatca

SEQ ID NO: 556530 - DNA, 25 bp, Mus musculus
gcctgttggaagagccacaaagtca

SEQ ID NO: 556531 - DNA, 25 bp, Mus musculus
gcctgttggaagtgccacaaagtca

SEQ ID NO: 556532 - DNA, 25 bp, Mus musculus
gcctgttggagtaccagttgagaat

SEQ ID NO: 556533 - DNA, 25 bp, Mus musculus
gcctgttggagttccagttgagaat

SEQ ID NO: 556534 - DNA, 25 bp, Mus musculus
gcctgttggattaaagggttttcag

SEQ ID NO: 556535 - DNA, 25 bp, Mus musculus
gcctgttggatttaagggttttcag

SEQ ID NO: 556536 - DNA, 25 bp, Mus musculus
gcctgttgtacccatcctcaaatgg

SEQ ID NO: 556537 - DNA, 25 bp, Mus musculus
gcctgttgtaccgatcctcaaatgg

SEQ ID NO: 556538 - DNA, 25 bp, Mus musculus
gcctgttgtcacattatgcttctag

SEQ ID NO: 556539 - DNA, 25 bp, Mus musculus
gcctgttgtcactttatgcttctag

SEQ ID NO: 556540 - DNA, 25 bp, Mus musculus
gcctgttgtcataaggctgggaacc

SEQ ID NO: 556541 - DNA, 25 bp, Mus musculus
gcctgttgtcattaggctgggaacc

SEQ ID NO: 556542 - DNA, 25 bp, Mus musculus
gcctgttgtctgctgagagttccta

SEQ ID NO: 556543 - DNA, 25 bp, Mus musculus
gcctgttgtctggtgagagttccta

SEQ ID NO: 556544 - DNA, 25 bp, Mus musculus
gcctgttgtgagaagtgcccatgtt

SEQ ID NO: 556545 - DNA, 25 bp, Mus musculus
gcctgttgtgagtagtgcccatgtt

SEQ ID NO: 556546 - DNA, 25 bp, Mus musculus
gcctgttgttgtacccaaccaaggg

SEQ ID NO: 556547 - DNA, 25 bp, Mus musculus
gcctgttgttgttcccaaccaaggg

SEQ ID NO: 556548 - DNA, 25 bp, Mus musculus
gcctgtttaatcaccctatgtagtt

SEQ ID NO: 556549 - DNA, 25 bp, Mus musculus
gcctgtttaatctccctatgtagtt

SEQ ID NO: 556550 - DNA, 25 bp, Mus musculus
gcctgtttactgacttcttaagcca

SEQ ID NO: 556551 - DNA, 25 bp, Mus musculus
gcctgtttactgtcttcttaagcca

SEQ ID NO: 556552 - DNA, 25 bp, Mus musculus
gcctgtttagctaccttgggttcaa

SEQ ID NO: 556553 - DNA, 25 bp, Mus musculus
gcctgtttagcttccttgggttcaa

SEQ ID NO: 556554 - DNA, 25 bp, Mus musculus
gcctgtttaggcatcaaagtgctga

SEQ ID NO: 556555 - DNA, 25 bp, Mus musculus
gcctgtttaggcttcaaagtgctga

SEQ ID NO: 556556 - DNA, 25 bp, Mus musculus
gcctgtttatggctcagaggctaca

SEQ ID NO: 556557 - DNA, 25 bp, Mus musculus
gcctgtttatgggtcagaggctaca

SEQ ID NO: 556558 - DNA, 25 bp, Mus musculus
gcctgtttcagtattgggtttcgga

SEQ ID NO: 556559 - DNA, 25 bp, Mus musculus
gcctgtttcagttttgggtttcgga

SEQ ID NO: 556560 - DNA, 25 bp, Mus musculus
gcctgtttctcacagtgcgttagca

SEQ ID NO: 556561 - DNA, 25 bp, Mus musculus
gcctgtttctcagagtgcgttagca

SEQ ID NO: 556562 - DNA, 25 bp, Mus musculus
gcctgtttctccagtgagcagctga

SEQ ID NO: 556563 - DNA, 25 bp, Mus musculus
gcctgtttctcctgtgagcagctga

SEQ ID NO: 556564 - DNA, 25 bp, Mus musculus
gcctgtttctctctaatgcatcaac

SEQ ID NO: 556565 - DNA, 25 bp, Mus musculus
gcctgtttctctgtaatgcatcaac

SEQ ID NO: 556566 - DNA, 25 bp, Mus musculus
gcctgtttctggattgagtgctgca

SEQ ID NO: 556567 - DNA, 25 bp, Mus musculus
gcctgtttctggtttgagtgctgca

SEQ ID NO: 556568 - DNA, 25 bp, Mus musculus
gcctgtttctttcccagacttagcc

SEQ ID NO: 556569 - DNA, 25 bp, Mus musculus
gcctgtttctttgccagacttagcc

SEQ ID NO: 556570 - DNA, 25 bp, Mus musculus
gcctgtttgaacacatagctcctaa

SEQ ID NO: 556571 - DNA, 25 bp, Mus musculus
gcctgtttgaactcatagctcctaa

SEQ ID NO: 556572 - DNA, 25 bp, Mus musculus
gcctgtttgaagacattctcggcag

SEQ ID NO: 556573 - DNA, 25 bp, Mus musculus
gcctgtttgaagtcattctcggcag

SEQ ID NO: 556574 - DNA, 25 bp, Mus musculus
gcctgtttgctgacatctatcatat

SEQ ID NO: 556575 - DNA, 25 bp, Mus musculus
gcctgtttgctgtcatctatcatat

SEQ ID NO: 556576 - DNA, 25 bp, Mus musculus
gcctgtttggcacaaggttactcct

SEQ ID NO: 556577 - DNA, 25 bp, Mus musculus
gcctgtttggcagaaggttactcct

SEQ ID NO: 556578 - DNA, 25 bp, Mus musculus
gcctgtttggcccagatctgatccc

SEQ ID NO: 556579 - DNA, 25 bp, Mus musculus
gcctgtttggccgagatctgatccc

SEQ ID NO: 556580 - DNA, 25 bp, Mus musculus
gcctgtttgtaacaagtctactcct

SEQ ID NO: 556581 - DNA, 25 bp, Mus musculus
gcctgtttgtaagaagtctactcct

SEQ ID NO: 556582 - DNA, 25 bp, Mus musculus
gcctgtttgtctactcccaagagat

SEQ ID NO: 556583 - DNA, 25 bp, Mus musculus
gcctgtttgtcttctcccaagagat

SEQ ID NO: 556584 - DNA, 25 bp, Mus musculus
gcctgtttgtgaaataacccatccc

SEQ ID NO: 556585 - DNA, 25 bp, Mus musculus
gcctgtttgtgatataacccatccc

SEQ ID NO: 556586 - DNA, 25 bp, Mus musculus
gcctgttttagcatcacttatggtt

SEQ ID NO: 556587 - DNA, 25 bp, Mus musculus
gcctgttttagcttcacttatggtt

SEQ ID NO: 556588 - DNA, 25 bp, Mus musculus
gcctgttttaggctcatcccagttt

SEQ ID NO: 556589 - DNA, 25 bp, Mus musculus
gcctgttttagggtcatcccagttt

SEQ ID NO: 556590 - DNA, 25 bp, Mus musculus
gcctgtttttagcttgccttgttaa

SEQ ID NO: 556591 - DNA, 25 bp, Mus musculus
gcctgtttttaggttgccttgttaa

SEQ ID NO: 556592 - DNA, 25 bp, Mus musculus
gcctgtttttatcttaccagtattc

SEQ ID NO: 556593 - DNA, 25 bp, Mus musculus
gcctgtttttatgttaccagtattc

SEQ ID NO: 556594 - DNA, 25 bp, Mus musculus
gcctgtttttctcactcttctcaga

SEQ ID NO: 556595 - DNA, 25 bp, Mus musculus
gcctgtttttctgactcttctcaga

SEQ ID NO: 556596 - DNA, 25 bp, Mus musculus
gccttaaaaaggacgtgccgcaacg

SEQ ID NO: 556597 - DNA, 25 bp, Mus musculus
gccttaaaaaggtcgtgccgcaacg

SEQ ID NO: 556598 - DNA, 25 bp, Mus musculus
gccttaaacccgagccaccgtagtg

SEQ ID NO: 556599 - DNA, 25 bp, Mus musculus
gccttaaacccgtgccaccgtagtg

SEQ ID NO: 556600 - DNA, 25 bp, Mus musculus
gccttaaacctcattatttcactgc

SEQ ID NO: 556601 - DNA, 25 bp, Mus musculus
gccttaaacctctttatttcactgc

SEQ ID NO: 556602 - DNA, 25 bp, Mus musculus
gccttaaatcttagcatgcccaaag

SEQ ID NO: 556603 - DNA, 25 bp, Mus musculus
gccttaaatcttccctggcagtggg

SEQ ID NO: 556604 - DNA, 25 bp, Mus musculus
gccttaaatcttgcctggcagtggg

SEQ ID NO: 556605 - DNA, 25 bp, Mus musculus
gccttaaatctttgcatgcccaaag

SEQ ID NO: 556606 - DNA, 25 bp, Mus musculus
gccttaacagaaacataaccctagt

SEQ ID NO: 556607 - DNA, 25 bp, Mus musculus
gccttaacagaaatcttacctccat

SEQ ID NO: 556608 - DNA, 25 bp, Mus musculus
gccttaacagaatcataaccctagt

SEQ ID NO: 556609 - DNA, 25 bp, Mus musculus
gccttaacagaattcttacctccat

SEQ ID NO: 556610 - DNA, 25 bp, Mus musculus
gccttaacaggcatacgactacttt

SEQ ID NO: 556611 - DNA, 25 bp, Mus musculus
gccttaacaggcttacgactacttt

SEQ ID NO: 556612 - DNA, 25 bp, Mus musculus
gccttaaccttcagttggcatcaag

SEQ ID NO: 556613 - DNA, 25 bp, Mus musculus
gccttaaccttctgttggcatcaag

SEQ ID NO: 556614 - DNA, 25 bp, Mus musculus
gccttaacgctgagagttcatgtct

SEQ ID NO: 556615 - DNA, 25 bp, Mus musculus
gccttaacgctgtgagttcatgtct

SEQ ID NO: 556616 - DNA, 25 bp, Mus musculus
gccttaactcacatcacacattggt

SEQ ID NO: 556617 - DNA, 25 bp, Mus musculus
gccttaactcacttcacacattggt

SEQ ID NO: 556618 - DNA, 25 bp, Mus musculus
gccttaactgtaatcttgaactatc

SEQ ID NO: 556619 - DNA, 25 bp, Mus musculus
gccttaactgtattcttgaactatc

SEQ ID NO: 556620 - DNA, 25 bp, Mus musculus
gccttaacttatccttttattggca

SEQ ID NO: 556621 - DNA, 25 bp, Mus musculus
gccttaacttatgcttttattggca

SEQ ID NO: 556622 - DNA, 25 bp, Mus musculus
gccttaacttcaaattgccttcttt

SEQ ID NO: 556623 - DNA, 25 bp, Mus musculus
gccttaacttcatattgccttcttt

SEQ ID NO: 556624 - DNA, 25 bp, Mus musculus
gccttaacttggcttactgctcagc

SEQ ID NO: 556625 - DNA, 25 bp, Mus musculus
gccttaacttgggttactgctcagc

SEQ ID NO: 556626 - DNA, 25 bp, Mus musculus
gccttaagccgtaagtcgagggtct

SEQ ID NO: 556627 - DNA, 25 bp, Mus musculus
gccttaagccgttagtcgagggtct

SEQ ID NO: 556628 - DNA, 25 bp, Mus musculus
gccttaaggcccctgtgtgggtaat

SEQ ID NO: 556629 - DNA, 25 bp, Mus musculus
gccttaaggcccgtgtgtgggtaat

SEQ ID NO: 556630 - DNA, 25 bp, Mus musculus
gccttaaggtttcgtctctcaaaag

SEQ ID NO: 556631 - DNA, 25 bp, Mus musculus
gccttaaggtttggtctctcaaaag

SEQ ID NO: 556632 - DNA, 25 bp, Mus musculus
gccttaatactccactctactgtaa

SEQ ID NO: 556633 - DNA, 25 bp, Mus musculus
gccttaatactcgactctactgtaa

SEQ ID NO: 556634 - DNA, 25 bp, Mus musculus
gccttaatcaagacaccaaagcctt

SEQ ID NO: 556635 - DNA, 25 bp, Mus musculus
gccttaatcaagtcaccaaagcctt

SEQ ID NO: 556636 - DNA, 25 bp, Mus musculus
gccttaatcttaaaccctgtgtctt

SEQ ID NO: 556637 - DNA, 25 bp, Mus musculus
gccttaatcttataccctgtgtctt

SEQ ID NO: 556638 - DNA, 25 bp, Mus musculus
gccttaatgagaacatctgtgcact

SEQ ID NO: 556639 - DNA, 25 bp, Mus musculus
gccttaatgagatcatctgtgcact

SEQ ID NO: 556640 - DNA, 25 bp, Mus musculus
gccttacaactgcttttctgtcgtt

SEQ ID NO: 556641 - DNA, 25 bp, Mus musculus
gccttacaactggttttctgtcgtt

SEQ ID NO: 556642 - DNA, 25 bp, Mus musculus
gccttacaagagctatgtgccgaca

SEQ ID NO: 556643 - DNA, 25 bp, Mus musculus
gccttacaagaggtatgtgccgaca

SEQ ID NO: 556644 - DNA, 25 bp, Mus musculus
gccttacaagccacagaaactgcag

SEQ ID NO: 556645 - DNA, 25 bp, Mus musculus
gccttacaagcctcagaaactgcag

SEQ ID NO: 556646 - DNA, 25 bp, Mus musculus
gccttacaatacagagactgatgct

SEQ ID NO: 556647 - DNA, 25 bp, Mus musculus
gccttacaatactgagactgatgct

SEQ ID NO: 556648 - DNA, 25 bp, Mus musculus
gccttacacaaaagccatggtgcat

SEQ ID NO: 556649 - DNA, 25 bp, Mus musculus
gccttacacaaatgccatggtgcat

SEQ ID NO: 556650 - DNA, 25 bp, Mus musculus
gccttacacataagcagctactctt

SEQ ID NO: 556651 - DNA, 25 bp, Mus musculus
gccttacacatatgcagctactctt

SEQ ID NO: 556652 - DNA, 25 bp, Mus musculus
gccttacagcttatggaatggctaa

SEQ ID NO: 556653 - DNA, 25 bp, Mus musculus
gccttacagcttttggaatggctaa

SEQ ID NO: 556654 - DNA, 25 bp, Mus musculus
gccttacatcagctttggcaagttc

SEQ ID NO: 556655 - DNA, 25 bp, Mus musculus
gccttacatcaggtttggcaagttc

SEQ ID NO: 556656 - DNA, 25 bp, Mus musculus
gccttacatgggaagaactgctcta

SEQ ID NO: 556657 - DNA, 25 bp, Mus musculus
gccttacatgggtagaactgctcta

SEQ ID NO: 556658 - DNA, 25 bp, Mus musculus
gccttacatttccactcacaacagt

SEQ ID NO: 556659 - DNA, 25 bp, Mus musculus
gccttacatttcgactcacaacagt

SEQ ID NO: 556660 - DNA, 25 bp, Mus musculus
gccttaccctgtctgactatgttta

SEQ ID NO: 556661 - DNA, 25 bp, Mus musculus
gccttaccctgtgtgactatgttta

SEQ ID NO: 556662 - DNA, 25 bp, Mus musculus
gccttaccgaagctgattacctgag

SEQ ID NO: 556663 - DNA, 25 bp, Mus musculus
gccttaccgaaggtgattacctgag

SEQ ID NO: 556664 - DNA, 25 bp, Mus musculus
gccttacctggcacaagcattacat

SEQ ID NO: 556665 - DNA, 25 bp, Mus musculus
gccttacctggctcaagcattacat

SEQ ID NO: 556666 - DNA, 25 bp, Mus musculus
gccttactactgctaatcactgtca

SEQ ID NO: 556667 - DNA, 25 bp, Mus musculus
gccttactactggtaatcactgtca

SEQ ID NO: 556668 - DNA, 25 bp, Mus musculus
gccttactatatactgaactgctca

SEQ ID NO: 556669 - DNA, 25 bp, Mus musculus
gccttactatattctgaactgctca

SEQ ID NO: 556670 - DNA, 25 bp, Mus musculus
gccttactatgacatggtgccttca

SEQ ID NO: 556671 - DNA, 25 bp, Mus musculus
gccttactatgagatggtgccttca

SEQ ID NO: 556672 - DNA, 25 bp, Mus musculus
gccttactgtgcactgtctgaaaca

SEQ ID NO: 556673 - DNA, 25 bp, Mus musculus
gccttactgtgctctgtctgaaaca

SEQ ID NO: 556674 - DNA, 25 bp, Mus musculus
gccttacttattatttcaacgacag

SEQ ID NO: 556675 - DNA, 25 bp, Mus musculus
gccttacttattttttcaacgacag

SEQ ID NO: 556676 - DNA, 25 bp, Mus musculus
gccttagaaggactgtagcatttta

SEQ ID NO: 556677 - DNA, 25 bp, Mus musculus
gccttagaaggagtgtagcatttta

SEQ ID NO: 556678 - DNA, 25 bp, Mus musculus
gccttagaatgtaaactgctatcca

SEQ ID NO: 556679 - DNA, 25 bp, Mus musculus
gccttagaatgttaactgctatcca

SEQ ID NO: 556680 - DNA, 25 bp, Mus musculus
gccttagactatagctcacctggta

SEQ ID NO: 556681 - DNA, 25 bp, Mus musculus
gccttagactattgctcacctggta

SEQ ID NO: 556682 - DNA, 25 bp, Mus musculus
gccttagagataagcctttgacgaa

SEQ ID NO: 556683 - DNA, 25 bp, Mus musculus
gccttagagatatgcctttgacgaa

SEQ ID NO: 556684 - DNA, 25 bp, Mus musculus
gccttagagttcaggagccagtctg

SEQ ID NO: 556685 - DNA, 25 bp, Mus musculus
gccttagagttctggagccagtctg

SEQ ID NO: 556686 - DNA, 25 bp, Mus musculus
gccttagatctcacgccgccaatgc

SEQ ID NO: 556687 - DNA, 25 bp, Mus musculus
gccttagatctctcgccgccaatgc

SEQ ID NO: 556688 - DNA, 25 bp, Mus musculus
gccttagatgagaccctgttcagag

SEQ ID NO: 556689 - DNA, 25 bp, Mus musculus
gccttagatgagtccctgttcagag

SEQ ID NO: 556690 - DNA, 25 bp, Mus musculus
gccttagccagtcctgccagggcag

SEQ ID NO: 556691 - DNA, 25 bp, Mus musculus
gccttagccagtgctgccagggcag

SEQ ID NO: 556692 - DNA, 25 bp, Mus musculus
gccttagcctttcatgtgctgggat

SEQ ID NO: 556693 - DNA, 25 bp, Mus musculus
gccttagcctttgatgtgctgggat

SEQ ID NO: 556694 - DNA, 25 bp, Mus musculus
gccttagctcagaggatggtgatga

SEQ ID NO: 556695 - DNA, 25 bp, Mus musculus
gccttagctcagtggatggtgatga

SEQ ID NO: 556696 - DNA, 25 bp, Mus musculus
gccttagctcttactcgatagttag

SEQ ID NO: 556697 - DNA, 25 bp, Mus musculus
gccttagctctttctcgatagttag

SEQ ID NO: 556698 - DNA, 25 bp, Mus musculus
gccttagcttcaactactggataca

SEQ ID NO: 556699 - DNA, 25 bp, Mus musculus
gccttagcttcatctactggataca

SEQ ID NO: 556700 - DNA, 25 bp, Mus musculus
gccttaggaagtatgtcccttggcc

SEQ ID NO: 556701 - DNA, 25 bp, Mus musculus
gccttaggaagtttgtcccttggcc

SEQ ID NO: 556702 - DNA, 25 bp, Mus musculus
gccttaggacccatttccataaatg

SEQ ID NO: 556703 - DNA, 25 bp, Mus musculus
gccttaggacccttttccataaatg

SEQ ID NO: 556704 - DNA, 25 bp, Mus musculus
gccttaggagagccaagtttactga

SEQ ID NO: 556705 - DNA, 25 bp, Mus musculus
gccttaggagaggcaagtttactga

SEQ ID NO: 556706 - DNA, 25 bp, Mus musculus
gccttaggctttaacttatgtctct

SEQ ID NO: 556707 - DNA, 25 bp, Mus musculus
gccttaggcttttacttatgtctct

SEQ ID NO: 556708 - DNA, 25 bp, Mus musculus
gccttagggcgcactgtgaaactcg

SEQ ID NO: 556709 - DNA, 25 bp, Mus musculus
gccttagggcgctctgtgaaactcg

SEQ ID NO: 556710 - DNA, 25 bp, Mus musculus
gccttagggcttccattggattttt

SEQ ID NO: 556711 - DNA, 25 bp, Mus musculus
gccttagggcttgcattggattttt

SEQ ID NO: 556712 - DNA, 25 bp, Mus musculus
gccttagggttgacctgttctccct

SEQ ID NO: 556713 - DNA, 25 bp, Mus musculus
gccttagggttgtcctgttctccct

SEQ ID NO: 556714 - DNA, 25 bp, Mus musculus
gccttaggtacccacaaagctgatt

SEQ ID NO: 556715 - DNA, 25 bp, Mus musculus
gccttaggtaccgacaaagctgatt

SEQ ID NO: 556716 - DNA, 25 bp, Mus musculus
gccttaggtcctcagcttggtaaaa

SEQ ID NO: 556717 - DNA, 25 bp, Mus musculus
gccttaggtcctgagcttggtaaaa

SEQ ID NO: 556718 - DNA, 25 bp, Mus musculus
gccttaggtgttatgttacggtgat

SEQ ID NO: 556719 - DNA, 25 bp, Mus musculus
gccttaggtgttctggcaagagtct

SEQ ID NO: 556720 - DNA, 25 bp, Mus musculus
gccttaggtgttgtggcaagagtct

SEQ ID NO: 556721 - DNA, 25 bp, Mus musculus
gccttaggtgttttgttacggtgat

SEQ ID NO: 556722 - DNA, 25 bp, Mus musculus
gccttagtaaaacattctctcatat

SEQ ID NO: 556723 - DNA, 25 bp, Mus musculus
gccttagtaaaagattctctcatat

SEQ ID NO: 556724 - DNA, 25 bp, Mus musculus
gccttagtaagaagtggtgagtccc

SEQ ID NO: 556725 - DNA, 25 bp, Mus musculus
gccttagtaagatgtggtgagtccc

SEQ ID NO: 556726 - DNA, 25 bp, Mus musculus
gccttagtcacaagctgacctgggt

SEQ ID NO: 556727 - DNA, 25 bp, Mus musculus
gccttagtcacatgctgacctgggt

SEQ ID NO: 556728 - DNA, 25 bp, Mus musculus
gccttagtcactataatgccttttt

SEQ ID NO: 556729 - DNA, 25 bp, Mus musculus
gccttagtcactttaatgccttttt

SEQ ID NO: 556730 - DNA, 25 bp, Mus musculus
gccttagtgatcctttctttgcttc

SEQ ID NO: 556731 - DNA, 25 bp, Mus musculus
gccttagtgatcgtttctttgcttc

SEQ ID NO: 556732 - DNA, 25 bp, Mus musculus
gccttagtgggaagacctcggagta

SEQ ID NO: 556733 - DNA, 25 bp, Mus musculus
gccttagtgggatgacctcggagta

SEQ ID NO: 556734 - DNA, 25 bp, Mus musculus
gccttagtggtaacagacatctcga

SEQ ID NO: 556735 - DNA, 25 bp, Mus musculus
gccttagtggtatcagacatctcga

SEQ ID NO: 556736 - DNA, 25 bp, Mus musculus
gccttagttactcagcatttggttt

SEQ ID NO: 556737 - DNA, 25 bp, Mus musculus
gccttagttactgagcatttggttt

SEQ ID NO: 556738 - DNA, 25 bp, Mus musculus
gccttagttcacagatccttcagta

SEQ ID NO: 556739 - DNA, 25 bp, Mus musculus
gccttagttcactgatccttcagta

SEQ ID NO: 556740 - DNA, 25 bp, Mus musculus
gccttagttcccattatactttgca

SEQ ID NO: 556741 - DNA, 25 bp, Mus musculus
gccttagttccctttatactttgca

SEQ ID NO: 556742 - DNA, 25 bp, Mus musculus
gccttatacttgctagaagaaactg

SEQ ID NO: 556743 - DNA, 25 bp, Mus musculus
gccttatacttggtagaagaaactg

SEQ ID NO: 556744 - DNA, 25 bp, Mus musculus
gccttataggacatcacgggtggga

SEQ ID NO: 556745 - DNA, 25 bp, Mus musculus
gccttataggacttcacgggtggga

SEQ ID NO: 556746 - DNA, 25 bp, Mus musculus
gccttatagggcagggtcttaacct

SEQ ID NO: 556747 - DNA, 25 bp, Mus musculus
gccttatagggctgggtcttaacct

SEQ ID NO: 556748 - DNA, 25 bp, Mus musculus
gccttatatggtacttgcttcagag

SEQ ID NO: 556749 - DNA, 25 bp, Mus musculus
gccttatatggttcttgcttcagag

SEQ ID NO: 556750 - DNA, 25 bp, Mus musculus
gccttatcagatctcaggatgctga

SEQ ID NO: 556751 - DNA, 25 bp, Mus musculus
gccttatcagatgtcaggatgctga

SEQ ID NO: 556752 - DNA, 25 bp, Mus musculus
gccttatcctttatcctttcatagt

SEQ ID NO: 556753 - DNA, 25 bp, Mus musculus
gccttatcctttttcctttcatagt

SEQ ID NO: 556754 - DNA, 25 bp, Mus musculus
gccttatcggatcaactgctgcaga

SEQ ID NO: 556755 - DNA, 25 bp, Mus musculus
gccttatcggatgaactgctgcaga

SEQ ID NO: 556756 - DNA, 25 bp, Mus musculus
gccttatctcgtctttaactgctaa

SEQ ID NO: 556757 - DNA, 25 bp, Mus musculus
gccttatctcgtgtttaactgctaa

SEQ ID NO: 556758 - DNA, 25 bp, Mus musculus
gccttatctggtagatggaatactc

SEQ ID NO: 556759 - DNA, 25 bp, Mus musculus
gccttatctggttgatggaatactc

SEQ ID NO: 556760 - DNA, 25 bp, Mus musculus
gccttatgaaaaacccgctggtcgt

SEQ ID NO: 556761 - DNA, 25 bp, Mus musculus
gccttatgaaaatcccgctggtcgt

SEQ ID NO: 556762 - DNA, 25 bp, Mus musculus
gccttatgcccactggtgcctgtga

SEQ ID NO: 556763 - DNA, 25 bp, Mus musculus
gccttatgcccagtggtgcctgtga

SEQ ID NO: 556764 - DNA, 25 bp, Mus musculus
gccttatgctctaagaaatgttctg

SEQ ID NO: 556765 - DNA, 25 bp, Mus musculus
gccttatgctcttagaaatgttctg

SEQ ID NO: 556766 - DNA, 25 bp, Mus musculus
gccttatggctgacgggaagatctt

SEQ ID NO: 556767 - DNA, 25 bp, Mus musculus
gccttatggctgtcgggaagatctt

SEQ ID NO: 556768 - DNA, 25 bp, Mus musculus
gccttatgggagaggttgtccctgt

SEQ ID NO: 556769 - DNA, 25 bp, Mus musculus
gccttatgggagtggttgtccctgt

SEQ ID NO: 556770 - DNA, 25 bp, Mus musculus
gccttatggtccctggaaccaacaa

SEQ ID NO: 556771 - DNA, 25 bp, Mus musculus
gccttatggtccgtggaaccaacaa

SEQ ID NO: 556772 - DNA, 25 bp, Mus musculus
gccttatgtgaactgatcacgtcac

SEQ ID NO: 556773 - DNA, 25 bp, Mus musculus
gccttatgtgaagtgatcacgtcac

SEQ ID NO: 556774 - DNA, 25 bp, Mus musculus
gccttattacctagctttatcttga

SEQ ID NO: 556775 - DNA, 25 bp, Mus musculus
gccttattaccttgctttatcttga

SEQ ID NO: 556776 - DNA, 25 bp, Mus musculus
gccttattcattagctcagaccttt

SEQ ID NO: 556777 - DNA, 25 bp, Mus musculus
gccttattcatttgctcagaccttt

SEQ ID NO: 556778 - DNA, 25 bp, Mus musculus
gccttattccatatagttcccagat

SEQ ID NO: 556779 - DNA, 25 bp, Mus musculus
gccttattccatttagttcccagat

SEQ ID NO: 556780 - DNA, 25 bp, Mus musculus
gccttattcctacttttaccttgat

SEQ ID NO: 556781 - DNA, 25 bp, Mus musculus
gccttattcctagttttaccttgat

SEQ ID NO: 556782 - DNA, 25 bp, Mus musculus
gccttattctagcaccactgtggaa

SEQ ID NO: 556783 - DNA, 25 bp, Mus musculus
gccttattctaggaccactgtggaa

SEQ ID NO: 556784 - DNA, 25 bp, Mus musculus
gccttattctatagagcatcctcat

SEQ ID NO: 556785 - DNA, 25 bp, Mus musculus
gccttattctattgagcatcctcat

SEQ ID NO: 556786 - DNA, 25 bp, Mus musculus
gccttattctgaatttatcctaaca

SEQ ID NO: 556787 - DNA, 25 bp, Mus musculus
gccttattctgattttatcctaaca

SEQ ID NO: 556788 - DNA, 25 bp, Mus musculus
gccttattgatcacagaccctggaa

SEQ ID NO: 556789 - DNA, 25 bp, Mus musculus
gccttattgatctcagaccctggaa

SEQ ID NO: 556790 - DNA, 25 bp, Mus musculus
gccttatttaatatcacactcctga

SEQ ID NO: 556791 - DNA, 25 bp, Mus musculus
gccttatttaatttcacactcctga

SEQ ID NO: 556792 - DNA, 25 bp, Mus musculus
gccttatttcttactgtgctgggat

SEQ ID NO: 556793 - DNA, 25 bp, Mus musculus
gccttatttctttctgtgctgggat

SEQ ID NO: 556794 - DNA, 25 bp, Mus musculus
gccttatttgtgaactgtgtgagtc

SEQ ID NO: 556795 - DNA, 25 bp, Mus musculus
gccttatttgtgtactgtgtgagtc

SEQ ID NO: 556796 - DNA, 25 bp, Mus musculus
gccttcaaaacaattgtgttcatgc

SEQ ID NO: 556797 - DNA, 25 bp, Mus musculus
gccttcaaaacatttgtgttcatgc

SEQ ID NO: 556798 - DNA, 25 bp, Mus musculus
gccttcaaaagaccctgcagctgac

SEQ ID NO: 556799 - DNA, 25 bp, Mus musculus
gccttcaaaagagcctgcagctgac

SEQ ID NO: 556800 - DNA, 25 bp, Mus musculus
gccttcaaaaggagttccggcgtga

SEQ ID NO: 556801 - DNA, 25 bp, Mus musculus
gccttcaaaaggtgttccggcgtga

SEQ ID NO: 556802 - DNA, 25 bp, Mus musculus
gccttcaaaattcctctgccaaaga

SEQ ID NO: 556803 - DNA, 25 bp, Mus musculus
gccttcaaaattgctctgccaaaga

SEQ ID NO: 556804 - DNA, 25 bp, Mus musculus
gccttcaaaggcacctagtcaaatg

SEQ ID NO: 556805 - DNA, 25 bp, Mus musculus
gccttcaaaggctcctagtcaaatg

SEQ ID NO: 556806 - DNA, 25 bp, Mus musculus
gccttcaaagtaagatgtggactgt

SEQ ID NO: 556807 - DNA, 25 bp, Mus musculus
gccttcaaagtatgatgtggactgt

SEQ ID NO: 556808 - DNA, 25 bp, Mus musculus
gccttcaacctcagggctccatgat

SEQ ID NO: 556809 - DNA, 25 bp, Mus musculus
gccttcaacctctgggctccatgat

SEQ ID NO: 556810 - DNA, 25 bp, Mus musculus
gccttcaactacagactaaaacctt

SEQ ID NO: 556811 - DNA, 25 bp, Mus musculus
gccttcaactactgactaaaacctt

SEQ ID NO: 556812 - DNA, 25 bp, Mus musculus
gccttcaactgtaccctagatctaa

SEQ ID NO: 556813 - DNA, 25 bp, Mus musculus
gccttcaactgttccctagatctaa

SEQ ID NO: 556814 - DNA, 25 bp, Mus musculus
gccttcaaggccacagtatacgctg

SEQ ID NO: 556815 - DNA, 25 bp, Mus musculus
gccttcaaggcctcagtatacgctg

SEQ ID NO: 556816 - DNA, 25 bp, Mus musculus
gccttcaagggtacccaggacagtc

SEQ ID NO: 556817 - DNA, 25 bp, Mus musculus
gccttcaagggttcccaggacagtc

SEQ ID NO: 556818 - DNA, 25 bp, Mus musculus
gccttcaatcctcctgttttattat

SEQ ID NO: 556819 - DNA, 25 bp, Mus musculus
gccttcaatcctgctgttttattat

SEQ ID NO: 556820 - DNA, 25 bp, Mus musculus
gccttcaatgctccatttgttgtca

SEQ ID NO: 556821 - DNA, 25 bp, Mus musculus
gccttcaatgctgcatttgttgtca

SEQ ID NO: 556822 - DNA, 25 bp, Mus musculus
gccttcaattggatatatagctcag

SEQ ID NO: 556823 - DNA, 25 bp, Mus musculus
gccttcaattggttatatagctcag

SEQ ID NO: 556824 - DNA, 25 bp, Mus musculus
gccttcacatggacctggtgtatgt

SEQ ID NO: 556825 - DNA, 25 bp, Mus musculus
gccttcacatggtcctggtgtatgt

SEQ ID NO: 556826 - DNA, 25 bp, Mus musculus
gccttcaccaatcggtaccactgaa

SEQ ID NO: 556827 - DNA, 25 bp, Mus musculus
gccttcaccaatgggtaccactgaa

SEQ ID NO: 556828 - DNA, 25 bp, Mus musculus
gccttcacccttcgcatctagaaaa

SEQ ID NO: 556829 - DNA, 25 bp, Mus musculus
gccttcacccttggcatctagaaaa

SEQ ID NO: 556830 - DNA, 25 bp, Mus musculus
gccttcaccgcgattgaggaggtgc

SEQ ID NO: 556831 - DNA, 25 bp, Mus musculus
gccttcaccgcgtttgaggaggtgc

SEQ ID NO: 556832 - DNA, 25 bp, Mus musculus
gccttcacctgcaggtactgtgaca

SEQ ID NO: 556833 - DNA, 25 bp, Mus musculus
gccttcacctgctggtactgtgaca

SEQ ID NO: 556834 - DNA, 25 bp, Mus musculus
gccttcacgcctaggctaagttaga

SEQ ID NO: 556835 - DNA, 25 bp, Mus musculus
gccttcacgccttggctaagttaga

SEQ ID NO: 556836 - DNA, 25 bp, Mus musculus
gccttcacggatccagacaattttg

SEQ ID NO: 556837 - DNA, 25 bp, Mus musculus
gccttcacggatgcagacaattttg

SEQ ID NO: 556838 - DNA, 25 bp, Mus musculus
gccttcactcagcttccaaagtaag

SEQ ID NO: 556839 - DNA, 25 bp, Mus musculus
gccttcactcaggttccaaagtaag

SEQ ID NO: 556840 - DNA, 25 bp, Mus musculus
gccttcactgacactgcctaatggg

SEQ ID NO: 556841 - DNA, 25 bp, Mus musculus
gccttcactgaccaaaccaaaggtc

SEQ ID NO: 556842 - DNA, 25 bp, Mus musculus
gccttcactgacgaaaccaaaggtc

SEQ ID NO: 556843 - DNA, 25 bp, Mus musculus
gccttcactgactctgcctaatggg

SEQ ID NO: 556844 - DNA, 25 bp, Mus musculus
gccttcactgtaacgtctggaaaca

SEQ ID NO: 556845 - DNA, 25 bp, Mus musculus
gccttcactgtatcgtctggaaaca

SEQ ID NO: 556846 - DNA, 25 bp, Mus musculus
gccttcagactcaatcatccagtga

SEQ ID NO: 556847 - DNA, 25 bp, Mus musculus
gccttcagactctatcatccagtga

SEQ ID NO: 556848 - DNA, 25 bp, Mus musculus
gccttcagcaggcacggatgcagat

SEQ ID NO: 556849 - DNA, 25 bp, Mus musculus
gccttcagcagggacggatgcagat

SEQ ID NO: 556850 - DNA, 25 bp, Mus musculus
gccttcagcagtcagtgtctcagaa

SEQ ID NO: 556851 - DNA, 25 bp, Mus musculus
gccttcagcagtgagtgtctcagaa

SEQ ID NO: 556852 - DNA, 25 bp, Mus musculus
gccttcagcataccggatcatgaca

SEQ ID NO: 556853 - DNA, 25 bp, Mus musculus
gccttcagcatagcggatcatgaca

SEQ ID NO: 556854 - DNA, 25 bp, Mus musculus
gccttcagctccaataattccgtag

SEQ ID NO: 556855 - DNA, 25 bp, Mus musculus
gccttcagctcctataattccgtag

SEQ ID NO: 556856 - DNA, 25 bp, Mus musculus
gccttcaggagtagggatgtagctc

SEQ ID NO: 556857 - DNA, 25 bp, Mus musculus
gccttcaggagttgggatgtagctc

SEQ ID NO: 556858 - DNA, 25 bp, Mus musculus
gccttcagtactaaccggatctttt

SEQ ID NO: 556859 - DNA, 25 bp, Mus musculus
gccttcagtacttaccggatctttt

SEQ ID NO: 556860 - DNA, 25 bp, Mus musculus
gccttcatagggaccatttcctcca

SEQ ID NO: 556861 - DNA, 25 bp, Mus musculus
gccttcatagggtccatttcctcca

SEQ ID NO: 556862 - DNA, 25 bp, Mus musculus
gccttcatataaatcagttgcctgg

SEQ ID NO: 556863 - DNA, 25 bp, Mus musculus
gccttcatataattcagttgcctgg

SEQ ID NO: 556864 - DNA, 25 bp, Mus musculus
gccttcatatgaatccttctcaggt

SEQ ID NO: 556865 - DNA, 25 bp, Mus musculus
gccttcatatgattccttctcaggt

SEQ ID NO: 556866 - DNA, 25 bp, Mus musculus
gccttcatattacagcaccttctct

SEQ ID NO: 556867 - DNA, 25 bp, Mus musculus
gccttcatattagagcaccttctct

SEQ ID NO: 556868 - DNA, 25 bp, Mus musculus
gccttcatcaagaatgagtacccag

SEQ ID NO: 556869 - DNA, 25 bp, Mus musculus
gccttcatcaagtatgagtacccag

SEQ ID NO: 556870 - DNA, 25 bp, Mus musculus
gccttcatcattcccgtcatttata

SEQ ID NO: 556871 - DNA, 25 bp, Mus musculus
gccttcatcattgccgtcatttata

SEQ ID NO: 556872 - DNA, 25 bp, Mus musculus
gccttcatccttcacgatgcaaaga

SEQ ID NO: 556873 - DNA, 25 bp, Mus musculus
gccttcatccttgacgatgcaaaga

SEQ ID NO: 556874 - DNA, 25 bp, Mus musculus
gccttcatcgatactctgcagagta

SEQ ID NO: 556875 - DNA, 25 bp, Mus musculus
gccttcatcgattctctgcagagta

SEQ ID NO: 556876 - DNA, 25 bp, Mus musculus
gccttcatctgcacagacctaaaga

SEQ ID NO: 556877 - DNA, 25 bp, Mus musculus
gccttcatctgctcagacctaaaga

SEQ ID NO: 556878 - DNA, 25 bp, Mus musculus
gccttcatttccaatccagctggga

SEQ ID NO: 556879 - DNA, 25 bp, Mus musculus
gccttcatttcctatccagctggga

SEQ ID NO: 556880 - DNA, 25 bp, Mus musculus
gccttcatttttctagcccagagca

SEQ ID NO: 556881 - DNA, 25 bp, Mus musculus
gccttcatttttgtagcccagagca

SEQ ID NO: 556882 - DNA, 25 bp, Mus musculus
gccttccaacgacgttctgtgtgaa

SEQ ID NO: 556883 - DNA, 25 bp, Mus musculus
gccttccaacgaggttctgtgtgaa

SEQ ID NO: 556884 - DNA, 25 bp, Mus musculus
gccttccaagcacagacaatccatg

SEQ ID NO: 556885 - DNA, 25 bp, Mus musculus
gccttccaagcagagacaatccatg

SEQ ID NO: 556886 - DNA, 25 bp, Mus musculus
gccttccacaagcatgcttttgaaa

SEQ ID NO: 556887 - DNA, 25 bp, Mus musculus
gccttccacaaggatgcttttgaaa

SEQ ID NO: 556888 - DNA, 25 bp, Mus musculus
gccttccacagcacactgtaattta

SEQ ID NO: 556889 - DNA, 25 bp, Mus musculus
gccttccacagctcactgtaattta

SEQ ID NO: 556890 - DNA, 25 bp, Mus musculus
gccttccacccacttattagttgtg

SEQ ID NO: 556891 - DNA, 25 bp, Mus musculus
gccttccacccagttattagttgtg

SEQ ID NO: 556892 - DNA, 25 bp, Mus musculus
gccttccactagaggctgaagccag

SEQ ID NO: 556893 - DNA, 25 bp, Mus musculus
gccttccactagtggctgaagccag

SEQ ID NO: 556894 - DNA, 25 bp, Mus musculus
gccttccactctcttgaggtttttt

SEQ ID NO: 556895 - DNA, 25 bp, Mus musculus
gccttccactctgttgaggtttttt

SEQ ID NO: 556896 - DNA, 25 bp, Mus musculus
gccttccagacacagacgtttgatg

SEQ ID NO: 556897 - DNA, 25 bp, Mus musculus
gccttccagacagagacgtttgatg

SEQ ID NO: 556898 - DNA, 25 bp, Mus musculus
gccttccagactaaagtggccttta

SEQ ID NO: 556899 - DNA, 25 bp, Mus musculus
gccttccagactctcctcaaagaga

SEQ ID NO: 556900 - DNA, 25 bp, Mus musculus
gccttccagactgtcctcaaagaga

SEQ ID NO: 556901 - DNA, 25 bp, Mus musculus
gccttccagacttaagtggccttta

SEQ ID NO: 556902 - DNA, 25 bp, Mus musculus
gccttccagagaatggcccaactga

SEQ ID NO: 556903 - DNA, 25 bp, Mus musculus
gccttccagagattggcccaactga

SEQ ID NO: 556904 - DNA, 25 bp, Mus musculus
gccttccagaggcagtggactctag

SEQ ID NO: 556905 - DNA, 25 bp, Mus musculus
gccttccagagggagtggactctag

SEQ ID NO: 556906 - DNA, 25 bp, Mus musculus
gccttccagtgcctgtgacagctta

SEQ ID NO: 556907 - DNA, 25 bp, Mus musculus
gccttccagtgcgtgtgacagctta

SEQ ID NO: 556908 - DNA, 25 bp, Mus musculus
gccttccatcataaacagtgtctca

SEQ ID NO: 556909 - DNA, 25 bp, Mus musculus
gccttccatcattaacagtgtctca

SEQ ID NO: 556910 - DNA, 25 bp, Mus musculus
gccttccatggcactcatatgtgta

SEQ ID NO: 556911 - DNA, 25 bp, Mus musculus
gccttccatggctctcatatgtgta

SEQ ID NO: 556912 - DNA, 25 bp, Mus musculus
gccttcccaagcaatttcagcaaag

SEQ ID NO: 556913 - DNA, 25 bp, Mus musculus
gccttcccaagctatttcagcaaag

SEQ ID NO: 556914 - DNA, 25 bp, Mus musculus
gccttcccattgacagtgctgagag

SEQ ID NO: 556915 - DNA, 25 bp, Mus musculus
gccttcccattgtcagtgctgagag

SEQ ID NO: 556916 - DNA, 25 bp, Mus musculus
gccttccccaggagtaaccttgaga

SEQ ID NO: 556917 - DNA, 25 bp, Mus musculus
gccttccccaggtgtaaccttgaga

SEQ ID NO: 556918 - DNA, 25 bp, Mus musculus
gccttccccggactcttgtagagga

SEQ ID NO: 556919 - DNA, 25 bp, Mus musculus
gccttccccggagtcttgtagagga

SEQ ID NO: 556920 - DNA, 25 bp, Mus musculus
gccttcccctcgattctgatgatga

SEQ ID NO: 556921 - DNA, 25 bp, Mus musculus
gccttcccctcgtttctgatgatga

SEQ ID NO: 556922 - DNA, 25 bp, Mus musculus
gccttcccctgaagttgcagtggga

SEQ ID NO: 556923 - DNA, 25 bp, Mus musculus
gccttcccctgatgttgcagtggga

SEQ ID NO: 556924 - DNA, 25 bp, Mus musculus
gccttcccgctcattttatatgtat

SEQ ID NO: 556925 - DNA, 25 bp, Mus musculus
gccttcccgctctttttatatgtat

SEQ ID NO: 556926 - DNA, 25 bp, Mus musculus
gccttcccgtgactggcagaaagat

SEQ ID NO: 556927 - DNA, 25 bp, Mus musculus
gccttcccgtgagtggcagaaagat

SEQ ID NO: 556928 - DNA, 25 bp, Mus musculus
gccttccctcaaatgttttctaaga

SEQ ID NO: 556929 - DNA, 25 bp, Mus musculus
gccttccctcaattgttttctaaga

SEQ ID NO: 556930 - DNA, 25 bp, Mus musculus
gccttccctcgacactggagtatgt

SEQ ID NO: 556931 - DNA, 25 bp, Mus musculus
gccttccctcgagactggagtatgt

SEQ ID NO: 556932 - DNA, 25 bp, Mus musculus
gccttccctggcaagagtatactat

SEQ ID NO: 556933 - DNA, 25 bp, Mus musculus
gccttccctggctagagtatactat

SEQ ID NO: 556934 - DNA, 25 bp, Mus musculus
gccttccgaaaaatctgctagcttt

SEQ ID NO: 556935 - DNA, 25 bp, Mus musculus
gccttccgaaaattctgctagcttt

SEQ ID NO: 556936 - DNA, 25 bp, Mus musculus
gccttccgctaccttcttaatgaag

SEQ ID NO: 556937 - DNA, 25 bp, Mus musculus
gccttccgctacgttcttaatgaag

SEQ ID NO: 556938 - DNA, 25 bp, Mus musculus
gccttccggcgcataaagtcagcaa

SEQ ID NO: 556939 - DNA, 25 bp, Mus musculus
gccttccggcgcttaaagtcagcaa

SEQ ID NO: 556940 - DNA, 25 bp, Mus musculus
gccttccgtgacagttacagacagc

SEQ ID NO: 556941 - DNA, 25 bp, Mus musculus
gccttccgtgactgttacagacagc

SEQ ID NO: 556942 - DNA, 25 bp, Mus musculus
gccttccgtgtcaggatctttagta

SEQ ID NO: 556943 - DNA, 25 bp, Mus musculus
gccttccgtgtctggatctttagta

SEQ ID NO: 556944 - DNA, 25 bp, Mus musculus
gccttcctaaatcgcagtgctactg

SEQ ID NO: 556945 - DNA, 25 bp, Mus musculus
gccttcctaaatggcagtgctactg

SEQ ID NO: 556946 - DNA, 25 bp, Mus musculus
gccttcctaatcactaacagtctaa

SEQ ID NO: 556947 - DNA, 25 bp, Mus musculus
gccttcctaatctctaacagtctaa

SEQ ID NO: 556948 - DNA, 25 bp, Mus musculus
gccttcctagccaagtttcctgggc

SEQ ID NO: 556949 - DNA, 25 bp, Mus musculus
gccttcctagcctagtttcctgggc

SEQ ID NO: 556950 - DNA, 25 bp, Mus musculus
gccttcctagctatgcaaattgagt

SEQ ID NO: 556951 - DNA, 25 bp, Mus musculus
gccttcctagctttgcaaattgagt

SEQ ID NO: 556952 - DNA, 25 bp, Mus musculus
gccttcctcatcaggaactgtttat

SEQ ID NO: 556953 - DNA, 25 bp, Mus musculus
gccttcctcatctggaactgtttat

SEQ ID NO: 556954 - DNA, 25 bp, Mus musculus
gccttcctcctgcaatcaagataac

SEQ ID NO: 556955 - DNA, 25 bp, Mus musculus
gccttcctcctggaatcaagataac

SEQ ID NO: 556956 - DNA, 25 bp, Mus musculus
gccttcctgagaactgtcatgctaa

SEQ ID NO: 556957 - DNA, 25 bp, Mus musculus
gccttcctgagatctgtcatgctaa

SEQ ID NO: 556958 - DNA, 25 bp, Mus musculus
gccttcctggcaatagagttttcct

SEQ ID NO: 556959 - DNA, 25 bp, Mus musculus
gccttcctggcattagagttttcct

SEQ ID NO: 556960 - DNA, 25 bp, Mus musculus
gccttcctgggcattacatatgtgg

SEQ ID NO: 556961 - DNA, 25 bp, Mus musculus
gccttcctgggctttacatatgtgg

SEQ ID NO: 556962 - DNA, 25 bp, Mus musculus
gccttcctggtgaaagagtctgtgt

SEQ ID NO: 556963 - DNA, 25 bp, Mus musculus
gccttcctggtgacacatggctgga

SEQ ID NO: 556964 - DNA, 25 bp, Mus musculus
gccttcctggtgtaagagtctgtgt

SEQ ID NO: 556965 - DNA, 25 bp, Mus musculus
gccttcctggtgtcacatggctgga

SEQ ID NO: 556966 - DNA, 25 bp, Mus musculus
gccttcctgtgcaatttgtacctga

SEQ ID NO: 556967 - DNA, 25 bp, Mus musculus
gccttcctgtgctatttgtacctga

SEQ ID NO: 556968 - DNA, 25 bp, Mus musculus
gccttccttacgaacatgtattaac

SEQ ID NO: 556969 - DNA, 25 bp, Mus musculus
gccttccttacgtacatgtattaac

SEQ ID NO: 556970 - DNA, 25 bp, Mus musculus
gccttccttagaagctaggcttatc

SEQ ID NO: 556971 - DNA, 25 bp, Mus musculus
gccttccttagatgctaggcttatc

SEQ ID NO: 556972 - DNA, 25 bp, Mus musculus
gccttccttatcatccaattcagag

SEQ ID NO: 556973 - DNA, 25 bp, Mus musculus
gccttccttatcattgctacgaaat

SEQ ID NO: 556974 - DNA, 25 bp, Mus musculus
gccttccttatcttccaattcagag

SEQ ID NO: 556975 - DNA, 25 bp, Mus musculus
gccttccttatctttgctacgaaat

SEQ ID NO: 556976 - DNA, 25 bp, Mus musculus
gccttccttctcagaaattgatcga

SEQ ID NO: 556977 - DNA, 25 bp, Mus musculus
gccttccttctctgaaattgatcga

SEQ ID NO: 556978 - DNA, 25 bp, Mus musculus
gccttccttcttcggtatggaatcc

SEQ ID NO: 556979 - DNA, 25 bp, Mus musculus
gccttccttcttgggtatggaatcc

SEQ ID NO: 556980 - DNA, 25 bp, Mus musculus
gccttccttgcacggtggctaagaa

SEQ ID NO: 556981 - DNA, 25 bp, Mus musculus
gccttccttgcagggtggctaagaa

SEQ ID NO: 556982 - DNA, 25 bp, Mus musculus
gccttccttgtgaactttttgttag

SEQ ID NO: 556983 - DNA, 25 bp, Mus musculus
gccttccttgtgtactttttgttag

SEQ ID NO: 556984 - DNA, 25 bp, Mus musculus
gccttccttttgagctgtggacaaa

SEQ ID NO: 556985 - DNA, 25 bp, Mus musculus
gccttccttttgtgctgtggacaaa

SEQ ID NO: 556986 - DNA, 25 bp, Mus musculus
gccttcgaccatccagtttgacgat

SEQ ID NO: 556987 - DNA, 25 bp, Mus musculus
gccttcgaccatgcagtttgacgat

SEQ ID NO: 556988 - DNA, 25 bp, Mus musculus
gccttcgatgacacagctcctaatg

SEQ ID NO: 556989 - DNA, 25 bp, Mus musculus
gccttcgatgactcagctcctaatg

SEQ ID NO: 556990 - DNA, 25 bp, Mus musculus
gccttcgattgcacggctaccatga

SEQ ID NO: 556991 - DNA, 25 bp, Mus musculus
gccttcgattgctcggctaccatga

SEQ ID NO: 556992 - DNA, 25 bp, Mus musculus
gccttcgccaaccaggatgttacaa

SEQ ID NO: 556993 - DNA, 25 bp, Mus musculus
gccttcgccaacgaggatgttacaa

SEQ ID NO: 556994 - DNA, 25 bp, Mus musculus
gccttcgcggttctagtactgggat

SEQ ID NO: 556995 - DNA, 25 bp, Mus musculus
gccttcgcggttgtagtactgggat

SEQ ID NO: 556996 - DNA, 25 bp, Mus musculus
gccttcggaaagagcttttatgcca

SEQ ID NO: 556997 - DNA, 25 bp, Mus musculus
gccttcggaaagtgcttttatgcca

SEQ ID NO: 556998 - DNA, 25 bp, Mus musculus
gccttcggtaagactccatgtgatc

SEQ ID NO: 556999 - DNA, 25 bp, Mus musculus
gccttcggtaagtctccatgtgatc

SEQ ID NO: 557000 - DNA, 25 bp, Mus musculus
gccttcgtggatccggatgactgta

SEQ ID NO: 557001 - DNA, 25 bp, Mus musculus
gccttcgtggatgcggatgactgta

SEQ ID NO: 557002 - DNA, 25 bp, Mus musculus
gccttcgtgggcatatggttagttt

SEQ ID NO: 557003 - DNA, 25 bp, Mus musculus
gccttcgtgggcttatggttagttt

SEQ ID NO: 557004 - DNA, 25 bp, Mus musculus
gccttcgtgtgtatgacaaggaagg

SEQ ID NO: 557005 - DNA, 25 bp, Mus musculus
gccttcgtgtgtttgacaaggaagg

SEQ ID NO: 557006 - DNA, 25 bp, Mus musculus
gccttcgttactcggttccaagtgg

SEQ ID NO: 557007 - DNA, 25 bp, Mus musculus
gccttcgttactgggttccaagtgg

SEQ ID NO: 557008 - DNA, 25 bp, Mus musculus
gccttctaactaacttgggacaaca

SEQ ID NO: 557009 - DNA, 25 bp, Mus musculus
gccttctaactatcttgggacaaca

SEQ ID NO: 557010 - DNA, 25 bp, Mus musculus
gccttctaatggctctttcaatata

SEQ ID NO: 557011 - DNA, 25 bp, Mus musculus
gccttctaatgggtctttcaatata

SEQ ID NO: 557012 - DNA, 25 bp, Mus musculus
gccttctagatgaaagtgaccttat

SEQ ID NO: 557013 - DNA, 25 bp, Mus musculus
gccttctagatgtaagtgaccttat

SEQ ID NO: 557014 - DNA, 25 bp, Mus musculus
gccttctagcatacttcctggataa

SEQ ID NO: 557015 - DNA, 25 bp, Mus musculus
gccttctagcatatacagtctgggt

SEQ ID NO: 557016 - DNA, 25 bp, Mus musculus
gccttctagcattcttcctggataa

SEQ ID NO: 557017 - DNA, 25 bp, Mus musculus
gccttctagcatttacagtctgggt

SEQ ID NO: 557018 - DNA, 25 bp, Mus musculus
gccttctataggatgatgctgtcat

SEQ ID NO: 557019 - DNA, 25 bp, Mus musculus
gccttctataggttgatgctgtcat

SEQ ID NO: 557020 - DNA, 25 bp, Mus musculus
gccttctatggtagtattattgctc

SEQ ID NO: 557021 - DNA, 25 bp, Mus musculus
gccttctatggttgtattattgctc

SEQ ID NO: 557022 - DNA, 25 bp, Mus musculus
gccttctattacaacaaccccttgg

SEQ ID NO: 557023 - DNA, 25 bp, Mus musculus
gccttctattactacaaccccttgg

SEQ ID NO: 557024 - DNA, 25 bp, Mus musculus
gccttctcaacacccgtggtattaa

SEQ ID NO: 557025 - DNA, 25 bp, Mus musculus
gccttctcaacagccgtggtattaa

SEQ ID NO: 557026 - DNA, 25 bp, Mus musculus
gccttctcactacttgcagtctatg

SEQ ID NO: 557027 - DNA, 25 bp, Mus musculus
gccttctcactagttgcagtctatg

SEQ ID NO: 557028 - DNA, 25 bp, Mus musculus
gccttctcagtgcagtgtccatgtg

SEQ ID NO: 557029 - DNA, 25 bp, Mus musculus
gccttctcagtggagtgtccatgtg

SEQ ID NO: 557030 - DNA, 25 bp, Mus musculus
gccttctcatctccactacataatg

SEQ ID NO: 557031 - DNA, 25 bp, Mus musculus
gccttctcatctgcactacataatg

SEQ ID NO: 557032 - DNA, 25 bp, Mus musculus
gccttctcatgcatgtcattgctat

SEQ ID NO: 557033 - DNA, 25 bp, Mus musculus
gccttctcatgcttgtcattgctat

SEQ ID NO: 557034 - DNA, 25 bp, Mus musculus
gccttctcatttagctttgttaagt

SEQ ID NO: 557035 - DNA, 25 bp, Mus musculus
gccttctcattttgctttgttaagt

SEQ ID NO: 557036 - DNA, 25 bp, Mus musculus
gccttctccagtcttagtcattctt

SEQ ID NO: 557037 - DNA, 25 bp, Mus musculus
gccttctccagtgttagtcattctt

SEQ ID NO: 557038 - DNA, 25 bp, Mus musculus
gccttctccgagagtggtccgggaa

SEQ ID NO: 557039 - DNA, 25 bp, Mus musculus
gccttctccgagtgtggtccgggaa

SEQ ID NO: 557040 - DNA, 25 bp, Mus musculus
gccttctcggaaaggcctctgtaga

SEQ ID NO: 557041 - DNA, 25 bp, Mus musculus
gccttctcggaatggcctctgtaga

SEQ ID NO: 557042 - DNA, 25 bp, Mus musculus
gccttctctgtaacttatgatccag

SEQ ID NO: 557043 - DNA, 25 bp, Mus musculus
gccttctctgtatcttatgatccag

SEQ ID NO: 557044 - DNA, 25 bp, Mus musculus
gccttctctgtgcatgtaacctact

SEQ ID NO: 557045 - DNA, 25 bp, Mus musculus
gccttctctgtggatgtaacctact

SEQ ID NO: 557046 - DNA, 25 bp, Mus musculus
gccttctcttttccaaaagaagaga

SEQ ID NO: 557047 - DNA, 25 bp, Mus musculus
gccttctcttttgcaaaagaagaga

SEQ ID NO: 557048 - DNA, 25 bp, Mus musculus
gccttctgaggcatttaaaatcgga

SEQ ID NO: 557049 - DNA, 25 bp, Mus musculus
gccttctgaggcttttaaaatcgga

SEQ ID NO: 557050 - DNA, 25 bp, Mus musculus
gccttctgagtgcattaacactgag

SEQ ID NO: 557051 - DNA, 25 bp, Mus musculus
gccttctgagtggattaacactgag

SEQ ID NO: 557052 - DNA, 25 bp, Mus musculus
gccttctgcacaccggctctgagag

SEQ ID NO: 557053 - DNA, 25 bp, Mus musculus
gccttctgcacagcggctctgagag

SEQ ID NO: 557054 - DNA, 25 bp, Mus musculus
gccttctgctctattttccttgtag

SEQ ID NO: 557055 - DNA, 25 bp, Mus musculus
gccttctgctcttttttccttgtag

SEQ ID NO: 557056 - DNA, 25 bp, Mus musculus
gccttctgcttcagtacatggtata

SEQ ID NO: 557057 - DNA, 25 bp, Mus musculus
gccttctgcttctgtacatggtata

SEQ ID NO: 557058 - DNA, 25 bp, Mus musculus
gccttctgctttccattgggaacaa

SEQ ID NO: 557059 - DNA, 25 bp, Mus musculus
gccttctgctttgcattgggaacaa

SEQ ID NO: 557060 - DNA, 25 bp, Mus musculus
gccttctggagtctgagcaaacact

SEQ ID NO: 557061 - DNA, 25 bp, Mus musculus
gccttctggagtgtgagcaaacact

SEQ ID NO: 557062 - DNA, 25 bp, Mus musculus
gccttctggctgcaatggttcaatt

SEQ ID NO: 557063 - DNA, 25 bp, Mus musculus
gccttctggctggaatggttcaatt

SEQ ID NO: 557064 - DNA, 25 bp, Mus musculus
gccttctgggctaccgaggtaagat

SEQ ID NO: 557065 - DNA, 25 bp, Mus musculus
gccttctgggcttccgaggtaagat

SEQ ID NO: 557066 - DNA, 25 bp, Mus musculus
gccttctgggtaagctctcggagga

SEQ ID NO: 557067 - DNA, 25 bp, Mus musculus
gccttctgggtatgctctcggagga

SEQ ID NO: 557068 - DNA, 25 bp, Mus musculus
gccttctggtggaaaacatgccttt

SEQ ID NO: 557069 - DNA, 25 bp, Mus musculus
gccttctggtggtaaacatgccttt

SEQ ID NO: 557070 - DNA, 25 bp, Mus musculus
gccttctgtaaacgagtgcggattt

SEQ ID NO: 557071 - DNA, 25 bp, Mus musculus
gccttctgtaaaggagtgcggattt

SEQ ID NO: 557072 - DNA, 25 bp, Mus musculus
gccttctgtactatgtaacttgcac

SEQ ID NO: 557073 - DNA, 25 bp, Mus musculus
gccttctgtactttgtaacttgcac

SEQ ID NO: 557074 - DNA, 25 bp, Mus musculus
gccttctgtaggaggcccaacagtg

SEQ ID NO: 557075 - DNA, 25 bp, Mus musculus
gccttctgtaggtggcccaacagtg

SEQ ID NO: 557076 - DNA, 25 bp, Mus musculus
gccttctgtggacccaatgatctca

SEQ ID NO: 557077 - DNA, 25 bp, Mus musculus
gccttctgtggagccaatgatctca

SEQ ID NO: 557078 - DNA, 25 bp, Mus musculus
gccttctgttaactgatttcctgtg

SEQ ID NO: 557079 - DNA, 25 bp, Mus musculus
gccttctgttaagtgatttcctgtg

SEQ ID NO: 557080 - DNA, 25 bp, Mus musculus
gccttctgttagagtggtagtacat

SEQ ID NO: 557081 - DNA, 25 bp, Mus musculus
gccttctgttagtgtggtagtacat

SEQ ID NO: 557082 - DNA, 25 bp, Mus musculus
gccttcttaggcagtgcactgacat

SEQ ID NO: 557083 - DNA, 25 bp, Mus musculus
gccttcttaggccaatgtattctat

SEQ ID NO: 557084 - DNA, 25 bp, Mus musculus
gccttcttaggcgaatgtattctat

SEQ ID NO: 557085 - DNA, 25 bp, Mus musculus
gccttcttaggctgtgcactgacat

SEQ ID NO: 557086 - DNA, 25 bp, Mus musculus
gccttcttcaaaacctactgctgaa

SEQ ID NO: 557087 - DNA, 25 bp, Mus musculus
gccttcttcaaatcctactgctgaa

SEQ ID NO: 557088 - DNA, 25 bp, Mus musculus
gccttcttcaacaacttggtttgca

SEQ ID NO: 557089 - DNA, 25 bp, Mus musculus
gccttcttcaactacttggtttgca

SEQ ID NO: 557090 - DNA, 25 bp, Mus musculus
gccttcttcaagaacattcacgaca

SEQ ID NO: 557091 - DNA, 25 bp, Mus musculus
gccttcttcaagtacattcacgaca

SEQ ID NO: 557092 - DNA, 25 bp, Mus musculus
gccttcttcactattaccaagtcta

SEQ ID NO: 557093 - DNA, 25 bp, Mus musculus
gccttcttcacttttaccaagtcta

SEQ ID NO: 557094 - DNA, 25 bp, Mus musculus
gccttcttccatcagtacctagtga

SEQ ID NO: 557095 - DNA, 25 bp, Mus musculus
gccttcttccatgagtacctagtga

SEQ ID NO: 557096 - DNA, 25 bp, Mus musculus
gccttcttcctgctagtgcatggag

SEQ ID NO: 557097 - DNA, 25 bp, Mus musculus
gccttcttcctggtagtgcatggag

SEQ ID NO: 557098 - DNA, 25 bp, Mus musculus
gccttcttctctcgtatcttttgga

SEQ ID NO: 557099 - DNA, 25 bp, Mus musculus
gccttcttctctggtatcttttgga

SEQ ID NO: 557100 - DNA, 25 bp, Mus musculus
gccttcttgagaaagcttcatgttt

SEQ ID NO: 557101 - DNA, 25 bp, Mus musculus
gccttcttgagatagcttcatgttt

SEQ ID NO: 557102 - DNA, 25 bp, Mus musculus
gccttcttgatgatcttagtttctg

SEQ ID NO: 557103 - DNA, 25 bp, Mus musculus
gccttcttgatgttcttagtttctg

SEQ ID NO: 557104 - DNA, 25 bp, Mus musculus
gccttcttgctcatgttttatgatc

SEQ ID NO: 557105 - DNA, 25 bp, Mus musculus
gccttcttgctcttgttttatgatc

SEQ ID NO: 557106 - DNA, 25 bp, Mus musculus
gccttcttggaaccttggaactctt

SEQ ID NO: 557107 - DNA, 25 bp, Mus musculus
gccttcttggaagcttggaactctt

SEQ ID NO: 557108 - DNA, 25 bp, Mus musculus
gccttcttggtaacagttagaaatt

SEQ ID NO: 557109 - DNA, 25 bp, Mus musculus
gccttcttggtatcagttagaaatt

SEQ ID NO: 557110 - DNA, 25 bp, Mus musculus
gccttcttgttcattgcttcagcaa

SEQ ID NO: 557111 - DNA, 25 bp, Mus musculus
gccttcttgttctttgcttcagcaa

SEQ ID NO: 557112 - DNA, 25 bp, Mus musculus
gccttctttaagcagtgcaccgaat

SEQ ID NO: 557113 - DNA, 25 bp, Mus musculus
gccttctttaaggagtgcaccgaat

SEQ ID NO: 557114 - DNA, 25 bp, Mus musculus
gccttctttagacatcgacctggag

SEQ ID NO: 557115 - DNA, 25 bp, Mus musculus
gccttctttagagatcgacctggag

SEQ ID NO: 557116 - DNA, 25 bp, Mus musculus
gccttctttatactatgacgctcgc

SEQ ID NO: 557117 - DNA, 25 bp, Mus musculus
gccttctttatagtatgacgctcgc

SEQ ID NO: 557118 - DNA, 25 bp, Mus musculus
gccttctttctacaaacatctctgg

SEQ ID NO: 557119 - DNA, 25 bp, Mus musculus
gccttctttctagaaacatctctgg

SEQ ID NO: 557120 - DNA, 25 bp, Mus musculus
gccttctttggcaaagcacgctgca

SEQ ID NO: 557121 - DNA, 25 bp, Mus musculus
gccttctttggctaagcacgctgca

SEQ ID NO: 557122 - DNA, 25 bp, Mus musculus
gccttctttgggatgtgaaaccgat

SEQ ID NO: 557123 - DNA, 25 bp, Mus musculus
gccttctttgggttgtgaaaccgat

SEQ ID NO: 557124 - DNA, 25 bp, Mus musculus
gccttctttgtcaggaaattccatt

SEQ ID NO: 557125 - DNA, 25 bp, Mus musculus
gccttctttgtctggaaattccatt

SEQ ID NO: 557126 - DNA, 25 bp, Mus musculus
gccttctttgtgcaatttattgatt

SEQ ID NO: 557127 - DNA, 25 bp, Mus musculus
gccttctttgtggaatttattgatt

SEQ ID NO: 557128 - DNA, 25 bp, Mus musculus
gccttcttttagctgtgccacatga

SEQ ID NO: 557129 - DNA, 25 bp, Mus musculus
gccttcttttaggtgtgccacatga

SEQ ID NO: 557130 - DNA, 25 bp, Mus musculus
gccttgaaaggcaaatgctgccttc

SEQ ID NO: 557131 - DNA, 25 bp, Mus musculus
gccttgaaaggctaatgctgccttc

SEQ ID NO: 557132 - DNA, 25 bp, Mus musculus
gccttgaaatcacagtgccgcttgc

SEQ ID NO: 557133 - DNA, 25 bp, Mus musculus
gccttgaaatcagagtgccgcttgc

SEQ ID NO: 557134 - DNA, 25 bp, Mus musculus
gccttgaaatgtctgggcattgcca

SEQ ID NO: 557135 - DNA, 25 bp, Mus musculus
gccttgaaatgtgtgggcattgcca

SEQ ID NO: 557136 - DNA, 25 bp, Mus musculus
gccttgaacaagagacgcagctcat

SEQ ID NO: 557137 - DNA, 25 bp, Mus musculus
gccttgaacaagtgacgcagctcat

SEQ ID NO: 557138 - DNA, 25 bp, Mus musculus
gccttgaacatacacttgccctgtt

SEQ ID NO: 557139 - DNA, 25 bp, Mus musculus
gccttgaacatagacttgccctgtt

SEQ ID NO: 557140 - DNA, 25 bp, Mus musculus
gccttgaactccctttgttgaccag

SEQ ID NO: 557141 - DNA, 25 bp, Mus musculus
gccttgaactccgtttgttgaccag

SEQ ID NO: 557142 - DNA, 25 bp, Mus musculus
gccttgaacttaatagccatggatt

SEQ ID NO: 557143 - DNA, 25 bp, Mus musculus
gccttgaacttattagccatggatt

SEQ ID NO: 557144 - DNA, 25 bp, Mus musculus
gccttgaacttgatgggccactcca

SEQ ID NO: 557145 - DNA, 25 bp, Mus musculus
gccttgaacttgttgggccactcca

SEQ ID NO: 557146 - DNA, 25 bp, Mus musculus
gccttgaagaaaagcaaccaacgtt

SEQ ID NO: 557147 - DNA, 25 bp, Mus musculus
gccttgaagaaatgcaaccaacgtt

SEQ ID NO: 557148 - DNA, 25 bp, Mus musculus
gccttgaagatgcttctccttggta

SEQ ID NO: 557149 - DNA, 25 bp, Mus musculus
gccttgaagatggttctccttggta

SEQ ID NO: 557150 - DNA, 25 bp, Mus musculus
gccttgaagggtccagttgccacaa

SEQ ID NO: 557151 - DNA, 25 bp, Mus musculus
gccttgaagggtgcagttgccacaa

SEQ ID NO: 557152 - DNA, 25 bp, Mus musculus
gccttgaatcacatggaacgctgag

SEQ ID NO: 557153 - DNA, 25 bp, Mus musculus
gccttgaatcacttggaacgctgag

SEQ ID NO: 557154 - DNA, 25 bp, Mus musculus
gccttgacctgcagttgtttgatga

SEQ ID NO: 557155 - DNA, 25 bp, Mus musculus
gccttgacctgctgttgtttgatga

SEQ ID NO: 557156 - DNA, 25 bp, Mus musculus
gccttgaccttacctctgagtagat

SEQ ID NO: 557157 - DNA, 25 bp, Mus musculus
gccttgaccttagctctgagtagat

SEQ ID NO: 557158 - DNA, 25 bp, Mus musculus
gccttgacttcccaagtgatgaaat

SEQ ID NO: 557159 - DNA, 25 bp, Mus musculus
gccttgacttccgaagtgatgaaat

SEQ ID NO: 557160 - DNA, 25 bp, Mus musculus
gccttgacttgtacctagtgttgta

SEQ ID NO: 557161 - DNA, 25 bp, Mus musculus
gccttgacttgttcctagtgttgta

SEQ ID NO: 557162 - DNA, 25 bp, Mus musculus
gccttgacttttctgccctgagttt

SEQ ID NO: 557163 - DNA, 25 bp, Mus musculus
gccttgacttttgtgccctgagttt

SEQ ID NO: 557164 - DNA, 25 bp, Mus musculus
gccttgagacagagaccgagtacca

SEQ ID NO: 557165 - DNA, 25 bp, Mus musculus
gccttgagacagtgaccgagtacca

SEQ ID NO: 557166 - DNA, 25 bp, Mus musculus
gccttgagacgacgcctatgggctt

SEQ ID NO: 557167 - DNA, 25 bp, Mus musculus
gccttgagacgaggcctatgggctt

SEQ ID NO: 557168 - DNA, 25 bp, Mus musculus
gccttgagcctaataaacagcctcc

SEQ ID NO: 557169 - DNA, 25 bp, Mus musculus
gccttgagcctattaaacagcctcc

SEQ ID NO: 557170 - DNA, 25 bp, Mus musculus
gccttgaggctgaacagtgcgacta

SEQ ID NO: 557171 - DNA, 25 bp, Mus musculus
gccttgaggctgtacagtgcgacta

SEQ ID NO: 557172 - DNA, 25 bp, Mus musculus
gccttgagtcctctcttgactcccc

SEQ ID NO: 557173 - DNA, 25 bp, Mus musculus
gccttgagtcctgtcttgactcccc

SEQ ID NO: 557174 - DNA, 25 bp, Mus musculus
gccttgagtgcaataattttccctt

SEQ ID NO: 557175 - DNA, 25 bp, Mus musculus
gccttgagtgcattaattttccctt

SEQ ID NO: 557176 - DNA, 25 bp, Mus musculus
gccttgataccacggcaggagccaa

SEQ ID NO: 557177 - DNA, 25 bp, Mus musculus
gccttgataccagggcaggagccaa

SEQ ID NO: 557178 - DNA, 25 bp, Mus musculus
gccttgatccatacatctacttttt

SEQ ID NO: 557179 - DNA, 25 bp, Mus musculus
gccttgatccattcatctacttttt

SEQ ID NO: 557180 - DNA, 25 bp, Mus musculus
gccttgatcccacggatttgactgt

SEQ ID NO: 557181 - DNA, 25 bp, Mus musculus
gccttgatcccagggatttgactgt

SEQ ID NO: 557182 - DNA, 25 bp, Mus musculus
gccttgatccctacattttacatat

SEQ ID NO: 557183 - DNA, 25 bp, Mus musculus
gccttgatcccttcattttacatat

SEQ ID NO: 557184 - DNA, 25 bp, Mus musculus
gccttgatgccgcagggcgccttct

SEQ ID NO: 557185 - DNA, 25 bp, Mus musculus
gccttgatgccggagggcgccttct

SEQ ID NO: 557186 - DNA, 25 bp, Mus musculus
gccttgatgggtcttcggtcagcaa

SEQ ID NO: 557187 - DNA, 25 bp, Mus musculus
gccttgatgggtgttcggtcagcaa

SEQ ID NO: 557188 - DNA, 25 bp, Mus musculus
gccttgattcgcaggacctatgcaa

SEQ ID NO: 557189 - DNA, 25 bp, Mus musculus
gccttgattcgctggacctatgcaa

SEQ ID NO: 557190 - DNA, 25 bp, Mus musculus
gccttgattcttctgcaccagggaa

SEQ ID NO: 557191 - DNA, 25 bp, Mus musculus
gccttgattcttgtgcaccagggaa

SEQ ID NO: 557192 - DNA, 25 bp, Mus musculus
gccttgatttccctacttgcaaagg

SEQ ID NO: 557193 - DNA, 25 bp, Mus musculus
gccttgatttccgtacttgcaaagg

SEQ ID NO: 557194 - DNA, 25 bp, Mus musculus
gccttgattttgcagtgtggccaag

SEQ ID NO: 557195 - DNA, 25 bp, Mus musculus
gccttgattttggagtgtggccaag

SEQ ID NO: 557196 - DNA, 25 bp, Mus musculus
gccttgcaattcagatgcgctttta

SEQ ID NO: 557197 - DNA, 25 bp, Mus musculus
gccttgcaattctgatgcgctttta

SEQ ID NO: 557198 - DNA, 25 bp, Mus musculus
gccttgcagactatgccgacgatgg

SEQ ID NO: 557199 - DNA, 25 bp, Mus musculus
gccttgcagactttgccgacgatgg

SEQ ID NO: 557200 - DNA, 25 bp, Mus musculus
gccttgcagataattcggtaccgct

SEQ ID NO: 557201 - DNA, 25 bp, Mus musculus
gccttgcagatatttcggtaccgct

SEQ ID NO: 557202 - DNA, 25 bp, Mus musculus
gccttgcagggcagcctgtctgtgt

SEQ ID NO: 557203 - DNA, 25 bp, Mus musculus
gccttgcagggctgcctgtctgtgt

SEQ ID NO: 557204 - DNA, 25 bp, Mus musculus
gccttgcatcataggtggtagtgat

SEQ ID NO: 557205 - DNA, 25 bp, Mus musculus
gccttgcatcattggtggtagtgat

SEQ ID NO: 557206 - DNA, 25 bp, Mus musculus
gccttgcatctgatctatttgttta

SEQ ID NO: 557207 - DNA, 25 bp, Mus musculus
gccttgcatctgttctatttgttta

SEQ ID NO: 557208 - DNA, 25 bp, Mus musculus
gccttgcatgagacacttcattcag

SEQ ID NO: 557209 - DNA, 25 bp, Mus musculus
gccttgcatgagtcacttcattcag

SEQ ID NO: 557210 - DNA, 25 bp, Mus musculus
gccttgcattccacaggccaggcaa

SEQ ID NO: 557211 - DNA, 25 bp, Mus musculus
gccttgcattcctcaggccaggcaa

SEQ ID NO: 557212 - DNA, 25 bp, Mus musculus
gccttgcatttaatggtgtctctga

SEQ ID NO: 557213 - DNA, 25 bp, Mus musculus
gccttgcatttattggtgtctctga

SEQ ID NO: 557214 - DNA, 25 bp, Mus musculus
gccttgccaggacgctggaagtaca

SEQ ID NO: 557215 - DNA, 25 bp, Mus musculus
gccttgccaggaggctggaagtaca

SEQ ID NO: 557216 - DNA, 25 bp, Mus musculus
gccttgccaggtcctgacttgggaa

SEQ ID NO: 557217 - DNA, 25 bp, Mus musculus
gccttgccaggtgctgacttgggaa

SEQ ID NO: 557218 - DNA, 25 bp, Mus musculus
gccttgccggagaggctctaggact

SEQ ID NO: 557219 - DNA, 25 bp, Mus musculus
gccttgccggagtggctctaggact

SEQ ID NO: 557220 - DNA, 25 bp, Mus musculus
gccttgcctagaaattggtatcaaa

SEQ ID NO: 557221 - DNA, 25 bp, Mus musculus
gccttgcctagatattggtatcaaa

SEQ ID NO: 557222 - DNA, 25 bp, Mus musculus
gccttgcctcatactgggattttag

SEQ ID NO: 557223 - DNA, 25 bp, Mus musculus
gccttgcctcattctgggattttag

SEQ ID NO: 557224 - DNA, 25 bp, Mus musculus
gccttgcctcggagcttagctgatt

SEQ ID NO: 557225 - DNA, 25 bp, Mus musculus
gccttgcctcggtgcttagctgatt

SEQ ID NO: 557226 - DNA, 25 bp, Mus musculus
gccttgcctgcccaagatgaagagt

SEQ ID NO: 557227 - DNA, 25 bp, Mus musculus
gccttgcctgccgaagatgaagagt

SEQ ID NO: 557228 - DNA, 25 bp, Mus musculus
gccttgcctggacattgtgtcatga

SEQ ID NO: 557229 - DNA, 25 bp, Mus musculus
gccttgcctggagattgtgtcatga

SEQ ID NO: 557230 - DNA, 25 bp, Mus musculus
gccttgcctggtccttataaacttc

SEQ ID NO: 557231 - DNA, 25 bp, Mus musculus
gccttgcctggtgcttataaacttc

SEQ ID NO: 557232 - DNA, 25 bp, Mus musculus
gccttgcctgtaactcaacaaatga

SEQ ID NO: 557233 - DNA, 25 bp, Mus musculus
gccttgcctgtatctcaacaaatga

SEQ ID NO: 557234 - DNA, 25 bp, Mus musculus
gccttgccttgtagctcattataca

SEQ ID NO: 557235 - DNA, 25 bp, Mus musculus
gccttgccttgttgctcattataca

SEQ ID NO: 557236 - DNA, 25 bp, Mus musculus
gccttgcgagtgcttcaaagtaaga

SEQ ID NO: 557237 - DNA, 25 bp, Mus musculus
gccttgcgagtggttcaaagtaaga

SEQ ID NO: 557238 - DNA, 25 bp, Mus musculus
gccttgcgtcagaagattgtcatca

SEQ ID NO: 557239 - DNA, 25 bp, Mus musculus
gccttgcgtcagtagattgtcatca

SEQ ID NO: 557240 - DNA, 25 bp, Mus musculus
gccttgctacttagcatgatagtga

SEQ ID NO: 557241 - DNA, 25 bp, Mus musculus
gccttgctactttgcatgatagtga

SEQ ID NO: 557242 - DNA, 25 bp, Mus musculus
gccttgctccaacctgtgttcataa

SEQ ID NO: 557243 - DNA, 25 bp, Mus musculus
gccttgctccaagctgtgttcataa

SEQ ID NO: 557244 - DNA, 25 bp, Mus musculus
gccttgctgctgatttggaaacttt

SEQ ID NO: 557245 - DNA, 25 bp, Mus musculus
gccttgctgctgttttggaaacttt

SEQ ID NO: 557246 - DNA, 25 bp, Mus musculus
gccttgctggcaattaaatatccaa

SEQ ID NO: 557247 - DNA, 25 bp, Mus musculus
gccttgctggcatttaaatatccaa

SEQ ID NO: 557248 - DNA, 25 bp, Mus musculus
gccttgctgggaacggtgaataaac

SEQ ID NO: 557249 - DNA, 25 bp, Mus musculus
gccttgctgggatcggtgaataaac

SEQ ID NO: 557250 - DNA, 25 bp, Mus musculus
gccttgctggttactatgctgacaa

SEQ ID NO: 557251 - DNA, 25 bp, Mus musculus
gccttgctggtttctatgctgacaa

SEQ ID NO: 557252 - DNA, 25 bp, Mus musculus
gccttgctgttgctggttagctaaa

SEQ ID NO: 557253 - DNA, 25 bp, Mus musculus
gccttgctgttggtggttagctaaa

SEQ ID NO: 557254 - DNA, 25 bp, Mus musculus
gccttgcttcagaccctaagactga

SEQ ID NO: 557255 - DNA, 25 bp, Mus musculus
gccttgcttcagtccctaagactga

SEQ ID NO: 557256 - DNA, 25 bp, Mus musculus
gccttgctttacaaacgggacctct

SEQ ID NO: 557257 - DNA, 25 bp, Mus musculus
gccttgctttactaacgggacctct

SEQ ID NO: 557258 - DNA, 25 bp, Mus musculus
gccttgctttcaactggttgtcagt

SEQ ID NO: 557259 - DNA, 25 bp, Mus musculus
gccttgctttcatctggttgtcagt

SEQ ID NO: 557260 - DNA, 25 bp, Mus musculus
gccttggaaacaaacattattccat

SEQ ID NO: 557261 - DNA, 25 bp, Mus musculus
gccttggaaacatacattattccat

SEQ ID NO: 557262 - DNA, 25 bp, Mus musculus
gccttggaaactacccgctgtatta

SEQ ID NO: 557263 - DNA, 25 bp, Mus musculus
gccttggaaacttcccgctgtatta

SEQ ID NO: 557264 - DNA, 25 bp, Mus musculus
gccttggaccaaattgctgcagcat

SEQ ID NO: 557265 - DNA, 25 bp, Mus musculus
gccttggaccaatttgctgcagcat

SEQ ID NO: 557266 - DNA, 25 bp, Mus musculus
gccttggacgctatgcgagagatga

SEQ ID NO: 557267 - DNA, 25 bp, Mus musculus
gccttggacgctttgcgagagatga

SEQ ID NO: 557268 - DNA, 25 bp, Mus musculus
gccttggacgtcctacacagcgaga

SEQ ID NO: 557269 - DNA, 25 bp, Mus musculus
gccttggacgtcgtacacagcgaga

SEQ ID NO: 557270 - DNA, 25 bp, Mus musculus
gccttggactccagtcaatcattgg

SEQ ID NO: 557271 - DNA, 25 bp, Mus musculus
gccttggactcctgtcaatcattgg

SEQ ID NO: 557272 - DNA, 25 bp, Mus musculus
gccttggagaggacataggagccaa

SEQ ID NO: 557273 - DNA, 25 bp, Mus musculus
gccttggagaggtcataggagccaa

SEQ ID NO: 557274 - DNA, 25 bp, Mus musculus
gccttggagcagaaatagagaccct

SEQ ID NO: 557275 - DNA, 25 bp, Mus musculus
gccttggagcagtaatagagaccct

SEQ ID NO: 557276 - DNA, 25 bp, Mus musculus
gccttggagtgccttagttccgaaa

SEQ ID NO: 557277 - DNA, 25 bp, Mus musculus
gccttggagtgcgttagttccgaaa

SEQ ID NO: 557278 - DNA, 25 bp, Mus musculus
gccttggatcctcagatgaaagaca

SEQ ID NO: 557279 - DNA, 25 bp, Mus musculus
gccttggatcctgagatgaaagaca

SEQ ID NO: 557280 - DNA, 25 bp, Mus musculus
gccttggcacttaatctctgcagaa

SEQ ID NO: 557281 - DNA, 25 bp, Mus musculus
gccttggcactttatctctgcagaa

SEQ ID NO: 557282 - DNA, 25 bp, Mus musculus
gccttggcagccatctttattgctc

SEQ ID NO: 557283 - DNA, 25 bp, Mus musculus
gccttggcagccttctttattgctc

SEQ ID NO: 557284 - DNA, 25 bp, Mus musculus
gccttggcagtactcactctggaaa

SEQ ID NO: 557285 - DNA, 25 bp, Mus musculus
gccttggcagtagtcactctggaaa

SEQ ID NO: 557286 - DNA, 25 bp, Mus musculus
gccttggcatccatacagaggatag

SEQ ID NO: 557287 - DNA, 25 bp, Mus musculus
gccttggcatccttacagaggatag

SEQ ID NO: 557288 - DNA, 25 bp, Mus musculus
gccttggcatttacatcactggtgt

SEQ ID NO: 557289 - DNA, 25 bp, Mus musculus
gccttggcattttcatcactggtgt

SEQ ID NO: 557290 - DNA, 25 bp, Mus musculus
gccttggcgaagctggaacgtttct

SEQ ID NO: 557291 - DNA, 25 bp, Mus musculus
gccttggcgaaggtggaacgtttct

SEQ ID NO: 557292 - DNA, 25 bp, Mus musculus
gccttggcgcgtatcttcttctttg

SEQ ID NO: 557293 - DNA, 25 bp, Mus musculus
gccttggcgcgtttcttcttctttg

SEQ ID NO: 557294 - DNA, 25 bp, Mus musculus
gccttggctacacatgaccatactg

SEQ ID NO: 557295 - DNA, 25 bp, Mus musculus
gccttggctacacttaaaatcctgt

SEQ ID NO: 557296 - DNA, 25 bp, Mus musculus
gccttggctacagatgaccatactg

SEQ ID NO: 557297 - DNA, 25 bp, Mus musculus
gccttggctacagttaaaatcctgt

SEQ ID NO: 557298 - DNA, 25 bp, Mus musculus
gccttggctagcacagtgtttggaa

SEQ ID NO: 557299 - DNA, 25 bp, Mus musculus
gccttggctagctcagtgtttggaa

SEQ ID NO: 557300 - DNA, 25 bp, Mus musculus
gccttggctcccagaaggaatctga

SEQ ID NO: 557301 - DNA, 25 bp, Mus musculus
gccttggctccctgaaggaatctga

SEQ ID NO: 557302 - DNA, 25 bp, Mus musculus
gccttggctgacaagtaccactaaa

SEQ ID NO: 557303 - DNA, 25 bp, Mus musculus
gccttggctgactagtaccactaaa

SEQ ID NO: 557304 - DNA, 25 bp, Mus musculus
gccttggctgagcaccgaggttcaa

SEQ ID NO: 557305 - DNA, 25 bp, Mus musculus
gccttggctgaggaccgaggttcaa

SEQ ID NO: 557306 - DNA, 25 bp, Mus musculus
gccttggctgccactggatgagctg

SEQ ID NO: 557307 - DNA, 25 bp, Mus musculus
gccttggctgcctctggatgagctg

SEQ ID NO: 557308 - DNA, 25 bp, Mus musculus
gccttggctttcagatactgtggaa

SEQ ID NO: 557309 - DNA, 25 bp, Mus musculus
gccttggctttctgatactgtggaa

SEQ ID NO: 557310 - DNA, 25 bp, Mus musculus
gccttgggaatacgacgcatcttca

SEQ ID NO: 557311 - DNA, 25 bp, Mus musculus
gccttgggaataggacgcatcttca

SEQ ID NO: 557312 - DNA, 25 bp, Mus musculus
gccttgggactcactattggaggta

SEQ ID NO: 557313 - DNA, 25 bp, Mus musculus
gccttgggactctctattggaggta

SEQ ID NO: 557314 - DNA, 25 bp, Mus musculus
gccttgggcactataccacagttag

SEQ ID NO: 557315 - DNA, 25 bp, Mus musculus
gccttgggcactttaccacagttag

SEQ ID NO: 557316 - DNA, 25 bp, Mus musculus
gccttgggcattcttgtatctcctg

SEQ ID NO: 557317 - DNA, 25 bp, Mus musculus
gccttgggcattgttgtatctcctg

SEQ ID NO: 557318 - DNA, 25 bp, Mus musculus
gccttgggcgtaagctggccatagt

SEQ ID NO: 557319 - DNA, 25 bp, Mus musculus
gccttgggcgtatgctggccatagt

SEQ ID NO: 557320 - DNA, 25 bp, Mus musculus
gccttgggcttcactcaaatgtaaa

SEQ ID NO: 557321 - DNA, 25 bp, Mus musculus
gccttgggcttctctcaaatgtaaa

SEQ ID NO: 557322 - DNA, 25 bp, Mus musculus
gccttgggtaggcagccctgggaga

SEQ ID NO: 557323 - DNA, 25 bp, Mus musculus
gccttgggtagggagccctgggaga

SEQ ID NO: 557324 - DNA, 25 bp, Mus musculus
gccttggtactgaagctcagggtca

SEQ ID NO: 557325 - DNA, 25 bp, Mus musculus
gccttggtactgtagctcagggtca

SEQ ID NO: 557326 - DNA, 25 bp, Mus musculus
gccttggtagcaagttcctggattg

SEQ ID NO: 557327 - DNA, 25 bp, Mus musculus
gccttggtagcatgttcctggattg

SEQ ID NO: 557328 - DNA, 25 bp, Mus musculus
gccttggtcccaaggctgtgagcag

SEQ ID NO: 557329 - DNA, 25 bp, Mus musculus
gccttggtcccatggctgtgagcag

SEQ ID NO: 557330 - DNA, 25 bp, Mus musculus
gccttggtcctacttcagagggaga

SEQ ID NO: 557331 - DNA, 25 bp, Mus musculus
gccttggtcctagttcagagggaga

SEQ ID NO: 557332 - DNA, 25 bp, Mus musculus
gccttggtgctcacttgagtacaaa

SEQ ID NO: 557333 - DNA, 25 bp, Mus musculus
gccttggtgctctcttgagtacaaa

SEQ ID NO: 557334 - DNA, 25 bp, Mus musculus
gccttggtgtttcctctctattgtg

SEQ ID NO: 557335 - DNA, 25 bp, Mus musculus
gccttggtgtttgctctctattgtg

SEQ ID NO: 557336 - DNA, 25 bp, Mus musculus
gccttggttttacagctcacgtccc

SEQ ID NO: 557337 - DNA, 25 bp, Mus musculus
gccttggttttagagctcacgtccc

SEQ ID NO: 557338 - DNA, 25 bp, Mus musculus
gccttgtaatcacctgtccttctaa

SEQ ID NO: 557339 - DNA, 25 bp, Mus musculus
gccttgtaatcagctgtccttctaa

SEQ ID NO: 557340 - DNA, 25 bp, Mus musculus
gccttgtacaagagccagcatttga

SEQ ID NO: 557341 - DNA, 25 bp, Mus musculus
gccttgtacaagtgccagcatttga

SEQ ID NO: 557342 - DNA, 25 bp, Mus musculus
gccttgtaccagctctcagaagatg

SEQ ID NO: 557343 - DNA, 25 bp, Mus musculus
gccttgtaccaggtctcagaagatg

SEQ ID NO: 557344 - DNA, 25 bp, Mus musculus
gccttgtactgacagctggttgtca

SEQ ID NO: 557345 - DNA, 25 bp, Mus musculus
gccttgtactgagagctggttgtca

SEQ ID NO: 557346 - DNA, 25 bp, Mus musculus
gccttgtataatctgtaagtaccta

SEQ ID NO: 557347 - DNA, 25 bp, Mus musculus
gccttgtataatgtgtaagtaccta

SEQ ID NO: 557348 - DNA, 25 bp, Mus musculus
gccttgtatatgctagacagttgca

SEQ ID NO: 557349 - DNA, 25 bp, Mus musculus
gccttgtatatggtagacagttgca

SEQ ID NO: 557350 - DNA, 25 bp, Mus musculus
gccttgtatctcaacaccctgagtg

SEQ ID NO: 557351 - DNA, 25 bp, Mus musculus
gccttgtatctctacaccctgagtg

SEQ ID NO: 557352 - DNA, 25 bp, Mus musculus
gccttgtatgtcataatcttatgct

SEQ ID NO: 557353 - DNA, 25 bp, Mus musculus
gccttgtatgtcttaatcttatgct

SEQ ID NO: 557354 - DNA, 25 bp, Mus musculus
gccttgtattgtctgatttgattaa

SEQ ID NO: 557355 - DNA, 25 bp, Mus musculus
gccttgtattgtgtgatttgattaa

SEQ ID NO: 557356 - DNA, 25 bp, Mus musculus
gccttgtcaccaattggaggtggcc

SEQ ID NO: 557357 - DNA, 25 bp, Mus musculus
gccttgtcaccatttggaggtggcc

SEQ ID NO: 557358 - DNA, 25 bp, Mus musculus
gccttgtcagcaaatctgtgagagt

SEQ ID NO: 557359 - DNA, 25 bp, Mus musculus
gccttgtcagcatatctgtgagagt

SEQ ID NO: 557360 - DNA, 25 bp, Mus musculus
gccttgtccaagctgccaatgatgc

SEQ ID NO: 557361 - DNA, 25 bp, Mus musculus
gccttgtccaaggtgccaatgatgc

SEQ ID NO: 557362 - DNA, 25 bp, Mus musculus
gccttgtccccgcaagtcgaagctt

SEQ ID NO: 557363 - DNA, 25 bp, Mus musculus
gccttgtccccggaagtcgaagctt

SEQ ID NO: 557364 - DNA, 25 bp, Mus musculus
gccttgtcgaaaaccacactcggat

SEQ ID NO: 557365 - DNA, 25 bp, Mus musculus
gccttgtcgaaatccacactcggat

SEQ ID NO: 557366 - DNA, 25 bp, Mus musculus
gccttgtctagtattgcgttatctt

SEQ ID NO: 557367 - DNA, 25 bp, Mus musculus
gccttgtctagttttgcgttatctt

SEQ ID NO: 557368 - DNA, 25 bp, Mus musculus
gccttgtcttccctaaagcaaaaat

SEQ ID NO: 557369 - DNA, 25 bp, Mus musculus
gccttgtcttccgtaaagcaaaaat

SEQ ID NO: 557370 - DNA, 25 bp, Mus musculus
gccttgtgaaggctggctcagctcc

SEQ ID NO: 557371 - DNA, 25 bp, Mus musculus
gccttgtgaagggtggctcagctcc

SEQ ID NO: 557372 - DNA, 25 bp, Mus musculus
gccttgtgcattaaaatcttcaaat

SEQ ID NO: 557373 - DNA, 25 bp, Mus musculus
gccttgtgcatttaaatcttcaaat

SEQ ID NO: 557374 - DNA, 25 bp, Mus musculus
gccttgtgccagaagtcactacatg

SEQ ID NO: 557375 - DNA, 25 bp, Mus musculus
gccttgtgccagtagtcactacatg

SEQ ID NO: 557376 - DNA, 25 bp, Mus musculus
gccttgtgcgacatatgtgttggac

SEQ ID NO: 557377 - DNA, 25 bp, Mus musculus
gccttgtgcgacttatgtgttggac

SEQ ID NO: 557378 - DNA, 25 bp, Mus musculus
gccttgtgctcgctggtatttttat

SEQ ID NO: 557379 - DNA, 25 bp, Mus musculus
gccttgtgctcggtggtatttttat

SEQ ID NO: 557380 - DNA, 25 bp, Mus musculus
gccttgtgcttcctgattggaaaac

SEQ ID NO: 557381 - DNA, 25 bp, Mus musculus
gccttgtgcttcgtgattggaaaac

SEQ ID NO: 557382 - DNA, 25 bp, Mus musculus
gccttgtggcatccaataggtgctt

SEQ ID NO: 557383 - DNA, 25 bp, Mus musculus
gccttgtggcatgcaataggtgctt

SEQ ID NO: 557384 - DNA, 25 bp, Mus musculus
gccttgtggtctcaaattgtctcat

SEQ ID NO: 557385 - DNA, 25 bp, Mus musculus
gccttgtggtctgaaattgtctcat

SEQ ID NO: 557386 - DNA, 25 bp, Mus musculus
gccttgtggttacattgggtaccct

SEQ ID NO: 557387 - DNA, 25 bp, Mus musculus
gccttgtggttagattgggtaccct

SEQ ID NO: 557388 - DNA, 25 bp, Mus musculus
gccttgtgtagtccgaagctctcaa

SEQ ID NO: 557389 - DNA, 25 bp, Mus musculus
gccttgtgtagtgcgaagctctcaa

SEQ ID NO: 557390 - DNA, 25 bp, Mus musculus
gccttgtgttggcaacatgagcact

SEQ ID NO: 557391 - DNA, 25 bp, Mus musculus
gccttgtgttgggaacatgagcact

SEQ ID NO: 557392 - DNA, 25 bp, Mus musculus
gccttgttaatcacttctttcatat

SEQ ID NO: 557393 - DNA, 25 bp, Mus musculus
gccttgttaatctcttctttcatat

SEQ ID NO: 557394 - DNA, 25 bp, Mus musculus
gccttgttactgaggcttggtgaca

SEQ ID NO: 557395 - DNA, 25 bp, Mus musculus
gccttgttactgtggcttggtgaca

SEQ ID NO: 557396 - DNA, 25 bp, Mus musculus
gccttgttatttcacttaacttggt

SEQ ID NO: 557397 - DNA, 25 bp, Mus musculus
gccttgttatttgacttaacttggt

SEQ ID NO: 557398 - DNA, 25 bp, Mus musculus
gccttgttcataaatgtgctctgaa

SEQ ID NO: 557399 - DNA, 25 bp, Mus musculus
gccttgttcatatatgtgctctgaa

SEQ ID NO: 557400 - DNA, 25 bp, Mus musculus
gccttgttcttaacacacttgagat

SEQ ID NO: 557401 - DNA, 25 bp, Mus musculus
gccttgttcttatcacacttgagat

SEQ ID NO: 557402 - DNA, 25 bp, Mus musculus
gccttgttgaaacgcagcctcatgc

SEQ ID NO: 557403 - DNA, 25 bp, Mus musculus
gccttgttgaaaggcagcctcatgc

SEQ ID NO: 557404 - DNA, 25 bp, Mus musculus
gccttgttgagcctcgaactgcttc

SEQ ID NO: 557405 - DNA, 25 bp, Mus musculus
gccttgttgagcgtcgaactgcttc

SEQ ID NO: 557406 - DNA, 25 bp, Mus musculus
gccttgttggccacagtggaatagg

SEQ ID NO: 557407 - DNA, 25 bp, Mus musculus
gccttgttggccactaatatttagg

SEQ ID NO: 557408 - DNA, 25 bp, Mus musculus
gccttgttggccatcatcgggagga

SEQ ID NO: 557409 - DNA, 25 bp, Mus musculus
gccttgttggcctcagtggaatagg

SEQ ID NO: 557410 - DNA, 25 bp, Mus musculus
gccttgttggcctctaatatttagg

SEQ ID NO: 557411 - DNA, 25 bp, Mus musculus
gccttgttggccttcatcgggagga

SEQ ID NO: 557412 - DNA, 25 bp, Mus musculus
gccttgttgggcatcctgtaaaaat

SEQ ID NO: 557413 - DNA, 25 bp, Mus musculus
gccttgttgggcttcctgtaaaaat

SEQ ID NO: 557414 - DNA, 25 bp, Mus musculus
gccttgtttatgctgttaccttcca

SEQ ID NO: 557415 - DNA, 25 bp, Mus musculus
gccttgtttatggtgttaccttcca

SEQ ID NO: 557416 - DNA, 25 bp, Mus musculus
gccttgtttctcacatcacacagga

SEQ ID NO: 557417 - DNA, 25 bp, Mus musculus
gccttgtttctctcatcacacagga

SEQ ID NO: 557418 - DNA, 25 bp, Mus musculus
gccttgtttcttcatgacattattg

SEQ ID NO: 557419 - DNA, 25 bp, Mus musculus
gccttgtttcttgatgacattattg

SEQ ID NO: 557420 - DNA, 25 bp, Mus musculus
gcctttaaactaaatcttgtccaac

SEQ ID NO: 557421 - DNA, 25 bp, Mus musculus
gcctttaaactatatcttgtccaac

SEQ ID NO: 557422 - DNA, 25 bp, Mus musculus
gcctttaaatagacaccgatgggtt

SEQ ID NO: 557423 - DNA, 25 bp, Mus musculus
gcctttaaatagctgtggtgttttc

SEQ ID NO: 557424 - DNA, 25 bp, Mus musculus
gcctttaaataggtgtggtgttttc

SEQ ID NO: 557425 - DNA, 25 bp, Mus musculus
gcctttaaatagtcaccgatgggtt

SEQ ID NO: 557426 - DNA, 25 bp, Mus musculus
gcctttaacaatacttcttgttctg

SEQ ID NO: 557427 - DNA, 25 bp, Mus musculus
gcctttaacaattcttcttgttctg

SEQ ID NO: 557428 - DNA, 25 bp, Mus musculus
gcctttaatcttagagcttcagcat

SEQ ID NO: 557429 - DNA, 25 bp, Mus musculus
gcctttaatctttgagcttcagcat

SEQ ID NO: 557430 - DNA, 25 bp, Mus musculus
gcctttaatgagcacggttcccagt

SEQ ID NO: 557431 - DNA, 25 bp, Mus musculus
gcctttaatgaggacggttcccagt

SEQ ID NO: 557432 - DNA, 25 bp, Mus musculus
gcctttaatgtgagtcagcccatct

SEQ ID NO: 557433 - DNA, 25 bp, Mus musculus
gcctttaatgtgtgtcagcccatct

SEQ ID NO: 557434 - DNA, 25 bp, Mus musculus
gcctttacaatacggacttctgtgt

SEQ ID NO: 557435 - DNA, 25 bp, Mus musculus
gcctttacaatagggacttctgtgt

SEQ ID NO: 557436 - DNA, 25 bp, Mus musculus
gcctttacaatccttcccaaaaatg

SEQ ID NO: 557437 - DNA, 25 bp, Mus musculus
gcctttacaatcgttcccaaaaatg

SEQ ID NO: 557438 - DNA, 25 bp, Mus musculus
gcctttacacttctttgatttcacc

SEQ ID NO: 557439 - DNA, 25 bp, Mus musculus
gcctttacacttgtttgatttcacc

SEQ ID NO: 557440 - DNA, 25 bp, Mus musculus
gcctttacagacagtccactggatt

SEQ ID NO: 557441 - DNA, 25 bp, Mus musculus
gcctttacagactgtccactggatt

SEQ ID NO: 557442 - DNA, 25 bp, Mus musculus
gcctttacccaaagttcaagcctta

SEQ ID NO: 557443 - DNA, 25 bp, Mus musculus
gcctttacccaatgttcaagcctta

SEQ ID NO: 557444 - DNA, 25 bp, Mus musculus
gcctttaccccaaatggactctact

SEQ ID NO: 557445 - DNA, 25 bp, Mus musculus
gcctttaccccatatggactctact

SEQ ID NO: 557446 - DNA, 25 bp, Mus musculus
gcctttaccgggatgactctggtga

SEQ ID NO: 557447 - DNA, 25 bp, Mus musculus
gcctttaccgggttgactctggtga

SEQ ID NO: 557448 - DNA, 25 bp, Mus musculus
gcctttacgacaagctgtggtttgc

SEQ ID NO: 557449 - DNA, 25 bp, Mus musculus
gcctttacgacatgctgtggtttgc

SEQ ID NO: 557450 - DNA, 25 bp, Mus musculus
gcctttacgagaaacgctgcaaacc

SEQ ID NO: 557451 - DNA, 25 bp, Mus musculus
gcctttacgagatacgctgcaaacc

SEQ ID NO: 557452 - DNA, 25 bp, Mus musculus
gcctttactgtactttgccgtgata

SEQ ID NO: 557453 - DNA, 25 bp, Mus musculus
gcctttactgtagtttgccgtgata

SEQ ID NO: 557454 - DNA, 25 bp, Mus musculus
gcctttacttctatgatatgctcaa

SEQ ID NO: 557455 - DNA, 25 bp, Mus musculus
gcctttacttctttgatatgctcaa

SEQ ID NO: 557456 - DNA, 25 bp, Mus musculus
gcctttagaggcatttgctgtgttg

SEQ ID NO: 557457 - DNA, 25 bp, Mus musculus
gcctttagaggcttttgctgtgttg

SEQ ID NO: 557458 - DNA, 25 bp, Mus musculus
gcctttagcaagatgccaagctgac

SEQ ID NO: 557459 - DNA, 25 bp, Mus musculus
gcctttagcaagttgccaagctgac

SEQ ID NO: 557460 - DNA, 25 bp, Mus musculus
gcctttagccaactcatcttgccaa

SEQ ID NO: 557461 - DNA, 25 bp, Mus musculus
gcctttagccaagtcatcttgccaa

SEQ ID NO: 557462 - DNA, 25 bp, Mus musculus
gcctttagctaacataattcccata

SEQ ID NO: 557463 - DNA, 25 bp, Mus musculus
gcctttagctaagataattcccata

SEQ ID NO: 557464 - DNA, 25 bp, Mus musculus
gcctttagctctaattatatttttg

SEQ ID NO: 557465 - DNA, 25 bp, Mus musculus
gcctttagctcttattatatttttg

SEQ ID NO: 557466 - DNA, 25 bp, Mus musculus
gcctttaggcccaggtttgggaatg

SEQ ID NO: 557467 - DNA, 25 bp, Mus musculus
gcctttaggccctggtttgggaatg

SEQ ID NO: 557468 - DNA, 25 bp, Mus musculus
gcctttagtaatacacaggaagcgt

SEQ ID NO: 557469 - DNA, 25 bp, Mus musculus
gcctttagtaattcacaggaagcgt

SEQ ID NO: 557470 - DNA, 25 bp, Mus musculus
gcctttagttgcatttatctctctg

SEQ ID NO: 557471 - DNA, 25 bp, Mus musculus
gcctttagttgcttttatctctctg

SEQ ID NO: 557472 - DNA, 25 bp, Mus musculus
gcctttatattacagcacatgccat

SEQ ID NO: 557473 - DNA, 25 bp, Mus musculus
gcctttatattagagcacatgccat

SEQ ID NO: 557474 - DNA, 25 bp, Mus musculus
gcctttatccttattcctacaggag

SEQ ID NO: 557475 - DNA, 25 bp, Mus musculus
gcctttatcctttttcctacaggag

SEQ ID NO: 557476 - DNA, 25 bp, Mus musculus
gcctttatgcatatgtactttatgc

SEQ ID NO: 557477 - DNA, 25 bp, Mus musculus
gcctttatgcatttgtactttatgc

SEQ ID NO: 557478 - DNA, 25 bp, Mus musculus
gcctttatgtagacagctgtctgcc

SEQ ID NO: 557479 - DNA, 25 bp, Mus musculus
gcctttatgtagtcagctgtctgcc

SEQ ID NO: 557480 - DNA, 25 bp, Mus musculus
gcctttatgtccctggattgacact

SEQ ID NO: 557481 - DNA, 25 bp, Mus musculus
gcctttatgtccgtggattgacact

SEQ ID NO: 557482 - DNA, 25 bp, Mus musculus
gcctttatgtctcgctttgagtaaa

SEQ ID NO: 557483 - DNA, 25 bp, Mus musculus
gcctttatgtctggctttgagtaaa

SEQ ID NO: 557484 - DNA, 25 bp, Mus musculus
gcctttattccaagcacttgagaaa

SEQ ID NO: 557485 - DNA, 25 bp, Mus musculus
gcctttattccatgcacttgagaaa

SEQ ID NO: 557486 - DNA, 25 bp, Mus musculus
gcctttcaaaatcgatctcacggag

SEQ ID NO: 557487 - DNA, 25 bp, Mus musculus
gcctttcaaaatggatctcacggag

SEQ ID NO: 557488 - DNA, 25 bp, Mus musculus
gcctttcacatcatgcagtacattt

SEQ ID NO: 557489 - DNA, 25 bp, Mus musculus
gcctttcacatcttgcagtacattt

SEQ ID NO: 557490 - DNA, 25 bp, Mus musculus
gcctttcacgatctctttgatcacg

SEQ ID NO: 557491 - DNA, 25 bp, Mus musculus
gcctttcacgatgtctttgatcacg

SEQ ID NO: 557492 - DNA, 25 bp, Mus musculus
gcctttcacttaactggacagtcac

SEQ ID NO: 557493 - DNA, 25 bp, Mus musculus
gcctttcacttatctggacagtcac

SEQ ID NO: 557494 - DNA, 25 bp, Mus musculus
gcctttcacttcatcactacatgaa

SEQ ID NO: 557495 - DNA, 25 bp, Mus musculus
gcctttcacttcttcactacatgaa

SEQ ID NO: 557496 - DNA, 25 bp, Mus musculus
gcctttcagagcactattgtttcag

SEQ ID NO: 557497 - DNA, 25 bp, Mus musculus
gcctttcagagctctattgtttcag

SEQ ID NO: 557498 - DNA, 25 bp, Mus musculus
gcctttcagaggatgcatgcttttg

SEQ ID NO: 557499 - DNA, 25 bp, Mus musculus
gcctttcagaggttgcatgcttttg

SEQ ID NO: 557500 - DNA, 25 bp, Mus musculus
gcctttcagagtcgatatttccctt

SEQ ID NO: 557501 - DNA, 25 bp, Mus musculus
gcctttcagagtggatatttccctt

SEQ ID NO: 557502 - DNA, 25 bp, Mus musculus
gcctttcataatagtctctgtgcta

SEQ ID NO: 557503 - DNA, 25 bp, Mus musculus
gcctttcataattgtctctgtgcta

SEQ ID NO: 557504 - DNA, 25 bp, Mus musculus
gcctttcatcacacaatctggactt

SEQ ID NO: 557505 - DNA, 25 bp, Mus musculus
gcctttcatcactcaatctggactt

SEQ ID NO: 557506 - DNA, 25 bp, Mus musculus
gcctttcatcccagtatcatttttt

SEQ ID NO: 557507 - DNA, 25 bp, Mus musculus
gcctttcatcccattgtattctgag

SEQ ID NO: 557508 - DNA, 25 bp, Mus musculus
gcctttcatccctgtatcatttttt

SEQ ID NO: 557509 - DNA, 25 bp, Mus musculus
gcctttcatccctttgtattctgag

SEQ ID NO: 557510 - DNA, 25 bp, Mus musculus
gcctttcatgacaacttttacttgt

SEQ ID NO: 557511 - DNA, 25 bp, Mus musculus
gcctttcatgactacttttacttgt

SEQ ID NO: 557512 - DNA, 25 bp, Mus musculus
gcctttccaagactgggtttatctt

SEQ ID NO: 557513 - DNA, 25 bp, Mus musculus
gcctttccaagagtgggtttatctt

SEQ ID NO: 557514 - DNA, 25 bp, Mus musculus
gcctttccagcacgttttagtgcct

SEQ ID NO: 557515 - DNA, 25 bp, Mus musculus
gcctttccagcaggttttagtgcct

SEQ ID NO: 557516 - DNA, 25 bp, Mus musculus
gcctttccaggacaatgacggtgat

SEQ ID NO: 557517 - DNA, 25 bp, Mus musculus
gcctttccaggagaatgacggtgat

SEQ ID NO: 557518 - DNA, 25 bp, Mus musculus
gcctttccatatatttgatgagaga

SEQ ID NO: 557519 - DNA, 25 bp, Mus musculus
gcctttccatatttttgatgagaga

SEQ ID NO: 557520 - DNA, 25 bp, Mus musculus
gcctttcccctactgacacaagaag

SEQ ID NO: 557521 - DNA, 25 bp, Mus musculus
gcctttcccctagtgacacaagaag

SEQ ID NO: 557522 - DNA, 25 bp, Mus musculus
gcctttccctaactacttgctaaat

SEQ ID NO: 557523 - DNA, 25 bp, Mus musculus
gcctttccctaagtacttgctaaat

SEQ ID NO: 557524 - DNA, 25 bp, Mus musculus
gcctttcctaatcagtgatgacccc

SEQ ID NO: 557525 - DNA, 25 bp, Mus musculus
gcctttcctaatgagtgatgacccc

SEQ ID NO: 557526 - DNA, 25 bp, Mus musculus
gcctttcctgacagatttgggagac

SEQ ID NO: 557527 - DNA, 25 bp, Mus musculus
gcctttcctgactgatttgggagac

SEQ ID NO: 557528 - DNA, 25 bp, Mus musculus
gcctttcctgccaggtgggccaaat

SEQ ID NO: 557529 - DNA, 25 bp, Mus musculus
gcctttcctgcctggtgggccaaat

SEQ ID NO: 557530 - DNA, 25 bp, Mus musculus
gcctttcctggtagctataccacca

SEQ ID NO: 557531 - DNA, 25 bp, Mus musculus
gcctttcctggttgctataccacca

SEQ ID NO: 557532 - DNA, 25 bp, Mus musculus
gcctttcctgttattgtcgtcatca

SEQ ID NO: 557533 - DNA, 25 bp, Mus musculus
gcctttcctgtttttgtcgtcatca

SEQ ID NO: 557534 - DNA, 25 bp, Mus musculus
gcctttcgtccaccttaagttaact

SEQ ID NO: 557535 - DNA, 25 bp, Mus musculus
gcctttcgtccagcttaagttaact

SEQ ID NO: 557536 - DNA, 25 bp, Mus musculus
gcctttctagagagactcatggagt

SEQ ID NO: 557537 - DNA, 25 bp, Mus musculus
gcctttctagagtgactcatggagt

SEQ ID NO: 557538 - DNA, 25 bp, Mus musculus
gcctttctagttcccagactttgag

SEQ ID NO: 557539 - DNA, 25 bp, Mus musculus
gcctttctagttgccagactttgag

SEQ ID NO: 557540 - DNA, 25 bp, Mus musculus
gcctttctatgcaggagctccttat

SEQ ID NO: 557541 - DNA, 25 bp, Mus musculus
gcctttctatgctggagctccttat

SEQ ID NO: 557542 - DNA, 25 bp, Mus musculus
gcctttctattgagttctctacact

SEQ ID NO: 557543 - DNA, 25 bp, Mus musculus
gcctttctattgtgttctctacact

SEQ ID NO: 557544 - DNA, 25 bp, Mus musculus
gcctttctcacaatcagagccataa

SEQ ID NO: 557545 - DNA, 25 bp, Mus musculus
gcctttctcacattcagagccataa

SEQ ID NO: 557546 - DNA, 25 bp, Mus musculus
gcctttctcaggcttgagcctttaa

SEQ ID NO: 557547 - DNA, 25 bp, Mus musculus
gcctttctcagggttgagcctttaa

SEQ ID NO: 557548 - DNA, 25 bp, Mus musculus
gcctttctcatcaatggctacacgt

SEQ ID NO: 557549 - DNA, 25 bp, Mus musculus
gcctttctcatctatggctacacgt

SEQ ID NO: 557550 - DNA, 25 bp, Mus musculus
gcctttctcgtacatggcgtcctgt

SEQ ID NO: 557551 - DNA, 25 bp, Mus musculus
gcctttctcgtagatggcgtcctgt

SEQ ID NO: 557552 - DNA, 25 bp, Mus musculus
gcctttctctatcctaacacatgga

SEQ ID NO: 557553 - DNA, 25 bp, Mus musculus
gcctttctctatgctaacacatgga

SEQ ID NO: 557554 - DNA, 25 bp, Mus musculus
gcctttctctgcaccagctaagtac

SEQ ID NO: 557555 - DNA, 25 bp, Mus musculus
gcctttctctgctccagctaagtac

SEQ ID NO: 557556 - DNA, 25 bp, Mus musculus
gcctttctgacccaaaattccaata

SEQ ID NO: 557557 - DNA, 25 bp, Mus musculus
gcctttctgaccgaaaattccaata

SEQ ID NO: 557558 - DNA, 25 bp, Mus musculus
gcctttctgagacctggtggtgtat

SEQ ID NO: 557559 - DNA, 25 bp, Mus musculus
gcctttctgagagctggtggtgtat

SEQ ID NO: 557560 - DNA, 25 bp, Mus musculus
gcctttctgagtagggagtaagttt

SEQ ID NO: 557561 - DNA, 25 bp, Mus musculus
gcctttctgagttgggagtaagttt

SEQ ID NO: 557562 - DNA, 25 bp, Mus musculus
gcctttctgccactactgttttctg

SEQ ID NO: 557563 - DNA, 25 bp, Mus musculus
gcctttctgccagtactgttttctg

SEQ ID NO: 557564 - DNA, 25 bp, Mus musculus
gcctttctggagcatatcctgtcat

SEQ ID NO: 557565 - DNA, 25 bp, Mus musculus
gcctttctggaggatatcctgtcat

SEQ ID NO: 557566 - DNA, 25 bp, Mus musculus
gcctttctggcaaagatgtggtgtt

SEQ ID NO: 557567 - DNA, 25 bp, Mus musculus
gcctttctggcatagatgtggtgtt

SEQ ID NO: 557568 - DNA, 25 bp, Mus musculus
gcctttctgtcaatactggtgtttt

SEQ ID NO: 557569 - DNA, 25 bp, Mus musculus
gcctttctgtcattactggtgtttt

SEQ ID NO: 557570 - DNA, 25 bp, Mus musculus
gcctttcttattcacagtcttactg

SEQ ID NO: 557571 - DNA, 25 bp, Mus musculus
gcctttcttattgacagtcttactg

SEQ ID NO: 557572 - DNA, 25 bp, Mus musculus
gcctttcttccaatccaagtttagt

SEQ ID NO: 557573 - DNA, 25 bp, Mus musculus
gcctttcttccattccaagtttagt

SEQ ID NO: 557574 - DNA, 25 bp, Mus musculus
gcctttcttgctaatggatctgata

SEQ ID NO: 557575 - DNA, 25 bp, Mus musculus
gcctttcttgcttatggatctgata

SEQ ID NO: 557576 - DNA, 25 bp, Mus musculus
gcctttcttggcctagagtcataaa

SEQ ID NO: 557577 - DNA, 25 bp, Mus musculus
gcctttcttggcgtagagtcataaa

SEQ ID NO: 557578 - DNA, 25 bp, Mus musculus
gcctttcttgttcacttcgccatag

SEQ ID NO: 557579 - DNA, 25 bp, Mus musculus
gcctttcttgttgacttcgccatag

SEQ ID NO: 557580 - DNA, 25 bp, Mus musculus
gcctttgaccccacttcatataaag

SEQ ID NO: 557581 - DNA, 25 bp, Mus musculus
gcctttgacccctcttcatataaag

SEQ ID NO: 557582 - DNA, 25 bp, Mus musculus
gcctttgacgttaattggtgcatac

SEQ ID NO: 557583 - DNA, 25 bp, Mus musculus
gcctttgacgtttattggtgcatac

SEQ ID NO: 557584 - DNA, 25 bp, Mus musculus
gcctttgagaagcatcagtactata

SEQ ID NO: 557585 - DNA, 25 bp, Mus musculus
gcctttgagaaggatcagtactata

SEQ ID NO: 557586 - DNA, 25 bp, Mus musculus
gcctttgagcatcgtacgtgcttac

SEQ ID NO: 557587 - DNA, 25 bp, Mus musculus
gcctttgagcatggtacgtgcttac

SEQ ID NO: 557588 - DNA, 25 bp, Mus musculus
gcctttgaggctctacttgcaataa

SEQ ID NO: 557589 - DNA, 25 bp, Mus musculus
gcctttgaggctgtacttgcaataa

SEQ ID NO: 557590 - DNA, 25 bp, Mus musculus
gcctttgagggccactttagctttt

SEQ ID NO: 557591 - DNA, 25 bp, Mus musculus
gcctttgagggcgactttagctttt

SEQ ID NO: 557592 - DNA, 25 bp, Mus musculus
gcctttgatataactactgcccagt

SEQ ID NO: 557593 - DNA, 25 bp, Mus musculus
gcctttgatatatctactgcccagt

SEQ ID NO: 557594 - DNA, 25 bp, Mus musculus
gcctttgatgagagttctatcaccc

SEQ ID NO: 557595 - DNA, 25 bp, Mus musculus
gcctttgatgagtgttctatcaccc

SEQ ID NO: 557596 - DNA, 25 bp, Mus musculus
gcctttgatgcaagtcagttcggtc

SEQ ID NO: 557597 - DNA, 25 bp, Mus musculus
gcctttgatgcatgtcagttcggtc

SEQ ID NO: 557598 - DNA, 25 bp, Mus musculus
gcctttgcacgtaaaagatatcttc

SEQ ID NO: 557599 - DNA, 25 bp, Mus musculus
gcctttgcacgttaaagatatcttc

SEQ ID NO: 557600 - DNA, 25 bp, Mus musculus
gcctttgccaagctggaaaccacca

SEQ ID NO: 557601 - DNA, 25 bp, Mus musculus
gcctttgccaaggtggaaaccacca

SEQ ID NO: 557602 - DNA, 25 bp, Mus musculus
gcctttgccatgaatcggccgtagt

SEQ ID NO: 557603 - DNA, 25 bp, Mus musculus
gcctttgccatgtatcggccgtagt

SEQ ID NO: 557604 - DNA, 25 bp, Mus musculus
gcctttgccattagacatgctaagc

SEQ ID NO: 557605 - DNA, 25 bp, Mus musculus
gcctttgccatttgacatgctaagc

SEQ ID NO: 557606 - DNA, 25 bp, Mus musculus
gcctttgcccaaagtagggactggc

SEQ ID NO: 557607 - DNA, 25 bp, Mus musculus
gcctttgcccaatgtagggactggc

SEQ ID NO: 557608 - DNA, 25 bp, Mus musculus
gcctttgcccagctttacagagaaa

SEQ ID NO: 557609 - DNA, 25 bp, Mus musculus
gcctttgcccaggtttacagagaaa

SEQ ID NO: 557610 - DNA, 25 bp, Mus musculus
gcctttgcctccaatataccaagat

SEQ ID NO: 557611 - DNA, 25 bp, Mus musculus
gcctttgcctcctatataccaagat

SEQ ID NO: 557612 - DNA, 25 bp, Mus musculus
gcctttgcggatcacctcattttga

SEQ ID NO: 557613 - DNA, 25 bp, Mus musculus
gcctttgcggatgacctcattttga

SEQ ID NO: 557614 - DNA, 25 bp, Mus musculus
gcctttgcgtgcaaaagtaaccttt

SEQ ID NO: 557615 - DNA, 25 bp, Mus musculus
gcctttgcgtgctaaagtaaccttt

SEQ ID NO: 557616 - DNA, 25 bp, Mus musculus
gcctttgctcacctgctctgttagg

SEQ ID NO: 557617 - DNA, 25 bp, Mus musculus
gcctttgctcacgtgctctgttagg

SEQ ID NO: 557618 - DNA, 25 bp, Mus musculus
gcctttgcttcaacctatctttgaa

SEQ ID NO: 557619 - DNA, 25 bp, Mus musculus
gcctttgcttcatcctatctttgaa

SEQ ID NO: 557620 - DNA, 25 bp, Mus musculus
gcctttgctttgctgcatggttact

SEQ ID NO: 557621 - DNA, 25 bp, Mus musculus
gcctttgctttggtgcatggttact

SEQ ID NO: 557622 - DNA, 25 bp, Mus musculus
gcctttgcttttatatccttttcag

SEQ ID NO: 557623 - DNA, 25 bp, Mus musculus
gcctttgcttttcctcggttggagc

SEQ ID NO: 557624 - DNA, 25 bp, Mus musculus
gcctttgcttttgctcggttggagc

SEQ ID NO: 557625 - DNA, 25 bp, Mus musculus
gcctttgcttttttatccttttcag

SEQ ID NO: 557626 - DNA, 25 bp, Mus musculus
gcctttggactaattttccactagt

SEQ ID NO: 557627 - DNA, 25 bp, Mus musculus
gcctttggactatttttccactagt

SEQ ID NO: 557628 - DNA, 25 bp, Mus musculus
gcctttggagctatgcatataatgc

SEQ ID NO: 557629 - DNA, 25 bp, Mus musculus
gcctttggagctttgcatataatgc

SEQ ID NO: 557630 - DNA, 25 bp, Mus musculus
gcctttggaggaccatggtaccatg

SEQ ID NO: 557631 - DNA, 25 bp, Mus musculus
gcctttggaggagcatggtaccatg

SEQ ID NO: 557632 - DNA, 25 bp, Mus musculus
gcctttggatcgacacagtgcagac

SEQ ID NO: 557633 - DNA, 25 bp, Mus musculus
gcctttggatcgtcacagtgcagac

SEQ ID NO: 557634 - DNA, 25 bp, Mus musculus
gcctttggcacaacctgaagatatg

SEQ ID NO: 557635 - DNA, 25 bp, Mus musculus
gcctttggcacatcctgaagatatg

SEQ ID NO: 557636 - DNA, 25 bp, Mus musculus
gcctttggcctgatgctgagatgta

SEQ ID NO: 557637 - DNA, 25 bp, Mus musculus
gcctttggcctgttgctgagatgta

SEQ ID NO: 557638 - DNA, 25 bp, Mus musculus
gcctttggctgtagtcccagtttcc

SEQ ID NO: 557639 - DNA, 25 bp, Mus musculus
gcctttggctgttgtcccagtttcc

SEQ ID NO: 557640 - DNA, 25 bp, Mus musculus
gcctttgggaagactgtatctgtaa

SEQ ID NO: 557641 - DNA, 25 bp, Mus musculus
gcctttgggaagtctgtatctgtaa

SEQ ID NO: 557642 - DNA, 25 bp, Mus musculus
gcctttgggacgaagcttactttat

SEQ ID NO: 557643 - DNA, 25 bp, Mus musculus
gcctttgggacgtagcttactttat

SEQ ID NO: 557644 - DNA, 25 bp, Mus musculus
gcctttggtcccagagcccgtgtca

SEQ ID NO: 557645 - DNA, 25 bp, Mus musculus
gcctttggtccctgagcccgtgtca

SEQ ID NO: 557646 - DNA, 25 bp, Mus musculus
gcctttggttacagtacctttgcct

SEQ ID NO: 557647 - DNA, 25 bp, Mus musculus
gcctttggttactgtacctttgcct

SEQ ID NO: 557648 - DNA, 25 bp, Mus musculus
gcctttggttatctctagtagctgt

SEQ ID NO: 557649 - DNA, 25 bp, Mus musculus
gcctttggttatgtctagtagctgt

SEQ ID NO: 557650 - DNA, 25 bp, Mus musculus
gcctttggttccatgttgcttggat

SEQ ID NO: 557651 - DNA, 25 bp, Mus musculus
gcctttggttccttgttgcttggat

SEQ ID NO: 557652 - DNA, 25 bp, Mus musculus
gcctttgtagcacggctcagtgatg

SEQ ID NO: 557653 - DNA, 25 bp, Mus musculus
gcctttgtagcagggctcagtgatg

SEQ ID NO: 557654 - DNA, 25 bp, Mus musculus
gcctttgtattaaagatgcacaggt

SEQ ID NO: 557655 - DNA, 25 bp, Mus musculus
gcctttgtattatagatgcacaggt

SEQ ID NO: 557656 - DNA, 25 bp, Mus musculus
gcctttgtcaacaacattttctttg

SEQ ID NO: 557657 - DNA, 25 bp, Mus musculus
gcctttgtcaaccagtaccgagacg

SEQ ID NO: 557658 - DNA, 25 bp, Mus musculus
gcctttgtcaacgagtaccgagacg

SEQ ID NO: 557659 - DNA, 25 bp, Mus musculus
gcctttgtcaactacattttctttg

SEQ ID NO: 557660 - DNA, 25 bp, Mus musculus
gcctttgtcactagtcccaacgaaa

SEQ ID NO: 557661 - DNA, 25 bp, Mus musculus
gcctttgtcacttgtcccaacgaaa

SEQ ID NO: 557662 - DNA, 25 bp, Mus musculus
gcctttgtcagtccatttgtcagta

SEQ ID NO: 557663 - DNA, 25 bp, Mus musculus
gcctttgtcagtgcatttgtcagta

SEQ ID NO: 557664 - DNA, 25 bp, Mus musculus
gcctttgtccatctttcagagtgca

SEQ ID NO: 557665 - DNA, 25 bp, Mus musculus
gcctttgtccatgtttcagagtgca

SEQ ID NO: 557666 - DNA, 25 bp, Mus musculus
gcctttgtccttccaagttgatatt

SEQ ID NO: 557667 - DNA, 25 bp, Mus musculus
gcctttgtccttgcaagttgatatt

SEQ ID NO: 557668 - DNA, 25 bp, Mus musculus
gcctttgtctctccagggctagaat

SEQ ID NO: 557669 - DNA, 25 bp, Mus musculus
gcctttgtctctgcagggctagaat

SEQ ID NO: 557670 - DNA, 25 bp, Mus musculus
gcctttgtgaaacgcatgttcttgg

SEQ ID NO: 557671 - DNA, 25 bp, Mus musculus
gcctttgtgaaaggcatgttcttgg

SEQ ID NO: 557672 - DNA, 25 bp, Mus musculus
gcctttgtgagtatccttgctgtag

SEQ ID NO: 557673 - DNA, 25 bp, Mus musculus
gcctttgtgagtttccttgctgtag

SEQ ID NO: 557674 - DNA, 25 bp, Mus musculus
gcctttgtgcccagtaattactagt

SEQ ID NO: 557675 - DNA, 25 bp, Mus musculus
gcctttgtgcccatttccattggaa

SEQ ID NO: 557676 - DNA, 25 bp, Mus musculus
gcctttgtgccctgtaattactagt

SEQ ID NO: 557677 - DNA, 25 bp, Mus musculus
gcctttgtgcccttttccattggaa

SEQ ID NO: 557678 - DNA, 25 bp, Mus musculus
gcctttgtggatcctgtacacaaac

SEQ ID NO: 557679 - DNA, 25 bp, Mus musculus
gcctttgtggatgctgtacacaaac

SEQ ID NO: 557680 - DNA, 25 bp, Mus musculus
gcctttgtgggcagagctaatccaa

SEQ ID NO: 557681 - DNA, 25 bp, Mus musculus
gcctttgtgggctgagctaatccaa

SEQ ID NO: 557682 - DNA, 25 bp, Mus musculus
gcctttgtgggtcgaaatctgtctc

SEQ ID NO: 557683 - DNA, 25 bp, Mus musculus
gcctttgtgggtggaaatctgtctc

SEQ ID NO: 557684 - DNA, 25 bp, Mus musculus
gcctttgtgtgtacttaggtcacat

SEQ ID NO: 557685 - DNA, 25 bp, Mus musculus
gcctttgtgtgttcttaggtcacat

SEQ ID NO: 557686 - DNA, 25 bp, Mus musculus
gcctttgtgttcatttgttctcaga

SEQ ID NO: 557687 - DNA, 25 bp, Mus musculus
gcctttgtgttcttttgttctcaga

SEQ ID NO: 557688 - DNA, 25 bp, Mus musculus
gcctttgttactcttgtgcctggaa

SEQ ID NO: 557689 - DNA, 25 bp, Mus musculus
gcctttgttactgttgtgcctggaa

SEQ ID NO: 557690 - DNA, 25 bp, Mus musculus
gcctttgttagcatgctatgttgct

SEQ ID NO: 557691 - DNA, 25 bp, Mus musculus
gcctttgttagcttgctatgttgct

SEQ ID NO: 557692 - DNA, 25 bp, Mus musculus
gcctttgttatcagttgtttctgta

SEQ ID NO: 557693 - DNA, 25 bp, Mus musculus
gcctttgttatctgttgtttctgta

SEQ ID NO: 557694 - DNA, 25 bp, Mus musculus
gcctttgttcaaatgtcttctatca

SEQ ID NO: 557695 - DNA, 25 bp, Mus musculus
gcctttgttcaattgtcttctatca

SEQ ID NO: 557696 - DNA, 25 bp, Mus musculus
gcctttgttcccagtcctagagaga

SEQ ID NO: 557697 - DNA, 25 bp, Mus musculus
gcctttgttccctgtcctagagaga

SEQ ID NO: 557698 - DNA, 25 bp, Mus musculus
gcctttgttggacagtatgagtttt

SEQ ID NO: 557699 - DNA, 25 bp, Mus musculus
gcctttgttggagagtatgagtttt

SEQ ID NO: 557700 - DNA, 25 bp, Mus musculus
gcctttgttggccacggagtaatgt

SEQ ID NO: 557701 - DNA, 25 bp, Mus musculus
gcctttgttggcgacggagtaatgt

SEQ ID NO: 557702 - DNA, 25 bp, Mus musculus
gcctttgtttaaaaccctctgtgag

SEQ ID NO: 557703 - DNA, 25 bp, Mus musculus
gcctttgtttaataccctctgtgag

SEQ ID NO: 557704 - DNA, 25 bp, Mus musculus
gcctttgtttatccaagagcctgag

SEQ ID NO: 557705 - DNA, 25 bp, Mus musculus
gcctttgtttatgcaagagcctgag

SEQ ID NO: 557706 - DNA, 25 bp, Mus musculus
gccttttaaagcagatcccttcact

SEQ ID NO: 557707 - DNA, 25 bp, Mus musculus
gccttttaaagctgatcccttcact

SEQ ID NO: 557708 - DNA, 25 bp, Mus musculus
gccttttaaattctggagaccctgt

SEQ ID NO: 557709 - DNA, 25 bp, Mus musculus
gccttttaaattgtggagaccctgt

SEQ ID NO: 557710 - DNA, 25 bp, Mus musculus
gccttttaccacaagagacttctct

SEQ ID NO: 557711 - DNA, 25 bp, Mus musculus
gccttttaccactagagacttctct

SEQ ID NO: 557712 - DNA, 25 bp, Mus musculus
gccttttattgcattaactctacat

SEQ ID NO: 557713 - DNA, 25 bp, Mus musculus
gccttttattgctttaactctacat

SEQ ID NO: 557714 - DNA, 25 bp, Mus musculus
gccttttcaaagacaacgacgactt

SEQ ID NO: 557715 - DNA, 25 bp, Mus musculus
gccttttcaaagtcaacgacgactt

SEQ ID NO: 557716 - DNA, 25 bp, Mus musculus
gccttttcaaccctgagatggatgg

SEQ ID NO: 557717 - DNA, 25 bp, Mus musculus
gccttttcaaccgtgagatggatgg

SEQ ID NO: 557718 - DNA, 25 bp, Mus musculus
gccttttcacttcgtgttgcgtaca

SEQ ID NO: 557719 - DNA, 25 bp, Mus musculus
gccttttcacttggtgttgcgtaca

SEQ ID NO: 557720 - DNA, 25 bp, Mus musculus
gccttttcagagagccagctcctgg

SEQ ID NO: 557721 - DNA, 25 bp, Mus musculus
gccttttcagagtgccagctcctgg

SEQ ID NO: 557722 - DNA, 25 bp, Mus musculus
gccttttcagccacttaactgagta

SEQ ID NO: 557723 - DNA, 25 bp, Mus musculus
gccttttcagcctcttaactgagta

SEQ ID NO: 557724 - DNA, 25 bp, Mus musculus
gccttttcagctctcatcctgaaga

SEQ ID NO: 557725 - DNA, 25 bp, Mus musculus
gccttttcagctgtcatcctgaaga

SEQ ID NO: 557726 - DNA, 25 bp, Mus musculus
gccttttcatatatcaagtccgctc

SEQ ID NO: 557727 - DNA, 25 bp, Mus musculus
gccttttcatatttcaagtccgctc

SEQ ID NO: 557728 - DNA, 25 bp, Mus musculus
gccttttcattcaagctgcacacaa

SEQ ID NO: 557729 - DNA, 25 bp, Mus musculus
gccttttcattctagctgcacacaa

SEQ ID NO: 557730 - DNA, 25 bp, Mus musculus
gccttttcctcaatgtgttatactt

SEQ ID NO: 557731 - DNA, 25 bp, Mus musculus
gccttttcctcattgtgttatactt

SEQ ID NO: 557732 - DNA, 25 bp, Mus musculus
gccttttcctccctagtattggcaa

SEQ ID NO: 557733 - DNA, 25 bp, Mus musculus
gccttttcctccgtagtattggcaa

SEQ ID NO: 557734 - DNA, 25 bp, Mus musculus
gccttttcctggatctcagatctag

SEQ ID NO: 557735 - DNA, 25 bp, Mus musculus
gccttttcctggttctcagatctag

SEQ ID NO: 557736 - DNA, 25 bp, Mus musculus
gccttttccttcagtgatgtcactt

SEQ ID NO: 557737 - DNA, 25 bp, Mus musculus
gccttttccttctgtgatgtcactt

SEQ ID NO: 557738 - DNA, 25 bp, Mus musculus
gccttttcgcttccagggagcttaa

SEQ ID NO: 557739 - DNA, 25 bp, Mus musculus
gccttttcgcttgcagggagcttaa

SEQ ID NO: 557740 - DNA, 25 bp, Mus musculus
gccttttcggttattaccatcatct

SEQ ID NO: 557741 - DNA, 25 bp, Mus musculus
gccttttcggtttttaccatcatct

SEQ ID NO: 557742 - DNA, 25 bp, Mus musculus
gccttttctacaatgggtggagctt

SEQ ID NO: 557743 - DNA, 25 bp, Mus musculus
gccttttctacattgggtggagctt

SEQ ID NO: 557744 - DNA, 25 bp, Mus musculus
gccttttctagaaagtggtagtacc

SEQ ID NO: 557745 - DNA, 25 bp, Mus musculus
gccttttctagatagtggtagtacc

SEQ ID NO: 557746 - DNA, 25 bp, Mus musculus
gccttttctcaacatagcacctgga

SEQ ID NO: 557747 - DNA, 25 bp, Mus musculus
gccttttctcaagatagcacctgga

SEQ ID NO: 557748 - DNA, 25 bp, Mus musculus
gccttttctcagaaatccagcatgg

SEQ ID NO: 557749 - DNA, 25 bp, Mus musculus
gccttttctcagtaatccagcatgg

SEQ ID NO: 557750 - DNA, 25 bp, Mus musculus
gccttttctgaaccctgagaggttc

SEQ ID NO: 557751 - DNA, 25 bp, Mus musculus
gccttttctgaagcctgagaggttc

SEQ ID NO: 557752 - DNA, 25 bp, Mus musculus
gccttttctgacctccgactaggga

SEQ ID NO: 557753 - DNA, 25 bp, Mus musculus
gccttttctgacgtccgactaggga

SEQ ID NO: 557754 - DNA, 25 bp, Mus musculus
gccttttctgtcattgaatagtcca

SEQ ID NO: 557755 - DNA, 25 bp, Mus musculus
gccttttctgtctttgaatagtcca

SEQ ID NO: 557756 - DNA, 25 bp, Mus musculus
gccttttcttatctatgctttcttg

SEQ ID NO: 557757 - DNA, 25 bp, Mus musculus
gccttttcttatgtatgctttcttg

SEQ ID NO: 557758 - DNA, 25 bp, Mus musculus
gccttttcttgccatgcatattcgt

SEQ ID NO: 557759 - DNA, 25 bp, Mus musculus
gccttttcttgcgatgcatattcgt

SEQ ID NO: 557760 - DNA, 25 bp, Mus musculus
gccttttgacatccctatgggaact

SEQ ID NO: 557761 - DNA, 25 bp, Mus musculus
gccttttgacatgcctatgggaact

SEQ ID NO: 557762 - DNA, 25 bp, Mus musculus
gccttttgacccctgttgatgaaga

SEQ ID NO: 557763 - DNA, 25 bp, Mus musculus
gccttttgacccgtgttgatgaaga

SEQ ID NO: 557764 - DNA, 25 bp, Mus musculus
gccttttgagccataagtgtgctta

SEQ ID NO: 557765 - DNA, 25 bp, Mus musculus
gccttttgagccttaagtgtgctta

SEQ ID NO: 557766 - DNA, 25 bp, Mus musculus
gccttttgagtaccatccggcaaca

SEQ ID NO: 557767 - DNA, 25 bp, Mus musculus
gccttttgagtagcatccggcaaca

SEQ ID NO: 557768 - DNA, 25 bp, Mus musculus
gccttttgcacaccggttttgagag

SEQ ID NO: 557769 - DNA, 25 bp, Mus musculus
gccttttgcacagcggttttgagag

SEQ ID NO: 557770 - DNA, 25 bp, Mus musculus
gccttttgccaaccatctttcgacc

SEQ ID NO: 557771 - DNA, 25 bp, Mus musculus
gccttttgccaagcatctttcgacc

SEQ ID NO: 557772 - DNA, 25 bp, Mus musculus
gccttttgcctgaagcagctcaaca

SEQ ID NO: 557773 - DNA, 25 bp, Mus musculus
gccttttgcctgtagcagctcaaca

SEQ ID NO: 557774 - DNA, 25 bp, Mus musculus
gccttttggaatcactccctgaaaa

SEQ ID NO: 557775 - DNA, 25 bp, Mus musculus
gccttttggaatgactccctgaaaa

SEQ ID NO: 557776 - DNA, 25 bp, Mus musculus
gccttttggccaatacatctggtag

SEQ ID NO: 557777 - DNA, 25 bp, Mus musculus
gccttttggccattacatctggtag

SEQ ID NO: 557778 - DNA, 25 bp, Mus musculus
gccttttgggttagggctcagcaca

SEQ ID NO: 557779 - DNA, 25 bp, Mus musculus
gccttttgggtttgggctcagcaca

SEQ ID NO: 557780 - DNA, 25 bp, Mus musculus
gccttttgtccccttcttcaaaatg

SEQ ID NO: 557781 - DNA, 25 bp, Mus musculus
gccttttgtcccgttcttcaaaatg

SEQ ID NO: 557782 - DNA, 25 bp, Mus musculus
gccttttgtgctattttactgtttt

SEQ ID NO: 557783 - DNA, 25 bp, Mus musculus
gccttttgtgcttttttactgtttt

SEQ ID NO: 557784 - DNA, 25 bp, Mus musculus
gccttttgtggactttcctttctat

SEQ ID NO: 557785 - DNA, 25 bp, Mus musculus
gccttttgtggagtttcctttctat

SEQ ID NO: 557786 - DNA, 25 bp, Mus musculus
gccttttgtgtacgaccaatcggca

SEQ ID NO: 557787 - DNA, 25 bp, Mus musculus
gccttttgtgtaggaccaatcggca

SEQ ID NO: 557788 - DNA, 25 bp, Mus musculus
gccttttgttcaaacattcctcact

SEQ ID NO: 557789 - DNA, 25 bp, Mus musculus
gccttttgttcatacattcctcact

SEQ ID NO: 557790 - DNA, 25 bp, Mus musculus
gcctttttacatagccaccaggatg

SEQ ID NO: 557791 - DNA, 25 bp, Mus musculus
gcctttttacattgccaccaggatg

SEQ ID NO: 557792 - DNA, 25 bp, Mus musculus
gcctttttagcaactgtcgttgacc

SEQ ID NO: 557793 - DNA, 25 bp, Mus musculus
gcctttttagcatctgtcgttgacc

SEQ ID NO: 557794 - DNA, 25 bp, Mus musculus
gcctttttagctagtgactctgttg

SEQ ID NO: 557795 - DNA, 25 bp, Mus musculus
gcctttttagcttgtgactctgttg

SEQ ID NO: 557796 - DNA, 25 bp, Mus musculus
gcctttttaggtcgcatcactgcta

SEQ ID NO: 557797 - DNA, 25 bp, Mus musculus
gcctttttaggtggcatcactgcta

SEQ ID NO: 557798 - DNA, 25 bp, Mus musculus
gcctttttcacgaggcttcgagaag

SEQ ID NO: 557799 - DNA, 25 bp, Mus musculus
gcctttttcacgtggcttcgagaag

SEQ ID NO: 557800 - DNA, 25 bp, Mus musculus
gcctttttcgacctgtgtagtcaca

SEQ ID NO: 557801 - DNA, 25 bp, Mus musculus
gcctttttcgacgtgtgtagtcaca

SEQ ID NO: 557802 - DNA, 25 bp, Mus musculus
gcctttttctccatcaagtttcagt

SEQ ID NO: 557803 - DNA, 25 bp, Mus musculus
gcctttttctccttcaagtttcagt

SEQ ID NO: 557804 - DNA, 25 bp, Mus musculus
gcctttttgactcacatctcgggaa

SEQ ID NO: 557805 - DNA, 25 bp, Mus musculus
gcctttttgactgacatctcgggaa

SEQ ID NO: 557806 - DNA, 25 bp, Mus musculus
gcctttttgctgcattcattggtct

SEQ ID NO: 557807 - DNA, 25 bp, Mus musculus
gcctttttgctggattcattggtct

SEQ ID NO: 557808 - DNA, 25 bp, Mus musculus
gcctttttggaacttgttgtaattg

SEQ ID NO: 557809 - DNA, 25 bp, Mus musculus
gcctttttggaagttgttgtaattg

SEQ ID NO: 557810 - DNA, 25 bp, Mus musculus
gcctttttggatccctgaaacaaca

SEQ ID NO: 557811 - DNA, 25 bp, Mus musculus
gcctttttggatgcctgaaacaaca

SEQ ID NO: 557812 - DNA, 25 bp, Mus musculus
gcctttttgtctcaatcttccaata

SEQ ID NO: 557813 - DNA, 25 bp, Mus musculus
gcctttttgtctgaatcttccaata

SEQ ID NO: 557814 - DNA, 25 bp, Mus musculus
gccttttttcccctataatattctg

SEQ ID NO: 557815 - DNA, 25 bp, Mus musculus
gccttttttcccgtataatattctg

SEQ ID NO: 557816 - DNA, 25 bp, Mus musculus
gcgaaaaccaaactgcataagctta

SEQ ID NO: 557817 - DNA, 25 bp, Mus musculus
gcgaaaaccaaagtgcataagctta

SEQ ID NO: 557818 - DNA, 25 bp, Mus musculus
gcgaaaatatccagccaagcagcaa

SEQ ID NO: 557819 - DNA, 25 bp, Mus musculus
gcgaaaatatcctgccaagcagcaa

SEQ ID NO: 557820 - DNA, 25 bp, Mus musculus
gcgaaaccgaaaactcttttgctat

SEQ ID NO: 557821 - DNA, 25 bp, Mus musculus
gcgaaaccgaaatctcttttgctat

SEQ ID NO: 557822 - DNA, 25 bp, Mus musculus
gcgaaacgtcagagccttggcatag

SEQ ID NO: 557823 - DNA, 25 bp, Mus musculus
gcgaaacgtcagtgccttggcatag

SEQ ID NO: 557824 - DNA, 25 bp, Mus musculus
gcgaaactgcctattctgctattta

SEQ ID NO: 557825 - DNA, 25 bp, Mus musculus
gcgaaactgccttttctgctattta

SEQ ID NO: 557826 - DNA, 25 bp, Mus musculus
gcgaaagagtttcgtggcattgtta

SEQ ID NO: 557827 - DNA, 25 bp, Mus musculus
gcgaaagagtttggtggcattgtta

SEQ ID NO: 557828 - DNA, 25 bp, Mus musculus
gcgaaagatcttcagtgtgcttgaa

SEQ ID NO: 557829 - DNA, 25 bp, Mus musculus
gcgaaagatcttgagtgtgcttgaa

SEQ ID NO: 557830 - DNA, 25 bp, Mus musculus
gcgaaagccccaagagactgaaggt

SEQ ID NO: 557831 - DNA, 25 bp, Mus musculus
gcgaaagccccatgagactgaaggt

SEQ ID NO: 557832 - DNA, 25 bp, Mus musculus
gcgaaagccccgatcttccgaggag

SEQ ID NO: 557833 - DNA, 25 bp, Mus musculus
gcgaaagccccgttcttccgaggag

SEQ ID NO: 557834 - DNA, 25 bp, Mus musculus
gcgaaagctacacggatctcataca

SEQ ID NO: 557835 - DNA, 25 bp, Mus musculus
gcgaaagctacagggatctcataca

SEQ ID NO: 557836 - DNA, 25 bp, Mus musculus
gcgaaagctgcaccggccaaacagg

SEQ ID NO: 557837 - DNA, 25 bp, Mus musculus
gcgaaagctgcagcggccaaacagg

SEQ ID NO: 557838 - DNA, 25 bp, Mus musculus
gcgaaagtagctcttgtgcttgtaa

SEQ ID NO: 557839 - DNA, 25 bp, Mus musculus
gcgaaagtagctgttgtgcttgtaa

SEQ ID NO: 557840 - DNA, 25 bp, Mus musculus
gcgaaagtatacagcatgcctagta

SEQ ID NO: 557841 - DNA, 25 bp, Mus musculus
gcgaaagtatactgcatgcctagta

SEQ ID NO: 557842 - DNA, 25 bp, Mus musculus
gcgaaagtcagacctgttccaggat

SEQ ID NO: 557843 - DNA, 25 bp, Mus musculus
gcgaaagtcagagctgttccaggat

SEQ ID NO: 557844 - DNA, 25 bp, Mus musculus
gcgaaagtgcatacagtccatcctg

SEQ ID NO: 557845 - DNA, 25 bp, Mus musculus
gcgaaagtgcattcagtccatcctg

SEQ ID NO: 557846 - DNA, 25 bp, Mus musculus
gcgaaagtgttccttctgttcatgt

SEQ ID NO: 557847 - DNA, 25 bp, Mus musculus
gcgaaagtgttcgttctgttcatgt

SEQ ID NO: 557848 - DNA, 25 bp, Mus musculus
gcgaaataggcacatttcctgtggc

SEQ ID NO: 557849 - DNA, 25 bp, Mus musculus
gcgaaataggcagatttcctgtggc

SEQ ID NO: 557850 - DNA, 25 bp, Mus musculus
gcgaaatcccaaatcacacacttga

SEQ ID NO: 557851 - DNA, 25 bp, Mus musculus
gcgaaatcccaattcacacacttga

SEQ ID NO: 557852 - DNA, 25 bp, Mus musculus
gcgaaattccgcatgggctccagga

SEQ ID NO: 557853 - DNA, 25 bp, Mus musculus
gcgaaattccgcttgggctccagga

SEQ ID NO: 557854 - DNA, 25 bp, Mus musculus
gcgaacaactgtattcttcagatgt

SEQ ID NO: 557855 - DNA, 25 bp, Mus musculus
gcgaacaactgttttcttcagatgt

SEQ ID NO: 557856 - DNA, 25 bp, Mus musculus
gcgaacacagttcctaatggcatat

SEQ ID NO: 557857 - DNA, 25 bp, Mus musculus
gcgaacacagttgctaatggcatat

SEQ ID NO: 557858 - DNA, 25 bp, Mus musculus
gcgaacacatctctcacgtggagaa

SEQ ID NO: 557859 - DNA, 25 bp, Mus musculus
gcgaacacatctgtcacgtggagaa

SEQ ID NO: 557860 - DNA, 25 bp, Mus musculus
gcgaacaggacaagcgcttcatcta

SEQ ID NO: 557861 - DNA, 25 bp, Mus musculus
gcgaacaggacatgcgcttcatcta

SEQ ID NO: 557862 - DNA, 25 bp, Mus musculus
gcgaacctactcagggctatttgct

SEQ ID NO: 557863 - DNA, 25 bp, Mus musculus
gcgaacctactctgggctatttgct

SEQ ID NO: 557864 - DNA, 25 bp, Mus musculus
gcgaacctggcgagtcctggtctgc

SEQ ID NO: 557865 - DNA, 25 bp, Mus musculus
gcgaacctggcgtgtcctggtctgc

SEQ ID NO: 557866 - DNA, 25 bp, Mus musculus
gcgaacctttcgagactgctcaaac

SEQ ID NO: 557867 - DNA, 25 bp, Mus musculus
gcgaacctttcgtgactgctcaaac

SEQ ID NO: 557868 - DNA, 25 bp, Mus musculus
gcgaacgacgaacaaccctgagata

SEQ ID NO: 557869 - DNA, 25 bp, Mus musculus
gcgaacgacgaagaaccctgagata

SEQ ID NO: 557870 - DNA, 25 bp, Mus musculus
gcgaacggcgtcaggcgctaccagt

SEQ ID NO: 557871 - DNA, 25 bp, Mus musculus
gcgaacggcgtctggcgctaccagt

SEQ ID NO: 557872 - DNA, 25 bp, Mus musculus
gcgaacgtgacaaccgcagactgat

SEQ ID NO: 557873 - DNA, 25 bp, Mus musculus
gcgaacgtgacatccgcagactgat

SEQ ID NO: 557874 - DNA, 25 bp, Mus musculus
gcgaactcggatatgacccatggaa

SEQ ID NO: 557875 - DNA, 25 bp, Mus musculus
gcgaactcggatttgacccatggaa

SEQ ID NO: 557876 - DNA, 25 bp, Mus musculus
gcgaactctacaatgttgactccta

SEQ ID NO: 557877 - DNA, 25 bp, Mus musculus
gcgaactctacattgttgactccta

SEQ ID NO: 557878 - DNA, 25 bp, Mus musculus
gcgaactctgtaattgactagggaa

SEQ ID NO: 557879 - DNA, 25 bp, Mus musculus
gcgaactctgtatttgactagggaa

SEQ ID NO: 557880 - DNA, 25 bp, Mus musculus
gcgaactgagatagccgcggtattc

SEQ ID NO: 557881 - DNA, 25 bp, Mus musculus
gcgaactgagattgccgcggtattc

SEQ ID NO: 557882 - DNA, 25 bp, Mus musculus
gcgaactggttgattactgattttt

SEQ ID NO: 557883 - DNA, 25 bp, Mus musculus
gcgaactggttgtttactgattttt

SEQ ID NO: 557884 - DNA, 25 bp, Mus musculus
gcgaacttaccaagtctctgcagga

SEQ ID NO: 557885 - DNA, 25 bp, Mus musculus
gcgaacttaccatgtctctgcagga

SEQ ID NO: 557886 - DNA, 25 bp, Mus musculus
gcgaacttgaacagcatcatccacc

SEQ ID NO: 557887 - DNA, 25 bp, Mus musculus
gcgaacttgaactgcatcatccacc

SEQ ID NO: 557888 - DNA, 25 bp, Mus musculus
gcgaacttgcaactcctttcatttt

SEQ ID NO: 557889 - DNA, 25 bp, Mus musculus
gcgaacttgcaagtcctttcatttt

SEQ ID NO: 557890 - DNA, 25 bp, Mus musculus
gcgaagacaaggataccccactgct

SEQ ID NO: 557891 - DNA, 25 bp, Mus musculus
gcgaagacaaggttaccccactgct

SEQ ID NO: 557892 - DNA, 25 bp, Mus musculus
gcgaagacctgcacagagcataaac

SEQ ID NO: 557893 - DNA, 25 bp, Mus musculus
gcgaagacctgctcagagcataaac

SEQ ID NO: 557894 - DNA, 25 bp, Mus musculus
gcgaagactaggaaatagactcatt

SEQ ID NO: 557895 - DNA, 25 bp, Mus musculus
gcgaagactaggtaatagactcatt

SEQ ID NO: 557896 - DNA, 25 bp, Mus musculus
gcgaagagagctcgtcctcagatga

SEQ ID NO: 557897 - DNA, 25 bp, Mus musculus
gcgaagagagctggtcctcagatga

SEQ ID NO: 557898 - DNA, 25 bp, Mus musculus
gcgaagagtcaaatccatcccaggc

SEQ ID NO: 557899 - DNA, 25 bp, Mus musculus
gcgaagagtcaattccatcccaggc

SEQ ID NO: 557900 - DNA, 25 bp, Mus musculus
gcgaagcagaacaccttcttcaaga

SEQ ID NO: 557901 - DNA, 25 bp, Mus musculus
gcgaagcagaactccttcttcaaga

SEQ ID NO: 557902 - DNA, 25 bp, Mus musculus
gcgaagcattctagagttaatgtct

SEQ ID NO: 557903 - DNA, 25 bp, Mus musculus
gcgaagcattcttgagttaatgtct

SEQ ID NO: 557904 - DNA, 25 bp, Mus musculus
gcgaagccccttcaatgttgtagaa

SEQ ID NO: 557905 - DNA, 25 bp, Mus musculus
gcgaagccccttgaatgttgtagaa

SEQ ID NO: 557906 - DNA, 25 bp, Mus musculus
gcgaaggacccaaaagtatctcaag

SEQ ID NO: 557907 - DNA, 25 bp, Mus musculus
gcgaaggacccataagtatctcaag

SEQ ID NO: 557908 - DNA, 25 bp, Mus musculus
gcgaaggagaataaggagacgaatc

SEQ ID NO: 557909 - DNA, 25 bp, Mus musculus
gcgaaggagaattaggagacgaatc

SEQ ID NO: 557910 - DNA, 25 bp, Mus musculus
gcgaaggatctgaagccggccgttc

SEQ ID NO: 557911 - DNA, 25 bp, Mus musculus
gcgaaggatctgtagccggccgttc

SEQ ID NO: 557912 - DNA, 25 bp, Mus musculus
gcgaaggcctctaaccccaagtggg

SEQ ID NO: 557913 - DNA, 25 bp, Mus musculus
gcgaaggcctcttaccccaagtggg

SEQ ID NO: 557914 - DNA, 25 bp, Mus musculus
gcgaagggaggtacttagagctatt

SEQ ID NO: 557915 - DNA, 25 bp, Mus musculus
gcgaagggaggttcttagagctatt

SEQ ID NO: 557916 - DNA, 25 bp, Mus musculus
gcgaagggcatgacctcaggctcca

SEQ ID NO: 557917 - DNA, 25 bp, Mus musculus
gcgaagggcatgtcctcaggctcca

SEQ ID NO: 557918 - DNA, 25 bp, Mus musculus
gcgaaggtttttaactcctcacatt

SEQ ID NO: 557919 - DNA, 25 bp, Mus musculus
gcgaaggttttttactcctcacatt

SEQ ID NO: 557920 - DNA, 25 bp, Mus musculus
gcgaagtcccagctttacaagccat

SEQ ID NO: 557921 - DNA, 25 bp, Mus musculus
gcgaagtcccaggtttacaagccat

SEQ ID NO: 557922 - DNA, 25 bp, Mus musculus
gcgaagtccgcgagacgagccgaac

SEQ ID NO: 557923 - DNA, 25 bp, Mus musculus
gcgaagtccgcgtgacgagccgaac

SEQ ID NO: 557924 - DNA, 25 bp, Mus musculus
gcgaagtgcctccattagtgagctc

SEQ ID NO: 557925 - DNA, 25 bp, Mus musculus
gcgaagtgcctcgattagtgagctc

SEQ ID NO: 557926 - DNA, 25 bp, Mus musculus
gcgaagtggttcatgccgcccaaga

SEQ ID NO: 557927 - DNA, 25 bp, Mus musculus
gcgaagtggttcttgccgcccaaga

SEQ ID NO: 557928 - DNA, 25 bp, Mus musculus
gcgaagttcataagctttgcctagt

SEQ ID NO: 557929 - DNA, 25 bp, Mus musculus
gcgaagttcatatgctttgcctagt

SEQ ID NO: 557930 - DNA, 25 bp, Mus musculus
gcgaagttcctaagaaagcactctc

SEQ ID NO: 557931 - DNA, 25 bp, Mus musculus
gcgaagttcctatgaaagcactctc

SEQ ID NO: 557932 - DNA, 25 bp, Mus musculus
gcgaatacattcagagcacacggct

SEQ ID NO: 557933 - DNA, 25 bp, Mus musculus
gcgaatacattctgagcacacggct

SEQ ID NO: 557934 - DNA, 25 bp, Mus musculus
gcgaatacctgaatcagcaggccat

SEQ ID NO: 557935 - DNA, 25 bp, Mus musculus
gcgaatacctgattcagcaggccat

SEQ ID NO: 557936 - DNA, 25 bp, Mus musculus
gcgaatacgctaaatactgcacaga

SEQ ID NO: 557937 - DNA, 25 bp, Mus musculus
gcgaatacgctatatactgcacaga

SEQ ID NO: 557938 - DNA, 25 bp, Mus musculus
gcgaatactatcctccattcaaaca

SEQ ID NO: 557939 - DNA, 25 bp, Mus musculus
gcgaatactatcgtccattcaaaca

SEQ ID NO: 557940 - DNA, 25 bp, Mus musculus
gcgaatatcaagcatgtagaccaag

SEQ ID NO: 557941 - DNA, 25 bp, Mus musculus
gcgaatatcaaggatgtagaccaag

SEQ ID NO: 557942 - DNA, 25 bp, Mus musculus
gcgaatatccaccacgaatgttgaa

SEQ ID NO: 557943 - DNA, 25 bp, Mus musculus
gcgaatatccacgacgaatgttgaa

SEQ ID NO: 557944 - DNA, 25 bp, Mus musculus
gcgaatatgaacattggtagatcca

SEQ ID NO: 557945 - DNA, 25 bp, Mus musculus
gcgaatatgaactttggtagatcca

SEQ ID NO: 557946 - DNA, 25 bp, Mus musculus
gcgaatatgttcaaaattcctattt

SEQ ID NO: 557947 - DNA, 25 bp, Mus musculus
gcgaatatgttctaaattcctattt

SEQ ID NO: 557948 - DNA, 25 bp, Mus musculus
gcgaatcaattcatcctaagtaggc

SEQ ID NO: 557949 - DNA, 25 bp, Mus musculus
gcgaatcaattcttcctaagtaggc

SEQ ID NO: 557950 - DNA, 25 bp, Mus musculus
gcgaatcattgcctcggaaacctga

SEQ ID NO: 557951 - DNA, 25 bp, Mus musculus
gcgaatcattgcgtcggaaacctga

SEQ ID NO: 557952 - DNA, 25 bp, Mus musculus
gcgaatgaattaacggaggcttctt

SEQ ID NO: 557953 - DNA, 25 bp, Mus musculus
gcgaatgaattatcggaggcttctt

SEQ ID NO: 557954 - DNA, 25 bp, Mus musculus
gcgaatgaggccacgattgattcaa

SEQ ID NO: 557955 - DNA, 25 bp, Mus musculus
gcgaatgaggcctcgattgattcaa

SEQ ID NO: 557956 - DNA, 25 bp, Mus musculus
gcgaatgatggtccacagctctata

SEQ ID NO: 557957 - DNA, 25 bp, Mus musculus
gcgaatgatggtgcacagctctata

SEQ ID NO: 557958 - DNA, 25 bp, Mus musculus
gcgaatgattgtatactagctagga

SEQ ID NO: 557959 - DNA, 25 bp, Mus musculus
gcgaatgattgtttactagctagga

SEQ ID NO: 557960 - DNA, 25 bp, Mus musculus
gcgaatgcccttaccagtgaaccat

SEQ ID NO: 557961 - DNA, 25 bp, Mus musculus
gcgaatgccctttccagtgaaccat

SEQ ID NO: 557962 - DNA, 25 bp, Mus musculus
gcgaatgctcaactttgtccagaat

SEQ ID NO: 557963 - DNA, 25 bp, Mus musculus
gcgaatgctcaagtttgtccagaat

SEQ ID NO: 557964 - DNA, 25 bp, Mus musculus
gcgaatgctgacactatcctggaag

SEQ ID NO: 557965 - DNA, 25 bp, Mus musculus
gcgaatgctgactctatcctggaag

SEQ ID NO: 557966 - DNA, 25 bp, Mus musculus
gcgaatgttactcaagtttcttaga

SEQ ID NO: 557967 - DNA, 25 bp, Mus musculus
gcgaatgttactgaagtttcttaga

SEQ ID NO: 557968 - DNA, 25 bp, Mus musculus
gcgaattaaccaaactcagccaaga

SEQ ID NO: 557969 - DNA, 25 bp, Mus musculus
gcgaattaaccatactcagccaaga

SEQ ID NO: 557970 - DNA, 25 bp, Mus musculus
gcgaattagcatcaaccaggccctg

SEQ ID NO: 557971 - DNA, 25 bp, Mus musculus
gcgaattagcatgaaccaggccctg

SEQ ID NO: 557972 - DNA, 25 bp, Mus musculus
gcgaattctcttactccgaggcgga

SEQ ID NO: 557973 - DNA, 25 bp, Mus musculus
gcgaattctctttctccgaggcgga

SEQ ID NO: 557974 - DNA, 25 bp, Mus musculus
gcgaattgactgaagagccacacaa

SEQ ID NO: 557975 - DNA, 25 bp, Mus musculus
gcgaattgactgtagagccacacaa

SEQ ID NO: 557976 - DNA, 25 bp, Mus musculus
gcgaattgcggcccgttcgacataa

SEQ ID NO: 557977 - DNA, 25 bp, Mus musculus
gcgaattgcggcgcgttcgacataa

SEQ ID NO: 557978 - DNA, 25 bp, Mus musculus
gcgacaaagagaacaagatgcttaa

SEQ ID NO: 557979 - DNA, 25 bp, Mus musculus
gcgacaaagagatcaagatgcttaa

SEQ ID NO: 557980 - DNA, 25 bp, Mus musculus
gcgacaaatcagctctcaagccaaa

SEQ ID NO: 557981 - DNA, 25 bp, Mus musculus
gcgacaaatcaggtctcaagccaaa

SEQ ID NO: 557982 - DNA, 25 bp, Mus musculus
gcgacaaccacaccctgctagaaag

SEQ ID NO: 557983 - DNA, 25 bp, Mus musculus
gcgacaaccacagcctgctagaaag

SEQ ID NO: 557984 - DNA, 25 bp, Mus musculus
gcgacaacttcgagggctacatgct

SEQ ID NO: 557985 - DNA, 25 bp, Mus musculus
gcgacaacttcgtgggctacatgct

SEQ ID NO: 557986 - DNA, 25 bp, Mus musculus
gcgacaagacaactgctcatagaaa

SEQ ID NO: 557987 - DNA, 25 bp, Mus musculus
gcgacaagacaagtgctcatagaaa

SEQ ID NO: 557988 - DNA, 25 bp, Mus musculus
gcgacaagtcggaagagccctcaaa

SEQ ID NO: 557989 - DNA, 25 bp, Mus musculus
gcgacaagtcggtagagccctcaaa

SEQ ID NO: 557990 - DNA, 25 bp, Mus musculus
gcgacaatcacacagactcgtctgt

SEQ ID NO: 557991 - DNA, 25 bp, Mus musculus
gcgacaatcacagagactcgtctgt

SEQ ID NO: 557992 - DNA, 25 bp, Mus musculus
gcgacaatctcacccggaatgactt

SEQ ID NO: 557993 - DNA, 25 bp, Mus musculus
gcgacaatctcagccggaatgactt

SEQ ID NO: 557994 - DNA, 25 bp, Mus musculus
gcgacaatgacgattctgactgccc

SEQ ID NO: 557995 - DNA, 25 bp, Mus musculus
gcgacaatgacgtttctgactgccc

SEQ ID NO: 557996 - DNA, 25 bp, Mus musculus
gcgacacaatgtactgcgttttcat

SEQ ID NO: 557997 - DNA, 25 bp, Mus musculus
gcgacacaatgttctgcgttttcat

SEQ ID NO: 557998 - DNA, 25 bp, Mus musculus
gcgacacaccacaggcattcaaacc

SEQ ID NO: 557999 - DNA, 25 bp, Mus musculus
gcgacacaccactggcattcaaacc

SEQ ID NO: 558000 - DNA, 25 bp, Mus musculus
gcgacacacgggaggaaatcctaat

SEQ ID NO: 558001 - DNA, 25 bp, Mus musculus
gcgacacacgggtggaaatcctaat

SEQ ID NO: 558002 - DNA, 25 bp, Mus musculus
gcgacacactctatgaactccggtg

SEQ ID NO: 558003 - DNA, 25 bp, Mus musculus
gcgacacactctttgaactccggtg

SEQ ID NO: 558004 - DNA, 25 bp, Mus musculus
gcgacaccctgaacatgaacaatta

SEQ ID NO: 558005 - DNA, 25 bp, Mus musculus
gcgacaccctgatcatgaacaatta

SEQ ID NO: 558006 - DNA, 25 bp, Mus musculus
gcgacacctgagcagatggcacaat

SEQ ID NO: 558007 - DNA, 25 bp, Mus musculus
gcgacacctgaggagatggcacaat

SEQ ID NO: 558008 - DNA, 25 bp, Mus musculus
gcgacacgggttacgcgacaacgga

SEQ ID NO: 558009 - DNA, 25 bp, Mus musculus
gcgacacgggtttcgcgacaacgga

SEQ ID NO: 558010 - DNA, 25 bp, Mus musculus
gcgacactccaaacagacacatgac

SEQ ID NO: 558011 - DNA, 25 bp, Mus musculus
gcgacactccaatcagacacatgac

SEQ ID NO: 558012 - DNA, 25 bp, Mus musculus
gcgacagaagcacgtgtctcaccca

SEQ ID NO: 558013 - DNA, 25 bp, Mus musculus
gcgacagaagcaggtgtctcaccca

SEQ ID NO: 558014 - DNA, 25 bp, Mus musculus
gcgacagaccacataagttcaggat

SEQ ID NO: 558015 - DNA, 25 bp, Mus musculus
gcgacagaccacttaagttcaggat

SEQ ID NO: 558016 - DNA, 25 bp, Mus musculus
gcgacagagaagacacagagctaaa

SEQ ID NO: 558017 - DNA, 25 bp, Mus musculus
gcgacagagaagtcacagagctaaa

SEQ ID NO: 558018 - DNA, 25 bp, Mus musculus
gcgacagccccgagccaatgtttgg

SEQ ID NO: 558019 - DNA, 25 bp, Mus musculus
gcgacagccccgtgccaatgtttgg

SEQ ID NO: 558020 - DNA, 25 bp, Mus musculus
gcgacagcggagacttcacgtccac

SEQ ID NO: 558021 - DNA, 25 bp, Mus musculus
gcgacagcggagtcttcacgtccac

SEQ ID NO: 558022 - DNA, 25 bp, Mus musculus
gcgacagctgtgagcgctacttcaa

SEQ ID NO: 558023 - DNA, 25 bp, Mus musculus
gcgacagctgtgtgcgctacttcaa

SEQ ID NO: 558024 - DNA, 25 bp, Mus musculus
gcgacagggctgcatttctgtgcca

SEQ ID NO: 558025 - DNA, 25 bp, Mus musculus
gcgacagggctggatttctgtgcca

SEQ ID NO: 558026 - DNA, 25 bp, Mus musculus
gcgacagggtgcatgcaattctgca

SEQ ID NO: 558027 - DNA, 25 bp, Mus musculus
gcgacagggtgcttgcaattctgca

SEQ ID NO: 558028 - DNA, 25 bp, Mus musculus
gcgacagtagtgatacggtcagcac

SEQ ID NO: 558029 - DNA, 25 bp, Mus musculus
gcgacagtagtgttacggtcagcac

SEQ ID NO: 558030 - DNA, 25 bp, Mus musculus
gcgacagtcgccaacggaactgctt

SEQ ID NO: 558031 - DNA, 25 bp, Mus musculus
gcgacagtcgcctacggaactgctt

SEQ ID NO: 558032 - DNA, 25 bp, Mus musculus
gcgacagtgctaagtgtgcagcctt

SEQ ID NO: 558033 - DNA, 25 bp, Mus musculus
gcgacagtgctatgtgtgcagcctt

SEQ ID NO: 558034 - DNA, 25 bp, Mus musculus
gcgacatcacccatgaaaaggcagt

SEQ ID NO: 558035 - DNA, 25 bp, Mus musculus
gcgacatcacccttgaaaaggcagt

SEQ ID NO: 558036 - DNA, 25 bp, Mus musculus
gcgacatcgacaacaggaaggacct

SEQ ID NO: 558037 - DNA, 25 bp, Mus musculus
gcgacatcgacatcaggaaggacct

SEQ ID NO: 558038 - DNA, 25 bp, Mus musculus
gcgacatctacgagggccagtggca

SEQ ID NO: 558039 - DNA, 25 bp, Mus musculus
gcgacatctacgtgggccagtggca

SEQ ID NO: 558040 - DNA, 25 bp, Mus musculus
gcgacatctctcagtcaaatctcga

SEQ ID NO: 558041 - DNA, 25 bp, Mus musculus
gcgacatctctctgtcaaatctcga

SEQ ID NO: 558042 - DNA, 25 bp, Mus musculus
gcgacatctgtaaaaagtttctgta

SEQ ID NO: 558043 - DNA, 25 bp, Mus musculus
gcgacatctgtataaagtttctgta

SEQ ID NO: 558044 - DNA, 25 bp, Mus musculus
gcgacatctgtgacgcctcgtttat

SEQ ID NO: 558045 - DNA, 25 bp, Mus musculus
gcgacatctgtgtcgcctcgtttat

SEQ ID NO: 558046 - DNA, 25 bp, Mus musculus
gcgacatcttagagtcaacctttga

SEQ ID NO: 558047 - DNA, 25 bp, Mus musculus
gcgacatcttagtgtcaacctttga

SEQ ID NO: 558048 - DNA, 25 bp, Mus musculus
gcgacatcttccaccagaagtgcaa

SEQ ID NO: 558049 - DNA, 25 bp, Mus musculus
gcgacatcttcctccagaagtgcaa

SEQ ID NO: 558050 - DNA, 25 bp, Mus musculus
gcgacatgacacctggttcttgcca

SEQ ID NO: 558051 - DNA, 25 bp, Mus musculus
gcgacatgacacgtggttcttgcca

SEQ ID NO: 558052 - DNA, 25 bp, Mus musculus
gcgacatgcaggacggcttcgacat

SEQ ID NO: 558053 - DNA, 25 bp, Mus musculus
gcgacatgcaggtcggcttcgacat

SEQ ID NO: 558054 - DNA, 25 bp, Mus musculus
gcgacatgctggctcttctagaaac

SEQ ID NO: 558055 - DNA, 25 bp, Mus musculus
gcgacatgctgggtcttctagaaac

SEQ ID NO: 558056 - DNA, 25 bp, Mus musculus
gcgacatgcttcatcagactggctg

SEQ ID NO: 558057 - DNA, 25 bp, Mus musculus
gcgacatgcttcttcagactggctg

SEQ ID NO: 558058 - DNA, 25 bp, Mus musculus
gcgacatggctaaacgcaccaagaa

SEQ ID NO: 558059 - DNA, 25 bp, Mus musculus
gcgacatggctatacgcaccaagaa

SEQ ID NO: 558060 - DNA, 25 bp, Mus musculus
gcgacattccttcactttctaggat

SEQ ID NO: 558061 - DNA, 25 bp, Mus musculus
gcgacattccttgactttctaggat

SEQ ID NO: 558062 - DNA, 25 bp, Mus musculus
gcgacattcttacttgttcgtagat

SEQ ID NO: 558063 - DNA, 25 bp, Mus musculus
gcgacattcttagttgttcgtagat

SEQ ID NO: 558064 - DNA, 25 bp, Mus musculus
gcgacattgacactgagacctcctc

SEQ ID NO: 558065 - DNA, 25 bp, Mus musculus
gcgacattgacagtgagacctcctc

SEQ ID NO: 558066 - DNA, 25 bp, Mus musculus
gcgacatttattacaatgagctgct

SEQ ID NO: 558067 - DNA, 25 bp, Mus musculus
gcgacatttatttcaatgagctgct

SEQ ID NO: 558068 - DNA, 25 bp, Mus musculus
gcgacattttgaccaccctccaaat

SEQ ID NO: 558069 - DNA, 25 bp, Mus musculus
gcgacattttgagcaccctccaaat

SEQ ID NO: 558070 - DNA, 25 bp, Mus musculus
gcgaccaacggaaactctcaaaaat

SEQ ID NO: 558071 - DNA, 25 bp, Mus musculus
gcgaccaacggatactctcaaaaat

SEQ ID NO: 558072 - DNA, 25 bp, Mus musculus
gcgaccaagggcagtgctagcatct

SEQ ID NO: 558073 - DNA, 25 bp, Mus musculus
gcgaccaagggctgtgctagcatct

SEQ ID NO: 558074 - DNA, 25 bp, Mus musculus
gcgaccaatcatctaaaggaccaag

SEQ ID NO: 558075 - DNA, 25 bp, Mus musculus
gcgaccaatcatgtaaaggaccaag

SEQ ID NO: 558076 - DNA, 25 bp, Mus musculus
gcgaccagaggtcgcgttcttttga

SEQ ID NO: 558077 - DNA, 25 bp, Mus musculus
gcgaccagaggtggcgttcttttga

SEQ ID NO: 558078 - DNA, 25 bp, Mus musculus
gcgaccaggttgaagacaactacct

SEQ ID NO: 558079 - DNA, 25 bp, Mus musculus
gcgaccaggttgtagacaactacct

SEQ ID NO: 558080 - DNA, 25 bp, Mus musculus
gcgaccatcaccagggctgcagtca

SEQ ID NO: 558081 - DNA, 25 bp, Mus musculus
gcgaccatcacctgggctgcagtca

SEQ ID NO: 558082 - DNA, 25 bp, Mus musculus
gcgaccatgagtatgagggctgttt

SEQ ID NO: 558083 - DNA, 25 bp, Mus musculus
gcgaccatgagtttgagggctgttt

SEQ ID NO: 558084 - DNA, 25 bp, Mus musculus
gcgaccatgtgcaatgtgggctcat

SEQ ID NO: 558085 - DNA, 25 bp, Mus musculus
gcgaccatgtgctatgtgggctcat

SEQ ID NO: 558086 - DNA, 25 bp, Mus musculus
gcgaccattggacagcagttcacag

SEQ ID NO: 558087 - DNA, 25 bp, Mus musculus
gcgaccattggagagcagttcacag

SEQ ID NO: 558088 - DNA, 25 bp, Mus musculus
gcgaccattgttagccacatacggg

SEQ ID NO: 558089 - DNA, 25 bp, Mus musculus
gcgaccattgtttgccacatacggg

SEQ ID NO: 558090 - DNA, 25 bp, Mus musculus
gcgacccaagaacactagagccatg

SEQ ID NO: 558091 - DNA, 25 bp, Mus musculus
gcgacccaagaagactagagccatg

SEQ ID NO: 558092 - DNA, 25 bp, Mus musculus
gcgacccatataaatagctattctt

SEQ ID NO: 558093 - DNA, 25 bp, Mus musculus
gcgacccatatatatagctattctt

SEQ ID NO: 558094 - DNA, 25 bp, Mus musculus
gcgaccccgcaaagtgggagagctt

SEQ ID NO: 558095 - DNA, 25 bp, Mus musculus
gcgaccccgcaatgtgggagagctt

SEQ ID NO: 558096 - DNA, 25 bp, Mus musculus
gcgacccgaaggagccgtatgccag

SEQ ID NO: 558097 - DNA, 25 bp, Mus musculus
gcgacccgaaggtgccgtatgccag

SEQ ID NO: 558098 - DNA, 25 bp, Mus musculus
gcgaccctggaaagacagcctttga

SEQ ID NO: 558099 - DNA, 25 bp, Mus musculus
gcgaccctggaatgacagcctttga

SEQ ID NO: 558100 - DNA, 25 bp, Mus musculus
gcgacccttaaaagcctggagaatc

SEQ ID NO: 558101 - DNA, 25 bp, Mus musculus
gcgacccttaaatgcctggagaatc

SEQ ID NO: 558102 - DNA, 25 bp, Mus musculus
gcgaccgacctgaaggactgggttc

SEQ ID NO: 558103 - DNA, 25 bp, Mus musculus
gcgaccgacctgtaggactgggttc

SEQ ID NO: 558104 - DNA, 25 bp, Mus musculus
gcgaccgcacggagttgggatttac

SEQ ID NO: 558105 - DNA, 25 bp, Mus musculus
gcgaccgcacggtgttgggatttac

SEQ ID NO: 558106 - DNA, 25 bp, Mus musculus
gcgaccggacagctcgctctgctag

SEQ ID NO: 558107 - DNA, 25 bp, Mus musculus
gcgaccggacaggtcgctctgctag

SEQ ID NO: 558108 - DNA, 25 bp, Mus musculus
gcgaccggctttcagaaaggccttt

SEQ ID NO: 558109 - DNA, 25 bp, Mus musculus
gcgaccggctttgagaaaggccttt

SEQ ID NO: 558110 - DNA, 25 bp, Mus musculus
gcgaccgggaaaacatcgacgattt

SEQ ID NO: 558111 - DNA, 25 bp, Mus musculus
gcgaccgggaaatcatcgacgattt

SEQ ID NO: 558112 - DNA, 25 bp, Mus musculus
gcgaccgggcgcacagaagtatgga

SEQ ID NO: 558113 - DNA, 25 bp, Mus musculus
gcgaccgggcgctcagaagtatgga

SEQ ID NO: 558114 - DNA, 25 bp, Mus musculus
gcgaccgggctgatgaagtttttga

SEQ ID NO: 558115 - DNA, 25 bp, Mus musculus
gcgaccgggctgttgaagtttttga

SEQ ID NO: 558116 - DNA, 25 bp, Mus musculus
gcgacctaccacagttgcggtgctc

SEQ ID NO: 558117 - DNA, 25 bp, Mus musculus
gcgacctaccactgttgcggtgctc

SEQ ID NO: 558118 - DNA, 25 bp, Mus musculus
gcgacctaggcgatggaagttccag

SEQ ID NO: 558119 - DNA, 25 bp, Mus musculus
gcgacctaggcgttggaagttccag

SEQ ID NO: 558120 - DNA, 25 bp, Mus musculus
gcgacctcctgacgccctgatggct

SEQ ID NO: 558121 - DNA, 25 bp, Mus musculus
gcgacctcctgaggccctgatggct

SEQ ID NO: 558122 - DNA, 25 bp, Mus musculus
gcgacctctctacatggacgtacag

SEQ ID NO: 558123 - DNA, 25 bp, Mus musculus
gcgacctctctagatggacgtacag

SEQ ID NO: 558124 - DNA, 25 bp, Mus musculus
gcgacctgagacctccatgagtgga

SEQ ID NO: 558125 - DNA, 25 bp, Mus musculus
gcgacctgagacgtccatgagtgga

SEQ ID NO: 558126 - DNA, 25 bp, Mus musculus
gcgacctgcaagattcacaagaggg

SEQ ID NO: 558127 - DNA, 25 bp, Mus musculus
gcgacctgcaagtttcacaagaggg

SEQ ID NO: 558128 - DNA, 25 bp, Mus musculus
gcgacctggctaaaaagtccctgga

SEQ ID NO: 558129 - DNA, 25 bp, Mus musculus
gcgacctggctataaagtccctgga

SEQ ID NO: 558130 - DNA, 25 bp, Mus musculus
gcgaccttctagcattcaacataag

SEQ ID NO: 558131 - DNA, 25 bp, Mus musculus
gcgaccttctaggattcaacataag

SEQ ID NO: 558132 - DNA, 25 bp, Mus musculus
gcgaccttctgtcagacattagttt

SEQ ID NO: 558133 - DNA, 25 bp, Mus musculus
gcgaccttctgtgagacattagttt

SEQ ID NO: 558134 - DNA, 25 bp, Mus musculus
gcgaccttgaatcgattcgactgac

SEQ ID NO: 558135 - DNA, 25 bp, Mus musculus
gcgaccttgaatggattcgactgac

SEQ ID NO: 558136 - DNA, 25 bp, Mus musculus
gcgaccttggtgaagccctggctta

SEQ ID NO: 558137 - DNA, 25 bp, Mus musculus
gcgaccttggtgtagccctggctta

SEQ ID NO: 558138 - DNA, 25 bp, Mus musculus
gcgaccttttgcaagtcctgggtgg

SEQ ID NO: 558139 - DNA, 25 bp, Mus musculus
gcgaccttttgctagtcctgggtgg

SEQ ID NO: 558140 - DNA, 25 bp, Mus musculus
gcgacgaaacagcacaggtgccata

SEQ ID NO: 558141 - DNA, 25 bp, Mus musculus
gcgacgaaacaggacaggtgccata

SEQ ID NO: 558142 - DNA, 25 bp, Mus musculus
gcgacgaaattacgaactcacatta

SEQ ID NO: 558143 - DNA, 25 bp, Mus musculus
gcgacgaaattaggaactcacatta

SEQ ID NO: 558144 - DNA, 25 bp, Mus musculus
gcgacgaaccctaccaatacaagaa

SEQ ID NO: 558145 - DNA, 25 bp, Mus musculus
gcgacgaacccttccaatacaagaa

SEQ ID NO: 558146 - DNA, 25 bp, Mus musculus
gcgacgaagggtctgtttttcttgt

SEQ ID NO: 558147 - DNA, 25 bp, Mus musculus
gcgacgaagggtgtgtttttcttgt

SEQ ID NO: 558148 - DNA, 25 bp, Mus musculus
gcgacgaatcctcgtggctactaat

SEQ ID NO: 558149 - DNA, 25 bp, Mus musculus
gcgacgaatcctggtggctactaat

SEQ ID NO: 558150 - DNA, 25 bp, Mus musculus
gcgacgaccaccatgtaaagccgat

SEQ ID NO: 558151 - DNA, 25 bp, Mus musculus
gcgacgaccaccttgtaaagccgat

SEQ ID NO: 558152 - DNA, 25 bp, Mus musculus
gcgacgaccgtacatctgtgttgaa

SEQ ID NO: 558153 - DNA, 25 bp, Mus musculus
gcgacgaccgtagatctgtgttgaa

SEQ ID NO: 558154 - DNA, 25 bp, Mus musculus
gcgacgacctcaacctagagattga

SEQ ID NO: 558155 - DNA, 25 bp, Mus musculus
gcgacgacctcatcctagagattga

SEQ ID NO: 558156 - DNA, 25 bp, Mus musculus
gcgacgagatttctggacaagccca

SEQ ID NO: 558157 - DNA, 25 bp, Mus musculus
gcgacgagatttgtggacaagccca

SEQ ID NO: 558158 - DNA, 25 bp, Mus musculus
gcgacgagccctcagagcgcttctg

SEQ ID NO: 558159 - DNA, 25 bp, Mus musculus
gcgacgagccctgagagcgcttctg

SEQ ID NO: 558160 - DNA, 25 bp, Mus musculus
gcgacgatgtcaatcgaaggcacta

SEQ ID NO: 558161 - DNA, 25 bp, Mus musculus
gcgacgatgtcattcgaaggcacta

SEQ ID NO: 558162 - DNA, 25 bp, Mus musculus
gcgacgccctagaacgggaattcca

SEQ ID NO: 558163 - DNA, 25 bp, Mus musculus
gcgacgccctagtacgggaattcca

SEQ ID NO: 558164 - DNA, 25 bp, Mus musculus
gcgacgcctcgcaacagatgaacag

SEQ ID NO: 558165 - DNA, 25 bp, Mus musculus
gcgacgcctcgctacagatgaacag

SEQ ID NO: 558166 - DNA, 25 bp, Mus musculus
gcgacgcgctggcgttacagcgcaa

SEQ ID NO: 558167 - DNA, 25 bp, Mus musculus
gcgacgcgctggggttacagcgcaa

SEQ ID NO: 558168 - DNA, 25 bp, Mus musculus
gcgacgctcggtaggtacgtgctta

SEQ ID NO: 558169 - DNA, 25 bp, Mus musculus
gcgacgctcggttggtacgtgctta

SEQ ID NO: 558170 - DNA, 25 bp, Mus musculus
gcgacgcttccgctgtccggaaatc

SEQ ID NO: 558171 - DNA, 25 bp, Mus musculus
gcgacgcttccggtgtccggaaatc

SEQ ID NO: 558172 - DNA, 25 bp, Mus musculus
gcgacggcgacgacatctcggcgac

SEQ ID NO: 558173 - DNA, 25 bp, Mus musculus
gcgacggcgacgtcatctcggcgac

SEQ ID NO: 558174 - DNA, 25 bp, Mus musculus
gcgacggtttccaggagatgctttg

SEQ ID NO: 558175 - DNA, 25 bp, Mus musculus
gcgacggtttcctggagatgctttg

SEQ ID NO: 558176 - DNA, 25 bp, Mus musculus
gcgacgtacaaaatcaacgctatct

SEQ ID NO: 558177 - DNA, 25 bp, Mus musculus
gcgacgtacaaattcaacgctatct

SEQ ID NO: 558178 - DNA, 25 bp, Mus musculus
gcgacgtctgtgcacctgtaccaga

SEQ ID NO: 558179 - DNA, 25 bp, Mus musculus
gcgacgtctgtggacctgtaccaga

SEQ ID NO: 558180 - DNA, 25 bp, Mus musculus
gcgacgtgatctacaggggctttga

SEQ ID NO: 558181 - DNA, 25 bp, Mus musculus
gcgacgtgatcttcaggggctttga

SEQ ID NO: 558182 - DNA, 25 bp, Mus musculus
gcgacgtggacaaggatgtgcttac

SEQ ID NO: 558183 - DNA, 25 bp, Mus musculus
gcgacgtggacatggatgtgcttac

SEQ ID NO: 558184 - DNA, 25 bp, Mus musculus
gcgactaacaaaattgcacacccaa

SEQ ID NO: 558185 - DNA, 25 bp, Mus musculus
gcgactaacaaatttgcacacccaa

SEQ ID NO: 558186 - DNA, 25 bp, Mus musculus
gcgactaagccaaagtcggagggct

SEQ ID NO: 558187 - DNA, 25 bp, Mus musculus
gcgactaagccatagtcggagggct

SEQ ID NO: 558188 - DNA, 25 bp, Mus musculus
gcgactagaggcctcacagctggaa

SEQ ID NO: 558189 - DNA, 25 bp, Mus musculus
gcgactagaggcgtcacagctggaa

SEQ ID NO: 558190 - DNA, 25 bp, Mus musculus
gcgactagcagccagatgtcctggc

SEQ ID NO: 558191 - DNA, 25 bp, Mus musculus
gcgactagcagcgagatgtcctggc

SEQ ID NO: 558192 - DNA, 25 bp, Mus musculus
gcgactatgaggacaccgacggcga

SEQ ID NO: 558193 - DNA, 25 bp, Mus musculus
gcgactatgaggtcaccgacggcga

SEQ ID NO: 558194 - DNA, 25 bp, Mus musculus
gcgactccaggcaaatttcttaact

SEQ ID NO: 558195 - DNA, 25 bp, Mus musculus
gcgactccaggctaatttcttaact

SEQ ID NO: 558196 - DNA, 25 bp, Mus musculus
gcgactccggagacagcccaaatat

SEQ ID NO: 558197 - DNA, 25 bp, Mus musculus
gcgactccggagtcagcccaaatat

SEQ ID NO: 558198 - DNA, 25 bp, Mus musculus
gcgactcctttcaaaagggctacat

SEQ ID NO: 558199 - DNA, 25 bp, Mus musculus
gcgactcctttctaaagggctacat

SEQ ID NO: 558200 - DNA, 25 bp, Mus musculus
gcgactcggagactgcagactcagt

SEQ ID NO: 558201 - DNA, 25 bp, Mus musculus
gcgactcggagagtgcagactcagt

SEQ ID NO: 558202 - DNA, 25 bp, Mus musculus
gcgactcggaggatgctttacactt

SEQ ID NO: 558203 - DNA, 25 bp, Mus musculus
gcgactcggaggttgctttacactt

SEQ ID NO: 558204 - DNA, 25 bp, Mus musculus
gcgactctatggagggctatgtgct

SEQ ID NO: 558205 - DNA, 25 bp, Mus musculus
gcgactctatggtgggctatgtgct

SEQ ID NO: 558206 - DNA, 25 bp, Mus musculus
gcgactctctggacaacttttcttc

SEQ ID NO: 558207 - DNA, 25 bp, Mus musculus
gcgactctctggtcaacttttcttc

SEQ ID NO: 558208 - DNA, 25 bp, Mus musculus
gcgactctgtggacctgagtgccag

SEQ ID NO: 558209 - DNA, 25 bp, Mus musculus
gcgactctgtggtcctgagtgccag

SEQ ID NO: 558210 - DNA, 25 bp, Mus musculus
gcgactcttcagaatgttctccgga

SEQ ID NO: 558211 - DNA, 25 bp, Mus musculus
gcgactcttcagtatgttctccgga

SEQ ID NO: 558212 - DNA, 25 bp, Mus musculus
gcgactcttctcatgtggcacagat

SEQ ID NO: 558213 - DNA, 25 bp, Mus musculus
gcgactcttctcttgtggcacagat

SEQ ID NO: 558214 - DNA, 25 bp, Mus musculus
gcgactctttccatagtctgggtac

SEQ ID NO: 558215 - DNA, 25 bp, Mus musculus
gcgactctttccttagtctgggtac

SEQ ID NO: 558216 - DNA, 25 bp, Mus musculus
gcgactgaaactcttgcatctttgt

SEQ ID NO: 558217 - DNA, 25 bp, Mus musculus
gcgactgaaactgttgcatctttgt

SEQ ID NO: 558218 - DNA, 25 bp, Mus musculus
gcgactgaagccacttaataggtta

SEQ ID NO: 558219 - DNA, 25 bp, Mus musculus
gcgactgaagcctcttaataggtta

SEQ ID NO: 558220 - DNA, 25 bp, Mus musculus
gcgactgaccaaaagcccaaagctg

SEQ ID NO: 558221 - DNA, 25 bp, Mus musculus
gcgactgaccaacctgcagcaggaa

SEQ ID NO: 558222 - DNA, 25 bp, Mus musculus
gcgactgaccaagctgcagcaggaa

SEQ ID NO: 558223 - DNA, 25 bp, Mus musculus
gcgactgaccaatagcccaaagctg

SEQ ID NO: 558224 - DNA, 25 bp, Mus musculus
gcgactgcctataaatccaacttca

SEQ ID NO: 558225 - DNA, 25 bp, Mus musculus
gcgactgcctattaatccaacttca

SEQ ID NO: 558226 - DNA, 25 bp, Mus musculus
gcgactgctcatatgcagaggagct

SEQ ID NO: 558227 - DNA, 25 bp, Mus musculus
gcgactgctcatttgcagaggagct

SEQ ID NO: 558228 - DNA, 25 bp, Mus musculus
gcgactgctgcacctctgactgcat

SEQ ID NO: 558229 - DNA, 25 bp, Mus musculus
gcgactgctgcagctctgactgcat

SEQ ID NO: 558230 - DNA, 25 bp, Mus musculus
gcgactgctgctcttgagagtgtca

SEQ ID NO: 558231 - DNA, 25 bp, Mus musculus
gcgactgctgctgttgagagtgtca

SEQ ID NO: 558232 - DNA, 25 bp, Mus musculus
gcgactggaggtctatttacaggaa

SEQ ID NO: 558233 - DNA, 25 bp, Mus musculus
gcgactggaggtgtatttacaggaa

SEQ ID NO: 558234 - DNA, 25 bp, Mus musculus
gcgactggatttcgcctgatcacac

SEQ ID NO: 558235 - DNA, 25 bp, Mus musculus
gcgactggatttggcctgatcacac

SEQ ID NO: 558236 - DNA, 25 bp, Mus musculus
gcgactggcggcaccagcaggaact

SEQ ID NO: 558237 - DNA, 25 bp, Mus musculus
gcgactggcggctccagcaggaact

SEQ ID NO: 558238 - DNA, 25 bp, Mus musculus
gcgactggcttcaactacattgtct

SEQ ID NO: 558239 - DNA, 25 bp, Mus musculus
gcgactggcttctactacattgtct

SEQ ID NO: 558240 - DNA, 25 bp, Mus musculus
gcgactggtacaagaagcagctaca

SEQ ID NO: 558241 - DNA, 25 bp, Mus musculus
gcgactggtacatgaagcagctaca

SEQ ID NO: 558242 - DNA, 25 bp, Mus musculus
gcgactgtacataatctcacttaga

SEQ ID NO: 558243 - DNA, 25 bp, Mus musculus
gcgactgtacattatctcacttaga

SEQ ID NO: 558244 - DNA, 25 bp, Mus musculus
gcgactgtctagctttatccagaaa

SEQ ID NO: 558245 - DNA, 25 bp, Mus musculus
gcgactgtctaggtttatccagaaa

SEQ ID NO: 558246 - DNA, 25 bp, Mus musculus
gcgacttcaccgatagtgtgttcat

SEQ ID NO: 558247 - DNA, 25 bp, Mus musculus
gcgacttcaccgttagtgtgttcat

SEQ ID NO: 558248 - DNA, 25 bp, Mus musculus
gcgacttcatcaataggtttccatc

SEQ ID NO: 558249 - DNA, 25 bp, Mus musculus
gcgacttcatcattaggtttccatc

SEQ ID NO: 558250 - DNA, 25 bp, Mus musculus
gcgacttcatgacgccattggcaaa

SEQ ID NO: 558251 - DNA, 25 bp, Mus musculus
gcgacttcatgaggccattggcaaa

SEQ ID NO: 558252 - DNA, 25 bp, Mus musculus
gcgacttccacaaacctggattttt

SEQ ID NO: 558253 - DNA, 25 bp, Mus musculus
gcgacttccacatacctggattttt

SEQ ID NO: 558254 - DNA, 25 bp, Mus musculus
gcgacttcggctcggactgagtctc

SEQ ID NO: 558255 - DNA, 25 bp, Mus musculus
gcgacttcggctgggactgagtctc

SEQ ID NO: 558256 - DNA, 25 bp, Mus musculus
gcgacttcgttaagcggcacttttt

SEQ ID NO: 558257 - DNA, 25 bp, Mus musculus
gcgacttcgttatgcggcacttttt

SEQ ID NO: 558258 - DNA, 25 bp, Mus musculus
gcgacttctgcccaaaacaatgaaa

SEQ ID NO: 558259 - DNA, 25 bp, Mus musculus
gcgacttctgccgaaaacaatgaaa

SEQ ID NO: 558260 - DNA, 25 bp, Mus musculus
gcgacttgatcgaacaggcagctga

SEQ ID NO: 558261 - DNA, 25 bp, Mus musculus
gcgacttgatcgtacaggcagctga

SEQ ID NO: 558262 - DNA, 25 bp, Mus musculus
gcgacttgcctcacagaaagagctt

SEQ ID NO: 558263 - DNA, 25 bp, Mus musculus
gcgacttgcctctcagaaagagctt

SEQ ID NO: 558264 - DNA, 25 bp, Mus musculus
gcgacttgctggctactcttgtaga

SEQ ID NO: 558265 - DNA, 25 bp, Mus musculus
gcgacttgctgggtactcttgtaga

SEQ ID NO: 558266 - DNA, 25 bp, Mus musculus
gcgacttgtcataagttcttgcttt

SEQ ID NO: 558267 - DNA, 25 bp, Mus musculus
gcgacttgtcattagttcttgcttt

SEQ ID NO: 558268 - DNA, 25 bp, Mus musculus
gcgacttgtgtgactttgcaatgat

SEQ ID NO: 558269 - DNA, 25 bp, Mus musculus
gcgacttgtgtgtctttgcaatgat

SEQ ID NO: 558270 - DNA, 25 bp, Mus musculus
gcgacttgttacacctcgtgtcctg

SEQ ID NO: 558271 - DNA, 25 bp, Mus musculus
gcgacttgttactcctcgtgtcctg

SEQ ID NO: 558272 - DNA, 25 bp, Mus musculus
gcgacttgttgcagcccaggaagaa

SEQ ID NO: 558273 - DNA, 25 bp, Mus musculus
gcgacttgttgctgcccaggaagaa

SEQ ID NO: 558274 - DNA, 25 bp, Mus musculus
gcgactttccccacttgtaaagaag

SEQ ID NO: 558275 - DNA, 25 bp, Mus musculus
gcgactttcccctcttgtaaagaag

SEQ ID NO: 558276 - DNA, 25 bp, Mus musculus
gcgactttcttgacgacataggcaa

SEQ ID NO: 558277 - DNA, 25 bp, Mus musculus
gcgactttcttgtcgacataggcaa

SEQ ID NO: 558278 - DNA, 25 bp, Mus musculus
gcgacttttagacctgaaactttgc

SEQ ID NO: 558279 - DNA, 25 bp, Mus musculus
gcgacttttagagctgaaactttgc

SEQ ID NO: 558280 - DNA, 25 bp, Mus musculus
gcgacttttggcattgcgtctacta

SEQ ID NO: 558281 - DNA, 25 bp, Mus musculus
gcgacttttggctttgcgtctacta

SEQ ID NO: 558282 - DNA, 25 bp, Mus musculus
gcgagaaaccgtatggatgtgttga

SEQ ID NO: 558283 - DNA, 25 bp, Mus musculus
gcgagaaaccgtttggatgtgttga

SEQ ID NO: 558284 - DNA, 25 bp, Mus musculus
gcgagaaagccacacctgcgctgga

SEQ ID NO: 558285 - DNA, 25 bp, Mus musculus
gcgagaaagccagacctgcgctgga

SEQ ID NO: 558286 - DNA, 25 bp, Mus musculus
gcgagaaaggcgatcttcatttttt

SEQ ID NO: 558287 - DNA, 25 bp, Mus musculus
gcgagaaaggcgttcttcatttttt

SEQ ID NO: 558288 - DNA, 25 bp, Mus musculus
gcgagaaataaacgcgttgaccccg

SEQ ID NO: 558289 - DNA, 25 bp, Mus musculus
gcgagaaataaaggcgttgaccccg

SEQ ID NO: 558290 - DNA, 25 bp, Mus musculus
gcgagaacactactcttggtagcct

SEQ ID NO: 558291 - DNA, 25 bp, Mus musculus
gcgagaacactagtcttggtagcct

SEQ ID NO: 558292 - DNA, 25 bp, Mus musculus
gcgagaactccaatgttctggcaaa

SEQ ID NO: 558293 - DNA, 25 bp, Mus musculus
gcgagaactccattgttctggcaaa

SEQ ID NO: 558294 - DNA, 25 bp, Mus musculus
gcgagaagcagacattctctcccta

SEQ ID NO: 558295 - DNA, 25 bp, Mus musculus
gcgagaagcagagattctctcccta

SEQ ID NO: 558296 - DNA, 25 bp, Mus musculus
gcgagaagcttcaaaccacagagta

SEQ ID NO: 558297 - DNA, 25 bp, Mus musculus
gcgagaagcttctaaccacagagta

SEQ ID NO: 558298 - DNA, 25 bp, Mus musculus
gcgagaaggactaggaacaggccct

SEQ ID NO: 558299 - DNA, 25 bp, Mus musculus
gcgagaaggacttggaacaggccct

SEQ ID NO: 558300 - DNA, 25 bp, Mus musculus
gcgagaaggtcgctccgtctagccc

SEQ ID NO: 558301 - DNA, 25 bp, Mus musculus
gcgagaaggtcggtccgtctagccc

SEQ ID NO: 558302 - DNA, 25 bp, Mus musculus
gcgagaatacttatcaacagtcctg

SEQ ID NO: 558303 - DNA, 25 bp, Mus musculus
gcgagaatacttttcaacagtcctg

SEQ ID NO: 558304 - DNA, 25 bp, Mus musculus
gcgagaatccttacgtctgggtcag

SEQ ID NO: 558305 - DNA, 25 bp, Mus musculus
gcgagaatcctttcgtctgggtcag

SEQ ID NO: 558306 - DNA, 25 bp, Mus musculus
gcgagaattactcaagggcttgttc

SEQ ID NO: 558307 - DNA, 25 bp, Mus musculus
gcgagaattactgaagggcttgttc

SEQ ID NO: 558308 - DNA, 25 bp, Mus musculus
gcgagaccactgagtgaagcggtct

SEQ ID NO: 558309 - DNA, 25 bp, Mus musculus
gcgagaccactgtgtgaagcggtct

SEQ ID NO: 558310 - DNA, 25 bp, Mus musculus
gcgagaccccacaaacatcaaatgg

SEQ ID NO: 558311 - DNA, 25 bp, Mus musculus
gcgagaccccactaacatcaaatgg

SEQ ID NO: 558312 - DNA, 25 bp, Mus musculus
gcgagaccctggaaggcattaccat

SEQ ID NO: 558313 - DNA, 25 bp, Mus musculus
gcgagaccctggtaggcattaccat

SEQ ID NO: 558314 - DNA, 25 bp, Mus musculus
gcgagacctcatctgagaactaaaa

SEQ ID NO: 558315 - DNA, 25 bp, Mus musculus
gcgagacctcatgtgagaactaaaa

SEQ ID NO: 558316 - DNA, 25 bp, Mus musculus
gcgagacctcgccagagtctagagc

SEQ ID NO: 558317 - DNA, 25 bp, Mus musculus
gcgagacctcgcgagagtctagagc

SEQ ID NO: 558318 - DNA, 25 bp, Mus musculus
gcgagacgtgatagacagcctggta

SEQ ID NO: 558319 - DNA, 25 bp, Mus musculus
gcgagacgtgattgacagcctggta

SEQ ID NO: 558320 - DNA, 25 bp, Mus musculus
gcgagactatctccagactggatta

SEQ ID NO: 558321 - DNA, 25 bp, Mus musculus
gcgagactatctgcagactggatta

SEQ ID NO: 558322 - DNA, 25 bp, Mus musculus
gcgagactcttgacccaagtgttaa

SEQ ID NO: 558323 - DNA, 25 bp, Mus musculus
gcgagactcttgtcccaagtgttaa

SEQ ID NO: 558324 - DNA, 25 bp, Mus musculus
gcgagactgttcaagtgtgcccaga

SEQ ID NO: 558325 - DNA, 25 bp, Mus musculus
gcgagactgttctagtgtgcccaga

SEQ ID NO: 558326 - DNA, 25 bp, Mus musculus
gcgagacttcctcttggtctacaat

SEQ ID NO: 558327 - DNA, 25 bp, Mus musculus
gcgagacttcctgttggtctacaat

SEQ ID NO: 558328 - DNA, 25 bp, Mus musculus
gcgagacttgcaaatacttgtatct

SEQ ID NO: 558329 - DNA, 25 bp, Mus musculus
gcgagacttgcatatacttgtatct

SEQ ID NO: 558330 - DNA, 25 bp, Mus musculus
gcgagagaactaccccttcacctga

SEQ ID NO: 558331 - DNA, 25 bp, Mus musculus
gcgagagaactagcccttcacctga

SEQ ID NO: 558332 - DNA, 25 bp, Mus musculus
gcgagagaagtacctttaccaaaag

SEQ ID NO: 558333 - DNA, 25 bp, Mus musculus
gcgagagaagtagctttaccaaaag

SEQ ID NO: 558334 - DNA, 25 bp, Mus musculus
gcgagagaccgacacttttgacatg

SEQ ID NO: 558335 - DNA, 25 bp, Mus musculus
gcgagagaccgagacttttgacatg

SEQ ID NO: 558336 - DNA, 25 bp, Mus musculus
gcgagagatcagcttcatgtttcca

SEQ ID NO: 558337 - DNA, 25 bp, Mus musculus
gcgagagatcaggttcatgtttcca

SEQ ID NO: 558338 - DNA, 25 bp, Mus musculus
gcgagagatcgtccacattcaggca

SEQ ID NO: 558339 - DNA, 25 bp, Mus musculus
gcgagagatcgtgcacattcaggca

SEQ ID NO: 558340 - DNA, 25 bp, Mus musculus
gcgagagccaagataccttactgta

SEQ ID NO: 558341 - DNA, 25 bp, Mus musculus
gcgagagccaagttaccttactgta

SEQ ID NO: 558342 - DNA, 25 bp, Mus musculus
gcgagagcgagaaaattgatcctga

SEQ ID NO: 558343 - DNA, 25 bp, Mus musculus
gcgagagcgagaagagcttccagct

SEQ ID NO: 558344 - DNA, 25 bp, Mus musculus
gcgagagcgagataattgatcctga

SEQ ID NO: 558345 - DNA, 25 bp, Mus musculus
gcgagagcgagatgagcttccagct

SEQ ID NO: 558346 - DNA, 25 bp, Mus musculus
gcgagaggaggcctagcatgttcga

SEQ ID NO: 558347 - DNA, 25 bp, Mus musculus
gcgagaggaggcgtagcatgttcga

SEQ ID NO: 558348 - DNA, 25 bp, Mus musculus
gcgagataatgcaccttaagttttt

SEQ ID NO: 558349 - DNA, 25 bp, Mus musculus
gcgagataatgctccttaagttttt

SEQ ID NO: 558350 - DNA, 25 bp, Mus musculus
gcgagatcgcgccgcgcttcaacat

SEQ ID NO: 558351 - DNA, 25 bp, Mus musculus
gcgagatcgcgcggcgcttcaacat

SEQ ID NO: 558352 - DNA, 25 bp, Mus musculus
gcgagatctcagctttaaagagcag

SEQ ID NO: 558353 - DNA, 25 bp, Mus musculus
gcgagatctcaggtttaaagagcag

SEQ ID NO: 558354 - DNA, 25 bp, Mus musculus
gcgagatctctgagatcagggcata

SEQ ID NO: 558355 - DNA, 25 bp, Mus musculus
gcgagatctctgtgatcagggcata

SEQ ID NO: 558356 - DNA, 25 bp, Mus musculus
gcgagatcttcgcaggagactcaca

SEQ ID NO: 558357 - DNA, 25 bp, Mus musculus
gcgagatcttcggaggagactcaca

SEQ ID NO: 558358 - DNA, 25 bp, Mus musculus
gcgagatggaacaggacttggacta

SEQ ID NO: 558359 - DNA, 25 bp, Mus musculus
gcgagatggaactggacttggacta

SEQ ID NO: 558360 - DNA, 25 bp, Mus musculus
gcgagattattaaacacttggatta

SEQ ID NO: 558361 - DNA, 25 bp, Mus musculus
gcgagattattatacacttggatta

SEQ ID NO: 558362 - DNA, 25 bp, Mus musculus
gcgagattggtgaaaagttctattt

SEQ ID NO: 558363 - DNA, 25 bp, Mus musculus
gcgagattggtgtaaagttctattt

SEQ ID NO: 558364 - DNA, 25 bp, Mus musculus
gcgagcaatattctgtagtcatttt

SEQ ID NO: 558365 - DNA, 25 bp, Mus musculus
gcgagcaatattgtgtagtcatttt

SEQ ID NO: 558366 - DNA, 25 bp, Mus musculus
gcgagcacatcgacacaagtacaca

SEQ ID NO: 558367 - DNA, 25 bp, Mus musculus
gcgagcacatcgtcacaagtacaca

SEQ ID NO: 558368 - DNA, 25 bp, Mus musculus
gcgagcaccttacctactgaatgag

SEQ ID NO: 558369 - DNA, 25 bp, Mus musculus
gcgagcaccttagctactgaatgag

SEQ ID NO: 558370 - DNA, 25 bp, Mus musculus
gcgagcagacataaccgaacgattg

SEQ ID NO: 558371 - DNA, 25 bp, Mus musculus
gcgagcagacattaccgaacgattg

SEQ ID NO: 558372 - DNA, 25 bp, Mus musculus
gcgagcaggtgcacctgagcaatag

SEQ ID NO: 558373 - DNA, 25 bp, Mus musculus
gcgagcaggtgctcctgagcaatag

SEQ ID NO: 558374 - DNA, 25 bp, Mus musculus
gcgagcagtgccaacggaactataa

SEQ ID NO: 558375 - DNA, 25 bp, Mus musculus
gcgagcagtgcctacggaactataa

SEQ ID NO: 558376 - DNA, 25 bp, Mus musculus
gcgagcatcgttatcatttttgggc

SEQ ID NO: 558377 - DNA, 25 bp, Mus musculus
gcgagcatcgttttcatttttgggc

SEQ ID NO: 558378 - DNA, 25 bp, Mus musculus
gcgagccaagctcatgtcaactgtt

SEQ ID NO: 558379 - DNA, 25 bp, Mus musculus
gcgagccaagctgatgtcaactgtt

SEQ ID NO: 558380 - DNA, 25 bp, Mus musculus
gcgagccacaagctgcactgtgaaa

SEQ ID NO: 558381 - DNA, 25 bp, Mus musculus
gcgagccacaaggtgcactgtgaaa

SEQ ID NO: 558382 - DNA, 25 bp, Mus musculus
gcgagccaggccatgtgacacagga

SEQ ID NO: 558383 - DNA, 25 bp, Mus musculus
gcgagccaggccttgtgacacagga

SEQ ID NO: 558384 - DNA, 25 bp, Mus musculus
gcgagccatggacttgctcaaagtg

SEQ ID NO: 558385 - DNA, 25 bp, Mus musculus
gcgagccatggagttgctcaaagtg

SEQ ID NO: 558386 - DNA, 25 bp, Mus musculus
gcgagcccagcgaccgaaattgcga

SEQ ID NO: 558387 - DNA, 25 bp, Mus musculus
gcgagcccagcgtccgaaattgcga

SEQ ID NO: 558388 - DNA, 25 bp, Mus musculus
gcgagcccgggcagttgataatcag

SEQ ID NO: 558389 - DNA, 25 bp, Mus musculus
gcgagcccgggctgttgataatcag

SEQ ID NO: 558390 - DNA, 25 bp, Mus musculus
gcgagccctcagaaagcaagatgga

SEQ ID NO: 558391 - DNA, 25 bp, Mus musculus
gcgagccctcagtaagcaagatgga

SEQ ID NO: 558392 - DNA, 25 bp, Mus musculus
gcgagccctctgaccttggaaaggt

SEQ ID NO: 558393 - DNA, 25 bp, Mus musculus
gcgagccctctgtccttggaaaggt

SEQ ID NO: 558394 - DNA, 25 bp, Mus musculus
gcgagccctgctagcttaggtgagt

SEQ ID NO: 558395 - DNA, 25 bp, Mus musculus
gcgagccctgcttgcttaggtgagt

SEQ ID NO: 558396 - DNA, 25 bp, Mus musculus
gcgagccgggttcttgatgacccac

SEQ ID NO: 558397 - DNA, 25 bp, Mus musculus
gcgagccgggttgttgatgacccac

SEQ ID NO: 558398 - DNA, 25 bp, Mus musculus
gcgagcctgattcctatcatgaagt

SEQ ID NO: 558399 - DNA, 25 bp, Mus musculus
gcgagcctgattgctatcatgaagt

SEQ ID NO: 558400 - DNA, 25 bp, Mus musculus
gcgagcgatgagacagtctgagttt

SEQ ID NO: 558401 - DNA, 25 bp, Mus musculus
gcgagcgatgagtcagtctgagttt

SEQ ID NO: 558402 - DNA, 25 bp, Mus musculus
gcgagcgcccgtacgcatgcgccga

SEQ ID NO: 558403 - DNA, 25 bp, Mus musculus
gcgagcgcccgttcgcatgcgccga

SEQ ID NO: 558404 - DNA, 25 bp, Mus musculus
gcgagcgccggtccaaataacgttg

SEQ ID NO: 558405 - DNA, 25 bp, Mus musculus
gcgagcgccggtgcaaataacgttg

SEQ ID NO: 558406 - DNA, 25 bp, Mus musculus
gcgagcgcgagaaagtagctgttct

SEQ ID NO: 558407 - DNA, 25 bp, Mus musculus
gcgagcgcgagatagtagctgttct

SEQ ID NO: 558408 - DNA, 25 bp, Mus musculus
gcgagcgcgctcctgtaagcttgcc

SEQ ID NO: 558409 - DNA, 25 bp, Mus musculus
gcgagcgcgctcgtgtaagcttgcc

SEQ ID NO: 558410 - DNA, 25 bp, Mus musculus
gcgagcgctgtgcattgcagcattt

SEQ ID NO: 558411 - DNA, 25 bp, Mus musculus
gcgagcgctgtggattgcagcattt

SEQ ID NO: 558412 - DNA, 25 bp, Mus musculus
gcgagcgcttatcgtcttcagggta

SEQ ID NO: 558413 - DNA, 25 bp, Mus musculus
gcgagcgcttatggtcttcagggta

SEQ ID NO: 558414 - DNA, 25 bp, Mus musculus
gcgagcgcttttcatttggcagatt

SEQ ID NO: 558415 - DNA, 25 bp, Mus musculus
gcgagcgcttttgatttggcagatt

SEQ ID NO: 558416 - DNA, 25 bp, Mus musculus
gcgagcgggccaaaaacaggctaaa

SEQ ID NO: 558417 - DNA, 25 bp, Mus musculus
gcgagcgggccataaacaggctaaa

SEQ ID NO: 558418 - DNA, 25 bp, Mus musculus
gcgagcgtcggtatgggcaacttca

SEQ ID NO: 558419 - DNA, 25 bp, Mus musculus
gcgagcgtcggtttgggcaacttca

SEQ ID NO: 558420 - DNA, 25 bp, Mus musculus
gcgagcgtgagcctccaaagaagaa

SEQ ID NO: 558421 - DNA, 25 bp, Mus musculus
gcgagcgtgagcgtccaaagaagaa

SEQ ID NO: 558422 - DNA, 25 bp, Mus musculus
gcgagcgtgagtaccagcagtagca

SEQ ID NO: 558423 - DNA, 25 bp, Mus musculus
gcgagcgtgagttccagcagtagca

SEQ ID NO: 558424 - DNA, 25 bp, Mus musculus
gcgagctaacttctacttattcttg

SEQ ID NO: 558425 - DNA, 25 bp, Mus musculus
gcgagctaacttgtacttattcttg

SEQ ID NO: 558426 - DNA, 25 bp, Mus musculus
gcgagctacatcaggttcactggaa

SEQ ID NO: 558427 - DNA, 25 bp, Mus musculus
gcgagctacatctggttcactggaa

SEQ ID NO: 558428 - DNA, 25 bp, Mus musculus
gcgagctcaacaacgagatcctggg

SEQ ID NO: 558429 - DNA, 25 bp, Mus musculus
gcgagctcaacatcgagatcctggg

SEQ ID NO: 558430 - DNA, 25 bp, Mus musculus
gcgagctccagaaggtcccgggcct

SEQ ID NO: 558431 - DNA, 25 bp, Mus musculus
gcgagctccagatggtcccgggcct

SEQ ID NO: 558432 - DNA, 25 bp, Mus musculus
gcgagctcctgaccatagtctgtca

SEQ ID NO: 558433 - DNA, 25 bp, Mus musculus
gcgagctcctgagcatagtctgtca

SEQ ID NO: 558434 - DNA, 25 bp, Mus musculus
gcgagctctcgtcaactgcaatcga

SEQ ID NO: 558435 - DNA, 25 bp, Mus musculus
gcgagctctcgtgaactgcaatcga

SEQ ID NO: 558436 - DNA, 25 bp, Mus musculus
gcgagctcttcaaccgtttaagttc

SEQ ID NO: 558437 - DNA, 25 bp, Mus musculus
gcgagctcttcatccgtttaagttc

SEQ ID NO: 558438 - DNA, 25 bp, Mus musculus
gcgagctgaggtccttgttttacca

SEQ ID NO: 558439 - DNA, 25 bp, Mus musculus
gcgagctgaggtgcttgttttacca

SEQ ID NO: 558440 - DNA, 25 bp, Mus musculus
gcgagctgatccataagcgctacga

SEQ ID NO: 558441 - DNA, 25 bp, Mus musculus
gcgagctgatccttaagcgctacga

SEQ ID NO: 558442 - DNA, 25 bp, Mus musculus
gcgagctgatgtccactggagttct

SEQ ID NO: 558443 - DNA, 25 bp, Mus musculus
gcgagctgatgtgcactggagttct

SEQ ID NO: 558444 - DNA, 25 bp, Mus musculus
gcgagctgctgacattggtgataca

SEQ ID NO: 558445 - DNA, 25 bp, Mus musculus
gcgagctgctgagattggtgataca

SEQ ID NO: 558446 - DNA, 25 bp, Mus musculus
gcgagctggctcacttaaattcttg

SEQ ID NO: 558447 - DNA, 25 bp, Mus musculus
gcgagctggctctcttaaattcttg

SEQ ID NO: 558448 - DNA, 25 bp, Mus musculus
gcgagctgggctaagagcactacca

SEQ ID NO: 558449 - DNA, 25 bp, Mus musculus
gcgagctgggcttagagcactacca

SEQ ID NO: 558450 - DNA, 25 bp, Mus musculus
gcgagctgtactaatcggtgaatca

SEQ ID NO: 558451 - DNA, 25 bp, Mus musculus
gcgagctgtacttatcggtgaatca

SEQ ID NO: 558452 - DNA, 25 bp, Mus musculus
gcgagctgtgctcttatagatacca

SEQ ID NO: 558453 - DNA, 25 bp, Mus musculus
gcgagctgtgctgttatagatacca

SEQ ID NO: 558454 - DNA, 25 bp, Mus musculus
gcgagctgttaaattgcactgggat

SEQ ID NO: 558455 - DNA, 25 bp, Mus musculus
gcgagctgttaatttgcactgggat

SEQ ID NO: 558456 - DNA, 25 bp, Mus musculus
gcgagcttcagtcaacgcgatggtt

SEQ ID NO: 558457 - DNA, 25 bp, Mus musculus
gcgagcttcagtgaacgcgatggtt

SEQ ID NO: 558458 - DNA, 25 bp, Mus musculus
gcgagcttgctgcacattgaattga

SEQ ID NO: 558459 - DNA, 25 bp, Mus musculus
gcgagcttgctggacattgaattga

SEQ ID NO: 558460 - DNA, 25 bp, Mus musculus
gcgagctttcatcttcagcatgcac

SEQ ID NO: 558461 - DNA, 25 bp, Mus musculus
gcgagctttcatgttcagcatgcac

SEQ ID NO: 558462 - DNA, 25 bp, Mus musculus
gcgagctttcgacgttttggatcca

SEQ ID NO: 558463 - DNA, 25 bp, Mus musculus
gcgagctttcgaggttttggatcca

SEQ ID NO: 558464 - DNA, 25 bp, Mus musculus
gcgaggaaagaaaacctagcgagca

SEQ ID NO: 558465 - DNA, 25 bp, Mus musculus
gcgaggaaagaatacctagcgagca

SEQ ID NO: 558466 - DNA, 25 bp, Mus musculus
gcgaggaaatcaccattatcacaac

SEQ ID NO: 558467 - DNA, 25 bp, Mus musculus
gcgaggaaatcagcattatcacaac

SEQ ID NO: 558468 - DNA, 25 bp, Mus musculus
gcgaggaacaggaaactgtccccat

SEQ ID NO: 558469 - DNA, 25 bp, Mus musculus
gcgaggaacaggtaactgtccccat

SEQ ID NO: 558470 - DNA, 25 bp, Mus musculus
gcgaggacctgcagtgatgaagttc

SEQ ID NO: 558471 - DNA, 25 bp, Mus musculus
gcgaggacctgctgtgatgaagttc

SEQ ID NO: 558472 - DNA, 25 bp, Mus musculus
gcgaggactgcgatgccatgatgaa

SEQ ID NO: 558473 - DNA, 25 bp, Mus musculus
gcgaggactgcgttgccatgatgaa

SEQ ID NO: 558474 - DNA, 25 bp, Mus musculus
gcgaggactggcacactgatacagc

SEQ ID NO: 558475 - DNA, 25 bp, Mus musculus
gcgaggactggctcactgatacagc

SEQ ID NO: 558476 - DNA, 25 bp, Mus musculus
gcgaggacttcaattgcaactgtga

SEQ ID NO: 558477 - DNA, 25 bp, Mus musculus
gcgaggacttcatttgcaactgtga

SEQ ID NO: 558478 - DNA, 25 bp, Mus musculus
gcgaggagacttagccgccactgcg

SEQ ID NO: 558479 - DNA, 25 bp, Mus musculus
gcgaggagactttgccgccactgcg

SEQ ID NO: 558480 - DNA, 25 bp, Mus musculus
gcgaggagctcaagtacaacccttt

SEQ ID NO: 558481 - DNA, 25 bp, Mus musculus
gcgaggagctcatgtacaacccttt

SEQ ID NO: 558482 - DNA, 25 bp, Mus musculus
gcgaggaggaggatcagcccatcta

SEQ ID NO: 558483 - DNA, 25 bp, Mus musculus
gcgaggaggaggttcagcccatcta

SEQ ID NO: 558484 - DNA, 25 bp, Mus musculus
gcgaggagttacattatgttcttct

SEQ ID NO: 558485 - DNA, 25 bp, Mus musculus
gcgaggagttactttatgttcttct

SEQ ID NO: 558486 - DNA, 25 bp, Mus musculus
gcgaggagttcaccagccgcatgca

SEQ ID NO: 558487 - DNA, 25 bp, Mus musculus
gcgaggagttcagcagccgcatgca

SEQ ID NO: 558488 - DNA, 25 bp, Mus musculus
gcgaggagttggaccacgttttcaa

SEQ ID NO: 558489 - DNA, 25 bp, Mus musculus
gcgaggagttggtccacgttttcaa

SEQ ID NO: 558490 - DNA, 25 bp, Mus musculus
gcgaggatgacaaggttaagctaca

SEQ ID NO: 558491 - DNA, 25 bp, Mus musculus
gcgaggatgacatggttaagctaca

SEQ ID NO: 558492 - DNA, 25 bp, Mus musculus
gcgaggatgccgatgaattgcacaa

SEQ ID NO: 558493 - DNA, 25 bp, Mus musculus
gcgaggatgccgttgaattgcacaa

SEQ ID NO: 558494 - DNA, 25 bp, Mus musculus
gcgaggatgtaaatgggctatacca

SEQ ID NO: 558495 - DNA, 25 bp, Mus musculus
gcgaggatgtaattgggctatacca

SEQ ID NO: 558496 - DNA, 25 bp, Mus musculus
gcgaggcgttttacccggtcaagcg

SEQ ID NO: 558497 - DNA, 25 bp, Mus musculus
gcgaggcgtttttcccggtcaagcg

SEQ ID NO: 558498 - DNA, 25 bp, Mus musculus
gcgagggaaactaagctctctgcca

SEQ ID NO: 558499 - DNA, 25 bp, Mus musculus
gcgagggaaacttagctctctgcca

SEQ ID NO: 558500 - DNA, 25 bp, Mus musculus
gcgagggaaatgatggtctctcata

SEQ ID NO: 558501 - DNA, 25 bp, Mus musculus
gcgagggaaatgttggtctctcata

SEQ ID NO: 558502 - DNA, 25 bp, Mus musculus
gcgagggaccgcatcgagcgtctct

SEQ ID NO: 558503 - DNA, 25 bp, Mus musculus
gcgagggaccgcttcgagcgtctct

SEQ ID NO: 558504 - DNA, 25 bp, Mus musculus
gcgagggagctgctttgctacatat

SEQ ID NO: 558505 - DNA, 25 bp, Mus musculus
gcgagggagctggtttgctacatat

SEQ ID NO: 558506 - DNA, 25 bp, Mus musculus
gcgagggatgttacgctatcccaat

SEQ ID NO: 558507 - DNA, 25 bp, Mus musculus
gcgagggatgtttcgctatcccaat

SEQ ID NO: 558508 - DNA, 25 bp, Mus musculus
gcgagggcagctcagccacggcggg

SEQ ID NO: 558509 - DNA, 25 bp, Mus musculus
gcgagggcagctgagccacggcggg

SEQ ID NO: 558510 - DNA, 25 bp, Mus musculus
gcgagggcccttagatcaggatcct

SEQ ID NO: 558511 - DNA, 25 bp, Mus musculus
gcgagggccctttgatcaggatcct

SEQ ID NO: 558512 - DNA, 25 bp, Mus musculus
gcgaggtacccacggaagaatcatt

SEQ ID NO: 558513 - DNA, 25 bp, Mus musculus
gcgaggtacccagggaagaatcatt

SEQ ID NO: 558514 - DNA, 25 bp, Mus musculus
gcgaggtcagatcgcatgttccaga

SEQ ID NO: 558515 - DNA, 25 bp, Mus musculus
gcgaggtcagatggcatgttccaga

SEQ ID NO: 558516 - DNA, 25 bp, Mus musculus
gcgaggtccaggacaatctgggtta

SEQ ID NO: 558517 - DNA, 25 bp, Mus musculus
gcgaggtccaggtcaatctgggtta

SEQ ID NO: 558518 - DNA, 25 bp, Mus musculus
gcgaggtgcctcagtatctagaatg

SEQ ID NO: 558519 - DNA, 25 bp, Mus musculus
gcgaggtgcctctgtatctagaatg

SEQ ID NO: 558520 - DNA, 25 bp, Mus musculus
gcgaggtgcgctacgagtccatccg

SEQ ID NO: 558521 - DNA, 25 bp, Mus musculus
gcgaggtgcgcttcgagtccatccg

SEQ ID NO: 558522 - DNA, 25 bp, Mus musculus
gcgaggtgcggccactttcatccgt

SEQ ID NO: 558523 - DNA, 25 bp, Mus musculus
gcgaggtgcggcgactttcatccgt

SEQ ID NO: 558524 - DNA, 25 bp, Mus musculus
gcgaggtggacaacaaaatagctac

SEQ ID NO: 558525 - DNA, 25 bp, Mus musculus
gcgaggtggacatcaaaatagctac

SEQ ID NO: 558526 - DNA, 25 bp, Mus musculus
gcgaggtgtctaagaggcttcccta

SEQ ID NO: 558527 - DNA, 25 bp, Mus musculus
gcgaggtgtctatgaggcttcccta

SEQ ID NO: 558528 - DNA, 25 bp, Mus musculus
gcgaggttcttcataccgaatctaa

SEQ ID NO: 558529 - DNA, 25 bp, Mus musculus
gcgaggttcttcttaccgaatctaa

SEQ ID NO: 558530 - DNA, 25 bp, Mus musculus
gcgagtaacaacatgccacgtaaag

SEQ ID NO: 558531 - DNA, 25 bp, Mus musculus
gcgagtaacaacttgccacgtaaag

SEQ ID NO: 558532 - DNA, 25 bp, Mus musculus
gcgagtaatttcctttccctgatta

SEQ ID NO: 558533 - DNA, 25 bp, Mus musculus
gcgagtaatttcgtttccctgatta

SEQ ID NO: 558534 - DNA, 25 bp, Mus musculus
gcgagtacaggtctagtgtttctac

SEQ ID NO: 558535 - DNA, 25 bp, Mus musculus
gcgagtacaggtgtagtgtttctac

SEQ ID NO: 558536 - DNA, 25 bp, Mus musculus
gcgagtagagtcatcttggttcttt

SEQ ID NO: 558537 - DNA, 25 bp, Mus musculus
gcgagtagagtcttcttggttcttt

SEQ ID NO: 558538 - DNA, 25 bp, Mus musculus
gcgagtagttttacttcaagctgtg

SEQ ID NO: 558539 - DNA, 25 bp, Mus musculus
gcgagtagtttttcttcaagctgtg

SEQ ID NO: 558540 - DNA, 25 bp, Mus musculus
gcgagtatggccagcaggcgtacac

SEQ ID NO: 558541 - DNA, 25 bp, Mus musculus
gcgagtatggcctgcaggcgtacac

SEQ ID NO: 558542 - DNA, 25 bp, Mus musculus
gcgagtattctcaccagtctttttt

SEQ ID NO: 558543 - DNA, 25 bp, Mus musculus
gcgagtattctctccagtctttttt

SEQ ID NO: 558544 - DNA, 25 bp, Mus musculus
gcgagtcagatgattttattttccg

SEQ ID NO: 558545 - DNA, 25 bp, Mus musculus
gcgagtcagatgtttttattttccg

SEQ ID NO: 558546 - DNA, 25 bp, Mus musculus
gcgagtcccttcatttggttttccg

SEQ ID NO: 558547 - DNA, 25 bp, Mus musculus
gcgagtcccttcttttggttttccg

SEQ ID NO: 558548 - DNA, 25 bp, Mus musculus
gcgagtctattcaaccaactctgtg

SEQ ID NO: 558549 - DNA, 25 bp, Mus musculus
gcgagtctattctaccaactctgtg

SEQ ID NO: 558550 - DNA, 25 bp, Mus musculus
gcgagtctgcaaaagaatttgaaac

SEQ ID NO: 558551 - DNA, 25 bp, Mus musculus
gcgagtctgcaatagaatttgaaac

SEQ ID NO: 558552 - DNA, 25 bp, Mus musculus
gcgagtgagcgaacagttttttgac

SEQ ID NO: 558553 - DNA, 25 bp, Mus musculus
gcgagtgagcgatcagttttttgac

SEQ ID NO: 558554 - DNA, 25 bp, Mus musculus
gcgagtgagtgcagcttctgtaata

SEQ ID NO: 558555 - DNA, 25 bp, Mus musculus
gcgagtgagtgctgcttctgtaata

SEQ ID NO: 558556 - DNA, 25 bp, Mus musculus
gcgagtgatcaccatcatgcagaac

SEQ ID NO: 558557 - DNA, 25 bp, Mus musculus
gcgagtgatcacgatcatgcagaac

SEQ ID NO: 558558 - DNA, 25 bp, Mus musculus
gcgagtgcaggtccatgcttccaga

SEQ ID NO: 558559 - DNA, 25 bp, Mus musculus
gcgagtgcaggtgcatgcttccaga

SEQ ID NO: 558560 - DNA, 25 bp, Mus musculus
gcgagtgctacacggtaattgcatt

SEQ ID NO: 558561 - DNA, 25 bp, Mus musculus
gcgagtgctacagggtaattgcatt

SEQ ID NO: 558562 - DNA, 25 bp, Mus musculus
gcgagtgcttcaaagtaagaacaag

SEQ ID NO: 558563 - DNA, 25 bp, Mus musculus
gcgagtgcttcatagtaagaacaag

SEQ ID NO: 558564 - DNA, 25 bp, Mus musculus
gcgagtgcttcgcagtaagtccata

SEQ ID NO: 558565 - DNA, 25 bp, Mus musculus
gcgagtgcttcggagtaagtccata

SEQ ID NO: 558566 - DNA, 25 bp, Mus musculus
gcgagtgcttgactagccttcagaa

SEQ ID NO: 558567 - DNA, 25 bp, Mus musculus
gcgagtgcttgagtagccttcagaa

SEQ ID NO: 558568 - DNA, 25 bp, Mus musculus
gcgagtggacggcttacagtattac

SEQ ID NO: 558569 - DNA, 25 bp, Mus musculus
gcgagtggacgggttacagtattac

SEQ ID NO: 558570 - DNA, 25 bp, Mus musculus
gcgagtgtgcttataagcctgcatt

SEQ ID NO: 558571 - DNA, 25 bp, Mus musculus
gcgagtgtgcttttaagcctgcatt

SEQ ID NO: 558572 - DNA, 25 bp, Mus musculus
gcgagtgttaacctgtcagctttta

SEQ ID NO: 558573 - DNA, 25 bp, Mus musculus
gcgagtgttaacgtgtcagctttta

SEQ ID NO: 558574 - DNA, 25 bp, Mus musculus
gcgagtgttactaagcctttagaat

SEQ ID NO: 558575 - DNA, 25 bp, Mus musculus
gcgagtgttacttagcctttagaat

SEQ ID NO: 558576 - DNA, 25 bp, Mus musculus
gcgagttctagacctcacactcagg

SEQ ID NO: 558577 - DNA, 25 bp, Mus musculus
gcgagttctagagctcacactcagg

SEQ ID NO: 558578 - DNA, 25 bp, Mus musculus
gcgagttgctttagttctctatgta

SEQ ID NO: 558579 - DNA, 25 bp, Mus musculus
gcgagttgcttttgttctctatgta

SEQ ID NO: 558580 - DNA, 25 bp, Mus musculus
gcgagttgtgctcctccacagtaga

SEQ ID NO: 558581 - DNA, 25 bp, Mus musculus
gcgagttgtgctgctccacagtaga

SEQ ID NO: 558582 - DNA, 25 bp, Mus musculus
gcgagtttattcagcatttacacca

SEQ ID NO: 558583 - DNA, 25 bp, Mus musculus
gcgagtttattctgcatttacacca

SEQ ID NO: 558584 - DNA, 25 bp, Mus musculus
gcgagtttcgcaaaagcttctgtaa

SEQ ID NO: 558585 - DNA, 25 bp, Mus musculus
gcgagtttcgcataagcttctgtaa

SEQ ID NO: 558586 - DNA, 25 bp, Mus musculus
gcgagtttctacaacagggagcttt

SEQ ID NO: 558587 - DNA, 25 bp, Mus musculus
gcgagtttctactacagggagcttt

SEQ ID NO: 558588 - DNA, 25 bp, Mus musculus
gcgataaaggtcaaaaaccgatgga

SEQ ID NO: 558589 - DNA, 25 bp, Mus musculus
gcgataaaggtctaaaaccgatgga

SEQ ID NO: 558590 - DNA, 25 bp, Mus musculus
gcgataaggcccaaggtaggctaaa

SEQ ID NO: 558591 - DNA, 25 bp, Mus musculus
gcgataaggccctaggtaggctaaa

SEQ ID NO: 558592 - DNA, 25 bp, Mus musculus
gcgatacaagcgcatccaacgcaag

SEQ ID NO: 558593 - DNA, 25 bp, Mus musculus
gcgatacaagcggatccaacgcaag

SEQ ID NO: 558594 - DNA, 25 bp, Mus musculus
gcgatacatctgaaacacacagctt

SEQ ID NO: 558595 - DNA, 25 bp, Mus musculus
gcgatacatctgtaacacacagctt

SEQ ID NO: 558596 - DNA, 25 bp, Mus musculus
gcgatacgaggtactttctaagcta

SEQ ID NO: 558597 - DNA, 25 bp, Mus musculus
gcgatacgaggttctttctaagcta

SEQ ID NO: 558598 - DNA, 25 bp, Mus musculus
gcgatacgccaacaacagcaattac

SEQ ID NO: 558599 - DNA, 25 bp, Mus musculus
gcgatacgccaagaacagcaattac

SEQ ID NO: 558600 - DNA, 25 bp, Mus musculus
gcgatactcctaaaacataaacata

SEQ ID NO: 558601 - DNA, 25 bp, Mus musculus
gcgatactcctataacataaacata

SEQ ID NO: 558602 - DNA, 25 bp, Mus musculus
gcgatagacccaccacccagtgaat

SEQ ID NO: 558603 - DNA, 25 bp, Mus musculus
gcgatagacccagcacccagtgaat

SEQ ID NO: 558604 - DNA, 25 bp, Mus musculus
gcgatataagcgagccggctgaaga

SEQ ID NO: 558605 - DNA, 25 bp, Mus musculus
gcgatataagcgtgccggctgaaga

SEQ ID NO: 558606 - DNA, 25 bp, Mus musculus
gcgatatctgtgaccgtcgtagtga

SEQ ID NO: 558607 - DNA, 25 bp, Mus musculus
gcgatatctgtgtccgtcgtagtga

SEQ ID NO: 558608 - DNA, 25 bp, Mus musculus
gcgatatgagcaactgcctcaggct

SEQ ID NO: 558609 - DNA, 25 bp, Mus musculus
gcgatatgagcatctgcctcaggct

SEQ ID NO: 558610 - DNA, 25 bp, Mus musculus
gcgatattatgtcttctctctgcag

SEQ ID NO: 558611 - DNA, 25 bp, Mus musculus
gcgatattatgtgttctctctgcag

SEQ ID NO: 558612 - DNA, 25 bp, Mus musculus
gcgatcaaggccacttaggttacat

SEQ ID NO: 558613 - DNA, 25 bp, Mus musculus
gcgatcaaggcctcttaggttacat

SEQ ID NO: 558614 - DNA, 25 bp, Mus musculus
gcgatcacaagcctcctgataagat

SEQ ID NO: 558615 - DNA, 25 bp, Mus musculus
gcgatcacaagcgtcctgataagat

SEQ ID NO: 558616 - DNA, 25 bp, Mus musculus
gcgatcagatgaagacggaccacct

SEQ ID NO: 558617 - DNA, 25 bp, Mus musculus
gcgatcagatgatgacggaccacct

SEQ ID NO: 558618 - DNA, 25 bp, Mus musculus
gcgatcagcagcaggactgcgcctt

SEQ ID NO: 558619 - DNA, 25 bp, Mus musculus
gcgatcagcagctggactgcgcctt

SEQ ID NO: 558620 - DNA, 25 bp, Mus musculus
gcgatcagcattctagtcctgggat

SEQ ID NO: 558621 - DNA, 25 bp, Mus musculus
gcgatcagcattgtagtcctgggat

SEQ ID NO: 558622 - DNA, 25 bp, Mus musculus
gcgatcagtcgtatacagaacattc

SEQ ID NO: 558623 - DNA, 25 bp, Mus musculus
gcgatcagtcgtttacagaacattc

SEQ ID NO: 558624 - DNA, 25 bp, Mus musculus
gcgatcatcatacaggccatctgct

SEQ ID NO: 558625 - DNA, 25 bp, Mus musculus
gcgatcatcatagaggccatctgct

SEQ ID NO: 558626 - DNA, 25 bp, Mus musculus
gcgatcatccacatattcctgaaac

SEQ ID NO: 558627 - DNA, 25 bp, Mus musculus
gcgatcatccacttattcctgaaac

SEQ ID NO: 558628 - DNA, 25 bp, Mus musculus
gcgatccattcgcttataggcagat

SEQ ID NO: 558629 - DNA, 25 bp, Mus musculus
gcgatccattcggttataggcagat

SEQ ID NO: 558630 - DNA, 25 bp, Mus musculus
gcgatcgggccaagcgggtttggca

SEQ ID NO: 558631 - DNA, 25 bp, Mus musculus
gcgatcgggccatgcgggtttggca

SEQ ID NO: 558632 - DNA, 25 bp, Mus musculus
gcgatctattatatcttaggttcac

SEQ ID NO: 558633 - DNA, 25 bp, Mus musculus
gcgatctattatttcttaggttcac

SEQ ID NO: 558634 - DNA, 25 bp, Mus musculus
gcgatctcgtcaactgtcttgtttc

SEQ ID NO: 558635 - DNA, 25 bp, Mus musculus
gcgatctcgtcatctgtcttgtttc

SEQ ID NO: 558636 - DNA, 25 bp, Mus musculus
gcgatctctattagctggacatttt

SEQ ID NO: 558637 - DNA, 25 bp, Mus musculus
gcgatctctatttgctggacatttt

SEQ ID NO: 558638 - DNA, 25 bp, Mus musculus
gcgatctgagctctttgcatcataa

SEQ ID NO: 558639 - DNA, 25 bp, Mus musculus
gcgatctgagctgtttgcatcataa

SEQ ID NO: 558640 - DNA, 25 bp, Mus musculus
gcgatctgtagccatgcgtgacaaa

SEQ ID NO: 558641 - DNA, 25 bp, Mus musculus
gcgatctgtagcgatgcgtgacaaa

SEQ ID NO: 558642 - DNA, 25 bp, Mus musculus
gcgatctgtgttctctgcaggtgaa

SEQ ID NO: 558643 - DNA, 25 bp, Mus musculus
gcgatctgtgttgtctgcaggtgaa

SEQ ID NO: 558644 - DNA, 25 bp, Mus musculus
gcgatcttctgtcaggcattcaacc

SEQ ID NO: 558645 - DNA, 25 bp, Mus musculus
gcgatcttctgtgaggcattcaacc

SEQ ID NO: 558646 - DNA, 25 bp, Mus musculus
gcgatcttgtgtctgttgccatggt

SEQ ID NO: 558647 - DNA, 25 bp, Mus musculus
gcgatcttgtgtgtgttgccatggt

SEQ ID NO: 558648 - DNA, 25 bp, Mus musculus
gcgatgaatctacccaaacaatgga

SEQ ID NO: 558649 - DNA, 25 bp, Mus musculus
gcgatgaatctagccaaacaatgga

SEQ ID NO: 558650 - DNA, 25 bp, Mus musculus
gcgatgaccccactgacaagttttt

SEQ ID NO: 558651 - DNA, 25 bp, Mus musculus
gcgatgaccccagtgacaagttttt

SEQ ID NO: 558652 - DNA, 25 bp, Mus musculus
gcgatgagcgaaaaccagaacctga

SEQ ID NO: 558653 - DNA, 25 bp, Mus musculus
gcgatgagcgaataccagaacctga

SEQ ID NO: 558654 - DNA, 25 bp, Mus musculus
gcgatgaggccactgtttccagaca

SEQ ID NO: 558655 - DNA, 25 bp, Mus musculus
gcgatgaggccagtgtttccagaca

SEQ ID NO: 558656 - DNA, 25 bp, Mus musculus
gcgatgaggcgcacctgttcttcag

SEQ ID NO: 558657 - DNA, 25 bp, Mus musculus
gcgatgaggcgctcctgttcttcag

SEQ ID NO: 558658 - DNA, 25 bp, Mus musculus
gcgatgagtcgtactgcaaggctta

SEQ ID NO: 558659 - DNA, 25 bp, Mus musculus
gcgatgagtcgttctgcaaggctta

SEQ ID NO: 558660 - DNA, 25 bp, Mus musculus
gcgatgatcattatttaccagccca

SEQ ID NO: 558661 - DNA, 25 bp, Mus musculus
gcgatgatcattttttaccagccca

SEQ ID NO: 558662 - DNA, 25 bp, Mus musculus
gcgatgatcggcacttggcaagcaa

SEQ ID NO: 558663 - DNA, 25 bp, Mus musculus
gcgatgatcggctcttggcaagcaa

SEQ ID NO: 558664 - DNA, 25 bp, Mus musculus
gcgatgatgacaacactctttcccg

SEQ ID NO: 558665 - DNA, 25 bp, Mus musculus
gcgatgatgacatcactctttcccg

SEQ ID NO: 558666 - DNA, 25 bp, Mus musculus
gcgatgattcagagaggctccttgt

SEQ ID NO: 558667 - DNA, 25 bp, Mus musculus
gcgatgattcagtgaggctccttgt

SEQ ID NO: 558668 - DNA, 25 bp, Mus musculus
gcgatgcactctcaagatgccgctt

SEQ ID NO: 558669 - DNA, 25 bp, Mus musculus
gcgatgcactctgaagatgccgctt

SEQ ID NO: 558670 - DNA, 25 bp, Mus musculus
gcgatgccaacgatgatgtcaaatt

SEQ ID NO: 558671 - DNA, 25 bp, Mus musculus
gcgatgccaacgttgatgtcaaatt

SEQ ID NO: 558672 - DNA, 25 bp, Mus musculus
gcgatgccccaactgtggaacccat

SEQ ID NO: 558673 - DNA, 25 bp, Mus musculus
gcgatgccccaagtgtggaacccat

SEQ ID NO: 558674 - DNA, 25 bp, Mus musculus
gcgatgccgctaatattcattgcgt

SEQ ID NO: 558675 - DNA, 25 bp, Mus musculus
gcgatgccgctattattcattgcgt

SEQ ID NO: 558676 - DNA, 25 bp, Mus musculus
gcgatgccgtttctttttcttagag

SEQ ID NO: 558677 - DNA, 25 bp, Mus musculus
gcgatgccgtttgtttttcttagag

SEQ ID NO: 558678 - DNA, 25 bp, Mus musculus
gcgatgcgtttaacccggaggaact

SEQ ID NO: 558679 - DNA, 25 bp, Mus musculus
gcgatgcgtttatcccggaggaact

SEQ ID NO: 558680 - DNA, 25 bp, Mus musculus
gcgatgctatcacttattggctact

SEQ ID NO: 558681 - DNA, 25 bp, Mus musculus
gcgatgctatcagttattggctact

SEQ ID NO: 558682 - DNA, 25 bp, Mus musculus
gcgatgctgagcaatacagaagcta

SEQ ID NO: 558683 - DNA, 25 bp, Mus musculus
gcgatgctgagctatacagaagcta

SEQ ID NO: 558684 - DNA, 25 bp, Mus musculus
gcgatgctggccagccacatgagtg

SEQ ID NO: 558685 - DNA, 25 bp, Mus musculus
gcgatgctggcctgccacatgagtg

SEQ ID NO: 558686 - DNA, 25 bp, Mus musculus
gcgatgcttgcccagcagatgcaat

SEQ ID NO: 558687 - DNA, 25 bp, Mus musculus
gcgatgcttgccgagcagatgcaat

SEQ ID NO: 558688 - DNA, 25 bp, Mus musculus
gcgatggatccacagagacttttta

SEQ ID NO: 558689 - DNA, 25 bp, Mus musculus
gcgatggatccagagagacttttta

SEQ ID NO: 558690 - DNA, 25 bp, Mus musculus
gcgatggcacagcttatgctccaga

SEQ ID NO: 558691 - DNA, 25 bp, Mus musculus
gcgatggcacaggttatgctccaga

SEQ ID NO: 558692 - DNA, 25 bp, Mus musculus
gcgatggcactgcagtcgccagtat

SEQ ID NO: 558693 - DNA, 25 bp, Mus musculus
gcgatggcactggagtcgccagtat

SEQ ID NO: 558694 - DNA, 25 bp, Mus musculus
gcgatggcgcgtccggcccaggtga

SEQ ID NO: 558695 - DNA, 25 bp, Mus musculus
gcgatggcgcgtgcggcccaggtga

SEQ ID NO: 558696 - DNA, 25 bp, Mus musculus
gcgatggcttgtatcggcaacgtaa

SEQ ID NO: 558697 - DNA, 25 bp, Mus musculus
gcgatggcttgtttcggcaacgtaa

SEQ ID NO: 558698 - DNA, 25 bp, Mus musculus
gcgatggggaacacaacttcgtgct

SEQ ID NO: 558699 - DNA, 25 bp, Mus musculus
gcgatggggaactcaacttcgtgct

SEQ ID NO: 558700 - DNA, 25 bp, Mus musculus
gcgatggtcataaatcagcttgtca

SEQ ID NO: 558701 - DNA, 25 bp, Mus musculus
gcgatggtcatatatcagcttgtca

SEQ ID NO: 558702 - DNA, 25 bp, Mus musculus
gcgatgtagcctcgttttaaatcca

SEQ ID NO: 558703 - DNA, 25 bp, Mus musculus
gcgatgtagcctggttttaaatcca

SEQ ID NO: 558704 - DNA, 25 bp, Mus musculus
gcgatgtcagtaattactaattcat

SEQ ID NO: 558705 - DNA, 25 bp, Mus musculus
gcgatgtcagtatttactaattcat

SEQ ID NO: 558706 - DNA, 25 bp, Mus musculus
gcgatgtcattgaatctctcataag

SEQ ID NO: 558707 - DNA, 25 bp, Mus musculus
gcgatgtcattgtatctctcataag

SEQ ID NO: 558708 - DNA, 25 bp, Mus musculus
gcgatgtgatgtccaactcggtcaa

SEQ ID NO: 558709 - DNA, 25 bp, Mus musculus
gcgatgtgatgtgcaactcggtcaa

SEQ ID NO: 558710 - DNA, 25 bp, Mus musculus
gcgatgtggatgcaccagtactcac

SEQ ID NO: 558711 - DNA, 25 bp, Mus musculus
gcgatgtggatggaccagtactcac

SEQ ID NO: 558712 - DNA, 25 bp, Mus musculus
gcgattacagtgagagccactagac

SEQ ID NO: 558713 - DNA, 25 bp, Mus musculus
gcgattacagtgtgagccactagac

SEQ ID NO: 558714 - DNA, 25 bp, Mus musculus
gcgattacggatatctttttcacaa

SEQ ID NO: 558715 - DNA, 25 bp, Mus musculus
gcgattacggatttctttttcacaa

SEQ ID NO: 558716 - DNA, 25 bp, Mus musculus
gcgattactggaaattgctgagaag

SEQ ID NO: 558717 - DNA, 25 bp, Mus musculus
gcgattactggatattgctgagaag

SEQ ID NO: 558718 - DNA, 25 bp, Mus musculus
gcgattcactcccactcaaaagatt

SEQ ID NO: 558719 - DNA, 25 bp, Mus musculus
gcgattcactccgactcaaaagatt

SEQ ID NO: 558720 - DNA, 25 bp, Mus musculus
gcgattcagccaatgatctctttca

SEQ ID NO: 558721 - DNA, 25 bp, Mus musculus
gcgattcagccattgatctctttca

SEQ ID NO: 558722 - DNA, 25 bp, Mus musculus
gcgattcatcgcaaaaccttctaat

SEQ ID NO: 558723 - DNA, 25 bp, Mus musculus
gcgattcatcgctaaaccttctaat

SEQ ID NO: 558724 - DNA, 25 bp, Mus musculus
gcgattccaacccagtgtaccggag

SEQ ID NO: 558725 - DNA, 25 bp, Mus musculus
gcgattccaaccgagtgtaccggag

SEQ ID NO: 558726 - DNA, 25 bp, Mus musculus
gcgattccccttaattagacttgta

SEQ ID NO: 558727 - DNA, 25 bp, Mus musculus
gcgattcccctttattagacttgta

SEQ ID NO: 558728 - DNA, 25 bp, Mus musculus
gcgattcccgcactcagaaagatga

SEQ ID NO: 558729 - DNA, 25 bp, Mus musculus
gcgattcccgcagtcagaaagatga

SEQ ID NO: 558730 - DNA, 25 bp, Mus musculus
gcgattcctggcaggcattatggtc

SEQ ID NO: 558731 - DNA, 25 bp, Mus musculus
gcgattcctggctggcattatggtc

SEQ ID NO: 558732 - DNA, 25 bp, Mus musculus
gcgattcctggtaattctgcagctc

SEQ ID NO: 558733 - DNA, 25 bp, Mus musculus
gcgattcctggttattctgcagctc

SEQ ID NO: 558734 - DNA, 25 bp, Mus musculus
gcgattccttacaatgtgtgtgtgc

SEQ ID NO: 558735 - DNA, 25 bp, Mus musculus
gcgattccttactatgtgtgtgtgc

SEQ ID NO: 558736 - DNA, 25 bp, Mus musculus
gcgattcggcttccaatttaaggac

SEQ ID NO: 558737 - DNA, 25 bp, Mus musculus
gcgattcggcttccactttaagaga

SEQ ID NO: 558738 - DNA, 25 bp, Mus musculus
gcgattcggcttgcaatttaaggac

SEQ ID NO: 558739 - DNA, 25 bp, Mus musculus
gcgattcggcttgcactttaagaga

SEQ ID NO: 558740 - DNA, 25 bp, Mus musculus
gcgattctacgtcgaaaattcccca

SEQ ID NO: 558741 - DNA, 25 bp, Mus musculus
gcgattctacgtggaaaattcccca

SEQ ID NO: 558742 - DNA, 25 bp, Mus musculus
gcgattgactcaagtggtgcgctca

SEQ ID NO: 558743 - DNA, 25 bp, Mus musculus
gcgattgactcatgtggtgcgctca

SEQ ID NO: 558744 - DNA, 25 bp, Mus musculus
gcgattgcgctcattcgcaggactt

SEQ ID NO: 558745 - DNA, 25 bp, Mus musculus
gcgattgcgctctttcgcaggactt

SEQ ID NO: 558746 - DNA, 25 bp, Mus musculus
gcgattgctcatcttggcatctgaa

SEQ ID NO: 558747 - DNA, 25 bp, Mus musculus
gcgattgctcatgttggcatctgaa

SEQ ID NO: 558748 - DNA, 25 bp, Mus musculus
gcgattgctgagatggacaccctga

SEQ ID NO: 558749 - DNA, 25 bp, Mus musculus
gcgattgctgagttggacaccctga

SEQ ID NO: 558750 - DNA, 25 bp, Mus musculus
gcgattgctgcaatgctgtctacca

SEQ ID NO: 558751 - DNA, 25 bp, Mus musculus
gcgattgctgcattgctgtctacca

SEQ ID NO: 558752 - DNA, 25 bp, Mus musculus
gcgattggccggactcgtctacgga

SEQ ID NO: 558753 - DNA, 25 bp, Mus musculus
gcgattggccggtctcgtctacgga

SEQ ID NO: 558754 - DNA, 25 bp, Mus musculus
gcgattggctacaatgttagcgtca

SEQ ID NO: 558755 - DNA, 25 bp, Mus musculus
gcgattggctactatgttagcgtca

SEQ ID NO: 558756 - DNA, 25 bp, Mus musculus
gcgattggtggcaacagcaaacact

SEQ ID NO: 558757 - DNA, 25 bp, Mus musculus
gcgattggtggctacagcaaacact

SEQ ID NO: 558758 - DNA, 25 bp, Mus musculus
gcgattgtccaaatctactttaatt

SEQ ID NO: 558759 - DNA, 25 bp, Mus musculus
gcgattgtccaattctactttaatt

SEQ ID NO: 558760 - DNA, 25 bp, Mus musculus
gcgattgtttctaagactagccctc

SEQ ID NO: 558761 - DNA, 25 bp, Mus musculus
gcgattgtttcttagactagccctc

SEQ ID NO: 558762 - DNA, 25 bp, Mus musculus
gcgattgtttgaaattcagtttagt

SEQ ID NO: 558763 - DNA, 25 bp, Mus musculus
gcgattgtttgatattcagtttagt

SEQ ID NO: 558764 - DNA, 25 bp, Mus musculus
gcgatttacccgatctcggcgggca

SEQ ID NO: 558765 - DNA, 25 bp, Mus musculus
gcgatttacccgttctcggcgggca

SEQ ID NO: 558766 - DNA, 25 bp, Mus musculus
gcgatttactgcaaggtcctgagtc

SEQ ID NO: 558767 - DNA, 25 bp, Mus musculus
gcgatttactgctaggtcctgagtc

SEQ ID NO: 558768 - DNA, 25 bp, Mus musculus
gcgatttatacgaagtgctgctctg

SEQ ID NO: 558769 - DNA, 25 bp, Mus musculus
gcgatttatacgtagtgctgctctg

SEQ ID NO: 558770 - DNA, 25 bp, Mus musculus
gcgatttctgccagtgagttcatgt

SEQ ID NO: 558771 - DNA, 25 bp, Mus musculus
gcgatttctgcctgtgagttcatgt

SEQ ID NO: 558772 - DNA, 25 bp, Mus musculus
gcgatttgatacattccaagtcttg

SEQ ID NO: 558773 - DNA, 25 bp, Mus musculus
gcgatttgatactttccaagtcttg

SEQ ID NO: 558774 - DNA, 25 bp, Mus musculus
gcgatttgggcacttcagttcttca

SEQ ID NO: 558775 - DNA, 25 bp, Mus musculus
gcgatttgggcagttcagttcttca

SEQ ID NO: 558776 - DNA, 25 bp, Mus musculus
gcgattttcaggctacgtttctaat

SEQ ID NO: 558777 - DNA, 25 bp, Mus musculus
gcgattttcagggtacgtttctaat

SEQ ID NO: 558778 - DNA, 25 bp, Mus musculus
gcgattttccagctccctattagaa

SEQ ID NO: 558779 - DNA, 25 bp, Mus musculus
gcgattttccaggtccctattagaa

SEQ ID NO: 558780 - DNA, 25 bp, Mus musculus
gcgatttttcttacacgggacttca

SEQ ID NO: 558781 - DNA, 25 bp, Mus musculus
gcgatttttctttcacgggacttca

SEQ ID NO: 558782 - DNA, 25 bp, Mus musculus
gcgatttttgagatcagggcctgcc

SEQ ID NO: 558783 - DNA, 25 bp, Mus musculus
gcgatttttgagttcagggcctgcc

SEQ ID NO: 558784 - DNA, 25 bp, Mus musculus
gcgcaaacagcaacttagccgttgt

SEQ ID NO: 558785 - DNA, 25 bp, Mus musculus
gcgcaaacagcatcttagccgttgt

SEQ ID NO: 558786 - DNA, 25 bp, Mus musculus
gcgcaaacagttaaggccggagtga

SEQ ID NO: 558787 - DNA, 25 bp, Mus musculus
gcgcaaacagtttaggccggagtga

SEQ ID NO: 558788 - DNA, 25 bp, Mus musculus
gcgcaaaccccgcttgatggaggaa

SEQ ID NO: 558789 - DNA, 25 bp, Mus musculus
gcgcaaaccccggttgatggaggaa

SEQ ID NO: 558790 - DNA, 25 bp, Mus musculus
gcgcaaagtattctaggattgtttt

SEQ ID NO: 558791 - DNA, 25 bp, Mus musculus
gcgcaaagtattgtaggattgtttt

SEQ ID NO: 558792 - DNA, 25 bp, Mus musculus
gcgcaaatgtcgcaatcctgccttt

SEQ ID NO: 558793 - DNA, 25 bp, Mus musculus
gcgcaaatgtcggaatcctgccttt

SEQ ID NO: 558794 - DNA, 25 bp, Mus musculus
gcgcaacaccatcctgggtgaagat

SEQ ID NO: 558795 - DNA, 25 bp, Mus musculus
gcgcaacaccatgctgggtgaagat

SEQ ID NO: 558796 - DNA, 25 bp, Mus musculus
gcgcaactatacacgatggcaggat

SEQ ID NO: 558797 - DNA, 25 bp, Mus musculus
gcgcaactatactcgatggcaggat

SEQ ID NO: 558798 - DNA, 25 bp, Mus musculus
gcgcaactccacagaatttaccaaa

SEQ ID NO: 558799 - DNA, 25 bp, Mus musculus
gcgcaactccactgaatttaccaaa

SEQ ID NO: 558800 - DNA, 25 bp, Mus musculus
gcgcaactgaatcgcttggacctaa

SEQ ID NO: 558801 - DNA, 25 bp, Mus musculus
gcgcaactgaatggcttggacctaa

SEQ ID NO: 558802 - DNA, 25 bp, Mus musculus
gcgcaactgtggacactatcaatgg

SEQ ID NO: 558803 - DNA, 25 bp, Mus musculus
gcgcaactgtggtcactatcaatgg

SEQ ID NO: 558804 - DNA, 25 bp, Mus musculus
gcgcaagaacttcgtagccccgagg

SEQ ID NO: 558805 - DNA, 25 bp, Mus musculus
gcgcaagaacttggtagccccgagg

SEQ ID NO: 558806 - DNA, 25 bp, Mus musculus
gcgcaagaatctatgaccctggaaa

SEQ ID NO: 558807 - DNA, 25 bp, Mus musculus
gcgcaagaatctttgaccctggaaa

SEQ ID NO: 558808 - DNA, 25 bp, Mus musculus
gcgcaagacggaccagagcgaaagc

SEQ ID NO: 558809 - DNA, 25 bp, Mus musculus
gcgcaagacggagcagagcgaaagc

SEQ ID NO: 558810 - DNA, 25 bp, Mus musculus
gcgcaagatgttcgaagatcacctc

SEQ ID NO: 558811 - DNA, 25 bp, Mus musculus
gcgcaagatgttggaagatcacctc

SEQ ID NO: 558812 - DNA, 25 bp, Mus musculus
gcgcaagctctacaagtgcatcaag

SEQ ID NO: 558813 - DNA, 25 bp, Mus musculus
gcgcaagctctagaagtgcatcaag

SEQ ID NO: 558814 - DNA, 25 bp, Mus musculus
gcgcaagctgcacattagtcacgac

SEQ ID NO: 558815 - DNA, 25 bp, Mus musculus
gcgcaagctgcagattagtcacgac

SEQ ID NO: 558816 - DNA, 25 bp, Mus musculus
gcgcaaggtgcactacttcatcatg

SEQ ID NO: 558817 - DNA, 25 bp, Mus musculus
gcgcaaggtgcagtacttcatcatg

SEQ ID NO: 558818 - DNA, 25 bp, Mus musculus
gcgcaagtatagattggtcacttat

SEQ ID NO: 558819 - DNA, 25 bp, Mus musculus
gcgcaagtatagtttggtcacttat

SEQ ID NO: 558820 - DNA, 25 bp, Mus musculus
gcgcaagtatgcagtcaaggcctga

SEQ ID NO: 558821 - DNA, 25 bp, Mus musculus
gcgcaagtatgcattcaaggcctga

SEQ ID NO: 558822 - DNA, 25 bp, Mus musculus
gcgcaagtatgctgtcaaggcctga

SEQ ID NO: 558823 - DNA, 25 bp, Mus musculus
gcgcaagtatgctttcaaggcctga

SEQ ID NO: 558824 - DNA, 25 bp, Mus musculus
gcgcaagtattaccctggccaggag

SEQ ID NO: 558825 - DNA, 25 bp, Mus musculus
gcgcaagtattagcctggccaggag

SEQ ID NO: 558826 - DNA, 25 bp, Mus musculus
gcgcaagtgactagtgcctccttgt

SEQ ID NO: 558827 - DNA, 25 bp, Mus musculus
gcgcaagtgacttgtgcctccttgt

SEQ ID NO: 558828 - DNA, 25 bp, Mus musculus
gcgcaagtgctcctgtaggtgtata

SEQ ID NO: 558829 - DNA, 25 bp, Mus musculus
gcgcaagtgctcgtgtaggtgtata

SEQ ID NO: 558830 - DNA, 25 bp, Mus musculus
gcgcaagtgggccatcggttcctac

SEQ ID NO: 558831 - DNA, 25 bp, Mus musculus
gcgcaagtgggcgatcggttcctac

SEQ ID NO: 558832 - DNA, 25 bp, Mus musculus
gcgcaatggtgtcgataacttggcc

SEQ ID NO: 558833 - DNA, 25 bp, Mus musculus
gcgcaatggtgtggataacttggcc

SEQ ID NO: 558834 - DNA, 25 bp, Mus musculus
gcgcaattccttaccgaattttctc

SEQ ID NO: 558835 - DNA, 25 bp, Mus musculus
gcgcaattcctttccgaattttctc

SEQ ID NO: 558836 - DNA, 25 bp, Mus musculus
gcgcaattctgtctctgttgtgaac

SEQ ID NO: 558837 - DNA, 25 bp, Mus musculus
gcgcaattctgtgtctgttgtgaac

SEQ ID NO: 558838 - DNA, 25 bp, Mus musculus
gcgcacaagaatcctgtccctggga

SEQ ID NO: 558839 - DNA, 25 bp, Mus musculus
gcgcacaagaatgctgtccctggga

SEQ ID NO: 558840 - DNA, 25 bp, Mus musculus
gcgcacaagggacaagaaccggtta

SEQ ID NO: 558841 - DNA, 25 bp, Mus musculus
gcgcacaagggagaagaaccggtta

SEQ ID NO: 558842 - DNA, 25 bp, Mus musculus
gcgcacaagggcaggcactggaaat

SEQ ID NO: 558843 - DNA, 25 bp, Mus musculus
gcgcacaagggctggcactggaaat

SEQ ID NO: 558844 - DNA, 25 bp, Mus musculus
gcgcacaccaccacatgcaaaagag

SEQ ID NO: 558845 - DNA, 25 bp, Mus musculus
gcgcacaccacctcatgcaaaagag

SEQ ID NO: 558846 - DNA, 25 bp, Mus musculus
gcgcacacttgaagaaggtgttttc

SEQ ID NO: 558847 - DNA, 25 bp, Mus musculus
gcgcacacttgatgaaggtgttttc

SEQ ID NO: 558848 - DNA, 25 bp, Mus musculus
gcgcacagaacgctcagctagtgaa

SEQ ID NO: 558849 - DNA, 25 bp, Mus musculus
gcgcacagaacggtcagctagtgaa

SEQ ID NO: 558850 - DNA, 25 bp, Mus musculus
gcgcacagcagcagaccacatggaa

SEQ ID NO: 558851 - DNA, 25 bp, Mus musculus
gcgcacagcagctgaccacatggaa

SEQ ID NO: 558852 - DNA, 25 bp, Mus musculus
gcgcacagcgatcctgaagacctag

SEQ ID NO: 558853 - DNA, 25 bp, Mus musculus
gcgcacagcgatgctgaagacctag

SEQ ID NO: 558854 - DNA, 25 bp, Mus musculus
gcgcacaggcaaaaccaagggctat

SEQ ID NO: 558855 - DNA, 25 bp, Mus musculus
gcgcacaggcaataccaagggctat

SEQ ID NO: 558856 - DNA, 25 bp, Mus musculus
gcgcacaggctgagggatccactgt

SEQ ID NO: 558857 - DNA, 25 bp, Mus musculus
gcgcacaggctgtgggatccactgt

SEQ ID NO: 558858 - DNA, 25 bp, Mus musculus
gcgcacaggtgcaacaagtggtcaa

SEQ ID NO: 558859 - DNA, 25 bp, Mus musculus
gcgcacaggtgctacaagtggtcaa

SEQ ID NO: 558860 - DNA, 25 bp, Mus musculus
gcgcacagtgagaaatttgctctgt

SEQ ID NO: 558861 - DNA, 25 bp, Mus musculus
gcgcacagtgagtaatttgctctgt

SEQ ID NO: 558862 - DNA, 25 bp, Mus musculus
gcgcacatatatacaccagctttta

SEQ ID NO: 558863 - DNA, 25 bp, Mus musculus
gcgcacatatattcaccagctttta

SEQ ID NO: 558864 - DNA, 25 bp, Mus musculus
gcgcacatttctctcatgagtgaag

SEQ ID NO: 558865 - DNA, 25 bp, Mus musculus
gcgcacatttctgtcatgagtgaag

SEQ ID NO: 558866 - DNA, 25 bp, Mus musculus
gcgcaccactttaggtttaggtcca

SEQ ID NO: 558867 - DNA, 25 bp, Mus musculus
gcgcaccacttttggtttaggtcca

SEQ ID NO: 558868 - DNA, 25 bp, Mus musculus
gcgcacccgcaactggagagagaca

SEQ ID NO: 558869 - DNA, 25 bp, Mus musculus
gcgcacccgcaagtggagagagaca

SEQ ID NO: 558870 - DNA, 25 bp, Mus musculus
gcgcaccgctgtaggcttgtggctc

SEQ ID NO: 558871 - DNA, 25 bp, Mus musculus
gcgcaccgctgttggcttgtggctc

SEQ ID NO: 558872 - DNA, 25 bp, Mus musculus
gcgcacctagggaatggccagaaaa

SEQ ID NO: 558873 - DNA, 25 bp, Mus musculus
gcgcacctagggtatggccagaaaa

SEQ ID NO: 558874 - DNA, 25 bp, Mus musculus
gcgcacctctacattcctaagaaag

SEQ ID NO: 558875 - DNA, 25 bp, Mus musculus
gcgcacctctactttcctaagaaag

SEQ ID NO: 558876 - DNA, 25 bp, Mus musculus
gcgcacctcttcagcagtgttaaga

SEQ ID NO: 558877 - DNA, 25 bp, Mus musculus
gcgcacctcttctgcagtgttaaga

SEQ ID NO: 558878 - DNA, 25 bp, Mus musculus
gcgcacctggtcacaggcattaaat

SEQ ID NO: 558879 - DNA, 25 bp, Mus musculus
gcgcacctggtctcaggcattaaat

SEQ ID NO: 558880 - DNA, 25 bp, Mus musculus
gcgcaccttaaaccagaagaagcct

SEQ ID NO: 558881 - DNA, 25 bp, Mus musculus
gcgcaccttaaagcagaagaagcct

SEQ ID NO: 558882 - DNA, 25 bp, Mus musculus
gcgcaccttggtcgaacactctgga

SEQ ID NO: 558883 - DNA, 25 bp, Mus musculus
gcgcaccttggtggaacactctgga

SEQ ID NO: 558884 - DNA, 25 bp, Mus musculus
gcgcacgactctacccaagtggatg

SEQ ID NO: 558885 - DNA, 25 bp, Mus musculus
gcgcacgactcttcccaagtggatg

SEQ ID NO: 558886 - DNA, 25 bp, Mus musculus
gcgcacgcatgcatgtggacacata

SEQ ID NO: 558887 - DNA, 25 bp, Mus musculus
gcgcacgcatgcttgtggacacata

SEQ ID NO: 558888 - DNA, 25 bp, Mus musculus
gcgcactatgacagcttgtggtata

SEQ ID NO: 558889 - DNA, 25 bp, Mus musculus
gcgcactatgactgcttgtggtata

SEQ ID NO: 558890 - DNA, 25 bp, Mus musculus
gcgcactcacagcatcttgctatca

SEQ ID NO: 558891 - DNA, 25 bp, Mus musculus
gcgcactcacaggatcttgctatca

SEQ ID NO: 558892 - DNA, 25 bp, Mus musculus
gcgcactcaccccaacgatgtaaga

SEQ ID NO: 558893 - DNA, 25 bp, Mus musculus
gcgcactcacccgaacgatgtaaga

SEQ ID NO: 558894 - DNA, 25 bp, Mus musculus
gcgcactcccaacaggtggtgtcaa

SEQ ID NO: 558895 - DNA, 25 bp, Mus musculus
gcgcactcccaagaggtggtgtcaa

SEQ ID NO: 558896 - DNA, 25 bp, Mus musculus
gcgcactcccagaacaagagcttta

SEQ ID NO: 558897 - DNA, 25 bp, Mus musculus
gcgcactcccagtacaagagcttta

SEQ ID NO: 558898 - DNA, 25 bp, Mus musculus
gcgcactgtagcaggaagtcagatc

SEQ ID NO: 558899 - DNA, 25 bp, Mus musculus
gcgcactgtagctggaagtcagatc

SEQ ID NO: 558900 - DNA, 25 bp, Mus musculus
gcgcactgtgcgaggcatgctgccc

SEQ ID NO: 558901 - DNA, 25 bp, Mus musculus
gcgcactgtgcgtggcatgctgccc

SEQ ID NO: 558902 - DNA, 25 bp, Mus musculus
gcgcacttcacaatcatgttaagca

SEQ ID NO: 558903 - DNA, 25 bp, Mus musculus
gcgcacttcacattcatgttaagca

SEQ ID NO: 558904 - DNA, 25 bp, Mus musculus
gcgcagaagcgtaagctccagatcc

SEQ ID NO: 558905 - DNA, 25 bp, Mus musculus
gcgcagaagcgttagctccagatcc

SEQ ID NO: 558906 - DNA, 25 bp, Mus musculus
gcgcagaccctgcacaaagtggata

SEQ ID NO: 558907 - DNA, 25 bp, Mus musculus
gcgcagaccctggacaaagtggata

SEQ ID NO: 558908 - DNA, 25 bp, Mus musculus
gcgcagagatatactgttggcccta

SEQ ID NO: 558909 - DNA, 25 bp, Mus musculus
gcgcagagatattctgttggcccta

SEQ ID NO: 558910 - DNA, 25 bp, Mus musculus
gcgcagagcatgaggaactggtgtc

SEQ ID NO: 558911 - DNA, 25 bp, Mus musculus
gcgcagagcatgtggaactggtgtc

SEQ ID NO: 558912 - DNA, 25 bp, Mus musculus
gcgcagatcattccttttggcagag

SEQ ID NO: 558913 - DNA, 25 bp, Mus musculus
gcgcagatcattgcttttggcagag

SEQ ID NO: 558914 - DNA, 25 bp, Mus musculus
gcgcagattagaagccaggttgcaa

SEQ ID NO: 558915 - DNA, 25 bp, Mus musculus
gcgcagattagatgccaggttgcaa

SEQ ID NO: 558916 - DNA, 25 bp, Mus musculus
gcgcagcaaaatcagcaacaccggg

SEQ ID NO: 558917 - DNA, 25 bp, Mus musculus
gcgcagcaaaatgagcaacaccggg

SEQ ID NO: 558918 - DNA, 25 bp, Mus musculus
gcgcagcagagtatcagcatatact

SEQ ID NO: 558919 - DNA, 25 bp, Mus musculus
gcgcagcagagtttcagcatatact

SEQ ID NO: 558920 - DNA, 25 bp, Mus musculus
gcgcagcagcatcacgagacttact

SEQ ID NO: 558921 - DNA, 25 bp, Mus musculus
gcgcagcagcatgacgagacttact

SEQ ID NO: 558922 - DNA, 25 bp, Mus musculus
gcgcagcaggtgcatcgccagcatt

SEQ ID NO: 558923 - DNA, 25 bp, Mus musculus
gcgcagcaggtggatcgccagcatt

SEQ ID NO: 558924 - DNA, 25 bp, Mus musculus
gcgcagcagttgctttttggttata

SEQ ID NO: 558925 - DNA, 25 bp, Mus musculus
gcgcagcagttggtttttggttata

SEQ ID NO: 558926 - DNA, 25 bp, Mus musculus
gcgcagccccaacgatagggtttta

SEQ ID NO: 558927 - DNA, 25 bp, Mus musculus
gcgcagccccaaggatagggtttta

SEQ ID NO: 558928 - DNA, 25 bp, Mus musculus
gcgcagccgcagatggagaatgcca

SEQ ID NO: 558929 - DNA, 25 bp, Mus musculus
gcgcagccgcagttggagaatgcca

SEQ ID NO: 558930 - DNA, 25 bp, Mus musculus
gcgcagcctcttagacttgggcaga

SEQ ID NO: 558931 - DNA, 25 bp, Mus musculus
gcgcagcctctttgacttgggcaga

SEQ ID NO: 558932 - DNA, 25 bp, Mus musculus
gcgcagctcaaacctgaagcctaga

SEQ ID NO: 558933 - DNA, 25 bp, Mus musculus
gcgcagctcaaagctgaagcctaga

SEQ ID NO: 558934 - DNA, 25 bp, Mus musculus
gcgcagctcaagcagaaggtcatga

SEQ ID NO: 558935 - DNA, 25 bp, Mus musculus
gcgcagctcaaggagaaggtcatga

SEQ ID NO: 558936 - DNA, 25 bp, Mus musculus
gcgcagctcgcacgtgaaacttcat

SEQ ID NO: 558937 - DNA, 25 bp, Mus musculus
gcgcagctcgcaggtgaaacttcat

SEQ ID NO: 558938 - DNA, 25 bp, Mus musculus
gcgcagctcgtacaggtcatcaaga

SEQ ID NO: 558939 - DNA, 25 bp, Mus musculus
gcgcagctcgtagaggtcatcaaga

SEQ ID NO: 558940 - DNA, 25 bp, Mus musculus
gcgcagctgccacatggagttcgaa

SEQ ID NO: 558941 - DNA, 25 bp, Mus musculus
gcgcagctgccagatggagttcgaa

SEQ ID NO: 558942 - DNA, 25 bp, Mus musculus
gcgcagctgcggattgtcgaatcca

SEQ ID NO: 558943 - DNA, 25 bp, Mus musculus
gcgcagctgcggtttgtcgaatcca

SEQ ID NO: 558944 - DNA, 25 bp, Mus musculus
gcgcagctgctactggaaatgctga

SEQ ID NO: 558945 - DNA, 25 bp, Mus musculus
gcgcagctgctagtggaaatgctga

SEQ ID NO: 558946 - DNA, 25 bp, Mus musculus
gcgcagcttctgatcaatttctatg

SEQ ID NO: 558947 - DNA, 25 bp, Mus musculus
gcgcagcttctgttcaatttctatg

SEQ ID NO: 558948 - DNA, 25 bp, Mus musculus
gcgcagctttctagagtgcctatat

SEQ ID NO: 558949 - DNA, 25 bp, Mus musculus
gcgcagctttcttgagtgcctatat

SEQ ID NO: 558950 - DNA, 25 bp, Mus musculus
gcgcagcttttcaattgtaccacag

SEQ ID NO: 558951 - DNA, 25 bp, Mus musculus
gcgcagcttttctattgtaccacag

SEQ ID NO: 558952 - DNA, 25 bp, Mus musculus
gcgcaggaacctcactaggactatg

SEQ ID NO: 558953 - DNA, 25 bp, Mus musculus
gcgcaggaacctgactaggactatg

SEQ ID NO: 558954 - DNA, 25 bp, Mus musculus
gcgcaggaccttacattggtttgtt

SEQ ID NO: 558955 - DNA, 25 bp, Mus musculus
gcgcaggacctttcattggtttgtt

SEQ ID NO: 558956 - DNA, 25 bp, Mus musculus
gcgcaggccgagaccgcaggtgttt

SEQ ID NO: 558957 - DNA, 25 bp, Mus musculus
gcgcaggccgagtccgcaggtgttt

SEQ ID NO: 558958 - DNA, 25 bp, Mus musculus
gcgcaggctgcacatgacattcctt

SEQ ID NO: 558959 - DNA, 25 bp, Mus musculus
gcgcaggctgcagatgacattcctt

SEQ ID NO: 558960 - DNA, 25 bp, Mus musculus
gcgcagggactgagctaaacagaaa

SEQ ID NO: 558961 - DNA, 25 bp, Mus musculus
gcgcagggactgtgctaaacagaaa

SEQ ID NO: 558962 - DNA, 25 bp, Mus musculus
gcgcagggcccgagaccacaaggaa

SEQ ID NO: 558963 - DNA, 25 bp, Mus musculus
gcgcagggcccgtgaccacaaggaa

SEQ ID NO: 558964 - DNA, 25 bp, Mus musculus
gcgcaggtacgtataatttttcaag

SEQ ID NO: 558965 - DNA, 25 bp, Mus musculus
gcgcaggtacgtttaatttttcaag

SEQ ID NO: 558966 - DNA, 25 bp, Mus musculus
gcgcaggtgaatagctcactttcat

SEQ ID NO: 558967 - DNA, 25 bp, Mus musculus
gcgcaggtgaattgctcactttcat

SEQ ID NO: 558968 - DNA, 25 bp, Mus musculus
gcgcaggtgacgcccttagatctct

SEQ ID NO: 558969 - DNA, 25 bp, Mus musculus
gcgcaggtgacggccttagatctct

SEQ ID NO: 558970 - DNA, 25 bp, Mus musculus
gcgcagtaaaggagcaacccattta

SEQ ID NO: 558971 - DNA, 25 bp, Mus musculus
gcgcagtaaaggtgcaacccattta

SEQ ID NO: 558972 - DNA, 25 bp, Mus musculus
gcgcagtcccaaagacagcgttgac

SEQ ID NO: 558973 - DNA, 25 bp, Mus musculus
gcgcagtcccaatgacagcgttgac

SEQ ID NO: 558974 - DNA, 25 bp, Mus musculus
gcgcagtcccgaacgatactggatg

SEQ ID NO: 558975 - DNA, 25 bp, Mus musculus
gcgcagtcccgatcgatactggatg

SEQ ID NO: 558976 - DNA, 25 bp, Mus musculus
gcgcagtgccacaaagctgtcatga

SEQ ID NO: 558977 - DNA, 25 bp, Mus musculus
gcgcagtgccactaagctgtcatga

SEQ ID NO: 558978 - DNA, 25 bp, Mus musculus
gcgcagtgccctacacgcacgagga

SEQ ID NO: 558979 - DNA, 25 bp, Mus musculus
gcgcagtgcccttcacgcacgagga

SEQ ID NO: 558980 - DNA, 25 bp, Mus musculus
gcgcagtgcctgaacattttcaaag

SEQ ID NO: 558981 - DNA, 25 bp, Mus musculus
gcgcagtgcctgtacattttcaaag

SEQ ID NO: 558982 - DNA, 25 bp, Mus musculus
gcgcagtgttggctttgatgtatcc

SEQ ID NO: 558983 - DNA, 25 bp, Mus musculus
gcgcagtgttgggtttgatgtatcc

SEQ ID NO: 558984 - DNA, 25 bp, Mus musculus
gcgcagttcaggacccgacaggaag

SEQ ID NO: 558985 - DNA, 25 bp, Mus musculus
gcgcagttcaggtcccgacaggaag

SEQ ID NO: 558986 - DNA, 25 bp, Mus musculus
gcgcagttcctacattcacgttatt

SEQ ID NO: 558987 - DNA, 25 bp, Mus musculus
gcgcagttcctagattcacgttatt

SEQ ID NO: 558988 - DNA, 25 bp, Mus musculus
gcgcatagacttccgcaatgaggat

SEQ ID NO: 558989 - DNA, 25 bp, Mus musculus
gcgcatagacttgcgcaatgaggat

SEQ ID NO: 558990 - DNA, 25 bp, Mus musculus
gcgcatatccctcttacccatacac

SEQ ID NO: 558991 - DNA, 25 bp, Mus musculus
gcgcatatccctgttacccatacac

SEQ ID NO: 558992 - DNA, 25 bp, Mus musculus
gcgcatcactgccttggaaaacatg

SEQ ID NO: 558993 - DNA, 25 bp, Mus musculus
gcgcatcactgcgttggaaaacatg

SEQ ID NO: 558994 - DNA, 25 bp, Mus musculus
gcgcatcaggccagcatactgggag

SEQ ID NO: 558995 - DNA, 25 bp, Mus musculus
gcgcatcaggcctgcatactgggag

SEQ ID NO: 558996 - DNA, 25 bp, Mus musculus
gcgcatcatgaccagactctcatag

SEQ ID NO: 558997 - DNA, 25 bp, Mus musculus
gcgcatcatgacgagactctcatag

SEQ ID NO: 558998 - DNA, 25 bp, Mus musculus
gcgcatccacctatcattactgaaa

SEQ ID NO: 558999 - DNA, 25 bp, Mus musculus
gcgcatccacctttcattactgaaa

SEQ ID NO: 559000 - DNA, 25 bp, Mus musculus
gcgcatccacttcggaaccgagttg

SEQ ID NO: 559001 - DNA, 25 bp, Mus musculus
gcgcatccacttgggaaccgagttg

SEQ ID NO: 559002 - DNA, 25 bp, Mus musculus
gcgcatctcatactagctggctggg

SEQ ID NO: 559003 - DNA, 25 bp, Mus musculus
gcgcatctcatagtagctggctggg

SEQ ID NO: 559004 - DNA, 25 bp, Mus musculus
gcgcatgagacaccaaactccacgg

SEQ ID NO: 559005 - DNA, 25 bp, Mus musculus
gcgcatgagacagcaaactccacgg

SEQ ID NO: 559006 - DNA, 25 bp, Mus musculus
gcgcatgccttgaaagatatctttt

SEQ ID NO: 559007 - DNA, 25 bp, Mus musculus
gcgcatgccttgtaagatatctttt

SEQ ID NO: 559008 - DNA, 25 bp, Mus musculus
gcgcatgctgttaacttcgtggacg

SEQ ID NO: 559009 - DNA, 25 bp, Mus musculus
gcgcatgctgtttacttcgtggacg

SEQ ID NO: 559010 - DNA, 25 bp, Mus musculus
gcgcatggagccactgggcctggaa

SEQ ID NO: 559011 - DNA, 25 bp, Mus musculus
gcgcatggagcctctgggcctggaa

SEQ ID NO: 559012 - DNA, 25 bp, Mus musculus
gcgcatggccttcctcgccaggaag

SEQ ID NO: 559013 - DNA, 25 bp, Mus musculus
gcgcatggccttgctcgccaggaag

SEQ ID NO: 559014 - DNA, 25 bp, Mus musculus
gcgcatggtccaagaagctgagaag

SEQ ID NO: 559015 - DNA, 25 bp, Mus musculus
gcgcatggtccatgaagctgagaag

SEQ ID NO: 559016 - DNA, 25 bp, Mus musculus
gcgcatgtcctccttgcttaaagga

SEQ ID NO: 559017 - DNA, 25 bp, Mus musculus
gcgcatgtcctcgttgcttaaagga

SEQ ID NO: 559018 - DNA, 25 bp, Mus musculus
gcgcatgtgcaactcgatgtgaaca

SEQ ID NO: 559019 - DNA, 25 bp, Mus musculus
gcgcatgtgcaagtcgatgtgaaca

SEQ ID NO: 559020 - DNA, 25 bp, Mus musculus
gcgcatgtgcagctgttaagtgcta

SEQ ID NO: 559021 - DNA, 25 bp, Mus musculus
gcgcatgtgcaggtgttaagtgcta

SEQ ID NO: 559022 - DNA, 25 bp, Mus musculus
gcgcattatagcaacttcccaagga

SEQ ID NO: 559023 - DNA, 25 bp, Mus musculus
gcgcattatagctacttcccaagga

SEQ ID NO: 559024 - DNA, 25 bp, Mus musculus
gcgcattcatgacgttggagagact

SEQ ID NO: 559025 - DNA, 25 bp, Mus musculus
gcgcattcatgaggttggagagact

SEQ ID NO: 559026 - DNA, 25 bp, Mus musculus
gcgcattcattgaggccctgggagt

SEQ ID NO: 559027 - DNA, 25 bp, Mus musculus
gcgcattcattgtggccctgggagt

SEQ ID NO: 559028 - DNA, 25 bp, Mus musculus
gcgcattgcattcgagtgactgaac

SEQ ID NO: 559029 - DNA, 25 bp, Mus musculus
gcgcattgcattggagtgactgaac

SEQ ID NO: 559030 - DNA, 25 bp, Mus musculus
gcgcattggtgaaagccactggttt

SEQ ID NO: 559031 - DNA, 25 bp, Mus musculus
gcgcattggtgatagccactggttt

SEQ ID NO: 559032 - DNA, 25 bp, Mus musculus
gcgccaaaccggagcggccaagaag

SEQ ID NO: 559033 - DNA, 25 bp, Mus musculus
gcgccaaaccggtgcggccaagaag

SEQ ID NO: 559034 - DNA, 25 bp, Mus musculus
gcgccaacagctagccatatcagaa

SEQ ID NO: 559035 - DNA, 25 bp, Mus musculus
gcgccaacagcttgccatatcagaa

SEQ ID NO: 559036 - DNA, 25 bp, Mus musculus
gcgccaaccttgaggctatttctaa

SEQ ID NO: 559037 - DNA, 25 bp, Mus musculus
gcgccaaccttgtggctatttctaa

SEQ ID NO: 559038 - DNA, 25 bp, Mus musculus
gcgccaactactacgttctatacta

SEQ ID NO: 559039 - DNA, 25 bp, Mus musculus
gcgccaactacttcgttctatacta

SEQ ID NO: 559040 - DNA, 25 bp, Mus musculus
gcgccaactcttactgctatgagaa

SEQ ID NO: 559041 - DNA, 25 bp, Mus musculus
gcgccaactctttctgctatgagaa

SEQ ID NO: 559042 - DNA, 25 bp, Mus musculus
gcgccaagatcgagaagcccaatgg

SEQ ID NO: 559043 - DNA, 25 bp, Mus musculus
gcgccaagatcgtgaagcccaatgg

SEQ ID NO: 559044 - DNA, 25 bp, Mus musculus
gcgccaagcccaccatcaaatgtat

SEQ ID NO: 559045 - DNA, 25 bp, Mus musculus
gcgccaagcccagcatcaaatgtat

SEQ ID NO: 559046 - DNA, 25 bp, Mus musculus
gcgccaaggagtatgctttctacca

SEQ ID NO: 559047 - DNA, 25 bp, Mus musculus
gcgccaaggagtttgctttctacca

SEQ ID NO: 559048 - DNA, 25 bp, Mus musculus
gcgccaaggttgaactctacaccaa

SEQ ID NO: 559049 - DNA, 25 bp, Mus musculus
gcgccaaggttgtactctacaccaa

SEQ ID NO: 559050 - DNA, 25 bp, Mus musculus
gcgccaagtcatcggccaggtcaaa

SEQ ID NO: 559051 - DNA, 25 bp, Mus musculus
gcgccaagtcatgggccaggtcaaa

SEQ ID NO: 559052 - DNA, 25 bp, Mus musculus
gcgccaatattcagactagcctact

SEQ ID NO: 559053 - DNA, 25 bp, Mus musculus
gcgccaatattctgactagcctact

SEQ ID NO: 559054 - DNA, 25 bp, Mus musculus
gcgccaatgccaatcttcatgagaa

SEQ ID NO: 559055 - DNA, 25 bp, Mus musculus
gcgccaatgccattcttcatgagaa

SEQ ID NO: 559056 - DNA, 25 bp, Mus musculus
gcgccacaaaacctagcatatccag

SEQ ID NO: 559057 - DNA, 25 bp, Mus musculus
gcgccacaaaacgtagcatatccag

SEQ ID NO: 559058 - DNA, 25 bp, Mus musculus
gcgccacacggaccccagggtagaa

SEQ ID NO: 559059 - DNA, 25 bp, Mus musculus
gcgccacacggagcccagggtagaa

SEQ ID NO: 559060 - DNA, 25 bp, Mus musculus
gcgccacaggcgctattctgagtac

SEQ ID NO: 559061 - DNA, 25 bp, Mus musculus
gcgccacaggcggtattctgagtac

SEQ ID NO: 559062 - DNA, 25 bp, Mus musculus
gcgccacataagcattgtaatttca

SEQ ID NO: 559063 - DNA, 25 bp, Mus musculus
gcgccacataaggattgtaatttca

SEQ ID NO: 559064 - DNA, 25 bp, Mus musculus
gcgccacattgcctggatgttattt

SEQ ID NO: 559065 - DNA, 25 bp, Mus musculus
gcgccacattgcgtggatgttattt

SEQ ID NO: 559066 - DNA, 25 bp, Mus musculus
gcgccaccaactacatcagagagta

SEQ ID NO: 559067 - DNA, 25 bp, Mus musculus
gcgccaccaacttcatcagagagta

SEQ ID NO: 559068 - DNA, 25 bp, Mus musculus
gcgccaccacctcaaatttatgatg

SEQ ID NO: 559069 - DNA, 25 bp, Mus musculus
gcgccaccacctgaaatttatgatg

SEQ ID NO: 559070 - DNA, 25 bp, Mus musculus
gcgccaccaggaagatgctaccgta

SEQ ID NO: 559071 - DNA, 25 bp, Mus musculus
gcgccaccaggatgatgctaccgta

SEQ ID NO: 559072 - DNA, 25 bp, Mus musculus
gcgccaccgctcagaagactgtggt

SEQ ID NO: 559073 - DNA, 25 bp, Mus musculus
gcgccaccgctctgaagactgtggt

SEQ ID NO: 559074 - DNA, 25 bp, Mus musculus
gcgccaccgggtcatcttagagtga

SEQ ID NO: 559075 - DNA, 25 bp, Mus musculus
gcgccaccgggtgatcttagagtga

SEQ ID NO: 559076 - DNA, 25 bp, Mus musculus
gcgccacttgccagtagtgaatgca

SEQ ID NO: 559077 - DNA, 25 bp, Mus musculus
gcgccacttgcctgtagtgaatgca

SEQ ID NO: 559078 - DNA, 25 bp, Mus musculus
gcgccactttctcagcaagccaaga

SEQ ID NO: 559079 - DNA, 25 bp, Mus musculus
gcgccactttctgagcaagccaaga

SEQ ID NO: 559080 - DNA, 25 bp, Mus musculus
gcgccagaaccacggctcagatgga

SEQ ID NO: 559081 - DNA, 25 bp, Mus musculus
gcgccagaaccagggctcagatgga

SEQ ID NO: 559082 - DNA, 25 bp, Mus musculus
gcgccagagcaacatccagactctg

SEQ ID NO: 559083 - DNA, 25 bp, Mus musculus
gcgccagagcaagatccagactctg

SEQ ID NO: 559084 - DNA, 25 bp, Mus musculus
gcgccagagcggcagagaaacttca

SEQ ID NO: 559085 - DNA, 25 bp, Mus musculus
gcgccagagcgggagagaaacttca

SEQ ID NO: 559086 - DNA, 25 bp, Mus musculus
gcgccagagtgcatcaactttcgga

SEQ ID NO: 559087 - DNA, 25 bp, Mus musculus
gcgccagagtgcttcaactttcgga

SEQ ID NO: 559088 - DNA, 25 bp, Mus musculus
gcgccaggaaaacacgccggtttct

SEQ ID NO: 559089 - DNA, 25 bp, Mus musculus
gcgccaggaaaagacgccggtttct

SEQ ID NO: 559090 - DNA, 25 bp, Mus musculus
gcgccaggaacacattgccaagaga

SEQ ID NO: 559091 - DNA, 25 bp, Mus musculus
gcgccaggaacagattgccaagaga

SEQ ID NO: 559092 - DNA, 25 bp, Mus musculus
gcgccaggaactacactttgctctg

SEQ ID NO: 559093 - DNA, 25 bp, Mus musculus
gcgccaggaacttcactttgctctg

SEQ ID NO: 559094 - DNA, 25 bp, Mus musculus
gcgccaggcgtcatcacaaaactta

SEQ ID NO: 559095 - DNA, 25 bp, Mus musculus
gcgccaggcgtcttcacaaaactta

SEQ ID NO: 559096 - DNA, 25 bp, Mus musculus
gcgccagtcccacagcaagatttta

SEQ ID NO: 559097 - DNA, 25 bp, Mus musculus
gcgccagtcccagagcaagatttta

SEQ ID NO: 559098 - DNA, 25 bp, Mus musculus
gcgccatagagcaagtcgggagaaa

SEQ ID NO: 559099 - DNA, 25 bp, Mus musculus
gcgccatagagctagtcgggagaaa

SEQ ID NO: 559100 - DNA, 25 bp, Mus musculus
gcgccatatctacccattttgaatt

SEQ ID NO: 559101 - DNA, 25 bp, Mus musculus
gcgccatatctagccattttgaatt

SEQ ID NO: 559102 - DNA, 25 bp, Mus musculus
gcgccatcctttaagtctctgagag

SEQ ID NO: 559103 - DNA, 25 bp, Mus musculus
gcgccatccttttagtctctgagag

SEQ ID NO: 559104 - DNA, 25 bp, Mus musculus
gcgccatcgcagaagaagcagggaa

SEQ ID NO: 559105 - DNA, 25 bp, Mus musculus
gcgccatcgcagtagaagcagggaa

SEQ ID NO: 559106 - DNA, 25 bp, Mus musculus
gcgccatgacatcgccttcgtggag

SEQ ID NO: 559107 - DNA, 25 bp, Mus musculus
gcgccatgacatggccttcgtggag

SEQ ID NO: 559108 - DNA, 25 bp, Mus musculus
gcgccatgagcaaggccctggagct

SEQ ID NO: 559109 - DNA, 25 bp, Mus musculus
gcgccatgagcatggccctggagct

SEQ ID NO: 559110 - DNA, 25 bp, Mus musculus
gcgccatgcagccacctgagcaata

SEQ ID NO: 559111 - DNA, 25 bp, Mus musculus
gcgccatgcagcgacctgagcaata

SEQ ID NO: 559112 - DNA, 25 bp, Mus musculus
gcgccatgctggagagttggtacta

SEQ ID NO: 559113 - DNA, 25 bp, Mus musculus
gcgccatgctggtgagttggtacta

SEQ ID NO: 559114 - DNA, 25 bp, Mus musculus
gcgccatgtcctctccagaagagag

SEQ ID NO: 559115 - DNA, 25 bp, Mus musculus
gcgccatgtcctgtccagaagagag

SEQ ID NO: 559116 - DNA, 25 bp, Mus musculus
gcgccatgttatagaagctgtttat

SEQ ID NO: 559117 - DNA, 25 bp, Mus musculus
gcgccatgttattgaagctgtttat

SEQ ID NO: 559118 - DNA, 25 bp, Mus musculus
gcgccattagcactctcataagatg

SEQ ID NO: 559119 - DNA, 25 bp, Mus musculus
gcgccattagcagtctcataagatg

SEQ ID NO: 559120 - DNA, 25 bp, Mus musculus
gcgccattggcgacacccggatttc

SEQ ID NO: 559121 - DNA, 25 bp, Mus musculus
gcgccattggcgtcacccggatttc

SEQ ID NO: 559122 - DNA, 25 bp, Mus musculus
gcgccatttcaacggacatcgacac

SEQ ID NO: 559123 - DNA, 25 bp, Mus musculus
gcgccatttcaagggacatcgacac

SEQ ID NO: 559124 - DNA, 25 bp, Mus musculus
gcgccatttggacccatgggtgcca

SEQ ID NO: 559125 - DNA, 25 bp, Mus musculus
gcgccatttggagccatgggtgcca

SEQ ID NO: 559126 - DNA, 25 bp, Mus musculus
gcgcccaaggccagaacgcaaggct

SEQ ID NO: 559127 - DNA, 25 bp, Mus musculus
gcgcccaaggcctgaacgcaaggct

SEQ ID NO: 559128 - DNA, 25 bp, Mus musculus
gcgcccaatacccatttgttgaagc

SEQ ID NO: 559129 - DNA, 25 bp, Mus musculus
gcgcccaataccgatttgttgaagc

SEQ ID NO: 559130 - DNA, 25 bp, Mus musculus
gcgcccacagctcgtttgtgtataa

SEQ ID NO: 559131 - DNA, 25 bp, Mus musculus
gcgcccacagctggtttgtgtataa

SEQ ID NO: 559132 - DNA, 25 bp, Mus musculus
gcgcccaccagaacacgttggaggt

SEQ ID NO: 559133 - DNA, 25 bp, Mus musculus
gcgcccaccagatcacgttggaggt

SEQ ID NO: 559134 - DNA, 25 bp, Mus musculus
gcgcccactcaacatcatctagtga

SEQ ID NO: 559135 - DNA, 25 bp, Mus musculus
gcgcccactcaagatcatctagtga

SEQ ID NO: 559136 - DNA, 25 bp, Mus musculus
gcgcccagagttccactggtctaga

SEQ ID NO: 559137 - DNA, 25 bp, Mus musculus
gcgcccagagttgcactggtctaga

SEQ ID NO: 559138 - DNA, 25 bp, Mus musculus
gcgcccagggccaaagcattgagaa

SEQ ID NO: 559139 - DNA, 25 bp, Mus musculus
gcgcccagggcctaagcattgagaa

SEQ ID NO: 559140 - DNA, 25 bp, Mus musculus
gcgccccaaccacgagcagaagcag

SEQ ID NO: 559141 - DNA, 25 bp, Mus musculus
gcgccccaaccaggagcagaagcag

SEQ ID NO: 559142 - DNA, 25 bp, Mus musculus
gcgccccagtcaattcctgaagaga

SEQ ID NO: 559143 - DNA, 25 bp, Mus musculus
gcgccccagtcatttcctgaagaga

SEQ ID NO: 559144 - DNA, 25 bp, Mus musculus
gcgccccataggctaagatctatca

SEQ ID NO: 559145 - DNA, 25 bp, Mus musculus
gcgccccatagggtaagatctatca

SEQ ID NO: 559146 - DNA, 25 bp, Mus musculus
gcgccccatcttactattgacgcgt

SEQ ID NO: 559147 - DNA, 25 bp, Mus musculus
gcgccccatctttctattgacgcgt

SEQ ID NO: 559148 - DNA, 25 bp, Mus musculus
gcgccccgatctcggcagttgaaga

SEQ ID NO: 559149 - DNA, 25 bp, Mus musculus
gcgccccgatctgggcagttgaaga

SEQ ID NO: 559150 - DNA, 25 bp, Mus musculus
gcgcccctaagtatgccgagagctg

SEQ ID NO: 559151 - DNA, 25 bp, Mus musculus
gcgcccctaagtttgccgagagctg

SEQ ID NO: 559152 - DNA, 25 bp, Mus musculus
gcgcccctaggactaaggccaggaa

SEQ ID NO: 559153 - DNA, 25 bp, Mus musculus
gcgcccctaggagtaaggccaggaa

SEQ ID NO: 559154 - DNA, 25 bp, Mus musculus
gcgcccctgtgcatttggaaatcaa

SEQ ID NO: 559155 - DNA, 25 bp, Mus musculus
gcgcccctgtgcttttggaaatcaa

SEQ ID NO: 559156 - DNA, 25 bp, Mus musculus
gcgccccttgtgaacaacaagctaa

SEQ ID NO: 559157 - DNA, 25 bp, Mus musculus
gcgccccttgtgtacaacaagctaa

SEQ ID NO: 559158 - DNA, 25 bp, Mus musculus
gcgcccgccgagagctgaggaacta

SEQ ID NO: 559159 - DNA, 25 bp, Mus musculus
gcgcccgccgagtgctgaggaacta

SEQ ID NO: 559160 - DNA, 25 bp, Mus musculus
gcgcccggtgcgagcccaaggataa

SEQ ID NO: 559161 - DNA, 25 bp, Mus musculus
gcgcccggtgcgtgcccaaggataa

SEQ ID NO: 559162 - DNA, 25 bp, Mus musculus
gcgcccgtctggaggttaagccaag

SEQ ID NO: 559163 - DNA, 25 bp, Mus musculus
gcgcccgtctggtggttaagccaag

SEQ ID NO: 559164 - DNA, 25 bp, Mus musculus
gcgcccgtgaggaaaaggagcaccc

SEQ ID NO: 559165 - DNA, 25 bp, Mus musculus
gcgcccgtgaggtaaaggagcaccc

SEQ ID NO: 559166 - DNA, 25 bp, Mus musculus
gcgccctaatctctgatgactgtag

SEQ ID NO: 559167 - DNA, 25 bp, Mus musculus
gcgccctaatctgtgatgactgtag

SEQ ID NO: 559168 - DNA, 25 bp, Mus musculus
gcgccctaggcaatggttgttctct

SEQ ID NO: 559169 - DNA, 25 bp, Mus musculus
gcgccctaggcattggttgttctct

SEQ ID NO: 559170 - DNA, 25 bp, Mus musculus
gcgccctatcgtcaaggctatacaa

SEQ ID NO: 559171 - DNA, 25 bp, Mus musculus
gcgccctatcgtgaaggctatacaa

SEQ ID NO: 559172 - DNA, 25 bp, Mus musculus
gcgccctcaagtacagcttttggaa

SEQ ID NO: 559173 - DNA, 25 bp, Mus musculus
gcgccctcaagttcagcttttggaa

SEQ ID NO: 559174 - DNA, 25 bp, Mus musculus
gcgccctcatttctgatgcttgagt

SEQ ID NO: 559175 - DNA, 25 bp, Mus musculus
gcgccctcatttgtgatgcttgagt

SEQ ID NO: 559176 - DNA, 25 bp, Mus musculus
gcgccctgaagacttgggtttcctt

SEQ ID NO: 559177 - DNA, 25 bp, Mus musculus
gcgccctgaagagttgggtttcctt

SEQ ID NO: 559178 - DNA, 25 bp, Mus musculus
gcgccctgctgaagattatgtgccc

SEQ ID NO: 559179 - DNA, 25 bp, Mus musculus
gcgccctgctgatgattatgtgccc

SEQ ID NO: 559180 - DNA, 25 bp, Mus musculus
gcgcccttgttcctgaattacacaa

SEQ ID NO: 559181 - DNA, 25 bp, Mus musculus
gcgcccttgttcgtgaattacacaa

SEQ ID NO: 559182 - DNA, 25 bp, Mus musculus
gcgccgacttgcagcccagttggga

SEQ ID NO: 559183 - DNA, 25 bp, Mus musculus
gcgccgacttgctgcccagttggga

SEQ ID NO: 559184 - DNA, 25 bp, Mus musculus
gcgccgaggcccaaggcagcctgaa

SEQ ID NO: 559185 - DNA, 25 bp, Mus musculus
gcgccgaggccctaggcagcctgaa

SEQ ID NO: 559186 - DNA, 25 bp, Mus musculus
gcgccgaggtatatgccccactgga

SEQ ID NO: 559187 - DNA, 25 bp, Mus musculus
gcgccgaggtatttgccccactgga

SEQ ID NO: 559188 - DNA, 25 bp, Mus musculus
gcgccgagtgtcaggtggaatccta

SEQ ID NO: 559189 - DNA, 25 bp, Mus musculus
gcgccgagtgtctggtggaatccta

SEQ ID NO: 559190 - DNA, 25 bp, Mus musculus
gcgccgatctcaaaactgcctcgag

SEQ ID NO: 559191 - DNA, 25 bp, Mus musculus
gcgccgatctcataactgcctcgag

SEQ ID NO: 559192 - DNA, 25 bp, Mus musculus
gcgccgccaagcacttggataaaga

SEQ ID NO: 559193 - DNA, 25 bp, Mus musculus
gcgccgccaagctcttggataaaga

SEQ ID NO: 559194 - DNA, 25 bp, Mus musculus
gcgccgccgtcgcatgactggaaaa

SEQ ID NO: 559195 - DNA, 25 bp, Mus musculus
gcgccgccgtcggatgactggaaaa

SEQ ID NO: 559196 - DNA, 25 bp, Mus musculus
gcgccgcgccaccaggaagatgcta

SEQ ID NO: 559197 - DNA, 25 bp, Mus musculus
gcgccgcgccacgaggaagatgcta

SEQ ID NO: 559198 - DNA, 25 bp, Mus musculus
gcgccgctacccatctggagaggag

SEQ ID NO: 559199 - DNA, 25 bp, Mus musculus
gcgccgctacccttctggagaggag

SEQ ID NO: 559200 - DNA, 25 bp, Mus musculus
gcgccgctcggccacgtattataaa

SEQ ID NO: 559201 - DNA, 25 bp, Mus musculus
gcgccgctcggcgacgtattataaa

SEQ ID NO: 559202 - DNA, 25 bp, Mus musculus
gcgccgctgtctaccaagagcttta

SEQ ID NO: 559203 - DNA, 25 bp, Mus musculus
gcgccgctgtcttccaagagcttta

SEQ ID NO: 559204 - DNA, 25 bp, Mus musculus
gcgccggccagtcactcgaaggatc

SEQ ID NO: 559205 - DNA, 25 bp, Mus musculus
gcgccggccagtgactcgaaggatc

SEQ ID NO: 559206 - DNA, 25 bp, Mus musculus
gcgccggcggttcattctcgagtct

SEQ ID NO: 559207 - DNA, 25 bp, Mus musculus
gcgccggcggttgattctcgagtct

SEQ ID NO: 559208 - DNA, 25 bp, Mus musculus
gcgccgggtcttaccgagtgaggag

SEQ ID NO: 559209 - DNA, 25 bp, Mus musculus
gcgccgggtctttccgagtgaggag

SEQ ID NO: 559210 - DNA, 25 bp, Mus musculus
gcgccggtccggaggtggtcacttc

SEQ ID NO: 559211 - DNA, 25 bp, Mus musculus
gcgccggtccggtggtggtcacttc

SEQ ID NO: 559212 - DNA, 25 bp, Mus musculus
gcgccgtagtctctgttagcatgtc

SEQ ID NO: 559213 - DNA, 25 bp, Mus musculus
gcgccgtagtctgtgttagcatgtc

SEQ ID NO: 559214 - DNA, 25 bp, Mus musculus
gcgccgtcatttccctggagggcaa

SEQ ID NO: 559215 - DNA, 25 bp, Mus musculus
gcgccgtcatttgcctggagggcaa

SEQ ID NO: 559216 - DNA, 25 bp, Mus musculus
gcgccgtgctgcacagaacattagt

SEQ ID NO: 559217 - DNA, 25 bp, Mus musculus
gcgccgtgctgctcagaacattagt

SEQ ID NO: 559218 - DNA, 25 bp, Mus musculus
gcgccgtgtgatatacgttggtaaa

SEQ ID NO: 559219 - DNA, 25 bp, Mus musculus
gcgccgtgtgatttacgttggtaaa

SEQ ID NO: 559220 - DNA, 25 bp, Mus musculus
gcgccgttgttcacagtactgtggg

SEQ ID NO: 559221 - DNA, 25 bp, Mus musculus
gcgccgttgttctcagtactgtggg

SEQ ID NO: 559222 - DNA, 25 bp, Mus musculus
gcgccgtttgcaatccgtttatttg

SEQ ID NO: 559223 - DNA, 25 bp, Mus musculus
gcgccgtttgcattccgtttatttg

SEQ ID NO: 559224 - DNA, 25 bp, Mus musculus
gcgcctaagcgacaagcactgccta

SEQ ID NO: 559225 - DNA, 25 bp, Mus musculus
gcgcctaagcgagaagcactgccta

SEQ ID NO: 559226 - DNA, 25 bp, Mus musculus
gcgcctaatctacaatttatcccgt

SEQ ID NO: 559227 - DNA, 25 bp, Mus musculus
gcgcctaatctagaatttatcccgt

SEQ ID NO: 559228 - DNA, 25 bp, Mus musculus
gcgcctagagttccattagatttca

SEQ ID NO: 559229 - DNA, 25 bp, Mus musculus
gcgcctagagttgcattagatttca

SEQ ID NO: 559230 - DNA, 25 bp, Mus musculus
gcgcctatacaaagcctggaaaaga

SEQ ID NO: 559231 - DNA, 25 bp, Mus musculus
gcgcctatacaatgcctggaaaaga

SEQ ID NO: 559232 - DNA, 25 bp, Mus musculus
gcgcctatgccaagcacaagggcag

SEQ ID NO: 559233 - DNA, 25 bp, Mus musculus
gcgcctatgccatgcacaagggcag

SEQ ID NO: 559234 - DNA, 25 bp, Mus musculus
gcgcctatggctacagagatcctgg

SEQ ID NO: 559235 - DNA, 25 bp, Mus musculus
gcgcctatggcttcagagatcctgg

SEQ ID NO: 559236 - DNA, 25 bp, Mus musculus
gcgcctcaacctcgaggagtggatt

SEQ ID NO: 559237 - DNA, 25 bp, Mus musculus
gcgcctcaacctggaggagtggatt

SEQ ID NO: 559238 - DNA, 25 bp, Mus musculus
gcgcctcaactaacaaaacgtgggt

SEQ ID NO: 559239 - DNA, 25 bp, Mus musculus
gcgcctcaactatcaaaacgtgggt

SEQ ID NO: 559240 - DNA, 25 bp, Mus musculus
gcgcctcgcagcacaaagtgaagat

SEQ ID NO: 559241 - DNA, 25 bp, Mus musculus
gcgcctcgcagctcaaagtgaagat

SEQ ID NO: 559242 - DNA, 25 bp, Mus musculus
gcgcctcgggcaatttcactgtgca

SEQ ID NO: 559243 - DNA, 25 bp, Mus musculus
gcgcctcgggcattttcactgtgca

SEQ ID NO: 559244 - DNA, 25 bp, Mus musculus
gcgcctcggtttacatgtggattta

SEQ ID NO: 559245 - DNA, 25 bp, Mus musculus
gcgcctcggttttcatgtggattta

SEQ ID NO: 559246 - DNA, 25 bp, Mus musculus
gcgcctctagcgacgagagctgtcc

SEQ ID NO: 559247 - DNA, 25 bp, Mus musculus
gcgcctctagcgtcgagagctgtcc

SEQ ID NO: 559248 - DNA, 25 bp, Mus musculus
gcgcctctccgcaggattaagagtt

SEQ ID NO: 559249 - DNA, 25 bp, Mus musculus
gcgcctctccgctggattaagagtt

SEQ ID NO: 559250 - DNA, 25 bp, Mus musculus
gcgcctctgttgagtcctaaaatat

SEQ ID NO: 559251 - DNA, 25 bp, Mus musculus
gcgcctctgttgtgtcctaaaatat

SEQ ID NO: 559252 - DNA, 25 bp, Mus musculus
gcgcctcttagacattccacaagtt

SEQ ID NO: 559253 - DNA, 25 bp, Mus musculus
gcgcctcttagagattccacaagtt

SEQ ID NO: 559254 - DNA, 25 bp, Mus musculus
gcgcctcttccaatcgtttgaggaa

SEQ ID NO: 559255 - DNA, 25 bp, Mus musculus
gcgcctcttccattcgtttgaggaa

SEQ ID NO: 559256 - DNA, 25 bp, Mus musculus
gcgcctgacctaaaattgcatccta

SEQ ID NO: 559257 - DNA, 25 bp, Mus musculus
gcgcctgacctataattgcatccta

SEQ ID NO: 559258 - DNA, 25 bp, Mus musculus
gcgcctgattttcgcctgtggatga

SEQ ID NO: 559259 - DNA, 25 bp, Mus musculus
gcgcctgattttggcctgtggatga

SEQ ID NO: 559260 - DNA, 25 bp, Mus musculus
gcgcctgccagaagacatatcacaa

SEQ ID NO: 559261 - DNA, 25 bp, Mus musculus
gcgcctgccagatgacatatcacaa

SEQ ID NO: 559262 - DNA, 25 bp, Mus musculus
gcgcctgcttatctagagtgctgtt

SEQ ID NO: 559263 - DNA, 25 bp, Mus musculus
gcgcctgcttatgtagagtgctgtt

SEQ ID NO: 559264 - DNA, 25 bp, Mus musculus
gcgcctgctttgatgtgaactgtta

SEQ ID NO: 559265 - DNA, 25 bp, Mus musculus
gcgcctgctttgttgtgaactgtta

SEQ ID NO: 559266 - DNA, 25 bp, Mus musculus
gcgcctggatttcggacatgcttgt

SEQ ID NO: 559267 - DNA, 25 bp, Mus musculus
gcgcctggatttgggacatgcttgt

SEQ ID NO: 559268 - DNA, 25 bp, Mus musculus
gcgcctggcaagaaaggactcccat

SEQ ID NO: 559269 - DNA, 25 bp, Mus musculus
gcgcctggcaagtaaggactcccat

SEQ ID NO: 559270 - DNA, 25 bp, Mus musculus
gcgcctgtaaccagaatatgaccgt

SEQ ID NO: 559271 - DNA, 25 bp, Mus musculus
gcgcctgtaacctgaatatgaccgt

SEQ ID NO: 559272 - DNA, 25 bp, Mus musculus
gcgcctgtcatcatctaggagcgag

SEQ ID NO: 559273 - DNA, 25 bp, Mus musculus
gcgcctgtcatcttctaggagcgag

SEQ ID NO: 559274 - DNA, 25 bp, Mus musculus
gcgcctgtctatcaagggcttgtta

SEQ ID NO: 559275 - DNA, 25 bp, Mus musculus
gcgcctgtctatgaagggcttgtta

SEQ ID NO: 559276 - DNA, 25 bp, Mus musculus
gcgcctgtgaggctgttgtacatga

SEQ ID NO: 559277 - DNA, 25 bp, Mus musculus
gcgcctgtgagggtgttgtacatga

SEQ ID NO: 559278 - DNA, 25 bp, Mus musculus
gcgcctgtgctcacttacatcagag

SEQ ID NO: 559279 - DNA, 25 bp, Mus musculus
gcgcctgtgctctcttacatcagag

SEQ ID NO: 559280 - DNA, 25 bp, Mus musculus
gcgcctgttctgaagccaacttaaa

SEQ ID NO: 559281 - DNA, 25 bp, Mus musculus
gcgcctgttctgtagccaacttaaa

SEQ ID NO: 559282 - DNA, 25 bp, Mus musculus
gcgcctgttgctagttgaacacaca

SEQ ID NO: 559283 - DNA, 25 bp, Mus musculus
gcgcctgttgcttgttgaacacaca

SEQ ID NO: 559284 - DNA, 25 bp, Mus musculus
gcgccttactaactccatgatgatg

SEQ ID NO: 559285 - DNA, 25 bp, Mus musculus
gcgccttactaagtccatgatgatg

SEQ ID NO: 559286 - DNA, 25 bp, Mus musculus
gcgccttagcaacaactctgtggta

SEQ ID NO: 559287 - DNA, 25 bp, Mus musculus
gcgccttagcaagaactctgtggta

SEQ ID NO: 559288 - DNA, 25 bp, Mus musculus
gcgccttatggaagatggacttgaa

SEQ ID NO: 559289 - DNA, 25 bp, Mus musculus
gcgccttatggatgatggacttgaa

SEQ ID NO: 559290 - DNA, 25 bp, Mus musculus
gcgccttccgaaagttgcacgtaga

SEQ ID NO: 559291 - DNA, 25 bp, Mus musculus
gcgccttccgaatgttgcacgtaga

SEQ ID NO: 559292 - DNA, 25 bp, Mus musculus
gcgccttccttgatataacacaacc

SEQ ID NO: 559293 - DNA, 25 bp, Mus musculus
gcgccttccttgttataacacaacc

SEQ ID NO: 559294 - DNA, 25 bp, Mus musculus
gcgccttgagaaagtttcctacttc

SEQ ID NO: 559295 - DNA, 25 bp, Mus musculus
gcgccttgagaatgtttcctacttc

SEQ ID NO: 559296 - DNA, 25 bp, Mus musculus
gcgccttgtataagctagacagttg

SEQ ID NO: 559297 - DNA, 25 bp, Mus musculus
gcgccttgtatatgctagacagttg

SEQ ID NO: 559298 - DNA, 25 bp, Mus musculus
gcgccttgtgctcatctacagagag

SEQ ID NO: 559299 - DNA, 25 bp, Mus musculus
gcgccttgtgctgatctacagagag

SEQ ID NO: 559300 - DNA, 25 bp, Mus musculus
gcgcctttctgccggacgcgagcag

SEQ ID NO: 559301 - DNA, 25 bp, Mus musculus
gcgcctttctgcgggacgcgagcag

SEQ ID NO: 559302 - DNA, 25 bp, Mus musculus
gcgccttttctgaaccacttctggg

SEQ ID NO: 559303 - DNA, 25 bp, Mus musculus
gcgccttttctgtaccacttctggg

SEQ ID NO: 559304 - DNA, 25 bp, Mus musculus
gcgccttttgttctacttgtgtggc

SEQ ID NO: 559305 - DNA, 25 bp, Mus musculus
gcgccttttgttgtacttgtgtggc

SEQ ID NO: 559306 - DNA, 25 bp, Mus musculus
gcgcctttttcacccatgggactag

SEQ ID NO: 559307 - DNA, 25 bp, Mus musculus
gcgcctttttcagccatgggactag

SEQ ID NO: 559308 - DNA, 25 bp, Mus musculus
gcgcgaaaggtccaggtgacaactt

SEQ ID NO: 559309 - DNA, 25 bp, Mus musculus
gcgcgaaaggtcgaggtgacaactt

SEQ ID NO: 559310 - DNA, 25 bp, Mus musculus
gcgcgaaccccaagcctcgggaagg

SEQ ID NO: 559311 - DNA, 25 bp, Mus musculus
gcgcgaaccccatgcctcgggaagg

SEQ ID NO: 559312 - DNA, 25 bp, Mus musculus
gcgcgaacctctcccatttatttat

SEQ ID NO: 559313 - DNA, 25 bp, Mus musculus
gcgcgaacctctgccatttatttat

SEQ ID NO: 559314 - DNA, 25 bp, Mus musculus
gcgcgaagaaccaacaagccatgtg

SEQ ID NO: 559315 - DNA, 25 bp, Mus musculus
gcgcgaagaacctacaagccatgtg

SEQ ID NO: 559316 - DNA, 25 bp, Mus musculus
gcgcgacacctcaaactttttggtt

SEQ ID NO: 559317 - DNA, 25 bp, Mus musculus
gcgcgacacctctaactttttggtt

SEQ ID NO: 559318 - DNA, 25 bp, Mus musculus
gcgcgacagtgcatgatgacgacct

SEQ ID NO: 559319 - DNA, 25 bp, Mus musculus
gcgcgacagtgcttgatgacgacct

SEQ ID NO: 559320 - DNA, 25 bp, Mus musculus
gcgcgaccagaacggctatagtgaa

SEQ ID NO: 559321 - DNA, 25 bp, Mus musculus
gcgcgaccagaagggctatagtgaa

SEQ ID NO: 559322 - DNA, 25 bp, Mus musculus
gcgcgacccagtacggtttattcct

SEQ ID NO: 559323 - DNA, 25 bp, Mus musculus
gcgcgacccagttcggtttattcct

SEQ ID NO: 559324 - DNA, 25 bp, Mus musculus
gcgcgactcttcagaatgttctccg

SEQ ID NO: 559325 - DNA, 25 bp, Mus musculus
gcgcgactcttctgaatgttctccg

SEQ ID NO: 559326 - DNA, 25 bp, Mus musculus
gcgcgagaaatgagacgtaccccag

SEQ ID NO: 559327 - DNA, 25 bp, Mus musculus
gcgcgagaaatgtgacgtaccccag

SEQ ID NO: 559328 - DNA, 25 bp, Mus musculus
gcgcgagaccctcagattccagatt

SEQ ID NO: 559329 - DNA, 25 bp, Mus musculus
gcgcgagaccctgagattccagatt

SEQ ID NO: 559330 - DNA, 25 bp, Mus musculus
gcgcgagcagctaccgtcagaagtt

SEQ ID NO: 559331 - DNA, 25 bp, Mus musculus
gcgcgagcagcttccgtcagaagtt

SEQ ID NO: 559332 - DNA, 25 bp, Mus musculus
gcgcgagcgcaaccgcgtaaagctg

SEQ ID NO: 559333 - DNA, 25 bp, Mus musculus
gcgcgagcgcaagcgcgtaaagctg

SEQ ID NO: 559334 - DNA, 25 bp, Mus musculus
gcgcgagcgcaccaccagaacttgg

SEQ ID NO: 559335 - DNA, 25 bp, Mus musculus
gcgcgagcgcacgaccagaacttgg

SEQ ID NO: 559336 - DNA, 25 bp, Mus musculus
gcgcgagcgttgactatcatggtac

SEQ ID NO: 559337 - DNA, 25 bp, Mus musculus
gcgcgagcgttgtctatcatggtac

SEQ ID NO: 559338 - DNA, 25 bp, Mus musculus
gcgcgatgcgaacctctttgttcac

SEQ ID NO: 559339 - DNA, 25 bp, Mus musculus
gcgcgatgcgaagctctttgttcac

SEQ ID NO: 559340 - DNA, 25 bp, Mus musculus
gcgcgcaaagttctgtgcttttgga

SEQ ID NO: 559341 - DNA, 25 bp, Mus musculus
gcgcgcaaagttgtgtgcttttgga

SEQ ID NO: 559342 - DNA, 25 bp, Mus musculus
gcgcgcaccagtacccgggaggaaa

SEQ ID NO: 559343 - DNA, 25 bp, Mus musculus
gcgcgcaccagttcccgggaggaaa

SEQ ID NO: 559344 - DNA, 25 bp, Mus musculus
gcgcgcattcttacagtctgattaa

SEQ ID NO: 559345 - DNA, 25 bp, Mus musculus
gcgcgcattctttcagtctgattaa

SEQ ID NO: 559346 - DNA, 25 bp, Mus musculus
gcgcgccctaggcactatgggattt

SEQ ID NO: 559347 - DNA, 25 bp, Mus musculus
gcgcgccctagggactatgggattt

SEQ ID NO: 559348 - DNA, 25 bp, Mus musculus
gcgcgccctcaaattaaacaggcct

SEQ ID NO: 559349 - DNA, 25 bp, Mus musculus
gcgcgccctcaatttaaacaggcct

SEQ ID NO: 559350 - DNA, 25 bp, Mus musculus
gcgcgccctggtctttcacttaggc

SEQ ID NO: 559351 - DNA, 25 bp, Mus musculus
gcgcgccctggtgtttcacttaggc

SEQ ID NO: 559352 - DNA, 25 bp, Mus musculus
gcgcgccgccgcaccaaggttgtgt

SEQ ID NO: 559353 - DNA, 25 bp, Mus musculus
gcgcgccgccgctccaaggttgtgt

SEQ ID NO: 559354 - DNA, 25 bp, Mus musculus
gcgcgccgtaacagcgtatgtgttt

SEQ ID NO: 559355 - DNA, 25 bp, Mus musculus
gcgcgccgtaactgcgtatgtgttt

SEQ ID NO: 559356 - DNA, 25 bp, Mus musculus
gcgcgcgaccagaacgatggacttt

SEQ ID NO: 559357 - DNA, 25 bp, Mus musculus
gcgcgcgaccagtacgatggacttt

SEQ ID NO: 559358 - DNA, 25 bp, Mus musculus
gcgcgcgatggtcagataactgttc

SEQ ID NO: 559359 - DNA, 25 bp, Mus musculus
gcgcgcgatggtgagataactgttc

SEQ ID NO: 559360 - DNA, 25 bp, Mus musculus
gcgcgcgcgaacatgtatgtacata

SEQ ID NO: 559361 - DNA, 25 bp, Mus musculus
gcgcgcgcgaacttgtatgtacata

SEQ ID NO: 559362 - DNA, 25 bp, Mus musculus
gcgcgcgcggaaacgagtatcagcc

SEQ ID NO: 559363 - DNA, 25 bp, Mus musculus
gcgcgcgcggaatcgagtatcagcc

SEQ ID NO: 559364 - DNA, 25 bp, Mus musculus
gcgcgcggatcaacgagagcctaag

SEQ ID NO: 559365 - DNA, 25 bp, Mus musculus
gcgcgcggatcatcgagagcctaag

SEQ ID NO: 559366 - DNA, 25 bp, Mus musculus
gcgcgcggccaacttgcaaattgga

SEQ ID NO: 559367 - DNA, 25 bp, Mus musculus
gcgcgcggccaagttgcaaattgga

SEQ ID NO: 559368 - DNA, 25 bp, Mus musculus
gcgcgcggcgggaggctgggacctc

SEQ ID NO: 559369 - DNA, 25 bp, Mus musculus
gcgcgcggcgggtggctgggacctc

SEQ ID NO: 559370 - DNA, 25 bp, Mus musculus
gcgcgcgggccgaaaagaaccaact

SEQ ID NO: 559371 - DNA, 25 bp, Mus musculus
gcgcgcgggccgtaaagaaccaact

SEQ ID NO: 559372 - DNA, 25 bp, Mus musculus
gcgcgcgtgcagaccaagctgtgaa

SEQ ID NO: 559373 - DNA, 25 bp, Mus musculus
gcgcgcgtgcagtccaagctgtgaa

SEQ ID NO: 559374 - DNA, 25 bp, Mus musculus
gcgcgctcgagtatgctaaacaaca

SEQ ID NO: 559375 - DNA, 25 bp, Mus musculus
gcgcgctcgagtttgctaaacaaca

SEQ ID NO: 559376 - DNA, 25 bp, Mus musculus
gcgcgctcgtgtaagcttgccgtcc

SEQ ID NO: 559377 - DNA, 25 bp, Mus musculus
gcgcgctcgtgttagcttgccgtcc

SEQ ID NO: 559378 - DNA, 25 bp, Mus musculus
gcgcgctgagctattctgagaatac

SEQ ID NO: 559379 - DNA, 25 bp, Mus musculus
gcgcgctgagcttttctgagaatac

SEQ ID NO: 559380 - DNA, 25 bp, Mus musculus
gcgcgctgtccgcaaataccaggaa

SEQ ID NO: 559381 - DNA, 25 bp, Mus musculus
gcgcgctgtccggaaataccaggaa

SEQ ID NO: 559382 - DNA, 25 bp, Mus musculus
gcgcgctgtgctagagatttctcat

SEQ ID NO: 559383 - DNA, 25 bp, Mus musculus
gcgcgctgtgcttgagatttctcat

SEQ ID NO: 559384 - DNA, 25 bp, Mus musculus
gcgcgcttaaatccacccgtaagag

SEQ ID NO: 559385 - DNA, 25 bp, Mus musculus
gcgcgcttaaatgcacccgtaagag

SEQ ID NO: 559386 - DNA, 25 bp, Mus musculus
gcgcggaacttaccacgaaacgtga

SEQ ID NO: 559387 - DNA, 25 bp, Mus musculus
gcgcggaacttagcacgaaacgtga

SEQ ID NO: 559388 - DNA, 25 bp, Mus musculus
gcgcggaccccgaagcctttggcaa

SEQ ID NO: 559389 - DNA, 25 bp, Mus musculus
gcgcggaccccgtagcctttggcaa

SEQ ID NO: 559390 - DNA, 25 bp, Mus musculus
gcgcggactctgaggactgtcttca

SEQ ID NO: 559391 - DNA, 25 bp, Mus musculus
gcgcggactctgtggactgtcttca

SEQ ID NO: 559392 - DNA, 25 bp, Mus musculus
gcgcggaggctcatgaatctcactt

SEQ ID NO: 559393 - DNA, 25 bp, Mus musculus
gcgcggaggctcttgaatctcactt

SEQ ID NO: 559394 - DNA, 25 bp, Mus musculus
gcgcggattcctcgtgaggcaaact

SEQ ID NO: 559395 - DNA, 25 bp, Mus musculus
gcgcggattcctggtgaggcaaact

SEQ ID NO: 559396 - DNA, 25 bp, Mus musculus
gcgcggccccttaaaggacagcgga

SEQ ID NO: 559397 - DNA, 25 bp, Mus musculus
gcgcggcccctttaaggacagcgga

SEQ ID NO: 559398 - DNA, 25 bp, Mus musculus
gcgcggccttacacccagagggtga

SEQ ID NO: 559399 - DNA, 25 bp, Mus musculus
gcgcggccttactcccagagggtga

SEQ ID NO: 559400 - DNA, 25 bp, Mus musculus
gcgcggcgtcttcaggaggtggctc

SEQ ID NO: 559401 - DNA, 25 bp, Mus musculus
gcgcggcgtcttgaggaggtggctc

SEQ ID NO: 559402 - DNA, 25 bp, Mus musculus
gcgcggctattccacaaaccagttt

SEQ ID NO: 559403 - DNA, 25 bp, Mus musculus
gcgcggctattcgacaaaccagttt

SEQ ID NO: 559404 - DNA, 25 bp, Mus musculus
gcgcggctggccagctaagctatat

SEQ ID NO: 559405 - DNA, 25 bp, Mus musculus
gcgcggctggcctgctaagctatat

SEQ ID NO: 559406 - DNA, 25 bp, Mus musculus
gcgcgggcgggtccgggtgcggctc

SEQ ID NO: 559407 - DNA, 25 bp, Mus musculus
gcgcgggcgggtgcgggtgcggctc

SEQ ID NO: 559408 - DNA, 25 bp, Mus musculus
gcgcgggctcttaggtgaatgtcac

SEQ ID NO: 559409 - DNA, 25 bp, Mus musculus
gcgcgggctctttggtgaatgtcac

SEQ ID NO: 559410 - DNA, 25 bp, Mus musculus
gcgcgggtaccaacgagaacaagga

SEQ ID NO: 559411 - DNA, 25 bp, Mus musculus
gcgcgggtaccatcgagaacaagga

SEQ ID NO: 559412 - DNA, 25 bp, Mus musculus
gcgcggtacaatccccagtgccagg

SEQ ID NO: 559413 - DNA, 25 bp, Mus musculus
gcgcggtacaatgcccagtgccagg

SEQ ID NO: 559414 - DNA, 25 bp, Mus musculus
gcgcggtcaggaagactcggcacaa

SEQ ID NO: 559415 - DNA, 25 bp, Mus musculus
gcgcggtcaggatgactcggcacaa

SEQ ID NO: 559416 - DNA, 25 bp, Mus musculus
gcgcggtctattacagtgcttgcat

SEQ ID NO: 559417 - DNA, 25 bp, Mus musculus
gcgcggtctatttcagtgcttgcat

SEQ ID NO: 559418 - DNA, 25 bp, Mus musculus
gcgcggtggcggaagccatttccaa

SEQ ID NO: 559419 - DNA, 25 bp, Mus musculus
gcgcggtggcggtagccatttccaa

SEQ ID NO: 559420 - DNA, 25 bp, Mus musculus
gcgcggtgtcaaccttcgtggccta

SEQ ID NO: 559421 - DNA, 25 bp, Mus musculus
gcgcggtgtcaagcttcgtggccta

SEQ ID NO: 559422 - DNA, 25 bp, Mus musculus
gcgcggttacaacagatcctgtctt

SEQ ID NO: 559423 - DNA, 25 bp, Mus musculus
gcgcggttacaagagatcctgtctt

SEQ ID NO: 559424 - DNA, 25 bp, Mus musculus
gcgcggttggaactcgttactttga

SEQ ID NO: 559425 - DNA, 25 bp, Mus musculus
gcgcggttggaagtcgttactttga

SEQ ID NO: 559426 - DNA, 25 bp, Mus musculus
gcgcgtaggcggcacggcacggtgt

SEQ ID NO: 559427 - DNA, 25 bp, Mus musculus
gcgcgtaggcgggacggcacggtgt

SEQ ID NO: 559428 - DNA, 25 bp, Mus musculus
gcgcgtagggcaactcctgaaggac

SEQ ID NO: 559429 - DNA, 25 bp, Mus musculus
gcgcgtagggcatctcctgaaggac

SEQ ID NO: 559430 - DNA, 25 bp, Mus musculus
gcgcgtcaagccagaaactctacta

SEQ ID NO: 559431 - DNA, 25 bp, Mus musculus
gcgcgtcaagcctgaaactctacta

SEQ ID NO: 559432 - DNA, 25 bp, Mus musculus
gcgcgtgcgcgtacttgctgagcca

SEQ ID NO: 559433 - DNA, 25 bp, Mus musculus
gcgcgtgcgcgttcttgctgagcca

SEQ ID NO: 559434 - DNA, 25 bp, Mus musculus
gcgcgtgtagttctttggtccctga

SEQ ID NO: 559435 - DNA, 25 bp, Mus musculus
gcgcgtgtagttgtttggtccctga

SEQ ID NO: 559436 - DNA, 25 bp, Mus musculus
gcgcgtgtgctacaactacaacttt

SEQ ID NO: 559437 - DNA, 25 bp, Mus musculus
gcgcgtgtgctagaactacaacttt

SEQ ID NO: 559438 - DNA, 25 bp, Mus musculus
gcgcgttctgagcactcgttgccag

SEQ ID NO: 559439 - DNA, 25 bp, Mus musculus
gcgcgttctgaggactcgttgccag

SEQ ID NO: 559440 - DNA, 25 bp, Mus musculus
gcgcgtttaaagctcatcggtggat

SEQ ID NO: 559441 - DNA, 25 bp, Mus musculus
gcgcgtttaaaggtcatcggtggat

SEQ ID NO: 559442 - DNA, 25 bp, Mus musculus
gcgctaaagcttcatagggttttgt

SEQ ID NO: 559443 - DNA, 25 bp, Mus musculus
gcgctaaagcttgatagggttttgt

SEQ ID NO: 559444 - DNA, 25 bp, Mus musculus
gcgctaagagacatctatcactccc

SEQ ID NO: 559445 - DNA, 25 bp, Mus musculus
gcgctaagagacttctatcactccc

SEQ ID NO: 559446 - DNA, 25 bp, Mus musculus
gcgctacatctgacgggtttgtaat

SEQ ID NO: 559447 - DNA, 25 bp, Mus musculus
gcgctacatctgtcgggtttgtaat

SEQ ID NO: 559448 - DNA, 25 bp, Mus musculus
gcgctacctccacagccataaaatg

SEQ ID NO: 559449 - DNA, 25 bp, Mus musculus
gcgctacctccagagccataaaatg

SEQ ID NO: 559450 - DNA, 25 bp, Mus musculus
gcgctacgaccaataatcaactctg

SEQ ID NO: 559451 - DNA, 25 bp, Mus musculus
gcgctacgaccattaatcaactctg

SEQ ID NO: 559452 - DNA, 25 bp, Mus musculus
gcgctacgacggcttgaagtacgat

SEQ ID NO: 559453 - DNA, 25 bp, Mus musculus
gcgctacgacgggttgaagtacgat

SEQ ID NO: 559454 - DNA, 25 bp, Mus musculus
gcgctactacttctcatgttgcatt

SEQ ID NO: 559455 - DNA, 25 bp, Mus musculus
gcgctactacttgtcatgttgcatt

SEQ ID NO: 559456 - DNA, 25 bp, Mus musculus
gcgctagcagatccaatgctctctt

SEQ ID NO: 559457 - DNA, 25 bp, Mus musculus
gcgctagcagatgcaatgctctctt

SEQ ID NO: 559458 - DNA, 25 bp, Mus musculus
gcgctagcgaacacggaacccggag

SEQ ID NO: 559459 - DNA, 25 bp, Mus musculus
gcgctagcgaactcggaacccggag

SEQ ID NO: 559460 - DNA, 25 bp, Mus musculus
gcgctagtgggaaccttctcatggg

SEQ ID NO: 559461 - DNA, 25 bp, Mus musculus
gcgctagtgggatccttctcatggg

SEQ ID NO: 559462 - DNA, 25 bp, Mus musculus
gcgctataccagcaagagttacata

SEQ ID NO: 559463 - DNA, 25 bp, Mus musculus
gcgctataccaggaagagttacata

SEQ ID NO: 559464 - DNA, 25 bp, Mus musculus
gcgctatcgagcaacgggctggaat

SEQ ID NO: 559465 - DNA, 25 bp, Mus musculus
gcgctatcgagctacgggctggaat

SEQ ID NO: 559466 - DNA, 25 bp, Mus musculus
gcgctatctatccttgcgttggaga

SEQ ID NO: 559467 - DNA, 25 bp, Mus musculus
gcgctatctatcgttgcgttggaga

SEQ ID NO: 559468 - DNA, 25 bp, Mus musculus
gcgctatctgtgaaattccttggtg

SEQ ID NO: 559469 - DNA, 25 bp, Mus musculus
gcgctatctgtgtaattccttggtg

SEQ ID NO: 559470 - DNA, 25 bp, Mus musculus
gcgctatgaagaactcgtgctgaat

SEQ ID NO: 559471 - DNA, 25 bp, Mus musculus
gcgctatgaagatctcgtgctgaat

SEQ ID NO: 559472 - DNA, 25 bp, Mus musculus
gcgctatgacggcaggttaaccctc

SEQ ID NO: 559473 - DNA, 25 bp, Mus musculus
gcgctatgacgggaggttaaccctc

SEQ ID NO: 559474 - DNA, 25 bp, Mus musculus
gcgctatgcatgagccaactttggg

SEQ ID NO: 559475 - DNA, 25 bp, Mus musculus
gcgctatgcatgtgccaactttggg

SEQ ID NO: 559476 - DNA, 25 bp, Mus musculus
gcgctattctgacgctgaccaatgt

SEQ ID NO: 559477 - DNA, 25 bp, Mus musculus
gcgctattctgaggctgaccaatgt

SEQ ID NO: 559478 - DNA, 25 bp, Mus musculus
gcgctcaaagccctaatggaagttt

SEQ ID NO: 559479 - DNA, 25 bp, Mus musculus
gcgctcaaagccgtaatggaagttt

SEQ ID NO: 559480 - DNA, 25 bp, Mus musculus
gcgctcaaccccacacaggaagaag

SEQ ID NO: 559481 - DNA, 25 bp, Mus musculus
gcgctcaacccctcacaggaagaag

SEQ ID NO: 559482 - DNA, 25 bp, Mus musculus
gcgctcaactccctcataggagttt

SEQ ID NO: 559483 - DNA, 25 bp, Mus musculus
gcgctcaactccgtcataggagttt

SEQ ID NO: 559484 - DNA, 25 bp, Mus musculus
gcgctcaaggtcatcaacctgggta

SEQ ID NO: 559485 - DNA, 25 bp, Mus musculus
gcgctcaaggtcttcaacctgggta

SEQ ID NO: 559486 - DNA, 25 bp, Mus musculus
gcgctcacaacacctccggaaggga

SEQ ID NO: 559487 - DNA, 25 bp, Mus musculus
gcgctcacaacagctccggaaggga

SEQ ID NO: 559488 - DNA, 25 bp, Mus musculus
gcgctcacagggactagccgggtta

SEQ ID NO: 559489 - DNA, 25 bp, Mus musculus
gcgctcacagggtctagccgggtta

SEQ ID NO: 559490 - DNA, 25 bp, Mus musculus
gcgctcaccttgatcatgctcttaa

SEQ ID NO: 559491 - DNA, 25 bp, Mus musculus
gcgctcaccttgttcatgctcttaa

SEQ ID NO: 559492 - DNA, 25 bp, Mus musculus
gcgctcacttttagtatttaaatat

SEQ ID NO: 559493 - DNA, 25 bp, Mus musculus
gcgctcactttttgtatttaaatat

SEQ ID NO: 559494 - DNA, 25 bp, Mus musculus
gcgctcattggactacgactttaac

SEQ ID NO: 559495 - DNA, 25 bp, Mus musculus
gcgctcattggagtacgactttaac

SEQ ID NO: 559496 - DNA, 25 bp, Mus musculus
gcgctccacgtgcagagacgtctag

SEQ ID NO: 559497 - DNA, 25 bp, Mus musculus
gcgctccacgtggagagacgtctag

SEQ ID NO: 559498 - DNA, 25 bp, Mus musculus
gcgctccgagttagttatggtttct

SEQ ID NO: 559499 - DNA, 25 bp, Mus musculus
gcgctccgagtttgttatggtttct

SEQ ID NO: 559500 - DNA, 25 bp, Mus musculus
gcgctccgcttcaggttaaatagta

SEQ ID NO: 559501 - DNA, 25 bp, Mus musculus
gcgctccgcttctggttaaatagta

SEQ ID NO: 559502 - DNA, 25 bp, Mus musculus
gcgctccgtagtaaggccctggata

SEQ ID NO: 559503 - DNA, 25 bp, Mus musculus
gcgctccgtagttaggccctggata

SEQ ID NO: 559504 - DNA, 25 bp, Mus musculus
gcgctcgaggcaacggtcatacaaa

SEQ ID NO: 559505 - DNA, 25 bp, Mus musculus
gcgctcgaggcatcggtcatacaaa

SEQ ID NO: 559506 - DNA, 25 bp, Mus musculus
gcgctcgcagaacaacgtctacagc

SEQ ID NO: 559507 - DNA, 25 bp, Mus musculus
gcgctcgcagaacagctacaccaga

SEQ ID NO: 559508 - DNA, 25 bp, Mus musculus
gcgctcgcagaagaacgtctacagc

SEQ ID NO: 559509 - DNA, 25 bp, Mus musculus
gcgctcgcagaagagctacaccaga

SEQ ID NO: 559510 - DNA, 25 bp, Mus musculus
gcgctcgcagcaaaccgaaggtggt

SEQ ID NO: 559511 - DNA, 25 bp, Mus musculus
gcgctcgcagcataccgaaggtggt

SEQ ID NO: 559512 - DNA, 25 bp, Mus musculus
gcgctcggcagtcaacatgaacctt

SEQ ID NO: 559513 - DNA, 25 bp, Mus musculus
gcgctcggcagtgaacatgaacctt

SEQ ID NO: 559514 - DNA, 25 bp, Mus musculus
gcgctcgggtttatcattcgaaact

SEQ ID NO: 559515 - DNA, 25 bp, Mus musculus
gcgctcgggtttttcattcgaaact

SEQ ID NO: 559516 - DNA, 25 bp, Mus musculus
gcgctcgtgctgaggctgagcaaat

SEQ ID NO: 559517 - DNA, 25 bp, Mus musculus
gcgctcgtgctgtggctgagcaaat

SEQ ID NO: 559518 - DNA, 25 bp, Mus musculus
gcgctctatcatatctagcatactg

SEQ ID NO: 559519 - DNA, 25 bp, Mus musculus
gcgctctatcatttctagcatactg

SEQ ID NO: 559520 - DNA, 25 bp, Mus musculus
gcgctctcagctcaatgacatctca

SEQ ID NO: 559521 - DNA, 25 bp, Mus musculus
gcgctctcagctgaatgacatctca

SEQ ID NO: 559522 - DNA, 25 bp, Mus musculus
gcgctctcagggagctatgtggcat

SEQ ID NO: 559523 - DNA, 25 bp, Mus musculus
gcgctctcagggtgctatgtggcat

SEQ ID NO: 559524 - DNA, 25 bp, Mus musculus
gcgctctccattcttacaaacacta

SEQ ID NO: 559525 - DNA, 25 bp, Mus musculus
gcgctctccattgttacaaacacta

SEQ ID NO: 559526 - DNA, 25 bp, Mus musculus
gcgctctgctgtattactacttaga

SEQ ID NO: 559527 - DNA, 25 bp, Mus musculus
gcgctctgctgttttactacttaga

SEQ ID NO: 559528 - DNA, 25 bp, Mus musculus
gcgctctgtaaaagggacgtcccca

SEQ ID NO: 559529 - DNA, 25 bp, Mus musculus
gcgctctgtaaatgggacgtcccca

SEQ ID NO: 559530 - DNA, 25 bp, Mus musculus
gcgctctgtaccaggtcaactggat

SEQ ID NO: 559531 - DNA, 25 bp, Mus musculus
gcgctctgtacctggtcaactggat

SEQ ID NO: 559532 - DNA, 25 bp, Mus musculus
gcgctcttcctcacagagatgatgt

SEQ ID NO: 559533 - DNA, 25 bp, Mus musculus
gcgctcttcctctcagagatgatgt

SEQ ID NO: 559534 - DNA, 25 bp, Mus musculus
gcgctcttcgagctattggatcttt

SEQ ID NO: 559535 - DNA, 25 bp, Mus musculus
gcgctcttcgaggtattggatcttt

SEQ ID NO: 559536 - DNA, 25 bp, Mus musculus
gcgctcttggtacccgtggaaagta

SEQ ID NO: 559537 - DNA, 25 bp, Mus musculus
gcgctcttggtagccgtggaaagta

SEQ ID NO: 559538 - DNA, 25 bp, Mus musculus
gcgctctttgtgaagggctgcagca

SEQ ID NO: 559539 - DNA, 25 bp, Mus musculus
gcgctctttgtgtagggctgcagca

SEQ ID NO: 559540 - DNA, 25 bp, Mus musculus
gcgctgaaccttatcggtgggtcca

SEQ ID NO: 559541 - DNA, 25 bp, Mus musculus
gcgctgaaccttttcggtgggtcca

SEQ ID NO: 559542 - DNA, 25 bp, Mus musculus
gcgctgaactccaggtcctaagttt

SEQ ID NO: 559543 - DNA, 25 bp, Mus musculus
gcgctgaactcctggtcctaagttt

SEQ ID NO: 559544 - DNA, 25 bp, Mus musculus
gcgctgaagaccctggtggaccaaa

SEQ ID NO: 559545 - DNA, 25 bp, Mus musculus
gcgctgaagaccgtggtggaccaaa

SEQ ID NO: 559546 - DNA, 25 bp, Mus musculus
gcgctgacatctatgcaatgggctt

SEQ ID NO: 559547 - DNA, 25 bp, Mus musculus
gcgctgacatctttgcaatgggctt

SEQ ID NO: 559548 - DNA, 25 bp, Mus musculus
gcgctgacatgtcgagagaatagat

SEQ ID NO: 559549 - DNA, 25 bp, Mus musculus
gcgctgacatgtggagagaatagat

SEQ ID NO: 559550 - DNA, 25 bp, Mus musculus
gcgctgaccccgctggtggatgagg

SEQ ID NO: 559551 - DNA, 25 bp, Mus musculus
gcgctgaccccggtggtggatgagg

SEQ ID NO: 559552 - DNA, 25 bp, Mus musculus
gcgctgactgttatctggatccctg

SEQ ID NO: 559553 - DNA, 25 bp, Mus musculus
gcgctgactgttttctggatccctg

SEQ ID NO: 559554 - DNA, 25 bp, Mus musculus
gcgctgagcagcactgtcatccggg

SEQ ID NO: 559555 - DNA, 25 bp, Mus musculus
gcgctgagcagctctgtcatccggg

SEQ ID NO: 559556 - DNA, 25 bp, Mus musculus
gcgctgagcttacaatagcccatgt

SEQ ID NO: 559557 - DNA, 25 bp, Mus musculus
gcgctgagcttagaatagcccatgt

SEQ ID NO: 559558 - DNA, 25 bp, Mus musculus
gcgctgataacgagacaccctgtga

SEQ ID NO: 559559 - DNA, 25 bp, Mus musculus
gcgctgataacgtgacaccctgtga

SEQ ID NO: 559560 - DNA, 25 bp, Mus musculus
gcgctgataagaatgcacatcccaa

SEQ ID NO: 559561 - DNA, 25 bp, Mus musculus
gcgctgataagattgcacatcccaa

SEQ ID NO: 559562 - DNA, 25 bp, Mus musculus
gcgctgatatccagtgttctaacta

SEQ ID NO: 559563 - DNA, 25 bp, Mus musculus
gcgctgatatcctgtgttctaacta

SEQ ID NO: 559564 - DNA, 25 bp, Mus musculus
gcgctgatcgatactctgcctgtgt

SEQ ID NO: 559565 - DNA, 25 bp, Mus musculus
gcgctgatcgattctctgcctgtgt

SEQ ID NO: 559566 - DNA, 25 bp, Mus musculus
gcgctgatgattctcaagtctcgat

SEQ ID NO: 559567 - DNA, 25 bp, Mus musculus
gcgctgatgattgtcaagtctcgat

SEQ ID NO: 559568 - DNA, 25 bp, Mus musculus
gcgctgatgcgcagactgagagaaa

SEQ ID NO: 559569 - DNA, 25 bp, Mus musculus
gcgctgatgcgctgactgagagaaa

SEQ ID NO: 559570 - DNA, 25 bp, Mus musculus
gcgctgcacagtctataatgacctt

SEQ ID NO: 559571 - DNA, 25 bp, Mus musculus
gcgctgcacagtgtataatgacctt

SEQ ID NO: 559572 - DNA, 25 bp, Mus musculus
gcgctgcatatcacgtggcttcaca

SEQ ID NO: 559573 - DNA, 25 bp, Mus musculus
gcgctgcatatctcgtggcttcaca

SEQ ID NO: 559574 - DNA, 25 bp, Mus musculus
gcgctgccactcagatacaatcagg

SEQ ID NO: 559575 - DNA, 25 bp, Mus musculus
gcgctgccactctgatacaatcagg

SEQ ID NO: 559576 - DNA, 25 bp, Mus musculus
gcgctgcccgaacaaggacacttga

SEQ ID NO: 559577 - DNA, 25 bp, Mus musculus
gcgctgcccgaagaaggacacttga

SEQ ID NO: 559578 - DNA, 25 bp, Mus musculus
gcgctgcctgaaatagggttagcaa

SEQ ID NO: 559579 - DNA, 25 bp, Mus musculus
gcgctgcctgaattagggttagcaa

SEQ ID NO: 559580 - DNA, 25 bp, Mus musculus
gcgctgcgaactaccactgcggcat

SEQ ID NO: 559581 - DNA, 25 bp, Mus musculus
gcgctgcgaacttccactgcggcat

SEQ ID NO: 559582 - DNA, 25 bp, Mus musculus
gcgctgcgcggccttttcacgtgtc

SEQ ID NO: 559583 - DNA, 25 bp, Mus musculus
gcgctgcgcggcgttttcacgtgtc

SEQ ID NO: 559584 - DNA, 25 bp, Mus musculus
gcgctgcgttagattgctaggctgc

SEQ ID NO: 559585 - DNA, 25 bp, Mus musculus
gcgctgcgttagtttgctaggctgc

SEQ ID NO: 559586 - DNA, 25 bp, Mus musculus
gcgctgctcacaagccgaggcgtgt

SEQ ID NO: 559587 - DNA, 25 bp, Mus musculus
gcgctgctcacatgccgaggcgtgt

SEQ ID NO: 559588 - DNA, 25 bp, Mus musculus
gcgctgctcatgcttacgtgggaca

SEQ ID NO: 559589 - DNA, 25 bp, Mus musculus
gcgctgctcatggttacgtgggaca

SEQ ID NO: 559590 - DNA, 25 bp, Mus musculus
gcgctgctgccgagactgtaaagag

SEQ ID NO: 559591 - DNA, 25 bp, Mus musculus
gcgctgctgccgtgactgtaaagag

SEQ ID NO: 559592 - DNA, 25 bp, Mus musculus
gcgctggaccaaaaatgacttgcat

SEQ ID NO: 559593 - DNA, 25 bp, Mus musculus
gcgctggaccaataatgacttgcat

SEQ ID NO: 559594 - DNA, 25 bp, Mus musculus
gcgctggactcgcatgaagccttga

SEQ ID NO: 559595 - DNA, 25 bp, Mus musculus
gcgctggactcggatgaagccttga

SEQ ID NO: 559596 - DNA, 25 bp, Mus musculus
gcgctggacttcctaactgttattt

SEQ ID NO: 559597 - DNA, 25 bp, Mus musculus
gcgctggacttcgtaactgttattt

SEQ ID NO: 559598 - DNA, 25 bp, Mus musculus
gcgctggcacagactgttactgctg

SEQ ID NO: 559599 - DNA, 25 bp, Mus musculus
gcgctggcacagtctgttactgctg

SEQ ID NO: 559600 - DNA, 25 bp, Mus musculus
gcgctggcacctatttgtatattga

SEQ ID NO: 559601 - DNA, 25 bp, Mus musculus
gcgctggcacctttttgtatattga

SEQ ID NO: 559602 - DNA, 25 bp, Mus musculus
gcgctggccttaccatcatgagtgg

SEQ ID NO: 559603 - DNA, 25 bp, Mus musculus
gcgctggccttagcatcatgagtgg

SEQ ID NO: 559604 - DNA, 25 bp, Mus musculus
gcgctggcgttacagcgcaacagca

SEQ ID NO: 559605 - DNA, 25 bp, Mus musculus
gcgctggcgttagagcgcaacagca

SEQ ID NO: 559606 - DNA, 25 bp, Mus musculus
gcgctgggatatccatttgttttct

SEQ ID NO: 559607 - DNA, 25 bp, Mus musculus
gcgctgggatatgcatttgttttct

SEQ ID NO: 559608 - DNA, 25 bp, Mus musculus
gcgctgggcgccaaataagtctcca

SEQ ID NO: 559609 - DNA, 25 bp, Mus musculus
gcgctgggcgcctaataagtctcca

SEQ ID NO: 559610 - DNA, 25 bp, Mus musculus
gcgctgggcttgctttttcttggta

SEQ ID NO: 559611 - DNA, 25 bp, Mus musculus
gcgctgggcttggtttttcttggta

SEQ ID NO: 559612 - DNA, 25 bp, Mus musculus
gcgctgggggcaagacttatgaaat

SEQ ID NO: 559613 - DNA, 25 bp, Mus musculus
gcgctgggggcatgacttatgaaat

SEQ ID NO: 559614 - DNA, 25 bp, Mus musculus
gcgctggtagctcggactacctgcc

SEQ ID NO: 559615 - DNA, 25 bp, Mus musculus
gcgctggtagctgggactacctgcc

SEQ ID NO: 559616 - DNA, 25 bp, Mus musculus
gcgctggtgaggacccctggaccat

SEQ ID NO: 559617 - DNA, 25 bp, Mus musculus
gcgctggtgaggtcccctggaccat

SEQ ID NO: 559618 - DNA, 25 bp, Mus musculus
gcgctgtaactgagcttcatccaga

SEQ ID NO: 559619 - DNA, 25 bp, Mus musculus
gcgctgtaactgtgcttcatccaga

SEQ ID NO: 559620 - DNA, 25 bp, Mus musculus
gcgctgtaagccatgcacctagaag

SEQ ID NO: 559621 - DNA, 25 bp, Mus musculus
gcgctgtaagccttgcacctagaag

SEQ ID NO: 559622 - DNA, 25 bp, Mus musculus
gcgctgtaatacagaaccacctaac

SEQ ID NO: 559623 - DNA, 25 bp, Mus musculus
gcgctgtaatactgaaccacctaac

SEQ ID NO: 559624 - DNA, 25 bp, Mus musculus
gcgctgtagagtacggtgccactgc

SEQ ID NO: 559625 - DNA, 25 bp, Mus musculus
gcgctgtagagttcggtgccactgc

SEQ ID NO: 559626 - DNA, 25 bp, Mus musculus
gcgctgtatcagaggcacaaagtct

SEQ ID NO: 559627 - DNA, 25 bp, Mus musculus
gcgctgtatcagtggcacaaagtct

SEQ ID NO: 559628 - DNA, 25 bp, Mus musculus
gcgctgtcagagatgtcggtgcaac

SEQ ID NO: 559629 - DNA, 25 bp, Mus musculus
gcgctgtcagagttgtcggtgcaac

SEQ ID NO: 559630 - DNA, 25 bp, Mus musculus
gcgctgtccagccacttgaaggagc

SEQ ID NO: 559631 - DNA, 25 bp, Mus musculus
gcgctgtccagcgacttgaaggagc

SEQ ID NO: 559632 - DNA, 25 bp, Mus musculus
gcgctgtgcctactctcaaggtaaa

SEQ ID NO: 559633 - DNA, 25 bp, Mus musculus
gcgctgtgcctagtctcaaggtaaa

SEQ ID NO: 559634 - DNA, 25 bp, Mus musculus
gcgctgtgcctgcaggtacctcgaa

SEQ ID NO: 559635 - DNA, 25 bp, Mus musculus
gcgctgtgcctggaggtacctcgaa

SEQ ID NO: 559636 - DNA, 25 bp, Mus musculus
gcgctgtgctgccaaactgtatttg

SEQ ID NO: 559637 - DNA, 25 bp, Mus musculus
gcgctgtgctgcgaaactgtatttg

SEQ ID NO: 559638 - DNA, 25 bp, Mus musculus
gcgctgtggttgaccgcgaccgcac

SEQ ID NO: 559639 - DNA, 25 bp, Mus musculus
gcgctgtggttgtccgcgaccgcac

SEQ ID NO: 559640 - DNA, 25 bp, Mus musculus
gcgctgttcgttagtgggttttcac

SEQ ID NO: 559641 - DNA, 25 bp, Mus musculus
gcgctgttcgtttgtgggttttcac

SEQ ID NO: 559642 - DNA, 25 bp, Mus musculus
gcgcttaactacagagacaagtttc

SEQ ID NO: 559643 - DNA, 25 bp, Mus musculus
gcgcttaactactgagacaagtttc

SEQ ID NO: 559644 - DNA, 25 bp, Mus musculus
gcgcttacttgcatgaaatactatc

SEQ ID NO: 559645 - DNA, 25 bp, Mus musculus
gcgcttacttgcttgaaatactatc

SEQ ID NO: 559646 - DNA, 25 bp, Mus musculus
gcgcttagctccactgagcaaggat

SEQ ID NO: 559647 - DNA, 25 bp, Mus musculus
gcgcttagctcctctgagcaaggat

SEQ ID NO: 559648 - DNA, 25 bp, Mus musculus
gcgcttatatggcaacagtgctccc

SEQ ID NO: 559649 - DNA, 25 bp, Mus musculus
gcgcttatatgggaacagtgctccc

SEQ ID NO: 559650 - DNA, 25 bp, Mus musculus
gcgcttatctgactttctgctgcgt

SEQ ID NO: 559651 - DNA, 25 bp, Mus musculus
gcgcttatctgagtttctgctgcgt

SEQ ID NO: 559652 - DNA, 25 bp, Mus musculus
gcgcttcaacctacttctatttaag

SEQ ID NO: 559653 - DNA, 25 bp, Mus musculus
gcgcttcaaccttcttctatttaag

SEQ ID NO: 559654 - DNA, 25 bp, Mus musculus
gcgcttcaccatcaagataacacaa

SEQ ID NO: 559655 - DNA, 25 bp, Mus musculus
gcgcttcaccatgaagataacacaa

SEQ ID NO: 559656 - DNA, 25 bp, Mus musculus
gcgcttcagtaaaggacgtcctggt

SEQ ID NO: 559657 - DNA, 25 bp, Mus musculus
gcgcttcagtaatggacgtcctggt

SEQ ID NO: 559658 - DNA, 25 bp, Mus musculus
gcgcttcagtccacggtctgtactg

SEQ ID NO: 559659 - DNA, 25 bp, Mus musculus
gcgcttcagtcctcggtctgtactg

SEQ ID NO: 559660 - DNA, 25 bp, Mus musculus
gcgcttccatagacactgctttgaa

SEQ ID NO: 559661 - DNA, 25 bp, Mus musculus
gcgcttccatagtcactgctttgaa

SEQ ID NO: 559662 - DNA, 25 bp, Mus musculus
gcgcttccgtggagatcactagtga

SEQ ID NO: 559663 - DNA, 25 bp, Mus musculus
gcgcttccgtggtgatcactagtga

SEQ ID NO: 559664 - DNA, 25 bp, Mus musculus
gcgcttctatcaaagctgttcctga

SEQ ID NO: 559665 - DNA, 25 bp, Mus musculus
gcgcttctatcatagctgttcctga

SEQ ID NO: 559666 - DNA, 25 bp, Mus musculus
gcgcttctctagatgatgctgcaat

SEQ ID NO: 559667 - DNA, 25 bp, Mus musculus
gcgcttctctagttgatgctgcaat

SEQ ID NO: 559668 - DNA, 25 bp, Mus musculus
gcgcttctgaacactttggcttcag

SEQ ID NO: 559669 - DNA, 25 bp, Mus musculus
gcgcttctgaactctttggcttcag

SEQ ID NO: 559670 - DNA, 25 bp, Mus musculus
gcgcttctttgacacacgcatgaat

SEQ ID NO: 559671 - DNA, 25 bp, Mus musculus
gcgcttctttgagacacgcatgaat

SEQ ID NO: 559672 - DNA, 25 bp, Mus musculus
gcgcttgaaccaaaattccaggctt

SEQ ID NO: 559673 - DNA, 25 bp, Mus musculus
gcgcttgaaccataattccaggctt

SEQ ID NO: 559674 - DNA, 25 bp, Mus musculus
gcgcttgagcccagttgaaggattt

SEQ ID NO: 559675 - DNA, 25 bp, Mus musculus
gcgcttgagccctgttgaaggattt

SEQ ID NO: 559676 - DNA, 25 bp, Mus musculus
gcgcttgcatttcggcttctggaaa

SEQ ID NO: 559677 - DNA, 25 bp, Mus musculus
gcgcttgcatttgggcttctggaaa

SEQ ID NO: 559678 - DNA, 25 bp, Mus musculus
gcgcttggacttcatcctagtggaa

SEQ ID NO: 559679 - DNA, 25 bp, Mus musculus
gcgcttggacttgatcctagtggaa

SEQ ID NO: 559680 - DNA, 25 bp, Mus musculus
gcgcttggcagactaagtccccgcg

SEQ ID NO: 559681 - DNA, 25 bp, Mus musculus
gcgcttggcagagtaagtccccgcg

SEQ ID NO: 559682 - DNA, 25 bp, Mus musculus
gcgcttggtagcatacctcaaccaa

SEQ ID NO: 559683 - DNA, 25 bp, Mus musculus
gcgcttggtagcttacctcaaccaa

SEQ ID NO: 559684 - DNA, 25 bp, Mus musculus
gcgcttggtggtattaaagtgcatg

SEQ ID NO: 559685 - DNA, 25 bp, Mus musculus
gcgcttggtggttttaaagtgcatg

SEQ ID NO: 559686 - DNA, 25 bp, Mus musculus
gcgcttgttctcaactggctgtgct

SEQ ID NO: 559687 - DNA, 25 bp, Mus musculus
gcgcttgttctctactggctgtgct

SEQ ID NO: 559688 - DNA, 25 bp, Mus musculus
gcgctttataacagagggcttactc

SEQ ID NO: 559689 - DNA, 25 bp, Mus musculus
gcgctttataactgagggcttactc

SEQ ID NO: 559690 - DNA, 25 bp, Mus musculus
gcgctttctaggcaatactgtattt

SEQ ID NO: 559691 - DNA, 25 bp, Mus musculus
gcgctttctagggaatactgtattt

SEQ ID NO: 559692 - DNA, 25 bp, Mus musculus
gcgctttcttccactgacacgggaa

SEQ ID NO: 559693 - DNA, 25 bp, Mus musculus
gcgctttcttcctctgacacgggaa

SEQ ID NO: 559694 - DNA, 25 bp, Mus musculus
gcgctttctttgcatggaggggctg

SEQ ID NO: 559695 - DNA, 25 bp, Mus musculus
gcgctttctttggatggaggggctg

SEQ ID NO: 559696 - DNA, 25 bp, Mus musculus
gcgctttgttctccttaaaggcaaa

SEQ ID NO: 559697 - DNA, 25 bp, Mus musculus
gcgctttgttctgcttaaaggcaaa

SEQ ID NO: 559698 - DNA, 25 bp, Mus musculus
gcgctttgttttctctctgcaagaa

SEQ ID NO: 559699 - DNA, 25 bp, Mus musculus
gcgctttgttttgtctctgcaagaa

SEQ ID NO: 559700 - DNA, 25 bp, Mus musculus
gcgcttttcatgctcttacatcctg

SEQ ID NO: 559701 - DNA, 25 bp, Mus musculus
gcgcttttcatggtcttacatcctg

SEQ ID NO: 559702 - DNA, 25 bp, Mus musculus
gcgcttttctccaccagtggatgga

SEQ ID NO: 559703 - DNA, 25 bp, Mus musculus
gcgcttttctcctccagtggatgga

SEQ ID NO: 559704 - DNA, 25 bp, Mus musculus
gcgcttttgctgatgatatctttga

SEQ ID NO: 559705 - DNA, 25 bp, Mus musculus
gcgcttttgctgttgatatctttga

SEQ ID NO: 559706 - DNA, 25 bp, Mus musculus
gcggaaaaacctcgccacttactgc

SEQ ID NO: 559707 - DNA, 25 bp, Mus musculus
gcggaaaaacctggccacttactgc

SEQ ID NO: 559708 - DNA, 25 bp, Mus musculus
gcggaaaaggctcctaaggctaaag

SEQ ID NO: 559709 - DNA, 25 bp, Mus musculus
gcggaaaaggctgctaaggctaaag

SEQ ID NO: 559710 - DNA, 25 bp, Mus musculus
gcggaaacaatacgaaaggcagcta

SEQ ID NO: 559711 - DNA, 25 bp, Mus musculus
gcggaaacaataggaaaggcagcta

SEQ ID NO: 559712 - DNA, 25 bp, Mus musculus
gcggaaacaatccttcctggaggag

SEQ ID NO: 559713 - DNA, 25 bp, Mus musculus
gcggaaacaatcgttcctggaggag

SEQ ID NO: 559714 - DNA, 25 bp, Mus musculus
gcggaaacacgcatcagcgcagatt

SEQ ID NO: 559715 - DNA, 25 bp, Mus musculus
gcggaaacacgcttcagcgcagatt

SEQ ID NO: 559716 - DNA, 25 bp, Mus musculus
gcggaaagatctcaatgcccctgac

SEQ ID NO: 559717 - DNA, 25 bp, Mus musculus
gcggaaagatctgaatgcccctgac

SEQ ID NO: 559718 - DNA, 25 bp, Mus musculus
gcggaaagtgatctgcatccccaaa

SEQ ID NO: 559719 - DNA, 25 bp, Mus musculus
gcggaaagtgatgtgcatccccaaa

SEQ ID NO: 559720 - DNA, 25 bp, Mus musculus
gcggaaatgcctcgcctgcattaaa

SEQ ID NO: 559721 - DNA, 25 bp, Mus musculus
gcggaaatgcctggcctgcattaaa

SEQ ID NO: 559722 - DNA, 25 bp, Mus musculus
gcggaaattcttctgcgcacacttg

SEQ ID NO: 559723 - DNA, 25 bp, Mus musculus
gcggaaattcttgtgcgcacacttg

SEQ ID NO: 559724 - DNA, 25 bp, Mus musculus
gcggaacaagacaacctcaatgatg

SEQ ID NO: 559725 - DNA, 25 bp, Mus musculus
gcggaacaagactacctcaatgatg

SEQ ID NO: 559726 - DNA, 25 bp, Mus musculus
gcggaaccagcaatagtttctgaaa

SEQ ID NO: 559727 - DNA, 25 bp, Mus musculus
gcggaaccagcattagtttctgaaa

SEQ ID NO: 559728 - DNA, 25 bp, Mus musculus
gcggaacgaaccctggtgttacaat

SEQ ID NO: 559729 - DNA, 25 bp, Mus musculus
gcggaacgaaccgtggtgttacaat

SEQ ID NO: 559730 - DNA, 25 bp, Mus musculus
gcggaagacatcatttgcattcaaa

SEQ ID NO: 559731 - DNA, 25 bp, Mus musculus
gcggaagacatcttttgcattcaaa

SEQ ID NO: 559732 - DNA, 25 bp, Mus musculus
gcggaagacgatacctccattgaaa

SEQ ID NO: 559733 - DNA, 25 bp, Mus musculus
gcggaagacgattcctccattgaaa

SEQ ID NO: 559734 - DNA, 25 bp, Mus musculus
gcggaagagcgcacccatggaacca

SEQ ID NO: 559735 - DNA, 25 bp, Mus musculus
gcggaagagcgctcccatggaacca

SEQ ID NO: 559736 - DNA, 25 bp, Mus musculus
gcggaagagcttattgaaactgcaa

SEQ ID NO: 559737 - DNA, 25 bp, Mus musculus
gcggaagagctttttgaaactgcaa

SEQ ID NO: 559738 - DNA, 25 bp, Mus musculus
gcggaagatccccatcatcattcgc

SEQ ID NO: 559739 - DNA, 25 bp, Mus musculus
gcggaagatcccgatcatcattcgc

SEQ ID NO: 559740 - DNA, 25 bp, Mus musculus
gcggaagccagaattgttcctgtgt

SEQ ID NO: 559741 - DNA, 25 bp, Mus musculus
gcggaagccagatttgttcctgtgt

SEQ ID NO: 559742 - DNA, 25 bp, Mus musculus
gcggaagccgagactcgccatattg

SEQ ID NO: 559743 - DNA, 25 bp, Mus musculus
gcggaagccgagtctcgccatattg

SEQ ID NO: 559744 - DNA, 25 bp, Mus musculus
gcggaagcgaagctgcctggctggg

SEQ ID NO: 559745 - DNA, 25 bp, Mus musculus
gcggaagcgaaggtgcctggctggg

SEQ ID NO: 559746 - DNA, 25 bp, Mus musculus
gcggaaggcgagaaacaactcctaa

SEQ ID NO: 559747 - DNA, 25 bp, Mus musculus
gcggaaggcgagtaacaactcctaa

SEQ ID NO: 559748 - DNA, 25 bp, Mus musculus
gcggaagtccatagatctgcaaaca

SEQ ID NO: 559749 - DNA, 25 bp, Mus musculus
gcggaagtccattgatctgcaaaca

SEQ ID NO: 559750 - DNA, 25 bp, Mus musculus
gcggaagttccaccacttaataagt

SEQ ID NO: 559751 - DNA, 25 bp, Mus musculus
gcggaagttccagcacttaataagt

SEQ ID NO: 559752 - DNA, 25 bp, Mus musculus
gcggaatatccgatatggtttcaat

SEQ ID NO: 559753 - DNA, 25 bp, Mus musculus
gcggaatatccgttatggtttcaat

SEQ ID NO: 559754 - DNA, 25 bp, Mus musculus
gcggaatctcggagctgaaggaaac

SEQ ID NO: 559755 - DNA, 25 bp, Mus musculus
gcggaatctcggtgctgaaggaaac

SEQ ID NO: 559756 - DNA, 25 bp, Mus musculus
gcggaatgatccatggcttactata

SEQ ID NO: 559757 - DNA, 25 bp, Mus musculus
gcggaatgatccttggcttactata

SEQ ID NO: 559758 - DNA, 25 bp, Mus musculus
gcggaattctaaactgcttccaatt

SEQ ID NO: 559759 - DNA, 25 bp, Mus musculus
gcggaattctaatctgcttccaatt

SEQ ID NO: 559760 - DNA, 25 bp, Mus musculus
gcggaatttcagcaagcaggccaca

SEQ ID NO: 559761 - DNA, 25 bp, Mus musculus
gcggaatttcaggaagcaggccaca

SEQ ID NO: 559762 - DNA, 25 bp, Mus musculus
gcggacaaagctaatacactcatat

SEQ ID NO: 559763 - DNA, 25 bp, Mus musculus
gcggacaaagcttatacactcatat

SEQ ID NO: 559764 - DNA, 25 bp, Mus musculus
gcggacactacaaaggccagcagat

SEQ ID NO: 559765 - DNA, 25 bp, Mus musculus
gcggacactacataggccagcagat

SEQ ID NO: 559766 - DNA, 25 bp, Mus musculus
gcggacagcagcagccttaacaagc

SEQ ID NO: 559767 - DNA, 25 bp, Mus musculus
gcggacagcagctgccttaacaagc

SEQ ID NO: 559768 - DNA, 25 bp, Mus musculus
gcggacaggattctgctcaatgcct

SEQ ID NO: 559769 - DNA, 25 bp, Mus musculus
gcggacaggattgtgctcaatgcct

SEQ ID NO: 559770 - DNA, 25 bp, Mus musculus
gcggacagttggatctggactcgcc

SEQ ID NO: 559771 - DNA, 25 bp, Mus musculus
gcggacagttggttctggactcgcc

SEQ ID NO: 559772 - DNA, 25 bp, Mus musculus
gcggacatctgactggccttcttag

SEQ ID NO: 559773 - DNA, 25 bp, Mus musculus
gcggacatctgagtggccttcttag

SEQ ID NO: 559774 - DNA, 25 bp, Mus musculus
gcggaccagtggcactgagcccaaa

SEQ ID NO: 559775 - DNA, 25 bp, Mus musculus
gcggaccagtgggactgagcccaaa

SEQ ID NO: 559776 - DNA, 25 bp, Mus musculus
gcggacccaaaactgaaacgtcaca

SEQ ID NO: 559777 - DNA, 25 bp, Mus musculus
gcggacccaaaagtgaaacgtcaca

SEQ ID NO: 559778 - DNA, 25 bp, Mus musculus
gcggacctgtgtacctttattaaag

SEQ ID NO: 559779 - DNA, 25 bp, Mus musculus
gcggacctgtgttcctttattaaag

SEQ ID NO: 559780 - DNA, 25 bp, Mus musculus
gcggacgctgtacctgctctgaagt

SEQ ID NO: 559781 - DNA, 25 bp, Mus musculus
gcggacgctgtagctgctctgaagt

SEQ ID NO: 559782 - DNA, 25 bp, Mus musculus
gcggacgggtgtatacaagccttta

SEQ ID NO: 559783 - DNA, 25 bp, Mus musculus
gcggacgggtgtttacaagccttta

SEQ ID NO: 559784 - DNA, 25 bp, Mus musculus
gcggactccccaagataatgctcgg

SEQ ID NO: 559785 - DNA, 25 bp, Mus musculus
gcggactccccatgataatgctcgg

SEQ ID NO: 559786 - DNA, 25 bp, Mus musculus
gcggactcctcgcattttccgggcg

SEQ ID NO: 559787 - DNA, 25 bp, Mus musculus
gcggactcctcggattttccgggcg

SEQ ID NO: 559788 - DNA, 25 bp, Mus musculus
gcggactcgagaccggcgaacacta

SEQ ID NO: 559789 - DNA, 25 bp, Mus musculus
gcggactcgagagcggcgaacacta

SEQ ID NO: 559790 - DNA, 25 bp, Mus musculus
gcggactctataatgctactctgaa

SEQ ID NO: 559791 - DNA, 25 bp, Mus musculus
gcggactctatattgctactctgaa

SEQ ID NO: 559792 - DNA, 25 bp, Mus musculus
gcggactggaaacactcactgaact

SEQ ID NO: 559793 - DNA, 25 bp, Mus musculus
gcggactggaaagactcactgaact

SEQ ID NO: 559794 - DNA, 25 bp, Mus musculus
gcggactgtttcactatactagaga

SEQ ID NO: 559795 - DNA, 25 bp, Mus musculus
gcggactgtttctctatactagaga

SEQ ID NO: 559796 - DNA, 25 bp, Mus musculus
gcggacttcagtactatttggcttg

SEQ ID NO: 559797 - DNA, 25 bp, Mus musculus
gcggacttcagttctatttggcttg

SEQ ID NO: 559798 - DNA, 25 bp, Mus musculus
gcggacttggtgactcttctagaat

SEQ ID NO: 559799 - DNA, 25 bp, Mus musculus
gcggacttggtgtctcttctagaat

SEQ ID NO: 559800 - DNA, 25 bp, Mus musculus
gcggactttgtccatgatcgaagaa

SEQ ID NO: 559801 - DNA, 25 bp, Mus musculus
gcggactttgtcgatgatcgaagaa

SEQ ID NO: 559802 - DNA, 25 bp, Mus musculus
gcggagaaccaacaacttcccaacg

SEQ ID NO: 559803 - DNA, 25 bp, Mus musculus
gcggagaaccaagaacttcccaacg

SEQ ID NO: 559804 - DNA, 25 bp, Mus musculus
gcggagaatctgacctgaccaatat

SEQ ID NO: 559805 - DNA, 25 bp, Mus musculus
gcggagaatctgtcctgaccaatat

SEQ ID NO: 559806 - DNA, 25 bp, Mus musculus
gcggagacagcaataggcatcctct

SEQ ID NO: 559807 - DNA, 25 bp, Mus musculus
gcggagacagcattaggcatcctct

SEQ ID NO: 559808 - DNA, 25 bp, Mus musculus
gcggagacctacctgcgggtcatga

SEQ ID NO: 559809 - DNA, 25 bp, Mus musculus
gcggagacctacgtgcgggtcatga

SEQ ID NO: 559810 - DNA, 25 bp, Mus musculus
gcggagagacttcttaagccactaa

SEQ ID NO: 559811 - DNA, 25 bp, Mus musculus
gcggagagacttgttaagccactaa

SEQ ID NO: 559812 - DNA, 25 bp, Mus musculus
gcggagatcgaaaccactgcttgga

SEQ ID NO: 559813 - DNA, 25 bp, Mus musculus
gcggagatcgaatccactgcttgga

SEQ ID NO: 559814 - DNA, 25 bp, Mus musculus
gcggagatgctacgcttcaacttaa

SEQ ID NO: 559815 - DNA, 25 bp, Mus musculus
gcggagatgctaggcttcaacttaa

SEQ ID NO: 559816 - DNA, 25 bp, Mus musculus
gcggagatgtcgcatcactgcttac

SEQ ID NO: 559817 - DNA, 25 bp, Mus musculus
gcggagatgtcggatcactgcttac

SEQ ID NO: 559818 - DNA, 25 bp, Mus musculus
gcggagcacagaagatgtagtttca

SEQ ID NO: 559819 - DNA, 25 bp, Mus musculus
gcggagcacagatgatgtagtttca

SEQ ID NO: 559820 - DNA, 25 bp, Mus musculus
gcggagccactcagtgagttggact

SEQ ID NO: 559821 - DNA, 25 bp, Mus musculus
gcggagccactctgtgagttggact

SEQ ID NO: 559822 - DNA, 25 bp, Mus musculus
gcggagcctttcacagagtactgga

SEQ ID NO: 559823 - DNA, 25 bp, Mus musculus
gcggagcctttctcagagtactgga

SEQ ID NO: 559824 - DNA, 25 bp, Mus musculus
gcggagcgagatcacttacagtgcc

SEQ ID NO: 559825 - DNA, 25 bp, Mus musculus
gcggagcgagatgacttacagtgcc

SEQ ID NO: 559826 - DNA, 25 bp, Mus musculus
gcggagctcagcaagtaacctaggg

SEQ ID NO: 559827 - DNA, 25 bp, Mus musculus
gcggagctcagctagtaacctaggg

SEQ ID NO: 559828 - DNA, 25 bp, Mus musculus
gcggagctgcttaaaccatgttcaa

SEQ ID NO: 559829 - DNA, 25 bp, Mus musculus
gcggagctgctttaaccatgttcaa

SEQ ID NO: 559830 - DNA, 25 bp, Mus musculus
gcggagcttctgctgtctagtgttt

SEQ ID NO: 559831 - DNA, 25 bp, Mus musculus
gcggagcttctggtgtctagtgttt

SEQ ID NO: 559832 - DNA, 25 bp, Mus musculus
gcggagcttgacaatcctgggctgt

SEQ ID NO: 559833 - DNA, 25 bp, Mus musculus
gcggagcttgactatcctgggctgt

SEQ ID NO: 559834 - DNA, 25 bp, Mus musculus
gcggagctttcccaagactgtcgct

SEQ ID NO: 559835 - DNA, 25 bp, Mus musculus
gcggagctttccgaagactgtcgct

SEQ ID NO: 559836 - DNA, 25 bp, Mus musculus
gcggagctttttaagcatgattgga

SEQ ID NO: 559837 - DNA, 25 bp, Mus musculus
gcggagcttttttagcatgattgga

SEQ ID NO: 559838 - DNA, 25 bp, Mus musculus
gcggaggaaacaccagatcacatat

SEQ ID NO: 559839 - DNA, 25 bp, Mus musculus
gcggaggaaacagcagatcacatat

SEQ ID NO: 559840 - DNA, 25 bp, Mus musculus
gcggaggaagttccacttcttcttt

SEQ ID NO: 559841 - DNA, 25 bp, Mus musculus
gcggaggaagttgcacttcttcttt

SEQ ID NO: 559842 - DNA, 25 bp, Mus musculus
gcggaggattctagtggctaccaac

SEQ ID NO: 559843 - DNA, 25 bp, Mus musculus
gcggaggattcttgtggctaccaac

SEQ ID NO: 559844 - DNA, 25 bp, Mus musculus
gcggaggcaggactgtaattcattc

SEQ ID NO: 559845 - DNA, 25 bp, Mus musculus
gcggaggcaggagtgtaattcattc

SEQ ID NO: 559846 - DNA, 25 bp, Mus musculus
gcggaggcctttcccctagagttca

SEQ ID NO: 559847 - DNA, 25 bp, Mus musculus
gcggaggcctttgccctagagttca

SEQ ID NO: 559848 - DNA, 25 bp, Mus musculus
gcggagggcgcaagtgttatacata

SEQ ID NO: 559849 - DNA, 25 bp, Mus musculus
gcggagggcgcatgtgttatacata

SEQ ID NO: 559850 - DNA, 25 bp, Mus musculus
gcggaggtgctgactcacagatgat

SEQ ID NO: 559851 - DNA, 25 bp, Mus musculus
gcggaggtgctgtctcacagatgat

SEQ ID NO: 559852 - DNA, 25 bp, Mus musculus
gcggagtagttacaagtgccactgt

SEQ ID NO: 559853 - DNA, 25 bp, Mus musculus
gcggagtagttagaagtgccactgt

SEQ ID NO: 559854 - DNA, 25 bp, Mus musculus
gcggagtggcgtattctcacaggat

SEQ ID NO: 559855 - DNA, 25 bp, Mus musculus
gcggagtggcgttttctcacaggat

SEQ ID NO: 559856 - DNA, 25 bp, Mus musculus
gcggagtgtctgagtgcatcatcat

SEQ ID NO: 559857 - DNA, 25 bp, Mus musculus
gcggagtgtctgtgtgcatcatcat

SEQ ID NO: 559858 - DNA, 25 bp, Mus musculus
gcggagttatctcatcataatttga

SEQ ID NO: 559859 - DNA, 25 bp, Mus musculus
gcggagttatctgatcataatttga

SEQ ID NO: 559860 - DNA, 25 bp, Mus musculus
gcggagttggcgactttgactgtca

SEQ ID NO: 559861 - DNA, 25 bp, Mus musculus
gcggagttggcgtctttgactgtca

SEQ ID NO: 559862 - DNA, 25 bp, Mus musculus
gcggataataagcttaccctctgat

SEQ ID NO: 559863 - DNA, 25 bp, Mus musculus
gcggataataaggttaccctctgat

SEQ ID NO: 559864 - DNA, 25 bp, Mus musculus
gcggataattctcgttcttcattta

SEQ ID NO: 559865 - DNA, 25 bp, Mus musculus
gcggataattctggttcttcattta

SEQ ID NO: 559866 - DNA, 25 bp, Mus musculus
gcggatatttagatcactggtcact

SEQ ID NO: 559867 - DNA, 25 bp, Mus musculus
gcggatatttagttcactggtcact

SEQ ID NO: 559868 - DNA, 25 bp, Mus musculus
gcggatcaaccactgtacagcagca

SEQ ID NO: 559869 - DNA, 25 bp, Mus musculus
gcggatcaaccagtgtacagcagca

SEQ ID NO: 559870 - DNA, 25 bp, Mus musculus
gcggatcatcttctccatttgtgta

SEQ ID NO: 559871 - DNA, 25 bp, Mus musculus
gcggatcatcttgtccatttgtgta

SEQ ID NO: 559872 - DNA, 25 bp, Mus musculus
gcggatcatgttagatattcgctta

SEQ ID NO: 559873 - DNA, 25 bp, Mus musculus
gcggatcatgtttgatattcgctta

SEQ ID NO: 559874 - DNA, 25 bp, Mus musculus
gcggatccgccaagcagagactctg

SEQ ID NO: 559875 - DNA, 25 bp, Mus musculus
gcggatccgccatgcagagactctg

SEQ ID NO: 559876 - DNA, 25 bp, Mus musculus
gcggatcctgcacgctctgggtggg

SEQ ID NO: 559877 - DNA, 25 bp, Mus musculus
gcggatcctgcaggctctgggtggg

SEQ ID NO: 559878 - DNA, 25 bp, Mus musculus
gcggatctccaaaatatgcttactt

SEQ ID NO: 559879 - DNA, 25 bp, Mus musculus
gcggatctccaatatatgcttactt

SEQ ID NO: 559880 - DNA, 25 bp, Mus musculus
gcggatctcgtcctgattgagcgac

SEQ ID NO: 559881 - DNA, 25 bp, Mus musculus
gcggatctcgtcgtgattgagcgac

SEQ ID NO: 559882 - DNA, 25 bp, Mus musculus
gcggatcttgagatttttggccaca

SEQ ID NO: 559883 - DNA, 25 bp, Mus musculus
gcggatcttgagttttttggccaca

SEQ ID NO: 559884 - DNA, 25 bp, Mus musculus
gcggatgaaagcaactctgtcagtt

SEQ ID NO: 559885 - DNA, 25 bp, Mus musculus
gcggatgaaagctactctgtcagtt

SEQ ID NO: 559886 - DNA, 25 bp, Mus musculus
gcggatgacctcattttgatgttaa

SEQ ID NO: 559887 - DNA, 25 bp, Mus musculus
gcggatgacctctttttgatgttaa

SEQ ID NO: 559888 - DNA, 25 bp, Mus musculus
gcggatgcacagatactccagatct

SEQ ID NO: 559889 - DNA, 25 bp, Mus musculus
gcggatgcacagttactccagatct

SEQ ID NO: 559890 - DNA, 25 bp, Mus musculus
gcggatgcagcacctgtttatgatt

SEQ ID NO: 559891 - DNA, 25 bp, Mus musculus
gcggatgcagcagctgtttatgatt

SEQ ID NO: 559892 - DNA, 25 bp, Mus musculus
gcggatgcagtgatctaatctccat

SEQ ID NO: 559893 - DNA, 25 bp, Mus musculus
gcggatgcagtgttctaatctccat

SEQ ID NO: 559894 - DNA, 25 bp, Mus musculus
gcggatgcattgaggactcacagtc

SEQ ID NO: 559895 - DNA, 25 bp, Mus musculus
gcggatgcattgtggactcacagtc

SEQ ID NO: 559896 - DNA, 25 bp, Mus musculus
gcggatggctctaggtagcttccac

SEQ ID NO: 559897 - DNA, 25 bp, Mus musculus
gcggatggctcttggtagcttccac

SEQ ID NO: 559898 - DNA, 25 bp, Mus musculus
gcggatgggatacacacataaacat

SEQ ID NO: 559899 - DNA, 25 bp, Mus musculus
gcggatgggatagacacataaacat

SEQ ID NO: 559900 - DNA, 25 bp, Mus musculus
gcggatgggccaatcctggaacaat

SEQ ID NO: 559901 - DNA, 25 bp, Mus musculus
gcggatgggccattcctggaacaat

SEQ ID NO: 559902 - DNA, 25 bp, Mus musculus
gcggatgtatttattgtacaaacca

SEQ ID NO: 559903 - DNA, 25 bp, Mus musculus
gcggatgtattttttgtacaaacca

SEQ ID NO: 559904 - DNA, 25 bp, Mus musculus
gcggatgtcaggaaatctgttctaa

SEQ ID NO: 559905 - DNA, 25 bp, Mus musculus
gcggatgtcaggtaatctgttctaa

SEQ ID NO: 559906 - DNA, 25 bp, Mus musculus
gcggatgtcatcatagcactgatca

SEQ ID NO: 559907 - DNA, 25 bp, Mus musculus
gcggatgtcatcttagcactgatca

SEQ ID NO: 559908 - DNA, 25 bp, Mus musculus
gcggatgtccgacagtctgttgaca

SEQ ID NO: 559909 - DNA, 25 bp, Mus musculus
gcggatgtccgagagtctgttgaca

SEQ ID NO: 559910 - DNA, 25 bp, Mus musculus
gcggatgtgaccatcacatggatga

SEQ ID NO: 559911 - DNA, 25 bp, Mus musculus
gcggatgtgaccttcacatggatga

SEQ ID NO: 559912 - DNA, 25 bp, Mus musculus
gcggatgtgttcattgaggctattt

SEQ ID NO: 559913 - DNA, 25 bp, Mus musculus
gcggatgtgttctttgaggctattt

SEQ ID NO: 559914 - DNA, 25 bp, Mus musculus
gcggatgttatcagctgccctgcaa

SEQ ID NO: 559915 - DNA, 25 bp, Mus musculus
gcggatgttatctgctgccctgcaa

SEQ ID NO: 559916 - DNA, 25 bp, Mus musculus
gcggatgttttcaatctctgttgtc

SEQ ID NO: 559917 - DNA, 25 bp, Mus musculus
gcggatgttttctatctctgttgtc

SEQ ID NO: 559918 - DNA, 25 bp, Mus musculus
gcggattaagagatcaggcaatgca

SEQ ID NO: 559919 - DNA, 25 bp, Mus musculus
gcggattaagagttcaggcaatgca

SEQ ID NO: 559920 - DNA, 25 bp, Mus musculus
gcggattacgtgcagatggctactt

SEQ ID NO: 559921 - DNA, 25 bp, Mus musculus
gcggattacgtggagatggctactt

SEQ ID NO: 559922 - DNA, 25 bp, Mus musculus
gcggattatctgactggcatgcaca

SEQ ID NO: 559923 - DNA, 25 bp, Mus musculus
gcggattatctgtctggcatgcaca

SEQ ID NO: 559924 - DNA, 25 bp, Mus musculus
gcggattccagaacatcgcctgtct

SEQ ID NO: 559925 - DNA, 25 bp, Mus musculus
gcggattccagatcatcgcctgtct

SEQ ID NO: 559926 - DNA, 25 bp, Mus musculus
gcggattccaggactgagagcccaa

SEQ ID NO: 559927 - DNA, 25 bp, Mus musculus
gcggattccaggtctgagagcccaa

SEQ ID NO: 559928 - DNA, 25 bp, Mus musculus
gcggattcgaagctacatggccaag

SEQ ID NO: 559929 - DNA, 25 bp, Mus musculus
gcggattcgaaggtacatggccaag

SEQ ID NO: 559930 - DNA, 25 bp, Mus musculus
gcggattcggctaccagaaaacaaa

SEQ ID NO: 559931 - DNA, 25 bp, Mus musculus
gcggattcggcttccagaaaacaaa

SEQ ID NO: 559932 - DNA, 25 bp, Mus musculus
gcggattgagcacatcaagcactca

SEQ ID NO: 559933 - DNA, 25 bp, Mus musculus
gcggattgagcagatcaagcactca

SEQ ID NO: 559934 - DNA, 25 bp, Mus musculus
gcggattggcagattttcagctagg

SEQ ID NO: 559935 - DNA, 25 bp, Mus musculus
gcggattggcagtttttcagctagg

SEQ ID NO: 559936 - DNA, 25 bp, Mus musculus
gcggattggccgcagtctaagaact

SEQ ID NO: 559937 - DNA, 25 bp, Mus musculus
gcggattggccggagtctaagaact

SEQ ID NO: 559938 - DNA, 25 bp, Mus musculus
gcggatttcggaactggaaatgacc

SEQ ID NO: 559939 - DNA, 25 bp, Mus musculus
gcggatttcggatctggaaatgacc

SEQ ID NO: 559940 - DNA, 25 bp, Mus musculus
gcggattttgcacgccacacatcca

SEQ ID NO: 559941 - DNA, 25 bp, Mus musculus
gcggattttgcaggccacacatcca

SEQ ID NO: 559942 - DNA, 25 bp, Mus musculus
gcggattttttgaatgggcagacct

SEQ ID NO: 559943 - DNA, 25 bp, Mus musculus
gcggattttttgtatgggcagacct

SEQ ID NO: 559944 - DNA, 25 bp, Mus musculus
gcggcaaacctcagctctaatgtaa

SEQ ID NO: 559945 - DNA, 25 bp, Mus musculus
gcggcaaacctctgctctaatgtaa

SEQ ID NO: 559946 - DNA, 25 bp, Mus musculus
gcggcaaagggtcgttactgtccca

SEQ ID NO: 559947 - DNA, 25 bp, Mus musculus
gcggcaaagggtggttactgtccca

SEQ ID NO: 559948 - DNA, 25 bp, Mus musculus
gcggcaacatttcggcttatcctgg

SEQ ID NO: 559949 - DNA, 25 bp, Mus musculus
gcggcaacatttgggcttatcctgg

SEQ ID NO: 559950 - DNA, 25 bp, Mus musculus
gcggcaagcagtacaaccacagcag

SEQ ID NO: 559951 - DNA, 25 bp, Mus musculus
gcggcaagcagttcaaccacagcag

SEQ ID NO: 559952 - DNA, 25 bp, Mus musculus
gcggcaagcatgaacgctgttctaa

SEQ ID NO: 559953 - DNA, 25 bp, Mus musculus
gcggcaagcatgtacgctgttctaa

SEQ ID NO: 559954 - DNA, 25 bp, Mus musculus
gcggcaagcgctatagctggagctc

SEQ ID NO: 559955 - DNA, 25 bp, Mus musculus
gcggcaagcgctttagctggagctc

SEQ ID NO: 559956 - DNA, 25 bp, Mus musculus
gcggcacctgctattgaccatgcta

SEQ ID NO: 559957 - DNA, 25 bp, Mus musculus
gcggcacctgcttttgaccatgcta

SEQ ID NO: 559958 - DNA, 25 bp, Mus musculus
gcggcacgtagcattaataccagat

SEQ ID NO: 559959 - DNA, 25 bp, Mus musculus
gcggcacgtagctttaataccagat

SEQ ID NO: 559960 - DNA, 25 bp, Mus musculus
gcggcactcatgaaggaattctcaa

SEQ ID NO: 559961 - DNA, 25 bp, Mus musculus
gcggcactcatgtaggaattctcaa

SEQ ID NO: 559962 - DNA, 25 bp, Mus musculus
gcggcactgcccatttatttatatt

SEQ ID NO: 559963 - DNA, 25 bp, Mus musculus
gcggcactgcccttttatttatatt

SEQ ID NO: 559964 - DNA, 25 bp, Mus musculus
gcggcagactccagttactcatgaa

SEQ ID NO: 559965 - DNA, 25 bp, Mus musculus
gcggcagactcctgttactcatgaa

SEQ ID NO: 559966 - DNA, 25 bp, Mus musculus
gcggcagacttcagttcattgcaga

SEQ ID NO: 559967 - DNA, 25 bp, Mus musculus
gcggcagacttctgttcattgcaga

SEQ ID NO: 559968 - DNA, 25 bp, Mus musculus
gcggcagacttgaatttctctcttt

SEQ ID NO: 559969 - DNA, 25 bp, Mus musculus
gcggcagacttgtatttctctcttt

SEQ ID NO: 559970 - DNA, 25 bp, Mus musculus
gcggcagagctcatgttctaggttc

SEQ ID NO: 559971 - DNA, 25 bp, Mus musculus
gcggcagagctcttgttctaggttc

SEQ ID NO: 559972 - DNA, 25 bp, Mus musculus
gcggcagcacctcgtttttagacta

SEQ ID NO: 559973 - DNA, 25 bp, Mus musculus
gcggcagcacctggtttttagacta

SEQ ID NO: 559974 - DNA, 25 bp, Mus musculus
gcggcagcatctactattgtgagtg

SEQ ID NO: 559975 - DNA, 25 bp, Mus musculus
gcggcagcatcttctattgtgagtg

SEQ ID NO: 559976 - DNA, 25 bp, Mus musculus
gcggcagccccgaaattgttaaggc

SEQ ID NO: 559977 - DNA, 25 bp, Mus musculus
gcggcagccccgtaattgttaaggc

SEQ ID NO: 559978 - DNA, 25 bp, Mus musculus
gcggcagcgcgaccatcattaatca

SEQ ID NO: 559979 - DNA, 25 bp, Mus musculus
gcggcagcgcgagcatcattaatca

SEQ ID NO: 559980 - DNA, 25 bp, Mus musculus
gcggcagctcaaagcgttgctgtta

SEQ ID NO: 559981 - DNA, 25 bp, Mus musculus
gcggcagctcaatgcgttgctgtta

SEQ ID NO: 559982 - DNA, 25 bp, Mus musculus
gcggcagctgaccttccgggagaag

SEQ ID NO: 559983 - DNA, 25 bp, Mus musculus
gcggcagctgacgttccgggagaag

SEQ ID NO: 559984 - DNA, 25 bp, Mus musculus
gcggcaggatgacccaagccttaat

SEQ ID NO: 559985 - DNA, 25 bp, Mus musculus
gcggcaggatgagccaagccttaat

SEQ ID NO: 559986 - DNA, 25 bp, Mus musculus
gcggcaggcatgcagtgccacacta

SEQ ID NO: 559987 - DNA, 25 bp, Mus musculus
gcggcaggcatggagtgccacacta

SEQ ID NO: 559988 - DNA, 25 bp, Mus musculus
gcggcaggcctacagcatgcatcaa

SEQ ID NO: 559989 - DNA, 25 bp, Mus musculus
gcggcaggcctagagcatgcatcaa

SEQ ID NO: 559990 - DNA, 25 bp, Mus musculus
gcggcagggccacgtattagacaca

SEQ ID NO: 559991 - DNA, 25 bp, Mus musculus
gcggcagggccaggtattagacaca

SEQ ID NO: 559992 - DNA, 25 bp, Mus musculus
gcggcaggtccaactacggagagaa

SEQ ID NO: 559993 - DNA, 25 bp, Mus musculus
gcggcaggtccatctacggagagaa

SEQ ID NO: 559994 - DNA, 25 bp, Mus musculus
gcggcaggtgctagaaggacaatct

SEQ ID NO: 559995 - DNA, 25 bp, Mus musculus
gcggcaggtgcttgaaggacaatct

SEQ ID NO: 559996 - DNA, 25 bp, Mus musculus
gcggcagtacctcctgaggccaggg

SEQ ID NO: 559997 - DNA, 25 bp, Mus musculus
gcggcagtacctgctgaggccaggg

SEQ ID NO: 559998 - DNA, 25 bp, Mus musculus
gcggcagtgaaacgaacggctctca

SEQ ID NO: 559999 - DNA, 25 bp, Mus musculus
gcggcagtgaaaggaacggctctca

SEQ ID NO: 560000 - DNA, 25 bp, Mus musculus
gcggcatacttccatttctacagtg

SEQ ID NO: 560001 - DNA, 25 bp, Mus musculus
gcggcatacttcgatttctacagtg

SEQ ID NO: 560002 - DNA, 25 bp, Mus musculus
gcggcatatttgctctattaacaca

SEQ ID NO: 560003 - DNA, 25 bp, Mus musculus
gcggcatatttggtctattaacaca

SEQ ID NO: 560004 - DNA, 25 bp, Mus musculus
gcggcatcttgtattcatagtctat

SEQ ID NO: 560005 - DNA, 25 bp, Mus musculus
gcggcatcttgttttcatagtctat

SEQ ID NO: 560006 - DNA, 25 bp, Mus musculus
gcggcatgccttaatccaatggcac

SEQ ID NO: 560007 - DNA, 25 bp, Mus musculus
gcggcatgcctttatccaatggcac

SEQ ID NO: 560008 - DNA, 25 bp, Mus musculus
gcggcatggaggctccccaaaaagt

SEQ ID NO: 560009 - DNA, 25 bp, Mus musculus
gcggcatggagggtccccaaaaagt

SEQ ID NO: 560010 - DNA, 25 bp, Mus musculus
gcggcatggtgcaagttgaataacc

SEQ ID NO: 560011 - DNA, 25 bp, Mus musculus
gcggcatggtgctagttgaataacc

SEQ ID NO: 560012 - DNA, 25 bp, Mus musculus
gcggcatgttctcgatttgactcaa

SEQ ID NO: 560013 - DNA, 25 bp, Mus musculus
gcggcatgttctggatttgactcaa

SEQ ID NO: 560014 - DNA, 25 bp, Mus musculus
gcggcattctccaagctttaattga

SEQ ID NO: 560015 - DNA, 25 bp, Mus musculus
gcggcattctcctagctttaattga

SEQ ID NO: 560016 - DNA, 25 bp, Mus musculus
gcggccaacctcagtcaaagtattt

SEQ ID NO: 560017 - DNA, 25 bp, Mus musculus
gcggccaacctctgtcaaagtattt

SEQ ID NO: 560018 - DNA, 25 bp, Mus musculus
gcggccaatgcacttccaagtaaac

SEQ ID NO: 560019 - DNA, 25 bp, Mus musculus
gcggccaatgcagttccaagtaaac

SEQ ID NO: 560020 - DNA, 25 bp, Mus musculus
gcggccacctgacacatgtgggaac

SEQ ID NO: 560021 - DNA, 25 bp, Mus musculus
gcggccacctgagacatgtgggaac

SEQ ID NO: 560022 - DNA, 25 bp, Mus musculus
gcggccagcacgaactggttgatca

SEQ ID NO: 560023 - DNA, 25 bp, Mus musculus
gcggccagcacgtactggttgatca

SEQ ID NO: 560024 - DNA, 25 bp, Mus musculus
gcggccatcaaactgtgccctggga

SEQ ID NO: 560025 - DNA, 25 bp, Mus musculus
gcggccatcaaagtgtgccctggga

SEQ ID NO: 560026 - DNA, 25 bp, Mus musculus
gcggccatgcacctgatgtgtgaca

SEQ ID NO: 560027 - DNA, 25 bp, Mus musculus
gcggccatgcacgtgatgtgtgaca

SEQ ID NO: 560028 - DNA, 25 bp, Mus musculus
gcggccatggaacgcactgcatgtt

SEQ ID NO: 560029 - DNA, 25 bp, Mus musculus
gcggccatggaaggcactgcatgtt

SEQ ID NO: 560030 - DNA, 25 bp, Mus musculus
gcggccatggtgctgaacaatttat

SEQ ID NO: 560031 - DNA, 25 bp, Mus musculus
gcggccatggtggtgaacaatttat

SEQ ID NO: 560032 - DNA, 25 bp, Mus musculus
gcggcccaggagcaagttctagaaa

SEQ ID NO: 560033 - DNA, 25 bp, Mus musculus
gcggcccaggaggaagttctagaaa

SEQ ID NO: 560034 - DNA, 25 bp, Mus musculus
gcggcccctttaaggacagcggaga

SEQ ID NO: 560035 - DNA, 25 bp, Mus musculus
gcggcccctttatggacagcggaga

SEQ ID NO: 560036 - DNA, 25 bp, Mus musculus
gcggcccgaggtctgcacattttgc

SEQ ID NO: 560037 - DNA, 25 bp, Mus musculus
gcggcccgaggtgtgcacattttgc

SEQ ID NO: 560038 - DNA, 25 bp, Mus musculus
gcggcccgatctcaggatcctcagc

SEQ ID NO: 560039 - DNA, 25 bp, Mus musculus
gcggcccgatctgaggatcctcagc

SEQ ID NO: 560040 - DNA, 25 bp, Mus musculus
gcggcccggctaaacagatgccagg

SEQ ID NO: 560041 - DNA, 25 bp, Mus musculus
gcggcccggctatacagatgccagg

SEQ ID NO: 560042 - DNA, 25 bp, Mus musculus
gcggccctaaagctctgtttttact

SEQ ID NO: 560043 - DNA, 25 bp, Mus musculus
gcggccctaaaggtctgtttttact

SEQ ID NO: 560044 - DNA, 25 bp, Mus musculus
gcggccctactgagctgagcgccat

SEQ ID NO: 560045 - DNA, 25 bp, Mus musculus
gcggccctactgtgctgagcgccat

SEQ ID NO: 560046 - DNA, 25 bp, Mus musculus
gcggccctgctgagcgtgaacgcca

SEQ ID NO: 560047 - DNA, 25 bp, Mus musculus
gcggccctgctgtgcgtgaacgcca

SEQ ID NO: 560048 - DNA, 25 bp, Mus musculus
gcggccctggtacttaaagcactaa

SEQ ID NO: 560049 - DNA, 25 bp, Mus musculus
gcggccctggtagttaaagcactaa

SEQ ID NO: 560050 - DNA, 25 bp, Mus musculus
gcggccgaggctacaatgcatggtc

SEQ ID NO: 560051 - DNA, 25 bp, Mus musculus
gcggccgaggcttcaatgcatggtc

SEQ ID NO: 560052 - DNA, 25 bp, Mus musculus
gcggccgatgacactctgtaaggaa

SEQ ID NO: 560053 - DNA, 25 bp, Mus musculus
gcggccgatgactctctgtaaggaa

SEQ ID NO: 560054 - DNA, 25 bp, Mus musculus
gcggccgcaggaagttctctaagaa

SEQ ID NO: 560055 - DNA, 25 bp, Mus musculus
gcggccgcaggatgttctctaagaa

SEQ ID NO: 560056 - DNA, 25 bp, Mus musculus
gcggcctaaaccaaaagcatcctat

SEQ ID NO: 560057 - DNA, 25 bp, Mus musculus
gcggcctaaacctaaagcatcctat

SEQ ID NO: 560058 - DNA, 25 bp, Mus musculus
gcggcctcaaagacacaccagtaac

SEQ ID NO: 560059 - DNA, 25 bp, Mus musculus
gcggcctcaaagtcacaccagtaac

SEQ ID NO: 560060 - DNA, 25 bp, Mus musculus
gcggcctccattataggacacctgt

SEQ ID NO: 560061 - DNA, 25 bp, Mus musculus
gcggcctccattttaggacacctgt

SEQ ID NO: 560062 - DNA, 25 bp, Mus musculus
gcggcctctgaacttggacagcgaa

SEQ ID NO: 560063 - DNA, 25 bp, Mus musculus
gcggcctctgaagttggacagcgaa

SEQ ID NO: 560064 - DNA, 25 bp, Mus musculus
gcggcctgacggagcgtgtgtgtct

SEQ ID NO: 560065 - DNA, 25 bp, Mus musculus
gcggcctgacggtgcgtgtgtgtct

SEQ ID NO: 560066 - DNA, 25 bp, Mus musculus
gcggcctgagttagactcctaggac

SEQ ID NO: 560067 - DNA, 25 bp, Mus musculus
gcggcctgagtttgactcctaggac

SEQ ID NO: 560068 - DNA, 25 bp, Mus musculus
gcggccttacaactgcgagctgtgc

SEQ ID NO: 560069 - DNA, 25 bp, Mus musculus
gcggccttacaagtgcgagctgtgc

SEQ ID NO: 560070 - DNA, 25 bp, Mus musculus
gcggccttcctcaaggtaacttgga

SEQ ID NO: 560071 - DNA, 25 bp, Mus musculus
gcggccttcctctaggtaacttgga

SEQ ID NO: 560072 - DNA, 25 bp, Mus musculus
gcggcctttgaccaaactccacaca

SEQ ID NO: 560073 - DNA, 25 bp, Mus musculus
gcggcctttgacgaaactccacaca

SEQ ID NO: 560074 - DNA, 25 bp, Mus musculus
gcggccttttacaaggaagcccctg

SEQ ID NO: 560075 - DNA, 25 bp, Mus musculus
gcggccttttactaggaagcccctg

SEQ ID NO: 560076 - DNA, 25 bp, Mus musculus
gcggccttttctaagctgaattgct

SEQ ID NO: 560077 - DNA, 25 bp, Mus musculus
gcggccttttcttagctgaattgct

SEQ ID NO: 560078 - DNA, 25 bp, Mus musculus
gcggcgacacgaacttcggcaagat

SEQ ID NO: 560079 - DNA, 25 bp, Mus musculus
gcggcgacacgatcttcggcaagat

SEQ ID NO: 560080 - DNA, 25 bp, Mus musculus
gcggcgacatggctgaaccctctga

SEQ ID NO: 560081 - DNA, 25 bp, Mus musculus
gcggcgacatgggtgaaccctctga

SEQ ID NO: 560082 - DNA, 25 bp, Mus musculus
gcggcgacctgtcactgctgtatta

SEQ ID NO: 560083 - DNA, 25 bp, Mus musculus
gcggcgacctgtgactgctgtatta

SEQ ID NO: 560084 - DNA, 25 bp, Mus musculus
gcggcgagtttgatgacctagtgtc

SEQ ID NO: 560085 - DNA, 25 bp, Mus musculus
gcggcgagtttgttgacctagtgtc

SEQ ID NO: 560086 - DNA, 25 bp, Mus musculus
gcggcgatatccagtctggctgcaa

SEQ ID NO: 560087 - DNA, 25 bp, Mus musculus
gcggcgatatcctgtctggctgcaa

SEQ ID NO: 560088 - DNA, 25 bp, Mus musculus
gcggcgatggacacgttcataggaa

SEQ ID NO: 560089 - DNA, 25 bp, Mus musculus
gcggcgatggactcgttcataggaa

SEQ ID NO: 560090 - DNA, 25 bp, Mus musculus
gcggcgattggtcgctacagcaaac

SEQ ID NO: 560091 - DNA, 25 bp, Mus musculus
gcggcgattggtggctacagcaaac

SEQ ID NO: 560092 - DNA, 25 bp, Mus musculus
gcggcgcagtagactactactttgt

SEQ ID NO: 560093 - DNA, 25 bp, Mus musculus
gcggcgcagtagtctactactttgt

SEQ ID NO: 560094 - DNA, 25 bp, Mus musculus
gcggcgcctgtcaatcaagggcttg

SEQ ID NO: 560095 - DNA, 25 bp, Mus musculus
gcggcgcctgtctatcaagggcttg

SEQ ID NO: 560096 - DNA, 25 bp, Mus musculus
gcggcgcgagctcaacaacgagatc

SEQ ID NO: 560097 - DNA, 25 bp, Mus musculus
gcggcgcgagctgaacaacgagatc

SEQ ID NO: 560098 - DNA, 25 bp, Mus musculus
gcggcgctaattatgcaccagttgc

SEQ ID NO: 560099 - DNA, 25 bp, Mus musculus
gcggcgctaattttgcaccagttgc

SEQ ID NO: 560100 - DNA, 25 bp, Mus musculus
gcggcgctcttcagaaagccagtga

SEQ ID NO: 560101 - DNA, 25 bp, Mus musculus
gcggcgctcttctgaaagccagtga

SEQ ID NO: 560102 - DNA, 25 bp, Mus musculus
gcggcggaatcacaggctgattacc

SEQ ID NO: 560103 - DNA, 25 bp, Mus musculus
gcggcggaatcagaggctgattacc

SEQ ID NO: 560104 - DNA, 25 bp, Mus musculus
gcggcggatggacacttcaagatta

SEQ ID NO: 560105 - DNA, 25 bp, Mus musculus
gcggcggatggagacttcaagatta

SEQ ID NO: 560106 - DNA, 25 bp, Mus musculus
gcggcggcaagaatcgaacccaagt

SEQ ID NO: 560107 - DNA, 25 bp, Mus musculus
gcggcggcaagattcgaacccaagt

SEQ ID NO: 560108 - DNA, 25 bp, Mus musculus
gcggcggcaatcctgcgcaatgaag

SEQ ID NO: 560109 - DNA, 25 bp, Mus musculus
gcggcggcaatcgtgcgcaatgaag

SEQ ID NO: 560110 - DNA, 25 bp, Mus musculus
gcggcggccaggacgaatattccat

SEQ ID NO: 560111 - DNA, 25 bp, Mus musculus
gcggcggccaggtcgaatattccat

SEQ ID NO: 560112 - DNA, 25 bp, Mus musculus
gcggcggccattcattgtggctatt

SEQ ID NO: 560113 - DNA, 25 bp, Mus musculus
gcggcggccattgattgtggctatt

SEQ ID NO: 560114 - DNA, 25 bp, Mus musculus
gcggcggccgggaagtcatcaccat

SEQ ID NO: 560115 - DNA, 25 bp, Mus musculus
gcggcggccgggtagtcatcaccat

SEQ ID NO: 560116 - DNA, 25 bp, Mus musculus
gcggcgggaacaactccgcgtcgtc

SEQ ID NO: 560117 - DNA, 25 bp, Mus musculus
gcggcgggaacatctccgcgtcgtc

SEQ ID NO: 560118 - DNA, 25 bp, Mus musculus
gcggcgtaatcactgtgcatctcat

SEQ ID NO: 560119 - DNA, 25 bp, Mus musculus
gcggcgtaatcagtgtgcatctcat

SEQ ID NO: 560120 - DNA, 25 bp, Mus musculus
gcggcgtgaagtagcttcactgctt

SEQ ID NO: 560121 - DNA, 25 bp, Mus musculus
gcggcgtgaagttgcttcactgctt

SEQ ID NO: 560122 - DNA, 25 bp, Mus musculus
gcggcgtgtcacatacagttatgtt

SEQ ID NO: 560123 - DNA, 25 bp, Mus musculus
gcggcgtgtcacttacagttatgtt

SEQ ID NO: 560124 - DNA, 25 bp, Mus musculus
gcggcgtgttaacgagctcacatat

SEQ ID NO: 560125 - DNA, 25 bp, Mus musculus
gcggcgtgttaaggagctcacatat

SEQ ID NO: 560126 - DNA, 25 bp, Mus musculus
gcggctaacattatctatagtcgat

SEQ ID NO: 560127 - DNA, 25 bp, Mus musculus
gcggctaacattttctatagtcgat

SEQ ID NO: 560128 - DNA, 25 bp, Mus musculus
gcggctatgagcatcagggtagtcc

SEQ ID NO: 560129 - DNA, 25 bp, Mus musculus
gcggctatgagcttcagggtagtcc

SEQ ID NO: 560130 - DNA, 25 bp, Mus musculus
gcggctatgggaaactggcacaaaa

SEQ ID NO: 560131 - DNA, 25 bp, Mus musculus
gcggctatgggatactggcacaaaa

SEQ ID NO: 560132 - DNA, 25 bp, Mus musculus
gcggctccagtgaaaattcccctta

SEQ ID NO: 560133 - DNA, 25 bp, Mus musculus
gcggctccagtgtaaattcccctta

SEQ ID NO: 560134 - DNA, 25 bp, Mus musculus
gcggctcccaacacagagggataat

SEQ ID NO: 560135 - DNA, 25 bp, Mus musculus
gcggctcccaactcagagggataat

SEQ ID NO: 560136 - DNA, 25 bp, Mus musculus
gcggctcccacaactctgggaagaa

SEQ ID NO: 560137 - DNA, 25 bp, Mus musculus
gcggctcccacatctctgggaagaa

SEQ ID NO: 560138 - DNA, 25 bp, Mus musculus
gcggctccctagaggaatttctgag

SEQ ID NO: 560139 - DNA, 25 bp, Mus musculus
gcggctccctagtggaatttctgag

SEQ ID NO: 560140 - DNA, 25 bp, Mus musculus
gcggctctacttaatgtagcctgta

SEQ ID NO: 560141 - DNA, 25 bp, Mus musculus
gcggctctactttatgtagcctgta

SEQ ID NO: 560142 - DNA, 25 bp, Mus musculus
gcggctctagcaccaaaagactgtt

SEQ ID NO: 560143 - DNA, 25 bp, Mus musculus
gcggctctagcagcaaaagactgtt

SEQ ID NO: 560144 - DNA, 25 bp, Mus musculus
gcggctctagttcctatagcttgag

SEQ ID NO: 560145 - DNA, 25 bp, Mus musculus
gcggctctagttgctatagcttgag

SEQ ID NO: 560146 - DNA, 25 bp, Mus musculus
gcggctctcctacctctggaagaaa

SEQ ID NO: 560147 - DNA, 25 bp, Mus musculus
gcggctctcctagctctggaagaaa

SEQ ID NO: 560148 - DNA, 25 bp, Mus musculus
gcggctctttccagatagttgatga

SEQ ID NO: 560149 - DNA, 25 bp, Mus musculus
gcggctctttcctgatagttgatga

SEQ ID NO: 560150 - DNA, 25 bp, Mus musculus
gcggctgaacccagactacctaagc

SEQ ID NO: 560151 - DNA, 25 bp, Mus musculus
gcggctgaaccctgactacctaagc

SEQ ID NO: 560152 - DNA, 25 bp, Mus musculus
gcggctgaccaaatttgtgacctta

SEQ ID NO: 560153 - DNA, 25 bp, Mus musculus
gcggctgaccaattttgtgacctta

SEQ ID NO: 560154 - DNA, 25 bp, Mus musculus
gcggctgacggaatagttattcctg

SEQ ID NO: 560155 - DNA, 25 bp, Mus musculus
gcggctgacggattagttattcctg

SEQ ID NO: 560156 - DNA, 25 bp, Mus musculus
gcggctgagcagacttttgtataat

SEQ ID NO: 560157 - DNA, 25 bp, Mus musculus
gcggctgagcagtcttttgtataat

SEQ ID NO: 560158 - DNA, 25 bp, Mus musculus
gcggctgagttcaggcaaagacaag

SEQ ID NO: 560159 - DNA, 25 bp, Mus musculus
gcggctgagttctggcaaagacaag

SEQ ID NO: 560160 - DNA, 25 bp, Mus musculus
gcggctgcaagaaccaatagtgtta

SEQ ID NO: 560161 - DNA, 25 bp, Mus musculus
gcggctgcaagatccaatagtgtta

SEQ ID NO: 560162 - DNA, 25 bp, Mus musculus
gcggctgccagtacaaaaaatcaag

SEQ ID NO: 560163 - DNA, 25 bp, Mus musculus
gcggctgccagttcaaaaaatcaag

SEQ ID NO: 560164 - DNA, 25 bp, Mus musculus
gcggctgcggcgaggccatgaacag

SEQ ID NO: 560165 - DNA, 25 bp, Mus musculus
gcggctgcggcgtggccatgaacag

SEQ ID NO: 560166 - DNA, 25 bp, Mus musculus
gcggctgctcatcaaataattcctg

SEQ ID NO: 560167 - DNA, 25 bp, Mus musculus
gcggctgctcatgaaataattcctg

SEQ ID NO: 560168 - DNA, 25 bp, Mus musculus
gcggctgctggcagagtgtttacac

SEQ ID NO: 560169 - DNA, 25 bp, Mus musculus
gcggctgctggctgagtgtttacac

SEQ ID NO: 560170 - DNA, 25 bp, Mus musculus
gcggctggaccactgtcagcagtac

SEQ ID NO: 560171 - DNA, 25 bp, Mus musculus
gcggctggaccagtgtcagcagtac

SEQ ID NO: 560172 - DNA, 25 bp, Mus musculus
gcggctggatgacaacctgctgtac

SEQ ID NO: 560173 - DNA, 25 bp, Mus musculus
gcggctggatgagaacctgctgtac

SEQ ID NO: 560174 - DNA, 25 bp, Mus musculus
gcggctggctgaactgaaccaattt

SEQ ID NO: 560175 - DNA, 25 bp, Mus musculus
gcggctggctgatctgaaccaattt

SEQ ID NO: 560176 - DNA, 25 bp, Mus musculus
gcggctggtcagaacattgcacaca

SEQ ID NO: 560177 - DNA, 25 bp, Mus musculus
gcggctggtcagatgctattctaat

SEQ ID NO: 560178 - DNA, 25 bp, Mus musculus
gcggctggtcagtacattgcacaca

SEQ ID NO: 560179 - DNA, 25 bp, Mus musculus
gcggctggtcagttgctattctaat

SEQ ID NO: 560180 - DNA, 25 bp, Mus musculus
gcggctgtcatcatgccacaaaatg

SEQ ID NO: 560181 - DNA, 25 bp, Mus musculus
gcggctgtcatcttgccacaaaatg

SEQ ID NO: 560182 - DNA, 25 bp, Mus musculus
gcggctgtggcaacaccctcctgaa

SEQ ID NO: 560183 - DNA, 25 bp, Mus musculus
gcggctgtggcatcaccctcctgaa

SEQ ID NO: 560184 - DNA, 25 bp, Mus musculus
gcggctgtgggcaggctcctaaaat

SEQ ID NO: 560185 - DNA, 25 bp, Mus musculus
gcggctgtgggctggctcctaaaat

SEQ ID NO: 560186 - DNA, 25 bp, Mus musculus
gcggctgttagccacctacagacaa

SEQ ID NO: 560187 - DNA, 25 bp, Mus musculus
gcggctgttagcgacctacagacaa

SEQ ID NO: 560188 - DNA, 25 bp, Mus musculus
gcggctgttctccaaagcggtccag

SEQ ID NO: 560189 - DNA, 25 bp, Mus musculus
gcggctgttctcgaaagcggtccag

SEQ ID NO: 560190 - DNA, 25 bp, Mus musculus
gcggcttaacacacaaatcactcaa

SEQ ID NO: 560191 - DNA, 25 bp, Mus musculus
gcggcttaacactcaaatcactcaa

SEQ ID NO: 560192 - DNA, 25 bp, Mus musculus
gcggcttatttaaccccgctaagca

SEQ ID NO: 560193 - DNA, 25 bp, Mus musculus
gcggcttatttatccccgctaagca

SEQ ID NO: 560194 - DNA, 25 bp, Mus musculus
gcggcttcagagacagtgtacctat

SEQ ID NO: 560195 - DNA, 25 bp, Mus musculus
gcggcttcagagtcagtgtacctat

SEQ ID NO: 560196 - DNA, 25 bp, Mus musculus
gcggcttcccacacatgagacaaac

SEQ ID NO: 560197 - DNA, 25 bp, Mus musculus
gcggcttcccactcatgagacaaac

SEQ ID NO: 560198 - DNA, 25 bp, Mus musculus
gcggcttcccgcagatcttgggcgc

SEQ ID NO: 560199 - DNA, 25 bp, Mus musculus
gcggcttcccgctgatcttgggcgc

SEQ ID NO: 560200 - DNA, 25 bp, Mus musculus
gcggcttctatacattggcttgatt

SEQ ID NO: 560201 - DNA, 25 bp, Mus musculus
gcggcttctatagattggcttgatt

SEQ ID NO: 560202 - DNA, 25 bp, Mus musculus
gcggcttctgaaagtatctctgtgg

SEQ ID NO: 560203 - DNA, 25 bp, Mus musculus
gcggcttctgaatgtatctctgtgg

SEQ ID NO: 560204 - DNA, 25 bp, Mus musculus
gcggcttctgtaactgcattggagc

SEQ ID NO: 560205 - DNA, 25 bp, Mus musculus
gcggcttctgtatctgcattggagc

SEQ ID NO: 560206 - DNA, 25 bp, Mus musculus
gcggcttctttaacagtctatttca

SEQ ID NO: 560207 - DNA, 25 bp, Mus musculus
gcggcttctttatcagtctatttca

SEQ ID NO: 560208 - DNA, 25 bp, Mus musculus
gcggcttgaattagatgtatctcca

SEQ ID NO: 560209 - DNA, 25 bp, Mus musculus
gcggcttgaatttgatgtatctcca

SEQ ID NO: 560210 - DNA, 25 bp, Mus musculus
gcggcttgtacgcatagctgtatta

SEQ ID NO: 560211 - DNA, 25 bp, Mus musculus
gcggcttgtacggatagctgtatta

SEQ ID NO: 560212 - DNA, 25 bp, Mus musculus
gcggctttggacagagttcaggcaa

SEQ ID NO: 560213 - DNA, 25 bp, Mus musculus
gcggctttggactgagttcaggcaa

SEQ ID NO: 560214 - DNA, 25 bp, Mus musculus
gcggctttgttcaacttgtatttaa

SEQ ID NO: 560215 - DNA, 25 bp, Mus musculus
gcggctttgttctacttgtatttaa

SEQ ID NO: 560216 - DNA, 25 bp, Mus musculus
gcggctttttgtaaagtgtcctcct

SEQ ID NO: 560217 - DNA, 25 bp, Mus musculus
gcggctttttgttaagtgtcctcct

SEQ ID NO: 560218 - DNA, 25 bp, Mus musculus
gcgggaaacagactctgcaaagcgc

SEQ ID NO: 560219 - DNA, 25 bp, Mus musculus
gcgggaaacagagtctgcaaagcgc

SEQ ID NO: 560220 - DNA, 25 bp, Mus musculus
gcgggaacaagtccatgaagaccaa

SEQ ID NO: 560221 - DNA, 25 bp, Mus musculus
gcgggaacaagtgcatgaagaccaa

SEQ ID NO: 560222 - DNA, 25 bp, Mus musculus
gcgggaacatcacagcatggagaca

SEQ ID NO: 560223 - DNA, 25 bp, Mus musculus
gcgggaacatcagagcatggagaca

SEQ ID NO: 560224 - DNA, 25 bp, Mus musculus
gcgggaacccgcatcccagaggaga

SEQ ID NO: 560225 - DNA, 25 bp, Mus musculus
gcgggaacccgcttcccagaggaga

SEQ ID NO: 560226 - DNA, 25 bp, Mus musculus
gcgggaacctgtctttgaatttgta

SEQ ID NO: 560227 - DNA, 25 bp, Mus musculus
gcgggaacctgtgtttgaatttgta

SEQ ID NO: 560228 - DNA, 25 bp, Mus musculus
gcgggaacgctgaaccctgagctga

SEQ ID NO: 560229 - DNA, 25 bp, Mus musculus
gcgggaacgctgtaccctgagctga

SEQ ID NO: 560230 - DNA, 25 bp, Mus musculus
gcgggaactctgacaggctgagctc

SEQ ID NO: 560231 - DNA, 25 bp, Mus musculus
gcgggaactctgtcaggctgagctc

SEQ ID NO: 560232 - DNA, 25 bp, Mus musculus
gcgggaaggcatattcttagaatat

SEQ ID NO: 560233 - DNA, 25 bp, Mus musculus
gcgggaaggcattttcttagaatat

SEQ ID NO: 560234 - DNA, 25 bp, Mus musculus
gcgggaagtcttacagattgcgtca

SEQ ID NO: 560235 - DNA, 25 bp, Mus musculus
gcgggaagtctttcagattgcgtca

SEQ ID NO: 560236 - DNA, 25 bp, Mus musculus
gcgggaagttcccagacactaccta

SEQ ID NO: 560237 - DNA, 25 bp, Mus musculus
gcgggaagttccgagacactaccta

SEQ ID NO: 560238 - DNA, 25 bp, Mus musculus
gcgggaatcatgataagcagcttca

SEQ ID NO: 560239 - DNA, 25 bp, Mus musculus
gcgggaatcatgttaagcagcttca

SEQ ID NO: 560240 - DNA, 25 bp, Mus musculus
gcgggaatttcacctttccattttg

SEQ ID NO: 560241 - DNA, 25 bp, Mus musculus
gcgggaatttcagctttccattttg

SEQ ID NO: 560242 - DNA, 25 bp, Mus musculus
gcgggacacgtgatatcctgtctga

SEQ ID NO: 560243 - DNA, 25 bp, Mus musculus
gcgggacacgtgttatcctgtctga

SEQ ID NO: 560244 - DNA, 25 bp, Mus musculus
gcgggacctttacttcgagttcaga

SEQ ID NO: 560245 - DNA, 25 bp, Mus musculus
gcgggacctttagttcgagttcaga

SEQ ID NO: 560246 - DNA, 25 bp, Mus musculus
gcgggactacggactaccaccgtgg

SEQ ID NO: 560247 - DNA, 25 bp, Mus musculus
gcgggactacggtctaccaccgtgg

SEQ ID NO: 560248 - DNA, 25 bp, Mus musculus
gcgggactcggcagcgccgcactta

SEQ ID NO: 560249 - DNA, 25 bp, Mus musculus
gcgggactcggctgcgccgcactta

SEQ ID NO: 560250 - DNA, 25 bp, Mus musculus
gcgggactggccacttgtctgaaga

SEQ ID NO: 560251 - DNA, 25 bp, Mus musculus
gcgggactggcctcttgtctgaaga

SEQ ID NO: 560252 - DNA, 25 bp, Mus musculus
gcgggactttaccatgcctaagtat

SEQ ID NO: 560253 - DNA, 25 bp, Mus musculus
gcgggactttacgatgcctaagtat

SEQ ID NO: 560254 - DNA, 25 bp, Mus musculus
gcgggactttatcctgatcacaaac

SEQ ID NO: 560255 - DNA, 25 bp, Mus musculus
gcgggactttatgctgatcacaaac

SEQ ID NO: 560256 - DNA, 25 bp, Mus musculus
gcgggagacactatctctagtggtt

SEQ ID NO: 560257 - DNA, 25 bp, Mus musculus
gcgggagacactttctctagtggtt

SEQ ID NO: 560258 - DNA, 25 bp, Mus musculus
gcgggagagactcttggctttttat

SEQ ID NO: 560259 - DNA, 25 bp, Mus musculus
gcgggagagactgttggctttttat

SEQ ID NO: 560260 - DNA, 25 bp, Mus musculus
gcgggagagcgcactgtcacttgcc

SEQ ID NO: 560261 - DNA, 25 bp, Mus musculus
gcgggagagcgctctgtcacttgcc

SEQ ID NO: 560262 - DNA, 25 bp, Mus musculus
gcgggagtatgcagccaacaagttt

SEQ ID NO: 560263 - DNA, 25 bp, Mus musculus
gcgggagtatgctgccaacaagttt

SEQ ID NO: 560264 - DNA, 25 bp, Mus musculus
gcgggagtccttcctaggaagctct

SEQ ID NO: 560265 - DNA, 25 bp, Mus musculus
gcgggagtccttgctaggaagctct

SEQ ID NO: 560266 - DNA, 25 bp, Mus musculus
gcgggatccactcttcggcagagaa

SEQ ID NO: 560267 - DNA, 25 bp, Mus musculus
gcgggatccactgttcggcagagaa

SEQ ID NO: 560268 - DNA, 25 bp, Mus musculus
gcgggatccccaatatgctgttgaa

SEQ ID NO: 560269 - DNA, 25 bp, Mus musculus
gcgggatccccattatgctgttgaa

SEQ ID NO: 560270 - DNA, 25 bp, Mus musculus
gcgggatgctgtcccaagcaagccc

SEQ ID NO: 560271 - DNA, 25 bp, Mus musculus
gcgggatgctgtgccaagcaagccc

SEQ ID NO: 560272 - DNA, 25 bp, Mus musculus
gcgggattacttagaggaccagccc

SEQ ID NO: 560273 - DNA, 25 bp, Mus musculus
gcgggattactttgaggaccagccc

SEQ ID NO: 560274 - DNA, 25 bp, Mus musculus
gcgggattcctaatgtagccaggac

SEQ ID NO: 560275 - DNA, 25 bp, Mus musculus
gcgggattcctattgtagccaggac

SEQ ID NO: 560276 - DNA, 25 bp, Mus musculus
gcgggattctggctagtctgatact

SEQ ID NO: 560277 - DNA, 25 bp, Mus musculus
gcgggattctgggtagtctgatact

SEQ ID NO: 560278 - DNA, 25 bp, Mus musculus
gcgggattgctacacttgccacata

SEQ ID NO: 560279 - DNA, 25 bp, Mus musculus
gcgggattgctagacttgccacata

SEQ ID NO: 560280 - DNA, 25 bp, Mus musculus
gcgggcaactcaatttcaaaacctt

SEQ ID NO: 560281 - DNA, 25 bp, Mus musculus
gcgggcaactcattttcaaaacctt

SEQ ID NO: 560282 - DNA, 25 bp, Mus musculus
gcgggcaagcagcaattgtgtcaca

SEQ ID NO: 560283 - DNA, 25 bp, Mus musculus
gcgggcaagcaggaattgtgtcaca

SEQ ID NO: 560284 - DNA, 25 bp, Mus musculus
gcgggcaagctgctcatcagcctgt

SEQ ID NO: 560285 - DNA, 25 bp, Mus musculus
gcgggcaagctggtcatcagcctgt

SEQ ID NO: 560286 - DNA, 25 bp, Mus musculus
gcgggcaatgctcttgctccctgag

SEQ ID NO: 560287 - DNA, 25 bp, Mus musculus
gcgggcaatgctgttgctccctgag

SEQ ID NO: 560288 - DNA, 25 bp, Mus musculus
gcgggcaatttcattctcaacggtt

SEQ ID NO: 560289 - DNA, 25 bp, Mus musculus
gcgggcaatttctttctcaacggtt

SEQ ID NO: 560290 - DNA, 25 bp, Mus musculus
gcgggcacaccaccgcaatgtcaaa

SEQ ID NO: 560291 - DNA, 25 bp, Mus musculus
gcgggcacaccagcgcaatgtcaaa

SEQ ID NO: 560292 - DNA, 25 bp, Mus musculus
gcgggcacacccagttagagcatgg

SEQ ID NO: 560293 - DNA, 25 bp, Mus musculus
gcgggcacaccctgttagagcatgg

SEQ ID NO: 560294 - DNA, 25 bp, Mus musculus
gcgggcacttttacagcttgctata

SEQ ID NO: 560295 - DNA, 25 bp, Mus musculus
gcgggcactttttcagcttgctata

SEQ ID NO: 560296 - DNA, 25 bp, Mus musculus
gcgggcagactgcactgacagtact

SEQ ID NO: 560297 - DNA, 25 bp, Mus musculus
gcgggcagactggactgacagtact

SEQ ID NO: 560298 - DNA, 25 bp, Mus musculus
gcgggcagcatcatccaacaggtat

SEQ ID NO: 560299 - DNA, 25 bp, Mus musculus
gcgggcagcatcttccaacaggtat

SEQ ID NO: 560300 - DNA, 25 bp, Mus musculus
gcgggcagccatactgaacacgtta

SEQ ID NO: 560301 - DNA, 25 bp, Mus musculus
gcgggcagccattctgaacacgtta

SEQ ID NO: 560302 - DNA, 25 bp, Mus musculus
gcgggcagcccaaggtgagcatctt

SEQ ID NO: 560303 - DNA, 25 bp, Mus musculus
gcgggcagcccatggtgagcatctt

SEQ ID NO: 560304 - DNA, 25 bp, Mus musculus
gcgggcagctgaatgctttgagcat

SEQ ID NO: 560305 - DNA, 25 bp, Mus musculus
gcgggcagctgattgctttgagcat

SEQ ID NO: 560306 - DNA, 25 bp, Mus musculus
gcgggcagtgccctaagctgttcaa

SEQ ID NO: 560307 - DNA, 25 bp, Mus musculus
gcgggcagtgccgtaagctgttcaa

SEQ ID NO: 560308 - DNA, 25 bp, Mus musculus
gcgggcagttcgctctgggttcctt

SEQ ID NO: 560309 - DNA, 25 bp, Mus musculus
gcgggcagttcggtctgggttcctt

SEQ ID NO: 560310 - DNA, 25 bp, Mus musculus
gcgggcatcaccaggatagcgcctg

SEQ ID NO: 560311 - DNA, 25 bp, Mus musculus
gcgggcatcacctggatagcgcctg

SEQ ID NO: 560312 - DNA, 25 bp, Mus musculus
gcgggcatcgcgctcgggtggtcgg

SEQ ID NO: 560313 - DNA, 25 bp, Mus musculus
gcgggcatcgcggtcgggtggtcgg

SEQ ID NO: 560314 - DNA, 25 bp, Mus musculus
gcgggcatgtctacctagatgatgt

SEQ ID NO: 560315 - DNA, 25 bp, Mus musculus
gcgggcatgtcttcctagatgatgt

SEQ ID NO: 560316 - DNA, 25 bp, Mus musculus
gcgggccacatgacaaattcagctt

SEQ ID NO: 560317 - DNA, 25 bp, Mus musculus
gcgggccacatgtcaaattcagctt

SEQ ID NO: 560318 - DNA, 25 bp, Mus musculus
gcgggccatgctacggtaactctga

SEQ ID NO: 560319 - DNA, 25 bp, Mus musculus
gcgggccatgcttcggtaactctga

SEQ ID NO: 560320 - DNA, 25 bp, Mus musculus
gcgggcccagtcacaggtacataca

SEQ ID NO: 560321 - DNA, 25 bp, Mus musculus
gcgggcccagtctcaggtacataca

SEQ ID NO: 560322 - DNA, 25 bp, Mus musculus
gcgggcccatttctgaagactctgg

SEQ ID NO: 560323 - DNA, 25 bp, Mus musculus
gcgggcccatttgtgaagactctgg

SEQ ID NO: 560324 - DNA, 25 bp, Mus musculus
gcgggccccatcctcagttttagag

SEQ ID NO: 560325 - DNA, 25 bp, Mus musculus
gcgggccccatcgtcagttttagag

SEQ ID NO: 560326 - DNA, 25 bp, Mus musculus
gcgggccctgtaaaccctgggacag

SEQ ID NO: 560327 - DNA, 25 bp, Mus musculus
gcgggccctgtataccctgggacag

SEQ ID NO: 560328 - DNA, 25 bp, Mus musculus
gcgggccgcacacacgctggactaa

SEQ ID NO: 560329 - DNA, 25 bp, Mus musculus
gcgggccgcacagacgctggactaa

SEQ ID NO: 560330 - DNA, 25 bp, Mus musculus
gcgggcctacagctccggaagaata

SEQ ID NO: 560331 - DNA, 25 bp, Mus musculus
gcgggcctacaggtccggaagaata

SEQ ID NO: 560332 - DNA, 25 bp, Mus musculus
gcgggcctgctaaggatctcagtga

SEQ ID NO: 560333 - DNA, 25 bp, Mus musculus
gcgggcctgctatggatctcagtga

SEQ ID NO: 560334 - DNA, 25 bp, Mus musculus
gcgggcctgggcataagctgctcta

SEQ ID NO: 560335 - DNA, 25 bp, Mus musculus
gcgggcctgggcttaagctgctcta

SEQ ID NO: 560336 - DNA, 25 bp, Mus musculus
gcgggccttcgaaggtggctattca

SEQ ID NO: 560337 - DNA, 25 bp, Mus musculus
gcgggccttcgatggtggctattca

SEQ ID NO: 560338 - DNA, 25 bp, Mus musculus
gcgggccttggtatactttcctgct

SEQ ID NO: 560339 - DNA, 25 bp, Mus musculus
gcgggccttggtttactttcctgct

SEQ ID NO: 560340 - DNA, 25 bp, Mus musculus
gcgggcctttagaaagaagaccaat

SEQ ID NO: 560341 - DNA, 25 bp, Mus musculus
gcgggcctttagtaagaagaccaat

SEQ ID NO: 560342 - DNA, 25 bp, Mus musculus
gcgggcctttttaggagcagtaagc

SEQ ID NO: 560343 - DNA, 25 bp, Mus musculus
gcgggccttttttggagcagtaagc

SEQ ID NO: 560344 - DNA, 25 bp, Mus musculus
gcgggcgacttcactctggagaagc

SEQ ID NO: 560345 - DNA, 25 bp, Mus musculus
gcgggcgacttctctctggagaagc

SEQ ID NO: 560346 - DNA, 25 bp, Mus musculus
gcgggcgatcaaatggtgattcatt

SEQ ID NO: 560347 - DNA, 25 bp, Mus musculus
gcgggcgatcaattggtgattcatt

SEQ ID NO: 560348 - DNA, 25 bp, Mus musculus
gcgggcgccaagaactttttcaagt

SEQ ID NO: 560349 - DNA, 25 bp, Mus musculus
gcgggcgccaagtactttttcaagt

SEQ ID NO: 560350 - DNA, 25 bp, Mus musculus
gcgggcgctaagaagcctttgttcg

SEQ ID NO: 560351 - DNA, 25 bp, Mus musculus
gcgggcgctaagtagcctttgttcg

SEQ ID NO: 560352 - DNA, 25 bp, Mus musculus
gcgggcggcctccattataggacac

SEQ ID NO: 560353 - DNA, 25 bp, Mus musculus
gcgggcggcctcgattataggacac

SEQ ID NO: 560354 - DNA, 25 bp, Mus musculus
gcgggctcctgactcggcagattaa

SEQ ID NO: 560355 - DNA, 25 bp, Mus musculus
gcgggctcctgagtcggcagattaa

SEQ ID NO: 560356 - DNA, 25 bp, Mus musculus
gcgggctgagaccttcgggggctat

SEQ ID NO: 560357 - DNA, 25 bp, Mus musculus
gcgggctgagacgttcgggggctat

SEQ ID NO: 560358 - DNA, 25 bp, Mus musculus
gcgggctggcttagtacaaacttat

SEQ ID NO: 560359 - DNA, 25 bp, Mus musculus
gcgggctggctttgtacaaacttat

SEQ ID NO: 560360 - DNA, 25 bp, Mus musculus
gcgggcttagcgcaatatcttttcg

SEQ ID NO: 560361 - DNA, 25 bp, Mus musculus
gcgggcttagcggaatatcttttcg

SEQ ID NO: 560362 - DNA, 25 bp, Mus musculus
gcgggcttgtttcctgtgctcgtta

SEQ ID NO: 560363 - DNA, 25 bp, Mus musculus
gcgggcttgtttgctgtgctcgtta

SEQ ID NO: 560364 - DNA, 25 bp, Mus musculus
gcgggctttacgactgtcttaagca

SEQ ID NO: 560365 - DNA, 25 bp, Mus musculus
gcgggctttacgtctgtcttaagca

SEQ ID NO: 560366 - DNA, 25 bp, Mus musculus
gcgggcttttcgctttcagatgttc

SEQ ID NO: 560367 - DNA, 25 bp, Mus musculus
gcgggcttttcggtttcagatgttc

SEQ ID NO: 560368 - DNA, 25 bp, Mus musculus
gcggggagatcaaccctgtcaaggt

SEQ ID NO: 560369 - DNA, 25 bp, Mus musculus
gcggggagatcatccctgtcaaggt

SEQ ID NO: 560370 - DNA, 25 bp, Mus musculus
gcgggtaacataatcttccttccag

SEQ ID NO: 560371 - DNA, 25 bp, Mus musculus
gcgggtaacatattcttccttccag

SEQ ID NO: 560372 - DNA, 25 bp, Mus musculus
gcgggtacataaatgtgtgtccctt

SEQ ID NO: 560373 - DNA, 25 bp, Mus musculus
gcgggtacataattgtgtgtccctt

SEQ ID NO: 560374 - DNA, 25 bp, Mus musculus
gcgggtaccaaactgttcttcatga

SEQ ID NO: 560375 - DNA, 25 bp, Mus musculus
gcgggtaccaaagtgttcttcatga

SEQ ID NO: 560376 - DNA, 25 bp, Mus musculus
gcgggtatggaacagcacccctgct

SEQ ID NO: 560377 - DNA, 25 bp, Mus musculus
gcgggtatggaagagcacccctgct

SEQ ID NO: 560378 - DNA, 25 bp, Mus musculus
gcgggtatgtatattgtgcctaatt

SEQ ID NO: 560379 - DNA, 25 bp, Mus musculus
gcgggtatgtattttgtgcctaatt

SEQ ID NO: 560380 - DNA, 25 bp, Mus musculus
gcgggtcatctccatgtacgctgag

SEQ ID NO: 560381 - DNA, 25 bp, Mus musculus
gcgggtcatctcgatgtacgctgag

SEQ ID NO: 560382 - DNA, 25 bp, Mus musculus
gcgggtcatgaactttcgccgcttt

SEQ ID NO: 560383 - DNA, 25 bp, Mus musculus
gcgggtcatgaagtttcgccgcttt

SEQ ID NO: 560384 - DNA, 25 bp, Mus musculus
gcgggtccccaaaagcaggtgcttc

SEQ ID NO: 560385 - DNA, 25 bp, Mus musculus
gcgggtccccaatagcaggtgcttc

SEQ ID NO: 560386 - DNA, 25 bp, Mus musculus
gcgggtcctttgaaagtccttgata

SEQ ID NO: 560387 - DNA, 25 bp, Mus musculus
gcgggtcctttgtaagtccttgata

SEQ ID NO: 560388 - DNA, 25 bp, Mus musculus
gcgggtcgcaaacgacagcgttcct

SEQ ID NO: 560389 - DNA, 25 bp, Mus musculus
gcgggtcgcaaaggacagcgttcct

SEQ ID NO: 560390 - DNA, 25 bp, Mus musculus
gcgggtctccctacaggatgtgata

SEQ ID NO: 560391 - DNA, 25 bp, Mus musculus
gcgggtctcccttcaggatgtgata

SEQ ID NO: 560392 - DNA, 25 bp, Mus musculus
gcgggtgccacacccttgactgtgt

SEQ ID NO: 560393 - DNA, 25 bp, Mus musculus
gcgggtgccacagccttgactgtgt

SEQ ID NO: 560394 - DNA, 25 bp, Mus musculus
gcgggtgctattcttgctcttacaa

SEQ ID NO: 560395 - DNA, 25 bp, Mus musculus
gcgggtgctattgttgctcttacaa

SEQ ID NO: 560396 - DNA, 25 bp, Mus musculus
gcgggtgctttgaggcctatttgtt

SEQ ID NO: 560397 - DNA, 25 bp, Mus musculus
gcgggtgctttgtggcctatttgtt

SEQ ID NO: 560398 - DNA, 25 bp, Mus musculus
gcgggtggattcacagataagcttc

SEQ ID NO: 560399 - DNA, 25 bp, Mus musculus
gcgggtggattctcagataagcttc

SEQ ID NO: 560400 - DNA, 25 bp, Mus musculus
gcgggtgtctttctggatcaccatt

SEQ ID NO: 560401 - DNA, 25 bp, Mus musculus
gcgggtgtctttgtggatcaccatt

SEQ ID NO: 560402 - DNA, 25 bp, Mus musculus
gcgggttatgataactgtgttcctt

SEQ ID NO: 560403 - DNA, 25 bp, Mus musculus
gcgggttatgattactgtgttcctt

SEQ ID NO: 560404 - DNA, 25 bp, Mus musculus
gcgggttctaatagctgccttaggg

SEQ ID NO: 560405 - DNA, 25 bp, Mus musculus
gcgggttctaattgctgccttaggg

SEQ ID NO: 560406 - DNA, 25 bp, Mus musculus
gcgggttctgtgagatccaaagtcc

SEQ ID NO: 560407 - DNA, 25 bp, Mus musculus
gcgggttctgtgtgatccaaagtcc

SEQ ID NO: 560408 - DNA, 25 bp, Mus musculus
gcgggttgtcgcaaaagccttcaac

SEQ ID NO: 560409 - DNA, 25 bp, Mus musculus
gcgggttgtcgctaaagccttcaac

SEQ ID NO: 560410 - DNA, 25 bp, Mus musculus
gcgggttgtcttcgttattagttga

SEQ ID NO: 560411 - DNA, 25 bp, Mus musculus
gcgggttgtcttggttattagttga

SEQ ID NO: 560412 - DNA, 25 bp, Mus musculus
gcgggtttccatactaatgtcaaca

SEQ ID NO: 560413 - DNA, 25 bp, Mus musculus
gcgggtttccattctaatgtcaaca

SEQ ID NO: 560414 - DNA, 25 bp, Mus musculus
gcgggttttcgcagctcaatgaatc

SEQ ID NO: 560415 - DNA, 25 bp, Mus musculus
gcgggttttcgctgctcaatgaatc

SEQ ID NO: 560416 - DNA, 25 bp, Mus musculus
gcgggttttctcacgctgcacaacg

SEQ ID NO: 560417 - DNA, 25 bp, Mus musculus
gcgggttttctctcgctgcacaacg

SEQ ID NO: 560418 - DNA, 25 bp, Mus musculus
gcggtaaacaaaatcccatgtattt

SEQ ID NO: 560419 - DNA, 25 bp, Mus musculus
gcggtaaacaaattcccatgtattt

SEQ ID NO: 560420 - DNA, 25 bp, Mus musculus
gcggtaaccagaagctatgtagctc

SEQ ID NO: 560421 - DNA, 25 bp, Mus musculus
gcggtaaccagatgctatgtagctc

SEQ ID NO: 560422 - DNA, 25 bp, Mus musculus
gcggtaagctgcctactgatgtgat

SEQ ID NO: 560423 - DNA, 25 bp, Mus musculus
gcggtaagctgcgtactgatgtgat

SEQ ID NO: 560424 - DNA, 25 bp, Mus musculus
gcggtaatgaggacttatggacact

SEQ ID NO: 560425 - DNA, 25 bp, Mus musculus
gcggtaatgaggtcttatggacact

SEQ ID NO: 560426 - DNA, 25 bp, Mus musculus
gcggtacagacgcaccaggttcacc

SEQ ID NO: 560427 - DNA, 25 bp, Mus musculus
gcggtacagacggaccaggttcacc

SEQ ID NO: 560428 - DNA, 25 bp, Mus musculus
gcggtacatcatcacttaagctact

SEQ ID NO: 560429 - DNA, 25 bp, Mus musculus
gcggtacatcatgacttaagctact

SEQ ID NO: 560430 - DNA, 25 bp, Mus musculus
gcggtacatcgacacagatccagca

SEQ ID NO: 560431 - DNA, 25 bp, Mus musculus
gcggtacatcgagacagatccagca

SEQ ID NO: 560432 - DNA, 25 bp, Mus musculus
gcggtacattgaccttggcccaaat

SEQ ID NO: 560433 - DNA, 25 bp, Mus musculus
gcggtacattgagcttggcccaaat

SEQ ID NO: 560434 - DNA, 25 bp, Mus musculus
gcggtaccttcacagtccagaggaa

SEQ ID NO: 560435 - DNA, 25 bp, Mus musculus
gcggtaccttcagagtccagaggaa

SEQ ID NO: 560436 - DNA, 25 bp, Mus musculus
gcggtactgcttcagatcttagcgt

SEQ ID NO: 560437 - DNA, 25 bp, Mus musculus
gcggtactgcttgagatcttagcgt

SEQ ID NO: 560438 - DNA, 25 bp, Mus musculus
gcggtacttgtaagtgctggccaat

SEQ ID NO: 560439 - DNA, 25 bp, Mus musculus
gcggtacttgtatgtgctggccaat

SEQ ID NO: 560440 - DNA, 25 bp, Mus musculus
gcggtagagactacagcctcttcat

SEQ ID NO: 560441 - DNA, 25 bp, Mus musculus
gcggtagagacttcagcctcttcat

SEQ ID NO: 560442 - DNA, 25 bp, Mus musculus
gcggtagctgctctattctgtagtg

SEQ ID NO: 560443 - DNA, 25 bp, Mus musculus
gcggtagctgctgtattctgtagtg

SEQ ID NO: 560444 - DNA, 25 bp, Mus musculus
gcggtaggttttccaaggctttctg

SEQ ID NO: 560445 - DNA, 25 bp, Mus musculus
gcggtaggttttgcaaggctttctg

SEQ ID NO: 560446 - DNA, 25 bp, Mus musculus
gcggtagtggcacactccctttttt

SEQ ID NO: 560447 - DNA, 25 bp, Mus musculus
gcggtagtggcagactccctttttt

SEQ ID NO: 560448 - DNA, 25 bp, Mus musculus
gcggtataatgcacccaggccaaaa

SEQ ID NO: 560449 - DNA, 25 bp, Mus musculus
gcggtataatgctcccaggccaaaa

SEQ ID NO: 560450 - DNA, 25 bp, Mus musculus
gcggtatataccagttagtgctcaa

SEQ ID NO: 560451 - DNA, 25 bp, Mus musculus
gcggtatatacctgttagtgctcaa

SEQ ID NO: 560452 - DNA, 25 bp, Mus musculus
gcggtatcaacaactatttaacctt

SEQ ID NO: 560453 - DNA, 25 bp, Mus musculus
gcggtatcaacatctatttaacctt

SEQ ID NO: 560454 - DNA, 25 bp, Mus musculus
gcggtatgtaccctggctgaagtaa

SEQ ID NO: 560455 - DNA, 25 bp, Mus musculus
gcggtatgtaccgtggctgaagtaa

SEQ ID NO: 560456 - DNA, 25 bp, Mus musculus
gcggtatgtcccaattacaaatgta

SEQ ID NO: 560457 - DNA, 25 bp, Mus musculus
gcggtatgtccctattacaaatgta

SEQ ID NO: 560458 - DNA, 25 bp, Mus musculus
gcggtattaagtagctttttcaggt

SEQ ID NO: 560459 - DNA, 25 bp, Mus musculus
gcggtattaagttgctttttcaggt

SEQ ID NO: 560460 - DNA, 25 bp, Mus musculus
gcggtattcaccagcaatcttagca

SEQ ID NO: 560461 - DNA, 25 bp, Mus musculus
gcggtattcacctgcaatcttagca

SEQ ID NO: 560462 - DNA, 25 bp, Mus musculus
gcggtattggccaggcttctggaat

SEQ ID NO: 560463 - DNA, 25 bp, Mus musculus
gcggtattggcctggcttctggaat

SEQ ID NO: 560464 - DNA, 25 bp, Mus musculus
gcggtcaaccgcaaacggaagaagc

SEQ ID NO: 560465 - DNA, 25 bp, Mus musculus
gcggtcaaccgctaacggaagaagc

SEQ ID NO: 560466 - DNA, 25 bp, Mus musculus
gcggtcaactgtcttaagcatcctg

SEQ ID NO: 560467 - DNA, 25 bp, Mus musculus
gcggtcaactgtgttaagcatcctg

SEQ ID NO: 560468 - DNA, 25 bp, Mus musculus
gcggtcaagatgatcacccgccgcg

SEQ ID NO: 560469 - DNA, 25 bp, Mus musculus
gcggtcaagatgttcacccgccgcg

SEQ ID NO: 560470 - DNA, 25 bp, Mus musculus
gcggtcactgcacgcaggagaccat

SEQ ID NO: 560471 - DNA, 25 bp, Mus musculus
gcggtcactgcaggcaggagaccat

SEQ ID NO: 560472 - DNA, 25 bp, Mus musculus
gcggtcagcacaccaagaccactgg

SEQ ID NO: 560473 - DNA, 25 bp, Mus musculus
gcggtcagcacagcaagaccactgg

SEQ ID NO: 560474 - DNA, 25 bp, Mus musculus
gcggtcagtggcaagcgaatatact

SEQ ID NO: 560475 - DNA, 25 bp, Mus musculus
gcggtcagtggctagcgaatatact

SEQ ID NO: 560476 - DNA, 25 bp, Mus musculus
gcggtcagttccaagtgagcggcaa

SEQ ID NO: 560477 - DNA, 25 bp, Mus musculus
gcggtcagttcctagtgagcggcaa

SEQ ID NO: 560478 - DNA, 25 bp, Mus musculus
gcggtcattacgagatggattctac

SEQ ID NO: 560479 - DNA, 25 bp, Mus musculus
gcggtcattacgtgatggattctac

SEQ ID NO: 560480 - DNA, 25 bp, Mus musculus
gcggtccaggaacaaaggcactcta

SEQ ID NO: 560481 - DNA, 25 bp, Mus musculus
gcggtccaggaagaaaggcactcta

SEQ ID NO: 560482 - DNA, 25 bp, Mus musculus
gcggtccagtggagagcttctctta

SEQ ID NO: 560483 - DNA, 25 bp, Mus musculus
gcggtccagtggtgagcttctctta

SEQ ID NO: 560484 - DNA, 25 bp, Mus musculus
gcggtccatcagagtgccaagattg

SEQ ID NO: 560485 - DNA, 25 bp, Mus musculus
gcggtccatcagtgtgccaagattg

SEQ ID NO: 560486 - DNA, 25 bp, Mus musculus
gcggtcccagggaaatgcaagtgat

SEQ ID NO: 560487 - DNA, 25 bp, Mus musculus
gcggtcccagggtaatgcaagtgat

SEQ ID NO: 560488 - DNA, 25 bp, Mus musculus
gcggtcccgccaatgacttggaaaa

SEQ ID NO: 560489 - DNA, 25 bp, Mus musculus
gcggtcccgccattgacttggaaaa

SEQ ID NO: 560490 - DNA, 25 bp, Mus musculus
gcggtccctcagctgcaacagtgtg

SEQ ID NO: 560491 - DNA, 25 bp, Mus musculus
gcggtccctcaggtgcaacagtgtg

SEQ ID NO: 560492 - DNA, 25 bp, Mus musculus
gcggtcctaagtatatgctgccaaa

SEQ ID NO: 560493 - DNA, 25 bp, Mus musculus
gcggtcctaagtttatgctgccaaa

SEQ ID NO: 560494 - DNA, 25 bp, Mus musculus
gcggtcctcaaaacctatgatggtc

SEQ ID NO: 560495 - DNA, 25 bp, Mus musculus
gcggtcctcaaatcctatgatggtc

SEQ ID NO: 560496 - DNA, 25 bp, Mus musculus
gcggtcctccttatatcctgaagga

SEQ ID NO: 560497 - DNA, 25 bp, Mus musculus
gcggtcctccttttatcctgaagga

SEQ ID NO: 560498 - DNA, 25 bp, Mus musculus
gcggtcgacattacagaaatcaagc

SEQ ID NO: 560499 - DNA, 25 bp, Mus musculus
gcggtcgacatttcagaaatcaagc

SEQ ID NO: 560500 - DNA, 25 bp, Mus musculus
gcggtcgaggcgctcatcagcaaca

SEQ ID NO: 560501 - DNA, 25 bp, Mus musculus
gcggtcgaggcggtcatcagcaaca

SEQ ID NO: 560502 - DNA, 25 bp, Mus musculus
gcggtctcactgatagttttgggcc

SEQ ID NO: 560503 - DNA, 25 bp, Mus musculus
gcggtctcactgttagttttgggcc

SEQ ID NO: 560504 - DNA, 25 bp, Mus musculus
gcggtctccaagatgacccttaggg

SEQ ID NO: 560505 - DNA, 25 bp, Mus musculus
gcggtctccaagttgacccttaggg

SEQ ID NO: 560506 - DNA, 25 bp, Mus musculus
gcggtctcttttcaagcctgttagg

SEQ ID NO: 560507 - DNA, 25 bp, Mus musculus
gcggtctcttttgaagcctgttagg

SEQ ID NO: 560508 - DNA, 25 bp, Mus musculus
gcggtctttgaaaaccctgggaact

SEQ ID NO: 560509 - DNA, 25 bp, Mus musculus
gcggtctttgaataccctgggaact

SEQ ID NO: 560510 - DNA, 25 bp, Mus musculus
gcggtgaacctgatatgccaggcgt

SEQ ID NO: 560511 - DNA, 25 bp, Mus musculus
gcggtgaacctgttatgccaggcgt

SEQ ID NO: 560512 - DNA, 25 bp, Mus musculus
gcggtgaagaacaacagcatctgtg

SEQ ID NO: 560513 - DNA, 25 bp, Mus musculus
gcggtgaagaactacagcatctgtg

SEQ ID NO: 560514 - DNA, 25 bp, Mus musculus
gcggtgaagtaaccagagaagattt

SEQ ID NO: 560515 - DNA, 25 bp, Mus musculus
gcggtgaagtaagcagagaagattt

SEQ ID NO: 560516 - DNA, 25 bp, Mus musculus
gcggtgacaactcaggattttcccc

SEQ ID NO: 560517 - DNA, 25 bp, Mus musculus
gcggtgacaactgaggattttcccc

SEQ ID NO: 560518 - DNA, 25 bp, Mus musculus
gcggtgacattgaggcttataaatc

SEQ ID NO: 560519 - DNA, 25 bp, Mus musculus
gcggtgacattgtggcttataaatc

SEQ ID NO: 560520 - DNA, 25 bp, Mus musculus
gcggtgaccacacacgatgcaagac

SEQ ID NO: 560521 - DNA, 25 bp, Mus musculus
gcggtgaccacagacgatgcaagac

SEQ ID NO: 560522 - DNA, 25 bp, Mus musculus
gcggtgagatggcttcgccggtaag

SEQ ID NO: 560523 - DNA, 25 bp, Mus musculus
gcggtgagatgggttcgccggtaag

SEQ ID NO: 560524 - DNA, 25 bp, Mus musculus
gcggtgagtgacatttggcttatta

SEQ ID NO: 560525 - DNA, 25 bp, Mus musculus
gcggtgagtgacttttggcttatta

SEQ ID NO: 560526 - DNA, 25 bp, Mus musculus
gcggtgagtgccaaaacctcggccc

SEQ ID NO: 560527 - DNA, 25 bp, Mus musculus
gcggtgagtgcctaaacctcggccc

SEQ ID NO: 560528 - DNA, 25 bp, Mus musculus
gcggtgagttaccattgggccctat

SEQ ID NO: 560529 - DNA, 25 bp, Mus musculus
gcggtgagttacgattgggccctat

SEQ ID NO: 560530 - DNA, 25 bp, Mus musculus
gcggtgattttaacgagttcccagt

SEQ ID NO: 560531 - DNA, 25 bp, Mus musculus
gcggtgattttatcgagttcccagt

SEQ ID NO: 560532 - DNA, 25 bp, Mus musculus
gcggtgcagctcatgtgactaagtt

SEQ ID NO: 560533 - DNA, 25 bp, Mus musculus
gcggtgcagctcttgtgactaagtt

SEQ ID NO: 560534 - DNA, 25 bp, Mus musculus
gcggtgcaggcaacttgcagactga

SEQ ID NO: 560535 - DNA, 25 bp, Mus musculus
gcggtgcaggcatcttgcagactga

SEQ ID NO: 560536 - DNA, 25 bp, Mus musculus
gcggtgcagtgtcccaatgtttcgt

SEQ ID NO: 560537 - DNA, 25 bp, Mus musculus
gcggtgcagtgtgccaatgtttcgt

SEQ ID NO: 560538 - DNA, 25 bp, Mus musculus
gcggtgcattcgcaagatggatcac

SEQ ID NO: 560539 - DNA, 25 bp, Mus musculus
gcggtgcattcggaagatggatcac

SEQ ID NO: 560540 - DNA, 25 bp, Mus musculus
gcggtgccaactaccccatcgtgga

SEQ ID NO: 560541 - DNA, 25 bp, Mus musculus
gcggtgccaacttccccatcgtgga

SEQ ID NO: 560542 - DNA, 25 bp, Mus musculus
gcggtgcctgtgaatgcctgaacga

SEQ ID NO: 560543 - DNA, 25 bp, Mus musculus
gcggtgcctgtgtatgcctgaacga

SEQ ID NO: 560544 - DNA, 25 bp, Mus musculus
gcggtgctcggtacccattgacagc

SEQ ID NO: 560545 - DNA, 25 bp, Mus musculus
gcggtgctcggttcccattgacagc

SEQ ID NO: 560546 - DNA, 25 bp, Mus musculus
gcggtgctctggactgtctttgaaa

SEQ ID NO: 560547 - DNA, 25 bp, Mus musculus
gcggtgctctggtctgtctttgaaa

SEQ ID NO: 560548 - DNA, 25 bp, Mus musculus
gcggtgctgaaacgcgtccacagcc

SEQ ID NO: 560549 - DNA, 25 bp, Mus musculus
gcggtgctgaaaggcgtccacagcc

SEQ ID NO: 560550 - DNA, 25 bp, Mus musculus
gcggtgcttcctctggtgactgaca

SEQ ID NO: 560551 - DNA, 25 bp, Mus musculus
gcggtgcttcctgtggtgactgaca

SEQ ID NO: 560552 - DNA, 25 bp, Mus musculus
gcggtgcttctcctgcaggaactcg

SEQ ID NO: 560553 - DNA, 25 bp, Mus musculus
gcggtgcttctcgtgcaggaactcg

SEQ ID NO: 560554 - DNA, 25 bp, Mus musculus
gcggtggacacacaccactggagat

SEQ ID NO: 560555 - DNA, 25 bp, Mus musculus
gcggtggacacagaccactggagat

SEQ ID NO: 560556 - DNA, 25 bp, Mus musculus
gcggtggatttacctgccctgcagt

SEQ ID NO: 560557 - DNA, 25 bp, Mus musculus
gcggtggatttagctgccctgcagt

SEQ ID NO: 560558 - DNA, 25 bp, Mus musculus
gcggtggcgacgacttgcaccccgt

SEQ ID NO: 560559 - DNA, 25 bp, Mus musculus
gcggtggcgacgtcttgcaccccgt

SEQ ID NO: 560560 - DNA, 25 bp, Mus musculus
gcggtggtcatcacagaccggcaga

SEQ ID NO: 560561 - DNA, 25 bp, Mus musculus
gcggtggtcatctcagaccggcaga

SEQ ID NO: 560562 - DNA, 25 bp, Mus musculus
gcggtggtcccaatgttcaaagaga

SEQ ID NO: 560563 - DNA, 25 bp, Mus musculus
gcggtggtcccattgttcaaagaga

SEQ ID NO: 560564 - DNA, 25 bp, Mus musculus
gcggtggtgccgcagccggttccgg

SEQ ID NO: 560565 - DNA, 25 bp, Mus musculus
gcggtggtgccggagccggttccgg

SEQ ID NO: 560566 - DNA, 25 bp, Mus musculus
gcggtggtgctgcatgcctttctac

SEQ ID NO: 560567 - DNA, 25 bp, Mus musculus
gcggtggtgctggatgcctttctac

SEQ ID NO: 560568 - DNA, 25 bp, Mus musculus
gcggtgtctttgcttgactcttata

SEQ ID NO: 560569 - DNA, 25 bp, Mus musculus
gcggtgtctttggttgactcttata

SEQ ID NO: 560570 - DNA, 25 bp, Mus musculus
gcggtgtggtgtctctataactagc

SEQ ID NO: 560571 - DNA, 25 bp, Mus musculus
gcggtgtggtgtgtctataactagc

SEQ ID NO: 560572 - DNA, 25 bp, Mus musculus
gcggtgtgtaagctgtttccttcaa

SEQ ID NO: 560573 - DNA, 25 bp, Mus musculus
gcggtgtgtaaggtgtttccttcaa

SEQ ID NO: 560574 - DNA, 25 bp, Mus musculus
gcggtgtgtatcaaaactgcaaata

SEQ ID NO: 560575 - DNA, 25 bp, Mus musculus
gcggtgtgtatctaaactgcaaata

SEQ ID NO: 560576 - DNA, 25 bp, Mus musculus
gcggtgtgtgttagcttaaagtgta

SEQ ID NO: 560577 - DNA, 25 bp, Mus musculus
gcggtgtgtgtttgcttaaagtgta

SEQ ID NO: 560578 - DNA, 25 bp, Mus musculus
gcggtgttcctaatgaaataagata

SEQ ID NO: 560579 - DNA, 25 bp, Mus musculus
gcggtgttcctattgaaataagata

SEQ ID NO: 560580 - DNA, 25 bp, Mus musculus
gcggtgttggacataacctgactgg

SEQ ID NO: 560581 - DNA, 25 bp, Mus musculus
gcggtgttggacttaacctgactgg

SEQ ID NO: 560582 - DNA, 25 bp, Mus musculus
gcggtgttggtcatcacatcagata

SEQ ID NO: 560583 - DNA, 25 bp, Mus musculus
gcggtgttggtcttcacatcagata

SEQ ID NO: 560584 - DNA, 25 bp, Mus musculus
gcggtgttgtgtctgatagactcat

SEQ ID NO: 560585 - DNA, 25 bp, Mus musculus
gcggtgttgtgtgtgatagactcat

SEQ ID NO: 560586 - DNA, 25 bp, Mus musculus
gcggttaaaagccaatctgtcagat

SEQ ID NO: 560587 - DNA, 25 bp, Mus musculus
gcggttaaaagcgaatctgtcagat

SEQ ID NO: 560588 - DNA, 25 bp, Mus musculus
gcggttaagagcaattcccagcagc

SEQ ID NO: 560589 - DNA, 25 bp, Mus musculus
gcggttaagagctattcccagcagc

SEQ ID NO: 560590 - DNA, 25 bp, Mus musculus
gcggttaatgcgctatttccactca

SEQ ID NO: 560591 - DNA, 25 bp, Mus musculus
gcggttaatgcggtatttccactca

SEQ ID NO: 560592 - DNA, 25 bp, Mus musculus
gcggttacacggagctactatagag

SEQ ID NO: 560593 - DNA, 25 bp, Mus musculus
gcggttacacggtgctactatagag

SEQ ID NO: 560594 - DNA, 25 bp, Mus musculus
gcggttacaggaatggaaagcactt

SEQ ID NO: 560595 - DNA, 25 bp, Mus musculus
gcggttacaggattggaaagcactt

SEQ ID NO: 560596 - DNA, 25 bp, Mus musculus
gcggttagacacaataactccggtt

SEQ ID NO: 560597 - DNA, 25 bp, Mus musculus
gcggttagacactataactccggtt

SEQ ID NO: 560598 - DNA, 25 bp, Mus musculus
gcggttagccagcatgctagttact

SEQ ID NO: 560599 - DNA, 25 bp, Mus musculus
gcggttagccaggatgctagttact

SEQ ID NO: 560600 - DNA, 25 bp, Mus musculus
gcggttcaaaaccatgagccccagc

SEQ ID NO: 560601 - DNA, 25 bp, Mus musculus
gcggttcaaaacgatgagccccagc

SEQ ID NO: 560602 - DNA, 25 bp, Mus musculus
gcggttcaaactacagggcttactc

SEQ ID NO: 560603 - DNA, 25 bp, Mus musculus
gcggttcaaacttcagggcttactc

SEQ ID NO: 560604 - DNA, 25 bp, Mus musculus
gcggttcaagttatattattgcaat

SEQ ID NO: 560605 - DNA, 25 bp, Mus musculus
gcggttcaagttttattattgcaat

SEQ ID NO: 560606 - DNA, 25 bp, Mus musculus
gcggttcacggaattatttcatttg

SEQ ID NO: 560607 - DNA, 25 bp, Mus musculus
gcggttcacggatttatttcatttg

SEQ ID NO: 560608 - DNA, 25 bp, Mus musculus
gcggttcccgaacgacatataccca

SEQ ID NO: 560609 - DNA, 25 bp, Mus musculus
gcggttcccgaaggacatataccca

SEQ ID NO: 560610 - DNA, 25 bp, Mus musculus
gcggttccctcacatttctctgtaa

SEQ ID NO: 560611 - DNA, 25 bp, Mus musculus
gcggttccctcagatttctctgtaa

SEQ ID NO: 560612 - DNA, 25 bp, Mus musculus
gcggttcctaacctgtctttatgga

SEQ ID NO: 560613 - DNA, 25 bp, Mus musculus
gcggttcctaacgtgtctttatgga

SEQ ID NO: 560614 - DNA, 25 bp, Mus musculus
gcggttccttggacgacttagtccg

SEQ ID NO: 560615 - DNA, 25 bp, Mus musculus
gcggttccttggtcgacttagtccg

SEQ ID NO: 560616 - DNA, 25 bp, Mus musculus
gcggttcgtgcacatttttattcca

SEQ ID NO: 560617 - DNA, 25 bp, Mus musculus
gcggttcgtgcagatttttattcca

SEQ ID NO: 560618 - DNA, 25 bp, Mus musculus
gcggttctccttcctctctgaagtt

SEQ ID NO: 560619 - DNA, 25 bp, Mus musculus
gcggttctccttgctctctgaagtt

SEQ ID NO: 560620 - DNA, 25 bp, Mus musculus
gcggttgcattgctaatgatccagc

SEQ ID NO: 560621 - DNA, 25 bp, Mus musculus
gcggttgcattggtaatgatccagc

SEQ ID NO: 560622 - DNA, 25 bp, Mus musculus
gcggttgcctataattctaaatgtg

SEQ ID NO: 560623 - DNA, 25 bp, Mus musculus
gcggttgcctattattctaaatgtg

SEQ ID NO: 560624 - DNA, 25 bp, Mus musculus
gcggttgcttaactgcctgaatagt

SEQ ID NO: 560625 - DNA, 25 bp, Mus musculus
gcggttgcttaagtgcctgaatagt

SEQ ID NO: 560626 - DNA, 25 bp, Mus musculus
gcggttggatagcaagctgactttt

SEQ ID NO: 560627 - DNA, 25 bp, Mus musculus
gcggttggataggaagctgactttt

SEQ ID NO: 560628 - DNA, 25 bp, Mus musculus
gcggttggccccaggtctgcataga

SEQ ID NO: 560629 - DNA, 25 bp, Mus musculus
gcggttggcccctggtctgcataga

SEQ ID NO: 560630 - DNA, 25 bp, Mus musculus
gcggttgtaccaactttatgagcta

SEQ ID NO: 560631 - DNA, 25 bp, Mus musculus
gcggttgtaccacggccaaacgcct

SEQ ID NO: 560632 - DNA, 25 bp, Mus musculus
gcggttgtaccagggccaaacgcct

SEQ ID NO: 560633 - DNA, 25 bp, Mus musculus
gcggttgtaccatctttatgagcta

SEQ ID NO: 560634 - DNA, 25 bp, Mus musculus
gcggttgtcagaaacatacagtcct

SEQ ID NO: 560635 - DNA, 25 bp, Mus musculus
gcggttgtcagatacatacagtcct

SEQ ID NO: 560636 - DNA, 25 bp, Mus musculus
gcggttgtcagtattgcactgtaaa

SEQ ID NO: 560637 - DNA, 25 bp, Mus musculus
gcggttgtcagttttgcactgtaaa

SEQ ID NO: 560638 - DNA, 25 bp, Mus musculus
gcggttgtttccatggaccctagag

SEQ ID NO: 560639 - DNA, 25 bp, Mus musculus
gcggttgtttccttggaccctagag

SEQ ID NO: 560640 - DNA, 25 bp, Mus musculus
gcggtttaaacccatcgagcagctg

SEQ ID NO: 560641 - DNA, 25 bp, Mus musculus
gcggtttaaaccgatcgagcagctg

SEQ ID NO: 560642 - DNA, 25 bp, Mus musculus
gcggtttaacctaccacatggcaga

SEQ ID NO: 560643 - DNA, 25 bp, Mus musculus
gcggtttaaccttccacatggcaga

SEQ ID NO: 560644 - DNA, 25 bp, Mus musculus
gcggtttagatgatgcctccacaga

SEQ ID NO: 560645 - DNA, 25 bp, Mus musculus
gcggtttagatgttgcctccacaga

SEQ ID NO: 560646 - DNA, 25 bp, Mus musculus
gcggtttcctgaccgcggtttccct

SEQ ID NO: 560647 - DNA, 25 bp, Mus musculus
gcggtttcctgagcgcggtttccct

SEQ ID NO: 560648 - DNA, 25 bp, Mus musculus
gcggtttcctttcatgaagtgccta

SEQ ID NO: 560649 - DNA, 25 bp, Mus musculus
gcggtttcctttgatgaagtgccta

SEQ ID NO: 560650 - DNA, 25 bp, Mus musculus
gcggtttctcgtcgcttcggtcctt

SEQ ID NO: 560651 - DNA, 25 bp, Mus musculus
gcggtttctcgtggcttcggtcctt

SEQ ID NO: 560652 - DNA, 25 bp, Mus musculus
gcggtttggcacatgtgttcaacat

SEQ ID NO: 560653 - DNA, 25 bp, Mus musculus
gcggtttggcacttgtgttcaacat

SEQ ID NO: 560654 - DNA, 25 bp, Mus musculus
gcggttttatggcttggttttgaat

SEQ ID NO: 560655 - DNA, 25 bp, Mus musculus
gcggttttatgggttggttttgaat

SEQ ID NO: 560656 - DNA, 25 bp, Mus musculus
gcggtttttatcctcttttatccag

SEQ ID NO: 560657 - DNA, 25 bp, Mus musculus
gcggtttttatcgtcttttatccag

SEQ ID NO: 560658 - DNA, 25 bp, Mus musculus
gcggtttttatgacactagtgtgca

SEQ ID NO: 560659 - DNA, 25 bp, Mus musculus
gcggtttttatgtcactagtgtgca

SEQ ID NO: 560660 - DNA, 25 bp, Mus musculus
gcgtaaaacgaaatctgctgtgctg

SEQ ID NO: 560661 - DNA, 25 bp, Mus musculus
gcgtaaaacgaattctgctgtgctg

SEQ ID NO: 560662 - DNA, 25 bp, Mus musculus
gcgtaaacaacgcattctgtgcatg

SEQ ID NO: 560663 - DNA, 25 bp, Mus musculus
gcgtaaacaacggattctgtgcatg

SEQ ID NO: 560664 - DNA, 25 bp, Mus musculus
gcgtaaacacccactaacattaaca

SEQ ID NO: 560665 - DNA, 25 bp, Mus musculus
gcgtaaacaccctctaacattaaca

SEQ ID NO: 560666 - DNA, 25 bp, Mus musculus
gcgtaaatgagaagcctaaccagga

SEQ ID NO: 560667 - DNA, 25 bp, Mus musculus
gcgtaaatgagatgcctaaccagga

SEQ ID NO: 560668 - DNA, 25 bp, Mus musculus
gcgtaaattaggctagtgagtgaat

SEQ ID NO: 560669 - DNA, 25 bp, Mus musculus
gcgtaaattagggtagtgagtgaat

SEQ ID NO: 560670 - DNA, 25 bp, Mus musculus
gcgtaacacggcacggcatttctac

SEQ ID NO: 560671 - DNA, 25 bp, Mus musculus
gcgtaacacggctcggcatttctac

SEQ ID NO: 560672 - DNA, 25 bp, Mus musculus
gcgtaacacgttcatcctgtatttt

SEQ ID NO: 560673 - DNA, 25 bp, Mus musculus
gcgtaacacgttgatcctgtatttt

SEQ ID NO: 560674 - DNA, 25 bp, Mus musculus
gcgtaacagctgacagtttttcaca

SEQ ID NO: 560675 - DNA, 25 bp, Mus musculus
gcgtaacagctgtcagtttttcaca

SEQ ID NO: 560676 - DNA, 25 bp, Mus musculus
gcgtaactgtccagtatctatcaat

SEQ ID NO: 560677 - DNA, 25 bp, Mus musculus
gcgtaactgtcctgtatctatcaat

SEQ ID NO: 560678 - DNA, 25 bp, Mus musculus
gcgtaagaggcgcttctttcccaac

SEQ ID NO: 560679 - DNA, 25 bp, Mus musculus
gcgtaagaggcggttctttcccaac

SEQ ID NO: 560680 - DNA, 25 bp, Mus musculus
gcgtaagatccgctgagctgaaatg

SEQ ID NO: 560681 - DNA, 25 bp, Mus musculus
gcgtaagatccggtgagctgaaatg

SEQ ID NO: 560682 - DNA, 25 bp, Mus musculus
gcgtaagcactcactgtttctaaca

SEQ ID NO: 560683 - DNA, 25 bp, Mus musculus
gcgtaagcactctctgtttctaaca

SEQ ID NO: 560684 - DNA, 25 bp, Mus musculus
gcgtaagccgcgaagtgtaatgagt

SEQ ID NO: 560685 - DNA, 25 bp, Mus musculus
gcgtaagccgcgtagtgtaatgagt

SEQ ID NO: 560686 - DNA, 25 bp, Mus musculus
gcgtaaggagaacttgcctggcccc

SEQ ID NO: 560687 - DNA, 25 bp, Mus musculus
gcgtaaggagaagttgcctggcccc

SEQ ID NO: 560688 - DNA, 25 bp, Mus musculus
gcgtaaggcatactggttaatctca

SEQ ID NO: 560689 - DNA, 25 bp, Mus musculus
gcgtaaggcatagtggttaatctca

SEQ ID NO: 560690 - DNA, 25 bp, Mus musculus
gcgtaagtgtagctctgtgaaccga

SEQ ID NO: 560691 - DNA, 25 bp, Mus musculus
gcgtaagtgtaggtctgtgaaccga

SEQ ID NO: 560692 - DNA, 25 bp, Mus musculus
gcgtaagttacaagcctcatgccta

SEQ ID NO: 560693 - DNA, 25 bp, Mus musculus
gcgtaagttacatgcctcatgccta

SEQ ID NO: 560694 - DNA, 25 bp, Mus musculus
gcgtaatgtggcaagtcaagactgt

SEQ ID NO: 560695 - DNA, 25 bp, Mus musculus
gcgtaatgtggctagtcaagactgt

SEQ ID NO: 560696 - DNA, 25 bp, Mus musculus
gcgtaatttcatacaaagctctggt

SEQ ID NO: 560697 - DNA, 25 bp, Mus musculus
gcgtaatttcatcatagggcttttc

SEQ ID NO: 560698 - DNA, 25 bp, Mus musculus
gcgtaatttcatgatagggcttttc

SEQ ID NO: 560699 - DNA, 25 bp, Mus musculus
gcgtaatttcattcaaagctctggt

SEQ ID NO: 560700 - DNA, 25 bp, Mus musculus
gcgtaattttgccatcactttcttc

SEQ ID NO: 560701 - DNA, 25 bp, Mus musculus
gcgtaattttgcgatcactttcttc

SEQ ID NO: 560702 - DNA, 25 bp, Mus musculus
gcgtacaaataaagggtttccctgt

SEQ ID NO: 560703 - DNA, 25 bp, Mus musculus
gcgtacaaataatgggtttccctgt

SEQ ID NO: 560704 - DNA, 25 bp, Mus musculus
gcgtacaagcccattggatacctaa

SEQ ID NO: 560705 - DNA, 25 bp, Mus musculus
gcgtacaagccctttggatacctaa

SEQ ID NO: 560706 - DNA, 25 bp, Mus musculus
gcgtacaatgacaacgtccactaca

SEQ ID NO: 560707 - DNA, 25 bp, Mus musculus
gcgtacaatgactacgtccactaca

SEQ ID NO: 560708 - DNA, 25 bp, Mus musculus
gcgtacagacttatgctggctatct

SEQ ID NO: 560709 - DNA, 25 bp, Mus musculus
gcgtacagacttttgctggctatct

SEQ ID NO: 560710 - DNA, 25 bp, Mus musculus
gcgtacagcaagaccggcatctcat

SEQ ID NO: 560711 - DNA, 25 bp, Mus musculus
gcgtacagcaagtccggcatctcat

SEQ ID NO: 560712 - DNA, 25 bp, Mus musculus
gcgtacagccatattctgcattttt

SEQ ID NO: 560713 - DNA, 25 bp, Mus musculus
gcgtacagccattttctgcattttt

SEQ ID NO: 560714 - DNA, 25 bp, Mus musculus
gcgtacataaggcacaccaggaagg

SEQ ID NO: 560715 - DNA, 25 bp, Mus musculus
gcgtacataagggacaccaggaagg

SEQ ID NO: 560716 - DNA, 25 bp, Mus musculus
gcgtacatcgtcaccaagggtcagc

SEQ ID NO: 560717 - DNA, 25 bp, Mus musculus
gcgtacatcgtctccaagggtcagc

SEQ ID NO: 560718 - DNA, 25 bp, Mus musculus
gcgtacatggagcttgtgcattcat

SEQ ID NO: 560719 - DNA, 25 bp, Mus musculus
gcgtacatggaggttgtgcattcat

SEQ ID NO: 560720 - DNA, 25 bp, Mus musculus
gcgtacattgatccacgggcaaggc

SEQ ID NO: 560721 - DNA, 25 bp, Mus musculus
gcgtacattgatgcacgggcaaggc

SEQ ID NO: 560722 - DNA, 25 bp, Mus musculus
gcgtacccagaaccttttatacttc

SEQ ID NO: 560723 - DNA, 25 bp, Mus musculus
gcgtacccagaagcttttatacttc

SEQ ID NO: 560724 - DNA, 25 bp, Mus musculus
gcgtacccatgaacctggtaggcaa

SEQ ID NO: 560725 - DNA, 25 bp, Mus musculus
gcgtacccatgatcctggtaggcaa

SEQ ID NO: 560726 - DNA, 25 bp, Mus musculus
gcgtaccctgtacctagatcgtgag

SEQ ID NO: 560727 - DNA, 25 bp, Mus musculus
gcgtaccctgtagctagatcgtgag

SEQ ID NO: 560728 - DNA, 25 bp, Mus musculus
gcgtacctgcagaacaaccatcaaa

SEQ ID NO: 560729 - DNA, 25 bp, Mus musculus
gcgtacctgcagtacaaccatcaaa

SEQ ID NO: 560730 - DNA, 25 bp, Mus musculus
gcgtacgcccacaaatgtttgactg

SEQ ID NO: 560731 - DNA, 25 bp, Mus musculus
gcgtacgcccactaatgtttgactg

SEQ ID NO: 560732 - DNA, 25 bp, Mus musculus
gcgtacgcgagcagccggagctctt

SEQ ID NO: 560733 - DNA, 25 bp, Mus musculus
gcgtacgcgagctgccggagctctt

SEQ ID NO: 560734 - DNA, 25 bp, Mus musculus
gcgtacgctttgagtagcactgtgt

SEQ ID NO: 560735 - DNA, 25 bp, Mus musculus
gcgtacgctttgtgtagcactgtgt

SEQ ID NO: 560736 - DNA, 25 bp, Mus musculus
gcgtacgggtttctgctttggctta

SEQ ID NO: 560737 - DNA, 25 bp, Mus musculus
gcgtacgggtttgtgctttggctta

SEQ ID NO: 560738 - DNA, 25 bp, Mus musculus
gcgtacgttgcgcatactttcagta

SEQ ID NO: 560739 - DNA, 25 bp, Mus musculus
gcgtacgttgcggatactttcagta

SEQ ID NO: 560740 - DNA, 25 bp, Mus musculus
gcgtactacagtactaacttcccca

SEQ ID NO: 560741 - DNA, 25 bp, Mus musculus
gcgtactacagttctaacttcccca

SEQ ID NO: 560742 - DNA, 25 bp, Mus musculus
gcgtactcgaagaaatccaaactga

SEQ ID NO: 560743 - DNA, 25 bp, Mus musculus
gcgtactcgaagtaatccaaactga

SEQ ID NO: 560744 - DNA, 25 bp, Mus musculus
gcgtactgaagcatgtttcgcgagt

SEQ ID NO: 560745 - DNA, 25 bp, Mus musculus
gcgtactgaagcttgtttcgcgagt

SEQ ID NO: 560746 - DNA, 25 bp, Mus musculus
gcgtactgcagacggcgcccaatgc

SEQ ID NO: 560747 - DNA, 25 bp, Mus musculus
gcgtactgcagagggcgcccaatgc

SEQ ID NO: 560748 - DNA, 25 bp, Mus musculus
gcgtacttgccccagcattaagaag

SEQ ID NO: 560749 - DNA, 25 bp, Mus musculus
gcgtacttgcccgagcattaagaag

SEQ ID NO: 560750 - DNA, 25 bp, Mus musculus
gcgtacttgctgagccactttactg

SEQ ID NO: 560751 - DNA, 25 bp, Mus musculus
gcgtacttgctgtgccactttactg

SEQ ID NO: 560752 - DNA, 25 bp, Mus musculus
gcgtacttttggaatgagcatcgtg

SEQ ID NO: 560753 - DNA, 25 bp, Mus musculus
gcgtacttttggtatgagcatcgtg

SEQ ID NO: 560754 - DNA, 25 bp, Mus musculus
gcgtagaaaaagcacagctctggca

SEQ ID NO: 560755 - DNA, 25 bp, Mus musculus
gcgtagaaaaaggacagctctggca

SEQ ID NO: 560756 - DNA, 25 bp, Mus musculus
gcgtagaagccgaaagcgctatcgt

SEQ ID NO: 560757 - DNA, 25 bp, Mus musculus
gcgtagaagccgtaagcgctatcgt

SEQ ID NO: 560758 - DNA, 25 bp, Mus musculus
gcgtagacaaatctgcttcctgagt

SEQ ID NO: 560759 - DNA, 25 bp, Mus musculus
gcgtagacaaatgtgcttcctgagt

SEQ ID NO: 560760 - DNA, 25 bp, Mus musculus
gcgtagacaggacccgcgtgttcac

SEQ ID NO: 560761 - DNA, 25 bp, Mus musculus
gcgtagacaggagccgcgtgttcac

SEQ ID NO: 560762 - DNA, 25 bp, Mus musculus
gcgtagacggatccgcttggctctc

SEQ ID NO: 560763 - DNA, 25 bp, Mus musculus
gcgtagacggatgcgcttggctctc

SEQ ID NO: 560764 - DNA, 25 bp, Mus musculus
gcgtagacttacacttaactccttt

SEQ ID NO: 560765 - DNA, 25 bp, Mus musculus
gcgtagacttactcttaactccttt

SEQ ID NO: 560766 - DNA, 25 bp, Mus musculus
gcgtagatttttacactgtctcaga

SEQ ID NO: 560767 - DNA, 25 bp, Mus musculus
gcgtagattttttcactgtctcaga

SEQ ID NO: 560768 - DNA, 25 bp, Mus musculus
gcgtagcggttgagttgtaaagtct

SEQ ID NO: 560769 - DNA, 25 bp, Mus musculus
gcgtagcggttgtgttgtaaagtct

SEQ ID NO: 560770 - DNA, 25 bp, Mus musculus
gcgtagctattgaaaggctttgaac

SEQ ID NO: 560771 - DNA, 25 bp, Mus musculus
gcgtagctattgtaaggctttgaac

SEQ ID NO: 560772 - DNA, 25 bp, Mus musculus
gcgtaggcactgaatcccaagggtc

SEQ ID NO: 560773 - DNA, 25 bp, Mus musculus
gcgtaggcactgtatcccaagggtc

SEQ ID NO: 560774 - DNA, 25 bp, Mus musculus
gcgtagggcaggagtttcttctgaa

SEQ ID NO: 560775 - DNA, 25 bp, Mus musculus
gcgtagggcaggtgtttcttctgaa

SEQ ID NO: 560776 - DNA, 25 bp, Mus musculus
gcgtaggtgaatactctcgttgagt

SEQ ID NO: 560777 - DNA, 25 bp, Mus musculus
gcgtaggtgaattctctcgttgagt

SEQ ID NO: 560778 - DNA, 25 bp, Mus musculus
gcgtagtaaagaacagcggctgctc

SEQ ID NO: 560779 - DNA, 25 bp, Mus musculus
gcgtagtaaagatcagcggctgctc

SEQ ID NO: 560780 - DNA, 25 bp, Mus musculus
gcgtagtaccttactgttgacggcg

SEQ ID NO: 560781 - DNA, 25 bp, Mus musculus
gcgtagtacctttctgttgacggcg

SEQ ID NO: 560782 - DNA, 25 bp, Mus musculus
gcgtagtcacacctgggctgtcttg

SEQ ID NO: 560783 - DNA, 25 bp, Mus musculus
gcgtagtcacacgtgggctgtcttg

SEQ ID NO: 560784 - DNA, 25 bp, Mus musculus
gcgtagtgcagacaatgggtttatt

SEQ ID NO: 560785 - DNA, 25 bp, Mus musculus
gcgtagtgcagagaatgggtttatt

SEQ ID NO: 560786 - DNA, 25 bp, Mus musculus
gcgtagttaacgcttgaattccaca

SEQ ID NO: 560787 - DNA, 25 bp, Mus musculus
gcgtagttaacggttgaattccaca

SEQ ID NO: 560788 - DNA, 25 bp, Mus musculus
gcgtagttatggctcctgctaaagg

SEQ ID NO: 560789 - DNA, 25 bp, Mus musculus
gcgtagttatgggtcctgctaaagg

SEQ ID NO: 560790 - DNA, 25 bp, Mus musculus
gcgtataaatgcaataacacaggta

SEQ ID NO: 560791 - DNA, 25 bp, Mus musculus
gcgtataaatgctataacacaggta

SEQ ID NO: 560792 - DNA, 25 bp, Mus musculus
gcgtataacctcagtcggccgtggg

SEQ ID NO: 560793 - DNA, 25 bp, Mus musculus
gcgtataacctctgtcggccgtggg

SEQ ID NO: 560794 - DNA, 25 bp, Mus musculus
gcgtatacaggtacttgctaccctc

SEQ ID NO: 560795 - DNA, 25 bp, Mus musculus
gcgtatacaggttcttgctaccctc

SEQ ID NO: 560796 - DNA, 25 bp, Mus musculus
gcgtataccgttaattccagcattc

SEQ ID NO: 560797 - DNA, 25 bp, Mus musculus
gcgtataccgtttattccagcattc

SEQ ID NO: 560798 - DNA, 25 bp, Mus musculus
gcgtatatccaccatcttctgatga

SEQ ID NO: 560799 - DNA, 25 bp, Mus musculus
gcgtatatccacgatcttctgatga

SEQ ID NO: 560800 - DNA, 25 bp, Mus musculus
gcgtatatgcagaacaaatacacat

SEQ ID NO: 560801 - DNA, 25 bp, Mus musculus
gcgtatatgcagtacaaatacacat

SEQ ID NO: 560802 - DNA, 25 bp, Mus musculus
gcgtatccgtgaagagtttgtgagt

SEQ ID NO: 560803 - DNA, 25 bp, Mus musculus
gcgtatccgtgatgagtttgtgagt

SEQ ID NO: 560804 - DNA, 25 bp, Mus musculus
gcgtatcctggcctatgtgttccca

SEQ ID NO: 560805 - DNA, 25 bp, Mus musculus
gcgtatcctggcgtatgtgttccca

SEQ ID NO: 560806 - DNA, 25 bp, Mus musculus
gcgtatgatctcactgtggctttta

SEQ ID NO: 560807 - DNA, 25 bp, Mus musculus
gcgtatgatctctctgtggctttta

SEQ ID NO: 560808 - DNA, 25 bp, Mus musculus
gcgtatgcaatgaagcgggacctca

SEQ ID NO: 560809 - DNA, 25 bp, Mus musculus
gcgtatgcaatgtagcgggacctca

SEQ ID NO: 560810 - DNA, 25 bp, Mus musculus
gcgtatgccatcaccggttctaatt

SEQ ID NO: 560811 - DNA, 25 bp, Mus musculus
gcgtatgccatctccggttctaatt

SEQ ID NO: 560812 - DNA, 25 bp, Mus musculus
gcgtatgcggaaatgtgtctcctta

SEQ ID NO: 560813 - DNA, 25 bp, Mus musculus
gcgtatgcggaattgtgtctcctta

SEQ ID NO: 560814 - DNA, 25 bp, Mus musculus
gcgtatgctcatctcgcagattcat

SEQ ID NO: 560815 - DNA, 25 bp, Mus musculus
gcgtatgctcatgtcgcagattcat

SEQ ID NO: 560816 - DNA, 25 bp, Mus musculus
gcgtatgtacagaaagcttgcacac

SEQ ID NO: 560817 - DNA, 25 bp, Mus musculus
gcgtatgtacagtaagcttgcacac

SEQ ID NO: 560818 - DNA, 25 bp, Mus musculus
gcgtatgtacatagtcacagagcaa

SEQ ID NO: 560819 - DNA, 25 bp, Mus musculus
gcgtatgtacattgtcacagagcaa

SEQ ID NO: 560820 - DNA, 25 bp, Mus musculus
gcgtatgtcagtccaggtgtttcca

SEQ ID NO: 560821 - DNA, 25 bp, Mus musculus
gcgtatgtcagtgcaggtgtttcca

SEQ ID NO: 560822 - DNA, 25 bp, Mus musculus
gcgtatgtcatgaaacaggtcccta

SEQ ID NO: 560823 - DNA, 25 bp, Mus musculus
gcgtatgtcatgtaacaggtcccta

SEQ ID NO: 560824 - DNA, 25 bp, Mus musculus
gcgtattattctaacatgtccaaat

SEQ ID NO: 560825 - DNA, 25 bp, Mus musculus
gcgtattattcttacatgtccaaat

SEQ ID NO: 560826 - DNA, 25 bp, Mus musculus
gcgtattcatggataagttcccact

SEQ ID NO: 560827 - DNA, 25 bp, Mus musculus
gcgtattcatggttaagttcccact

SEQ ID NO: 560828 - DNA, 25 bp, Mus musculus
gcgtattcattgagtctgttccaga

SEQ ID NO: 560829 - DNA, 25 bp, Mus musculus
gcgtattcattgtgtctgttccaga

SEQ ID NO: 560830 - DNA, 25 bp, Mus musculus
gcgtattcatttataatccagactt

SEQ ID NO: 560831 - DNA, 25 bp, Mus musculus
gcgtattcatttttaatccagactt

SEQ ID NO: 560832 - DNA, 25 bp, Mus musculus
gcgtattctatcatgtggactgcat

SEQ ID NO: 560833 - DNA, 25 bp, Mus musculus
gcgtattctatcttgtggactgcat

SEQ ID NO: 560834 - DNA, 25 bp, Mus musculus
gcgtattgacgacctgtgtctgagt

SEQ ID NO: 560835 - DNA, 25 bp, Mus musculus
gcgtattgacgagctgtgtctgagt

SEQ ID NO: 560836 - DNA, 25 bp, Mus musculus
gcgtattgagcacattaagcactct

SEQ ID NO: 560837 - DNA, 25 bp, Mus musculus
gcgtattgagcagattaagcactct

SEQ ID NO: 560838 - DNA, 25 bp, Mus musculus
gcgtatttaccaagcttcgtgggaa

SEQ ID NO: 560839 - DNA, 25 bp, Mus musculus
gcgtatttaccatgcttcgtgggaa

SEQ ID NO: 560840 - DNA, 25 bp, Mus musculus
gcgtatttccttagctcattatcca

SEQ ID NO: 560841 - DNA, 25 bp, Mus musculus
gcgtatttcctttgctcattatcca

SEQ ID NO: 560842 - DNA, 25 bp, Mus musculus
gcgtattttctgcagttcgttttat

SEQ ID NO: 560843 - DNA, 25 bp, Mus musculus
gcgtattttctggagttcgttttat

SEQ ID NO: 560844 - DNA, 25 bp, Mus musculus
gcgtattttgggaggaagtattact

SEQ ID NO: 560845 - DNA, 25 bp, Mus musculus
gcgtattttgggtggaagtattact

SEQ ID NO: 560846 - DNA, 25 bp, Mus musculus
gcgtcaaaagcccattacactgtat

SEQ ID NO: 560847 - DNA, 25 bp, Mus musculus
gcgtcaaaagccgattacactgtat

SEQ ID NO: 560848 - DNA, 25 bp, Mus musculus
gcgtcaacaggtaacacttccgctg

SEQ ID NO: 560849 - DNA, 25 bp, Mus musculus
gcgtcaacaggttacacttccgctg

SEQ ID NO: 560850 - DNA, 25 bp, Mus musculus
gcgtcaacttccaggagcgagtgtt

SEQ ID NO: 560851 - DNA, 25 bp, Mus musculus
gcgtcaacttcctggagcgagtgtt

SEQ ID NO: 560852 - DNA, 25 bp, Mus musculus
gcgtcaaggaaacgctccggcctga

SEQ ID NO: 560853 - DNA, 25 bp, Mus musculus
gcgtcaaggaaaggctccggcctga

SEQ ID NO: 560854 - DNA, 25 bp, Mus musculus
gcgtcaatttccagggcctgtacct

SEQ ID NO: 560855 - DNA, 25 bp, Mus musculus
gcgtcaatttcctgggcctgtacct

SEQ ID NO: 560856 - DNA, 25 bp, Mus musculus
gcgtcacagtcgctgaagccaaaat

SEQ ID NO: 560857 - DNA, 25 bp, Mus musculus
gcgtcacagtcggtgaagccaaaat

SEQ ID NO: 560858 - DNA, 25 bp, Mus musculus
gcgtcacagtgtcgagacctcagga

SEQ ID NO: 560859 - DNA, 25 bp, Mus musculus
gcgtcacagtgtggagacctcagga

SEQ ID NO: 560860 - DNA, 25 bp, Mus musculus
gcgtcaccatttccctttaatgtca

SEQ ID NO: 560861 - DNA, 25 bp, Mus musculus
gcgtcaccatttgcctttaatgtca

SEQ ID NO: 560862 - DNA, 25 bp, Mus musculus
gcgtcaccgcaaatggtacattcag

SEQ ID NO: 560863 - DNA, 25 bp, Mus musculus
gcgtcaccgcaattggtacattcag

SEQ ID NO: 560864 - DNA, 25 bp, Mus musculus
gcgtcacctgcaactgtatttgcaa

SEQ ID NO: 560865 - DNA, 25 bp, Mus musculus
gcgtcacctgcatctgtatttgcaa

SEQ ID NO: 560866 - DNA, 25 bp, Mus musculus
gcgtcacgctaccagtgtgctgcag

SEQ ID NO: 560867 - DNA, 25 bp, Mus musculus
gcgtcacgctacgagtgtgctgcag

SEQ ID NO: 560868 - DNA, 25 bp, Mus musculus
gcgtcactagccctaaactctaaga

SEQ ID NO: 560869 - DNA, 25 bp, Mus musculus
gcgtcactagccgtaaactctaaga

SEQ ID NO: 560870 - DNA, 25 bp, Mus musculus
gcgtcactccagaaacaagcatctc

SEQ ID NO: 560871 - DNA, 25 bp, Mus musculus
gcgtcactccagtaacaagcatctc

SEQ ID NO: 560872 - DNA, 25 bp, Mus musculus
gcgtcactgtacaggcggcacaaat

SEQ ID NO: 560873 - DNA, 25 bp, Mus musculus
gcgtcactgtactggcggcacaaat

SEQ ID NO: 560874 - DNA, 25 bp, Mus musculus
gcgtcagaaactagcttacagggtg

SEQ ID NO: 560875 - DNA, 25 bp, Mus musculus
gcgtcagaaacttgcttacagggtg

SEQ ID NO: 560876 - DNA, 25 bp, Mus musculus
gcgtcagaaagcagtccaccgatct

SEQ ID NO: 560877 - DNA, 25 bp, Mus musculus
gcgtcagaaagctgtccaccgatct

SEQ ID NO: 560878 - DNA, 25 bp, Mus musculus
gcgtcagatctgactccaggacaat

SEQ ID NO: 560879 - DNA, 25 bp, Mus musculus
gcgtcagatctgtctccaggacaat

SEQ ID NO: 560880 - DNA, 25 bp, Mus musculus
gcgtcagatttacagcttatgctag

SEQ ID NO: 560881 - DNA, 25 bp, Mus musculus
gcgtcagatttagagcttatgctag

SEQ ID NO: 560882 - DNA, 25 bp, Mus musculus
gcgtcagcctgtcaactatttcttg

SEQ ID NO: 560883 - DNA, 25 bp, Mus musculus
gcgtcagcctgtgaactatttcttg

SEQ ID NO: 560884 - DNA, 25 bp, Mus musculus
gcgtcagctcttctaaaccagtgtg

SEQ ID NO: 560885 - DNA, 25 bp, Mus musculus
gcgtcagctcttgtaaaccagtgtg

SEQ ID NO: 560886 - DNA, 25 bp, Mus musculus
gcgtcagctgtaattttgatcaaaa

SEQ ID NO: 560887 - DNA, 25 bp, Mus musculus
gcgtcagctgtatttttgatcaaaa

SEQ ID NO: 560888 - DNA, 25 bp, Mus musculus
gcgtcaggcagaatcttcacaagtg

SEQ ID NO: 560889 - DNA, 25 bp, Mus musculus
gcgtcaggcagattcttcacaagtg

SEQ ID NO: 560890 - DNA, 25 bp, Mus musculus
gcgtcaggtttcattacagatgttt

SEQ ID NO: 560891 - DNA, 25 bp, Mus musculus
gcgtcaggtttctttacagatgttt

SEQ ID NO: 560892 - DNA, 25 bp, Mus musculus
gcgtcagtcaaaacacagacctgta

SEQ ID NO: 560893 - DNA, 25 bp, Mus musculus
gcgtcagtcaaatcacagacctgta

SEQ ID NO: 560894 - DNA, 25 bp, Mus musculus
gcgtcagtgattctcacacatcgct

SEQ ID NO: 560895 - DNA, 25 bp, Mus musculus
gcgtcagtgattgtcacacatcgct

SEQ ID NO: 560896 - DNA, 25 bp, Mus musculus
gcgtcagtgctcactgccaaaggga

SEQ ID NO: 560897 - DNA, 25 bp, Mus musculus
gcgtcagtgctctctgccaaaggga

SEQ ID NO: 560898 - DNA, 25 bp, Mus musculus
gcgtcataaccccttcaatgaggag

SEQ ID NO: 560899 - DNA, 25 bp, Mus musculus
gcgtcataacccgttcaatgaggag

SEQ ID NO: 560900 - DNA, 25 bp, Mus musculus
gcgtcatggtgtcccaccgatctgg

SEQ ID NO: 560901 - DNA, 25 bp, Mus musculus
gcgtcatggtgtgccaccgatctgg

SEQ ID NO: 560902 - DNA, 25 bp, Mus musculus
gcgtcatgttggatctcaccagtga

SEQ ID NO: 560903 - DNA, 25 bp, Mus musculus
gcgtcatgttggttctcaccagtga

SEQ ID NO: 560904 - DNA, 25 bp, Mus musculus
gcgtcatgtttaccaactgtatgca

SEQ ID NO: 560905 - DNA, 25 bp, Mus musculus
gcgtcatgtttagcaactgtatgca

SEQ ID NO: 560906 - DNA, 25 bp, Mus musculus
gcgtcattcaagaagctccgttagc

SEQ ID NO: 560907 - DNA, 25 bp, Mus musculus
gcgtcattcaagtagctccgttagc

SEQ ID NO: 560908 - DNA, 25 bp, Mus musculus
gcgtcatttcagatgcagactgctg

SEQ ID NO: 560909 - DNA, 25 bp, Mus musculus
gcgtcatttcagttgcagactgctg

SEQ ID NO: 560910 - DNA, 25 bp, Mus musculus
gcgtcatttctcaatggacactcta

SEQ ID NO: 560911 - DNA, 25 bp, Mus musculus
gcgtcatttctctatggacactcta

SEQ ID NO: 560912 - DNA, 25 bp, Mus musculus
gcgtcatttggcagctacttgctta

SEQ ID NO: 560913 - DNA, 25 bp, Mus musculus
gcgtcatttggctgctacttgctta

SEQ ID NO: 560914 - DNA, 25 bp, Mus musculus
gcgtccacacacatacagcttcctc

SEQ ID NO: 560915 - DNA, 25 bp, Mus musculus
gcgtccacacacttacagcttcctc

SEQ ID NO: 560916 - DNA, 25 bp, Mus musculus
gcgtccacgtatatctccatgtgaa

SEQ ID NO: 560917 - DNA, 25 bp, Mus musculus
gcgtccacgtatttctccatgtgaa

SEQ ID NO: 560918 - DNA, 25 bp, Mus musculus
gcgtccactgtgcagcactttcaga

SEQ ID NO: 560919 - DNA, 25 bp, Mus musculus
gcgtccactgtggagcactttcaga

SEQ ID NO: 560920 - DNA, 25 bp, Mus musculus
gcgtccaggcatatctcttagtgga

SEQ ID NO: 560921 - DNA, 25 bp, Mus musculus
gcgtccaggcatttctcttagtgga

SEQ ID NO: 560922 - DNA, 25 bp, Mus musculus
gcgtccagtatcagcatgtgttaca

SEQ ID NO: 560923 - DNA, 25 bp, Mus musculus
gcgtccagtatctgcatgtgttaca

SEQ ID NO: 560924 - DNA, 25 bp, Mus musculus
gcgtccatcagtatgaatctccggg

SEQ ID NO: 560925 - DNA, 25 bp, Mus musculus
gcgtccatcagtttgaatctccggg

SEQ ID NO: 560926 - DNA, 25 bp, Mus musculus
gcgtcccagcagctcagtgtgatta

SEQ ID NO: 560927 - DNA, 25 bp, Mus musculus
gcgtcccagcaggtcagtgtgatta

SEQ ID NO: 560928 - DNA, 25 bp, Mus musculus
gcgtccccagacattattccataat

SEQ ID NO: 560929 - DNA, 25 bp, Mus musculus
gcgtccccagactttattccataat

SEQ ID NO: 560930 - DNA, 25 bp, Mus musculus
gcgtccctatcaagtacttatctaa

SEQ ID NO: 560931 - DNA, 25 bp, Mus musculus
gcgtccctatcatgtacttatctaa

SEQ ID NO: 560932 - DNA, 25 bp, Mus musculus
gcgtccctatccagggattcaagaa

SEQ ID NO: 560933 - DNA, 25 bp, Mus musculus
gcgtccctatcctgggattcaagaa

SEQ ID NO: 560934 - DNA, 25 bp, Mus musculus
gcgtccctcaacattcaacaggtaa

SEQ ID NO: 560935 - DNA, 25 bp, Mus musculus
gcgtccctcaactttcaacaggtaa

SEQ ID NO: 560936 - DNA, 25 bp, Mus musculus
gcgtccctcctgcatgtactgactg

SEQ ID NO: 560937 - DNA, 25 bp, Mus musculus
gcgtccctcctggatgtactgactg

SEQ ID NO: 560938 - DNA, 25 bp, Mus musculus
gcgtcccttgtcaattcccaaataa

SEQ ID NO: 560939 - DNA, 25 bp, Mus musculus
gcgtcccttgtctattcccaaataa

SEQ ID NO: 560940 - DNA, 25 bp, Mus musculus
gcgtccgaaccacctcagatggagg

SEQ ID NO: 560941 - DNA, 25 bp, Mus musculus
gcgtccgaaccagctcagatggagg

SEQ ID NO: 560942 - DNA, 25 bp, Mus musculus
gcgtccgcatcccacaggaagggaa

SEQ ID NO: 560943 - DNA, 25 bp, Mus musculus
gcgtccgcatccgacaggaagggaa

SEQ ID NO: 560944 - DNA, 25 bp, Mus musculus
gcgtccgggtacctggaattatcta

SEQ ID NO: 560945 - DNA, 25 bp, Mus musculus
gcgtccgggtacgtggaattatcta

SEQ ID NO: 560946 - DNA, 25 bp, Mus musculus
gcgtcctaactaaaattttggtgct

SEQ ID NO: 560947 - DNA, 25 bp, Mus musculus
gcgtcctaactataattttggtgct

SEQ ID NO: 560948 - DNA, 25 bp, Mus musculus
gcgtcctcagaacagccaaatcgaa

SEQ ID NO: 560949 - DNA, 25 bp, Mus musculus
gcgtcctcagaagagccaaatcgaa

SEQ ID NO: 560950 - DNA, 25 bp, Mus musculus
gcgtcctccttactgtacatagcag

SEQ ID NO: 560951 - DNA, 25 bp, Mus musculus
gcgtcctccttagtgtacatagcag

SEQ ID NO: 560952 - DNA, 25 bp, Mus musculus
gcgtcctctgtgcagtcactagata

SEQ ID NO: 560953 - DNA, 25 bp, Mus musculus
gcgtcctctgtggagtcactagata

SEQ ID NO: 560954 - DNA, 25 bp, Mus musculus
gcgtcctgagttaattttggttctt

SEQ ID NO: 560955 - DNA, 25 bp, Mus musculus
gcgtcctgagtttattttggttctt

SEQ ID NO: 560956 - DNA, 25 bp, Mus musculus
gcgtcctggattctgtcgtcaatgg

SEQ ID NO: 560957 - DNA, 25 bp, Mus musculus
gcgtcctggattgtgtcgtcaatgg

SEQ ID NO: 560958 - DNA, 25 bp, Mus musculus
gcgtccttatgaatgttttgaccat

SEQ ID NO: 560959 - DNA, 25 bp, Mus musculus
gcgtccttatgattgttttgaccat

SEQ ID NO: 560960 - DNA, 25 bp, Mus musculus
gcgtccttcagtctatctccaaaga

SEQ ID NO: 560961 - DNA, 25 bp, Mus musculus
gcgtccttcagtgtatctccaaaga

SEQ ID NO: 560962 - DNA, 25 bp, Mus musculus
gcgtccttcccacttaacattttct

SEQ ID NO: 560963 - DNA, 25 bp, Mus musculus
gcgtccttcccagttaacattttct

SEQ ID NO: 560964 - DNA, 25 bp, Mus musculus
gcgtccttctcactcttatcttgag

SEQ ID NO: 560965 - DNA, 25 bp, Mus musculus
gcgtccttctcagtcttatcttgag

SEQ ID NO: 560966 - DNA, 25 bp, Mus musculus
gcgtccttgcagaacattactcaga

SEQ ID NO: 560967 - DNA, 25 bp, Mus musculus
gcgtccttgcagtacattactcaga

SEQ ID NO: 560968 - DNA, 25 bp, Mus musculus
gcgtcgacctctatgtcctggagaa

SEQ ID NO: 560969 - DNA, 25 bp, Mus musculus
gcgtcgacctctttgtcctggagaa

SEQ ID NO: 560970 - DNA, 25 bp, Mus musculus
gcgtcgatactaccacggcaatgga

SEQ ID NO: 560971 - DNA, 25 bp, Mus musculus
gcgtcgatactagcacggcaatgga

SEQ ID NO: 560972 - DNA, 25 bp, Mus musculus
gcgtcgcacgtaaatttgcagtgag

SEQ ID NO: 560973 - DNA, 25 bp, Mus musculus
gcgtcgcacgtatatttgcagtgag

SEQ ID NO: 560974 - DNA, 25 bp, Mus musculus
gcgtcgccatgcctcggaaaattga

SEQ ID NO: 560975 - DNA, 25 bp, Mus musculus
gcgtcgccatgcgtcggaaaattga

SEQ ID NO: 560976 - DNA, 25 bp, Mus musculus
gcgtcggagcgcaagtacggagtgg

SEQ ID NO: 560977 - DNA, 25 bp, Mus musculus
gcgtcggagcgctagtacggagtgg

SEQ ID NO: 560978 - DNA, 25 bp, Mus musculus
gcgtcggagtcaagctaggttttat

SEQ ID NO: 560979 - DNA, 25 bp, Mus musculus
gcgtcggagtcatgctaggttttat

SEQ ID NO: 560980 - DNA, 25 bp, Mus musculus
gcgtcggccataagcagcgccacgg

SEQ ID NO: 560981 - DNA, 25 bp, Mus musculus
gcgtcggccatatgcagcgccacgg

SEQ ID NO: 560982 - DNA, 25 bp, Mus musculus
gcgtcggccgtacgaggtaactcca

SEQ ID NO: 560983 - DNA, 25 bp, Mus musculus
gcgtcggccgtaggaggtaactcca

SEQ ID NO: 560984 - DNA, 25 bp, Mus musculus
gcgtcggtgacaaggttgcgagtga

SEQ ID NO: 560985 - DNA, 25 bp, Mus musculus
gcgtcggtgacatggttgcgagtga

SEQ ID NO: 560986 - DNA, 25 bp, Mus musculus
gcgtcggttagacgctgcatatact

SEQ ID NO: 560987 - DNA, 25 bp, Mus musculus
gcgtcggttagaggctgcatatact

SEQ ID NO: 560988 - DNA, 25 bp, Mus musculus
gcgtcgtctgttatcatgcacaatc

SEQ ID NO: 560989 - DNA, 25 bp, Mus musculus
gcgtcgtctgttttcatgcacaatc

SEQ ID NO: 560990 - DNA, 25 bp, Mus musculus
gcgtcgtgaccaacaacagggtgat

SEQ ID NO: 560991 - DNA, 25 bp, Mus musculus
gcgtcgtgaccatcaacagggtgat

SEQ ID NO: 560992 - DNA, 25 bp, Mus musculus
gcgtcgttacggattttgtttcatt

SEQ ID NO: 560993 - DNA, 25 bp, Mus musculus
gcgtcgttacggtttttgtttcatt

SEQ ID NO: 560994 - DNA, 25 bp, Mus musculus
gcgtcgttcacacggtgaaagccta

SEQ ID NO: 560995 - DNA, 25 bp, Mus musculus
gcgtcgttcacagggtgaaagccta

SEQ ID NO: 560996 - DNA, 25 bp, Mus musculus
gcgtctacactcaagtctgcaagta

SEQ ID NO: 560997 - DNA, 25 bp, Mus musculus
gcgtctacactctagtctgcaagta

SEQ ID NO: 560998 - DNA, 25 bp, Mus musculus
gcgtctacacttccgaaaagccatg

SEQ ID NO: 560999 - DNA, 25 bp, Mus musculus
gcgtctacacttgcgaaaagccatg

SEQ ID NO: 561000 - DNA, 25 bp, Mus musculus
gcgtctactctaacaaaacatcaca

SEQ ID NO: 561001 - DNA, 25 bp, Mus musculus
gcgtctactctatcaaaacatcaca

SEQ ID NO: 561002 - DNA, 25 bp, Mus musculus
gcgtctataccccagtgtcatccta

SEQ ID NO: 561003 - DNA, 25 bp, Mus musculus
gcgtctatacccgagtgtcatccta

SEQ ID NO: 561004 - DNA, 25 bp, Mus musculus
gcgtctataccgaggagagtggaac

SEQ ID NO: 561005 - DNA, 25 bp, Mus musculus
gcgtctataccgtggagagtggaac

SEQ ID NO: 561006 - DNA, 25 bp, Mus musculus
gcgtctataggcaatgtcactggaa

SEQ ID NO: 561007 - DNA, 25 bp, Mus musculus
gcgtctataggctatgtcactggaa

SEQ ID NO: 561008 - DNA, 25 bp, Mus musculus
gcgtctatgcctctatggtgttcca

SEQ ID NO: 561009 - DNA, 25 bp, Mus musculus
gcgtctatgcctgtatggtgttcca

SEQ ID NO: 561010 - DNA, 25 bp, Mus musculus
gcgtctatggtcagtgaagctgctg

SEQ ID NO: 561011 - DNA, 25 bp, Mus musculus
gcgtctatggtctgtgaagctgctg

SEQ ID NO: 561012 - DNA, 25 bp, Mus musculus
gcgtctatttctccagttgtcttaa

SEQ ID NO: 561013 - DNA, 25 bp, Mus musculus
gcgtctatttctgcagttgtcttaa

SEQ ID NO: 561014 - DNA, 25 bp, Mus musculus
gcgtctcagctacggtttctattgc

SEQ ID NO: 561015 - DNA, 25 bp, Mus musculus
gcgtctcagctagggtttctattgc

SEQ ID NO: 561016 - DNA, 25 bp, Mus musculus
gcgtctcataatacctacctgatag

SEQ ID NO: 561017 - DNA, 25 bp, Mus musculus
gcgtctcataattcctacctgatag

SEQ ID NO: 561018 - DNA, 25 bp, Mus musculus
gcgtctcatcgcatatgctcttaga

SEQ ID NO: 561019 - DNA, 25 bp, Mus musculus
gcgtctcatcgcttatgctcttaga

SEQ ID NO: 561020 - DNA, 25 bp, Mus musculus
gcgtctccaagaaggtgccagcaaa

SEQ ID NO: 561021 - DNA, 25 bp, Mus musculus
gcgtctccaagatggtgccagcaaa

SEQ ID NO: 561022 - DNA, 25 bp, Mus musculus
gcgtctccagagataggcagtattc

SEQ ID NO: 561023 - DNA, 25 bp, Mus musculus
gcgtctccagagttaggcagtattc

SEQ ID NO: 561024 - DNA, 25 bp, Mus musculus
gcgtctccaggtctatagcagcagg

SEQ ID NO: 561025 - DNA, 25 bp, Mus musculus
gcgtctccaggtgtatagcagcagg

SEQ ID NO: 561026 - DNA, 25 bp, Mus musculus
gcgtctccagtgctgggttaatgct

SEQ ID NO: 561027 - DNA, 25 bp, Mus musculus
gcgtctccagtggtgggttaatgct

SEQ ID NO: 561028 - DNA, 25 bp, Mus musculus
gcgtctcccacgatttcgaatatat

SEQ ID NO: 561029 - DNA, 25 bp, Mus musculus
gcgtctcccacgttttcgaatatat

SEQ ID NO: 561030 - DNA, 25 bp, Mus musculus
gcgtctccctcgcaagtgcgccaga

SEQ ID NO: 561031 - DNA, 25 bp, Mus musculus
gcgtctccctcggaagtgcgccaga

SEQ ID NO: 561032 - DNA, 25 bp, Mus musculus
gcgtctccgaagcactcagagctaa

SEQ ID NO: 561033 - DNA, 25 bp, Mus musculus
gcgtctccgaaggactcagagctaa

SEQ ID NO: 561034 - DNA, 25 bp, Mus musculus
gcgtctccgtggaatgaattccatc

SEQ ID NO: 561035 - DNA, 25 bp, Mus musculus
gcgtctccgtggtatgaattccatc

SEQ ID NO: 561036 - DNA, 25 bp, Mus musculus
gcgtctcctcaacttgcagaacgaa

SEQ ID NO: 561037 - DNA, 25 bp, Mus musculus
gcgtctcctcaagttgcagaacgaa

SEQ ID NO: 561038 - DNA, 25 bp, Mus musculus
gcgtctcgtcgcctggctaggaact

SEQ ID NO: 561039 - DNA, 25 bp, Mus musculus
gcgtctcgtcgcgtggctaggaact

SEQ ID NO: 561040 - DNA, 25 bp, Mus musculus
gcgtctctacttagatatcctactt

SEQ ID NO: 561041 - DNA, 25 bp, Mus musculus
gcgtctctactttgatatcctactt

SEQ ID NO: 561042 - DNA, 25 bp, Mus musculus
gcgtctctcaccagtagacaatacg

SEQ ID NO: 561043 - DNA, 25 bp, Mus musculus
gcgtctctcacctgtagacaatacg

SEQ ID NO: 561044 - DNA, 25 bp, Mus musculus
gcgtctctcccaatatcgataataa

SEQ ID NO: 561045 - DNA, 25 bp, Mus musculus
gcgtctctcccattatcgataataa

SEQ ID NO: 561046 - DNA, 25 bp, Mus musculus
gcgtctctgcgtcagcacagatgca

SEQ ID NO: 561047 - DNA, 25 bp, Mus musculus
gcgtctctgcgtgagcacagatgca

SEQ ID NO: 561048 - DNA, 25 bp, Mus musculus
gcgtctgaaggaaatcgttctctaa

SEQ ID NO: 561049 - DNA, 25 bp, Mus musculus
gcgtctgaaggatatcgttctctaa

SEQ ID NO: 561050 - DNA, 25 bp, Mus musculus
gcgtctgacaggcaaaatgattctc

SEQ ID NO: 561051 - DNA, 25 bp, Mus musculus
gcgtctgacagggaaaatgattctc

SEQ ID NO: 561052 - DNA, 25 bp, Mus musculus
gcgtctgacattagcatatttaggt

SEQ ID NO: 561053 - DNA, 25 bp, Mus musculus
gcgtctgacatttgcatatttaggt

SEQ ID NO: 561054 - DNA, 25 bp, Mus musculus
gcgtctgacttcattgagtgcactg

SEQ ID NO: 561055 - DNA, 25 bp, Mus musculus
gcgtctgacttctttgagtgcactg

SEQ ID NO: 561056 - DNA, 25 bp, Mus musculus
gcgtctgcagatctcttcatcaaaa

SEQ ID NO: 561057 - DNA, 25 bp, Mus musculus
gcgtctgcagatgtcttcatcaaaa

SEQ ID NO: 561058 - DNA, 25 bp, Mus musculus
gcgtctgcggtcatcagcattttaa

SEQ ID NO: 561059 - DNA, 25 bp, Mus musculus
gcgtctgcggtcttcagcattttaa

SEQ ID NO: 561060 - DNA, 25 bp, Mus musculus
gcgtctggagtaaaagcctatcaag

SEQ ID NO: 561061 - DNA, 25 bp, Mus musculus
gcgtctggagtataagcctatcaag

SEQ ID NO: 561062 - DNA, 25 bp, Mus musculus
gcgtctggatgaactgcactatctt

SEQ ID NO: 561063 - DNA, 25 bp, Mus musculus
gcgtctggatgatctgcactatctt

SEQ ID NO: 561064 - DNA, 25 bp, Mus musculus
gcgtctggcaaaatcttgtatttct

SEQ ID NO: 561065 - DNA, 25 bp, Mus musculus
gcgtctggcaaattcttgtatttct

SEQ ID NO: 561066 - DNA, 25 bp, Mus musculus
gcgtctgggcaacacctgcaggcga

SEQ ID NO: 561067 - DNA, 25 bp, Mus musculus
gcgtctgggcaagacctgcaggcga

SEQ ID NO: 561068 - DNA, 25 bp, Mus musculus
gcgtctgggtaaagacttcaacaac

SEQ ID NO: 561069 - DNA, 25 bp, Mus musculus
gcgtctgggtaatgacttcaacaac

SEQ ID NO: 561070 - DNA, 25 bp, Mus musculus
gcgtctgtcctgagagtgatgttta

SEQ ID NO: 561071 - DNA, 25 bp, Mus musculus
gcgtctgtcctgtgagtgatgttta

SEQ ID NO: 561072 - DNA, 25 bp, Mus musculus
gcgtctgtctatcggagaaggtaca

SEQ ID NO: 561073 - DNA, 25 bp, Mus musculus
gcgtctgtctatgggagaaggtaca

SEQ ID NO: 561074 - DNA, 25 bp, Mus musculus
gcgtctgtgaaaaccaagcctagga

SEQ ID NO: 561075 - DNA, 25 bp, Mus musculus
gcgtctgtgaaatccaagcctagga

SEQ ID NO: 561076 - DNA, 25 bp, Mus musculus
gcgtctgtgacaaataaccctatct

SEQ ID NO: 561077 - DNA, 25 bp, Mus musculus
gcgtctgtgacatataaccctatct

SEQ ID NO: 561078 - DNA, 25 bp, Mus musculus
gcgtctgtggcaccagctagctgca

SEQ ID NO: 561079 - DNA, 25 bp, Mus musculus
gcgtctgtggcagcagctagctgca

SEQ ID NO: 561080 - DNA, 25 bp, Mus musculus
gcgtctgttactcgccctgggatta

SEQ ID NO: 561081 - DNA, 25 bp, Mus musculus
gcgtctgttactggccctgggatta

SEQ ID NO: 561082 - DNA, 25 bp, Mus musculus
gcgtctgttcatagtcatcttttga

SEQ ID NO: 561083 - DNA, 25 bp, Mus musculus
gcgtctgttcattgtcatcttttga

SEQ ID NO: 561084 - DNA, 25 bp, Mus musculus
gcgtctgttgctccttagtgtctgg

SEQ ID NO: 561085 - DNA, 25 bp, Mus musculus
gcgtctgttgctgcttagtgtctgg

SEQ ID NO: 561086 - DNA, 25 bp, Mus musculus
gcgtcttagcatcaaaagcttacca

SEQ ID NO: 561087 - DNA, 25 bp, Mus musculus
gcgtcttagcatgaaaagcttacca

SEQ ID NO: 561088 - DNA, 25 bp, Mus musculus
gcgtcttcagaacagcctccggagc

SEQ ID NO: 561089 - DNA, 25 bp, Mus musculus
gcgtcttcagaagagcctccggagc

SEQ ID NO: 561090 - DNA, 25 bp, Mus musculus
gcgtcttccagaaggagaacttcca

SEQ ID NO: 561091 - DNA, 25 bp, Mus musculus
gcgtcttccagatggagaacttcca

SEQ ID NO: 561092 - DNA, 25 bp, Mus musculus
gcgtcttctagaacaggacaggact

SEQ ID NO: 561093 - DNA, 25 bp, Mus musculus
gcgtcttctagatcaggacaggact

SEQ ID NO: 561094 - DNA, 25 bp, Mus musculus
gcgtcttctataaggccagccaggt

SEQ ID NO: 561095 - DNA, 25 bp, Mus musculus
gcgtcttctatatggccagccaggt

SEQ ID NO: 561096 - DNA, 25 bp, Mus musculus
gcgtcttctcctcatggattagtta

SEQ ID NO: 561097 - DNA, 25 bp, Mus musculus
gcgtcttctcctgatggattagtta

SEQ ID NO: 561098 - DNA, 25 bp, Mus musculus
gcgtcttggatcctgagatctgtgc

SEQ ID NO: 561099 - DNA, 25 bp, Mus musculus
gcgtcttggatcgtgagatctgtgc

SEQ ID NO: 561100 - DNA, 25 bp, Mus musculus
gcgtcttgtgttaagctttttgtga

SEQ ID NO: 561101 - DNA, 25 bp, Mus musculus
gcgtcttgtgtttagctttttgtga

SEQ ID NO: 561102 - DNA, 25 bp, Mus musculus
gcgtctttcagacatggcccaggag

SEQ ID NO: 561103 - DNA, 25 bp, Mus musculus
gcgtctttcagagatggcccaggag

SEQ ID NO: 561104 - DNA, 25 bp, Mus musculus
gcgtctttcatgcttactgttcatc

SEQ ID NO: 561105 - DNA, 25 bp, Mus musculus
gcgtctttcatggttactgttcatc

SEQ ID NO: 561106 - DNA, 25 bp, Mus musculus
gcgtctttgacaactctaatttgga

SEQ ID NO: 561107 - DNA, 25 bp, Mus musculus
gcgtctttgacatctctaatttgga

SEQ ID NO: 561108 - DNA, 25 bp, Mus musculus
gcgtctttgagaattactatgtcct

SEQ ID NO: 561109 - DNA, 25 bp, Mus musculus
gcgtctttgagatttactatgtcct

SEQ ID NO: 561110 - DNA, 25 bp, Mus musculus
gcgtctttggaactaattcctcaca

SEQ ID NO: 561111 - DNA, 25 bp, Mus musculus
gcgtctttggaagtaattcctcaca

SEQ ID NO: 561112 - DNA, 25 bp, Mus musculus
gcgtcttttgctcgcacatgcacaa

SEQ ID NO: 561113 - DNA, 25 bp, Mus musculus
gcgtcttttgctggcacatgcacaa

SEQ ID NO: 561114 - DNA, 25 bp, Mus musculus
gcgtgaaaagacagcctatagaatt

SEQ ID NO: 561115 - DNA, 25 bp, Mus musculus
gcgtgaaaagactgcctatagaatt

SEQ ID NO: 561116 - DNA, 25 bp, Mus musculus
gcgtgaacgccaacgccgtgctgca

SEQ ID NO: 561117 - DNA, 25 bp, Mus musculus
gcgtgaacgccatcgccgtgctgca

SEQ ID NO: 561118 - DNA, 25 bp, Mus musculus
gcgtgaatcagaaggatcgtctcca

SEQ ID NO: 561119 - DNA, 25 bp, Mus musculus
gcgtgaatcagatggatcgtctcca

SEQ ID NO: 561120 - DNA, 25 bp, Mus musculus
gcgtgaatgcgtctaagagcccagt

SEQ ID NO: 561121 - DNA, 25 bp, Mus musculus
gcgtgaatgcgtgtaagagcccagt

SEQ ID NO: 561122 - DNA, 25 bp, Mus musculus
gcgtgaccagatccctgaattggaa

SEQ ID NO: 561123 - DNA, 25 bp, Mus musculus
gcgtgaccagatgcctgaattggaa

SEQ ID NO: 561124 - DNA, 25 bp, Mus musculus
gcgtgacctcatcctctggatggaa

SEQ ID NO: 561125 - DNA, 25 bp, Mus musculus
gcgtgacctcatgctctggatggaa

SEQ ID NO: 561126 - DNA, 25 bp, Mus musculus
gcgtgacgttctcgccgctttcgga

SEQ ID NO: 561127 - DNA, 25 bp, Mus musculus
gcgtgacgttctggccgctttcgga

SEQ ID NO: 561128 - DNA, 25 bp, Mus musculus
gcgtgactacttcgagtacgctcct

SEQ ID NO: 561129 - DNA, 25 bp, Mus musculus
gcgtgactacttggagtacgctcct

SEQ ID NO: 561130 - DNA, 25 bp, Mus musculus
gcgtgactatccacccatgcaagta

SEQ ID NO: 561131 - DNA, 25 bp, Mus musculus
gcgtgactatcctcccatgcaagta

SEQ ID NO: 561132 - DNA, 25 bp, Mus musculus
gcgtgacttccacaagagtttatga

SEQ ID NO: 561133 - DNA, 25 bp, Mus musculus
gcgtgacttccagaagagtttatga

SEQ ID NO: 561134 - DNA, 25 bp, Mus musculus
gcgtgacttgcaaggagacatacct

SEQ ID NO: 561135 - DNA, 25 bp, Mus musculus
gcgtgacttgcatggagacatacct

SEQ ID NO: 561136 - DNA, 25 bp, Mus musculus
gcgtgagaatttaaccagacttcaa

SEQ ID NO: 561137 - DNA, 25 bp, Mus musculus
gcgtgagaattttaccagacttcaa

SEQ ID NO: 561138 - DNA, 25 bp, Mus musculus
gcgtgagacgggagatggctgcagg

SEQ ID NO: 561139 - DNA, 25 bp, Mus musculus
gcgtgagacgggtgatggctgcagg

SEQ ID NO: 561140 - DNA, 25 bp, Mus musculus
gcgtgagactcacaacaccaagctt

SEQ ID NO: 561141 - DNA, 25 bp, Mus musculus
gcgtgagactcagaacaccaagctt

SEQ ID NO: 561142 - DNA, 25 bp, Mus musculus
gcgtgagagcatctgtgattttgtt

SEQ ID NO: 561143 - DNA, 25 bp, Mus musculus
gcgtgagagcatgtgtgattttgtt

SEQ ID NO: 561144 - DNA, 25 bp, Mus musculus
gcgtgagaggccagtgcacagcata

SEQ ID NO: 561145 - DNA, 25 bp, Mus musculus
gcgtgagaggcctgtgcacagcata

SEQ ID NO: 561146 - DNA, 25 bp, Mus musculus
gcgtgagccaacatgccagctaaat

SEQ ID NO: 561147 - DNA, 25 bp, Mus musculus
gcgtgagccaacttgccagctaaat

SEQ ID NO: 561148 - DNA, 25 bp, Mus musculus
gcgtgagcctgcaggtcgtgtcatt

SEQ ID NO: 561149 - DNA, 25 bp, Mus musculus
gcgtgagcctgctggtcgtgtcatt

SEQ ID NO: 561150 - DNA, 25 bp, Mus musculus
gcgtgagctgccaagagacttctaa

SEQ ID NO: 561151 - DNA, 25 bp, Mus musculus
gcgtgagctgcctagagacttctaa

SEQ ID NO: 561152 - DNA, 25 bp, Mus musculus
gcgtgagctgtcagtaccatgtcta

SEQ ID NO: 561153 - DNA, 25 bp, Mus musculus
gcgtgagctgtctgtaccatgtcta

SEQ ID NO: 561154 - DNA, 25 bp, Mus musculus
gcgtgaggacctcccggtgatttaa

SEQ ID NO: 561155 - DNA, 25 bp, Mus musculus
gcgtgaggacctgccggtgatttaa

SEQ ID NO: 561156 - DNA, 25 bp, Mus musculus
gcgtgaggcgctatgacctaaggat

SEQ ID NO: 561157 - DNA, 25 bp, Mus musculus
gcgtgaggcgctttgacctaaggat

SEQ ID NO: 561158 - DNA, 25 bp, Mus musculus
gcgtgaggctacacagaataataaa

SEQ ID NO: 561159 - DNA, 25 bp, Mus musculus
gcgtgaggctactcagaataataaa

SEQ ID NO: 561160 - DNA, 25 bp, Mus musculus
gcgtgagtgttgaggattctatgca

SEQ ID NO: 561161 - DNA, 25 bp, Mus musculus
gcgtgagtgttgtggattctatgca

SEQ ID NO: 561162 - DNA, 25 bp, Mus musculus
gcgtgagttcagatctcaggtctga

SEQ ID NO: 561163 - DNA, 25 bp, Mus musculus
gcgtgagttcagttctcaggtctga

SEQ ID NO: 561164 - DNA, 25 bp, Mus musculus
gcgtgatacgcactgtgaacagcct

SEQ ID NO: 561165 - DNA, 25 bp, Mus musculus
gcgtgatacgcagtgtgaacagcct

SEQ ID NO: 561166 - DNA, 25 bp, Mus musculus
gcgtgatagctgcacttattgacat

SEQ ID NO: 561167 - DNA, 25 bp, Mus musculus
gcgtgatagctggacttattgacat

SEQ ID NO: 561168 - DNA, 25 bp, Mus musculus
gcgtgatcaggtagcggatagactt

SEQ ID NO: 561169 - DNA, 25 bp, Mus musculus
gcgtgatcaggttgcggatagactt

SEQ ID NO: 561170 - DNA, 25 bp, Mus musculus
gcgtgatggtagacactgcttttct

SEQ ID NO: 561171 - DNA, 25 bp, Mus musculus
gcgtgatggtagtcactgcttttct

SEQ ID NO: 561172 - DNA, 25 bp, Mus musculus
gcgtgatgtgccagaagagccttcc

SEQ ID NO: 561173 - DNA, 25 bp, Mus musculus
gcgtgatgtgcctgaagagccttcc

SEQ ID NO: 561174 - DNA, 25 bp, Mus musculus
gcgtgattatcacacagatcttttt

SEQ ID NO: 561175 - DNA, 25 bp, Mus musculus
gcgtgattatcagacagatcttttt

SEQ ID NO: 561176 - DNA, 25 bp, Mus musculus
gcgtgattttcccttgaggagttct

SEQ ID NO: 561177 - DNA, 25 bp, Mus musculus
gcgtgattttccgttgaggagttct

SEQ ID NO: 561178 - DNA, 25 bp, Mus musculus
gcgtgcaagcaaacttccgagaact

SEQ ID NO: 561179 - DNA, 25 bp, Mus musculus
gcgtgcaagcaatcttccgagaact

SEQ ID NO: 561180 - DNA, 25 bp, Mus musculus
gcgtgcaatgtcagaaggaacctgt

SEQ ID NO: 561181 - DNA, 25 bp, Mus musculus
gcgtgcaatgtctgaaggaacctgt

SEQ ID NO: 561182 - DNA, 25 bp, Mus musculus
gcgtgcacaacaacaccaagctgat

SEQ ID NO: 561183 - DNA, 25 bp, Mus musculus
gcgtgcacaacatcaccaagctgat

SEQ ID NO: 561184 - DNA, 25 bp, Mus musculus
gcgtgcacagccatttatgatacca

SEQ ID NO: 561185 - DNA, 25 bp, Mus musculus
gcgtgcacagccttttatgatacca

SEQ ID NO: 561186 - DNA, 25 bp, Mus musculus
gcgtgcacagcgacctcatgtacat

SEQ ID NO: 561187 - DNA, 25 bp, Mus musculus
gcgtgcacagcgtcctcatgtacat

SEQ ID NO: 561188 - DNA, 25 bp, Mus musculus
gcgtgcaccatcatatgcaattttt

SEQ ID NO: 561189 - DNA, 25 bp, Mus musculus
gcgtgcaccatcttatgcaattttt

SEQ ID NO: 561190 - DNA, 25 bp, Mus musculus
gcgtgcacctacacatattcaaata

SEQ ID NO: 561191 - DNA, 25 bp, Mus musculus
gcgtgcacctactcatattcaaata

SEQ ID NO: 561192 - DNA, 25 bp, Mus musculus
gcgtgcacgtgaagctggcgaacct

SEQ ID NO: 561193 - DNA, 25 bp, Mus musculus
gcgtgcacgtgatgctggcgaacct

SEQ ID NO: 561194 - DNA, 25 bp, Mus musculus
gcgtgcactttcactacgtttgaac

SEQ ID NO: 561195 - DNA, 25 bp, Mus musculus
gcgtgcactttctctacgtttgaac

SEQ ID NO: 561196 - DNA, 25 bp, Mus musculus
gcgtgcagaccgatggccagataga

SEQ ID NO: 561197 - DNA, 25 bp, Mus musculus
gcgtgcagaccgttggccagataga

SEQ ID NO: 561198 - DNA, 25 bp, Mus musculus
gcgtgcagcacgagctgctagagaa

SEQ ID NO: 561199 - DNA, 25 bp, Mus musculus
gcgtgcagcacgtgctgctagagaa

SEQ ID NO: 561200 - DNA, 25 bp, Mus musculus
gcgtgcatgataacagagcccctag

SEQ ID NO: 561201 - DNA, 25 bp, Mus musculus
gcgtgcatgatatcagagcccctag

SEQ ID NO: 561202 - DNA, 25 bp, Mus musculus
gcgtgcatgccccagagcagcagtt

SEQ ID NO: 561203 - DNA, 25 bp, Mus musculus
gcgtgcatgcccgagagcagcagtt

SEQ ID NO: 561204 - DNA, 25 bp, Mus musculus
gcgtgcatgtgccttgttagcaaca

SEQ ID NO: 561205 - DNA, 25 bp, Mus musculus
gcgtgcatgtgcgttgttagcaaca

SEQ ID NO: 561206 - DNA, 25 bp, Mus musculus
gcgtgcccaaggataaggccatcaa

SEQ ID NO: 561207 - DNA, 25 bp, Mus musculus
gcgtgcccaaggttaaggccatcaa

SEQ ID NO: 561208 - DNA, 25 bp, Mus musculus
gcgtgcccaatgcttcctgggacaa

SEQ ID NO: 561209 - DNA, 25 bp, Mus musculus
gcgtgcccaatggttcctgggacaa

SEQ ID NO: 561210 - DNA, 25 bp, Mus musculus
gcgtgcccgaggagatggaccctgg

SEQ ID NO: 561211 - DNA, 25 bp, Mus musculus
gcgtgcccgaggtgatggaccctgg

SEQ ID NO: 561212 - DNA, 25 bp, Mus musculus
gcgtgcccggagacgattacagcaa

SEQ ID NO: 561213 - DNA, 25 bp, Mus musculus
gcgtgcccggagtcgattacagcaa

SEQ ID NO: 561214 - DNA, 25 bp, Mus musculus
gcgtgccgctgacagagctgaattc

SEQ ID NO: 561215 - DNA, 25 bp, Mus musculus
gcgtgccgctgagagagctgaattc

SEQ ID NO: 561216 - DNA, 25 bp, Mus musculus
gcgtgccggaatagcgattaccagc

SEQ ID NO: 561217 - DNA, 25 bp, Mus musculus
gcgtgccggaattgcgattaccagc

SEQ ID NO: 561218 - DNA, 25 bp, Mus musculus
gcgtgcctccacagggtcaggaacc

SEQ ID NO: 561219 - DNA, 25 bp, Mus musculus
gcgtgcctccactgggtcaggaacc

SEQ ID NO: 561220 - DNA, 25 bp, Mus musculus
gcgtgcctggccattgtatgtcact

SEQ ID NO: 561221 - DNA, 25 bp, Mus musculus
gcgtgcctggcctttgtatgtcact

SEQ ID NO: 561222 - DNA, 25 bp, Mus musculus
gcgtgcctgtctatttgtactgtaa

SEQ ID NO: 561223 - DNA, 25 bp, Mus musculus
gcgtgcctgtctttttgtactgtaa

SEQ ID NO: 561224 - DNA, 25 bp, Mus musculus
gcgtgcgaaagtaagccagctcagt

SEQ ID NO: 561225 - DNA, 25 bp, Mus musculus
gcgtgcgaaagttagccagctcagt

SEQ ID NO: 561226 - DNA, 25 bp, Mus musculus
gcgtgcgcacacacaggctgaacag

SEQ ID NO: 561227 - DNA, 25 bp, Mus musculus
gcgtgcgcacacacatggaaataat

SEQ ID NO: 561228 - DNA, 25 bp, Mus musculus
gcgtgcgcacactcaggctgaacag

SEQ ID NO: 561229 - DNA, 25 bp, Mus musculus
gcgtgcgcacactcatggaaataat

SEQ ID NO: 561230 - DNA, 25 bp, Mus musculus
gcgtgcgccatgagacgtaccgctc

SEQ ID NO: 561231 - DNA, 25 bp, Mus musculus
gcgtgcgccatgtgacgtaccgctc

SEQ ID NO: 561232 - DNA, 25 bp, Mus musculus
gcgtgctaacgaaaccgtaggttct

SEQ ID NO: 561233 - DNA, 25 bp, Mus musculus
gcgtgctaacgataccgtaggttct

SEQ ID NO: 561234 - DNA, 25 bp, Mus musculus
gcgtgctaattaatctgggagttcc

SEQ ID NO: 561235 - DNA, 25 bp, Mus musculus
gcgtgctaattattctgggagttcc

SEQ ID NO: 561236 - DNA, 25 bp, Mus musculus
gcgtgctacccgatttcctgcaagg

SEQ ID NO: 561237 - DNA, 25 bp, Mus musculus
gcgtgctacccgttttcctgcaagg

SEQ ID NO: 561238 - DNA, 25 bp, Mus musculus
gcgtgctacgtgaacaactaaggta

SEQ ID NO: 561239 - DNA, 25 bp, Mus musculus
gcgtgctacgtgtacaactaaggta

SEQ ID NO: 561240 - DNA, 25 bp, Mus musculus
gcgtgctccagccaaatattttctt

SEQ ID NO: 561241 - DNA, 25 bp, Mus musculus
gcgtgctccagcgaaatattttctt

SEQ ID NO: 561242 - DNA, 25 bp, Mus musculus
gcgtgctcctttagcggagacaagt

SEQ ID NO: 561243 - DNA, 25 bp, Mus musculus
gcgtgctccttttgcggagacaagt

SEQ ID NO: 561244 - DNA, 25 bp, Mus musculus
gcgtgctctctcattttgatagatc

SEQ ID NO: 561245 - DNA, 25 bp, Mus musculus
gcgtgctctctctttttgatagatc

SEQ ID NO: 561246 - DNA, 25 bp, Mus musculus
gcgtgctcttgtacccgtctggctg

SEQ ID NO: 561247 - DNA, 25 bp, Mus musculus
gcgtgctcttgttcccgtctggctg

SEQ ID NO: 561248 - DNA, 25 bp, Mus musculus
gcgtgctgcagcacaatcgtttaat

SEQ ID NO: 561249 - DNA, 25 bp, Mus musculus
gcgtgctgcagctcaatcgtttaat

SEQ ID NO: 561250 - DNA, 25 bp, Mus musculus
gcgtgctgcttgagtagttgtttaa

SEQ ID NO: 561251 - DNA, 25 bp, Mus musculus
gcgtgctgcttgtgtagttgtttaa

SEQ ID NO: 561252 - DNA, 25 bp, Mus musculus
gcgtgctgtgttcaatccaggttgc

SEQ ID NO: 561253 - DNA, 25 bp, Mus musculus
gcgtgctgtgttgaatccaggttgc

SEQ ID NO: 561254 - DNA, 25 bp, Mus musculus
gcgtgcttattgacctggttgatag

SEQ ID NO: 561255 - DNA, 25 bp, Mus musculus
gcgtgcttattgtcctggttgatag

SEQ ID NO: 561256 - DNA, 25 bp, Mus musculus
gcgtgcttccaacaccgcagtaaag

SEQ ID NO: 561257 - DNA, 25 bp, Mus musculus
gcgtgcttccaagaccgcagtaaag

SEQ ID NO: 561258 - DNA, 25 bp, Mus musculus
gcgtgctttgctacaccttgtgcta

SEQ ID NO: 561259 - DNA, 25 bp, Mus musculus
gcgtgctttgcttcaccttgtgcta

SEQ ID NO: 561260 - DNA, 25 bp, Mus musculus
gcgtggaaccctattggaatcatga

SEQ ID NO: 561261 - DNA, 25 bp, Mus musculus
gcgtggaacccttttggaatcatga

SEQ ID NO: 561262 - DNA, 25 bp, Mus musculus
gcgtggaatcacaaatggcatctgt

SEQ ID NO: 561263 - DNA, 25 bp, Mus musculus
gcgtggaatcactaatggcatctgt

SEQ ID NO: 561264 - DNA, 25 bp, Mus musculus
gcgtggacctcgaagttgctaaagt

SEQ ID NO: 561265 - DNA, 25 bp, Mus musculus
gcgtggacctcgtagttgctaaagt

SEQ ID NO: 561266 - DNA, 25 bp, Mus musculus
gcgtggactgttatcaccaaccaaa

SEQ ID NO: 561267 - DNA, 25 bp, Mus musculus
gcgtggactgttttcaccaaccaaa

SEQ ID NO: 561268 - DNA, 25 bp, Mus musculus
gcgtggagaacccttaatcatttcc

SEQ ID NO: 561269 - DNA, 25 bp, Mus musculus
gcgtggagaaccgttaatcatttcc

SEQ ID NO: 561270 - DNA, 25 bp, Mus musculus
gcgtggagagagcagtctcacttaa

SEQ ID NO: 561271 - DNA, 25 bp, Mus musculus
gcgtggagagaggagtctcacttaa

SEQ ID NO: 561272 - DNA, 25 bp, Mus musculus
gcgtggaggacgattctcgtctgtt

SEQ ID NO: 561273 - DNA, 25 bp, Mus musculus
gcgtggaggacgtttctcgtctgtt

SEQ ID NO: 561274 - DNA, 25 bp, Mus musculus
gcgtggagggatacaagtgccttca

SEQ ID NO: 561275 - DNA, 25 bp, Mus musculus
gcgtggagggattcaagtgccttca

SEQ ID NO: 561276 - DNA, 25 bp, Mus musculus
gcgtggatagtgactaatctgtgct

SEQ ID NO: 561277 - DNA, 25 bp, Mus musculus
gcgtggatagtgtctaatctgtgct

SEQ ID NO: 561278 - DNA, 25 bp, Mus musculus
gcgtggattattagggttactcatt

SEQ ID NO: 561279 - DNA, 25 bp, Mus musculus
gcgtggattatttgggttactcatt

SEQ ID NO: 561280 - DNA, 25 bp, Mus musculus
gcgtggcaagcgctctcctaagtcc

SEQ ID NO: 561281 - DNA, 25 bp, Mus musculus
gcgtggcaagcggtctcctaagtcc

SEQ ID NO: 561282 - DNA, 25 bp, Mus musculus
gcgtggcaagggacatttactcctc

SEQ ID NO: 561283 - DNA, 25 bp, Mus musculus
gcgtggcaagggtcatttactcctc

SEQ ID NO: 561284 - DNA, 25 bp, Mus musculus
gcgtggccaccaactaagatgaaaa

SEQ ID NO: 561285 - DNA, 25 bp, Mus musculus
gcgtggccaccatctaagatgaaaa

SEQ ID NO: 561286 - DNA, 25 bp, Mus musculus
gcgtggcctataatgtggtacctgc

SEQ ID NO: 561287 - DNA, 25 bp, Mus musculus
gcgtggcctatattgtggtacctgc

SEQ ID NO: 561288 - DNA, 25 bp, Mus musculus
gcgtggcgccggacctgcccgaggg

SEQ ID NO: 561289 - DNA, 25 bp, Mus musculus
gcgtggcgccggtcctgcccgaggg

SEQ ID NO: 561290 - DNA, 25 bp, Mus musculus
gcgtggcgtgtgacattcctgaaca

SEQ ID NO: 561291 - DNA, 25 bp, Mus musculus
gcgtggcgtgtgtcattcctgaaca

SEQ ID NO: 561292 - DNA, 25 bp, Mus musculus
gcgtggctcacacttggatccatga

SEQ ID NO: 561293 - DNA, 25 bp, Mus musculus
gcgtggctcacagttggatccatga

SEQ ID NO: 561294 - DNA, 25 bp, Mus musculus
gcgtggctccacagcacccgtaggg

SEQ ID NO: 561295 - DNA, 25 bp, Mus musculus
gcgtggctccactgcacccgtaggg

SEQ ID NO: 561296 - DNA, 25 bp, Mus musculus
gcgtggctgaccacatcgagtccat

SEQ ID NO: 561297 - DNA, 25 bp, Mus musculus
gcgtggctgacctcatcgagtccat

SEQ ID NO: 561298 - DNA, 25 bp, Mus musculus
gcgtggctgctaccaaccagctgca

SEQ ID NO: 561299 - DNA, 25 bp, Mus musculus
gcgtggctgctagcaaccagctgca

SEQ ID NO: 561300 - DNA, 25 bp, Mus musculus
gcgtggctgttgaaggaagtttgca

SEQ ID NO: 561301 - DNA, 25 bp, Mus musculus
gcgtggctgttgtaggaagtttgca

SEQ ID NO: 561302 - DNA, 25 bp, Mus musculus
gcgtggcttattagacctttgtgtt

SEQ ID NO: 561303 - DNA, 25 bp, Mus musculus
gcgtggcttatttgacctttgtgtt

SEQ ID NO: 561304 - DNA, 25 bp, Mus musculus
gcgtgggaattgcatgtcttgtcat

SEQ ID NO: 561305 - DNA, 25 bp, Mus musculus
gcgtgggaattggatgtcttgtcat

SEQ ID NO: 561306 - DNA, 25 bp, Mus musculus
gcgtgggacagtacgtactgtgact

SEQ ID NO: 561307 - DNA, 25 bp, Mus musculus
gcgtgggacagttcgtactgtgact

SEQ ID NO: 561308 - DNA, 25 bp, Mus musculus
gcgtgggagacaaattcttcctgaa

SEQ ID NO: 561309 - DNA, 25 bp, Mus musculus
gcgtgggagacatattcttcctgaa

SEQ ID NO: 561310 - DNA, 25 bp, Mus musculus
gcgtgggcagttatgcaccgtttcc

SEQ ID NO: 561311 - DNA, 25 bp, Mus musculus
gcgtgggcagttttgcaccgtttcc

SEQ ID NO: 561312 - DNA, 25 bp, Mus musculus
gcgtgggctccaagttctgggaaca

SEQ ID NO: 561313 - DNA, 25 bp, Mus musculus
gcgtgggctccatgttctgggaaca

SEQ ID NO: 561314 - DNA, 25 bp, Mus musculus
gcgtgggcttcgaggtcaagctact

SEQ ID NO: 561315 - DNA, 25 bp, Mus musculus
gcgtgggcttcgtggtcaagctact

SEQ ID NO: 561316 - DNA, 25 bp, Mus musculus
gcgtgggtgatcaaactgaggtcaa

SEQ ID NO: 561317 - DNA, 25 bp, Mus musculus
gcgtgggtgatctaactgaggtcaa

SEQ ID NO: 561318 - DNA, 25 bp, Mus musculus
gcgtgggtgcacctcagccgtttct

SEQ ID NO: 561319 - DNA, 25 bp, Mus musculus
gcgtgggtgcacgtcagccgtttct

SEQ ID NO: 561320 - DNA, 25 bp, Mus musculus
gcgtgggtggtaacggcatcttcct

SEQ ID NO: 561321 - DNA, 25 bp, Mus musculus
gcgtgggtggtatcggcatcttcct

SEQ ID NO: 561322 - DNA, 25 bp, Mus musculus
gcgtgggtttctctggcaatcttac

SEQ ID NO: 561323 - DNA, 25 bp, Mus musculus
gcgtgggtttctgtggcaatcttac

SEQ ID NO: 561324 - DNA, 25 bp, Mus musculus
gcgtggtagccacaactagagccta

SEQ ID NO: 561325 - DNA, 25 bp, Mus musculus
gcgtggtagccagaactagagccta

SEQ ID NO: 561326 - DNA, 25 bp, Mus musculus
gcgtggtcagcaagattcgattctt

SEQ ID NO: 561327 - DNA, 25 bp, Mus musculus
gcgtggtcagcatgattcgattctt

SEQ ID NO: 561328 - DNA, 25 bp, Mus musculus
gcgtggtccccgaagagagtccaag

SEQ ID NO: 561329 - DNA, 25 bp, Mus musculus
gcgtggtccccgtagagagtccaag

SEQ ID NO: 561330 - DNA, 25 bp, Mus musculus
gcgtggtgcgctattggtacagcct

SEQ ID NO: 561331 - DNA, 25 bp, Mus musculus
gcgtggtgcgcttttggtacagcct

SEQ ID NO: 561332 - DNA, 25 bp, Mus musculus
gcgtggtggagcattggcaacccta

SEQ ID NO: 561333 - DNA, 25 bp, Mus musculus
gcgtggtggagctttggcaacccta

SEQ ID NO: 561334 - DNA, 25 bp, Mus musculus
gcgtggtggccaaatgtggtcattc

SEQ ID NO: 561335 - DNA, 25 bp, Mus musculus
gcgtggtggccatatgtggtcattc

SEQ ID NO: 561336 - DNA, 25 bp, Mus musculus
gcgtggtgggttaggctctgccggc

SEQ ID NO: 561337 - DNA, 25 bp, Mus musculus
gcgtggtgggtttggctctgccggc

SEQ ID NO: 561338 - DNA, 25 bp, Mus musculus
gcgtggtggtggacttgaaccccaa

SEQ ID NO: 561339 - DNA, 25 bp, Mus musculus
gcgtggtggtggtcttgaaccccaa

SEQ ID NO: 561340 - DNA, 25 bp, Mus musculus
gcgtggttgccgaggaactctgtta

SEQ ID NO: 561341 - DNA, 25 bp, Mus musculus
gcgtggttgccgcaattgttcttat

SEQ ID NO: 561342 - DNA, 25 bp, Mus musculus
gcgtggttgccggaattgttcttat

SEQ ID NO: 561343 - DNA, 25 bp, Mus musculus
gcgtggttgccgtggaactctgtta

SEQ ID NO: 561344 - DNA, 25 bp, Mus musculus
gcgtggtttggtatagatgacccct

SEQ ID NO: 561345 - DNA, 25 bp, Mus musculus
gcgtggtttggtttagatgacccct

SEQ ID NO: 561346 - DNA, 25 bp, Mus musculus
gcgtggttttttaactgagtcaact

SEQ ID NO: 561347 - DNA, 25 bp, Mus musculus
gcgtggtttttttactgagtcaact

SEQ ID NO: 561348 - DNA, 25 bp, Mus musculus
gcgtgtaaacagcaattcttgagac

SEQ ID NO: 561349 - DNA, 25 bp, Mus musculus
gcgtgtaaacaggaattcttgagac

SEQ ID NO: 561350 - DNA, 25 bp, Mus musculus
gcgtgtaacgatcgctgttcagcta

SEQ ID NO: 561351 - DNA, 25 bp, Mus musculus
gcgtgtaacgatggctgttcagcta

SEQ ID NO: 561352 - DNA, 25 bp, Mus musculus
gcgtgtaattgtatgctaaacttct

SEQ ID NO: 561353 - DNA, 25 bp, Mus musculus
gcgtgtaattgtttgctaaacttct

SEQ ID NO: 561354 - DNA, 25 bp, Mus musculus
gcgtgtaccaccatggacatgtgtt

SEQ ID NO: 561355 - DNA, 25 bp, Mus musculus
gcgtgtaccaccttggacatgtgtt

SEQ ID NO: 561356 - DNA, 25 bp, Mus musculus
gcgtgtacgtccattgaaatgcaca

SEQ ID NO: 561357 - DNA, 25 bp, Mus musculus
gcgtgtacgtcctttgaaatgcaca

SEQ ID NO: 561358 - DNA, 25 bp, Mus musculus
gcgtgtactgtgaaagccttgcaaa

SEQ ID NO: 561359 - DNA, 25 bp, Mus musculus
gcgtgtactgtgtaagccttgcaaa

SEQ ID NO: 561360 - DNA, 25 bp, Mus musculus
gcgtgtagaaagcagtgtcatcctt

SEQ ID NO: 561361 - DNA, 25 bp, Mus musculus
gcgtgtagaaaggagtgtcatcctt

SEQ ID NO: 561362 - DNA, 25 bp, Mus musculus
gcgtgtagactcaccaggaagcctg

SEQ ID NO: 561363 - DNA, 25 bp, Mus musculus
gcgtgtagactctccaggaagcctg

SEQ ID NO: 561364 - DNA, 25 bp, Mus musculus
gcgtgtatatccaacataagtacga

SEQ ID NO: 561365 - DNA, 25 bp, Mus musculus
gcgtgtatatcctacataagtacga

SEQ ID NO: 561366 - DNA, 25 bp, Mus musculus
gcgtgtatctgaaatccacatgtgt

SEQ ID NO: 561367 - DNA, 25 bp, Mus musculus
gcgtgtatctgatatccacatgtgt

SEQ ID NO: 561368 - DNA, 25 bp, Mus musculus
gcgtgtcactttagcatcaatgtta

SEQ ID NO: 561369 - DNA, 25 bp, Mus musculus
gcgtgtcacttttgcatcaatgtta

SEQ ID NO: 561370 - DNA, 25 bp, Mus musculus
gcgtgtcagaaactctgagcccttc

SEQ ID NO: 561371 - DNA, 25 bp, Mus musculus
gcgtgtcagaaagtctgagcccttc

SEQ ID NO: 561372 - DNA, 25 bp, Mus musculus
gcgtgtcattacagagggaactttt

SEQ ID NO: 561373 - DNA, 25 bp, Mus musculus
gcgtgtcattactgagggaactttt

SEQ ID NO: 561374 - DNA, 25 bp, Mus musculus
gcgtgtccaactaagatgtggtgaa

SEQ ID NO: 561375 - DNA, 25 bp, Mus musculus
gcgtgtccaacttagatgtggtgaa

SEQ ID NO: 561376 - DNA, 25 bp, Mus musculus
gcgtgtccaattcggtcctctgcaa

SEQ ID NO: 561377 - DNA, 25 bp, Mus musculus
gcgtgtccaattgggtcctctgcaa

SEQ ID NO: 561378 - DNA, 25 bp, Mus musculus
gcgtgtccgcccagtggacaagcag

SEQ ID NO: 561379 - DNA, 25 bp, Mus musculus
gcgtgtccgccctgtggacaagcag

SEQ ID NO: 561380 - DNA, 25 bp, Mus musculus
gcgtgtccgggcattaattgaagct

SEQ ID NO: 561381 - DNA, 25 bp, Mus musculus
gcgtgtccgggctttaattgaagct

SEQ ID NO: 561382 - DNA, 25 bp, Mus musculus
gcgtgtcgcacaacgaggatcctgc

SEQ ID NO: 561383 - DNA, 25 bp, Mus musculus
gcgtgtcgcacatcgaggatcctgc

SEQ ID NO: 561384 - DNA, 25 bp, Mus musculus
gcgtgtctcatgatgaataactcaa

SEQ ID NO: 561385 - DNA, 25 bp, Mus musculus
gcgtgtctcatgttgaataactcaa

SEQ ID NO: 561386 - DNA, 25 bp, Mus musculus
gcgtgtctttgtcatcttacaatct

SEQ ID NO: 561387 - DNA, 25 bp, Mus musculus
gcgtgtctttgtgatcttacaatct

SEQ ID NO: 561388 - DNA, 25 bp, Mus musculus
gcgtgtgaatgtatttgtgcctgta

SEQ ID NO: 561389 - DNA, 25 bp, Mus musculus
gcgtgtgaatgtttttgtgcctgta

SEQ ID NO: 561390 - DNA, 25 bp, Mus musculus
gcgtgtgcagaacactcttagttcc

SEQ ID NO: 561391 - DNA, 25 bp, Mus musculus
gcgtgtgcagaagactcttagttcc

SEQ ID NO: 561392 - DNA, 25 bp, Mus musculus
gcgtgtgccaccactgaacagggac

SEQ ID NO: 561393 - DNA, 25 bp, Mus musculus
gcgtgtgccaccatatttagctaag

SEQ ID NO: 561394 - DNA, 25 bp, Mus musculus
gcgtgtgccacctctgaacagggac

SEQ ID NO: 561395 - DNA, 25 bp, Mus musculus
gcgtgtgccaccttatttagctaag

SEQ ID NO: 561396 - DNA, 25 bp, Mus musculus
gcgtgtgcccacctcataggaagga

SEQ ID NO: 561397 - DNA, 25 bp, Mus musculus
gcgtgtgcccacgtcataggaagga

SEQ ID NO: 561398 - DNA, 25 bp, Mus musculus
gcgtgtgctatgcatgtgtaaacta

SEQ ID NO: 561399 - DNA, 25 bp, Mus musculus
gcgtgtgctatggatgtgtaaacta

SEQ ID NO: 561400 - DNA, 25 bp, Mus musculus
gcgtgtgctcaccttgatggaacct

SEQ ID NO: 561401 - DNA, 25 bp, Mus musculus
gcgtgtgctcacgttgatggaacct

SEQ ID NO: 561402 - DNA, 25 bp, Mus musculus
gcgtgtgcttccccgagaatatatt

SEQ ID NO: 561403 - DNA, 25 bp, Mus musculus
gcgtgtgcttccgcgagaatatatt

SEQ ID NO: 561404 - DNA, 25 bp, Mus musculus
gcgtgtggatgaagacactgtaaac

SEQ ID NO: 561405 - DNA, 25 bp, Mus musculus
gcgtgtggatgatgacactgtaaac

SEQ ID NO: 561406 - DNA, 25 bp, Mus musculus
gcgtgtggatggagccaatgaaacc

SEQ ID NO: 561407 - DNA, 25 bp, Mus musculus
gcgtgtggatggtgccaatgaaacc

SEQ ID NO: 561408 - DNA, 25 bp, Mus musculus
gcgtgtggtataaccgtggtttcta

SEQ ID NO: 561409 - DNA, 25 bp, Mus musculus
gcgtgtggtatatccgtggtttcta

SEQ ID NO: 561410 - DNA, 25 bp, Mus musculus
gcgtgtgtgactcagcctacagcag

SEQ ID NO: 561411 - DNA, 25 bp, Mus musculus
gcgtgtgtgactgagcctacagcag

SEQ ID NO: 561412 - DNA, 25 bp, Mus musculus
gcgtgtgtgcgcatgtggtaacatc

SEQ ID NO: 561413 - DNA, 25 bp, Mus musculus
gcgtgtgtgcgcttgtggtaacatc

SEQ ID NO: 561414 - DNA, 25 bp, Mus musculus
gcgtgtgttgctccaataaagtttg

SEQ ID NO: 561415 - DNA, 25 bp, Mus musculus
gcgtgtgttgctgcaataaagtttg

SEQ ID NO: 561416 - DNA, 25 bp, Mus musculus
gcgtgtgttgttataacatgcccac

SEQ ID NO: 561417 - DNA, 25 bp, Mus musculus
gcgtgtgttgttttaacatgcccac

SEQ ID NO: 561418 - DNA, 25 bp, Mus musculus
gcgtgttccagcactaaatactttt

SEQ ID NO: 561419 - DNA, 25 bp, Mus musculus
gcgtgttccagctctaaatactttt

SEQ ID NO: 561420 - DNA, 25 bp, Mus musculus
gcgtgttgccttagatatcacagaa

SEQ ID NO: 561421 - DNA, 25 bp, Mus musculus
gcgtgttgccttcatgtgtgtgaga

SEQ ID NO: 561422 - DNA, 25 bp, Mus musculus
gcgtgttgccttgatgtgtgtgaga

SEQ ID NO: 561423 - DNA, 25 bp, Mus musculus
gcgtgttgcctttgatatcacagaa

SEQ ID NO: 561424 - DNA, 25 bp, Mus musculus
gcgtgttggcctactgtaaggtcat

SEQ ID NO: 561425 - DNA, 25 bp, Mus musculus
gcgtgttggccttctgtaaggtcat

SEQ ID NO: 561426 - DNA, 25 bp, Mus musculus
gcgtgtttacaactagcccgagact

SEQ ID NO: 561427 - DNA, 25 bp, Mus musculus
gcgtgtttacaagtagcccgagact

SEQ ID NO: 561428 - DNA, 25 bp, Mus musculus
gcgtgtttgactattgcatgcacat

SEQ ID NO: 561429 - DNA, 25 bp, Mus musculus
gcgtgtttgacttttgcatgcacat

SEQ ID NO: 561430 - DNA, 25 bp, Mus musculus
gcgtgtttgataagacaatggcttc

SEQ ID NO: 561431 - DNA, 25 bp, Mus musculus
gcgtgtttgatatgacaatggcttc

SEQ ID NO: 561432 - DNA, 25 bp, Mus musculus
gcgtgttttgtacttccattcttta

SEQ ID NO: 561433 - DNA, 25 bp, Mus musculus
gcgtgttttgtagttccattcttta

SEQ ID NO: 561434 - DNA, 25 bp, Mus musculus
gcgttaaagatcatgttttctcctc

SEQ ID NO: 561435 - DNA, 25 bp, Mus musculus
gcgttaaagatcttgttttctcctc

SEQ ID NO: 561436 - DNA, 25 bp, Mus musculus
gcgttaatcttgctttatcctggca

SEQ ID NO: 561437 - DNA, 25 bp, Mus musculus
gcgttaatcttggtttatcctggca

SEQ ID NO: 561438 - DNA, 25 bp, Mus musculus
gcgttaatgacgactttgtgattga

SEQ ID NO: 561439 - DNA, 25 bp, Mus musculus
gcgttaatgacgtctttgtgattga

SEQ ID NO: 561440 - DNA, 25 bp, Mus musculus
gcgttacatggactcctacgacatt

SEQ ID NO: 561441 - DNA, 25 bp, Mus musculus
gcgttacatggagtcctacgacatt

SEQ ID NO: 561442 - DNA, 25 bp, Mus musculus
gcgttacccttgctgagacaggctt

SEQ ID NO: 561443 - DNA, 25 bp, Mus musculus
gcgttacccttggtgagacaggctt

SEQ ID NO: 561444 - DNA, 25 bp, Mus musculus
gcgttacctaatcccagatgtcctg

SEQ ID NO: 561445 - DNA, 25 bp, Mus musculus
gcgttacctaatgccagatgtcctg

SEQ ID NO: 561446 - DNA, 25 bp, Mus musculus
gcgttacctctacccatttggtggg

SEQ ID NO: 561447 - DNA, 25 bp, Mus musculus
gcgttacctctagccatttggtggg

SEQ ID NO: 561448 - DNA, 25 bp, Mus musculus
gcgttacgttaactcacacgaccct

SEQ ID NO: 561449 - DNA, 25 bp, Mus musculus
gcgttacgttaagtcacacgaccct

SEQ ID NO: 561450 - DNA, 25 bp, Mus musculus
gcgttactcttacggacttgttcag

SEQ ID NO: 561451 - DNA, 25 bp, Mus musculus
gcgttactcttagggacttgttcag

SEQ ID NO: 561452 - DNA, 25 bp, Mus musculus
gcgttactgtggcaggagcaactaa

SEQ ID NO: 561453 - DNA, 25 bp, Mus musculus
gcgttactgtgggaggagcaactaa

SEQ ID NO: 561454 - DNA, 25 bp, Mus musculus
gcgttacttccacattaaccaggat

SEQ ID NO: 561455 - DNA, 25 bp, Mus musculus
gcgttacttccagattaaccaggat

SEQ ID NO: 561456 - DNA, 25 bp, Mus musculus
gcgttacttctgcagatacttcatg

SEQ ID NO: 561457 - DNA, 25 bp, Mus musculus
gcgttacttctggagatacttcatg

SEQ ID NO: 561458 - DNA, 25 bp, Mus musculus
gcgttagaccataccaaagccggag

SEQ ID NO: 561459 - DNA, 25 bp, Mus musculus
gcgttagaccattccaaagccggag

SEQ ID NO: 561460 - DNA, 25 bp, Mus musculus
gcgttagactgcagatccgggtgat

SEQ ID NO: 561461 - DNA, 25 bp, Mus musculus
gcgttagactgctgatccgggtgat

SEQ ID NO: 561462 - DNA, 25 bp, Mus musculus
gcgttagagggtctctcatgcagca

SEQ ID NO: 561463 - DNA, 25 bp, Mus musculus
gcgttagagggtgtctcatgcagca

SEQ ID NO: 561464 - DNA, 25 bp, Mus musculus
gcgttagcagcacagagtctggcct

SEQ ID NO: 561465 - DNA, 25 bp, Mus musculus
gcgttagcagcagagagtctggcct

SEQ ID NO: 561466 - DNA, 25 bp, Mus musculus
gcgttagcccatatcacagtggatc

SEQ ID NO: 561467 - DNA, 25 bp, Mus musculus
gcgttagcccatttcacagtggatc

SEQ ID NO: 561468 - DNA, 25 bp, Mus musculus
gcgttagcggacagccagaggcaaa

SEQ ID NO: 561469 - DNA, 25 bp, Mus musculus
gcgttagcggactgccagaggcaaa

SEQ ID NO: 561470 - DNA, 25 bp, Mus musculus
gcgttagctgccagattagtttatc

SEQ ID NO: 561471 - DNA, 25 bp, Mus musculus
gcgttagctgcctgattagtttatc

SEQ ID NO: 561472 - DNA, 25 bp, Mus musculus
gcgttagtacatctagatgggcatc

SEQ ID NO: 561473 - DNA, 25 bp, Mus musculus
gcgttagtacatgtagatgggcatc

SEQ ID NO: 561474 - DNA, 25 bp, Mus musculus
gcgttagtggttcccctgctcctgg

SEQ ID NO: 561475 - DNA, 25 bp, Mus musculus
gcgttagtggttgccctgctcctgg

SEQ ID NO: 561476 - DNA, 25 bp, Mus musculus
gcgttatagcatataagcagtctga

SEQ ID NO: 561477 - DNA, 25 bp, Mus musculus
gcgttatagcatttaagcagtctga

SEQ ID NO: 561478 - DNA, 25 bp, Mus musculus
gcgttatctcagcttcttcaggcgg

SEQ ID NO: 561479 - DNA, 25 bp, Mus musculus
gcgttatctcaggttcttcaggcgg

SEQ ID NO: 561480 - DNA, 25 bp, Mus musculus
gcgttatcttttatcatgaccctac

SEQ ID NO: 561481 - DNA, 25 bp, Mus musculus
gcgttatcttttttcatgaccctac

SEQ ID NO: 561482 - DNA, 25 bp, Mus musculus
gcgttattgttgaagagtgctctta

SEQ ID NO: 561483 - DNA, 25 bp, Mus musculus
gcgttattgttgtagagtgctctta

SEQ ID NO: 561484 - DNA, 25 bp, Mus musculus
gcgttatttcccagacaagcttcag

SEQ ID NO: 561485 - DNA, 25 bp, Mus musculus
gcgttatttccctgacaagcttcag

SEQ ID NO: 561486 - DNA, 25 bp, Mus musculus
gcgttcaaaggtactcacaagtctg

SEQ ID NO: 561487 - DNA, 25 bp, Mus musculus
gcgttcaaaggttctcacaagtctg

SEQ ID NO: 561488 - DNA, 25 bp, Mus musculus
gcgttcaaccacagtgtcatctcta

SEQ ID NO: 561489 - DNA, 25 bp, Mus musculus
gcgttcaaccactgtgtcatctcta

SEQ ID NO: 561490 - DNA, 25 bp, Mus musculus
gcgttcacaaaaagaacccacccag

SEQ ID NO: 561491 - DNA, 25 bp, Mus musculus
gcgttcacaaaatgaacccacccag

SEQ ID NO: 561492 - DNA, 25 bp, Mus musculus
gcgttcacagccagagcatgggatc

SEQ ID NO: 561493 - DNA, 25 bp, Mus musculus
gcgttcacagcctgagcatgggatc

SEQ ID NO: 561494 - DNA, 25 bp, Mus musculus
gcgttcaccaccctgcagaggaagt

SEQ ID NO: 561495 - DNA, 25 bp, Mus musculus
gcgttcaccaccgtgcagaggaagt

SEQ ID NO: 561496 - DNA, 25 bp, Mus musculus
gcgttcacgacgctgaatggatcac

SEQ ID NO: 561497 - DNA, 25 bp, Mus musculus
gcgttcacgacggtgaatggatcac

SEQ ID NO: 561498 - DNA, 25 bp, Mus musculus
gcgttcactgcgacctgggagtaaa

SEQ ID NO: 561499 - DNA, 25 bp, Mus musculus
gcgttcactgcgtcctgggagtaaa

SEQ ID NO: 561500 - DNA, 25 bp, Mus musculus
gcgttcactgtcatgggccagaaaa

SEQ ID NO: 561501 - DNA, 25 bp, Mus musculus
gcgttcactgtcttgggccagaaaa

SEQ ID NO: 561502 - DNA, 25 bp, Mus musculus
gcgttcagtggcatttctcgcctga

SEQ ID NO: 561503 - DNA, 25 bp, Mus musculus
gcgttcagtggcttttctcgcctga

SEQ ID NO: 561504 - DNA, 25 bp, Mus musculus
gcgttcatcgtgattgccatgatta

SEQ ID NO: 561505 - DNA, 25 bp, Mus musculus
gcgttcatcgtgtttgccatgatta

SEQ ID NO: 561506 - DNA, 25 bp, Mus musculus
gcgttcatctggctcagattcaaat

SEQ ID NO: 561507 - DNA, 25 bp, Mus musculus
gcgttcatctgggtcagattcaaat

SEQ ID NO: 561508 - DNA, 25 bp, Mus musculus
gcgttcatgactaccttctatatac

SEQ ID NO: 561509 - DNA, 25 bp, Mus musculus
gcgttcatgacttccttctatatac

SEQ ID NO: 561510 - DNA, 25 bp, Mus musculus
gcgttcatgcagaagtgcccacata

SEQ ID NO: 561511 - DNA, 25 bp, Mus musculus
gcgttcatgcagtagtgcccacata

SEQ ID NO: 561512 - DNA, 25 bp, Mus musculus
gcgttcatttacctaagcagtagtc

SEQ ID NO: 561513 - DNA, 25 bp, Mus musculus
gcgttcatttacgtaagcagtagtc

SEQ ID NO: 561514 - DNA, 25 bp, Mus musculus
gcgttcatttgcagagactgttcga

SEQ ID NO: 561515 - DNA, 25 bp, Mus musculus
gcgttcatttgctgagactgttcga

SEQ ID NO: 561516 - DNA, 25 bp, Mus musculus
gcgttcccaatgagtagacggactt

SEQ ID NO: 561517 - DNA, 25 bp, Mus musculus
gcgttcccaatgtgtagacggactt

SEQ ID NO: 561518 - DNA, 25 bp, Mus musculus
gcgttcccatctagtgtatttggtt

SEQ ID NO: 561519 - DNA, 25 bp, Mus musculus
gcgttcccatcttgtgtatttggtt

SEQ ID NO: 561520 - DNA, 25 bp, Mus musculus
gcgttcccgatccagagaccgtgga

SEQ ID NO: 561521 - DNA, 25 bp, Mus musculus
gcgttcccgatcgagagaccgtgga

SEQ ID NO: 561522 - DNA, 25 bp, Mus musculus
gcgttcccggttcatgccataaaga

SEQ ID NO: 561523 - DNA, 25 bp, Mus musculus
gcgttcccggttgatgccataaaga

SEQ ID NO: 561524 - DNA, 25 bp, Mus musculus
gcgttcctggtacctcctaaaggag

SEQ ID NO: 561525 - DNA, 25 bp, Mus musculus
gcgttcctggtagctcctaaaggag

SEQ ID NO: 561526 - DNA, 25 bp, Mus musculus
gcgttccttcatctctcctggaact

SEQ ID NO: 561527 - DNA, 25 bp, Mus musculus
gcgttccttcatgtctcctggaact

SEQ ID NO: 561528 - DNA, 25 bp, Mus musculus
gcgttccttctgactccgggtacct

SEQ ID NO: 561529 - DNA, 25 bp, Mus musculus
gcgttccttctgtctccgggtacct

SEQ ID NO: 561530 - DNA, 25 bp, Mus musculus
gcgttcgagaaactgaccccagtga

SEQ ID NO: 561531 - DNA, 25 bp, Mus musculus
gcgttcgagaaagtgaccccagtga

SEQ ID NO: 561532 - DNA, 25 bp, Mus musculus
gcgttcgcagttccagcgattgcaa

SEQ ID NO: 561533 - DNA, 25 bp, Mus musculus
gcgttcgcagttgcagcgattgcaa

SEQ ID NO: 561534 - DNA, 25 bp, Mus musculus
gcgttcgcgttcagctgactaacgg

SEQ ID NO: 561535 - DNA, 25 bp, Mus musculus
gcgttcgcgttctgctgactaacgg

SEQ ID NO: 561536 - DNA, 25 bp, Mus musculus
gcgttcgtgagcaactggcatggta

SEQ ID NO: 561537 - DNA, 25 bp, Mus musculus
gcgttcgtgagctactggcatggta

SEQ ID NO: 561538 - DNA, 25 bp, Mus musculus
gcgttctaacgcatggagtaataat

SEQ ID NO: 561539 - DNA, 25 bp, Mus musculus
gcgttctaacgcttggagtaataat

SEQ ID NO: 561540 - DNA, 25 bp, Mus musculus
gcgttctatcaccaggttttacctg

SEQ ID NO: 561541 - DNA, 25 bp, Mus musculus
gcgttctatcacgaggttttacctg

SEQ ID NO: 561542 - DNA, 25 bp, Mus musculus
gcgttctatcagaagtctgtttctg

SEQ ID NO: 561543 - DNA, 25 bp, Mus musculus
gcgttctatcagtagtctgtttctg

SEQ ID NO: 561544 - DNA, 25 bp, Mus musculus
gcgttctcagtcatcccaggccaag

SEQ ID NO: 561545 - DNA, 25 bp, Mus musculus
gcgttctcagtcttcccaggccaag

SEQ ID NO: 561546 - DNA, 25 bp, Mus musculus
gcgttctcgaacacaggcagacaag

SEQ ID NO: 561547 - DNA, 25 bp, Mus musculus
gcgttctcgaactcaggcagacaag

SEQ ID NO: 561548 - DNA, 25 bp, Mus musculus
gcgttctcttctcagatccgaatgt

SEQ ID NO: 561549 - DNA, 25 bp, Mus musculus
gcgttctcttctgagatccgaatgt

SEQ ID NO: 561550 - DNA, 25 bp, Mus musculus
gcgttctgcaccatccaaaggagga

SEQ ID NO: 561551 - DNA, 25 bp, Mus musculus
gcgttctgcaccttccaaaggagga

SEQ ID NO: 561552 - DNA, 25 bp, Mus musculus
gcgttctgggaaattgtcacatgtt

SEQ ID NO: 561553 - DNA, 25 bp, Mus musculus
gcgttctgggaatttgtcacatgtt

SEQ ID NO: 561554 - DNA, 25 bp, Mus musculus
gcgttctgggccaggctacagataa

SEQ ID NO: 561555 - DNA, 25 bp, Mus musculus
gcgttctgggcctggctacagataa

SEQ ID NO: 561556 - DNA, 25 bp, Mus musculus
gcgttctggttgcacattagtctgt

SEQ ID NO: 561557 - DNA, 25 bp, Mus musculus
gcgttctggttggacattagtctgt

SEQ ID NO: 561558 - DNA, 25 bp, Mus musculus
gcgttctgtgacatcagttgtcctt

SEQ ID NO: 561559 - DNA, 25 bp, Mus musculus
gcgttctgtgacttcagttgtcctt

SEQ ID NO: 561560 - DNA, 25 bp, Mus musculus
gcgttcttaacaagcagcctagtgt

SEQ ID NO: 561561 - DNA, 25 bp, Mus musculus
gcgttcttaacatgcagcctagtgt

SEQ ID NO: 561562 - DNA, 25 bp, Mus musculus
gcgttcttcacgctttgagtagctt

SEQ ID NO: 561563 - DNA, 25 bp, Mus musculus
gcgttcttcacggtttgagtagctt

SEQ ID NO: 561564 - DNA, 25 bp, Mus musculus
gcgttcttccagaaattctgcttct

SEQ ID NO: 561565 - DNA, 25 bp, Mus musculus
gcgttcttccagtaattctgcttct

SEQ ID NO: 561566 - DNA, 25 bp, Mus musculus
gcgttcttcttaccgagtacagtca

SEQ ID NO: 561567 - DNA, 25 bp, Mus musculus
gcgttcttcttagcgagtacagtca

SEQ ID NO: 561568 - DNA, 25 bp, Mus musculus
gcgttcttgtggaactggtgccaca

SEQ ID NO: 561569 - DNA, 25 bp, Mus musculus
gcgttcttgtggtactggtgccaca

SEQ ID NO: 561570 - DNA, 25 bp, Mus musculus
gcgttcttttcactggtttatctac

SEQ ID NO: 561571 - DNA, 25 bp, Mus musculus
gcgttcttttcagtggtttatctac

SEQ ID NO: 561572 - DNA, 25 bp, Mus musculus
gcgttgaactgtattcttgatgcat

SEQ ID NO: 561573 - DNA, 25 bp, Mus musculus
gcgttgaactgttttcttgatgcat

SEQ ID NO: 561574 - DNA, 25 bp, Mus musculus
gcgttgaattgcagtcttaagctta

SEQ ID NO: 561575 - DNA, 25 bp, Mus musculus
gcgttgaattgctgtcttaagctta

SEQ ID NO: 561576 - DNA, 25 bp, Mus musculus
gcgttgactgtaagcattttctgca

SEQ ID NO: 561577 - DNA, 25 bp, Mus musculus
gcgttgactgtatgcattttctgca

SEQ ID NO: 561578 - DNA, 25 bp, Mus musculus
gcgttgagaaggatatttccctctt

SEQ ID NO: 561579 - DNA, 25 bp, Mus musculus
gcgttgagaaggttatttccctctt

SEQ ID NO: 561580 - DNA, 25 bp, Mus musculus
gcgttgcaatcaaatacggtatttc

SEQ ID NO: 561581 - DNA, 25 bp, Mus musculus
gcgttgcaatcatatacggtatttc

SEQ ID NO: 561582 - DNA, 25 bp, Mus musculus
gcgttgctaggaatgcgtcagtttt

SEQ ID NO: 561583 - DNA, 25 bp, Mus musculus
gcgttgctaggattgcgtcagtttt

SEQ ID NO: 561584 - DNA, 25 bp, Mus musculus
gcgttggaatctcctgatgctgtga

SEQ ID NO: 561585 - DNA, 25 bp, Mus musculus
gcgttggaatctgctgatgctgtga

SEQ ID NO: 561586 - DNA, 25 bp, Mus musculus
gcgttggacacaagagcctctggga

SEQ ID NO: 561587 - DNA, 25 bp, Mus musculus
gcgttggacacatgagcctctggga

SEQ ID NO: 561588 - DNA, 25 bp, Mus musculus
gcgttggcagcaagcaagacagtta

SEQ ID NO: 561589 - DNA, 25 bp, Mus musculus
gcgttggcagcatgcaagacagtta

SEQ ID NO: 561590 - DNA, 25 bp, Mus musculus
gcgttggccacgatttacagtgttt

SEQ ID NO: 561591 - DNA, 25 bp, Mus musculus
gcgttggccacgttttacagtgttt

SEQ ID NO: 561592 - DNA, 25 bp, Mus musculus
gcgttggctcggaccggctgtcctc

SEQ ID NO: 561593 - DNA, 25 bp, Mus musculus
gcgttggctcggtccggctgtcctc

SEQ ID NO: 561594 - DNA, 25 bp, Mus musculus
gcgttgggagcaagcttttcacagc

SEQ ID NO: 561595 - DNA, 25 bp, Mus musculus
gcgttgggagcatgcttttcacagc

SEQ ID NO: 561596 - DNA, 25 bp, Mus musculus
gcgttgggccatcaatgaacattta

SEQ ID NO: 561597 - DNA, 25 bp, Mus musculus
gcgttgggccatgaatgaacattta

SEQ ID NO: 561598 - DNA, 25 bp, Mus musculus
gcgttgggtccaaagatgcagtccc

SEQ ID NO: 561599 - DNA, 25 bp, Mus musculus
gcgttgggtccatagatgcagtccc

SEQ ID NO: 561600 - DNA, 25 bp, Mus musculus
gcgttggtcctcatttatgccatag

SEQ ID NO: 561601 - DNA, 25 bp, Mus musculus
gcgttggtcctcttttatgccatag

SEQ ID NO: 561602 - DNA, 25 bp, Mus musculus
gcgttggtgccaagaatgcttttgc

SEQ ID NO: 561603 - DNA, 25 bp, Mus musculus
gcgttggtgccatgaatgcttttgc

SEQ ID NO: 561604 - DNA, 25 bp, Mus musculus
gcgttggtgcccaagctgacaaagg

SEQ ID NO: 561605 - DNA, 25 bp, Mus musculus
gcgttggtgccctagctgacaaagg

SEQ ID NO: 561606 - DNA, 25 bp, Mus musculus
gcgttgtagacgcaagcctgcagtc

SEQ ID NO: 561607 - DNA, 25 bp, Mus musculus
gcgttgtagacggaagcctgcagtc

SEQ ID NO: 561608 - DNA, 25 bp, Mus musculus
gcgttgtcaacaattttaggcctat

SEQ ID NO: 561609 - DNA, 25 bp, Mus musculus
gcgttgtcaacatttttaggcctat

SEQ ID NO: 561610 - DNA, 25 bp, Mus musculus
gcgttgtcactgaccattcttgcct

SEQ ID NO: 561611 - DNA, 25 bp, Mus musculus
gcgttgtcactgtccattcttgcct

SEQ ID NO: 561612 - DNA, 25 bp, Mus musculus
gcgttgtcacttcctgtctgcttcc

SEQ ID NO: 561613 - DNA, 25 bp, Mus musculus
gcgttgtcacttgctgtctgcttcc

SEQ ID NO: 561614 - DNA, 25 bp, Mus musculus
gcgttgtgaaccacagtagtagctg

SEQ ID NO: 561615 - DNA, 25 bp, Mus musculus
gcgttgtgaacctcagtagtagctg

SEQ ID NO: 561616 - DNA, 25 bp, Mus musculus
gcgttgtgacatcgaaaggcagaat

SEQ ID NO: 561617 - DNA, 25 bp, Mus musculus
gcgttgtgacatggaaaggcagaat

SEQ ID NO: 561618 - DNA, 25 bp, Mus musculus
gcgttgtgatctaaggcttcatcgt

SEQ ID NO: 561619 - DNA, 25 bp, Mus musculus
gcgttgtgatcttaggcttcatcgt

SEQ ID NO: 561620 - DNA, 25 bp, Mus musculus
gcgttgttagcaacacatctaccag

SEQ ID NO: 561621 - DNA, 25 bp, Mus musculus
gcgttgttagcatcacatctaccag

SEQ ID NO: 561622 - DNA, 25 bp, Mus musculus
gcgttgttcaggcagtttaccccta

SEQ ID NO: 561623 - DNA, 25 bp, Mus musculus
gcgttgttcagggagtttaccccta

SEQ ID NO: 561624 - DNA, 25 bp, Mus musculus
gcgtttaaactgatcagagccacat

SEQ ID NO: 561625 - DNA, 25 bp, Mus musculus
gcgtttaaactgttcagagccacat

SEQ ID NO: 561626 - DNA, 25 bp, Mus musculus
gcgtttaaattgactgaatctacct

SEQ ID NO: 561627 - DNA, 25 bp, Mus musculus
gcgtttaaattgtctgaatctacct

SEQ ID NO: 561628 - DNA, 25 bp, Mus musculus
gcgtttaacatgaagtttacccatt

SEQ ID NO: 561629 - DNA, 25 bp, Mus musculus
gcgtttaacatgtagtttacccatt

SEQ ID NO: 561630 - DNA, 25 bp, Mus musculus
gcgtttaatcagctccacagtggat

SEQ ID NO: 561631 - DNA, 25 bp, Mus musculus
gcgtttaatcaggtccacagtggat

SEQ ID NO: 561632 - DNA, 25 bp, Mus musculus
gcgtttacacaacatcaagcctgga

SEQ ID NO: 561633 - DNA, 25 bp, Mus musculus
gcgtttacacaagatcaagcctgga

SEQ ID NO: 561634 - DNA, 25 bp, Mus musculus
gcgtttacccaaactcccattataa

SEQ ID NO: 561635 - DNA, 25 bp, Mus musculus
gcgtttacccaatctcccattataa

SEQ ID NO: 561636 - DNA, 25 bp, Mus musculus
gcgtttacggtgaagtttagctcct

SEQ ID NO: 561637 - DNA, 25 bp, Mus musculus
gcgtttacggtgtagtttagctcct

SEQ ID NO: 561638 - DNA, 25 bp, Mus musculus
gcgtttactgagaggccttcactgc

SEQ ID NO: 561639 - DNA, 25 bp, Mus musculus
gcgtttactgagtggccttcactgc

SEQ ID NO: 561640 - DNA, 25 bp, Mus musculus
gcgtttactttgaggctccatcgaa

SEQ ID NO: 561641 - DNA, 25 bp, Mus musculus
gcgtttactttgtggctccatcgaa

SEQ ID NO: 561642 - DNA, 25 bp, Mus musculus
gcgtttatcaccatattgcttgcag

SEQ ID NO: 561643 - DNA, 25 bp, Mus musculus
gcgtttatcaccttattgcttgcag

SEQ ID NO: 561644 - DNA, 25 bp, Mus musculus
gcgtttcaacataattcagccagga

SEQ ID NO: 561645 - DNA, 25 bp, Mus musculus
gcgtttcaacattattcagccagga

SEQ ID NO: 561646 - DNA, 25 bp, Mus musculus
gcgtttcagatcaacacctttaacc

SEQ ID NO: 561647 - DNA, 25 bp, Mus musculus
gcgtttcagatctacacctttaacc

SEQ ID NO: 561648 - DNA, 25 bp, Mus musculus
gcgtttcaggagacaactgttgcga

SEQ ID NO: 561649 - DNA, 25 bp, Mus musculus
gcgtttcaggagtcaactgttgcga

SEQ ID NO: 561650 - DNA, 25 bp, Mus musculus
gcgtttccagtgcagttgggcatat

SEQ ID NO: 561651 - DNA, 25 bp, Mus musculus
gcgtttccagtggagttgggcatat

SEQ ID NO: 561652 - DNA, 25 bp, Mus musculus
gcgtttccatagagctgagcttcat

SEQ ID NO: 561653 - DNA, 25 bp, Mus musculus
gcgtttccatagtgctgagcttcat

SEQ ID NO: 561654 - DNA, 25 bp, Mus musculus
gcgtttcccctgacagtgaaaatca

SEQ ID NO: 561655 - DNA, 25 bp, Mus musculus
gcgtttcccctgtcagtgaaaatca

SEQ ID NO: 561656 - DNA, 25 bp, Mus musculus
gcgtttcggcccctacaagtgggca

SEQ ID NO: 561657 - DNA, 25 bp, Mus musculus
gcgtttcggcccgtacaagtgggca

SEQ ID NO: 561658 - DNA, 25 bp, Mus musculus
gcgtttctcagcataaacttatccc

SEQ ID NO: 561659 - DNA, 25 bp, Mus musculus
gcgtttctcagcttaaacttatccc

SEQ ID NO: 561660 - DNA, 25 bp, Mus musculus
gcgtttctccttcagattcttgtgt

SEQ ID NO: 561661 - DNA, 25 bp, Mus musculus
gcgtttctccttgagattcttgtgt

SEQ ID NO: 561662 - DNA, 25 bp, Mus musculus
gcgtttctctgtctgattgaaccca

SEQ ID NO: 561663 - DNA, 25 bp, Mus musculus
gcgtttctctgtgtgattgaaccca

SEQ ID NO: 561664 - DNA, 25 bp, Mus musculus
gcgtttcttcgaagagctctggaac

SEQ ID NO: 561665 - DNA, 25 bp, Mus musculus
gcgtttcttcgatgagctctggaac

SEQ ID NO: 561666 - DNA, 25 bp, Mus musculus
gcgtttcttttcagtacaggaccca

SEQ ID NO: 561667 - DNA, 25 bp, Mus musculus
gcgtttcttttctgtacaggaccca

SEQ ID NO: 561668 - DNA, 25 bp, Mus musculus
gcgtttgaggcacttatggcttact

SEQ ID NO: 561669 - DNA, 25 bp, Mus musculus
gcgtttgaggcagttatggcttact

SEQ ID NO: 561670 - DNA, 25 bp, Mus musculus
gcgtttgagtcacagtcttgctcca

SEQ ID NO: 561671 - DNA, 25 bp, Mus musculus
gcgtttgagtcagagtcttgctcca

SEQ ID NO: 561672 - DNA, 25 bp, Mus musculus
gcgtttgatactcatgctttgctaa

SEQ ID NO: 561673 - DNA, 25 bp, Mus musculus
gcgtttgatactgatgctttgctaa

SEQ ID NO: 561674 - DNA, 25 bp, Mus musculus
gcgtttgcacctattgttgggaagt

SEQ ID NO: 561675 - DNA, 25 bp, Mus musculus
gcgtttgcaccttttgttgggaagt

SEQ ID NO: 561676 - DNA, 25 bp, Mus musculus
gcgtttgccctccatggtgtggtaa

SEQ ID NO: 561677 - DNA, 25 bp, Mus musculus
gcgtttgccctcgatggtgtggtaa

SEQ ID NO: 561678 - DNA, 25 bp, Mus musculus
gcgtttgcctcaccggatatgttta

SEQ ID NO: 561679 - DNA, 25 bp, Mus musculus
gcgtttgcctcagcggatatgttta

SEQ ID NO: 561680 - DNA, 25 bp, Mus musculus
gcgtttgcgtggaccgaccggaaat

SEQ ID NO: 561681 - DNA, 25 bp, Mus musculus
gcgtttgcgtggtccgaccggaaat

SEQ ID NO: 561682 - DNA, 25 bp, Mus musculus
gcgtttgggcaacgtcattagagac

SEQ ID NO: 561683 - DNA, 25 bp, Mus musculus
gcgtttgggcaaggtcattagagac

SEQ ID NO: 561684 - DNA, 25 bp, Mus musculus
gcgtttggtattcagaattcttccc

SEQ ID NO: 561685 - DNA, 25 bp, Mus musculus
gcgtttggtattgagaattcttccc

SEQ ID NO: 561686 - DNA, 25 bp, Mus musculus
gcgtttggttacagaagcctgctca

SEQ ID NO: 561687 - DNA, 25 bp, Mus musculus
gcgtttggttactgaagcctgctca

SEQ ID NO: 561688 - DNA, 25 bp, Mus musculus
gcgtttgtaaacatgccatgggtcc

SEQ ID NO: 561689 - DNA, 25 bp, Mus musculus
gcgtttgtaaacttgccatgggtcc

SEQ ID NO: 561690 - DNA, 25 bp, Mus musculus
gcgtttgtactaccactgtatttgt

SEQ ID NO: 561691 - DNA, 25 bp, Mus musculus
gcgtttgtactagcactgtatttgt

SEQ ID NO: 561692 - DNA, 25 bp, Mus musculus
gcgtttgttcacactctgctcttga

SEQ ID NO: 561693 - DNA, 25 bp, Mus musculus
gcgtttgttcactctctgctcttga

SEQ ID NO: 561694 - DNA, 25 bp, Mus musculus
gcgtttgttgttagtatgtcacagt

SEQ ID NO: 561695 - DNA, 25 bp, Mus musculus
gcgtttgttgtttgtatgtcacagt

SEQ ID NO: 561696 - DNA, 25 bp, Mus musculus
gcgttttaatcactgctcagtgtaa

SEQ ID NO: 561697 - DNA, 25 bp, Mus musculus
gcgttttaatcagtgctcagtgtaa

SEQ ID NO: 561698 - DNA, 25 bp, Mus musculus
gcgttttcaacaaatactgctagca

SEQ ID NO: 561699 - DNA, 25 bp, Mus musculus
gcgttttcaacatatactgctagca

SEQ ID NO: 561700 - DNA, 25 bp, Mus musculus
gcgttttcaagcacggagtcagcct

SEQ ID NO: 561701 - DNA, 25 bp, Mus musculus
gcgttttcaagctcggagtcagcct

SEQ ID NO: 561702 - DNA, 25 bp, Mus musculus
gcgttttcattgatacttgtgcttg

SEQ ID NO: 561703 - DNA, 25 bp, Mus musculus
gcgttttcattgttacttgtgcttg

SEQ ID NO: 561704 - DNA, 25 bp, Mus musculus
gcgttttcccaccggccatttctat

SEQ ID NO: 561705 - DNA, 25 bp, Mus musculus
gcgttttcccacgggccatttctat

SEQ ID NO: 561706 - DNA, 25 bp, Mus musculus
gcgttttccctactgtgtgcgagta

SEQ ID NO: 561707 - DNA, 25 bp, Mus musculus
gcgttttccctagtgtgtgcgagta

SEQ ID NO: 561708 - DNA, 25 bp, Mus musculus
gcgttttcctgtatagacctgctaa

SEQ ID NO: 561709 - DNA, 25 bp, Mus musculus
gcgttttcctgtttagacctgctaa

SEQ ID NO: 561710 - DNA, 25 bp, Mus musculus
gcgttttcgttcacacaaacttggg

SEQ ID NO: 561711 - DNA, 25 bp, Mus musculus
gcgttttcgttctcacaaacttggg

SEQ ID NO: 561712 - DNA, 25 bp, Mus musculus
gcgttttctctgatggctgaagttt

SEQ ID NO: 561713 - DNA, 25 bp, Mus musculus
gcgttttctctgttggctgaagttt

SEQ ID NO: 561714 - DNA, 25 bp, Mus musculus
gcgttttctgaccaccggtgtatgt

SEQ ID NO: 561715 - DNA, 25 bp, Mus musculus
gcgttttctgacgaccggtgtatgt

SEQ ID NO: 561716 - DNA, 25 bp, Mus musculus
gcgttttctgggatccgggtgatca

SEQ ID NO: 561717 - DNA, 25 bp, Mus musculus
gcgttttctgggttccgggtgatca

SEQ ID NO: 561718 - DNA, 25 bp, Mus musculus
gcgttttcttttcacccatgtgcaa

SEQ ID NO: 561719 - DNA, 25 bp, Mus musculus
gcgttttcttttgacccatgtgcaa

SEQ ID NO: 561720 - DNA, 25 bp, Mus musculus
gcgttttgcacgatctgtagagaca

SEQ ID NO: 561721 - DNA, 25 bp, Mus musculus
gcgttttgcacgttctgtagagaca

SEQ ID NO: 561722 - DNA, 25 bp, Mus musculus
gcgttttgcagacccaatgatactt

SEQ ID NO: 561723 - DNA, 25 bp, Mus musculus
gcgttttgcagagccaatgatactt

SEQ ID NO: 561724 - DNA, 25 bp, Mus musculus
gcgttttgctttataggtcactaat

SEQ ID NO: 561725 - DNA, 25 bp, Mus musculus
gcgttttgctttttaggtcactaat

SEQ ID NO: 561726 - DNA, 25 bp, Mus musculus
gcgttttggaagcagattgctacac

SEQ ID NO: 561727 - DNA, 25 bp, Mus musculus
gcgttttggaaggagattgctacac

SEQ ID NO: 561728 - DNA, 25 bp, Mus musculus
gcgttttggaccatgttaggaccat

SEQ ID NO: 561729 - DNA, 25 bp, Mus musculus
gcgttttggaccttgttaggaccat

SEQ ID NO: 561730 - DNA, 25 bp, Mus musculus
gcgttttggcagaagagctttttat

SEQ ID NO: 561731 - DNA, 25 bp, Mus musculus
gcgttttggcagtagagctttttat

SEQ ID NO: 561732 - DNA, 25 bp, Mus musculus
gcgtttttaaagaccgagttctgtg

SEQ ID NO: 561733 - DNA, 25 bp, Mus musculus
gcgtttttaaagtccgagttctgtg

SEQ ID NO: 561734 - DNA, 25 bp, Mus musculus
gcgtttttcaccagtacgaggagta

SEQ ID NO: 561735 - DNA, 25 bp, Mus musculus
gcgtttttcacctgtacgaggagta

SEQ ID NO: 561736 - DNA, 25 bp, Mus musculus
gcgtttttctctcctcacttcagaa

SEQ ID NO: 561737 - DNA, 25 bp, Mus musculus
gcgtttttctctgctcacttcagaa

SEQ ID NO: 561738 - DNA, 25 bp, Mus musculus
gcgtttttctgtaccctagatcctt

SEQ ID NO: 561739 - DNA, 25 bp, Mus musculus
gcgtttttctgttccctagatcctt

SEQ ID NO: 561740 - DNA, 25 bp, Mus musculus
gcgtttttgagtctgtcatcgatat

SEQ ID NO: 561741 - DNA, 25 bp, Mus musculus
gcgtttttgagtgtgtcatcgatat

SEQ ID NO: 561742 - DNA, 25 bp, Mus musculus
gcgtttttgggacctgcagaaatct

SEQ ID NO: 561743 - DNA, 25 bp, Mus musculus
gcgtttttgggagctgcagaaatct

SEQ ID NO: 561744 - DNA, 25 bp, Mus musculus
gcgtttttgttgaggtttcgtgtgc

SEQ ID NO: 561745 - DNA, 25 bp, Mus musculus
gcgtttttgttgtggtttcgtgtgc

SEQ ID NO: 561746 - DNA, 25 bp, Mus musculus
gcgttttttataagcgtggccgcca

SEQ ID NO: 561747 - DNA, 25 bp, Mus musculus
gcgttttttatatgcgtggccgcca

SEQ ID NO: 561748 - DNA, 25 bp, Mus musculus
gctaaaaaatctcagggcaagttct

SEQ ID NO: 561749 - DNA, 25 bp, Mus musculus
gctaaaaaatctgagggcaagttct

SEQ ID NO: 561750 - DNA, 25 bp, Mus musculus
gctaaaaacatacatcatctatgct

SEQ ID NO: 561751 - DNA, 25 bp, Mus musculus
gctaaaaacatagatcatctatgct

SEQ ID NO: 561752 - DNA, 25 bp, Mus musculus
gctaaaaaccgcagcctgtgtgtgg

SEQ ID NO: 561753 - DNA, 25 bp, Mus musculus
gctaaaaaccgctgcctgtgtgtgg

SEQ ID NO: 561754 - DNA, 25 bp, Mus musculus
gctaaaaacgaactagcgccttgtt

SEQ ID NO: 561755 - DNA, 25 bp, Mus musculus
gctaaaaacgaagtagcgccttgtt

SEQ ID NO: 561756 - DNA, 25 bp, Mus musculus
gctaaaaagggcacaggctcaattt

SEQ ID NO: 561757 - DNA, 25 bp, Mus musculus
gctaaaaagggctcaggctcaattt

SEQ ID NO: 561758 - DNA, 25 bp, Mus musculus
gctaaaaagttaccgctcagccact

SEQ ID NO: 561759 - DNA, 25 bp, Mus musculus
gctaaaaagttagcgctcagccact

SEQ ID NO: 561760 - DNA, 25 bp, Mus musculus
gctaaaaatgatcttgctgttgtgg

SEQ ID NO: 561761 - DNA, 25 bp, Mus musculus
gctaaaaatgatgttgctgttgtgg

SEQ ID NO: 561762 - DNA, 25 bp, Mus musculus
gctaaaaatgggacttcttttcaca

SEQ ID NO: 561763 - DNA, 25 bp, Mus musculus
gctaaaaatgggtcttcttttcaca

SEQ ID NO: 561764 - DNA, 25 bp, Mus musculus
gctaaaaatgtgagccctcggcttc

SEQ ID NO: 561765 - DNA, 25 bp, Mus musculus
gctaaaaatgtgtgccctcggcttc

SEQ ID NO: 561766 - DNA, 25 bp, Mus musculus
gctaaaaccaggctgcatttaatgt

SEQ ID NO: 561767 - DNA, 25 bp, Mus musculus
gctaaaaccagggtgcatttaatgt

SEQ ID NO: 561768 - DNA, 25 bp, Mus musculus
gctaaaaccattcttccacccggat

SEQ ID NO: 561769 - DNA, 25 bp, Mus musculus
gctaaaaccattgttccacccggat

SEQ ID NO: 561770 - DNA, 25 bp, Mus musculus
gctaaaactcagatcctgggctgga

SEQ ID NO: 561771 - DNA, 25 bp, Mus musculus
gctaaaactcagttcctgggctgga

SEQ ID NO: 561772 - DNA, 25 bp, Mus musculus
gctaaaactgagacacattattctg

SEQ ID NO: 561773 - DNA, 25 bp, Mus musculus
gctaaaactgagtcacattattctg

SEQ ID NO: 561774 - DNA, 25 bp, Mus musculus
gctaaaagctgtctgtctgtggcag

SEQ ID NO: 561775 - DNA, 25 bp, Mus musculus
gctaaaagctgtgtgtctgtggcag

SEQ ID NO: 561776 - DNA, 25 bp, Mus musculus
gctaaaaggcacataaccttggtgg

SEQ ID NO: 561777 - DNA, 25 bp, Mus musculus
gctaaaaggcacttaaccttggtgg

SEQ ID NO: 561778 - DNA, 25 bp, Mus musculus
gctaaaagtcatcttcgagtttttt

SEQ ID NO: 561779 - DNA, 25 bp, Mus musculus
gctaaaagtcatgttcgagtttttt

SEQ ID NO: 561780 - DNA, 25 bp, Mus musculus
gctaaaagttggatgcagcagttat

SEQ ID NO: 561781 - DNA, 25 bp, Mus musculus
gctaaaagttggttgcagcagttat

SEQ ID NO: 561782 - DNA, 25 bp, Mus musculus
gctaaaatcattactgtccaatcta

SEQ ID NO: 561783 - DNA, 25 bp, Mus musculus
gctaaaatcatttctgtccaatcta

SEQ ID NO: 561784 - DNA, 25 bp, Mus musculus
gctaaaatctaaactgctcacatat

SEQ ID NO: 561785 - DNA, 25 bp, Mus musculus
gctaaaatctaatctgctcacatat

SEQ ID NO: 561786 - DNA, 25 bp, Mus musculus
gctaaaatgacgaaggctgcctcat

SEQ ID NO: 561787 - DNA, 25 bp, Mus musculus
gctaaaatgacgtaggctgcctcat

SEQ ID NO: 561788 - DNA, 25 bp, Mus musculus
gctaaaatgatgactgccaaatatg

SEQ ID NO: 561789 - DNA, 25 bp, Mus musculus
gctaaaatgatgtctgccaaatatg

SEQ ID NO: 561790 - DNA, 25 bp, Mus musculus
gctaaaatgtcacagccatatatat

SEQ ID NO: 561791 - DNA, 25 bp, Mus musculus
gctaaaatgtcagagccatatatat

SEQ ID NO: 561792 - DNA, 25 bp, Mus musculus
gctaaaatgtttagcctgctctgga

SEQ ID NO: 561793 - DNA, 25 bp, Mus musculus
gctaaaatgttttgcctgctctgga

SEQ ID NO: 561794 - DNA, 25 bp, Mus musculus
gctaaacaagttaggcttctactca

SEQ ID NO: 561795 - DNA, 25 bp, Mus musculus
gctaaacaagtttggcttctactca

SEQ ID NO: 561796 - DNA, 25 bp, Mus musculus
gctaaacacacccagtttgaggaaa

SEQ ID NO: 561797 - DNA, 25 bp, Mus musculus
gctaaacacaccgagtttgaggaaa

SEQ ID NO: 561798 - DNA, 25 bp, Mus musculus
gctaaacacattcccaagcctggca

SEQ ID NO: 561799 - DNA, 25 bp, Mus musculus
gctaaacacattgccaagcctggca

SEQ ID NO: 561800 - DNA, 25 bp, Mus musculus
gctaaacacttcagcatgcacaagg

SEQ ID NO: 561801 - DNA, 25 bp, Mus musculus
gctaaacacttctgcatgcacaagg

SEQ ID NO: 561802 - DNA, 25 bp, Mus musculus
gctaaacagcccctctgaatagaca

SEQ ID NO: 561803 - DNA, 25 bp, Mus musculus
gctaaacagcccgtctgaatagaca

SEQ ID NO: 561804 - DNA, 25 bp, Mus musculus
gctaaacagcctacccaaatggttt

SEQ ID NO: 561805 - DNA, 25 bp, Mus musculus
gctaaacagccttcccaaatggttt

SEQ ID NO: 561806 - DNA, 25 bp, Mus musculus
gctaaaccaagtctactgccattgt

SEQ ID NO: 561807 - DNA, 25 bp, Mus musculus
gctaaaccaagtgtactgccattgt

SEQ ID NO: 561808 - DNA, 25 bp, Mus musculus
gctaaacccaatccgccaggcgtct

SEQ ID NO: 561809 - DNA, 25 bp, Mus musculus
gctaaacccaatgcgccaggcgtct

SEQ ID NO: 561810 - DNA, 25 bp, Mus musculus
gctaaacccacacgactcattaaca

SEQ ID NO: 561811 - DNA, 25 bp, Mus musculus
gctaaacccacaggactcattaaca

SEQ ID NO: 561812 - DNA, 25 bp, Mus musculus
gctaaacccattctaatgcacattt

SEQ ID NO: 561813 - DNA, 25 bp, Mus musculus
gctaaacccattgtaatgcacattt

SEQ ID NO: 561814 - DNA, 25 bp, Mus musculus
gctaaacctaggacatcttttgagt

SEQ ID NO: 561815 - DNA, 25 bp, Mus musculus
gctaaacctaggtcatcttttgagt

SEQ ID NO: 561816 - DNA, 25 bp, Mus musculus
gctaaacctcagatttacctgtccg

SEQ ID NO: 561817 - DNA, 25 bp, Mus musculus
gctaaacctcagttttacctgtccg

SEQ ID NO: 561818 - DNA, 25 bp, Mus musculus
gctaaacctgccagctggccaagga

SEQ ID NO: 561819 - DNA, 25 bp, Mus musculus
gctaaacctgcctgctggccaagga

SEQ ID NO: 561820 - DNA, 25 bp, Mus musculus
gctaaactcacgcagcaggtcttca

SEQ ID NO: 561821 - DNA, 25 bp, Mus musculus
gctaaactcacggagcaggtcttca

SEQ ID NO: 561822 - DNA, 25 bp, Mus musculus
gctaaactccataacggtgacctca

SEQ ID NO: 561823 - DNA, 25 bp, Mus musculus
gctaaactccattacggtgacctca

SEQ ID NO: 561824 - DNA, 25 bp, Mus musculus
gctaaactctgccttcgggactggg

SEQ ID NO: 561825 - DNA, 25 bp, Mus musculus
gctaaactctgcgttcgggactggg

SEQ ID NO: 561826 - DNA, 25 bp, Mus musculus
gctaaactgagcaccagacgtgtct

SEQ ID NO: 561827 - DNA, 25 bp, Mus musculus
gctaaactgagctccagacgtgtct

SEQ ID NO: 561828 - DNA, 25 bp, Mus musculus
gctaaactgcttaattttgacctgt

SEQ ID NO: 561829 - DNA, 25 bp, Mus musculus
gctaaactgctttattttgacctgt

SEQ ID NO: 561830 - DNA, 25 bp, Mus musculus
gctaaacttagccttgacaatgtca

SEQ ID NO: 561831 - DNA, 25 bp, Mus musculus
gctaaacttagcgttgacaatgtca

SEQ ID NO: 561832 - DNA, 25 bp, Mus musculus
gctaaacttatccagcaccgtggga

SEQ ID NO: 561833 - DNA, 25 bp, Mus musculus
gctaaacttatcgagcaccgtggga

SEQ ID NO: 561834 - DNA, 25 bp, Mus musculus
gctaaacttccaagtgtcatgattt

SEQ ID NO: 561835 - DNA, 25 bp, Mus musculus
gctaaacttccatgtgtcatgattt

SEQ ID NO: 561836 - DNA, 25 bp, Mus musculus
gctaaagaaacaccccttcaccgga

SEQ ID NO: 561837 - DNA, 25 bp, Mus musculus
gctaaagaaacagcccttcaccgga

SEQ ID NO: 561838 - DNA, 25 bp, Mus musculus
gctaaagaaagtcaccaccttttgt

SEQ ID NO: 561839 - DNA, 25 bp, Mus musculus
gctaaagaaagtgaccaccttttgt

SEQ ID NO: 561840 - DNA, 25 bp, Mus musculus
gctaaagaacggactctgctgcttc

SEQ ID NO: 561841 - DNA, 25 bp, Mus musculus
gctaaagaacggtctctgctgcttc

SEQ ID NO: 561842 - DNA, 25 bp, Mus musculus
gctaaagagagcatttctgttgcta

SEQ ID NO: 561843 - DNA, 25 bp, Mus musculus
gctaaagagagcttttctgttgcta

SEQ ID NO: 561844 - DNA, 25 bp, Mus musculus
gctaaagagatcacatattctgacc

SEQ ID NO: 561845 - DNA, 25 bp, Mus musculus
gctaaagagatctcatattctgacc

SEQ ID NO: 561846 - DNA, 25 bp, Mus musculus
gctaaagagcccataaaattgtcgg

SEQ ID NO: 561847 - DNA, 25 bp, Mus musculus
gctaaagagcccttaaaattgtcgg

SEQ ID NO: 561848 - DNA, 25 bp, Mus musculus
gctaaagagctcactagaacctgct

SEQ ID NO: 561849 - DNA, 25 bp, Mus musculus
gctaaagagctctctagaacctgct

SEQ ID NO: 561850 - DNA, 25 bp, Mus musculus
gctaaagcaccacctacattatttt

SEQ ID NO: 561851 - DNA, 25 bp, Mus musculus
gctaaagcaccagctacattatttt

SEQ ID NO: 561852 - DNA, 25 bp, Mus musculus
gctaaagcagcacccgccaaacagg

SEQ ID NO: 561853 - DNA, 25 bp, Mus musculus
gctaaagcagcagccgccaaacagg

SEQ ID NO: 561854 - DNA, 25 bp, Mus musculus
gctaaagcagtaagtgatcctttga

SEQ ID NO: 561855 - DNA, 25 bp, Mus musculus
gctaaagcagtatgtgatcctttga

SEQ ID NO: 561856 - DNA, 25 bp, Mus musculus
gctaaagcccttatgtcctggaaaa

SEQ ID NO: 561857 - DNA, 25 bp, Mus musculus
gctaaagcccttttgtcctggaaaa

SEQ ID NO: 561858 - DNA, 25 bp, Mus musculus
gctaaagctgcaattgtctgttatg

SEQ ID NO: 561859 - DNA, 25 bp, Mus musculus
gctaaagctgcatttgtctgttatg

SEQ ID NO: 561860 - DNA, 25 bp, Mus musculus
gctaaagctgctactgtttctaagg

SEQ ID NO: 561861 - DNA, 25 bp, Mus musculus
gctaaagctgcttctgtttctaagg

SEQ ID NO: 561862 - DNA, 25 bp, Mus musculus
gctaaaggaaacattgaggaaattt

SEQ ID NO: 561863 - DNA, 25 bp, Mus musculus
gctaaaggaaactttgaggaaattt

SEQ ID NO: 561864 - DNA, 25 bp, Mus musculus
gctaaaggagttagccacccaccag

SEQ ID NO: 561865 - DNA, 25 bp, Mus musculus
gctaaaggagtttgccacccaccag

SEQ ID NO: 561866 - DNA, 25 bp, Mus musculus
gctaaaggatcgcaattgtcacaac

SEQ ID NO: 561867 - DNA, 25 bp, Mus musculus
gctaaaggatcggaattgtcacaac

SEQ ID NO: 561868 - DNA, 25 bp, Mus musculus
gctaaaggattgcaccatcaagcct

SEQ ID NO: 561869 - DNA, 25 bp, Mus musculus
gctaaaggattggaccatcaagcct

SEQ ID NO: 561870 - DNA, 25 bp, Mus musculus
gctaaaggcactaatgtttcagttt

SEQ ID NO: 561871 - DNA, 25 bp, Mus musculus
gctaaaggcacttatgtttcagttt

SEQ ID NO: 561872 - DNA, 25 bp, Mus musculus
gctaaaggccatagtacaactgggt

SEQ ID NO: 561873 - DNA, 25 bp, Mus musculus
gctaaaggccattgtacaactgggt

SEQ ID NO: 561874 - DNA, 25 bp, Mus musculus
gctaaaggccctcagaaagaacatg

SEQ ID NO: 561875 - DNA, 25 bp, Mus musculus
gctaaaggccctgagaaagaacatg

SEQ ID NO: 561876 - DNA, 25 bp, Mus musculus
gctaaaggcttcacaggacaagcac

SEQ ID NO: 561877 - DNA, 25 bp, Mus musculus
gctaaaggcttctcaggacaagcac

SEQ ID NO: 561878 - DNA, 25 bp, Mus musculus
gctaaaggtgtgattgctatgttga

SEQ ID NO: 561879 - DNA, 25 bp, Mus musculus
gctaaaggtgtgtttgctatgttga

SEQ ID NO: 561880 - DNA, 25 bp, Mus musculus
gctaaagtaaaactcatttgcggtt

SEQ ID NO: 561881 - DNA, 25 bp, Mus musculus
gctaaagtaaaagtcatttgcggtt

SEQ ID NO: 561882 - DNA, 25 bp, Mus musculus
gctaaagtaaccatgtagataccat

SEQ ID NO: 561883 - DNA, 25 bp, Mus musculus
gctaaagtaaccttgtagataccat

SEQ ID NO: 561884 - DNA, 25 bp, Mus musculus
gctaaagtagcacctgatgggtatc

SEQ ID NO: 561885 - DNA, 25 bp, Mus musculus
gctaaagtagcagctgatgggtatc

SEQ ID NO: 561886 - DNA, 25 bp, Mus musculus
gctaaagtagctcctacttcctcat

SEQ ID NO: 561887 - DNA, 25 bp, Mus musculus
gctaaagtagctgctacttcctcat

SEQ ID NO: 561888 - DNA, 25 bp, Mus musculus
gctaaagtccacagccaggtgtttg

SEQ ID NO: 561889 - DNA, 25 bp, Mus musculus
gctaaagtccactgccaggtgtttg

SEQ ID NO: 561890 - DNA, 25 bp, Mus musculus
gctaaagtgcctaatgagacctcaa

SEQ ID NO: 561891 - DNA, 25 bp, Mus musculus
gctaaagtgccttatgagacctcaa

SEQ ID NO: 561892 - DNA, 25 bp, Mus musculus
gctaaagttgacagccaatggccgg

SEQ ID NO: 561893 - DNA, 25 bp, Mus musculus
gctaaagttgactgccaatggccgg

SEQ ID NO: 561894 - DNA, 25 bp, Mus musculus
gctaaataaagtcaaccctaggtca

SEQ ID NO: 561895 - DNA, 25 bp, Mus musculus
gctaaataaagtgaaccctaggtca

SEQ ID NO: 561896 - DNA, 25 bp, Mus musculus
gctaaataaatccaagaggtgttta

SEQ ID NO: 561897 - DNA, 25 bp, Mus musculus
gctaaataaatcgaagaggtgttta

SEQ ID NO: 561898 - DNA, 25 bp, Mus musculus
gctaaataacatctctactggattc

SEQ ID NO: 561899 - DNA, 25 bp, Mus musculus
gctaaataacatgtctactggattc

SEQ ID NO: 561900 - DNA, 25 bp, Mus musculus
gctaaataaccacccaccacatatg

SEQ ID NO: 561901 - DNA, 25 bp, Mus musculus
gctaaataaccagccaccacatatg

SEQ ID NO: 561902 - DNA, 25 bp, Mus musculus
gctaaatacctacccttttacatgg

SEQ ID NO: 561903 - DNA, 25 bp, Mus musculus
gctaaatacctagccttttacatgg

SEQ ID NO: 561904 - DNA, 25 bp, Mus musculus
gctaaatacctcaatcagttccaga

SEQ ID NO: 561905 - DNA, 25 bp, Mus musculus
gctaaatacctctatcagttccaga

SEQ ID NO: 561906 - DNA, 25 bp, Mus musculus
gctaaatagggacgtccgtaggcca

SEQ ID NO: 561907 - DNA, 25 bp, Mus musculus
gctaaatagggaggtccgtaggcca

SEQ ID NO: 561908 - DNA, 25 bp, Mus musculus
gctaaatattgtacagggtacttgg

SEQ ID NO: 561909 - DNA, 25 bp, Mus musculus
gctaaatattgttcagggtacttgg

SEQ ID NO: 561910 - DNA, 25 bp, Mus musculus
gctaaatctccgagctgtttattgg

SEQ ID NO: 561911 - DNA, 25 bp, Mus musculus
gctaaatctccgtgctgtttattgg

SEQ ID NO: 561912 - DNA, 25 bp, Mus musculus
gctaaatctcttagaatatgccatt

SEQ ID NO: 561913 - DNA, 25 bp, Mus musculus
gctaaatctctttgaatatgccatt

SEQ ID NO: 561914 - DNA, 25 bp, Mus musculus
gctaaatctgatcaggttcctccct

SEQ ID NO: 561915 - DNA, 25 bp, Mus musculus
gctaaatctgatgaggttcctccct

SEQ ID NO: 561916 - DNA, 25 bp, Mus musculus
gctaaatctggtacctgaaggtcta

SEQ ID NO: 561917 - DNA, 25 bp, Mus musculus
gctaaatctggttcctgaaggtcta

SEQ ID NO: 561918 - DNA, 25 bp, Mus musculus
gctaaatcttagagcaattgttaca

SEQ ID NO: 561919 - DNA, 25 bp, Mus musculus
gctaaatcttagtgcaattgttaca

SEQ ID NO: 561920 - DNA, 25 bp, Mus musculus
gctaaatgccttcagctttactttt

SEQ ID NO: 561921 - DNA, 25 bp, Mus musculus
gctaaatgccttgagctttactttt

SEQ ID NO: 561922 - DNA, 25 bp, Mus musculus
gctaaatggcttctatggcagcatg

SEQ ID NO: 561923 - DNA, 25 bp, Mus musculus
gctaaatggcttgtatggcagcatg

SEQ ID NO: 561924 - DNA, 25 bp, Mus musculus
gctaaattcacacctctcatgaagt

SEQ ID NO: 561925 - DNA, 25 bp, Mus musculus
gctaaattcacagctctcatgaagt

SEQ ID NO: 561926 - DNA, 25 bp, Mus musculus
gctaaattccttctcatattccatg

SEQ ID NO: 561927 - DNA, 25 bp, Mus musculus
gctaaattccttgtcatattccatg

SEQ ID NO: 561928 - DNA, 25 bp, Mus musculus
gctaaattgtctagaggctttgctg

SEQ ID NO: 561929 - DNA, 25 bp, Mus musculus
gctaaattgtcttgaggctttgctg

SEQ ID NO: 561930 - DNA, 25 bp, Mus musculus
gctaaattgtggcttctttcagatt

SEQ ID NO: 561931 - DNA, 25 bp, Mus musculus
gctaaattgtgggttctttcagatt

SEQ ID NO: 561932 - DNA, 25 bp, Mus musculus
gctaacaaagagaaccgggaggcgc

SEQ ID NO: 561933 - DNA, 25 bp, Mus musculus
gctaacaaagagtaccgggaggcgc

SEQ ID NO: 561934 - DNA, 25 bp, Mus musculus
gctaacaacttgctggctggcctaa

SEQ ID NO: 561935 - DNA, 25 bp, Mus musculus
gctaacaacttggtggctggcctaa

SEQ ID NO: 561936 - DNA, 25 bp, Mus musculus
gctaacaatcctatacatgtctaga

SEQ ID NO: 561937 - DNA, 25 bp, Mus musculus
gctaacaatcctttacatgtctaga

SEQ ID NO: 561938 - DNA, 25 bp, Mus musculus
gctaacaatctgctggttcatcaca

SEQ ID NO: 561939 - DNA, 25 bp, Mus musculus
gctaacaatctggtggttcatcaca

SEQ ID NO: 561940 - DNA, 25 bp, Mus musculus
gctaacacagctcgatctcgaatga

SEQ ID NO: 561941 - DNA, 25 bp, Mus musculus
gctaacacagctggatctcgaatga

SEQ ID NO: 561942 - DNA, 25 bp, Mus musculus
gctaacacattgctctttccactag

SEQ ID NO: 561943 - DNA, 25 bp, Mus musculus
gctaacacattggtctttccactag

SEQ ID NO: 561944 - DNA, 25 bp, Mus musculus
gctaacactacacataaccagattt

SEQ ID NO: 561945 - DNA, 25 bp, Mus musculus
gctaacactacagataaccagattt

SEQ ID NO: 561946 - DNA, 25 bp, Mus musculus
gctaacactttgcaactgtcagcca

SEQ ID NO: 561947 - DNA, 25 bp, Mus musculus
gctaacactttggaactgtcagcca

SEQ ID NO: 561948 - DNA, 25 bp, Mus musculus
gctaacagagacaacggcgcgcatg

SEQ ID NO: 561949 - DNA, 25 bp, Mus musculus
gctaacagagactacggcgcgcatg

SEQ ID NO: 561950 - DNA, 25 bp, Mus musculus
gctaacagcaggatttgctcttgca

SEQ ID NO: 561951 - DNA, 25 bp, Mus musculus
gctaacagcaggttttgctcttgca

SEQ ID NO: 561952 - DNA, 25 bp, Mus musculus
gctaacagccaaccttgtggataat

SEQ ID NO: 561953 - DNA, 25 bp, Mus musculus
gctaacagccaagcttgtggataat

SEQ ID NO: 561954 - DNA, 25 bp, Mus musculus
gctaacagccgtctctgcagtaaaa

SEQ ID NO: 561955 - DNA, 25 bp, Mus musculus
gctaacagccgtgtctgcagtaaaa

SEQ ID NO: 561956 - DNA, 25 bp, Mus musculus
gctaacagcctgagactcttggatg

SEQ ID NO: 561957 - DNA, 25 bp, Mus musculus
gctaacagcctgcaccagattgaaa

SEQ ID NO: 561958 - DNA, 25 bp, Mus musculus
gctaacagcctggaccagattgaaa

SEQ ID NO: 561959 - DNA, 25 bp, Mus musculus
gctaacagcctgtgactcttggatg

SEQ ID NO: 561960 - DNA, 25 bp, Mus musculus
gctaacagctatcagtatgccttca

SEQ ID NO: 561961 - DNA, 25 bp, Mus musculus
gctaacagctatgagtatgccttca

SEQ ID NO: 561962 - DNA, 25 bp, Mus musculus
gctaacagtataagatgtgcacctc

SEQ ID NO: 561963 - DNA, 25 bp, Mus musculus
gctaacagtatatgatgtgcacctc

SEQ ID NO: 561964 - DNA, 25 bp, Mus musculus
gctaacagtattattgtgcctggat

SEQ ID NO: 561965 - DNA, 25 bp, Mus musculus
gctaacagtatttttgtgcctggat

SEQ ID NO: 561966 - DNA, 25 bp, Mus musculus
gctaacagtcagagcttcggctact

SEQ ID NO: 561967 - DNA, 25 bp, Mus musculus
gctaacagtcagtgcttcggctact

SEQ ID NO: 561968 - DNA, 25 bp, Mus musculus
gctaacagtctacttgagctgcact

SEQ ID NO: 561969 - DNA, 25 bp, Mus musculus
gctaacagtctagttgagctgcact

SEQ ID NO: 561970 - DNA, 25 bp, Mus musculus
gctaacagttagattcatctaggaa

SEQ ID NO: 561971 - DNA, 25 bp, Mus musculus
gctaacagttagtttcatctaggaa

SEQ ID NO: 561972 - DNA, 25 bp, Mus musculus
gctaacagttgcctttcaggaaact

SEQ ID NO: 561973 - DNA, 25 bp, Mus musculus
gctaacagttgcgtttcaggaaact

SEQ ID NO: 561974 - DNA, 25 bp, Mus musculus
gctaacatcagcacagactttactg

SEQ ID NO: 561975 - DNA, 25 bp, Mus musculus
gctaacatcagctcagactttactg

SEQ ID NO: 561976 - DNA, 25 bp, Mus musculus
gctaacatctagagatcctgtggat

SEQ ID NO: 561977 - DNA, 25 bp, Mus musculus
gctaacatctagtgatcctgtggat

SEQ ID NO: 561978 - DNA, 25 bp, Mus musculus
gctaacatgctgagattatctgata

SEQ ID NO: 561979 - DNA, 25 bp, Mus musculus
gctaacatgctgtgattatctgata

SEQ ID NO: 561980 - DNA, 25 bp, Mus musculus
gctaacatttttccatcttgatatt

SEQ ID NO: 561981 - DNA, 25 bp, Mus musculus
gctaacatttttgcatcttgatatt

SEQ ID NO: 561982 - DNA, 25 bp, Mus musculus
gctaaccacttccttaatttcacaa

SEQ ID NO: 561983 - DNA, 25 bp, Mus musculus
gctaaccacttcgttaatttcacaa

SEQ ID NO: 561984 - DNA, 25 bp, Mus musculus
gctaaccaggatcacttgctgactt

SEQ ID NO: 561985 - DNA, 25 bp, Mus musculus
gctaaccaggatgacttgctgactt

SEQ ID NO: 561986 - DNA, 25 bp, Mus musculus
gctaaccaggcaccatgcgagagat

SEQ ID NO: 561987 - DNA, 25 bp, Mus musculus
gctaaccaggcagcatgcgagagat

SEQ ID NO: 561988 - DNA, 25 bp, Mus musculus
gctaaccagtggaagtggccaatat

SEQ ID NO: 561989 - DNA, 25 bp, Mus musculus
gctaaccagtggtagtggccaatat

SEQ ID NO: 561990 - DNA, 25 bp, Mus musculus
gctaaccatcatcctgataacccta

SEQ ID NO: 561991 - DNA, 25 bp, Mus musculus
gctaaccatcatgctgataacccta

SEQ ID NO: 561992 - DNA, 25 bp, Mus musculus
gctaacccaagccagttcaaaatgt

SEQ ID NO: 561993 - DNA, 25 bp, Mus musculus
gctaacccaagcgagttcaaaatgt

SEQ ID NO: 561994 - DNA, 25 bp, Mus musculus
gctaacccagatccgaaggaccatt

SEQ ID NO: 561995 - DNA, 25 bp, Mus musculus
gctaacccagatgcgaaggaccatt

SEQ ID NO: 561996 - DNA, 25 bp, Mus musculus
gctaacccatgacgaaagcctctca

SEQ ID NO: 561997 - DNA, 25 bp, Mus musculus
gctaacccatgaggaaagcctctca

SEQ ID NO: 561998 - DNA, 25 bp, Mus musculus
gctaaccccatgaacttgttgaaga

SEQ ID NO: 561999 - DNA, 25 bp, Mus musculus
gctaaccccatgtacttgttgaaga

SEQ ID NO: 562000 - DNA, 25 bp, Mus musculus
gctaaccgggcaattcagaagatgg

SEQ ID NO: 562001 - DNA, 25 bp, Mus musculus
gctaaccgggcatttcagaagatgg

SEQ ID NO: 562002 - DNA, 25 bp, Mus musculus
gctaacctaatgaccgaaaccagtg

SEQ ID NO: 562003 - DNA, 25 bp, Mus musculus
gctaacctaatgtccgaaaccagtg

SEQ ID NO: 562004 - DNA, 25 bp, Mus musculus
gctaacctagccacataatgtgtga

SEQ ID NO: 562005 - DNA, 25 bp, Mus musculus
gctaacctagcctcataatgtgtga

SEQ ID NO: 562006 - DNA, 25 bp, Mus musculus
gctaacctaggcaacgtactgggat

SEQ ID NO: 562007 - DNA, 25 bp, Mus musculus
gctaacctaggctacgtactgggat

SEQ ID NO: 562008 - DNA, 25 bp, Mus musculus
gctaacctccagagcagtactgtca

SEQ ID NO: 562009 - DNA, 25 bp, Mus musculus
gctaacctccagtgcagtactgtca

SEQ ID NO: 562010 - DNA, 25 bp, Mus musculus
gctaacctgacactactggtcactc

SEQ ID NO: 562011 - DNA, 25 bp, Mus musculus
gctaacctgacagtactggtcactc

SEQ ID NO: 562012 - DNA, 25 bp, Mus musculus
gctaacctgctgattgagatgctgt

SEQ ID NO: 562013 - DNA, 25 bp, Mus musculus
gctaacctgctgtttgagatgctgt

SEQ ID NO: 562014 - DNA, 25 bp, Mus musculus
gctaacctggaactctttatgtaaa

SEQ ID NO: 562015 - DNA, 25 bp, Mus musculus
gctaacctggaagtctttatgtaaa

SEQ ID NO: 562016 - DNA, 25 bp, Mus musculus
gctaacctggagacatcaagtttca

SEQ ID NO: 562017 - DNA, 25 bp, Mus musculus
gctaacctggagtcatcaagtttca

SEQ ID NO: 562018 - DNA, 25 bp, Mus musculus
gctaacctgttgatattgggtgggt

SEQ ID NO: 562019 - DNA, 25 bp, Mus musculus
gctaacctgttgttattgggtgggt

SEQ ID NO: 562020 - DNA, 25 bp, Mus musculus
gctaaccttccaagtctcaaagcag

SEQ ID NO: 562021 - DNA, 25 bp, Mus musculus
gctaaccttccatgtctcaaagcag

SEQ ID NO: 562022 - DNA, 25 bp, Mus musculus
gctaacctttcaacggtgattaaat

SEQ ID NO: 562023 - DNA, 25 bp, Mus musculus
gctaacctttcatcggtgattaaat

SEQ ID NO: 562024 - DNA, 25 bp, Mus musculus
gctaacgatagcaatgtggcattat

SEQ ID NO: 562025 - DNA, 25 bp, Mus musculus
gctaacgatagctatgtggcattat

SEQ ID NO: 562026 - DNA, 25 bp, Mus musculus
gctaacgggttaattggaaggctgt

SEQ ID NO: 562027 - DNA, 25 bp, Mus musculus
gctaacgggttatttggaaggctgt

SEQ ID NO: 562028 - DNA, 25 bp, Mus musculus
gctaacgtcgtgctaagggcagacc

SEQ ID NO: 562029 - DNA, 25 bp, Mus musculus
gctaacgtcgtggtaagggcagacc

SEQ ID NO: 562030 - DNA, 25 bp, Mus musculus
gctaactaaactatggaagtccaag

SEQ ID NO: 562031 - DNA, 25 bp, Mus musculus
gctaactaaactttggaagtccaag

SEQ ID NO: 562032 - DNA, 25 bp, Mus musculus
gctaactaacgtctccaagttatgt

SEQ ID NO: 562033 - DNA, 25 bp, Mus musculus
gctaactaacgtgtccaagttatgt

SEQ ID NO: 562034 - DNA, 25 bp, Mus musculus
gctaactacttgacagtttatgcga

SEQ ID NO: 562035 - DNA, 25 bp, Mus musculus
gctaactacttgtcagtttatgcga

SEQ ID NO: 562036 - DNA, 25 bp, Mus musculus
gctaactcacccagacaaaggtcat

SEQ ID NO: 562037 - DNA, 25 bp, Mus musculus
gctaactcaccctgacaaaggtcat

SEQ ID NO: 562038 - DNA, 25 bp, Mus musculus
gctaactccaaacgtggcttcactg

SEQ ID NO: 562039 - DNA, 25 bp, Mus musculus
gctaactccaaaggtggcttcactg

SEQ ID NO: 562040 - DNA, 25 bp, Mus musculus
gctaactcgttgaattcaggcatgt

SEQ ID NO: 562041 - DNA, 25 bp, Mus musculus
gctaactcgttgtattcaggcatgt

SEQ ID NO: 562042 - DNA, 25 bp, Mus musculus
gctaactctccgaaacaccagtggg

SEQ ID NO: 562043 - DNA, 25 bp, Mus musculus
gctaactctccgtaacaccagtggg

SEQ ID NO: 562044 - DNA, 25 bp, Mus musculus
gctaactcttctagactgacaggta

SEQ ID NO: 562045 - DNA, 25 bp, Mus musculus
gctaactcttcttgactgacaggta

SEQ ID NO: 562046 - DNA, 25 bp, Mus musculus
gctaactgacaactgctgagaatgg

SEQ ID NO: 562047 - DNA, 25 bp, Mus musculus
gctaactgacaagtgctgagaatgg

SEQ ID NO: 562048 - DNA, 25 bp, Mus musculus
gctaactgactacctatcatctacc

SEQ ID NO: 562049 - DNA, 25 bp, Mus musculus
gctaactgactagctatcatctacc

SEQ ID NO: 562050 - DNA, 25 bp, Mus musculus
gctaactgctgtactagactaatgt

SEQ ID NO: 562051 - DNA, 25 bp, Mus musculus
gctaactgctgttctagactaatgt

SEQ ID NO: 562052 - DNA, 25 bp, Mus musculus
gctaactggtctaatgccaacttga

SEQ ID NO: 562053 - DNA, 25 bp, Mus musculus
gctaactggtcttatgccaacttga

SEQ ID NO: 562054 - DNA, 25 bp, Mus musculus
gctaactgtagaaagacacattcct

SEQ ID NO: 562055 - DNA, 25 bp, Mus musculus
gctaactgtagatagacacattcct

SEQ ID NO: 562056 - DNA, 25 bp, Mus musculus
gctaactgtcctactttacaatagt

SEQ ID NO: 562057 - DNA, 25 bp, Mus musculus
gctaactgtccttctttacaatagt

SEQ ID NO: 562058 - DNA, 25 bp, Mus musculus
gctaactgttgtctgatcctttgct

SEQ ID NO: 562059 - DNA, 25 bp, Mus musculus
gctaactgttgtgtgatcctttgct

SEQ ID NO: 562060 - DNA, 25 bp, Mus musculus
gctaacttagccacttggttgtata

SEQ ID NO: 562061 - DNA, 25 bp, Mus musculus
gctaacttagcctcttggttgtata

SEQ ID NO: 562062 - DNA, 25 bp, Mus musculus
gctaacttcaaacctcgcttgtgat

SEQ ID NO: 562063 - DNA, 25 bp, Mus musculus
gctaacttcaaagctcgcttgtgat

SEQ ID NO: 562064 - DNA, 25 bp, Mus musculus
gctaacttcgtcatggcaacaggcc

SEQ ID NO: 562065 - DNA, 25 bp, Mus musculus
gctaacttcgtcttggcaacaggcc

SEQ ID NO: 562066 - DNA, 25 bp, Mus musculus
gctaacttgtacaccattttcaaga

SEQ ID NO: 562067 - DNA, 25 bp, Mus musculus
gctaacttgtactccattttcaaga

SEQ ID NO: 562068 - DNA, 25 bp, Mus musculus
gctaacttttctctttacttcatgg

SEQ ID NO: 562069 - DNA, 25 bp, Mus musculus
gctaacttttctgtttacttcatgg

SEQ ID NO: 562070 - DNA, 25 bp, Mus musculus
gctaagaaacccactgcagctggag

SEQ ID NO: 562071 - DNA, 25 bp, Mus musculus
gctaagaaaccctctgcagctggag

SEQ ID NO: 562072 - DNA, 25 bp, Mus musculus
gctaagaaacgacgtctggttggct

SEQ ID NO: 562073 - DNA, 25 bp, Mus musculus
gctaagaaacgaggtctggttggct

SEQ ID NO: 562074 - DNA, 25 bp, Mus musculus
gctaagaaccaccaagttctctctg

SEQ ID NO: 562075 - DNA, 25 bp, Mus musculus
gctaagaaccacgaagttctctctg

SEQ ID NO: 562076 - DNA, 25 bp, Mus musculus
gctaagaacccacttttgcatgtgt

SEQ ID NO: 562077 - DNA, 25 bp, Mus musculus
gctaagaacccagttttgcatgtgt

SEQ ID NO: 562078 - DNA, 25 bp, Mus musculus
gctaagaagcaactgccgacagaac

SEQ ID NO: 562079 - DNA, 25 bp, Mus musculus
gctaagaagcaagtgccgacagaac

SEQ ID NO: 562080 - DNA, 25 bp, Mus musculus
gctaagaaggctaacttgtgccaat

SEQ ID NO: 562081 - DNA, 25 bp, Mus musculus
gctaagaaggcttacttgtgccaat

SEQ ID NO: 562082 - DNA, 25 bp, Mus musculus
gctaagaatcagctctctccatcat

SEQ ID NO: 562083 - DNA, 25 bp, Mus musculus
gctaagaatcaggtctctccatcat

SEQ ID NO: 562084 - DNA, 25 bp, Mus musculus
gctaagacacccaactaagtttgag

SEQ ID NO: 562085 - DNA, 25 bp, Mus musculus
gctaagacaccctactaagtttgag

SEQ ID NO: 562086 - DNA, 25 bp, Mus musculus
gctaagacctacctttttgttggag

SEQ ID NO: 562087 - DNA, 25 bp, Mus musculus
gctaagacctacgtttttgttggag

SEQ ID NO: 562088 - DNA, 25 bp, Mus musculus
gctaagactgttctctttggttgtt

SEQ ID NO: 562089 - DNA, 25 bp, Mus musculus
gctaagactgttgtctttggttgtt

SEQ ID NO: 562090 - DNA, 25 bp, Mus musculus
gctaagactttcctgacttccgtat

SEQ ID NO: 562091 - DNA, 25 bp, Mus musculus
gctaagactttcgtgacttccgtat

SEQ ID NO: 562092 - DNA, 25 bp, Mus musculus
gctaagacttttacaggtggacata

SEQ ID NO: 562093 - DNA, 25 bp, Mus musculus
gctaagactttttcaggtggacata

SEQ ID NO: 562094 - DNA, 25 bp, Mus musculus
gctaagagacgaaacactaccggga

SEQ ID NO: 562095 - DNA, 25 bp, Mus musculus
gctaagagacgatacactaccggga

SEQ ID NO: 562096 - DNA, 25 bp, Mus musculus
gctaagagcacaatactgactgctc

SEQ ID NO: 562097 - DNA, 25 bp, Mus musculus
gctaagagcacattactgactgctc

SEQ ID NO: 562098 - DNA, 25 bp, Mus musculus
gctaagagctgcatcatggaggcct

SEQ ID NO: 562099 - DNA, 25 bp, Mus musculus
gctaagagctgcttcatggaggcct

SEQ ID NO: 562100 - DNA, 25 bp, Mus musculus
gctaagaggctaagctcagccccaa

SEQ ID NO: 562101 - DNA, 25 bp, Mus musculus
gctaagaggctatgctcagccccaa

SEQ ID NO: 562102 - DNA, 25 bp, Mus musculus
gctaagaggtttcctctcaagacca

SEQ ID NO: 562103 - DNA, 25 bp, Mus musculus
gctaagaggtttgctctcaagacca

SEQ ID NO: 562104 - DNA, 25 bp, Mus musculus
gctaagagtgttagtggttgtaatt

SEQ ID NO: 562105 - DNA, 25 bp, Mus musculus
gctaagagtgtttgtggttgtaatt

SEQ ID NO: 562106 - DNA, 25 bp, Mus musculus
gctaagatacttaagactgggccta

SEQ ID NO: 562107 - DNA, 25 bp, Mus musculus
gctaagatactttagactgggccta

SEQ ID NO: 562108 - DNA, 25 bp, Mus musculus
gctaagatcagtccaggtccggaga

SEQ ID NO: 562109 - DNA, 25 bp, Mus musculus
gctaagatcagtgcaggtccggaga

SEQ ID NO: 562110 - DNA, 25 bp, Mus musculus
gctaagatgcccctgttaaactttt

SEQ ID NO: 562111 - DNA, 25 bp, Mus musculus
gctaagatgcccgtgttaaactttt

SEQ ID NO: 562112 - DNA, 25 bp, Mus musculus
gctaagatgtctcttatgtgtattt

SEQ ID NO: 562113 - DNA, 25 bp, Mus musculus
gctaagatgtctgttatgtgtattt

SEQ ID NO: 562114 - DNA, 25 bp, Mus musculus
gctaagattcacagcacaggtgagc

SEQ ID NO: 562115 - DNA, 25 bp, Mus musculus
gctaagattcactgcacaggtgagc

SEQ ID NO: 562116 - DNA, 25 bp, Mus musculus
gctaagcaaggccaaataatttttt

SEQ ID NO: 562117 - DNA, 25 bp, Mus musculus
gctaagcaaggcgaaataatttttt

SEQ ID NO: 562118 - DNA, 25 bp, Mus musculus
gctaagcactctacatagggcaggt

SEQ ID NO: 562119 - DNA, 25 bp, Mus musculus
gctaagcactcttcatagggcaggt

SEQ ID NO: 562120 - DNA, 25 bp, Mus musculus
gctaagcagaacacactgatattaa

SEQ ID NO: 562121 - DNA, 25 bp, Mus musculus
gctaagcagaactcactgatattaa

SEQ ID NO: 562122 - DNA, 25 bp, Mus musculus
gctaagcagcttatccaagacaata

SEQ ID NO: 562123 - DNA, 25 bp, Mus musculus
gctaagcagcttttccaagacaata

SEQ ID NO: 562124 - DNA, 25 bp, Mus musculus
gctaagcattgcctacttcgataga

SEQ ID NO: 562125 - DNA, 25 bp, Mus musculus
gctaagcattgcgtacttcgataga

SEQ ID NO: 562126 - DNA, 25 bp, Mus musculus
gctaagccacttcaagattactcat

SEQ ID NO: 562127 - DNA, 25 bp, Mus musculus
gctaagccacttgaagattactcat

SEQ ID NO: 562128 - DNA, 25 bp, Mus musculus
gctaagccaggtacacagaacatca

SEQ ID NO: 562129 - DNA, 25 bp, Mus musculus
gctaagccaggttcacagaacatca

SEQ ID NO: 562130 - DNA, 25 bp, Mus musculus
gctaagccagtcaagcagctatgac

SEQ ID NO: 562131 - DNA, 25 bp, Mus musculus
gctaagccagtctagcagctatgac

SEQ ID NO: 562132 - DNA, 25 bp, Mus musculus
gctaagccatctctattctcaggag

SEQ ID NO: 562133 - DNA, 25 bp, Mus musculus
gctaagccatctgtattctcaggag

SEQ ID NO: 562134 - DNA, 25 bp, Mus musculus
gctaagcccagacagtcctagattg

SEQ ID NO: 562135 - DNA, 25 bp, Mus musculus
gctaagcccagagagtcctagattg

SEQ ID NO: 562136 - DNA, 25 bp, Mus musculus
gctaagcctatgactacaacagttt

SEQ ID NO: 562137 - DNA, 25 bp, Mus musculus
gctaagcctatgtctacaacagttt

SEQ ID NO: 562138 - DNA, 25 bp, Mus musculus
gctaagcctcaacttctttgcatga

SEQ ID NO: 562139 - DNA, 25 bp, Mus musculus
gctaagcctcaagttctttgcatga

SEQ ID NO: 562140 - DNA, 25 bp, Mus musculus
gctaagctaacaaaggactcaccct

SEQ ID NO: 562141 - DNA, 25 bp, Mus musculus
gctaagctaacataggactcaccct

SEQ ID NO: 562142 - DNA, 25 bp, Mus musculus
gctaagctccagcaactggaggccc

SEQ ID NO: 562143 - DNA, 25 bp, Mus musculus
gctaagctccaggaactggaggccc

SEQ ID NO: 562144 - DNA, 25 bp, Mus musculus
gctaagctgcttcaactggaccatt

SEQ ID NO: 562145 - DNA, 25 bp, Mus musculus
gctaagctgcttgaactggaccatt

SEQ ID NO: 562146 - DNA, 25 bp, Mus musculus
gctaagcttatacttttaaagggca

SEQ ID NO: 562147 - DNA, 25 bp, Mus musculus
gctaagcttatagttttaaagggca

SEQ ID NO: 562148 - DNA, 25 bp, Mus musculus
gctaagcttgatcacttcttggagc

SEQ ID NO: 562149 - DNA, 25 bp, Mus musculus
gctaagcttgatgacttcttggagc

SEQ ID NO: 562150 - DNA, 25 bp, Mus musculus
gctaaggaacaaatgcaggctgtct

SEQ ID NO: 562151 - DNA, 25 bp, Mus musculus
gctaaggaacaattgcaggctgtct

SEQ ID NO: 562152 - DNA, 25 bp, Mus musculus
gctaaggaatctacccgaactctga

SEQ ID NO: 562153 - DNA, 25 bp, Mus musculus
gctaaggaatcttcccgaactctga

SEQ ID NO: 562154 - DNA, 25 bp, Mus musculus
gctaaggacgcgagcttggccccag

SEQ ID NO: 562155 - DNA, 25 bp, Mus musculus
gctaaggacgcgtgcttggccccag

SEQ ID NO: 562156 - DNA, 25 bp, Mus musculus
gctaaggagactaccatttccaata

SEQ ID NO: 562157 - DNA, 25 bp, Mus musculus
gctaaggagacttccatttccaata

SEQ ID NO: 562158 - DNA, 25 bp, Mus musculus
gctaaggagggcctgtcctacacaa

SEQ ID NO: 562159 - DNA, 25 bp, Mus musculus
gctaaggagggcgtgtcctacacaa

SEQ ID NO: 562160 - DNA, 25 bp, Mus musculus
gctaaggatagacaccatgcttgag

SEQ ID NO: 562161 - DNA, 25 bp, Mus musculus
gctaaggatagagaccatgcttgag

SEQ ID NO: 562162 - DNA, 25 bp, Mus musculus
gctaaggatcttactgagagccctg

SEQ ID NO: 562163 - DNA, 25 bp, Mus musculus
gctaaggatctttctgagagccctg

SEQ ID NO: 562164 - DNA, 25 bp, Mus musculus
gctaaggatgatccttttgccatgc

SEQ ID NO: 562165 - DNA, 25 bp, Mus musculus
gctaaggatgatgcttttgccatgc

SEQ ID NO: 562166 - DNA, 25 bp, Mus musculus
gctaaggcacccaagaactcagacc

SEQ ID NO: 562167 - DNA, 25 bp, Mus musculus
gctaaggcaccctagaactcagacc

SEQ ID NO: 562168 - DNA, 25 bp, Mus musculus
gctaaggcacttatcccaattataa

SEQ ID NO: 562169 - DNA, 25 bp, Mus musculus
gctaaggcacttttcccaattataa

SEQ ID NO: 562170 - DNA, 25 bp, Mus musculus
gctaaggcatgtactgttgtgcaga

SEQ ID NO: 562171 - DNA, 25 bp, Mus musculus
gctaaggcatgttctgttgtgcaga

SEQ ID NO: 562172 - DNA, 25 bp, Mus musculus
gctaaggccactacacaaaacctgt

SEQ ID NO: 562173 - DNA, 25 bp, Mus musculus
gctaaggccacttcacaaaacctgt

SEQ ID NO: 562174 - DNA, 25 bp, Mus musculus
gctaaggccagcatgtatgcatcgc

SEQ ID NO: 562175 - DNA, 25 bp, Mus musculus
gctaaggccagcttgtatgcatcgc

SEQ ID NO: 562176 - DNA, 25 bp, Mus musculus
gctaaggctcggcatgcttctataa

SEQ ID NO: 562177 - DNA, 25 bp, Mus musculus
gctaaggctcgggatgcttctataa

SEQ ID NO: 562178 - DNA, 25 bp, Mus musculus
gctaaggctctgcatgaggagatca

SEQ ID NO: 562179 - DNA, 25 bp, Mus musculus
gctaaggctctggatgaggagatca

SEQ ID NO: 562180 - DNA, 25 bp, Mus musculus
gctaaggctgccctacatgggaatt

SEQ ID NO: 562181 - DNA, 25 bp, Mus musculus
gctaaggctgccgtacatgggaatt

SEQ ID NO: 562182 - DNA, 25 bp, Mus musculus
gctaaggcttccatttctggcttgc

SEQ ID NO: 562183 - DNA, 25 bp, Mus musculus
gctaaggcttccttttctggcttgc

SEQ ID NO: 562184 - DNA, 25 bp, Mus musculus
gctaagggaaggcttcagagcattt

SEQ ID NO: 562185 - DNA, 25 bp, Mus musculus
gctaagggaagggttcagagcattt

SEQ ID NO: 562186 - DNA, 25 bp, Mus musculus
gctaagggactaactgctgcctgga

SEQ ID NO: 562187 - DNA, 25 bp, Mus musculus
gctaagggactatctgctgcctgga

SEQ ID NO: 562188 - DNA, 25 bp, Mus musculus
gctaagggccatacatgaatcccat

SEQ ID NO: 562189 - DNA, 25 bp, Mus musculus
gctaagggccattcatgaatcccat

SEQ ID NO: 562190 - DNA, 25 bp, Mus musculus
gctaagggcccgagccctttggcca

SEQ ID NO: 562191 - DNA, 25 bp, Mus musculus
gctaagggcccgtgccctttggcca

SEQ ID NO: 562192 - DNA, 25 bp, Mus musculus
gctaaggttctgaagactgctctct

SEQ ID NO: 562193 - DNA, 25 bp, Mus musculus
gctaaggttctgtagactgctctct

SEQ ID NO: 562194 - DNA, 25 bp, Mus musculus
gctaagtaagataccattaaccgta

SEQ ID NO: 562195 - DNA, 25 bp, Mus musculus
gctaagtaagattccattaaccgta

SEQ ID NO: 562196 - DNA, 25 bp, Mus musculus
gctaagtacatactccctgaaatat

SEQ ID NO: 562197 - DNA, 25 bp, Mus musculus
gctaagtacatagtccctgaaatat

SEQ ID NO: 562198 - DNA, 25 bp, Mus musculus
gctaagtagaacagtttccttgtcc

SEQ ID NO: 562199 - DNA, 25 bp, Mus musculus
gctaagtagaactgtttccttgtcc

SEQ ID NO: 562200 - DNA, 25 bp, Mus musculus
gctaagtagcgtccaggagtccgat

SEQ ID NO: 562201 - DNA, 25 bp, Mus musculus
gctaagtagcgtgcaggagtccgat

SEQ ID NO: 562202 - DNA, 25 bp, Mus musculus
gctaagtatgataacatggcaacca

SEQ ID NO: 562203 - DNA, 25 bp, Mus musculus
gctaagtatgattacatggcaacca

SEQ ID NO: 562204 - DNA, 25 bp, Mus musculus
gctaagtatgtgagctttaacggtc

SEQ ID NO: 562205 - DNA, 25 bp, Mus musculus
gctaagtatgtgtgctttaacggtc

SEQ ID NO: 562206 - DNA, 25 bp, Mus musculus
gctaagtcaagaacaacagtccggg

SEQ ID NO: 562207 - DNA, 25 bp, Mus musculus
gctaagtcaagatcaacagtccggg

SEQ ID NO: 562208 - DNA, 25 bp, Mus musculus
gctaagtcacttaacattctcaggt

SEQ ID NO: 562209 - DNA, 25 bp, Mus musculus
gctaagtcactttacattctcaggt

SEQ ID NO: 562210 - DNA, 25 bp, Mus musculus
gctaagtcatgaacccctttagtga

SEQ ID NO: 562211 - DNA, 25 bp, Mus musculus
gctaagtcatgatcccctttagtga

SEQ ID NO: 562212 - DNA, 25 bp, Mus musculus
gctaagtcctggctccatgggagac

SEQ ID NO: 562213 - DNA, 25 bp, Mus musculus
gctaagtcctgggtccatgggagac

SEQ ID NO: 562214 - DNA, 25 bp, Mus musculus
gctaagtcgtttaggatcagggtca

SEQ ID NO: 562215 - DNA, 25 bp, Mus musculus
gctaagtcgttttggatcagggtca

SEQ ID NO: 562216 - DNA, 25 bp, Mus musculus
gctaagtctcttctctataccggaa

SEQ ID NO: 562217 - DNA, 25 bp, Mus musculus
gctaagtctcttgtctataccggaa

SEQ ID NO: 562218 - DNA, 25 bp, Mus musculus
gctaagtctgaacacaccgtgtact

SEQ ID NO: 562219 - DNA, 25 bp, Mus musculus
gctaagtctgaagacaccgtgtact

SEQ ID NO: 562220 - DNA, 25 bp, Mus musculus
gctaagtctgttcatcagggttcaa

SEQ ID NO: 562221 - DNA, 25 bp, Mus musculus
gctaagtctgttgatcagggttcaa

SEQ ID NO: 562222 - DNA, 25 bp, Mus musculus
gctaagtgcaaacccatttaaggaa

SEQ ID NO: 562223 - DNA, 25 bp, Mus musculus
gctaagtgcaaagccatttaaggaa

SEQ ID NO: 562224 - DNA, 25 bp, Mus musculus
gctaagtgccccagaggcttggctg

SEQ ID NO: 562225 - DNA, 25 bp, Mus musculus
gctaagtgcccctgaggcttggctg

SEQ ID NO: 562226 - DNA, 25 bp, Mus musculus
gctaagtgctggacagaagcctgga

SEQ ID NO: 562227 - DNA, 25 bp, Mus musculus
gctaagtgctggtcagaagcctgga

SEQ ID NO: 562228 - DNA, 25 bp, Mus musculus
gctaagtggccaagtgaagtcccct

SEQ ID NO: 562229 - DNA, 25 bp, Mus musculus
gctaagtggccatgtgaagtcccct

SEQ ID NO: 562230 - DNA, 25 bp, Mus musculus
gctaagtgggatcagcaccacgtaa

SEQ ID NO: 562231 - DNA, 25 bp, Mus musculus
gctaagtgggatgagcaccacgtaa

SEQ ID NO: 562232 - DNA, 25 bp, Mus musculus
gctaagtggtgtctcaaccagcctt

SEQ ID NO: 562233 - DNA, 25 bp, Mus musculus
gctaagtggtgtgtcaaccagcctt

SEQ ID NO: 562234 - DNA, 25 bp, Mus musculus
gctaagtgtattattttgctccaga

SEQ ID NO: 562235 - DNA, 25 bp, Mus musculus
gctaagtgtatttttttgctccaga

SEQ ID NO: 562236 - DNA, 25 bp, Mus musculus
gctaagtgtgttatcaaacaaatgg

SEQ ID NO: 562237 - DNA, 25 bp, Mus musculus
gctaagtgtgttttcaaacaaatgg

SEQ ID NO: 562238 - DNA, 25 bp, Mus musculus
gctaagtgttagcagtcctcgtctt

SEQ ID NO: 562239 - DNA, 25 bp, Mus musculus
gctaagtgttaggagtcctcgtctt

SEQ ID NO: 562240 - DNA, 25 bp, Mus musculus
gctaagttacagacataggcattaa

SEQ ID NO: 562241 - DNA, 25 bp, Mus musculus
gctaagttacagtcataggcattaa

SEQ ID NO: 562242 - DNA, 25 bp, Mus musculus
gctaagttcagaagcccagtggacc

SEQ ID NO: 562243 - DNA, 25 bp, Mus musculus
gctaagttcagatgcccagtggacc

SEQ ID NO: 562244 - DNA, 25 bp, Mus musculus
gctaagttccggcatgtggcacatg

SEQ ID NO: 562245 - DNA, 25 bp, Mus musculus
gctaagttccgggatgtggcacatg

SEQ ID NO: 562246 - DNA, 25 bp, Mus musculus
gctaagttggtacactctctgctcc

SEQ ID NO: 562247 - DNA, 25 bp, Mus musculus
gctaagttggtagactctctgctcc

SEQ ID NO: 562248 - DNA, 25 bp, Mus musculus
gctaagttgtttcagatcgcggata

SEQ ID NO: 562249 - DNA, 25 bp, Mus musculus
gctaagttgtttgagatcgcggata

SEQ ID NO: 562250 - DNA, 25 bp, Mus musculus
gctaagtttactactattccaagag

SEQ ID NO: 562251 - DNA, 25 bp, Mus musculus
gctaagtttacttctattccaagag

SEQ ID NO: 562252 - DNA, 25 bp, Mus musculus
gctaagtttcttacgtgtattctac

SEQ ID NO: 562253 - DNA, 25 bp, Mus musculus
gctaagtttctttcgtgtattctac

SEQ ID NO: 562254 - DNA, 25 bp, Mus musculus
gctaataaaaacagcaatccttgaa

SEQ ID NO: 562255 - DNA, 25 bp, Mus musculus
gctaataaaaactgcaatccttgaa

SEQ ID NO: 562256 - DNA, 25 bp, Mus musculus
gctaataagttccatgcagacacga

SEQ ID NO: 562257 - DNA, 25 bp, Mus musculus
gctaataagttcgatgcagacacga

SEQ ID NO: 562258 - DNA, 25 bp, Mus musculus
gctaataataacactttgtgtgtgt

SEQ ID NO: 562259 - DNA, 25 bp, Mus musculus
gctaataataactctttgtgtgtgt

SEQ ID NO: 562260 - DNA, 25 bp, Mus musculus
gctaataatcacagccttttttttt

SEQ ID NO: 562261 - DNA, 25 bp, Mus musculus
gctaataatcactgccttttttttt

SEQ ID NO: 562262 - DNA, 25 bp, Mus musculus
gctaataccagtaaagttttgactt

SEQ ID NO: 562263 - DNA, 25 bp, Mus musculus
gctaataccagttaagttttgactt

SEQ ID NO: 562264 - DNA, 25 bp, Mus musculus
gctaatactgtgacaaggtgcatat

SEQ ID NO: 562265 - DNA, 25 bp, Mus musculus
gctaatactgtgtcaaggtgcatat

SEQ ID NO: 562266 - DNA, 25 bp, Mus musculus
gctaatagcaacaccgatactctta

SEQ ID NO: 562267 - DNA, 25 bp, Mus musculus
gctaatagcaactccgatactctta

SEQ ID NO: 562268 - DNA, 25 bp, Mus musculus
gctaatagcattatattcctgtgca

SEQ ID NO: 562269 - DNA, 25 bp, Mus musculus
gctaatagcattttattcctgtgca

SEQ ID NO: 562270 - DNA, 25 bp, Mus musculus
gctaatagcttgcaaaactcagtac

SEQ ID NO: 562271 - DNA, 25 bp, Mus musculus
gctaatagcttggaaaactcagtac

SEQ ID NO: 562272 - DNA, 25 bp, Mus musculus
gctaatagtcataaaactgttgtta

SEQ ID NO: 562273 - DNA, 25 bp, Mus musculus
gctaatagtcattaaactgttgtta

SEQ ID NO: 562274 - DNA, 25 bp, Mus musculus
gctaatagtgatcgtcttcaggaca

SEQ ID NO: 562275 - DNA, 25 bp, Mus musculus
gctaatagtgatggtcttcaggaca

SEQ ID NO: 562276 - DNA, 25 bp, Mus musculus
gctaatagtttcacaagtggcttga

SEQ ID NO: 562277 - DNA, 25 bp, Mus musculus
gctaatagtttctcaagtggcttga

SEQ ID NO: 562278 - DNA, 25 bp, Mus musculus
gctaatatacatacatgggaccttt

SEQ ID NO: 562279 - DNA, 25 bp, Mus musculus
gctaatatacattcatgggaccttt

SEQ ID NO: 562280 - DNA, 25 bp, Mus musculus
gctaatatattcaagttttatcagg

SEQ ID NO: 562281 - DNA, 25 bp, Mus musculus
gctaatatattcacacctgtgagat

SEQ ID NO: 562282 - DNA, 25 bp, Mus musculus
gctaatatattcatataggctattt

SEQ ID NO: 562283 - DNA, 25 bp, Mus musculus
gctaatatattctagttttatcagg

SEQ ID NO: 562284 - DNA, 25 bp, Mus musculus
gctaatatattctcacctgtgagat

SEQ ID NO: 562285 - DNA, 25 bp, Mus musculus
gctaatatattcttataggctattt

SEQ ID NO: 562286 - DNA, 25 bp, Mus musculus
gctaatatattgagactgctcttct

SEQ ID NO: 562287 - DNA, 25 bp, Mus musculus
gctaatatattgtgactgctcttct

SEQ ID NO: 562288 - DNA, 25 bp, Mus musculus
gctaatatcttgaacatgtgtgtgt

SEQ ID NO: 562289 - DNA, 25 bp, Mus musculus
gctaatatcttgtacatgtgtgtgt

SEQ ID NO: 562290 - DNA, 25 bp, Mus musculus
gctaatatggcacatcatttttatt

SEQ ID NO: 562291 - DNA, 25 bp, Mus musculus
gctaatatggcagatcatttttatt

SEQ ID NO: 562292 - DNA, 25 bp, Mus musculus
gctaatcaagagctgacacgtcaca

SEQ ID NO: 562293 - DNA, 25 bp, Mus musculus
gctaatcaagaggtgacacgtcaca

SEQ ID NO: 562294 - DNA, 25 bp, Mus musculus
gctaatcactgacacttggatgcaa

SEQ ID NO: 562295 - DNA, 25 bp, Mus musculus
gctaatcactgagacttggatgcaa

SEQ ID NO: 562296 - DNA, 25 bp, Mus musculus
gctaatcactttcacgtgttcttaa

SEQ ID NO: 562297 - DNA, 25 bp, Mus musculus
gctaatcactttgacgtgttcttaa

SEQ ID NO: 562298 - DNA, 25 bp, Mus musculus
gctaatcagcgcacaagggtttatt

SEQ ID NO: 562299 - DNA, 25 bp, Mus musculus
gctaatcagcgctcaagggtttatt

SEQ ID NO: 562300 - DNA, 25 bp, Mus musculus
gctaatcatgctatctgctaacgag

SEQ ID NO: 562301 - DNA, 25 bp, Mus musculus
gctaatcatgctttctgctaacgag

SEQ ID NO: 562302 - DNA, 25 bp, Mus musculus
gctaatccaattattcctgtcactg

SEQ ID NO: 562303 - DNA, 25 bp, Mus musculus
gctaatccaatttttcctgtcactg

SEQ ID NO: 562304 - DNA, 25 bp, Mus musculus
gctaatccctagagacttacttggt

SEQ ID NO: 562305 - DNA, 25 bp, Mus musculus
gctaatccctagtgacttacttggt

SEQ ID NO: 562306 - DNA, 25 bp, Mus musculus
gctaatcctttgagaggccagccta

SEQ ID NO: 562307 - DNA, 25 bp, Mus musculus
gctaatcctttgtgaggccagccta

SEQ ID NO: 562308 - DNA, 25 bp, Mus musculus
gctaatcgctagctgacttttgtaa

SEQ ID NO: 562309 - DNA, 25 bp, Mus musculus
gctaatcgctaggtgacttttgtaa

SEQ ID NO: 562310 - DNA, 25 bp, Mus musculus
gctaatcgtgccagggagcctggaa

SEQ ID NO: 562311 - DNA, 25 bp, Mus musculus
gctaatcgtgcctgggagcctggaa

SEQ ID NO: 562312 - DNA, 25 bp, Mus musculus
gctaatctaatactggctgtcttgt

SEQ ID NO: 562313 - DNA, 25 bp, Mus musculus
gctaatctaatagtggctgtcttgt

SEQ ID NO: 562314 - DNA, 25 bp, Mus musculus
gctaatctacgtcataacacacacc

SEQ ID NO: 562315 - DNA, 25 bp, Mus musculus
gctaatctacgtgataacacacacc

SEQ ID NO: 562316 - DNA, 25 bp, Mus musculus
gctaatctactaaggtgtctaggtt

SEQ ID NO: 562317 - DNA, 25 bp, Mus musculus
gctaatctactatggtgtctaggtt

SEQ ID NO: 562318 - DNA, 25 bp, Mus musculus
gctaatctccgtacctggaaggcag

SEQ ID NO: 562319 - DNA, 25 bp, Mus musculus
gctaatctccgttcctggaaggcag

SEQ ID NO: 562320 - DNA, 25 bp, Mus musculus
gctaatctgaggcagttctctgcat

SEQ ID NO: 562321 - DNA, 25 bp, Mus musculus
gctaatctgagggagttctctgcat

SEQ ID NO: 562322 - DNA, 25 bp, Mus musculus
gctaatcttactagcgagcggagat

SEQ ID NO: 562323 - DNA, 25 bp, Mus musculus
gctaatcttacttgcgagcggagat

SEQ ID NO: 562324 - DNA, 25 bp, Mus musculus
gctaatcttattctgtctcctgaag

SEQ ID NO: 562325 - DNA, 25 bp, Mus musculus
gctaatcttattgtgtctcctgaag

SEQ ID NO: 562326 - DNA, 25 bp, Mus musculus
gctaatgaacttaaactgccaaaca

SEQ ID NO: 562327 - DNA, 25 bp, Mus musculus
gctaatgaactttaactgccaaaca

SEQ ID NO: 562328 - DNA, 25 bp, Mus musculus
gctaatgaagacaccggacatttta

SEQ ID NO: 562329 - DNA, 25 bp, Mus musculus
gctaatgaagactccggacatttta

SEQ ID NO: 562330 - DNA, 25 bp, Mus musculus
gctaatgactagcttgctcctgatc

SEQ ID NO: 562331 - DNA, 25 bp, Mus musculus
gctaatgactaggttgctcctgatc

SEQ ID NO: 562332 - DNA, 25 bp, Mus musculus
gctaatgactgcactcaagtatgta

SEQ ID NO: 562333 - DNA, 25 bp, Mus musculus
gctaatgactgctctcaagtatgta

SEQ ID NO: 562334 - DNA, 25 bp, Mus musculus
gctaatgagattctgatgttgttgc

SEQ ID NO: 562335 - DNA, 25 bp, Mus musculus
gctaatgagattgtgatgttgttgc

SEQ ID NO: 562336 - DNA, 25 bp, Mus musculus
gctaatgaggtgacaggagtgttat

SEQ ID NO: 562337 - DNA, 25 bp, Mus musculus
gctaatgaggtgtcaggagtgttat

SEQ ID NO: 562338 - DNA, 25 bp, Mus musculus
gctaatgcaactctgagcccttgtt

SEQ ID NO: 562339 - DNA, 25 bp, Mus musculus
gctaatgcaactgtgagcccttgtt

SEQ ID NO: 562340 - DNA, 25 bp, Mus musculus
gctaatgcaagacgccaaaaatgtt

SEQ ID NO: 562341 - DNA, 25 bp, Mus musculus
gctaatgcaagaggccaaaaatgtt

SEQ ID NO: 562342 - DNA, 25 bp, Mus musculus
gctaatgcagagatggacaaacccg

SEQ ID NO: 562343 - DNA, 25 bp, Mus musculus
gctaatgcagagttggacaaacccg

SEQ ID NO: 562344 - DNA, 25 bp, Mus musculus
gctaatgccaacatgcactggcttt

SEQ ID NO: 562345 - DNA, 25 bp, Mus musculus
gctaatgccaacttgcactggcttt

SEQ ID NO: 562346 - DNA, 25 bp, Mus musculus
gctaatgcctgtagcaaatttctac

SEQ ID NO: 562347 - DNA, 25 bp, Mus musculus
gctaatgcctgttgcaaatttctac

SEQ ID NO: 562348 - DNA, 25 bp, Mus musculus
gctaatgcgttccagcttccaggag

SEQ ID NO: 562349 - DNA, 25 bp, Mus musculus
gctaatgcgttcgagcttccaggag

SEQ ID NO: 562350 - DNA, 25 bp, Mus musculus
gctaatgctgctacttcactcctgt

SEQ ID NO: 562351 - DNA, 25 bp, Mus musculus
gctaatgctgcttcttcactcctgt

SEQ ID NO: 562352 - DNA, 25 bp, Mus musculus
gctaatgcttccaaggtatctgtgt

SEQ ID NO: 562353 - DNA, 25 bp, Mus musculus
gctaatgcttcctaggtatctgtgt

SEQ ID NO: 562354 - DNA, 25 bp, Mus musculus
gctaatggaagtacctgcaatatca

SEQ ID NO: 562355 - DNA, 25 bp, Mus musculus
gctaatggaagttcctgcaatatca

SEQ ID NO: 562356 - DNA, 25 bp, Mus musculus
gctaatggaggacacagcaactact

SEQ ID NO: 562357 - DNA, 25 bp, Mus musculus
gctaatggaggagacagcaactact

SEQ ID NO: 562358 - DNA, 25 bp, Mus musculus
gctaatggatgacaccccttttctt

SEQ ID NO: 562359 - DNA, 25 bp, Mus musculus
gctaatggatgagaccccttttctt

SEQ ID NO: 562360 - DNA, 25 bp, Mus musculus
gctaatggatgtacctgacagggta

SEQ ID NO: 562361 - DNA, 25 bp, Mus musculus
gctaatggatgttcctgacagggta

SEQ ID NO: 562362 - DNA, 25 bp, Mus musculus
gctaatggcacaaccgtccatgtgg

SEQ ID NO: 562363 - DNA, 25 bp, Mus musculus
gctaatggcacatccgtccatgtgg

SEQ ID NO: 562364 - DNA, 25 bp, Mus musculus
gctaatggcatgcaagttctctcca

SEQ ID NO: 562365 - DNA, 25 bp, Mus musculus
gctaatggcatggaagttctctcca

SEQ ID NO: 562366 - DNA, 25 bp, Mus musculus
gctaatggtttgatctaagttaatc

SEQ ID NO: 562367 - DNA, 25 bp, Mus musculus
gctaatggtttgttctaagttaatc

SEQ ID NO: 562368 - DNA, 25 bp, Mus musculus
gctaatgtcaacctgttttgcatca

SEQ ID NO: 562369 - DNA, 25 bp, Mus musculus
gctaatgtcaacgtgttttgcatca

SEQ ID NO: 562370 - DNA, 25 bp, Mus musculus
gctaatgtccataccattgccttga

SEQ ID NO: 562371 - DNA, 25 bp, Mus musculus
gctaatgtccattccattgccttga

SEQ ID NO: 562372 - DNA, 25 bp, Mus musculus
gctaatgtgcatattctccttaaat

SEQ ID NO: 562373 - DNA, 25 bp, Mus musculus
gctaatgtgcattttctccttaaat

SEQ ID NO: 562374 - DNA, 25 bp, Mus musculus
gctaatgttctgatcactgtgcgcc

SEQ ID NO: 562375 - DNA, 25 bp, Mus musculus
gctaatgttctgttcactgtgcgcc

SEQ ID NO: 562376 - DNA, 25 bp, Mus musculus
gctaatgttggacaccgtaacctaa

SEQ ID NO: 562377 - DNA, 25 bp, Mus musculus
gctaatgttggagaccgtaacctaa

SEQ ID NO: 562378 - DNA, 25 bp, Mus musculus
gctaattacctgattggatcctgta

SEQ ID NO: 562379 - DNA, 25 bp, Mus musculus
gctaattacctgtttggatcctgta

SEQ ID NO: 562380 - DNA, 25 bp, Mus musculus
gctaattagagaagccttggctgtt

SEQ ID NO: 562381 - DNA, 25 bp, Mus musculus
gctaattagagatgccttggctgtt

SEQ ID NO: 562382 - DNA, 25 bp, Mus musculus
gctaattattatcacccctttcccg

SEQ ID NO: 562383 - DNA, 25 bp, Mus musculus
gctaattattatgacccctttcccg

SEQ ID NO: 562384 - DNA, 25 bp, Mus musculus
gctaattcaagacggttcacaggac

SEQ ID NO: 562385 - DNA, 25 bp, Mus musculus
gctaattcaagagggttcacaggac

SEQ ID NO: 562386 - DNA, 25 bp, Mus musculus
gctaattccagaagactgctttgtt

SEQ ID NO: 562387 - DNA, 25 bp, Mus musculus
gctaattccagatgactgctttgtt

SEQ ID NO: 562388 - DNA, 25 bp, Mus musculus
gctaattccagcaggcttcaaacta

SEQ ID NO: 562389 - DNA, 25 bp, Mus musculus
gctaattccagctggcttcaaacta

SEQ ID NO: 562390 - DNA, 25 bp, Mus musculus
gctaattccccacaacccaatttat

SEQ ID NO: 562391 - DNA, 25 bp, Mus musculus
gctaattccccagaacccaatttat

SEQ ID NO: 562392 - DNA, 25 bp, Mus musculus
gctaattccctcaactggaaggagt

SEQ ID NO: 562393 - DNA, 25 bp, Mus musculus
gctaattccctctactggaaggagt

SEQ ID NO: 562394 - DNA, 25 bp, Mus musculus
gctaattcgcatcttctggtgctat

SEQ ID NO: 562395 - DNA, 25 bp, Mus musculus
gctaattcgcatgttctggtgctat

SEQ ID NO: 562396 - DNA, 25 bp, Mus musculus
gctaattctcagattacagggttat

SEQ ID NO: 562397 - DNA, 25 bp, Mus musculus
gctaattctcagtttacagggttat

SEQ ID NO: 562398 - DNA, 25 bp, Mus musculus
gctaattcttgtcttcgtttactct

SEQ ID NO: 562399 - DNA, 25 bp, Mus musculus
gctaattcttgtgttcgtttactct

SEQ ID NO: 562400 - DNA, 25 bp, Mus musculus
gctaattgacttaaggagctgacat

SEQ ID NO: 562401 - DNA, 25 bp, Mus musculus
gctaattgactttaggagctgacat

SEQ ID NO: 562402 - DNA, 25 bp, Mus musculus
gctaattgctaactggattccctgt

SEQ ID NO: 562403 - DNA, 25 bp, Mus musculus
gctaattgctaagtggattccctgt

SEQ ID NO: 562404 - DNA, 25 bp, Mus musculus
gctaattgtcagctgcttaagcttt

SEQ ID NO: 562405 - DNA, 25 bp, Mus musculus
gctaattgtcaggtgcttaagcttt

SEQ ID NO: 562406 - DNA, 25 bp, Mus musculus
gctaatttaacaatggctgcctgtg

SEQ ID NO: 562407 - DNA, 25 bp, Mus musculus
gctaatttaacattggctgcctgtg

SEQ ID NO: 562408 - DNA, 25 bp, Mus musculus
gctaatttactaaggtgcccaccac

SEQ ID NO: 562409 - DNA, 25 bp, Mus musculus
gctaatttactatggtgcccaccac

SEQ ID NO: 562410 - DNA, 25 bp, Mus musculus
gctaatttagatctgttcaggccag

SEQ ID NO: 562411 - DNA, 25 bp, Mus musculus
gctaatttagatgtgttcaggccag

SEQ ID NO: 562412 - DNA, 25 bp, Mus musculus
gctaatttataacaccaggctggtc

SEQ ID NO: 562413 - DNA, 25 bp, Mus musculus
gctaatttataagaccaggctggtc

SEQ ID NO: 562414 - DNA, 25 bp, Mus musculus
gctaatttgtttaatgacgcaggca

SEQ ID NO: 562415 - DNA, 25 bp, Mus musculus
gctaatttgttttatgacgcaggca

SEQ ID NO: 562416 - DNA, 25 bp, Mus musculus
gctaattttcctcactcccaagtgt

SEQ ID NO: 562417 - DNA, 25 bp, Mus musculus
gctaattttcctgactcccaagtgt

SEQ ID NO: 562418 - DNA, 25 bp, Mus musculus
gctacaaaagacctgactcattccc

SEQ ID NO: 562419 - DNA, 25 bp, Mus musculus
gctacaaaagacgtgactcattccc

SEQ ID NO: 562420 - DNA, 25 bp, Mus musculus
gctacaaacaacacgggaatggcta

SEQ ID NO: 562421 - DNA, 25 bp, Mus musculus
gctacaaacaactcgggaatggcta

SEQ ID NO: 562422 - DNA, 25 bp, Mus musculus
gctacaaagagtctttcaggccatt

SEQ ID NO: 562423 - DNA, 25 bp, Mus musculus
gctacaaagagtgtttcaggccatt

SEQ ID NO: 562424 - DNA, 25 bp, Mus musculus
gctacaaagctcaggaatggttaca

SEQ ID NO: 562425 - DNA, 25 bp, Mus musculus
gctacaaagctctggaatggttaca

SEQ ID NO: 562426 - DNA, 25 bp, Mus musculus
gctacaaaggctccatccatacaga

SEQ ID NO: 562427 - DNA, 25 bp, Mus musculus
gctacaaaggctgcatccatacaga

SEQ ID NO: 562428 - DNA, 25 bp, Mus musculus
gctacaaagggcagctttatccata

SEQ ID NO: 562429 - DNA, 25 bp, Mus musculus
gctacaaagggctgctttatccata

SEQ ID NO: 562430 - DNA, 25 bp, Mus musculus
gctacaaagtccacttactgataca

SEQ ID NO: 562431 - DNA, 25 bp, Mus musculus
gctacaaagtcctcttactgataca

SEQ ID NO: 562432 - DNA, 25 bp, Mus musculus
gctacaaatctaatcctaagtctaa

SEQ ID NO: 562433 - DNA, 25 bp, Mus musculus
gctacaaatctattcctaagtctaa

SEQ ID NO: 562434 - DNA, 25 bp, Mus musculus
gctacaaatctgactggcagaccct

SEQ ID NO: 562435 - DNA, 25 bp, Mus musculus
gctacaaatctgtctggcagaccct

SEQ ID NO: 562436 - DNA, 25 bp, Mus musculus
gctacaaattcaacatcttctaccc

SEQ ID NO: 562437 - DNA, 25 bp, Mus musculus
gctacaaattcacctgcacacaatg

SEQ ID NO: 562438 - DNA, 25 bp, Mus musculus
gctacaaattcagctgcacacaatg

SEQ ID NO: 562439 - DNA, 25 bp, Mus musculus
gctacaaattcatcatcttctaccc

SEQ ID NO: 562440 - DNA, 25 bp, Mus musculus
gctacaacaaggaattcctggctaa

SEQ ID NO: 562441 - DNA, 25 bp, Mus musculus
gctacaacaaggtattcctggctaa

SEQ ID NO: 562442 - DNA, 25 bp, Mus musculus
gctacaacaataactcacacagtga

SEQ ID NO: 562443 - DNA, 25 bp, Mus musculus
gctacaacaatatctcacacagtga

SEQ ID NO: 562444 - DNA, 25 bp, Mus musculus
gctacaacagccacagaacattcca

SEQ ID NO: 562445 - DNA, 25 bp, Mus musculus
gctacaacagcctcagaacattcca

SEQ ID NO: 562446 - DNA, 25 bp, Mus musculus
gctacaacaggaatcttgtgcatta

SEQ ID NO: 562447 - DNA, 25 bp, Mus musculus
gctacaacaggattcttgtgcatta

SEQ ID NO: 562448 - DNA, 25 bp, Mus musculus
gctacaacagttattaaggatacat

SEQ ID NO: 562449 - DNA, 25 bp, Mus musculus
gctacaacagtttttaaggatacat

SEQ ID NO: 562450 - DNA, 25 bp, Mus musculus
gctacaacatacattcgtgacatga

SEQ ID NO: 562451 - DNA, 25 bp, Mus musculus
gctacaacatactttcgtgacatga

SEQ ID NO: 562452 - DNA, 25 bp, Mus musculus
gctacaaccacaagcttcgcaagaa

SEQ ID NO: 562453 - DNA, 25 bp, Mus musculus
gctacaaccacatgcttcgcaagaa

SEQ ID NO: 562454 - DNA, 25 bp, Mus musculus
gctacaaccagaaagtcttcccaac

SEQ ID NO: 562455 - DNA, 25 bp, Mus musculus
gctacaaccagatagtcttcccaac

SEQ ID NO: 562456 - DNA, 25 bp, Mus musculus
gctacaaccgctcagctagctaatt

SEQ ID NO: 562457 - DNA, 25 bp, Mus musculus
gctacaaccgctgagctagctaatt

SEQ ID NO: 562458 - DNA, 25 bp, Mus musculus
gctacaacctgtacatcttgtcatt

SEQ ID NO: 562459 - DNA, 25 bp, Mus musculus
gctacaacctgttcatcttgtcatt

SEQ ID NO: 562460 - DNA, 25 bp, Mus musculus
gctacaacgccaccactgagaatgt

SEQ ID NO: 562461 - DNA, 25 bp, Mus musculus
gctacaacgccagcactgagaatgt

SEQ ID NO: 562462 - DNA, 25 bp, Mus musculus
gctacaactcagctgaactcagtac

SEQ ID NO: 562463 - DNA, 25 bp, Mus musculus
gctacaactcaggtgaactcagtac

SEQ ID NO: 562464 - DNA, 25 bp, Mus musculus
gctacaactggcatactgtgttcaa

SEQ ID NO: 562465 - DNA, 25 bp, Mus musculus
gctacaactggcttactgtgttcaa

SEQ ID NO: 562466 - DNA, 25 bp, Mus musculus
gctacaactgtcaacactgattctc

SEQ ID NO: 562467 - DNA, 25 bp, Mus musculus
gctacaactgtctacactgattctc

SEQ ID NO: 562468 - DNA, 25 bp, Mus musculus
gctacaacttccaaattacaggcag

SEQ ID NO: 562469 - DNA, 25 bp, Mus musculus
gctacaacttcctaattacaggcag

SEQ ID NO: 562470 - DNA, 25 bp, Mus musculus
gctacaagactgatactgccattta

SEQ ID NO: 562471 - DNA, 25 bp, Mus musculus
gctacaagactgttactgccattta

SEQ ID NO: 562472 - DNA, 25 bp, Mus musculus
gctacaagatgaagcgccaggctaa

SEQ ID NO: 562473 - DNA, 25 bp, Mus musculus
gctacaagatgatgcgccaggctaa

SEQ ID NO: 562474 - DNA, 25 bp, Mus musculus
gctacaagccctccatttacaaaga

SEQ ID NO: 562475 - DNA, 25 bp, Mus musculus
gctacaagccctgcatttacaaaga

SEQ ID NO: 562476 - DNA, 25 bp, Mus musculus
gctacaagctataaaccaaaccaaa

SEQ ID NO: 562477 - DNA, 25 bp, Mus musculus
gctacaagctattaaccaaaccaaa

SEQ ID NO: 562478 - DNA, 25 bp, Mus musculus
gctacaaggccaattctattctcac

SEQ ID NO: 562479 - DNA, 25 bp, Mus musculus
gctacaaggccatttctattctcac

SEQ ID NO: 562480 - DNA, 25 bp, Mus musculus
gctacaaggcgtataaacagttgca

SEQ ID NO: 562481 - DNA, 25 bp, Mus musculus
gctacaaggcgtttaaacagttgca

SEQ ID NO: 562482 - DNA, 25 bp, Mus musculus
gctacaaggctgagtggttcggcaa

SEQ ID NO: 562483 - DNA, 25 bp, Mus musculus
gctacaaggctgtgtggttcggcaa

SEQ ID NO: 562484 - DNA, 25 bp, Mus musculus
gctacaagtactacgaaatgcacta

SEQ ID NO: 562485 - DNA, 25 bp, Mus musculus
gctacaagtacttcgaaatgcacta

SEQ ID NO: 562486 - DNA, 25 bp, Mus musculus
gctacaatccagaacagagggcgca

SEQ ID NO: 562487 - DNA, 25 bp, Mus musculus
gctacaatccagtacagagggcgca

SEQ ID NO: 562488 - DNA, 25 bp, Mus musculus
gctacaatctcgcattcaggatgca

SEQ ID NO: 562489 - DNA, 25 bp, Mus musculus
gctacaatctcggattcaggatgca

SEQ ID NO: 562490 - DNA, 25 bp, Mus musculus
gctacaatcttcaagctagctgtca

SEQ ID NO: 562491 - DNA, 25 bp, Mus musculus
gctacaatcttctagctagctgtca

SEQ ID NO: 562492 - DNA, 25 bp, Mus musculus
gctacaatgctccagaacaatcttt

SEQ ID NO: 562493 - DNA, 25 bp, Mus musculus
gctacaatgctcgagaacaatcttt

SEQ ID NO: 562494 - DNA, 25 bp, Mus musculus
gctacaatgtgaaactgcttcaggg

SEQ ID NO: 562495 - DNA, 25 bp, Mus musculus
gctacaatgtgatactgcttcaggg

SEQ ID NO: 562496 - DNA, 25 bp, Mus musculus
gctacaattccgaaggagggttctg

SEQ ID NO: 562497 - DNA, 25 bp, Mus musculus
gctacaattccgtaggagggttctg

SEQ ID NO: 562498 - DNA, 25 bp, Mus musculus
gctacacaacacatgaggcaccgca

SEQ ID NO: 562499 - DNA, 25 bp, Mus musculus
gctacacaacacttgaggcaccgca

SEQ ID NO: 562500 - DNA, 25 bp, Mus musculus
gctacacaagaaaaccatccgaaca

SEQ ID NO: 562501 - DNA, 25 bp, Mus musculus
gctacacaagaataccatccgaaca

SEQ ID NO: 562502 - DNA, 25 bp, Mus musculus
gctacacaatcaaacgtagtgtcat

SEQ ID NO: 562503 - DNA, 25 bp, Mus musculus
gctacacaatcatacgtagtgtcat

SEQ ID NO: 562504 - DNA, 25 bp, Mus musculus
gctacacacacactaaactcctttg

SEQ ID NO: 562505 - DNA, 25 bp, Mus musculus
gctacacacacagtaaactcctttg

SEQ ID NO: 562506 - DNA, 25 bp, Mus musculus
gctacacacactatcagggtacttc

SEQ ID NO: 562507 - DNA, 25 bp, Mus musculus
gctacacacactttcagggtacttc

SEQ ID NO: 562508 - DNA, 25 bp, Mus musculus
gctacacacagacctcagagccagt

SEQ ID NO: 562509 - DNA, 25 bp, Mus musculus
gctacacacagagctcagagccagt

SEQ ID NO: 562510 - DNA, 25 bp, Mus musculus
gctacacacctcagtgatttcattc

SEQ ID NO: 562511 - DNA, 25 bp, Mus musculus
gctacacacctcattggcttgctta

SEQ ID NO: 562512 - DNA, 25 bp, Mus musculus
gctacacacctctgtgatttcattc

SEQ ID NO: 562513 - DNA, 25 bp, Mus musculus
gctacacacctctttggcttgctta

SEQ ID NO: 562514 - DNA, 25 bp, Mus musculus
gctacacagaagacctatttccgga

SEQ ID NO: 562515 - DNA, 25 bp, Mus musculus
gctacacagaagtcctatttccgga

SEQ ID NO: 562516 - DNA, 25 bp, Mus musculus
gctacacagatgacatacactttat

SEQ ID NO: 562517 - DNA, 25 bp, Mus musculus
gctacacagatgtcatacactttat

SEQ ID NO: 562518 - DNA, 25 bp, Mus musculus
gctacacagcttccattccaaatgg

SEQ ID NO: 562519 - DNA, 25 bp, Mus musculus
gctacacagcttgcattccaaatgg

SEQ ID NO: 562520 - DNA, 25 bp, Mus musculus
gctacacagggaaatggctcttcaa

SEQ ID NO: 562521 - DNA, 25 bp, Mus musculus
gctacacagggatatggctcttcaa

SEQ ID NO: 562522 - DNA, 25 bp, Mus musculus
gctacacatgcacctttatccaggc

SEQ ID NO: 562523 - DNA, 25 bp, Mus musculus
gctacacatgcagctttatccaggc

SEQ ID NO: 562524 - DNA, 25 bp, Mus musculus
gctacacattgaaggccactgcaca

SEQ ID NO: 562525 - DNA, 25 bp, Mus musculus
gctacacattgatggccactgcaca

SEQ ID NO: 562526 - DNA, 25 bp, Mus musculus
gctacaccacatatgctacagatat

SEQ ID NO: 562527 - DNA, 25 bp, Mus musculus
gctacaccacatttgctacagatat

SEQ ID NO: 562528 - DNA, 25 bp, Mus musculus
gctacaccagtacgctgattcaatc

SEQ ID NO: 562529 - DNA, 25 bp, Mus musculus
gctacaccagtaggctgattcaatc

SEQ ID NO: 562530 - DNA, 25 bp, Mus musculus
gctacacccagcattatctttagga

SEQ ID NO: 562531 - DNA, 25 bp, Mus musculus
gctacacccagctttatctttagga

SEQ ID NO: 562532 - DNA, 25 bp, Mus musculus
gctacacccattcacaaacaagtat

SEQ ID NO: 562533 - DNA, 25 bp, Mus musculus
gctacacccattgacaaacaagtat

SEQ ID NO: 562534 - DNA, 25 bp, Mus musculus
gctacaccgcacaatggccagttaa

SEQ ID NO: 562535 - DNA, 25 bp, Mus musculus
gctacaccgcactatggccagttaa

SEQ ID NO: 562536 - DNA, 25 bp, Mus musculus
gctacacctgctcatcatgcattta

SEQ ID NO: 562537 - DNA, 25 bp, Mus musculus
gctacacctgctgatcatgcattta

SEQ ID NO: 562538 - DNA, 25 bp, Mus musculus
gctacacctggtcccgagagtctgg

SEQ ID NO: 562539 - DNA, 25 bp, Mus musculus
gctacacctggtgccgagagtctgg

SEQ ID NO: 562540 - DNA, 25 bp, Mus musculus
gctacacctgtgatatcagaggtgg

SEQ ID NO: 562541 - DNA, 25 bp, Mus musculus
gctacacctgtgttatcagaggtgg

SEQ ID NO: 562542 - DNA, 25 bp, Mus musculus
gctacacgaggcactgtctcatgaa

SEQ ID NO: 562543 - DNA, 25 bp, Mus musculus
gctacacgaggctctgtctcatgaa

SEQ ID NO: 562544 - DNA, 25 bp, Mus musculus
gctacacgcttgatttcctttggga

SEQ ID NO: 562545 - DNA, 25 bp, Mus musculus
gctacacgcttgttttcctttggga

SEQ ID NO: 562546 - DNA, 25 bp, Mus musculus
gctacacggtaaatgcattttaaag

SEQ ID NO: 562547 - DNA, 25 bp, Mus musculus
gctacacggtaattgcattttaaag

SEQ ID NO: 562548 - DNA, 25 bp, Mus musculus
gctacacgtccaaggacctgttgaa

SEQ ID NO: 562549 - DNA, 25 bp, Mus musculus
gctacacgtccatggacctgttgaa

SEQ ID NO: 562550 - DNA, 25 bp, Mus musculus
gctacactagcaagaagatccatca

SEQ ID NO: 562551 - DNA, 25 bp, Mus musculus
gctacactagcatgaagatccatca

SEQ ID NO: 562552 - DNA, 25 bp, Mus musculus
gctacactcagcctacttgtaggat

SEQ ID NO: 562553 - DNA, 25 bp, Mus musculus
gctacactcagcgtacttgtaggat

SEQ ID NO: 562554 - DNA, 25 bp, Mus musculus
gctacactcattcttgtgtgtaagg

SEQ ID NO: 562555 - DNA, 25 bp, Mus musculus
gctacactcattgttgtgtgtaagg

SEQ ID NO: 562556 - DNA, 25 bp, Mus musculus
gctacactccaaccaaaatctcagt

SEQ ID NO: 562557 - DNA, 25 bp, Mus musculus
gctacactccaagcaaaatctcagt

SEQ ID NO: 562558 - DNA, 25 bp, Mus musculus
gctacactctgtcgttctgcatggg

SEQ ID NO: 562559 - DNA, 25 bp, Mus musculus
gctacactctgtggttctgcatggg

SEQ ID NO: 562560 - DNA, 25 bp, Mus musculus
gctacactgagcactggtgcagatt

SEQ ID NO: 562561 - DNA, 25 bp, Mus musculus
gctacactgagctctggtgcagatt

SEQ ID NO: 562562 - DNA, 25 bp, Mus musculus
gctacactgctgacatctgaacttt

SEQ ID NO: 562563 - DNA, 25 bp, Mus musculus
gctacactgctgtcatctgaacttt

SEQ ID NO: 562564 - DNA, 25 bp, Mus musculus
gctacactggttatgattatttgag

SEQ ID NO: 562565 - DNA, 25 bp, Mus musculus
gctacactggttttgattatttgag

SEQ ID NO: 562566 - DNA, 25 bp, Mus musculus
gctacacttaatctttttctttggt

SEQ ID NO: 562567 - DNA, 25 bp, Mus musculus
gctacacttaatgtttttctttggt

SEQ ID NO: 562568 - DNA, 25 bp, Mus musculus
gctacacttgatactaaaaagctat

SEQ ID NO: 562569 - DNA, 25 bp, Mus musculus
gctacacttgattctaaaaagctat

SEQ ID NO: 562570 - DNA, 25 bp, Mus musculus
gctacagaaaatcctattcctcttg

SEQ ID NO: 562571 - DNA, 25 bp, Mus musculus
gctacagaaaatgctattcctcttg

SEQ ID NO: 562572 - DNA, 25 bp, Mus musculus
gctacagaactgcataacatgcaaa

SEQ ID NO: 562573 - DNA, 25 bp, Mus musculus
gctacagaactggataacatgcaaa

SEQ ID NO: 562574 - DNA, 25 bp, Mus musculus
gctacagaagacaggcctggcacgg

SEQ ID NO: 562575 - DNA, 25 bp, Mus musculus
gctacagaagactggcctggcacgg

SEQ ID NO: 562576 - DNA, 25 bp, Mus musculus
gctacagaagatcttattcttgctg

SEQ ID NO: 562577 - DNA, 25 bp, Mus musculus
gctacagaagatgttattcttgctg

SEQ ID NO: 562578 - DNA, 25 bp, Mus musculus
gctacagaagcaccgtttgtgtttt

SEQ ID NO: 562579 - DNA, 25 bp, Mus musculus
gctacagaagcagcgtttgtgtttt

SEQ ID NO: 562580 - DNA, 25 bp, Mus musculus
gctacagaaggcaatgggcagaaga

SEQ ID NO: 562581 - DNA, 25 bp, Mus musculus
gctacagaaggctatgggcagaaga

SEQ ID NO: 562582 - DNA, 25 bp, Mus musculus
gctacagaataaatgcaaggccaac

SEQ ID NO: 562583 - DNA, 25 bp, Mus musculus
gctacagaataacagcctggttcaa

SEQ ID NO: 562584 - DNA, 25 bp, Mus musculus
gctacagaataagagcctggttcaa

SEQ ID NO: 562585 - DNA, 25 bp, Mus musculus
gctacagaataattgcaaggccaac

SEQ ID NO: 562586 - DNA, 25 bp, Mus musculus
gctacagacagtcgcatactcttcc

SEQ ID NO: 562587 - DNA, 25 bp, Mus musculus
gctacagacagtggcatactcttcc

SEQ ID NO: 562588 - DNA, 25 bp, Mus musculus
gctacagagcatcgcttcagtttgc

SEQ ID NO: 562589 - DNA, 25 bp, Mus musculus
gctacagagcatggcttcagtttgc

SEQ ID NO: 562590 - DNA, 25 bp, Mus musculus
gctacagagctccagttgggagaat

SEQ ID NO: 562591 - DNA, 25 bp, Mus musculus
gctacagagctcgagttgggagaat

SEQ ID NO: 562592 - DNA, 25 bp, Mus musculus
gctacagagtatccaggttcattct

SEQ ID NO: 562593 - DNA, 25 bp, Mus musculus
gctacagagtatgcaggttcattct

SEQ ID NO: 562594 - DNA, 25 bp, Mus musculus
gctacagagtcactttaatgtttaa

SEQ ID NO: 562595 - DNA, 25 bp, Mus musculus
gctacagagtcagtttaatgtttaa

SEQ ID NO: 562596 - DNA, 25 bp, Mus musculus
gctacagagtgcattagggagatcc

SEQ ID NO: 562597 - DNA, 25 bp, Mus musculus
gctacagagtgctttagggagatcc

SEQ ID NO: 562598 - DNA, 25 bp, Mus musculus
gctacagagttgacgagcaggtcct

SEQ ID NO: 562599 - DNA, 25 bp, Mus musculus
gctacagagttgtcgagcaggtcct

SEQ ID NO: 562600 - DNA, 25 bp, Mus musculus
gctacagagtttctaaaccctgcct

SEQ ID NO: 562601 - DNA, 25 bp, Mus musculus
gctacagagtttgtaaaccctgcct

SEQ ID NO: 562602 - DNA, 25 bp, Mus musculus
gctacagatcacatcttggacatcc

SEQ ID NO: 562603 - DNA, 25 bp, Mus musculus
gctacagatcacttcttggacatcc

SEQ ID NO: 562604 - DNA, 25 bp, Mus musculus
gctacagcaaacactaaggaaccct

SEQ ID NO: 562605 - DNA, 25 bp, Mus musculus
gctacagcaaactctaaggaaccct

SEQ ID NO: 562606 - DNA, 25 bp, Mus musculus
gctacagcaagccaagcaatggtta

SEQ ID NO: 562607 - DNA, 25 bp, Mus musculus
gctacagcaagcgaagcaatggtta

SEQ ID NO: 562608 - DNA, 25 bp, Mus musculus
gctacagcaatgatcctatggccaa

SEQ ID NO: 562609 - DNA, 25 bp, Mus musculus
gctacagcaatgcaccgggcagcag

SEQ ID NO: 562610 - DNA, 25 bp, Mus musculus
gctacagcaatggaccgggcagcag

SEQ ID NO: 562611 - DNA, 25 bp, Mus musculus
gctacagcaatgttcctatggccaa

SEQ ID NO: 562612 - DNA, 25 bp, Mus musculus
gctacagcaattatggcttaagatc

SEQ ID NO: 562613 - DNA, 25 bp, Mus musculus
gctacagcaattttggcttaagatc

SEQ ID NO: 562614 - DNA, 25 bp, Mus musculus
gctacagcactgattccaaatttac

SEQ ID NO: 562615 - DNA, 25 bp, Mus musculus
gctacagcactgtttccaaatttac

SEQ ID NO: 562616 - DNA, 25 bp, Mus musculus
gctacagcagcaaggtgaggaccca

SEQ ID NO: 562617 - DNA, 25 bp, Mus musculus
gctacagcagcatggtgaggaccca

SEQ ID NO: 562618 - DNA, 25 bp, Mus musculus
gctacagcagcgagtgcttttacct

SEQ ID NO: 562619 - DNA, 25 bp, Mus musculus
gctacagcagcgtgtgcttttacct

SEQ ID NO: 562620 - DNA, 25 bp, Mus musculus
gctacagccaacagggtgcttatat

SEQ ID NO: 562621 - DNA, 25 bp, Mus musculus
gctacagccaactgggtgcttatat

SEQ ID NO: 562622 - DNA, 25 bp, Mus musculus
gctacagccaatcttaaaacaccct

SEQ ID NO: 562623 - DNA, 25 bp, Mus musculus
gctacagccaatgttaaaacaccct

SEQ ID NO: 562624 - DNA, 25 bp, Mus musculus
gctacagccacgctagaatttcctt

SEQ ID NO: 562625 - DNA, 25 bp, Mus musculus
gctacagccacggtagaatttcctt

SEQ ID NO: 562626 - DNA, 25 bp, Mus musculus
gctacagccgctccaagtctcggtc

SEQ ID NO: 562627 - DNA, 25 bp, Mus musculus
gctacagccgctgcaagtctcggtc

SEQ ID NO: 562628 - DNA, 25 bp, Mus musculus
gctacagccgggaccgagcttgctt

SEQ ID NO: 562629 - DNA, 25 bp, Mus musculus
gctacagccgggtccgagcttgctt

SEQ ID NO: 562630 - DNA, 25 bp, Mus musculus
gctacagccgtgacatgggtgcatg

SEQ ID NO: 562631 - DNA, 25 bp, Mus musculus
gctacagccgtgtcatgggtgcatg

SEQ ID NO: 562632 - DNA, 25 bp, Mus musculus
gctacagcgtacacagaatcaatca

SEQ ID NO: 562633 - DNA, 25 bp, Mus musculus
gctacagcgtactcagaatcaatca

SEQ ID NO: 562634 - DNA, 25 bp, Mus musculus
gctacagctcccatgagttgatttc

SEQ ID NO: 562635 - DNA, 25 bp, Mus musculus
gctacagctcccttgagttgatttc

SEQ ID NO: 562636 - DNA, 25 bp, Mus musculus
gctacagctctactttattcccaga

SEQ ID NO: 562637 - DNA, 25 bp, Mus musculus
gctacagctctagtttattcccaga

SEQ ID NO: 562638 - DNA, 25 bp, Mus musculus
gctacagcttagaccggacacaggg

SEQ ID NO: 562639 - DNA, 25 bp, Mus musculus
gctacagcttagtccggacacaggg

SEQ ID NO: 562640 - DNA, 25 bp, Mus musculus
gctacagctttgcagtgtgtgcgaa

SEQ ID NO: 562641 - DNA, 25 bp, Mus musculus
gctacagctttggagtgtgtgcgaa

SEQ ID NO: 562642 - DNA, 25 bp, Mus musculus
gctacaggaaacagcgtcccatcag

SEQ ID NO: 562643 - DNA, 25 bp, Mus musculus
gctacaggaaactgcgtcccatcag

SEQ ID NO: 562644 - DNA, 25 bp, Mus musculus
gctacaggaacccagacttcgttta

SEQ ID NO: 562645 - DNA, 25 bp, Mus musculus
gctacaggaaccgagacttcgttta

SEQ ID NO: 562646 - DNA, 25 bp, Mus musculus
gctacaggaagacccacgactattt

SEQ ID NO: 562647 - DNA, 25 bp, Mus musculus
gctacaggaagagccacgactattt

SEQ ID NO: 562648 - DNA, 25 bp, Mus musculus
gctacaggacatagtgcacatgcaa

SEQ ID NO: 562649 - DNA, 25 bp, Mus musculus
gctacaggacattgtgcacatgcaa

SEQ ID NO: 562650 - DNA, 25 bp, Mus musculus
gctacaggaccaccttatgtgatta

SEQ ID NO: 562651 - DNA, 25 bp, Mus musculus
gctacaggaccagcttatgtgatta

SEQ ID NO: 562652 - DNA, 25 bp, Mus musculus
gctacaggaccgaggccagattcag

SEQ ID NO: 562653 - DNA, 25 bp, Mus musculus
gctacaggaccgtggccagattcag

SEQ ID NO: 562654 - DNA, 25 bp, Mus musculus
gctacaggagtactttagtgtggct

SEQ ID NO: 562655 - DNA, 25 bp, Mus musculus
gctacaggagtagtttagtgtggct

SEQ ID NO: 562656 - DNA, 25 bp, Mus musculus
gctacaggcagtcaattctgtcacc

SEQ ID NO: 562657 - DNA, 25 bp, Mus musculus
gctacaggcagtgaattctgtcacc

SEQ ID NO: 562658 - DNA, 25 bp, Mus musculus
gctacagggcaacatgtgggcaact

SEQ ID NO: 562659 - DNA, 25 bp, Mus musculus
gctacagggcaagatgtgggcaact

SEQ ID NO: 562660 - DNA, 25 bp, Mus musculus
gctacagggtccaggttagtctaaa

SEQ ID NO: 562661 - DNA, 25 bp, Mus musculus
gctacagggtcctggttagtctaaa

SEQ ID NO: 562662 - DNA, 25 bp, Mus musculus
gctacaggtcagcttcccgtaaaaa

SEQ ID NO: 562663 - DNA, 25 bp, Mus musculus
gctacaggtcaggttcccgtaaaaa

SEQ ID NO: 562664 - DNA, 25 bp, Mus musculus
gctacaggtcccacacaagttggtt

SEQ ID NO: 562665 - DNA, 25 bp, Mus musculus
gctacaggtccctcacaagttggtt

SEQ ID NO: 562666 - DNA, 25 bp, Mus musculus
gctacaggtttacatccacacacag

SEQ ID NO: 562667 - DNA, 25 bp, Mus musculus
gctacaggtttagatccacacacag

SEQ ID NO: 562668 - DNA, 25 bp, Mus musculus
gctacagtaactagaggtgcctgag

SEQ ID NO: 562669 - DNA, 25 bp, Mus musculus
gctacagtaacttgaggtgcctgag

SEQ ID NO: 562670 - DNA, 25 bp, Mus musculus
gctacagtaattacctggacactcc

SEQ ID NO: 562671 - DNA, 25 bp, Mus musculus
gctacagtaatttcctggacactcc

SEQ ID NO: 562672 - DNA, 25 bp, Mus musculus
gctacagtagtcaaaggagcacact

SEQ ID NO: 562673 - DNA, 25 bp, Mus musculus
gctacagtagtctaaggagcacact

SEQ ID NO: 562674 - DNA, 25 bp, Mus musculus
gctacagtccttatttacagtatat

SEQ ID NO: 562675 - DNA, 25 bp, Mus musculus
gctacagtccttttttacagtatat

SEQ ID NO: 562676 - DNA, 25 bp, Mus musculus
gctacagtcggccaaaagttctgct

SEQ ID NO: 562677 - DNA, 25 bp, Mus musculus
gctacagtcggcgaaaagttctgct

SEQ ID NO: 562678 - DNA, 25 bp, Mus musculus
gctacagtctccatgtgctaggaag

SEQ ID NO: 562679 - DNA, 25 bp, Mus musculus
gctacagtctccttgtgctaggaag

SEQ ID NO: 562680 - DNA, 25 bp, Mus musculus
gctacagtctgaagatgagctacag

SEQ ID NO: 562681 - DNA, 25 bp, Mus musculus
gctacagtctgatgatgagctacag

SEQ ID NO: 562682 - DNA, 25 bp, Mus musculus
gctacagtcttactagccgttcctt

SEQ ID NO: 562683 - DNA, 25 bp, Mus musculus
gctacagtcttagtagccgttcctt

SEQ ID NO: 562684 - DNA, 25 bp, Mus musculus
gctacagtctttcaagccgttccta

SEQ ID NO: 562685 - DNA, 25 bp, Mus musculus
gctacagtctttgaagccgttccta

SEQ ID NO: 562686 - DNA, 25 bp, Mus musculus
gctacagtgagtctgtctcctgcta

SEQ ID NO: 562687 - DNA, 25 bp, Mus musculus
gctacagtgagtgtgtctcctgcta

SEQ ID NO: 562688 - DNA, 25 bp, Mus musculus
gctacagtgcagaagtatgccagtt

SEQ ID NO: 562689 - DNA, 25 bp, Mus musculus
gctacagtgcagctgtctttcattt

SEQ ID NO: 562690 - DNA, 25 bp, Mus musculus
gctacagtgcaggtgtctttcattt

SEQ ID NO: 562691 - DNA, 25 bp, Mus musculus
gctacagtgcagtagtatgccagtt

SEQ ID NO: 562692 - DNA, 25 bp, Mus musculus
gctacagtgcatcaccgccgagtga

SEQ ID NO: 562693 - DNA, 25 bp, Mus musculus
gctacagtgcatgaccgccgagtga

SEQ ID NO: 562694 - DNA, 25 bp, Mus musculus
gctacagtgtggcatcttagtgcaa

SEQ ID NO: 562695 - DNA, 25 bp, Mus musculus
gctacagtgtgggatcttagtgcaa

SEQ ID NO: 562696 - DNA, 25 bp, Mus musculus
gctacagttctgctcagagggccgt

SEQ ID NO: 562697 - DNA, 25 bp, Mus musculus
gctacagttctggtcagagggccgt

SEQ ID NO: 562698 - DNA, 25 bp, Mus musculus
gctacagttgtgatggcagtccctc

SEQ ID NO: 562699 - DNA, 25 bp, Mus musculus
gctacagttgtgttggcagtccctc

SEQ ID NO: 562700 - DNA, 25 bp, Mus musculus
gctacagtttcaacttccatttgaa

SEQ ID NO: 562701 - DNA, 25 bp, Mus musculus
gctacagtttcatcttccatttgaa

SEQ ID NO: 562702 - DNA, 25 bp, Mus musculus
gctacataacaaaagcaaggccttt

SEQ ID NO: 562703 - DNA, 25 bp, Mus musculus
gctacataacaatagcaaggccttt

SEQ ID NO: 562704 - DNA, 25 bp, Mus musculus
gctacataaggccacagtcatcaca

SEQ ID NO: 562705 - DNA, 25 bp, Mus musculus
gctacataaggcgacagtcatcaca

SEQ ID NO: 562706 - DNA, 25 bp, Mus musculus
gctacataatgtaaatgccctggtc

SEQ ID NO: 562707 - DNA, 25 bp, Mus musculus
gctacataatgttaatgccctggtc

SEQ ID NO: 562708 - DNA, 25 bp, Mus musculus
gctacatacaagacctgtgccagaa

SEQ ID NO: 562709 - DNA, 25 bp, Mus musculus
gctacatacaagtcctgtgccagaa

SEQ ID NO: 562710 - DNA, 25 bp, Mus musculus
gctacatactgaactttgttcgtgc

SEQ ID NO: 562711 - DNA, 25 bp, Mus musculus
gctacatactgatctttgttcgtgc

SEQ ID NO: 562712 - DNA, 25 bp, Mus musculus
gctacatagagactgcccggcgcga

SEQ ID NO: 562713 - DNA, 25 bp, Mus musculus
gctacatagagagtgcccggcgcga

SEQ ID NO: 562714 - DNA, 25 bp, Mus musculus
gctacatagcacatggttgatattt

SEQ ID NO: 562715 - DNA, 25 bp, Mus musculus
gctacatagcacttggttgatattt

SEQ ID NO: 562716 - DNA, 25 bp, Mus musculus
gctacatagtttagtatctgcctaa

SEQ ID NO: 562717 - DNA, 25 bp, Mus musculus
gctacatagttttgtatctgcctaa

SEQ ID NO: 562718 - DNA, 25 bp, Mus musculus
gctacatatagcctcacgtgaccca

SEQ ID NO: 562719 - DNA, 25 bp, Mus musculus
gctacatatagcgtcacgtgaccca

SEQ ID NO: 562720 - DNA, 25 bp, Mus musculus
gctacatatggtcttttggttttga

SEQ ID NO: 562721 - DNA, 25 bp, Mus musculus
gctacatatggtgttttggttttga

SEQ ID NO: 562722 - DNA, 25 bp, Mus musculus
gctacatcaccacggttgttcagag

SEQ ID NO: 562723 - DNA, 25 bp, Mus musculus
gctacatcaccagggttgttcagag

SEQ ID NO: 562724 - DNA, 25 bp, Mus musculus
gctacatcacctaaggccagtggtt

SEQ ID NO: 562725 - DNA, 25 bp, Mus musculus
gctacatcaccttaggccagtggtt

SEQ ID NO: 562726 - DNA, 25 bp, Mus musculus
gctacatcactgaggatgagctcaa

SEQ ID NO: 562727 - DNA, 25 bp, Mus musculus
gctacatcactgtggatgagctcaa

SEQ ID NO: 562728 - DNA, 25 bp, Mus musculus
gctacatcaggtctctaagggcaat

SEQ ID NO: 562729 - DNA, 25 bp, Mus musculus
gctacatcaggtgtctaagggcaat

SEQ ID NO: 562730 - DNA, 25 bp, Mus musculus
gctacatccatcagtcatctgaaga

SEQ ID NO: 562731 - DNA, 25 bp, Mus musculus
gctacatccatctgtcatctgaaga

SEQ ID NO: 562732 - DNA, 25 bp, Mus musculus
gctacatccctgaaaaagtgccttt

SEQ ID NO: 562733 - DNA, 25 bp, Mus musculus
gctacatccctgtaaaagtgccttt

SEQ ID NO: 562734 - DNA, 25 bp, Mus musculus
gctacatctactatggcgaggtcaa

SEQ ID NO: 562735 - DNA, 25 bp, Mus musculus
gctacatctactttggcgaggtcaa

SEQ ID NO: 562736 - DNA, 25 bp, Mus musculus
gctacatctatgacccagtggacat

SEQ ID NO: 562737 - DNA, 25 bp, Mus musculus
gctacatctatgtcccagtggacat

SEQ ID NO: 562738 - DNA, 25 bp, Mus musculus
gctacatctcgccacaagattacag

SEQ ID NO: 562739 - DNA, 25 bp, Mus musculus
gctacatctcgcgacaagattacag

SEQ ID NO: 562740 - DNA, 25 bp, Mus musculus
gctacatctgtaacataacgagtca

SEQ ID NO: 562741 - DNA, 25 bp, Mus musculus
gctacatctgtatcataacgagtca

SEQ ID NO: 562742 - DNA, 25 bp, Mus musculus
gctacatcttgacctgtccatctaa

SEQ ID NO: 562743 - DNA, 25 bp, Mus musculus
gctacatcttgagctgtccatctaa

SEQ ID NO: 562744 - DNA, 25 bp, Mus musculus
gctacatctttgctaaagccgatct

SEQ ID NO: 562745 - DNA, 25 bp, Mus musculus
gctacatctttggtaaagccgatct

SEQ ID NO: 562746 - DNA, 25 bp, Mus musculus
gctacatgaagcatgccagaggcag

SEQ ID NO: 562747 - DNA, 25 bp, Mus musculus
gctacatgaagcttgccagaggcag

SEQ ID NO: 562748 - DNA, 25 bp, Mus musculus
gctacatgacagaaccagcctggac

SEQ ID NO: 562749 - DNA, 25 bp, Mus musculus
gctacatgacagtaccagcctggac

SEQ ID NO: 562750 - DNA, 25 bp, Mus musculus
gctacatgacccagctctttctctt

SEQ ID NO: 562751 - DNA, 25 bp, Mus musculus
gctacatgacccagtgaccttgaag

SEQ ID NO: 562752 - DNA, 25 bp, Mus musculus
gctacatgaccctgctctttctctt

SEQ ID NO: 562753 - DNA, 25 bp, Mus musculus
gctacatgaccctgtgaccttgaag

SEQ ID NO: 562754 - DNA, 25 bp, Mus musculus
gctacatgataacctccaagccagg

SEQ ID NO: 562755 - DNA, 25 bp, Mus musculus
gctacatgataagctccaagccagg

SEQ ID NO: 562756 - DNA, 25 bp, Mus musculus
gctacatgcactcatcttgtctaca

SEQ ID NO: 562757 - DNA, 25 bp, Mus musculus
gctacatgcactgatcttgtctaca

SEQ ID NO: 562758 - DNA, 25 bp, Mus musculus
gctacatggaaacacgaacaacttg

SEQ ID NO: 562759 - DNA, 25 bp, Mus musculus
gctacatggaaagacgaacaacttg

SEQ ID NO: 562760 - DNA, 25 bp, Mus musculus
gctacatggaagacccaagaccaca

SEQ ID NO: 562761 - DNA, 25 bp, Mus musculus
gctacatggaagtcccaagaccaca

SEQ ID NO: 562762 - DNA, 25 bp, Mus musculus
gctacatggctgacgcagttcacaa

SEQ ID NO: 562763 - DNA, 25 bp, Mus musculus
gctacatggctgtcgcagttcacaa

SEQ ID NO: 562764 - DNA, 25 bp, Mus musculus
gctacatgtactacatttgcctgca

SEQ ID NO: 562765 - DNA, 25 bp, Mus musculus
gctacatgtacttcatttgcctgca

SEQ ID NO: 562766 - DNA, 25 bp, Mus musculus
gctacatgttcccacgaacacagtg

SEQ ID NO: 562767 - DNA, 25 bp, Mus musculus
gctacatgttccgacgaacacagtg

SEQ ID NO: 562768 - DNA, 25 bp, Mus musculus
gctacattacacatgcaagtctggg

SEQ ID NO: 562769 - DNA, 25 bp, Mus musculus
gctacattacacttgcaagtctggg

SEQ ID NO: 562770 - DNA, 25 bp, Mus musculus
gctacattaggtcacatcattaggg

SEQ ID NO: 562771 - DNA, 25 bp, Mus musculus
gctacattaggtgacatcattaggg

SEQ ID NO: 562772 - DNA, 25 bp, Mus musculus
gctacattcaaaatgtgaacagcaa

SEQ ID NO: 562773 - DNA, 25 bp, Mus musculus
gctacattcaaattgtgaacagcaa

SEQ ID NO: 562774 - DNA, 25 bp, Mus musculus
gctacattccctcagagcttatttg

SEQ ID NO: 562775 - DNA, 25 bp, Mus musculus
gctacattccctgagagcttatttg

SEQ ID NO: 562776 - DNA, 25 bp, Mus musculus
gctacattctgcatgacttatgctc

SEQ ID NO: 562777 - DNA, 25 bp, Mus musculus
gctacattctgcttgacttatgctc

SEQ ID NO: 562778 - DNA, 25 bp, Mus musculus
gctacattgttgatgcagcccagaa

SEQ ID NO: 562779 - DNA, 25 bp, Mus musculus
gctacattgttgttgcagcccagaa

SEQ ID NO: 562780 - DNA, 25 bp, Mus musculus
gctacatttacacatctagcagtca

SEQ ID NO: 562781 - DNA, 25 bp, Mus musculus
gctacatttacagatctagcagtca

SEQ ID NO: 562782 - DNA, 25 bp, Mus musculus
gctacatttatgaccaggagaccca

SEQ ID NO: 562783 - DNA, 25 bp, Mus musculus
gctacatttatgatcggcataccca

SEQ ID NO: 562784 - DNA, 25 bp, Mus musculus
gctacatttatgtccaggagaccca

SEQ ID NO: 562785 - DNA, 25 bp, Mus musculus
gctacatttatgttcggcataccca

SEQ ID NO: 562786 - DNA, 25 bp, Mus musculus
gctacattttacactcgctagagca

SEQ ID NO: 562787 - DNA, 25 bp, Mus musculus
gctacattttacattgcttgagtca

SEQ ID NO: 562788 - DNA, 25 bp, Mus musculus
gctacattttactctcgctagagca

SEQ ID NO: 562789 - DNA, 25 bp, Mus musculus
gctacattttactttgcttgagtca

SEQ ID NO: 562790 - DNA, 25 bp, Mus musculus
gctaccaaaaccattacaactccag

SEQ ID NO: 562791 - DNA, 25 bp, Mus musculus
gctaccaaaacctttacaactccag

SEQ ID NO: 562792 - DNA, 25 bp, Mus musculus
gctaccaaaagcatcctacagtgag

SEQ ID NO: 562793 - DNA, 25 bp, Mus musculus
gctaccaaaagcttcctacagtgag

SEQ ID NO: 562794 - DNA, 25 bp, Mus musculus
gctaccaaactgctattaaaacatg

SEQ ID NO: 562795 - DNA, 25 bp, Mus musculus
gctaccaaactggtattaaaacatg

SEQ ID NO: 562796 - DNA, 25 bp, Mus musculus
gctaccaagattccacacccgagtg

SEQ ID NO: 562797 - DNA, 25 bp, Mus musculus
gctaccaagattgcacacccgagtg

SEQ ID NO: 562798 - DNA, 25 bp, Mus musculus
gctaccaagtcaatcacattttcag

SEQ ID NO: 562799 - DNA, 25 bp, Mus musculus
gctaccaagtcattcacattttcag

SEQ ID NO: 562800 - DNA, 25 bp, Mus musculus
gctaccaagtgcctatgaattgact

SEQ ID NO: 562801 - DNA, 25 bp, Mus musculus
gctaccaagtgcgtatgaattgact

SEQ ID NO: 562802 - DNA, 25 bp, Mus musculus
gctaccaataaacttcttctgagga

SEQ ID NO: 562803 - DNA, 25 bp, Mus musculus
gctaccaataaagttcttctgagga

SEQ ID NO: 562804 - DNA, 25 bp, Mus musculus
gctaccacctggacgcaagtgttca

SEQ ID NO: 562805 - DNA, 25 bp, Mus musculus
gctaccacctggtcgcaagtgttca

SEQ ID NO: 562806 - DNA, 25 bp, Mus musculus
gctaccacggcaaaaccggaagagt

SEQ ID NO: 562807 - DNA, 25 bp, Mus musculus
gctaccacggcataaccggaagagt

SEQ ID NO: 562808 - DNA, 25 bp, Mus musculus
gctaccactgttaggttcaaatcct

SEQ ID NO: 562809 - DNA, 25 bp, Mus musculus
gctaccactgtttggttcaaatcct

SEQ ID NO: 562810 - DNA, 25 bp, Mus musculus
gctaccactttaagttctgtgcatg

SEQ ID NO: 562811 - DNA, 25 bp, Mus musculus
gctaccactttatgttctgtgcatg

SEQ ID NO: 562812 - DNA, 25 bp, Mus musculus
gctaccagaagtcgaccgagctgct

SEQ ID NO: 562813 - DNA, 25 bp, Mus musculus
gctaccagaagtggaccgagctgct

SEQ ID NO: 562814 - DNA, 25 bp, Mus musculus
gctaccagcgtcagatgttcatcct

SEQ ID NO: 562815 - DNA, 25 bp, Mus musculus
gctaccagcgtctgatgttcatcct

SEQ ID NO: 562816 - DNA, 25 bp, Mus musculus
gctaccagggatctgtatcaggcaa

SEQ ID NO: 562817 - DNA, 25 bp, Mus musculus
gctaccagggatgtgtatcaggcaa

SEQ ID NO: 562818 - DNA, 25 bp, Mus musculus
gctaccagtcctctattctgtttag

SEQ ID NO: 562819 - DNA, 25 bp, Mus musculus
gctaccagtcctgtattctgtttag

SEQ ID NO: 562820 - DNA, 25 bp, Mus musculus
gctaccagtttcattgaattgattt

SEQ ID NO: 562821 - DNA, 25 bp, Mus musculus
gctaccagtttctttgaattgattt

SEQ ID NO: 562822 - DNA, 25 bp, Mus musculus
gctaccatacctatgtctgtggatg

SEQ ID NO: 562823 - DNA, 25 bp, Mus musculus
gctaccatacctcacagttcaaagt

SEQ ID NO: 562824 - DNA, 25 bp, Mus musculus
gctaccatacctgacagttcaaagt

SEQ ID NO: 562825 - DNA, 25 bp, Mus musculus
gctaccatacctttgtctgtggatg

SEQ ID NO: 562826 - DNA, 25 bp, Mus musculus
gctaccatatttaaactaggaactg

SEQ ID NO: 562827 - DNA, 25 bp, Mus musculus
gctaccatattttaactaggaactg

SEQ ID NO: 562828 - DNA, 25 bp, Mus musculus
gctaccatccagcagaatgttgatg

SEQ ID NO: 562829 - DNA, 25 bp, Mus musculus
gctaccatccaggagaatgttgatg

SEQ ID NO: 562830 - DNA, 25 bp, Mus musculus
gctaccatcccaaattgctaagcat

SEQ ID NO: 562831 - DNA, 25 bp, Mus musculus
gctaccatcccatattgctaagcat

SEQ ID NO: 562832 - DNA, 25 bp, Mus musculus
gctaccatctgcaggtctaacttta

SEQ ID NO: 562833 - DNA, 25 bp, Mus musculus
gctaccatctgctggtctaacttta

SEQ ID NO: 562834 - DNA, 25 bp, Mus musculus
gctaccatcttacatttcctctggg

SEQ ID NO: 562835 - DNA, 25 bp, Mus musculus
gctaccatcttagatttcctctggg

SEQ ID NO: 562836 - DNA, 25 bp, Mus musculus
gctaccatctttcctggactgtttt

SEQ ID NO: 562837 - DNA, 25 bp, Mus musculus
gctaccatctttgctggactgtttt

SEQ ID NO: 562838 - DNA, 25 bp, Mus musculus
gctaccatgtgtagctgttatgtct

SEQ ID NO: 562839 - DNA, 25 bp, Mus musculus
gctaccatgtgttgctgttatgtct

SEQ ID NO: 562840 - DNA, 25 bp, Mus musculus
gctaccattaccagagactctgcaa

SEQ ID NO: 562841 - DNA, 25 bp, Mus musculus
gctaccattacctgagactctgcaa

SEQ ID NO: 562842 - DNA, 25 bp, Mus musculus
gctaccattatgctacatgccttga

SEQ ID NO: 562843 - DNA, 25 bp, Mus musculus
gctaccattatggtacatgccttga

SEQ ID NO: 562844 - DNA, 25 bp, Mus musculus
gctaccattcagactcaatcttgga

SEQ ID NO: 562845 - DNA, 25 bp, Mus musculus
gctaccattcagtctcaatcttgga

SEQ ID NO: 562846 - DNA, 25 bp, Mus musculus
gctaccattgaacttgtattccttg

SEQ ID NO: 562847 - DNA, 25 bp, Mus musculus
gctaccattgaagttgtattccttg

SEQ ID NO: 562848 - DNA, 25 bp, Mus musculus
gctaccatttacatatctgatctat

SEQ ID NO: 562849 - DNA, 25 bp, Mus musculus
gctaccatttacttatctgatctat

SEQ ID NO: 562850 - DNA, 25 bp, Mus musculus
gctaccatttagagcattttgcttg

SEQ ID NO: 562851 - DNA, 25 bp, Mus musculus
gctaccatttagtgcattttgcttg

SEQ ID NO: 562852 - DNA, 25 bp, Mus musculus
gctaccatttatctaactatcttct

SEQ ID NO: 562853 - DNA, 25 bp, Mus musculus
gctaccatttatgtaactatcttct

SEQ ID NO: 562854 - DNA, 25 bp, Mus musculus
gctacccaaagcaggagactcaact

SEQ ID NO: 562855 - DNA, 25 bp, Mus musculus
gctacccaaagctggagactcaact

SEQ ID NO: 562856 - DNA, 25 bp, Mus musculus
gctacccaaggacagcatgccagat

SEQ ID NO: 562857 - DNA, 25 bp, Mus musculus
gctacccaaggagagcatgccagat

SEQ ID NO: 562858 - DNA, 25 bp, Mus musculus
gctacccaaggcctaaggctggtga

SEQ ID NO: 562859 - DNA, 25 bp, Mus musculus
gctacccaaggcgtaaggctggtga

SEQ ID NO: 562860 - DNA, 25 bp, Mus musculus
gctacccacaacaggaatgtcttca

SEQ ID NO: 562861 - DNA, 25 bp, Mus musculus
gctacccacaactggaatgtcttca

SEQ ID NO: 562862 - DNA, 25 bp, Mus musculus
gctacccacatgcatatcagctgga

SEQ ID NO: 562863 - DNA, 25 bp, Mus musculus
gctacccacatggatatcagctgga

SEQ ID NO: 562864 - DNA, 25 bp, Mus musculus
gctacccacgtgacatcaggcaagg

SEQ ID NO: 562865 - DNA, 25 bp, Mus musculus
gctacccacgtgtcatcaggcaagg

SEQ ID NO: 562866 - DNA, 25 bp, Mus musculus
gctacccagaatatgcaggctcaaa

SEQ ID NO: 562867 - DNA, 25 bp, Mus musculus
gctacccagaatttgcaggctcaaa

SEQ ID NO: 562868 - DNA, 25 bp, Mus musculus
gctacccagagtcccgggagctgat

SEQ ID NO: 562869 - DNA, 25 bp, Mus musculus
gctacccagagtgccgggagctgat

SEQ ID NO: 562870 - DNA, 25 bp, Mus musculus
gctacccaggcaaattctaagacag

SEQ ID NO: 562871 - DNA, 25 bp, Mus musculus
gctacccaggcatattctaagacag

SEQ ID NO: 562872 - DNA, 25 bp, Mus musculus
gctacccagtataacacagaagtta

SEQ ID NO: 562873 - DNA, 25 bp, Mus musculus
gctacccagtataacttgctgtgct

SEQ ID NO: 562874 - DNA, 25 bp, Mus musculus
gctacccagtattacacagaagtta

SEQ ID NO: 562875 - DNA, 25 bp, Mus musculus
gctacccagtattacttgctgtgct

SEQ ID NO: 562876 - DNA, 25 bp, Mus musculus
gctacccataatagactttctgaca

SEQ ID NO: 562877 - DNA, 25 bp, Mus musculus
gctacccataattgactttctgaca

SEQ ID NO: 562878 - DNA, 25 bp, Mus musculus
gctacccataccataccatattttt

SEQ ID NO: 562879 - DNA, 25 bp, Mus musculus
gctacccataccttaccatattttt

SEQ ID NO: 562880 - DNA, 25 bp, Mus musculus
gctaccccagtgaggcatggtgctg

SEQ ID NO: 562881 - DNA, 25 bp, Mus musculus
gctaccccagtgtggcatggtgctg

SEQ ID NO: 562882 - DNA, 25 bp, Mus musculus
gctaccccgatcattgagtccagag

SEQ ID NO: 562883 - DNA, 25 bp, Mus musculus
gctaccccgatctttgagtccagag

SEQ ID NO: 562884 - DNA, 25 bp, Mus musculus
gctacccctttccaacagccaagtg

SEQ ID NO: 562885 - DNA, 25 bp, Mus musculus
gctacccctttcgaacagccaagtg

SEQ ID NO: 562886 - DNA, 25 bp, Mus musculus
gctacccgaagcaggctattggaat

SEQ ID NO: 562887 - DNA, 25 bp, Mus musculus
gctacccgaagctggctattggaat

SEQ ID NO: 562888 - DNA, 25 bp, Mus musculus
gctacccgagccaataatttgttga

SEQ ID NO: 562889 - DNA, 25 bp, Mus musculus
gctacccgagcctataatttgttga

SEQ ID NO: 562890 - DNA, 25 bp, Mus musculus
gctacccgcccaagtccggaggagg

SEQ ID NO: 562891 - DNA, 25 bp, Mus musculus
gctacccgcccatgtccggaggagg

SEQ ID NO: 562892 - DNA, 25 bp, Mus musculus
gctaccctaccaagtgtatttcatt

SEQ ID NO: 562893 - DNA, 25 bp, Mus musculus
gctaccctaccatgtgtatttcatt

SEQ ID NO: 562894 - DNA, 25 bp, Mus musculus
gctaccctaggtaacatagttccag

SEQ ID NO: 562895 - DNA, 25 bp, Mus musculus
gctaccctaggttacatagttccag

SEQ ID NO: 562896 - DNA, 25 bp, Mus musculus
gctaccctcattactttcaaacttt

SEQ ID NO: 562897 - DNA, 25 bp, Mus musculus
gctaccctcatttctttcaaacttt

SEQ ID NO: 562898 - DNA, 25 bp, Mus musculus
gctaccctcttaatcctttaaagtg

SEQ ID NO: 562899 - DNA, 25 bp, Mus musculus
gctaccctcttattcctttaaagtg

SEQ ID NO: 562900 - DNA, 25 bp, Mus musculus
gctaccctgcttccagcatggagag

SEQ ID NO: 562901 - DNA, 25 bp, Mus musculus
gctaccctgcttgcagcatggagag

SEQ ID NO: 562902 - DNA, 25 bp, Mus musculus
gctaccctgggcaattctatttatt

SEQ ID NO: 562903 - DNA, 25 bp, Mus musculus
gctaccctgggcagcatagaaaaac

SEQ ID NO: 562904 - DNA, 25 bp, Mus musculus
gctaccctgggctattctatttatt

SEQ ID NO: 562905 - DNA, 25 bp, Mus musculus
gctaccctgggctgcatagaaaaac

SEQ ID NO: 562906 - DNA, 25 bp, Mus musculus
gctacccttcctctttttaagatga

SEQ ID NO: 562907 - DNA, 25 bp, Mus musculus
gctacccttcctgtttttaagatga

SEQ ID NO: 562908 - DNA, 25 bp, Mus musculus
gctacccttgaacttgcttcataac

SEQ ID NO: 562909 - DNA, 25 bp, Mus musculus
gctacccttgaagttgcttcataac

SEQ ID NO: 562910 - DNA, 25 bp, Mus musculus
gctacccttgagcagtatggcttct

SEQ ID NO: 562911 - DNA, 25 bp, Mus musculus
gctacccttgaggagtatggcttct

SEQ ID NO: 562912 - DNA, 25 bp, Mus musculus
gctaccgagacaagggtgcccgaca

SEQ ID NO: 562913 - DNA, 25 bp, Mus musculus
gctaccgagacatgggtgcccgaca

SEQ ID NO: 562914 - DNA, 25 bp, Mus musculus
gctaccgagagaccttttgctgagt

SEQ ID NO: 562915 - DNA, 25 bp, Mus musculus
gctaccgagagagcttttgctgagt

SEQ ID NO: 562916 - DNA, 25 bp, Mus musculus
gctaccgccactagtgtgttgggtt

SEQ ID NO: 562917 - DNA, 25 bp, Mus musculus
gctaccgccacttgtgtgttgggtt

SEQ ID NO: 562918 - DNA, 25 bp, Mus musculus
gctaccgcggagagttctgccttag

SEQ ID NO: 562919 - DNA, 25 bp, Mus musculus
gctaccgcggagtgttctgccttag

SEQ ID NO: 562920 - DNA, 25 bp, Mus musculus
gctaccggagatatgtggcgtacac

SEQ ID NO: 562921 - DNA, 25 bp, Mus musculus
gctaccggagatttgtggcgtacac

SEQ ID NO: 562922 - DNA, 25 bp, Mus musculus
gctaccggaggcagacatttaagaa

SEQ ID NO: 562923 - DNA, 25 bp, Mus musculus
gctaccggaggctgacatttaagaa

SEQ ID NO: 562924 - DNA, 25 bp, Mus musculus
gctaccggtgacaggaagggtctca

SEQ ID NO: 562925 - DNA, 25 bp, Mus musculus
gctaccggtgactggaagggtctca

SEQ ID NO: 562926 - DNA, 25 bp, Mus musculus
gctaccggtggcaacctcagcagga

SEQ ID NO: 562927 - DNA, 25 bp, Mus musculus
gctaccggtggctacctcagcagga

SEQ ID NO: 562928 - DNA, 25 bp, Mus musculus
gctaccgtagcaacacaatagtcag

SEQ ID NO: 562929 - DNA, 25 bp, Mus musculus
gctaccgtagcatcacaatagtcag

SEQ ID NO: 562930 - DNA, 25 bp, Mus musculus
gctaccgtagctattggccaactgt

SEQ ID NO: 562931 - DNA, 25 bp, Mus musculus
gctaccgtagcttttggccaactgt

SEQ ID NO: 562932 - DNA, 25 bp, Mus musculus
gctaccgtcccaagaaacaacctga

SEQ ID NO: 562933 - DNA, 25 bp, Mus musculus
gctaccgtcccatgaaacaacctga

SEQ ID NO: 562934 - DNA, 25 bp, Mus musculus
gctaccgtggttattgtgcttaatc

SEQ ID NO: 562935 - DNA, 25 bp, Mus musculus
gctaccgtggtttttgtgcttaatc

SEQ ID NO: 562936 - DNA, 25 bp, Mus musculus
gctaccgtgtggaatgagctcactt

SEQ ID NO: 562937 - DNA, 25 bp, Mus musculus
gctaccgtgtggtatgagctcactt

SEQ ID NO: 562938 - DNA, 25 bp, Mus musculus
gctacctaaaacaattggctgaaca

SEQ ID NO: 562939 - DNA, 25 bp, Mus musculus
gctacctaaaactattggctgaaca

SEQ ID NO: 562940 - DNA, 25 bp, Mus musculus
gctacctaagcccagaggactttaa

SEQ ID NO: 562941 - DNA, 25 bp, Mus musculus
gctacctaagccgagaggactttaa

SEQ ID NO: 562942 - DNA, 25 bp, Mus musculus
gctacctaagtactggtcttcatta

SEQ ID NO: 562943 - DNA, 25 bp, Mus musculus
gctacctaagtagtggtcttcatta

SEQ ID NO: 562944 - DNA, 25 bp, Mus musculus
gctacctacaaaaacattcatttcg

SEQ ID NO: 562945 - DNA, 25 bp, Mus musculus
gctacctacaaatacattcatttcg

SEQ ID NO: 562946 - DNA, 25 bp, Mus musculus
gctacctacacaccaattgctttga

SEQ ID NO: 562947 - DNA, 25 bp, Mus musculus
gctacctacacagcaattgctttga

SEQ ID NO: 562948 - DNA, 25 bp, Mus musculus
gctacctaccctctttctaaagaga

SEQ ID NO: 562949 - DNA, 25 bp, Mus musculus
gctacctaccctgtttctaaagaga

SEQ ID NO: 562950 - DNA, 25 bp, Mus musculus
gctacctactgtaagtttctctttt

SEQ ID NO: 562951 - DNA, 25 bp, Mus musculus
gctacctactgttagtttctctttt

SEQ ID NO: 562952 - DNA, 25 bp, Mus musculus
gctacctagactacactcaccaata

SEQ ID NO: 562953 - DNA, 25 bp, Mus musculus
gctacctagactacagtgccctgtg

SEQ ID NO: 562954 - DNA, 25 bp, Mus musculus
gctacctagacttcactcaccaata

SEQ ID NO: 562955 - DNA, 25 bp, Mus musculus
gctacctagacttcagtgccctgtg

SEQ ID NO: 562956 - DNA, 25 bp, Mus musculus
gctacctagagtaggctgtttactt

SEQ ID NO: 562957 - DNA, 25 bp, Mus musculus
gctacctagagttggctgtttactt

SEQ ID NO: 562958 - DNA, 25 bp, Mus musculus
gctacctagtaaatttgaggctaag

SEQ ID NO: 562959 - DNA, 25 bp, Mus musculus
gctacctagtaattttgaggctaag

SEQ ID NO: 562960 - DNA, 25 bp, Mus musculus
gctacctagtgtatgagcccctaaa

SEQ ID NO: 562961 - DNA, 25 bp, Mus musculus
gctacctagtgtttgagcccctaaa

SEQ ID NO: 562962 - DNA, 25 bp, Mus musculus
gctacctatggcagcaaagctagcc

SEQ ID NO: 562963 - DNA, 25 bp, Mus musculus
gctacctatggctgcaaagctagcc

SEQ ID NO: 562964 - DNA, 25 bp, Mus musculus
gctacctcacaacctgtgcggttta

SEQ ID NO: 562965 - DNA, 25 bp, Mus musculus
gctacctcacaagctgtgcggttta

SEQ ID NO: 562966 - DNA, 25 bp, Mus musculus
gctacctcaggtcttttttacctca

SEQ ID NO: 562967 - DNA, 25 bp, Mus musculus
gctacctcaggtgttttttacctca

SEQ ID NO: 562968 - DNA, 25 bp, Mus musculus
gctacctcatgtactgtggatctca

SEQ ID NO: 562969 - DNA, 25 bp, Mus musculus
gctacctcatgttctgtggatctca

SEQ ID NO: 562970 - DNA, 25 bp, Mus musculus
gctacctcctacaccttatatagtt

SEQ ID NO: 562971 - DNA, 25 bp, Mus musculus
gctacctcctactccttatatagtt

SEQ ID NO: 562972 - DNA, 25 bp, Mus musculus
gctacctcctcacactatttaggga

SEQ ID NO: 562973 - DNA, 25 bp, Mus musculus
gctacctcctcagactatttaggga

SEQ ID NO: 562974 - DNA, 25 bp, Mus musculus
gctacctctataatagctgctattt

SEQ ID NO: 562975 - DNA, 25 bp, Mus musculus
gctacctctatattagctgctattt

SEQ ID NO: 562976 - DNA, 25 bp, Mus musculus
gctacctctccaaactgatgcagaa

SEQ ID NO: 562977 - DNA, 25 bp, Mus musculus
gctacctctccatactgatgcagaa

SEQ ID NO: 562978 - DNA, 25 bp, Mus musculus
gctacctctgtaacaaccaaattct

SEQ ID NO: 562979 - DNA, 25 bp, Mus musculus
gctacctctgtatcaaccaaattct

SEQ ID NO: 562980 - DNA, 25 bp, Mus musculus
gctacctgaaaccatacaactgaga

SEQ ID NO: 562981 - DNA, 25 bp, Mus musculus
gctacctgaaacgatacaactgaga

SEQ ID NO: 562982 - DNA, 25 bp, Mus musculus
gctacctgactgaggacaattttaa

SEQ ID NO: 562983 - DNA, 25 bp, Mus musculus
gctacctgactgtggacaattttaa

SEQ ID NO: 562984 - DNA, 25 bp, Mus musculus
gctacctgagaaatgattcggtttt

SEQ ID NO: 562985 - DNA, 25 bp, Mus musculus
gctacctgagaattgattcggtttt

SEQ ID NO: 562986 - DNA, 25 bp, Mus musculus
gctacctgagtcatttactacgagt

SEQ ID NO: 562987 - DNA, 25 bp, Mus musculus
gctacctgagtcttttactacgagt

SEQ ID NO: 562988 - DNA, 25 bp, Mus musculus
gctacctgagttactttgctgtctt

SEQ ID NO: 562989 - DNA, 25 bp, Mus musculus
gctacctgagtttctttgctgtctt

SEQ ID NO: 562990 - DNA, 25 bp, Mus musculus
gctacctgcactctaaaactgcaaa

SEQ ID NO: 562991 - DNA, 25 bp, Mus musculus
gctacctgcactgtaaaactgcaaa

SEQ ID NO: 562992 - DNA, 25 bp, Mus musculus
gctacctggacaatctgtctgccct

SEQ ID NO: 562993 - DNA, 25 bp, Mus musculus
gctacctggacattctgtctgccct

SEQ ID NO: 562994 - DNA, 25 bp, Mus musculus
gctacctggagaagccttgcctgag

SEQ ID NO: 562995 - DNA, 25 bp, Mus musculus
gctacctggagatgccttgcctgag

SEQ ID NO: 562996 - DNA, 25 bp, Mus musculus
gctacctggataagtttgtcttaaa

SEQ ID NO: 562997 - DNA, 25 bp, Mus musculus
gctacctggatatgtttgtcttaaa

SEQ ID NO: 562998 - DNA, 25 bp, Mus musculus
gctacctgggcaacgtgcgccgcgt

SEQ ID NO: 562999 - DNA, 25 bp, Mus musculus
gctacctgggcatcgtgcgccgcgt

SEQ ID NO: 563000 - DNA, 25 bp, Mus musculus
gctacctgggctacaagtcaaatcc

SEQ ID NO: 563001 - DNA, 25 bp, Mus musculus
gctacctgggcttcaagtcaaatcc

SEQ ID NO: 563002 - DNA, 25 bp, Mus musculus
gctacctggtagatggtgtagcgca

SEQ ID NO: 563003 - DNA, 25 bp, Mus musculus
gctacctggtagttggtgtagcgca

SEQ ID NO: 563004 - DNA, 25 bp, Mus musculus
gctacctggtgtcaagacctaactt

SEQ ID NO: 563005 - DNA, 25 bp, Mus musculus
gctacctggtgtgaagacctaactt

SEQ ID NO: 563006 - DNA, 25 bp, Mus musculus
gctacctgtagcaatttcaagccat

SEQ ID NO: 563007 - DNA, 25 bp, Mus musculus
gctacctgtagctatttcaagccat

SEQ ID NO: 563008 - DNA, 25 bp, Mus musculus
gctacctgtgcgctattacacacaa

SEQ ID NO: 563009 - DNA, 25 bp, Mus musculus
gctacctgtgcggtattacacacaa

SEQ ID NO: 563010 - DNA, 25 bp, Mus musculus
gctacctgtggacttttgtgattct

SEQ ID NO: 563011 - DNA, 25 bp, Mus musculus
gctacctgtggagttttgtgattct

SEQ ID NO: 563012 - DNA, 25 bp, Mus musculus
gctacctgtgtgaatatgctgtgtt

SEQ ID NO: 563013 - DNA, 25 bp, Mus musculus
gctacctgtgtgtatatgctgtgtt

SEQ ID NO: 563014 - DNA, 25 bp, Mus musculus
gctacctgttctaaaatgctgaata

SEQ ID NO: 563015 - DNA, 25 bp, Mus musculus
gctacctgttcttaaatgctgaata

SEQ ID NO: 563016 - DNA, 25 bp, Mus musculus
gctaccttagatacaaacctgccaa

SEQ ID NO: 563017 - DNA, 25 bp, Mus musculus
gctaccttagattcaaacctgccaa

SEQ ID NO: 563018 - DNA, 25 bp, Mus musculus
gctaccttcaatacaacctcagata

SEQ ID NO: 563019 - DNA, 25 bp, Mus musculus
gctaccttcaattcaacctcagata

SEQ ID NO: 563020 - DNA, 25 bp, Mus musculus
gctaccttcacccagtttgtgtatg

SEQ ID NO: 563021 - DNA, 25 bp, Mus musculus
gctaccttcaccgagtttgtgtatg

SEQ ID NO: 563022 - DNA, 25 bp, Mus musculus
gctaccttgatcaccatgactgcta

SEQ ID NO: 563023 - DNA, 25 bp, Mus musculus
gctaccttgatctccatgactgcta

SEQ ID NO: 563024 - DNA, 25 bp, Mus musculus
gctaccttgtgacattgtttctcat

SEQ ID NO: 563025 - DNA, 25 bp, Mus musculus
gctaccttgtgagattgtttctcat

SEQ ID NO: 563026 - DNA, 25 bp, Mus musculus
gctaccttttctctaaatgctcacc

SEQ ID NO: 563027 - DNA, 25 bp, Mus musculus
gctaccttttctgtaaatgctcacc

SEQ ID NO: 563028 - DNA, 25 bp, Mus musculus
gctacgaacagaacagagcttgagt

SEQ ID NO: 563029 - DNA, 25 bp, Mus musculus
gctacgaacagatcagagcttgagt

SEQ ID NO: 563030 - DNA, 25 bp, Mus musculus
gctacgagactcaaagcaaaagcaa

SEQ ID NO: 563031 - DNA, 25 bp, Mus musculus
gctacgagactctaagcaaaagcaa

SEQ ID NO: 563032 - DNA, 25 bp, Mus musculus
gctacgagcacgaggacatccagaa

SEQ ID NO: 563033 - DNA, 25 bp, Mus musculus
gctacgagcacgtggacatccagaa

SEQ ID NO: 563034 - DNA, 25 bp, Mus musculus
gctacgagtttcagagttagtcact

SEQ ID NO: 563035 - DNA, 25 bp, Mus musculus
gctacgagtttctgagttagtcact

SEQ ID NO: 563036 - DNA, 25 bp, Mus musculus
gctacgatgttcactgattcctaat

SEQ ID NO: 563037 - DNA, 25 bp, Mus musculus
gctacgatgttctctgattcctaat

SEQ ID NO: 563038 - DNA, 25 bp, Mus musculus
gctacgattcaaccaacaccagtta

SEQ ID NO: 563039 - DNA, 25 bp, Mus musculus
gctacgattcaagcaacaccagtta

SEQ ID NO: 563040 - DNA, 25 bp, Mus musculus
gctacgcaatgcctatcgggaggtt

SEQ ID NO: 563041 - DNA, 25 bp, Mus musculus
gctacgcaatgcgtatcgggaggtt

SEQ ID NO: 563042 - DNA, 25 bp, Mus musculus
gctacgcacataaactctgtctcaa

SEQ ID NO: 563043 - DNA, 25 bp, Mus musculus
gctacgcacatatactctgtctcaa

SEQ ID NO: 563044 - DNA, 25 bp, Mus musculus
gctacgcatcccatcacttcattgt

SEQ ID NO: 563045 - DNA, 25 bp, Mus musculus
gctacgcatcccttcacttcattgt

SEQ ID NO: 563046 - DNA, 25 bp, Mus musculus
gctacgccatggactacggctacaa

SEQ ID NO: 563047 - DNA, 25 bp, Mus musculus
gctacgccatggtctacggctacaa

SEQ ID NO: 563048 - DNA, 25 bp, Mus musculus
gctacgccctgcagctgcaacagat

SEQ ID NO: 563049 - DNA, 25 bp, Mus musculus
gctacgccctgctgctgcaacagat

SEQ ID NO: 563050 - DNA, 25 bp, Mus musculus
gctacgcgtggaactgcatgactgg

SEQ ID NO: 563051 - DNA, 25 bp, Mus musculus
gctacgcgtggatctgcatgactgg

SEQ ID NO: 563052 - DNA, 25 bp, Mus musculus
gctacgctaggcagaaccatggcta

SEQ ID NO: 563053 - DNA, 25 bp, Mus musculus
gctacgctaggctgaaccatggcta

SEQ ID NO: 563054 - DNA, 25 bp, Mus musculus
gctacgctgcatccgtgaggagtat

SEQ ID NO: 563055 - DNA, 25 bp, Mus musculus
gctacgctgcatgcgtgaggagtat

SEQ ID NO: 563056 - DNA, 25 bp, Mus musculus
gctacgctggcaactggaataccca

SEQ ID NO: 563057 - DNA, 25 bp, Mus musculus
gctacgctggcatctggaataccca

SEQ ID NO: 563058 - DNA, 25 bp, Mus musculus
gctacggaaaaccatgcctgtctca

SEQ ID NO: 563059 - DNA, 25 bp, Mus musculus
gctacggaaaacgatgcctgtctca

SEQ ID NO: 563060 - DNA, 25 bp, Mus musculus
gctacggaaggtcttgcctgtgaat

SEQ ID NO: 563061 - DNA, 25 bp, Mus musculus
gctacggaaggtgttgcctgtgaat

SEQ ID NO: 563062 - DNA, 25 bp, Mus musculus
gctacggaagtacgagtctgcctat

SEQ ID NO: 563063 - DNA, 25 bp, Mus musculus
gctacggaagtaggagtctgcctat

SEQ ID NO: 563064 - DNA, 25 bp, Mus musculus
gctacggaccatcttgctacagaag

SEQ ID NO: 563065 - DNA, 25 bp, Mus musculus
gctacggaccatgttgctacagaag

SEQ ID NO: 563066 - DNA, 25 bp, Mus musculus
gctacggagctgattacttgaggat

SEQ ID NO: 563067 - DNA, 25 bp, Mus musculus
gctacggagctgtttacttgaggat

SEQ ID NO: 563068 - DNA, 25 bp, Mus musculus
gctacggaggcactgagtgtctcac

SEQ ID NO: 563069 - DNA, 25 bp, Mus musculus
gctacggaggcagtgagtgtctcac

SEQ ID NO: 563070 - DNA, 25 bp, Mus musculus
gctacggaggccacgcccaggacag

SEQ ID NO: 563071 - DNA, 25 bp, Mus musculus
gctacggaggcctcgcccaggacag

SEQ ID NO: 563072 - DNA, 25 bp, Mus musculus
gctacggattcccaagtgagctaga

SEQ ID NO: 563073 - DNA, 25 bp, Mus musculus
gctacggattccgaagtgagctaga

SEQ ID NO: 563074 - DNA, 25 bp, Mus musculus
gctacggcaaatactggtaacccag

SEQ ID NO: 563075 - DNA, 25 bp, Mus musculus
gctacggcaaattctggtaacccag

SEQ ID NO: 563076 - DNA, 25 bp, Mus musculus
gctacggcagtacttcagatcagtc

SEQ ID NO: 563077 - DNA, 25 bp, Mus musculus
gctacggcagtagttcagatcagtc

SEQ ID NO: 563078 - DNA, 25 bp, Mus musculus
gctacggccgtgagctccgaaggat

SEQ ID NO: 563079 - DNA, 25 bp, Mus musculus
gctacggccgtgtgctccgaaggat

SEQ ID NO: 563080 - DNA, 25 bp, Mus musculus
gctacggcgacaactggctcaggag

SEQ ID NO: 563081 - DNA, 25 bp, Mus musculus
gctacggcgacatctggctcaggag

SEQ ID NO: 563082 - DNA, 25 bp, Mus musculus
gctacgggaaatccttatttgcaca

SEQ ID NO: 563083 - DNA, 25 bp, Mus musculus
gctacgggaaatgcttatttgcaca

SEQ ID NO: 563084 - DNA, 25 bp, Mus musculus
gctacgggacccaagatcaattcaa

SEQ ID NO: 563085 - DNA, 25 bp, Mus musculus
gctacgggaccctagatcaattcaa

SEQ ID NO: 563086 - DNA, 25 bp, Mus musculus
gctacgtactaactataagggcctg

SEQ ID NO: 563087 - DNA, 25 bp, Mus musculus
gctacgtactaagtataagggcctg

SEQ ID NO: 563088 - DNA, 25 bp, Mus musculus
gctacgtcacggaaacttgtgcctt

SEQ ID NO: 563089 - DNA, 25 bp, Mus musculus
gctacgtcacggtaacttgtgcctt

SEQ ID NO: 563090 - DNA, 25 bp, Mus musculus
gctacgtccagtatcaccacaggaa

SEQ ID NO: 563091 - DNA, 25 bp, Mus musculus
gctacgtccagtttcaccacaggaa

SEQ ID NO: 563092 - DNA, 25 bp, Mus musculus
gctacgtctcttatttatgccttga

SEQ ID NO: 563093 - DNA, 25 bp, Mus musculus
gctacgtctcttttttatgccttga

SEQ ID NO: 563094 - DNA, 25 bp, Mus musculus
gctacgtgctggagctcctacagac

SEQ ID NO: 563095 - DNA, 25 bp, Mus musculus
gctacgtgctggtgctcctacagac

SEQ ID NO: 563096 - DNA, 25 bp, Mus musculus
gctacgttcagaagttccagcgtga

SEQ ID NO: 563097 - DNA, 25 bp, Mus musculus
gctacgttcagatgttccagcgtga

SEQ ID NO: 563098 - DNA, 25 bp, Mus musculus
gctacgttccaaagtgtcaaggttt

SEQ ID NO: 563099 - DNA, 25 bp, Mus musculus
gctacgttccaatgtgtcaaggttt

SEQ ID NO: 563100 - DNA, 25 bp, Mus musculus
gctacgttgataagggcgataccga

SEQ ID NO: 563101 - DNA, 25 bp, Mus musculus
gctacgttgatatgggcgataccga

SEQ ID NO: 563102 - DNA, 25 bp, Mus musculus
gctacgttgattctaaactgcagat

SEQ ID NO: 563103 - DNA, 25 bp, Mus musculus
gctacgttgattgtaaactgcagat

SEQ ID NO: 563104 - DNA, 25 bp, Mus musculus
gctacgtttgcgcagtgacccgaga

SEQ ID NO: 563105 - DNA, 25 bp, Mus musculus
gctacgtttgcggagtgacccgaga

SEQ ID NO: 563106 - DNA, 25 bp, Mus musculus
gctacgtttgtaacatgcttgcctg

SEQ ID NO: 563107 - DNA, 25 bp, Mus musculus
gctacgtttgtatcatgcttgcctg

SEQ ID NO: 563108 - DNA, 25 bp, Mus musculus
gctactaaatgtcatgcttctttcc

SEQ ID NO: 563109 - DNA, 25 bp, Mus musculus
gctactaaatgtgatgcttctttcc

SEQ ID NO: 563110 - DNA, 25 bp, Mus musculus
gctactaaattgaatctatctacac

SEQ ID NO: 563111 - DNA, 25 bp, Mus musculus
gctactaaattgtatctatctacac

SEQ ID NO: 563112 - DNA, 25 bp, Mus musculus
gctactaatcggacattcataaatg

SEQ ID NO: 563113 - DNA, 25 bp, Mus musculus
gctactaatcggtcattcataaatg

SEQ ID NO: 563114 - DNA, 25 bp, Mus musculus
gctactacaatcaaacacagtttcg

SEQ ID NO: 563115 - DNA, 25 bp, Mus musculus
gctactacaatctaacacagtttcg

SEQ ID NO: 563116 - DNA, 25 bp, Mus musculus
gctactacacctcatcttaggcaaa

SEQ ID NO: 563117 - DNA, 25 bp, Mus musculus
gctactacacctgatcttaggcaaa

SEQ ID NO: 563118 - DNA, 25 bp, Mus musculus
gctactaccgctccggtgttgagat

SEQ ID NO: 563119 - DNA, 25 bp, Mus musculus
gctactaccgctgcggtgttgagat

SEQ ID NO: 563120 - DNA, 25 bp, Mus musculus
gctactacgattacactgccaggaa

SEQ ID NO: 563121 - DNA, 25 bp, Mus musculus
gctactacgatttcactgccaggaa

SEQ ID NO: 563122 - DNA, 25 bp, Mus musculus
gctactactaagatggtgtgccccg

SEQ ID NO: 563123 - DNA, 25 bp, Mus musculus
gctactactaagcttgacccttgta

SEQ ID NO: 563124 - DNA, 25 bp, Mus musculus
gctactactaaggttgacccttgta

SEQ ID NO: 563125 - DNA, 25 bp, Mus musculus
gctactactaagttggtgtgccccg

SEQ ID NO: 563126 - DNA, 25 bp, Mus musculus
gctactactaataaatgtgacaatg

SEQ ID NO: 563127 - DNA, 25 bp, Mus musculus
gctactactaattaatgtgacaatg

SEQ ID NO: 563128 - DNA, 25 bp, Mus musculus
gctactactattcaagacaccacgg

SEQ ID NO: 563129 - DNA, 25 bp, Mus musculus
gctactactattgaagacaccacgg

SEQ ID NO: 563130 - DNA, 25 bp, Mus musculus
gctactactgtgcattcttgggagt

SEQ ID NO: 563131 - DNA, 25 bp, Mus musculus
gctactactgtggattcttgggagt

SEQ ID NO: 563132 - DNA, 25 bp, Mus musculus
gctactacttagaggagttttgcaa

SEQ ID NO: 563133 - DNA, 25 bp, Mus musculus
gctactacttagtggagttttgcaa

SEQ ID NO: 563134 - DNA, 25 bp, Mus musculus
gctactagaagcatccatctgtcaa

SEQ ID NO: 563135 - DNA, 25 bp, Mus musculus
gctactagaagcttccatctgtcaa

SEQ ID NO: 563136 - DNA, 25 bp, Mus musculus
gctactagctttctctacattggaa

SEQ ID NO: 563137 - DNA, 25 bp, Mus musculus
gctactagctttgtctacattggaa

SEQ ID NO: 563138 - DNA, 25 bp, Mus musculus
gctactagtattcagagtgcccatc

SEQ ID NO: 563139 - DNA, 25 bp, Mus musculus
gctactagtattgagagtgcccatc

SEQ ID NO: 563140 - DNA, 25 bp, Mus musculus
gctactatacaaacctttggtgatg

SEQ ID NO: 563141 - DNA, 25 bp, Mus musculus
gctactatacaatcctttggtgatg

SEQ ID NO: 563142 - DNA, 25 bp, Mus musculus
gctactatatttcttgctggccaag

SEQ ID NO: 563143 - DNA, 25 bp, Mus musculus
gctactatatttgttgctggccaag

SEQ ID NO: 563144 - DNA, 25 bp, Mus musculus
gctactatccatcgccttacaatta

SEQ ID NO: 563145 - DNA, 25 bp, Mus musculus
gctactatccatggccttacaatta

SEQ ID NO: 563146 - DNA, 25 bp, Mus musculus
gctactatctcacgctgagggccaa

SEQ ID NO: 563147 - DNA, 25 bp, Mus musculus
gctactatctcaggctgagggccaa

SEQ ID NO: 563148 - DNA, 25 bp, Mus musculus
gctactatcttcaacagtgacatca

SEQ ID NO: 563149 - DNA, 25 bp, Mus musculus
gctactatcttctacagtgacatca

SEQ ID NO: 563150 - DNA, 25 bp, Mus musculus
gctactatgctcagaagataaagtg

SEQ ID NO: 563151 - DNA, 25 bp, Mus musculus
gctactatgctctgaagataaagtg

SEQ ID NO: 563152 - DNA, 25 bp, Mus musculus
gctactatgtagagcttggaaccaa

SEQ ID NO: 563153 - DNA, 25 bp, Mus musculus
gctactatgtagtgcttggaaccaa

SEQ ID NO: 563154 - DNA, 25 bp, Mus musculus
gctactattattaagtctgccacta

SEQ ID NO: 563155 - DNA, 25 bp, Mus musculus
gctactattatttagtctgccacta

SEQ ID NO: 563156 - DNA, 25 bp, Mus musculus
gctactattcctcacacaatgactt

SEQ ID NO: 563157 - DNA, 25 bp, Mus musculus
gctactattcctgacacaatgactt

SEQ ID NO: 563158 - DNA, 25 bp, Mus musculus
gctactattcttcctggtgacatca

SEQ ID NO: 563159 - DNA, 25 bp, Mus musculus
gctactattcttgctggtgacatca

SEQ ID NO: 563160 - DNA, 25 bp, Mus musculus
gctactattgcaactgctatggttt

SEQ ID NO: 563161 - DNA, 25 bp, Mus musculus
gctactattgcatctgctatggttt

SEQ ID NO: 563162 - DNA, 25 bp, Mus musculus
gctactattgtgctagcatctcaca

SEQ ID NO: 563163 - DNA, 25 bp, Mus musculus
gctactattgtggtagcatctcaca

SEQ ID NO: 563164 - DNA, 25 bp, Mus musculus
gctactcaaacgcagccatgctgag

SEQ ID NO: 563165 - DNA, 25 bp, Mus musculus
gctactcaaacggagccatgctgag

SEQ ID NO: 563166 - DNA, 25 bp, Mus musculus
gctactcacacactgcctagactag

SEQ ID NO: 563167 - DNA, 25 bp, Mus musculus
gctactcacacagtgcctagactag

SEQ ID NO: 563168 - DNA, 25 bp, Mus musculus
gctactcacagtaagccatcctaaa

SEQ ID NO: 563169 - DNA, 25 bp, Mus musculus
gctactcacagttagccatcctaaa

SEQ ID NO: 563170 - DNA, 25 bp, Mus musculus
gctactcacctgagcttcctttgag

SEQ ID NO: 563171 - DNA, 25 bp, Mus musculus
gctactcacctgtgcttcctttgag

SEQ ID NO: 563172 - DNA, 25 bp, Mus musculus
gctactcacgcgaggtcttcgaaag

SEQ ID NO: 563173 - DNA, 25 bp, Mus musculus
gctactcacgcgtggtcttcgaaag

SEQ ID NO: 563174 - DNA, 25 bp, Mus musculus
gctactcactggattttgcagattt

SEQ ID NO: 563175 - DNA, 25 bp, Mus musculus
gctactcactggtttttgcagattt

SEQ ID NO: 563176 - DNA, 25 bp, Mus musculus
gctactcaggcacgtattttgctag

SEQ ID NO: 563177 - DNA, 25 bp, Mus musculus
gctactcaggcaggtattttgctag

SEQ ID NO: 563178 - DNA, 25 bp, Mus musculus
gctactcagtgcatgtactttacta

SEQ ID NO: 563179 - DNA, 25 bp, Mus musculus
gctactcagtgcttgtactttacta

SEQ ID NO: 563180 - DNA, 25 bp, Mus musculus
gctactcatattagtttgtgttcat

SEQ ID NO: 563181 - DNA, 25 bp, Mus musculus
gctactcatatttgtttgtgttcat

SEQ ID NO: 563182 - DNA, 25 bp, Mus musculus
gctactcattctatactatactcgg

SEQ ID NO: 563183 - DNA, 25 bp, Mus musculus
gctactcattctttactatactcgg

SEQ ID NO: 563184 - DNA, 25 bp, Mus musculus
gctactccattcacacttacctgtg

SEQ ID NO: 563185 - DNA, 25 bp, Mus musculus
gctactccattcagcatgttgtaca

SEQ ID NO: 563186 - DNA, 25 bp, Mus musculus
gctactccattctcacttacctgtg

SEQ ID NO: 563187 - DNA, 25 bp, Mus musculus
gctactccattctgcatgttgtaca

SEQ ID NO: 563188 - DNA, 25 bp, Mus musculus
gctactccatttcgaccctagaaat

SEQ ID NO: 563189 - DNA, 25 bp, Mus musculus
gctactccatttggaccctagaaat

SEQ ID NO: 563190 - DNA, 25 bp, Mus musculus
gctactcccagccttttttatagaa

SEQ ID NO: 563191 - DNA, 25 bp, Mus musculus
gctactcccagcgttttttatagaa

SEQ ID NO: 563192 - DNA, 25 bp, Mus musculus
gctactcccgagaaatgcttaaaca

SEQ ID NO: 563193 - DNA, 25 bp, Mus musculus
gctactcccgagtaatgcttaaaca

SEQ ID NO: 563194 - DNA, 25 bp, Mus musculus
gctactcccgtgatcccttggaggg

SEQ ID NO: 563195 - DNA, 25 bp, Mus musculus
gctactcccgtgttcccttggaggg

SEQ ID NO: 563196 - DNA, 25 bp, Mus musculus
gctactcctcggagagcagctgcaa

SEQ ID NO: 563197 - DNA, 25 bp, Mus musculus
gctactcctcggtgagcagctgcaa

SEQ ID NO: 563198 - DNA, 25 bp, Mus musculus
gctactcctttgatccttgtgaaag

SEQ ID NO: 563199 - DNA, 25 bp, Mus musculus
gctactcctttgttccttgtgaaag

SEQ ID NO: 563200 - DNA, 25 bp, Mus musculus
gctactcgcgttatccaaaagctgc

SEQ ID NO: 563201 - DNA, 25 bp, Mus musculus
gctactcgcgttttccaaaagctgc

SEQ ID NO: 563202 - DNA, 25 bp, Mus musculus
gctactcgctttaacagctacctga

SEQ ID NO: 563203 - DNA, 25 bp, Mus musculus
gctactcgcttttacagctacctga

SEQ ID NO: 563204 - DNA, 25 bp, Mus musculus
gctactcggaggaaagcgtcttgta

SEQ ID NO: 563205 - DNA, 25 bp, Mus musculus
gctactcggaggtaagcgtcttgta

SEQ ID NO: 563206 - DNA, 25 bp, Mus musculus
gctactcggtgtacgtgtacaaggt

SEQ ID NO: 563207 - DNA, 25 bp, Mus musculus
gctactcggtgttcgtgtacaaggt

SEQ ID NO: 563208 - DNA, 25 bp, Mus musculus
gctactcgtcgccccggaggacgaa

SEQ ID NO: 563209 - DNA, 25 bp, Mus musculus
gctactcgtcgcgccggaggacgaa

SEQ ID NO: 563210 - DNA, 25 bp, Mus musculus
gctactctaatcatttacgtattaa

SEQ ID NO: 563211 - DNA, 25 bp, Mus musculus
gctactctaatcttttacgtattaa

SEQ ID NO: 563212 - DNA, 25 bp, Mus musculus
gctactctactcactgaattgtctt

SEQ ID NO: 563213 - DNA, 25 bp, Mus musculus
gctactctactctctgaattgtctt

SEQ ID NO: 563214 - DNA, 25 bp, Mus musculus
gctactctatggcttacggtcgtgc

SEQ ID NO: 563215 - DNA, 25 bp, Mus musculus
gctactctatgggttacggtcgtgc

SEQ ID NO: 563216 - DNA, 25 bp, Mus musculus
gctactctctcacgatctcagattt

SEQ ID NO: 563217 - DNA, 25 bp, Mus musculus
gctactctctcaggatctcagattt

SEQ ID NO: 563218 - DNA, 25 bp, Mus musculus
gctactctgactcatgaagtgttca

SEQ ID NO: 563219 - DNA, 25 bp, Mus musculus
gctactctgactgatgaagtgttca

SEQ ID NO: 563220 - DNA, 25 bp, Mus musculus
gctactctgatcaacattcgtaatg

SEQ ID NO: 563221 - DNA, 25 bp, Mus musculus
gctactctgatctacattcgtaatg

SEQ ID NO: 563222 - DNA, 25 bp, Mus musculus
gctactctgtataaatgagttctaa

SEQ ID NO: 563223 - DNA, 25 bp, Mus musculus
gctactctgtattaatgagttctaa

SEQ ID NO: 563224 - DNA, 25 bp, Mus musculus
gctactctgtggatgagggttcatt

SEQ ID NO: 563225 - DNA, 25 bp, Mus musculus
gctactctgtggttgagggttcatt

SEQ ID NO: 563226 - DNA, 25 bp, Mus musculus
gctactcttcaactaccatgtctat

SEQ ID NO: 563227 - DNA, 25 bp, Mus musculus
gctactcttcaagtaccatgtctat

SEQ ID NO: 563228 - DNA, 25 bp, Mus musculus
gctactcttggcatttacttgcaat

SEQ ID NO: 563229 - DNA, 25 bp, Mus musculus
gctactcttggcttttacttgcaat

SEQ ID NO: 563230 - DNA, 25 bp, Mus musculus
gctactgaaatcagtcaggagtatt

SEQ ID NO: 563231 - DNA, 25 bp, Mus musculus
gctactgaaatctgtcaggagtatt

SEQ ID NO: 563232 - DNA, 25 bp, Mus musculus
gctactgaacaccatgggctaagac

SEQ ID NO: 563233 - DNA, 25 bp, Mus musculus
gctactgaacacgatgggctaagac

SEQ ID NO: 563234 - DNA, 25 bp, Mus musculus
gctactgaacgtatttccacttgga

SEQ ID NO: 563235 - DNA, 25 bp, Mus musculus
gctactgaacgtttttccacttgga

SEQ ID NO: 563236 - DNA, 25 bp, Mus musculus
gctactgaacttcgattgatgcgga

SEQ ID NO: 563237 - DNA, 25 bp, Mus musculus
gctactgaacttggattgatgcgga

SEQ ID NO: 563238 - DNA, 25 bp, Mus musculus
gctactgaatatcttggtctgcgtt

SEQ ID NO: 563239 - DNA, 25 bp, Mus musculus
gctactgaatatgttggtctgcgtt

SEQ ID NO: 563240 - DNA, 25 bp, Mus musculus
gctactgaatctactgtgttgtctc

SEQ ID NO: 563241 - DNA, 25 bp, Mus musculus
gctactgaatcttctgtgttgtctc

SEQ ID NO: 563242 - DNA, 25 bp, Mus musculus
gctactgacctgagatcaactattt

SEQ ID NO: 563243 - DNA, 25 bp, Mus musculus
gctactgacctgtgatcaactattt

SEQ ID NO: 563244 - DNA, 25 bp, Mus musculus
gctactgactcacaatgacccgaaa

SEQ ID NO: 563245 - DNA, 25 bp, Mus musculus
gctactgactcagaatgacccgaaa

SEQ ID NO: 563246 - DNA, 25 bp, Mus musculus
gctactgactctatatacctgtgac

SEQ ID NO: 563247 - DNA, 25 bp, Mus musculus
gctactgactctttatacctgtgac

SEQ ID NO: 563248 - DNA, 25 bp, Mus musculus
gctactgagcagagtctgagatgtg

SEQ ID NO: 563249 - DNA, 25 bp, Mus musculus
gctactgagcagctgctattctttt

SEQ ID NO: 563250 - DNA, 25 bp, Mus musculus
gctactgagcaggtgctattctttt

SEQ ID NO: 563251 - DNA, 25 bp, Mus musculus
gctactgagcagtgtctgagatgtg

SEQ ID NO: 563252 - DNA, 25 bp, Mus musculus
gctactgagggcagctcatttgctc

SEQ ID NO: 563253 - DNA, 25 bp, Mus musculus
gctactgagggctgctcatttgctc

SEQ ID NO: 563254 - DNA, 25 bp, Mus musculus
gctactgagtgaaggcctgtcttga

SEQ ID NO: 563255 - DNA, 25 bp, Mus musculus
gctactgagtgatggcctgtcttga

SEQ ID NO: 563256 - DNA, 25 bp, Mus musculus
gctactgatgacatagagcctcaaa

SEQ ID NO: 563257 - DNA, 25 bp, Mus musculus
gctactgatgacttagagcctcaaa

SEQ ID NO: 563258 - DNA, 25 bp, Mus musculus
gctactgattatcttccttttctgg

SEQ ID NO: 563259 - DNA, 25 bp, Mus musculus
gctactgattatgttccttttctgg

SEQ ID NO: 563260 - DNA, 25 bp, Mus musculus
gctactgattggctcagagtcccaa

SEQ ID NO: 563261 - DNA, 25 bp, Mus musculus
gctactgattgggtcagagtcccaa

SEQ ID NO: 563262 - DNA, 25 bp, Mus musculus
gctactgcaaccagaacaccatatt

SEQ ID NO: 563263 - DNA, 25 bp, Mus musculus
gctactgcaacctgaacaccatatt

SEQ ID NO: 563264 - DNA, 25 bp, Mus musculus
gctactgcacaaagttacgctgttt

SEQ ID NO: 563265 - DNA, 25 bp, Mus musculus
gctactgcacaatgttacgctgttt

SEQ ID NO: 563266 - DNA, 25 bp, Mus musculus
gctactgcagagaccttcgacatta

SEQ ID NO: 563267 - DNA, 25 bp, Mus musculus
gctactgcagagtccttcgacatta

SEQ ID NO: 563268 - DNA, 25 bp, Mus musculus
gctactgcagccatgggtttgccta

SEQ ID NO: 563269 - DNA, 25 bp, Mus musculus
gctactgcagccttgggtttgccta

SEQ ID NO: 563270 - DNA, 25 bp, Mus musculus
gctactgcagctacgataccaagca

SEQ ID NO: 563271 - DNA, 25 bp, Mus musculus
gctactgcagcttcgataccaagca

SEQ ID NO: 563272 - DNA, 25 bp, Mus musculus
gctactgcagttagtcacgggaacc

SEQ ID NO: 563273 - DNA, 25 bp, Mus musculus
gctactgcagtttgtcacgggaacc

SEQ ID NO: 563274 - DNA, 25 bp, Mus musculus
gctactgcatgacaagggcaagtcc

SEQ ID NO: 563275 - DNA, 25 bp, Mus musculus
gctactgcatgagaagggcaagtcc

SEQ ID NO: 563276 - DNA, 25 bp, Mus musculus
gctactgcatggactgtgtactcga

SEQ ID NO: 563277 - DNA, 25 bp, Mus musculus
gctactgcatggtctgtgtactcga

SEQ ID NO: 563278 - DNA, 25 bp, Mus musculus
gctactgccaaacctaaaaatctga

SEQ ID NO: 563279 - DNA, 25 bp, Mus musculus
gctactgccaaagctaaaaatctga

SEQ ID NO: 563280 - DNA, 25 bp, Mus musculus
gctactgcccagctcattgatgaag

SEQ ID NO: 563281 - DNA, 25 bp, Mus musculus
gctactgcccaggtcattgatgaag

SEQ ID NO: 563282 - DNA, 25 bp, Mus musculus
gctactgcctgtagtcaccaaagag

SEQ ID NO: 563283 - DNA, 25 bp, Mus musculus
gctactgcctgttgtcaccaaagag

SEQ ID NO: 563284 - DNA, 25 bp, Mus musculus
gctactgcctttatattttcctgct

SEQ ID NO: 563285 - DNA, 25 bp, Mus musculus
gctactgcctttttattttcctgct

SEQ ID NO: 563286 - DNA, 25 bp, Mus musculus
gctactgctatacctcactgaaatg

SEQ ID NO: 563287 - DNA, 25 bp, Mus musculus
gctactgctatagctcactgaaatg

SEQ ID NO: 563288 - DNA, 25 bp, Mus musculus
gctactgctgggacacgcacaggaa

SEQ ID NO: 563289 - DNA, 25 bp, Mus musculus
gctactgctgggtcacgcacaggaa

SEQ ID NO: 563290 - DNA, 25 bp, Mus musculus
gctactgcttgaaggtgttcactga

SEQ ID NO: 563291 - DNA, 25 bp, Mus musculus
gctactgcttgatggtgttcactga

SEQ ID NO: 563292 - DNA, 25 bp, Mus musculus
gctactgcttggagcgcaggctcta

SEQ ID NO: 563293 - DNA, 25 bp, Mus musculus
gctactgcttggtgcgcaggctcta

SEQ ID NO: 563294 - DNA, 25 bp, Mus musculus
gctactggaaaaagcctgctcttgg

SEQ ID NO: 563295 - DNA, 25 bp, Mus musculus
gctactggaaaatgcctgctcttgg

SEQ ID NO: 563296 - DNA, 25 bp, Mus musculus
gctactggaacccttgtggaagtca

SEQ ID NO: 563297 - DNA, 25 bp, Mus musculus
gctactggaaccgttgtggaagtca

SEQ ID NO: 563298 - DNA, 25 bp, Mus musculus
gctactggcagcataacctcttaaa

SEQ ID NO: 563299 - DNA, 25 bp, Mus musculus
gctactggcagcttaacctcttaaa

SEQ ID NO: 563300 - DNA, 25 bp, Mus musculus
gctactggccagcagctggatgtca

SEQ ID NO: 563301 - DNA, 25 bp, Mus musculus
gctactggccaggagctggatgtca

SEQ ID NO: 563302 - DNA, 25 bp, Mus musculus
gctactggcctgcatggtggaccaa

SEQ ID NO: 563303 - DNA, 25 bp, Mus musculus
gctactggcctggatggtggaccaa

SEQ ID NO: 563304 - DNA, 25 bp, Mus musculus
gctactggcgtaagtaagggtcaga

SEQ ID NO: 563305 - DNA, 25 bp, Mus musculus
gctactggcgtatgtaagggtcaga

SEQ ID NO: 563306 - DNA, 25 bp, Mus musculus
gctactggctacaagacactgagac

SEQ ID NO: 563307 - DNA, 25 bp, Mus musculus
gctactggctacaagcatggctgat

SEQ ID NO: 563308 - DNA, 25 bp, Mus musculus
gctactggctactagacactgagac

SEQ ID NO: 563309 - DNA, 25 bp, Mus musculus
gctactggctactagcatggctgat

SEQ ID NO: 563310 - DNA, 25 bp, Mus musculus
gctactggctgtcctatatcaacag

SEQ ID NO: 563311 - DNA, 25 bp, Mus musculus
gctactggctgtgctatatcaacag

SEQ ID NO: 563312 - DNA, 25 bp, Mus musculus
gctactggcttaagcctaagtctta

SEQ ID NO: 563313 - DNA, 25 bp, Mus musculus
gctactggcttatgcctaagtctta

SEQ ID NO: 563314 - DNA, 25 bp, Mus musculus
gctactgggactaccttagggtgta

SEQ ID NO: 563315 - DNA, 25 bp, Mus musculus
gctactgggacttccttagggtgta

SEQ ID NO: 563316 - DNA, 25 bp, Mus musculus
gctactgggcaccatccaaatgctg

SEQ ID NO: 563317 - DNA, 25 bp, Mus musculus
gctactgggcacgatccaaatgctg

SEQ ID NO: 563318 - DNA, 25 bp, Mus musculus
gctactgggccaactggtggcagat

SEQ ID NO: 563319 - DNA, 25 bp, Mus musculus
gctactgggccatctggtggcagat

SEQ ID NO: 563320 - DNA, 25 bp, Mus musculus
gctactggtcatccaagagcacctt

SEQ ID NO: 563321 - DNA, 25 bp, Mus musculus
gctactggtcatgcaagagcacctt

SEQ ID NO: 563322 - DNA, 25 bp, Mus musculus
gctactggtgaaagaggctggcctc

SEQ ID NO: 563323 - DNA, 25 bp, Mus musculus
gctactggtgaatgaggctggcctc

SEQ ID NO: 563324 - DNA, 25 bp, Mus musculus
gctactggttggctatggttttata

SEQ ID NO: 563325 - DNA, 25 bp, Mus musculus
gctactggttgggtatggttttata

SEQ ID NO: 563326 - DNA, 25 bp, Mus musculus
gctactgtaatgagtctcctggtca

SEQ ID NO: 563327 - DNA, 25 bp, Mus musculus
gctactgtaatgtgtctcctggtca

SEQ ID NO: 563328 - DNA, 25 bp, Mus musculus
gctactgtagacatggcttgcttaa

SEQ ID NO: 563329 - DNA, 25 bp, Mus musculus
gctactgtagacttggcttgcttaa

SEQ ID NO: 563330 - DNA, 25 bp, Mus musculus
gctactgtagttatggtgtggcact

SEQ ID NO: 563331 - DNA, 25 bp, Mus musculus
gctactgtagttttggtgtggcact

SEQ ID NO: 563332 - DNA, 25 bp, Mus musculus
gctactgtataccatatgtcctgaa

SEQ ID NO: 563333 - DNA, 25 bp, Mus musculus
gctactgtatacgatatgtcctgaa

SEQ ID NO: 563334 - DNA, 25 bp, Mus musculus
gctactgtatcaatgggagtgaccc

SEQ ID NO: 563335 - DNA, 25 bp, Mus musculus
gctactgtatcattgggagtgaccc

SEQ ID NO: 563336 - DNA, 25 bp, Mus musculus
gctactgtattaagttatgcacgac

SEQ ID NO: 563337 - DNA, 25 bp, Mus musculus
gctactgtattatgttatgcacgac

SEQ ID NO: 563338 - DNA, 25 bp, Mus musculus
gctactgtcagtctgaagagtttct

SEQ ID NO: 563339 - DNA, 25 bp, Mus musculus
gctactgtcagtgtgaagagtttct

SEQ ID NO: 563340 - DNA, 25 bp, Mus musculus
gctactgtccccattgatggatcag

SEQ ID NO: 563341 - DNA, 25 bp, Mus musculus
gctactgtcccctttgatggatcag

SEQ ID NO: 563342 - DNA, 25 bp, Mus musculus
gctactgtccctaacggttggcatt

SEQ ID NO: 563343 - DNA, 25 bp, Mus musculus
gctactgtcccttacggttggcatt

SEQ ID NO: 563344 - DNA, 25 bp, Mus musculus
gctactgtcctcctgtatactgtga

SEQ ID NO: 563345 - DNA, 25 bp, Mus musculus
gctactgtcctcgtgtatactgtga

SEQ ID NO: 563346 - DNA, 25 bp, Mus musculus
gctactgtctgtatggctcattcaa

SEQ ID NO: 563347 - DNA, 25 bp, Mus musculus
gctactgtctgtttggctcattcaa

SEQ ID NO: 563348 - DNA, 25 bp, Mus musculus
gctactgtgattcttcaagcagaaa

SEQ ID NO: 563349 - DNA, 25 bp, Mus musculus
gctactgtgattgttcaagcagaaa

SEQ ID NO: 563350 - DNA, 25 bp, Mus musculus
gctactgtgcatctgaagttctgga

SEQ ID NO: 563351 - DNA, 25 bp, Mus musculus
gctactgtgcatgtgaagttctgga

SEQ ID NO: 563352 - DNA, 25 bp, Mus musculus
gctactgtgctcctgtgtttgtgtt

SEQ ID NO: 563353 - DNA, 25 bp, Mus musculus
gctactgtgctcgtgtgtttgtgtt

SEQ ID NO: 563354 - DNA, 25 bp, Mus musculus
gctactgtggccagtgttcttgctg

SEQ ID NO: 563355 - DNA, 25 bp, Mus musculus
gctactgtggcctgtgttcttgctg

SEQ ID NO: 563356 - DNA, 25 bp, Mus musculus
gctactgtggctcagtaattttcca

SEQ ID NO: 563357 - DNA, 25 bp, Mus musculus
gctactgtggctgagtaattttcca

SEQ ID NO: 563358 - DNA, 25 bp, Mus musculus
gctactgtgtcactgtgcctaagag

SEQ ID NO: 563359 - DNA, 25 bp, Mus musculus
gctactgtgtcagtgtgcctaagag

SEQ ID NO: 563360 - DNA, 25 bp, Mus musculus
gctactgtgtctcgcctgagataga

SEQ ID NO: 563361 - DNA, 25 bp, Mus musculus
gctactgtgtctggcctgagataga

SEQ ID NO: 563362 - DNA, 25 bp, Mus musculus
gctactgtgtgtattgagccacatt

SEQ ID NO: 563363 - DNA, 25 bp, Mus musculus
gctactgtgtgttttgagccacatt

SEQ ID NO: 563364 - DNA, 25 bp, Mus musculus
gctactgtgttaacatctgtgtctg

SEQ ID NO: 563365 - DNA, 25 bp, Mus musculus
gctactgtgttatcatctgtgtctg

SEQ ID NO: 563366 - DNA, 25 bp, Mus musculus
gctactgtgtttaggtgctgagttt

SEQ ID NO: 563367 - DNA, 25 bp, Mus musculus
gctactgtgttttggtgctgagttt

SEQ ID NO: 563368 - DNA, 25 bp, Mus musculus
gctactgttacgaagcacaatattg

SEQ ID NO: 563369 - DNA, 25 bp, Mus musculus
gctactgttacgtagcacaatattg

SEQ ID NO: 563370 - DNA, 25 bp, Mus musculus
gctactgttagtcataattgcctta

SEQ ID NO: 563371 - DNA, 25 bp, Mus musculus
gctactgttagtgataattgcctta

SEQ ID NO: 563372 - DNA, 25 bp, Mus musculus
gctactgttatgcacactttcttgt

SEQ ID NO: 563373 - DNA, 25 bp, Mus musculus
gctactgttatggacactttcttgt

SEQ ID NO: 563374 - DNA, 25 bp, Mus musculus
gctactgttcatctgcaaatggacc

SEQ ID NO: 563375 - DNA, 25 bp, Mus musculus
gctactgttcatgtgcaaatggacc

SEQ ID NO: 563376 - DNA, 25 bp, Mus musculus
gctactgttgagcttgcttcttgag

SEQ ID NO: 563377 - DNA, 25 bp, Mus musculus
gctactgttgaggttgcttcttgag

SEQ ID NO: 563378 - DNA, 25 bp, Mus musculus
gctactgttgctcccaggtgtttac

SEQ ID NO: 563379 - DNA, 25 bp, Mus musculus
gctactgttgctgccaggtgtttac

SEQ ID NO: 563380 - DNA, 25 bp, Mus musculus
gctactgttggtagaactatgctga

SEQ ID NO: 563381 - DNA, 25 bp, Mus musculus
gctactgttggttgaactatgctga

SEQ ID NO: 563382 - DNA, 25 bp, Mus musculus
gctacttaaagtcgctgatctattt

SEQ ID NO: 563383 - DNA, 25 bp, Mus musculus
gctacttaaagtggctgatctattt

SEQ ID NO: 563384 - DNA, 25 bp, Mus musculus
gctacttaatccaatgggttctgta

SEQ ID NO: 563385 - DNA, 25 bp, Mus musculus
gctacttaatcctatgggttctgta

SEQ ID NO: 563386 - DNA, 25 bp, Mus musculus
gctacttacttcacgactgttggga

SEQ ID NO: 563387 - DNA, 25 bp, Mus musculus
gctacttacttctcgactgttggga

SEQ ID NO: 563388 - DNA, 25 bp, Mus musculus
gctacttaggtgactttttatgctc

SEQ ID NO: 563389 - DNA, 25 bp, Mus musculus
gctacttaggtgtctttttatgctc

SEQ ID NO: 563390 - DNA, 25 bp, Mus musculus
gctacttagtgtcgattctgctcac

SEQ ID NO: 563391 - DNA, 25 bp, Mus musculus
gctacttagtgtggattctgctcac

SEQ ID NO: 563392 - DNA, 25 bp, Mus musculus
gctacttatagcagtgcccttggac

SEQ ID NO: 563393 - DNA, 25 bp, Mus musculus
gctacttatagctgtgcccttggac

SEQ ID NO: 563394 - DNA, 25 bp, Mus musculus
gctacttattcacccacgaacttgg

SEQ ID NO: 563395 - DNA, 25 bp, Mus musculus
gctacttattcagccacgaacttgg

SEQ ID NO: 563396 - DNA, 25 bp, Mus musculus
gctacttattttccagggcctttga

SEQ ID NO: 563397 - DNA, 25 bp, Mus musculus
gctacttattttgcagggcctttga

SEQ ID NO: 563398 - DNA, 25 bp, Mus musculus
gctacttcaaggcttccagcagtga

SEQ ID NO: 563399 - DNA, 25 bp, Mus musculus
gctacttcaagggttccagcagtga

SEQ ID NO: 563400 - DNA, 25 bp, Mus musculus
gctacttcaattccacatacacgat

SEQ ID NO: 563401 - DNA, 25 bp, Mus musculus
gctacttcaattgcacatacacgat

SEQ ID NO: 563402 - DNA, 25 bp, Mus musculus
gctacttcagctatctagtcttcat

SEQ ID NO: 563403 - DNA, 25 bp, Mus musculus
gctacttcagctttctagtcttcat

SEQ ID NO: 563404 - DNA, 25 bp, Mus musculus
gctacttcaggcattccggttagga

SEQ ID NO: 563405 - DNA, 25 bp, Mus musculus
gctacttcaggctttccggttagga

SEQ ID NO: 563406 - DNA, 25 bp, Mus musculus
gctacttcatccatgtgctcaagaa

SEQ ID NO: 563407 - DNA, 25 bp, Mus musculus
gctacttcatccttgtgctcaagaa

SEQ ID NO: 563408 - DNA, 25 bp, Mus musculus
gctacttccctgagtcagtgactgt

SEQ ID NO: 563409 - DNA, 25 bp, Mus musculus
gctacttccctgtgtcagtgactgt

SEQ ID NO: 563410 - DNA, 25 bp, Mus musculus
gctacttcctcaaggccaagagtgc

SEQ ID NO: 563411 - DNA, 25 bp, Mus musculus
gctacttcctcatggccaagagtgc

SEQ ID NO: 563412 - DNA, 25 bp, Mus musculus
gctacttcctgaactcgctaatgta

SEQ ID NO: 563413 - DNA, 25 bp, Mus musculus
gctacttcctgatctcgctaatgta

SEQ ID NO: 563414 - DNA, 25 bp, Mus musculus
gctacttcgagacccctaagaacaa

SEQ ID NO: 563415 - DNA, 25 bp, Mus musculus
gctacttcgagagccctaagaacaa

SEQ ID NO: 563416 - DNA, 25 bp, Mus musculus
gctacttcgtgtctcttataaacca

SEQ ID NO: 563417 - DNA, 25 bp, Mus musculus
gctacttcgtgtgtcttataaacca

SEQ ID NO: 563418 - DNA, 25 bp, Mus musculus
gctacttgactgaggctgccgtgtt

SEQ ID NO: 563419 - DNA, 25 bp, Mus musculus
gctacttgactgtggctgccgtgtt

SEQ ID NO: 563420 - DNA, 25 bp, Mus musculus
gctacttgagttcctgtgccagtga

SEQ ID NO: 563421 - DNA, 25 bp, Mus musculus
gctacttgagttgctgtgccagtga

SEQ ID NO: 563422 - DNA, 25 bp, Mus musculus
gctacttgatctcttttggtttgta

SEQ ID NO: 563423 - DNA, 25 bp, Mus musculus
gctacttgatctgttttggtttgta

SEQ ID NO: 563424 - DNA, 25 bp, Mus musculus
gctacttgattgctatacacaaaat

SEQ ID NO: 563425 - DNA, 25 bp, Mus musculus
gctacttgattggtatacacaaaat

SEQ ID NO: 563426 - DNA, 25 bp, Mus musculus
gctacttgcggtatcactatggatc

SEQ ID NO: 563427 - DNA, 25 bp, Mus musculus
gctacttgcggtttcactatggatc

SEQ ID NO: 563428 - DNA, 25 bp, Mus musculus
gctacttgctagatggaatcctctt

SEQ ID NO: 563429 - DNA, 25 bp, Mus musculus
gctacttgctagttggaatcctctt

SEQ ID NO: 563430 - DNA, 25 bp, Mus musculus
gctacttggaagaggtcagtcccta

SEQ ID NO: 563431 - DNA, 25 bp, Mus musculus
gctacttggaagtggtcagtcccta

SEQ ID NO: 563432 - DNA, 25 bp, Mus musculus
gctacttggaataaggtgaactacc

SEQ ID NO: 563433 - DNA, 25 bp, Mus musculus
gctacttggaattaggtgaactacc

SEQ ID NO: 563434 - DNA, 25 bp, Mus musculus
gctacttggagcctgttcactgtgt

SEQ ID NO: 563435 - DNA, 25 bp, Mus musculus
gctacttggagcgtgttcactgtgt

SEQ ID NO: 563436 - DNA, 25 bp, Mus musculus
gctacttggatgatgatagtgaagc

SEQ ID NO: 563437 - DNA, 25 bp, Mus musculus
gctacttggatgatgggtgttcaag

SEQ ID NO: 563438 - DNA, 25 bp, Mus musculus
gctacttggatgttgatagtgaagc

SEQ ID NO: 563439 - DNA, 25 bp, Mus musculus
gctacttggatgttgggtgttcaag

SEQ ID NO: 563440 - DNA, 25 bp, Mus musculus
gctacttggcacatgacaacacagt

SEQ ID NO: 563441 - DNA, 25 bp, Mus musculus
gctacttggcacttgacaacacagt

SEQ ID NO: 563442 - DNA, 25 bp, Mus musculus
gctacttggcttccagaacctcaga

SEQ ID NO: 563443 - DNA, 25 bp, Mus musculus
gctacttggcttgcagaacctcaga

SEQ ID NO: 563444 - DNA, 25 bp, Mus musculus
gctacttgtgagctgactgtggtaa

SEQ ID NO: 563445 - DNA, 25 bp, Mus musculus
gctacttgtgaggtgactgtggtaa

SEQ ID NO: 563446 - DNA, 25 bp, Mus musculus
gctacttgtgttacttatggaagcc

SEQ ID NO: 563447 - DNA, 25 bp, Mus musculus
gctacttgtgtttcttatggaagcc

SEQ ID NO: 563448 - DNA, 25 bp, Mus musculus
gctactttagagagcatacttctat

SEQ ID NO: 563449 - DNA, 25 bp, Mus musculus
gctactttagagtgcatacttctat

SEQ ID NO: 563450 - DNA, 25 bp, Mus musculus
gctactttagatctccccaggagct

SEQ ID NO: 563451 - DNA, 25 bp, Mus musculus
gctactttagatgtccccaggagct

SEQ ID NO: 563452 - DNA, 25 bp, Mus musculus
gctactttagtcatttggagggcaa

SEQ ID NO: 563453 - DNA, 25 bp, Mus musculus
gctactttagtcttttggagggcaa

SEQ ID NO: 563454 - DNA, 25 bp, Mus musculus
gctactttcacaccagattgtctaa

SEQ ID NO: 563455 - DNA, 25 bp, Mus musculus
gctactttcacagcagattgtctaa

SEQ ID NO: 563456 - DNA, 25 bp, Mus musculus
gctactttcagccagaggagcaaat

SEQ ID NO: 563457 - DNA, 25 bp, Mus musculus
gctactttcagcgagaggagcaaat

SEQ ID NO: 563458 - DNA, 25 bp, Mus musculus
gctactttcagtctttggtctttga

SEQ ID NO: 563459 - DNA, 25 bp, Mus musculus
gctactttcagtgtttggtctttga

SEQ ID NO: 563460 - DNA, 25 bp, Mus musculus
gctactttccgaagtcaaacgccag

SEQ ID NO: 563461 - DNA, 25 bp, Mus musculus
gctactttccgatgtcaaacgccag

SEQ ID NO: 563462 - DNA, 25 bp, Mus musculus
gctactttgtctcgtccaaatccat

SEQ ID NO: 563463 - DNA, 25 bp, Mus musculus
gctactttgtctggtccaaatccat

SEQ ID NO: 563464 - DNA, 25 bp, Mus musculus
gctactttgtgcatggtctatgttg

SEQ ID NO: 563465 - DNA, 25 bp, Mus musculus
gctactttgtgcttggtctatgttg

SEQ ID NO: 563466 - DNA, 25 bp, Mus musculus
gctactttgttgctctcagcaagaa

SEQ ID NO: 563467 - DNA, 25 bp, Mus musculus
gctactttgttggtctcagcaagaa

SEQ ID NO: 563468 - DNA, 25 bp, Mus musculus
gctacttttaaaatctgcgggtctg

SEQ ID NO: 563469 - DNA, 25 bp, Mus musculus
gctacttttaaattctgcgggtctg

SEQ ID NO: 563470 - DNA, 25 bp, Mus musculus
gctacttttagcacatggctggctt

SEQ ID NO: 563471 - DNA, 25 bp, Mus musculus
gctacttttagctcatggctggctt

SEQ ID NO: 563472 - DNA, 25 bp, Mus musculus
gctacttttatgagagctttcccct

SEQ ID NO: 563473 - DNA, 25 bp, Mus musculus
gctacttttatgtgagctttcccct

SEQ ID NO: 563474 - DNA, 25 bp, Mus musculus
gctacttttcagagttgaaatctag

SEQ ID NO: 563475 - DNA, 25 bp, Mus musculus
gctacttttcagtgttgaaatctag

SEQ ID NO: 563476 - DNA, 25 bp, Mus musculus
gctacttttgatacccaactgttaa

SEQ ID NO: 563477 - DNA, 25 bp, Mus musculus
gctacttttgattcccaactgttaa

SEQ ID NO: 563478 - DNA, 25 bp, Mus musculus
gctactttttccagcaatcagtctg

SEQ ID NO: 563479 - DNA, 25 bp, Mus musculus
gctactttttcctgcaatcagtctg

SEQ ID NO: 563480 - DNA, 25 bp, Mus musculus
gctagaaaaagccttccgtgctata

SEQ ID NO: 563481 - DNA, 25 bp, Mus musculus
gctagaaaaagcgttccgtgctata

SEQ ID NO: 563482 - DNA, 25 bp, Mus musculus
gctagaaacctacctactgccgctg

SEQ ID NO: 563483 - DNA, 25 bp, Mus musculus
gctagaaacctagctactgccgctg

SEQ ID NO: 563484 - DNA, 25 bp, Mus musculus
gctagaaatattcctatccttttca

SEQ ID NO: 563485 - DNA, 25 bp, Mus musculus
gctagaaatattgctatccttttca

SEQ ID NO: 563486 - DNA, 25 bp, Mus musculus
gctagaacctggaagtcagagaggc

SEQ ID NO: 563487 - DNA, 25 bp, Mus musculus
gctagaacctggtagtcagagaggc

SEQ ID NO: 563488 - DNA, 25 bp, Mus musculus
gctagaactagcagcagtcactgca

SEQ ID NO: 563489 - DNA, 25 bp, Mus musculus
gctagaactagcctggattttgtta

SEQ ID NO: 563490 - DNA, 25 bp, Mus musculus
gctagaactagcgtggattttgtta

SEQ ID NO: 563491 - DNA, 25 bp, Mus musculus
gctagaactagctgcagtcactgca

SEQ ID NO: 563492 - DNA, 25 bp, Mus musculus
gctagaacttggaagcttggccttt

SEQ ID NO: 563493 - DNA, 25 bp, Mus musculus
gctagaacttggtagcttggccttt

SEQ ID NO: 563494 - DNA, 25 bp, Mus musculus
gctagaagagatcaacgccttgcta

SEQ ID NO: 563495 - DNA, 25 bp, Mus musculus
gctagaagagatgaacgccttgcta

SEQ ID NO: 563496 - DNA, 25 bp, Mus musculus
gctagaagtagtatgttccttgaca

SEQ ID NO: 563497 - DNA, 25 bp, Mus musculus
gctagaagtagtttgttccttgaca

SEQ ID NO: 563498 - DNA, 25 bp, Mus musculus
gctagaagtcctccgagttttctga

SEQ ID NO: 563499 - DNA, 25 bp, Mus musculus
gctagaagtcctgcgagttttctga

SEQ ID NO: 563500 - DNA, 25 bp, Mus musculus
gctagaagttggaatcactgtagta

SEQ ID NO: 563501 - DNA, 25 bp, Mus musculus
gctagaagttggtatcactgtagta

SEQ ID NO: 563502 - DNA, 25 bp, Mus musculus
gctagaatcacaaatttattttcca

SEQ ID NO: 563503 - DNA, 25 bp, Mus musculus
gctagaatcacatatttattttcca

SEQ ID NO: 563504 - DNA, 25 bp, Mus musculus
gctagaatgaccaatccagagtaat

SEQ ID NO: 563505 - DNA, 25 bp, Mus musculus
gctagaatgacctatccagagtaat

SEQ ID NO: 563506 - DNA, 25 bp, Mus musculus
gctagaatgatcactgagagtctca

SEQ ID NO: 563507 - DNA, 25 bp, Mus musculus
gctagaatgatctctgagagtctca

SEQ ID NO: 563508 - DNA, 25 bp, Mus musculus
gctagaattagcatctgccctatgt

SEQ ID NO: 563509 - DNA, 25 bp, Mus musculus
gctagaattagcttctgccctatgt

SEQ ID NO: 563510 - DNA, 25 bp, Mus musculus
gctagaattcctctattgactttga

SEQ ID NO: 563511 - DNA, 25 bp, Mus musculus
gctagaattcctgtattgactttga

SEQ ID NO: 563512 - DNA, 25 bp, Mus musculus
gctagaattttcatttctggatcct

SEQ ID NO: 563513 - DNA, 25 bp, Mus musculus
gctagaattttcttttctggatcct

SEQ ID NO: 563514 - DNA, 25 bp, Mus musculus
gctagacaagttcataacccctttc

SEQ ID NO: 563515 - DNA, 25 bp, Mus musculus
gctagacaagttgataacccctttc

SEQ ID NO: 563516 - DNA, 25 bp, Mus musculus
gctagacaataaagaccctgcctcg

SEQ ID NO: 563517 - DNA, 25 bp, Mus musculus
gctagacaataatgaccctgcctcg

SEQ ID NO: 563518 - DNA, 25 bp, Mus musculus
gctagacacagacttgacactccct

SEQ ID NO: 563519 - DNA, 25 bp, Mus musculus
gctagacacagagttgacactccct

SEQ ID NO: 563520 - DNA, 25 bp, Mus musculus
gctagacactagctggcttctcaga

SEQ ID NO: 563521 - DNA, 25 bp, Mus musculus
gctagacactaggtggcttctcaga

SEQ ID NO: 563522 - DNA, 25 bp, Mus musculus
gctagacagagacccagaacctctt

SEQ ID NO: 563523 - DNA, 25 bp, Mus musculus
gctagacagagagccagaacctctt

SEQ ID NO: 563524 - DNA, 25 bp, Mus musculus
gctagacagcgcatggcccgtggca

SEQ ID NO: 563525 - DNA, 25 bp, Mus musculus
gctagacagcgcttggcccgtggca

SEQ ID NO: 563526 - DNA, 25 bp, Mus musculus
gctagacaggcactttacaaagcta

SEQ ID NO: 563527 - DNA, 25 bp, Mus musculus
gctagacaggcagtttacaaagcta

SEQ ID NO: 563528 - DNA, 25 bp, Mus musculus
gctagacatcgacgaaactgaggct

SEQ ID NO: 563529 - DNA, 25 bp, Mus musculus
gctagacatcgaggaaactgaggct

SEQ ID NO: 563530 - DNA, 25 bp, Mus musculus
gctagacatgcaataggccctgagt

SEQ ID NO: 563531 - DNA, 25 bp, Mus musculus
gctagacatgcattaggccctgagt

SEQ ID NO: 563532 - DNA, 25 bp, Mus musculus
gctagaccactaactctaagggctg

SEQ ID NO: 563533 - DNA, 25 bp, Mus musculus
gctagaccactatctctaagggctg

SEQ ID NO: 563534 - DNA, 25 bp, Mus musculus
gctagaccagcgataacaggcttgg

SEQ ID NO: 563535 - DNA, 25 bp, Mus musculus
gctagaccagcgttaacaggcttgg

SEQ ID NO: 563536 - DNA, 25 bp, Mus musculus
gctagaccagtcactgacaagcatg

SEQ ID NO: 563537 - DNA, 25 bp, Mus musculus
gctagaccagtctctgacaagcatg

SEQ ID NO: 563538 - DNA, 25 bp, Mus musculus
gctagaccataccttctatcttgaa

SEQ ID NO: 563539 - DNA, 25 bp, Mus musculus
gctagaccatacgttctatcttgaa

SEQ ID NO: 563540 - DNA, 25 bp, Mus musculus
gctagacctgcaactcaagagatcc

SEQ ID NO: 563541 - DNA, 25 bp, Mus musculus
gctagacctgcacaccacttaaaaa

SEQ ID NO: 563542 - DNA, 25 bp, Mus musculus
gctagacctgcagaccacttaaaaa

SEQ ID NO: 563543 - DNA, 25 bp, Mus musculus
gctagacctgcatctcaagagatcc

SEQ ID NO: 563544 - DNA, 25 bp, Mus musculus
gctagaccttggaaagtagattctt

SEQ ID NO: 563545 - DNA, 25 bp, Mus musculus
gctagaccttggtaagtagattctt

SEQ ID NO: 563546 - DNA, 25 bp, Mus musculus
gctagacgataaaggccaaatactg

SEQ ID NO: 563547 - DNA, 25 bp, Mus musculus
gctagacgataatggccaaatactg

SEQ ID NO: 563548 - DNA, 25 bp, Mus musculus
gctagacgggctactgcatgtgaaa

SEQ ID NO: 563549 - DNA, 25 bp, Mus musculus
gctagacgggcttctgcatgtgaaa

SEQ ID NO: 563550 - DNA, 25 bp, Mus musculus
gctagacgtcagatttcaggtggta

SEQ ID NO: 563551 - DNA, 25 bp, Mus musculus
gctagacgtcagttttcaggtggta

SEQ ID NO: 563552 - DNA, 25 bp, Mus musculus
gctagactacctaattttgattatg

SEQ ID NO: 563553 - DNA, 25 bp, Mus musculus
gctagactaccttattttgattatg

SEQ ID NO: 563554 - DNA, 25 bp, Mus musculus
gctagactagctacctcggagatgt

SEQ ID NO: 563555 - DNA, 25 bp, Mus musculus
gctagactagcttcctcggagatgt

SEQ ID NO: 563556 - DNA, 25 bp, Mus musculus
gctagactagtcattgagcgtccca

SEQ ID NO: 563557 - DNA, 25 bp, Mus musculus
gctagactagtctttgagcgtccca

SEQ ID NO: 563558 - DNA, 25 bp, Mus musculus
gctagactcctaagtccgatctttg

SEQ ID NO: 563559 - DNA, 25 bp, Mus musculus
gctagactcctatgtccgatctttg

SEQ ID NO: 563560 - DNA, 25 bp, Mus musculus
gctagactccttcctgtgaatgtat

SEQ ID NO: 563561 - DNA, 25 bp, Mus musculus
gctagactccttgctgtgaatgtat

SEQ ID NO: 563562 - DNA, 25 bp, Mus musculus
gctagacttgatagactatgttcaa

SEQ ID NO: 563563 - DNA, 25 bp, Mus musculus
gctagacttgattgactatgttcaa

SEQ ID NO: 563564 - DNA, 25 bp, Mus musculus
gctagacttgccaacattcaacatt

SEQ ID NO: 563565 - DNA, 25 bp, Mus musculus
gctagacttgcctacattcaacatt

SEQ ID NO: 563566 - DNA, 25 bp, Mus musculus
gctagactttgaatcgggaaacaat

SEQ ID NO: 563567 - DNA, 25 bp, Mus musculus
gctagactttgattcgggaaacaat

SEQ ID NO: 563568 - DNA, 25 bp, Mus musculus
gctagagaactacatggaccccatg

SEQ ID NO: 563569 - DNA, 25 bp, Mus musculus
gctagagaactagatggaccccatg

SEQ ID NO: 563570 - DNA, 25 bp, Mus musculus
gctagagaagtcctctacccctgag

SEQ ID NO: 563571 - DNA, 25 bp, Mus musculus
gctagagaagtcgtctacccctgag

SEQ ID NO: 563572 - DNA, 25 bp, Mus musculus
gctagagaattgctcaggctcctat

SEQ ID NO: 563573 - DNA, 25 bp, Mus musculus
gctagagaattggtcaggctcctat

SEQ ID NO: 563574 - DNA, 25 bp, Mus musculus
gctagagacacaagtccctttatgt

SEQ ID NO: 563575 - DNA, 25 bp, Mus musculus
gctagagacacatgtccctttatgt

SEQ ID NO: 563576 - DNA, 25 bp, Mus musculus
gctagagacacgctaatgcctttga

SEQ ID NO: 563577 - DNA, 25 bp, Mus musculus
gctagagacacggtaatgcctttga

SEQ ID NO: 563578 - DNA, 25 bp, Mus musculus
gctagagacctcacccacttttgct

SEQ ID NO: 563579 - DNA, 25 bp, Mus musculus
gctagagacctctcccacttttgct

SEQ ID NO: 563580 - DNA, 25 bp, Mus musculus
gctagagagagtaccctaggtgcta

SEQ ID NO: 563581 - DNA, 25 bp, Mus musculus
gctagagagagttccctaggtgcta

SEQ ID NO: 563582 - DNA, 25 bp, Mus musculus
gctagagagcacacatctgcttctg
